United States Patent 7,691,997 (FUNCTIONAL AND HYPERFUNCTIONAL SIRNA) - sequence listing, part 19

SEQ ID NO: 754035 - RNA, 19 nt, Homo sapiens
gaaacccuccauuaccaaa

SEQ ID NO: 754036 - RNA, 19 nt, Homo sapiens
aggaggagcccgcagauaa

SEQ ID NO: 754037 - RNA, 19 nt, Homo sapiens
gaagccaucgugcagaaga

SEQ ID NO: 754038 - RNA, 19 nt, Homo sapiens
aggacaagcucccugagaa

SEQ ID NO: 754039 - RNA, 19 nt, Homo sapiens
caagaaguucgcauguaaa

SEQ ID NO: 754040 - RNA, 19 nt, Homo sapiens
gauccguuaugcagaaauc

SEQ ID NO: 754041 - RNA, 19 nt, Homo sapiens
gguggaagaaggccuggua

SEQ ID NO: 754042 - RNA, 19 nt, Homo sapiens
ccucacagguggagaacau

SEQ ID NO: 754043 - RNA, 19 nt, Homo sapiens
gacgacuaguguucuuauu

SEQ ID NO: 754044 - RNA, 19 nt, Homo sapiens
cgacauguccaccaaaucu

SEQ ID NO: 754045 - RNA, 19 nt, Homo sapiens
cgucgccgcugaugccaaa

SEQ ID NO: 754046 - RNA, 19 nt, Homo sapiens
cccaggaaacccuccauua

SEQ ID NO: 754047 - RNA, 19 nt, Homo sapiens
augguaaacguguguauua

SEQ ID NO: 754048 - RNA, 19 nt, Homo sapiens
caaccaacagauccuuaaa

SEQ ID NO: 754049 - RNA, 19 nt, Homo sapiens
ccaaccaacagauccuuaa

SEQ ID NO: 754050 - RNA, 19 nt, Homo sapiens
gaaacaucacgccuagaga

SEQ ID NO: 754051 - RNA, 19 nt, Homo sapiens
agaagaaaggugucaagaa

SEQ ID NO: 754052 - RNA, 19 nt, Homo sapiens
ggacagcgccaaccccuuu

SEQ ID NO: 754053 - RNA, 19 nt, Homo sapiens
ucgccaaggacuauuauaa

SEQ ID NO: 754054 - RNA, 19 nt, Homo sapiens
acgacuaguguucuuauua

SEQ ID NO: 754055 - RNA, 19 nt, Homo sapiens
uggaagccaucgugcagaa

SEQ ID NO: 754056 - RNA, 19 nt, Homo sapiens
auuauaacccgcagccuua

SEQ ID NO: 754057 - RNA, 19 nt, Homo sapiens
ccaggaaacccuccauuac

SEQ ID NO: 754058 - RNA, 19 nt, Homo sapiens
guuaagacgacuaguguuc

SEQ ID NO: 754059 - RNA, 19 nt, Homo sapiens
cccaggauguguacucguu

SEQ ID NO: 754060 - RNA, 19 nt, Homo sapiens
ggaaacccuccauuaccaa

SEQ ID NO: 754061 - RNA, 19 nt, Homo sapiens
guaaauguuaagacgacua

SEQ ID NO: 754062 - RNA, 19 nt, Homo sapiens
ccuagcaacuuccuguaca

SEQ ID NO: 754063 - RNA, 19 nt, Homo sapiens
gagcagggacagcgcuaga

SEQ ID NO: 754064 - RNA, 19 nt, Homo sapiens
caaagaccgugggcucaag

SEQ ID NO: 754065 - RNA, 19 nt, Homo sapiens
cucaagaaguucgcaugua

SEQ ID NO: 754066 - RNA, 19 nt, Homo sapiens
gaccucuccugacgacaug

SEQ ID NO: 754067 - RNA, 19 nt, Homo sapiens
ggccaaguaugaugagaac

SEQ ID NO: 754068 - RNA, 19 nt, Homo sapiens
ccagacaagggcacagaaa

SEQ ID NO: 754069 - RNA, 19 nt, Homo sapiens
gagaaggccgacaaagcuu

SEQ ID NO: 754070 - RNA, 19 nt, Homo sapiens
cgacagcuucuccaaguuc

SEQ ID NO: 754071 - RNA, 19 nt, Homo sapiens
gcagaagaaaggugucaag

SEQ ID NO: 754072 - RNA, 19 nt, Homo sapiens
cuggagaacuuucccuaca

SEQ ID NO: 754073 - RNA, 19 nt, Homo sapiens
ccgcucaccuuccuacagu

SEQ ID NO: 754074 - RNA, 19 nt, Homo sapiens
gcaaaggggacacccauga

SEQ ID NO: 754075 - RNA, 19 nt, Homo sapiens
gaggaggcaagaagccaaa

SEQ ID NO: 754076 - RNA, 19 nt, Homo sapiens
aaaccgaggccuucacauc

SEQ ID NO: 754077 - RNA, 19 nt, Homo sapiens
ugucuucuacugacuguuu

SEQ ID NO: 754078 - RNA, 19 nt, Homo sapiens
cagcagcuuuugacuguuu

SEQ ID NO: 754079 - RNA, 19 nt, Homo sapiens
accaaaaccucgccaagua

SEQ ID NO: 754080 - RNA, 19 nt, Homo sapiens
gcucgcuucucccgugugu

SEQ ID NO: 754081 - RNA, 19 nt, Homo sapiens
gaggcaagaagccaaagau

SEQ ID NO: 754082 - RNA, 19 nt, Homo sapiens
gaguacuccucccuaugug

SEQ ID NO: 754083 - RNA, 19 nt, Homo sapiens
guguccaccuguucuguga

SEQ ID NO: 754084 - RNA, 19 nt, Homo sapiens
gaagcugcagaacgacauu

SEQ ID NO: 754085 - RNA, 19 nt, Homo sapiens
aaacagucauugcauucag

SEQ ID NO: 754086 - RNA, 19 nt, Homo sapiens
gccaaggacuauuauaacc

SEQ ID NO: 754087 - RNA, 19 nt, Homo sapiens
cagggacagcgcuagauuu

SEQ ID NO: 754088 - RNA, 19 nt, Homo sapiens
agacaagggcacagaaaca

SEQ ID NO: 754089 - RNA, 19 nt, Homo sapiens
ggaggcaagaagccaaaga

SEQ ID NO: 754090 - RNA, 19 nt, Homo sapiens
aaacucaugaacaguaaga

SEQ ID NO: 754091 - RNA, 19 nt, Homo sapiens
cgcccagccucaagaaguu

SEQ ID NO: 754092 - RNA, 19 nt, Homo sapiens
gaagcggaaccuggucuug

SEQ ID NO: 754093 - RNA, 19 nt, Homo sapiens
gaagaaaggugucaagaac

SEQ ID NO: 754094 - RNA, 19 nt, Homo sapiens
ucaagaaguucgcauguaa

SEQ ID NO: 754095 - RNA, 19 nt, Homo sapiens
caucacgccuagagaauua

SEQ ID NO: 754096 - RNA, 19 nt, Homo sapiens
ccaagaagcuccucgacaa

SEQ ID NO: 754097 - RNA, 19 nt, Homo sapiens
gagggaagauagaagcaua

SEQ ID NO: 754098 - RNA, 19 nt, Homo sapiens
gaagaaggccugguaaaug

SEQ ID NO: 754099 - RNA, 19 nt, Homo sapiens
cgacaaagcuugggcugaa

SEQ ID NO: 754100 - RNA, 19 nt, Homo sapiens
cagcagaccucgcaggaaa

SEQ ID NO: 754101 - RNA, 19 nt, Homo sapiens
gaugagaacuugaugaaaa

SEQ ID NO: 754102 - RNA, 19 nt, Homo sapiens
gcaagaagccaaagaugga

SEQ ID NO: 754103 - RNA, 19 nt, Homo sapiens
gggagaagguggccucguu

SEQ ID NO: 754104 - RNA, 19 nt, Homo sapiens
gguccucucuccuuuggua

SEQ ID NO: 754105 - RNA, 19 nt, Homo sapiens
ggaagaaggccugguaaau

SEQ ID NO: 754106 - RNA, 19 nt, Homo sapiens
aagaaggccugguaaaugu

SEQ ID NO: 754107 - RNA, 19 nt, Homo sapiens
ccaucucacucuucaguuu

SEQ ID NO: 754108 - RNA, 19 nt, Homo sapiens
gaaauccgccucaaguaca

SEQ ID NO: 754109 - RNA, 19 nt, Homo sapiens
gcugauccguuaugcagaa

SEQ ID NO: 754110 - RNA, 19 nt, Homo sapiens
caccagugcugcccaaaga

SEQ ID NO: 754111 - RNA, 19 nt, Homo sapiens
ucacggcgcugaccucaca

SEQ ID NO: 754112 - RNA, 19 nt, Homo sapiens
gaguaccucuugccuuguu

SEQ ID NO: 754113 - RNA, 19 nt, Homo sapiens
gcccaucccuuuccgacaa

SEQ ID NO: 754114 - RNA, 19 nt, Homo sapiens
ccucugagcccaucccuuu

SEQ ID NO: 754115 - RNA, 19 nt, Homo sapiens
gcaaacaacagaacuacca

SEQ ID NO: 754116 - RNA, 19 nt, Homo sapiens
gaagguggccguggacaug

SEQ ID NO: 754117 - RNA, 19 nt, Homo sapiens
gagcgcagcuuccucuacu

SEQ ID NO: 754118 - RNA, 19 nt, Homo sapiens
ugccaaaccuggagaacuu

SEQ ID NO: 754119 - RNA, 19 nt, Homo sapiens
ggaaacaucacgccuagag

SEQ ID NO: 754120 - RNA, 19 nt, Homo sapiens
gacgacauguccaccaaau

SEQ ID NO: 754121 - RNA, 19 nt, Homo sapiens
aaacaucacgccuagagaa

SEQ ID NO: 754122 - RNA, 19 nt, Homo sapiens
cagguuugcuucacucuuc

SEQ ID NO: 754123 - RNA, 19 nt, Homo sapiens
gaaauccaaccaacagauc

SEQ ID NO: 754124 - RNA, 19 nt, Homo sapiens
gcagaaauccaaccaacag

SEQ ID NO: 754125 - RNA, 19 nt, Homo sapiens
caacugguccucucuccuu

SEQ ID NO: 754126 - RNA, 19 nt, Homo sapiens
aaggaugccuccacaccua

SEQ ID NO: 754127 - RNA, 19 nt, Homo sapiens
gggcagaagcucccaacuu

SEQ ID NO: 754128 - RNA, 19 nt, Homo sapiens
gaaacccuccauuaccaaa

SEQ ID NO: 754129 - RNA, 19 nt, Homo sapiens
aggaggagcccgcagauaa

SEQ ID NO: 754130 - RNA, 19 nt, Homo sapiens
caguuucccuccucucuug

SEQ ID NO: 754131 - RNA, 19 nt, Homo sapiens
gaagccaucgugcagaaga

SEQ ID NO: 754132 - RNA, 19 nt, Homo sapiens
caagaaguucgcauguaaa

SEQ ID NO: 754133 - RNA, 19 nt, Homo sapiens
gauccguuaugcagaaauc

SEQ ID NO: 754134 - RNA, 19 nt, Homo sapiens
gguggaagaaggccuggua

SEQ ID NO: 754135 - RNA, 19 nt, Homo sapiens
ccucacagguggagaacau

SEQ ID NO: 754136 - RNA, 19 nt, Homo sapiens
gaacacugccuccccaaaa

SEQ ID NO: 754137 - RNA, 19 nt, Homo sapiens
cgacauguccaccaaaucu

SEQ ID NO: 754138 - RNA, 19 nt, Homo sapiens
cgucgccgcugaugccaaa

SEQ ID NO: 754139 - RNA, 19 nt, Homo sapiens
cccaggaaacccuccauua

SEQ ID NO: 754140 - RNA, 19 nt, Homo sapiens
caaccaacagauccuuaaa

SEQ ID NO: 754141 - RNA, 19 nt, Homo sapiens
ccaaccaacagauccuuaa

SEQ ID NO: 754142 - RNA, 19 nt, Homo sapiens
gaaacaucacgccuagaga

SEQ ID NO: 754143 - RNA, 19 nt, Homo sapiens
agaagaaaggugucaagaa

SEQ ID NO: 754144 - RNA, 19 nt, Homo sapiens
gcagugagggaagauagaa

SEQ ID NO: 754145 - RNA, 19 nt, Homo sapiens
ccagggacauggaaaugag

SEQ ID NO: 754146 - RNA, 19 nt, Homo sapiens
ggacagcgccaaccccuuu

SEQ ID NO: 754147 - RNA, 19 nt, Homo sapiens
ucgccaaggacuauuauaa

SEQ ID NO: 754148 - RNA, 19 nt, Homo sapiens
ccagagcagugagggaaga

SEQ ID NO: 754149 - RNA, 19 nt, Homo sapiens
uggaagccaucgugcagaa

SEQ ID NO: 754150 - RNA, 19 nt, Homo sapiens
auuauaacccgcagccuua

SEQ ID NO: 754151 - RNA, 19 nt, Homo sapiens
ccaggaaacccuccauuac

SEQ ID NO: 754152 - RNA, 19 nt, Homo sapiens
cccaggauguguacucguu

SEQ ID NO: 754153 - RNA, 19 nt, Homo sapiens
ggaaacccuccauuaccaa

SEQ ID NO: 754154 - RNA, 19 nt, Homo sapiens
caaagaccgugggcucaag

SEQ ID NO: 754155 - RNA, 19 nt, Homo sapiens
cucaagaaguucgcaugua

SEQ ID NO: 754156 - RNA, 19 nt, Homo sapiens
gaccucuccugacgacaug

SEQ ID NO: 754157 - RNA, 19 nt, Homo sapiens
ggccaaguaugaugagaac

SEQ ID NO: 754158 - RNA, 19 nt, Homo sapiens
gagcagugagggaagauag

SEQ ID NO: 754159 - RNA, 19 nt, Homo sapiens
ggccagaaggcaccuguga

SEQ ID NO: 754160 - RNA, 19 nt, Homo sapiens
ccagacaagggcacagaaa

SEQ ID NO: 754161 - RNA, 19 nt, Homo sapiens
gagaaggccgacaaagcuu

SEQ ID NO: 754162 - RNA, 19 nt, Homo sapiens
cgacagcuucuccaaguuc

SEQ ID NO: 754163 - RNA, 19 nt, Homo sapiens
gcagaagaaaggugucaag

SEQ ID NO: 754164 - RNA, 19 nt, Homo sapiens
cuggagaacuuucccuaca

SEQ ID NO: 754165 - RNA, 19 nt, Homo sapiens
ccgcucaccuuccuacagu

SEQ ID NO: 754166 - RNA, 19 nt, Homo sapiens
ggaagauagaagcauaaau

SEQ ID NO: 754167 - RNA, 19 nt, Homo sapiens
gggaagauagaagcauaaa

SEQ ID NO: 754168 - RNA, 19 nt, Homo sapiens
gcaaugccagggacaugga

SEQ ID NO: 754169 - RNA, 19 nt, Homo sapiens
gcaaaggggacacccauga

SEQ ID NO: 754170 - RNA, 19 nt, Homo sapiens
ggagugcccagagcaguga

SEQ ID NO: 754171 - RNA, 19 nt, Homo sapiens
ggaacaggagggcauugga

SEQ ID NO: 754172 - RNA, 19 nt, Homo sapiens
gagaaggugcggccagaag

SEQ ID NO: 754173 - RNA, 19 nt, Homo sapiens
gaggaggcaagaagccaaa

SEQ ID NO: 754174 - RNA, 19 nt, Homo sapiens
cagcagcuuuugacuguuu

SEQ ID NO: 754175 - RNA, 19 nt, Homo sapiens
accaaaaccucgccaagua

SEQ ID NO: 754176 - RNA, 19 nt, Homo sapiens
gaggcaagaagccaaagau

SEQ ID NO: 754177 - RNA, 19 nt, Homo sapiens
gaguacuccucccuaugug

SEQ ID NO: 754178 - RNA, 19 nt, Homo sapiens
guguccaccuguucuguga

SEQ ID NO: 754179 - RNA, 19 nt, Homo sapiens
gaagcugcagaacgacauu

SEQ ID NO: 754180 - RNA, 19 nt, Homo sapiens
agacaagggcacagaaaca

SEQ ID NO: 754181 - RNA, 19 nt, Homo sapiens
ggaggcaagaagccaaaga

SEQ ID NO: 754182 - RNA, 19 nt, Homo sapiens
gccaaggacuauuauaacc

SEQ ID NO: 754183 - RNA, 19 nt, Homo sapiens
cgcccagccucaagaaguu

SEQ ID NO: 754184 - RNA, 19 nt, Homo sapiens
gaagcggaaccuggucuug

SEQ ID NO: 754185 - RNA, 19 nt, Homo sapiens
ccaaaucugacgacuccuu

SEQ ID NO: 754186 - RNA, 19 nt, Homo sapiens
aggaaacccuccauuacca

SEQ ID NO: 754187 - RNA, 19 nt, Homo sapiens
gagacgcguucaccaccau

SEQ ID NO: 754188 - RNA, 19 nt, Homo sapiens
ugaaauccgccucaaguac

SEQ ID NO: 754189 - RNA, 19 nt, Homo sapiens
ggaggagcccgcagauaac

SEQ ID NO: 754190 - RNA, 19 nt, Homo sapiens
ugagaaggccgacaaagcu

SEQ ID NO: 754191 - RNA, 19 nt, Homo sapiens
ccugaaauccgccucaagu

SEQ ID NO: 754192 - RNA, 19 nt, Homo sapiens
gaccaaggagacagacuca

SEQ ID NO: 754193 - RNA, 19 nt, Homo sapiens
gaagaaaggugucaagaac

SEQ ID NO: 754194 - RNA, 19 nt, Homo sapiens
caucacgccuagagaauua

SEQ ID NO: 754195 - RNA, 19 nt, Homo sapiens
guauauugcuucacacuga

SEQ ID NO: 754196 - RNA, 19 nt, Homo sapiens
cgacaaagcuugggcugaa

SEQ ID NO: 754197 - RNA, 19 nt, Homo sapiens
cagcagaccucgcaggaaa

SEQ ID NO: 754198 - RNA, 19 nt, Homo sapiens
guaucgagcuguuucuaaa

SEQ ID NO: 754199 - RNA, 19 nt, Homo sapiens
gaugagaacuugaugaaaa

SEQ ID NO: 754200 - RNA, 19 nt, Homo sapiens
gggagaagguggccucguu

SEQ ID NO: 754201 - RNA, 19 nt, Homo sapiens
gguccucucuccuuuggua

SEQ ID NO: 754202 - RNA, 19 nt, Homo sapiens
cgacuaguguucuuauuag

SEQ ID NO: 754203 - RNA, 19 nt, Homo sapiens
ucacggcgcugaccucaca

SEQ ID NO: 754204 - RNA, 19 nt, Homo sapiens
gcaaacaacagaacuacca

SEQ ID NO: 754205 - RNA, 19 nt, Homo sapiens
gagcgcagcuuccucuacu

SEQ ID NO: 754206 - RNA, 19 nt, Homo sapiens
ugccaaaccuggagaacuu

SEQ ID NO: 754207 - RNA, 19 nt, Homo sapiens
ggaaacaucacgccuagag

SEQ ID NO: 754208 - RNA, 19 nt, Homo sapiens
gacgacauguccaccaaau

SEQ ID NO: 754209 - RNA, 19 nt, Homo sapiens
aaacaucacgccuagagaa

SEQ ID NO: 754210 - RNA, 19 nt, Homo sapiens
cacugaagauuguguguau

SEQ ID NO: 754211 - RNA, 19 nt, Homo sapiens
caacugguccucucuccuu

SEQ ID NO: 754212 - RNA, 19 nt, Homo sapiens
gguuugaguccucguuaua

SEQ ID NO: 754213 - RNA, 19 nt, Homo sapiens
gaaacccuccauuaccaaa

SEQ ID NO: 754214 - RNA, 19 nt, Homo sapiens
uuugaguccucguuauaua

SEQ ID NO: 754215 - RNA, 19 nt, Homo sapiens
aggacaagcucccugagaa

SEQ ID NO: 754216 - RNA, 19 nt, Homo sapiens
ccucacagguggagaacau

SEQ ID NO: 754217 - RNA, 19 nt, Homo sapiens
gacgacuaguguucuuauu

SEQ ID NO: 754218 - RNA, 19 nt, Homo sapiens
cgacauguccaccaaaucu

SEQ ID NO: 754219 - RNA, 19 nt, Homo sapiens
cgucgccgcugaugccaaa

SEQ ID NO: 754220 - RNA, 19 nt, Homo sapiens
cccaggaaacccuccauua

SEQ ID NO: 754221 - RNA, 19 nt, Homo sapiens
agaagaaaggugucaagaa

SEQ ID NO: 754222 - RNA, 19 nt, Homo sapiens
gaaacaucacgccuagaga

SEQ ID NO: 754223 - RNA, 19 nt, Homo sapiens
ggacagcgccaaccccuuu

SEQ ID NO: 754224 - RNA, 19 nt, Homo sapiens
ucgccaaggacuauuauaa

SEQ ID NO: 754225 - RNA, 19 nt, Homo sapiens
acgacuaguguucuuauua

SEQ ID NO: 754226 - RNA, 19 nt, Homo sapiens
auuauaacccgcagccuua

SEQ ID NO: 754227 - RNA, 19 nt, Homo sapiens
ccaggaaacccuccauuac

SEQ ID NO: 754228 - RNA, 19 nt, Homo sapiens
guuaagacgacuaguguuc

SEQ ID NO: 754229 - RNA, 19 nt, Homo sapiens
ggaaacccuccauuaccaa

SEQ ID NO: 754230 - RNA, 19 nt, Homo sapiens
guaaauguuaagacgacua

SEQ ID NO: 754231 - RNA, 19 nt, Homo sapiens
gaccucuccugacgacaug

SEQ ID NO: 754232 - RNA, 19 nt, Homo sapiens
ggccaaguaugaugagaac

SEQ ID NO: 754233 - RNA, 19 nt, Homo sapiens
gagaaggccgacaaagcuu

SEQ ID NO: 754234 - RNA, 19 nt, Homo sapiens
cgacagcuucuccaaguuc

SEQ ID NO: 754235 - RNA, 19 nt, Homo sapiens
gcagaagaaaggugucaag

SEQ ID NO: 754236 - RNA, 19 nt, Homo sapiens
cuggagaacuuucccuaca

SEQ ID NO: 754237 - RNA, 19 nt, Homo sapiens
ccgcucaccuuccuacagu

SEQ ID NO: 754238 - RNA, 19 nt, Homo sapiens
gcaaaggggacacccauga

SEQ ID NO: 754239 - RNA, 19 nt, Homo sapiens
cagcagcuuuugacuguuu

SEQ ID NO: 754240 - RNA, 19 nt, Homo sapiens
accaaaaccucgccaagua

SEQ ID NO: 754241 - RNA, 19 nt, Homo sapiens
gaguacuccucccuaugug

SEQ ID NO: 754242 - RNA, 19 nt, Homo sapiens
guguccaccuguucuguga

SEQ ID NO: 754243 - RNA, 19 nt, Homo sapiens
gaagcugcagaacgacauu

SEQ ID NO: 754244 - RNA, 19 nt, Homo sapiens
aaacagucauugcauucag

SEQ ID NO: 754245 - RNA, 19 nt, Homo sapiens
ccaaaucugacgacuccuu

SEQ ID NO: 754246 - RNA, 19 nt, Homo sapiens
aggaaacccuccauuacca

SEQ ID NO: 754247 - RNA, 19 nt, Homo sapiens
gccaaggacuauuauaacc

SEQ ID NO: 754248 - RNA, 19 nt, Homo sapiens
ugagaaggccgacaaagcu

SEQ ID NO: 754249 - RNA, 19 nt, Homo sapiens
ggacaagcucccugagaac

SEQ ID NO: 754250 - RNA, 19 nt, Homo sapiens
cgaagggagcggcuacuca

SEQ ID NO: 754251 - RNA, 19 nt, Homo sapiens
cagaagaaaggugucaaga

SEQ ID NO: 754252 - RNA, 19 nt, Homo sapiens
ggcagcggguccagaaucu

SEQ ID NO: 754253 - RNA, 19 nt, Homo sapiens
cccgagucaugcagucuuu

SEQ ID NO: 754254 - RNA, 19 nt, Homo sapiens
gcagcaagccacccuucuc

SEQ ID NO: 754255 - RNA, 19 nt, Homo sapiens
cucgacagcuucuccaagu

SEQ ID NO: 754256 - RNA, 19 nt, Homo sapiens
uaaauguuaagacgacuag

SEQ ID NO: 754257 - RNA, 19 nt, Homo sapiens
gacaaagcuugggcugaag

SEQ ID NO: 754258 - RNA, 19 nt, Homo sapiens
gcagaccucgcaggaaaca

SEQ ID NO: 754259 - RNA, 19 nt, Homo sapiens
uguaucgagcuguuucuaa

SEQ ID NO: 754260 - RNA, 19 nt, Homo sapiens
gaaggaggaccuggaagcu

SEQ ID NO: 754261 - RNA, 19 nt, Homo sapiens
cugcagggguggccaagua

SEQ ID NO: 754262 - RNA, 19 nt, Homo sapiens
cagcagcaagcccuucaga

SEQ ID NO: 754263 - RNA, 19 nt, Homo sapiens
cagcggguccagaaucuuc

SEQ ID NO: 754264 - RNA, 19 nt, Homo sapiens
aacagucauugcauucaga

SEQ ID NO: 754265 - RNA, 19 nt, Homo sapiens
auaaccagcccgagucaug

SEQ ID NO: 754266 - RNA, 19 nt, Homo sapiens
gcucaccuuccuacaguuc

SEQ ID NO: 754267 - RNA, 19 nt, Homo sapiens
ggaaauaacuccucugaua

SEQ ID NO: 754268 - RNA, 19 nt, Homo sapiens
ggaaacagcuuuacuacuu

SEQ ID NO: 754269 - RNA, 19 nt, Homo sapiens
ggacacagaugauauuauu

SEQ ID NO: 754270 - RNA, 19 nt, Homo sapiens
ggaaauaaguggcaucauc

SEQ ID NO: 754271 - RNA, 19 nt, Homo sapiens
gaaauaacuccucugauaa

SEQ ID NO: 754272 - RNA, 19 nt, Homo sapiens
gaaacagcuuuacuacuuu

SEQ ID NO: 754273 - RNA, 19 nt, Homo sapiens
gaagagccuugaccaacua

SEQ ID NO: 754274 - RNA, 19 nt, Homo sapiens
uaagugaucuucuaggauu

SEQ ID NO: 754275 - RNA, 19 nt, Homo sapiens
ggacugaaacugacaauga

SEQ ID NO: 754276 - RNA, 19 nt, Homo sapiens
uuaagaagguggagaauau

SEQ ID NO: 754277 - RNA, 19 nt, Homo sapiens
caagcgaacuauuuaggua

SEQ ID NO: 754278 - RNA, 19 nt, Homo sapiens
gcaaaacucuucagccaua

SEQ ID NO: 754279 - RNA, 19 nt, Homo sapiens
ggaaaucgaagaagaagaa

SEQ ID NO: 754280 - RNA, 19 nt, Homo sapiens
caaacaacaugaauaguca

SEQ ID NO: 754281 - RNA, 19 nt, Homo sapiens
aaacuuaccuaucaaggaa

SEQ ID NO: 754282 - RNA, 19 nt, Homo sapiens
ggaaagcuaggaaauauga

SEQ ID NO: 754283 - RNA, 19 nt, Homo sapiens
gagagaacauauaaacaga

SEQ ID NO: 754284 - RNA, 19 nt, Homo sapiens
caaauugugucuacucaga

SEQ ID NO: 754285 - RNA, 19 nt, Homo sapiens
gagaacauauaaacagaga

SEQ ID NO: 754286 - RNA, 19 nt, Homo sapiens
gagaucaagcgaacuauuu

SEQ ID NO: 754287 - RNA, 19 nt, Homo sapiens
gagcuggacacaccauuua

SEQ ID NO: 754288 - RNA, 19 nt, Homo sapiens
caggaaagcuaggaaauau

SEQ ID NO: 754289 - RNA, 19 nt, Homo sapiens
gaaauaaguggcaucauca

SEQ ID NO: 754290 - RNA, 19 nt, Homo sapiens
agacacagauggccucaaa

SEQ ID NO: 754291 - RNA, 19 nt, Homo sapiens
ccaccaaguuguugaaaga

SEQ ID NO: 754292 - RNA, 19 nt, Homo sapiens
ucacugcguuccuaucuaa

SEQ ID NO: 754293 - RNA, 19 nt, Homo sapiens
gagaugcuauaucguggua

SEQ ID NO: 754294 - RNA, 19 nt, Homo sapiens
gaaagaacagcuuacucua

SEQ ID NO: 754295 - RNA, 19 nt, Homo sapiens
agacucagauuaaggguuu

SEQ ID NO: 754296 - RNA, 19 nt, Homo sapiens
gacaaugaaucccuuaauc

SEQ ID NO: 754297 - RNA, 19 nt, Homo sapiens
gaaauguugucacuauugg

SEQ ID NO: 754298 - RNA, 19 nt, Homo sapiens
ugaagaagauggugaagca

SEQ ID NO: 754299 - RNA, 19 nt, Homo sapiens
caauggaaaucgaagaaga

SEQ ID NO: 754300 - RNA, 19 nt, Homo sapiens
ggaaauguugucacuauug

SEQ ID NO: 754301 - RNA, 19 nt, Homo sapiens
ggauaugucuguguuggaa

SEQ ID NO: 754302 - RNA, 19 nt, Homo sapiens
gaauagaaacuuuggaauc

SEQ ID NO: 754303 - RNA, 19 nt, Homo sapiens
cuauagaacuggagauuuc

SEQ ID NO: 754304 - RNA, 19 nt, Homo sapiens
ucagaggaauagaaacuuu

SEQ ID NO: 754305 - RNA, 19 nt, Homo sapiens
gaaauuccauggacaucuc

SEQ ID NO: 754306 - RNA, 19 nt, Homo sapiens
caaugaaucccuuaaucua

SEQ ID NO: 754307 - RNA, 19 nt, Homo sapiens
gaccagagauuagaaugug

SEQ ID NO: 754308 - RNA, 19 nt, Homo sapiens
uauuaaagcuguccaccaa

SEQ ID NO: 754309 - RNA, 19 nt, Homo sapiens
ugagagagaugcuauaucg

SEQ ID NO: 754310 - RNA, 19 nt, Homo sapiens
gagauuagaaugugccaaa

SEQ ID NO: 754311 - RNA, 19 nt, Homo sapiens
gaagguggagaauauuaaa

SEQ ID NO: 754312 - RNA, 19 nt, Homo sapiens
gaucuugacucucuuuggu

SEQ ID NO: 754313 - RNA, 19 nt, Homo sapiens
ggucugaaaccaauaagaa

SEQ ID NO: 754314 - RNA, 19 nt, Homo sapiens
gcagagagaacauauaaac

SEQ ID NO: 754315 - RNA, 19 nt, Homo sapiens
uaacuccucugauaaaguc

SEQ ID NO: 754316 - RNA, 19 nt, Homo sapiens
gaacuggagauuucauuuc

SEQ ID NO: 754317 - RNA, 19 nt, Homo sapiens
caacuaaaguccauuucag

SEQ ID NO: 754318 - RNA, 19 nt, Homo sapiens
acaagguggugucauauug

SEQ ID NO: 754319 - RNA, 19 nt, Homo sapiens
caaggcaccuaaacucuca

SEQ ID NO: 754320 - RNA, 19 nt, Homo sapiens
guugugaaguuaagaauag

SEQ ID NO: 754321 - RNA, 19 nt, Homo sapiens
caaguuguguccauccuau

SEQ ID NO: 754322 - RNA, 19 nt, Homo sapiens
guuaucagaugcugggaaa

SEQ ID NO: 754323 - RNA, 19 nt, Homo sapiens
ggagacugaggacauguua

SEQ ID NO: 754324 - RNA, 19 nt, Homo sapiens
gcacggacacagaugauau

SEQ ID NO: 754325 - RNA, 19 nt, Homo sapiens
gcccaaagcaugaagcaaa

SEQ ID NO: 754326 - RNA, 19 nt, Homo sapiens
uauaagugaucuucuagga

SEQ ID NO: 754327 - RNA, 19 nt, Homo sapiens
gggaaauguugucacuauu

SEQ ID NO: 754328 - RNA, 19 nt, Homo sapiens
acuacaagguggugucaua

SEQ ID NO: 754329 - RNA, 19 nt, Homo sapiens
uaacaagaccaucaggaaa

SEQ ID NO: 754330 - RNA, 19 nt, Homo sapiens
ccacauaaagccagacuug

SEQ ID NO: 754331 - RNA, 19 nt, Homo sapiens
ucucagguguuauaaguga

SEQ ID NO: 754332 - RNA, 19 nt, Homo sapiens
gagacuaucuuuggcaaca

SEQ ID NO: 754333 - RNA, 19 nt, Homo sapiens
caugggaacuguccacugu

SEQ ID NO: 754334 - RNA, 19 nt, Homo sapiens
gaucugggaaacagcuuua

SEQ ID NO: 754335 - RNA, 19 nt, Homo sapiens
gaacagacucagauuaagg

SEQ ID NO: 754336 - RNA, 19 nt, Homo sapiens
acaaagggacugaaacuga

SEQ ID NO: 754337 - RNA, 19 nt, Homo sapiens
aaucagagggucaacauuu

SEQ ID NO: 754338 - RNA, 19 nt, Homo sapiens
caagaguaguuauccuuuc

SEQ ID NO: 754339 - RNA, 19 nt, Homo sapiens
ccaggaaagcuaggaaaua

SEQ ID NO: 754340 - RNA, 19 nt, Homo sapiens
aaacucuucagccauauua

SEQ ID NO: 754341 - RNA, 19 nt, Homo sapiens
gaaucuguacccauuauug

SEQ ID NO: 754342 - RNA, 19 nt, Homo sapiens
uaguuuagcuucaguacug

SEQ ID NO: 754343 - RNA, 19 nt, Homo sapiens
aagaacagcuuacucuagu

SEQ ID NO: 754344 - RNA, 19 nt, Homo sapiens
gauugugucuuacuuggau

SEQ ID NO: 754345 - RNA, 19 nt, Homo sapiens
ugggaaauguugucacuau

SEQ ID NO: 754346 - RNA, 19 nt, Homo sapiens
ggaaacaauggaaaucgaa

SEQ ID NO: 754347 - RNA, 19 nt, Homo sapiens
ggaacuguccacugucaaa

SEQ ID NO: 754348 - RNA, 19 nt, Homo sapiens
caaaugagagagaugcuau

SEQ ID NO: 754349 - RNA, 19 nt, Homo sapiens
caaugucgaccagagauua

SEQ ID NO: 754350 - RNA, 19 nt, Homo sapiens
cauaaagccagacuugauu

SEQ ID NO: 754351 - RNA, 19 nt, Homo sapiens
ucuauggacugacaaugaa

SEQ ID NO: 754352 - RNA, 19 nt, Homo sapiens
ucgaacagacucagauuaa

SEQ ID NO: 754353 - RNA, 19 nt, Homo sapiens
gaugaugccuauugugaac

SEQ ID NO: 754354 - RNA, 19 nt, Homo sapiens
ccacagcguucaguugaug

SEQ ID NO: 754355 - RNA, 19 nt, Homo sapiens
uggcagagagaacauauaa

SEQ ID NO: 754356 - RNA, 19 nt, Homo sapiens
uguugucacuauuggauua

SEQ ID NO: 754357 - RNA, 19 nt, Homo sapiens
aggaguagguuaucagaug

SEQ ID NO: 754358 - RNA, 19 nt, Homo sapiens
gaagcacggacacagauga

SEQ ID NO: 754359 - RNA, 19 nt, Homo sapiens
guaauggggugucugauga

SEQ ID NO: 754360 - RNA, 19 nt, Homo sapiens
gauaaagucagaggaauag

SEQ ID NO: 754361 - RNA, 19 nt, Homo sapiens
cuacugacacuuucgauug

SEQ ID NO: 754362 - RNA, 19 nt, Homo sapiens
auaccucauuucagacuua

SEQ ID NO: 754363 - RNA, 19 nt, Homo sapiens
gaaagcacccgccaugacu

SEQ ID NO: 754364 - RNA, 19 nt, Homo sapiens
uaaacucucagguaaagaa

SEQ ID NO: 754365 - RNA, 19 nt, Homo sapiens
ugauaaagucagaggaaua

SEQ ID NO: 754366 - RNA, 19 nt, Homo sapiens
ugauugacguugacuuaau

SEQ ID NO: 754367 - RNA, 19 nt, Homo sapiens
ggacaucacucuuaucaaa

SEQ ID NO: 754368 - RNA, 19 nt, Homo sapiens
gcgaagaguucaauuagua

SEQ ID NO: 754369 - RNA, 19 nt, Homo sapiens
gaagagaauuggcuguuaa

SEQ ID NO: 754370 - RNA, 19 nt, Homo sapiens
gcaaauauccugcgagauu

SEQ ID NO: 754371 - RNA, 19 nt, Homo sapiens
gaagguaucauguuucaua

SEQ ID NO: 754372 - RNA, 19 nt, Homo sapiens
ggacaaagcucuggaacug

SEQ ID NO: 754373 - RNA, 19 nt, Homo sapiens
ccagggauguugcuaaaua

SEQ ID NO: 754374 - RNA, 19 nt, Homo sapiens
ggaagagaauuggcuguua

SEQ ID NO: 754375 - RNA, 19 nt, Homo sapiens
ccaagaagguaucauguuu

SEQ ID NO: 754376 - RNA, 19 nt, Homo sapiens
guacacaggcuacuaauuu

SEQ ID NO: 754377 - RNA, 19 nt, Homo sapiens
gaacauauccaagaaggua

SEQ ID NO: 754378 - RNA, 19 nt, Homo sapiens
gaaauacacccgucagauu

SEQ ID NO: 754379 - RNA, 19 nt, Homo sapiens
gagaaacccugauguaaag

SEQ ID NO: 754380 - RNA, 19 nt, Homo sapiens
gaaagcagccucaaagaau

SEQ ID NO: 754381 - RNA, 19 nt, Homo sapiens
gaugaaacccuuguucuua

SEQ ID NO: 754382 - RNA, 19 nt, Homo sapiens
gaucauuccuuaagcacua

SEQ ID NO: 754383 - RNA, 19 nt, Homo sapiens
agggauagcuuucugcuua

SEQ ID NO: 754384 - RNA, 19 nt, Homo sapiens
aaacagguaucaugugaaa

SEQ ID NO: 754385 - RNA, 19 nt, Homo sapiens
ggagaaggcuauggaagaa

SEQ ID NO: 754386 - RNA, 19 nt, Homo sapiens
ggaggaacauauccaagaa

SEQ ID NO: 754387 - RNA, 19 nt, Homo sapiens
ugaagagccucaagauauu

SEQ ID NO: 754388 - RNA, 19 nt, Homo sapiens
guauuucucuugauucuug

SEQ ID NO: 754389 - RNA, 19 nt, Homo sapiens
gcaaacggcuucagaccau

SEQ ID NO: 754390 - RNA, 19 nt, Homo sapiens
ggagcgaagaguucaauua

SEQ ID NO: 754391 - RNA, 19 nt, Homo sapiens
cuaccuagcucccaucuau

SEQ ID NO: 754392 - RNA, 19 nt, Homo sapiens
gaugauagucgaauaagaa

SEQ ID NO: 754393 - RNA, 19 nt, Homo sapiens
ggaaagcagccucaaagaa

SEQ ID NO: 754394 - RNA, 19 nt, Homo sapiens
guagaaaugcuaacugaaa

SEQ ID NO: 754395 - RNA, 19 nt, Homo sapiens
gguaucauguuucauauca

SEQ ID NO: 754396 - RNA, 19 nt, Homo sapiens
ggauguugcuaaauagauu

SEQ ID NO: 754397 - RNA, 19 nt, Homo sapiens
gacaagagggaaaguauuu

SEQ ID NO: 754398 - RNA, 19 nt, Homo sapiens
ggagagagcuauccaaaau

SEQ ID NO: 754399 - RNA, 19 nt, Homo sapiens
gaucguaguauucauauga

SEQ ID NO: 754400 - RNA, 19 nt, Homo sapiens
guaaagaucagucccaguu

SEQ ID NO: 754401 - RNA, 19 nt, Homo sapiens
ugagagguauguuuauuug

SEQ ID NO: 754402 - RNA, 19 nt, Homo sapiens
gguagguacucaacuuaaa

SEQ ID NO: 754403 - RNA, 19 nt, Homo sapiens
cauaauggaugaucagcaa

SEQ ID NO: 754404 - RNA, 19 nt, Homo sapiens
agaauuggcuguuaagcaa

SEQ ID NO: 754405 - RNA, 19 nt, Homo sapiens
gaagagccucaagauauua

SEQ ID NO: 754406 - RNA, 19 nt, Homo sapiens
ggaagggucuaccucuguu

SEQ ID NO: 754407 - RNA, 19 nt, Homo sapiens
guagaagagaccacauuua

SEQ ID NO: 754408 - RNA, 19 nt, Homo sapiens
uacacaggcuacuaauuua

SEQ ID NO: 754409 - RNA, 19 nt, Homo sapiens
ggguugagcccuaaacuuu

SEQ ID NO: 754410 - RNA, 19 nt, Homo sapiens
gaacugcuggaucguagua

SEQ ID NO: 754411 - RNA, 19 nt, Homo sapiens
gaagagaccacauuuacag

SEQ ID NO: 754412 - RNA, 19 nt, Homo sapiens
uauaauagauccacguuac

SEQ ID NO: 754413 - RNA, 19 nt, Homo sapiens
gauagucgaauaagaagaa

SEQ ID NO: 754414 - RNA, 19 nt, Homo sapiens
ugagaaacccugauguaaa

SEQ ID NO: 754415 - RNA, 19 nt, Homo sapiens
ggccagggauguugcuaaa

SEQ ID NO: 754416 - RNA, 19 nt, Homo sapiens
ucagagagauaaagcacuu

SEQ ID NO: 754417 - RNA, 19 nt, Homo sapiens
aaagcagccucaaagaauu

SEQ ID NO: 754418 - RNA, 19 nt, Homo sapiens
guaggagucuugauagaag

SEQ ID NO: 754419 - RNA, 19 nt, Homo sapiens
caaaaggacaucacucuua

SEQ ID NO: 754420 - RNA, 19 nt, Homo sapiens
uggaauaccuaaagauugu

SEQ ID NO: 754421 - RNA, 19 nt, Homo sapiens
gaagugacauagacaaucc

SEQ ID NO: 754422 - RNA, 19 nt, Homo sapiens
guaugaugauagucgaaua

SEQ ID NO: 754423 - RNA, 19 nt, Homo sapiens
gcugagaaacccugaugua

SEQ ID NO: 754424 - RNA, 19 nt, Homo sapiens
gggauagcuuucugcuuaa

SEQ ID NO: 754425 - RNA, 19 nt, Homo sapiens
gcacuuuaguacauaguca

SEQ ID NO: 754426 - RNA, 19 nt, Homo sapiens
cagauaaucaucaggaauu

SEQ ID NO: 754427 - RNA, 19 nt, Homo sapiens
aaagaucagucccaguuau

SEQ ID NO: 754428 - RNA, 19 nt, Homo sapiens
gagaccacauuuacaguca

SEQ ID NO: 754429 - RNA, 19 nt, Homo sapiens
ucauucaccuucucucuga

SEQ ID NO: 754430 - RNA, 19 nt, Homo sapiens
gagcgaagaguucaauuag

SEQ ID NO: 754431 - RNA, 19 nt, Homo sapiens
cuguaaaccuugagggaua

SEQ ID NO: 754432 - RNA, 19 nt, Homo sapiens
ccacguuacuggaaucugu

SEQ ID NO: 754433 - RNA, 19 nt, Homo sapiens
caaauauccugcgagauuc

SEQ ID NO: 754434 - RNA, 19 nt, Homo sapiens
cauagacaauccuacuuug

SEQ ID NO: 754435 - RNA, 19 nt, Homo sapiens
ggaucuacauuauaccaau

SEQ ID NO: 754436 - RNA, 19 nt, Homo sapiens
aaacagcuauuuacaaagc

SEQ ID NO: 754437 - RNA, 19 nt, Homo sapiens
gaucagucccaguuauaaa

SEQ ID NO: 754438 - RNA, 19 nt, Homo sapiens
gagcgaggaugauuucacu

SEQ ID NO: 754439 - RNA, 19 nt, Homo sapiens
ccagagagcauggaacaaa

SEQ ID NO: 754440 - RNA, 19 nt, Homo sapiens
ucugagaucuaaagcuaaa

SEQ ID NO: 754441 - RNA, 19 nt, Homo sapiens
ggauagcuuucugcuuaaa

SEQ ID NO: 754442 - RNA, 19 nt, Homo sapiens
gaaugugacuaggaaauac

SEQ ID NO: 754443 - RNA, 19 nt, Homo sapiens
caucaagagguaauaauga

SEQ ID NO: 754444 - RNA, 19 nt, Homo sapiens
gaacaaaugcuggauccau

SEQ ID NO: 754445 - RNA, 19 nt, Homo sapiens
ucagcaagcuuugaacuca

SEQ ID NO: 754446 - RNA, 19 nt, Homo sapiens
gauaucaaaggcgcaaaua

SEQ ID NO: 754447 - RNA, 19 nt, Homo sapiens
cuggauccauuaucuuuaa

SEQ ID NO: 754448 - RNA, 19 nt, Homo sapiens
ugccaucacuagaagauuu

SEQ ID NO: 754449 - RNA, 19 nt, Homo sapiens
uaaagaucagucccaguua

SEQ ID NO: 754450 - RNA, 19 nt, Homo sapiens
gauacuaguagcaugaauu

SEQ ID NO: 754451 - RNA, 19 nt, Homo sapiens
aagaagguaucauguuuca

SEQ ID NO: 754452 - RNA, 19 nt, Homo sapiens
cggguuacauuccagauga

SEQ ID NO: 754453 - RNA, 19 nt, Homo sapiens
agacuauacucgagauuuc

SEQ ID NO: 754454 - RNA, 19 nt, Homo sapiens
gggcugaauuugaagcaau

SEQ ID NO: 754455 - RNA, 19 nt, Homo sapiens
ggaaauacacccgucagau

SEQ ID NO: 754456 - RNA, 19 nt, Homo sapiens
gcgaauuguucaguauuau

SEQ ID NO: 754457 - RNA, 19 nt, Homo sapiens
gggucuaccucuguuauga

SEQ ID NO: 754458 - RNA, 19 nt, Homo sapiens
gaagggucuaccucuguua

SEQ ID NO: 754459 - RNA, 19 nt, Homo sapiens
ugaacucaaucaugcaaga

SEQ ID NO: 754460 - RNA, 19 nt, Homo sapiens
uaggaucacagaauacuaa

SEQ ID NO: 754461 - RNA, 19 nt, Homo sapiens
uagguaacaucccuuagga

SEQ ID NO: 754462 - RNA, 19 nt, Homo sapiens
gcucccaucuauucauuca

SEQ ID NO: 754463 - RNA, 19 nt, Homo sapiens
gccuugggcugaauuugaa

SEQ ID NO: 754464 - RNA, 19 nt, Homo sapiens
guugagcuguuugccauaa

SEQ ID NO: 754465 - RNA, 19 nt, Homo sapiens
ugguagaaaugcuaacuga

SEQ ID NO: 754466 - RNA, 19 nt, Homo sapiens
uaucaaaggcgcaaauauc

SEQ ID NO: 754467 - RNA, 19 nt, Homo sapiens
gcacugguguuucuagaua

SEQ ID NO: 754468 - RNA, 19 nt, Homo sapiens
gaaagugaaugaugguaaa

SEQ ID NO: 754469 - RNA, 19 nt, Homo sapiens
ccaaauacauccugaaaga

SEQ ID NO: 754470 - RNA, 19 nt, Homo sapiens
cgagaagcauucaucauua

SEQ ID NO: 754471 - RNA, 19 nt, Homo sapiens
gaagcugaauccuuuauga

SEQ ID NO: 754472 - RNA, 19 nt, Homo sapiens
uaaugucacugcucaaauu

SEQ ID NO: 754473 - RNA, 19 nt, Homo sapiens
acaaagcugugauucagua

SEQ ID NO: 754474 - RNA, 19 nt, Homo sapiens
agucaaggauucuucauuu

SEQ ID NO: 754475 - RNA, 19 nt, Homo sapiens
gaggacagaugacauugga

SEQ ID NO: 754476 - RNA, 19 nt, Homo sapiens
aaagacagcuucuccaucu

SEQ ID NO: 754477 - RNA, 19 nt, Homo sapiens
ggacauaaaccacgagagu

SEQ ID NO: 754478 - RNA, 19 nt, Homo sapiens
ugacauagcacugauuaaa

SEQ ID NO: 754479 - RNA, 19 nt, Homo sapiens
cgacguggcucgagaagca

SEQ ID NO: 754480 - RNA, 19 nt, Homo sapiens
ggaagcaggucaguaugga

SEQ ID NO: 754481 - RNA, 19 nt, Homo sapiens
cauacuggcuguuggcauu

SEQ ID NO: 754482 - RNA, 19 nt, Homo sapiens
gaaauccuuuacugcaguu

SEQ ID NO: 754483 - RNA, 19 nt, Homo sapiens
gagaagcauucaucauuac

SEQ ID NO: 754484 - RNA, 19 nt, Homo sapiens
caacaucacgccuauuugu

SEQ ID NO: 754485 - RNA, 19 nt, Homo sapiens
gcuguuggcauuucuguaa

SEQ ID NO: 754486 - RNA, 19 nt, Homo sapiens
caguuuaauuccagccuua

SEQ ID NO: 754487 - RNA, 19 nt, Homo sapiens
cuauuugucugccaagaaa

SEQ ID NO: 754488 - RNA, 19 nt, Homo sapiens
gcuuugugcuggcuuagaa

SEQ ID NO: 754489 - RNA, 19 nt, Homo sapiens
gaaugaugguaaauaugug

SEQ ID NO: 754490 - RNA, 19 nt, Homo sapiens
ucaaacagacagagaagaa

SEQ ID NO: 754491 - RNA, 19 nt, Homo sapiens
gaugcuggcuuugacaaug

SEQ ID NO: 754492 - RNA, 19 nt, Homo sapiens
acacaagccuggucugaag

SEQ ID NO: 754493 - RNA, 19 nt, Homo sapiens
ccacuugccaguuuaauuc

SEQ ID NO: 754494 - RNA, 19 nt, Homo sapiens
ucgagaacauaauuaguga

SEQ ID NO: 754495 - RNA, 19 nt, Homo sapiens
cuacaaagcugugauucag

SEQ ID NO: 754496 - RNA, 19 nt, Homo sapiens
cuacgacuuucucaagauu

SEQ ID NO: 754497 - RNA, 19 nt, Homo sapiens
gcaaggacacuuucuacuc

SEQ ID NO: 754498 - RNA, 19 nt, Homo sapiens
gaaaagaagcugaauccuu

SEQ ID NO: 754499 - RNA, 19 nt, Homo sapiens
uaugacaacuggguccuaa

SEQ ID NO: 754500 - RNA, 19 nt, Homo sapiens
caacaggagggcguauaua

SEQ ID NO: 754501 - RNA, 19 nt, Homo sapiens
gagaccuucuacacaauga

SEQ ID NO: 754502 - RNA, 19 nt, Homo sapiens
ucgagaagcauucaucauu

SEQ ID NO: 754503 - RNA, 19 nt, Homo sapiens
gcugucauuucuccacuug

SEQ ID NO: 754504 - RNA, 19 nt, Homo sapiens
gacauagcacugauuaaau

SEQ ID NO: 754505 - RNA, 19 nt, Homo sapiens
ugaaagugaaugaugguaa

SEQ ID NO: 754506 - RNA, 19 nt, Homo sapiens
caguacagcugugaagaga

SEQ ID NO: 754507 - RNA, 19 nt, Homo sapiens
ggagugaccaccuacaaag

SEQ ID NO: 754508 - RNA, 19 nt, Homo sapiens
gaccaucaccuuugucaca

SEQ ID NO: 754509 - RNA, 19 nt, Homo sapiens
ggacauggcaguuguugcu

SEQ ID NO: 754510 - RNA, 19 nt, Homo sapiens
caucauuacuguggacaug

SEQ ID NO: 754511 - RNA, 19 nt, Homo sapiens
aaguguaacugcuaacaug

SEQ ID NO: 754512 - RNA, 19 nt, Homo sapiens
cagcgcagccuugcccuua

SEQ ID NO: 754513 - RNA, 19 nt, Homo sapiens
caaagggguuuucuugcua

SEQ ID NO: 754514 - RNA, 19 nt, Homo sapiens
gugugaggcugauggauuc

SEQ ID NO: 754515 - RNA, 19 nt, Homo sapiens
gggcacugguguuucuaga

SEQ ID NO: 754516 - RNA, 19 nt, Homo sapiens
aaugacauagcacugauua

SEQ ID NO: 754517 - RNA, 19 nt, Homo sapiens
gacaaugacauagcacuga

SEQ ID NO: 754518 - RNA, 19 nt, Homo sapiens
caggugcacuuuuauauga

SEQ ID NO: 754519 - RNA, 19 nt, Homo sapiens
agacagcuucuccaucuuu

SEQ ID NO: 754520 - RNA, 19 nt, Homo sapiens
aguauggagucuacacaaa

SEQ ID NO: 754521 - RNA, 19 nt, Homo sapiens
gugcagcauuguugacugu

SEQ ID NO: 754522 - RNA, 19 nt, Homo sapiens
ucaccuuugucacagauga

SEQ ID NO: 754523 - RNA, 19 nt, Homo sapiens
ccacaggauugaaacaaaa

SEQ ID NO: 754524 - RNA, 19 nt, Homo sapiens
ucacugcucaaauuacauu

SEQ ID NO: 754525 - RNA, 19 nt, Homo sapiens
acauaaaccacgagaguga

SEQ ID NO: 754526 - RNA, 19 nt, Homo sapiens
uuucuccacuugccaguuu

SEQ ID NO: 754527 - RNA, 19 nt, Homo sapiens
uuaacuauauucccuggau

SEQ ID NO: 754528 - RNA, 19 nt, Homo sapiens
agacuaucaccucauuaua

SEQ ID NO: 754529 - RNA, 19 nt, Homo sapiens
cccacaggauugaaacaaa

SEQ ID NO: 754530 - RNA, 19 nt, Homo sapiens
ggaucgagaacauaauuag

SEQ ID NO: 754531 - RNA, 19 nt, Homo sapiens
gcaacaucacgccuauuug

SEQ ID NO: 754532 - RNA, 19 nt, Homo sapiens
acuaucaccucauuauaca

SEQ ID NO: 754533 - RNA, 19 nt, Homo sapiens
aaaagacuaucaccucauu

SEQ ID NO: 754534 - RNA, 19 nt, Homo sapiens
aagcauucaucauuacugu

SEQ ID NO: 754535 - RNA, 19 nt, Homo sapiens
uaacugcuaacaugcuuug

SEQ ID NO: 754536 - RNA, 19 nt, Homo sapiens
gaaguguaacugcuaacau

SEQ ID NO: 754537 - RNA, 19 nt, Homo sapiens
gacuaucaccucauuauac

SEQ ID NO: 754538 - RNA, 19 nt, Homo sapiens
acaaugaaagugaaugaug

SEQ ID NO: 754539 - RNA, 19 nt, Homo sapiens
gaccuucuacacaaugaaa

SEQ ID NO: 754540 - RNA, 19 nt, Homo sapiens
gcgcagccuugcccuuauc

SEQ ID NO: 754541 - RNA, 19 nt, Homo sapiens
ugucacugcucaaauuaca

SEQ ID NO: 754542 - RNA, 19 nt, Homo sapiens
caugcuuugugcuggcuua

SEQ ID NO: 754543 - RNA, 19 nt, Homo sapiens
uaugaggacagaugacauu

SEQ ID NO: 754544 - RNA, 19 nt, Homo sapiens
aaauacauccugaaagaca

SEQ ID NO: 754545 - RNA, 19 nt, Homo sapiens
ggcaaguccugauauuagg

SEQ ID NO: 754546 - RNA, 19 nt, Homo sapiens
caggagggcguauauaugg

SEQ ID NO: 754547 - RNA, 19 nt, Homo sapiens
gaggagggguucaguguca

SEQ ID NO: 754548 - RNA, 19 nt, Homo sapiens
acacaaugaaagugaauga

SEQ ID NO: 754549 - RNA, 19 nt, Homo sapiens
gauucaaacagacagagaa

SEQ ID NO: 754550 - RNA, 19 nt, Homo sapiens
uaaacugccuguccaugcu

SEQ ID NO: 754551 - RNA, 19 nt, Homo sapiens
gaaaagccacccuauccaa

SEQ ID NO: 754552 - RNA, 19 nt, Homo sapiens
aaaauguacugcugcauau

SEQ ID NO: 754553 - RNA, 19 nt, Homo sapiens
acaaugacauagcacugau

SEQ ID NO: 754554 - RNA, 19 nt, Homo sapiens
guccugauauuagguggaa

SEQ ID NO: 754555 - RNA, 19 nt, Homo sapiens
guaaugucacugcucaaau

SEQ ID NO: 754556 - RNA, 19 nt, Homo sapiens
gaagcauucaucauuacug

SEQ ID NO: 754557 - RNA, 19 nt, Homo sapiens
ugucugcagucaaggauuc

SEQ ID NO: 754558 - RNA, 19 nt, Homo sapiens
guaaucaauagcaacauca

SEQ ID NO: 754559 - RNA, 19 nt, Homo sapiens
uguaaucaauagcaacauc

SEQ ID NO: 754560 - RNA, 19 nt, Homo sapiens
gagccuguuuguggacuau

SEQ ID NO: 754561 - RNA, 19 nt, Homo sapiens
uuacugcaguuugucagaa

SEQ ID NO: 754562 - RNA, 19 nt, Homo sapiens
aggugaggcugcugucauu

SEQ ID NO: 754563 - RNA, 19 nt, Homo sapiens
gaucgagaacauaauuagu

SEQ ID NO: 754564 - RNA, 19 nt, Homo sapiens
ggaaguguaacugcuaaca

SEQ ID NO: 754565 - RNA, 19 nt, Homo sapiens
uggcaaguccugauauuag

SEQ ID NO: 754566 - RNA, 19 nt, Homo sapiens
guccuggagugaccaccua

SEQ ID NO: 754567 - RNA, 19 nt, Homo sapiens
caccauggacccaauaaua

SEQ ID NO: 754568 - RNA, 19 nt, Homo sapiens
gcaaggacacuuucuacuc

SEQ ID NO: 754569 - RNA, 19 nt, Homo sapiens
ccauggacccaauaauaaa

SEQ ID NO: 754570 - RNA, 19 nt, Homo sapiens
accauggacccaauaauaa

SEQ ID NO: 754571 - RNA, 19 nt, Homo sapiens
guucgaggccuucuaugca

SEQ ID NO: 754572 - RNA, 19 nt, Homo sapiens
cgacuacuccaacgagaag

SEQ ID NO: 754573 - RNA, 19 nt, Homo sapiens
ucucccaccucugcgagua

SEQ ID NO: 754574 - RNA, 19 nt, Homo sapiens
gaacagaugucauagagaa

SEQ ID NO: 754575 - RNA, 19 nt, Homo sapiens
gaagauagaugacaaagau

SEQ ID NO: 754576 - RNA, 19 nt, Homo sapiens
ugacaaagaugaacucgua

SEQ ID NO: 754577 - RNA, 19 nt, Homo sapiens
ggaaauggauugauaaugg

SEQ ID NO: 754578 - RNA, 19 nt, Homo sapiens
gaaaguaaguggaaaugga

SEQ ID NO: 754579 - RNA, 19 nt, Homo sapiens
gaacuggauucacgccuua

SEQ ID NO: 754580 - RNA, 19 nt, Homo sapiens
cuaagaaacuguagugaaa

SEQ ID NO: 754581 - RNA, 19 nt, Homo sapiens
caacaagaauggcaacuau

SEQ ID NO: 754582 - RNA, 19 nt, Homo sapiens
aaacagacuugucaacauu

SEQ ID NO: 754583 - RNA, 19 nt, Homo sapiens
gcacaucuccuggaauuaa

SEQ ID NO: 754584 - RNA, 19 nt, Homo sapiens
ggacuuaguuaauucuuca

SEQ ID NO: 754585 - RNA, 19 nt, Homo sapiens
aaacuuaccuucuuacucu

SEQ ID NO: 754586 - RNA, 19 nt, Homo sapiens
agauaaagaugaacaggaa

SEQ ID NO: 754587 - RNA, 19 nt, Homo sapiens
caaagaugaacucguauuu

SEQ ID NO: 754588 - RNA, 19 nt, Homo sapiens
caaaagaacagaugucaua

SEQ ID NO: 754589 - RNA, 19 nt, Homo sapiens
cauuguagaucaucccuuu

SEQ ID NO: 754590 - RNA, 19 nt, Homo sapiens
gaaaacugaugacaaagaa

SEQ ID NO: 754591 - RNA, 19 nt, Homo sapiens
uggcacaucuccuggaauu

SEQ ID NO: 754592 - RNA, 19 nt, Homo sapiens
uaaacagacuugucaacau

SEQ ID NO: 754593 - RNA, 19 nt, Homo sapiens
gaauggcaacuauugauug

SEQ ID NO: 754594 - RNA, 19 nt, Homo sapiens
ggacucuguuucucaaugu

SEQ ID NO: 754595 - RNA, 19 nt, Homo sapiens
gaagggauguaaacagacu

SEQ ID NO: 754596 - RNA, 19 nt, Homo sapiens
gacuaugacuuuaaagauc

SEQ ID NO: 754597 - RNA, 19 nt, Homo sapiens
ggacuaugacuuuaaagau

SEQ ID NO: 754598 - RNA, 19 nt, Homo sapiens
guuguggaguaaacuguua

SEQ ID NO: 754599 - RNA, 19 nt, Homo sapiens
gggauccucuguuuacuuc

SEQ ID NO: 754600 - RNA, 19 nt, Homo sapiens
gcauucaaacguacaauug

SEQ ID NO: 754601 - RNA, 19 nt, Homo sapiens
gaucaucccuuuugaagau

SEQ ID NO: 754602 - RNA, 19 nt, Homo sapiens
uggaagggauguaaacaga

SEQ ID NO: 754603 - RNA, 19 nt, Homo sapiens
gaugauagucacaguguug

SEQ ID NO: 754604 - RNA, 19 nt, Homo sapiens
gaucagggagagauuuauu

SEQ ID NO: 754605 - RNA, 19 nt, Homo sapiens
aaguggaaauggauugaua

SEQ ID NO: 754606 - RNA, 19 nt, Homo sapiens
gauguaaacagacuuguca

SEQ ID NO: 754607 - RNA, 19 nt, Homo sapiens
ggaccuaagauauugaaga

SEQ ID NO: 754608 - RNA, 19 nt, Homo sapiens
gcaaaaugacaacuacuua

SEQ ID NO: 754609 - RNA, 19 nt, Homo sapiens
uacagaaaccauccuauuu

SEQ ID NO: 754610 - RNA, 19 nt, Homo sapiens
gaccuaagauauugaagac

SEQ ID NO: 754611 - RNA, 19 nt, Homo sapiens
gauccucuguuuacuucuu

SEQ ID NO: 754612 - RNA, 19 nt, Homo sapiens
gcauagcacagauacagaa

SEQ ID NO: 754613 - RNA, 19 nt, Homo sapiens
gaacucguauuuuacauuc

SEQ ID NO: 754614 - RNA, 19 nt, Homo sapiens
gcagucuccuucagaguca

SEQ ID NO: 754615 - RNA, 19 nt, Homo sapiens
gauucacgccuuauacaaa

SEQ ID NO: 754616 - RNA, 19 nt, Homo sapiens
gcacagauacagaaaccau

SEQ ID NO: 754617 - RNA, 19 nt, Homo sapiens
aagaacagaugucauagag

SEQ ID NO: 754618 - RNA, 19 nt, Homo sapiens
caagaauggcaacuauuga

SEQ ID NO: 754619 - RNA, 19 nt, Homo sapiens
acaagaauggcaacuauug

SEQ ID NO: 754620 - RNA, 19 nt, Homo sapiens
gaugaaagggaaaguaagu

SEQ ID NO: 754621 - RNA, 19 nt, Homo sapiens
gauuaaggccugaugauac

SEQ ID NO: 754622 - RNA, 19 nt, Homo sapiens
ggaucggauuaucauauga

SEQ ID NO: 754623 - RNA, 19 nt, Homo sapiens
guccagagccuucauucaa

SEQ ID NO: 754624 - RNA, 19 nt, Homo sapiens
caacggcaggaaauucuaa

SEQ ID NO: 754625 - RNA, 19 nt, Homo sapiens
aaacaucaacggcaggaaa

SEQ ID NO: 754626 - RNA, 19 nt, Homo sapiens
guaaacagacuugucaaca

SEQ ID NO: 754627 - RNA, 19 nt, Homo sapiens
gagccuucauucaaucuca

SEQ ID NO: 754628 - RNA, 19 nt, Homo sapiens
cagagucacagaauagauu

SEQ ID NO: 754629 - RNA, 19 nt, Homo sapiens
ccagagccuucauucaauc

SEQ ID NO: 754630 - RNA, 19 nt, Homo sapiens
caguguuggugacaaauau

SEQ ID NO: 754631 - RNA, 19 nt, Homo sapiens
auacagaaaccauccuauu

SEQ ID NO: 754632 - RNA, 19 nt, Homo sapiens
caauguuggaccuaagaua

SEQ ID NO: 754633 - RNA, 19 nt, Homo sapiens
gauagaugacaaagaugaa

SEQ ID NO: 754634 - RNA, 19 nt, Homo sapiens
gaaaaguacaucaugcaaa

SEQ ID NO: 754635 - RNA, 19 nt, Homo sapiens
gaaacuguagugaaaagua

SEQ ID NO: 754636 - RNA, 19 nt, Homo sapiens
gggacuuaguuaauucuuc

SEQ ID NO: 754637 - RNA, 19 nt, Homo sapiens
ggauucacgccuuauacaa

SEQ ID NO: 754638 - RNA, 19 nt, Homo sapiens
ccacugcauagcacagaua

SEQ ID NO: 754639 - RNA, 19 nt, Homo sapiens
gaagaaaaggugaaaaugg

SEQ ID NO: 754640 - RNA, 19 nt, Homo sapiens
uggaucggauuaucauaug

SEQ ID NO: 754641 - RNA, 19 nt, Homo sapiens
ugggaaaacugaugacaaa

SEQ ID NO: 754642 - RNA, 19 nt, Homo sapiens
cucuaaagaugaaugauca

SEQ ID NO: 754643 - RNA, 19 nt, Homo sapiens
ggaaaacugaugacaaaga

SEQ ID NO: 754644 - RNA, 19 nt, Homo sapiens
agauuaaggccugaugaua

SEQ ID NO: 754645 - RNA, 19 nt, Homo sapiens
aagaaaaggugaaaaugga

SEQ ID NO: 754646 - RNA, 19 nt, Homo sapiens
agggagagauuuauucaac

SEQ ID NO: 754647 - RNA, 19 nt, Homo sapiens
aaagggaaaguaaguggaa

SEQ ID NO: 754648 - RNA, 19 nt, Homo sapiens
caggcaaauucucugaaga

SEQ ID NO: 754649 - RNA, 19 nt, Homo sapiens
ucuaagaaacuguagugaa

SEQ ID NO: 754650 - RNA, 19 nt, Homo sapiens
ucaacaagaauggcaacua

SEQ ID NO: 754651 - RNA, 19 nt, Homo sapiens
agauagaugacaaagauga

SEQ ID NO: 754652 - RNA, 19 nt, Homo sapiens
gcaaaauacaggcaaauuc

SEQ ID NO: 754653 - RNA, 19 nt, Homo sapiens
aaagaacagaugucauaga

SEQ ID NO: 754654 - RNA, 19 nt, Homo sapiens
uccagagccuucauucaau

SEQ ID NO: 754655 - RNA, 19 nt, Homo sapiens
acaaagaugaacucguauu

SEQ ID NO: 754656 - RNA, 19 nt, Homo sapiens
agagucacagaauagauua

SEQ ID NO: 754657 - RNA, 19 nt, Homo sapiens
gaaugaucagggagagauu

SEQ ID NO: 754658 - RNA, 19 nt, Homo sapiens
agaauggcaacuauugauu

SEQ ID NO: 754659 - RNA, 19 nt, Homo sapiens
guaaguggaaauggauuga

SEQ ID NO: 754660 - RNA, 19 nt, Homo sapiens
ccuucagagucacagaaua

SEQ ID NO: 754661 - RNA, 19 nt, Homo sapiens
gcaccucauugcagugacu

SEQ ID NO: 754662 - RNA, 19 nt, Homo sapiens
aauuguaucugugggaaga

SEQ ID NO: 754663 - RNA, 19 nt, Homo sapiens
uguuggaccuaagauauug

SEQ ID NO: 754664 - RNA, 19 nt, Homo sapiens
guuggugacaaauaucuuu

SEQ ID NO: 754665 - RNA, 19 nt, Homo sapiens
uaaagaugaacaggaagaa

SEQ ID NO: 754666 - RNA, 19 nt, Homo sapiens
gggaaaguaaguggaaaug

SEQ ID NO: 754667 - RNA, 19 nt, Homo sapiens
ggaguccagagccuucauu

SEQ ID NO: 754668 - RNA, 19 nt, Homo sapiens
acaggcaaauucucugaag

SEQ ID NO: 754669 - RNA, 19 nt, Homo sapiens
aauguuggaccuaagauau

SEQ ID NO: 754670 - RNA, 19 nt, Homo sapiens
guggaguaaacuguuauua

SEQ ID NO: 754671 - RNA, 19 nt, Homo sapiens
ucagggagagauuuauuca

SEQ ID NO: 754672 - RNA, 19 nt, Homo sapiens
ugugggacuuaguuaauuc

SEQ ID NO: 754673 - RNA, 19 nt, Homo sapiens
ggugugcgccaagaagaaa

SEQ ID NO: 754674 - RNA, 19 nt, Homo sapiens
gaacgaagacccucugaug

SEQ ID NO: 754675 - RNA, 19 nt, Homo sapiens
ugaaggagcugagacauau

SEQ ID NO: 754676 - RNA, 19 nt, Homo sapiens
gaaccagagugcucagcua

SEQ ID NO: 754677 - RNA, 19 nt, Homo sapiens
ggaaggagccaacaucaau

SEQ ID NO: 754678 - RNA, 19 nt, Homo sapiens
gagagaaggucgaguaggu

SEQ ID NO: 754679 - RNA, 19 nt, Homo sapiens
ggaugugggccuuuaauaa

SEQ ID NO: 754680 - RNA, 19 nt, Homo sapiens
gcaaugccaucaucaacga

SEQ ID NO: 754681 - RNA, 19 nt, Homo sapiens
gcagauaugcaaucaaaga

SEQ ID NO: 754682 - RNA, 19 nt, Homo sapiens
gaaauccuauaccaugaug

SEQ ID NO: 754683 - RNA, 19 nt, Homo sapiens
gaaggagccaacaucaaua

SEQ ID NO: 754684 - RNA, 19 nt, Homo sapiens
acauaaagcuggaaaugga

SEQ ID NO: 754685 - RNA, 19 nt, Homo sapiens
gcaaguguaucgggacauu

SEQ ID NO: 754686 - RNA, 19 nt, Homo sapiens
gggaaauccuauaccauga

SEQ ID NO: 754687 - RNA, 19 nt, Homo sapiens
agacauugcugaccucaug

SEQ ID NO: 754688 - RNA, 19 nt, Homo sapiens
gguaggaucauaagucauu

SEQ ID NO: 754689 - RNA, 19 nt, Homo sapiens
aaaccaaagugaagagaga

SEQ ID NO: 754690 - RNA, 19 nt, Homo sapiens
gcagcaaggcaucgacaua

SEQ ID NO: 754691 - RNA, 19 nt, Homo sapiens
gagccaacaucaauaaguc

SEQ ID NO: 754692 - RNA, 19 nt, Homo sapiens
gaaggucgaguaggugaua

SEQ ID NO: 754693 - RNA, 19 nt, Homo sapiens
gaggcuagguaggaucaua

SEQ ID NO: 754694 - RNA, 19 nt, Homo sapiens
gaacuuugcccagaaggaa

SEQ ID NO: 754695 - RNA, 19 nt, Homo sapiens
gaccucuucucucgcguua

SEQ ID NO: 754696 - RNA, 19 nt, Homo sapiens
ucgaguaggugauagaaga

SEQ ID NO: 754697 - RNA, 19 nt, Homo sapiens
ucaccuggcugcucaagga

SEQ ID NO: 754698 - RNA, 19 nt, Homo sapiens
gagaaggucaguaagauca

SEQ ID NO: 754699 - RNA, 19 nt, Homo sapiens
gaaggaaggagccaacauc

SEQ ID NO: 754700 - RNA, 19 nt, Homo sapiens
gaaagugggagaggacuga

SEQ ID NO: 754701 - RNA, 19 nt, Homo sapiens
ugagagagaaggucgagua

SEQ ID NO: 754702 - RNA, 19 nt, Homo sapiens
ggagacagagaagauuaua

SEQ ID NO: 754703 - RNA, 19 nt, Homo sapiens
ggaagaagggagugucaga

SEQ ID NO: 754704 - RNA, 19 nt, Homo sapiens
caaagugaagagagagaua

SEQ ID NO: 754705 - RNA, 19 nt, Homo sapiens
gaggagaagcuacgcaaga

SEQ ID NO: 754706 - RNA, 19 nt, Homo sapiens
cauggacuguggaaauaaa

SEQ ID NO: 754707 - RNA, 19 nt, Homo sapiens
ugagcuauauggagaucua

SEQ ID NO: 754708 - RNA, 19 nt, Homo sapiens
guacgcaguguuugacuuu

SEQ ID NO: 754709 - RNA, 19 nt, Homo sapiens
gagaaucaguaccggaaag

SEQ ID NO: 754710 - RNA, 19 nt, Homo sapiens
ugaaggagaucugcuacga

SEQ ID NO: 754711 - RNA, 19 nt, Homo sapiens
caccauggcugaccugaag

SEQ ID NO: 754712 - RNA, 19 nt, Homo sapiens
agaagaggcugcaggaucu

SEQ ID NO: 754713 - RNA, 19 nt, Homo sapiens
gagcugagacauaugugaa

SEQ ID NO: 754714 - RNA, 19 nt, Homo sapiens
gugaaggagcugagacaua

SEQ ID NO: 754715 - RNA, 19 nt, Homo sapiens
ggacauuggagaagagaug

SEQ ID NO: 754716 - RNA, 19 nt, Homo sapiens
gcaggagugucuggagcua

SEQ ID NO: 754717 - RNA, 19 nt, Homo sapiens
ugcaggaucuggagaauca

SEQ ID NO: 754718 - RNA, 19 nt, Homo sapiens
ccaaguagauauggacauc

SEQ ID NO: 754719 - RNA, 19 nt, Homo sapiens
caacacggagucccagauu

SEQ ID NO: 754720 - RNA, 19 nt, Homo sapiens
auauggagaucuacuguga

SEQ ID NO: 754721 - RNA, 19 nt, Homo sapiens
gccaggagaugagagagaa

SEQ ID NO: 754722 - RNA, 19 nt, Homo sapiens
ggaugagaaugaagaaggu

SEQ ID NO: 754723 - RNA, 19 nt, Homo sapiens
cagcaaggcaucgacauaa

SEQ ID NO: 754724 - RNA, 19 nt, Homo sapiens
gaagucagggaauaggauu

SEQ ID NO: 754725 - RNA, 19 nt, Homo sapiens
caggagacagagaagauua

SEQ ID NO: 754726 - RNA, 19 nt, Homo sapiens
gaaauaaagcacggacugu

SEQ ID NO: 754727 - RNA, 19 nt, Homo sapiens
uagguaggaucauaaguca

SEQ ID NO: 754728 - RNA, 19 nt, Homo sapiens
gggagaggacugagaguga

SEQ ID NO: 754729 - RNA, 19 nt, Homo sapiens
gcccugcugacaucaauua

SEQ ID NO: 754730 - RNA, 19 nt, Homo sapiens
ccaaggagcaaaccaaagu

SEQ ID NO: 754731 - RNA, 19 nt, Homo sapiens
caacaccaccuccaucauc

SEQ ID NO: 754732 - RNA, 19 nt, Homo sapiens
ggagcugugucgcaccuau

SEQ ID NO: 754733 - RNA, 19 nt, Homo sapiens
ggauugugaugggcaagaa

SEQ ID NO: 754734 - RNA, 19 nt, Homo sapiens
caucaucaauccuaaacag

SEQ ID NO: 754735 - RNA, 19 nt, Homo sapiens
aagcaaauccgcugcaaug

SEQ ID NO: 754736 - RNA, 19 nt, Homo sapiens
gagcaaaccaaagugaaga

SEQ ID NO: 754737 - RNA, 19 nt, Homo sapiens
caucucagcagcaagugua

SEQ ID NO: 754738 - RNA, 19 nt, Homo sapiens
cgacauaaagcuggaaaug

SEQ ID NO: 754739 - RNA, 19 nt, Homo sapiens
gcugagacauaugugaaug

SEQ ID NO: 754740 - RNA, 19 nt, Homo sapiens
gagcccugcugacaucaau

SEQ ID NO: 754741 - RNA, 19 nt, Homo sapiens
ucucggcccuugcagauau

SEQ ID NO: 754742 - RNA, 19 nt, Homo sapiens
cuacaacgugugcaucuuu

SEQ ID NO: 754743 - RNA, 19 nt, Homo sapiens
ccagccagauggagaagug

SEQ ID NO: 754744 - RNA, 19 nt, Homo sapiens
gaaggucaguaagaucagu

SEQ ID NO: 754745 - RNA, 19 nt, Homo sapiens
cucauggacuguggaaaua

SEQ ID NO: 754746 - RNA, 19 nt, Homo sapiens
gcugggaaauccuauacca

SEQ ID NO: 754747 - RNA, 19 nt, Homo sapiens
gcaaggcaucgacauaaag

SEQ ID NO: 754748 - RNA, 19 nt, Homo sapiens
cagaagcccugaggaugga

SEQ ID NO: 754749 - RNA, 19 nt, Homo sapiens
caucacccaccacacauaa

SEQ ID NO: 754750 - RNA, 19 nt, Homo sapiens
cggagaaggucaguaagau

SEQ ID NO: 754751 - RNA, 19 nt, Homo sapiens
gcaggagacagagaagauu

SEQ ID NO: 754752 - RNA, 19 nt, Homo sapiens
ucacacagcgcugccauga

SEQ ID NO: 754753 - RNA, 19 nt, Homo sapiens
ggaaauccuauaccaugau

SEQ ID NO: 754754 - RNA, 19 nt, Homo sapiens
gugaagagagagauaggaa

SEQ ID NO: 754755 - RNA, 19 nt, Homo sapiens
cagccaggaugccaagugu

SEQ ID NO: 754756 - RNA, 19 nt, Homo sapiens
ccaaguguguggucagcau

SEQ ID NO: 754757 - RNA, 19 nt, Homo sapiens
ggagcaaaccaaagugaag

SEQ ID NO: 754758 - RNA, 19 nt, Homo sapiens
ggaagagggcacggaguug

SEQ ID NO: 754759 - RNA, 19 nt, Homo sapiens
aaguagauauggacaucaa

SEQ ID NO: 754760 - RNA, 19 nt, Homo sapiens
uggugaaccugaacgaaga

SEQ ID NO: 754761 - RNA, 19 nt, Homo sapiens
ggauggagagagaagcauu

SEQ ID NO: 754762 - RNA, 19 nt, Homo sapiens
ugacuacacuagggaaagu

SEQ ID NO: 754763 - RNA, 19 nt, Homo sapiens
ggagccaacaucaauaagu

SEQ ID NO: 754764 - RNA, 19 nt, Homo sapiens
ucaguaagaucaguuuggu

SEQ ID NO: 754765 - RNA, 19 nt, Homo sapiens
ggagaaggucaguaagauc

SEQ ID NO: 754766 - RNA, 19 nt, Homo sapiens
gugcucagcuauccuacuc

SEQ ID NO: 754767 - RNA, 19 nt, Homo sapiens
ccucuucucucgcguuagu

SEQ ID NO: 754768 - RNA, 19 nt, Homo sapiens
uggcugaccugaagaugca

SEQ ID NO: 754769 - RNA, 19 nt, Homo sapiens
aaucaguaccggaaagaaa

SEQ ID NO: 754770 - RNA, 19 nt, Homo sapiens
cugcugacaucaauuacga

SEQ ID NO: 754771 - RNA, 19 nt, Homo sapiens
gaggugaagcugcagaaca

SEQ ID NO: 754772 - RNA, 19 nt, Homo sapiens
ggagaaucaguaccggaaa

SEQ ID NO: 754773 - RNA, 19 nt, Homo sapiens
ggagcugagacauauguga

SEQ ID NO: 754774 - RNA, 19 nt, Homo sapiens
ccgaagagauucugaugaa

SEQ ID NO: 754775 - RNA, 19 nt, Homo sapiens
ucaacgagcuggucgacuu

SEQ ID NO: 754776 - RNA, 19 nt, Homo sapiens
gcgacgagcuggccuucaa

SEQ ID NO: 754777 - RNA, 19 nt, Homo sapiens
gcagcuggccgaagagauu

SEQ ID NO: 754778 - RNA, 19 nt, Homo sapiens
ccaccaccaucgccaagaa

SEQ ID NO: 754779 - RNA, 19 nt, Homo sapiens
ucaagauccugaacaugga

SEQ ID NO: 754780 - RNA, 19 nt, Homo sapiens
gauuuauucccaagaacua

SEQ ID NO: 754781 - RNA, 19 nt, Homo sapiens
gaacuacauccgcgucaag

SEQ ID NO: 754782 - RNA, 19 nt, Homo sapiens
ggacggccuuggacugaac

SEQ ID NO: 754783 - RNA, 19 nt, Homo sapiens
caagggagacacacucaag

SEQ ID NO: 754784 - RNA, 19 nt, Homo sapiens
guacagcuuucaggcuaca

SEQ ID NO: 754785 - RNA, 19 nt, Homo sapiens
gagacacacucaagauccu

SEQ ID NO: 754786 - RNA, 19 nt, Homo sapiens
cauggaggaugaccagaac

SEQ ID NO: 754787 - RNA, 19 nt, Homo sapiens
cgaagagauucugaugaag

SEQ ID NO: 754788 - RNA, 19 nt, Homo sapiens
uggaguccguggcccugua

SEQ ID NO: 754789 - RNA, 19 nt, Homo sapiens
gggagacacacucaagauc

SEQ ID NO: 754790 - RNA, 19 nt, Homo sapiens
gccaagaagcggcagaucu

SEQ ID NO: 754791 - RNA, 19 nt, Homo sapiens
gccgaagagauucugauga

SEQ ID NO: 754792 - RNA, 19 nt, Homo sapiens
cgagcuggccuucaacaag

SEQ ID NO: 754793 - RNA, 19 nt, Homo sapiens
caacgagcuggucgacuuc

SEQ ID NO: 754794 - RNA, 19 nt, Homo sapiens
ggccgaagagauucugaug

SEQ ID NO: 754795 - RNA, 19 nt, Homo sapiens
ggauuuauucccaagaacu

SEQ ID NO: 754796 - RNA, 19 nt, Homo sapiens
gggugucgagggauuuauu

SEQ ID NO: 754797 - RNA, 19 nt, Homo sapiens
ucugggagccuuccugauc

SEQ ID NO: 754798 - RNA, 19 nt, Homo sapiens
ggcccaguuugacuucuca

SEQ ID NO: 754799 - RNA, 19 nt, Homo sapiens
gaagauggaucauuuauug

SEQ ID NO: 754800 - RNA, 19 nt, Homo sapiens
gaagauggcaggauaauua

SEQ ID NO: 754801 - RNA, 19 nt, Homo sapiens
ggagaagccuuugaaauua

SEQ ID NO: 754802 - RNA, 19 nt, Homo sapiens
gcacauaucucacuuucaa

SEQ ID NO: 754803 - RNA, 19 nt, Homo sapiens
gaagaggacuaaucguaua

SEQ ID NO: 754804 - RNA, 19 nt, Homo sapiens
gagagaauaugcugguuua

SEQ ID NO: 754805 - RNA, 19 nt, Homo sapiens
gaaacaauauggaggauga

SEQ ID NO: 754806 - RNA, 19 nt, Homo sapiens
caacuuggauuuaugguaa

SEQ ID NO: 754807 - RNA, 19 nt, Homo sapiens
ggacuaaucguauaucuaa

SEQ ID NO: 754808 - RNA, 19 nt, Homo sapiens
caaacucucucaacucuaa

SEQ ID NO: 754809 - RNA, 19 nt, Homo sapiens
gaaauaccaucuucaguuc

SEQ ID NO: 754810 - RNA, 19 nt, Homo sapiens
gagcuuaguucugguguua

SEQ ID NO: 754811 - RNA, 19 nt, Homo sapiens
gaacuggcuuggugacuuu

SEQ ID NO: 754812 - RNA, 19 nt, Homo sapiens
gaagauaucaggaguaaau

SEQ ID NO: 754813 - RNA, 19 nt, Homo sapiens
gaacugugauuauugguau

SEQ ID NO: 754814 - RNA, 19 nt, Homo sapiens
gagaagccuuugaaauuaa

SEQ ID NO: 754815 - RNA, 19 nt, Homo sapiens
cgaacaagaugaaagagua

SEQ ID NO: 754816 - RNA, 19 nt, Homo sapiens
gcauagauguugcuacuug

SEQ ID NO: 754817 - RNA, 19 nt, Homo sapiens
gaauagagguggaaaguac

SEQ ID NO: 754818 - RNA, 19 nt, Homo sapiens
gaacagccacucacgauuu

SEQ ID NO: 754819 - RNA, 19 nt, Homo sapiens
gccgggagcugaacauaua

SEQ ID NO: 754820 - RNA, 19 nt, Homo sapiens
gaggaaagcuccaccuuag

SEQ ID NO: 754821 - RNA, 19 nt, Homo sapiens
gaaagugagccuuauauau

SEQ ID NO: 754822 - RNA, 19 nt, Homo sapiens
gcgaguauauuguugaauu

SEQ ID NO: 754823 - RNA, 19 nt, Homo sapiens
gaccacaacagcaauauua

SEQ ID NO: 754824 - RNA, 19 nt, Homo sapiens
ggaaaagcaugucuuauuu

SEQ ID NO: 754825 - RNA, 19 nt, Homo sapiens
ccauaauccugucuuaaua

SEQ ID NO: 754826 - RNA, 19 nt, Homo sapiens
ggugaacaaucaacuagua

SEQ ID NO: 754827 - RNA, 19 nt, Homo sapiens
gggacuaccuaagaaauua

SEQ ID NO: 754828 - RNA, 19 nt, Homo sapiens
ggcagugagucuucaauua

SEQ ID NO: 754829 - RNA, 19 nt, Homo sapiens
gcccagagauggucauauu

SEQ ID NO: 754830 - RNA, 19 nt, Homo sapiens
gaaacaugcuggccgaaga

SEQ ID NO: 754831 - RNA, 19 nt, Homo sapiens
gagcaagaacuuucauaua

SEQ ID NO: 754832 - RNA, 19 nt, Homo sapiens
gaagggaucuguugaaagc

SEQ ID NO: 754833 - RNA, 19 nt, Homo sapiens
agacagugcugccgauaua

SEQ ID NO: 754834 - RNA, 19 nt, Homo sapiens
uaagaugccuucuaacuuc

SEQ ID NO: 754835 - RNA, 19 nt, Homo sapiens
gagaagggaucuguugaaa

SEQ ID NO: 754836 - RNA, 19 nt, Homo sapiens
gggaagauaucaggaguaa

SEQ ID NO: 754837 - RNA, 19 nt, Homo sapiens
gagauugaaugaugacuau

SEQ ID NO: 754838 - RNA, 19 nt, Homo sapiens
aaacuuaacuggcuaucuu

SEQ ID NO: 754839 - RNA, 19 nt, Homo sapiens
gcaauggcaucuuguuaug

SEQ ID NO: 754840 - RNA, 19 nt, Homo sapiens
aagcuaagaugccuucuaa

SEQ ID NO: 754841 - RNA, 19 nt, Homo sapiens
gguggaaaguacucaguua

SEQ ID NO: 754842 - RNA, 19 nt, Homo sapiens
cuacgagauuggagaauua

SEQ ID NO: 754843 - RNA, 19 nt, Homo sapiens
gaacacaucccaaagaagu

SEQ ID NO: 754844 - RNA, 19 nt, Homo sapiens
gaagaacacaucccaaaga

SEQ ID NO: 754845 - RNA, 19 nt, Homo sapiens
ggacugaugugugcgauug

SEQ ID NO: 754846 - RNA, 19 nt, Homo sapiens
gagaauaugcugguuuaua

SEQ ID NO: 754847 - RNA, 19 nt, Homo sapiens
caaagaaacucuggaaugg

SEQ ID NO: 754848 - RNA, 19 nt, Homo sapiens
caacagaaccaccgaagaa

SEQ ID NO: 754849 - RNA, 19 nt, Homo sapiens
guacagugcuuucuuacau

SEQ ID NO: 754850 - RNA, 19 nt, Homo sapiens
cuggaagucucaaauaaua

SEQ ID NO: 754851 - RNA, 19 nt, Homo sapiens
gaugaaaccuuuggugaau

SEQ ID NO: 754852 - RNA, 19 nt, Homo sapiens
ggauguccguccauugaua

SEQ ID NO: 754853 - RNA, 19 nt, Homo sapiens
gaugaaagaguauacauga

SEQ ID NO: 754854 - RNA, 19 nt, Homo sapiens
acucaaggcugguuuauug

SEQ ID NO: 754855 - RNA, 19 nt, Homo sapiens
gaagugaacauucuaagau

SEQ ID NO: 754856 - RNA, 19 nt, Homo sapiens
caaaauugguggugacuua

SEQ ID NO: 754857 - RNA, 19 nt, Homo sapiens
ccagagauggucauauuua

SEQ ID NO: 754858 - RNA, 19 nt, Homo sapiens
gaacuauccuugccaaugc

SEQ ID NO: 754859 - RNA, 19 nt, Homo sapiens
gcaagacuuugaagauaga

SEQ ID NO: 754860 - RNA, 19 nt, Homo sapiens
aaagggagaucuauacuuc

SEQ ID NO: 754861 - RNA, 19 nt, Homo sapiens
caaaagagaugaaagguau

SEQ ID NO: 754862 - RNA, 19 nt, Homo sapiens
ucaguuaccuuaucuuugu

SEQ ID NO: 754863 - RNA, 19 nt, Homo sapiens
gaaaguacucaguuaaaga

SEQ ID NO: 754864 - RNA, 19 nt, Homo sapiens
ggucucagcuguaaaccaa

SEQ ID NO: 754865 - RNA, 19 nt, Homo sapiens
cagugaagauggaucauuu

SEQ ID NO: 754866 - RNA, 19 nt, Homo sapiens
ggaaaguacucaguuaaag

SEQ ID NO: 754867 - RNA, 19 nt, Homo sapiens
gaccauaucuaauguaacu

SEQ ID NO: 754868 - RNA, 19 nt, Homo sapiens
cacagaagauggcaggaua

SEQ ID NO: 754869 - RNA, 19 nt, Homo sapiens
ggacaauaaugagaaaugu

SEQ ID NO: 754870 - RNA, 19 nt, Homo sapiens
gcacugauuuuguacauaa

SEQ ID NO: 754871 - RNA, 19 nt, Homo sapiens
gcacauggaauaucuacuu

SEQ ID NO: 754872 - RNA, 19 nt, Homo sapiens
gcugaagacuuuguauaaa

SEQ ID NO: 754873 - RNA, 19 nt, Homo sapiens
cagagauggucauauuuaa

SEQ ID NO: 754874 - RNA, 19 nt, Homo sapiens
caagaacuuucauauagga

SEQ ID NO: 754875 - RNA, 19 nt, Homo sapiens
ccacaguuaucuuaccuuu

SEQ ID NO: 754876 - RNA, 19 nt, Homo sapiens
ggagggagauccaauuguc

SEQ ID NO: 754877 - RNA, 19 nt, Homo sapiens
ggacaaagaaacucuggaa

SEQ ID NO: 754878 - RNA, 19 nt, Homo sapiens
gaacaauucaggaacauuc

SEQ ID NO: 754879 - RNA, 19 nt, Homo sapiens
guuacuggcuuuacccuaa

SEQ ID NO: 754880 - RNA, 19 nt, Homo sapiens
gagaggagacauuaagauu

SEQ ID NO: 754881 - RNA, 19 nt, Homo sapiens
ggagaagggaguaaaggua

SEQ ID NO: 754882 - RNA, 19 nt, Homo sapiens
uaacagucuuagccuauaa

SEQ ID NO: 754883 - RNA, 19 nt, Homo sapiens
gaaaaccacaguuaucuua

SEQ ID NO: 754884 - RNA, 19 nt, Homo sapiens
cgauauaacucaaguaacu

SEQ ID NO: 754885 - RNA, 19 nt, Homo sapiens
ggagcuaauuugaccauau

SEQ ID NO: 754886 - RNA, 19 nt, Homo sapiens
caaauugaaugugaagcua

SEQ ID NO: 754887 - RNA, 19 nt, Homo sapiens
uaaguaggguucagccaaa

SEQ ID NO: 754888 - RNA, 19 nt, Homo sapiens
aaaccauaauccugucuua

SEQ ID NO: 754889 - RNA, 19 nt, Homo sapiens
ggucaacaguuccaaagga

SEQ ID NO: 754890 - RNA, 19 nt, Homo sapiens
gaugacgccugcugucuau

SEQ ID NO: 754891 - RNA, 19 nt, Homo sapiens
gaagguggaagaagugaaa

SEQ ID NO: 754892 - RNA, 19 nt, Homo sapiens
gaggagacauuaagauuuu

SEQ ID NO: 754893 - RNA, 19 nt, Homo sapiens
guaggugguguuuguauua

SEQ ID NO: 754894 - RNA, 19 nt, Homo sapiens
gaaugcacauggaauaucu

SEQ ID NO: 754895 - RNA, 19 nt, Homo sapiens
cgaaauacuuaacuacugu

SEQ ID NO: 754896 - RNA, 19 nt, Homo sapiens
ggacuaaauucaacugcau

SEQ ID NO: 754897 - RNA, 19 nt, Homo sapiens
gcaagaacuuucauauagg

SEQ ID NO: 754898 - RNA, 19 nt, Homo sapiens
ucaaaagacucacccaaua

SEQ ID NO: 754899 - RNA, 19 nt, Homo sapiens
gaaggaaacucaagagauu

SEQ ID NO: 754900 - RNA, 19 nt, Homo sapiens
gcagagaccuuccaaacua

SEQ ID NO: 754901 - RNA, 19 nt, Homo sapiens
gcagaaagauagaaggaaa

SEQ ID NO: 754902 - RNA, 19 nt, Homo sapiens
ggauauggauggaaaugua

SEQ ID NO: 754903 - RNA, 19 nt, Homo sapiens
gaacuucuaugagauucua

SEQ ID NO: 754904 - RNA, 19 nt, Homo sapiens
ccaggaagcugauuucugu

SEQ ID NO: 754905 - RNA, 19 nt, Homo sapiens
cagaggaacuugaguaugu

SEQ ID NO: 754906 - RNA, 19 nt, Homo sapiens
gaaucgagcucauccgaau

SEQ ID NO: 754907 - RNA, 19 nt, Homo sapiens
gcagagaggcacccuguuu

SEQ ID NO: 754908 - RNA, 19 nt, Homo sapiens
acacacagcucgcuucuuc

SEQ ID NO: 754909 - RNA, 19 nt, Homo sapiens
gauauuccauuuccaguuc

SEQ ID NO: 754910 - RNA, 19 nt, Homo sapiens
gcaauuuccuggauaccuu

SEQ ID NO: 754911 - RNA, 19 nt, Homo sapiens
guacaaagaacaaggaguu

SEQ ID NO: 754912 - RNA, 19 nt, Homo sapiens
ggaccaauccacaaauaaa

SEQ ID NO: 754913 - RNA, 19 nt, Homo sapiens
ggaguguaguuuccuugua

SEQ ID NO: 754914 - RNA, 19 nt, Homo sapiens
gaagcugauuucugucuga

SEQ ID NO: 754915 - RNA, 19 nt, Homo sapiens
ggagacugcuggcuauuag

SEQ ID NO: 754916 - RNA, 19 nt, Homo sapiens
ggaagacgcgauccacaaa

SEQ ID NO: 754917 - RNA, 19 nt, Homo sapiens
gaagcaagacguucaucaa

SEQ ID NO: 754918 - RNA, 19 nt, Homo sapiens
ggaguucauucaucucaau

SEQ ID NO: 754919 - RNA, 19 nt, Homo sapiens
cagaagugcugcagaaucu

SEQ ID NO: 754920 - RNA, 19 nt, Homo sapiens
acgaacaccugaacaaaga

SEQ ID NO: 754921 - RNA, 19 nt, Homo sapiens
ggacuucaaggcccacuuu

SEQ ID NO: 754922 - RNA, 19 nt, Homo sapiens
cagagaccuuccaaacuaa

SEQ ID NO: 754923 - RNA, 19 nt, Homo sapiens
gaguguaguuuccuuguag

SEQ ID NO: 754924 - RNA, 19 nt, Homo sapiens
agagaaggcuuugaagaga

SEQ ID NO: 754925 - RNA, 19 nt, Homo sapiens
gaacuacggacugcacuga

SEQ ID NO: 754926 - RNA, 19 nt, Homo sapiens
aaagauagaaggaaacuca

SEQ ID NO: 754927 - RNA, 19 nt, Homo sapiens
gaauugaccagguaagcuu

SEQ ID NO: 754928 - RNA, 19 nt, Homo sapiens
gcaaugggaagcuggaguu

SEQ ID NO: 754929 - RNA, 19 nt, Homo sapiens
gacaaucggcuaugccauu

SEQ ID NO: 754930 - RNA, 19 nt, Homo sapiens
gauagaaggaaacucaaga

SEQ ID NO: 754931 - RNA, 19 nt, Homo sapiens
caccaugucuaccuaugaa

SEQ ID NO: 754932 - RNA, 19 nt, Homo sapiens
uaccagaagugcugcagaa

SEQ ID NO: 754933 - RNA, 19 nt, Homo sapiens
cugcugggcugcuucauug

SEQ ID NO: 754934 - RNA, 19 nt, Homo sapiens
acaaggaguucauucaucu

SEQ ID NO: 754935 - RNA, 19 nt, Homo sapiens
ggacaucaaauucaagaag

SEQ ID NO: 754936 - RNA, 19 nt, Homo sapiens
gggagacugcuggcuauua

SEQ ID NO: 754937 - RNA, 19 nt, Homo sapiens
gaagcuggaguuugaugaa

SEQ ID NO: 754938 - RNA, 19 nt, Homo sapiens
cagcagaggaacuugagua

SEQ ID NO: 754939 - RNA, 19 nt, Homo sapiens
ccucugagcuguuccuucu

SEQ ID NO: 754940 - RNA, 19 nt, Homo sapiens
gcaauuccucccuguucua

SEQ ID NO: 754941 - RNA, 19 nt, Homo sapiens
gcuggaguuugaugaauuc

SEQ ID NO: 754942 - RNA, 19 nt, Homo sapiens
gcaagacguucaucaaccu

SEQ ID NO: 754943 - RNA, 19 nt, Homo sapiens
acaaucggcuaugccauuu

SEQ ID NO: 754944 - RNA, 19 nt, Homo sapiens
gaucugggaagaaugaaau

SEQ ID NO: 754945 - RNA, 19 nt, Homo sapiens
gcaccaugucuaccuauga

SEQ ID NO: 754946 - RNA, 19 nt, Homo sapiens
augggaagcuggaguuuga

SEQ ID NO: 754947 - RNA, 19 nt, Homo sapiens
uaagccugaucuccuguaa

SEQ ID NO: 754948 - RNA, 19 nt, Homo sapiens
aagcugaagcaguggauua

SEQ ID NO: 754949 - RNA, 19 nt, Homo sapiens
ucaagaagcuaagccugau

SEQ ID NO: 754950 - RNA, 19 nt, Homo sapiens
ggaggugacagcagaggaa

SEQ ID NO: 754951 - RNA, 19 nt, Homo sapiens
aaucggcuaugccauuuau

SEQ ID NO: 754952 - RNA, 19 nt, Homo sapiens
gcccugaugcagaaagaua

SEQ ID NO: 754953 - RNA, 19 nt, Homo sapiens
ccgaugcccuggaggaaga

SEQ ID NO: 754954 - RNA, 19 nt, Homo sapiens
uaaaugcugugcugcaaaa

SEQ ID NO: 754955 - RNA, 19 nt, Homo sapiens
cagcucgcuucuucacuuu

SEQ ID NO: 754956 - RNA, 19 nt, Homo sapiens
ggauggcauuuaaggacuu

SEQ ID NO: 754957 - RNA, 19 nt, Homo sapiens
ggaguggcguucuguuggu

SEQ ID NO: 754958 - RNA, 19 nt, Homo sapiens
ggacgccguuuggucuuau

SEQ ID NO: 754959 - RNA, 19 nt, Homo sapiens
ggaagcuggaguuugauga

SEQ ID NO: 754960 - RNA, 19 nt, Homo sapiens
ucugagcuguuccuucuug

SEQ ID NO: 754961 - RNA, 19 nt, Homo sapiens
gugccaaugugcugacaau

SEQ ID NO: 754962 - RNA, 19 nt, Homo sapiens
aagacgcgauccacaaaug

SEQ ID NO: 754963 - RNA, 19 nt, Homo sapiens
acagcucgcuucuucacuu

SEQ ID NO: 754964 - RNA, 19 nt, Homo sapiens
ggauauuccauuuccaguu

SEQ ID NO: 754965 - RNA, 19 nt, Homo sapiens
gaagacgcgauccacaaau

SEQ ID NO: 754966 - RNA, 19 nt, Homo sapiens
gagcagccaugccuuaccu

SEQ ID NO: 754967 - RNA, 19 nt, Homo sapiens
caaggcccacuuugauaaa

SEQ ID NO: 754968 - RNA, 19 nt, Homo sapiens
aauucuggauggcauuuaa

SEQ ID NO: 754969 - RNA, 19 nt, Homo sapiens
ggaauucuggauggcauuu

SEQ ID NO: 754970 - RNA, 19 nt, Homo sapiens
ucgccucccuuacgcuuaa

SEQ ID NO: 754971 - RNA, 19 nt, Homo sapiens
ggaagaaugaaaugaacuc

SEQ ID NO: 754972 - RNA, 19 nt, Homo sapiens
gcaggaggaguguaguuuc

SEQ ID NO: 754973 - RNA, 19 nt, Homo sapiens
gaauucuggauggcauuua

SEQ ID NO: 754974 - RNA, 19 nt, Homo sapiens
guuccaggcucucaguaca

SEQ ID NO: 754975 - RNA, 19 nt, Homo sapiens
gaggaacuugaguauguuu

SEQ ID NO: 754976 - RNA, 19 nt, Homo sapiens
gggaguacauccugauucc

SEQ ID NO: 754977 - RNA, 19 nt, Homo sapiens
cugggcugcuucauugaua

SEQ ID NO: 754978 - RNA, 19 nt, Homo sapiens
acuacggacugcacugaaa

SEQ ID NO: 754979 - RNA, 19 nt, Homo sapiens
ggaacuugaguauguuuua

SEQ ID NO: 754980 - RNA, 19 nt, Homo sapiens
guuugaggaugcagacuuc

SEQ ID NO: 754981 - RNA, 19 nt, Homo sapiens
gacgaacaccugaacaaag

SEQ ID NO: 754982 - RNA, 19 nt, Homo sapiens
gaagaaugaaaugaacuca

SEQ ID NO: 754983 - RNA, 19 nt, Homo sapiens
ugagugcccugacaaagac

SEQ ID NO: 754984 - RNA, 19 nt, Homo sapiens
cagagaggcacccuguuug

SEQ ID NO: 754985 - RNA, 19 nt, Homo sapiens
cggacgccguuuggucuua

SEQ ID NO: 754986 - RNA, 19 nt, Homo sapiens
uagagaaggcuuugaagag

SEQ ID NO: 754987 - RNA, 19 nt, Homo sapiens
cuagagaaggcuuugaaga

SEQ ID NO: 754988 - RNA, 19 nt, Homo sapiens
gaguucauucaucucaaua

SEQ ID NO: 754989 - RNA, 19 nt, Homo sapiens
gcagaggaacuugaguaug

SEQ ID NO: 754990 - RNA, 19 nt, Homo sapiens
cagcaauuccucccuguuc

SEQ ID NO: 754991 - RNA, 19 nt, Homo sapiens
aacaaggaguucauucauc

SEQ ID NO: 754992 - RNA, 19 nt, Homo sapiens
ugacagcagaggaacuuga

SEQ ID NO: 754993 - RNA, 19 nt, Homo sapiens
agacgaacaccugaacaaa

SEQ ID NO: 754994 - RNA, 19 nt, Homo sapiens
agaaggaaacucaagagau

SEQ ID NO: 754995 - RNA, 19 nt, Homo sapiens
ggcaggaggaguguaguuu

SEQ ID NO: 754996 - RNA, 19 nt, Homo sapiens
ucacacugcucuggaugau

SEQ ID NO: 754997 - RNA, 19 nt, Homo sapiens
gcucgcuucuucacuuucu

SEQ ID NO: 754998 - RNA, 19 nt, Homo sapiens
agagaggcacccuguuuga

SEQ ID NO: 754999 - RNA, 19 nt, Homo sapiens
gaaucuaucugcuguuaaa

SEQ ID NO: 755000 - RNA, 19 nt, Homo sapiens
ggagggaucagccaaauuu

SEQ ID NO: 755001 - RNA, 19 nt, Homo sapiens
gucaugaccuuccuaguuu

SEQ ID NO: 755002 - RNA, 19 nt, Homo sapiens
gaagagaaggccauugaga

SEQ ID NO: 755003 - RNA, 19 nt, Homo sapiens
aagaaucuaucugcuguua

SEQ ID NO: 755004 - RNA, 19 nt, Homo sapiens
gaucugcccucugccuuug

SEQ ID NO: 755005 - RNA, 19 nt, Homo sapiens
gcaaggccuucgacaugau

SEQ ID NO: 755006 - RNA, 19 nt, Homo sapiens
ggacgauggcgguggguuu

SEQ ID NO: 755007 - RNA, 19 nt, Homo sapiens
ugaauuugcugucuugaac

SEQ ID NO: 755008 - RNA, 19 nt, Homo sapiens
gacaugaucgaggccauua

SEQ ID NO: 755009 - RNA, 19 nt, Homo sapiens
ugacacgaguugcugugaa

SEQ ID NO: 755010 - RNA, 19 nt, Homo sapiens
gcacucgggcucaccauca

SEQ ID NO: 755011 - RNA, 19 nt, Homo sapiens
ccuguuaccuccgcauuug

SEQ ID NO: 755012 - RNA, 19 nt, Homo sapiens
cccagcaaaugcaauaaug

SEQ ID NO: 755013 - RNA, 19 nt, Homo sapiens
ccauugagaagguggauga

SEQ ID NO: 755014 - RNA, 19 nt, Homo sapiens
aagagaaggccauugagaa

SEQ ID NO: 755015 - RNA, 19 nt, Homo sapiens
gaccacauccaccucauca

SEQ ID NO: 755016 - RNA, 19 nt, Homo sapiens
uuugcugucuugaacauaa

SEQ ID NO: 755017 - RNA, 19 nt, Homo sapiens
ggccuuggguucuguuugg

SEQ ID NO: 755018 - RNA, 19 nt, Homo sapiens
ggaucugcccucugccuuu

SEQ ID NO: 755019 - RNA, 19 nt, Homo sapiens
uaucugaauuugcugucuu

SEQ ID NO: 755020 - RNA, 19 nt, Homo sapiens
cgcaaggccuucgacauga

SEQ ID NO: 755021 - RNA, 19 nt, Homo sapiens
ucgcaaggccuucgacaug

SEQ ID NO: 755022 - RNA, 19 nt, Homo sapiens
ccaccacuuuccaccauca

SEQ ID NO: 755023 - RNA, 19 nt, Homo sapiens
agaaggccauugagaaggu

SEQ ID NO: 755024 - RNA, 19 nt, Homo sapiens
caacugccgaggugauguu

SEQ ID NO: 755025 - RNA, 19 nt, Homo sapiens
gaacggcugggugacuuug

SEQ ID NO: 755026 - RNA, 19 nt, Homo sapiens
gcuggaggacuucaucuuc

SEQ ID NO: 755027 - RNA, 19 nt, Homo sapiens
gacacgaguugcugugaac

SEQ ID NO: 755028 - RNA, 19 nt, Homo sapiens
uugaagagaaggccauuga

SEQ ID NO: 755029 - RNA, 19 nt, Homo sapiens
ccugaacacccacaaagug

SEQ ID NO: 755030 - RNA, 19 nt, Homo sapiens
gcagcgugaucgaccacau

SEQ ID NO: 755031 - RNA, 19 nt, Homo sapiens
uagcucagcagcccaagga

SEQ ID NO: 755032 - RNA, 19 nt, Homo sapiens
ugccuucccugacgaguuc

SEQ ID NO: 755033 - RNA, 19 nt, Homo sapiens
gagaguuacauggguauca

SEQ ID NO: 755034 - RNA, 19 nt, Homo sapiens
augaccugcuggagaguua

SEQ ID NO: 755035 - RNA, 19 nt, Homo sapiens
caacgucaaggagcuguau

SEQ ID NO: 755036 - RNA, 19 nt, Homo sapiens
accaucagcugccaaacug

SEQ ID NO: 755037 - RNA, 19 nt, Homo sapiens
ucaucaagcgcaucaagga

SEQ ID NO: 755038 - RNA, 19 nt, Homo sapiens
gggagggaucagccaaauu

SEQ ID NO: 755039 - RNA, 19 nt, Homo sapiens
ugguggagcugggaaagga

SEQ ID NO: 755040 - RNA, 19 nt, Homo sapiens
agagaaggccauugagaag

SEQ ID NO: 755041 - RNA, 19 nt, Homo sapiens
gaauuugcugucuugaaca

SEQ ID NO: 755042 - RNA, 19 nt, Homo sapiens
caaacuggucccucugucu

SEQ ID NO: 755043 - RNA, 19 nt, Homo sapiens
gagggaucagccaaauuug

SEQ ID NO: 755044 - RNA, 19 nt, Homo sapiens
caaaguggacauggacaag

SEQ ID NO: 755045 - RNA, 19 nt, Homo sapiens
ccacuucucgcugcucaug

SEQ ID NO: 755046 - RNA, 19 nt, Homo sapiens
cagcgugggcgacaugauc

SEQ ID NO: 755047 - RNA, 19 nt, Homo sapiens
caaggagggcagcgugauc

SEQ ID NO: 755048 - RNA, 19 nt, Homo sapiens
gagcauggcuuacauacua

SEQ ID NO: 755049 - RNA, 19 nt, Homo sapiens
gaacugacuuucauauuug

SEQ ID NO: 755050 - RNA, 19 nt, Homo sapiens
caacaugcuugguuaauuu

SEQ ID NO: 755051 - RNA, 19 nt, Homo sapiens
gaaacuccaucucuacuaa

SEQ ID NO: 755052 - RNA, 19 nt, Homo sapiens
ccaaguagcuagaccuaua

SEQ ID NO: 755053 - RNA, 19 nt, Homo sapiens
guaaauggcuuccaaacug

SEQ ID NO: 755054 - RNA, 19 nt, Homo sapiens
gauaagaccgugaugauaa

SEQ ID NO: 755055 - RNA, 19 nt, Homo sapiens
gauuaaagccagcuaguua

SEQ ID NO: 755056 - RNA, 19 nt, Homo sapiens
cauggaagcuuuauucuug

SEQ ID NO: 755057 - RNA, 19 nt, Homo sapiens
gaccaaaguuuaccuaaug

SEQ ID NO: 755058 - RNA, 19 nt, Homo sapiens
ccacaaugcuucacaauuc

SEQ ID NO: 755059 - RNA, 19 nt, Homo sapiens
caaaucagaccaaaguuua

SEQ ID NO: 755060 - RNA, 19 nt, Homo sapiens
gauguaggcuagaauugua

SEQ ID NO: 755061 - RNA, 19 nt, Homo sapiens
gcaaagaacacuaguuuca

SEQ ID NO: 755062 - RNA, 19 nt, Homo sapiens
gagacaggguuucauauug

SEQ ID NO: 755063 - RNA, 19 nt, Homo sapiens
ggaccuaaauucuaaauac

SEQ ID NO: 755064 - RNA, 19 nt, Homo sapiens
gcaaguagauaauguaagg

SEQ ID NO: 755065 - RNA, 19 nt, Homo sapiens
gaacuaucauuaccauugu

SEQ ID NO: 755066 - RNA, 19 nt, Homo sapiens
gagcaucaguuuucauuua

SEQ ID NO: 755067 - RNA, 19 nt, Homo sapiens
agaagguuauccugaauua

SEQ ID NO: 755068 - RNA, 19 nt, Homo sapiens
ugaaaccaaucccagaaua

SEQ ID NO: 755069 - RNA, 19 nt, Homo sapiens
gaaggagguuucuguuuua

SEQ ID NO: 755070 - RNA, 19 nt, Homo sapiens
gggcaaagcuuucccuucu

SEQ ID NO: 755071 - RNA, 19 nt, Homo sapiens
uaacauuaguuccguaguu

SEQ ID NO: 755072 - RNA, 19 nt, Homo sapiens
cuaagacaaugaagacuuu

SEQ ID NO: 755073 - RNA, 19 nt, Homo sapiens
caaacacucuccuaucaau

SEQ ID NO: 755074 - RNA, 19 nt, Homo sapiens
ggaaaugacuacaaacacu

SEQ ID NO: 755075 - RNA, 19 nt, Homo sapiens
ggaacuaucauuaccauug

SEQ ID NO: 755076 - RNA, 19 nt, Homo sapiens
cgacacccguuuguaaaua

SEQ ID NO: 755077 - RNA, 19 nt, Homo sapiens
gaacacuaguuucauuuac

SEQ ID NO: 755078 - RNA, 19 nt, Homo sapiens
guagagacaggguuucaua

SEQ ID NO: 755079 - RNA, 19 nt, Homo sapiens
cuacuagccucuuaaacaa

SEQ ID NO: 755080 - RNA, 19 nt, Homo sapiens
cgaaugucuuuguucuuua

SEQ ID NO: 755081 - RNA, 19 nt, Homo sapiens
ggugggauggcuuuaauua

SEQ ID NO: 755082 - RNA, 19 nt, Homo sapiens
cuauggagguggugaaauu

SEQ ID NO: 755083 - RNA, 19 nt, Homo sapiens
uaagggauguggcagcaaa

SEQ ID NO: 755084 - RNA, 19 nt, Homo sapiens
gcagaagguuauccugaau

SEQ ID NO: 755085 - RNA, 19 nt, Homo sapiens
ggaguucccucaguuugaa

SEQ ID NO: 755086 - RNA, 19 nt, Homo sapiens
uacaaacacucuccuauca

SEQ ID NO: 755087 - RNA, 19 nt, Homo sapiens
ggauaagaccgugaugaua

SEQ ID NO: 755088 - RNA, 19 nt, Homo sapiens
uccagggacucauuuauaa

SEQ ID NO: 755089 - RNA, 19 nt, Homo sapiens
ggaucugacuacauaggua

SEQ ID NO: 755090 - RNA, 19 nt, Homo sapiens
gacacccguuuguaaauaa

SEQ ID NO: 755091 - RNA, 19 nt, Homo sapiens
ucaagaccauccuggcuaa

SEQ ID NO: 755092 - RNA, 19 nt, Homo sapiens
agaccaaacugauucaugu

SEQ ID NO: 755093 - RNA, 19 nt, Homo sapiens
ugggauggcuuuaauuaug

SEQ ID NO: 755094 - RNA, 19 nt, Homo sapiens
agaccacucuguauuaaug

SEQ ID NO: 755095 - RNA, 19 nt, Homo sapiens
gauagaauccgaggcauug

SEQ ID NO: 755096 - RNA, 19 nt, Homo sapiens
gaaccaccugcuccaaaua

SEQ ID NO: 755097 - RNA, 19 nt, Homo sapiens
gaaaccaaucccagaauau

SEQ ID NO: 755098 - RNA, 19 nt, Homo sapiens
aaacaaggaagcaugaauu

SEQ ID NO: 755099 - RNA, 19 nt, Homo sapiens
ccaaguagcagggacuaua

SEQ ID NO: 755100 - RNA, 19 nt, Homo sapiens
gcagugagccgagaucaug

SEQ ID NO: 755101 - RNA, 19 nt, Homo sapiens
caaacugauucauguacaa

SEQ ID NO: 755102 - RNA, 19 nt, Homo sapiens
guacucauuuguaagacuu

SEQ ID NO: 755103 - RNA, 19 nt, Homo sapiens
ucagaacacucaugucuac

SEQ ID NO: 755104 - RNA, 19 nt, Homo sapiens
ugacauauuugaggauaga

SEQ ID NO: 755105 - RNA, 19 nt, Homo sapiens
gaaaacacccaaacacaaa

SEQ ID NO: 755106 - RNA, 19 nt, Homo sapiens
acgaaugucuuuguucuuu

SEQ ID NO: 755107 - RNA, 19 nt, Homo sapiens
gacagggucucacucuuuc

SEQ ID NO: 755108 - RNA, 19 nt, Homo sapiens
acacauacacauauccaua

SEQ ID NO: 755109 - RNA, 19 nt, Homo sapiens
uguagucuguguucuaauu

SEQ ID NO: 755110 - RNA, 19 nt, Homo sapiens
gaaugaaggagguuucugu

SEQ ID NO: 755111 - RNA, 19 nt, Homo sapiens
gaaccgagcaggccuggau

SEQ ID NO: 755112 - RNA, 19 nt, Homo sapiens
gggaaaggacaaauacuug

SEQ ID NO: 755113 - RNA, 19 nt, Homo sapiens
guccagcucuuauauguag

SEQ ID NO: 755114 - RNA, 19 nt, Homo sapiens
gccaugauucuaaauagua

SEQ ID NO: 755115 - RNA, 19 nt, Homo sapiens
gcucugcauucucugcuuu

SEQ ID NO: 755116 - RNA, 19 nt, Homo sapiens
acaagacaguccaccguuu

SEQ ID NO: 755117 - RNA, 19 nt, Homo sapiens
acagagagacugcuccuuu

SEQ ID NO: 755118 - RNA, 19 nt, Homo sapiens
ugaaggagguuucuguuuu

SEQ ID NO: 755119 - RNA, 19 nt, Homo sapiens
ggaggacagugaagacagu

SEQ ID NO: 755120 - RNA, 19 nt, Homo sapiens
gagccuguucuucuacuua

SEQ ID NO: 755121 - RNA, 19 nt, Homo sapiens
acccucagguugauaauuu

SEQ ID NO: 755122 - RNA, 19 nt, Homo sapiens
ccaaagugcugggauuaca

SEQ ID NO: 755123 - RNA, 19 nt, Homo sapiens
auacagccaugauucuaaa

SEQ ID NO: 755124 - RNA, 19 nt, Homo sapiens
cauuugaggucaggaguuu

SEQ ID NO: 755125 - RNA, 19 nt, Homo sapiens
uguaugaccuuuagcaagu

SEQ ID NO: 755126 - RNA, 19 nt, Homo sapiens
gaucugacuacauagguaa

SEQ ID NO: 755127 - RNA, 19 nt, Homo sapiens
gagccgagaucaugucacu

SEQ ID NO: 755128 - RNA, 19 nt, Homo sapiens
gaagcuuuauucuugcaau

SEQ ID NO: 755129 - RNA, 19 nt, Homo sapiens
ugacugcucugcauucucu

SEQ ID NO: 755130 - RNA, 19 nt, Homo sapiens
gcugagagaggaagaguau

SEQ ID NO: 755131 - RNA, 19 nt, Homo sapiens
caucaccagccaccuaaua

SEQ ID NO: 755132 - RNA, 19 nt, Homo sapiens
cuaagaaacuagaaugaac

SEQ ID NO: 755133 - RNA, 19 nt, Homo sapiens
gcuacugcuucccuucuuu

SEQ ID NO: 755134 - RNA, 19 nt, Homo sapiens
aaagccagcuaguuaaaca

SEQ ID NO: 755135 - RNA, 19 nt, Homo sapiens
gaaugaugcagauugaguu

SEQ ID NO: 755136 - RNA, 19 nt, Homo sapiens
ccaaacugcaauugacaua

SEQ ID NO: 755137 - RNA, 19 nt, Homo sapiens
cagagagacugcuccuuuc

SEQ ID NO: 755138 - RNA, 19 nt, Homo sapiens
uguaagacuuucugacaug

SEQ ID NO: 755139 - RNA, 19 nt, Homo sapiens
gcaggagaaucacuugaac

SEQ ID NO: 755140 - RNA, 19 nt, Homo sapiens
ucaggugguucccuuguga

SEQ ID NO: 755141 - RNA, 19 nt, Homo sapiens
acagcuggcccaagaauaa

SEQ ID NO: 755142 - RNA, 19 nt, Homo sapiens
ccagaagaauugcggaaag

SEQ ID NO: 755143 - RNA, 19 nt, Homo sapiens
ucagagguauccagcaugu

SEQ ID NO: 755144 - RNA, 19 nt, Homo sapiens
agacaaaucagaccaaagu

SEQ ID NO: 755145 - RNA, 19 nt, Homo sapiens
cguaaucaauggcugguau

SEQ ID NO: 755146 - RNA, 19 nt, Homo sapiens
ggagguuucuguuuuaaga

SEQ ID NO: 755147 - RNA, 19 nt, Homo sapiens
aagacuuucugacauguaa

SEQ ID NO: 755148 - RNA, 19 nt, Homo sapiens
gagcauggcuuacauacua

SEQ ID NO: 755149 - RNA, 19 nt, Homo sapiens
ggaaagccauggcagauuu

SEQ ID NO: 755150 - RNA, 19 nt, Homo sapiens
guaaauggcuuccaaacug

SEQ ID NO: 755151 - RNA, 19 nt, Homo sapiens
gauaagaccgugaugauaa

SEQ ID NO: 755152 - RNA, 19 nt, Homo sapiens
gaccaaaguuuaccuaaug

SEQ ID NO: 755153 - RNA, 19 nt, Homo sapiens
ccacaaugcuucacaauuc

SEQ ID NO: 755154 - RNA, 19 nt, Homo sapiens
caaaucagaccaaaguuua

SEQ ID NO: 755155 - RNA, 19 nt, Homo sapiens
gaucuaagccucaucugua

SEQ ID NO: 755156 - RNA, 19 nt, Homo sapiens
gcaaguagauaauguaagg

SEQ ID NO: 755157 - RNA, 19 nt, Homo sapiens
gaacuaucauuaccauugu

SEQ ID NO: 755158 - RNA, 19 nt, Homo sapiens
gagcaucaguuuucauuua

SEQ ID NO: 755159 - RNA, 19 nt, Homo sapiens
agaagguuauccugaauua

SEQ ID NO: 755160 - RNA, 19 nt, Homo sapiens
ugaaaccaaucccagaaua

SEQ ID NO: 755161 - RNA, 19 nt, Homo sapiens
gggcaaagcuuucccuucu

SEQ ID NO: 755162 - RNA, 19 nt, Homo sapiens
caaacacucuccuaucaau

SEQ ID NO: 755163 - RNA, 19 nt, Homo sapiens
ggaaaugacuacaaacacu

SEQ ID NO: 755164 - RNA, 19 nt, Homo sapiens
ggaacuaucauuaccauug

SEQ ID NO: 755165 - RNA, 19 nt, Homo sapiens
cuauggagguggugaaauu

SEQ ID NO: 755166 - RNA, 19 nt, Homo sapiens
uaagggauguggcagcaaa

SEQ ID NO: 755167 - RNA, 19 nt, Homo sapiens
gcagaagguuauccugaau

SEQ ID NO: 755168 - RNA, 19 nt, Homo sapiens
ggaguucccucaguuugaa

SEQ ID NO: 755169 - RNA, 19 nt, Homo sapiens
uacaaacacucuccuauca

SEQ ID NO: 755170 - RNA, 19 nt, Homo sapiens
ggauaagaccgugaugaua

SEQ ID NO: 755171 - RNA, 19 nt, Homo sapiens
agaccaaacugauucaugu

SEQ ID NO: 755172 - RNA, 19 nt, Homo sapiens
gauagaauccgaggcauug

SEQ ID NO: 755173 - RNA, 19 nt, Homo sapiens
gaaccaccugcuccaaaua

SEQ ID NO: 755174 - RNA, 19 nt, Homo sapiens
gaaaccaaucccagaauau

SEQ ID NO: 755175 - RNA, 19 nt, Homo sapiens
aaacaaggaagcaugaauu

SEQ ID NO: 755176 - RNA, 19 nt, Homo sapiens
caaacugauucauguacaa

SEQ ID NO: 755177 - RNA, 19 nt, Homo sapiens
ucagaacacucaugucuac

SEQ ID NO: 755178 - RNA, 19 nt, Homo sapiens
ugacauauuugaggauaga

SEQ ID NO: 755179 - RNA, 19 nt, Homo sapiens
gaaccgagcaggccuggau

SEQ ID NO: 755180 - RNA, 19 nt, Homo sapiens
gcucugcauucucugcuuu

SEQ ID NO: 755181 - RNA, 19 nt, Homo sapiens
acagagagacugcuccuuu

SEQ ID NO: 755182 - RNA, 19 nt, Homo sapiens
ggaggacagugaagacagu

SEQ ID NO: 755183 - RNA, 19 nt, Homo sapiens
ugacugcucugcauucucu

SEQ ID NO: 755184 - RNA, 19 nt, Homo sapiens
gcugagagaggaagaguau

SEQ ID NO: 755185 - RNA, 19 nt, Homo sapiens
caucaccagccaccuaaua

SEQ ID NO: 755186 - RNA, 19 nt, Homo sapiens
gaaugaugcagauugaguu

SEQ ID NO: 755187 - RNA, 19 nt, Homo sapiens
ccaaacugcaauugacaua

SEQ ID NO: 755188 - RNA, 19 nt, Homo sapiens
cagagagacugcuccuuuc

SEQ ID NO: 755189 - RNA, 19 nt, Homo sapiens
ucaggugguucccuuguga

SEQ ID NO: 755190 - RNA, 19 nt, Homo sapiens
acagcuggcccaagaauaa

SEQ ID NO: 755191 - RNA, 19 nt, Homo sapiens
ccagaagaauugcggaaag

SEQ ID NO: 755192 - RNA, 19 nt, Homo sapiens
ucagagguauccagcaugu

SEQ ID NO: 755193 - RNA, 19 nt, Homo sapiens
agacaaaucagaccaaagu

SEQ ID NO: 755194 - RNA, 19 nt, Homo sapiens
cguaaucaauggcugguau

SEQ ID NO: 755195 - RNA, 19 nt, Homo sapiens
caaauggaaaugacuacaa

SEQ ID NO: 755196 - RNA, 19 nt, Homo sapiens
gaugagcauggcuuacaua

SEQ ID NO: 755197 - RNA, 19 nt, Homo sapiens
acaaaucagaccaaaguuu

SEQ ID NO: 755198 - RNA, 19 nt, Homo sapiens
ccugugcucuucccaaaug

SEQ ID NO: 755199 - RNA, 19 nt, Homo sapiens
ccacaucaccagccaccua

SEQ ID NO: 755200 - RNA, 19 nt, Homo sapiens
ggccaugacucagacaaau

SEQ ID NO: 755201 - RNA, 19 nt, Homo sapiens
ccacacacccuggcuuuga

SEQ ID NO: 755202 - RNA, 19 nt, Homo sapiens
gaugcagauugaguucaua

SEQ ID NO: 755203 - RNA, 19 nt, Homo sapiens
ccucaucuguauccucuug

SEQ ID NO: 755204 - RNA, 19 nt, Homo sapiens
gaugcugccucccaaucuu

SEQ ID NO: 755205 - RNA, 19 nt, Homo sapiens
aaaccaaucccagaauauu

SEQ ID NO: 755206 - RNA, 19 nt, Homo sapiens
ccaaacugauucauguaca

SEQ ID NO: 755207 - RNA, 19 nt, Homo sapiens
gcuuugaaguggagucugu

SEQ ID NO: 755208 - RNA, 19 nt, Homo sapiens
ggaugagcauggcuuacau

SEQ ID NO: 755209 - RNA, 19 nt, Homo sapiens
gaugauaaucguagcaauc

SEQ ID NO: 755210 - RNA, 19 nt, Homo sapiens
gggauaagaccgugaugau

SEQ ID NO: 755211 - RNA, 19 nt, Homo sapiens
ucagacaaaucagaccaaa

SEQ ID NO: 755212 - RNA, 19 nt, Homo sapiens
gcauuccuguggagguuga

SEQ ID NO: 755213 - RNA, 19 nt, Homo sapiens
agaccaaaguuuaccuaau

SEQ ID NO: 755214 - RNA, 19 nt, Homo sapiens
ggacagugaagacaguuuc

SEQ ID NO: 755215 - RNA, 19 nt, Homo sapiens
caauuccuccggagacuuu

SEQ ID NO: 755216 - RNA, 19 nt, Homo sapiens
ccaccugcuccaaauauaa

SEQ ID NO: 755217 - RNA, 19 nt, Homo sapiens
uagcacuccuggcugguuu

SEQ ID NO: 755218 - RNA, 19 nt, Homo sapiens
ggauggagcgcuaccuuag

SEQ ID NO: 755219 - RNA, 19 nt, Homo sapiens
ggugaaauucgugaacuuu

SEQ ID NO: 755220 - RNA, 19 nt, Homo sapiens
cagaagaauugcggaaagu

SEQ ID NO: 755221 - RNA, 19 nt, Homo sapiens
agaaccaccugcuccaaau

SEQ ID NO: 755222 - RNA, 19 nt, Homo sapiens
gaccaaacugauucaugua

SEQ ID NO: 755223 - RNA, 19 nt, Homo sapiens
gagcgcuaccuuagggaua

SEQ ID NO: 755224 - RNA, 19 nt, Homo sapiens
gaagaauugcggaaagucu

SEQ ID NO: 755225 - RNA, 19 nt, Homo sapiens
cccugaaacuugcaaauca

SEQ ID NO: 755226 - RNA, 19 nt, Homo sapiens
gaaccauacccaagucagu

SEQ ID NO: 755227 - RNA, 19 nt, Homo sapiens
ccgaggcauugauaucauu

SEQ ID NO: 755228 - RNA, 19 nt, Homo sapiens
cagcaaauggaaaugacua

SEQ ID NO: 755229 - RNA, 19 nt, Homo sapiens
gucuacagcuggcccaaga

SEQ ID NO: 755230 - RNA, 19 nt, Homo sapiens
ugcagaagguuauccugaa

SEQ ID NO: 755231 - RNA, 19 nt, Homo sapiens
gcugaaaccaaucccagaa

SEQ ID NO: 755232 - RNA, 19 nt, Homo sapiens
ggaagaggaaucagaacca

SEQ ID NO: 755233 - RNA, 19 nt, Homo sapiens
uuagccagaugcuugugua

SEQ ID NO: 755234 - RNA, 19 nt, Homo sapiens
ggauguggcagcaaaugga

SEQ ID NO: 755235 - RNA, 19 nt, Homo sapiens
ugagagaggaagaguaugu

SEQ ID NO: 755236 - RNA, 19 nt, Homo sapiens
ccaccuggcuucagaacac

SEQ ID NO: 755237 - RNA, 19 nt, Homo sapiens
auaagaccgugaugauaau

SEQ ID NO: 755238 - RNA, 19 nt, Homo sapiens
cuccauggaacuaucauua

SEQ ID NO: 755239 - RNA, 19 nt, Homo sapiens
gugcccaccuggcuucaga

SEQ ID NO: 755240 - RNA, 19 nt, Homo sapiens
agaauccgaggcauugaua

SEQ ID NO: 755241 - RNA, 19 nt, Homo sapiens
cacacacccuggcuuugaa

SEQ ID NO: 755242 - RNA, 19 nt, Homo sapiens
cagaaccaccugcuccaaa

SEQ ID NO: 755243 - RNA, 19 nt, Homo sapiens
aucaauggcugguaucuca

SEQ ID NO: 755244 - RNA, 19 nt, Homo sapiens
cuacaaacacucuccuauc

SEQ ID NO: 755245 - RNA, 19 nt, Homo sapiens
gcagauugaguucauaaaa

SEQ ID NO: 755246 - RNA, 19 nt, Homo sapiens
cgaggaugagcauggcuua

SEQ ID NO: 755247 - RNA, 19 nt, Homo sapiens
gcaaucagccccaaauaca

SEQ ID NO: 755248 - RNA, 19 nt, Homo sapiens
gagcauggcuuacauacua

SEQ ID NO: 755249 - RNA, 19 nt, Homo sapiens
guaaauggcuuccaaacug

SEQ ID NO: 755250 - RNA, 19 nt, Homo sapiens
gauaagaccgugaugauaa

SEQ ID NO: 755251 - RNA, 19 nt, Homo sapiens
gaccaaaguuuaccuaaug

SEQ ID NO: 755252 - RNA, 19 nt, Homo sapiens
ccacaaugcuucacaauuc

SEQ ID NO: 755253 - RNA, 19 nt, Homo sapiens
caaaucagaccaaaguuua

SEQ ID NO: 755254 - RNA, 19 nt, Homo sapiens
gcaaguagauaauguaagg

SEQ ID NO: 755255 - RNA, 19 nt, Homo sapiens
gaacuaucauuaccauugu

SEQ ID NO: 755256 - RNA, 19 nt, Homo sapiens
gagcaucaguuuucauuua

SEQ ID NO: 755257 - RNA, 19 nt, Homo sapiens
agaagguuauccugaauua

SEQ ID NO: 755258 - RNA, 19 nt, Homo sapiens
ugaaaccaaucccagaaua

SEQ ID NO: 755259 - RNA, 19 nt, Homo sapiens
gaaggagguuucuguuuua

SEQ ID NO: 755260 - RNA, 19 nt, Homo sapiens
gggcaaagcuuucccuucu

SEQ ID NO: 755261 - RNA, 19 nt, Homo sapiens
caaacacucuccuaucaau

SEQ ID NO: 755262 - RNA, 19 nt, Homo sapiens
ggaaaugacuacaaacacu

SEQ ID NO: 755263 - RNA, 19 nt, Homo sapiens
ggaacuaucauuaccauug

SEQ ID NO: 755264 - RNA, 19 nt, Homo sapiens
cuauggagguggugaaauu

SEQ ID NO: 755265 - RNA, 19 nt, Homo sapiens
uaagggauguggcagcaaa

SEQ ID NO: 755266 - RNA, 19 nt, Homo sapiens
gcagaagguuauccugaau

SEQ ID NO: 755267 - RNA, 19 nt, Homo sapiens
ggaguucccucaguuugaa

SEQ ID NO: 755268 - RNA, 19 nt, Homo sapiens
uacaaacacucuccuauca

SEQ ID NO: 755269 - RNA, 19 nt, Homo sapiens
ggauaagaccgugaugaua

SEQ ID NO: 755270 - RNA, 19 nt, Homo sapiens
agaccaaacugauucaugu

SEQ ID NO: 755271 - RNA, 19 nt, Homo sapiens
gauagaauccgaggcauug

SEQ ID NO: 755272 - RNA, 19 nt, Homo sapiens
gaaccaccugcuccaaaua

SEQ ID NO: 755273 - RNA, 19 nt, Homo sapiens
gaaaccaaucccagaauau

SEQ ID NO: 755274 - RNA, 19 nt, Homo sapiens
aaacaaggaagcaugaauu

SEQ ID NO: 755275 - RNA, 19 nt, Homo sapiens
caaacugauucauguacaa

SEQ ID NO: 755276 - RNA, 19 nt, Homo sapiens
ucagaacacucaugucuac

SEQ ID NO: 755277 - RNA, 19 nt, Homo sapiens
ugacauauuugaggauaga

SEQ ID NO: 755278 - RNA, 19 nt, Homo sapiens
gaaccgagcaggccuggau

SEQ ID NO: 755279 - RNA, 19 nt, Homo sapiens
gaaugaaggagguuucugu

SEQ ID NO: 755280 - RNA, 19 nt, Homo sapiens
gcucugcauucucugcuuu

SEQ ID NO: 755281 - RNA, 19 nt, Homo sapiens
acagagagacugcuccuuu

SEQ ID NO: 755282 - RNA, 19 nt, Homo sapiens
ggaggacagugaagacagu

SEQ ID NO: 755283 - RNA, 19 nt, Homo sapiens
ugaaggagguuucuguuuu

SEQ ID NO: 755284 - RNA, 19 nt, Homo sapiens
gagccuguucuucuacuua

SEQ ID NO: 755285 - RNA, 19 nt, Homo sapiens
ugacugcucugcauucucu

SEQ ID NO: 755286 - RNA, 19 nt, Homo sapiens
gcugagagaggaagaguau

SEQ ID NO: 755287 - RNA, 19 nt, Homo sapiens
caucaccagccaccuaaua

SEQ ID NO: 755288 - RNA, 19 nt, Homo sapiens
cuaagaaacuagaaugaac

SEQ ID NO: 755289 - RNA, 19 nt, Homo sapiens
gaaugaugcagauugaguu

SEQ ID NO: 755290 - RNA, 19 nt, Homo sapiens
ccaaacugcaauugacaua

SEQ ID NO: 755291 - RNA, 19 nt, Homo sapiens
cagagagacugcuccuuuc

SEQ ID NO: 755292 - RNA, 19 nt, Homo sapiens
ucaggugguucccuuguga

SEQ ID NO: 755293 - RNA, 19 nt, Homo sapiens
acagcuggcccaagaauaa

SEQ ID NO: 755294 - RNA, 19 nt, Homo sapiens
ccagaagaauugcggaaag

SEQ ID NO: 755295 - RNA, 19 nt, Homo sapiens
ucagagguauccagcaugu

SEQ ID NO: 755296 - RNA, 19 nt, Homo sapiens
agacaaaucagaccaaagu

SEQ ID NO: 755297 - RNA, 19 nt, Homo sapiens
cguaaucaauggcugguau

SEQ ID NO: 755298 - RNA, 19 nt, Homo sapiens
caaauggaaaugacuacaa

SEQ ID NO: 755299 - RNA, 19 nt, Homo sapiens
ggagguuucuguuuuaaga

SEQ ID NO: 755300 - RNA, 19 nt, Homo sapiens
gaugagcauggcuuacaua

SEQ ID NO: 755301 - RNA, 19 nt, Homo sapiens
acaaaucagaccaaaguuu

SEQ ID NO: 755302 - RNA, 19 nt, Homo sapiens
ccugugcucuucccaaaug

SEQ ID NO: 755303 - RNA, 19 nt, Homo sapiens
ccacaucaccagccaccua

SEQ ID NO: 755304 - RNA, 19 nt, Homo sapiens
ggccaugacucagacaaau

SEQ ID NO: 755305 - RNA, 19 nt, Homo sapiens
ccacacacccuggcuuuga

SEQ ID NO: 755306 - RNA, 19 nt, Homo sapiens
gaugcagauugaguucaua

SEQ ID NO: 755307 - RNA, 19 nt, Homo sapiens
gaugcugccucccaaucuu

SEQ ID NO: 755308 - RNA, 19 nt, Homo sapiens
aaaccaaucccagaauauu

SEQ ID NO: 755309 - RNA, 19 nt, Homo sapiens
ccaaacugauucauguaca

SEQ ID NO: 755310 - RNA, 19 nt, Homo sapiens
gcuuugaaguggagucugu

SEQ ID NO: 755311 - RNA, 19 nt, Homo sapiens
ggaugagcauggcuuacau

SEQ ID NO: 755312 - RNA, 19 nt, Homo sapiens
gaugauaaucguagcaauc

SEQ ID NO: 755313 - RNA, 19 nt, Homo sapiens
gggauaagaccgugaugau

SEQ ID NO: 755314 - RNA, 19 nt, Homo sapiens
ccuaggcuccguagaaauu

SEQ ID NO: 755315 - RNA, 19 nt, Homo sapiens
ucagacaaaucagaccaaa

SEQ ID NO: 755316 - RNA, 19 nt, Homo sapiens
agaccaaaguuuaccuaau

SEQ ID NO: 755317 - RNA, 19 nt, Homo sapiens
ggacagugaagacaguuuc

SEQ ID NO: 755318 - RNA, 19 nt, Homo sapiens
caauuccuccggagacuuu

SEQ ID NO: 755319 - RNA, 19 nt, Homo sapiens
ccaccugcuccaaauauaa

SEQ ID NO: 755320 - RNA, 19 nt, Homo sapiens
gcauuccuguggagguuga

SEQ ID NO: 755321 - RNA, 19 nt, Homo sapiens
uagcacuccuggcugguuu

SEQ ID NO: 755322 - RNA, 19 nt, Homo sapiens
ggauggagcgcuaccuuag

SEQ ID NO: 755323 - RNA, 19 nt, Homo sapiens
ggugaaauucgugaacuuu

SEQ ID NO: 755324 - RNA, 19 nt, Homo sapiens
cagaagaauugcggaaagu

SEQ ID NO: 755325 - RNA, 19 nt, Homo sapiens
agaaccaccugcuccaaau

SEQ ID NO: 755326 - RNA, 19 nt, Homo sapiens
gaccaaacugauucaugua

SEQ ID NO: 755327 - RNA, 19 nt, Homo sapiens
gagcgcuaccuuagggaua

SEQ ID NO: 755328 - RNA, 19 nt, Homo sapiens
gaagaauugcggaaagucu

SEQ ID NO: 755329 - RNA, 19 nt, Homo sapiens
cccugaaacuugcaaauca

SEQ ID NO: 755330 - RNA, 19 nt, Homo sapiens
gaaccauacccaagucagu

SEQ ID NO: 755331 - RNA, 19 nt, Homo sapiens
ccgaggcauugauaucauu

SEQ ID NO: 755332 - RNA, 19 nt, Homo sapiens
ucacuggcccuuucucaug

SEQ ID NO: 755333 - RNA, 19 nt, Homo sapiens
cagcaaauggaaaugacua

SEQ ID NO: 755334 - RNA, 19 nt, Homo sapiens
gucuacagcuggcccaaga

SEQ ID NO: 755335 - RNA, 19 nt, Homo sapiens
ugcagaagguuauccugaa

SEQ ID NO: 755336 - RNA, 19 nt, Homo sapiens
ggaagaggaaucagaacca

SEQ ID NO: 755337 - RNA, 19 nt, Homo sapiens
gcugaaaccaaucccagaa

SEQ ID NO: 755338 - RNA, 19 nt, Homo sapiens
uuagccagaugcuugugua

SEQ ID NO: 755339 - RNA, 19 nt, Homo sapiens
ggauguggcagcaaaugga

SEQ ID NO: 755340 - RNA, 19 nt, Homo sapiens
ugagagaggaagaguaugu

SEQ ID NO: 755341 - RNA, 19 nt, Homo sapiens
ccaccuggcuucagaacac

SEQ ID NO: 755342 - RNA, 19 nt, Homo sapiens
auaagaccgugaugauaau

SEQ ID NO: 755343 - RNA, 19 nt, Homo sapiens
cgacuacacugagguucug

SEQ ID NO: 755344 - RNA, 19 nt, Homo sapiens
cuccauggaacuaucauua

SEQ ID NO: 755345 - RNA, 19 nt, Homo sapiens
gugcccaccuggcuucaga

SEQ ID NO: 755346 - RNA, 19 nt, Homo sapiens
agaauccgaggcauugaua

SEQ ID NO: 755347 - RNA, 19 nt, Homo sapiens
cacacacccuggcuuugaa

SEQ ID NO: 755348 - RNA, 19 nt, Homo sapiens
ucacacagaugauaugauu

SEQ ID NO: 755349 - RNA, 19 nt, Homo sapiens
caaaggaaacugacaaauu

SEQ ID NO: 755350 - RNA, 19 nt, Homo sapiens
gcacaaagccacauuucaa

SEQ ID NO: 755351 - RNA, 19 nt, Homo sapiens
gagauacacuacucuucua

SEQ ID NO: 755352 - RNA, 19 nt, Homo sapiens
gcacugagauacacuacuc

SEQ ID NO: 755353 - RNA, 19 nt, Homo sapiens
aaacaacgaugugugugua

SEQ ID NO: 755354 - RNA, 19 nt, Homo sapiens
gaucagaccaucagaagga

SEQ ID NO: 755355 - RNA, 19 nt, Homo sapiens
ccaucucacuuucuugaua

SEQ ID NO: 755356 - RNA, 19 nt, Homo sapiens
caaauaagugcucuuguga

SEQ ID NO: 755357 - RNA, 19 nt, Homo sapiens
ggauuuguauaaagaguga

SEQ ID NO: 755358 - RNA, 19 nt, Homo sapiens
gaagaugcuauuucuagaa

SEQ ID NO: 755359 - RNA, 19 nt, Homo sapiens
caaguuccuucuucccuuu

SEQ ID NO: 755360 - RNA, 19 nt, Homo sapiens
ggauuggucucuucacaca

SEQ ID NO: 755361 - RNA, 19 nt, Homo sapiens
gcagccaucucacuuucuu

SEQ ID NO: 755362 - RNA, 19 nt, Homo sapiens
caguucaccuaccguguua

SEQ ID NO: 755363 - RNA, 19 nt, Homo sapiens
gcuacgagguguucagcuu

SEQ ID NO: 755364 - RNA, 19 nt, Homo sapiens
cuucaugaauuaagccuuu

SEQ ID NO: 755365 - RNA, 19 nt, Homo sapiens
ugagaaagagaaaccuaua

SEQ ID NO: 755366 - RNA, 19 nt, Homo sapiens
ugaagaugcuauuucuaga

SEQ ID NO: 755367 - RNA, 19 nt, Homo sapiens
gaggauuggucucuucaca

SEQ ID NO: 755368 - RNA, 19 nt, Homo sapiens
cagaaggauuuguauaaag

SEQ ID NO: 755369 - RNA, 19 nt, Homo sapiens
gaaagagaaaccuauagca

SEQ ID NO: 755370 - RNA, 19 nt, Homo sapiens
caucucacuuucuugauau

SEQ ID NO: 755371 - RNA, 19 nt, Homo sapiens
ccacagcccagaaggauga

SEQ ID NO: 755372 - RNA, 19 nt, Homo sapiens
gcaaauacagacacagcaa

SEQ ID NO: 755373 - RNA, 19 nt, Homo sapiens
ccaggucccuugucaccaa

SEQ ID NO: 755374 - RNA, 19 nt, Homo sapiens
caucagaaggauuuguaua

SEQ ID NO: 755375 - RNA, 19 nt, Homo sapiens
gaaaugcuacgagguguuc

SEQ ID NO: 755376 - RNA, 19 nt, Homo sapiens
aaagagaaaccuauagcaa

SEQ ID NO: 755377 - RNA, 19 nt, Homo sapiens
caccuugugucuucaguga

SEQ ID NO: 755378 - RNA, 19 nt, Homo sapiens
gggcacgccaucuaaguuu

SEQ ID NO: 755379 - RNA, 19 nt, Homo sapiens
gcuaaacaacgaugugugu

SEQ ID NO: 755380 - RNA, 19 nt, Homo sapiens
agagaaaccuauagcaacu

SEQ ID NO: 755381 - RNA, 19 nt, Homo sapiens
ccagaaggaugagaaaugc

SEQ ID NO: 755382 - RNA, 19 nt, Homo sapiens
ucaccuaccguguuacuga

SEQ ID NO: 755383 - RNA, 19 nt, Homo sapiens
ccacacgccuaccaguuca

SEQ ID NO: 755384 - RNA, 19 nt, Homo sapiens
gagcacaaagccacauuuc

SEQ ID NO: 755385 - RNA, 19 nt, Homo sapiens
gagaaagagaaaccuauag

SEQ ID NO: 755386 - RNA, 19 nt, Homo sapiens
caugugauccucagguuug

SEQ ID NO: 755387 - RNA, 19 nt, Homo sapiens
aaagccacauuucaaagga

SEQ ID NO: 755388 - RNA, 19 nt, Homo sapiens
cacaaagccacauuucaaa

SEQ ID NO: 755389 - RNA, 19 nt, Homo sapiens
gcaacuucaugaauuaagc

SEQ ID NO: 755390 - RNA, 19 nt, Homo sapiens
ugacaaauaagugcucuug

SEQ ID NO: 755391 - RNA, 19 nt, Homo sapiens
agaaaccuauagcaacuuc

SEQ ID NO: 755392 - RNA, 19 nt, Homo sapiens
cuaagggcacgccaucuaa

SEQ ID NO: 755393 - RNA, 19 nt, Homo sapiens
accaagcccugcuccauga

SEQ ID NO: 755394 - RNA, 19 nt, Homo sapiens
cacagcaaguuccuucuuc

SEQ ID NO: 755395 - RNA, 19 nt, Homo sapiens
cagaccaucagaaggauuu

SEQ ID NO: 755396 - RNA, 19 nt, Homo sapiens
gauaugauuggguccaugu

SEQ ID NO: 755397 - RNA, 19 nt, Homo sapiens
agaaggaugagaaaugcua

SEQ ID NO: 755398 - RNA, 19 nt, Homo sapiens
caaaggcccaacugcgauu

SEQ ID NO: 755399 - RNA, 19 nt, Homo sapiens
guguucagcuugucacagu

SEQ ID NO: 755400 - RNA, 19 nt, Homo sapiens
gaggaucagaccaucagaa

SEQ ID NO: 755401 - RNA, 19 nt, Homo sapiens
cucaggacaugguuaucua

SEQ ID NO: 755402 - RNA, 19 nt, Homo sapiens
uguuuccugugguucauua

SEQ ID NO: 755403 - RNA, 19 nt, Homo sapiens
uaaacaacgaugugugugu

SEQ ID NO: 755404 - RNA, 19 nt, Homo sapiens
ucuaagggcacgccaucua

SEQ ID NO: 755405 - RNA, 19 nt, Homo sapiens
uguacacuuucaugaacua

SEQ ID NO: 755406 - RNA, 19 nt, Homo sapiens
ggcacgccaucuaaguuug

SEQ ID NO: 755407 - RNA, 19 nt, Homo sapiens
caccuaccguguuacugaa

SEQ ID NO: 755408 - RNA, 19 nt, Homo sapiens
caaagccacauuucaaagg

SEQ ID NO: 755409 - RNA, 19 nt, Homo sapiens
ccaguucaccuaccguguu

SEQ ID NO: 755410 - RNA, 19 nt, Homo sapiens
cugaagaugcuauuucuag

SEQ ID NO: 755411 - RNA, 19 nt, Homo sapiens
acacagaugauaugauugg

SEQ ID NO: 755412 - RNA, 19 nt, Homo sapiens
gcgauuguccaccuugugu

SEQ ID NO: 755413 - RNA, 19 nt, Homo sapiens
gcacgccaucuaaguuugu

SEQ ID NO: 755414 - RNA, 19 nt, Homo sapiens
gcugcagggaugaaaguuu

SEQ ID NO: 755415 - RNA, 19 nt, Homo sapiens
ugacucuccuaugaaggua

SEQ ID NO: 755416 - RNA, 19 nt, Homo sapiens
gugcugugcuccauagacu

SEQ ID NO: 755417 - RNA, 19 nt, Homo sapiens
gugguucauuaucugauug

SEQ ID NO: 755418 - RNA, 19 nt, Homo sapiens
auacccaggucccuuguca

SEQ ID NO: 755419 - RNA, 19 nt, Homo sapiens
ugagauacacuacucuucu

SEQ ID NO: 755420 - RNA, 19 nt, Homo sapiens
gggccaaagcugucucuca

SEQ ID NO: 755421 - RNA, 19 nt, Homo sapiens
cuacagcacugagauacac

SEQ ID NO: 755422 - RNA, 19 nt, Homo sapiens
gugcaccccuucaugcuaa

SEQ ID NO: 755423 - RNA, 19 nt, Homo sapiens
ugugguucauuaucugauu

SEQ ID NO: 755424 - RNA, 19 nt, Homo sapiens
ugugagcacuuuugagaaa

SEQ ID NO: 755425 - RNA, 19 nt, Homo sapiens
cugcagccaucucacuuuc

SEQ ID NO: 755426 - RNA, 19 nt, Homo sapiens
cccagaaggaugagaaaug

SEQ ID NO: 755427 - RNA, 19 nt, Homo sapiens
auacacuacucuucuaagg

SEQ ID NO: 755428 - RNA, 19 nt, Homo sapiens
ccagcugccagaagaagaa

SEQ ID NO: 755429 - RNA, 19 nt, Homo sapiens
gccacacgccuaccaguuc

SEQ ID NO: 755430 - RNA, 19 nt, Homo sapiens
auacagacacagcaaguuc

SEQ ID NO: 755431 - RNA, 19 nt, Homo sapiens
ggaaacugacaaauuaucc

SEQ ID NO: 755432 - RNA, 19 nt, Homo sapiens
cuggacggcuuccuguuuc

SEQ ID NO: 755433 - RNA, 19 nt, Homo sapiens
gagaaaccuauagcaacuu

SEQ ID NO: 755434 - RNA, 19 nt, Homo sapiens
ucucuucacacagaugaua

SEQ ID NO: 755435 - RNA, 19 nt, Homo sapiens
cuugauauuucugaggauu

SEQ ID NO: 755436 - RNA, 19 nt, Homo sapiens
uguguacacuuucaugaac

SEQ ID NO: 755437 - RNA, 19 nt, Homo sapiens
ugacugugcugugcuccau

SEQ ID NO: 755438 - RNA, 19 nt, Homo sapiens
cugcagggaugaaaguuuu

SEQ ID NO: 755439 - RNA, 19 nt, Homo sapiens
ggucucuucacacagauga

SEQ ID NO: 755440 - RNA, 19 nt, Homo sapiens
ucugaggauuggucucuuc

SEQ ID NO: 755441 - RNA, 19 nt, Homo sapiens
gaaggauuuguauaaagag

SEQ ID NO: 755442 - RNA, 19 nt, Homo sapiens
cuauagcaacuucaugaau

SEQ ID NO: 755443 - RNA, 19 nt, Homo sapiens
auuggucucuucacacaga

SEQ ID NO: 755444 - RNA, 19 nt, Homo sapiens
gauacacuacucuucuaag

SEQ ID NO: 755445 - RNA, 19 nt, Homo sapiens
acucuccuaugaagguaaa

SEQ ID NO: 755446 - RNA, 19 nt, Homo sapiens
aagccacauuucaaaggaa

SEQ ID NO: 755447 - RNA, 19 nt, Homo sapiens
ccuccucaccucugcguuu

SEQ ID NO: 755448 - RNA, 19 nt, Homo sapiens
aaagucggcugcagaauua

SEQ ID NO: 755449 - RNA, 19 nt, Homo sapiens
gaauagagccauaaagaaa

SEQ ID NO: 755450 - RNA, 19 nt, Homo sapiens
gaaagugaaucuaacaaag

SEQ ID NO: 755451 - RNA, 19 nt, Homo sapiens
gcaaagcgcagaaauguug

SEQ ID NO: 755452 - RNA, 19 nt, Homo sapiens
caagaaagacaaugaguuu

SEQ ID NO: 755453 - RNA, 19 nt, Homo sapiens
acaagugccucauuuaauu

SEQ ID NO: 755454 - RNA, 19 nt, Homo sapiens
gaucugacaccuaucuuua

SEQ ID NO: 755455 - RNA, 19 nt, Homo sapiens
gaaggacugucgaauggaa

SEQ ID NO: 755456 - RNA, 19 nt, Homo sapiens
gaauugggaucaagaagau

SEQ ID NO: 755457 - RNA, 19 nt, Homo sapiens
gcagaauuauugccaaguu

SEQ ID NO: 755458 - RNA, 19 nt, Homo sapiens
gagaaggaacugacagaua

SEQ ID NO: 755459 - RNA, 19 nt, Homo sapiens
gacaaugaguuuaaagaga

SEQ ID NO: 755460 - RNA, 19 nt, Homo sapiens
ucaagaagaugaagcugaa

SEQ ID NO: 755461 - RNA, 19 nt, Homo sapiens
gaaaguugauagcucuguu

SEQ ID NO: 755462 - RNA, 19 nt, Homo sapiens
agauuaauguggccaauaa

SEQ ID NO: 755463 - RNA, 19 nt, Homo sapiens
gaacugacagauaggaauu

SEQ ID NO: 755464 - RNA, 19 nt, Homo sapiens
agaaggaacugacagauag

SEQ ID NO: 755465 - RNA, 19 nt, Homo sapiens
caacaaaacugaagauaca

SEQ ID NO: 755466 - RNA, 19 nt, Homo sapiens
ugaagcacgugaauacaaa

SEQ ID NO: 755467 - RNA, 19 nt, Homo sapiens
gcacuaaguccucugaguu

SEQ ID NO: 755468 - RNA, 19 nt, Homo sapiens
cgacaagugccucauuuaa

SEQ ID NO: 755469 - RNA, 19 nt, Homo sapiens
caaagucggcugcagaauu

SEQ ID NO: 755470 - RNA, 19 nt, Homo sapiens
cauagguacucugcauuua

SEQ ID NO: 755471 - RNA, 19 nt, Homo sapiens
gaagauacaccugacaaga

SEQ ID NO: 755472 - RNA, 19 nt, Homo sapiens
gcauagguacucugcauuu

SEQ ID NO: 755473 - RNA, 19 nt, Homo sapiens
ugacaguggugaaugcaaa

SEQ ID NO: 755474 - RNA, 19 nt, Homo sapiens
uagguacucugcauuuaaa

SEQ ID NO: 755475 - RNA, 19 nt, Homo sapiens
gcaggaauucugaaaguga

SEQ ID NO: 755476 - RNA, 19 nt, Homo sapiens
ggaauugggaucaagaaga

SEQ ID NO: 755477 - RNA, 19 nt, Homo sapiens
gaacagggaagaauaacgu

SEQ ID NO: 755478 - RNA, 19 nt, Homo sapiens
caaaguggcagcugaaaca

SEQ ID NO: 755479 - RNA, 19 nt, Homo sapiens
gagaugaagaagagaauga

SEQ ID NO: 755480 - RNA, 19 nt, Homo sapiens
aaagagaaaggcauaggua

SEQ ID NO: 755481 - RNA, 19 nt, Homo sapiens
gaaagcaaagcgcagaaau

SEQ ID NO: 755482 - RNA, 19 nt, Homo sapiens
ccuuaaaguuagucaguuu

SEQ ID NO: 755483 - RNA, 19 nt, Homo sapiens
gaagauuaauguggccaau

SEQ ID NO: 755484 - RNA, 19 nt, Homo sapiens
gacaagugccucauuuaau

SEQ ID NO: 755485 - RNA, 19 nt, Homo sapiens
gcgacaagugccucauuua

SEQ ID NO: 755486 - RNA, 19 nt, Homo sapiens
aagaauagagccauaaaga

SEQ ID NO: 755487 - RNA, 19 nt, Homo sapiens
aguaguaguuaccgaagua

SEQ ID NO: 755488 - RNA, 19 nt, Homo sapiens
caccuugguugauaaaguu

SEQ ID NO: 755489 - RNA, 19 nt, Homo sapiens
ucugacaccuaucuuuaaa

SEQ ID NO: 755490 - RNA, 19 nt, Homo sapiens
aaagaaaugccgagaagga

SEQ ID NO: 755491 - RNA, 19 nt, Homo sapiens
caaagauacuacccagagu

SEQ ID NO: 755492 - RNA, 19 nt, Homo sapiens
caagugccucauuuaauuu

SEQ ID NO: 755493 - RNA, 19 nt, Homo sapiens
caaauggcccuaccaccuu

SEQ ID NO: 755494 - RNA, 19 nt, Homo sapiens
cugaagaggugggaacauu

SEQ ID NO: 755495 - RNA, 19 nt, Homo sapiens
gcgggcagacaccaauuua

SEQ ID NO: 755496 - RNA, 19 nt, Homo sapiens
uaacaaaguggcagcugaa

SEQ ID NO: 755497 - RNA, 19 nt, Homo sapiens
caggaauucugaaagugaa

SEQ ID NO: 755498 - RNA, 19 nt, Homo sapiens
caaaagaaaugccgagaag

SEQ ID NO: 755499 - RNA, 19 nt, Homo sapiens
guucugauuccacccaaua

SEQ ID NO: 755500 - RNA, 19 nt, Homo sapiens
augcaaagguggagaugaa

SEQ ID NO: 755501 - RNA, 19 nt, Homo sapiens
ucugugaucugacaccuau

SEQ ID NO: 755502 - RNA, 19 nt, Homo sapiens
gggauuggauagugaagca

SEQ ID NO: 755503 - RNA, 19 nt, Homo sapiens
uggaaggacugucgaaugg

SEQ ID NO: 755504 - RNA, 19 nt, Homo sapiens
gaaaacauggccaaaagaa

SEQ ID NO: 755505 - RNA, 19 nt, Homo sapiens
caaagguggagaugaagaa

SEQ ID NO: 755506 - RNA, 19 nt, Homo sapiens
gcaaagguggagaugaaga

SEQ ID NO: 755507 - RNA, 19 nt, Homo sapiens
caacaaaauuacagcaaga

SEQ ID NO: 755508 - RNA, 19 nt, Homo sapiens
cagcaaaucagaagacaca

SEQ ID NO: 755509 - RNA, 19 nt, Homo sapiens
accagucucuucaccauuu

SEQ ID NO: 755510 - RNA, 19 nt, Homo sapiens
ccaccuugguugauaaagu

SEQ ID NO: 755511 - RNA, 19 nt, Homo sapiens
uaucgucuguguuccaaau

SEQ ID NO: 755512 - RNA, 19 nt, Homo sapiens
gauaggaauugggaucaag

SEQ ID NO: 755513 - RNA, 19 nt, Homo sapiens
gaagaauagagccauaaag

SEQ ID NO: 755514 - RNA, 19 nt, Homo sapiens
ggaggacgcuuuucuggau

SEQ ID NO: 755515 - RNA, 19 nt, Homo sapiens
agaauagagccauaaagaa

SEQ ID NO: 755516 - RNA, 19 nt, Homo sapiens
guucuuaucgucuguguuc

SEQ ID NO: 755517 - RNA, 19 nt, Homo sapiens
gaguaaaccagucucuuca

SEQ ID NO: 755518 - RNA, 19 nt, Homo sapiens
gaagaggugggaacauucu

SEQ ID NO: 755519 - RNA, 19 nt, Homo sapiens
gcagacgaguugcacaaaa

SEQ ID NO: 755520 - RNA, 19 nt, Homo sapiens
caacauauugcugaacguu

SEQ ID NO: 755521 - RNA, 19 nt, Homo sapiens
aaaccagucucuucaccau

SEQ ID NO: 755522 - RNA, 19 nt, Homo sapiens
aagauacaccugacaagaa

SEQ ID NO: 755523 - RNA, 19 nt, Homo sapiens
uggcaggaauucugaaagu

SEQ ID NO: 755524 - RNA, 19 nt, Homo sapiens
gugcgggauuggauaguga

SEQ ID NO: 755525 - RNA, 19 nt, Homo sapiens
ggaacugacagauaggaau

SEQ ID NO: 755526 - RNA, 19 nt, Homo sapiens
gagcgacaagugccucauu

SEQ ID NO: 755527 - RNA, 19 nt, Homo sapiens
agauacaccugacaagaag

SEQ ID NO: 755528 - RNA, 19 nt, Homo sapiens
gggaacaguggcaggaauu

SEQ ID NO: 755529 - RNA, 19 nt, Homo sapiens
gugaagcacgugaauacaa

SEQ ID NO: 755530 - RNA, 19 nt, Homo sapiens
gaaaugccuaucacaagca

SEQ ID NO: 755531 - RNA, 19 nt, Homo sapiens
uaaagcuugugucggaaau

SEQ ID NO: 755532 - RNA, 19 nt, Homo sapiens
ugaagaauagagccauaaa

SEQ ID NO: 755533 - RNA, 19 nt, Homo sapiens
aaucagaagacacagcuuu

SEQ ID NO: 755534 - RNA, 19 nt, Homo sapiens
gaugagccacccaaaguag

SEQ ID NO: 755535 - RNA, 19 nt, Homo sapiens
gaaggugacaguggugaau

SEQ ID NO: 755536 - RNA, 19 nt, Homo sapiens
gguggcaucugaaaagaaa

SEQ ID NO: 755537 - RNA, 19 nt, Homo sapiens
guaaagcuugugucggaaa

SEQ ID NO: 755538 - RNA, 19 nt, Homo sapiens
aagcaaagcgcagaaaugu

SEQ ID NO: 755539 - RNA, 19 nt, Homo sapiens
aagugaaucuaacaaagug

SEQ ID NO: 755540 - RNA, 19 nt, Homo sapiens
ucucuucuuugacauucua

SEQ ID NO: 755541 - RNA, 19 nt, Homo sapiens
guuuaaagagaaaggcaua

SEQ ID NO: 755542 - RNA, 19 nt, Homo sapiens
acaagaaagacaaugaguu

SEQ ID NO: 755543 - RNA, 19 nt, Homo sapiens
cuugaagaauagagccaua

SEQ ID NO: 755544 - RNA, 19 nt, Homo sapiens
ccaauugacgagaagaaug

SEQ ID NO: 755545 - RNA, 19 nt, Homo sapiens
gagaaaggcauagguacuc

SEQ ID NO: 755546 - RNA, 19 nt, Homo sapiens
gcguuucuuuccucccuuu

SEQ ID NO: 755547 - RNA, 19 nt, Homo sapiens
cuucaccauuucccacuaa

SEQ ID NO: 755548 - RNA, 19 nt, Homo sapiens
aaagucggcugcagaauua

SEQ ID NO: 755549 - RNA, 19 nt, Homo sapiens
gaauagagccauaaagaaa

SEQ ID NO: 755550 - RNA, 19 nt, Homo sapiens
gaaagugaaucuaacaaag

SEQ ID NO: 755551 - RNA, 19 nt, Homo sapiens
gcaaagcgcagaaauguug

SEQ ID NO: 755552 - RNA, 19 nt, Homo sapiens
gggcaggacucaucuuaaa

SEQ ID NO: 755553 - RNA, 19 nt, Homo sapiens
caagaaagacaaugaguuu

SEQ ID NO: 755554 - RNA, 19 nt, Homo sapiens
acaagugccucauuuaauu

SEQ ID NO: 755555 - RNA, 19 nt, Homo sapiens
gaucugacaccuaucuuua

SEQ ID NO: 755556 - RNA, 19 nt, Homo sapiens
aagaagggcuauaaacuaa

SEQ ID NO: 755557 - RNA, 19 nt, Homo sapiens
gaaggacugucgaauggaa

SEQ ID NO: 755558 - RNA, 19 nt, Homo sapiens
ggacaugagugugcuuuga

SEQ ID NO: 755559 - RNA, 19 nt, Homo sapiens
gaauugggaucaagaagau

SEQ ID NO: 755560 - RNA, 19 nt, Homo sapiens
gcagaauuauugccaaguu

SEQ ID NO: 755561 - RNA, 19 nt, Homo sapiens
gagaaggaacugacagaua

SEQ ID NO: 755562 - RNA, 19 nt, Homo sapiens
gacaaugaguuuaaagaga

SEQ ID NO: 755563 - RNA, 19 nt, Homo sapiens
ucaagaagaugaagcugaa

SEQ ID NO: 755564 - RNA, 19 nt, Homo sapiens
gaaaguugauagcucuguu

SEQ ID NO: 755565 - RNA, 19 nt, Homo sapiens
agauuaauguggccaauaa

SEQ ID NO: 755566 - RNA, 19 nt, Homo sapiens
gaagauauucagcagcuuu

SEQ ID NO: 755567 - RNA, 19 nt, Homo sapiens
gaacugacagauaggaauu

SEQ ID NO: 755568 - RNA, 19 nt, Homo sapiens
agaaggaacugacagauag

SEQ ID NO: 755569 - RNA, 19 nt, Homo sapiens
caacaaaacugaagauaca

SEQ ID NO: 755570 - RNA, 19 nt, Homo sapiens
gaagggcuauaaacuaaag

SEQ ID NO: 755571 - RNA, 19 nt, Homo sapiens
ugaagcacgugaauacaaa

SEQ ID NO: 755572 - RNA, 19 nt, Homo sapiens
cgacaagugccucauuuaa

SEQ ID NO: 755573 - RNA, 19 nt, Homo sapiens
caaagucggcugcagaauu

SEQ ID NO: 755574 - RNA, 19 nt, Homo sapiens
cauagguacucugcauuua

SEQ ID NO: 755575 - RNA, 19 nt, Homo sapiens
gaagauacaccugacaaga

SEQ ID NO: 755576 - RNA, 19 nt, Homo sapiens
aaagaagggcuauaaacua

SEQ ID NO: 755577 - RNA, 19 nt, Homo sapiens
gcauagguacucugcauuu

SEQ ID NO: 755578 - RNA, 19 nt, Homo sapiens
ugacaguggugaaugcaaa

SEQ ID NO: 755579 - RNA, 19 nt, Homo sapiens
uagguacucugcauuuaaa

SEQ ID NO: 755580 - RNA, 19 nt, Homo sapiens
gcaggaauucugaaaguga

SEQ ID NO: 755581 - RNA, 19 nt, Homo sapiens
ggaauugggaucaagaaga

SEQ ID NO: 755582 - RNA, 19 nt, Homo sapiens
gaacagggaagaauaacgu

SEQ ID NO: 755583 - RNA, 19 nt, Homo sapiens
caaaguggcagcugaaaca

SEQ ID NO: 755584 - RNA, 19 nt, Homo sapiens
aaacuaaagccgaagauau

SEQ ID NO: 755585 - RNA, 19 nt, Homo sapiens
gagaugaagaagagaauga

SEQ ID NO: 755586 - RNA, 19 nt, Homo sapiens
aaagagaaaggcauaggua

SEQ ID NO: 755587 - RNA, 19 nt, Homo sapiens
gaaagcaaagcgcagaaau

SEQ ID NO: 755588 - RNA, 19 nt, Homo sapiens
ccuuaaaguuagucaguuu

SEQ ID NO: 755589 - RNA, 19 nt, Homo sapiens
caucagaaguguggacaug

SEQ ID NO: 755590 - RNA, 19 nt, Homo sapiens
gaagauuaauguggccaau

SEQ ID NO: 755591 - RNA, 19 nt, Homo sapiens
gacaagugccucauuuaau

SEQ ID NO: 755592 - RNA, 19 nt, Homo sapiens
gcgacaagugccucauuua

SEQ ID NO: 755593 - RNA, 19 nt, Homo sapiens
aagaauagagccauaaaga

SEQ ID NO: 755594 - RNA, 19 nt, Homo sapiens
aguaguaguuaccgaagua

SEQ ID NO: 755595 - RNA, 19 nt, Homo sapiens
caccuugguugauaaaguu

SEQ ID NO: 755596 - RNA, 19 nt, Homo sapiens
ucugacaccuaucuuuaaa

SEQ ID NO: 755597 - RNA, 19 nt, Homo sapiens
caaagauacuacccagagu

SEQ ID NO: 755598 - RNA, 19 nt, Homo sapiens
aaagaaaugccgagaagga

SEQ ID NO: 755599 - RNA, 19 nt, Homo sapiens
caagugccucauuuaauuu

SEQ ID NO: 755600 - RNA, 19 nt, Homo sapiens
caaauggcccuaccaccuu

SEQ ID NO: 755601 - RNA, 19 nt, Homo sapiens
gcgggcagacaccaauuua

SEQ ID NO: 755602 - RNA, 19 nt, Homo sapiens
caaaagaaaugccgagaag

SEQ ID NO: 755603 - RNA, 19 nt, Homo sapiens
uaacaaaguggcagcugaa

SEQ ID NO: 755604 - RNA, 19 nt, Homo sapiens
caggaauucugaaagugaa

SEQ ID NO: 755605 - RNA, 19 nt, Homo sapiens
guucugauuccacccaaua

SEQ ID NO: 755606 - RNA, 19 nt, Homo sapiens
augcaaagguggagaugaa

SEQ ID NO: 755607 - RNA, 19 nt, Homo sapiens
ucugugaucugacaccuau

SEQ ID NO: 755608 - RNA, 19 nt, Homo sapiens
gggauuggauagugaagca

SEQ ID NO: 755609 - RNA, 19 nt, Homo sapiens
uggaaggacugucgaaugg

SEQ ID NO: 755610 - RNA, 19 nt, Homo sapiens
caaagguggagaugaagaa

SEQ ID NO: 755611 - RNA, 19 nt, Homo sapiens
gcaaagguggagaugaaga

SEQ ID NO: 755612 - RNA, 19 nt, Homo sapiens
caacaaaauuacagcaaga

SEQ ID NO: 755613 - RNA, 19 nt, Homo sapiens
gaaaacauggccaaaagaa

SEQ ID NO: 755614 - RNA, 19 nt, Homo sapiens
cagcaaaucagaagacaca

SEQ ID NO: 755615 - RNA, 19 nt, Homo sapiens
accagucucuucaccauuu

SEQ ID NO: 755616 - RNA, 19 nt, Homo sapiens
ccaccuugguugauaaagu

SEQ ID NO: 755617 - RNA, 19 nt, Homo sapiens
uaaacuaaagccgaagaua

SEQ ID NO: 755618 - RNA, 19 nt, Homo sapiens
uaucgucuguguuccaaau

SEQ ID NO: 755619 - RNA, 19 nt, Homo sapiens
gauaggaauugggaucaag

SEQ ID NO: 755620 - RNA, 19 nt, Homo sapiens
gaagaauagagccauaaag

SEQ ID NO: 755621 - RNA, 19 nt, Homo sapiens
ggaggacgcuuuucuggau

SEQ ID NO: 755622 - RNA, 19 nt, Homo sapiens
agaauagagccauaaagaa

SEQ ID NO: 755623 - RNA, 19 nt, Homo sapiens
guucuuaucgucuguguuc

SEQ ID NO: 755624 - RNA, 19 nt, Homo sapiens
gaguaaaccagucucuuca

SEQ ID NO: 755625 - RNA, 19 nt, Homo sapiens
gcagacgaguugcacaaaa

SEQ ID NO: 755626 - RNA, 19 nt, Homo sapiens
caacauauugcugaacguu

SEQ ID NO: 755627 - RNA, 19 nt, Homo sapiens
aaaccagucucuucaccau

SEQ ID NO: 755628 - RNA, 19 nt, Homo sapiens
aagauacaccugacaagaa

SEQ ID NO: 755629 - RNA, 19 nt, Homo sapiens
uggcaggaauucugaaagu

SEQ ID NO: 755630 - RNA, 19 nt, Homo sapiens
gugcgggauuggauaguga

SEQ ID NO: 755631 - RNA, 19 nt, Homo sapiens
aacuaaagccgaagauauu

SEQ ID NO: 755632 - RNA, 19 nt, Homo sapiens
ggaacugacagauaggaau

SEQ ID NO: 755633 - RNA, 19 nt, Homo sapiens
gagcgacaagugccucauu

SEQ ID NO: 755634 - RNA, 19 nt, Homo sapiens
agauacaccugacaagaag

SEQ ID NO: 755635 - RNA, 19 nt, Homo sapiens
gggaacaguggcaggaauu

SEQ ID NO: 755636 - RNA, 19 nt, Homo sapiens
gugaagcacgugaauacaa

SEQ ID NO: 755637 - RNA, 19 nt, Homo sapiens
gaaaugccuaucacaagca

SEQ ID NO: 755638 - RNA, 19 nt, Homo sapiens
uaaagcuugugucggaaau

SEQ ID NO: 755639 - RNA, 19 nt, Homo sapiens
ugaagaauagagccauaaa

SEQ ID NO: 755640 - RNA, 19 nt, Homo sapiens
gaaguguggacaugagugu

SEQ ID NO: 755641 - RNA, 19 nt, Homo sapiens
aaucagaagacacagcuuu

SEQ ID NO: 755642 - RNA, 19 nt, Homo sapiens
gaugagccacccaaaguag

SEQ ID NO: 755643 - RNA, 19 nt, Homo sapiens
gaaggugacaguggugaau

SEQ ID NO: 755644 - RNA, 19 nt, Homo sapiens
gguggcaucugaaaagaaa

SEQ ID NO: 755645 - RNA, 19 nt, Homo sapiens
guaaagcuugugucggaaa

SEQ ID NO: 755646 - RNA, 19 nt, Homo sapiens
aagcaaagcgcagaaaugu

SEQ ID NO: 755647 - RNA, 19 nt, Homo sapiens
aagugaaucuaacaaagug

SEQ ID NO: 755648 - RNA, 19 nt, Homo sapiens
aaagucggcugcagaauua

SEQ ID NO: 755649 - RNA, 19 nt, Homo sapiens
gaauagagccauaaagaaa

SEQ ID NO: 755650 - RNA, 19 nt, Homo sapiens
gaaagugaaucuaacaaag

SEQ ID NO: 755651 - RNA, 19 nt, Homo sapiens
gcaaagcgcagaaauguug

SEQ ID NO: 755652 - RNA, 19 nt, Homo sapiens
caagaaagacaaugaguuu

SEQ ID NO: 755653 - RNA, 19 nt, Homo sapiens
acaagugccucauuuaauu

SEQ ID NO: 755654 - RNA, 19 nt, Homo sapiens
gaucugacaccuaucuuua

SEQ ID NO: 755655 - RNA, 19 nt, Homo sapiens
aagaagggcuauaaacuaa

SEQ ID NO: 755656 - RNA, 19 nt, Homo sapiens
gaaggacugucgaauggaa

SEQ ID NO: 755657 - RNA, 19 nt, Homo sapiens
ggacaugagugugcuuuga

SEQ ID NO: 755658 - RNA, 19 nt, Homo sapiens
gaauugggaucaagaagau

SEQ ID NO: 755659 - RNA, 19 nt, Homo sapiens
gcagaauuauugccaaguu

SEQ ID NO: 755660 - RNA, 19 nt, Homo sapiens
gagaaggaacugacagaua

SEQ ID NO: 755661 - RNA, 19 nt, Homo sapiens
gacaaugaguuuaaagaga

SEQ ID NO: 755662 - RNA, 19 nt, Homo sapiens
ucaagaagaugaagcugaa

SEQ ID NO: 755663 - RNA, 19 nt, Homo sapiens
gaaaguugauagcucuguu

SEQ ID NO: 755664 - RNA, 19 nt, Homo sapiens
agauuaauguggccaauaa

SEQ ID NO: 755665 - RNA, 19 nt, Homo sapiens
gaagauauucagcagcuuu

SEQ ID NO: 755666 - RNA, 19 nt, Homo sapiens
gaacugacagauaggaauu

SEQ ID NO: 755667 - RNA, 19 nt, Homo sapiens
agaaggaacugacagauag

SEQ ID NO: 755668 - RNA, 19 nt, Homo sapiens
caacaaaacugaagauaca

SEQ ID NO: 755669 - RNA, 19 nt, Homo sapiens
gaagggcuauaaacuaaag

SEQ ID NO: 755670 - RNA, 19 nt, Homo sapiens
ugaagcacgugaauacaaa

SEQ ID NO: 755671 - RNA, 19 nt, Homo sapiens
gcacuaaguccucugaguu

SEQ ID NO: 755672 - RNA, 19 nt, Homo sapiens
cgacaagugccucauuuaa

SEQ ID NO: 755673 - RNA, 19 nt, Homo sapiens
caaagucggcugcagaauu

SEQ ID NO: 755674 - RNA, 19 nt, Homo sapiens
cauagguacucugcauuua

SEQ ID NO: 755675 - RNA, 19 nt, Homo sapiens
gaagauacaccugacaaga

SEQ ID NO: 755676 - RNA, 19 nt, Homo sapiens
aaagaagggcuauaaacua

SEQ ID NO: 755677 - RNA, 19 nt, Homo sapiens
gcauagguacucugcauuu

SEQ ID NO: 755678 - RNA, 19 nt, Homo sapiens
ugacaguggugaaugcaaa

SEQ ID NO: 755679 - RNA, 19 nt, Homo sapiens
uagguacucugcauuuaaa

SEQ ID NO: 755680 - RNA, 19 nt, Homo sapiens
gcaggaauucugaaaguga

SEQ ID NO: 755681 - RNA, 19 nt, Homo sapiens
ggaauugggaucaagaaga

SEQ ID NO: 755682 - RNA, 19 nt, Homo sapiens
gaacagggaagaauaacgu

SEQ ID NO: 755683 - RNA, 19 nt, Homo sapiens
caaaguggcagcugaaaca

SEQ ID NO: 755684 - RNA, 19 nt, Homo sapiens
aaacuaaagccgaagauau

SEQ ID NO: 755685 - RNA, 19 nt, Homo sapiens
gagaugaagaagagaauga

SEQ ID NO: 755686 - RNA, 19 nt, Homo sapiens
aaagagaaaggcauaggua

SEQ ID NO: 755687 - RNA, 19 nt, Homo sapiens
gaaagcaaagcgcagaaau

SEQ ID NO: 755688 - RNA, 19 nt, Homo sapiens
ccuuaaaguuagucaguuu

SEQ ID NO: 755689 - RNA, 19 nt, Homo sapiens
caucagaaguguggacaug

SEQ ID NO: 755690 - RNA, 19 nt, Homo sapiens
gaagauuaauguggccaau

SEQ ID NO: 755691 - RNA, 19 nt, Homo sapiens
gacaagugccucauuuaau

SEQ ID NO: 755692 - RNA, 19 nt, Homo sapiens
gcgacaagugccucauuua

SEQ ID NO: 755693 - RNA, 19 nt, Homo sapiens
aagaauagagccauaaaga

SEQ ID NO: 755694 - RNA, 19 nt, Homo sapiens
aguaguaguuaccgaagua

SEQ ID NO: 755695 - RNA, 19 nt, Homo sapiens
caccuugguugauaaaguu

SEQ ID NO: 755696 - RNA, 19 nt, Homo sapiens
ucugacaccuaucuuuaaa

SEQ ID NO: 755697 - RNA, 19 nt, Homo sapiens
caaagauacuacccagagu

SEQ ID NO: 755698 - RNA, 19 nt, Homo sapiens
caagugccucauuuaauuu

SEQ ID NO: 755699 - RNA, 19 nt, Homo sapiens
caaauggcccuaccaccuu

SEQ ID NO: 755700 - RNA, 19 nt, Homo sapiens
aaagaaaugccgagaagga

SEQ ID NO: 755701 - RNA, 19 nt, Homo sapiens
gcgggcagacaccaauuua

SEQ ID NO: 755702 - RNA, 19 nt, Homo sapiens
caaaagaaaugccgagaag

SEQ ID NO: 755703 - RNA, 19 nt, Homo sapiens
uaacaaaguggcagcugaa

SEQ ID NO: 755704 - RNA, 19 nt, Homo sapiens
caggaauucugaaagugaa

SEQ ID NO: 755705 - RNA, 19 nt, Homo sapiens
guucugauuccacccaaua

SEQ ID NO: 755706 - RNA, 19 nt, Homo sapiens
augcaaagguggagaugaa

SEQ ID NO: 755707 - RNA, 19 nt, Homo sapiens
ucugugaucugacaccuau

SEQ ID NO: 755708 - RNA, 19 nt, Homo sapiens
gggauuggauagugaagca

SEQ ID NO: 755709 - RNA, 19 nt, Homo sapiens
uggaaggacugucgaaugg

SEQ ID NO: 755710 - RNA, 19 nt, Homo sapiens
caaagguggagaugaagaa

SEQ ID NO: 755711 - RNA, 19 nt, Homo sapiens
gcaaagguggagaugaaga

SEQ ID NO: 755712 - RNA, 19 nt, Homo sapiens
caacaaaauuacagcaaga

SEQ ID NO: 755713 - RNA, 19 nt, Homo sapiens
gaaaacauggccaaaagaa

SEQ ID NO: 755714 - RNA, 19 nt, Homo sapiens
cagcaaaucagaagacaca

SEQ ID NO: 755715 - RNA, 19 nt, Homo sapiens
accagucucuucaccauuu

SEQ ID NO: 755716 - RNA, 19 nt, Homo sapiens
ccaccuugguugauaaagu

SEQ ID NO: 755717 - RNA, 19 nt, Homo sapiens
uaaacuaaagccgaagaua

SEQ ID NO: 755718 - RNA, 19 nt, Homo sapiens
uaucgucuguguuccaaau

SEQ ID NO: 755719 - RNA, 19 nt, Homo sapiens
gauaggaauugggaucaag

SEQ ID NO: 755720 - RNA, 19 nt, Homo sapiens
gaagaauagagccauaaag

SEQ ID NO: 755721 - RNA, 19 nt, Homo sapiens
ggaggacgcuuuucuggau

SEQ ID NO: 755722 - RNA, 19 nt, Homo sapiens
agaauagagccauaaagaa

SEQ ID NO: 755723 - RNA, 19 nt, Homo sapiens
guucuuaucgucuguguuc

SEQ ID NO: 755724 - RNA, 19 nt, Homo sapiens
gaguaaaccagucucuuca

SEQ ID NO: 755725 - RNA, 19 nt, Homo sapiens
gcagacgaguugcacaaaa

SEQ ID NO: 755726 - RNA, 19 nt, Homo sapiens
caacauauugcugaacguu

SEQ ID NO: 755727 - RNA, 19 nt, Homo sapiens
aaaccagucucuucaccau

SEQ ID NO: 755728 - RNA, 19 nt, Homo sapiens
aagauacaccugacaagaa

SEQ ID NO: 755729 - RNA, 19 nt, Homo sapiens
uggcaggaauucugaaagu

SEQ ID NO: 755730 - RNA, 19 nt, Homo sapiens
gugcgggauuggauaguga

SEQ ID NO: 755731 - RNA, 19 nt, Homo sapiens
aacuaaagccgaagauauu

SEQ ID NO: 755732 - RNA, 19 nt, Homo sapiens
gagcgacaagugccucauu

SEQ ID NO: 755733 - RNA, 19 nt, Homo sapiens
agauacaccugacaagaag

SEQ ID NO: 755734 - RNA, 19 nt, Homo sapiens
gggaacaguggcaggaauu

SEQ ID NO: 755735 - RNA, 19 nt, Homo sapiens
gugaagcacgugaauacaa

SEQ ID NO: 755736 - RNA, 19 nt, Homo sapiens
gaaaugccuaucacaagca

SEQ ID NO: 755737 - RNA, 19 nt, Homo sapiens
uaaagcuugugucggaaau

SEQ ID NO: 755738 - RNA, 19 nt, Homo sapiens
ggaacugacagauaggaau

SEQ ID NO: 755739 - RNA, 19 nt, Homo sapiens
ugaagaauagagccauaaa

SEQ ID NO: 755740 - RNA, 19 nt, Homo sapiens
gaaguguggacaugagugu

SEQ ID NO: 755741 - RNA, 19 nt, Homo sapiens
aaucagaagacacagcuuu

SEQ ID NO: 755742 - RNA, 19 nt, Homo sapiens
gaugagccacccaaaguag

SEQ ID NO: 755743 - RNA, 19 nt, Homo sapiens
gaaggugacaguggugaau

SEQ ID NO: 755744 - RNA, 19 nt, Homo sapiens
gguggcaucugaaaagaaa

SEQ ID NO: 755745 - RNA, 19 nt, Homo sapiens
guaaagcuugugucggaaa

SEQ ID NO: 755746 - RNA, 19 nt, Homo sapiens
aagcaaagcgcagaaaugu

SEQ ID NO: 755747 - RNA, 19 nt, Homo sapiens
aagugaaucuaacaaagug

SEQ ID NO: 755748 - RNA, 19 nt, Homo sapiens
gaacacaaaugucuaguuu

SEQ ID NO: 755749 - RNA, 19 nt, Homo sapiens
ggagagagcuuuaacugaa

SEQ ID NO: 755750 - RNA, 19 nt, Homo sapiens
ccacagagcuuguugagaa

SEQ ID NO: 755751 - RNA, 19 nt, Homo sapiens
gaaagaaugugcuguuaau

SEQ ID NO: 755752 - RNA, 19 nt, Homo sapiens
ccaaggacaugaacaauuu

SEQ ID NO: 755753 - RNA, 19 nt, Homo sapiens
gauaguggcuggaauuuga

SEQ ID NO: 755754 - RNA, 19 nt, Homo sapiens
ugagaaagcuuuaagagaa

SEQ ID NO: 755755 - RNA, 19 nt, Homo sapiens
ggaaggaaaucuaaggaaa

SEQ ID NO: 755756 - RNA, 19 nt, Homo sapiens
gcagaggccaugaauauua

SEQ ID NO: 755757 - RNA, 19 nt, Homo sapiens
caacagaaccucauauuug

SEQ ID NO: 755758 - RNA, 19 nt, Homo sapiens
uagcagagguuuaaaugua

SEQ ID NO: 755759 - RNA, 19 nt, Homo sapiens
gaaacuagcuccagaacuc

SEQ ID NO: 755760 - RNA, 19 nt, Homo sapiens
gcagugggcucacauauca

SEQ ID NO: 755761 - RNA, 19 nt, Homo sapiens
gcacuucgauauaugauug

SEQ ID NO: 755762 - RNA, 19 nt, Homo sapiens
gaaagaagacuacaucugu

SEQ ID NO: 755763 - RNA, 19 nt, Homo sapiens
gaauaaauccuucguccua

SEQ ID NO: 755764 - RNA, 19 nt, Homo sapiens
gaaugggccuugaauguga

SEQ ID NO: 755765 - RNA, 19 nt, Homo sapiens
ggaacuugguuuaggguua

SEQ ID NO: 755766 - RNA, 19 nt, Homo sapiens
gaugaucucuacccuauga

SEQ ID NO: 755767 - RNA, 19 nt, Homo sapiens
gaagaccacuggagcuauu

SEQ ID NO: 755768 - RNA, 19 nt, Homo sapiens
gaacucugauacauaguaa

SEQ ID NO: 755769 - RNA, 19 nt, Homo sapiens
gaacuugguuuaggguuaa

SEQ ID NO: 755770 - RNA, 19 nt, Homo sapiens
gcucaggacuguuauauag

SEQ ID NO: 755771 - RNA, 19 nt, Homo sapiens
gagcugacauugccucaaa

SEQ ID NO: 755772 - RNA, 19 nt, Homo sapiens
gagcagaggccaugaauau

SEQ ID NO: 755773 - RNA, 19 nt, Homo sapiens
gcaugaaacuuccuugguu

SEQ ID NO: 755774 - RNA, 19 nt, Homo sapiens
ucacagagguccggguuua

SEQ ID NO: 755775 - RNA, 19 nt, Homo sapiens
gcaaagaucaccaagaaga

SEQ ID NO: 755776 - RNA, 19 nt, Homo sapiens
gagaaagcuuuaagagaaa

SEQ ID NO: 755777 - RNA, 19 nt, Homo sapiens
ggacuagaaccuaucuuua

SEQ ID NO: 755778 - RNA, 19 nt, Homo sapiens
gacaguguguggagcauua

SEQ ID NO: 755779 - RNA, 19 nt, Homo sapiens
uaaguuaguugcagaagaa

SEQ ID NO: 755780 - RNA, 19 nt, Homo sapiens
uuccaaggcugauguauua

SEQ ID NO: 755781 - RNA, 19 nt, Homo sapiens
cacuggagcuauucaauua

SEQ ID NO: 755782 - RNA, 19 nt, Homo sapiens
gaaauaagaguaccuaucu

SEQ ID NO: 755783 - RNA, 19 nt, Homo sapiens
gagaugcacuucgauauau

SEQ ID NO: 755784 - RNA, 19 nt, Homo sapiens
gagaaacuguccguaaauu

SEQ ID NO: 755785 - RNA, 19 nt, Homo sapiens
gaagguggauuugcaguug

SEQ ID NO: 755786 - RNA, 19 nt, Homo sapiens
guacugacgugauugaaug

SEQ ID NO: 755787 - RNA, 19 nt, Homo sapiens
uaacucgccuucuguauau

SEQ ID NO: 755788 - RNA, 19 nt, Homo sapiens
gcaccaagccgaaaguaaa

SEQ ID NO: 755789 - RNA, 19 nt, Homo sapiens
uaaaggaucucuugaaucg

SEQ ID NO: 755790 - RNA, 19 nt, Homo sapiens
ggaauuaacagucuugaga

SEQ ID NO: 755791 - RNA, 19 nt, Homo sapiens
ggagaugcacuucgauaua

SEQ ID NO: 755792 - RNA, 19 nt, Homo sapiens
gaugucagcuuugaauuug

SEQ ID NO: 755793 - RNA, 19 nt, Homo sapiens
gaagaucuuggacuuauuu

SEQ ID NO: 755794 - RNA, 19 nt, Homo sapiens
gcuguuaucucuacuggaa

SEQ ID NO: 755795 - RNA, 19 nt, Homo sapiens
ucgaagagaucccugcaua

SEQ ID NO: 755796 - RNA, 19 nt, Homo sapiens
ugaagaaucugaaaugaag

SEQ ID NO: 755797 - RNA, 19 nt, Homo sapiens
agaaagacauggccauuau

SEQ ID NO: 755798 - RNA, 19 nt, Homo sapiens
cauugaagcuugcaccuuu

SEQ ID NO: 755799 - RNA, 19 nt, Homo sapiens
ggaagacucugaggaugaa

SEQ ID NO: 755800 - RNA, 19 nt, Homo sapiens
ggagguguccuaaguguuu

SEQ ID NO: 755801 - RNA, 19 nt, Homo sapiens
gcaguuguuugcaaggaua

SEQ ID NO: 755802 - RNA, 19 nt, Homo sapiens
gcaccacugccuuaauuua

SEQ ID NO: 755803 - RNA, 19 nt, Homo sapiens
gaaugugaaugaagcuuug

SEQ ID NO: 755804 - RNA, 19 nt, Homo sapiens
agaaagaaaugaagaguag

SEQ ID NO: 755805 - RNA, 19 nt, Homo sapiens
cagcaccacugccuuaauu

SEQ ID NO: 755806 - RNA, 19 nt, Homo sapiens
gagcguagcuaugaauuag

SEQ ID NO: 755807 - RNA, 19 nt, Homo sapiens
ggaaagaaugugcuguuaa

SEQ ID NO: 755808 - RNA, 19 nt, Homo sapiens
uaaaggaaaucgaagagau

SEQ ID NO: 755809 - RNA, 19 nt, Homo sapiens
ccaauacccugaugacuca

SEQ ID NO: 755810 - RNA, 19 nt, Homo sapiens
gaaaugaagaguagcauca

SEQ ID NO: 755811 - RNA, 19 nt, Homo sapiens
gaaugcugccuuuauuaua

SEQ ID NO: 755812 - RNA, 19 nt, Homo sapiens
gacuagaaccuaucuuuaa

SEQ ID NO: 755813 - RNA, 19 nt, Homo sapiens
gaagcgagauggaauuaac

SEQ ID NO: 755814 - RNA, 19 nt, Homo sapiens
agaagugaaugaacuauug

SEQ ID NO: 755815 - RNA, 19 nt, Homo sapiens
gagagagcuuuaacugaaa

SEQ ID NO: 755816 - RNA, 19 nt, Homo sapiens
gagacuggcuucaggaugu

SEQ ID NO: 755817 - RNA, 19 nt, Homo sapiens
ugauauauguggcaugaaa

SEQ ID NO: 755818 - RNA, 19 nt, Homo sapiens
cagaggccaugaauauuaa

SEQ ID NO: 755819 - RNA, 19 nt, Homo sapiens
gcaggaacucugauacaua

SEQ ID NO: 755820 - RNA, 19 nt, Homo sapiens
cuacagcccucacuaacaa

SEQ ID NO: 755821 - RNA, 19 nt, Homo sapiens
cagggaaucuuaaauuugu

SEQ ID NO: 755822 - RNA, 19 nt, Homo sapiens
guaacucgccuucuguaua

SEQ ID NO: 755823 - RNA, 19 nt, Homo sapiens
ccuauucuguugccaauuu

SEQ ID NO: 755824 - RNA, 19 nt, Homo sapiens
ugaaugaacuauugaugga

SEQ ID NO: 755825 - RNA, 19 nt, Homo sapiens
gaagaaauucccagacaau

SEQ ID NO: 755826 - RNA, 19 nt, Homo sapiens
gaaacuuccuugguuguau

SEQ ID NO: 755827 - RNA, 19 nt, Homo sapiens
uaagaguaccuaucucaua

SEQ ID NO: 755828 - RNA, 19 nt, Homo sapiens
ccaauagucuccaucacuu

SEQ ID NO: 755829 - RNA, 19 nt, Homo sapiens
ugaaugagcuccggcaguu

SEQ ID NO: 755830 - RNA, 19 nt, Homo sapiens
aggcaaagaucaccaagaa

SEQ ID NO: 755831 - RNA, 19 nt, Homo sapiens
uaagagaaacuguccguaa

SEQ ID NO: 755832 - RNA, 19 nt, Homo sapiens
ggagacagccuaagguguu

SEQ ID NO: 755833 - RNA, 19 nt, Homo sapiens
ggacuuauuucagcuuaau

SEQ ID NO: 755834 - RNA, 19 nt, Homo sapiens
gcacauauuacugcugaua

SEQ ID NO: 755835 - RNA, 19 nt, Homo sapiens
gagaaagaaaugaagagua

SEQ ID NO: 755836 - RNA, 19 nt, Homo sapiens
ggaagaucuuggacuuauu

SEQ ID NO: 755837 - RNA, 19 nt, Homo sapiens
gaacagugccuaggauaug

SEQ ID NO: 755838 - RNA, 19 nt, Homo sapiens
ggaaugcugccuuuauuau

SEQ ID NO: 755839 - RNA, 19 nt, Homo sapiens
agcaauaacuucuauguug

SEQ ID NO: 755840 - RNA, 19 nt, Homo sapiens
caccagaaauuccaguaaa

SEQ ID NO: 755841 - RNA, 19 nt, Homo sapiens
gauggcagcugcaaucagu

SEQ ID NO: 755842 - RNA, 19 nt, Homo sapiens
gaagagacgccuggaaaga

SEQ ID NO: 755843 - RNA, 19 nt, Homo sapiens
gucagggaaucuuaaauuu

SEQ ID NO: 755844 - RNA, 19 nt, Homo sapiens
gcacagagcccagcaacug

SEQ ID NO: 755845 - RNA, 19 nt, Homo sapiens
gaagcucgccuaagggaaa

SEQ ID NO: 755846 - RNA, 19 nt, Homo sapiens
aagagaaacuguccguaaa

SEQ ID NO: 755847 - RNA, 19 nt, Homo sapiens
gcugauauauguggcauga

SEQ ID NO: 755848 - RNA, 19 nt, Homo sapiens
gaagggagcugugaaagug

SEQ ID NO: 755849 - RNA, 19 nt, Homo sapiens
gaaauaggcuccugguucu

SEQ ID NO: 755850 - RNA, 19 nt, Homo sapiens
gaagacacccuuuguggaa

SEQ ID NO: 755851 - RNA, 19 nt, Homo sapiens
ccaaggaguucguguacaa

SEQ ID NO: 755852 - RNA, 19 nt, Homo sapiens
aaauuuggcuccacuaaga

SEQ ID NO: 755853 - RNA, 19 nt, Homo sapiens
ugacauggcccagguauuu

SEQ ID NO: 755854 - RNA, 19 nt, Homo sapiens
ggagcugagugucuggauu

SEQ ID NO: 755855 - RNA, 19 nt, Homo sapiens
gagcugagugucuggauug

SEQ ID NO: 755856 - RNA, 19 nt, Homo sapiens
ggaaaggaccaugcagcua

SEQ ID NO: 755857 - RNA, 19 nt, Homo sapiens
gcuacaaccugaacaccau

SEQ ID NO: 755858 - RNA, 19 nt, Homo sapiens
gagguguccuaccagauug

SEQ ID NO: 755859 - RNA, 19 nt, Homo sapiens
ggagaagacacccuuugug

SEQ ID NO: 755860 - RNA, 19 nt, Homo sapiens
cacccagccucuucuuuga

SEQ ID NO: 755861 - RNA, 19 nt, Homo sapiens
ccaugcagcuagagaucaa

SEQ ID NO: 755862 - RNA, 19 nt, Homo sapiens
ccaccagcuuucugcauau

SEQ ID NO: 755863 - RNA, 19 nt, Homo sapiens
ugagguguccuaccagauu

SEQ ID NO: 755864 - RNA, 19 nt, Homo sapiens
caucaucuccuacuuguac

SEQ ID NO: 755865 - RNA, 19 nt, Homo sapiens
cugauucucugccuaggaa

SEQ ID NO: 755866 - RNA, 19 nt, Homo sapiens
gagccucucucugucuaug

SEQ ID NO: 755867 - RNA, 19 nt, Homo sapiens
gcacccaagaccacagaaa

SEQ ID NO: 755868 - RNA, 19 nt, Homo sapiens
ucacccagccucuucuuug

SEQ ID NO: 755869 - RNA, 19 nt, Homo sapiens
ugagaagggagcugugaaa

SEQ ID NO: 755870 - RNA, 19 nt, Homo sapiens
aaaggaccaugcagcuaga

SEQ ID NO: 755871 - RNA, 19 nt, Homo sapiens
accaccagcuuucugcaua

SEQ ID NO: 755872 - RNA, 19 nt, Homo sapiens
gcagcuagagaucaaagug

SEQ ID NO: 755873 - RNA, 19 nt, Homo sapiens
ucccagcucucacccaaug

SEQ ID NO: 755874 - RNA, 19 nt, Homo sapiens
ucacggugccucucauuuc

SEQ ID NO: 755875 - RNA, 19 nt, Homo sapiens
uggaaggccucagcuacaa

SEQ ID NO: 755876 - RNA, 19 nt, Homo sapiens
gaaagugcuguaccuggau

SEQ ID NO: 755877 - RNA, 19 nt, Homo sapiens
cuccuucgcugccaccaaa

SEQ ID NO: 755878 - RNA, 19 nt, Homo sapiens
gaucaaaguggcccugaac

SEQ ID NO: 755879 - RNA, 19 nt, Homo sapiens
cugagugucuggauugauc

SEQ ID NO: 755880 - RNA, 19 nt, Homo sapiens
gcucagcccaucaccuuca

SEQ ID NO: 755881 - RNA, 19 nt, Homo sapiens
aauaugaaggccacuggua

SEQ ID NO: 755882 - RNA, 19 nt, Homo sapiens
caccagcuuucugcauauu

SEQ ID NO: 755883 - RNA, 19 nt, Homo sapiens
caaauuuggcuccacuaag

SEQ ID NO: 755884 - RNA, 19 nt, Homo sapiens
ggaccaugcagcuagagau

SEQ ID NO: 755885 - RNA, 19 nt, Homo sapiens
acccagcccuaccuucauu

SEQ ID NO: 755886 - RNA, 19 nt, Homo sapiens
gagcacccaagaccacaga

SEQ ID NO: 755887 - RNA, 19 nt, Homo sapiens
cccagccucuucuuugaug

SEQ ID NO: 755888 - RNA, 19 nt, Homo sapiens
ucacccagcccuaccuuca

SEQ ID NO: 755889 - RNA, 19 nt, Homo sapiens
gcuccacuaagaugaagaa

SEQ ID NO: 755890 - RNA, 19 nt, Homo sapiens
gagaucaagagcagcuuca

SEQ ID NO: 755891 - RNA, 19 nt, Homo sapiens
cacgugcccugugcugauu

SEQ ID NO: 755892 - RNA, 19 nt, Homo sapiens
gaggagcuagagcggcuuu

SEQ ID NO: 755893 - RNA, 19 nt, Homo sapiens
ccagcuuucugcauauuuu

SEQ ID NO: 755894 - RNA, 19 nt, Homo sapiens
gagcugugaaagugcugua

SEQ ID NO: 755895 - RNA, 19 nt, Homo sapiens
gagaagggagcugugaaag

SEQ ID NO: 755896 - RNA, 19 nt, Homo sapiens
ggugagaagggagcuguga

SEQ ID NO: 755897 - RNA, 19 nt, Homo sapiens
ccgcucagcccaucaccuu

SEQ ID NO: 755898 - RNA, 19 nt, Homo sapiens
gaucaagagcagcuucaac

SEQ ID NO: 755899 - RNA, 19 nt, Homo sapiens
guggaaggccucagcuaca

SEQ ID NO: 755900 - RNA, 19 nt, Homo sapiens
gacauggcccagguauuug

SEQ ID NO: 755901 - RNA, 19 nt, Homo sapiens
gaccaugcagcuagagauc

SEQ ID NO: 755902 - RNA, 19 nt, Homo sapiens
ccuuugagguguccuacca

SEQ ID NO: 755903 - RNA, 19 nt, Homo sapiens
ggcccacagucagacauga

SEQ ID NO: 755904 - RNA, 19 nt, Homo sapiens
ccacugguacccugagaag

SEQ ID NO: 755905 - RNA, 19 nt, Homo sapiens
cuggccaacugaccaucua

SEQ ID NO: 755906 - RNA, 19 nt, Homo sapiens
ugaacaccaugcaguaucc

SEQ ID NO: 755907 - RNA, 19 nt, Homo sapiens
agaagggagcugugaaagu

SEQ ID NO: 755908 - RNA, 19 nt, Homo sapiens
ggccacugguacccugaga

SEQ ID NO: 755909 - RNA, 19 nt, Homo sapiens
gcaaggagcuuuagaguag

SEQ ID NO: 755910 - RNA, 19 nt, Homo sapiens
gaacacacuugguauauug

SEQ ID NO: 755911 - RNA, 19 nt, Homo sapiens
gaaaugaacucuacuucug

SEQ ID NO: 755912 - RNA, 19 nt, Homo sapiens
gagcacauguagcuaauuu

SEQ ID NO: 755913 - RNA, 19 nt, Homo sapiens
gaaaggaguggugauauua

SEQ ID NO: 755914 - RNA, 19 nt, Homo sapiens
gaaaucaggaguagcaaua

SEQ ID NO: 755915 - RNA, 19 nt, Homo sapiens
gcucacaccuguaaucaaa

SEQ ID NO: 755916 - RNA, 19 nt, Homo sapiens
ggaugaaacuggcgaagaa

SEQ ID NO: 755917 - RNA, 19 nt, Homo sapiens
gaccaugucucuacagaaa

SEQ ID NO: 755918 - RNA, 19 nt, Homo sapiens
ugaaauagcuaaccucugu

SEQ ID NO: 755919 - RNA, 19 nt, Homo sapiens
ggaagcagcuacucaacuu

SEQ ID NO: 755920 - RNA, 19 nt, Homo sapiens
gcaguuaaccucuaggaua

SEQ ID NO: 755921 - RNA, 19 nt, Homo sapiens
gcaacuggguaucuuaauu

SEQ ID NO: 755922 - RNA, 19 nt, Homo sapiens
agaaacaucucaucauuga

SEQ ID NO: 755923 - RNA, 19 nt, Homo sapiens
gaagcaaacuaugggauuu

SEQ ID NO: 755924 - RNA, 19 nt, Homo sapiens
gggcauaguuacaauuauu

SEQ ID NO: 755925 - RNA, 19 nt, Homo sapiens
caaagaaacuaagucugua

SEQ ID NO: 755926 - RNA, 19 nt, Homo sapiens
gcaaagaaacuaagucugu

SEQ ID NO: 755927 - RNA, 19 nt, Homo sapiens
gucaacagcugcucaguuu

SEQ ID NO: 755928 - RNA, 19 nt, Homo sapiens
ggacaaagaauuuaaagca

SEQ ID NO: 755929 - RNA, 19 nt, Homo sapiens
gaaaccacaaccaaaguua

SEQ ID NO: 755930 - RNA, 19 nt, Homo sapiens
cuagaaacaucucaucauu

SEQ ID NO: 755931 - RNA, 19 nt, Homo sapiens
gaacauaagcaauaacauc

SEQ ID NO: 755932 - RNA, 19 nt, Homo sapiens
gcaaagaaagucuaauguu

SEQ ID NO: 755933 - RNA, 19 nt, Homo sapiens
ggacuuaaauagcaaagca

SEQ ID NO: 755934 - RNA, 19 nt, Homo sapiens
caguuaaccucuaggauaa

SEQ ID NO: 755935 - RNA, 19 nt, Homo sapiens
ggaaggcucgaguugauua

SEQ ID NO: 755936 - RNA, 19 nt, Homo sapiens
ggagguucaugcuacguua

SEQ ID NO: 755937 - RNA, 19 nt, Homo sapiens
gaagaaagggcacagaugu

SEQ ID NO: 755938 - RNA, 19 nt, Homo sapiens
ugaaaggaguggugauauu

SEQ ID NO: 755939 - RNA, 19 nt, Homo sapiens
ugacagaaaucuaacuuca

SEQ ID NO: 755940 - RNA, 19 nt, Homo sapiens
caaguaggcccaauacaaa

SEQ ID NO: 755941 - RNA, 19 nt, Homo sapiens
acacaaagcauguagcuaa

SEQ ID NO: 755942 - RNA, 19 nt, Homo sapiens
gauccaauuucaucucauu

SEQ ID NO: 755943 - RNA, 19 nt, Homo sapiens
ggacuucauuccaaauaug

SEQ ID NO: 755944 - RNA, 19 nt, Homo sapiens
gcauguagcuaacaguugu

SEQ ID NO: 755945 - RNA, 19 nt, Homo sapiens
gcuaaccucuguuucaaga

SEQ ID NO: 755946 - RNA, 19 nt, Homo sapiens
gagaugcugugccagauga

SEQ ID NO: 755947 - RNA, 19 nt, Homo sapiens
gaucaccagggcauaauua

SEQ ID NO: 755948 - RNA, 19 nt, Homo sapiens
gaugauugauugugguuga

SEQ ID NO: 755949 - RNA, 19 nt, Homo sapiens
gaaauucagggugcuguua

SEQ ID NO: 755950 - RNA, 19 nt, Homo sapiens
ggauguagcuguuuuaguu

SEQ ID NO: 755951 - RNA, 19 nt, Homo sapiens
cauaaggacuucauuccaa

SEQ ID NO: 755952 - RNA, 19 nt, Homo sapiens
gcaacaguaucuacaggaa

SEQ ID NO: 755953 - RNA, 19 nt, Homo sapiens
caacuggguaucuuaauuu

SEQ ID NO: 755954 - RNA, 19 nt, Homo sapiens
ggaaauggauugggguuua

SEQ ID NO: 755955 - RNA, 19 nt, Homo sapiens
gagaccagcuaaggcaaua

SEQ ID NO: 755956 - RNA, 19 nt, Homo sapiens
ucaagugacugaagcagaa

SEQ ID NO: 755957 - RNA, 19 nt, Homo sapiens
guaggcagauuauacaugu

SEQ ID NO: 755958 - RNA, 19 nt, Homo sapiens
guaaguaagagucauguuu

SEQ ID NO: 755959 - RNA, 19 nt, Homo sapiens
aauagaagcugguuauauc

SEQ ID NO: 755960 - RNA, 19 nt, Homo sapiens
gauaugaaauagggaaaga

SEQ ID NO: 755961 - RNA, 19 nt, Homo sapiens
agaagagguuggcuguuua

SEQ ID NO: 755962 - RNA, 19 nt, Homo sapiens
gaggguaggugaugguaga

SEQ ID NO: 755963 - RNA, 19 nt, Homo sapiens
guuaugcucugauuuccua

SEQ ID NO: 755964 - RNA, 19 nt, Homo sapiens
guauaucgauggcuuaaca

SEQ ID NO: 755965 - RNA, 19 nt, Homo sapiens
uaugauggcccuuucuuua

SEQ ID NO: 755966 - RNA, 19 nt, Homo sapiens
uacaauagcugcugguguu

SEQ ID NO: 755967 - RNA, 19 nt, Homo sapiens
aagaagagguuggcuguuu

SEQ ID NO: 755968 - RNA, 19 nt, Homo sapiens
caccagggcauaauuauaa

SEQ ID NO: 755969 - RNA, 19 nt, Homo sapiens
ccacuaacaguaaauauga

SEQ ID NO: 755970 - RNA, 19 nt, Homo sapiens
gcccgaauccucaucuuua

SEQ ID NO: 755971 - RNA, 19 nt, Homo sapiens
ggucauagaggacuuaaau

SEQ ID NO: 755972 - RNA, 19 nt, Homo sapiens
ggaaccaugauuugaauuu

SEQ ID NO: 755973 - RNA, 19 nt, Homo sapiens
ggacaggguaucauaaaga

SEQ ID NO: 755974 - RNA, 19 nt, Homo sapiens
cgaauccucaucuuuaaua

SEQ ID NO: 755975 - RNA, 19 nt, Homo sapiens
aaacuugggcacuuucuua

SEQ ID NO: 755976 - RNA, 19 nt, Homo sapiens
cgaagugaaucugaaauug

SEQ ID NO: 755977 - RNA, 19 nt, Homo sapiens
ugugccagaugaaauauua

SEQ ID NO: 755978 - RNA, 19 nt, Homo sapiens
ugacaaaccuuccguugag

SEQ ID NO: 755979 - RNA, 19 nt, Homo sapiens
cugcaaagcuaaugauaug

SEQ ID NO: 755980 - RNA, 19 nt, Homo sapiens
ggaaagaagcaaacuaugg

SEQ ID NO: 755981 - RNA, 19 nt, Homo sapiens
ugaaugacauaacugagaa

SEQ ID NO: 755982 - RNA, 19 nt, Homo sapiens
ggauuuacuuugcuaagau

SEQ ID NO: 755983 - RNA, 19 nt, Homo sapiens
aaacaacuuugccuuugaa

SEQ ID NO: 755984 - RNA, 19 nt, Homo sapiens
gaaugcaguuauuaaguca

SEQ ID NO: 755985 - RNA, 19 nt, Homo sapiens
ccagcgaucuauugacaaa

SEQ ID NO: 755986 - RNA, 19 nt, Homo sapiens
caagauagagugcagaguu

SEQ ID NO: 755987 - RNA, 19 nt, Homo sapiens
ugaucaagcucgucuuuau

SEQ ID NO: 755988 - RNA, 19 nt, Homo sapiens
ccauaaagggacuacauua

SEQ ID NO: 755989 - RNA, 19 nt, Homo sapiens
gguaacugcugccaauguu

SEQ ID NO: 755990 - RNA, 19 nt, Homo sapiens
cauccacucuguauauuau

SEQ ID NO: 755991 - RNA, 19 nt, Homo sapiens
cuggaacucugaucugaua

SEQ ID NO: 755992 - RNA, 19 nt, Homo sapiens
uuacggugguucuacaaua

SEQ ID NO: 755993 - RNA, 19 nt, Homo sapiens
caacagcugcucaguuuau

SEQ ID NO: 755994 - RNA, 19 nt, Homo sapiens
gaagcugguuauauccaaa

SEQ ID NO: 755995 - RNA, 19 nt, Homo sapiens
caagaucucagucaaguga

SEQ ID NO: 755996 - RNA, 19 nt, Homo sapiens
cagcugcucaguuuauuua

SEQ ID NO: 755997 - RNA, 19 nt, Homo sapiens
gaagugaaucugaaauugu

SEQ ID NO: 755998 - RNA, 19 nt, Homo sapiens
aaagguaacugcugccaau

SEQ ID NO: 755999 - RNA, 19 nt, Homo sapiens
gaaaccauccacucuguau

SEQ ID NO: 756000 - RNA, 19 nt, Homo sapiens
gcagcaggcgaucauguua

SEQ ID NO: 756001 - RNA, 19 nt, Homo sapiens
gcaugggucuuggaugaaa

SEQ ID NO: 756002 - RNA, 19 nt, Homo sapiens
ggacaagaaugaggcaaca

SEQ ID NO: 756003 - RNA, 19 nt, Homo sapiens
ucauagcucugccuuauag

SEQ ID NO: 756004 - RNA, 19 nt, Homo sapiens
uauuaacacuggacaaaga

SEQ ID NO: 756005 - RNA, 19 nt, Homo sapiens
gagguuggcuguuuauggu

SEQ ID NO: 756006 - RNA, 19 nt, Homo sapiens
cagauucacugaguuaaga

SEQ ID NO: 756007 - RNA, 19 nt, Homo sapiens
gcaauaacaucuguauggu

SEQ ID NO: 756008 - RNA, 19 nt, Homo sapiens
ugaagauacugaaucauca

SEQ ID NO: 756009 - RNA, 19 nt, Homo sapiens
gcaagucgaugucguaaua

SEQ ID NO: 756010 - RNA, 19 nt, Homo sapiens
gagcauggcuuguuaagau

SEQ ID NO: 756011 - RNA, 19 nt, Homo sapiens
uuacagagcugacagauga

SEQ ID NO: 756012 - RNA, 19 nt, Homo sapiens
gcacuuggaucgcaugaaa

SEQ ID NO: 756013 - RNA, 19 nt, Homo sapiens
ucagagauguguauaauga

SEQ ID NO: 756014 - RNA, 19 nt, Homo sapiens
gaacgucaaugauucuguu

SEQ ID NO: 756015 - RNA, 19 nt, Homo sapiens
ccacuuggauuuauaguau

SEQ ID NO: 756016 - RNA, 19 nt, Homo sapiens
gaaaauggaugaauacguu

SEQ ID NO: 756017 - RNA, 19 nt, Homo sapiens
ggaacaaucugcaaugucu

SEQ ID NO: 756018 - RNA, 19 nt, Homo sapiens
ccaccagacuugcucauuu

SEQ ID NO: 756019 - RNA, 19 nt, Homo sapiens
uaaugagcauggcuuguua

SEQ ID NO: 756020 - RNA, 19 nt, Homo sapiens
gaaaggugauucuucucuu

SEQ ID NO: 756021 - RNA, 19 nt, Homo sapiens
guaauaacuugcacaggaa

SEQ ID NO: 756022 - RNA, 19 nt, Homo sapiens
agacagcgguguugauuga

SEQ ID NO: 756023 - RNA, 19 nt, Homo sapiens
guacuugcuuccuaagaaa

SEQ ID NO: 756024 - RNA, 19 nt, Homo sapiens
gaaccacacacucuaaaga

SEQ ID NO: 756025 - RNA, 19 nt, Homo sapiens
gcacaggaaauaagaaugu

SEQ ID NO: 756026 - RNA, 19 nt, Homo sapiens
guucagagauguguauaau

SEQ ID NO: 756027 - RNA, 19 nt, Homo sapiens
cacacacucuaaagaaaua

SEQ ID NO: 756028 - RNA, 19 nt, Homo sapiens
gauguguacuugcuuccua

SEQ ID NO: 756029 - RNA, 19 nt, Homo sapiens
cuucauggcucuuuagaug

SEQ ID NO: 756030 - RNA, 19 nt, Homo sapiens
cacaggaacuugcuucaug

SEQ ID NO: 756031 - RNA, 19 nt, Homo sapiens
ggagcaauugucuacauua

SEQ ID NO: 756032 - RNA, 19 nt, Homo sapiens
gcccuuggcuggugcuaaa

SEQ ID NO: 756033 - RNA, 19 nt, Homo sapiens
gagagaagcagcaaaccaa

SEQ ID NO: 756034 - RNA, 19 nt, Homo sapiens
gaaguuccaagcccuguuu

SEQ ID NO: 756035 - RNA, 19 nt, Homo sapiens
ccaguuugcugaugacaug

SEQ ID NO: 756036 - RNA, 19 nt, Homo sapiens
caaugauucuguuaccaaa

SEQ ID NO: 756037 - RNA, 19 nt, Homo sapiens
ggaaauaagaauguaguga

SEQ ID NO: 756038 - RNA, 19 nt, Homo sapiens
gaugacuucugguggugua

SEQ ID NO: 756039 - RNA, 19 nt, Homo sapiens
gcuugcaucugccaucauu

SEQ ID NO: 756040 - RNA, 19 nt, Homo sapiens
gagcaauugucuacauuac

SEQ ID NO: 756041 - RNA, 19 nt, Homo sapiens
gcugacagaugaccaagca

SEQ ID NO: 756042 - RNA, 19 nt, Homo sapiens
ccaugaacgucaaugauuc

SEQ ID NO: 756043 - RNA, 19 nt, Homo sapiens
ccaagaagcaaauccaguu

SEQ ID NO: 756044 - RNA, 19 nt, Homo sapiens
aacaggaaaugcuaaggua

SEQ ID NO: 756045 - RNA, 19 nt, Homo sapiens
ccacuggguuuauaagaag

SEQ ID NO: 756046 - RNA, 19 nt, Homo sapiens
caucaagcaggcagaauuu

SEQ ID NO: 756047 - RNA, 19 nt, Homo sapiens
cauguuaauuucccuuaga

SEQ ID NO: 756048 - RNA, 19 nt, Homo sapiens
cuacucaacucagaaugaa

SEQ ID NO: 756049 - RNA, 19 nt, Homo sapiens
gguggugcauguuaauuuc

SEQ ID NO: 756050 - RNA, 19 nt, Homo sapiens
gaacaucaagcaggcagaa

SEQ ID NO: 756051 - RNA, 19 nt, Homo sapiens
gccaugaacgucaaugauu

SEQ ID NO: 756052 - RNA, 19 nt, Homo sapiens
gaagggcgagucagaagau

SEQ ID NO: 756053 - RNA, 19 nt, Homo sapiens
ugcaggaguucaccaaauu

SEQ ID NO: 756054 - RNA, 19 nt, Homo sapiens
uaauuucccuuagaaguuc

SEQ ID NO: 756055 - RNA, 19 nt, Homo sapiens
gcagagggucgucuacuca

SEQ ID NO: 756056 - RNA, 19 nt, Homo sapiens
guucucagguggaccaugu

SEQ ID NO: 756057 - RNA, 19 nt, Homo sapiens
caagaagcaaauccaguuu

SEQ ID NO: 756058 - RNA, 19 nt, Homo sapiens
agacuacacucuauuugag

SEQ ID NO: 756059 - RNA, 19 nt, Homo sapiens
uuagguaccuuauuaacag

SEQ ID NO: 756060 - RNA, 19 nt, Homo sapiens
ugacagaugaccaagcaaa

SEQ ID NO: 756061 - RNA, 19 nt, Homo sapiens
uaacuugcacaggaaauaa

SEQ ID NO: 756062 - RNA, 19 nt, Homo sapiens
cagagaagcagggauggua

SEQ ID NO: 756063 - RNA, 19 nt, Homo sapiens
gaacaaucugcaaugucua

SEQ ID NO: 756064 - RNA, 19 nt, Homo sapiens
caaaauaucugggacucaa

SEQ ID NO: 756065 - RNA, 19 nt, Homo sapiens
uguacuugcuuccuaagaa

SEQ ID NO: 756066 - RNA, 19 nt, Homo sapiens
ccagauggcaaacgaguug

SEQ ID NO: 756067 - RNA, 19 nt, Homo sapiens
aaucugcaaugucuaaauc

SEQ ID NO: 756068 - RNA, 19 nt, Homo sapiens
cacaggaaauaagaaugua

SEQ ID NO: 756069 - RNA, 19 nt, Homo sapiens
gaagauccgaggcauugug

SEQ ID NO: 756070 - RNA, 19 nt, Homo sapiens
gcugcauccuacacagaua

SEQ ID NO: 756071 - RNA, 19 nt, Homo sapiens
ggaggcccacuuggauuua

SEQ ID NO: 756072 - RNA, 19 nt, Homo sapiens
gagggucgucuacucaauu

SEQ ID NO: 756073 - RNA, 19 nt, Homo sapiens
ugguaaagcuaaaugaagu

SEQ ID NO: 756074 - RNA, 19 nt, Homo sapiens
ccucuaggauuuauuucug

SEQ ID NO: 756075 - RNA, 19 nt, Homo sapiens
cugcugugcugcucucaaa

SEQ ID NO: 756076 - RNA, 19 nt, Homo sapiens
gauccgaggcauuguggaa

SEQ ID NO: 756077 - RNA, 19 nt, Homo sapiens
ccacacacucuaaagaaau

SEQ ID NO: 756078 - RNA, 19 nt, Homo sapiens
ggaagggcgagucagaaga

SEQ ID NO: 756079 - RNA, 19 nt, Homo sapiens
ccagacagcgguguugauu

SEQ ID NO: 756080 - RNA, 19 nt, Homo sapiens
gcauguuaauuucccuuag

SEQ ID NO: 756081 - RNA, 19 nt, Homo sapiens
ggguggugcauguuaauuu

SEQ ID NO: 756082 - RNA, 19 nt, Homo sapiens
cugaugacaugcaggaguu

SEQ ID NO: 756083 - RNA, 19 nt, Homo sapiens
ggccauucaaaccuaauua

SEQ ID NO: 756084 - RNA, 19 nt, Homo sapiens
ccacaguucccaccuuugu

SEQ ID NO: 756085 - RNA, 19 nt, Homo sapiens
aaauccaguuugcugauga

SEQ ID NO: 756086 - RNA, 19 nt, Homo sapiens
uauaagaaguauccaaacg

SEQ ID NO: 756087 - RNA, 19 nt, Homo sapiens
gcagcaauuucugugugaa

SEQ ID NO: 756088 - RNA, 19 nt, Homo sapiens
ugaagaggaccacagaugu

SEQ ID NO: 756089 - RNA, 19 nt, Homo sapiens
aagaagauccgaggcauug

SEQ ID NO: 756090 - RNA, 19 nt, Homo sapiens
auagugggcuguacacaca

SEQ ID NO: 756091 - RNA, 19 nt, Homo sapiens
acaguuguaucguaugcaa

SEQ ID NO: 756092 - RNA, 19 nt, Homo sapiens
gaaacaagugguggugugu

SEQ ID NO: 756093 - RNA, 19 nt, Homo sapiens
guggaacaaucugcaaugu

SEQ ID NO: 756094 - RNA, 19 nt, Homo sapiens
ggugguaaagcuaaaugaa

SEQ ID NO: 756095 - RNA, 19 nt, Homo sapiens
uggagcaauugucuacauu

SEQ ID NO: 756096 - RNA, 19 nt, Homo sapiens
ucaaugauucuguuaccaa

SEQ ID NO: 756097 - RNA, 19 nt, Homo sapiens
uguaucagcucuccaaagc

SEQ ID NO: 756098 - RNA, 19 nt, Homo sapiens
agaaguauccaaacguguu

SEQ ID NO: 756099 - RNA, 19 nt, Homo sapiens
ucgaggacgccgagaagua

SEQ ID NO: 756100 - RNA, 19 nt, Homo sapiens
uaacaggaaaugcuaaggu

SEQ ID NO: 756101 - RNA, 19 nt, Homo sapiens
aaggugauucuucucuuua

SEQ ID NO: 756102 - RNA, 19 nt, Homo sapiens
acacaggcuuuggcacuga

SEQ ID NO: 756103 - RNA, 19 nt, Homo sapiens
aaacaguuguaucguaugc

SEQ ID NO: 756104 - RNA, 19 nt, Homo sapiens
gacuucuggugguguauug

SEQ ID NO: 756105 - RNA, 19 nt, Homo sapiens
caccaaaacuggccgaaga

SEQ ID NO: 756106 - RNA, 19 nt, Homo sapiens
gaggcccacuuggauuuau

SEQ ID NO: 756107 - RNA, 19 nt, Homo sapiens
caaugucuaaaucgccuua

SEQ ID NO: 756108 - RNA, 19 nt, Homo sapiens
gcaauaugggccacuccaa

SEQ ID NO: 756109 - RNA, 19 nt, Homo sapiens
gcacagagaucucaaacua

SEQ ID NO: 756110 - RNA, 19 nt, Homo sapiens
gaagacaucuacaagcuua

SEQ ID NO: 756111 - RNA, 19 nt, Homo sapiens
gcagaaaggugcauugauu

SEQ ID NO: 756112 - RNA, 19 nt, Homo sapiens
caagaaagguguugacaga

SEQ ID NO: 756113 - RNA, 19 nt, Homo sapiens
ccaaagagcaguauuuauu

SEQ ID NO: 756114 - RNA, 19 nt, Homo sapiens
gcauacaguucuugacuuu

SEQ ID NO: 756115 - RNA, 19 nt, Homo sapiens
gaaauaccuucaugaacaa

SEQ ID NO: 756116 - RNA, 19 nt, Homo sapiens
gugcauuccuuguuaauaa

SEQ ID NO: 756117 - RNA, 19 nt, Homo sapiens
gaaggucaauggcucauau

SEQ ID NO: 756118 - RNA, 19 nt, Homo sapiens
ccggagaucucgcggauua

SEQ ID NO: 756119 - RNA, 19 nt, Homo sapiens
aaaggugcauugauucuua

SEQ ID NO: 756120 - RNA, 19 nt, Homo sapiens
ggagaucugccuaguguua

SEQ ID NO: 756121 - RNA, 19 nt, Homo sapiens
aaauagagcuucacagaau

SEQ ID NO: 756122 - RNA, 19 nt, Homo sapiens
caagauauauugacacaca

SEQ ID NO: 756123 - RNA, 19 nt, Homo sapiens
gcacuuaauugcuaguaug

SEQ ID NO: 756124 - RNA, 19 nt, Homo sapiens
guuacgagaugacagauuu

SEQ ID NO: 756125 - RNA, 19 nt, Homo sapiens
caacaauggugcucacaug

SEQ ID NO: 756126 - RNA, 19 nt, Homo sapiens
gaaauagagcuucacagaa

SEQ ID NO: 756127 - RNA, 19 nt, Homo sapiens
agaaugaucuagaguaugu

SEQ ID NO: 756128 - RNA, 19 nt, Homo sapiens
cuacaaaucucaaagaaac

SEQ ID NO: 756129 - RNA, 19 nt, Homo sapiens
gaagcucccauguuguuua

SEQ ID NO: 756130 - RNA, 19 nt, Homo sapiens
ugaagaagauggacaugug

SEQ ID NO: 756131 - RNA, 19 nt, Homo sapiens
gauugugucuggacugaaa

SEQ ID NO: 756132 - RNA, 19 nt, Homo sapiens
gaagcaagguauacaaugc

SEQ ID NO: 756133 - RNA, 19 nt, Homo sapiens
gggaaaagauugacaaaga

SEQ ID NO: 756134 - RNA, 19 nt, Homo sapiens
ccaaauggguugauuacuc

SEQ ID NO: 756135 - RNA, 19 nt, Homo sapiens
gccggaagcugauugcauu

SEQ ID NO: 756136 - RNA, 19 nt, Homo sapiens
gaacacagaaggagaacga

SEQ ID NO: 756137 - RNA, 19 nt, Homo sapiens
gcaaacacaggacagauga

SEQ ID NO: 756138 - RNA, 19 nt, Homo sapiens
uagaguauguugaagaaga

SEQ ID NO: 756139 - RNA, 19 nt, Homo sapiens
ugacggugcugaaauacuu

SEQ ID NO: 756140 - RNA, 19 nt, Homo sapiens
caaauggguugauuacucu

SEQ ID NO: 756141 - RNA, 19 nt, Homo sapiens
ggacauggcugugaaucag

SEQ ID NO: 756142 - RNA, 19 nt, Homo sapiens
guggagaucugccuagugu

SEQ ID NO: 756143 - RNA, 19 nt, Homo sapiens
gcuuaggcaugauuugaaa

SEQ ID NO: 756144 - RNA, 19 nt, Homo sapiens
ucuucuagcuguugucaua

SEQ ID NO: 756145 - RNA, 19 nt, Homo sapiens
ggaaaagauugacaaagaa

SEQ ID NO: 756146 - RNA, 19 nt, Homo sapiens
gcccaaagagcaguauuua

SEQ ID NO: 756147 - RNA, 19 nt, Homo sapiens
gaacccagaaccaggcuaa

SEQ ID NO: 756148 - RNA, 19 nt, Homo sapiens
aaaagugcauuccuuguua

SEQ ID NO: 756149 - RNA, 19 nt, Homo sapiens
gcugaugucuggcuguuca

SEQ ID NO: 756150 - RNA, 19 nt, Homo sapiens
gacaaagcaagauauauug

SEQ ID NO: 756151 - RNA, 19 nt, Homo sapiens
gaaccaggcuaaggcauac

SEQ ID NO: 756152 - RNA, 19 nt, Homo sapiens
uaggauaucuacaacuuuc

SEQ ID NO: 756153 - RNA, 19 nt, Homo sapiens
acaaagaaauagagcuuca

SEQ ID NO: 756154 - RNA, 19 nt, Homo sapiens
uuaaaccguuggcaauaaa

SEQ ID NO: 756155 - RNA, 19 nt, Homo sapiens
uuuaaaggcuguaauugga

SEQ ID NO: 756156 - RNA, 19 nt, Homo sapiens
cuaaugaugcucuuuaaug

SEQ ID NO: 756157 - RNA, 19 nt, Homo sapiens
gucauacaguuccagauuu

SEQ ID NO: 756158 - RNA, 19 nt, Homo sapiens
aaagugcauuccuuguuaa

SEQ ID NO: 756159 - RNA, 19 nt, Homo sapiens
acaaagauguaacugaaag

SEQ ID NO: 756160 - RNA, 19 nt, Homo sapiens
aagugacggugcugaaaua

SEQ ID NO: 756161 - RNA, 19 nt, Homo sapiens
cagaggaucgucccaguuu

SEQ ID NO: 756162 - RNA, 19 nt, Homo sapiens
agaaauagagcuucacaga

SEQ ID NO: 756163 - RNA, 19 nt, Homo sapiens
gacauguggugguacgaaa

SEQ ID NO: 756164 - RNA, 19 nt, Homo sapiens
gcaauuuauuagucaagug

SEQ ID NO: 756165 - RNA, 19 nt, Homo sapiens
cuuaauugcuaguauguug

SEQ ID NO: 756166 - RNA, 19 nt, Homo sapiens
ucacagaauucuucaucau

SEQ ID NO: 756167 - RNA, 19 nt, Homo sapiens
agauguaacugaaagacuu

SEQ ID NO: 756168 - RNA, 19 nt, Homo sapiens
ucuacaagcuuaggcauga

SEQ ID NO: 756169 - RNA, 19 nt, Homo sapiens
gauacuaccucaggcagau

SEQ ID NO: 756170 - RNA, 19 nt, Homo sapiens
ucuagaguauguugaagaa

SEQ ID NO: 756171 - RNA, 19 nt, Homo sapiens
gcugacaacucugcugaug

SEQ ID NO: 756172 - RNA, 19 nt, Homo sapiens
cagcugagcacaucauuuc

SEQ ID NO: 756173 - RNA, 19 nt, Homo sapiens
ggaagcaagguauacaaug

SEQ ID NO: 756174 - RNA, 19 nt, Homo sapiens
acaaggacauggcugugaa

SEQ ID NO: 756175 - RNA, 19 nt, Homo sapiens
gagcuucacagaauucuuc

SEQ ID NO: 756176 - RNA, 19 nt, Homo sapiens
gcuaaggcauacaguucuu

SEQ ID NO: 756177 - RNA, 19 nt, Homo sapiens
ggaauaugcccugaacaug

SEQ ID NO: 756178 - RNA, 19 nt, Homo sapiens
gagccuccuuccagacaaa

SEQ ID NO: 756179 - RNA, 19 nt, Homo sapiens
gcuaguauguuguccaaaa

SEQ ID NO: 756180 - RNA, 19 nt, Homo sapiens
guagcuaaaccucaucaaa

SEQ ID NO: 756181 - RNA, 19 nt, Homo sapiens
gcccuaaugaugcucuuua

SEQ ID NO: 756182 - RNA, 19 nt, Homo sapiens
cagaguagcuaaaccucau

SEQ ID NO: 756183 - RNA, 19 nt, Homo sapiens
cuuaaauucucucuguuga

SEQ ID NO: 756184 - RNA, 19 nt, Homo sapiens
ucauacaguuccagauuuc

SEQ ID NO: 756185 - RNA, 19 nt, Homo sapiens
cacagaauucuucaucaua

SEQ ID NO: 756186 - RNA, 19 nt, Homo sapiens
uuuaaaccguuggcaauaa

SEQ ID NO: 756187 - RNA, 19 nt, Homo sapiens
ccagaggacuuuggaacug

SEQ ID NO: 756188 - RNA, 19 nt, Homo sapiens
gaaaggugcauugauucuu

SEQ ID NO: 756189 - RNA, 19 nt, Homo sapiens
ugaacaugcucuuacaaag

SEQ ID NO: 756190 - RNA, 19 nt, Homo sapiens
ugauaaggcccuaaugaug

SEQ ID NO: 756191 - RNA, 19 nt, Homo sapiens
acgcagagcuuggccaaug

SEQ ID NO: 756192 - RNA, 19 nt, Homo sapiens
ucaccaaauggguugauua

SEQ ID NO: 756193 - RNA, 19 nt, Homo sapiens
gcauaagggaagcaaggua

SEQ ID NO: 756194 - RNA, 19 nt, Homo sapiens
gccagaaguucgauacuac

SEQ ID NO: 756195 - RNA, 19 nt, Homo sapiens
gaaaagugcauuccuuguu

SEQ ID NO: 756196 - RNA, 19 nt, Homo sapiens
gcucccauguuguuuaaag

SEQ ID NO: 756197 - RNA, 19 nt, Homo sapiens
aagcucccauguuguuuaa

SEQ ID NO: 756198 - RNA, 19 nt, Homo sapiens
ccucauggaugguggagau

SEQ ID NO: 756199 - RNA, 19 nt, Homo sapiens
gggcuucacuccggacaga

SEQ ID NO: 756200 - RNA, 19 nt, Homo sapiens
uaaugaagccauggaacua

SEQ ID NO: 756201 - RNA, 19 nt, Homo sapiens
gucaauggcucauauuuug

SEQ ID NO: 756202 - RNA, 19 nt, Homo sapiens
cuuuggaacugugaauaua

SEQ ID NO: 756203 - RNA, 19 nt, Homo sapiens
gaaccagaaugcaguuuuc

SEQ ID NO: 756204 - RNA, 19 nt, Homo sapiens
guucuugacuuuggacaau

SEQ ID NO: 756205 - RNA, 19 nt, Homo sapiens
caucaaugaggauaggaua

SEQ ID NO: 756206 - RNA, 19 nt, Homo sapiens
ggcaauaaagaguaugaaa

SEQ ID NO: 756207 - RNA, 19 nt, Homo sapiens
gcguaacugugaacuaugg

SEQ ID NO: 756208 - RNA, 19 nt, Homo sapiens
cugcguaacugugaacuau

SEQ ID NO: 756209 - RNA, 19 nt, Homo sapiens
gagacaagcuguaaauaaa

SEQ ID NO: 756210 - RNA, 19 nt, Homo sapiens
gaaagugaaugaagggaaa

SEQ ID NO: 756211 - RNA, 19 nt, Homo sapiens
gcuuugaucuuguaguuua

SEQ ID NO: 756212 - RNA, 19 nt, Homo sapiens
gaauagaucugaauguaag

SEQ ID NO: 756213 - RNA, 19 nt, Homo sapiens
caagugaguuuaacaaaga

SEQ ID NO: 756214 - RNA, 19 nt, Homo sapiens
gaagggaaauaccgaaguu

SEQ ID NO: 756215 - RNA, 19 nt, Homo sapiens
gaacugggguaaucuuuua

SEQ ID NO: 756216 - RNA, 19 nt, Homo sapiens
ggaggaauuuguagaagaa

SEQ ID NO: 756217 - RNA, 19 nt, Homo sapiens
gaucuucaaugacuucaaa

SEQ ID NO: 756218 - RNA, 19 nt, Homo sapiens
gcaaagaaaggacgacgua

SEQ ID NO: 756219 - RNA, 19 nt, Homo sapiens
ggagagggcuauagaucuu

SEQ ID NO: 756220 - RNA, 19 nt, Homo sapiens
gcaggagcauuaagaagaa

SEQ ID NO: 756221 - RNA, 19 nt, Homo sapiens
acaccaagaucuucaauga

SEQ ID NO: 756222 - RNA, 19 nt, Homo sapiens
ucaagaagcuggcaacaca

SEQ ID NO: 756223 - RNA, 19 nt, Homo sapiens
gcacucagcuguggacguu

SEQ ID NO: 756224 - RNA, 19 nt, Homo sapiens
gcacauaccucagauucau

SEQ ID NO: 756225 - RNA, 19 nt, Homo sapiens
ucaaaggcauuaucuguug

SEQ ID NO: 756226 - RNA, 19 nt, Homo sapiens
gaagaaauuuugcacagua

SEQ ID NO: 756227 - RNA, 19 nt, Homo sapiens
ggaaauaccgaaguuauga

SEQ ID NO: 756228 - RNA, 19 nt, Homo sapiens
gcacaguaguuuaaaucuu

SEQ ID NO: 756229 - RNA, 19 nt, Homo sapiens
gaaagaagacaaucaaguc

SEQ ID NO: 756230 - RNA, 19 nt, Homo sapiens
gaagcugcguucugaaaug

SEQ ID NO: 756231 - RNA, 19 nt, Homo sapiens
uaacaucaguggaggguau

SEQ ID NO: 756232 - RNA, 19 nt, Homo sapiens
gggcuaguccugcauauuu

SEQ ID NO: 756233 - RNA, 19 nt, Homo sapiens
caaagcugaugcccaauug

SEQ ID NO: 756234 - RNA, 19 nt, Homo sapiens
ggagagguguugauaugug

SEQ ID NO: 756235 - RNA, 19 nt, Homo sapiens
gggcagccauugagauuau

SEQ ID NO: 756236 - RNA, 19 nt, Homo sapiens
ccaaagucaugcagaaaga

SEQ ID NO: 756237 - RNA, 19 nt, Homo sapiens
uuacugagcuggaucuuag

SEQ ID NO: 756238 - RNA, 19 nt, Homo sapiens
gcagaaagaagacaaucaa

SEQ ID NO: 756239 - RNA, 19 nt, Homo sapiens
gaagcagauugccaacauu

SEQ ID NO: 756240 - RNA, 19 nt, Homo sapiens
gagagguguugauauguga

SEQ ID NO: 756241 - RNA, 19 nt, Homo sapiens
aaucaugacugguauuguu

SEQ ID NO: 756242 - RNA, 19 nt, Homo sapiens
guggguauaugauugaauu

SEQ ID NO: 756243 - RNA, 19 nt, Homo sapiens
acaagcaacugauuucuca

SEQ ID NO: 756244 - RNA, 19 nt, Homo sapiens
cgaggaugcuauauaaaga

SEQ ID NO: 756245 - RNA, 19 nt, Homo sapiens
ccaaguguuugucugauga

SEQ ID NO: 756246 - RNA, 19 nt, Homo sapiens
gaaaggacgacguaaucaa

SEQ ID NO: 756247 - RNA, 19 nt, Homo sapiens
guaaugagcagcuaaaggu

SEQ ID NO: 756248 - RNA, 19 nt, Homo sapiens
uugcgaggaugcuauauaa

SEQ ID NO: 756249 - RNA, 19 nt, Homo sapiens
gaucugaauguaagaacua

SEQ ID NO: 756250 - RNA, 19 nt, Homo sapiens
gaaccaagagcaaagaaag

SEQ ID NO: 756251 - RNA, 19 nt, Homo sapiens
gggccuggauuccuucuga

SEQ ID NO: 756252 - RNA, 19 nt, Homo sapiens
gcaccagccuuuaaacacu

SEQ ID NO: 756253 - RNA, 19 nt, Homo sapiens
agagacaagcuguaaauaa

SEQ ID NO: 756254 - RNA, 19 nt, Homo sapiens
gaaaagagacaagcuguaa

SEQ ID NO: 756255 - RNA, 19 nt, Homo sapiens
gaagaggcagaauccagua

SEQ ID NO: 756256 - RNA, 19 nt, Homo sapiens
uggaugaacugcagcuuug

SEQ ID NO: 756257 - RNA, 19 nt, Homo sapiens
acaauaaacacccgaugua

SEQ ID NO: 756258 - RNA, 19 nt, Homo sapiens
ccaguuugcaggagcauua

SEQ ID NO: 756259 - RNA, 19 nt, Homo sapiens
guugauaugugaccugugu

SEQ ID NO: 756260 - RNA, 19 nt, Homo sapiens
acagugggcugcaaagguu

SEQ ID NO: 756261 - RNA, 19 nt, Homo sapiens
uagcuuugaucuuguaguu

SEQ ID NO: 756262 - RNA, 19 nt, Homo sapiens
ggucauggcacguuuaaca

SEQ ID NO: 756263 - RNA, 19 nt, Homo sapiens
gaaauaccgaaguuaugaa

SEQ ID NO: 756264 - RNA, 19 nt, Homo sapiens
gaagaaccagagccugaaa

SEQ ID NO: 756265 - RNA, 19 nt, Homo sapiens
gcauuaagaagaagaauac

SEQ ID NO: 756266 - RNA, 19 nt, Homo sapiens
gaacaagaaggauauuggu

SEQ ID NO: 756267 - RNA, 19 nt, Homo sapiens
cagcuuaauuuacuguuca

SEQ ID NO: 756268 - RNA, 19 nt, Homo sapiens
uaacaugagugcuuguaac

SEQ ID NO: 756269 - RNA, 19 nt, Homo sapiens
uagaagaaaucaagaagcu

SEQ ID NO: 756270 - RNA, 19 nt, Homo sapiens
ggaccgaggugaggaagag

SEQ ID NO: 756271 - RNA, 19 nt, Homo sapiens
cagccaaagucaugcagaa

SEQ ID NO: 756272 - RNA, 19 nt, Homo sapiens
caacauugaccguauuaca

SEQ ID NO: 756273 - RNA, 19 nt, Homo sapiens
gaauacaagugaguuuaac

SEQ ID NO: 756274 - RNA, 19 nt, Homo sapiens
ggagucaccccgaugauua

SEQ ID NO: 756275 - RNA, 19 nt, Homo sapiens
uaaggaggaauuuguagaa

SEQ ID NO: 756276 - RNA, 19 nt, Homo sapiens
uuaagugccucuucaccaa

SEQ ID NO: 756277 - RNA, 19 nt, Homo sapiens
aaacagaagcaguaaguuc

SEQ ID NO: 756278 - RNA, 19 nt, Homo sapiens
aaaggacgacguaaucaaa

SEQ ID NO: 756279 - RNA, 19 nt, Homo sapiens
gggcuaaaaugaaagguuu

SEQ ID NO: 756280 - RNA, 19 nt, Homo sapiens
gguaugcacccuaaagaga

SEQ ID NO: 756281 - RNA, 19 nt, Homo sapiens
caacacagcacaagcaacu

SEQ ID NO: 756282 - RNA, 19 nt, Homo sapiens
aacaggagaugggcacaua

SEQ ID NO: 756283 - RNA, 19 nt, Homo sapiens
cuggagagguguugauaug

SEQ ID NO: 756284 - RNA, 19 nt, Homo sapiens
guauugaacaagaaggaua

SEQ ID NO: 756285 - RNA, 19 nt, Homo sapiens
ugagcuggaucuuagagaa

SEQ ID NO: 756286 - RNA, 19 nt, Homo sapiens
gugaauacaagugaguuua

SEQ ID NO: 756287 - RNA, 19 nt, Homo sapiens
aaagagacaagcuguaaau

SEQ ID NO: 756288 - RNA, 19 nt, Homo sapiens
ucaaagaccggaugaaguc

SEQ ID NO: 756289 - RNA, 19 nt, Homo sapiens
cagagggccuggauuccuu

SEQ ID NO: 756290 - RNA, 19 nt, Homo sapiens
gaugcuauauaaagacaca

SEQ ID NO: 756291 - RNA, 19 nt, Homo sapiens
agaagcagauugccaacau

SEQ ID NO: 756292 - RNA, 19 nt, Homo sapiens
gagcuggaucuuagagaaa

SEQ ID NO: 756293 - RNA, 19 nt, Homo sapiens
guucaaaggcauuaucugu

SEQ ID NO: 756294 - RNA, 19 nt, Homo sapiens
agggugagauggacagaaa

SEQ ID NO: 756295 - RNA, 19 nt, Homo sapiens
acaaauacaccaagaucuu

SEQ ID NO: 756296 - RNA, 19 nt, Homo sapiens
caugacaaauacaccaaga

SEQ ID NO: 756297 - RNA, 19 nt, Homo sapiens
aaccagagccugaaacaga

SEQ ID NO: 756298 - RNA, 19 nt, Homo sapiens
gcgaggaugcuauauaaag

SEQ ID NO: 756299 - RNA, 19 nt, Homo sapiens
gggaaauaccgaaguuaug

SEQ ID NO: 756300 - RNA, 19 nt, Homo sapiens
caagagaaagugaaugaag

SEQ ID NO: 756301 - RNA, 19 nt, Homo sapiens
cauuucaucuuuguccuaa

SEQ ID NO: 756302 - RNA, 19 nt, Homo sapiens
acaagugaguuuaacaaag

SEQ ID NO: 756303 - RNA, 19 nt, Homo sapiens
agaauuugcuucccauuuu

SEQ ID NO: 756304 - RNA, 19 nt, Homo sapiens
caacaugcagggugagaug

SEQ ID NO: 756305 - RNA, 19 nt, Homo sapiens
aaaggucacucaagaacca

SEQ ID NO: 756306 - RNA, 19 nt, Homo sapiens
gcuaaaggucacucaagaa

SEQ ID NO: 756307 - RNA, 19 nt, Homo sapiens
ccugacaacugguucuguu

SEQ ID NO: 756308 - RNA, 19 nt, Homo sapiens
caaaugcucguccugacaa

SEQ ID NO: 756309 - RNA, 19 nt, Homo sapiens
gguaacagguccauaauaa

SEQ ID NO: 756310 - RNA, 19 nt, Homo sapiens
ggaaggugcugcaguauga

SEQ ID NO: 756311 - RNA, 19 nt, Homo sapiens
ggaaacuaaucccuaaaua

SEQ ID NO: 756312 - RNA, 19 nt, Homo sapiens
aaacuaggaugucugaaua

SEQ ID NO: 756313 - RNA, 19 nt, Homo sapiens
gaagacgcuuuacauaauu

SEQ ID NO: 756314 - RNA, 19 nt, Homo sapiens
gaaaagguaugguccaaua

SEQ ID NO: 756315 - RNA, 19 nt, Homo sapiens
gaaaggaggagaucaagaa

SEQ ID NO: 756316 - RNA, 19 nt, Homo sapiens
ccaaacacaugcuaggaua

SEQ ID NO: 756317 - RNA, 19 nt, Homo sapiens
gaucaaggauaaguaauug

SEQ ID NO: 756318 - RNA, 19 nt, Homo sapiens
gagacugggugcuauaauu

SEQ ID NO: 756319 - RNA, 19 nt, Homo sapiens
gugguuaucugccauuuaa

SEQ ID NO: 756320 - RNA, 19 nt, Homo sapiens
ggaggaauguguacaguuc

SEQ ID NO: 756321 - RNA, 19 nt, Homo sapiens
ugaagacgcuuuacauaau

SEQ ID NO: 756322 - RNA, 19 nt, Homo sapiens
uggcaucuguguuuauuua

SEQ ID NO: 756323 - RNA, 19 nt, Homo sapiens
gguggaaggugcugcagua

SEQ ID NO: 756324 - RNA, 19 nt, Homo sapiens
guacaguucuucacgcuau

SEQ ID NO: 756325 - RNA, 19 nt, Homo sapiens
gauaaguaauugugugguu

SEQ ID NO: 756326 - RNA, 19 nt, Homo sapiens
gcaaaucauuguacuggau

SEQ ID NO: 756327 - RNA, 19 nt, Homo sapiens
gcaguuuacaucugucuua

SEQ ID NO: 756328 - RNA, 19 nt, Homo sapiens
caagaggauuugcuuaugu

SEQ ID NO: 756329 - RNA, 19 nt, Homo sapiens
gaaacuaggaugucugaau

SEQ ID NO: 756330 - RNA, 19 nt, Homo sapiens
guacaccacaugcaguuua

SEQ ID NO: 756331 - RNA, 19 nt, Homo sapiens
guacaguucugcuuacuac

SEQ ID NO: 756332 - RNA, 19 nt, Homo sapiens
cgaaagacaccaaaucaga

SEQ ID NO: 756333 - RNA, 19 nt, Homo sapiens
ggacauguucuguguauag

SEQ ID NO: 756334 - RNA, 19 nt, Homo sapiens
gaucguauaguccuagaaa

SEQ ID NO: 756335 - RNA, 19 nt, Homo sapiens
gaaagacaccaaaucagau

SEQ ID NO: 756336 - RNA, 19 nt, Homo sapiens
gacagaaaguggauuugug

SEQ ID NO: 756337 - RNA, 19 nt, Homo sapiens
gcugaagacgcuuuacaua

SEQ ID NO: 756338 - RNA, 19 nt, Homo sapiens
caauauacgaucaaggaua

SEQ ID NO: 756339 - RNA, 19 nt, Homo sapiens
gagaaaauguucaccaaau

SEQ ID NO: 756340 - RNA, 19 nt, Homo sapiens
ggaauacccaguacaguuc

SEQ ID NO: 756341 - RNA, 19 nt, Homo sapiens
caguauggccucauuguuu

SEQ ID NO: 756342 - RNA, 19 nt, Homo sapiens
ccaagaggauuugcuuaug

SEQ ID NO: 756343 - RNA, 19 nt, Homo sapiens
agacugggugcuauaauua

SEQ ID NO: 756344 - RNA, 19 nt, Homo sapiens
guaauugugugguuaucug

SEQ ID NO: 756345 - RNA, 19 nt, Homo sapiens
gaacacaauauacgaucaa

SEQ ID NO: 756346 - RNA, 19 nt, Homo sapiens
ucauuguacuggauaauug

SEQ ID NO: 756347 - RNA, 19 nt, Homo sapiens
uaggaugucugaauaucaa

SEQ ID NO: 756348 - RNA, 19 nt, Homo sapiens
gcagauugaaauacaguuu

SEQ ID NO: 756349 - RNA, 19 nt, Homo sapiens
aaacacaugcuaggauaua

SEQ ID NO: 756350 - RNA, 19 nt, Homo sapiens
caucucuucucaccucuuu

SEQ ID NO: 756351 - RNA, 19 nt, Homo sapiens
aagguaugguccaauauaa

SEQ ID NO: 756352 - RNA, 19 nt, Homo sapiens
aaagguaugguccaauaua

SEQ ID NO: 756353 - RNA, 19 nt, Homo sapiens
ccaaacugcagcuggaaua

SEQ ID NO: 756354 - RNA, 19 nt, Homo sapiens
caaaucauuguacuggaua

SEQ ID NO: 756355 - RNA, 19 nt, Homo sapiens
uguggaaacuaaucccuaa

SEQ ID NO: 756356 - RNA, 19 nt, Homo sapiens
uuacuacacuucaagaaag

SEQ ID NO: 756357 - RNA, 19 nt, Homo sapiens
uaaaggagacugggugcua

SEQ ID NO: 756358 - RNA, 19 nt, Homo sapiens
gucaguauauucagcaaau

SEQ ID NO: 756359 - RNA, 19 nt, Homo sapiens
ggacagaaaguggauuugu

SEQ ID NO: 756360 - RNA, 19 nt, Homo sapiens
guaacagguccauaauaaa

SEQ ID NO: 756361 - RNA, 19 nt, Homo sapiens
gacggcagauugaaauaca

SEQ ID NO: 756362 - RNA, 19 nt, Homo sapiens
cugaagacgcuuuacauaa

SEQ ID NO: 756363 - RNA, 19 nt, Homo sapiens
uuacaucugucuuaacuac

SEQ ID NO: 756364 - RNA, 19 nt, Homo sapiens
gaucgaaagacaccaaauc

SEQ ID NO: 756365 - RNA, 19 nt, Homo sapiens
ucuagaagccgaaguuaug

SEQ ID NO: 756366 - RNA, 19 nt, Homo sapiens
uaugacagauacagacguu

SEQ ID NO: 756367 - RNA, 19 nt, Homo sapiens
cacaauauacgaucaagga

SEQ ID NO: 756368 - RNA, 19 nt, Homo sapiens
guuggcaucuguguuuauu

SEQ ID NO: 756369 - RNA, 19 nt, Homo sapiens
ggguaacagguccauaaua

SEQ ID NO: 756370 - RNA, 19 nt, Homo sapiens
gaagucggucuuuugauua

SEQ ID NO: 756371 - RNA, 19 nt, Homo sapiens
aagaggauuugcuuauguu

SEQ ID NO: 756372 - RNA, 19 nt, Homo sapiens
guuaugguccuauaguuga

SEQ ID NO: 756373 - RNA, 19 nt, Homo sapiens
cgaucaaggauaaguaauu

SEQ ID NO: 756374 - RNA, 19 nt, Homo sapiens
ggcgugaauuuggucguua

SEQ ID NO: 756375 - RNA, 19 nt, Homo sapiens
caguuuacaucugucuuaa

SEQ ID NO: 756376 - RNA, 19 nt, Homo sapiens
gaaaguaagcauuuuagga

SEQ ID NO: 756377 - RNA, 19 nt, Homo sapiens
ccaaagaagggcaguucaa

SEQ ID NO: 756378 - RNA, 19 nt, Homo sapiens
gacaccaaaucagaugaaa

SEQ ID NO: 756379 - RNA, 19 nt, Homo sapiens
guuuacaucugucuuaacu

SEQ ID NO: 756380 - RNA, 19 nt, Homo sapiens
aaaggagacugggugcuau

SEQ ID NO: 756381 - RNA, 19 nt, Homo sapiens
uccaguauuugaucacauu

SEQ ID NO: 756382 - RNA, 19 nt, Homo sapiens
aggaggagaucaagaaguc

SEQ ID NO: 756383 - RNA, 19 nt, Homo sapiens
guucuucacgcuaugauga

SEQ ID NO: 756384 - RNA, 19 nt, Homo sapiens
gagggcccaucucuucuca

SEQ ID NO: 756385 - RNA, 19 nt, Homo sapiens
agauacagacguucuagaa

SEQ ID NO: 756386 - RNA, 19 nt, Homo sapiens
aggauuugcuuauguucaa

SEQ ID NO: 756387 - RNA, 19 nt, Homo sapiens
gcgugaauuuggucguuau

SEQ ID NO: 756388 - RNA, 19 nt, Homo sapiens
ugaauuuggucguuauggu

SEQ ID NO: 756389 - RNA, 19 nt, Homo sapiens
caaggaagacagccauagu

SEQ ID NO: 756390 - RNA, 19 nt, Homo sapiens
ggaagaccacggcguagca

SEQ ID NO: 756391 - RNA, 19 nt, Homo sapiens
guauaguccuagaaacagu

SEQ ID NO: 756392 - RNA, 19 nt, Homo sapiens
ggauguucgugaugcugaa

SEQ ID NO: 756393 - RNA, 19 nt, Homo sapiens
agacuugcggcgugaauuu

SEQ ID NO: 756394 - RNA, 19 nt, Homo sapiens
gugaaucauuacaguaugg

SEQ ID NO: 756395 - RNA, 19 nt, Homo sapiens
uggaauacccaguacaguu

SEQ ID NO: 756396 - RNA, 19 nt, Homo sapiens
cggcguagcagaagccauu

SEQ ID NO: 756397 - RNA, 19 nt, Homo sapiens
agaagucggucuuuugauu

SEQ ID NO: 756398 - RNA, 19 nt, Homo sapiens
cuaugaugauuaugacaga

SEQ ID NO: 756399 - RNA, 19 nt, Homo sapiens
ucaaggauaaguaauugug

SEQ ID NO: 756400 - RNA, 19 nt, Homo sapiens
uccuauaguugauguguau

SEQ ID NO: 756401 - RNA, 19 nt, Homo sapiens
ugagcacaaucuagugaau

SEQ ID NO: 756402 - RNA, 19 nt, Homo sapiens
cuacugagcacaaucuagu

SEQ ID NO: 756403 - RNA, 19 nt, Homo sapiens
ccucuuuccuagucaguau

SEQ ID NO: 756404 - RNA, 19 nt, Homo sapiens
ucucaccucuuuccuaguc

SEQ ID NO: 756405 - RNA, 19 nt, Homo sapiens
cuacauggaauaauugaag

SEQ ID NO: 756406 - RNA, 19 nt, Homo sapiens
uuacaccauucguaucaau

SEQ ID NO: 756407 - RNA, 19 nt, Homo sapiens
cacaaucuagugaaucauu

SEQ ID NO: 756408 - RNA, 19 nt, Homo sapiens
gcaucuguguuuauuuacu

SEQ ID NO: 756409 - RNA, 19 nt, Homo sapiens
gcacaugccuguaaucuca

SEQ ID NO: 756410 - RNA, 19 nt, Homo sapiens
gaagacgcuuuacauaauu

SEQ ID NO: 756411 - RNA, 19 nt, Homo sapiens
guaauacccuuaaaccauu

SEQ ID NO: 756412 - RNA, 19 nt, Homo sapiens
gaaaggaggagaucaagaa

SEQ ID NO: 756413 - RNA, 19 nt, Homo sapiens
agaaagaaaugaaggcuaa

SEQ ID NO: 756414 - RNA, 19 nt, Homo sapiens
ggaauacaauguugcaaug

SEQ ID NO: 756415 - RNA, 19 nt, Homo sapiens
gaccauaauuugcaacauu

SEQ ID NO: 756416 - RNA, 19 nt, Homo sapiens
gaaaaggaaucaaggaaaa

SEQ ID NO: 756417 - RNA, 19 nt, Homo sapiens
ggaggaauguguacaguuc

SEQ ID NO: 756418 - RNA, 19 nt, Homo sapiens
ugaagacgcuuuacauaau

SEQ ID NO: 756419 - RNA, 19 nt, Homo sapiens
gcuaugcaaucguuuauau

SEQ ID NO: 756420 - RNA, 19 nt, Homo sapiens
gccaugaaauuuaagguaa

SEQ ID NO: 756421 - RNA, 19 nt, Homo sapiens
ggaauguguuuaaaggauu

SEQ ID NO: 756422 - RNA, 19 nt, Homo sapiens
gacuugacauguccaauuu

SEQ ID NO: 756423 - RNA, 19 nt, Homo sapiens
aaauuugccugccucuuua

SEQ ID NO: 756424 - RNA, 19 nt, Homo sapiens
cgacaaugauagauucaaa

SEQ ID NO: 756425 - RNA, 19 nt, Homo sapiens
guacaguucuucacgcuau

SEQ ID NO: 756426 - RNA, 19 nt, Homo sapiens
gcaacauugucucauuaaa

SEQ ID NO: 756427 - RNA, 19 nt, Homo sapiens
caagaggauuugcuuaugu

SEQ ID NO: 756428 - RNA, 19 nt, Homo sapiens
ucacaccucaguuuauuua

SEQ ID NO: 756429 - RNA, 19 nt, Homo sapiens
gcaggucguugauggcaaa

SEQ ID NO: 756430 - RNA, 19 nt, Homo sapiens
ggacaaacgauuccuuuua

SEQ ID NO: 756431 - RNA, 19 nt, Homo sapiens
gaaaaggauuagucaguuu

SEQ ID NO: 756432 - RNA, 19 nt, Homo sapiens
guagaacuguuaaccuaga

SEQ ID NO: 756433 - RNA, 19 nt, Homo sapiens
gaugccagcugggaaauug

SEQ ID NO: 756434 - RNA, 19 nt, Homo sapiens
cgaaagacaccaaaucaga

SEQ ID NO: 756435 - RNA, 19 nt, Homo sapiens
gaauguguuuaaaggauug

SEQ ID NO: 756436 - RNA, 19 nt, Homo sapiens
cagauacaaguacgaauua

SEQ ID NO: 756437 - RNA, 19 nt, Homo sapiens
gaucguauaguccuagaaa

SEQ ID NO: 756438 - RNA, 19 nt, Homo sapiens
gaaagacaccaaaucagau

SEQ ID NO: 756439 - RNA, 19 nt, Homo sapiens
gacagaaaguggauuugug

SEQ ID NO: 756440 - RNA, 19 nt, Homo sapiens
gcugaagacgcuuuacaua

SEQ ID NO: 756441 - RNA, 19 nt, Homo sapiens
ggagcguuguugaccauaa

SEQ ID NO: 756442 - RNA, 19 nt, Homo sapiens
aggcauguaucauucauuu

SEQ ID NO: 756443 - RNA, 19 nt, Homo sapiens
ugacauguccaauuucauu

SEQ ID NO: 756444 - RNA, 19 nt, Homo sapiens
uaagaguccaguuuguuua

SEQ ID NO: 756445 - RNA, 19 nt, Homo sapiens
gcaguaguuuacaguucua

SEQ ID NO: 756446 - RNA, 19 nt, Homo sapiens
guggugccaugaaauuuaa

SEQ ID NO: 756447 - RNA, 19 nt, Homo sapiens
uaucaggaauacaauguug

SEQ ID NO: 756448 - RNA, 19 nt, Homo sapiens
ccaagaggauuugcuuaug

SEQ ID NO: 756449 - RNA, 19 nt, Homo sapiens
uaagacaacacucauucua

SEQ ID NO: 756450 - RNA, 19 nt, Homo sapiens
gaugcaguguggauuaguu

SEQ ID NO: 756451 - RNA, 19 nt, Homo sapiens
ugguagaacuguuaaccua

SEQ ID NO: 756452 - RNA, 19 nt, Homo sapiens
uugcaacauugucucauua

SEQ ID NO: 756453 - RNA, 19 nt, Homo sapiens
gcagauugaaauacaguuu

SEQ ID NO: 756454 - RNA, 19 nt, Homo sapiens
ggaccuuuaugucuuguca

SEQ ID NO: 756455 - RNA, 19 nt, Homo sapiens
guauaaaccauggucauuu

SEQ ID NO: 756456 - RNA, 19 nt, Homo sapiens
ggaaaaggauuagucaguu

SEQ ID NO: 756457 - RNA, 19 nt, Homo sapiens
caggcaaugguuauaauua

SEQ ID NO: 756458 - RNA, 19 nt, Homo sapiens
cagaagccauuccgacaau

SEQ ID NO: 756459 - RNA, 19 nt, Homo sapiens
aacaagacccagcuuauuu

SEQ ID NO: 756460 - RNA, 19 nt, Homo sapiens
aaacaagacccagcuuauu

SEQ ID NO: 756461 - RNA, 19 nt, Homo sapiens
gauugauucuagaaccuuu

SEQ ID NO: 756462 - RNA, 19 nt, Homo sapiens
gguucaggguggaccuuua

SEQ ID NO: 756463 - RNA, 19 nt, Homo sapiens
ugacugcucagacacauuu

SEQ ID NO: 756464 - RNA, 19 nt, Homo sapiens
gagcguuguugaccauaau

SEQ ID NO: 756465 - RNA, 19 nt, Homo sapiens
ucagacacauuuagguuca

SEQ ID NO: 756466 - RNA, 19 nt, Homo sapiens
ggacagaaaguggauuugu

SEQ ID NO: 756467 - RNA, 19 nt, Homo sapiens
agaauacaacgauggauuu

SEQ ID NO: 756468 - RNA, 19 nt, Homo sapiens
gaagauuuggaacauagaa

SEQ ID NO: 756469 - RNA, 19 nt, Homo sapiens
gugaaaagauguugguuga

SEQ ID NO: 756470 - RNA, 19 nt, Homo sapiens
uuauaagucuggcucaaga

SEQ ID NO: 756471 - RNA, 19 nt, Homo sapiens
gacggcagauugaaauaca

SEQ ID NO: 756472 - RNA, 19 nt, Homo sapiens
cugaagacgcuuuacauaa

SEQ ID NO: 756473 - RNA, 19 nt, Homo sapiens
gaggaaaguugugggguua

SEQ ID NO: 756474 - RNA, 19 nt, Homo sapiens
guucugcuaugcaaucguu

SEQ ID NO: 756475 - RNA, 19 nt, Homo sapiens
gaaguugcagugagccaaa

SEQ ID NO: 756476 - RNA, 19 nt, Homo sapiens
gcucagacacauuuagguu

SEQ ID NO: 756477 - RNA, 19 nt, Homo sapiens
ugaaguaguagccacagua

SEQ ID NO: 756478 - RNA, 19 nt, Homo sapiens
gaguccaguuuguuuaaug

SEQ ID NO: 756479 - RNA, 19 nt, Homo sapiens
gcagaagccauuccgacaa

SEQ ID NO: 756480 - RNA, 19 nt, Homo sapiens
gaucgaaagacaccaaauc

SEQ ID NO: 756481 - RNA, 19 nt, Homo sapiens
ugacuugacauguccaauu

SEQ ID NO: 756482 - RNA, 19 nt, Homo sapiens
gaacuguuaaccuagaaau

SEQ ID NO: 756483 - RNA, 19 nt, Homo sapiens
gcauguaucauucauuuac

SEQ ID NO: 756484 - RNA, 19 nt, Homo sapiens
ucuagaagccgaaguuaug

SEQ ID NO: 756485 - RNA, 19 nt, Homo sapiens
uaugacagauacagacguu

SEQ ID NO: 756486 - RNA, 19 nt, Homo sapiens
ucugcuugcuguaaauuaa

SEQ ID NO: 756487 - RNA, 19 nt, Homo sapiens
gcaguuaauguucauguuc

SEQ ID NO: 756488 - RNA, 19 nt, Homo sapiens
ucagauugcuugcuuacag

SEQ ID NO: 756489 - RNA, 19 nt, Homo sapiens
gaaaccccgucucuacuaa

SEQ ID NO: 756490 - RNA, 19 nt, Homo sapiens
gguggaccuuuaugucuug

SEQ ID NO: 756491 - RNA, 19 nt, Homo sapiens
guugagaagccacucuuaa

SEQ ID NO: 756492 - RNA, 19 nt, Homo sapiens
gaaguaauacccuuaaacc

SEQ ID NO: 756493 - RNA, 19 nt, Homo sapiens
gaacugaaauuuugaugcu

SEQ ID NO: 756494 - RNA, 19 nt, Homo sapiens
caguguggauuaguucuuu

SEQ ID NO: 756495 - RNA, 19 nt, Homo sapiens
ucuaggccaaugauaauua

SEQ ID NO: 756496 - RNA, 19 nt, Homo sapiens
ggguggaccuuuaugucuu

SEQ ID NO: 756497 - RNA, 19 nt, Homo sapiens
aagaggauuugcuuauguu

SEQ ID NO: 756498 - RNA, 19 nt, Homo sapiens
uuaagaguccaguuuguuu

SEQ ID NO: 756499 - RNA, 19 nt, Homo sapiens
ugagaagccacucuuaaga

SEQ ID NO: 756500 - RNA, 19 nt, Homo sapiens
gaauacaauguugcaauga

SEQ ID NO: 756501 - RNA, 19 nt, Homo sapiens
gaucuaaauccaauucaag

SEQ ID NO: 756502 - RNA, 19 nt, Homo sapiens
gaagucggucuuuugauua

SEQ ID NO: 756503 - RNA, 19 nt, Homo sapiens
uagcaguaguuuacaguuc

SEQ ID NO: 756504 - RNA, 19 nt, Homo sapiens
uaaagaauacaacgaugga

SEQ ID NO: 756505 - RNA, 19 nt, Homo sapiens
gauacaaguacgaauuaug

SEQ ID NO: 756506 - RNA, 19 nt, Homo sapiens
cagauugcuugcuuacaga

SEQ ID NO: 756507 - RNA, 19 nt, Homo sapiens
caagaucuaaauccaauuc

SEQ ID NO: 756508 - RNA, 19 nt, Homo sapiens
guuaugguccuauaguuga

SEQ ID NO: 756509 - RNA, 19 nt, Homo sapiens
caaaguaucuggaaauuga

SEQ ID NO: 756510 - RNA, 19 nt, Homo sapiens
gcacaagucugcucucaaa

SEQ ID NO: 756511 - RNA, 19 nt, Homo sapiens
gauaaagacugugagauaa

SEQ ID NO: 756512 - RNA, 19 nt, Homo sapiens
gaaagacauucuccacuga

SEQ ID NO: 756513 - RNA, 19 nt, Homo sapiens
uaacaucuccgucuacaua

SEQ ID NO: 756514 - RNA, 19 nt, Homo sapiens
gacaaaggauccagcagua

SEQ ID NO: 756515 - RNA, 19 nt, Homo sapiens
uaacuuuccuugagacuuu

SEQ ID NO: 756516 - RNA, 19 nt, Homo sapiens
gaaugcaggucucguuuga

SEQ ID NO: 756517 - RNA, 19 nt, Homo sapiens
gaaucaagaucagggcuua

SEQ ID NO: 756518 - RNA, 19 nt, Homo sapiens
gaucauggcugcugagucu

SEQ ID NO: 756519 - RNA, 19 nt, Homo sapiens
guucagguaugacaaagua

SEQ ID NO: 756520 - RNA, 19 nt, Homo sapiens
ggcaaagucuacuauaauu

SEQ ID NO: 756521 - RNA, 19 nt, Homo sapiens
gaccuaagauuggccauuu

SEQ ID NO: 756522 - RNA, 19 nt, Homo sapiens
guucauugcuuccauuuga

SEQ ID NO: 756523 - RNA, 19 nt, Homo sapiens
gaaauuucuucuuggugua

SEQ ID NO: 756524 - RNA, 19 nt, Homo sapiens
gaaauaguguuccucucuu

SEQ ID NO: 756525 - RNA, 19 nt, Homo sapiens
caguaaagcugaugggauu

SEQ ID NO: 756526 - RNA, 19 nt, Homo sapiens
aaagaagacugacuagaug

SEQ ID NO: 756527 - RNA, 19 nt, Homo sapiens
gauucugucucaucucaua

SEQ ID NO: 756528 - RNA, 19 nt, Homo sapiens
gaagacauuuacugccaaa

SEQ ID NO: 756529 - RNA, 19 nt, Homo sapiens
ugucucaucucauaccuua

SEQ ID NO: 756530 - RNA, 19 nt, Homo sapiens
guuacuagaugagcaauuu

SEQ ID NO: 756531 - RNA, 19 nt, Homo sapiens
ugauaaagacugugagaua

SEQ ID NO: 756532 - RNA, 19 nt, Homo sapiens
cauauaagucucaguagua

SEQ ID NO: 756533 - RNA, 19 nt, Homo sapiens
uaaagaagacugacuagau

SEQ ID NO: 756534 - RNA, 19 nt, Homo sapiens
uagaacagauggcacuaaa

SEQ ID NO: 756535 - RNA, 19 nt, Homo sapiens
aaauaguguuccucucuua

SEQ ID NO: 756536 - RNA, 19 nt, Homo sapiens
uaguaucccuagagaaaua

SEQ ID NO: 756537 - RNA, 19 nt, Homo sapiens
gaggaagguuauucacuga

SEQ ID NO: 756538 - RNA, 19 nt, Homo sapiens
gaauuucuccuugaacuuu

SEQ ID NO: 756539 - RNA, 19 nt, Homo sapiens
caacaguucuccgucacua

SEQ ID NO: 756540 - RNA, 19 nt, Homo sapiens
gauaucuguucuacuguuu

SEQ ID NO: 756541 - RNA, 19 nt, Homo sapiens
caaacuaaacaccaagaua

SEQ ID NO: 756542 - RNA, 19 nt, Homo sapiens
gaguucagccucuucauuu

SEQ ID NO: 756543 - RNA, 19 nt, Homo sapiens
aaucacauguucguuguua

SEQ ID NO: 756544 - RNA, 19 nt, Homo sapiens
uuucuggacugucauauaa

SEQ ID NO: 756545 - RNA, 19 nt, Homo sapiens
ggauaucuguucuacuguu

SEQ ID NO: 756546 - RNA, 19 nt, Homo sapiens
gaagauaguccuguaaaca

SEQ ID NO: 756547 - RNA, 19 nt, Homo sapiens
uauaguacguucccucuug

SEQ ID NO: 756548 - RNA, 19 nt, Homo sapiens
gaauuaggauaacaagaag

SEQ ID NO: 756549 - RNA, 19 nt, Homo sapiens
gagauguggucuugcagaa

SEQ ID NO: 756550 - RNA, 19 nt, Homo sapiens
caaaggauccagcaguauu

SEQ ID NO: 756551 - RNA, 19 nt, Homo sapiens
guuccucucuuauauauuc

SEQ ID NO: 756552 - RNA, 19 nt, Homo sapiens
agauaguccuguaaacaua

SEQ ID NO: 756553 - RNA, 19 nt, Homo sapiens
gauuuggagucucuaggua

SEQ ID NO: 756554 - RNA, 19 nt, Homo sapiens
aaaugccacuguugugaua

SEQ ID NO: 756555 - RNA, 19 nt, Homo sapiens
aacccaauguuacuaguua

SEQ ID NO: 756556 - RNA, 19 nt, Homo sapiens
cccaauagcucucuuaugc

SEQ ID NO: 756557 - RNA, 19 nt, Homo sapiens
ggcccgaguuucuugauuu

SEQ ID NO: 756558 - RNA, 19 nt, Homo sapiens
gcacuuaaccucuguccau

SEQ ID NO: 756559 - RNA, 19 nt, Homo sapiens
ccucgaggcuuucuucaug

SEQ ID NO: 756560 - RNA, 19 nt, Homo sapiens
gaucagggcuuauuuugug

SEQ ID NO: 756561 - RNA, 19 nt, Homo sapiens
gagcagaguggcugaaguu

SEQ ID NO: 756562 - RNA, 19 nt, Homo sapiens
cauguagaauccaucagua

SEQ ID NO: 756563 - RNA, 19 nt, Homo sapiens
ugagacagcagaauuuauu

SEQ ID NO: 756564 - RNA, 19 nt, Homo sapiens
ucacauguucguuguuaua

SEQ ID NO: 756565 - RNA, 19 nt, Homo sapiens
agucugauguucugcauuu

SEQ ID NO: 756566 - RNA, 19 nt, Homo sapiens
aaggcaaagucuacuauaa

SEQ ID NO: 756567 - RNA, 19 nt, Homo sapiens
caguacagcuggugucgaa

SEQ ID NO: 756568 - RNA, 19 nt, Homo sapiens
gcgacauugugcugaauuu

SEQ ID NO: 756569 - RNA, 19 nt, Homo sapiens
gaaacacagcauucauuga

SEQ ID NO: 756570 - RNA, 19 nt, Homo sapiens
gugcagaaguuggcagaaa

SEQ ID NO: 756571 - RNA, 19 nt, Homo sapiens
uagcgagagucauauuuga

SEQ ID NO: 756572 - RNA, 19 nt, Homo sapiens
guucauccaugucauuuua

SEQ ID NO: 756573 - RNA, 19 nt, Homo sapiens
gggauucugucucaucuca

SEQ ID NO: 756574 - RNA, 19 nt, Homo sapiens
gcaagucuuucuguagaga

SEQ ID NO: 756575 - RNA, 19 nt, Homo sapiens
ccaguuaccuucagauggu

SEQ ID NO: 756576 - RNA, 19 nt, Homo sapiens
gaaaauuguuacugucuug

SEQ ID NO: 756577 - RNA, 19 nt, Homo sapiens
ugaaggaaguuaugguaca

SEQ ID NO: 756578 - RNA, 19 nt, Homo sapiens
gaaagugugauagcucauu

SEQ ID NO: 756579 - RNA, 19 nt, Homo sapiens
aaagauuugugcaccacua

SEQ ID NO: 756580 - RNA, 19 nt, Homo sapiens
aaacacagcauucauugau

SEQ ID NO: 756581 - RNA, 19 nt, Homo sapiens
uaagauuggccauuuguug

SEQ ID NO: 756582 - RNA, 19 nt, Homo sapiens
ggucuaaaauuccaugauu

SEQ ID NO: 756583 - RNA, 19 nt, Homo sapiens
ggaaaacuaugacuguaug

SEQ ID NO: 756584 - RNA, 19 nt, Homo sapiens
cuaaacaccaagauacuuu

SEQ ID NO: 756585 - RNA, 19 nt, Homo sapiens
uuacgcaagucuuucugua

SEQ ID NO: 756586 - RNA, 19 nt, Homo sapiens
gaaauuuguauccuucaug

SEQ ID NO: 756587 - RNA, 19 nt, Homo sapiens
uaaagaagaggaaagcaau

SEQ ID NO: 756588 - RNA, 19 nt, Homo sapiens
gugaaagugaugguuauua

SEQ ID NO: 756589 - RNA, 19 nt, Homo sapiens
ugugagcacuuugagauuu

SEQ ID NO: 756590 - RNA, 19 nt, Homo sapiens
gugcugaauuucuccuuga

SEQ ID NO: 756591 - RNA, 19 nt, Homo sapiens
gcaggucucguuugaugaa

SEQ ID NO: 756592 - RNA, 19 nt, Homo sapiens
auacggcccuuucagugua

SEQ ID NO: 756593 - RNA, 19 nt, Homo sapiens
acacagcauucauugauca

SEQ ID NO: 756594 - RNA, 19 nt, Homo sapiens
gucaaaguaucuggaaauu

SEQ ID NO: 756595 - RNA, 19 nt, Homo sapiens
gcggaauccuugacucuag

SEQ ID NO: 756596 - RNA, 19 nt, Homo sapiens
guugugauauggauuucaa

SEQ ID NO: 756597 - RNA, 19 nt, Homo sapiens
gaggcuuucuucauguuga

SEQ ID NO: 756598 - RNA, 19 nt, Homo sapiens
uuacuucguugucagagaa

SEQ ID NO: 756599 - RNA, 19 nt, Homo sapiens
ugaaucacauguucguugu

SEQ ID NO: 756600 - RNA, 19 nt, Homo sapiens
gcauaaugacuuugagguu

SEQ ID NO: 756601 - RNA, 19 nt, Homo sapiens
ucaguaguaucccuagaga

SEQ ID NO: 756602 - RNA, 19 nt, Homo sapiens
guuacuaguuagcgacauu

SEQ ID NO: 756603 - RNA, 19 nt, Homo sapiens
caagaaugcaggucucguu

SEQ ID NO: 756604 - RNA, 19 nt, Homo sapiens
gauguggucuugcagaaaa

SEQ ID NO: 756605 - RNA, 19 nt, Homo sapiens
ugagaauacugaaggaagu

SEQ ID NO: 756606 - RNA, 19 nt, Homo sapiens
aagcauguauuucucugaa

SEQ ID NO: 756607 - RNA, 19 nt, Homo sapiens
ucaggaaaauggaaucuuu

SEQ ID NO: 756608 - RNA, 19 nt, Homo sapiens
ccuaggagagugucuguuu

SEQ ID NO: 756609 - RNA, 19 nt, Homo sapiens
gaagaccgccugaaaguua

SEQ ID NO: 756610 - RNA, 19 nt, Homo sapiens
aaacagggaucaaauaaag

SEQ ID NO: 756611 - RNA, 19 nt, Homo sapiens
gcaaggagaagaagaagaa

SEQ ID NO: 756612 - RNA, 19 nt, Homo sapiens
caaagaagaccgccugaaa

SEQ ID NO: 756613 - RNA, 19 nt, Homo sapiens
cagcagagauacagccuuu

SEQ ID NO: 756614 - RNA, 19 nt, Homo sapiens
cuaaggcaguuguuuauga

SEQ ID NO: 756615 - RNA, 19 nt, Homo sapiens
gaaugaagagugugaucua

SEQ ID NO: 756616 - RNA, 19 nt, Homo sapiens
gaaggucgcagcguacuaa

SEQ ID NO: 756617 - RNA, 19 nt, Homo sapiens
ugaauucuuugccgucuaa

SEQ ID NO: 756618 - RNA, 19 nt, Homo sapiens
cauaaacagggaucaaaua

SEQ ID NO: 756619 - RNA, 19 nt, Homo sapiens
ucugagugcucuaugauaa

SEQ ID NO: 756620 - RNA, 19 nt, Homo sapiens
uaacacugguugacuugaa

SEQ ID NO: 756621 - RNA, 19 nt, Homo sapiens
guuaagccaauuccauuua

SEQ ID NO: 756622 - RNA, 19 nt, Homo sapiens
gaucuaccaugcauugucu

SEQ ID NO: 756623 - RNA, 19 nt, Homo sapiens
gguuaacacugguugacuu

SEQ ID NO: 756624 - RNA, 19 nt, Homo sapiens
ggaagcgguccgagaauga

SEQ ID NO: 756625 - RNA, 19 nt, Homo sapiens
caugaacucuggaaacagu

SEQ ID NO: 756626 - RNA, 19 nt, Homo sapiens
aaccagagcagcagagaua

SEQ ID NO: 756627 - RNA, 19 nt, Homo sapiens
gaagaagucagaggacaga

SEQ ID NO: 756628 - RNA, 19 nt, Homo sapiens
gaagaagaagaaagccaaa

SEQ ID NO: 756629 - RNA, 19 nt, Homo sapiens
cgucuaaggcaguuguuua

SEQ ID NO: 756630 - RNA, 19 nt, Homo sapiens
ggcuuuauuuccuacauuu

SEQ ID NO: 756631 - RNA, 19 nt, Homo sapiens
cugcggcucuuugacauua

SEQ ID NO: 756632 - RNA, 19 nt, Homo sapiens
ucaguugcaucugugauaa

SEQ ID NO: 756633 - RNA, 19 nt, Homo sapiens
gggaacgauugaccuguga

SEQ ID NO: 756634 - RNA, 19 nt, Homo sapiens
uaaacugcguguucacugu

SEQ ID NO: 756635 - RNA, 19 nt, Homo sapiens
auaaaucaguugcaucugu

SEQ ID NO: 756636 - RNA, 19 nt, Homo sapiens
agagauaguuaagccaauu

SEQ ID NO: 756637 - RNA, 19 nt, Homo sapiens
gacauaaacagggaucaaa

SEQ ID NO: 756638 - RNA, 19 nt, Homo sapiens
gcuauuauuucagugacaa

SEQ ID NO: 756639 - RNA, 19 nt, Homo sapiens
ggacauaaacagggaucaa

SEQ ID NO: 756640 - RNA, 19 nt, Homo sapiens
uaccaugcauugucucaga

SEQ ID NO: 756641 - RNA, 19 nt, Homo sapiens
ucagaggacagaggaauuu

SEQ ID NO: 756642 - RNA, 19 nt, Homo sapiens
ggucgcagcguacuaagug

SEQ ID NO: 756643 - RNA, 19 nt, Homo sapiens
ugagugcucuaugauaaau

SEQ ID NO: 756644 - RNA, 19 nt, Homo sapiens
ucagugaagagauaguuaa

SEQ ID NO: 756645 - RNA, 19 nt, Homo sapiens
ggaauuucucuuucuagga

SEQ ID NO: 756646 - RNA, 19 nt, Homo sapiens
gaacgauugaccugugaau

SEQ ID NO: 756647 - RNA, 19 nt, Homo sapiens
ccagugacgcuccgaguug

SEQ ID NO: 756648 - RNA, 19 nt, Homo sapiens
aaacuggacacucccuaaa

SEQ ID NO: 756649 - RNA, 19 nt, Homo sapiens
ugaagagugugaucuacca

SEQ ID NO: 756650 - RNA, 19 nt, Homo sapiens
caagcuaaacugcguguuc

SEQ ID NO: 756651 - RNA, 19 nt, Homo sapiens
caggaaacaaagcacauuu

SEQ ID NO: 756652 - RNA, 19 nt, Homo sapiens
gaagcgguccgagaaugaa

SEQ ID NO: 756653 - RNA, 19 nt, Homo sapiens
aguugcaucugugauaaua

SEQ ID NO: 756654 - RNA, 19 nt, Homo sapiens
guacuucacccgccacaag

SEQ ID NO: 756655 - RNA, 19 nt, Homo sapiens
gcuccgaguugaggauguu

SEQ ID NO: 756656 - RNA, 19 nt, Homo sapiens
cgauugaccugugaauucu

SEQ ID NO: 756657 - RNA, 19 nt, Homo sapiens
cagcuucggucaagugaac

SEQ ID NO: 756658 - RNA, 19 nt, Homo sapiens
aagcuaaacugcguguuca

SEQ ID NO: 756659 - RNA, 19 nt, Homo sapiens
gcggcucuuugacauuaaa

SEQ ID NO: 756660 - RNA, 19 nt, Homo sapiens
cugguugacuugaauagga

SEQ ID NO: 756661 - RNA, 19 nt, Homo sapiens
cguacuaagugaagaaguc

SEQ ID NO: 756662 - RNA, 19 nt, Homo sapiens
ggaaggucgcagcguacua

SEQ ID NO: 756663 - RNA, 19 nt, Homo sapiens
acuggacacucccuaaaug

SEQ ID NO: 756664 - RNA, 19 nt, Homo sapiens
gauucaggccaagcucuua

SEQ ID NO: 756665 - RNA, 19 nt, Homo sapiens
gaucaaauaaaggagguau

SEQ ID NO: 756666 - RNA, 19 nt, Homo sapiens
aaagaagaccgccugaaag

SEQ ID NO: 756667 - RNA, 19 nt, Homo sapiens
uaguuaagccaauuccauu

SEQ ID NO: 756668 - RNA, 19 nt, Homo sapiens
uaaggcaguuguuuaugac

SEQ ID NO: 756669 - RNA, 19 nt, Homo sapiens
gccacaagcgcaaggagaa

SEQ ID NO: 756670 - RNA, 19 nt, Homo sapiens
aagaagaccgccugaaagu

SEQ ID NO: 756671 - RNA, 19 nt, Homo sapiens
gaucuucacggggcuauua

SEQ ID NO: 756672 - RNA, 19 nt, Homo sapiens
gcucuuaaaggcagaucuu

SEQ ID NO: 756673 - RNA, 19 nt, Homo sapiens
gaccaccuccagccaguga

SEQ ID NO: 756674 - RNA, 19 nt, Homo sapiens
ucacggggcuauuauuuca

SEQ ID NO: 756675 - RNA, 19 nt, Homo sapiens
guccgagaaugaagagugu

SEQ ID NO: 756676 - RNA, 19 nt, Homo sapiens
gcagcguacuaagugaaga

SEQ ID NO: 756677 - RNA, 19 nt, Homo sapiens
cagugacgcuccgaguuga

SEQ ID NO: 756678 - RNA, 19 nt, Homo sapiens
gugaauucuuugccgucua

SEQ ID NO: 756679 - RNA, 19 nt, Homo sapiens
aaaguuauccccaagcuaa

SEQ ID NO: 756680 - RNA, 19 nt, Homo sapiens
ccaaaugccccucuuaugu

SEQ ID NO: 756681 - RNA, 19 nt, Homo sapiens
gagaaugaagagugugauc

SEQ ID NO: 756682 - RNA, 19 nt, Homo sapiens
uugcaucugugauaauaca

SEQ ID NO: 756683 - RNA, 19 nt, Homo sapiens
caaagcgaagggaacgauu

SEQ ID NO: 756684 - RNA, 19 nt, Homo sapiens
ggucugcgaagaaguucaa

SEQ ID NO: 756685 - RNA, 19 nt, Homo sapiens
gaaagccaaaggccucucu

SEQ ID NO: 756686 - RNA, 19 nt, Homo sapiens
gagauaguuaagccaauuc

SEQ ID NO: 756687 - RNA, 19 nt, Homo sapiens
auugaccugugaauucuuu

SEQ ID NO: 756688 - RNA, 19 nt, Homo sapiens
acgauugaccugugaauuc

SEQ ID NO: 756689 - RNA, 19 nt, Homo sapiens
ccucuuauguggguauuac

SEQ ID NO: 756690 - RNA, 19 nt, Homo sapiens
acagggaucaaauaaagga

SEQ ID NO: 756691 - RNA, 19 nt, Homo sapiens
gugaacggucugcgaagaa

SEQ ID NO: 756692 - RNA, 19 nt, Homo sapiens
uggcuuuauuuccuacauu

SEQ ID NO: 756693 - RNA, 19 nt, Homo sapiens
guuaacacugguugacuug

SEQ ID NO: 756694 - RNA, 19 nt, Homo sapiens
gaggaauuucucuuucuag

SEQ ID NO: 756695 - RNA, 19 nt, Homo sapiens
guacuaagugaagaaguca

SEQ ID NO: 756696 - RNA, 19 nt, Homo sapiens
uaaauguccaccuuucagu

SEQ ID NO: 756697 - RNA, 19 nt, Homo sapiens
aggcggugguccuggagua

SEQ ID NO: 756698 - RNA, 19 nt, Homo sapiens
gacacgcagccacagauga

SEQ ID NO: 756699 - RNA, 19 nt, Homo sapiens
aaagcgaagggaacgauug

SEQ ID NO: 756700 - RNA, 19 nt, Homo sapiens
ugaacggucugcgaagaag

SEQ ID NO: 756701 - RNA, 19 nt, Homo sapiens
aagaccgccugaaaguuau

SEQ ID NO: 756702 - RNA, 19 nt, Homo sapiens
ccaaagaagaccgccugaa

SEQ ID NO: 756703 - RNA, 19 nt, Homo sapiens
gaggacagaggaauuucuc

SEQ ID NO: 756704 - RNA, 19 nt, Homo sapiens
ugugaucuaccaugcauug

SEQ ID NO: 756705 - RNA, 19 nt, Homo sapiens
gucuaaggcaguuguuuau

SEQ ID NO: 756706 - RNA, 19 nt, Homo sapiens
aagcgaagggaacgauuga

SEQ ID NO: 756707 - RNA, 19 nt, Homo sapiens
gcagagauacagccuuuuc

SEQ ID NO: 756708 - RNA, 19 nt, Homo sapiens
acauaaacagggaucaaau

SEQ ID NO: 756709 - RNA, 19 nt, Homo sapiens
gaagaaaggucacauauuu

SEQ ID NO: 756710 - RNA, 19 nt, Homo sapiens
gaggaaagcuugcugauua

SEQ ID NO: 756711 - RNA, 19 nt, Homo sapiens
caggauggcuugugauuua

SEQ ID NO: 756712 - RNA, 19 nt, Homo sapiens
gaacuugaauggccuuaaa

SEQ ID NO: 756713 - RNA, 19 nt, Homo sapiens
caagcuggcuggcugauua

SEQ ID NO: 756714 - RNA, 19 nt, Homo sapiens
uauggaagcugaaauguaa

SEQ ID NO: 756715 - RNA, 19 nt, Homo sapiens
gaucagagaccauguuauu

SEQ ID NO: 756716 - RNA, 19 nt, Homo sapiens
ggagagaccugucguuaag

SEQ ID NO: 756717 - RNA, 19 nt, Homo sapiens
ccaaagugcugggauuaua

SEQ ID NO: 756718 - RNA, 19 nt, Homo sapiens
aaacaugucuauagaguug

SEQ ID NO: 756719 - RNA, 19 nt, Homo sapiens
gaagacauuuguaagcuau

SEQ ID NO: 756720 - RNA, 19 nt, Homo sapiens
aaacauagcaccuuaaguu

SEQ ID NO: 756721 - RNA, 19 nt, Homo sapiens
agaaggaaauggaagauaa

SEQ ID NO: 756722 - RNA, 19 nt, Homo sapiens
gcaugaaucugcuaaaucu

SEQ ID NO: 756723 - RNA, 19 nt, Homo sapiens
ccucaaagcucaguuuauu

SEQ ID NO: 756724 - RNA, 19 nt, Homo sapiens
gcuauuggaucaucacuug

SEQ ID NO: 756725 - RNA, 19 nt, Homo sapiens
gugaagccuuuacuuguua

SEQ ID NO: 756726 - RNA, 19 nt, Homo sapiens
uccaauagcuacuacauuu

SEQ ID NO: 756727 - RNA, 19 nt, Homo sapiens
gcacaagaguuccuacaca

SEQ ID NO: 756728 - RNA, 19 nt, Homo sapiens
guaaugagagcaaguauau

SEQ ID NO: 756729 - RNA, 19 nt, Homo sapiens
gaacgcagcaucugacaug

SEQ ID NO: 756730 - RNA, 19 nt, Homo sapiens
gaggaucugugaaaugcua

SEQ ID NO: 756731 - RNA, 19 nt, Homo sapiens
gaacugcuccugugguuug

SEQ ID NO: 756732 - RNA, 19 nt, Homo sapiens
guauugagcuguuuguugu

SEQ ID NO: 756733 - RNA, 19 nt, Homo sapiens
gaaaguugcaauucaugua

SEQ ID NO: 756734 - RNA, 19 nt, Homo sapiens
gagcuuaauuguccauuuc

SEQ ID NO: 756735 - RNA, 19 nt, Homo sapiens
ccucaaacauagcaccuua

SEQ ID NO: 756736 - RNA, 19 nt, Homo sapiens
gaacuuagcagacuuuacu

SEQ ID NO: 756737 - RNA, 19 nt, Homo sapiens
guaacaaacuacagaaagu

SEQ ID NO: 756738 - RNA, 19 nt, Homo sapiens
ggugaagccuuuacuuguu

SEQ ID NO: 756739 - RNA, 19 nt, Homo sapiens
guagaugucacuuuaguaa

SEQ ID NO: 756740 - RNA, 19 nt, Homo sapiens
ggaaauggaagauaaagug

SEQ ID NO: 756741 - RNA, 19 nt, Homo sapiens
aagaguaaaugccuuguuu

SEQ ID NO: 756742 - RNA, 19 nt, Homo sapiens
caaccaaggcggcuacuaa

SEQ ID NO: 756743 - RNA, 19 nt, Homo sapiens
gaggaacauuucauucuug

SEQ ID NO: 756744 - RNA, 19 nt, Homo sapiens
gaaccuaugucaagaugag

SEQ ID NO: 756745 - RNA, 19 nt, Homo sapiens
caacauggcuaaagcaaaa

SEQ ID NO: 756746 - RNA, 19 nt, Homo sapiens
caucccugcuuauuucuua

SEQ ID NO: 756747 - RNA, 19 nt, Homo sapiens
ucagcaaguuggaauagua

SEQ ID NO: 756748 - RNA, 19 nt, Homo sapiens
ugauggcacucauuaaauu

SEQ ID NO: 756749 - RNA, 19 nt, Homo sapiens
gaaagugaaauugcagaua

SEQ ID NO: 756750 - RNA, 19 nt, Homo sapiens
ccaaguagcugggauuaca

SEQ ID NO: 756751 - RNA, 19 nt, Homo sapiens
gauguuugcuucuguagau

SEQ ID NO: 756752 - RNA, 19 nt, Homo sapiens
caaaugguauugagcuguu

SEQ ID NO: 756753 - RNA, 19 nt, Homo sapiens
ucaauaaucuugugcugau

SEQ ID NO: 756754 - RNA, 19 nt, Homo sapiens
uuaccuaacuucuagugua

SEQ ID NO: 756755 - RNA, 19 nt, Homo sapiens
gaagauaaagugacuaguc

SEQ ID NO: 756756 - RNA, 19 nt, Homo sapiens
caaggcggcuacuaaguga

SEQ ID NO: 756757 - RNA, 19 nt, Homo sapiens
guacugaacccuuuaucaa

SEQ ID NO: 756758 - RNA, 19 nt, Homo sapiens
caaccugccuucuguaagu

SEQ ID NO: 756759 - RNA, 19 nt, Homo sapiens
caguauaccugcucuccua

SEQ ID NO: 756760 - RNA, 19 nt, Homo sapiens
gaauauacguguguagagu

SEQ ID NO: 756761 - RNA, 19 nt, Homo sapiens
guucagauuucuuaaggaa

SEQ ID NO: 756762 - RNA, 19 nt, Homo sapiens
ggacagagcaggagaucau

SEQ ID NO: 756763 - RNA, 19 nt, Homo sapiens
gaaggaaauggaagauaaa

SEQ ID NO: 756764 - RNA, 19 nt, Homo sapiens
gauggcuugugauuuauuu

SEQ ID NO: 756765 - RNA, 19 nt, Homo sapiens
gaaauggaagauaaaguga

SEQ ID NO: 756766 - RNA, 19 nt, Homo sapiens
uaacuuaugugacucuagu

SEQ ID NO: 756767 - RNA, 19 nt, Homo sapiens
gcagguagcaguagugugu

SEQ ID NO: 756768 - RNA, 19 nt, Homo sapiens
cuauagaguuggcaguuaa

SEQ ID NO: 756769 - RNA, 19 nt, Homo sapiens
gaccacaaguuagaagaaa

SEQ ID NO: 756770 - RNA, 19 nt, Homo sapiens
guaaaugccuuguuuuguu

SEQ ID NO: 756771 - RNA, 19 nt, Homo sapiens
gaaagggccaagaguaaau

SEQ ID NO: 756772 - RNA, 19 nt, Homo sapiens
gcacaaccucucacaaaug

SEQ ID NO: 756773 - RNA, 19 nt, Homo sapiens
ccaugugcauuaacuguuu

SEQ ID NO: 756774 - RNA, 19 nt, Homo sapiens
uuaagaagcugaacugcau

SEQ ID NO: 756775 - RNA, 19 nt, Homo sapiens
ggcaguuaaugcugaauuu

SEQ ID NO: 756776 - RNA, 19 nt, Homo sapiens
caauaucugucuccucuca

SEQ ID NO: 756777 - RNA, 19 nt, Homo sapiens
ccauuaaauucacacauga

SEQ ID NO: 756778 - RNA, 19 nt, Homo sapiens
gagcuccucucacaaguag

SEQ ID NO: 756779 - RNA, 19 nt, Homo sapiens
ggaaacgguugcagaaagg

SEQ ID NO: 756780 - RNA, 19 nt, Homo sapiens
gcuacuacauuugauagaa

SEQ ID NO: 756781 - RNA, 19 nt, Homo sapiens
gaccugucguuaaggauuu

SEQ ID NO: 756782 - RNA, 19 nt, Homo sapiens
ucacugcuguggucauuug

SEQ ID NO: 756783 - RNA, 19 nt, Homo sapiens
caauggugccucaaacaua

SEQ ID NO: 756784 - RNA, 19 nt, Homo sapiens
cuuaacagcugccguugaa

SEQ ID NO: 756785 - RNA, 19 nt, Homo sapiens
acagcucacugcaaccuua

SEQ ID NO: 756786 - RNA, 19 nt, Homo sapiens
gugcaaauacgauauguug

SEQ ID NO: 756787 - RNA, 19 nt, Homo sapiens
gauaaugugccaaccagaa

SEQ ID NO: 756788 - RNA, 19 nt, Homo sapiens
gagucauuguuccuuaaua

SEQ ID NO: 756789 - RNA, 19 nt, Homo sapiens
ugaagacauuuguaagcua

SEQ ID NO: 756790 - RNA, 19 nt, Homo sapiens
ucaagaaccuaugucaaga

SEQ ID NO: 756791 - RNA, 19 nt, Homo sapiens
ugaggaacauuucauucuu

SEQ ID NO: 756792 - RNA, 19 nt, Homo sapiens
gcagagagccucccguuuu

SEQ ID NO: 756793 - RNA, 19 nt, Homo sapiens
guuguuaacuucuuucucu

SEQ ID NO: 756794 - RNA, 19 nt, Homo sapiens
caauagcuacuacauuuga

SEQ ID NO: 756795 - RNA, 19 nt, Homo sapiens
caaauacgauauguugcuu

SEQ ID NO: 756796 - RNA, 19 nt, Homo sapiens
cacaagaguuccuacacaa

SEQ ID NO: 756797 - RNA, 19 nt, Homo sapiens
cacaaccucucacaaaugu

SEQ ID NO: 756798 - RNA, 19 nt, Homo sapiens
guuggaauaguaaggauua

SEQ ID NO: 756799 - RNA, 19 nt, Homo sapiens
aagcugaacugcaugaauc

SEQ ID NO: 756800 - RNA, 19 nt, Homo sapiens
ggacaaguuuacugcucuu

SEQ ID NO: 756801 - RNA, 19 nt, Homo sapiens
ucaauacucugcauuccau

SEQ ID NO: 756802 - RNA, 19 nt, Homo sapiens
uagcacuugugaugcaaua

SEQ ID NO: 756803 - RNA, 19 nt, Homo sapiens
gauaguacugaacccuuua

SEQ ID NO: 756804 - RNA, 19 nt, Homo sapiens
uaagagauacauuccaaga

SEQ ID NO: 756805 - RNA, 19 nt, Homo sapiens
aaucaggcuuguguucuua

SEQ ID NO: 756806 - RNA, 19 nt, Homo sapiens
ggauuuguagguauaauug

SEQ ID NO: 756807 - RNA, 19 nt, Homo sapiens
ucaguagcuugagauguua

SEQ ID NO: 756808 - RNA, 19 nt, Homo sapiens
ucaguggccuugugcaaau

SEQ ID NO: 756809 - RNA, 19 nt, Homo sapiens
gaacggcauuguuaaauca

SEQ ID NO: 756810 - RNA, 19 nt, Homo sapiens
gcauuuaacuuuggagaaa

SEQ ID NO: 756811 - RNA, 19 nt, Homo sapiens
ugagagcacuuucuuuaaa

SEQ ID NO: 756812 - RNA, 19 nt, Homo sapiens
ccagagaacggcauuguua

SEQ ID NO: 756813 - RNA, 19 nt, Homo sapiens
ccaaauauaaucccaagua

SEQ ID NO: 756814 - RNA, 19 nt, Homo sapiens
gagaaugucugagcaagga

SEQ ID NO: 756815 - RNA, 19 nt, Homo sapiens
ggaaaggaauucaaaagaa

SEQ ID NO: 756816 - RNA, 19 nt, Homo sapiens
cacaauugcugguucauau

SEQ ID NO: 756817 - RNA, 19 nt, Homo sapiens
aaaaugcacuugccuauaa

SEQ ID NO: 756818 - RNA, 19 nt, Homo sapiens
ugauaaggcugaaccaaau

SEQ ID NO: 756819 - RNA, 19 nt, Homo sapiens
gagcugauggugacuuuaa

SEQ ID NO: 756820 - RNA, 19 nt, Homo sapiens
cagcaagauuaguagguua

SEQ ID NO: 756821 - RNA, 19 nt, Homo sapiens
ugaauaaggugcauuuaac

SEQ ID NO: 756822 - RNA, 19 nt, Homo sapiens
uaaggugcauuuaacuuug

SEQ ID NO: 756823 - RNA, 19 nt, Homo sapiens
gcacuugccuauaagaaac

SEQ ID NO: 756824 - RNA, 19 nt, Homo sapiens
ggagaaguagcauuuaguu

SEQ ID NO: 756825 - RNA, 19 nt, Homo sapiens
ugggaaacuucacaucaua

SEQ ID NO: 756826 - RNA, 19 nt, Homo sapiens
gugaauaaggugcauuuaa

SEQ ID NO: 756827 - RNA, 19 nt, Homo sapiens
gauaaggcugaaccaaaua

SEQ ID NO: 756828 - RNA, 19 nt, Homo sapiens
ccaaguauccucucuccuu

SEQ ID NO: 756829 - RNA, 19 nt, Homo sapiens
gaaaugaaucugagcugau

SEQ ID NO: 756830 - RNA, 19 nt, Homo sapiens
gagggaaaauugauuaaga

SEQ ID NO: 756831 - RNA, 19 nt, Homo sapiens
aaacacaauugcugguuca

SEQ ID NO: 756832 - RNA, 19 nt, Homo sapiens
ugggauagcuccacuagag

SEQ ID NO: 756833 - RNA, 19 nt, Homo sapiens
aaaugaaucugagcugaug

SEQ ID NO: 756834 - RNA, 19 nt, Homo sapiens
gaaacagagagcauugaga

SEQ ID NO: 756835 - RNA, 19 nt, Homo sapiens
gagaacggcauuguuaaau

SEQ ID NO: 756836 - RNA, 19 nt, Homo sapiens
gagagcacuuucuuuaaaa

SEQ ID NO: 756837 - RNA, 19 nt, Homo sapiens
gcaagauuaguagguuaua

SEQ ID NO: 756838 - RNA, 19 nt, Homo sapiens
auugagagcacuuucuuua

SEQ ID NO: 756839 - RNA, 19 nt, Homo sapiens
cugcugaaauuguacuuau

SEQ ID NO: 756840 - RNA, 19 nt, Homo sapiens
caaaaguuguccagaaaug

SEQ ID NO: 756841 - RNA, 19 nt, Homo sapiens
guucgaagccuggaaaugu

SEQ ID NO: 756842 - RNA, 19 nt, Homo sapiens
gagaaguagcauuuaguug

SEQ ID NO: 756843 - RNA, 19 nt, Homo sapiens
gcuccuuacagcaagauua

SEQ ID NO: 756844 - RNA, 19 nt, Homo sapiens
ccuauaagaaacacaauug

SEQ ID NO: 756845 - RNA, 19 nt, Homo sapiens
gcuggaggcucagaaucaa

SEQ ID NO: 756846 - RNA, 19 nt, Homo sapiens
gcauugagagcacuuucuu

SEQ ID NO: 756847 - RNA, 19 nt, Homo sapiens
gcaaauggaaaggaauuca

SEQ ID NO: 756848 - RNA, 19 nt, Homo sapiens
gagcuugggagagggcuua

SEQ ID NO: 756849 - RNA, 19 nt, Homo sapiens
caauugcugguucauauga

SEQ ID NO: 756850 - RNA, 19 nt, Homo sapiens
cagagaacggcauuguuaa

SEQ ID NO: 756851 - RNA, 19 nt, Homo sapiens
gaauaaggugcauuuaacu

SEQ ID NO: 756852 - RNA, 19 nt, Homo sapiens
caaauggaaaggaauucaa

SEQ ID NO: 756853 - RNA, 19 nt, Homo sapiens
agaacggcauuguuaaauc

SEQ ID NO: 756854 - RNA, 19 nt, Homo sapiens
gaaacuuaggaaauaguga

SEQ ID NO: 756855 - RNA, 19 nt, Homo sapiens
ggcaauagcagaggaagga

SEQ ID NO: 756856 - RNA, 19 nt, Homo sapiens
caaagggcauaaaaucuug

SEQ ID NO: 756857 - RNA, 19 nt, Homo sapiens
gaaacuucacaucauacuu

SEQ ID NO: 756858 - RNA, 19 nt, Homo sapiens
acagcaagauuaguagguu

SEQ ID NO: 756859 - RNA, 19 nt, Homo sapiens
gaucuugucgcaccagcaa

SEQ ID NO: 756860 - RNA, 19 nt, Homo sapiens
ugggagagggcuuauguuu

SEQ ID NO: 756861 - RNA, 19 nt, Homo sapiens
agagaacggcauuguuaaa

SEQ ID NO: 756862 - RNA, 19 nt, Homo sapiens
ggaaacagagagcauugag

SEQ ID NO: 756863 - RNA, 19 nt, Homo sapiens
aaaguuguccagaaaugaa

SEQ ID NO: 756864 - RNA, 19 nt, Homo sapiens
gcauuuaguugggauagcu

SEQ ID NO: 756865 - RNA, 19 nt, Homo sapiens
gaggcugggugcagucaag

SEQ ID NO: 756866 - RNA, 19 nt, Homo sapiens
ccuuacagcaagauuagua

SEQ ID NO: 756867 - RNA, 19 nt, Homo sapiens
uaaggcugaaccaaauaua

SEQ ID NO: 756868 - RNA, 19 nt, Homo sapiens
cagaaucaagaaagaagaa

SEQ ID NO: 756869 - RNA, 19 nt, Homo sapiens
gcucagaaucaagaaagaa

SEQ ID NO: 756870 - RNA, 19 nt, Homo sapiens
uaauuugcaucugggagaa

SEQ ID NO: 756871 - RNA, 19 nt, Homo sapiens
ggcaucauauuagcuuuua

SEQ ID NO: 756872 - RNA, 19 nt, Homo sapiens
ccucucuccuuccuuguug

SEQ ID NO: 756873 - RNA, 19 nt, Homo sapiens
gaaagucuucaggaucaga

SEQ ID NO: 756874 - RNA, 19 nt, Homo sapiens
cggcauuguuaaaucagaa

SEQ ID NO: 756875 - RNA, 19 nt, Homo sapiens
gagcaaggagaccugaauc

SEQ ID NO: 756876 - RNA, 19 nt, Homo sapiens
ugggugcagucaagacaaa

SEQ ID NO: 756877 - RNA, 19 nt, Homo sapiens
uugugagccuggagaagua

SEQ ID NO: 756878 - RNA, 19 nt, Homo sapiens
gccuggagaaguagcauuu

SEQ ID NO: 756879 - RNA, 19 nt, Homo sapiens
acacaauugcugguucaua

SEQ ID NO: 756880 - RNA, 19 nt, Homo sapiens
gaaagaagaaaauccaagu

SEQ ID NO: 756881 - RNA, 19 nt, Homo sapiens
ucuugcugcugaaauugua

SEQ ID NO: 756882 - RNA, 19 nt, Homo sapiens
cugagcugauggugacuuu

SEQ ID NO: 756883 - RNA, 19 nt, Homo sapiens
uggcuuugguggagauuuc

SEQ ID NO: 756884 - RNA, 19 nt, Homo sapiens
ccucucagcuccccaaaau

SEQ ID NO: 756885 - RNA, 19 nt, Homo sapiens
uugauaaggcugaaccaaa

SEQ ID NO: 756886 - RNA, 19 nt, Homo sapiens
gcagucuugcugucuguga

SEQ ID NO: 756887 - RNA, 19 nt, Homo sapiens
gcaggaaaagguaaacuga

SEQ ID NO: 756888 - RNA, 19 nt, Homo sapiens
uggucuugcugcugaaauu

SEQ ID NO: 756889 - RNA, 19 nt, Homo sapiens
ggaaacuucacaucauacu

SEQ ID NO: 756890 - RNA, 19 nt, Homo sapiens
cuggagaaguagcauuuag

SEQ ID NO: 756891 - RNA, 19 nt, Homo sapiens
caucugggagaaugucuga

SEQ ID NO: 756892 - RNA, 19 nt, Homo sapiens
gugcugaauuuuccucaaa

SEQ ID NO: 756893 - RNA, 19 nt, Homo sapiens
gagacggccacuccagaga

SEQ ID NO: 756894 - RNA, 19 nt, Homo sapiens
gcagucaagacaaaaguaa

SEQ ID NO: 756895 - RNA, 19 nt, Homo sapiens
uagugaauaaggugcauuu

SEQ ID NO: 756896 - RNA, 19 nt, Homo sapiens
caaaaugcacuugccuaua

SEQ ID NO: 756897 - RNA, 19 nt, Homo sapiens
aauauaaucccaaguaucc

SEQ ID NO: 756898 - RNA, 19 nt, Homo sapiens
aaggcugaaccaaauauaa

SEQ ID NO: 756899 - RNA, 19 nt, Homo sapiens
ggcucagaaucaagaaaga

SEQ ID NO: 756900 - RNA, 19 nt, Homo sapiens
ugaagaggagaaacuggaa

SEQ ID NO: 756901 - RNA, 19 nt, Homo sapiens
cauuuccagugucuauaga

SEQ ID NO: 756902 - RNA, 19 nt, Homo sapiens
ggcuggaggcucagaauca

SEQ ID NO: 756903 - RNA, 19 nt, Homo sapiens
ggaugaagaggagaaacug

SEQ ID NO: 756904 - RNA, 19 nt, Homo sapiens
uugagagcacuuucuuuaa

SEQ ID NO: 756905 - RNA, 19 nt, Homo sapiens
gcugcugaaauuguacuua

SEQ ID NO: 756906 - RNA, 19 nt, Homo sapiens
ucucaauacugcaaaaguu

SEQ ID NO: 756907 - RNA, 19 nt, Homo sapiens
uucgaagccuggaaauguu

SEQ ID NO: 756908 - RNA, 19 nt, Homo sapiens
ucaguucgaagccuggaaa

SEQ ID NO: 756909 - RNA, 19 nt, Homo sapiens
gagcucagaucuuauuaua

SEQ ID NO: 756910 - RNA, 19 nt, Homo sapiens
gagaaacccuauaaaugua

SEQ ID NO: 756911 - RNA, 19 nt, Homo sapiens
gcucagaccuuauuaaaca

SEQ ID NO: 756912 - RNA, 19 nt, Homo sapiens
gcucagaucugguuaaaca

SEQ ID NO: 756913 - RNA, 19 nt, Homo sapiens
guacugaucuuauugaaca

SEQ ID NO: 756914 - RNA, 19 nt, Homo sapiens
gagagaagccuuauacuug

SEQ ID NO: 756915 - RNA, 19 nt, Homo sapiens
gcucagaucuuauuauaca

SEQ ID NO: 756916 - RNA, 19 nt, Homo sapiens
gagaaagccuucagucaga

SEQ ID NO: 756917 - RNA, 19 nt, Homo sapiens
agucagagcuccaaccuua

SEQ ID NO: 756918 - RNA, 19 nt, Homo sapiens
gcucagaccucacuaaaca

SEQ ID NO: 756919 - RNA, 19 nt, Homo sapiens
aaucagagcucaguccuua

SEQ ID NO: 756920 - RNA, 19 nt, Homo sapiens
agucagagcucagaucuua

SEQ ID NO: 756921 - RNA, 19 nt, Homo sapiens
ggagaaaccauauaaaugu

SEQ ID NO: 756922 - RNA, 19 nt, Homo sapiens
agucagagcucagaucuua

SEQ ID NO: 756923 - RNA, 19 nt, Homo sapiens
caacucuuaugcuacauua

SEQ ID NO: 756924 - RNA, 19 nt, Homo sapiens
gagagaaacccuauaaaug

SEQ ID NO: 756925 - RNA, 19 nt, Homo sapiens
gagaaaccauauccaugua

SEQ ID NO: 756926 - RNA, 19 nt, Homo sapiens
ugagaaaccuuaugaaugg

SEQ ID NO: 756927 - RNA, 19 nt, Homo sapiens
ugaaugcuguugauuauug

SEQ ID NO: 756928 - RNA, 19 nt, Homo sapiens
ggagagaaacccuauaaau

SEQ ID NO: 756929 - RNA, 19 nt, Homo sapiens
gggaaagccuucagucaga

SEQ ID NO: 756930 - RNA, 19 nt, Homo sapiens
gggaaagccuucagucaga

SEQ ID NO: 756931 - RNA, 19 nt, Homo sapiens
guucagaucuuguuaagca

SEQ ID NO: 756932 - RNA, 19 nt, Homo sapiens
ggagaaacccuaccagugu

SEQ ID NO: 756933 - RNA, 19 nt, Homo sapiens
gaaaccauaugcauguaau

SEQ ID NO: 756934 - RNA, 19 nt, Homo sapiens
agagaaaccuuaugcaugu

SEQ ID NO: 756935 - RNA, 19 nt, Homo sapiens
gaaaccauauccauguaau

SEQ ID NO: 756936 - RNA, 19 nt, Homo sapiens
gagaagccuuauacuugua

SEQ ID NO: 756937 - RNA, 19 nt, Homo sapiens
gagaauccauauaggagaa

SEQ ID NO: 756938 - RNA, 19 nt, Homo sapiens
gaagaaaccaaauccaugu

SEQ ID NO: 756939 - RNA, 19 nt, Homo sapiens
ucucagaccucauuaaaca

SEQ ID NO: 756940 - RNA, 19 nt, Homo sapiens
ggagaaaccauauccaugu

SEQ ID NO: 756941 - RNA, 19 nt, Homo sapiens
ggagagaagccuuauacuu

SEQ ID NO: 756942 - RNA, 19 nt, Homo sapiens
gagaaaaccuuuagugugu

SEQ ID NO: 756943 - RNA, 19 nt, Homo sapiens
gaucucagaccucauuaaa

SEQ ID NO: 756944 - RNA, 19 nt, Homo sapiens
gagcucagaccuuauuaaa

SEQ ID NO: 756945 - RNA, 19 nt, Homo sapiens
aaucaguguucaacucuua

SEQ ID NO: 756946 - RNA, 19 nt, Homo sapiens
gcacauguacugaucuuau

SEQ ID NO: 756947 - RNA, 19 nt, Homo sapiens
gagcuaugauuccaccauu

SEQ ID NO: 756948 - RNA, 19 nt, Homo sapiens
guucugaccuuauucuuca

SEQ ID NO: 756949 - RNA, 19 nt, Homo sapiens
gagaaaccauaugcaugua

SEQ ID NO: 756950 - RNA, 19 nt, Homo sapiens
gagaaaccauauaaaugug

SEQ ID NO: 756951 - RNA, 19 nt, Homo sapiens
ugagaaacccuaugaaugu

SEQ ID NO: 756952 - RNA, 19 nt, Homo sapiens
gagaagccuuacccaugua

SEQ ID NO: 756953 - RNA, 19 nt, Homo sapiens
gagaaaccuuauuccugua

SEQ ID NO: 756954 - RNA, 19 nt, Homo sapiens
gcaggaaggcuuucaguca

SEQ ID NO: 756955 - RNA, 19 nt, Homo sapiens
gcuccaaccuuauucuuca

SEQ ID NO: 756956 - RNA, 19 nt, Homo sapiens
cagagacacuguaccagaa

SEQ ID NO: 756957 - RNA, 19 nt, Homo sapiens
gaaaccaaauccaugugau

SEQ ID NO: 756958 - RNA, 19 nt, Homo sapiens
agagaaacccuauaaaugu

SEQ ID NO: 756959 - RNA, 19 nt, Homo sapiens
gggagaaaccauauaaaug

SEQ ID NO: 756960 - RNA, 19 nt, Homo sapiens
ucauaacugugacgaauau

SEQ ID NO: 756961 - RNA, 19 nt, Homo sapiens
gggaaaaccuuuagucaga

SEQ ID NO: 756962 - RNA, 19 nt, Homo sapiens
gaaugcuguugauuauuga

SEQ ID NO: 756963 - RNA, 19 nt, Homo sapiens
gaucagaacgucuuuaaaa

SEQ ID NO: 756964 - RNA, 19 nt, Homo sapiens
guucugaucucauuaacca

SEQ ID NO: 756965 - RNA, 19 nt, Homo sapiens
gcucagcucuuacccuaca

SEQ ID NO: 756966 - RNA, 19 nt, Homo sapiens
gcgcucagaucugguuaaa

SEQ ID NO: 756967 - RNA, 19 nt, Homo sapiens
caucagagaauccauauag

SEQ ID NO: 756968 - RNA, 19 nt, Homo sapiens
aaggagaccucauaacugu

SEQ ID NO: 756969 - RNA, 19 nt, Homo sapiens
ggaaagccuucagcacaug

SEQ ID NO: 756970 - RNA, 19 nt, Homo sapiens
guauaagugugaugcaugu

SEQ ID NO: 756971 - RNA, 19 nt, Homo sapiens
guucaacucuuaugcuaca

SEQ ID NO: 756972 - RNA, 19 nt, Homo sapiens
gggaaagccuucagcacau

SEQ ID NO: 756973 - RNA, 19 nt, Homo sapiens
ccauauaaaugcagugagu

SEQ ID NO: 756974 - RNA, 19 nt, Homo sapiens
gagaaaccuuaugcaugua

SEQ ID NO: 756975 - RNA, 19 nt, Homo sapiens
ggagaccucauaacuguga

SEQ ID NO: 756976 - RNA, 19 nt, Homo sapiens
gagaaacccuaugaaugug

SEQ ID NO: 756977 - RNA, 19 nt, Homo sapiens
ucaguaggcuuucagaucu

SEQ ID NO: 756978 - RNA, 19 nt, Homo sapiens
agucagugcucagcucuua

SEQ ID NO: 756979 - RNA, 19 nt, Homo sapiens
agagaagccuuacccaugu

SEQ ID NO: 756980 - RNA, 19 nt, Homo sapiens
aaacaucagagaauccaua

SEQ ID NO: 756981 - RNA, 19 nt, Homo sapiens
gagaacaagaccaagauug

SEQ ID NO: 756982 - RNA, 19 nt, Homo sapiens
agagaagccuuauacuugu

SEQ ID NO: 756983 - RNA, 19 nt, Homo sapiens
gugagaaaccuuaugaaug

SEQ ID NO: 756984 - RNA, 19 nt, Homo sapiens
cacauguacugaucuuauu

SEQ ID NO: 756985 - RNA, 19 nt, Homo sapiens
cuaugaaugugaugaaugu

SEQ ID NO: 756986 - RNA, 19 nt, Homo sapiens
ccuguaaucccaacacuuu

SEQ ID NO: 756987 - RNA, 19 nt, Homo sapiens
ggagagaaaccauaugcau

SEQ ID NO: 756988 - RNA, 19 nt, Homo sapiens
ggagagaaaccuuaugcau

SEQ ID NO: 756989 - RNA, 19 nt, Homo sapiens
ccaggauucugaaggcaaa

SEQ ID NO: 756990 - RNA, 19 nt, Homo sapiens
gaaacccuaugaaugugau

SEQ ID NO: 756991 - RNA, 19 nt, Homo sapiens
ccauauaaaugugaugugu

SEQ ID NO: 756992 - RNA, 19 nt, Homo sapiens
gcagugagcuaugauucca

SEQ ID NO: 756993 - RNA, 19 nt, Homo sapiens
agccaacucucugaacuua

SEQ ID NO: 756994 - RNA, 19 nt, Homo sapiens
aauacacacuggagagaaa

SEQ ID NO: 756995 - RNA, 19 nt, Homo sapiens
gugagaaacccuaugaaug

SEQ ID NO: 756996 - RNA, 19 nt, Homo sapiens
ccucauaacugugacgaau

SEQ ID NO: 756997 - RNA, 19 nt, Homo sapiens
cauguaaucagugcaauaa

SEQ ID NO: 756998 - RNA, 19 nt, Homo sapiens
guguucaacucuuaugcua

SEQ ID NO: 756999 - RNA, 19 nt, Homo sapiens
gauucauacuggagagaaa

SEQ ID NO: 757000 - RNA, 19 nt, Homo sapiens
gaaaccuuauuccuguaau

SEQ ID NO: 757001 - RNA, 19 nt, Homo sapiens
ggaggcagauguggaagca

SEQ ID NO: 757002 - RNA, 19 nt, Homo sapiens
gugaaaagccuuaucauug

SEQ ID NO: 757003 - RNA, 19 nt, Homo sapiens
uuacaucagaggauucaua

SEQ ID NO: 757004 - RNA, 19 nt, Homo sapiens
cagaauucagaccuuauua

SEQ ID NO: 757005 - RNA, 19 nt, Homo sapiens
agucagaauucagaccuua

SEQ ID NO: 757006 - RNA, 19 nt, Homo sapiens
ccaaauccaugugaugagu

SEQ ID NO: 757007 - RNA, 19 nt, Homo sapiens
ggugagaaacccuaugaau

SEQ ID NO: 757008 - RNA, 19 nt, Homo sapiens
ucagagcucagaucuuauu

SEQ ID NO: 757009 - RNA, 19 nt, Homo sapiens
gagcucagaucuuauuaua

SEQ ID NO: 757010 - RNA, 19 nt, Homo sapiens
gagaaacccuauaaaugua

SEQ ID NO: 757011 - RNA, 19 nt, Homo sapiens
gcucagaccuuauuaaaca

SEQ ID NO: 757012 - RNA, 19 nt, Homo sapiens
gcucagaucugguuaaaca

SEQ ID NO: 757013 - RNA, 19 nt, Homo sapiens
guacugaucuuauugaaca

SEQ ID NO: 757014 - RNA, 19 nt, Homo sapiens
gagagaagccuuauacuug

SEQ ID NO: 757015 - RNA, 19 nt, Homo sapiens
gcucagaucuuauuauaca

SEQ ID NO: 757016 - RNA, 19 nt, Homo sapiens
gagaaagccuucagucaga

SEQ ID NO: 757017 - RNA, 19 nt, Homo sapiens
agucagagcuccaaccuua

SEQ ID NO: 757018 - RNA, 19 nt, Homo sapiens
gcucagaccucacuaaaca

SEQ ID NO: 757019 - RNA, 19 nt, Homo sapiens
aaucagagcucaguccuua

SEQ ID NO: 757020 - RNA, 19 nt, Homo sapiens
agucagagcucagaucuua

SEQ ID NO: 757021 - RNA, 19 nt, Homo sapiens
ggagaaaccauauaaaugu

SEQ ID NO: 757022 - RNA, 19 nt, Homo sapiens
agucagagcucagaucuua

SEQ ID NO: 757023 - RNA, 19 nt, Homo sapiens
caacucuuaugcuacauua

SEQ ID NO: 757024 - RNA, 19 nt, Homo sapiens
gagagaaacccuauaaaug

SEQ ID NO: 757025 - RNA, 19 nt, Homo sapiens
gagaaaccauauccaugua

SEQ ID NO: 757026 - RNA, 19 nt, Homo sapiens
ugagaaaccuuaugaaugg

SEQ ID NO: 757027 - RNA, 19 nt, Homo sapiens
ugaaugcuguugauuauug

SEQ ID NO: 757028 - RNA, 19 nt, Homo sapiens
ggagagaaacccuauaaau

SEQ ID NO: 757029 - RNA, 19 nt, Homo sapiens
gggaaagccuucagucaga

SEQ ID NO: 757030 - RNA, 19 nt, Homo sapiens
gggaaagccuucagucaga

SEQ ID NO: 757031 - RNA, 19 nt, Homo sapiens
guucagaucuuguuaagca

SEQ ID NO: 757032 - RNA, 19 nt, Homo sapiens
ggagaaacccuaccagugu

SEQ ID NO: 757033 - RNA, 19 nt, Homo sapiens
gaaaccauaugcauguaau

SEQ ID NO: 757034 - RNA, 19 nt, Homo sapiens
agagaaaccuuaugcaugu

SEQ ID NO: 757035 - RNA, 19 nt, Homo sapiens
gaaaccauauccauguaau

SEQ ID NO: 757036 - RNA, 19 nt, Homo sapiens
gagaagccuuauacuugua

SEQ ID NO: 757037 - RNA, 19 nt, Homo sapiens
gagaauccauauaggagaa

SEQ ID NO: 757038 - RNA, 19 nt, Homo sapiens
gaagaaaccaaauccaugu

SEQ ID NO: 757039 - RNA, 19 nt, Homo sapiens
ucucagaccucauuaaaca

SEQ ID NO: 757040 - RNA, 19 nt, Homo sapiens
ggagaaaccauauccaugu

SEQ ID NO: 757041 - RNA, 19 nt, Homo sapiens
ggagagaagccuuauacuu

SEQ ID NO: 757042 - RNA, 19 nt, Homo sapiens
gagaaaaccuuuagugugu

SEQ ID NO: 757043 - RNA, 19 nt, Homo sapiens
gaucucagaccucauuaaa

SEQ ID NO: 757044 - RNA, 19 nt, Homo sapiens
gagcucagaccuuauuaaa

SEQ ID NO: 757045 - RNA, 19 nt, Homo sapiens
aaucaguguucaacucuua

SEQ ID NO: 757046 - RNA, 19 nt, Homo sapiens
gcacauguacugaucuuau

SEQ ID NO: 757047 - RNA, 19 nt, Homo sapiens
gagcuaugauuccaccauu

SEQ ID NO: 757048 - RNA, 19 nt, Homo sapiens
guucugaccuuauucuuca

SEQ ID NO: 757049 - RNA, 19 nt, Homo sapiens
gagaaaccauaugcaugua

SEQ ID NO: 757050 - RNA, 19 nt, Homo sapiens
gagaaaccauauaaaugug

SEQ ID NO: 757051 - RNA, 19 nt, Homo sapiens
ugagaaacccuaugaaugu

SEQ ID NO: 757052 - RNA, 19 nt, Homo sapiens
gagaagccuuacccaugua

SEQ ID NO: 757053 - RNA, 19 nt, Homo sapiens
gagaaaccuuauuccugua

SEQ ID NO: 757054 - RNA, 19 nt, Homo sapiens
gcaggaaggcuuucaguca

SEQ ID NO: 757055 - RNA, 19 nt, Homo sapiens
gcuccaaccuuauucuuca

SEQ ID NO: 757056 - RNA, 19 nt, Homo sapiens
cagagacacuguaccagaa

SEQ ID NO: 757057 - RNA, 19 nt, Homo sapiens
gaaaccaaauccaugugau

SEQ ID NO: 757058 - RNA, 19 nt, Homo sapiens
agagaaacccuauaaaugu

SEQ ID NO: 757059 - RNA, 19 nt, Homo sapiens
gggagaaaccauauaaaug

SEQ ID NO: 757060 - RNA, 19 nt, Homo sapiens
ucauaacugugacgaauau

SEQ ID NO: 757061 - RNA, 19 nt, Homo sapiens
gggaaaaccuuuagucaga

SEQ ID NO: 757062 - RNA, 19 nt, Homo sapiens
gaaugcuguugauuauuga

SEQ ID NO: 757063 - RNA, 19 nt, Homo sapiens
gaucagaacgucuuuaaaa

SEQ ID NO: 757064 - RNA, 19 nt, Homo sapiens
guucugaucucauuaacca

SEQ ID NO: 757065 - RNA, 19 nt, Homo sapiens
gcucagcucuuacccuaca

SEQ ID NO: 757066 - RNA, 19 nt, Homo sapiens
gcgcucagaucugguuaaa

SEQ ID NO: 757067 - RNA, 19 nt, Homo sapiens
caucagagaauccauauag

SEQ ID NO: 757068 - RNA, 19 nt, Homo sapiens
aaggagaccucauaacugu

SEQ ID NO: 757069 - RNA, 19 nt, Homo sapiens
ggaaagccuucagcacaug

SEQ ID NO: 757070 - RNA, 19 nt, Homo sapiens
guauaagugugaugcaugu

SEQ ID NO: 757071 - RNA, 19 nt, Homo sapiens
guucaacucuuaugcuaca

SEQ ID NO: 757072 - RNA, 19 nt, Homo sapiens
gggaaagccuucagcacau

SEQ ID NO: 757073 - RNA, 19 nt, Homo sapiens
ccauauaaaugcagugagu

SEQ ID NO: 757074 - RNA, 19 nt, Homo sapiens
gagaaaccuuaugcaugua

SEQ ID NO: 757075 - RNA, 19 nt, Homo sapiens
ggagaccucauaacuguga

SEQ ID NO: 757076 - RNA, 19 nt, Homo sapiens
gagaaacccuaugaaugug

SEQ ID NO: 757077 - RNA, 19 nt, Homo sapiens
ucaguaggcuuucagaucu

SEQ ID NO: 757078 - RNA, 19 nt, Homo sapiens
agucagugcucagcucuua

SEQ ID NO: 757079 - RNA, 19 nt, Homo sapiens
agagaagccuuacccaugu

SEQ ID NO: 757080 - RNA, 19 nt, Homo sapiens
aaacaucagagaauccaua

SEQ ID NO: 757081 - RNA, 19 nt, Homo sapiens
gagaacaagaccaagauug

SEQ ID NO: 757082 - RNA, 19 nt, Homo sapiens
agagaagccuuauacuugu

SEQ ID NO: 757083 - RNA, 19 nt, Homo sapiens
gugagaaaccuuaugaaug

SEQ ID NO: 757084 - RNA, 19 nt, Homo sapiens
cacauguacugaucuuauu

SEQ ID NO: 757085 - RNA, 19 nt, Homo sapiens
cuaugaaugugaugaaugu

SEQ ID NO: 757086 - RNA, 19 nt, Homo sapiens
ccuguaaucccaacacuuu

SEQ ID NO: 757087 - RNA, 19 nt, Homo sapiens
ggagagaaaccauaugcau

SEQ ID NO: 757088 - RNA, 19 nt, Homo sapiens
ggagagaaaccuuaugcau

SEQ ID NO: 757089 - RNA, 19 nt, Homo sapiens
ccaggauucugaaggcaaa

SEQ ID NO: 757090 - RNA, 19 nt, Homo sapiens
gaaacccuaugaaugugau

SEQ ID NO: 757091 - RNA, 19 nt, Homo sapiens
ccauauaaaugugaugugu

SEQ ID NO: 757092 - RNA, 19 nt, Homo sapiens
gcagugagcuaugauucca

SEQ ID NO: 757093 - RNA, 19 nt, Homo sapiens
agccaacucucugaacuua

SEQ ID NO: 757094 - RNA, 19 nt, Homo sapiens
aauacacacuggagagaaa

SEQ ID NO: 757095 - RNA, 19 nt, Homo sapiens
gugagaaacccuaugaaug

SEQ ID NO: 757096 - RNA, 19 nt, Homo sapiens
ccucauaacugugacgaau

SEQ ID NO: 757097 - RNA, 19 nt, Homo sapiens
cauguaaucagugcaauaa

SEQ ID NO: 757098 - RNA, 19 nt, Homo sapiens
guguucaacucuuaugcua

SEQ ID NO: 757099 - RNA, 19 nt, Homo sapiens
gauucauacuggagagaaa

SEQ ID NO: 757100 - RNA, 19 nt, Homo sapiens
gaaaccuuauuccuguaau

SEQ ID NO: 757101 - RNA, 19 nt, Homo sapiens
ggaggcagauguggaagca

SEQ ID NO: 757102 - RNA, 19 nt, Homo sapiens
gugaaaagccuuaucauug

SEQ ID NO: 757103 - RNA, 19 nt, Homo sapiens
uuacaucagaggauucaua

SEQ ID NO: 757104 - RNA, 19 nt, Homo sapiens
cagaauucagaccuuauua

SEQ ID NO: 757105 - RNA, 19 nt, Homo sapiens
agucagaauucagaccuua

SEQ ID NO: 757106 - RNA, 19 nt, Homo sapiens
ccaaauccaugugaugagu

SEQ ID NO: 757107 - RNA, 19 nt, Homo sapiens
ggugagaaacccuaugaau

SEQ ID NO: 757108 - RNA, 19 nt, Homo sapiens
ucagagcucagaucuuauu

SEQ ID NO: 757109 - RNA, 19 nt, Homo sapiens
ggaaagggauuuagucgua

SEQ ID NO: 757110 - RNA, 19 nt, Homo sapiens
ggaaacagauugcaaguga

SEQ ID NO: 757111 - RNA, 19 nt, Homo sapiens
gaucaaaucuuguaaguca

SEQ ID NO: 757112 - RNA, 19 nt, Homo sapiens
gaucagcacuuaauaauca

SEQ ID NO: 757113 - RNA, 19 nt, Homo sapiens
gguaagaacuuccgucgua

SEQ ID NO: 757114 - RNA, 19 nt, Homo sapiens
gggaaaggcuucagucgua

SEQ ID NO: 757115 - RNA, 19 nt, Homo sapiens
cgucagaguucauaucuua

SEQ ID NO: 757116 - RNA, 19 nt, Homo sapiens
gaacaucagagaauucaua

SEQ ID NO: 757117 - RNA, 19 nt, Homo sapiens
ggagagaaaugcuauaagu

SEQ ID NO: 757118 - RNA, 19 nt, Homo sapiens
gagagaaaccuuacaauug

SEQ ID NO: 757119 - RNA, 19 nt, Homo sapiens
gaacuuccgucguagauca

SEQ ID NO: 757120 - RNA, 19 nt, Homo sapiens
gggcagggcuucaaucaga

SEQ ID NO: 757121 - RNA, 19 nt, Homo sapiens
ggagagaaaccuuacaauu

SEQ ID NO: 757122 - RNA, 19 nt, Homo sapiens
agucguagaucaacacuua

SEQ ID NO: 757123 - RNA, 19 nt, Homo sapiens
gcucacaucuucaaacuca

SEQ ID NO: 757124 - RNA, 19 nt, Homo sapiens
aaucagagcucacgacuuc

SEQ ID NO: 757125 - RNA, 19 nt, Homo sapiens
gagagaagccauacaaaug

SEQ ID NO: 757126 - RNA, 19 nt, Homo sapiens
gaucaacacuuacuguaca

SEQ ID NO: 757127 - RNA, 19 nt, Homo sapiens
gaagacagcaacucaaaga

SEQ ID NO: 757128 - RNA, 19 nt, Homo sapiens
aagcaaagcuccacuguuc

SEQ ID NO: 757129 - RNA, 19 nt, Homo sapiens
gguaaagccuuccgucaga

SEQ ID NO: 757130 - RNA, 19 nt, Homo sapiens
ggagaaaccauauaauugu

SEQ ID NO: 757131 - RNA, 19 nt, Homo sapiens
agagaaaccuuacaauugu

SEQ ID NO: 757132 - RNA, 19 nt, Homo sapiens
gguaaggaauuuagucaga

SEQ ID NO: 757133 - RNA, 19 nt, Homo sapiens
guaugaagacucuaugaua

SEQ ID NO: 757134 - RNA, 19 nt, Homo sapiens
gagcagaucuuaaaauuca

SEQ ID NO: 757135 - RNA, 19 nt, Homo sapiens
agagaaaccuuacaagugu

SEQ ID NO: 757136 - RNA, 19 nt, Homo sapiens
cgucguagaucagcacuua

SEQ ID NO: 757137 - RNA, 19 nt, Homo sapiens
gaaaucagcagacaagauc

SEQ ID NO: 757138 - RNA, 19 nt, Homo sapiens
gagagaaaccuuacaagug

SEQ ID NO: 757139 - RNA, 19 nt, Homo sapiens
cagacaagauccaaaguga

SEQ ID NO: 757140 - RNA, 19 nt, Homo sapiens
gagagaaaccauacaaaug

SEQ ID NO: 757141 - RNA, 19 nt, Homo sapiens
gagagaaaccauacaaaug

SEQ ID NO: 757142 - RNA, 19 nt, Homo sapiens
ggagagaaaccauacaaau

SEQ ID NO: 757143 - RNA, 19 nt, Homo sapiens
gggagaaaccauauaauug

SEQ ID NO: 757144 - RNA, 19 nt, Homo sapiens
ggagagaaaccauacaaau

SEQ ID NO: 757145 - RNA, 19 nt, Homo sapiens
ucacugaugucuucaacuu

SEQ ID NO: 757146 - RNA, 19 nt, Homo sapiens
ggaggaaguucuacaaggu

SEQ ID NO: 757147 - RNA, 19 nt, Homo sapiens
agucagagcucacaucuuc

SEQ ID NO: 757148 - RNA, 19 nt, Homo sapiens
guaagaacaucagagaguu

SEQ ID NO: 757149 - RNA, 19 nt, Homo sapiens
cagucggucuucacaauua

SEQ ID NO: 757150 - RNA, 19 nt, Homo sapiens
ggagagaaaccauacguau

SEQ ID NO: 757151 - RNA, 19 nt, Homo sapiens
gagaaaccauauaauugug

SEQ ID NO: 757152 - RNA, 19 nt, Homo sapiens
ggagagaagccauacaaau

SEQ ID NO: 757153 - RNA, 19 nt, Homo sapiens
gcucacgacuucagauuca

SEQ ID NO: 757154 - RNA, 19 nt, Homo sapiens
guagaucagcacuuaauaa

SEQ ID NO: 757155 - RNA, 19 nt, Homo sapiens
agaggaaucuguaccaaga

SEQ ID NO: 757156 - RNA, 19 nt, Homo sapiens
aaagugagguggagacugu

SEQ ID NO: 757157 - RNA, 19 nt, Homo sapiens
gagaaaccauacaaaugug

SEQ ID NO: 757158 - RNA, 19 nt, Homo sapiens
gagaaaccauacaaaugug

SEQ ID NO: 757159 - RNA, 19 nt, Homo sapiens
uuacaagugugaagaaugu

SEQ ID NO: 757160 - RNA, 19 nt, Homo sapiens
gagaaaccauacaaaugug

SEQ ID NO: 757161 - RNA, 19 nt, Homo sapiens
ggacagaaauuuuaccaau

SEQ ID NO: 757162 - RNA, 19 nt, Homo sapiens
guagagaaaccauucaaau

SEQ ID NO: 757163 - RNA, 19 nt, Homo sapiens
gcgaucaaaucuuguaagu

SEQ ID NO: 757164 - RNA, 19 nt, Homo sapiens
gcacgauucugccuucucu

SEQ ID NO: 757165 - RNA, 19 nt, Homo sapiens
gaaagcacauaguguacag

SEQ ID NO: 757166 - RNA, 19 nt, Homo sapiens
gugguaaggguuucauuua

SEQ ID NO: 757167 - RNA, 19 nt, Homo sapiens
ggagagaaaccuuacaagu

SEQ ID NO: 757168 - RNA, 19 nt, Homo sapiens
caucucagcccuucauauu

SEQ ID NO: 757169 - RNA, 19 nt, Homo sapiens
ugagaaaccauacaaaugu

SEQ ID NO: 757170 - RNA, 19 nt, Homo sapiens
gauucugccuucucucaaa

SEQ ID NO: 757171 - RNA, 19 nt, Homo sapiens
gagaaaagccauacaaaug

SEQ ID NO: 757172 - RNA, 19 nt, Homo sapiens
ccaaugugaugaguacaaa

SEQ ID NO: 757173 - RNA, 19 nt, Homo sapiens
gagcucacaucuucaaacu

SEQ ID NO: 757174 - RNA, 19 nt, Homo sapiens
ucucagcccuucauauuca

SEQ ID NO: 757175 - RNA, 19 nt, Homo sapiens
uauucagccuucacaauuu

SEQ ID NO: 757176 - RNA, 19 nt, Homo sapiens
ugacgugugugguaaggaa

SEQ ID NO: 757177 - RNA, 19 nt, Homo sapiens
gagaauaguaagaacauca

SEQ ID NO: 757178 - RNA, 19 nt, Homo sapiens
gaaagcaaagcuccacugu

SEQ ID NO: 757179 - RNA, 19 nt, Homo sapiens
ucaggaacaucagagaauu

SEQ ID NO: 757180 - RNA, 19 nt, Homo sapiens
gagaaaccuuacaauugug

SEQ ID NO: 757181 - RNA, 19 nt, Homo sapiens
gaaacagauugcaagugau

SEQ ID NO: 757182 - RNA, 19 nt, Homo sapiens
ggaaaucagcagacaagau

SEQ ID NO: 757183 - RNA, 19 nt, Homo sapiens
agagaaaccauacaaaugu

SEQ ID NO: 757184 - RNA, 19 nt, Homo sapiens
gcacauaguguacagaaac

SEQ ID NO: 757185 - RNA, 19 nt, Homo sapiens
agagaaaccauacaaaugu

SEQ ID NO: 757186 - RNA, 19 nt, Homo sapiens
ggacugcgcggacugacuu

SEQ ID NO: 757187 - RNA, 19 nt, Homo sapiens
aaacagauugcaagugauu

SEQ ID NO: 757188 - RNA, 19 nt, Homo sapiens
gaacaucagagaguuguca

SEQ ID NO: 757189 - RNA, 19 nt, Homo sapiens
gagaagccauacaaaugca

SEQ ID NO: 757190 - RNA, 19 nt, Homo sapiens
gaaaagccauacaaaugug

SEQ ID NO: 757191 - RNA, 19 nt, Homo sapiens
gugagaaaccauacaaaug

SEQ ID NO: 757192 - RNA, 19 nt, Homo sapiens
ggugagaaaccauacaaau

SEQ ID NO: 757193 - RNA, 19 nt, Homo sapiens
gaaugugguaagugcuuua

SEQ ID NO: 757194 - RNA, 19 nt, Homo sapiens
gcucaaaccuucguaucca

SEQ ID NO: 757195 - RNA, 19 nt, Homo sapiens
gaagacucuaugauaagua

SEQ ID NO: 757196 - RNA, 19 nt, Homo sapiens
ucaugcugcugguacauuu

SEQ ID NO: 757197 - RNA, 19 nt, Homo sapiens
acucaggacucugcaaauu

SEQ ID NO: 757198 - RNA, 19 nt, Homo sapiens
ugugguaagugcuuuauuc

SEQ ID NO: 757199 - RNA, 19 nt, Homo sapiens
gggcaggacuauauacaac

SEQ ID NO: 757200 - RNA, 19 nt, Homo sapiens
acagauugcaagugauuua

SEQ ID NO: 757201 - RNA, 19 nt, Homo sapiens
gacagcaacucaaagaaaa

SEQ ID NO: 757202 - RNA, 19 nt, Homo sapiens
agacagcaacucaaagaaa

SEQ ID NO: 757203 - RNA, 19 nt, Homo sapiens
uauguaaagugugugguaa

SEQ ID NO: 757204 - RNA, 19 nt, Homo sapiens
acacaggagagaaaccuua

SEQ ID NO: 757205 - RNA, 19 nt, Homo sapiens
caucagagaauucauacug

SEQ ID NO: 757206 - RNA, 19 nt, Homo sapiens
caacacuuacuguacauug

SEQ ID NO: 757207 - RNA, 19 nt, Homo sapiens
ucagagaguccacacugua

SEQ ID NO: 757208 - RNA, 19 nt, Homo sapiens
gguuagggcaggacuauau

SEQ ID NO: 757209 - RNA, 19 nt, Homo sapiens
gagaaacccugcaauuuaa

SEQ ID NO: 757210 - RNA, 19 nt, Homo sapiens
gaaaugacuuugcugaauu

SEQ ID NO: 757211 - RNA, 19 nt, Homo sapiens
gaacagaugcuuucauuau

SEQ ID NO: 757212 - RNA, 19 nt, Homo sapiens
gaacacauaugaauucaca

SEQ ID NO: 757213 - RNA, 19 nt, Homo sapiens
ggaaauccuucauuaauca

SEQ ID NO: 757214 - RNA, 19 nt, Homo sapiens
ggagaaacccuaugaaugu

SEQ ID NO: 757215 - RNA, 19 nt, Homo sapiens
gggaauaccuuucugaauc

SEQ ID NO: 757216 - RNA, 19 nt, Homo sapiens
ggaaaugacuuugcugaau

SEQ ID NO: 757217 - RNA, 19 nt, Homo sapiens
gagagaaaccuuauaaaug

SEQ ID NO: 757218 - RNA, 19 nt, Homo sapiens
agagaaacccugcaauuua

SEQ ID NO: 757219 - RNA, 19 nt, Homo sapiens
gggagagccuucacuguuu

SEQ ID NO: 757220 - RNA, 19 nt, Homo sapiens
gcugaauucucaagccuua

SEQ ID NO: 757221 - RNA, 19 nt, Homo sapiens
ggagagaaaccuuauaaau

SEQ ID NO: 757222 - RNA, 19 nt, Homo sapiens
gagaaacccuaugaaugua

SEQ ID NO: 757223 - RNA, 19 nt, Homo sapiens
gagaaacccuaugaaugua

SEQ ID NO: 757224 - RNA, 19 nt, Homo sapiens
gagagaaacccugcaauuu

SEQ ID NO: 757225 - RNA, 19 nt, Homo sapiens
ggaaagccuucacucagaa

SEQ ID NO: 757226 - RNA, 19 nt, Homo sapiens
gggaaagccuucacucaga

SEQ ID NO: 757227 - RNA, 19 nt, Homo sapiens
gaacucacauuggagagaa

SEQ ID NO: 757228 - RNA, 19 nt, Homo sapiens
ggagagaaacccugcaauu

SEQ ID NO: 757229 - RNA, 19 nt, Homo sapiens
gaaacccuaugaauguaaa

SEQ ID NO: 757230 - RNA, 19 nt, Homo sapiens
gaagcaacuuuguaucuca

SEQ ID NO: 757231 - RNA, 19 nt, Homo sapiens
gagagaaaccguaugaaug

SEQ ID NO: 757232 - RNA, 19 nt, Homo sapiens
gagagaaacccuaugaaug

SEQ ID NO: 757233 - RNA, 19 nt, Homo sapiens
gggaaauccuucauuaauc

SEQ ID NO: 757234 - RNA, 19 nt, Homo sapiens
gcaauaaauuucucuuggu

SEQ ID NO: 757235 - RNA, 19 nt, Homo sapiens
gggaaagccuucaguucuu

SEQ ID NO: 757236 - RNA, 19 nt, Homo sapiens
gaacauacaaggacucaca

SEQ ID NO: 757237 - RNA, 19 nt, Homo sapiens
ggagagaggcccuaugaau

SEQ ID NO: 757238 - RNA, 19 nt, Homo sapiens
ucugggaaauccuucauua

SEQ ID NO: 757239 - RNA, 19 nt, Homo sapiens
cugcauaccuuaauauuca

SEQ ID NO: 757240 - RNA, 19 nt, Homo sapiens
ugacuuugcugaauucuca

SEQ ID NO: 757241 - RNA, 19 nt, Homo sapiens
gaaugcagaccaacacaaa

SEQ ID NO: 757242 - RNA, 19 nt, Homo sapiens
gagaaaccguaugaaugua

SEQ ID NO: 757243 - RNA, 19 nt, Homo sapiens
ggagagaaaccguaugaau

SEQ ID NO: 757244 - RNA, 19 nt, Homo sapiens
ggagagaaacccuaugaau

SEQ ID NO: 757245 - RNA, 19 nt, Homo sapiens
acucagaacucagaccuua

SEQ ID NO: 757246 - RNA, 19 nt, Homo sapiens
gggaaaagcuuuagaucaa

SEQ ID NO: 757247 - RNA, 19 nt, Homo sapiens
uggaacagaugcuuucauu

SEQ ID NO: 757248 - RNA, 19 nt, Homo sapiens
gggauagccuucacuagau

SEQ ID NO: 757249 - RNA, 19 nt, Homo sapiens
ccagaacugugaggcaaua

SEQ ID NO: 757250 - RNA, 19 nt, Homo sapiens
gaaaccguaugaauguaga

SEQ ID NO: 757251 - RNA, 19 nt, Homo sapiens
gagagaggcccuaugaaug

SEQ ID NO: 757252 - RNA, 19 nt, Homo sapiens
gagaggcccuaugaaugua

SEQ ID NO: 757253 - RNA, 19 nt, Homo sapiens
gaacugugaggcaauaaau

SEQ ID NO: 757254 - RNA, 19 nt, Homo sapiens
ucaaacaggugaguaacuu

SEQ ID NO: 757255 - RNA, 19 nt, Homo sapiens
uaucucaggucuuaaugaa

SEQ ID NO: 757256 - RNA, 19 nt, Homo sapiens
ggaaagccuucaguucuuc

SEQ ID NO: 757257 - RNA, 19 nt, Homo sapiens
acgcauuccuccagucuua

SEQ ID NO: 757258 - RNA, 19 nt, Homo sapiens
gugagaagccuuaugaaug

SEQ ID NO: 757259 - RNA, 19 nt, Homo sapiens
ggaacagaugcuuucauua

SEQ ID NO: 757260 - RNA, 19 nt, Homo sapiens
gggagaaacccuaugaaug

SEQ ID NO: 757261 - RNA, 19 nt, Homo sapiens
acagagaccuggaacagau

SEQ ID NO: 757262 - RNA, 19 nt, Homo sapiens
gggagaggcuuuauucacu

SEQ ID NO: 757263 - RNA, 19 nt, Homo sapiens
agagaaacccuaugaaugu

SEQ ID NO: 757264 - RNA, 19 nt, Homo sapiens
gccagauccucucgccuua

SEQ ID NO: 757265 - RNA, 19 nt, Homo sapiens
caccaggucuugucaacuu

SEQ ID NO: 757266 - RNA, 19 nt, Homo sapiens
ggauuuagauauucugcau

SEQ ID NO: 757267 - RNA, 19 nt, Homo sapiens
uaaaugguauggucuggau

SEQ ID NO: 757268 - RNA, 19 nt, Homo sapiens
ccaauucguuucaguuaca

SEQ ID NO: 757269 - RNA, 19 nt, Homo sapiens
gaauguaagauauguggaa

SEQ ID NO: 757270 - RNA, 19 nt, Homo sapiens
ugagaagccuuaugaaugc

SEQ ID NO: 757271 - RNA, 19 nt, Homo sapiens
gacaaucccuaugagugua

SEQ ID NO: 757272 - RNA, 19 nt, Homo sapiens
aaacuaauacugugaggaa

SEQ ID NO: 757273 - RNA, 19 nt, Homo sapiens
ggaaacugaaggaaggaua

SEQ ID NO: 757274 - RNA, 19 nt, Homo sapiens
gugaguaacuucaaaugag

SEQ ID NO: 757275 - RNA, 19 nt, Homo sapiens
cacuagaucuucucaacuu

SEQ ID NO: 757276 - RNA, 19 nt, Homo sapiens
ggagagccuucacuguuuc

SEQ ID NO: 757277 - RNA, 19 nt, Homo sapiens
uuuaagaacucacaaugga

SEQ ID NO: 757278 - RNA, 19 nt, Homo sapiens
cagcaacccuaggaaacua

SEQ ID NO: 757279 - RNA, 19 nt, Homo sapiens
caucacuggugucccuaua

SEQ ID NO: 757280 - RNA, 19 nt, Homo sapiens
ucucaagccuuaccaaaca

SEQ ID NO: 757281 - RNA, 19 nt, Homo sapiens
aaagaaggcaugcggauga

SEQ ID NO: 757282 - RNA, 19 nt, Homo sapiens
guacagcaacccuaggaaa

SEQ ID NO: 757283 - RNA, 19 nt, Homo sapiens
cacuauaacuguauuugga

SEQ ID NO: 757284 - RNA, 19 nt, Homo sapiens
aaacacaucagaaaucuca

SEQ ID NO: 757285 - RNA, 19 nt, Homo sapiens
ccaaacacaucagaaaucu

SEQ ID NO: 757286 - RNA, 19 nt, Homo sapiens
ggaagcaacuuuguaucuc

SEQ ID NO: 757287 - RNA, 19 nt, Homo sapiens
ccuccagucuuaauaauca

SEQ ID NO: 757288 - RNA, 19 nt, Homo sapiens
ggagagaagcccuuugagu

SEQ ID NO: 757289 - RNA, 19 nt, Homo sapiens
ucucaggucuuaaugaaca

SEQ ID NO: 757290 - RNA, 19 nt, Homo sapiens
gaaacccuaugaauguaag

SEQ ID NO: 757291 - RNA, 19 nt, Homo sapiens
ccacguguguuaaccuuca

SEQ ID NO: 757292 - RNA, 19 nt, Homo sapiens
gaucuucucaacuuacuga

SEQ ID NO: 757293 - RNA, 19 nt, Homo sapiens
gauauucugcauaccuuaa

SEQ ID NO: 757294 - RNA, 19 nt, Homo sapiens
gaacucacacuggagagaa

SEQ ID NO: 757295 - RNA, 19 nt, Homo sapiens
caaacucacaggucagaaa

SEQ ID NO: 757296 - RNA, 19 nt, Homo sapiens
gaaggauacacauggagaa

SEQ ID NO: 757297 - RNA, 19 nt, Homo sapiens
ggaauaccuuucugaaucc

SEQ ID NO: 757298 - RNA, 19 nt, Homo sapiens
agagaaaccguaugaaugu

SEQ ID NO: 757299 - RNA, 19 nt, Homo sapiens
cuuuguaucucaggucuua

SEQ ID NO: 757300 - RNA, 19 nt, Homo sapiens
gcauaaggaaugugggaaa

SEQ ID NO: 757301 - RNA, 19 nt, Homo sapiens
guaugaauguagagaaucu

SEQ ID NO: 757302 - RNA, 19 nt, Homo sapiens
ggaaauccuucaguuacuc

SEQ ID NO: 757303 - RNA, 19 nt, Homo sapiens
gagagaagccuuuugaaug

SEQ ID NO: 757304 - RNA, 19 nt, Homo sapiens
ggauagccuucacuagauc

SEQ ID NO: 757305 - RNA, 19 nt, Homo sapiens
gaaugugggagaggcuuua

SEQ ID NO: 757306 - RNA, 19 nt, Homo sapiens
guuaaaucauucagucugu

SEQ ID NO: 757307 - RNA, 19 nt, Homo sapiens
ggauacacauggagaagac

SEQ ID NO: 757308 - RNA, 19 nt, Homo sapiens
gaugagagacugucagcau

SEQ ID NO: 757309 - RNA, 19 nt, Homo sapiens
ggacaaagcgaaagaagaa

SEQ ID NO: 757310 - RNA, 19 nt, Homo sapiens
gaaaaugagugaggaguua

SEQ ID NO: 757311 - RNA, 19 nt, Homo sapiens
agaaacagccuaccucaua

SEQ ID NO: 757312 - RNA, 19 nt, Homo sapiens
ggagagagaccauuugaau

SEQ ID NO: 757313 - RNA, 19 nt, Homo sapiens
gaaacauaauucacgugua

SEQ ID NO: 757314 - RNA, 19 nt, Homo sapiens
gcuugacccugcaauauaa

SEQ ID NO: 757315 - RNA, 19 nt, Homo sapiens
acccagagcucacaccuua

SEQ ID NO: 757316 - RNA, 19 nt, Homo sapiens
gauauuacauccacaguac

SEQ ID NO: 757317 - RNA, 19 nt, Homo sapiens
gaaacagccuaccucauag

SEQ ID NO: 757318 - RNA, 19 nt, Homo sapiens
gggaggaccuucaaugauc

SEQ ID NO: 757319 - RNA, 19 nt, Homo sapiens
cgagggacaucgacgagua

SEQ ID NO: 757320 - RNA, 19 nt, Homo sapiens
ggagagaggcccuaugugu

SEQ ID NO: 757321 - RNA, 19 nt, Homo sapiens
guacuaaacagauuacguu

SEQ ID NO: 757322 - RNA, 19 nt, Homo sapiens
gauggagucugcucaggaa

SEQ ID NO: 757323 - RNA, 19 nt, Homo sapiens
gauauuguuuguucacuca

SEQ ID NO: 757324 - RNA, 19 nt, Homo sapiens
gggaaaggauuuguucaga

SEQ ID NO: 757325 - RNA, 19 nt, Homo sapiens
gcgcuaagcccuacaagug

SEQ ID NO: 757326 - RNA, 19 nt, Homo sapiens
agaguuagcuccaaauucu

SEQ ID NO: 757327 - RNA, 19 nt, Homo sapiens
aaagggaaguauugaguga

SEQ ID NO: 757328 - RNA, 19 nt, Homo sapiens
caaaauuccuccuagaaaa

SEQ ID NO: 757329 - RNA, 19 nt, Homo sapiens
ccacaguaccacaguauuu

SEQ ID NO: 757330 - RNA, 19 nt, Homo sapiens
caaccaagcaucacccauu

SEQ ID NO: 757331 - RNA, 19 nt, Homo sapiens
gcccagcacauaaugaaua

SEQ ID NO: 757332 - RNA, 19 nt, Homo sapiens
agacuacacuggaaaauaa

SEQ ID NO: 757333 - RNA, 19 nt, Homo sapiens
ggauguggcuguggacuuc

SEQ ID NO: 757334 - RNA, 19 nt, Homo sapiens
caccagagaacccacaaua

SEQ ID NO: 757335 - RNA, 19 nt, Homo sapiens
guggugcucuugacacaaa

SEQ ID NO: 757336 - RNA, 19 nt, Homo sapiens
gauugugccuuguccucua

SEQ ID NO: 757337 - RNA, 19 nt, Homo sapiens
cgacacagaggaccgagua

SEQ ID NO: 757338 - RNA, 19 nt, Homo sapiens
auaaagaguuagcuccaaa

SEQ ID NO: 757339 - RNA, 19 nt, Homo sapiens
ucagagcucuucccucaca

SEQ ID NO: 757340 - RNA, 19 nt, Homo sapiens
ccauaugcaugcaacaaau

SEQ ID NO: 757341 - RNA, 19 nt, Homo sapiens
ggagacugcccagcacaua

SEQ ID NO: 757342 - RNA, 19 nt, Homo sapiens
caucagaagagcugugaaa

SEQ ID NO: 757343 - RNA, 19 nt, Homo sapiens
gaagaagcacuuugacaac

SEQ ID NO: 757344 - RNA, 19 nt, Homo sapiens
agaagaagcacuuugacaa

SEQ ID NO: 757345 - RNA, 19 nt, Homo sapiens
cacaguaccacaguauuua

SEQ ID NO: 757346 - RNA, 19 nt, Homo sapiens
aaucugcacugauauuaca

SEQ ID NO: 757347 - RNA, 19 nt, Homo sapiens
cccagcacauaaugaauaa

SEQ ID NO: 757348 - RNA, 19 nt, Homo sapiens
gagacugcccagcacauaa

SEQ ID NO: 757349 - RNA, 19 nt, Homo sapiens
ccagagcucacaccuuauu

SEQ ID NO: 757350 - RNA, 19 nt, Homo sapiens
guucacucauuuagucauu

SEQ ID NO: 757351 - RNA, 19 nt, Homo sapiens
ccuauaugcugaagaugga

SEQ ID NO: 757352 - RNA, 19 nt, Homo sapiens
gcaaacaguggugcucuug

SEQ ID NO: 757353 - RNA, 19 nt, Homo sapiens
cccauucacuugauauugu

SEQ ID NO: 757354 - RNA, 19 nt, Homo sapiens
gcucccaccucaucagaca

SEQ ID NO: 757355 - RNA, 19 nt, Homo sapiens
ggacucacacuggcgcuaa

SEQ ID NO: 757356 - RNA, 19 nt, Homo sapiens
cagugaaugugguaaaaua

SEQ ID NO: 757357 - RNA, 19 nt, Homo sapiens
ugccuuguccucuacauua

SEQ ID NO: 757358 - RNA, 19 nt, Homo sapiens
cagagaacccacaauagga

SEQ ID NO: 757359 - RNA, 19 nt, Homo sapiens
uaaauuggauccucuuccu

SEQ ID NO: 757360 - RNA, 19 nt, Homo sapiens
ucacacagcaucagagagu

SEQ ID NO: 757361 - RNA, 19 nt, Homo sapiens
guggcgcucuugacacaaa

SEQ ID NO: 757362 - RNA, 19 nt, Homo sapiens
gcaaacaguggcgcucuug

SEQ ID NO: 757363 - RNA, 19 nt, Homo sapiens
ggcccuauaugcugaagau

SEQ ID NO: 757364 - RNA, 19 nt, Homo sapiens
ccagcuggacccuaaauug

SEQ ID NO: 757365 - RNA, 19 nt, Homo sapiens
ccagagaacccacaauagg

SEQ ID NO: 757366 - RNA, 19 nt, Homo sapiens
cauccacaguaccacagua

SEQ ID NO: 757367 - RNA, 19 nt, Homo sapiens
cacuugauauuguuuguuc

SEQ ID NO: 757368 - RNA, 19 nt, Homo sapiens
ccauucacuugauauuguu

SEQ ID NO: 757369 - RNA, 19 nt, Homo sapiens
gaacccacaauaggacaaa

SEQ ID NO: 757370 - RNA, 19 nt, Homo sapiens
gcuggacccuaaauuggau

SEQ ID NO: 757371 - RNA, 19 nt, Homo sapiens
cuacaagugucaggacugu

SEQ ID NO: 757372 - RNA, 19 nt, Homo sapiens
ucaagacugugggaaagga

SEQ ID NO: 757373 - RNA, 19 nt, Homo sapiens
gaaggcaaugguuguagga

SEQ ID NO: 757374 - RNA, 19 nt, Homo sapiens
caaggaaggcaaugguugu

SEQ ID NO: 757375 - RNA, 19 nt, Homo sapiens
ccagugagcagguccaaca

SEQ ID NO: 757376 - RNA, 19 nt, Homo sapiens
ccagauccaggcccuauau

SEQ ID NO: 757377 - RNA, 19 nt, Homo sapiens
gugggaggaccuucaauga

SEQ ID NO: 757378 - RNA, 19 nt, Homo sapiens
ugaaagggaaguauugagu

SEQ ID NO: 757379 - RNA, 19 nt, Homo sapiens
aggcaaugguuguaggaaa

SEQ ID NO: 757380 - RNA, 19 nt, Homo sapiens
caguggcgcucuugacaca

SEQ ID NO: 757381 - RNA, 19 nt, Homo sapiens
ggcaaacaguggugcucuu

SEQ ID NO: 757382 - RNA, 19 nt, Homo sapiens
aaagauuucccauucacuu

SEQ ID NO: 757383 - RNA, 19 nt, Homo sapiens
cagcuugacccugcaauau

SEQ ID NO: 757384 - RNA, 19 nt, Homo sapiens
gcuccaaauucugacauuc

SEQ ID NO: 757385 - RNA, 19 nt, Homo sapiens
aaagaguuagcuccaaauu

SEQ ID NO: 757386 - RNA, 19 nt, Homo sapiens
gugggagacuacacuggaa

SEQ ID NO: 757387 - RNA, 19 nt, Homo sapiens
uaggugcacugccugugaa

SEQ ID NO: 757388 - RNA, 19 nt, Homo sapiens
uugaagaaaccuugccuuu

SEQ ID NO: 757389 - RNA, 19 nt, Homo sapiens
ccagagcucccaccucauc

SEQ ID NO: 757390 - RNA, 19 nt, Homo sapiens
ucggaguacuaaacagauu

SEQ ID NO: 757391 - RNA, 19 nt, Homo sapiens
ccacaaaauuccuccuaga

SEQ ID NO: 757392 - RNA, 19 nt, Homo sapiens
aaacaguggugcucuugac

SEQ ID NO: 757393 - RNA, 19 nt, Homo sapiens
aaccaagcaucacccauuc

SEQ ID NO: 757394 - RNA, 19 nt, Homo sapiens
cggaguacuaaacagauua

SEQ ID NO: 757395 - RNA, 19 nt, Homo sapiens
ggcaaugguuguaggaaaa

SEQ ID NO: 757396 - RNA, 19 nt, Homo sapiens
caagaguggucgccuucgu

SEQ ID NO: 757397 - RNA, 19 nt, Homo sapiens
ggcaaacaguggcgcucuu

SEQ ID NO: 757398 - RNA, 19 nt, Homo sapiens
ugauauuacauccacagua

SEQ ID NO: 757399 - RNA, 19 nt, Homo sapiens
caaagcgaaagaagaaaca

SEQ ID NO: 757400 - RNA, 19 nt, Homo sapiens
acaauaggacaaagcgaaa

SEQ ID NO: 757401 - RNA, 19 nt, Homo sapiens
gcaugcaacaaauguggaa

SEQ ID NO: 757402 - RNA, 19 nt, Homo sapiens
cagaagaagcacuuugaca

SEQ ID NO: 757403 - RNA, 19 nt, Homo sapiens
aauaaagaguuagcuccaa

SEQ ID NO: 757404 - RNA, 19 nt, Homo sapiens
agagaggcccuaugugugu

SEQ ID NO: 757405 - RNA, 19 nt, Homo sapiens
guccagcgccuuuccuuuc

SEQ ID NO: 757406 - RNA, 19 nt, Homo sapiens
gauuucccauucacuugau

SEQ ID NO: 757407 - RNA, 19 nt, Homo sapiens
aaugagugaggaguuauua

SEQ ID NO: 757408 - RNA, 19 nt, Homo sapiens
gaaugugaaagggaaguau

SEQ ID NO: 757409 - RNA, 19 nt, Homo sapiens
ggacaaagcgaaagaagaa

SEQ ID NO: 757410 - RNA, 19 nt, Homo sapiens
gaaaaugagugaggaguua

SEQ ID NO: 757411 - RNA, 19 nt, Homo sapiens
agaaacagccuaccucaua

SEQ ID NO: 757412 - RNA, 19 nt, Homo sapiens
ggagagagaccauuugaau

SEQ ID NO: 757413 - RNA, 19 nt, Homo sapiens
gaaacauaauucacgugua

SEQ ID NO: 757414 - RNA, 19 nt, Homo sapiens
gcuugacccugcaauauaa

SEQ ID NO: 757415 - RNA, 19 nt, Homo sapiens
acccagagcucacaccuua

SEQ ID NO: 757416 - RNA, 19 nt, Homo sapiens
gauauuacauccacaguac

SEQ ID NO: 757417 - RNA, 19 nt, Homo sapiens
gaaacagccuaccucauag

SEQ ID NO: 757418 - RNA, 19 nt, Homo sapiens
gggaggaccuucaaugauc

SEQ ID NO: 757419 - RNA, 19 nt, Homo sapiens
cgagggacaucgacgagua

SEQ ID NO: 757420 - RNA, 19 nt, Homo sapiens
ggagagaggcccuaugugu

SEQ ID NO: 757421 - RNA, 19 nt, Homo sapiens
guacuaaacagauuacguu

SEQ ID NO: 757422 - RNA, 19 nt, Homo sapiens
gauggagucugcucaggaa

SEQ ID NO: 757423 - RNA, 19 nt, Homo sapiens
gauauuguuuguucacuca

SEQ ID NO: 757424 - RNA, 19 nt, Homo sapiens
gggaaaggauuuguucaga

SEQ ID NO: 757425 - RNA, 19 nt, Homo sapiens
gcgcuaagcccuacaagug

SEQ ID NO: 757426 - RNA, 19 nt, Homo sapiens
agaguuagcuccaaauucu

SEQ ID NO: 757427 - RNA, 19 nt, Homo sapiens
aaagggaaguauugaguga

SEQ ID NO: 757428 - RNA, 19 nt, Homo sapiens
caaaauuccuccuagaaaa

SEQ ID NO: 757429 - RNA, 19 nt, Homo sapiens
ccacaguaccacaguauuu

SEQ ID NO: 757430 - RNA, 19 nt, Homo sapiens
caaccaagcaucacccauu

SEQ ID NO: 757431 - RNA, 19 nt, Homo sapiens
gggaagugaugcuggagaa

SEQ ID NO: 757432 - RNA, 19 nt, Homo sapiens
ccagugaccuuugaagaug

SEQ ID NO: 757433 - RNA, 19 nt, Homo sapiens
gcccagcacauaaugaaua

SEQ ID NO: 757434 - RNA, 19 nt, Homo sapiens
agacuacacuggaaaauaa

SEQ ID NO: 757435 - RNA, 19 nt, Homo sapiens
ggauguggcuguggacuuc

SEQ ID NO: 757436 - RNA, 19 nt, Homo sapiens
caccagagaacccacaaua

SEQ ID NO: 757437 - RNA, 19 nt, Homo sapiens
guggugcucuugacacaaa

SEQ ID NO: 757438 - RNA, 19 nt, Homo sapiens
gauugugccuuguccucua

SEQ ID NO: 757439 - RNA, 19 nt, Homo sapiens
cgacacagaggaccgagua

SEQ ID NO: 757440 - RNA, 19 nt, Homo sapiens
auaaagaguuagcuccaaa

SEQ ID NO: 757441 - RNA, 19 nt, Homo sapiens
ucagagcucuucccucaca

SEQ ID NO: 757442 - RNA, 19 nt, Homo sapiens
ccauaugcaugcaacaaau

SEQ ID NO: 757443 - RNA, 19 nt, Homo sapiens
ggagacugcccagcacaua

SEQ ID NO: 757444 - RNA, 19 nt, Homo sapiens
gugaaccagugaccuuuga

SEQ ID NO: 757445 - RNA, 19 nt, Homo sapiens
agagacacauugagaagga

SEQ ID NO: 757446 - RNA, 19 nt, Homo sapiens
caucagaagagcugugaaa

SEQ ID NO: 757447 - RNA, 19 nt, Homo sapiens
gaagaagcacuuugacaac

SEQ ID NO: 757448 - RNA, 19 nt, Homo sapiens
agaagaagcacuuugacaa

SEQ ID NO: 757449 - RNA, 19 nt, Homo sapiens
cacaguaccacaguauuua

SEQ ID NO: 757450 - RNA, 19 nt, Homo sapiens
aaucugcacugauauuaca

SEQ ID NO: 757451 - RNA, 19 nt, Homo sapiens
cccagcacauaaugaauaa

SEQ ID NO: 757452 - RNA, 19 nt, Homo sapiens
gagacugcccagcacauaa

SEQ ID NO: 757453 - RNA, 19 nt, Homo sapiens
ccagagcucacaccuuauu

SEQ ID NO: 757454 - RNA, 19 nt, Homo sapiens
guucacucauuuagucauu

SEQ ID NO: 757455 - RNA, 19 nt, Homo sapiens
ccuauaugcugaagaugga

SEQ ID NO: 757456 - RNA, 19 nt, Homo sapiens
gcaaacaguggugcucuug

SEQ ID NO: 757457 - RNA, 19 nt, Homo sapiens
cccauucacuugauauugu

SEQ ID NO: 757458 - RNA, 19 nt, Homo sapiens
gcucccaccucaucagaca

SEQ ID NO: 757459 - RNA, 19 nt, Homo sapiens
ggacucacacuggcgcuaa

SEQ ID NO: 757460 - RNA, 19 nt, Homo sapiens
cagugaaugugguaaaaua

SEQ ID NO: 757461 - RNA, 19 nt, Homo sapiens
ugccuuguccucuacauua

SEQ ID NO: 757462 - RNA, 19 nt, Homo sapiens
cagagaacccacaauagga

SEQ ID NO: 757463 - RNA, 19 nt, Homo sapiens
ucacacagcaucagagagu

SEQ ID NO: 757464 - RNA, 19 nt, Homo sapiens
guggcgcucuugacacaaa

SEQ ID NO: 757465 - RNA, 19 nt, Homo sapiens
gcaaacaguggcgcucuug

SEQ ID NO: 757466 - RNA, 19 nt, Homo sapiens
ggcccuauaugcugaagau

SEQ ID NO: 757467 - RNA, 19 nt, Homo sapiens
uaaauuggauccucuuccu

SEQ ID NO: 757468 - RNA, 19 nt, Homo sapiens
ccagagaacccacaauagg

SEQ ID NO: 757469 - RNA, 19 nt, Homo sapiens
ccagcuggacccuaaauug

SEQ ID NO: 757470 - RNA, 19 nt, Homo sapiens
cauccacaguaccacagua

SEQ ID NO: 757471 - RNA, 19 nt, Homo sapiens
cacuugauauuguuuguuc

SEQ ID NO: 757472 - RNA, 19 nt, Homo sapiens
ccauucacuugauauuguu

SEQ ID NO: 757473 - RNA, 19 nt, Homo sapiens
gaacccacaauaggacaaa

SEQ ID NO: 757474 - RNA, 19 nt, Homo sapiens
cuacaagugucaggacugu

SEQ ID NO: 757475 - RNA, 19 nt, Homo sapiens
ucaagacugugggaaagga

SEQ ID NO: 757476 - RNA, 19 nt, Homo sapiens
gaaggcaaugguuguagga

SEQ ID NO: 757477 - RNA, 19 nt, Homo sapiens
caaggaaggcaaugguugu

SEQ ID NO: 757478 - RNA, 19 nt, Homo sapiens
ccagugagcagguccaaca

SEQ ID NO: 757479 - RNA, 19 nt, Homo sapiens
gcuggacccuaaauuggau

SEQ ID NO: 757480 - RNA, 19 nt, Homo sapiens
aagugaugcuggagaacua

SEQ ID NO: 757481 - RNA, 19 nt, Homo sapiens
gugggaggaccuucaauga

SEQ ID NO: 757482 - RNA, 19 nt, Homo sapiens
caccagagacacauugaga

SEQ ID NO: 757483 - RNA, 19 nt, Homo sapiens
ccagauccaggcccuauau

SEQ ID NO: 757484 - RNA, 19 nt, Homo sapiens
ugaaagggaaguauugagu

SEQ ID NO: 757485 - RNA, 19 nt, Homo sapiens
aggcaaugguuguaggaaa

SEQ ID NO: 757486 - RNA, 19 nt, Homo sapiens
caguggcgcucuugacaca

SEQ ID NO: 757487 - RNA, 19 nt, Homo sapiens
ggcaaacaguggugcucuu

SEQ ID NO: 757488 - RNA, 19 nt, Homo sapiens
aaagauuucccauucacuu

SEQ ID NO: 757489 - RNA, 19 nt, Homo sapiens
cagcuugacccugcaauau

SEQ ID NO: 757490 - RNA, 19 nt, Homo sapiens
gcuccaaauucugacauuc

SEQ ID NO: 757491 - RNA, 19 nt, Homo sapiens
aaagaguuagcuccaaauu

SEQ ID NO: 757492 - RNA, 19 nt, Homo sapiens
gugggagacuacacuggaa

SEQ ID NO: 757493 - RNA, 19 nt, Homo sapiens
uaggugcacugccugugaa

SEQ ID NO: 757494 - RNA, 19 nt, Homo sapiens
uugaagaaaccuugccuuu

SEQ ID NO: 757495 - RNA, 19 nt, Homo sapiens
ccagagcucccaccucauc

SEQ ID NO: 757496 - RNA, 19 nt, Homo sapiens
ucggaguacuaaacagauu

SEQ ID NO: 757497 - RNA, 19 nt, Homo sapiens
ccacaaaauuccuccuaga

SEQ ID NO: 757498 - RNA, 19 nt, Homo sapiens
aaacaguggugcucuugac

SEQ ID NO: 757499 - RNA, 19 nt, Homo sapiens
aaccaagcaucacccauuc

SEQ ID NO: 757500 - RNA, 19 nt, Homo sapiens
gaaccagugaccuuugaag

SEQ ID NO: 757501 - RNA, 19 nt, Homo sapiens
cggaguacuaaacagauua

SEQ ID NO: 757502 - RNA, 19 nt, Homo sapiens
ggcaaugguuguaggaaaa

SEQ ID NO: 757503 - RNA, 19 nt, Homo sapiens
caagaguggucgccuucgu

SEQ ID NO: 757504 - RNA, 19 nt, Homo sapiens
ggcaaacaguggcgcucuu

SEQ ID NO: 757505 - RNA, 19 nt, Homo sapiens
ugauauuacauccacagua

SEQ ID NO: 757506 - RNA, 19 nt, Homo sapiens
caaagcgaaagaagaaaca

SEQ ID NO: 757507 - RNA, 19 nt, Homo sapiens
acaauaggacaaagcgaaa

SEQ ID NO: 757508 - RNA, 19 nt, Homo sapiens
gcaugcaacaaauguggaa

SEQ ID NO: 757509 - RNA, 19 nt, Homo sapiens
ggacaaagcgaaagaagaa

SEQ ID NO: 757510 - RNA, 19 nt, Homo sapiens
gaaaaugagugaggaguua

SEQ ID NO: 757511 - RNA, 19 nt, Homo sapiens
agaaacagccuaccucaua

SEQ ID NO: 757512 - RNA, 19 nt, Homo sapiens
ggagagagaccauuugaau

SEQ ID NO: 757513 - RNA, 19 nt, Homo sapiens
gaaacauaauucacgugua

SEQ ID NO: 757514 - RNA, 19 nt, Homo sapiens
gcuugacccugcaauauaa

SEQ ID NO: 757515 - RNA, 19 nt, Homo sapiens
acccagagcucacaccuua

SEQ ID NO: 757516 - RNA, 19 nt, Homo sapiens
gauauuacauccacaguac

SEQ ID NO: 757517 - RNA, 19 nt, Homo sapiens
gaaacagccuaccucauag

SEQ ID NO: 757518 - RNA, 19 nt, Homo sapiens
gggaggaccuucaaugauc

SEQ ID NO: 757519 - RNA, 19 nt, Homo sapiens
cgagggacaucgacgagua

SEQ ID NO: 757520 - RNA, 19 nt, Homo sapiens
ggagagaggcccuaugugu

SEQ ID NO: 757521 - RNA, 19 nt, Homo sapiens
guacuaaacagauuacguu

SEQ ID NO: 757522 - RNA, 19 nt, Homo sapiens
gauggagucugcucaggaa

SEQ ID NO: 757523 - RNA, 19 nt, Homo sapiens
gauauuguuuguucacuca

SEQ ID NO: 757524 - RNA, 19 nt, Homo sapiens
gggaaaggauuuguucaga

SEQ ID NO: 757525 - RNA, 19 nt, Homo sapiens
gcgcuaagcccuacaagug

SEQ ID NO: 757526 - RNA, 19 nt, Homo sapiens
agaguuagcuccaaauucu

SEQ ID NO: 757527 - RNA, 19 nt, Homo sapiens
aaagggaaguauugaguga

SEQ ID NO: 757528 - RNA, 19 nt, Homo sapiens
caaaauuccuccuagaaaa

SEQ ID NO: 757529 - RNA, 19 nt, Homo sapiens
ccacaguaccacaguauuu

SEQ ID NO: 757530 - RNA, 19 nt, Homo sapiens
caaccaagcaucacccauu

SEQ ID NO: 757531 - RNA, 19 nt, Homo sapiens
gggaagugaugcuggagaa

SEQ ID NO: 757532 - RNA, 19 nt, Homo sapiens
ccagugaccuuugaagaug

SEQ ID NO: 757533 - RNA, 19 nt, Homo sapiens
gcccagcacauaaugaaua

SEQ ID NO: 757534 - RNA, 19 nt, Homo sapiens
gaacaucagcuuuccaaac

SEQ ID NO: 757535 - RNA, 19 nt, Homo sapiens
agacuacacuggaaaauaa

SEQ ID NO: 757536 - RNA, 19 nt, Homo sapiens
ggauguggcuguggacuuc

SEQ ID NO: 757537 - RNA, 19 nt, Homo sapiens
caccagagaacccacaaua

SEQ ID NO: 757538 - RNA, 19 nt, Homo sapiens
guggugcucuugacacaaa

SEQ ID NO: 757539 - RNA, 19 nt, Homo sapiens
gauugugccuuguccucua

SEQ ID NO: 757540 - RNA, 19 nt, Homo sapiens
cgacacagaggaccgagua

SEQ ID NO: 757541 - RNA, 19 nt, Homo sapiens
auaaagaguuagcuccaaa

SEQ ID NO: 757542 - RNA, 19 nt, Homo sapiens
ucagagcucuucccucaca

SEQ ID NO: 757543 - RNA, 19 nt, Homo sapiens
ccauaugcaugcaacaaau

SEQ ID NO: 757544 - RNA, 19 nt, Homo sapiens
gaaccuggucucaguggaa

SEQ ID NO: 757545 - RNA, 19 nt, Homo sapiens
ggagacugcccagcacaua

SEQ ID NO: 757546 - RNA, 19 nt, Homo sapiens
gugaaccagugaccuuuga

SEQ ID NO: 757547 - RNA, 19 nt, Homo sapiens
agagacacauugagaagga

SEQ ID NO: 757548 - RNA, 19 nt, Homo sapiens
caucagaagagcugugaaa

SEQ ID NO: 757549 - RNA, 19 nt, Homo sapiens
gaagaagcacuuugacaac

SEQ ID NO: 757550 - RNA, 19 nt, Homo sapiens
gaugugguaucucaguuag

SEQ ID NO: 757551 - RNA, 19 nt, Homo sapiens
agaagaagcacuuugacaa

SEQ ID NO: 757552 - RNA, 19 nt, Homo sapiens
uagaggaggcagaagauuu

SEQ ID NO: 757553 - RNA, 19 nt, Homo sapiens
cacaguaccacaguauuua

SEQ ID NO: 757554 - RNA, 19 nt, Homo sapiens
aaucugcacugauauuaca

SEQ ID NO: 757555 - RNA, 19 nt, Homo sapiens
cccagcacauaaugaauaa

SEQ ID NO: 757556 - RNA, 19 nt, Homo sapiens
gagacugcccagcacauaa

SEQ ID NO: 757557 - RNA, 19 nt, Homo sapiens
ccagagcucacaccuuauu

SEQ ID NO: 757558 - RNA, 19 nt, Homo sapiens
guucacucauuuagucauu

SEQ ID NO: 757559 - RNA, 19 nt, Homo sapiens
ccuauaugcugaagaugga

SEQ ID NO: 757560 - RNA, 19 nt, Homo sapiens
gcaaacaguggugcucuug

SEQ ID NO: 757561 - RNA, 19 nt, Homo sapiens
cccauucacuugauauugu

SEQ ID NO: 757562 - RNA, 19 nt, Homo sapiens
gcucccaccucaucagaca

SEQ ID NO: 757563 - RNA, 19 nt, Homo sapiens
ggacucacacuggcgcuaa

SEQ ID NO: 757564 - RNA, 19 nt, Homo sapiens
cagugaaugugguaaaaua

SEQ ID NO: 757565 - RNA, 19 nt, Homo sapiens
ugccuuguccucuacauua

SEQ ID NO: 757566 - RNA, 19 nt, Homo sapiens
cagagaacccacaauagga

SEQ ID NO: 757567 - RNA, 19 nt, Homo sapiens
ucacacagcaucagagagu

SEQ ID NO: 757568 - RNA, 19 nt, Homo sapiens
guggcgcucuugacacaaa

SEQ ID NO: 757569 - RNA, 19 nt, Homo sapiens
gcaaacaguggcgcucuug

SEQ ID NO: 757570 - RNA, 19 nt, Homo sapiens
ggcccuauaugcugaagau

SEQ ID NO: 757571 - RNA, 19 nt, Homo sapiens
uaaauuggauccucuuccu

SEQ ID NO: 757572 - RNA, 19 nt, Homo sapiens
ccagagaacccacaauagg

SEQ ID NO: 757573 - RNA, 19 nt, Homo sapiens
ccagcuggacccuaaauug

SEQ ID NO: 757574 - RNA, 19 nt, Homo sapiens
agacaccauuccagaguau

SEQ ID NO: 757575 - RNA, 19 nt, Homo sapiens
cauccacaguaccacagua

SEQ ID NO: 757576 - RNA, 19 nt, Homo sapiens
cacuugauauuguuuguuc

SEQ ID NO: 757577 - RNA, 19 nt, Homo sapiens
ccauucacuugauauuguu

SEQ ID NO: 757578 - RNA, 19 nt, Homo sapiens
gaacccacaauaggacaaa

SEQ ID NO: 757579 - RNA, 19 nt, Homo sapiens
aagacaccauuccagagua

SEQ ID NO: 757580 - RNA, 19 nt, Homo sapiens
caagacaccauuccagagu

SEQ ID NO: 757581 - RNA, 19 nt, Homo sapiens
cuacaagugucaggacugu

SEQ ID NO: 757582 - RNA, 19 nt, Homo sapiens
ucaagacugugggaaagga

SEQ ID NO: 757583 - RNA, 19 nt, Homo sapiens
gaaggcaaugguuguagga

SEQ ID NO: 757584 - RNA, 19 nt, Homo sapiens
caaggaaggcaaugguugu

SEQ ID NO: 757585 - RNA, 19 nt, Homo sapiens
ccagugagcagguccaaca

SEQ ID NO: 757586 - RNA, 19 nt, Homo sapiens
gcuggacccuaaauuggau

SEQ ID NO: 757587 - RNA, 19 nt, Homo sapiens
aagugaugcuggagaacua

SEQ ID NO: 757588 - RNA, 19 nt, Homo sapiens
caccagagacacauugaga

SEQ ID NO: 757589 - RNA, 19 nt, Homo sapiens
gugggaggaccuucaauga

SEQ ID NO: 757590 - RNA, 19 nt, Homo sapiens
ccagauccaggcccuauau

SEQ ID NO: 757591 - RNA, 19 nt, Homo sapiens
ugaaagggaaguauugagu

SEQ ID NO: 757592 - RNA, 19 nt, Homo sapiens
aggcaaugguuguaggaaa

SEQ ID NO: 757593 - RNA, 19 nt, Homo sapiens
caguggcgcucuugacaca

SEQ ID NO: 757594 - RNA, 19 nt, Homo sapiens
ggcaaacaguggugcucuu

SEQ ID NO: 757595 - RNA, 19 nt, Homo sapiens
aaagauuucccauucacuu

SEQ ID NO: 757596 - RNA, 19 nt, Homo sapiens
cagcuugacccugcaauau

SEQ ID NO: 757597 - RNA, 19 nt, Homo sapiens
gcuccaaauucugacauuc

SEQ ID NO: 757598 - RNA, 19 nt, Homo sapiens
aaagaguuagcuccaaauu

SEQ ID NO: 757599 - RNA, 19 nt, Homo sapiens
gugggagacuacacuggaa

SEQ ID NO: 757600 - RNA, 19 nt, Homo sapiens
uaggugcacugccugugaa

SEQ ID NO: 757601 - RNA, 19 nt, Homo sapiens
uugaagaaaccuugccuuu

SEQ ID NO: 757602 - RNA, 19 nt, Homo sapiens
ccagagcucccaccucauc

SEQ ID NO: 757603 - RNA, 19 nt, Homo sapiens
ucggaguacuaaacagauu

SEQ ID NO: 757604 - RNA, 19 nt, Homo sapiens
ccacaaaauuccuccuaga

SEQ ID NO: 757605 - RNA, 19 nt, Homo sapiens
aaacaguggugcucuugac

SEQ ID NO: 757606 - RNA, 19 nt, Homo sapiens
gaaccagugaccuuugaag

SEQ ID NO: 757607 - RNA, 19 nt, Homo sapiens
aaccaagcaucacccauuc

SEQ ID NO: 757608 - RNA, 19 nt, Homo sapiens
cggaguacuaaacagauua

SEQ ID NO: 757609 - RNA, 19 nt, Homo sapiens
ccacggaagucgagaauua

SEQ ID NO: 757610 - RNA, 19 nt, Homo sapiens
caacugaaccacccaaaua

SEQ ID NO: 757611 - RNA, 19 nt, Homo sapiens
gaaggaagcaugggauaua

SEQ ID NO: 757612 - RNA, 19 nt, Homo sapiens
gauuaacugugaagacuaa

SEQ ID NO: 757613 - RNA, 19 nt, Homo sapiens
guaaagggauaaaguggaa

SEQ ID NO: 757614 - RNA, 19 nt, Homo sapiens
gcacuacuccgagaaguua

SEQ ID NO: 757615 - RNA, 19 nt, Homo sapiens
ccagaaauguguuccuuau

SEQ ID NO: 757616 - RNA, 19 nt, Homo sapiens
aaaguuaaccuuccaauug

SEQ ID NO: 757617 - RNA, 19 nt, Homo sapiens
gggcuguccuuuacaaauu

SEQ ID NO: 757618 - RNA, 19 nt, Homo sapiens
ggaagacaguggcucugaa

SEQ ID NO: 757619 - RNA, 19 nt, Homo sapiens
gagaacggcuacaacuuca

SEQ ID NO: 757620 - RNA, 19 nt, Homo sapiens
ucucgcagaugaucaagua

SEQ ID NO: 757621 - RNA, 19 nt, Homo sapiens
ggauaaaguggaaaucauu

SEQ ID NO: 757622 - RNA, 19 nt, Homo sapiens
aaucucagcugggucaaua

SEQ ID NO: 757623 - RNA, 19 nt, Homo sapiens
acccaaauaucaucaagua

SEQ ID NO: 757624 - RNA, 19 nt, Homo sapiens
ggacucggaucugcuguga

SEQ ID NO: 757625 - RNA, 19 nt, Homo sapiens
gcaaguuagcuaauacaaa

SEQ ID NO: 757626 - RNA, 19 nt, Homo sapiens
ucaaguauuuggacucguu

SEQ ID NO: 757627 - RNA, 19 nt, Homo sapiens
cagaugaucaaguacuuua

SEQ ID NO: 757628 - RNA, 19 nt, Homo sapiens
ggaagcaugggauauagaa

SEQ ID NO: 757629 - RNA, 19 nt, Homo sapiens
ggaagucgagaauuaaugu

SEQ ID NO: 757630 - RNA, 19 nt, Homo sapiens
ucaucuaccuucaggauug

SEQ ID NO: 757631 - RNA, 19 nt, Homo sapiens
gggauaaaguggaaaucau

SEQ ID NO: 757632 - RNA, 19 nt, Homo sapiens
gcaggagaccgugugauuu

SEQ ID NO: 757633 - RNA, 19 nt, Homo sapiens
gcaccacuuugccuuacuu

SEQ ID NO: 757634 - RNA, 19 nt, Homo sapiens
ucaaguacuuuaagaagca

SEQ ID NO: 757635 - RNA, 19 nt, Homo sapiens
gaucaaguacuuuaagaag

SEQ ID NO: 757636 - RNA, 19 nt, Homo sapiens
gcccgacagucucuccaua

SEQ ID NO: 757637 - RNA, 19 nt, Homo sapiens
cccuguaucuggauuguaa

SEQ ID NO: 757638 - RNA, 19 nt, Homo sapiens
gacagucucuccauaugca

SEQ ID NO: 757639 - RNA, 19 nt, Homo sapiens
uaucuggauuguaauguga

SEQ ID NO: 757640 - RNA, 19 nt, Homo sapiens
gaagcucggugaccuuggu

SEQ ID NO: 757641 - RNA, 19 nt, Homo sapiens
ugacagacagaauuugaaa

SEQ ID NO: 757642 - RNA, 19 nt, Homo sapiens
ggaguuacuuagaauucau

SEQ ID NO: 757643 - RNA, 19 nt, Homo sapiens
gugcuuaauuuacucuguu

SEQ ID NO: 757644 - RNA, 19 nt, Homo sapiens
cggagaggauccaugagaa

SEQ ID NO: 757645 - RNA, 19 nt, Homo sapiens
gaagacaacgagcugaaca

SEQ ID NO: 757646 - RNA, 19 nt, Homo sapiens
ggagaucggccucuugaag

SEQ ID NO: 757647 - RNA, 19 nt, Homo sapiens
ccacaggguucagcagguu

SEQ ID NO: 757648 - RNA, 19 nt, Homo sapiens
gacaguggcucugaagaag

SEQ ID NO: 757649 - RNA, 19 nt, Homo sapiens
gacugggaguuacuuagaa

SEQ ID NO: 757650 - RNA, 19 nt, Homo sapiens
gcugacagacagaauuuga

SEQ ID NO: 757651 - RNA, 19 nt, Homo sapiens
ugaucaguguuaagcauuu

SEQ ID NO: 757652 - RNA, 19 nt, Homo sapiens
ggaguggugauucugcuaa

SEQ ID NO: 757653 - RNA, 19 nt, Homo sapiens
caggagaccgugugauuug

SEQ ID NO: 757654 - RNA, 19 nt, Homo sapiens
gggaguuacuuagaauuca

SEQ ID NO: 757655 - RNA, 19 nt, Homo sapiens
gaagucgagaauuaaugua

SEQ ID NO: 757656 - RNA, 19 nt, Homo sapiens
gggaaggaagcaugggaua

SEQ ID NO: 757657 - RNA, 19 nt, Homo sapiens
gcaccuggccagaguguca

SEQ ID NO: 757658 - RNA, 19 nt, Homo sapiens
aaguuaaccuuccaauugu

SEQ ID NO: 757659 - RNA, 19 nt, Homo sapiens
ggaaggaagcaugggauau

SEQ ID NO: 757660 - RNA, 19 nt, Homo sapiens
guagugagccuuugaaaau

SEQ ID NO: 757661 - RNA, 19 nt, Homo sapiens
gaacauugugcuggaguug

SEQ ID NO: 757662 - RNA, 19 nt, Homo sapiens
ccacagaggcaucccaaca

SEQ ID NO: 757663 - RNA, 19 nt, Homo sapiens
guaggaaaccagaaaugug

SEQ ID NO: 757664 - RNA, 19 nt, Homo sapiens
gguagccacucacccuuca

SEQ ID NO: 757665 - RNA, 19 nt, Homo sapiens
guaucuggauuguaaugug

SEQ ID NO: 757666 - RNA, 19 nt, Homo sapiens
gaacggcuacaacuucaag

SEQ ID NO: 757667 - RNA, 19 nt, Homo sapiens
ugucugagcugucgucacu

SEQ ID NO: 757668 - RNA, 19 nt, Homo sapiens
gaagacaguggcucugaag

SEQ ID NO: 757669 - RNA, 19 nt, Homo sapiens
ggaacuucgucaccuccuu

SEQ ID NO: 757670 - RNA, 19 nt, Homo sapiens
gcugugugcuuaauuuacu

SEQ ID NO: 757671 - RNA, 19 nt, Homo sapiens
ugagaacggcuacaacuuc

SEQ ID NO: 757672 - RNA, 19 nt, Homo sapiens
uuuauaacuuggugaguga

SEQ ID NO: 757673 - RNA, 19 nt, Homo sapiens
gagaccgugugauuugugu

SEQ ID NO: 757674 - RNA, 19 nt, Homo sapiens
ugucaaggcuuaugcuaac

SEQ ID NO: 757675 - RNA, 19 nt, Homo sapiens
gugaaucuuuaggguaauu

SEQ ID NO: 757676 - RNA, 19 nt, Homo sapiens
gcagaugaucaaguacuuu

SEQ ID NO: 757677 - RNA, 19 nt, Homo sapiens
gaaccacccaaauaucauc

SEQ ID NO: 757678 - RNA, 19 nt, Homo sapiens
gcaacugaaccacccaaau

SEQ ID NO: 757679 - RNA, 19 nt, Homo sapiens
ggauuaacugugaagacua

SEQ ID NO: 757680 - RNA, 19 nt, Homo sapiens
ucaaggagaucggccucuu

SEQ ID NO: 757681 - RNA, 19 nt, Homo sapiens
gacaacgagcugaacauug

SEQ ID NO: 757682 - RNA, 19 nt, Homo sapiens
ucugagcugucgucacuga

SEQ ID NO: 757683 - RNA, 19 nt, Homo sapiens
agacaguggcucugaagaa

SEQ ID NO: 757684 - RNA, 19 nt, Homo sapiens
guuaguaccggguucaguu

SEQ ID NO: 757685 - RNA, 19 nt, Homo sapiens
ccgacagucucuccauaug

SEQ ID NO: 757686 - RNA, 19 nt, Homo sapiens
acucggaucugcugugaca

SEQ ID NO: 757687 - RNA, 19 nt, Homo sapiens
uaggaaaccagaaaugugu

SEQ ID NO: 757688 - RNA, 19 nt, Homo sapiens
caugaucaguguuaagcau

SEQ ID NO: 757689 - RNA, 19 nt, Homo sapiens
ucaguuuaguucuugguau

SEQ ID NO: 757690 - RNA, 19 nt, Homo sapiens
gggacgcccuacuacaugu

SEQ ID NO: 757691 - RNA, 19 nt, Homo sapiens
ugacugggaguuacuuaga

SEQ ID NO: 757692 - RNA, 19 nt, Homo sapiens
aaacuccaccucugaagga

SEQ ID NO: 757693 - RNA, 19 nt, Homo sapiens
ggaaaccagaaauguguuc

SEQ ID NO: 757694 - RNA, 19 nt, Homo sapiens
gaagcaugggauauagaaa

SEQ ID NO: 757695 - RNA, 19 nt, Homo sapiens
augugaaucuuuaggguaa

SEQ ID NO: 757696 - RNA, 19 nt, Homo sapiens
ccagcaccacuuugccuua

SEQ ID NO: 757697 - RNA, 19 nt, Homo sapiens
gagaggacaguauggaagu

SEQ ID NO: 757698 - RNA, 19 nt, Homo sapiens
agaaggugcagaucuuuga

SEQ ID NO: 757699 - RNA, 19 nt, Homo sapiens
ucuccaugguugaaauaaa

SEQ ID NO: 757700 - RNA, 19 nt, Homo sapiens
cauuucaugaucaguguua

SEQ ID NO: 757701 - RNA, 19 nt, Homo sapiens
uacgagaacuggucagcau

SEQ ID NO: 757702 - RNA, 19 nt, Homo sapiens
gagccuucauuuccucauc

SEQ ID NO: 757703 - RNA, 19 nt, Homo sapiens
gcuggcgguucauuucaug

SEQ ID NO: 757704 - RNA, 19 nt, Homo sapiens
gagaacuggucagcaugug

SEQ ID NO: 757705 - RNA, 19 nt, Homo sapiens
gaugaucaaguacuuuaag

SEQ ID NO: 757706 - RNA, 19 nt, Homo sapiens
ggguucaguuuaguucuug

SEQ ID NO: 757707 - RNA, 19 nt, Homo sapiens
gagcacuacuccgagaagu

SEQ ID NO: 757708 - RNA, 19 nt, Homo sapiens
agaggacaguauggaagua

SEQ ID NO: 757709 - RNA, 19 nt, Homo sapiens
gaaagucucugguguucuu

SEQ ID NO: 757710 - RNA, 19 nt, Homo sapiens
gaaaagaagucacaagaaa

SEQ ID NO: 757711 - RNA, 19 nt, Homo sapiens
ggaugaaccuucucaacuu

SEQ ID NO: 757712 - RNA, 19 nt, Homo sapiens
gcaccugucuaugcuguua

SEQ ID NO: 757713 - RNA, 19 nt, Homo sapiens
gaauuucaaucaccgauca

SEQ ID NO: 757714 - RNA, 19 nt, Homo sapiens
ccacagggauguugcugaa

SEQ ID NO: 757715 - RNA, 19 nt, Homo sapiens
gcagacagcaguuggugua

SEQ ID NO: 757716 - RNA, 19 nt, Homo sapiens
gcucugggcuggcacaugu

SEQ ID NO: 757717 - RNA, 19 nt, Homo sapiens
guacagcccugacuuucau

SEQ ID NO: 757718 - RNA, 19 nt, Homo sapiens
ggacgucguuaugauuuga

SEQ ID NO: 757719 - RNA, 19 nt, Homo sapiens
ccuccuaccugaagaagaa

SEQ ID NO: 757720 - RNA, 19 nt, Homo sapiens
gaugaaccuucucaacuuc

SEQ ID NO: 757721 - RNA, 19 nt, Homo sapiens
acagggauguugcugaauu

SEQ ID NO: 757722 - RNA, 19 nt, Homo sapiens
gcacagauggugaacuugu

SEQ ID NO: 757723 - RNA, 19 nt, Homo sapiens
gagagcaccguguuaaaga

SEQ ID NO: 757724 - RNA, 19 nt, Homo sapiens
gaggacgucguuaugauuu

SEQ ID NO: 757725 - RNA, 19 nt, Homo sapiens
gaacugggccaugcuggaa

SEQ ID NO: 757726 - RNA, 19 nt, Homo sapiens
cagggauguugcugaauuu

SEQ ID NO: 757727 - RNA, 19 nt, Homo sapiens
uggcacagauggugaacuu

SEQ ID NO: 757728 - RNA, 19 nt, Homo sapiens
gacgugcugucccgcagua

SEQ ID NO: 757729 - RNA, 19 nt, Homo sapiens
gacagccucuucaucuaug

SEQ ID NO: 757730 - RNA, 19 nt, Homo sapiens
guaagcgucugauucuuuu

SEQ ID NO: 757731 - RNA, 19 nt, Homo sapiens
gauuugaccuuggcacaca

SEQ ID NO: 757732 - RNA, 19 nt, Homo sapiens
gagcaccguguuaaagaaa

SEQ ID NO: 757733 - RNA, 19 nt, Homo sapiens
gacaguaagcgucugauuc

SEQ ID NO: 757734 - RNA, 19 nt, Homo sapiens
ccagaccaguggaguggaa

SEQ ID NO: 757735 - RNA, 19 nt, Homo sapiens
gggaggcgacgcuaaguug

SEQ ID NO: 757736 - RNA, 19 nt, Homo sapiens
gaagaagaaagaggagaga

SEQ ID NO: 757737 - RNA, 19 nt, Homo sapiens
aagaaagucucugguguuc

SEQ ID NO: 757738 - RNA, 19 nt, Homo sapiens
aaagaaagucucugguguu

SEQ ID NO: 757739 - RNA, 19 nt, Homo sapiens
ggcggcagcugucuguguu

SEQ ID NO: 757740 - RNA, 19 nt, Homo sapiens
aguggaagcucuugaagca

SEQ ID NO: 757741 - RNA, 19 nt, Homo sapiens
gaaaaggugacaucaguug

SEQ ID NO: 757742 - RNA, 19 nt, Homo sapiens
gggcaugccaagaagauga

SEQ ID NO: 757743 - RNA, 19 nt, Homo sapiens
uggcaugucccuucaagaa

SEQ ID NO: 757744 - RNA, 19 nt, Homo sapiens
gcaccguguuaaagaaagu

SEQ ID NO: 757745 - RNA, 19 nt, Homo sapiens
cgacgggcaugccaagaag

SEQ ID NO: 757746 - RNA, 19 nt, Homo sapiens
gaugaugacagccucuuca

SEQ ID NO: 757747 - RNA, 19 nt, Homo sapiens
gguguacagcccugacuuu

SEQ ID NO: 757748 - RNA, 19 nt, Homo sapiens
cacagauggugaacuuguu

SEQ ID NO: 757749 - RNA, 19 nt, Homo sapiens
ugacagccucuucaucuau

SEQ ID NO: 757750 - RNA, 19 nt, Homo sapiens
agagcaccguguuaaagaa

SEQ ID NO: 757751 - RNA, 19 nt, Homo sapiens
gcugucaccuggccagucu

SEQ ID NO: 757752 - RNA, 19 nt, Homo sapiens
ccaagucuggcagcuauuu

SEQ ID NO: 757753 - RNA, 19 nt, Homo sapiens
ggaagcucuugaagcacuu

SEQ ID NO: 757754 - RNA, 19 nt, Homo sapiens
aguaagcgucugauucuuu

SEQ ID NO: 757755 - RNA, 19 nt, Homo sapiens
gauugaggacgucguuaug

SEQ ID NO: 757756 - RNA, 19 nt, Homo sapiens
uggcaucgguggcacagau

SEQ ID NO: 757757 - RNA, 19 nt, Homo sapiens
aaggugacaucaguuguga

SEQ ID NO: 757758 - RNA, 19 nt, Homo sapiens
agcagcagcuagagaagaa

SEQ ID NO: 757759 - RNA, 19 nt, Homo sapiens
ucgacaacgugaccuccua

SEQ ID NO: 757760 - RNA, 19 nt, Homo sapiens
uggcagcuauuuugcuuua

SEQ ID NO: 757761 - RNA, 19 nt, Homo sapiens
ugaggacgucguuaugauu

SEQ ID NO: 757762 - RNA, 19 nt, Homo sapiens
uagcaagcagugaugauga

SEQ ID NO: 757763 - RNA, 19 nt, Homo sapiens
gacagcaguugguguacag

SEQ ID NO: 757764 - RNA, 19 nt, Homo sapiens
gaugacaguaagcgucuga

SEQ ID NO: 757765 - RNA, 19 nt, Homo sapiens
ugucggaggcugcguguga

SEQ ID NO: 757766 - RNA, 19 nt, Homo sapiens
ccugagagcaccguguuaa

SEQ ID NO: 757767 - RNA, 19 nt, Homo sapiens
cuccaagucuggcagcuau

SEQ ID NO: 757768 - RNA, 19 nt, Homo sapiens
gacgagaagauccgaguca

SEQ ID NO: 757769 - RNA, 19 nt, Homo sapiens
gaagcacuuucuuuucaug

SEQ ID NO: 757770 - RNA, 19 nt, Homo sapiens
ucucucaccucaaauuagg

SEQ ID NO: 757771 - RNA, 19 nt, Homo sapiens
acaguaagcgucugauucu

SEQ ID NO: 757772 - RNA, 19 nt, Homo sapiens
uagcagcaaccgaauauac

SEQ ID NO: 757773 - RNA, 19 nt, Homo sapiens
aaucaccgaucagcaagga

SEQ ID NO: 757774 - RNA, 19 nt, Homo sapiens
ucugugggcugacguuucu

SEQ ID NO: 757775 - RNA, 19 nt, Homo sapiens
ugacaguaagcgucugauu

SEQ ID NO: 757776 - RNA, 19 nt, Homo sapiens
gaaccuucucaacuuccua

SEQ ID NO: 757777 - RNA, 19 nt, Homo sapiens
gcagcugucuguguuucuc

SEQ ID NO: 757778 - RNA, 19 nt, Homo sapiens
ugucucucaccucaaauua

SEQ ID NO: 757779 - RNA, 19 nt, Homo sapiens
gaauauaccaggcaaaacu

SEQ ID NO: 757780 - RNA, 19 nt, Homo sapiens
acagauggugaacuuguuu

SEQ ID NO: 757781 - RNA, 19 nt, Homo sapiens
uguuucuccuguucucaua

SEQ ID NO: 757782 - RNA, 19 nt, Homo sapiens
cuucagcagucucuacaag

SEQ ID NO: 757783 - RNA, 19 nt, Homo sapiens
gcuccaggacugccaggaa

SEQ ID NO: 757784 - RNA, 19 nt, Homo sapiens
uguugaaacucagcacgaa

SEQ ID NO: 757785 - RNA, 19 nt, Homo sapiens
gcaucgaguccuucugcuu

SEQ ID NO: 757786 - RNA, 19 nt, Homo sapiens
guuuagcagcaaccgaaua

SEQ ID NO: 757787 - RNA, 19 nt, Homo sapiens
ggaguggaagcucuugaag

SEQ ID NO: 757788 - RNA, 19 nt, Homo sapiens
ugagagcaccguguuaaag

SEQ ID NO: 757789 - RNA, 19 nt, Homo sapiens
gcagcaaccgaauauacca

SEQ ID NO: 757790 - RNA, 19 nt, Homo sapiens
uugaggacgucguuaugau

SEQ ID NO: 757791 - RNA, 19 nt, Homo sapiens
aaaggugacaucaguugug

SEQ ID NO: 757792 - RNA, 19 nt, Homo sapiens
cagaaaagaagucacaaga

SEQ ID NO: 757793 - RNA, 19 nt, Homo sapiens
agacagcaguugguguaca

SEQ ID NO: 757794 - RNA, 19 nt, Homo sapiens
gcagagccacagggauguu

SEQ ID NO: 757795 - RNA, 19 nt, Homo sapiens
gucguuaugauuugauuug

SEQ ID NO: 757796 - RNA, 19 nt, Homo sapiens
ugauugaggacgucguuau

SEQ ID NO: 757797 - RNA, 19 nt, Homo sapiens
gggaagugagaaacacguu

SEQ ID NO: 757798 - RNA, 19 nt, Homo sapiens
gcucuugaagcacuuucuu

SEQ ID NO: 757799 - RNA, 19 nt, Homo sapiens
gaccaguggcagucuguuc

SEQ ID NO: 757800 - RNA, 19 nt, Homo sapiens
ggugauugaggacgucguu

SEQ ID NO: 757801 - RNA, 19 nt, Homo sapiens
gcguccaccuucuccaagu

SEQ ID NO: 757802 - RNA, 19 nt, Homo sapiens
cguccaggauugcauucug

SEQ ID NO: 757803 - RNA, 19 nt, Homo sapiens
aaaccauggcaaugucuga

SEQ ID NO: 757804 - RNA, 19 nt, Homo sapiens
gaaagucucugguguucuu

SEQ ID NO: 757805 - RNA, 19 nt, Homo sapiens
gaaaagaagucacaagaaa

SEQ ID NO: 757806 - RNA, 19 nt, Homo sapiens
gcaccugucuaugcuguua

SEQ ID NO: 757807 - RNA, 19 nt, Homo sapiens
gcagacagcaguuggugua

SEQ ID NO: 757808 - RNA, 19 nt, Homo sapiens
gcucugggcuggcacaugu

SEQ ID NO: 757809 - RNA, 19 nt, Homo sapiens
guacagcccugacuuucau

SEQ ID NO: 757810 - RNA, 19 nt, Homo sapiens
ccuccuaccugaagaagaa

SEQ ID NO: 757811 - RNA, 19 nt, Homo sapiens
gagagcaccguguuaaaga

SEQ ID NO: 757812 - RNA, 19 nt, Homo sapiens
gaacugggccaugcuggaa

SEQ ID NO: 757813 - RNA, 19 nt, Homo sapiens
cgaggagcaucugugauuu

SEQ ID NO: 757814 - RNA, 19 nt, Homo sapiens
gacagccucuucaucuaug

SEQ ID NO: 757815 - RNA, 19 nt, Homo sapiens
guaagcgucugauucuuuu

SEQ ID NO: 757816 - RNA, 19 nt, Homo sapiens
gagcaccguguuaaagaaa

SEQ ID NO: 757817 - RNA, 19 nt, Homo sapiens
gacaguaagcgucugauuc

SEQ ID NO: 757818 - RNA, 19 nt, Homo sapiens
guccucugcuuaugggaua

SEQ ID NO: 757819 - RNA, 19 nt, Homo sapiens
gaucguggcggucuguuuc

SEQ ID NO: 757820 - RNA, 19 nt, Homo sapiens
gggaggcgacgcuaaguug

SEQ ID NO: 757821 - RNA, 19 nt, Homo sapiens
gaagaagaaagaggagaga

SEQ ID NO: 757822 - RNA, 19 nt, Homo sapiens
aagaaagucucugguguuc

SEQ ID NO: 757823 - RNA, 19 nt, Homo sapiens
aaagaaagucucugguguu

SEQ ID NO: 757824 - RNA, 19 nt, Homo sapiens
gaggagcaucugugauuug

SEQ ID NO: 757825 - RNA, 19 nt, Homo sapiens
ucgaggagcaucugugauu

SEQ ID NO: 757826 - RNA, 19 nt, Homo sapiens
gggcaugccaagaagauga

SEQ ID NO: 757827 - RNA, 19 nt, Homo sapiens
gcaccguguuaaagaaagu

SEQ ID NO: 757828 - RNA, 19 nt, Homo sapiens
cgacgggcaugccaagaag

SEQ ID NO: 757829 - RNA, 19 nt, Homo sapiens
gguguacagcccugacuuu

SEQ ID NO: 757830 - RNA, 19 nt, Homo sapiens
gaugaugacagccucuuca

SEQ ID NO: 757831 - RNA, 19 nt, Homo sapiens
agagcaccguguuaaagaa

SEQ ID NO: 757832 - RNA, 19 nt, Homo sapiens
gcugucaccuggccagucu

SEQ ID NO: 757833 - RNA, 19 nt, Homo sapiens
ugacagccucuucaucuau

SEQ ID NO: 757834 - RNA, 19 nt, Homo sapiens
ccaagucuggcagcuauuu

SEQ ID NO: 757835 - RNA, 19 nt, Homo sapiens
ccacuugcgugcgaucugu

SEQ ID NO: 757836 - RNA, 19 nt, Homo sapiens
aguaagcgucugauucuuu

SEQ ID NO: 757837 - RNA, 19 nt, Homo sapiens
gugauuuguccucugcuua

SEQ ID NO: 757838 - RNA, 19 nt, Homo sapiens
agcagcagcuagagaagaa

SEQ ID NO: 757839 - RNA, 19 nt, Homo sapiens
ucgacaacgugaccuccua

SEQ ID NO: 757840 - RNA, 19 nt, Homo sapiens
uggcagcuauuuugcuuua

SEQ ID NO: 757841 - RNA, 19 nt, Homo sapiens
ggccgacgaugagcuuguu

SEQ ID NO: 757842 - RNA, 19 nt, Homo sapiens
uagcaagcagugaugauga

SEQ ID NO: 757843 - RNA, 19 nt, Homo sapiens
gacagcaguugguguacag

SEQ ID NO: 757844 - RNA, 19 nt, Homo sapiens
gaugacaguaagcgucuga

SEQ ID NO: 757845 - RNA, 19 nt, Homo sapiens
gauuuguccucugcuuaug

SEQ ID NO: 757846 - RNA, 19 nt, Homo sapiens
ccugagagcaccguguuaa

SEQ ID NO: 757847 - RNA, 19 nt, Homo sapiens
cuccaagucuggcagcuau

SEQ ID NO: 757848 - RNA, 19 nt, Homo sapiens
cugcuuaugggauauguuu

SEQ ID NO: 757849 - RNA, 19 nt, Homo sapiens
gacgagaagauccgaguca

SEQ ID NO: 757850 - RNA, 19 nt, Homo sapiens
acaguaagcgucugauucu

SEQ ID NO: 757851 - RNA, 19 nt, Homo sapiens
ugacaguaagcgucugauu

SEQ ID NO: 757852 - RNA, 19 nt, Homo sapiens
ugauuuguccucugcuuau

SEQ ID NO: 757853 - RNA, 19 nt, Homo sapiens
cuucagcagucucuacaag

SEQ ID NO: 757854 - RNA, 19 nt, Homo sapiens
gcuccaggacugccaggaa

SEQ ID NO: 757855 - RNA, 19 nt, Homo sapiens
gcaucgaguccuucugcuu

SEQ ID NO: 757856 - RNA, 19 nt, Homo sapiens
ugagagcaccguguuaaag

SEQ ID NO: 757857 - RNA, 19 nt, Homo sapiens
cagaaaagaagucacaaga

SEQ ID NO: 757858 - RNA, 19 nt, Homo sapiens
gaugagcuuguucggaugu

SEQ ID NO: 757859 - RNA, 19 nt, Homo sapiens
agacagcaguugguguaca

SEQ ID NO: 757860 - RNA, 19 nt, Homo sapiens
aggagcaucugugauuugu

SEQ ID NO: 757861 - RNA, 19 nt, Homo sapiens
gaccaguggcagucuguuc

SEQ ID NO: 757862 - RNA, 19 nt, Homo sapiens
gcguccaccuucuccaagu

SEQ ID NO: 757863 - RNA, 19 nt, Homo sapiens
cguccaggauugcauucug

SEQ ID NO: 757864 - RNA, 19 nt, Homo sapiens
aaaccauggcaaugucuga

SEQ ID NO: 757865 - RNA, 19 nt, Homo sapiens
gaaagucucugguguucuu

SEQ ID NO: 757866 - RNA, 19 nt, Homo sapiens
gaaaagaagucacaagaaa

SEQ ID NO: 757867 - RNA, 19 nt, Homo sapiens
ggaugaaccuucucaacuu

SEQ ID NO: 757868 - RNA, 19 nt, Homo sapiens
gcaccugucuaugcuguua

SEQ ID NO: 757869 - RNA, 19 nt, Homo sapiens
gaauuucaaucaccgauca

SEQ ID NO: 757870 - RNA, 19 nt, Homo sapiens
ccacagggauguugcugaa

SEQ ID NO: 757871 - RNA, 19 nt, Homo sapiens
gcagacagcaguuggugua

SEQ ID NO: 757872 - RNA, 19 nt, Homo sapiens
gcucugggcuggcacaugu

SEQ ID NO: 757873 - RNA, 19 nt, Homo sapiens
guacagcccugacuuucau

SEQ ID NO: 757874 - RNA, 19 nt, Homo sapiens
ggacgucguuaugauuuga

SEQ ID NO: 757875 - RNA, 19 nt, Homo sapiens
ccuccuaccugaagaagaa

SEQ ID NO: 757876 - RNA, 19 nt, Homo sapiens
gaugaaccuucucaacuuc

SEQ ID NO: 757877 - RNA, 19 nt, Homo sapiens
acagggauguugcugaauu

SEQ ID NO: 757878 - RNA, 19 nt, Homo sapiens
gcacagauggugaacuugu

SEQ ID NO: 757879 - RNA, 19 nt, Homo sapiens
gagagcaccguguuaaaga

SEQ ID NO: 757880 - RNA, 19 nt, Homo sapiens
gaggacgucguuaugauuu

SEQ ID NO: 757881 - RNA, 19 nt, Homo sapiens
gaacugggccaugcuggaa

SEQ ID NO: 757882 - RNA, 19 nt, Homo sapiens
cagggauguugcugaauuu

SEQ ID NO: 757883 - RNA, 19 nt, Homo sapiens
uggcacagauggugaacuu

SEQ ID NO: 757884 - RNA, 19 nt, Homo sapiens
gacgugcugucccgcagua

SEQ ID NO: 757885 - RNA, 19 nt, Homo sapiens
gacagccucuucaucuaug

SEQ ID NO: 757886 - RNA, 19 nt, Homo sapiens
gauuugaccuuggcacaca

SEQ ID NO: 757887 - RNA, 19 nt, Homo sapiens
gagcaccguguuaaagaaa

SEQ ID NO: 757888 - RNA, 19 nt, Homo sapiens
ccagaccaguggaguggaa

SEQ ID NO: 757889 - RNA, 19 nt, Homo sapiens
gggaggcgacgcuaaguug

SEQ ID NO: 757890 - RNA, 19 nt, Homo sapiens
gaagaagaaagaggagaga

SEQ ID NO: 757891 - RNA, 19 nt, Homo sapiens
aagaaagucucugguguuc

SEQ ID NO: 757892 - RNA, 19 nt, Homo sapiens
aaagaaagucucugguguu

SEQ ID NO: 757893 - RNA, 19 nt, Homo sapiens
ggcggcagcugucuguguu

SEQ ID NO: 757894 - RNA, 19 nt, Homo sapiens
aguggaagcucuugaagca

SEQ ID NO: 757895 - RNA, 19 nt, Homo sapiens
gaaaaggugacaucaguug

SEQ ID NO: 757896 - RNA, 19 nt, Homo sapiens
gggcaugccaagaagauga

SEQ ID NO: 757897 - RNA, 19 nt, Homo sapiens
uggcaugucccuucaagaa

SEQ ID NO: 757898 - RNA, 19 nt, Homo sapiens
gcaccguguuaaagaaagu

SEQ ID NO: 757899 - RNA, 19 nt, Homo sapiens
cgacgggcaugccaagaag

SEQ ID NO: 757900 - RNA, 19 nt, Homo sapiens
gaugaugacagccucuuca

SEQ ID NO: 757901 - RNA, 19 nt, Homo sapiens
gguguacagcccugacuuu

SEQ ID NO: 757902 - RNA, 19 nt, Homo sapiens
ugacagccucuucaucuau

SEQ ID NO: 757903 - RNA, 19 nt, Homo sapiens
cacagauggugaacuuguu

SEQ ID NO: 757904 - RNA, 19 nt, Homo sapiens
agagcaccguguuaaagaa

SEQ ID NO: 757905 - RNA, 19 nt, Homo sapiens
gcugucaccuggccagucu

SEQ ID NO: 757906 - RNA, 19 nt, Homo sapiens
ccaagucuggcagcuauuu

SEQ ID NO: 757907 - RNA, 19 nt, Homo sapiens
ggaagcucuugaagcacuu

SEQ ID NO: 757908 - RNA, 19 nt, Homo sapiens
guguauggcgugaugauga

SEQ ID NO: 757909 - RNA, 19 nt, Homo sapiens
gauugaggacgucguuaug

SEQ ID NO: 757910 - RNA, 19 nt, Homo sapiens
uggcaucgguggcacagau

SEQ ID NO: 757911 - RNA, 19 nt, Homo sapiens
aaggugacaucaguuguga

SEQ ID NO: 757912 - RNA, 19 nt, Homo sapiens
agcagcagcuagagaagaa

SEQ ID NO: 757913 - RNA, 19 nt, Homo sapiens
ucgacaacgugaccuccua

SEQ ID NO: 757914 - RNA, 19 nt, Homo sapiens
ugacagaccguggcaagga

SEQ ID NO: 757915 - RNA, 19 nt, Homo sapiens
uggcagcuauuuugcuuua

SEQ ID NO: 757916 - RNA, 19 nt, Homo sapiens
ugaggacgucguuaugauu

SEQ ID NO: 757917 - RNA, 19 nt, Homo sapiens
gacagcaguugguguacag

SEQ ID NO: 757918 - RNA, 19 nt, Homo sapiens
ugucggaggcugcguguga

SEQ ID NO: 757919 - RNA, 19 nt, Homo sapiens
cuccaagucuggcagcuau

SEQ ID NO: 757920 - RNA, 19 nt, Homo sapiens
ccugagagcaccguguuaa

SEQ ID NO: 757921 - RNA, 19 nt, Homo sapiens
gacgagaagauccgaguca

SEQ ID NO: 757922 - RNA, 19 nt, Homo sapiens
gaagcacuuucuuuucaug

SEQ ID NO: 757923 - RNA, 19 nt, Homo sapiens
ucucucaccucaaauuagg

SEQ ID NO: 757924 - RNA, 19 nt, Homo sapiens
uagcagcaaccgaauauac

SEQ ID NO: 757925 - RNA, 19 nt, Homo sapiens
aaucaccgaucagcaagga

SEQ ID NO: 757926 - RNA, 19 nt, Homo sapiens
ucugugggcugacguuucu

SEQ ID NO: 757927 - RNA, 19 nt, Homo sapiens
gaaccuucucaacuuccua

SEQ ID NO: 757928 - RNA, 19 nt, Homo sapiens
gcagcugucuguguuucuc

SEQ ID NO: 757929 - RNA, 19 nt, Homo sapiens
ugucucucaccucaaauua

SEQ ID NO: 757930 - RNA, 19 nt, Homo sapiens
gaauauaccaggcaaaacu

SEQ ID NO: 757931 - RNA, 19 nt, Homo sapiens
acagauggugaacuuguuu

SEQ ID NO: 757932 - RNA, 19 nt, Homo sapiens
uguuucuccuguucucaua

SEQ ID NO: 757933 - RNA, 19 nt, Homo sapiens
acauguguauggcgugaug

SEQ ID NO: 757934 - RNA, 19 nt, Homo sapiens
cuucagcagucucuacaag

SEQ ID NO: 757935 - RNA, 19 nt, Homo sapiens
gcuccaggacugccaggaa

SEQ ID NO: 757936 - RNA, 19 nt, Homo sapiens
uguugaaacucagcacgaa

SEQ ID NO: 757937 - RNA, 19 nt, Homo sapiens
gcaucgaguccuucugcuu

SEQ ID NO: 757938 - RNA, 19 nt, Homo sapiens
guuuagcagcaaccgaaua

SEQ ID NO: 757939 - RNA, 19 nt, Homo sapiens
ggaguggaagcucuugaag

SEQ ID NO: 757940 - RNA, 19 nt, Homo sapiens
ugagagcaccguguuaaag

SEQ ID NO: 757941 - RNA, 19 nt, Homo sapiens
gcagcaaccgaauauacca

SEQ ID NO: 757942 - RNA, 19 nt, Homo sapiens
uugaggacgucguuaugau

SEQ ID NO: 757943 - RNA, 19 nt, Homo sapiens
cagaaaagaagucacaaga

SEQ ID NO: 757944 - RNA, 19 nt, Homo sapiens
aaaggugacaucaguugug

SEQ ID NO: 757945 - RNA, 19 nt, Homo sapiens
agacagcaguugguguaca

SEQ ID NO: 757946 - RNA, 19 nt, Homo sapiens
gcagagccacagggauguu

SEQ ID NO: 757947 - RNA, 19 nt, Homo sapiens
gucguuaugauuugauuug

SEQ ID NO: 757948 - RNA, 19 nt, Homo sapiens
ugauugaggacgucguuau

SEQ ID NO: 757949 - RNA, 19 nt, Homo sapiens
gggaagugagaaacacguu

SEQ ID NO: 757950 - RNA, 19 nt, Homo sapiens
gcucuugaagcacuuucuu

SEQ ID NO: 757951 - RNA, 19 nt, Homo sapiens
gaccaguggcagucuguuc

SEQ ID NO: 757952 - RNA, 19 nt, Homo sapiens
ggugauugaggacgucguu

SEQ ID NO: 757953 - RNA, 19 nt, Homo sapiens
gcguccaccuucuccaagu

SEQ ID NO: 757954 - RNA, 19 nt, Homo sapiens
cguccaggauugcauucug

SEQ ID NO: 757955 - RNA, 19 nt, Homo sapiens
caggaaagguccaaguuua

SEQ ID NO: 757956 - RNA, 19 nt, Homo sapiens
gcucagaucucuacccauu

SEQ ID NO: 757957 - RNA, 19 nt, Homo sapiens
gagcauagcaccugucauu

SEQ ID NO: 757958 - RNA, 19 nt, Homo sapiens
ugagagaaauguaagauga

SEQ ID NO: 757959 - RNA, 19 nt, Homo sapiens
uggaauagcccucgucuua

SEQ ID NO: 757960 - RNA, 19 nt, Homo sapiens
ccucauagguggcuucauu

SEQ ID NO: 757961 - RNA, 19 nt, Homo sapiens
gaauagcccucgucuuaca

SEQ ID NO: 757962 - RNA, 19 nt, Homo sapiens
cauagcaccugucauugua

SEQ ID NO: 757963 - RNA, 19 nt, Homo sapiens
caucauauccuccuugaaa

SEQ ID NO: 757964 - RNA, 19 nt, Homo sapiens
ggaggaaugucuucuucuu

SEQ ID NO: 757965 - RNA, 19 nt, Homo sapiens
gaaguuaucccaccuugga

SEQ ID NO: 757966 - RNA, 19 nt, Homo sapiens
gacgcucucuugcggauua

SEQ ID NO: 757967 - RNA, 19 nt, Homo sapiens
caucaaagcuaugcucaga

SEQ ID NO: 757968 - RNA, 19 nt, Homo sapiens
gaaacacaauggccaccaa

SEQ ID NO: 757969 - RNA, 19 nt, Homo sapiens
agaagcagauguccaagaa

SEQ ID NO: 757970 - RNA, 19 nt, Homo sapiens
caacuuacaucagcucugu

SEQ ID NO: 757971 - RNA, 19 nt, Homo sapiens
ucagaucucuacccauuug

SEQ ID NO: 757972 - RNA, 19 nt, Homo sapiens
gucagcggauuucuucuua

SEQ ID NO: 757973 - RNA, 19 nt, Homo sapiens
caagaacgcacaagauaug

SEQ ID NO: 757974 - RNA, 19 nt, Homo sapiens
gcaagaacgcacaagauau

SEQ ID NO: 757975 - RNA, 19 nt, Homo sapiens
agaaugggcuaaagagaga

SEQ ID NO: 757976 - RNA, 19 nt, Homo sapiens
caacaggucgggucuucua

SEQ ID NO: 757977 - RNA, 19 nt, Homo sapiens
aagcagauguccaagaaug

SEQ ID NO: 757978 - RNA, 19 nt, Homo sapiens
gcggauuucuucuuaguca

SEQ ID NO: 757979 - RNA, 19 nt, Homo sapiens
ucaaagcuaugcucagauc

SEQ ID NO: 757980 - RNA, 19 nt, Homo sapiens
gaaaauaccagugaaaaga

SEQ ID NO: 757981 - RNA, 19 nt, Homo sapiens
gcuccaagguauuccaguu

SEQ ID NO: 757982 - RNA, 19 nt, Homo sapiens
cagagacaauggacuucua

SEQ ID NO: 757983 - RNA, 19 nt, Homo sapiens
gaguuuggguggaggaaug

SEQ ID NO: 757984 - RNA, 19 nt, Homo sapiens
gcauagcaccugucauugu

SEQ ID NO: 757985 - RNA, 19 nt, Homo sapiens
gaaagguccaaguuuaugu

SEQ ID NO: 757986 - RNA, 19 nt, Homo sapiens
ggaaagguccaaguuuaug

SEQ ID NO: 757987 - RNA, 19 nt, Homo sapiens
gaacgcacaagauaugcaa

SEQ ID NO: 757988 - RNA, 19 nt, Homo sapiens
auagguggcuucauuagug

SEQ ID NO: 757989 - RNA, 19 nt, Homo sapiens
gguuuguugugauuuauga

SEQ ID NO: 757990 - RNA, 19 nt, Homo sapiens
caagaagacccgcaucauc

SEQ ID NO: 757991 - RNA, 19 nt, Homo sapiens
gagcaagaacgcacaagau

SEQ ID NO: 757992 - RNA, 19 nt, Homo sapiens
cagauuuccuucuaaccaa

SEQ ID NO: 757993 - RNA, 19 nt, Homo sapiens
gagagaaauguaagaugaa

SEQ ID NO: 757994 - RNA, 19 nt, Homo sapiens
agauauugcuccaagguau

SEQ ID NO: 757995 - RNA, 19 nt, Homo sapiens
agucagggauuuauaucaa

SEQ ID NO: 757996 - RNA, 19 nt, Homo sapiens
cgucuuacauuucugcaau

SEQ ID NO: 757997 - RNA, 19 nt, Homo sapiens
ccaggaaagguccaaguuu

SEQ ID NO: 757998 - RNA, 19 nt, Homo sapiens
uggauaagcaccucagaaa

SEQ ID NO: 757999 - RNA, 19 nt, Homo sapiens
ucugguuuguugugauuua

SEQ ID NO: 758000 - RNA, 19 nt, Homo sapiens
uuacugggaugcuuuacug

SEQ ID NO: 758001 - RNA, 19 nt, Homo sapiens
gagaagcagauguccaaga

SEQ ID NO: 758002 - RNA, 19 nt, Homo sapiens
ccucauauuuggagaagca

SEQ ID NO: 758003 - RNA, 19 nt, Homo sapiens
guggaggaaugucuucuuc

SEQ ID NO: 758004 - RNA, 19 nt, Homo sapiens
gaauguuacugggaugcuu

SEQ ID NO: 758005 - RNA, 19 nt, Homo sapiens
gguccaaguuuauguucug

SEQ ID NO: 758006 - RNA, 19 nt, Homo sapiens
ucagggauuuauaucaaug

SEQ ID NO: 758007 - RNA, 19 nt, Homo sapiens
ucaauuaugagaucaguuc

SEQ ID NO: 758008 - RNA, 19 nt, Homo sapiens
gaggaaugucuucuucuug

SEQ ID NO: 758009 - RNA, 19 nt, Homo sapiens
caucagagacaauggacuu

SEQ ID NO: 758010 - RNA, 19 nt, Homo sapiens
gagaggagaaacacaaugg

SEQ ID NO: 758011 - RNA, 19 nt, Homo sapiens
ucacucguuuaugaaguua

SEQ ID NO: 758012 - RNA, 19 nt, Homo sapiens
cagcggauuucuucuuagu

SEQ ID NO: 758013 - RNA, 19 nt, Homo sapiens
gggagcaucaagaggauuu

SEQ ID NO: 758014 - RNA, 19 nt, Homo sapiens
gcagauuuccuucuaacca

SEQ ID NO: 758015 - RNA, 19 nt, Homo sapiens
ugccuucucugguuuguug

SEQ ID NO: 758016 - RNA, 19 nt, Homo sapiens
ggugcugccuguugacuca

SEQ ID NO: 758017 - RNA, 19 nt, Homo sapiens
ucacaacgauagcacaaaa

SEQ ID NO: 758018 - RNA, 19 nt, Homo sapiens
caagaaugggcuaaagaga

SEQ ID NO: 758019 - RNA, 19 nt, Homo sapiens
gauauugcuccaagguauu

SEQ ID NO: 758020 - RNA, 19 nt, Homo sapiens
gacaauggacuucuaucug

SEQ ID NO: 758021 - RNA, 19 nt, Homo sapiens
ccauuugguccauauguuu

SEQ ID NO: 758022 - RNA, 19 nt, Homo sapiens
gacaagaagacccgcauca

SEQ ID NO: 758023 - RNA, 19 nt, Homo sapiens
uaacaucagagacaaugga

SEQ ID NO: 758024 - RNA, 19 nt, Homo sapiens
agcaagaacgcacaagaua

SEQ ID NO: 758025 - RNA, 19 nt, Homo sapiens
cauuugguccauauguuua

SEQ ID NO: 758026 - RNA, 19 nt, Homo sapiens
uacaucauauccuccuuga

SEQ ID NO: 758027 - RNA, 19 nt, Homo sapiens
gucauuaggcaccguauug

SEQ ID NO: 758028 - RNA, 19 nt, Homo sapiens
caucaaugguuaguuagca

SEQ ID NO: 758029 - RNA, 19 nt, Homo sapiens
acucuucuaccucauauuu

SEQ ID NO: 758030 - RNA, 19 nt, Homo sapiens
gcaacggcgaggagcuuaa

SEQ ID NO: 758031 - RNA, 19 nt, Homo sapiens
caucagcucuguguaccau

SEQ ID NO: 758032 - RNA, 19 nt, Homo sapiens
ucucugguuuguugugauu

SEQ ID NO: 758033 - RNA, 19 nt, Homo sapiens
cuacucuucuaccucauau

SEQ ID NO: 758034 - RNA, 19 nt, Homo sapiens
ggagaggagaaacacaaug

SEQ ID NO: 758035 - RNA, 19 nt, Homo sapiens
ggcccuuugucuucuauau

SEQ ID NO: 758036 - RNA, 19 nt, Homo sapiens
uagguggcuucauuaguga

SEQ ID NO: 758037 - RNA, 19 nt, Homo sapiens
caagaacgaagcagacucu

SEQ ID NO: 758038 - RNA, 19 nt, Homo sapiens
ccauauguuuaggcuguuu

SEQ ID NO: 758039 - RNA, 19 nt, Homo sapiens
cuacccauuugguccauau

SEQ ID NO: 758040 - RNA, 19 nt, Homo sapiens
uguuaggacuacucuucua

SEQ ID NO: 758041 - RNA, 19 nt, Homo sapiens
gcccucgucuuacauuucu

SEQ ID NO: 758042 - RNA, 19 nt, Homo sapiens
gcauugcuuuaucaggaau

SEQ ID NO: 758043 - RNA, 19 nt, Homo sapiens
cugaggugcugccuguuga

SEQ ID NO: 758044 - RNA, 19 nt, Homo sapiens
ccaagaaugggcuaaagag

SEQ ID NO: 758045 - RNA, 19 nt, Homo sapiens
ccacaaggccaagggugaa

SEQ ID NO: 758046 - RNA, 19 nt, Homo sapiens
ugcuuuaucaggaauguua

SEQ ID NO: 758047 - RNA, 19 nt, Homo sapiens
caacagcacaagcccucaa

SEQ ID NO: 758048 - RNA, 19 nt, Homo sapiens
ggaauagcccucgucuuac

SEQ ID NO: 758049 - RNA, 19 nt, Homo sapiens
uaggcaccguauugcauaa

SEQ ID NO: 758050 - RNA, 19 nt, Homo sapiens
uuaggcaccguauugcaua

SEQ ID NO: 758051 - RNA, 19 nt, Homo sapiens
gucagggauuuauaucaau

SEQ ID NO: 758052 - RNA, 19 nt, Homo sapiens
uuaccucaauuccggcuau

SEQ ID NO: 758053 - RNA, 19 nt, Homo sapiens
uaucugcccuuccuuuuau

SEQ ID NO: 758054 - RNA, 19 nt, Homo sapiens
ucagcucuguguaccaugu

SEQ ID NO: 758055 - RNA, 19 nt, Homo sapiens
gcacauugcugaauuaaua

SEQ ID NO: 758056 - RNA, 19 nt, Homo sapiens
gcagaagacuuauuuguaa

SEQ ID NO: 758057 - RNA, 19 nt, Homo sapiens
gaaacuagcucuucaaagu

SEQ ID NO: 758058 - RNA, 19 nt, Homo sapiens
gaaauacgcuuuaccaagu

SEQ ID NO: 758059 - RNA, 19 nt, Homo sapiens
gcagacgacuuuauagaua

SEQ ID NO: 758060 - RNA, 19 nt, Homo sapiens
gaaaucaucuggcuacuuc

SEQ ID NO: 758061 - RNA, 19 nt, Homo sapiens
ggagaauguugauguguua

SEQ ID NO: 758062 - RNA, 19 nt, Homo sapiens
gcacuaauuucucuucaaa

SEQ ID NO: 758063 - RNA, 19 nt, Homo sapiens
guacagcccugcuauagaa

SEQ ID NO: 758064 - RNA, 19 nt, Homo sapiens
ccagauggcugcacuguuu

SEQ ID NO: 758065 - RNA, 19 nt, Homo sapiens
caucagaucucuccauauu

SEQ ID NO: 758066 - RNA, 19 nt, Homo sapiens
uaaagaagaugauggaaga

SEQ ID NO: 758067 - RNA, 19 nt, Homo sapiens
ggaaguauuugauuucaga

SEQ ID NO: 758068 - RNA, 19 nt, Homo sapiens
gaacuuagagcacauguga

SEQ ID NO: 758069 - RNA, 19 nt, Homo sapiens
ugaccaaccuugauaaauu

SEQ ID NO: 758070 - RNA, 19 nt, Homo sapiens
gagcacaugugaggaaaua

SEQ ID NO: 758071 - RNA, 19 nt, Homo sapiens
gaucugcacugaaggaauu

SEQ ID NO: 758072 - RNA, 19 nt, Homo sapiens
gcaaaaccauccuaucuua

SEQ ID NO: 758073 - RNA, 19 nt, Homo sapiens
gaaagcguuugugaacuua

SEQ ID NO: 758074 - RNA, 19 nt, Homo sapiens
guggagaaaugcccaguua

SEQ ID NO: 758075 - RNA, 19 nt, Homo sapiens
ggucguagcucuuucuuca

SEQ ID NO: 758076 - RNA, 19 nt, Homo sapiens
gaagagcgacaucauauug

SEQ ID NO: 758077 - RNA, 19 nt, Homo sapiens
guacccugcuguauaauaa

SEQ ID NO: 758078 - RNA, 19 nt, Homo sapiens
ucacugagauuauuccuau

SEQ ID NO: 758079 - RNA, 19 nt, Homo sapiens
guaaugugaugucucagua

SEQ ID NO: 758080 - RNA, 19 nt, Homo sapiens
ucaaugaacucgugcagaa

SEQ ID NO: 758081 - RNA, 19 nt, Homo sapiens
gcagauaacaugccaaaga

SEQ ID NO: 758082 - RNA, 19 nt, Homo sapiens
gaagagugcagacgacuuu

SEQ ID NO: 758083 - RNA, 19 nt, Homo sapiens
gaagaguucugaucuguac

SEQ ID NO: 758084 - RNA, 19 nt, Homo sapiens
agaggaauauucugacaua

SEQ ID NO: 758085 - RNA, 19 nt, Homo sapiens
gaacuuaccuacagaaaau

SEQ ID NO: 758086 - RNA, 19 nt, Homo sapiens
gaagaugauggaagaauuu

SEQ ID NO: 758087 - RNA, 19 nt, Homo sapiens
caacaacaaucaacagcuu

SEQ ID NO: 758088 - RNA, 19 nt, Homo sapiens
ggaguuacccucucaauca

SEQ ID NO: 758089 - RNA, 19 nt, Homo sapiens
ggaaagaugaugaauacaa

SEQ ID NO: 758090 - RNA, 19 nt, Homo sapiens
ucacaaagcugcagaagac

SEQ ID NO: 758091 - RNA, 19 nt, Homo sapiens
ggagaaaugcccaguuauu

SEQ ID NO: 758092 - RNA, 19 nt, Homo sapiens
gugaauugcugaauacuau

SEQ ID NO: 758093 - RNA, 19 nt, Homo sapiens
guaugaaguuucuaaguga

SEQ ID NO: 758094 - RNA, 19 nt, Homo sapiens
gguaugaaguuucuaagug

SEQ ID NO: 758095 - RNA, 19 nt, Homo sapiens
gaccaaccuugauaaauug

SEQ ID NO: 758096 - RNA, 19 nt, Homo sapiens
gaaauacggaccuguaaug

SEQ ID NO: 758097 - RNA, 19 nt, Homo sapiens
cagauaacaugccaaagaa

SEQ ID NO: 758098 - RNA, 19 nt, Homo sapiens
cggauuaccuugugagauu

SEQ ID NO: 758099 - RNA, 19 nt, Homo sapiens
gcaauggccauauagcaua

SEQ ID NO: 758100 - RNA, 19 nt, Homo sapiens
gcagauugauauuacaaga

SEQ ID NO: 758101 - RNA, 19 nt, Homo sapiens
gugaauaccucucuuugga

SEQ ID NO: 758102 - RNA, 19 nt, Homo sapiens
guauaaagccuagcgauaa

SEQ ID NO: 758103 - RNA, 19 nt, Homo sapiens
ggaugacuauguauaauca

SEQ ID NO: 758104 - RNA, 19 nt, Homo sapiens
gccagaugauuguggauua

SEQ ID NO: 758105 - RNA, 19 nt, Homo sapiens
caaacaagcucgaaaucuc

SEQ ID NO: 758106 - RNA, 19 nt, Homo sapiens
gugcauuucugugauguua

SEQ ID NO: 758107 - RNA, 19 nt, Homo sapiens
caaugaauguguaugaguu

SEQ ID NO: 758108 - RNA, 19 nt, Homo sapiens
gcaaugaaagcguuuguga

SEQ ID NO: 758109 - RNA, 19 nt, Homo sapiens
guaauauguuccuagauga

SEQ ID NO: 758110 - RNA, 19 nt, Homo sapiens
ggaaugagauuagauuggu

SEQ ID NO: 758111 - RNA, 19 nt, Homo sapiens
ggaccauguuugugaauug

SEQ ID NO: 758112 - RNA, 19 nt, Homo sapiens
acagaacaguguacccuua

SEQ ID NO: 758113 - RNA, 19 nt, Homo sapiens
gaacuuggaaagaugauga

SEQ ID NO: 758114 - RNA, 19 nt, Homo sapiens
cuacagcacugaaccuuug

SEQ ID NO: 758115 - RNA, 19 nt, Homo sapiens
uggauuaucuuuggcuuua

SEQ ID NO: 758116 - RNA, 19 nt, Homo sapiens
gcaccuaguacaaugcuua

SEQ ID NO: 758117 - RNA, 19 nt, Homo sapiens
aaacauuaguccagaagaa

SEQ ID NO: 758118 - RNA, 19 nt, Homo sapiens
guacuccagucaauagaaa

SEQ ID NO: 758119 - RNA, 19 nt, Homo sapiens
ugccaagucuucuuugaua

SEQ ID NO: 758120 - RNA, 19 nt, Homo sapiens
gcacaacuacagaaagaaa

SEQ ID NO: 758121 - RNA, 19 nt, Homo sapiens
ugaagaggaugacaauaau

SEQ ID NO: 758122 - RNA, 19 nt, Homo sapiens
ugaaagcguuugugaacuu

SEQ ID NO: 758123 - RNA, 19 nt, Homo sapiens
caacuaugcccaugaaaug

SEQ ID NO: 758124 - RNA, 19 nt, Homo sapiens
ccagauugcugcagcuuug

SEQ ID NO: 758125 - RNA, 19 nt, Homo sapiens
gaauguguaugaguuauca

SEQ ID NO: 758126 - RNA, 19 nt, Homo sapiens
uuagagaugucuuauccua

SEQ ID NO: 758127 - RNA, 19 nt, Homo sapiens
uaacaaguguaagagcaua

SEQ ID NO: 758128 - RNA, 19 nt, Homo sapiens
gcaguaccuuucuggcuuu

SEQ ID NO: 758129 - RNA, 19 nt, Homo sapiens
caaagcugcagaagacuua

SEQ ID NO: 758130 - RNA, 19 nt, Homo sapiens
caaaugguauauccucgaa

SEQ ID NO: 758131 - RNA, 19 nt, Homo sapiens
gaugauggaagaauuugua

SEQ ID NO: 758132 - RNA, 19 nt, Homo sapiens
ccaguaaugugaugucuca

SEQ ID NO: 758133 - RNA, 19 nt, Homo sapiens
gagaaaugcccaguuauug

SEQ ID NO: 758134 - RNA, 19 nt, Homo sapiens
guucugaucuguaccuaug

SEQ ID NO: 758135 - RNA, 19 nt, Homo sapiens
caguauacuugguugauuu

SEQ ID NO: 758136 - RNA, 19 nt, Homo sapiens
gaacugcuuaguauuagaa

SEQ ID NO: 758137 - RNA, 19 nt, Homo sapiens
gcauuucugugauguuaug

SEQ ID NO: 758138 - RNA, 19 nt, Homo sapiens
caacaaacacaacauuuag

SEQ ID NO: 758139 - RNA, 19 nt, Homo sapiens
ccuggaaucugcugugaaa

SEQ ID NO: 758140 - RNA, 19 nt, Homo sapiens
uguaauauguuccuagaug

SEQ ID NO: 758141 - RNA, 19 nt, Homo sapiens
guuaaagaacugcuuagua

SEQ ID NO: 758142 - RNA, 19 nt, Homo sapiens
cuacuaggcccauauggua

SEQ ID NO: 758143 - RNA, 19 nt, Homo sapiens
cauccuaucuuaucgacaa

SEQ ID NO: 758144 - RNA, 19 nt, Homo sapiens
acacugcacuuucugaguu

SEQ ID NO: 758145 - RNA, 19 nt, Homo sapiens
aaagcagacugguaagaaa

SEQ ID NO: 758146 - RNA, 19 nt, Homo sapiens
gauaacaugccaaagaaga

SEQ ID NO: 758147 - RNA, 19 nt, Homo sapiens
ugauuuagguugcacauuc

SEQ ID NO: 758148 - RNA, 19 nt, Homo sapiens
ugagauugauccugcauug

SEQ ID NO: 758149 - RNA, 19 nt, Homo sapiens
ccacuacuuugcacucauu

SEQ ID NO: 758150 - RNA, 19 nt, Homo sapiens
gaacucgugcagaaucuuu

SEQ ID NO: 758151 - RNA, 19 nt, Homo sapiens
gaggaaauacggaccugua

SEQ ID NO: 758152 - RNA, 19 nt, Homo sapiens
gcacugaaccuuuggaaac

SEQ ID NO: 758153 - RNA, 19 nt, Homo sapiens
gaauuuaaggaccauguuu

SEQ ID NO: 758154 - RNA, 19 nt, Homo sapiens
ucugaucauugguuucuua

SEQ ID NO: 758155 - RNA, 19 nt, Homo sapiens
ggacaaacauguaaaccua

SEQ ID NO: 758156 - RNA, 19 nt, Homo sapiens
ccaagaagcugauaauuga

SEQ ID NO: 758157 - RNA, 19 nt, Homo sapiens
gaacaaguccacuaaauuu

SEQ ID NO: 758158 - RNA, 19 nt, Homo sapiens
gaagagaaguuuaauaugg

SEQ ID NO: 758159 - RNA, 19 nt, Homo sapiens
gaacaaacacguuauaaga

SEQ ID NO: 758160 - RNA, 19 nt, Homo sapiens
gcaauaggcuuaaacaauc

SEQ ID NO: 758161 - RNA, 19 nt, Homo sapiens
gcaaaccagucauuuauau

SEQ ID NO: 758162 - RNA, 19 nt, Homo sapiens
gaacaaagcuagagaugac

SEQ ID NO: 758163 - RNA, 19 nt, Homo sapiens
caaaagagcucaaaucuga

SEQ ID NO: 758164 - RNA, 19 nt, Homo sapiens
gaaguucuauggaaaguga

SEQ ID NO: 758165 - RNA, 19 nt, Homo sapiens
gaaauccaaggcaauauua

SEQ ID NO: 758166 - RNA, 19 nt, Homo sapiens
gaccaacccuuuauacuug

SEQ ID NO: 758167 - RNA, 19 nt, Homo sapiens
ggaaacauauccacacugu

SEQ ID NO: 758168 - RNA, 19 nt, Homo sapiens
gcaacgaucuugugucugu

SEQ ID NO: 758169 - RNA, 19 nt, Homo sapiens
agaaagagaugcuuaugaa

SEQ ID NO: 758170 - RNA, 19 nt, Homo sapiens
ggaaaucaguaauaugaga

SEQ ID NO: 758171 - RNA, 19 nt, Homo sapiens
gaauguaaaccuucucaua

SEQ ID NO: 758172 - RNA, 19 nt, Homo sapiens
gagaauauauggucugcuu

SEQ ID NO: 758173 - RNA, 19 nt, Homo sapiens
gaugagcuauuaaagauug

SEQ ID NO: 758174 - RNA, 19 nt, Homo sapiens
gaggaaaucaguaauauga

SEQ ID NO: 758175 - RNA, 19 nt, Homo sapiens
gagcgaagccagugaagua

SEQ ID NO: 758176 - RNA, 19 nt, Homo sapiens
ugaaugcacuuaacaagaa

SEQ ID NO: 758177 - RNA, 19 nt, Homo sapiens
gaagaugagcuauuaaaga

SEQ ID NO: 758178 - RNA, 19 nt, Homo sapiens
cggcaaacguucauugaua

SEQ ID NO: 758179 - RNA, 19 nt, Homo sapiens
guacaucaaugaagcuauu

SEQ ID NO: 758180 - RNA, 19 nt, Homo sapiens
gcaaaccguuguaacacua

SEQ ID NO: 758181 - RNA, 19 nt, Homo sapiens
gaguuuaccuugcaaaguu

SEQ ID NO: 758182 - RNA, 19 nt, Homo sapiens
ggaacaacauagauaguga

SEQ ID NO: 758183 - RNA, 19 nt, Homo sapiens
ccaaaguacugaagaauuc

SEQ ID NO: 758184 - RNA, 19 nt, Homo sapiens
ggaugaagcugcauuacau

SEQ ID NO: 758185 - RNA, 19 nt, Homo sapiens
gauggaaguuugcuuaguu

SEQ ID NO: 758186 - RNA, 19 nt, Homo sapiens
ggagaucaauuaaacuaga

SEQ ID NO: 758187 - RNA, 19 nt, Homo sapiens
gauguaauuucacacagua

SEQ ID NO: 758188 - RNA, 19 nt, Homo sapiens
uaucauagcuacugaagau

SEQ ID NO: 758189 - RNA, 19 nt, Homo sapiens
ugagaaagguguccugcua

SEQ ID NO: 758190 - RNA, 19 nt, Homo sapiens
gaaguacacugcagcaaag

SEQ ID NO: 758191 - RNA, 19 nt, Homo sapiens
ggacaaggcauauguggaa

SEQ ID NO: 758192 - RNA, 19 nt, Homo sapiens
uaagagcgauggagucuau

SEQ ID NO: 758193 - RNA, 19 nt, Homo sapiens
gggaacacauugacagaaa

SEQ ID NO: 758194 - RNA, 19 nt, Homo sapiens
guacaugaauccagccauu

SEQ ID NO: 758195 - RNA, 19 nt, Homo sapiens
ggcaaacguucauugauaa

SEQ ID NO: 758196 - RNA, 19 nt, Homo sapiens
caacauagauagugagcau

SEQ ID NO: 758197 - RNA, 19 nt, Homo sapiens
gaugcaauaugaaggagua

SEQ ID NO: 758198 - RNA, 19 nt, Homo sapiens
ccagauggcuuugauauca

SEQ ID NO: 758199 - RNA, 19 nt, Homo sapiens
ggcagaacauugcuuauga

SEQ ID NO: 758200 - RNA, 19 nt, Homo sapiens
gcagaaauccaaggcaaua

SEQ ID NO: 758201 - RNA, 19 nt, Homo sapiens
ugaagugccuacagaaauu

SEQ ID NO: 758202 - RNA, 19 nt, Homo sapiens
aggaguagcuguaaugaaa

SEQ ID NO: 758203 - RNA, 19 nt, Homo sapiens
gcagaacauugcuuaugaa

SEQ ID NO: 758204 - RNA, 19 nt, Homo sapiens
ccacuugaauaacguaauu

SEQ ID NO: 758205 - RNA, 19 nt, Homo sapiens
cagaagaaaugaagcauag

SEQ ID NO: 758206 - RNA, 19 nt, Homo sapiens
ggugagccgugcaaugaua

SEQ ID NO: 758207 - RNA, 19 nt, Homo sapiens
aacagaagaugagcuauua

SEQ ID NO: 758208 - RNA, 19 nt, Homo sapiens
ggagugugcugacaaauac

SEQ ID NO: 758209 - RNA, 19 nt, Homo sapiens
gcacuacugccucauguaa

SEQ ID NO: 758210 - RNA, 19 nt, Homo sapiens
ucauauaccugcugaacaa

SEQ ID NO: 758211 - RNA, 19 nt, Homo sapiens
aaucauggcucacaggaaa

SEQ ID NO: 758212 - RNA, 19 nt, Homo sapiens
caaaugcgguuuuaacuuu

SEQ ID NO: 758213 - RNA, 19 nt, Homo sapiens
gaaauuucuuggauucugu

SEQ ID NO: 758214 - RNA, 19 nt, Homo sapiens
caaagaaucuaucguaagc

SEQ ID NO: 758215 - RNA, 19 nt, Homo sapiens
gauaaauucugaccaaagg

SEQ ID NO: 758216 - RNA, 19 nt, Homo sapiens
gaaucaugcuucuauaaag

SEQ ID NO: 758217 - RNA, 19 nt, Homo sapiens
aggcauauguggaacguua

SEQ ID NO: 758218 - RNA, 19 nt, Homo sapiens
ugauauagguacucugauu

SEQ ID NO: 758219 - RNA, 19 nt, Homo sapiens
ccaaggauauucgaaauca

SEQ ID NO: 758220 - RNA, 19 nt, Homo sapiens
caaguugccuuaugaugug

SEQ ID NO: 758221 - RNA, 19 nt, Homo sapiens
aaacugcucuggaggaaga

SEQ ID NO: 758222 - RNA, 19 nt, Homo sapiens
gaaauguugucugcuguug

SEQ ID NO: 758223 - RNA, 19 nt, Homo sapiens
gaagaagggcuccggaaug

SEQ ID NO: 758224 - RNA, 19 nt, Homo sapiens
gaauaucugugccacuuag

SEQ ID NO: 758225 - RNA, 19 nt, Homo sapiens
acaaaguccugaauucuau

SEQ ID NO: 758226 - RNA, 19 nt, Homo sapiens
cagaacaaguccacuaaau

SEQ ID NO: 758227 - RNA, 19 nt, Homo sapiens
gaggaggaaaucaguaaua

SEQ ID NO: 758228 - RNA, 19 nt, Homo sapiens
aaagaucuaugauguggaa

SEQ ID NO: 758229 - RNA, 19 nt, Homo sapiens
gaaguuugcuuaguugaag

SEQ ID NO: 758230 - RNA, 19 nt, Homo sapiens
gccgaagccucaugauaaa

SEQ ID NO: 758231 - RNA, 19 nt, Homo sapiens
uaacaaggcaaauacacua

SEQ ID NO: 758232 - RNA, 19 nt, Homo sapiens
gacaaaguccugaauucua

SEQ ID NO: 758233 - RNA, 19 nt, Homo sapiens
guucauggcucaaacucaa

SEQ ID NO: 758234 - RNA, 19 nt, Homo sapiens
ggaggagaguucacuuuua

SEQ ID NO: 758235 - RNA, 19 nt, Homo sapiens
acacagaccuggugacagu

SEQ ID NO: 758236 - RNA, 19 nt, Homo sapiens
caacagaagaugagcuauu

SEQ ID NO: 758237 - RNA, 19 nt, Homo sapiens
agaauucgauccaugagaa

SEQ ID NO: 758238 - RNA, 19 nt, Homo sapiens
agaacaagcucuaacauac

SEQ ID NO: 758239 - RNA, 19 nt, Homo sapiens
ggaagaguuugaagcuaga

SEQ ID NO: 758240 - RNA, 19 nt, Homo sapiens
gaauggaguuuaccuugca

SEQ ID NO: 758241 - RNA, 19 nt, Homo sapiens
caaagaagcauguaauguc

SEQ ID NO: 758242 - RNA, 19 nt, Homo sapiens
cagaacaagcucuaacaua

SEQ ID NO: 758243 - RNA, 19 nt, Homo sapiens
gaauaacaccgacaaccaa

SEQ ID NO: 758244 - RNA, 19 nt, Homo sapiens
ggagaaauggaaauacuga

SEQ ID NO: 758245 - RNA, 19 nt, Homo sapiens
gcaguuauagccauuaaug

SEQ ID NO: 758246 - RNA, 19 nt, Homo sapiens
gacauccugugaucuguuu

SEQ ID NO: 758247 - RNA, 19 nt, Homo sapiens
aaagugaagugccuacaga

SEQ ID NO: 758248 - RNA, 19 nt, Homo sapiens
uaacaagaaggcagcauuu

SEQ ID NO: 758249 - RNA, 19 nt, Homo sapiens
uaacauacccagaagugaa

SEQ ID NO: 758250 - RNA, 19 nt, Homo sapiens
gaggagaaauggaaauacu

SEQ ID NO: 758251 - RNA, 19 nt, Homo sapiens
aagagaugcuuaugaagaa

SEQ ID NO: 758252 - RNA, 19 nt, Homo sapiens
gaaaugaagcauagccaau

SEQ ID NO: 758253 - RNA, 19 nt, Homo sapiens
ccacuaaauuuauggauac

SEQ ID NO: 758254 - RNA, 19 nt, Homo sapiens
gaagaaguagugaccaaga

SEQ ID NO: 758255 - RNA, 19 nt, Homo sapiens
gauaugagcucaaccuuca

SEQ ID NO: 758256 - RNA, 19 nt, Homo sapiens
ugacggaaauuaugcguaa

SEQ ID NO: 758257 - RNA, 19 nt, Homo sapiens
gaaauuaugcguaacaacu

SEQ ID NO: 758258 - RNA, 19 nt, Homo sapiens
caacaagacuacacagaac

SEQ ID NO: 758259 - RNA, 19 nt, Homo sapiens
cgaacgaggugacggaaau

SEQ ID NO: 758260 - RNA, 19 nt, Homo sapiens
gcacagacuugcccuugag

SEQ ID NO: 758261 - RNA, 19 nt, Homo sapiens
gcugggagaacauccguua

SEQ ID NO: 758262 - RNA, 19 nt, Homo sapiens
gaccaacuccuggauauga

SEQ ID NO: 758263 - RNA, 19 nt, Homo sapiens
cagaccaacuccuggauau

SEQ ID NO: 758264 - RNA, 19 nt, Homo sapiens
ucaacaagacuacacagaa

SEQ ID NO: 758265 - RNA, 19 nt, Homo sapiens
gagcucaaccuucaacaag

SEQ ID NO: 758266 - RNA, 19 nt, Homo sapiens
gcagcagcguucagaccaa

SEQ ID NO: 758267 - RNA, 19 nt, Homo sapiens
gaacgaggugacggaaauu

SEQ ID NO: 758268 - RNA, 19 nt, Homo sapiens
gcucaaccuucaacaagac

SEQ ID NO: 758269 - RNA, 19 nt, Homo sapiens
uggcugcacuggccgauuc

SEQ ID NO: 758270 - RNA, 19 nt, Homo sapiens
ucagaccaacuccuggaua

SEQ ID NO: 758271 - RNA, 19 nt, Homo sapiens
cgaggugacggaaauuaug

SEQ ID NO: 758272 - RNA, 19 nt, Homo sapiens
gauggcaggaauagaguug

SEQ ID NO: 758273 - RNA, 19 nt, Homo sapiens
ggccgauucuggucuccaa

SEQ ID NO: 758274 - RNA, 19 nt, Homo sapiens
cacgagcgauggcaggaau

SEQ ID NO: 758275 - RNA, 19 nt, Homo sapiens
gugugaagcuggccgaacu

SEQ ID NO: 758276 - RNA, 19 nt, Homo sapiens
agagaagccgggagcguuu

SEQ ID NO: 758277 - RNA, 19 nt, Homo sapiens
aagaagugcugggagaaca

SEQ ID NO: 758278 - RNA, 19 nt, Homo sapiens
guaacaacuucggcaaggu

SEQ ID NO: 758279 - RNA, 19 nt, Homo sapiens
gaagaagugcugggagaac

SEQ ID NO: 758280 - RNA, 19 nt, Homo sapiens
cggaaauuaugcguaacaa

SEQ ID NO: 758281 - RNA, 19 nt, Homo sapiens
cgauucuggucuccaagga

SEQ ID NO: 758282 - RNA, 19 nt, Homo sapiens
uggcaggaauagaguugga

SEQ ID NO: 758283 - RNA, 19 nt, Homo sapiens
guugguguccugcucauca

SEQ ID NO: 758284 - RNA, 19 nt, Homo sapiens
aauuaugcguaacaacuuc

SEQ ID NO: 758285 - RNA, 19 nt, Homo sapiens
gcacgagcgauggcaggaa

SEQ ID NO: 758286 - RNA, 19 nt, Homo sapiens
ugcacagacuugcccuuga

SEQ ID NO: 758287 - RNA, 19 nt, Homo sapiens
gaagugcugggagaacauc

SEQ ID NO: 758288 - RNA, 19 nt, Homo sapiens
ggaaauuaugcguaacaac

SEQ ID NO: 758289 - RNA, 19 nt, Homo sapiens
gggaaagacuucaguagua

SEQ ID NO: 758290 - RNA, 19 nt, Homo sapiens
gcagaagagucgcagaaua

SEQ ID NO: 758291 - RNA, 19 nt, Homo sapiens
caacuuaugugccaacaaa

SEQ ID NO: 758292 - RNA, 19 nt, Homo sapiens
ggaaaggcauccacagaaa

SEQ ID NO: 758293 - RNA, 19 nt, Homo sapiens
gaaauuacgccuucuugua

SEQ ID NO: 758294 - RNA, 19 nt, Homo sapiens
gagaaacccuauaguugua

SEQ ID NO: 758295 - RNA, 19 nt, Homo sapiens
ggaaagacuucaguaguaa

SEQ ID NO: 758296 - RNA, 19 nt, Homo sapiens
gguaaaggauucaguuuga

SEQ ID NO: 758297 - RNA, 19 nt, Homo sapiens
ggaaaucacuacucauugu

SEQ ID NO: 758298 - RNA, 19 nt, Homo sapiens
ggaaaacuaugucuucuua

SEQ ID NO: 758299 - RNA, 19 nt, Homo sapiens
ggaaucaucuugucaucuu

SEQ ID NO: 758300 - RNA, 19 nt, Homo sapiens
gagagaaacuacaugaaug

SEQ ID NO: 758301 - RNA, 19 nt, Homo sapiens
cgaaacaguucaugggaua

SEQ ID NO: 758302 - RNA, 19 nt, Homo sapiens
gagagaagccuuaugaaug

SEQ ID NO: 758303 - RNA, 19 nt, Homo sapiens
acacaggaaugaaaccuua

SEQ ID NO: 758304 - RNA, 19 nt, Homo sapiens
ggaaagccuucauuuggaa

SEQ ID NO: 758305 - RNA, 19 nt, Homo sapiens
ggaaugaaaccuuauguau

SEQ ID NO: 758306 - RNA, 19 nt, Homo sapiens
gcaguacccuggacucuau

SEQ ID NO: 758307 - RNA, 19 nt, Homo sapiens
gcuaaugaauggcagaauu

SEQ ID NO: 758308 - RNA, 19 nt, Homo sapiens
gagagaaacccuauaguug

SEQ ID NO: 758309 - RNA, 19 nt, Homo sapiens
gggaaagucuucaguagga

SEQ ID NO: 758310 - RNA, 19 nt, Homo sapiens
gagggaaaguguaaaucua

SEQ ID NO: 758311 - RNA, 19 nt, Homo sapiens
ucagagaacucauguagau

SEQ ID NO: 758312 - RNA, 19 nt, Homo sapiens
gcacaucagagaacacaua

SEQ ID NO: 758313 - RNA, 19 nt, Homo sapiens
ggagagaaacccuauaguu

SEQ ID NO: 758314 - RNA, 19 nt, Homo sapiens
ggaugcagcuguugugaga

SEQ ID NO: 758315 - RNA, 19 nt, Homo sapiens
ggacagaaaccauaugugu

SEQ ID NO: 758316 - RNA, 19 nt, Homo sapiens
gguuuaaagucacagcuua

SEQ ID NO: 758317 - RNA, 19 nt, Homo sapiens
gggaaagccuucaguuuua

SEQ ID NO: 758318 - RNA, 19 nt, Homo sapiens
gaaaucacagcucauugua

SEQ ID NO: 758319 - RNA, 19 nt, Homo sapiens
gaaaccauaugaaugcaau

SEQ ID NO: 758320 - RNA, 19 nt, Homo sapiens
gagaagagcuguguauggu

SEQ ID NO: 758321 - RNA, 19 nt, Homo sapiens
gggaaagccuucauuugga

SEQ ID NO: 758322 - RNA, 19 nt, Homo sapiens
guacaucagagaauucaua

SEQ ID NO: 758323 - RNA, 19 nt, Homo sapiens
gagagaaauuauugagcua

SEQ ID NO: 758324 - RNA, 19 nt, Homo sapiens
caagagagaaaccauauga

SEQ ID NO: 758325 - RNA, 19 nt, Homo sapiens
ggucaacccuuauaaaugc

SEQ ID NO: 758326 - RNA, 19 nt, Homo sapiens
gaaugaaaccuuauguaug

SEQ ID NO: 758327 - RNA, 19 nt, Homo sapiens
caacacaccaaaccugaua

SEQ ID NO: 758328 - RNA, 19 nt, Homo sapiens
ggaaaagccuucauuagga

SEQ ID NO: 758329 - RNA, 19 nt, Homo sapiens
ggagagaaaccauaugaau

SEQ ID NO: 758330 - RNA, 19 nt, Homo sapiens
ggagagaaacuacaugaau

SEQ ID NO: 758331 - RNA, 19 nt, Homo sapiens
uagaguggcuguuuauuuc

SEQ ID NO: 758332 - RNA, 19 nt, Homo sapiens
gagcaagucauaccuuauu

SEQ ID NO: 758333 - RNA, 19 nt, Homo sapiens
guacaucagagaacucaua

SEQ ID NO: 758334 - RNA, 19 nt, Homo sapiens
gagcaagucauaccuuauu

SEQ ID NO: 758335 - RNA, 19 nt, Homo sapiens
aaucagaccuguccaaaca

SEQ ID NO: 758336 - RNA, 19 nt, Homo sapiens
ggagugaacaucuuaugaa

SEQ ID NO: 758337 - RNA, 19 nt, Homo sapiens
gggaaaaccuucucucaaa

SEQ ID NO: 758338 - RNA, 19 nt, Homo sapiens
gaaaucacuacucauugua

SEQ ID NO: 758339 - RNA, 19 nt, Homo sapiens
ggagagaagccuuaugaau

SEQ ID NO: 758340 - RNA, 19 nt, Homo sapiens
aaucacagcucauuauaca

SEQ ID NO: 758341 - RNA, 19 nt, Homo sapiens
aaucacagcucauuauaca

SEQ ID NO: 758342 - RNA, 19 nt, Homo sapiens
caccaaaccugauaucauc

SEQ ID NO: 758343 - RNA, 19 nt, Homo sapiens
ggagugugauguuggagaa

SEQ ID NO: 758344 - RNA, 19 nt, Homo sapiens
guacaggagugugauguug

SEQ ID NO: 758345 - RNA, 19 nt, Homo sapiens
ggaagucacagcucauuau

SEQ ID NO: 758346 - RNA, 19 nt, Homo sapiens
gagagaaaccauaugaaug

SEQ ID NO: 758347 - RNA, 19 nt, Homo sapiens
guaaagcccuaugggugua

SEQ ID NO: 758348 - RNA, 19 nt, Homo sapiens
gagagaaaccauaugaaug

SEQ ID NO: 758349 - RNA, 19 nt, Homo sapiens
gauccuuguuccucagaua

SEQ ID NO: 758350 - RNA, 19 nt, Homo sapiens
gagugaacaucuuaugaau

SEQ ID NO: 758351 - RNA, 19 nt, Homo sapiens
ccagaugaauauagaauag

SEQ ID NO: 758352 - RNA, 19 nt, Homo sapiens
guuaaacguuguaaaguca

SEQ ID NO: 758353 - RNA, 19 nt, Homo sapiens
cacaagagauagaaacaau

SEQ ID NO: 758354 - RNA, 19 nt, Homo sapiens
gagagaagccuuguaagug

SEQ ID NO: 758355 - RNA, 19 nt, Homo sapiens
ggagagaagccuuguaagu

SEQ ID NO: 758356 - RNA, 19 nt, Homo sapiens
ugaaccagaugaauauaga

SEQ ID NO: 758357 - RNA, 19 nt, Homo sapiens
gaaaaucauucuuccauuc

SEQ ID NO: 758358 - RNA, 19 nt, Homo sapiens
uugaugaucuuauggauug

SEQ ID NO: 758359 - RNA, 19 nt, Homo sapiens
aaucauaccucauuguaca

SEQ ID NO: 758360 - RNA, 19 nt, Homo sapiens
guacaucaaagaacucauu

SEQ ID NO: 758361 - RNA, 19 nt, Homo sapiens
gaaaagccuucauuaggaa

SEQ ID NO: 758362 - RNA, 19 nt, Homo sapiens
cagcaagucauaccuaauu

SEQ ID NO: 758363 - RNA, 19 nt, Homo sapiens
cuacaugaaugcagugaau

SEQ ID NO: 758364 - RNA, 19 nt, Homo sapiens
ggucccaccucuccaagaa

SEQ ID NO: 758365 - RNA, 19 nt, Homo sapiens
guacaucagagaacccaua

SEQ ID NO: 758366 - RNA, 19 nt, Homo sapiens
ugggaaagcuuuugguuua

SEQ ID NO: 758367 - RNA, 19 nt, Homo sapiens
gaaacuucaugaaccagau

SEQ ID NO: 758368 - RNA, 19 nt, Homo sapiens
ggaaaaccuucucucaaaa

SEQ ID NO: 758369 - RNA, 19 nt, Homo sapiens
uaggaauucucaacucauu

SEQ ID NO: 758370 - RNA, 19 nt, Homo sapiens
caaaucacagcucauugua

SEQ ID NO: 758371 - RNA, 19 nt, Homo sapiens
agucacagcuuauuauaca

SEQ ID NO: 758372 - RNA, 19 nt, Homo sapiens
aaugaaaccuuauguaugc

SEQ ID NO: 758373 - RNA, 19 nt, Homo sapiens
gaaaccauauguguguaau

SEQ ID NO: 758374 - RNA, 19 nt, Homo sapiens
gaaaguauugaaucuggaa

SEQ ID NO: 758375 - RNA, 19 nt, Homo sapiens
gcuaugagggaaaguguaa

SEQ ID NO: 758376 - RNA, 19 nt, Homo sapiens
ggagagaaaccacaugagu

SEQ ID NO: 758377 - RNA, 19 nt, Homo sapiens
aaucacagcucauuguaca

SEQ ID NO: 758378 - RNA, 19 nt, Homo sapiens
gcaauuccugugcgacaua

SEQ ID NO: 758379 - RNA, 19 nt, Homo sapiens
aaucacagcucauuguaca

SEQ ID NO: 758380 - RNA, 19 nt, Homo sapiens
ugagcaaacuguuauugga

SEQ ID NO: 758381 - RNA, 19 nt, Homo sapiens
gggaaaguguaaaucuaga

SEQ ID NO: 758382 - RNA, 19 nt, Homo sapiens
caagagauagaaacaauca

SEQ ID NO: 758383 - RNA, 19 nt, Homo sapiens
caggagagaagccuuguaa

SEQ ID NO: 758384 - RNA, 19 nt, Homo sapiens
ccacaugagugcagggaau

SEQ ID NO: 758385 - RNA, 19 nt, Homo sapiens
caggagagaagccuuauga

SEQ ID NO: 758386 - RNA, 19 nt, Homo sapiens
ccauaugaaugcaaugaau

SEQ ID NO: 758387 - RNA, 19 nt, Homo sapiens
ccauauguguguaaugaau

SEQ ID NO: 758388 - RNA, 19 nt, Homo sapiens
gaggaaacuucaugaacca

SEQ ID NO: 758389 - RNA, 19 nt, Homo sapiens
gagaagugcugaagucuaa

SEQ ID NO: 758390 - RNA, 19 nt, Homo sapiens
aaacaaacuuggcuugaua

SEQ ID NO: 758391 - RNA, 19 nt, Homo sapiens
gaacugaauuggcuaggaa

SEQ ID NO: 758392 - RNA, 19 nt, Homo sapiens
guugauggcuuucauguaa

SEQ ID NO: 758393 - RNA, 19 nt, Homo sapiens
ggaaggagcagcagucauu

SEQ ID NO: 758394 - RNA, 19 nt, Homo sapiens
ccaaagagcaguugaagaa

SEQ ID NO: 758395 - RNA, 19 nt, Homo sapiens
gggaaaauguuuaggauua

SEQ ID NO: 758396 - RNA, 19 nt, Homo sapiens
aaacacaucugucugguau

SEQ ID NO: 758397 - RNA, 19 nt, Homo sapiens
gcacauaccucugcaguac

SEQ ID NO: 758398 - RNA, 19 nt, Homo sapiens
ggaucaguauuccauguua

SEQ ID NO: 758399 - RNA, 19 nt, Homo sapiens
gcaaugcuaaugaagaaua

SEQ ID NO: 758400 - RNA, 19 nt, Homo sapiens
gaauguguuuggaucagua

SEQ ID NO: 758401 - RNA, 19 nt, Homo sapiens
cagcagauaugaucaagga

SEQ ID NO: 758402 - RNA, 19 nt, Homo sapiens
auacauguguguugucaua

SEQ ID NO: 758403 - RNA, 19 nt, Homo sapiens
gagcagcagucauugaugu

SEQ ID NO: 758404 - RNA, 19 nt, Homo sapiens
caaagcaggccaauagaaa

SEQ ID NO: 758405 - RNA, 19 nt, Homo sapiens
gaggauggaugcuucacuu

SEQ ID NO: 758406 - RNA, 19 nt, Homo sapiens
caauaacaguugauacuca

SEQ ID NO: 758407 - RNA, 19 nt, Homo sapiens
gcaccucaguuacacauuc

SEQ ID NO: 758408 - RNA, 19 nt, Homo sapiens
gccauuaaccuagugauua

SEQ ID NO: 758409 - RNA, 19 nt, Homo sapiens
gaaauaaucaagcgaacug

SEQ ID NO: 758410 - RNA, 19 nt, Homo sapiens
gauggaugcuucacuuugu

SEQ ID NO: 758411 - RNA, 19 nt, Homo sapiens
uaacuacugugucuucugu

SEQ ID NO: 758412 - RNA, 19 nt, Homo sapiens
gguagccacuaauuaacua

SEQ ID NO: 758413 - RNA, 19 nt, Homo sapiens
gaguuugaguuacuauuga

SEQ ID NO: 758414 - RNA, 19 nt, Homo sapiens
gcaaagcaggccaauagaa

SEQ ID NO: 758415 - RNA, 19 nt, Homo sapiens
ggauuauuccuugcuauua

SEQ ID NO: 758416 - RNA, 19 nt, Homo sapiens
guagauggccuccuuguuc

SEQ ID NO: 758417 - RNA, 19 nt, Homo sapiens
gcagguauuccaaaucuga

SEQ ID NO: 758418 - RNA, 19 nt, Homo sapiens
gauuauuccuugcuauuag

SEQ ID NO: 758419 - RNA, 19 nt, Homo sapiens
ugaugccacuguuacaaua

SEQ ID NO: 758420 - RNA, 19 nt, Homo sapiens
cauguguguugucauauuu

SEQ ID NO: 758421 - RNA, 19 nt, Homo sapiens
caaggauguugauggcuuu

SEQ ID NO: 758422 - RNA, 19 nt, Homo sapiens
uaauguagauggccuccuu

SEQ ID NO: 758423 - RNA, 19 nt, Homo sapiens
gguaguaauugagcagaaa

SEQ ID NO: 758424 - RNA, 19 nt, Homo sapiens
ggaaaaguguugcuagaga

SEQ ID NO: 758425 - RNA, 19 nt, Homo sapiens
cuaauuaacuacugugucu

SEQ ID NO: 758426 - RNA, 19 nt, Homo sapiens
uauguauccuguugacuuu

SEQ ID NO: 758427 - RNA, 19 nt, Homo sapiens
gaaaaguguugcuagagaa

SEQ ID NO: 758428 - RNA, 19 nt, Homo sapiens
gagcagccauuaaccuagu

SEQ ID NO: 758429 - RNA, 19 nt, Homo sapiens
gagagaaggaucugcaaug

SEQ ID NO: 758430 - RNA, 19 nt, Homo sapiens
gaucugcaaugcuguuucu

SEQ ID NO: 758431 - RNA, 19 nt, Homo sapiens
gcgagaauccugcaaguca

SEQ ID NO: 758432 - RNA, 19 nt, Homo sapiens
ccagggagcauuccaguau

SEQ ID NO: 758433 - RNA, 19 nt, Homo sapiens
gcugaagucuaaagagcuu

SEQ ID NO: 758434 - RNA, 19 nt, Homo sapiens
uggcaaugcuaaugaagaa

SEQ ID NO: 758435 - RNA, 19 nt, Homo sapiens
caaguugguuggagaugug

SEQ ID NO: 758436 - RNA, 19 nt, Homo sapiens
caauguuacugcacacaga

SEQ ID NO: 758437 - RNA, 19 nt, Homo sapiens
ggaggugaugccacuguua

SEQ ID NO: 758438 - RNA, 19 nt, Homo sapiens
aagcaaagcaggccaauag

SEQ ID NO: 758439 - RNA, 19 nt, Homo sapiens
gaagcaaagcaggccaaua

SEQ ID NO: 758440 - RNA, 19 nt, Homo sapiens
ugauguauguauccuguug

SEQ ID NO: 758441 - RNA, 19 nt, Homo sapiens
ggauugcauuucccaagug

SEQ ID NO: 758442 - RNA, 19 nt, Homo sapiens
ggauggaugcuucacuuug

SEQ ID NO: 758443 - RNA, 19 nt, Homo sapiens
gauccugguuggcgagaau

SEQ ID NO: 758444 - RNA, 19 nt, Homo sapiens
guauguauccuguugacuu

SEQ ID NO: 758445 - RNA, 19 nt, Homo sapiens
ugggagacauuaccauaug

SEQ ID NO: 758446 - RNA, 19 nt, Homo sapiens
ugauggcuuucauguaauu

SEQ ID NO: 758447 - RNA, 19 nt, Homo sapiens
ucauugaugugggaauaaa

SEQ ID NO: 758448 - RNA, 19 nt, Homo sapiens
gagcaguugaagaaacaua

SEQ ID NO: 758449 - RNA, 19 nt, Homo sapiens
caagcgaacuggcauucca

SEQ ID NO: 758450 - RNA, 19 nt, Homo sapiens
uagauggccuccuuguuca

SEQ ID NO: 758451 - RNA, 19 nt, Homo sapiens
aaucaacagugagacaauu

SEQ ID NO: 758452 - RNA, 19 nt, Homo sapiens
cagggcagcugcaguugug

SEQ ID NO: 758453 - RNA, 19 nt, Homo sapiens
guuacaauaucucaucgau

SEQ ID NO: 758454 - RNA, 19 nt, Homo sapiens
acaucugucugguauggua

SEQ ID NO: 758455 - RNA, 19 nt, Homo sapiens
caacugaucaaaccaaagg

SEQ ID NO: 758456 - RNA, 19 nt, Homo sapiens
aaagagcaguugaagaaac

SEQ ID NO: 758457 - RNA, 19 nt, Homo sapiens
gaacgucccggaggugaug

SEQ ID NO: 758458 - RNA, 19 nt, Homo sapiens
acauguguguugucauauu

SEQ ID NO: 758459 - RNA, 19 nt, Homo sapiens
agucauugaugugggaaua

SEQ ID NO: 758460 - RNA, 19 nt, Homo sapiens
gcugcgacuucucuaaugu

SEQ ID NO: 758461 - RNA, 19 nt, Homo sapiens
uuaaauggguggguguuuc

SEQ ID NO: 758462 - RNA, 19 nt, Homo sapiens
aagagcaguugaagaaaca

SEQ ID NO: 758463 - RNA, 19 nt, Homo sapiens
gaucaguauuccauguuac

SEQ ID NO: 758464 - RNA, 19 nt, Homo sapiens
caacagugagacaauuaug

SEQ ID NO: 758465 - RNA, 19 nt, Homo sapiens
ggaaucaacagugagacaa

SEQ ID NO: 758466 - RNA, 19 nt, Homo sapiens
gccaauagaaaugcaauau

SEQ ID NO: 758467 - RNA, 19 nt, Homo sapiens
ggguauaucacuccaguuc

SEQ ID NO: 758468 - RNA, 19 nt, Homo sapiens
gggaauaaauagaguucac

SEQ ID NO: 758469 - RNA, 19 nt, Homo sapiens
caaagagcaguugaagaaa

SEQ ID NO: 758470 - RNA, 19 nt, Homo sapiens
gaaucaacagugagacaau

SEQ ID NO: 758471 - RNA, 19 nt, Homo sapiens
caacuuacuuuuccaccaa

SEQ ID NO: 758472 - RNA, 19 nt, Homo sapiens
ggauguugauggcuuucau

SEQ ID NO: 758473 - RNA, 19 nt, Homo sapiens
acacaucugucugguaugg

SEQ ID NO: 758474 - RNA, 19 nt, Homo sapiens
caggccagcucaagaagca

SEQ ID NO: 758475 - RNA, 19 nt, Homo sapiens
cgagaagugcugaagucua

SEQ ID NO: 758476 - RNA, 19 nt, Homo sapiens
gaaggagcagcagucauug

SEQ ID NO: 758477 - RNA, 19 nt, Homo sapiens
uuccagagcauauugauga

SEQ ID NO: 758478 - RNA, 19 nt, Homo sapiens
acagugagacaauuaugaa

SEQ ID NO: 758479 - RNA, 19 nt, Homo sapiens
uaauguaggacgaaugugu

SEQ ID NO: 758480 - RNA, 19 nt, Homo sapiens
cagcugcaguugugggaau

SEQ ID NO: 758481 - RNA, 19 nt, Homo sapiens
gcuguugucauuucuggaa

SEQ ID NO: 758482 - RNA, 19 nt, Homo sapiens
ugauuggcaaccagauuua

SEQ ID NO: 758483 - RNA, 19 nt, Homo sapiens
gcaauaacaguugauacuc

SEQ ID NO: 758484 - RNA, 19 nt, Homo sapiens
ggaagugcggcaggaggua

SEQ ID NO: 758485 - RNA, 19 nt, Homo sapiens
gaagugcugaagucuaaag

SEQ ID NO: 758486 - RNA, 19 nt, Homo sapiens
cugcagguauuccaaaucu

SEQ ID NO: 758487 - RNA, 19 nt, Homo sapiens
cauuauacauguguguugu

SEQ ID NO: 758488 - RNA, 19 nt, Homo sapiens
uuauguauguuacccuuca

SEQ ID NO: 758489 - RNA, 19 nt, Homo sapiens
ggacucuccucuuuauuua

SEQ ID NO: 758490 - RNA, 19 nt, Homo sapiens
gaucaaagguagauucuuc

SEQ ID NO: 758491 - RNA, 19 nt, Homo sapiens
aaagguagauucuucauga

SEQ ID NO: 758492 - RNA, 19 nt, Homo sapiens
ccaagggacucuccucuuu

SEQ ID NO: 758493 - RNA, 19 nt, Homo sapiens
caacaugaguucccugguu

SEQ ID NO: 758494 - RNA, 19 nt, Homo sapiens
gcacugacacaacaauuaa

SEQ ID NO: 758495 - RNA, 19 nt, Homo sapiens
ggaugcagcugagaaaguu

SEQ ID NO: 758496 - RNA, 19 nt, Homo sapiens
ucacacauccuuugccuuu

SEQ ID NO: 758497 - RNA, 19 nt, Homo sapiens
gggacucuccucuuuauuu

SEQ ID NO: 758498 - RNA, 19 nt, Homo sapiens
gcccugaacugcagauugu

SEQ ID NO: 758499 - RNA, 19 nt, Homo sapiens
caagggacucuccucuuua

SEQ ID NO: 758500 - RNA, 19 nt, Homo sapiens
ugacuucagugacgaucua

SEQ ID NO: 758501 - RNA, 19 nt, Homo sapiens
acacauccuuugccuuuau

SEQ ID NO: 758502 - RNA, 19 nt, Homo sapiens
gguugauugucuugucaua

SEQ ID NO: 758503 - RNA, 19 nt, Homo sapiens
ggugugcccugcaguuuua

SEQ ID NO: 758504 - RNA, 19 nt, Homo sapiens
caucaucaucuccuacuuu

SEQ ID NO: 758505 - RNA, 19 nt, Homo sapiens
aaacuauccugcacugaca

SEQ ID NO: 758506 - RNA, 19 nt, Homo sapiens
uuguagaccuuugcuauuu

SEQ ID NO: 758507 - RNA, 19 nt, Homo sapiens
ucuguaacccuuuauugua

SEQ ID NO: 758508 - RNA, 19 nt, Homo sapiens
cgccaucuguaacccuuua

SEQ ID NO: 758509 - RNA, 19 nt, Homo sapiens
uuucugacauuguaugcua

SEQ ID NO: 758510 - RNA, 19 nt, Homo sapiens
uaaaggaugcagcugagaa

SEQ ID NO: 758511 - RNA, 19 nt, Homo sapiens
guuggucacugaguuuauu

SEQ ID NO: 758512 - RNA, 19 nt, Homo sapiens
gauagggaacauuggauug

SEQ ID NO: 758513 - RNA, 19 nt, Homo sapiens
aagggacucuccucuuuau

SEQ ID NO: 758514 - RNA, 19 nt, Homo sapiens
acacguuggucacugaguu

SEQ ID NO: 758515 - RNA, 19 nt, Homo sapiens
gcagauacagaauccuuca

SEQ ID NO: 758516 - RNA, 19 nt, Homo sapiens
uaagaucaaagguagauuc

SEQ ID NO: 758517 - RNA, 19 nt, Homo sapiens
gcuaugucgccaucuguaa

SEQ ID NO: 758518 - RNA, 19 nt, Homo sapiens
caaccuaucauuuguagac

SEQ ID NO: 758519 - RNA, 19 nt, Homo sapiens
uuagcaaccuaucauuugu

SEQ ID NO: 758520 - RNA, 19 nt, Homo sapiens
gcagcucaguggaaaucau

SEQ ID NO: 758521 - RNA, 19 nt, Homo sapiens
gcgguugauugucuuguca

SEQ ID NO: 758522 - RNA, 19 nt, Homo sapiens
ggaauuuacagauagaaac

SEQ ID NO: 758523 - RNA, 19 nt, Homo sapiens
gucacugaguuuauucuau

SEQ ID NO: 758524 - RNA, 19 nt, Homo sapiens
caucuguaacccuuuauug

SEQ ID NO: 758525 - RNA, 19 nt, Homo sapiens
guagaccuuugcuauuucu

SEQ ID NO: 758526 - RNA, 19 nt, Homo sapiens
uaucauuuguagaccuuug

SEQ ID NO: 758527 - RNA, 19 nt, Homo sapiens
aaaggaugcagcugagaaa

SEQ ID NO: 758528 - RNA, 19 nt, Homo sapiens
cggcccagcuaccuguauu

SEQ ID NO: 758529 - RNA, 19 nt, Homo sapiens
cacacauccuuugccuuua

SEQ ID NO: 758530 - RNA, 19 nt, Homo sapiens
uguaugcgguugauugucu

SEQ ID NO: 758531 - RNA, 19 nt, Homo sapiens
cuuagcaaccuaucauuug

SEQ ID NO: 758532 - RNA, 19 nt, Homo sapiens
caaagguagauucuucaug

SEQ ID NO: 758533 - RNA, 19 nt, Homo sapiens
ugcacugacacaacaauua

SEQ ID NO: 758534 - RNA, 19 nt, Homo sapiens
ggucacugaguuuauucua

SEQ ID NO: 758535 - RNA, 19 nt, Homo sapiens
uagcaaccuaucauuugua

SEQ ID NO: 758536 - RNA, 19 nt, Homo sapiens
cagcucaguggaaaucauu

SEQ ID NO: 758537 - RNA, 19 nt, Homo sapiens
uccuuugccuuuauucuga

SEQ ID NO: 758538 - RNA, 19 nt, Homo sapiens
cacauccuuugccuuuauu

SEQ ID NO: 758539 - RNA, 19 nt, Homo sapiens
ccuaucauuuguagaccuu

SEQ ID NO: 758540 - RNA, 19 nt, Homo sapiens
ccuuagcaaccuaucauuu

SEQ ID NO: 758541 - RNA, 19 nt, Homo sapiens
ccguugauuuauaguuuga

SEQ ID NO: 758542 - RNA, 19 nt, Homo sapiens
uguauucuccaaacacuga

SEQ ID NO: 758543 - RNA, 19 nt, Homo sapiens
auucuucucucagucuuaa

SEQ ID NO: 758544 - RNA, 19 nt, Homo sapiens
uguagaccuuugcuauuuc

SEQ ID NO: 758545 - RNA, 19 nt, Homo sapiens
ugauagggaacauuggauu

SEQ ID NO: 758546 - RNA, 19 nt, Homo sapiens
uacggcagcucaguggaaa

SEQ ID NO: 758547 - RNA, 19 nt, Homo sapiens
cauggccuaugaucgcuau

SEQ ID NO: 758548 - RNA, 19 nt, Homo sapiens
cagauagaaacuacacguu

SEQ ID NO: 758549 - RNA, 19 nt, Homo sapiens
cuguaacccuuuauuguac

SEQ ID NO: 758550 - RNA, 19 nt, Homo sapiens
ggaggaagaagaccuuuuc

SEQ ID NO: 758551 - RNA, 19 nt, Homo sapiens
acuacacguuggucacuga

SEQ ID NO: 758552 - RNA, 19 nt, Homo sapiens
ggccuaugaucgcuauguc

SEQ ID NO: 758553 - RNA, 19 nt, Homo sapiens
uagggaacauuggauugau

SEQ ID NO: 758554 - RNA, 19 nt, Homo sapiens
gacacaacaauuaaugagu

SEQ ID NO: 758555 - RNA, 19 nt, Homo sapiens
ugacacaacaauuaaugag

SEQ ID NO: 758556 - RNA, 19 nt, Homo sapiens
cuaccuguauucuccaaac

SEQ ID NO: 758557 - RNA, 19 nt, Homo sapiens
guaugcgguugauugucuu

SEQ ID NO: 758558 - RNA, 19 nt, Homo sapiens
gaagaucugucuccuauug

SEQ ID NO: 758559 - RNA, 19 nt, Homo sapiens
gaauuuaccucuucaugaa

SEQ ID NO: 758560 - RNA, 19 nt, Homo sapiens
ggaauuauccuuaaacuug

SEQ ID NO: 758561 - RNA, 19 nt, Homo sapiens
gaacaucucugucacuacu

SEQ ID NO: 758562 - RNA, 19 nt, Homo sapiens
uacaaucacuggcuucaua

SEQ ID NO: 758563 - RNA, 19 nt, Homo sapiens
gaauucaucaguaccuuua

SEQ ID NO: 758564 - RNA, 19 nt, Homo sapiens
ucagaagaaucgacaauga

SEQ ID NO: 758565 - RNA, 19 nt, Homo sapiens
gaaagguucuugcuaugca

SEQ ID NO: 758566 - RNA, 19 nt, Homo sapiens
gcuaccaaaugggaaauua

SEQ ID NO: 758567 - RNA, 19 nt, Homo sapiens
uaaaacagguucagaagaa

SEQ ID NO: 758568 - RNA, 19 nt, Homo sapiens
ggaggagaacauuuauaua

SEQ ID NO: 758569 - RNA, 19 nt, Homo sapiens
ucaguaaugucgaccuaaa

SEQ ID NO: 758570 - RNA, 19 nt, Homo sapiens
aagaagccauugaaauuug

SEQ ID NO: 758571 - RNA, 19 nt, Homo sapiens
ccuauuacuuugugaagaa

SEQ ID NO: 758572 - RNA, 19 nt, Homo sapiens
gaaaagaagccauugaaau

SEQ ID NO: 758573 - RNA, 19 nt, Homo sapiens
gcacuaacauacaauacac

SEQ ID NO: 758574 - RNA, 19 nt, Homo sapiens
ccuuaaacuuggauucuaa

SEQ ID NO: 758575 - RNA, 19 nt, Homo sapiens
guucaaggcuuugcagaca

SEQ ID NO: 758576 - RNA, 19 nt, Homo sapiens
gaaccgaaguuagcuccau

SEQ ID NO: 758577 - RNA, 19 nt, Homo sapiens
aaaaggaggagaacauuua

SEQ ID NO: 758578 - RNA, 19 nt, Homo sapiens
caagcacagugguggcaaa

SEQ ID NO: 758579 - RNA, 19 nt, Homo sapiens
gaccuaaaugagccuaaua

SEQ ID NO: 758580 - RNA, 19 nt, Homo sapiens
uggaacaucucugucacua

SEQ ID NO: 758581 - RNA, 19 nt, Homo sapiens
gaagaaucgacaaugaugu

SEQ ID NO: 758582 - RNA, 19 nt, Homo sapiens
guaaugucgaccuaaauga

SEQ ID NO: 758583 - RNA, 19 nt, Homo sapiens
agaagccauugaaauuuga

SEQ ID NO: 758584 - RNA, 19 nt, Homo sapiens
agaauuuaccucuucauga

SEQ ID NO: 758585 - RNA, 19 nt, Homo sapiens
ggucauccaucucaguuuu

SEQ ID NO: 758586 - RNA, 19 nt, Homo sapiens
gaaaaggaggagaacauuu

SEQ ID NO: 758587 - RNA, 19 nt, Homo sapiens
ugaucacuguccaccauaa

SEQ ID NO: 758588 - RNA, 19 nt, Homo sapiens
acacuggacccuauuacuu

SEQ ID NO: 758589 - RNA, 19 nt, Homo sapiens
cacuggacccuauuacuuu

SEQ ID NO: 758590 - RNA, 19 nt, Homo sapiens
ggguuacacuguccguuca

SEQ ID NO: 758591 - RNA, 19 nt, Homo sapiens
gaacacuggacccuauuac

SEQ ID NO: 758592 - RNA, 19 nt, Homo sapiens
gaauaucuuggucuuucaa

SEQ ID NO: 758593 - RNA, 19 nt, Homo sapiens
aggaggagaacauuuauau

SEQ ID NO: 758594 - RNA, 19 nt, Homo sapiens
acaucucugucacuacuuu

SEQ ID NO: 758595 - RNA, 19 nt, Homo sapiens
cgaccuaaaugagccuaau

SEQ ID NO: 758596 - RNA, 19 nt, Homo sapiens
agaagaaucgacaaugaug

SEQ ID NO: 758597 - RNA, 19 nt, Homo sapiens
ggacuauuggcuucagaug

SEQ ID NO: 758598 - RNA, 19 nt, Homo sapiens
uaauacuguugcccugcua

SEQ ID NO: 758599 - RNA, 19 nt, Homo sapiens
ggacccuauuacuuuguga

SEQ ID NO: 758600 - RNA, 19 nt, Homo sapiens
cuaccaaaugggaaauuaa

SEQ ID NO: 758601 - RNA, 19 nt, Homo sapiens
cagaagaaucgacaaugau

SEQ ID NO: 758602 - RNA, 19 nt, Homo sapiens
gcauaaaacagguucagaa

SEQ ID NO: 758603 - RNA, 19 nt, Homo sapiens
gaugaagauaauacuguug

SEQ ID NO: 758604 - RNA, 19 nt, Homo sapiens
aaugaucacuguccaccau

SEQ ID NO: 758605 - RNA, 19 nt, Homo sapiens
cuucaguaaugucgaccua

SEQ ID NO: 758606 - RNA, 19 nt, Homo sapiens
agaauaucuuggucuuuca

SEQ ID NO: 758607 - RNA, 19 nt, Homo sapiens
gcuucauacuuccagagaa

SEQ ID NO: 758608 - RNA, 19 nt, Homo sapiens
ugaauucaucaguaccuuu

SEQ ID NO: 758609 - RNA, 19 nt, Homo sapiens
aaaggaggagaacauuuau

SEQ ID NO: 758610 - RNA, 19 nt, Homo sapiens
gguucuugcuaugcacuaa

SEQ ID NO: 758611 - RNA, 19 nt, Homo sapiens
gaucugucuccuauuggaa

SEQ ID NO: 758612 - RNA, 19 nt, Homo sapiens
agacacuuaugaagaaacu

SEQ ID NO: 758613 - RNA, 19 nt, Homo sapiens
ggacuucagggucauccau

SEQ ID NO: 758614 - RNA, 19 nt, Homo sapiens
guucagaagaaucgacaau

SEQ ID NO: 758615 - RNA, 19 nt, Homo sapiens
gauggaauuauccuuaaac

SEQ ID NO: 758616 - RNA, 19 nt, Homo sapiens
agaucugucuccuauugga

SEQ ID NO: 758617 - RNA, 19 nt, Homo sapiens
gcacagugguggcaaaagc

SEQ ID NO: 758618 - RNA, 19 nt, Homo sapiens
uccuuaaacuuggauucua

SEQ ID NO: 758619 - RNA, 19 nt, Homo sapiens
acuggacccuauuacuuug

SEQ ID NO: 758620 - RNA, 19 nt, Homo sapiens
aaggaggagaacauuuaua

SEQ ID NO: 758621 - RNA, 19 nt, Homo sapiens
ccuaaaugagccuaauaau

SEQ ID NO: 758622 - RNA, 19 nt, Homo sapiens
cacuggauaaagacacuua

SEQ ID NO: 758623 - RNA, 19 nt, Homo sapiens
aaguagcacugagcacguu

SEQ ID NO: 758624 - RNA, 19 nt, Homo sapiens
aaacagguucagaagaauc

SEQ ID NO: 758625 - RNA, 19 nt, Homo sapiens
caaagaagcuugccuauag

SEQ ID NO: 758626 - RNA, 19 nt, Homo sapiens
caacaaggauuaauugcaa

SEQ ID NO: 758627 - RNA, 19 nt, Homo sapiens
ggaagaagaaucuguauau

SEQ ID NO: 758628 - RNA, 19 nt, Homo sapiens
ggaaaaggcugucuacauu

SEQ ID NO: 758629 - RNA, 19 nt, Homo sapiens
gaaacuaaacccugugauu

SEQ ID NO: 758630 - RNA, 19 nt, Homo sapiens
cgaauuuacugaagacuug

SEQ ID NO: 758631 - RNA, 19 nt, Homo sapiens
gaagaagaaucuguauauc

SEQ ID NO: 758632 - RNA, 19 nt, Homo sapiens
uguagcaucuucuuuauga

SEQ ID NO: 758633 - RNA, 19 nt, Homo sapiens
gaccaguucuccauuucua

SEQ ID NO: 758634 - RNA, 19 nt, Homo sapiens
gcagaaguccguggucaua

SEQ ID NO: 758635 - RNA, 19 nt, Homo sapiens
ugacuuauguacccagaaa

SEQ ID NO: 758636 - RNA, 19 nt, Homo sapiens
uauauuggcuagcaaaugu

SEQ ID NO: 758637 - RNA, 19 nt, Homo sapiens
uagcagaucuacuuugugu

SEQ ID NO: 758638 - RNA, 19 nt, Homo sapiens
gcaauggcuuugugcucua

SEQ ID NO: 758639 - RNA, 19 nt, Homo sapiens
gcauugaucaccauaagaa

SEQ ID NO: 758640 - RNA, 19 nt, Homo sapiens
agaagaaucuguauaucug

SEQ ID NO: 758641 - RNA, 19 nt, Homo sapiens
gcaccuaugcuuuguaugu

SEQ ID NO: 758642 - RNA, 19 nt, Homo sapiens
gaugaaacaggaaaucuga

SEQ ID NO: 758643 - RNA, 19 nt, Homo sapiens
gcucuuuggugacuucuug

SEQ ID NO: 758644 - RNA, 19 nt, Homo sapiens
ggucuauuauguucacaaa

SEQ ID NO: 758645 - RNA, 19 nt, Homo sapiens
gcacaaagcagacauucgu

SEQ ID NO: 758646 - RNA, 19 nt, Homo sapiens
gaaggccucuuugccagaa

SEQ ID NO: 758647 - RNA, 19 nt, Homo sapiens
caggaaaucugacaguauc

SEQ ID NO: 758648 - RNA, 19 nt, Homo sapiens
ggacugguagaucgaauuu

SEQ ID NO: 758649 - RNA, 19 nt, Homo sapiens
ggucuugcauuauguguca

SEQ ID NO: 758650 - RNA, 19 nt, Homo sapiens
gaacauuugugaagguacu

SEQ ID NO: 758651 - RNA, 19 nt, Homo sapiens
uaagaaggaacauuuguga

SEQ ID NO: 758652 - RNA, 19 nt, Homo sapiens
ccacaagacaaucaaacua

SEQ ID NO: 758653 - RNA, 19 nt, Homo sapiens
gcagacauucguagagaaa

SEQ ID NO: 758654 - RNA, 19 nt, Homo sapiens
gcagaucuacuuugugugu

SEQ ID NO: 758655 - RNA, 19 nt, Homo sapiens
cacaagacaaucaaacuaa

SEQ ID NO: 758656 - RNA, 19 nt, Homo sapiens
ggagaagaaauauguaaag

SEQ ID NO: 758657 - RNA, 19 nt, Homo sapiens
aaagaagcuugccuauaga

SEQ ID NO: 758658 - RNA, 19 nt, Homo sapiens
ugggcuuccucuaauauua

SEQ ID NO: 758659 - RNA, 19 nt, Homo sapiens
gcuuugacccucuccuaua

SEQ ID NO: 758660 - RNA, 19 nt, Homo sapiens
ccagaacauuaauuugguu

SEQ ID NO: 758661 - RNA, 19 nt, Homo sapiens
gcgugggcuuccucuaaua

SEQ ID NO: 758662 - RNA, 19 nt, Homo sapiens
ugaauggacugugcuuuua

SEQ ID NO: 758663 - RNA, 19 nt, Homo sapiens
aaacuaaacccugugauuc

SEQ ID NO: 758664 - RNA, 19 nt, Homo sapiens
cauuaugugucauuguuug

SEQ ID NO: 758665 - RNA, 19 nt, Homo sapiens
gccaugacacuauugauga

SEQ ID NO: 758666 - RNA, 19 nt, Homo sapiens
acuuggagcuugcuucuga

SEQ ID NO: 758667 - RNA, 19 nt, Homo sapiens
cagcgugggcuuccucuaa

SEQ ID NO: 758668 - RNA, 19 nt, Homo sapiens
guagaucgaauuuacugaa

SEQ ID NO: 758669 - RNA, 19 nt, Homo sapiens
gaaaucugacaguaucuuc

SEQ ID NO: 758670 - RNA, 19 nt, Homo sapiens
gagcaggcacucugugaau

SEQ ID NO: 758671 - RNA, 19 nt, Homo sapiens
uaugucaaccucuauugua

SEQ ID NO: 758672 - RNA, 19 nt, Homo sapiens
agagaaacauggaugaaac

SEQ ID NO: 758673 - RNA, 19 nt, Homo sapiens
ucuaugaucucuguuguag

SEQ ID NO: 758674 - RNA, 19 nt, Homo sapiens
aagcagacauucguagaga

SEQ ID NO: 758675 - RNA, 19 nt, Homo sapiens
caaagcagacauucguaga

SEQ ID NO: 758676 - RNA, 19 nt, Homo sapiens
gaucgaauuuacugaagac

SEQ ID NO: 758677 - RNA, 19 nt, Homo sapiens
guaccauucaccuucauuu

SEQ ID NO: 758678 - RNA, 19 nt, Homo sapiens
ucaguuucaugccauauca

SEQ ID NO: 758679 - RNA, 19 nt, Homo sapiens
ucuauuauguucacaaagg

SEQ ID NO: 758680 - RNA, 19 nt, Homo sapiens
uaauuuagcaguagcagau

SEQ ID NO: 758681 - RNA, 19 nt, Homo sapiens
ugcauuaugugucauuguu

SEQ ID NO: 758682 - RNA, 19 nt, Homo sapiens
guguguagguauuuggauu

SEQ ID NO: 758683 - RNA, 19 nt, Homo sapiens
gaagaaucuguauaucugu

SEQ ID NO: 758684 - RNA, 19 nt, Homo sapiens
gcauccaauuguugcuuug

SEQ ID NO: 758685 - RNA, 19 nt, Homo sapiens
agucagccuuccaaguaua

SEQ ID NO: 758686 - RNA, 19 nt, Homo sapiens
gagaaacauggaugaaaca

SEQ ID NO: 758687 - RNA, 19 nt, Homo sapiens
guacuccagugccagaaag

SEQ ID NO: 758688 - RNA, 19 nt, Homo sapiens
aguaaacuguggaccuuga

SEQ ID NO: 758689 - RNA, 19 nt, Homo sapiens
uugacccucuccuauauuu

SEQ ID NO: 758690 - RNA, 19 nt, Homo sapiens
gucauuguuuguuggcuuu

SEQ ID NO: 758691 - RNA, 19 nt, Homo sapiens
gcauuaugugucauuguuu

SEQ ID NO: 758692 - RNA, 19 nt, Homo sapiens
aacaggaaaucugacagua

SEQ ID NO: 758693 - RNA, 19 nt, Homo sapiens
uaugugucauuguuuguug

SEQ ID NO: 758694 - RNA, 19 nt, Homo sapiens
ggaaaucugacaguaucuu

SEQ ID NO: 758695 - RNA, 19 nt, Homo sapiens
ggaugaaacaggaaaucug

SEQ ID NO: 758696 - RNA, 19 nt, Homo sapiens
cguguggucuauuauguuc

SEQ ID NO: 758697 - RNA, 19 nt, Homo sapiens
uagagaaacauggaugaaa

SEQ ID NO: 758698 - RNA, 19 nt, Homo sapiens
guauauauuggcuagcaaa

SEQ ID NO: 758699 - RNA, 19 nt, Homo sapiens
cauauucaacguaccauuc

SEQ ID NO: 758700 - RNA, 19 nt, Homo sapiens
aauaauaccaagugcuuug

SEQ ID NO: 758701 - RNA, 19 nt, Homo sapiens
aaaccuaucacaagaaguc

SEQ ID NO: 758702 - RNA, 19 nt, Homo sapiens
guagagaaacauggaugaa

SEQ ID NO: 758703 - RNA, 19 nt, Homo sapiens
agacauucguagagaaaca

SEQ ID NO: 758704 - RNA, 19 nt, Homo sapiens
cuuugacccucuccuauau

SEQ ID NO: 758705 - RNA, 19 nt, Homo sapiens
ugacacuauugaugacuuc

SEQ ID NO: 758706 - RNA, 19 nt, Homo sapiens
agaaggaacauuugugaag

SEQ ID NO: 758707 - RNA, 19 nt, Homo sapiens
cauaagaaggaacauuugu

SEQ ID NO: 758708 - RNA, 19 nt, Homo sapiens
acugguagaucgaauuuac

SEQ ID NO: 758709 - RNA, 19 nt, Homo sapiens
ccauaagaaggaacauuug

SEQ ID NO: 758710 - RNA, 19 nt, Homo sapiens
aaacccauuuccaguccaa

SEQ ID NO: 758711 - RNA, 19 nt, Homo sapiens
gcaaggacugguagaucga

SEQ ID NO: 758712 - RNA, 19 nt, Homo sapiens
uuugaccaguucuccauuu

SEQ ID NO: 758713 - RNA, 19 nt, Homo sapiens
guuuguguguguagguauu

SEQ ID NO: 758714 - RNA, 19 nt, Homo sapiens
guccagaacauuaauuugg

SEQ ID NO: 758715 - RNA, 19 nt, Homo sapiens
caauggcuuugugcucuau

SEQ ID NO: 758716 - RNA, 19 nt, Homo sapiens
gcagcucgccaacaaggau

SEQ ID NO: 758717 - RNA, 19 nt, Homo sapiens
cuaauggccaaaccacaaa

SEQ ID NO: 758718 - RNA, 19 nt, Homo sapiens
uagcagcaacccaucuuug

SEQ ID NO: 758719 - RNA, 19 nt, Homo sapiens
uagaucgaauuuacugaag

SEQ ID NO: 758720 - RNA, 19 nt, Homo sapiens
ccaacaaggauuaauugca

SEQ ID NO: 758721 - RNA, 19 nt, Homo sapiens
ccagaaagaggcacaaagc

SEQ ID NO: 758722 - RNA, 19 nt, Homo sapiens
accauaagaaggaacauuu

SEQ ID NO: 758723 - RNA, 19 nt, Homo sapiens
uuaauugcaaggacuggua

SEQ ID NO: 758724 - RNA, 19 nt, Homo sapiens
ucuaauggccaaaccacaa

SEQ ID NO: 758725 - RNA, 19 nt, Homo sapiens
gcacugagcuguccauuga

SEQ ID NO: 758726 - RNA, 19 nt, Homo sapiens
ggacaucgaguuuaugaaa

SEQ ID NO: 758727 - RNA, 19 nt, Homo sapiens
gcaacagauugaagaaauu

SEQ ID NO: 758728 - RNA, 19 nt, Homo sapiens
ucacuuuccuucucuguaa

SEQ ID NO: 758729 - RNA, 19 nt, Homo sapiens
ggaugaagcugacagugau

SEQ ID NO: 758730 - RNA, 19 nt, Homo sapiens
gagaaaggcguccggauga

SEQ ID NO: 758731 - RNA, 19 nt, Homo sapiens
gggcacagaugaccaaagu

SEQ ID NO: 758732 - RNA, 19 nt, Homo sapiens
gcccagaccuuggagaauu

SEQ ID NO: 758733 - RNA, 19 nt, Homo sapiens
gaaauuagaccagacaaag

SEQ ID NO: 758734 - RNA, 19 nt, Homo sapiens
ggagaucaccaucgucaaa

SEQ ID NO: 758735 - RNA, 19 nt, Homo sapiens
ggacggagaucaccaucgu

SEQ ID NO: 758736 - RNA, 19 nt, Homo sapiens
cuacgugccucccgagaaa

SEQ ID NO: 758737 - RNA, 19 nt, Homo sapiens
gggaucugauugaggauaa

SEQ ID NO: 758738 - RNA, 19 nt, Homo sapiens
ggacgcacaugcagaacau

SEQ ID NO: 758739 - RNA, 19 nt, Homo sapiens
ggagaggguccacuucaaa

SEQ ID NO: 758740 - RNA, 19 nt, Homo sapiens
agacaaugcuacuucaguu

SEQ ID NO: 758741 - RNA, 19 nt, Homo sapiens
gagagcacccacugaauug

SEQ ID NO: 758742 - RNA, 19 nt, Homo sapiens
gaccggaucucagccuuga

SEQ ID NO: 758743 - RNA, 19 nt, Homo sapiens
ccacucaggugcacacauc

SEQ ID NO: 758744 - RNA, 19 nt, Homo sapiens
ucaacacccucuucaaauc

SEQ ID NO: 758745 - RNA, 19 nt, Homo sapiens
guccacagcugaagagcaa

SEQ ID NO: 758746 - RNA, 19 nt, Homo sapiens
guaaauccaccuuaaucaa

SEQ ID NO: 758747 - RNA, 19 nt, Homo sapiens
gaagaaauuagaccagaca

SEQ ID NO: 758748 - RNA, 19 nt, Homo sapiens
ccaagaccaucgagaucaa

SEQ ID NO: 758749 - RNA, 19 nt, Homo sapiens
caagagggccgagguguug

SEQ ID NO: 758750 - RNA, 19 nt, Homo sapiens
aaauauauccguagaaugg

SEQ ID NO: 758751 - RNA, 19 nt, Homo sapiens
gaaaaggucuaagcaagug

SEQ ID NO: 758752 - RNA, 19 nt, Homo sapiens
ugagagcacccacugaauu

SEQ ID NO: 758753 - RNA, 19 nt, Homo sapiens
gaccagacaaagaguguuu

SEQ ID NO: 758754 - RNA, 19 nt, Homo sapiens
ucaaugaccaguacgagaa

SEQ ID NO: 758755 - RNA, 19 nt, Homo sapiens
gcacgauauugaggagaaa

SEQ ID NO: 758756 - RNA, 19 nt, Homo sapiens
aaucaacacccucuucaaa

SEQ ID NO: 758757 - RNA, 19 nt, Homo sapiens
gagcacaaacauaugauca

SEQ ID NO: 758758 - RNA, 19 nt, Homo sapiens
ccaacggcaucgacgugua

SEQ ID NO: 758759 - RNA, 19 nt, Homo sapiens
caacaucgucccugucauc

SEQ ID NO: 758760 - RNA, 19 nt, Homo sapiens
caacaucaaccgcaagaag

SEQ ID NO: 758761 - RNA, 19 nt, Homo sapiens
gguaaauccaccuuaauca

SEQ ID NO: 758762 - RNA, 19 nt, Homo sapiens
ugcaacagauugaagaaau

SEQ ID NO: 758763 - RNA, 19 nt, Homo sapiens
ccauugacaucucguccaa

SEQ ID NO: 758764 - RNA, 19 nt, Homo sapiens
gacaaaguguugaaaaugu

SEQ ID NO: 758765 - RNA, 19 nt, Homo sapiens
gcaagguggucaacaucgu

SEQ ID NO: 758766 - RNA, 19 nt, Homo sapiens
cagagcggcuuggguaaau

SEQ ID NO: 758767 - RNA, 19 nt, Homo sapiens
gcagagcggcuuggguaaa

SEQ ID NO: 758768 - RNA, 19 nt, Homo sapiens
gacaaugcuacuucaguuu

SEQ ID NO: 758769 - RNA, 19 nt, Homo sapiens
aaaccaagauuuugaagga

SEQ ID NO: 758770 - RNA, 19 nt, Homo sapiens
gagaaguuccgggagauga

SEQ ID NO: 758771 - RNA, 19 nt, Homo sapiens
gccugacucuguugaucua

SEQ ID NO: 758772 - RNA, 19 nt, Homo sapiens
gaggagaggguccacuuca

SEQ ID NO: 758773 - RNA, 19 nt, Homo sapiens
ugagcaagguggucaacau

SEQ ID NO: 758774 - RNA, 19 nt, Homo sapiens
gagccugacucuguugauc

SEQ ID NO: 758775 - RNA, 19 nt, Homo sapiens
ccaacggcguggaggagaa

SEQ ID NO: 758776 - RNA, 19 nt, Homo sapiens
gccuugagaugcuucacuu

SEQ ID NO: 758777 - RNA, 19 nt, Homo sapiens
aggaggaggucaacaucaa

SEQ ID NO: 758778 - RNA, 19 nt, Homo sapiens
ggguaaauccaccuuaauc

SEQ ID NO: 758779 - RNA, 19 nt, Homo sapiens
cagcugcguuggcgacaug

SEQ ID NO: 758780 - RNA, 19 nt, Homo sapiens
ggaggaggaggcugagaga

SEQ ID NO: 758781 - RNA, 19 nt, Homo sapiens
gcgagacaguuuacuuugc

SEQ ID NO: 758782 - RNA, 19 nt, Homo sapiens
gaaugagggaggcgucuuc

SEQ ID NO: 758783 - RNA, 19 nt, Homo sapiens
cauaugaucagcacaugga

SEQ ID NO: 758784 - RNA, 19 nt, Homo sapiens
ggcagcccaucaugaaguu

SEQ ID NO: 758785 - RNA, 19 nt, Homo sapiens
cagcugaagagcaagguuu

SEQ ID NO: 758786 - RNA, 19 nt, Homo sapiens
cugaugcgcugggaucuga

SEQ ID NO: 758787 - RNA, 19 nt, Homo sapiens
gagacaaugcuacuucagu

SEQ ID NO: 758788 - RNA, 19 nt, Homo sapiens
gcagugaccacgaguacca

SEQ ID NO: 758789 - RNA, 19 nt, Homo sapiens
aaauccaccuuaaucaaca

SEQ ID NO: 758790 - RNA, 19 nt, Homo sapiens
uuggguaaauccaccuuaa

SEQ ID NO: 758791 - RNA, 19 nt, Homo sapiens
ccaaagucccuuccugcuu

SEQ ID NO: 758792 - RNA, 19 nt, Homo sapiens
gcagggcacagaugaccaa

SEQ ID NO: 758793 - RNA, 19 nt, Homo sapiens
cagagcccaugguaacgaa

SEQ ID NO: 758794 - RNA, 19 nt, Homo sapiens
caagacugggcuguaguua

SEQ ID NO: 758795 - RNA, 19 nt, Homo sapiens
gggaccacaucaacaacga

SEQ ID NO: 758796 - RNA, 19 nt, Homo sapiens
cggaugaagcugacaguga

SEQ ID NO: 758797 - RNA, 19 nt, Homo sapiens
agaaaggcguccggaugaa

SEQ ID NO: 758798 - RNA, 19 nt, Homo sapiens
ggucuaagcaagugagucu

SEQ ID NO: 758799 - RNA, 19 nt, Homo sapiens
aaacauaugaucagcacau

SEQ ID NO: 758800 - RNA, 19 nt, Homo sapiens
gauugcaacagauugaaga

SEQ ID NO: 758801 - RNA, 19 nt, Homo sapiens
cagcaucccagccuugaga

SEQ ID NO: 758802 - RNA, 19 nt, Homo sapiens
ccaagacugggcuguaguu

SEQ ID NO: 758803 - RNA, 19 nt, Homo sapiens
ggaucugauugaggauaaa

SEQ ID NO: 758804 - RNA, 19 nt, Homo sapiens
gcacaugcagaacaucaag

SEQ ID NO: 758805 - RNA, 19 nt, Homo sapiens
gagcaagguggucaacauc

SEQ ID NO: 758806 - RNA, 19 nt, Homo sapiens
gcaggaggaggucaacauc

SEQ ID NO: 758807 - RNA, 19 nt, Homo sapiens
aagagacaaugcuacuuca

SEQ ID NO: 758808 - RNA, 19 nt, Homo sapiens
ucaggacgcacaugcagaa

SEQ ID NO: 758809 - RNA, 19 nt, Homo sapiens
ugaaacgccugagcaaggu

SEQ ID NO: 758810 - RNA, 19 nt, Homo sapiens
ccacugcugccucuacuuc

SEQ ID NO: 758811 - RNA, 19 nt, Homo sapiens
aaauuagaccagacaaaga

SEQ ID NO: 758812 - RNA, 19 nt, Homo sapiens
uaaauccaccuuaaucaac

SEQ ID NO: 758813 - RNA, 19 nt, Homo sapiens
ggccagcuccacccagaaa

SEQ ID NO: 758814 - RNA, 19 nt, Homo sapiens
uggcgagacaguuuacuuu

SEQ ID NO: 758815 - RNA, 19 nt, Homo sapiens
acaaugcuacuucaguuug

SEQ ID NO: 758816 - RNA, 19 nt, Homo sapiens
gaaaggcguccggaugaag

SEQ ID NO: 758817 - RNA, 19 nt, Homo sapiens
ccaucgagaucaaguccau

SEQ ID NO: 758818 - RNA, 19 nt, Homo sapiens
caagugaccagggaagugu

SEQ ID NO: 758819 - RNA, 19 nt, Homo sapiens
ccgagugagucagugauga

SEQ ID NO: 758820 - RNA, 19 nt, Homo sapiens
caaugaccaguacgagaaa

SEQ ID NO: 758821 - RNA, 19 nt, Homo sapiens
cgcacgauauugaggagaa

SEQ ID NO: 758822 - RNA, 19 nt, Homo sapiens
guccaucacgcacgauauu

SEQ ID NO: 758823 - RNA, 19 nt, Homo sapiens
gcuaaauauauccguagaa

SEQ ID NO: 758824 - RNA, 19 nt, Homo sapiens
cgagaaggaguguaugagu

SEQ ID NO: 758825 - RNA, 19 nt, Homo sapiens
uaacauggcugaugacuau

SEQ ID NO: 758826 - RNA, 19 nt, Homo sapiens
ggaugaaucugaacuauau

SEQ ID NO: 758827 - RNA, 19 nt, Homo sapiens
ggaauacagugagcagaua

SEQ ID NO: 758828 - RNA, 19 nt, Homo sapiens
gaaacgaucugcaggucuu

SEQ ID NO: 758829 - RNA, 19 nt, Homo sapiens
ggucauggcuugcugcuau

SEQ ID NO: 758830 - RNA, 19 nt, Homo sapiens
gaugagagcaccaaacuga

SEQ ID NO: 758831 - RNA, 19 nt, Homo sapiens
gaacuucuguggcuucagu

SEQ ID NO: 758832 - RNA, 19 nt, Homo sapiens
caacuucacugacuucuac

SEQ ID NO: 758833 - RNA, 19 nt, Homo sapiens
gcaggaggcuguugauugg

SEQ ID NO: 758834 - RNA, 19 nt, Homo sapiens
guaauggaauucaccuuug

SEQ ID NO: 758835 - RNA, 19 nt, Homo sapiens
ccacaagcccuauuccuaa

SEQ ID NO: 758836 - RNA, 19 nt, Homo sapiens
gauuggcucuugacuguga

SEQ ID NO: 758837 - RNA, 19 nt, Homo sapiens
gcacaagagugaagaccau

SEQ ID NO: 758838 - RNA, 19 nt, Homo sapiens
agaaagggaugaaucugaa

SEQ ID NO: 758839 - RNA, 19 nt, Homo sapiens
gcacaaagcccuaaaagug

SEQ ID NO: 758840 - RNA, 19 nt, Homo sapiens
agacaaggauuccgcuuau

SEQ ID NO: 758841 - RNA, 19 nt, Homo sapiens
gcuauaccaucaucauuca

SEQ ID NO: 758842 - RNA, 19 nt, Homo sapiens
gaaaucuuauacagccaaa

SEQ ID NO: 758843 - RNA, 19 nt, Homo sapiens
gaauucaccuuugcaucuu

SEQ ID NO: 758844 - RNA, 19 nt, Homo sapiens
ggaauucaccuuugcaucu

SEQ ID NO: 758845 - RNA, 19 nt, Homo sapiens
gaagaaaugagaaauacag

SEQ ID NO: 758846 - RNA, 19 nt, Homo sapiens
gaggcccacuuuauucuga

SEQ ID NO: 758847 - RNA, 19 nt, Homo sapiens
uggaggagcccuuggauuu

SEQ ID NO: 758848 - RNA, 19 nt, Homo sapiens
gaagcugucgucuauguug

SEQ ID NO: 758849 - RNA, 19 nt, Homo sapiens
uguacaagaugaacuucua

SEQ ID NO: 758850 - RNA, 19 nt, Homo sapiens
gcuauuuacuuccaugcuu

SEQ ID NO: 758851 - RNA, 19 nt, Homo sapiens
gaccuaauuuccuucuguu

SEQ ID NO: 758852 - RNA, 19 nt, Homo sapiens
gggaugaaucugaacuaua

SEQ ID NO: 758853 - RNA, 19 nt, Homo sapiens
gaccuccucuuucuuguca

SEQ ID NO: 758854 - RNA, 19 nt, Homo sapiens
guuguaggcuuguucuguu

SEQ ID NO: 758855 - RNA, 19 nt, Homo sapiens
cagagagagugaaagagaa

SEQ ID NO: 758856 - RNA, 19 nt, Homo sapiens
ggacagguacauugccauu

SEQ ID NO: 758857 - RNA, 19 nt, Homo sapiens
gaaaaugggcugguucuuu

SEQ ID NO: 758858 - RNA, 19 nt, Homo sapiens
ucucagaccuaauuuccuu

SEQ ID NO: 758859 - RNA, 19 nt, Homo sapiens
ggcaaucucagaccuaauu

SEQ ID NO: 758860 - RNA, 19 nt, Homo sapiens
ccagagagagugaaagaga

SEQ ID NO: 758861 - RNA, 19 nt, Homo sapiens
gagaaauacagaaacaguu

SEQ ID NO: 758862 - RNA, 19 nt, Homo sapiens
caacugaccacacccacaa

SEQ ID NO: 758863 - RNA, 19 nt, Homo sapiens
cugcaggucuugccaguga

SEQ ID NO: 758864 - RNA, 19 nt, Homo sapiens
gaccagagagagugaaaga

SEQ ID NO: 758865 - RNA, 19 nt, Homo sapiens
gcaucagcguggacaggua

SEQ ID NO: 758866 - RNA, 19 nt, Homo sapiens
gcaagguggucaacagcau

SEQ ID NO: 758867 - RNA, 19 nt, Homo sapiens
ucuuuacccugucucaaua

SEQ ID NO: 758868 - RNA, 19 nt, Homo sapiens
gcuggaaggcuauuuacuu

SEQ ID NO: 758869 - RNA, 19 nt, Homo sapiens
ccacaaggcauccaaaguc

SEQ ID NO: 758870 - RNA, 19 nt, Homo sapiens
gcagaccauugacgccuau

SEQ ID NO: 758871 - RNA, 19 nt, Homo sapiens
cugcaucccagaaaucuua

SEQ ID NO: 758872 - RNA, 19 nt, Homo sapiens
gacaaggauuccgcuuauu

SEQ ID NO: 758873 - RNA, 19 nt, Homo sapiens
caggcaaucucagaccuaa

SEQ ID NO: 758874 - RNA, 19 nt, Homo sapiens
ugccaggucuuauagauuc

SEQ ID NO: 758875 - RNA, 19 nt, Homo sapiens
ugaaaacccugaagaacuu

SEQ ID NO: 758876 - RNA, 19 nt, Homo sapiens
uacguuaacuucaacuuca

SEQ ID NO: 758877 - RNA, 19 nt, Homo sapiens
gagcagggagauuauaaca

SEQ ID NO: 758878 - RNA, 19 nt, Homo sapiens
guccaucuuugggaaauuu

SEQ ID NO: 758879 - RNA, 19 nt, Homo sapiens
ccaguggguuucauuuaca

SEQ ID NO: 758880 - RNA, 19 nt, Homo sapiens
ccaccaacauugacaucug

SEQ ID NO: 758881 - RNA, 19 nt, Homo sapiens
gaauacagugagcagauau

SEQ ID NO: 758882 - RNA, 19 nt, Homo sapiens
uagacaaggauuccgcuua

SEQ ID NO: 758883 - RNA, 19 nt, Homo sapiens
ucaacagcauguacaagau

SEQ ID NO: 758884 - RNA, 19 nt, Homo sapiens
uugauuggcucuugacugu

SEQ ID NO: 758885 - RNA, 19 nt, Homo sapiens
uggaagaaaugagaaauac

SEQ ID NO: 758886 - RNA, 19 nt, Homo sapiens
gcauguacaagaugaacuu

SEQ ID NO: 758887 - RNA, 19 nt, Homo sapiens
caacagcauguacaagaug

SEQ ID NO: 758888 - RNA, 19 nt, Homo sapiens
gcugaccuccucuuucuug

SEQ ID NO: 758889 - RNA, 19 nt, Homo sapiens
uaacccaugccaggucuua

SEQ ID NO: 758890 - RNA, 19 nt, Homo sapiens
gaaaagaaaacucagaaag

SEQ ID NO: 758891 - RNA, 19 nt, Homo sapiens
agaccuaauuuccuucugu

SEQ ID NO: 758892 - RNA, 19 nt, Homo sapiens
gcaaucucagaccuaauuu

SEQ ID NO: 758893 - RNA, 19 nt, Homo sapiens
gcuguugauuggcucuuga

SEQ ID NO: 758894 - RNA, 19 nt, Homo sapiens
caugccaggucuuauagau

SEQ ID NO: 758895 - RNA, 19 nt, Homo sapiens
gugaaaauguccaucuuug

SEQ ID NO: 758896 - RNA, 19 nt, Homo sapiens
ggagagagggaagcuugaa

SEQ ID NO: 758897 - RNA, 19 nt, Homo sapiens
ugacgccuaugccauguuc

SEQ ID NO: 758898 - RNA, 19 nt, Homo sapiens
gucaacagcauguacaaga

SEQ ID NO: 758899 - RNA, 19 nt, Homo sapiens
caaggcauccaaagucugu

SEQ ID NO: 758900 - RNA, 19 nt, Homo sapiens
gcucugaauccacaucuuc

SEQ ID NO: 758901 - RNA, 19 nt, Homo sapiens
ggaagaaaugagaaauaca

SEQ ID NO: 758902 - RNA, 19 nt, Homo sapiens
aagacuacguuaacuucaa

SEQ ID NO: 758903 - RNA, 19 nt, Homo sapiens
acaaggauuccgcuuauuc

SEQ ID NO: 758904 - RNA, 19 nt, Homo sapiens
uuccugaucuagaaccuuu

SEQ ID NO: 758905 - RNA, 19 nt, Homo sapiens
ccacugaugggaccagaga

SEQ ID NO: 758906 - RNA, 19 nt, Homo sapiens
uugaagcugucgucuaugu

SEQ ID NO: 758907 - RNA, 19 nt, Homo sapiens
ugucucaguuucccuacaa

SEQ ID NO: 758908 - RNA, 19 nt, Homo sapiens
gaggaauccggcauugcua

SEQ ID NO: 758909 - RNA, 19 nt, Homo sapiens
caaggaggaauccggcauu

SEQ ID NO: 758910 - RNA, 19 nt, Homo sapiens
gccaugagagcacauacuu

SEQ ID NO: 758911 - RNA, 19 nt, Homo sapiens
ugacugugaugcccgcaau

SEQ ID NO: 758912 - RNA, 19 nt, Homo sapiens
gucauggcuugcugcuaua

SEQ ID NO: 758913 - RNA, 19 nt, Homo sapiens
ggaggaauccggcauugcu

SEQ ID NO: 758914 - RNA, 19 nt, Homo sapiens
aaaugcaucaccuuugaaa

SEQ ID NO: 758915 - RNA, 19 nt, Homo sapiens
cacaaggcauccaaagucu

SEQ ID NO: 758916 - RNA, 19 nt, Homo sapiens
gcccgcaauucucaaagga

SEQ ID NO: 758917 - RNA, 19 nt, Homo sapiens
ugaagaccaugaccgacau

SEQ ID NO: 758918 - RNA, 19 nt, Homo sapiens
ugugugcaauuaaagauca

SEQ ID NO: 758919 - RNA, 19 nt, Homo sapiens
uuccuaacauggcugauga

SEQ ID NO: 758920 - RNA, 19 nt, Homo sapiens
ucacuguccugaccgucuu

SEQ ID NO: 758921 - RNA, 19 nt, Homo sapiens
ccauggaagacuacguuaa

SEQ ID NO: 758922 - RNA, 19 nt, Homo sapiens
aguaauggaauucaccuuu

SEQ ID NO: 758923 - RNA, 19 nt, Homo sapiens
gcaguuugcgagccauuuc

SEQ ID NO: 758924 - RNA, 19 nt, Homo sapiens
gagaaaagaaaacucagaa

SEQ ID NO: 758925 - RNA, 19 nt, Homo sapiens
uaacauggcugaugacuau

SEQ ID NO: 758926 - RNA, 19 nt, Homo sapiens
ggaugaaucugaacuauau

SEQ ID NO: 758927 - RNA, 19 nt, Homo sapiens
ggaauacagugagcagaua

SEQ ID NO: 758928 - RNA, 19 nt, Homo sapiens
gaaacgaucugcaggucuu

SEQ ID NO: 758929 - RNA, 19 nt, Homo sapiens
ggucauggcuugcugcuau

SEQ ID NO: 758930 - RNA, 19 nt, Homo sapiens
gaugagagcaccaaacuga

SEQ ID NO: 758931 - RNA, 19 nt, Homo sapiens
gaacuucuguggcuucagu

SEQ ID NO: 758932 - RNA, 19 nt, Homo sapiens
caacuucacugacuucuac

SEQ ID NO: 758933 - RNA, 19 nt, Homo sapiens
gcaggaggcuguugauugg

SEQ ID NO: 758934 - RNA, 19 nt, Homo sapiens
guaauggaauucaccuuug

SEQ ID NO: 758935 - RNA, 19 nt, Homo sapiens
gauuggcucuugacuguga

SEQ ID NO: 758936 - RNA, 19 nt, Homo sapiens
gcacaagagugaagaccau

SEQ ID NO: 758937 - RNA, 19 nt, Homo sapiens
agaaagggaugaaucugaa

SEQ ID NO: 758938 - RNA, 19 nt, Homo sapiens
gcacaaagcccuaaaagug

SEQ ID NO: 758939 - RNA, 19 nt, Homo sapiens
ucacaagcccuauuccuaa

SEQ ID NO: 758940 - RNA, 19 nt, Homo sapiens
agacaaggauuccgcuuau

SEQ ID NO: 758941 - RNA, 19 nt, Homo sapiens
gcuauaccaucaucauuca

SEQ ID NO: 758942 - RNA, 19 nt, Homo sapiens
gaaaucuuauacagccaaa

SEQ ID NO: 758943 - RNA, 19 nt, Homo sapiens
gaauucaccuuugcaucuu

SEQ ID NO: 758944 - RNA, 19 nt, Homo sapiens
ggaauucaccuuugcaucu

SEQ ID NO: 758945 - RNA, 19 nt, Homo sapiens
gaagaaaugagaaauacag

SEQ ID NO: 758946 - RNA, 19 nt, Homo sapiens
gaggcccacuuuauucuga

SEQ ID NO: 758947 - RNA, 19 nt, Homo sapiens
uggaggagcccuuggauuu

SEQ ID NO: 758948 - RNA, 19 nt, Homo sapiens
gaagcugucgucuauguug

SEQ ID NO: 758949 - RNA, 19 nt, Homo sapiens
uguacaagaugaacuucua

SEQ ID NO: 758950 - RNA, 19 nt, Homo sapiens
gcuauuuacuuccaugcuu

SEQ ID NO: 758951 - RNA, 19 nt, Homo sapiens
gaccuaauuuccuucuguu

SEQ ID NO: 758952 - RNA, 19 nt, Homo sapiens
gggaugaaucugaacuaua

SEQ ID NO: 758953 - RNA, 19 nt, Homo sapiens
gaccuccucuuucuuguca

SEQ ID NO: 758954 - RNA, 19 nt, Homo sapiens
guuguaggcuuguucuguu

SEQ ID NO: 758955 - RNA, 19 nt, Homo sapiens
cagagagagugaaagagaa

SEQ ID NO: 758956 - RNA, 19 nt, Homo sapiens
agagcaggcuugcaucuga

SEQ ID NO: 758957 - RNA, 19 nt, Homo sapiens
ggacagguacauugccauu

SEQ ID NO: 758958 - RNA, 19 nt, Homo sapiens
gaaaaugggcugguucuuu

SEQ ID NO: 758959 - RNA, 19 nt, Homo sapiens
ucucagaccuaauuuccuu

SEQ ID NO: 758960 - RNA, 19 nt, Homo sapiens
ggcaaucucagaccuaauu

SEQ ID NO: 758961 - RNA, 19 nt, Homo sapiens
ccagagagagugaaagaga

SEQ ID NO: 758962 - RNA, 19 nt, Homo sapiens
gagaaauacagaaacaguu

SEQ ID NO: 758963 - RNA, 19 nt, Homo sapiens
caacugaccacacccacaa

SEQ ID NO: 758964 - RNA, 19 nt, Homo sapiens
cugcaggucuugccaguga

SEQ ID NO: 758965 - RNA, 19 nt, Homo sapiens
gaccagagagagugaaaga

SEQ ID NO: 758966 - RNA, 19 nt, Homo sapiens
gcaucagcguggacaggua

SEQ ID NO: 758967 - RNA, 19 nt, Homo sapiens
gcaagguggucaacagcau

SEQ ID NO: 758968 - RNA, 19 nt, Homo sapiens
ucuuuacccugucucaaua

SEQ ID NO: 758969 - RNA, 19 nt, Homo sapiens
gcuggaaggcuauuuacuu

SEQ ID NO: 758970 - RNA, 19 nt, Homo sapiens
ccacaaggcauccaaaguc

SEQ ID NO: 758971 - RNA, 19 nt, Homo sapiens
gcagaccauugacgccuau

SEQ ID NO: 758972 - RNA, 19 nt, Homo sapiens
cugcaucccagaaaucuua

SEQ ID NO: 758973 - RNA, 19 nt, Homo sapiens
gacaaggauuccgcuuauu

SEQ ID NO: 758974 - RNA, 19 nt, Homo sapiens
ccacagagcaggcuugcau

SEQ ID NO: 758975 - RNA, 19 nt, Homo sapiens
caggcaaucucagaccuaa

SEQ ID NO: 758976 - RNA, 19 nt, Homo sapiens
ugccaggucuuauagauuc

SEQ ID NO: 758977 - RNA, 19 nt, Homo sapiens
ugaaaacccugaagaacuu

SEQ ID NO: 758978 - RNA, 19 nt, Homo sapiens
uacguuaacuucaacuuca

SEQ ID NO: 758979 - RNA, 19 nt, Homo sapiens
gagcagggagauuauaaca

SEQ ID NO: 758980 - RNA, 19 nt, Homo sapiens
guccaucuuugggaaauuu

SEQ ID NO: 758981 - RNA, 19 nt, Homo sapiens
ccaguggguuucauuuaca

SEQ ID NO: 758982 - RNA, 19 nt, Homo sapiens
ccaccaacauugacaucug

SEQ ID NO: 758983 - RNA, 19 nt, Homo sapiens
gaauacagugagcagauau

SEQ ID NO: 758984 - RNA, 19 nt, Homo sapiens
uagacaaggauuccgcuua

SEQ ID NO: 758985 - RNA, 19 nt, Homo sapiens
ucaacagcauguacaagau

SEQ ID NO: 758986 - RNA, 19 nt, Homo sapiens
uugauuggcucuugacugu

SEQ ID NO: 758987 - RNA, 19 nt, Homo sapiens
uggaagaaaugagaaauac

SEQ ID NO: 758988 - RNA, 19 nt, Homo sapiens
gcauguacaagaugaacuu

SEQ ID NO: 758989 - RNA, 19 nt, Homo sapiens
caacagcauguacaagaug

SEQ ID NO: 758990 - RNA, 19 nt, Homo sapiens
gcugaccuccucuuucuug

SEQ ID NO: 758991 - RNA, 19 nt, Homo sapiens
uaacccaugccaggucuua

SEQ ID NO: 758992 - RNA, 19 nt, Homo sapiens
gaaaagaaaacucagaaag

SEQ ID NO: 758993 - RNA, 19 nt, Homo sapiens
agaccuaauuuccuucugu

SEQ ID NO: 758994 - RNA, 19 nt, Homo sapiens
gcaaucucagaccuaauuu

SEQ ID NO: 758995 - RNA, 19 nt, Homo sapiens
gcuguugauuggcucuuga

SEQ ID NO: 758996 - RNA, 19 nt, Homo sapiens
caugccaggucuuauagau

SEQ ID NO: 758997 - RNA, 19 nt, Homo sapiens
gugaaaauguccaucuuug

SEQ ID NO: 758998 - RNA, 19 nt, Homo sapiens
ggagagagggaagcuugaa

SEQ ID NO: 758999 - RNA, 19 nt, Homo sapiens
ugacgccuaugccauguuc

SEQ ID NO: 759000 - RNA, 19 nt, Homo sapiens
gucaacagcauguacaaga

SEQ ID NO: 759001 - RNA, 19 nt, Homo sapiens
caaggcauccaaagucugu

SEQ ID NO: 759002 - RNA, 19 nt, Homo sapiens
aagacuacguuaacuucaa

SEQ ID NO: 759003 - RNA, 19 nt, Homo sapiens
ggaagaaaugagaaauaca

SEQ ID NO: 759004 - RNA, 19 nt, Homo sapiens
gcucugaauccacaucuuc

SEQ ID NO: 759005 - RNA, 19 nt, Homo sapiens
acaaggauuccgcuuauuc

SEQ ID NO: 759006 - RNA, 19 nt, Homo sapiens
uuccugaucuagaaccuuu

SEQ ID NO: 759007 - RNA, 19 nt, Homo sapiens
ccacugaugggaccagaga

SEQ ID NO: 759008 - RNA, 19 nt, Homo sapiens
uugaagcugucgucuaugu

SEQ ID NO: 759009 - RNA, 19 nt, Homo sapiens
ugucucaguuucccuacaa

SEQ ID NO: 759010 - RNA, 19 nt, Homo sapiens
gaggaauccggcauugcua

SEQ ID NO: 759011 - RNA, 19 nt, Homo sapiens
caaggaggaauccggcauu

SEQ ID NO: 759012 - RNA, 19 nt, Homo sapiens
gccaugagagcacauacuu

SEQ ID NO: 759013 - RNA, 19 nt, Homo sapiens
ugacugugaugcccgcaau

SEQ ID NO: 759014 - RNA, 19 nt, Homo sapiens
gucauggcuugcugcuaua

SEQ ID NO: 759015 - RNA, 19 nt, Homo sapiens
ggaggaauccggcauugcu

SEQ ID NO: 759016 - RNA, 19 nt, Homo sapiens
aaaugcaucaccuuugaaa

SEQ ID NO: 759017 - RNA, 19 nt, Homo sapiens
cacaaggcauccaaagucu

SEQ ID NO: 759018 - RNA, 19 nt, Homo sapiens
gcccgcaauucucaaagga

SEQ ID NO: 759019 - RNA, 19 nt, Homo sapiens
ugaagaccaugaccgacau

SEQ ID NO: 759020 - RNA, 19 nt, Homo sapiens
ugugugcaauuaaagauca

SEQ ID NO: 759021 - RNA, 19 nt, Homo sapiens
uuccuaacauggcugauga

SEQ ID NO: 759022 - RNA, 19 nt, Homo sapiens
ucacuguccugaccgucuu

SEQ ID NO: 759023 - RNA, 19 nt, Homo sapiens
gcaguuugcgagccauuuc

SEQ ID NO: 759024 - RNA, 19 nt, Homo sapiens
aguaauggaauucaccuuu

SEQ ID NO: 759025 - RNA, 19 nt, Homo sapiens
gaagaggaaugauuucaaa

SEQ ID NO: 759026 - RNA, 19 nt, Homo sapiens
gagagaagaggaaugauuu

SEQ ID NO: 759027 - RNA, 19 nt, Homo sapiens
gaagcagccuuuauguaug

SEQ ID NO: 759028 - RNA, 19 nt, Homo sapiens
ggaaugauuucaaagacau

SEQ ID NO: 759029 - RNA, 19 nt, Homo sapiens
ggagagaagaggaaugauu

SEQ ID NO: 759030 - RNA, 19 nt, Homo sapiens
cgaaaccacucgcaaguuc

SEQ ID NO: 759031 - RNA, 19 nt, Homo sapiens
ugaagcagccuuuauguau

SEQ ID NO: 759032 - RNA, 19 nt, Homo sapiens
ugaaaugaaugagcugauu

SEQ ID NO: 759033 - RNA, 19 nt, Homo sapiens
cuuguugacugcuuuauuu

SEQ ID NO: 759034 - RNA, 19 nt, Homo sapiens
agacauagaggacauuaaa

SEQ ID NO: 759035 - RNA, 19 nt, Homo sapiens
uaaaggagaguaagcagaa

SEQ ID NO: 759036 - RNA, 19 nt, Homo sapiens
gagaguaagcagaaugaaa

SEQ ID NO: 759037 - RNA, 19 nt, Homo sapiens
gaucacagucaucuuuauu

SEQ ID NO: 759038 - RNA, 19 nt, Homo sapiens
ucacagguuucccaagcua

SEQ ID NO: 759039 - RNA, 19 nt, Homo sapiens
guugacugcuuuauuucua

SEQ ID NO: 759040 - RNA, 19 nt, Homo sapiens
gcacaagguucggauagag

SEQ ID NO: 759041 - RNA, 19 nt, Homo sapiens
gaggagagaagaggaauga

SEQ ID NO: 759042 - RNA, 19 nt, Homo sapiens
ggaucacagucaucuuuau

SEQ ID NO: 759043 - RNA, 19 nt, Homo sapiens
guaagcagaaugaaaugaa

SEQ ID NO: 759044 - RNA, 19 nt, Homo sapiens
gagaagaccguguuuacca

SEQ ID NO: 759045 - RNA, 19 nt, Homo sapiens
gaggaaugauuucaaagac

SEQ ID NO: 759046 - RNA, 19 nt, Homo sapiens
ucaaagacauagaggacau

SEQ ID NO: 759047 - RNA, 19 nt, Homo sapiens
gaagaccguguuuaccauu

SEQ ID NO: 759048 - RNA, 19 nt, Homo sapiens
ccaugcauguggccuacua

SEQ ID NO: 759049 - RNA, 19 nt, Homo sapiens
ugauuugcaugcugcuuaa

SEQ ID NO: 759050 - RNA, 19 nt, Homo sapiens
gugauuugcaugcugcuua

SEQ ID NO: 759051 - RNA, 19 nt, Homo sapiens
agaguaagcagaaugaaau

SEQ ID NO: 759052 - RNA, 19 nt, Homo sapiens
guacaccagcagcaucuuu

SEQ ID NO: 759053 - RNA, 19 nt, Homo sapiens
aagcagccuuuauguaugu

SEQ ID NO: 759054 - RNA, 19 nt, Homo sapiens
guggaucacagucaucuuu

SEQ ID NO: 759055 - RNA, 19 nt, Homo sapiens
ggacuucgucugcaacaca

SEQ ID NO: 759056 - RNA, 19 nt, Homo sapiens
gagaagaggaaugauuuca

SEQ ID NO: 759057 - RNA, 19 nt, Homo sapiens
ugugugcuaugaccacuuu

SEQ ID NO: 759058 - RNA, 19 nt, Homo sapiens
ccaaucaugcccuaaagga

SEQ ID NO: 759059 - RNA, 19 nt, Homo sapiens
aaaaugcaaucacagguuu

SEQ ID NO: 759060 - RNA, 19 nt, Homo sapiens
gauuucagauaguggucaa

SEQ ID NO: 759061 - RNA, 19 nt, Homo sapiens
cagagaagaccguguuuac

SEQ ID NO: 759062 - RNA, 19 nt, Homo sapiens
gcuaccugcugcugaaagu

SEQ ID NO: 759063 - RNA, 19 nt, Homo sapiens
aaagacauagaggacauua

SEQ ID NO: 759064 - RNA, 19 nt, Homo sapiens
agaggaaugauuucaaaga

SEQ ID NO: 759065 - RNA, 19 nt, Homo sapiens
gaaaccacucgcaaguuca

SEQ ID NO: 759066 - RNA, 19 nt, Homo sapiens
aagaccguguuuaccauuu

SEQ ID NO: 759067 - RNA, 19 nt, Homo sapiens
acagagaagaccguguuua

SEQ ID NO: 759068 - RNA, 19 nt, Homo sapiens
guguugaaaugugggauug

SEQ ID NO: 759069 - RNA, 19 nt, Homo sapiens
agugguggcugcccaggaa

SEQ ID NO: 759070 - RNA, 19 nt, Homo sapiens
agaagaccguguuuaccau

SEQ ID NO: 759071 - RNA, 19 nt, Homo sapiens
aagaggacuucgucugcaa

SEQ ID NO: 759072 - RNA, 19 nt, Homo sapiens
uggaucacagucaucuuua

SEQ ID NO: 759073 - RNA, 19 nt, Homo sapiens
gaguaagcagaaugaaaug

SEQ ID NO: 759074 - RNA, 19 nt, Homo sapiens
agaagaggaaugauuucaa

SEQ ID NO: 759075 - RNA, 19 nt, Homo sapiens
ugugcuaccugcugcugaa

SEQ ID NO: 759076 - RNA, 19 nt, Homo sapiens
uugaagcagccuuuaugua

SEQ ID NO: 759077 - RNA, 19 nt, Homo sapiens
caucuuugaagcagccuuu

SEQ ID NO: 759078 - RNA, 19 nt, Homo sapiens
ggacguacaccagcagcau

SEQ ID NO: 759079 - RNA, 19 nt, Homo sapiens
caaagacauagaggacauu

SEQ ID NO: 759080 - RNA, 19 nt, Homo sapiens
aggaaugauuucaaagaca

SEQ ID NO: 759081 - RNA, 19 nt, Homo sapiens
gauuucugcgucugugauu

SEQ ID NO: 759082 - RNA, 19 nt, Homo sapiens
ugcccuggguguugaaaug

SEQ ID NO: 759083 - RNA, 19 nt, Homo sapiens
cagccuuuauguauguguu

SEQ ID NO: 759084 - RNA, 19 nt, Homo sapiens
ggagaguaagcagaaugaa

SEQ ID NO: 759085 - RNA, 19 nt, Homo sapiens
aaaggagaguaagcagaau

SEQ ID NO: 759086 - RNA, 19 nt, Homo sapiens
caaaaugcaaucacagguu

SEQ ID NO: 759087 - RNA, 19 nt, Homo sapiens
gcuuaacguggcagaguug

SEQ ID NO: 759088 - RNA, 19 nt, Homo sapiens
gguguugaaaugugggauu

SEQ ID NO: 759089 - RNA, 19 nt, Homo sapiens
ggacgcugcacacuuucau

SEQ ID NO: 759090 - RNA, 19 nt, Homo sapiens
aaagcacaagguucggaua

SEQ ID NO: 759091 - RNA, 19 nt, Homo sapiens
gagaagaaaugaagaauug

SEQ ID NO: 759092 - RNA, 19 nt, Homo sapiens
uaacagggaucuugaaauu

SEQ ID NO: 759093 - RNA, 19 nt, Homo sapiens
gaauagaacuggaugaaag

SEQ ID NO: 759094 - RNA, 19 nt, Homo sapiens
ugaaauagcucaacucagu

SEQ ID NO: 759095 - RNA, 19 nt, Homo sapiens
ggaacucucuggaaugaaa

SEQ ID NO: 759096 - RNA, 19 nt, Homo sapiens
ggaaauggaugucacaaag

SEQ ID NO: 759097 - RNA, 19 nt, Homo sapiens
ccaagaaacuggaacaaau

SEQ ID NO: 759098 - RNA, 19 nt, Homo sapiens
acagggaucuugaaauuaa

SEQ ID NO: 759099 - RNA, 19 nt, Homo sapiens
agaaagagaugacuugaug

SEQ ID NO: 759100 - RNA, 19 nt, Homo sapiens
gaacaugaggaaaccaaua

SEQ ID NO: 759101 - RNA, 19 nt, Homo sapiens
gaucuugucucagaauauu

SEQ ID NO: 759102 - RNA, 19 nt, Homo sapiens
ucagagaacuugugaagau

SEQ ID NO: 759103 - RNA, 19 nt, Homo sapiens
ggaacgacuuagcugaaua

SEQ ID NO: 759104 - RNA, 19 nt, Homo sapiens
gaggaacucucuggaauga

SEQ ID NO: 759105 - RNA, 19 nt, Homo sapiens
ggaaauagagaaauugaga

SEQ ID NO: 759106 - RNA, 19 nt, Homo sapiens
gaagauacagcaaauggaa

SEQ ID NO: 759107 - RNA, 19 nt, Homo sapiens
gaaagacugguuaaagaaa

SEQ ID NO: 759108 - RNA, 19 nt, Homo sapiens
ugacaaaguuaaaggaaga

SEQ ID NO: 759109 - RNA, 19 nt, Homo sapiens
ggagaaggaugaggcagaa

SEQ ID NO: 759110 - RNA, 19 nt, Homo sapiens
ugaccagucucaauauauu

SEQ ID NO: 759111 - RNA, 19 nt, Homo sapiens
ucgaaagacugguuaaaga

SEQ ID NO: 759112 - RNA, 19 nt, Homo sapiens
aaaccaauaugccuacuau

SEQ ID NO: 759113 - RNA, 19 nt, Homo sapiens
gaaacaugcacaauucuug

SEQ ID NO: 759114 - RNA, 19 nt, Homo sapiens
uaaggaaagugaaguaucu

SEQ ID NO: 759115 - RNA, 19 nt, Homo sapiens
uaaggcagcuggauaagca

SEQ ID NO: 759116 - RNA, 19 nt, Homo sapiens
gaggagugccugagacuaa

SEQ ID NO: 759117 - RNA, 19 nt, Homo sapiens
gcacaauucuuggauuaca

SEQ ID NO: 759118 - RNA, 19 nt, Homo sapiens
gcaacuaaagcauaaagaa

SEQ ID NO: 759119 - RNA, 19 nt, Homo sapiens
ugaaguaucuccgucaaga

SEQ ID NO: 759120 - RNA, 19 nt, Homo sapiens
gaaagaaggcgaugucacu

SEQ ID NO: 759121 - RNA, 19 nt, Homo sapiens
ggaaauaacgaaagaaagg

SEQ ID NO: 759122 - RNA, 19 nt, Homo sapiens
gaacaugccagcagaagca

SEQ ID NO: 759123 - RNA, 19 nt, Homo sapiens
uugcugaccucccagaaua

SEQ ID NO: 759124 - RNA, 19 nt, Homo sapiens
gaaaagggccauugagaaa

SEQ ID NO: 759125 - RNA, 19 nt, Homo sapiens
gcaccagugugggaaauga

SEQ ID NO: 759126 - RNA, 19 nt, Homo sapiens
gcaaacaacacuuggaaca

SEQ ID NO: 759127 - RNA, 19 nt, Homo sapiens
gcaugaagcuguucuuucc

SEQ ID NO: 759128 - RNA, 19 nt, Homo sapiens
aagagcaacuaaagcauaa

SEQ ID NO: 759129 - RNA, 19 nt, Homo sapiens
gaacuugugaagaucuuaa

SEQ ID NO: 759130 - RNA, 19 nt, Homo sapiens
gaacgacuuagcugaauau

SEQ ID NO: 759131 - RNA, 19 nt, Homo sapiens
uuaaugaccagucucaaua

SEQ ID NO: 759132 - RNA, 19 nt, Homo sapiens
gggaguacaugggaucaaa

SEQ ID NO: 759133 - RNA, 19 nt, Homo sapiens
aaaccaacauggagaagga

SEQ ID NO: 759134 - RNA, 19 nt, Homo sapiens
uaaagaaagagaugacuug

SEQ ID NO: 759135 - RNA, 19 nt, Homo sapiens
gcuaaaaucucaaagacaa

SEQ ID NO: 759136 - RNA, 19 nt, Homo sapiens
gaagaaaugaagaauugga

SEQ ID NO: 759137 - RNA, 19 nt, Homo sapiens
gcucaacucagucaagaaa

SEQ ID NO: 759138 - RNA, 19 nt, Homo sapiens
agaaggcgaugucacuauu

SEQ ID NO: 759139 - RNA, 19 nt, Homo sapiens
uuaaucaacuggaggaaau

SEQ ID NO: 759140 - RNA, 19 nt, Homo sapiens
ccggaaacaugcacaauuc

SEQ ID NO: 759141 - RNA, 19 nt, Homo sapiens
gcagagcuuuagcaaggaa

SEQ ID NO: 759142 - RNA, 19 nt, Homo sapiens
aaagggccauugagaaaga

SEQ ID NO: 759143 - RNA, 19 nt, Homo sapiens
gaaaguuacagagaagaaa

SEQ ID NO: 759144 - RNA, 19 nt, Homo sapiens
gagaauagaacuggaugaa

SEQ ID NO: 759145 - RNA, 19 nt, Homo sapiens
aaagguguguggagaaaug

SEQ ID NO: 759146 - RNA, 19 nt, Homo sapiens
guacaugggaucaaagaug

SEQ ID NO: 759147 - RNA, 19 nt, Homo sapiens
aaagagcaacuaaagcaua

SEQ ID NO: 759148 - RNA, 19 nt, Homo sapiens
gcagaagcauucaccaacu

SEQ ID NO: 759149 - RNA, 19 nt, Homo sapiens
gaccuuguucauacuauua

SEQ ID NO: 759150 - RNA, 19 nt, Homo sapiens
ccaacaagcagauaaggaa

SEQ ID NO: 759151 - RNA, 19 nt, Homo sapiens
ggaaaguuacagagaagaa

SEQ ID NO: 759152 - RNA, 19 nt, Homo sapiens
gaaagaaagggaguacaug

SEQ ID NO: 759153 - RNA, 19 nt, Homo sapiens
cgaaagacugguuaaagaa

SEQ ID NO: 759154 - RNA, 19 nt, Homo sapiens
uggagaagaugcaccaaau

SEQ ID NO: 759155 - RNA, 19 nt, Homo sapiens
agaacuggaugaaagcaaa

SEQ ID NO: 759156 - RNA, 19 nt, Homo sapiens
gcacuaguuuccguaagga

SEQ ID NO: 759157 - RNA, 19 nt, Homo sapiens
ccaaacccauacuaauguu

SEQ ID NO: 759158 - RNA, 19 nt, Homo sapiens
gaucugaaauagcucaacu

SEQ ID NO: 759159 - RNA, 19 nt, Homo sapiens
gggcgaaucugagcaccaa

SEQ ID NO: 759160 - RNA, 19 nt, Homo sapiens
ggaaacaugcacaauucuu

SEQ ID NO: 759161 - RNA, 19 nt, Homo sapiens
aaugaccagucucaauaua

SEQ ID NO: 759162 - RNA, 19 nt, Homo sapiens
gaaaccaauaugccuacua

SEQ ID NO: 759163 - RNA, 19 nt, Homo sapiens
cacagaagauacagcaaau

SEQ ID NO: 759164 - RNA, 19 nt, Homo sapiens
acaaagguguguggagaaa

SEQ ID NO: 759165 - RNA, 19 nt, Homo sapiens
cuugaugucugcacuaguu

SEQ ID NO: 759166 - RNA, 19 nt, Homo sapiens
ggaacaaacacuucuggau

SEQ ID NO: 759167 - RNA, 19 nt, Homo sapiens
ggcagagccugucggaaga

SEQ ID NO: 759168 - RNA, 19 nt, Homo sapiens
ggaaaagguuacaaaggaa

SEQ ID NO: 759169 - RNA, 19 nt, Homo sapiens
gaggaaaagugugaaauug

SEQ ID NO: 759170 - RNA, 19 nt, Homo sapiens
augcacaauucuuggauua

SEQ ID NO: 759171 - RNA, 19 nt, Homo sapiens
gagcaggagcugacacaga

SEQ ID NO: 759172 - RNA, 19 nt, Homo sapiens
ugacaugugcccugaaaga

SEQ ID NO: 759173 - RNA, 19 nt, Homo sapiens
uaucugaggaagccaauuu

SEQ ID NO: 759174 - RNA, 19 nt, Homo sapiens
aggagcagcuuggcagaua

SEQ ID NO: 759175 - RNA, 19 nt, Homo sapiens
gagaacuugugaagaucuu

SEQ ID NO: 759176 - RNA, 19 nt, Homo sapiens
gaggaacgacuuagcugaa

SEQ ID NO: 759177 - RNA, 19 nt, Homo sapiens
gcaccaaaucuuucuuuua

SEQ ID NO: 759178 - RNA, 19 nt, Homo sapiens
gaaacuggaacaaaucucu

SEQ ID NO: 759179 - RNA, 19 nt, Homo sapiens
cgaugucacuauuggagaa

SEQ ID NO: 759180 - RNA, 19 nt, Homo sapiens
caagaaacuggaacaaauc

SEQ ID NO: 759181 - RNA, 19 nt, Homo sapiens
agcaggagcugacacagaa

SEQ ID NO: 759182 - RNA, 19 nt, Homo sapiens
gaaauugagaauagaacug

SEQ ID NO: 759183 - RNA, 19 nt, Homo sapiens
acagagaguucagagcaaa

SEQ ID NO: 759184 - RNA, 19 nt, Homo sapiens
guggagaaaugcgcuauca

SEQ ID NO: 759185 - RNA, 19 nt, Homo sapiens
caacaagcagauaaggaaa

SEQ ID NO: 759186 - RNA, 19 nt, Homo sapiens
ugaaagcaaacaacacuug

SEQ ID NO: 759187 - RNA, 19 nt, Homo sapiens
ggaggaacucucuggaaug

SEQ ID NO: 759188 - RNA, 19 nt, Homo sapiens
gcacgaccuuguucauacu

SEQ ID NO: 759189 - RNA, 19 nt, Homo sapiens
guaucuccgucaagaagaa

SEQ ID NO: 759190 - RNA, 19 nt, Homo sapiens
ggaacaguguguccagcau

SEQ ID NO: 759191 - RNA, 19 nt, Homo sapiens
gaacaucaguuguaagaua

SEQ ID NO: 759192 - RNA, 19 nt, Homo sapiens
gcaguuguguccuuaaaua

SEQ ID NO: 759193 - RNA, 19 nt, Homo sapiens
gcaaauccauucucuuuua

SEQ ID NO: 759194 - RNA, 19 nt, Homo sapiens
gcaugaagcuccguguaua

SEQ ID NO: 759195 - RNA, 19 nt, Homo sapiens
agacacagaugacagauuu

SEQ ID NO: 759196 - RNA, 19 nt, Homo sapiens
cgaaauuccugcgaucuua

SEQ ID NO: 759197 - RNA, 19 nt, Homo sapiens
ggacggcgaugagcacuaa

SEQ ID NO: 759198 - RNA, 19 nt, Homo sapiens
gguauggccuggaguauca

SEQ ID NO: 759199 - RNA, 19 nt, Homo sapiens
ggacgcugcagauaaguua

SEQ ID NO: 759200 - RNA, 19 nt, Homo sapiens
ccgaaauccuuaaaucuau

SEQ ID NO: 759201 - RNA, 19 nt, Homo sapiens
gagaguuucugaagaccaa

SEQ ID NO: 759202 - RNA, 19 nt, Homo sapiens
gaugacagauuugaagauc

SEQ ID NO: 759203 - RNA, 19 nt, Homo sapiens
ucaggaauuucaaguaugu

SEQ ID NO: 759204 - RNA, 19 nt, Homo sapiens
gccgaaauccuuaaaucua

SEQ ID NO: 759205 - RNA, 19 nt, Homo sapiens
gaaccucggccucucgaaa

SEQ ID NO: 759206 - RNA, 19 nt, Homo sapiens
ggaagaggcaaauccauuc

SEQ ID NO: 759207 - RNA, 19 nt, Homo sapiens
ccaauugauagcuuucuua

SEQ ID NO: 759208 - RNA, 19 nt, Homo sapiens
cgaguugucucugugguuu

SEQ ID NO: 759209 - RNA, 19 nt, Homo sapiens
cagaauuuaugcaaaggaa

SEQ ID NO: 759210 - RNA, 19 nt, Homo sapiens
caccaccgcucgaucuaaa

SEQ ID NO: 759211 - RNA, 19 nt, Homo sapiens
gcugagacacugaaucuug

SEQ ID NO: 759212 - RNA, 19 nt, Homo sapiens
gagcggaaguuagaagcaa

SEQ ID NO: 759213 - RNA, 19 nt, Homo sapiens
cagcagaauuuaugcaaag

SEQ ID NO: 759214 - RNA, 19 nt, Homo sapiens
guacaaugcagguuagaau

SEQ ID NO: 759215 - RNA, 19 nt, Homo sapiens
cagaacaucaguuguaaga

SEQ ID NO: 759216 - RNA, 19 nt, Homo sapiens
gauccggccagcagaauuu

SEQ ID NO: 759217 - RNA, 19 nt, Homo sapiens
uaaaugugccucugagaug

SEQ ID NO: 759218 - RNA, 19 nt, Homo sapiens
guccuugauuucauaagua

SEQ ID NO: 759219 - RNA, 19 nt, Homo sapiens
gguuguccuugauuucaua

SEQ ID NO: 759220 - RNA, 19 nt, Homo sapiens
ccuuaaaucuauagacaga

SEQ ID NO: 759221 - RNA, 19 nt, Homo sapiens
guccagaugugccucuuug

SEQ ID NO: 759222 - RNA, 19 nt, Homo sapiens
gguggucccugcagucaug

SEQ ID NO: 759223 - RNA, 19 nt, Homo sapiens
guagaacaaacacuaaaug

SEQ ID NO: 759224 - RNA, 19 nt, Homo sapiens
gugcaguuguguccuuaaa

SEQ ID NO: 759225 - RNA, 19 nt, Homo sapiens
caaugcagguuagaauuca

SEQ ID NO: 759226 - RNA, 19 nt, Homo sapiens
gaaauuccugcgaucuuau

SEQ ID NO: 759227 - RNA, 19 nt, Homo sapiens
gagcugagacacugaaucu

SEQ ID NO: 759228 - RNA, 19 nt, Homo sapiens
cagcacauaccuuuccuuu

SEQ ID NO: 759229 - RNA, 19 nt, Homo sapiens
ccagcagaauuuaugcaaa

SEQ ID NO: 759230 - RNA, 19 nt, Homo sapiens
aggcaaauccauucucuuu

SEQ ID NO: 759231 - RNA, 19 nt, Homo sapiens
aaagagugguucuggaauc

SEQ ID NO: 759232 - RNA, 19 nt, Homo sapiens
ccuuaaauaugcagucuuc

SEQ ID NO: 759233 - RNA, 19 nt, Homo sapiens
cccagaacaucaguuguaa

SEQ ID NO: 759234 - RNA, 19 nt, Homo sapiens
gaaucuuguugccgaaauc

SEQ ID NO: 759235 - RNA, 19 nt, Homo sapiens
ugagaagaaagcugaauga

SEQ ID NO: 759236 - RNA, 19 nt, Homo sapiens
gugaagcuguccagaugug

SEQ ID NO: 759237 - RNA, 19 nt, Homo sapiens
uuagagaguuucugaagac

SEQ ID NO: 759238 - RNA, 19 nt, Homo sapiens
cugugaagcuguccagaug

SEQ ID NO: 759239 - RNA, 19 nt, Homo sapiens
ucccagaacaucaguugua

SEQ ID NO: 759240 - RNA, 19 nt, Homo sapiens
gaccaaacgggcuguaaag

SEQ ID NO: 759241 - RNA, 19 nt, Homo sapiens
cgaucuaaaugugcaguug

SEQ ID NO: 759242 - RNA, 19 nt, Homo sapiens
gggagacacagaugacaga

SEQ ID NO: 759243 - RNA, 19 nt, Homo sapiens
acgacgcacugaaagauga

SEQ ID NO: 759244 - RNA, 19 nt, Homo sapiens
gcgaaauuccugcgaucuu

SEQ ID NO: 759245 - RNA, 19 nt, Homo sapiens
caacuuccagcgagagaau

SEQ ID NO: 759246 - RNA, 19 nt, Homo sapiens
ugaccaaacgggcuguaaa

SEQ ID NO: 759247 - RNA, 19 nt, Homo sapiens
acacagaugacagauuuga

SEQ ID NO: 759248 - RNA, 19 nt, Homo sapiens
caaguggcauuuuguacaa

SEQ ID NO: 759249 - RNA, 19 nt, Homo sapiens
ggacguuucaaguggcauu

SEQ ID NO: 759250 - RNA, 19 nt, Homo sapiens
gauuugaagaucuggaaga

SEQ ID NO: 759251 - RNA, 19 nt, Homo sapiens
gagugguucuggaaucagu

SEQ ID NO: 759252 - RNA, 19 nt, Homo sapiens
gcagucuucacccagagua

SEQ ID NO: 759253 - RNA, 19 nt, Homo sapiens
uuaaagacgaggaggaaga

SEQ ID NO: 759254 - RNA, 19 nt, Homo sapiens
gagacacagaugacagauu

SEQ ID NO: 759255 - RNA, 19 nt, Homo sapiens
gaucuaaaugugcaguugu

SEQ ID NO: 759256 - RNA, 19 nt, Homo sapiens
gaagaggcaaauccauucu

SEQ ID NO: 759257 - RNA, 19 nt, Homo sapiens
cugagacacugaaucuugu

SEQ ID NO: 759258 - RNA, 19 nt, Homo sapiens
uuuagagaguuucugaaga

SEQ ID NO: 759259 - RNA, 19 nt, Homo sapiens
guucuuggccaccacaaug

SEQ ID NO: 759260 - RNA, 19 nt, Homo sapiens
gcggguauggccuggagua

SEQ ID NO: 759261 - RNA, 19 nt, Homo sapiens
gugcacaggcuuccaucaa

SEQ ID NO: 759262 - RNA, 19 nt, Homo sapiens
gcagaauuuaugcaaagga

SEQ ID NO: 759263 - RNA, 19 nt, Homo sapiens
aaauuccugcgaucuuaua

SEQ ID NO: 759264 - RNA, 19 nt, Homo sapiens
guuguguccuuaaauaugc

SEQ ID NO: 759265 - RNA, 19 nt, Homo sapiens
ugaaucuuguugccgaaau

SEQ ID NO: 759266 - RNA, 19 nt, Homo sapiens
ucaggucccaguugccuuu

SEQ ID NO: 759267 - RNA, 19 nt, Homo sapiens
acaaugcagguuagaauuc

SEQ ID NO: 759268 - RNA, 19 nt, Homo sapiens
acacuaaaugugccucuga

SEQ ID NO: 759269 - RNA, 19 nt, Homo sapiens
agaacaaacacuaaaugug

SEQ ID NO: 759270 - RNA, 19 nt, Homo sapiens
cagcaugaagcuccgugua

SEQ ID NO: 759271 - RNA, 19 nt, Homo sapiens
uaaguuacgacgcacugaa

SEQ ID NO: 759272 - RNA, 19 nt, Homo sapiens
cuaaaugugccucugagau

SEQ ID NO: 759273 - RNA, 19 nt, Homo sapiens
aagagugguucuggaauca

SEQ ID NO: 759274 - RNA, 19 nt, Homo sapiens
gaucgcaagaguccagugu

SEQ ID NO: 759275 - RNA, 19 nt, Homo sapiens
aggcgcaggucuccaacuu

SEQ ID NO: 759276 - RNA, 19 nt, Homo sapiens
ccucgugggcguugaguga

SEQ ID NO: 759277 - RNA, 19 nt, Homo sapiens
gaggauccggccagcagaa

SEQ ID NO: 759278 - RNA, 19 nt, Homo sapiens
cagaugacagauuugaaga

SEQ ID NO: 759279 - RNA, 19 nt, Homo sapiens
uacaaugcagguuagaauu

SEQ ID NO: 759280 - RNA, 19 nt, Homo sapiens
aauugguuguccuugauuu

SEQ ID NO: 759281 - RNA, 19 nt, Homo sapiens
uugccgaaauccuuaaauc

SEQ ID NO: 759282 - RNA, 19 nt, Homo sapiens
caucccagaacaucaguug

SEQ ID NO: 759283 - RNA, 19 nt, Homo sapiens
ccagucccaucccagaaca

SEQ ID NO: 759284 - RNA, 19 nt, Homo sapiens
uggaguaucagcagccauu

SEQ ID NO: 759285 - RNA, 19 nt, Homo sapiens
ggauccggccagcagaauu

SEQ ID NO: 759286 - RNA, 19 nt, Homo sapiens
gagaagaaagcugaaugag

SEQ ID NO: 759287 - RNA, 19 nt, Homo sapiens
ggucccaguugccuuucug

SEQ ID NO: 759288 - RNA, 19 nt, Homo sapiens
gcugugaagcuguccagau

SEQ ID NO: 759289 - RNA, 19 nt, Homo sapiens
gcucccgggucacucuugu

SEQ ID NO: 759290 - RNA, 19 nt, Homo sapiens
uguccuugauuucauaagu

SEQ ID NO: 759291 - RNA, 19 nt, Homo sapiens
ggaacaaacucaucucaaa

SEQ ID NO: 759292 - RNA, 19 nt, Homo sapiens
gacagaggcugcagcauua

SEQ ID NO: 759293 - RNA, 19 nt, Homo sapiens
gcacagaccuuccacugaa

SEQ ID NO: 759294 - RNA, 19 nt, Homo sapiens
ggagaagucuguuaaugaa

SEQ ID NO: 759295 - RNA, 19 nt, Homo sapiens
ccaaauggcccaaauauug

SEQ ID NO: 759296 - RNA, 19 nt, Homo sapiens
gaugagaaauacaaccaua

SEQ ID NO: 759297 - RNA, 19 nt, Homo sapiens
caagagggcugugauuaaa

SEQ ID NO: 759298 - RNA, 19 nt, Homo sapiens
ggaagaagauuuagaagac

SEQ ID NO: 759299 - RNA, 19 nt, Homo sapiens
gaacaggucacaauuugaa

SEQ ID NO: 759300 - RNA, 19 nt, Homo sapiens
gcaaaucacucaugcaaac

SEQ ID NO: 759301 - RNA, 19 nt, Homo sapiens
gcuuaagucuguagucuuu

SEQ ID NO: 759302 - RNA, 19 nt, Homo sapiens
ggacagaggcugcagcauu

SEQ ID NO: 759303 - RNA, 19 nt, Homo sapiens
ggaccaagcuaaacaagca

SEQ ID NO: 759304 - RNA, 19 nt, Homo sapiens
gaaacugacuuuugucuuu

SEQ ID NO: 759305 - RNA, 19 nt, Homo sapiens
aaauaaagguggugaaugu

SEQ ID NO: 759306 - RNA, 19 nt, Homo sapiens
caauaucucugaucuggaa

SEQ ID NO: 759307 - RNA, 19 nt, Homo sapiens
caaugcagaugaagcagua

SEQ ID NO: 759308 - RNA, 19 nt, Homo sapiens
guacaugggugaagaacau

SEQ ID NO: 759309 - RNA, 19 nt, Homo sapiens
gaaccaugauucagaagau

SEQ ID NO: 759310 - RNA, 19 nt, Homo sapiens
gauauuagcacaacacuca

SEQ ID NO: 759311 - RNA, 19 nt, Homo sapiens
caagauagcagcugacuuc

SEQ ID NO: 759312 - RNA, 19 nt, Homo sapiens
aagcauauguugacaaguu

SEQ ID NO: 759313 - RNA, 19 nt, Homo sapiens
caugacagcuguugcuuug

SEQ ID NO: 759314 - RNA, 19 nt, Homo sapiens
gugauggaauggaugaaua

SEQ ID NO: 759315 - RNA, 19 nt, Homo sapiens
aaacucaucucaaaguaga

SEQ ID NO: 759316 - RNA, 19 nt, Homo sapiens
ugacuaagcugaaggaaac

SEQ ID NO: 759317 - RNA, 19 nt, Homo sapiens
caaacaauacggugucuaa

SEQ ID NO: 759318 - RNA, 19 nt, Homo sapiens
uaacacaaccgaaaccaaa

SEQ ID NO: 759319 - RNA, 19 nt, Homo sapiens
caugaagucuuuagucgaa

SEQ ID NO: 759320 - RNA, 19 nt, Homo sapiens
uaaagguggugaauguuga

SEQ ID NO: 759321 - RNA, 19 nt, Homo sapiens
gaacagcuuuugauccuuu

SEQ ID NO: 759322 - RNA, 19 nt, Homo sapiens
uggaauggaugaauaaugu

SEQ ID NO: 759323 - RNA, 19 nt, Homo sapiens
ugacaaguuggaagaauua

SEQ ID NO: 759324 - RNA, 19 nt, Homo sapiens
agaaaggaaugaugcuaaa

SEQ ID NO: 759325 - RNA, 19 nt, Homo sapiens
ugacagcuguugcuuugaa

SEQ ID NO: 759326 - RNA, 19 nt, Homo sapiens
gaagaacaucuauuuagug

SEQ ID NO: 759327 - RNA, 19 nt, Homo sapiens
caaauggcccaaauauuga

SEQ ID NO: 759328 - RNA, 19 nt, Homo sapiens
gaagaacucugugcugaac

SEQ ID NO: 759329 - RNA, 19 nt, Homo sapiens
gaugaacaggucacaauuu

SEQ ID NO: 759330 - RNA, 19 nt, Homo sapiens
guuagaugcugcacagauu

SEQ ID NO: 759331 - RNA, 19 nt, Homo sapiens
aaaugucgauccuguugua

SEQ ID NO: 759332 - RNA, 19 nt, Homo sapiens
ugaauaaugucaugaaugc

SEQ ID NO: 759333 - RNA, 19 nt, Homo sapiens
ugaugagucugaaaugaaa

SEQ ID NO: 759334 - RNA, 19 nt, Homo sapiens
gaauaucgaaugcuuuaug

SEQ ID NO: 759335 - RNA, 19 nt, Homo sapiens
ggaguuggaauaaagguaa

SEQ ID NO: 759336 - RNA, 19 nt, Homo sapiens
gaagaagauuuagaagaca

SEQ ID NO: 759337 - RNA, 19 nt, Homo sapiens
uuaaugaagugauggaaug

SEQ ID NO: 759338 - RNA, 19 nt, Homo sapiens
guaagaugauaaugcaaga

SEQ ID NO: 759339 - RNA, 19 nt, Homo sapiens
caacugaggagaaugaaau

SEQ ID NO: 759340 - RNA, 19 nt, Homo sapiens
gaaaccaugcugcuccuuu

SEQ ID NO: 759341 - RNA, 19 nt, Homo sapiens
acaauacggugucuaacuu

SEQ ID NO: 759342 - RNA, 19 nt, Homo sapiens
ggguguggauguuuauaaa

SEQ ID NO: 759343 - RNA, 19 nt, Homo sapiens
gacagaggguaagaugaua

SEQ ID NO: 759344 - RNA, 19 nt, Homo sapiens
ugagaaaccucggauagug

SEQ ID NO: 759345 - RNA, 19 nt, Homo sapiens
ggugaagaacaucuauuua

SEQ ID NO: 759346 - RNA, 19 nt, Homo sapiens
ucaagagggcugugauuaa

SEQ ID NO: 759347 - RNA, 19 nt, Homo sapiens
gaagugauggaauggauga

SEQ ID NO: 759348 - RNA, 19 nt, Homo sapiens
acaaacucaucucaaagua

SEQ ID NO: 759349 - RNA, 19 nt, Homo sapiens
gaacaaacucaucucaaag

SEQ ID NO: 759350 - RNA, 19 nt, Homo sapiens
gugaaaguguggaauggaa

SEQ ID NO: 759351 - RNA, 19 nt, Homo sapiens
gaaggaaacugcugaaaac

SEQ ID NO: 759352 - RNA, 19 nt, Homo sapiens
ucgaaugcuuuaugaauga

SEQ ID NO: 759353 - RNA, 19 nt, Homo sapiens
caagaaaccaguaacagau

SEQ ID NO: 759354 - RNA, 19 nt, Homo sapiens
aaacuguacuguuguucaa

SEQ ID NO: 759355 - RNA, 19 nt, Homo sapiens
caaguuggaagaauuaaug

SEQ ID NO: 759356 - RNA, 19 nt, Homo sapiens
aggaauauguguaugaguu

SEQ ID NO: 759357 - RNA, 19 nt, Homo sapiens
ucacugaggaugaaacuga

SEQ ID NO: 759358 - RNA, 19 nt, Homo sapiens
aaucagagaccaccagaaa

SEQ ID NO: 759359 - RNA, 19 nt, Homo sapiens
caaaguagaagaugugagu

SEQ ID NO: 759360 - RNA, 19 nt, Homo sapiens
cagcuguugcuuugaauua

SEQ ID NO: 759361 - RNA, 19 nt, Homo sapiens
gggugaagaacaucuauuu

SEQ ID NO: 759362 - RNA, 19 nt, Homo sapiens
cgauuugguuccauugaaa

SEQ ID NO: 759363 - RNA, 19 nt, Homo sapiens
gaaggaaagaauugccaaa

SEQ ID NO: 759364 - RNA, 19 nt, Homo sapiens
caagcuguguggaccauau

SEQ ID NO: 759365 - RNA, 19 nt, Homo sapiens
uggagaaagucccaacuga

SEQ ID NO: 759366 - RNA, 19 nt, Homo sapiens
gaagcuuucuauucugauc

SEQ ID NO: 759367 - RNA, 19 nt, Homo sapiens
gaugagaaaccucggauag

SEQ ID NO: 759368 - RNA, 19 nt, Homo sapiens
gaauguuacccuaaugaga

SEQ ID NO: 759369 - RNA, 19 nt, Homo sapiens
gcacagaaagauggagaaa

SEQ ID NO: 759370 - RNA, 19 nt, Homo sapiens
ucacagaugcaguuccuuu

SEQ ID NO: 759371 - RNA, 19 nt, Homo sapiens
ucaagaaaccaguaacaga

SEQ ID NO: 759372 - RNA, 19 nt, Homo sapiens
gugaagaacaucuauuuag

SEQ ID NO: 759373 - RNA, 19 nt, Homo sapiens
ggaauaaagguaauguaca

SEQ ID NO: 759374 - RNA, 19 nt, Homo sapiens
gaccaucgccaaugaguuc

SEQ ID NO: 759375 - RNA, 19 nt, Homo sapiens
guggagaagucuguuaaug

SEQ ID NO: 759376 - RNA, 19 nt, Homo sapiens
aagacuggcuguaugaaga

SEQ ID NO: 759377 - RNA, 19 nt, Homo sapiens
aaaaugcaguugaggaaua

SEQ ID NO: 759378 - RNA, 19 nt, Homo sapiens
gcacagauuguuggccuaa

SEQ ID NO: 759379 - RNA, 19 nt, Homo sapiens
gaaaguguggaauggaaga

SEQ ID NO: 759380 - RNA, 19 nt, Homo sapiens
ggaugaaacugacuuuugu

SEQ ID NO: 759381 - RNA, 19 nt, Homo sapiens
cuugguaacuuucagauuc

SEQ ID NO: 759382 - RNA, 19 nt, Homo sapiens
aaauugccuugguaacuuu

SEQ ID NO: 759383 - RNA, 19 nt, Homo sapiens
cuagauaaccuuaaauugg

SEQ ID NO: 759384 - RNA, 19 nt, Homo sapiens
gaauauguguaugaguuca

SEQ ID NO: 759385 - RNA, 19 nt, Homo sapiens
uggacuagauaaccuuaaa

SEQ ID NO: 759386 - RNA, 19 nt, Homo sapiens
ggaauugaacaacacaugu

SEQ ID NO: 759387 - RNA, 19 nt, Homo sapiens
gaagucuguuaaugaagug

SEQ ID NO: 759388 - RNA, 19 nt, Homo sapiens
acauguauauugagacaga

SEQ ID NO: 759389 - RNA, 19 nt, Homo sapiens
gaaaagauauuagcacaac

SEQ ID NO: 759390 - RNA, 19 nt, Homo sapiens
cugaauaucgaaugcuuua

SEQ ID NO: 759391 - RNA, 19 nt, Homo sapiens
gaauaaaucuucucaguuc

SEQ ID NO: 759392 - RNA, 19 nt, Homo sapiens
ccaaguggguggugaauaa

SEQ ID NO: 759393 - RNA, 19 nt, Homo sapiens
ggaagacccugcuguguug

SEQ ID NO: 759394 - RNA, 19 nt, Homo sapiens
ggagaauucuggaggaaga

SEQ ID NO: 759395 - RNA, 19 nt, Homo sapiens
gcuggaaccugaccuauag

SEQ ID NO: 759396 - RNA, 19 nt, Homo sapiens
guacagacccugcuucuca

SEQ ID NO: 759397 - RNA, 19 nt, Homo sapiens
gcaacgucauugagacuuu

SEQ ID NO: 759398 - RNA, 19 nt, Homo sapiens
ggauacaggcuuagauuga

SEQ ID NO: 759399 - RNA, 19 nt, Homo sapiens
gugaauaaaucuucucagu

SEQ ID NO: 759400 - RNA, 19 nt, Homo sapiens
ccaagaagcugaggaggau

SEQ ID NO: 759401 - RNA, 19 nt, Homo sapiens
gaacuacucagucaaacau

SEQ ID NO: 759402 - RNA, 19 nt, Homo sapiens
gcaccugccucacuucaag

SEQ ID NO: 759403 - RNA, 19 nt, Homo sapiens
agcaagagcuaaagccuaa

SEQ ID NO: 759404 - RNA, 19 nt, Homo sapiens
ccaaggccaugaagaagau

SEQ ID NO: 759405 - RNA, 19 nt, Homo sapiens
gaguguugcuggagcugua

SEQ ID NO: 759406 - RNA, 19 nt, Homo sapiens
aggaggaucuggagaauuc

SEQ ID NO: 759407 - RNA, 19 nt, Homo sapiens
gaacccauuuccucauucu

SEQ ID NO: 759408 - RNA, 19 nt, Homo sapiens
ccaggaagguggcgucaca

SEQ ID NO: 759409 - RNA, 19 nt, Homo sapiens
caggagagccggacuagga

SEQ ID NO: 759410 - RNA, 19 nt, Homo sapiens
caaauacccaccucggaaa

SEQ ID NO: 759411 - RNA, 19 nt, Homo sapiens
caugggcgcugauuacauc

SEQ ID NO: 759412 - RNA, 19 nt, Homo sapiens
acgcugacgugggcuauua

SEQ ID NO: 759413 - RNA, 19 nt, Homo sapiens
gaucggacgcugcacaaga

SEQ ID NO: 759414 - RNA, 19 nt, Homo sapiens
cccaagagcugcgucauca

SEQ ID NO: 759415 - RNA, 19 nt, Homo sapiens
agucaaacaucccaaauac

SEQ ID NO: 759416 - RNA, 19 nt, Homo sapiens
agaagcaccugccucacuu

SEQ ID NO: 759417 - RNA, 19 nt, Homo sapiens
gaagguggcgucacaucug

SEQ ID NO: 759418 - RNA, 19 nt, Homo sapiens
gacauugaguaccgcaaga

SEQ ID NO: 759419 - RNA, 19 nt, Homo sapiens
gcuggagccuuccuuguac

SEQ ID NO: 759420 - RNA, 19 nt, Homo sapiens
cagucaaacaucccaaaua

SEQ ID NO: 759421 - RNA, 19 nt, Homo sapiens
ggacagcaacgucauugag

SEQ ID NO: 759422 - RNA, 19 nt, Homo sapiens
gcaagaaaugggacagcaa

SEQ ID NO: 759423 - RNA, 19 nt, Homo sapiens
ucagugucuuuguuggaua

SEQ ID NO: 759424 - RNA, 19 nt, Homo sapiens
gcugugagcaagagcuaaa

SEQ ID NO: 759425 - RNA, 19 nt, Homo sapiens
uaugaacuacucagucaaa

SEQ ID NO: 759426 - RNA, 19 nt, Homo sapiens
gacagcaacgucauugaga

SEQ ID NO: 759427 - RNA, 19 nt, Homo sapiens
gccuaauccuccugccuuu

SEQ ID NO: 759428 - RNA, 19 nt, Homo sapiens
gauacaggcuuagauugac

SEQ ID NO: 759429 - RNA, 19 nt, Homo sapiens
uuuguuggauacaggcuua

SEQ ID NO: 759430 - RNA, 19 nt, Homo sapiens
ccaugaagaagauguacaa

SEQ ID NO: 759431 - RNA, 19 nt, Homo sapiens
ggcuggaaccugaccuaua

SEQ ID NO: 759432 - RNA, 19 nt, Homo sapiens
auuaugaacuacucaguca

SEQ ID NO: 759433 - RNA, 19 nt, Homo sapiens
cggauggagugcugugaug

SEQ ID NO: 759434 - RNA, 19 nt, Homo sapiens
ggugcaggcuguggagaug

SEQ ID NO: 759435 - RNA, 19 nt, Homo sapiens
ugaggaggaucuggagaau

SEQ ID NO: 759436 - RNA, 19 nt, Homo sapiens
ggacgcugcacaagaucaa

SEQ ID NO: 759437 - RNA, 19 nt, Homo sapiens
gcccgaugaccaagacuuu

SEQ ID NO: 759438 - RNA, 19 nt, Homo sapiens
ggaagguggcgucacaucu

SEQ ID NO: 759439 - RNA, 19 nt, Homo sapiens
ggaggaagaggagaguguu

SEQ ID NO: 759440 - RNA, 19 nt, Homo sapiens
gaggaagacccugcugugu

SEQ ID NO: 759441 - RNA, 19 nt, Homo sapiens
guucccaauucuucuccua

SEQ ID NO: 759442 - RNA, 19 nt, Homo sapiens
caagagcuaaagccuaauc

SEQ ID NO: 759443 - RNA, 19 nt, Homo sapiens
aggcuuagauugacugacu

SEQ ID NO: 759444 - RNA, 19 nt, Homo sapiens
gaggaagaggagaguguug

SEQ ID NO: 759445 - RNA, 19 nt, Homo sapiens
agagcugcgucaucaccua

SEQ ID NO: 759446 - RNA, 19 nt, Homo sapiens
gagucccuguucccaauuc

SEQ ID NO: 759447 - RNA, 19 nt, Homo sapiens
cggacucacuggagaacau

SEQ ID NO: 759448 - RNA, 19 nt, Homo sapiens
ccaggugcccgaugaccaa

SEQ ID NO: 759449 - RNA, 19 nt, Homo sapiens
gaggaggaucuggagaauu

SEQ ID NO: 759450 - RNA, 19 nt, Homo sapiens
aggaagacccugcuguguu

SEQ ID NO: 759451 - RNA, 19 nt, Homo sapiens
caaguggguggugaauaaa

SEQ ID NO: 759452 - RNA, 19 nt, Homo sapiens
gauggagugcugugaugug

SEQ ID NO: 759453 - RNA, 19 nt, Homo sapiens
ggucagugucuuuguugga

SEQ ID NO: 759454 - RNA, 19 nt, Homo sapiens
caacgucauugagacuuuu

SEQ ID NO: 759455 - RNA, 19 nt, Homo sapiens
uugaguaccgcaagaaaug

SEQ ID NO: 759456 - RNA, 19 nt, Homo sapiens
gacacucuacgacguccua

SEQ ID NO: 759457 - RNA, 19 nt, Homo sapiens
gguggugaauaaaucuucu

SEQ ID NO: 759458 - RNA, 19 nt, Homo sapiens
ugaagaaccgugaugucau

SEQ ID NO: 759459 - RNA, 19 nt, Homo sapiens
cugaagaaccgugauguca

SEQ ID NO: 759460 - RNA, 19 nt, Homo sapiens
gcaaaccugagggcccaaa

SEQ ID NO: 759461 - RNA, 19 nt, Homo sapiens
gucagugucuuuguuggau

SEQ ID NO: 759462 - RNA, 19 nt, Homo sapiens
cgacguccuacacgacauu

SEQ ID NO: 759463 - RNA, 19 nt, Homo sapiens
aggcugaggugggcuggaa

SEQ ID NO: 759464 - RNA, 19 nt, Homo sapiens
guguccaggugcccgauga

SEQ ID NO: 759465 - RNA, 19 nt, Homo sapiens
cagaagcaccugccucacu

SEQ ID NO: 759466 - RNA, 19 nt, Homo sapiens
gacugacuguacccugaga

SEQ ID NO: 759467 - RNA, 19 nt, Homo sapiens
ccagacgggcuaccucauc

SEQ ID NO: 759468 - RNA, 19 nt, Homo sapiens
ggagucccuguucccaauu

SEQ ID NO: 759469 - RNA, 19 nt, Homo sapiens
gcacaugccugucaaauau

SEQ ID NO: 759470 - RNA, 19 nt, Homo sapiens
uaaauugucccucguauua

SEQ ID NO: 759471 - RNA, 19 nt, Homo sapiens
ccacuaggcugucacuaua

SEQ ID NO: 759472 - RNA, 19 nt, Homo sapiens
caaacaugcugaagacaua

SEQ ID NO: 759473 - RNA, 19 nt, Homo sapiens
cauaguaucugucaucuug

SEQ ID NO: 759474 - RNA, 19 nt, Homo sapiens
caucggacguuacggauua

SEQ ID NO: 759475 - RNA, 19 nt, Homo sapiens
gcuaacaacuucuacauca

SEQ ID NO: 759476 - RNA, 19 nt, Homo sapiens
gcacauggcccucaacaga

SEQ ID NO: 759477 - RNA, 19 nt, Homo sapiens
gcacaaggcaagugaguuu

SEQ ID NO: 759478 - RNA, 19 nt, Homo sapiens
gaugaaagauaacuguguu

SEQ ID NO: 759479 - RNA, 19 nt, Homo sapiens
gaaaaugacugaaauccaa

SEQ ID NO: 759480 - RNA, 19 nt, Homo sapiens
agaagaaucuggagcuaaa

SEQ ID NO: 759481 - RNA, 19 nt, Homo sapiens
uaaaggauguguuucugaa

SEQ ID NO: 759482 - RNA, 19 nt, Homo sapiens
gaauguaucagccagagua

SEQ ID NO: 759483 - RNA, 19 nt, Homo sapiens
gcuccaggcuuugauuaua

SEQ ID NO: 759484 - RNA, 19 nt, Homo sapiens
ucaguuauguugagaagaa

SEQ ID NO: 759485 - RNA, 19 nt, Homo sapiens
caacagagagcacuuuaga

SEQ ID NO: 759486 - RNA, 19 nt, Homo sapiens
caguuuggguuuacucuua

SEQ ID NO: 759487 - RNA, 19 nt, Homo sapiens
ccaaguggcuagguuguaa

SEQ ID NO: 759488 - RNA, 19 nt, Homo sapiens
uuacuugucuuucuuguug

SEQ ID NO: 759489 - RNA, 19 nt, Homo sapiens
guaaaugccuguugauggu

SEQ ID NO: 759490 - RNA, 19 nt, Homo sapiens
gauauuguuucaccgcuuu

SEQ ID NO: 759491 - RNA, 19 nt, Homo sapiens
agacauauuuggugaguug

SEQ ID NO: 759492 - RNA, 19 nt, Homo sapiens
gugguuaguuacucaguua

SEQ ID NO: 759493 - RNA, 19 nt, Homo sapiens
caacaguaaugaaagugaa

SEQ ID NO: 759494 - RNA, 19 nt, Homo sapiens
gggaaagguucaacaaaca

SEQ ID NO: 759495 - RNA, 19 nt, Homo sapiens
auacugauccuuccuauuu

SEQ ID NO: 759496 - RNA, 19 nt, Homo sapiens
cugaugcucugcugaauaa

SEQ ID NO: 759497 - RNA, 19 nt, Homo sapiens
ucacaugcaucggacguua

SEQ ID NO: 759498 - RNA, 19 nt, Homo sapiens
caaagaacagcauuccuaa

SEQ ID NO: 759499 - RNA, 19 nt, Homo sapiens
gaagacauauuuggugagu

SEQ ID NO: 759500 - RNA, 19 nt, Homo sapiens
ucaaagaacagcauuccua

SEQ ID NO: 759501 - RNA, 19 nt, Homo sapiens
gggaagggaugggaagauu

SEQ ID NO: 759502 - RNA, 19 nt, Homo sapiens
aaggauguguuucugaaua

SEQ ID NO: 759503 - RNA, 19 nt, Homo sapiens
cagcgcagauaauugagua

SEQ ID NO: 759504 - RNA, 19 nt, Homo sapiens
gaauguguaaccaauagua

SEQ ID NO: 759505 - RNA, 19 nt, Homo sapiens
caaaacaaauggagaagaa

SEQ ID NO: 759506 - RNA, 19 nt, Homo sapiens
gagaguauuuagugcaguu

SEQ ID NO: 759507 - RNA, 19 nt, Homo sapiens
gaagaaacauccaaaagca

SEQ ID NO: 759508 - RNA, 19 nt, Homo sapiens
gaacacagaagcuacuauc

SEQ ID NO: 759509 - RNA, 19 nt, Homo sapiens
gaaagauaacuguguugaa

SEQ ID NO: 759510 - RNA, 19 nt, Homo sapiens
gcaagugguuucaaagaac

SEQ ID NO: 759511 - RNA, 19 nt, Homo sapiens
agucaacgauuacaugauu

SEQ ID NO: 759512 - RNA, 19 nt, Homo sapiens
gaaugacagcuucuauauu

SEQ ID NO: 759513 - RNA, 19 nt, Homo sapiens
ccacuaaacauagcaaauu

SEQ ID NO: 759514 - RNA, 19 nt, Homo sapiens
cauagcaccuuuuguauaa

SEQ ID NO: 759515 - RNA, 19 nt, Homo sapiens
gggagcguguugaagauuu

SEQ ID NO: 759516 - RNA, 19 nt, Homo sapiens
gauacuaggucacaugcau

SEQ ID NO: 759517 - RNA, 19 nt, Homo sapiens
gggcugaaguucuauacug

SEQ ID NO: 759518 - RNA, 19 nt, Homo sapiens
gaacuugaauguguaacca

SEQ ID NO: 759519 - RNA, 19 nt, Homo sapiens
ccagcgaacuugaaugugu

SEQ ID NO: 759520 - RNA, 19 nt, Homo sapiens
auacagagaugacaagaag

SEQ ID NO: 759521 - RNA, 19 nt, Homo sapiens
uaaugaggcuaacaacuuc

SEQ ID NO: 759522 - RNA, 19 nt, Homo sapiens
gaaccaugccuuuagugaa

SEQ ID NO: 759523 - RNA, 19 nt, Homo sapiens
guagcugaaucaacaaguu

SEQ ID NO: 759524 - RNA, 19 nt, Homo sapiens
ggagagaacacagaagcua

SEQ ID NO: 759525 - RNA, 19 nt, Homo sapiens
gaacgacugguccgacuga

SEQ ID NO: 759526 - RNA, 19 nt, Homo sapiens
cagcgaacuugaaugugua

SEQ ID NO: 759527 - RNA, 19 nt, Homo sapiens
ugacagcuauucaccuuuc

SEQ ID NO: 759528 - RNA, 19 nt, Homo sapiens
gcucaacaguaaugaaagu

SEQ ID NO: 759529 - RNA, 19 nt, Homo sapiens
uacauuggcgcuauucuua

SEQ ID NO: 759530 - RNA, 19 nt, Homo sapiens
aagcuuagguuuaggugaa

SEQ ID NO: 759531 - RNA, 19 nt, Homo sapiens
gcaagacuaaugacuaugu

SEQ ID NO: 759532 - RNA, 19 nt, Homo sapiens
ugaacauccugacaccaua

SEQ ID NO: 759533 - RNA, 19 nt, Homo sapiens
gauaagccaccgccucuga

SEQ ID NO: 759534 - RNA, 19 nt, Homo sapiens
ugguaaugcuucuuuguuu

SEQ ID NO: 759535 - RNA, 19 nt, Homo sapiens
cagggagaauccaguguuu

SEQ ID NO: 759536 - RNA, 19 nt, Homo sapiens
gguuuacucuuacugauca

SEQ ID NO: 759537 - RNA, 19 nt, Homo sapiens
cauauuuggugaguuguuu

SEQ ID NO: 759538 - RNA, 19 nt, Homo sapiens
ugauugcuguuaacuacua

SEQ ID NO: 759539 - RNA, 19 nt, Homo sapiens
gcacauuucauuucuccaa

SEQ ID NO: 759540 - RNA, 19 nt, Homo sapiens
gcagucauguagaucugaa

SEQ ID NO: 759541 - RNA, 19 nt, Homo sapiens
uauccauugugguuaguua

SEQ ID NO: 759542 - RNA, 19 nt, Homo sapiens
aaagauaacuguguugaac

SEQ ID NO: 759543 - RNA, 19 nt, Homo sapiens
ccacgucuguuuuaguuua

SEQ ID NO: 759544 - RNA, 19 nt, Homo sapiens
gaagcugccugguguuagg

SEQ ID NO: 759545 - RNA, 19 nt, Homo sapiens
ggucccgggucuucucuuu

SEQ ID NO: 759546 - RNA, 19 nt, Homo sapiens
gagaagaaucuggagcuaa

SEQ ID NO: 759547 - RNA, 19 nt, Homo sapiens
acagagagcacuuuagaug

SEQ ID NO: 759548 - RNA, 19 nt, Homo sapiens
caauauaacucugcagacu

SEQ ID NO: 759549 - RNA, 19 nt, Homo sapiens
cacuaaacauagcaaauug

SEQ ID NO: 759550 - RNA, 19 nt, Homo sapiens
cgucagcccucuccagaug

SEQ ID NO: 759551 - RNA, 19 nt, Homo sapiens
aggaugggcugaaguucua

SEQ ID NO: 759552 - RNA, 19 nt, Homo sapiens
gaacagcauuccuaauccu

SEQ ID NO: 759553 - RNA, 19 nt, Homo sapiens
uacaggauaucaacaugaa

SEQ ID NO: 759554 - RNA, 19 nt, Homo sapiens
gauuauagauacgacuuca

SEQ ID NO: 759555 - RNA, 19 nt, Homo sapiens
cacuuuagauggcaccuuu

SEQ ID NO: 759556 - RNA, 19 nt, Homo sapiens
ggaugacacucaagauacu

SEQ ID NO: 759557 - RNA, 19 nt, Homo sapiens
uucagcagcucaacaguaa

SEQ ID NO: 759558 - RNA, 19 nt, Homo sapiens
cgccaggaguggaauauga

SEQ ID NO: 759559 - RNA, 19 nt, Homo sapiens
uaacaacuucuacaucaga

SEQ ID NO: 759560 - RNA, 19 nt, Homo sapiens
aaguagauauugacagcua

SEQ ID NO: 759561 - RNA, 19 nt, Homo sapiens
ugagugagccgcaggaguu

SEQ ID NO: 759562 - RNA, 19 nt, Homo sapiens
gagggaaagguucaacaaa

SEQ ID NO: 759563 - RNA, 19 nt, Homo sapiens
auauaacucugcagacuug

SEQ ID NO: 759564 - RNA, 19 nt, Homo sapiens
gugauucccucagcacaaa

SEQ ID NO: 759565 - RNA, 19 nt, Homo sapiens
gauggcauaugacaaagag

SEQ ID NO: 759566 - RNA, 19 nt, Homo sapiens
gauccuuccuauuucuuug

SEQ ID NO: 759567 - RNA, 19 nt, Homo sapiens
ggcugaaguucuauacuga

SEQ ID NO: 759568 - RNA, 19 nt, Homo sapiens
caagaaggaugggcugaag

SEQ ID NO: 759569 - RNA, 19 nt, Homo sapiens
gcucgaggaugcugacaua

SEQ ID NO: 759570 - RNA, 19 nt, Homo sapiens
ggaguaugcuaggcuauga

SEQ ID NO: 759571 - RNA, 19 nt, Homo sapiens
agaaggagcugcagagucu

SEQ ID NO: 759572 - RNA, 19 nt, Homo sapiens
ucaagagccuggacgagaa

SEQ ID NO: 759573 - RNA, 19 nt, Homo sapiens
cgaggaugcugacauaaag

SEQ ID NO: 759574 - RNA, 19 nt, Homo sapiens
gggagaagcaccugaagga

SEQ ID NO: 759575 - RNA, 19 nt, Homo sapiens
agaagcaccugaaggagau

SEQ ID NO: 759576 - RNA, 19 nt, Homo sapiens
ccaagacugugggccguuu

SEQ ID NO: 759577 - RNA, 19 nt, Homo sapiens
gcuaggcuaugacagagau

SEQ ID NO: 759578 - RNA, 19 nt, Homo sapiens
ggcacguccucgucaauga

SEQ ID NO: 759579 - RNA, 19 nt, Homo sapiens
ggagaucgaagcucuguac

SEQ ID NO: 759580 - RNA, 19 nt, Homo sapiens
ggucguggccuccaacaca

SEQ ID NO: 759581 - RNA, 19 nt, Homo sapiens
ggauguaccugcuuuugug

SEQ ID NO: 759582 - RNA, 19 nt, Homo sapiens
caggcaagcugcuaaaucc

SEQ ID NO: 759583 - RNA, 19 nt, Homo sapiens
guggacagcaccaucaaga

SEQ ID NO: 759584 - RNA, 19 nt, Homo sapiens
ucgaggaugcugacauaaa

SEQ ID NO: 759585 - RNA, 19 nt, Homo sapiens
gcagaagcaggagaucgaa

SEQ ID NO: 759586 - RNA, 19 nt, Homo sapiens
guccagaucaccaggaugu

SEQ ID NO: 759587 - RNA, 19 nt, Homo sapiens
gcaugaagguccccacgau

SEQ ID NO: 759588 - RNA, 19 nt, Homo sapiens
ucaaggucguggccuccaa

SEQ ID NO: 759589 - RNA, 19 nt, Homo sapiens
gaggaugcugacauaaaga

SEQ ID NO: 759590 - RNA, 19 nt, Homo sapiens
agcgugaccuccuuccauu

SEQ ID NO: 759591 - RNA, 19 nt, Homo sapiens
uaugcuaggcuaugacaga

SEQ ID NO: 759592 - RNA, 19 nt, Homo sapiens
ccagcagggugggcaugaa

SEQ ID NO: 759593 - RNA, 19 nt, Homo sapiens
gcucaccagccaagacugu

SEQ ID NO: 759594 - RNA, 19 nt, Homo sapiens
acgagaagcugcggacucu

SEQ ID NO: 759595 - RNA, 19 nt, Homo sapiens
augcugacauaaagaagga

SEQ ID NO: 759596 - RNA, 19 nt, Homo sapiens
cuacaucagcagcgacaau

SEQ ID NO: 759597 - RNA, 19 nt, Homo sapiens
ccagaucaccaggauguca

SEQ ID NO: 759598 - RNA, 19 nt, Homo sapiens
gggcacguccucgucaaug

SEQ ID NO: 759599 - RNA, 19 nt, Homo sapiens
gaagcuggcugcugaaaug

SEQ ID NO: 759600 - RNA, 19 nt, Homo sapiens
ggaguuaccucugaacaaa

SEQ ID NO: 759601 - RNA, 19 nt, Homo sapiens
acaaagaacugacacagaa

SEQ ID NO: 759602 - RNA, 19 nt, Homo sapiens
uagaggagcuggaagauga

SEQ ID NO: 759603 - RNA, 19 nt, Homo sapiens
ggacaaugauggagagaga

SEQ ID NO: 759604 - RNA, 19 nt, Homo sapiens
ggaaaugggccaagucaaa

SEQ ID NO: 759605 - RNA, 19 nt, Homo sapiens
gaacaguugucuaagaaca

SEQ ID NO: 759606 - RNA, 19 nt, Homo sapiens
gaacaaagaagagauugaa

SEQ ID NO: 759607 - RNA, 19 nt, Homo sapiens
gaaaggaaaggccaagaaa

SEQ ID NO: 759608 - RNA, 19 nt, Homo sapiens
gcacaaguccucuccaaau

SEQ ID NO: 759609 - RNA, 19 nt, Homo sapiens
agacgccgguuucucauua

SEQ ID NO: 759610 - RNA, 19 nt, Homo sapiens
gaaagaauaggcggaaauu

SEQ ID NO: 759611 - RNA, 19 nt, Homo sapiens
gaagaggagagaaaccaua

SEQ ID NO: 759612 - RNA, 19 nt, Homo sapiens
ugaaugaagugcagaugaa

SEQ ID NO: 759613 - RNA, 19 nt, Homo sapiens
gagcagcugcggaagguua

SEQ ID NO: 759614 - RNA, 19 nt, Homo sapiens
ggagagagaaagcaucaaa

SEQ ID NO: 759615 - RNA, 19 nt, Homo sapiens
gugcuuccauauccauuua

SEQ ID NO: 759616 - RNA, 19 nt, Homo sapiens
gccaggaggugcugucuga

SEQ ID NO: 759617 - RNA, 19 nt, Homo sapiens
gcaacugaguagagucaaa

SEQ ID NO: 759618 - RNA, 19 nt, Homo sapiens
aggaagaacuagcggauuu

SEQ ID NO: 759619 - RNA, 19 nt, Homo sapiens
ucucagaaauugaaggaaa

SEQ ID NO: 759620 - RNA, 19 nt, Homo sapiens
gcaauuauggccaaauaug

SEQ ID NO: 759621 - RNA, 19 nt, Homo sapiens
gaaagaggagccagccauu

SEQ ID NO: 759622 - RNA, 19 nt, Homo sapiens
gaacggauccacagagaag

SEQ ID NO: 759623 - RNA, 19 nt, Homo sapiens
gagaaguagcauucaauaa

SEQ ID NO: 759624 - RNA, 19 nt, Homo sapiens
caaagaagacaguggaguu

SEQ ID NO: 759625 - RNA, 19 nt, Homo sapiens
ugaguagagucaaaucaaa

SEQ ID NO: 759626 - RNA, 19 nt, Homo sapiens
caggaacaguugucuaaga

SEQ ID NO: 759627 - RNA, 19 nt, Homo sapiens
ccagaaugauggaaagaau

SEQ ID NO: 759628 - RNA, 19 nt, Homo sapiens
ccacagagaaguagcauuc

SEQ ID NO: 759629 - RNA, 19 nt, Homo sapiens
uaauccagcugcagcacua

SEQ ID NO: 759630 - RNA, 19 nt, Homo sapiens
caaaugaucgaccuacaga

SEQ ID NO: 759631 - RNA, 19 nt, Homo sapiens
ggaaagaauaggcggaaau

SEQ ID NO: 759632 - RNA, 19 nt, Homo sapiens
aggcaauuauggccaaaua

SEQ ID NO: 759633 - RNA, 19 nt, Homo sapiens
aaagaagacaguggaguua

SEQ ID NO: 759634 - RNA, 19 nt, Homo sapiens
gaacaagcagccagugaca

SEQ ID NO: 759635 - RNA, 19 nt, Homo sapiens
cacaaguccucuccaaaug

SEQ ID NO: 759636 - RNA, 19 nt, Homo sapiens
gaaagugagggagaagaaa

SEQ ID NO: 759637 - RNA, 19 nt, Homo sapiens
cagaagauguggaagaacu

SEQ ID NO: 759638 - RNA, 19 nt, Homo sapiens
ggugcugucugaauugaga

SEQ ID NO: 759639 - RNA, 19 nt, Homo sapiens
caauuauggccaaauauga

SEQ ID NO: 759640 - RNA, 19 nt, Homo sapiens
gaaagaaugagccuuaagc

SEQ ID NO: 759641 - RNA, 19 nt, Homo sapiens
ugacuucacuuccuuuggu

SEQ ID NO: 759642 - RNA, 19 nt, Homo sapiens
caauagaggagcuggaaga

SEQ ID NO: 759643 - RNA, 19 nt, Homo sapiens
ccaaauaaucgcccugaug

SEQ ID NO: 759644 - RNA, 19 nt, Homo sapiens
gaggugcugucugaauuga

SEQ ID NO: 759645 - RNA, 19 nt, Homo sapiens
ugagagaauuugaggaaag

SEQ ID NO: 759646 - RNA, 19 nt, Homo sapiens
aggaacaguugucuaagaa

SEQ ID NO: 759647 - RNA, 19 nt, Homo sapiens
gaaaugggccaagucaaag

SEQ ID NO: 759648 - RNA, 19 nt, Homo sapiens
guaguuaagccacauuuua

SEQ ID NO: 759649 - RNA, 19 nt, Homo sapiens
ggacguggaccugacacua

SEQ ID NO: 759650 - RNA, 19 nt, Homo sapiens
gagaaaccauaggcagaug

SEQ ID NO: 759651 - RNA, 19 nt, Homo sapiens
agagucaaaucaaagaaga

SEQ ID NO: 759652 - RNA, 19 nt, Homo sapiens
aguacuaucucagaaauug

SEQ ID NO: 759653 - RNA, 19 nt, Homo sapiens
ggaggacccugagcaacug

SEQ ID NO: 759654 - RNA, 19 nt, Homo sapiens
gagccaacaggaagaacua

SEQ ID NO: 759655 - RNA, 19 nt, Homo sapiens
ugagugagagugaagauga

SEQ ID NO: 759656 - RNA, 19 nt, Homo sapiens
gacuaccucuugagugaga

SEQ ID NO: 759657 - RNA, 19 nt, Homo sapiens
ccacgcagcugcucaucag

SEQ ID NO: 759658 - RNA, 19 nt, Homo sapiens
ucccagaccuguguuagaa

SEQ ID NO: 759659 - RNA, 19 nt, Homo sapiens
uagaagagcugggaaaaga

SEQ ID NO: 759660 - RNA, 19 nt, Homo sapiens
gaaugcagaugggccgaau

SEQ ID NO: 759661 - RNA, 19 nt, Homo sapiens
ggagggaggcacagaagau

SEQ ID NO: 759662 - RNA, 19 nt, Homo sapiens
gcucugcaguccuacuaug

SEQ ID NO: 759663 - RNA, 19 nt, Homo sapiens
acaguggaguuaccucuga

SEQ ID NO: 759664 - RNA, 19 nt, Homo sapiens
caagccaggccauaucauu

SEQ ID NO: 759665 - RNA, 19 nt, Homo sapiens
aaagaccaguggcagaaga

SEQ ID NO: 759666 - RNA, 19 nt, Homo sapiens
agagaaguagcauucaaua

SEQ ID NO: 759667 - RNA, 19 nt, Homo sapiens
acagagaaguagcauucaa

SEQ ID NO: 759668 - RNA, 19 nt, Homo sapiens
aagccaggccauaucauua

SEQ ID NO: 759669 - RNA, 19 nt, Homo sapiens
aaccauaggcagaugauaa

SEQ ID NO: 759670 - RNA, 19 nt, Homo sapiens
gagagaauuugaggaaagg

SEQ ID NO: 759671 - RNA, 19 nt, Homo sapiens
caaagaacugacacagaaa

SEQ ID NO: 759672 - RNA, 19 nt, Homo sapiens
auaggcagaugauaaagga

SEQ ID NO: 759673 - RNA, 19 nt, Homo sapiens
cuacagaaccuccuaacca

SEQ ID NO: 759674 - RNA, 19 nt, Homo sapiens
agaguacuaucucagaaau

SEQ ID NO: 759675 - RNA, 19 nt, Homo sapiens
guugagagaauuugaggaa

SEQ ID NO: 759676 - RNA, 19 nt, Homo sapiens
gccaagcuaugcaggaaca

SEQ ID NO: 759677 - RNA, 19 nt, Homo sapiens
gccagugacagacccuuua

SEQ ID NO: 759678 - RNA, 19 nt, Homo sapiens
gaucugcuugagccuguua

SEQ ID NO: 759679 - RNA, 19 nt, Homo sapiens
gaaggugucagaguucaau

SEQ ID NO: 759680 - RNA, 19 nt, Homo sapiens
gaguacagacgcuggaaga

SEQ ID NO: 759681 - RNA, 19 nt, Homo sapiens
aggaggugcugucugaauu

SEQ ID NO: 759682 - RNA, 19 nt, Homo sapiens
agaaugauggaaagaauga

SEQ ID NO: 759683 - RNA, 19 nt, Homo sapiens
ucccugauguagugaauga

SEQ ID NO: 759684 - RNA, 19 nt, Homo sapiens
uggaaagaaugagccuuaa

SEQ ID NO: 759685 - RNA, 19 nt, Homo sapiens
gcacuagaagaacuggaaa

SEQ ID NO: 759686 - RNA, 19 nt, Homo sapiens
caagaaagcccuaaaagag

SEQ ID NO: 759687 - RNA, 19 nt, Homo sapiens
ucaaccuccuccauaagaa

SEQ ID NO: 759688 - RNA, 19 nt, Homo sapiens
gaagggcagcagucagaga

SEQ ID NO: 759689 - RNA, 19 nt, Homo sapiens
uagaagggcagcagucaga

SEQ ID NO: 759690 - RNA, 19 nt, Homo sapiens
ggaggugcugucugaauug

SEQ ID NO: 759691 - RNA, 19 nt, Homo sapiens
ugaaagugagggagaagaa

SEQ ID NO: 759692 - RNA, 19 nt, Homo sapiens
gcaccagugacaccaaaga

SEQ ID NO: 759693 - RNA, 19 nt, Homo sapiens
gacgccgguuucucauuaa

SEQ ID NO: 759694 - RNA, 19 nt, Homo sapiens
ggaagaacuagcggauuug

SEQ ID NO: 759695 - RNA, 19 nt, Homo sapiens
ccaagucaaaggcaauuau

SEQ ID NO: 759696 - RNA, 19 nt, Homo sapiens
cgugaagucuuuggcaguu

SEQ ID NO: 759697 - RNA, 19 nt, Homo sapiens
gagcuucccagaccugugu

SEQ ID NO: 759698 - RNA, 19 nt, Homo sapiens
ggaaagaaugagccuuaag

SEQ ID NO: 759699 - RNA, 19 nt, Homo sapiens
gguuaagucucaauucuga

SEQ ID NO: 759700 - RNA, 19 nt, Homo sapiens
gaaggaagcagaggagaaa

SEQ ID NO: 759701 - RNA, 19 nt, Homo sapiens
caggagcgcugcaugcaaa

SEQ ID NO: 759702 - RNA, 19 nt, Homo sapiens
aagcaaagguugucacauc

SEQ ID NO: 759703 - RNA, 19 nt, Homo sapiens
aguaugggcugaagaagaa

SEQ ID NO: 759704 - RNA, 19 nt, Homo sapiens
caaagguugucacaucuuc

SEQ ID NO: 759705 - RNA, 19 nt, Homo sapiens
uggacacggugcucaaaua

SEQ ID NO: 759706 - RNA, 19 nt, Homo sapiens
gcagauccgagauaaguau

SEQ ID NO: 759707 - RNA, 19 nt, Homo sapiens
ggcagcagauccgagauaa

SEQ ID NO: 759708 - RNA, 19 nt, Homo sapiens
gaagaaggaggagaaggaa

SEQ ID NO: 759709 - RNA, 19 nt, Homo sapiens
gcggaggagucaaggaaga

SEQ ID NO: 759710 - RNA, 19 nt, Homo sapiens
ggacauguucaagaaguaa

SEQ ID NO: 759711 - RNA, 19 nt, Homo sapiens
ccucacaccucccuucauc

SEQ ID NO: 759712 - RNA, 19 nt, Homo sapiens
ugaagaagaaggaggagaa

SEQ ID NO: 759713 - RNA, 19 nt, Homo sapiens
ugugaucccugccaugcua

SEQ ID NO: 759714 - RNA, 19 nt, Homo sapiens
ugcaggacauguucaagaa

SEQ ID NO: 759715 - RNA, 19 nt, Homo sapiens
cagccuacuccaccuguua

SEQ ID NO: 759716 - RNA, 19 nt, Homo sapiens
caggacauguucaagaagu

SEQ ID NO: 759717 - RNA, 19 nt, Homo sapiens
cagcagauccgagauaagu

SEQ ID NO: 759718 - RNA, 19 nt, Homo sapiens
gcaaagguugucacaucuu

SEQ ID NO: 759719 - RNA, 19 nt, Homo sapiens
uagguuaagucucaauucu

SEQ ID NO: 759720 - RNA, 19 nt, Homo sapiens
ggaagcaaagguugucaca

SEQ ID NO: 759721 - RNA, 19 nt, Homo sapiens
ggacacggugcucaaauac

SEQ ID NO: 759722 - RNA, 19 nt, Homo sapiens
agaagaaggaggagaagga

SEQ ID NO: 759723 - RNA, 19 nt, Homo sapiens
gagcgcugcaugcaaauuc

SEQ ID NO: 759724 - RNA, 19 nt, Homo sapiens
ggacgaggaggaggaggaa

SEQ ID NO: 759725 - RNA, 19 nt, Homo sapiens
gagaaacgcgccagaaccu

SEQ ID NO: 759726 - RNA, 19 nt, Homo sapiens
cggcagcagauccgagaua

SEQ ID NO: 759727 - RNA, 19 nt, Homo sapiens
ggaagcagaggagaaagca

SEQ ID NO: 759728 - RNA, 19 nt, Homo sapiens
gaagaagaaggaggagaag

SEQ ID NO: 759729 - RNA, 19 nt, Homo sapiens
auaaguaugggcugaagaa

SEQ ID NO: 759730 - RNA, 19 nt, Homo sapiens
aggacauguucaagaagua

SEQ ID NO: 759731 - RNA, 19 nt, Homo sapiens
gagauaaguaugggcugaa

SEQ ID NO: 759732 - RNA, 19 nt, Homo sapiens
caaaggacauggggaagau

SEQ ID NO: 759733 - RNA, 19 nt, Homo sapiens
acacggugcucaaauaccu

SEQ ID NO: 759734 - RNA, 19 nt, Homo sapiens
agaaggaagcagaggagaa

SEQ ID NO: 759735 - RNA, 19 nt, Homo sapiens
gauaaguaugggcugaaga

SEQ ID NO: 759736 - RNA, 19 nt, Homo sapiens
caccuguuacuacuucuuu

SEQ ID NO: 759737 - RNA, 19 nt, Homo sapiens
cauucgaggcggacagaaa

SEQ ID NO: 759738 - RNA, 19 nt, Homo sapiens
cggcggaggagucaaggaa

SEQ ID NO: 759739 - RNA, 19 nt, Homo sapiens
gggagaaacgcgccagaac

SEQ ID NO: 759740 - RNA, 19 nt, Homo sapiens
uuacauagcuuuagagaag

SEQ ID NO: 759741 - RNA, 19 nt, Homo sapiens
aaacaccagugauuucaaa

SEQ ID NO: 759742 - RNA, 19 nt, Homo sapiens
uagagaagccauaacguua

SEQ ID NO: 759743 - RNA, 19 nt, Homo sapiens
gagaagccauaacguuaga

SEQ ID NO: 759744 - RNA, 19 nt, Homo sapiens
ccaauaaacaccagugauu

SEQ ID NO: 759745 - RNA, 19 nt, Homo sapiens
gcagagcaaucgccaugga

SEQ ID NO: 759746 - RNA, 19 nt, Homo sapiens
caucaagucuccacguguu

SEQ ID NO: 759747 - RNA, 19 nt, Homo sapiens
ggaaacaaagcaauagguu

SEQ ID NO: 759748 - RNA, 19 nt, Homo sapiens
gaccuuacauagcuuuaga

SEQ ID NO: 759749 - RNA, 19 nt, Homo sapiens
gggcguggcuuggcauuga

SEQ ID NO: 759750 - RNA, 19 nt, Homo sapiens
cguguucacuucuaaacua

SEQ ID NO: 759751 - RNA, 19 nt, Homo sapiens
ucagguaaaugaggucuuu

SEQ ID NO: 759752 - RNA, 19 nt, Homo sapiens
caauaaacaccagugauuu

SEQ ID NO: 759753 - RNA, 19 nt, Homo sapiens
gacagggcguccucucgua

SEQ ID NO: 759754 - RNA, 19 nt, Homo sapiens
gauggaaucacagccaaua

SEQ ID NO: 759755 - RNA, 19 nt, Homo sapiens
ccauggaguuugugaugaa

SEQ ID NO: 759756 - RNA, 19 nt, Homo sapiens
ucuccuccauucauguuua

SEQ ID NO: 759757 - RNA, 19 nt, Homo sapiens
gcgcguguguggccuaauc

SEQ ID NO: 759758 - RNA, 19 nt, Homo sapiens
aggacaugcucaagaagua

SEQ ID NO: 759759 - RNA, 19 nt, Homo sapiens
cccuuucucuugcuguuua

SEQ ID NO: 759760 - RNA, 19 nt, Homo sapiens
ucuccucucuggaagguuu

SEQ ID NO: 759761 - RNA, 19 nt, Homo sapiens
guguucacuucuaaacuaa

SEQ ID NO: 759762 - RNA, 19 nt, Homo sapiens
ugcaggacaugcucaagaa

SEQ ID NO: 759763 - RNA, 19 nt, Homo sapiens
uggacaccgucaucaagua

SEQ ID NO: 759764 - RNA, 19 nt, Homo sapiens
ccaaguacgccaagaugga

SEQ ID NO: 759765 - RNA, 19 nt, Homo sapiens
gccauggaguuugugauga

SEQ ID NO: 759766 - RNA, 19 nt, Homo sapiens
gaaucacagccaauaaaca

SEQ ID NO: 759767 - RNA, 19 nt, Homo sapiens
ggaaucacagccaauaaac

SEQ ID NO: 759768 - RNA, 19 nt, Homo sapiens
ugaggucuuugcauuuaau

SEQ ID NO: 759769 - RNA, 19 nt, Homo sapiens
acaaguacggcaucaagaa

SEQ ID NO: 759770 - RNA, 19 nt, Homo sapiens
gagcaaucgccauggaguu

SEQ ID NO: 759771 - RNA, 19 nt, Homo sapiens
uuagagaagccauaacguu

SEQ ID NO: 759772 - RNA, 19 nt, Homo sapiens
uggaaucacagccaauaaa

SEQ ID NO: 759773 - RNA, 19 nt, Homo sapiens
acguuagacugcaauacua

SEQ ID NO: 759774 - RNA, 19 nt, Homo sapiens
uugaaucucagguaaauga

SEQ ID NO: 759775 - RNA, 19 nt, Homo sapiens
guucacuucuaaacuaaag

SEQ ID NO: 759776 - RNA, 19 nt, Homo sapiens
ccauaacguuagacugcaa

SEQ ID NO: 759777 - RNA, 19 nt, Homo sapiens
gaugaagcaggcucuagga

SEQ ID NO: 759778 - RNA, 19 nt, Homo sapiens
caaucgccauggaguuugu

SEQ ID NO: 759779 - RNA, 19 nt, Homo sapiens
gacaaguacggcaucaaga

SEQ ID NO: 759780 - RNA, 19 nt, Homo sapiens
aauaaacaccagugauuuc

SEQ ID NO: 759781 - RNA, 19 nt, Homo sapiens
uguugaaucucagguaaau

SEQ ID NO: 759782 - RNA, 19 nt, Homo sapiens
guaaaugaggucuuugcau

SEQ ID NO: 759783 - RNA, 19 nt, Homo sapiens
ccauucauguuuaauuugc

SEQ ID NO: 759784 - RNA, 19 nt, Homo sapiens
cuucuaaacuaaaggaaac

SEQ ID NO: 759785 - RNA, 19 nt, Homo sapiens
cggccauacuugcguguga

SEQ ID NO: 759786 - RNA, 19 nt, Homo sapiens
uuuguugaaucucagguaa

SEQ ID NO: 759787 - RNA, 19 nt, Homo sapiens
gcuccgccgugaguauuug

SEQ ID NO: 759788 - RNA, 19 nt, Homo sapiens
cgagacaaguacggcauca

SEQ ID NO: 759789 - RNA, 19 nt, Homo sapiens
ucucccgggucgugucuuu

SEQ ID NO: 759790 - RNA, 19 nt, Homo sapiens
cggccguguucacuucuaa

SEQ ID NO: 759791 - RNA, 19 nt, Homo sapiens
gcaaucgccauggaguuug

SEQ ID NO: 759792 - RNA, 19 nt, Homo sapiens
ggacaccgucaucaaguac

SEQ ID NO: 759793 - RNA, 19 nt, Homo sapiens
ggccaaguacgccaagaug

SEQ ID NO: 759794 - RNA, 19 nt, Homo sapiens
caaguacggcaucaagaag

SEQ ID NO: 759795 - RNA, 19 nt, Homo sapiens
aguacggcaucaagaagaa

SEQ ID NO: 759796 - RNA, 19 nt, Homo sapiens
aaaggaaacaaagcaauag

SEQ ID NO: 759797 - RNA, 19 nt, Homo sapiens
cuaaaggaaacaaagcaau

SEQ ID NO: 759798 - RNA, 19 nt, Homo sapiens
ggacaugcucaagaaguag

SEQ ID NO: 759799 - RNA, 19 nt, Homo sapiens
uaaacaccagugauuucaa

SEQ ID NO: 759800 - RNA, 19 nt, Homo sapiens
agacaaguacggcaucaag

SEQ ID NO: 759801 - RNA, 19 nt, Homo sapiens
agaccgugguguccucugu

SEQ ID NO: 759802 - RNA, 19 nt, Homo sapiens
ugaccuucaugaccuuaca

SEQ ID NO: 759803 - RNA, 19 nt, Homo sapiens
ucacuucuaaacuaaagga

SEQ ID NO: 759804 - RNA, 19 nt, Homo sapiens
ccuccauucauguuuaauu

SEQ ID NO: 759805 - RNA, 19 nt, Homo sapiens
ugacaaauguggaugauga

SEQ ID NO: 759806 - RNA, 19 nt, Homo sapiens
gcaccgaccugccucugua

SEQ ID NO: 759807 - RNA, 19 nt, Homo sapiens
ggaagagccugucaucauc

SEQ ID NO: 759808 - RNA, 19 nt, Homo sapiens
caaggcagcuuaacuacau

SEQ ID NO: 759809 - RNA, 19 nt, Homo sapiens
ccaagggucuucaacuuug

SEQ ID NO: 759810 - RNA, 19 nt, Homo sapiens
cagggaauauuugcauuua

SEQ ID NO: 759811 - RNA, 19 nt, Homo sapiens
gggaauauuugcauuuaag

SEQ ID NO: 759812 - RNA, 19 nt, Homo sapiens
gcagcugccugaacagaga

SEQ ID NO: 759813 - RNA, 19 nt, Homo sapiens
gugaaggguuccugugauu

SEQ ID NO: 759814 - RNA, 19 nt, Homo sapiens
gccgagacgucaacuguga

SEQ ID NO: 759815 - RNA, 19 nt, Homo sapiens
ucacacuccuguccucuga

SEQ ID NO: 759816 - RNA, 19 nt, Homo sapiens
ggagagggcccacgauucu

SEQ ID NO: 759817 - RNA, 19 nt, Homo sapiens
gcucuaggcuacacugucu

SEQ ID NO: 759818 - RNA, 19 nt, Homo sapiens
uccaauggcuucccugaug

SEQ ID NO: 759819 - RNA, 19 nt, Homo sapiens
ccacaccuaugucaacaca

SEQ ID NO: 759820 - RNA, 19 nt, Homo sapiens
caacacaccggccagugaa

SEQ ID NO: 759821 - RNA, 19 nt, Homo sapiens
gacaggccagggaauauuu

SEQ ID NO: 759822 - RNA, 19 nt, Homo sapiens
gagacagcguuccagacaa

SEQ ID NO: 759823 - RNA, 19 nt, Homo sapiens
gagccgagacgucaacugu

SEQ ID NO: 759824 - RNA, 19 nt, Homo sapiens
gaagagccugucaucauca

SEQ ID NO: 759825 - RNA, 19 nt, Homo sapiens
gcucacacccucuuccaau

SEQ ID NO: 759826 - RNA, 19 nt, Homo sapiens
ccagggaauauuugcauuu

SEQ ID NO: 759827 - RNA, 19 nt, Homo sapiens
ucagacaggccagggaaua

SEQ ID NO: 759828 - RNA, 19 nt, Homo sapiens
cgacuguccguguguguuu

SEQ ID NO: 759829 - RNA, 19 nt, Homo sapiens
gauaucagccaccgagucu

SEQ ID NO: 759830 - RNA, 19 nt, Homo sapiens
ggaaaucuucaaccuccuu

SEQ ID NO: 759831 - RNA, 19 nt, Homo sapiens
ugucuugucugccgacugu

SEQ ID NO: 759832 - RNA, 19 nt, Homo sapiens
gccagggaauauuugcauu

SEQ ID NO: 759833 - RNA, 19 nt, Homo sapiens
ccaagugcaccuacgagaa

SEQ ID NO: 759834 - RNA, 19 nt, Homo sapiens
ccacaauaauaacaaugag

SEQ ID NO: 759835 - RNA, 19 nt, Homo sapiens
ucaacacaccggccaguga

SEQ ID NO: 759836 - RNA, 19 nt, Homo sapiens
gcuacacugucuccagcuu

SEQ ID NO: 759837 - RNA, 19 nt, Homo sapiens
gaagugccagggccucugu

SEQ ID NO: 759838 - RNA, 19 nt, Homo sapiens
gucaucaucacccgcaaua

SEQ ID NO: 759839 - RNA, 19 nt, Homo sapiens
uggaagagccugucaucau

SEQ ID NO: 759840 - RNA, 19 nt, Homo sapiens
ugcaacagcaucaauguga

SEQ ID NO: 759841 - RNA, 19 nt, Homo sapiens
gaaggguuccugugauugc

SEQ ID NO: 759842 - RNA, 19 nt, Homo sapiens
agacagcguuccagacaac

SEQ ID NO: 759843 - RNA, 19 nt, Homo sapiens
ccgcccugcugcacuauga

SEQ ID NO: 759844 - RNA, 19 nt, Homo sapiens
caggcuggcugcucugaca

SEQ ID NO: 759845 - RNA, 19 nt, Homo sapiens
ccacaccacaauaauaaca

SEQ ID NO: 759846 - RNA, 19 nt, Homo sapiens
ggugacaaauguggaugau

SEQ ID NO: 759847 - RNA, 19 nt, Homo sapiens
cccaagggucuucaacuuu

SEQ ID NO: 759848 - RNA, 19 nt, Homo sapiens
caggccaggugaaguuugu

SEQ ID NO: 759849 - RNA, 19 nt, Homo sapiens
guccacccaugcccucauu

SEQ ID NO: 759850 - RNA, 19 nt, Homo sapiens
gcagugcaacagcaucaau

SEQ ID NO: 759851 - RNA, 19 nt, Homo sapiens
uccaaccucuucuccuuug

SEQ ID NO: 759852 - RNA, 19 nt, Homo sapiens
acuccaaccucuucuccuu

SEQ ID NO: 759853 - RNA, 19 nt, Homo sapiens
caagugcaccuacgagaac

SEQ ID NO: 759854 - RNA, 19 nt, Homo sapiens
ccaggugaaguuuguguug

SEQ ID NO: 759855 - RNA, 19 nt, Homo sapiens
gggcugaggaaaucuucaa

SEQ ID NO: 759856 - RNA, 19 nt, Homo sapiens
ccaaguucaaggugacaaa

SEQ ID NO: 759857 - RNA, 19 nt, Homo sapiens
ggcggcacauggugaagug

SEQ ID NO: 759858 - RNA, 19 nt, Homo sapiens
gagcagucccacaccuaug

SEQ ID NO: 759859 - RNA, 19 nt, Homo sapiens
aguucaaggugacaaaugu

SEQ ID NO: 759860 - RNA, 19 nt, Homo sapiens
agacaggccagggaauauu

SEQ ID NO: 759861 - RNA, 19 nt, Homo sapiens
agagacagcguuccagaca

SEQ ID NO: 759862 - RNA, 19 nt, Homo sapiens
cuacgacuccaaccucuuc

SEQ ID NO: 759863 - RNA, 19 nt, Homo sapiens
guucuguccauuugucuug

SEQ ID NO: 759864 - RNA, 19 nt, Homo sapiens
ugugaaggguuccugugau

SEQ ID NO: 759865 - RNA, 19 nt, Homo sapiens
ccaaggcagcuuaacuaca

SEQ ID NO: 759866 - RNA, 19 nt, Homo sapiens
ccaaccucuucuccuuuga

SEQ ID NO: 759867 - RNA, 19 nt, Homo sapiens
caaggugacaaauguggau

SEQ ID NO: 759868 - RNA, 19 nt, Homo sapiens
ggacccacagguguucuug

SEQ ID NO: 759869 - RNA, 19 nt, Homo sapiens
gagaagaacugcauuauua

SEQ ID NO: 759870 - RNA, 19 nt, Homo sapiens
ggaugaagaugacaauuua

SEQ ID NO: 759871 - RNA, 19 nt, Homo sapiens
gaacuuaccuaauggauau

SEQ ID NO: 759872 - RNA, 19 nt, Homo sapiens
ggacagggauccucagauu

SEQ ID NO: 759873 - RNA, 19 nt, Homo sapiens
gcucagaacuuaccuaaug

SEQ ID NO: 759874 - RNA, 19 nt, Homo sapiens
gaacacaggcagcuuaauu

SEQ ID NO: 759875 - RNA, 19 nt, Homo sapiens
gaaauaaucaucagacaga

SEQ ID NO: 759876 - RNA, 19 nt, Homo sapiens
guacugaucugcccauguu

SEQ ID NO: 759877 - RNA, 19 nt, Homo sapiens
ugaguuagguucuggcaua

SEQ ID NO: 759878 - RNA, 19 nt, Homo sapiens
uuaacaaacugguguauga

SEQ ID NO: 759879 - RNA, 19 nt, Homo sapiens
caacucagcucagagaaga

SEQ ID NO: 759880 - RNA, 19 nt, Homo sapiens
gaacugcugcuaugucaaa

SEQ ID NO: 759881 - RNA, 19 nt, Homo sapiens
gaagaaccaaguaguauug

SEQ ID NO: 759882 - RNA, 19 nt, Homo sapiens
gaacaaguuuaaggucauu

SEQ ID NO: 759883 - RNA, 19 nt, Homo sapiens
cgagagaacugcugcuaug

SEQ ID NO: 759884 - RNA, 19 nt, Homo sapiens
caacagucuuuaacuuuga

SEQ ID NO: 759885 - RNA, 19 nt, Homo sapiens
guauaaaugugguggaaga

SEQ ID NO: 759886 - RNA, 19 nt, Homo sapiens
gagaacugcugcuauguca

SEQ ID NO: 759887 - RNA, 19 nt, Homo sapiens
gaaggagucaaauuuguuu

SEQ ID NO: 759888 - RNA, 19 nt, Homo sapiens
cagcagaggcuaagaauau

SEQ ID NO: 759889 - RNA, 19 nt, Homo sapiens
ccgcaaacgugacucagua

SEQ ID NO: 759890 - RNA, 19 nt, Homo sapiens
ccaacagucuuuaacuuug

SEQ ID NO: 759891 - RNA, 19 nt, Homo sapiens
uguuguagcuguccagaua

SEQ ID NO: 759892 - RNA, 19 nt, Homo sapiens
ggucgaaggugucaaacug

SEQ ID NO: 759893 - RNA, 19 nt, Homo sapiens
ggaagagccaguuguagaa

SEQ ID NO: 759894 - RNA, 19 nt, Homo sapiens
gggaugaagaugacaauuu

SEQ ID NO: 759895 - RNA, 19 nt, Homo sapiens
gagaugcacccucuguuaa

SEQ ID NO: 759896 - RNA, 19 nt, Homo sapiens
gcagaggcuaagaauauua

SEQ ID NO: 759897 - RNA, 19 nt, Homo sapiens
uaucagacgcccaaguuua

SEQ ID NO: 759898 - RNA, 19 nt, Homo sapiens
ugacagugaugaacgaaga

SEQ ID NO: 759899 - RNA, 19 nt, Homo sapiens
aaagaagaaccaaguagua

SEQ ID NO: 759900 - RNA, 19 nt, Homo sapiens
gauaucagacgcccaaguu

SEQ ID NO: 759901 - RNA, 19 nt, Homo sapiens
gagcaaauaacacagaaug

SEQ ID NO: 759902 - RNA, 19 nt, Homo sapiens
caacaacucagcucagaga

SEQ ID NO: 759903 - RNA, 19 nt, Homo sapiens
cgucugacauccaccagua

SEQ ID NO: 759904 - RNA, 19 nt, Homo sapiens
gaauauuaauggccagauc

SEQ ID NO: 759905 - RNA, 19 nt, Homo sapiens
ggaaguggagcaaauaaca

SEQ ID NO: 759906 - RNA, 19 nt, Homo sapiens
cuacaggugugcaagaaga

SEQ ID NO: 759907 - RNA, 19 nt, Homo sapiens
uggaagagaucaaguuagu

SEQ ID NO: 759908 - RNA, 19 nt, Homo sapiens
ggaacaaguuuaaggucau

SEQ ID NO: 759909 - RNA, 19 nt, Homo sapiens
cauguuagccuggaaauga

SEQ ID NO: 759910 - RNA, 19 nt, Homo sapiens
cugcugcuaugucaaauuu

SEQ ID NO: 759911 - RNA, 19 nt, Homo sapiens
gguuaaaucagcaaacaaa

SEQ ID NO: 759912 - RNA, 19 nt, Homo sapiens
caaaagcaguuaauggaaa

SEQ ID NO: 759913 - RNA, 19 nt, Homo sapiens
ggaagaaucuacacauccu

SEQ ID NO: 759914 - RNA, 19 nt, Homo sapiens
ucagagaagaacugcauua

SEQ ID NO: 759915 - RNA, 19 nt, Homo sapiens
caggagaggucgucugaca

SEQ ID NO: 759916 - RNA, 19 nt, Homo sapiens
gccuggaaaugaaauuaaa

SEQ ID NO: 759917 - RNA, 19 nt, Homo sapiens
acaggcagcuuaauuacau

SEQ ID NO: 759918 - RNA, 19 nt, Homo sapiens
ccaaagaccccaucucuaa

SEQ ID NO: 759919 - RNA, 19 nt, Homo sapiens
guuagguucuggcauaaug

SEQ ID NO: 759920 - RNA, 19 nt, Homo sapiens
caccaacagucuuuaacuu

SEQ ID NO: 759921 - RNA, 19 nt, Homo sapiens
ccucagauacccagaauau

SEQ ID NO: 759922 - RNA, 19 nt, Homo sapiens
guacaccaacagucuuuaa

SEQ ID NO: 759923 - RNA, 19 nt, Homo sapiens
uagauccaaugcauaacua

SEQ ID NO: 759924 - RNA, 19 nt, Homo sapiens
gaagagccaguuguagaaa

SEQ ID NO: 759925 - RNA, 19 nt, Homo sapiens
gaagcccgcaagcuaagua

SEQ ID NO: 759926 - RNA, 19 nt, Homo sapiens
ggaacaaguacauaccuau

SEQ ID NO: 759927 - RNA, 19 nt, Homo sapiens
gcacacauggucuucugaa

SEQ ID NO: 759928 - RNA, 19 nt, Homo sapiens
gaguuagguucuggcauaa

SEQ ID NO: 759929 - RNA, 19 nt, Homo sapiens
gaaacuggagcaacuugga

SEQ ID NO: 759930 - RNA, 19 nt, Homo sapiens
uaaguagggaugaagauga

SEQ ID NO: 759931 - RNA, 19 nt, Homo sapiens
ggagcaacuuggaagagau

SEQ ID NO: 759932 - RNA, 19 nt, Homo sapiens
gaauuggaagucccuagaa

SEQ ID NO: 759933 - RNA, 19 nt, Homo sapiens
gguggaagagccaguugua

SEQ ID NO: 759934 - RNA, 19 nt, Homo sapiens
uaacauguugcaagagauu

SEQ ID NO: 759935 - RNA, 19 nt, Homo sapiens
gcaaacgugacucaguaaa

SEQ ID NO: 759936 - RNA, 19 nt, Homo sapiens
gcagcagaggcuaagaaua

SEQ ID NO: 759937 - RNA, 19 nt, Homo sapiens
ccaguuguagaaagaaaua

SEQ ID NO: 759938 - RNA, 19 nt, Homo sapiens
agagcuguaugccgugaua

SEQ ID NO: 759939 - RNA, 19 nt, Homo sapiens
uuacauacagguugacuug

SEQ ID NO: 759940 - RNA, 19 nt, Homo sapiens
uuagaacacaggcagcuua

SEQ ID NO: 759941 - RNA, 19 nt, Homo sapiens
ggagaggucgucugacauc

SEQ ID NO: 759942 - RNA, 19 nt, Homo sapiens
aacacaggcagcuuaauua

SEQ ID NO: 759943 - RNA, 19 nt, Homo sapiens
cauacagguugacuuggaa

SEQ ID NO: 759944 - RNA, 19 nt, Homo sapiens
cagaggcuaagaauauuaa

SEQ ID NO: 759945 - RNA, 19 nt, Homo sapiens
uaaucuagauccaaugcau

SEQ ID NO: 759946 - RNA, 19 nt, Homo sapiens
ccagauaaccaucggaaca

SEQ ID NO: 759947 - RNA, 19 nt, Homo sapiens
acauacagguugacuugga

SEQ ID NO: 759948 - RNA, 19 nt, Homo sapiens
gagaaacuggagcaacuug

SEQ ID NO: 759949 - RNA, 19 nt, Homo sapiens
caagugugcauguuccauu

SEQ ID NO: 759950 - RNA, 19 nt, Homo sapiens
gaugacaauuuaggaccaa

SEQ ID NO: 759951 - RNA, 19 nt, Homo sapiens
agagaagaacugcauuauu

SEQ ID NO: 759952 - RNA, 19 nt, Homo sapiens
gaugcacccucuguuaaca

SEQ ID NO: 759953 - RNA, 19 nt, Homo sapiens
aagagaaacuggagcaacu

SEQ ID NO: 759954 - RNA, 19 nt, Homo sapiens
ugaaggagucaaauuuguu

SEQ ID NO: 759955 - RNA, 19 nt, Homo sapiens
cuacacauccuuugcuugu

SEQ ID NO: 759956 - RNA, 19 nt, Homo sapiens
uuuaacauguugcaagaga

SEQ ID NO: 759957 - RNA, 19 nt, Homo sapiens
acucgaaucucuuuucuuu

SEQ ID NO: 759958 - RNA, 19 nt, Homo sapiens
gaacuuacagacacagaac

SEQ ID NO: 759959 - RNA, 19 nt, Homo sapiens
cgucgggacuguacaccaa

SEQ ID NO: 759960 - RNA, 19 nt, Homo sapiens
cugaaggagucaaauuugu

SEQ ID NO: 759961 - RNA, 19 nt, Homo sapiens
gaaagcagcacaccaaaag

SEQ ID NO: 759962 - RNA, 19 nt, Homo sapiens
gagacucgaucugcuccaa

SEQ ID NO: 759963 - RNA, 19 nt, Homo sapiens
uaagugugcccgugcagaa

SEQ ID NO: 759964 - RNA, 19 nt, Homo sapiens
ggaacuuacagacacagaa

SEQ ID NO: 759965 - RNA, 19 nt, Homo sapiens
ugauagacaucgagagaac

SEQ ID NO: 759966 - RNA, 19 nt, Homo sapiens
caagcuaaguagggaugaa

SEQ ID NO: 759967 - RNA, 19 nt, Homo sapiens
caucuuugccuccuguuug

SEQ ID NO: 759968 - RNA, 19 nt, Homo sapiens
gcucagagaagaacugcau

SEQ ID NO: 759969 - RNA, 19 nt, Homo sapiens
gaccagaucuguaugauuu

SEQ ID NO: 759970 - RNA, 19 nt, Homo sapiens
gaugguagcuccugaugua

SEQ ID NO: 759971 - RNA, 19 nt, Homo sapiens
ggacauggauuaggacuuu

SEQ ID NO: 759972 - RNA, 19 nt, Homo sapiens
gaucaguccuuuccucuuu

SEQ ID NO: 759973 - RNA, 19 nt, Homo sapiens
ccaaagcgcugagauugua

SEQ ID NO: 759974 - RNA, 19 nt, Homo sapiens
cuacugaagucuacagaua

SEQ ID NO: 759975 - RNA, 19 nt, Homo sapiens
gaagagugguuguguguuc

SEQ ID NO: 759976 - RNA, 19 nt, Homo sapiens
ucaaggaguucaccaguuu

SEQ ID NO: 759977 - RNA, 19 nt, Homo sapiens
gaagaugacagagggauua

SEQ ID NO: 759978 - RNA, 19 nt, Homo sapiens
ggacagaauuucccacagu

SEQ ID NO: 759979 - RNA, 19 nt, Homo sapiens
gaucuacagugaugaccua

SEQ ID NO: 759980 - RNA, 19 nt, Homo sapiens
aaaggacucugaugucaaa

SEQ ID NO: 759981 - RNA, 19 nt, Homo sapiens
gugcagaggucauggaaga

SEQ ID NO: 759982 - RNA, 19 nt, Homo sapiens
aaagagcacugaacuagga

SEQ ID NO: 759983 - RNA, 19 nt, Homo sapiens
gaccuuagaucaguccuuu

SEQ ID NO: 759984 - RNA, 19 nt, Homo sapiens
ggacuuaccuuuucacaug

SEQ ID NO: 759985 - RNA, 19 nt, Homo sapiens
ggaaagagcacugaacuag

SEQ ID NO: 759986 - RNA, 19 nt, Homo sapiens
gaguauugguucuaagauu

SEQ ID NO: 759987 - RNA, 19 nt, Homo sapiens
gcaagagugugagcagauu

SEQ ID NO: 759988 - RNA, 19 nt, Homo sapiens
guacuuagucccagauaaa

SEQ ID NO: 759989 - RNA, 19 nt, Homo sapiens
gaacccaagccaauucaaa

SEQ ID NO: 759990 - RNA, 19 nt, Homo sapiens
gagcuacagaccaauauaa

SEQ ID NO: 759991 - RNA, 19 nt, Homo sapiens
ccauggaaaucacuacuug

SEQ ID NO: 759992 - RNA, 19 nt, Homo sapiens
gaagaccagaucuguauga

SEQ ID NO: 759993 - RNA, 19 nt, Homo sapiens
ggaccaagcaagaguguga

SEQ ID NO: 759994 - RNA, 19 nt, Homo sapiens
gguagcuccugauguaauu

SEQ ID NO: 759995 - RNA, 19 nt, Homo sapiens
ggagugaggugagggacuu

SEQ ID NO: 759996 - RNA, 19 nt, Homo sapiens
ccuauuaccuuuacguugu

SEQ ID NO: 759997 - RNA, 19 nt, Homo sapiens
gaaggaagaccagaucugu

SEQ ID NO: 759998 - RNA, 19 nt, Homo sapiens
gcaccaugguagacucauu

SEQ ID NO: 759999 - RNA, 19 nt, Homo sapiens
gauguugggcuauauguug

SEQ ID NO: 760000 - RNA, 19 nt, Homo sapiens
caaggcauccucccacgua

SEQ ID NO: 760001 - RNA, 19 nt, Homo sapiens
aaucaggccuauuugugua

SEQ ID NO: 760002 - RNA, 19 nt, Homo sapiens
gaaucaggccuauuugugu

SEQ ID NO: 760003 - RNA, 19 nt, Homo sapiens
gcauaaaggacucugaugu

SEQ ID NO: 760004 - RNA, 19 nt, Homo sapiens
uaacagaagcuacugaagu

SEQ ID NO: 760005 - RNA, 19 nt, Homo sapiens
ggaggaggagggcuuguuu

SEQ ID NO: 760006 - RNA, 19 nt, Homo sapiens
uggaagaagugacaacaug

SEQ ID NO: 760007 - RNA, 19 nt, Homo sapiens
ggacccaauuuccauagau

SEQ ID NO: 760008 - RNA, 19 nt, Homo sapiens
aaucauggcucuuguacuc

SEQ ID NO: 760009 - RNA, 19 nt, Homo sapiens
ucacagagcgucaacagau

SEQ ID NO: 760010 - RNA, 19 nt, Homo sapiens
gcgagaaaauucaagaaaa

SEQ ID NO: 760011 - RNA, 19 nt, Homo sapiens
gggaaaaggacauggauua

SEQ ID NO: 760012 - RNA, 19 nt, Homo sapiens
gcuuccagcuaccauguaa

SEQ ID NO: 760013 - RNA, 19 nt, Homo sapiens
gagaguauugguucuaaga

SEQ ID NO: 760014 - RNA, 19 nt, Homo sapiens
gaacaccgucagaaucaug

SEQ ID NO: 760015 - RNA, 19 nt, Homo sapiens
gcccaugguuacaguagaa

SEQ ID NO: 760016 - RNA, 19 nt, Homo sapiens
ccaggacucuagcagcaaa

SEQ ID NO: 760017 - RNA, 19 nt, Homo sapiens
gggagacuuuguagauguu

SEQ ID NO: 760018 - RNA, 19 nt, Homo sapiens
gcaguuacagacagguuaa

SEQ ID NO: 760019 - RNA, 19 nt, Homo sapiens
caauuuccauagaugcaaa

SEQ ID NO: 760020 - RNA, 19 nt, Homo sapiens
gaaacagaggguugaccua

SEQ ID NO: 760021 - RNA, 19 nt, Homo sapiens
gaugcuggauguucaugga

SEQ ID NO: 760022 - RNA, 19 nt, Homo sapiens
gcaaggagaguagccaaug

SEQ ID NO: 760023 - RNA, 19 nt, Homo sapiens
uggcccagcuacuccuuua

SEQ ID NO: 760024 - RNA, 19 nt, Homo sapiens
ggguuucucucaaguuugu

SEQ ID NO: 760025 - RNA, 19 nt, Homo sapiens
acagacagguuaacagaag

SEQ ID NO: 760026 - RNA, 19 nt, Homo sapiens
gacccaauuuccauagaug

SEQ ID NO: 760027 - RNA, 19 nt, Homo sapiens
caaagaugcacccaccauu

SEQ ID NO: 760028 - RNA, 19 nt, Homo sapiens
gaagcacugggccacauuu

SEQ ID NO: 760029 - RNA, 19 nt, Homo sapiens
gagcaaaacagaagaauca

SEQ ID NO: 760030 - RNA, 19 nt, Homo sapiens
aguaaguccuggcugcaua

SEQ ID NO: 760031 - RNA, 19 nt, Homo sapiens
ugaccauggugaaggcuuu

SEQ ID NO: 760032 - RNA, 19 nt, Homo sapiens
caccaugguagacucauua

SEQ ID NO: 760033 - RNA, 19 nt, Homo sapiens
gcuacuccuuuaccuguga

SEQ ID NO: 760034 - RNA, 19 nt, Homo sapiens
ggaguucaccaguuuaugg

SEQ ID NO: 760035 - RNA, 19 nt, Homo sapiens
acagaagaaucaugaaguc

SEQ ID NO: 760036 - RNA, 19 nt, Homo sapiens
auaaaggacucugauguca

SEQ ID NO: 760037 - RNA, 19 nt, Homo sapiens
ccaaagagcaaaaugaaaa

SEQ ID NO: 760038 - RNA, 19 nt, Homo sapiens
gguaggaacccaagccaau

SEQ ID NO: 760039 - RNA, 19 nt, Homo sapiens
cacagagcgucaacagauu

SEQ ID NO: 760040 - RNA, 19 nt, Homo sapiens
ggugggagacuuuguagau

SEQ ID NO: 760041 - RNA, 19 nt, Homo sapiens
gacauggauuaggacuuua

SEQ ID NO: 760042 - RNA, 19 nt, Homo sapiens
ccucagguuuccaucugua

SEQ ID NO: 760043 - RNA, 19 nt, Homo sapiens
aagggagugugguaaguuu

SEQ ID NO: 760044 - RNA, 19 nt, Homo sapiens
cugaugaucuacagugaug

SEQ ID NO: 760045 - RNA, 19 nt, Homo sapiens
ucaggaugcuggauguuca

SEQ ID NO: 760046 - RNA, 19 nt, Homo sapiens
agaauggacucagugcuau

SEQ ID NO: 760047 - RNA, 19 nt, Homo sapiens
caaaacagaagaaucauga

SEQ ID NO: 760048 - RNA, 19 nt, Homo sapiens
ccacguaggccuuccaaag

SEQ ID NO: 760049 - RNA, 19 nt, Homo sapiens
gcaaagaugcacccaccau

SEQ ID NO: 760050 - RNA, 19 nt, Homo sapiens
aacagaagcuacugaaguc

SEQ ID NO: 760051 - RNA, 19 nt, Homo sapiens
gcagugcccggacaccaaa

SEQ ID NO: 760052 - RNA, 19 nt, Homo sapiens
ggaagaugacagagggauu

SEQ ID NO: 760053 - RNA, 19 nt, Homo sapiens
ggcccagccuauuaccuuu

SEQ ID NO: 760054 - RNA, 19 nt, Homo sapiens
aagaauggacucagugcua

SEQ ID NO: 760055 - RNA, 19 nt, Homo sapiens
caaggaguucaccaguuua

SEQ ID NO: 760056 - RNA, 19 nt, Homo sapiens
aaaaggacauggauuagga

SEQ ID NO: 760057 - RNA, 19 nt, Homo sapiens
uuaauaaugcucagaguuc

SEQ ID NO: 760058 - RNA, 19 nt, Homo sapiens
guaaguccuggcugcauaa

SEQ ID NO: 760059 - RNA, 19 nt, Homo sapiens
gcuacagaccaauauaaga

SEQ ID NO: 760060 - RNA, 19 nt, Homo sapiens
gaaucucaaugccaguagu

SEQ ID NO: 760061 - RNA, 19 nt, Homo sapiens
gggcuuaaauuccgguacu

SEQ ID NO: 760062 - RNA, 19 nt, Homo sapiens
ggacucugaugucaaaaug

SEQ ID NO: 760063 - RNA, 19 nt, Homo sapiens
gaggagagaugaggaugcu

SEQ ID NO: 760064 - RNA, 19 nt, Homo sapiens
cuauuaccuuuacguugua

SEQ ID NO: 760065 - RNA, 19 nt, Homo sapiens
ggaaggaagaccagaucug

SEQ ID NO: 760066 - RNA, 19 nt, Homo sapiens
uuacagacagguuaacaga

SEQ ID NO: 760067 - RNA, 19 nt, Homo sapiens
guaggaacccaagccaauu

SEQ ID NO: 760068 - RNA, 19 nt, Homo sapiens
acagaagaauggacucagu

SEQ ID NO: 760069 - RNA, 19 nt, Homo sapiens
ggaugaggcuuucuucaaa

SEQ ID NO: 760070 - RNA, 19 nt, Homo sapiens
ugaauaagcucuggacauu

SEQ ID NO: 760071 - RNA, 19 nt, Homo sapiens
caccugagaugcuuguuua

SEQ ID NO: 760072 - RNA, 19 nt, Homo sapiens
caaagaggauggagugaga

SEQ ID NO: 760073 - RNA, 19 nt, Homo sapiens
ccagaggacuugcccagua

SEQ ID NO: 760074 - RNA, 19 nt, Homo sapiens
gaaugaggaccaaagguua

SEQ ID NO: 760075 - RNA, 19 nt, Homo sapiens
caucaaagcuguaaguucu

SEQ ID NO: 760076 - RNA, 19 nt, Homo sapiens
ucaaugggaucaggaguua

SEQ ID NO: 760077 - RNA, 19 nt, Homo sapiens
ggccuuaaauucccaguaa

SEQ ID NO: 760078 - RNA, 19 nt, Homo sapiens
caaauaugcugaacuaagg

SEQ ID NO: 760079 - RNA, 19 nt, Homo sapiens
aauauaggcucuugaauuc

SEQ ID NO: 760080 - RNA, 19 nt, Homo sapiens
gauagugggcccauuagua

SEQ ID NO: 760081 - RNA, 19 nt, Homo sapiens
ggucucaauucaugacaua

SEQ ID NO: 760082 - RNA, 19 nt, Homo sapiens
gaauuccacuccaaauaug

SEQ ID NO: 760083 - RNA, 19 nt, Homo sapiens
uuuaacaccuuuagccuua

SEQ ID NO: 760084 - RNA, 19 nt, Homo sapiens
caacacacacacaaacaua

SEQ ID NO: 760085 - RNA, 19 nt, Homo sapiens
gaaagaacagauacgguuu

SEQ ID NO: 760086 - RNA, 19 nt, Homo sapiens
caucaccucuuccuacaaa

SEQ ID NO: 760087 - RNA, 19 nt, Homo sapiens
agacacggcuuccugauug

SEQ ID NO: 760088 - RNA, 19 nt, Homo sapiens
cauuauaggucucaauuca

SEQ ID NO: 760089 - RNA, 19 nt, Homo sapiens
cuacaaaccuccuauacca

SEQ ID NO: 760090 - RNA, 19 nt, Homo sapiens
ugaaagaccaccauuauca

SEQ ID NO: 760091 - RNA, 19 nt, Homo sapiens
cuaauuagccuaucugaau

SEQ ID NO: 760092 - RNA, 19 nt, Homo sapiens
gaccaaacuuuaacaccuu

SEQ ID NO: 760093 - RNA, 19 nt, Homo sapiens
gguaggagauaaggagaaa

SEQ ID NO: 760094 - RNA, 19 nt, Homo sapiens
ggugauagugggcccauua

SEQ ID NO: 760095 - RNA, 19 nt, Homo sapiens
acaaguaagucauguaucu

SEQ ID NO: 760096 - RNA, 19 nt, Homo sapiens
gcucuggacauucucuuua

SEQ ID NO: 760097 - RNA, 19 nt, Homo sapiens
uaucucaguuuacauguga

SEQ ID NO: 760098 - RNA, 19 nt, Homo sapiens
gagguugguauacaaguua

SEQ ID NO: 760099 - RNA, 19 nt, Homo sapiens
cagcaacauuuauucaaga

SEQ ID NO: 760100 - RNA, 19 nt, Homo sapiens
gaccaaggccuacgagaga

SEQ ID NO: 760101 - RNA, 19 nt, Homo sapiens
ggacugacaccauguucaa

SEQ ID NO: 760102 - RNA, 19 nt, Homo sapiens
aaacauccacuguagcuuu

SEQ ID NO: 760103 - RNA, 19 nt, Homo sapiens
ccgaaugcuuuaccaguuu

SEQ ID NO: 760104 - RNA, 19 nt, Homo sapiens
ccaacgaggugcagaccaa

SEQ ID NO: 760105 - RNA, 19 nt, Homo sapiens
gggcaucaaucacauagca

SEQ ID NO: 760106 - RNA, 19 nt, Homo sapiens
gggaugaccuuacucuuuu

SEQ ID NO: 760107 - RNA, 19 nt, Homo sapiens
gggaucaggaguuagcuua

SEQ ID NO: 760108 - RNA, 19 nt, Homo sapiens
cuaccaccaucucaaguaa

SEQ ID NO: 760109 - RNA, 19 nt, Homo sapiens
cuaaguguauacccaacua

SEQ ID NO: 760110 - RNA, 19 nt, Homo sapiens
gguaccaccuugggacuaa

SEQ ID NO: 760111 - RNA, 19 nt, Homo sapiens
ggagaugcauugguagcaa

SEQ ID NO: 760112 - RNA, 19 nt, Homo sapiens
cuccaaauaugcugaacua

SEQ ID NO: 760113 - RNA, 19 nt, Homo sapiens
ccaucacccucccuccuua

SEQ ID NO: 760114 - RNA, 19 nt, Homo sapiens
gagauaaggagaaagaaca

SEQ ID NO: 760115 - RNA, 19 nt, Homo sapiens
ggagugagagacagccuaa

SEQ ID NO: 760116 - RNA, 19 nt, Homo sapiens
ccaacuaagucccuucauc

SEQ ID NO: 760117 - RNA, 19 nt, Homo sapiens
uaauuagccuaucugaaug

SEQ ID NO: 760118 - RNA, 19 nt, Homo sapiens
aaacuggucuucaugaaaa

SEQ ID NO: 760119 - RNA, 19 nt, Homo sapiens
uaggccagcugagcacuua

SEQ ID NO: 760120 - RNA, 19 nt, Homo sapiens
cauccacuguagcuuuaua

SEQ ID NO: 760121 - RNA, 19 nt, Homo sapiens
gaaagaccaccauuaucau

SEQ ID NO: 760122 - RNA, 19 nt, Homo sapiens
gaagaaagagcccggaaaa

SEQ ID NO: 760123 - RNA, 19 nt, Homo sapiens
uuauaggucucaauucaug

SEQ ID NO: 760124 - RNA, 19 nt, Homo sapiens
ucaaucaucccuccucuug

SEQ ID NO: 760125 - RNA, 19 nt, Homo sapiens
uaggagggcugagaaaugu

SEQ ID NO: 760126 - RNA, 19 nt, Homo sapiens
ugaauuccacuccaaauau

SEQ ID NO: 760127 - RNA, 19 nt, Homo sapiens
uaaggagaaagaacagaua

SEQ ID NO: 760128 - RNA, 19 nt, Homo sapiens
aacauccacuguagcuuua

SEQ ID NO: 760129 - RNA, 19 nt, Homo sapiens
aaacauggcagagcaaaga

SEQ ID NO: 760130 - RNA, 19 nt, Homo sapiens
gaucaggaguuagcuuaag

SEQ ID NO: 760131 - RNA, 19 nt, Homo sapiens
caacuaagucccuucaucu

SEQ ID NO: 760132 - RNA, 19 nt, Homo sapiens
gcaggucuccaacaugcua

SEQ ID NO: 760133 - RNA, 19 nt, Homo sapiens
guaaagaaugugaaagcaa

SEQ ID NO: 760134 - RNA, 19 nt, Homo sapiens
agagaaggguaggagauaa

SEQ ID NO: 760135 - RNA, 19 nt, Homo sapiens
guaggagggcugagaaaug

SEQ ID NO: 760136 - RNA, 19 nt, Homo sapiens
aauaagcucuggacauucu

SEQ ID NO: 760137 - RNA, 19 nt, Homo sapiens
uaaacuggucuucaugaaa

SEQ ID NO: 760138 - RNA, 19 nt, Homo sapiens
cccgggagaugcauuggua

SEQ ID NO: 760139 - RNA, 19 nt, Homo sapiens
ccaaauaugcugaacuaag

SEQ ID NO: 760140 - RNA, 19 nt, Homo sapiens
ugugaaagcaagcauguaa

SEQ ID NO: 760141 - RNA, 19 nt, Homo sapiens
gcccucagcuugaauacag

SEQ ID NO: 760142 - RNA, 19 nt, Homo sapiens
ugaaugaggaccaaagguu

SEQ ID NO: 760143 - RNA, 19 nt, Homo sapiens
acucugggcccuuugaaua

SEQ ID NO: 760144 - RNA, 19 nt, Homo sapiens
auagugggcccauuaguaa

SEQ ID NO: 760145 - RNA, 19 nt, Homo sapiens
gacccugccuucaaucauc

SEQ ID NO: 760146 - RNA, 19 nt, Homo sapiens
gcagugccguccucucucu

SEQ ID NO: 760147 - RNA, 19 nt, Homo sapiens
gaggcuggcacaaaugaaa

SEQ ID NO: 760148 - RNA, 19 nt, Homo sapiens
gaaaccugcauuuuaguua

SEQ ID NO: 760149 - RNA, 19 nt, Homo sapiens
uaagucauguaucucugaa

SEQ ID NO: 760150 - RNA, 19 nt, Homo sapiens
uaacaccuuuagccuuaug

SEQ ID NO: 760151 - RNA, 19 nt, Homo sapiens
ucacaaguaagucauguau

SEQ ID NO: 760152 - RNA, 19 nt, Homo sapiens
ugagguugguauacaaguu

SEQ ID NO: 760153 - RNA, 19 nt, Homo sapiens
cuuuaaggccuuuagauuu

SEQ ID NO: 760154 - RNA, 19 nt, Homo sapiens
ucaccucuuccuacaaaua

SEQ ID NO: 760155 - RNA, 19 nt, Homo sapiens
ucagcaacauuuauucaag

SEQ ID NO: 760156 - RNA, 19 nt, Homo sapiens
gagcuccucccuggauuaa

SEQ ID NO: 760157 - RNA, 19 nt, Homo sapiens
aagacacccuggcaaauca

SEQ ID NO: 760158 - RNA, 19 nt, Homo sapiens
ugggaugaccuuacucuuu

SEQ ID NO: 760159 - RNA, 19 nt, Homo sapiens
ucaaagcuguaaguucuca

SEQ ID NO: 760160 - RNA, 19 nt, Homo sapiens
cagaggacuugcccaguag

SEQ ID NO: 760161 - RNA, 19 nt, Homo sapiens
ggacuccuucuuccuauca

SEQ ID NO: 760162 - RNA, 19 nt, Homo sapiens
aaagaccaccauuaucauu

SEQ ID NO: 760163 - RNA, 19 nt, Homo sapiens
gaggugcagaccaaacuuu

SEQ ID NO: 760164 - RNA, 19 nt, Homo sapiens
caagacacccuggcaaauc

SEQ ID NO: 760165 - RNA, 19 nt, Homo sapiens
gagaaugacaaggcugaaa

SEQ ID NO: 760166 - RNA, 19 nt, Homo sapiens
gaugaggcuuucuucaaac

SEQ ID NO: 760167 - RNA, 19 nt, Homo sapiens
caacaugcuaccggugaua

SEQ ID NO: 760168 - RNA, 19 nt, Homo sapiens
ucaaucacauagcaagcuu

SEQ ID NO: 760169 - RNA, 19 nt, Homo sapiens
gaagagaacuuagauuuga

SEQ ID NO: 760170 - RNA, 19 nt, Homo sapiens
ggaugaggcuuucuucaaa

SEQ ID NO: 760171 - RNA, 19 nt, Homo sapiens
ugaauaagcucuggacauu

SEQ ID NO: 760172 - RNA, 19 nt, Homo sapiens
caccugagaugcuuguuua

SEQ ID NO: 760173 - RNA, 19 nt, Homo sapiens
ucaauaggaucaggaguua

SEQ ID NO: 760174 - RNA, 19 nt, Homo sapiens
caaagaggauggagugaga

SEQ ID NO: 760175 - RNA, 19 nt, Homo sapiens
ggacauaugcuacacaaug

SEQ ID NO: 760176 - RNA, 19 nt, Homo sapiens
ccagaggacuugcccagua

SEQ ID NO: 760177 - RNA, 19 nt, Homo sapiens
gaaugaggaccaaagguua

SEQ ID NO: 760178 - RNA, 19 nt, Homo sapiens
caucaaagcuguaaguucu

SEQ ID NO: 760179 - RNA, 19 nt, Homo sapiens
gggaagagaacuuagauuu

SEQ ID NO: 760180 - RNA, 19 nt, Homo sapiens
ggccuuaaauucccaguaa

SEQ ID NO: 760181 - RNA, 19 nt, Homo sapiens
gcucuggacuucucucauu

SEQ ID NO: 760182 - RNA, 19 nt, Homo sapiens
gacauaugcuacacaauga

SEQ ID NO: 760183 - RNA, 19 nt, Homo sapiens
caaauaugcugaacuaagg

SEQ ID NO: 760184 - RNA, 19 nt, Homo sapiens
aauauaggcucuugaauuc

SEQ ID NO: 760185 - RNA, 19 nt, Homo sapiens
gauagugggcccauuagua

SEQ ID NO: 760186 - RNA, 19 nt, Homo sapiens
ggucucaauucaugacaua

SEQ ID NO: 760187 - RNA, 19 nt, Homo sapiens
gaauuccacuccaaauaug

SEQ ID NO: 760188 - RNA, 19 nt, Homo sapiens
uuuaacaccuuuagccuua

SEQ ID NO: 760189 - RNA, 19 nt, Homo sapiens
caacacacacacaaacaua

SEQ ID NO: 760190 - RNA, 19 nt, Homo sapiens
gaaagaacagauacgguuu

SEQ ID NO: 760191 - RNA, 19 nt, Homo sapiens
caucaccucuuccuacaaa

SEQ ID NO: 760192 - RNA, 19 nt, Homo sapiens
agacacggcuuccugauug

SEQ ID NO: 760193 - RNA, 19 nt, Homo sapiens
gcaaggaccucagcagcuu

SEQ ID NO: 760194 - RNA, 19 nt, Homo sapiens
gaguggauccucuucuuua

SEQ ID NO: 760195 - RNA, 19 nt, Homo sapiens
ggaagagaacuuagauuug

SEQ ID NO: 760196 - RNA, 19 nt, Homo sapiens
gaauucaggucggcaagaa

SEQ ID NO: 760197 - RNA, 19 nt, Homo sapiens
cauuauaggucucaauuca

SEQ ID NO: 760198 - RNA, 19 nt, Homo sapiens
cuacaaaccuccuauacca

SEQ ID NO: 760199 - RNA, 19 nt, Homo sapiens
ugaaagaccaccauuauca

SEQ ID NO: 760200 - RNA, 19 nt, Homo sapiens
cuaauuagccuaucugaau

SEQ ID NO: 760201 - RNA, 19 nt, Homo sapiens
gaagucauguaucucugaa

SEQ ID NO: 760202 - RNA, 19 nt, Homo sapiens
gaccaaacuuuaacaccuu

SEQ ID NO: 760203 - RNA, 19 nt, Homo sapiens
gguaggagauaaggagaaa

SEQ ID NO: 760204 - RNA, 19 nt, Homo sapiens
ggugauagugggcccauua

SEQ ID NO: 760205 - RNA, 19 nt, Homo sapiens
gaagucuuguucuacuauu

SEQ ID NO: 760206 - RNA, 19 nt, Homo sapiens
gcucuggacauucucuuua

SEQ ID NO: 760207 - RNA, 19 nt, Homo sapiens
uaucucaguuuacauguga

SEQ ID NO: 760208 - RNA, 19 nt, Homo sapiens
gagguugguauacaaguua

SEQ ID NO: 760209 - RNA, 19 nt, Homo sapiens
cagcaacauuuauucaaga

SEQ ID NO: 760210 - RNA, 19 nt, Homo sapiens
gaccaaggccuacgagaga

SEQ ID NO: 760211 - RNA, 19 nt, Homo sapiens
ggacugacaccauguucaa

SEQ ID NO: 760212 - RNA, 19 nt, Homo sapiens
aggagaagcuggacauaug

SEQ ID NO: 760213 - RNA, 19 nt, Homo sapiens
gggagaggcugcugacuac

SEQ ID NO: 760214 - RNA, 19 nt, Homo sapiens
ugaaagggaagagaacuua

SEQ ID NO: 760215 - RNA, 19 nt, Homo sapiens
aaacauccacuguagcuuu

SEQ ID NO: 760216 - RNA, 19 nt, Homo sapiens
ccgaaugcuuuaccaguuu

SEQ ID NO: 760217 - RNA, 19 nt, Homo sapiens
ccaacgaggugcagaccaa

SEQ ID NO: 760218 - RNA, 19 nt, Homo sapiens
acaaggaagucauguaucu

SEQ ID NO: 760219 - RNA, 19 nt, Homo sapiens
gggaugaccuuacucuuuu

SEQ ID NO: 760220 - RNA, 19 nt, Homo sapiens
gaaaggagaagcuggacau

SEQ ID NO: 760221 - RNA, 19 nt, Homo sapiens
cuaccaccaucucaaguaa

SEQ ID NO: 760222 - RNA, 19 nt, Homo sapiens
gacauggcaucuucagaga

SEQ ID NO: 760223 - RNA, 19 nt, Homo sapiens
gauuugaccugugcaagga

SEQ ID NO: 760224 - RNA, 19 nt, Homo sapiens
ggagaugcauugguagcaa

SEQ ID NO: 760225 - RNA, 19 nt, Homo sapiens
cuccaaauaugcugaacua

SEQ ID NO: 760226 - RNA, 19 nt, Homo sapiens
ccaucacccucccuccuua

SEQ ID NO: 760227 - RNA, 19 nt, Homo sapiens
ucagugacauggcaucuuc

SEQ ID NO: 760228 - RNA, 19 nt, Homo sapiens
gagauaaggagaaagaaca

SEQ ID NO: 760229 - RNA, 19 nt, Homo sapiens
uaggccagcugagcauuua

SEQ ID NO: 760230 - RNA, 19 nt, Homo sapiens
ggagugagagacagccuaa

SEQ ID NO: 760231 - RNA, 19 nt, Homo sapiens
gagcuucaaugggcuucua

SEQ ID NO: 760232 - RNA, 19 nt, Homo sapiens
uaauuagccuaucugaaug

SEQ ID NO: 760233 - RNA, 19 nt, Homo sapiens
gcucacugaucaacaagga

SEQ ID NO: 760234 - RNA, 19 nt, Homo sapiens
gaggaagucuuguucuacu

SEQ ID NO: 760235 - RNA, 19 nt, Homo sapiens
cauccacuguagcuuuaua

SEQ ID NO: 760236 - RNA, 19 nt, Homo sapiens
gaaagaccaccauuaucau

SEQ ID NO: 760237 - RNA, 19 nt, Homo sapiens
gaagaaagagcccggaaaa

SEQ ID NO: 760238 - RNA, 19 nt, Homo sapiens
uuauaggucucaauucaug

SEQ ID NO: 760239 - RNA, 19 nt, Homo sapiens
uaggagggcugagaaaugu

SEQ ID NO: 760240 - RNA, 19 nt, Homo sapiens
ugaauuccacuccaaauau

SEQ ID NO: 760241 - RNA, 19 nt, Homo sapiens
ggaguggauccucuucuuu

SEQ ID NO: 760242 - RNA, 19 nt, Homo sapiens
uaaggagaaagaacagaua

SEQ ID NO: 760243 - RNA, 19 nt, Homo sapiens
aacauccacuguagcuuua

SEQ ID NO: 760244 - RNA, 19 nt, Homo sapiens
aaacauggcagagcaaaga

SEQ ID NO: 760245 - RNA, 19 nt, Homo sapiens
gaucaggaguuagcuuaag

SEQ ID NO: 760246 - RNA, 19 nt, Homo sapiens
ucacaaggaagucauguau

SEQ ID NO: 760247 - RNA, 19 nt, Homo sapiens
ucgaggaagucuuguucua

SEQ ID NO: 760248 - RNA, 19 nt, Homo sapiens
ggaagucauguaucucuga

SEQ ID NO: 760249 - RNA, 19 nt, Homo sapiens
ggcgugaucucucucuaug

SEQ ID NO: 760250 - RNA, 19 nt, Homo sapiens
guaaagaaugugaaagcaa

SEQ ID NO: 760251 - RNA, 19 nt, Homo sapiens
agagaaggguaggagauaa

SEQ ID NO: 760252 - RNA, 19 nt, Homo sapiens
guaggagggcugagaaaug

SEQ ID NO: 760253 - RNA, 19 nt, Homo sapiens
aauaagcucuggacauucu

SEQ ID NO: 760254 - RNA, 19 nt, Homo sapiens
cccgggagaugcauuggua

SEQ ID NO: 760255 - RNA, 19 nt, Homo sapiens
ccaaauaugcugaacuaag

SEQ ID NO: 760256 - RNA, 19 nt, Homo sapiens
ggaagucuuguucuacuau

SEQ ID NO: 760257 - RNA, 19 nt, Homo sapiens
ugugaaagcaagcauguaa

SEQ ID NO: 760258 - RNA, 19 nt, Homo sapiens
gcccucagcuugaauacag

SEQ ID NO: 760259 - RNA, 19 nt, Homo sapiens
ugaaugaggaccaaagguu

SEQ ID NO: 760260 - RNA, 19 nt, Homo sapiens
acucugggcccuuugaaua

SEQ ID NO: 760261 - RNA, 19 nt, Homo sapiens
gcagugccguccucucucu

SEQ ID NO: 760262 - RNA, 19 nt, Homo sapiens
gaggcuggcacaaaugaaa

SEQ ID NO: 760263 - RNA, 19 nt, Homo sapiens
gaaaccugcauuuuaguua

SEQ ID NO: 760264 - RNA, 19 nt, Homo sapiens
auagugggcccauuaguaa

SEQ ID NO: 760265 - RNA, 19 nt, Homo sapiens
gaucgaggaagucuuguuc

SEQ ID NO: 760266 - RNA, 19 nt, Homo sapiens
uaacaccuuuagccuuaug

SEQ ID NO: 760267 - RNA, 19 nt, Homo sapiens
uggauccucuucuuuauag

SEQ ID NO: 760268 - RNA, 19 nt, Homo sapiens
ugagguugguauacaaguu

SEQ ID NO: 760269 - RNA, 19 nt, Homo sapiens
gaaccgaaaugcuacacua

SEQ ID NO: 760270 - RNA, 19 nt, Homo sapiens
caacugaagucaaguaugu

SEQ ID NO: 760271 - RNA, 19 nt, Homo sapiens
ggagaaacuuguagacuau

SEQ ID NO: 760272 - RNA, 19 nt, Homo sapiens
guagaaaguccaagaauaa

SEQ ID NO: 760273 - RNA, 19 nt, Homo sapiens
ugaaagcgguuuagugauu

SEQ ID NO: 760274 - RNA, 19 nt, Homo sapiens
ccagaaaccuuuguuagaa

SEQ ID NO: 760275 - RNA, 19 nt, Homo sapiens
uggcaugugugguuuauua

SEQ ID NO: 760276 - RNA, 19 nt, Homo sapiens
gaagggagaacgcauguuu

SEQ ID NO: 760277 - RNA, 19 nt, Homo sapiens
agagacagccguauuaaua

SEQ ID NO: 760278 - RNA, 19 nt, Homo sapiens
gagcauauguaaacucugu

SEQ ID NO: 760279 - RNA, 19 nt, Homo sapiens
ccaagaaagugaaauaaag

SEQ ID NO: 760280 - RNA, 19 nt, Homo sapiens
uaccauauaugcaggauaa

SEQ ID NO: 760281 - RNA, 19 nt, Homo sapiens
ucaaagaaauggcagaugu

SEQ ID NO: 760282 - RNA, 19 nt, Homo sapiens
ugaauuaacuguagcaaag

SEQ ID NO: 760283 - RNA, 19 nt, Homo sapiens
ggagaugcuuucccaagaa

SEQ ID NO: 760284 - RNA, 19 nt, Homo sapiens
gauaauguuuccaaagaug

SEQ ID NO: 760285 - RNA, 19 nt, Homo sapiens
ccagugaucuugagacuuc

SEQ ID NO: 760286 - RNA, 19 nt, Homo sapiens
ggugaaaucuauccuuaau

SEQ ID NO: 760287 - RNA, 19 nt, Homo sapiens
ggaaagaguguuauaagug

SEQ ID NO: 760288 - RNA, 19 nt, Homo sapiens
ucacaugaauucuuggaaa

SEQ ID NO: 760289 - RNA, 19 nt, Homo sapiens
uguagaaaguccaagaaua

SEQ ID NO: 760290 - RNA, 19 nt, Homo sapiens
guaaacacgagcccuaaua

SEQ ID NO: 760291 - RNA, 19 nt, Homo sapiens
gaaggagaaagaagagaua

SEQ ID NO: 760292 - RNA, 19 nt, Homo sapiens
uguaaacucugucaucauu

SEQ ID NO: 760293 - RNA, 19 nt, Homo sapiens
caaaacagcugcauugguu

SEQ ID NO: 760294 - RNA, 19 nt, Homo sapiens
gaaagcgguuuagugauug

SEQ ID NO: 760295 - RNA, 19 nt, Homo sapiens
cacgagcccuaauaucuua

SEQ ID NO: 760296 - RNA, 19 nt, Homo sapiens
caggagagaugguuuaaag

SEQ ID NO: 760297 - RNA, 19 nt, Homo sapiens
gaagugacagccauagaaa

SEQ ID NO: 760298 - RNA, 19 nt, Homo sapiens
gaccaaaccuuccagugau

SEQ ID NO: 760299 - RNA, 19 nt, Homo sapiens
gaacuccauuugacagaug

SEQ ID NO: 760300 - RNA, 19 nt, Homo sapiens
gcuacucuuugaugaauuu

SEQ ID NO: 760301 - RNA, 19 nt, Homo sapiens
ucgcgucacugaaucuuua

SEQ ID NO: 760302 - RNA, 19 nt, Homo sapiens
gagaagcaguuuuauguuu

SEQ ID NO: 760303 - RNA, 19 nt, Homo sapiens
ggaagugacagccauagaa

SEQ ID NO: 760304 - RNA, 19 nt, Homo sapiens
gaaccaagggucugaugaa

SEQ ID NO: 760305 - RNA, 19 nt, Homo sapiens
guucuaaucaugucagaua

SEQ ID NO: 760306 - RNA, 19 nt, Homo sapiens
gagacagccguauuaauaa

SEQ ID NO: 760307 - RNA, 19 nt, Homo sapiens
cuauuaagcugucgucuuc

SEQ ID NO: 760308 - RNA, 19 nt, Homo sapiens
caauugaacuauuccacaa

SEQ ID NO: 760309 - RNA, 19 nt, Homo sapiens
ucacauaucgcgucacuga

SEQ ID NO: 760310 - RNA, 19 nt, Homo sapiens
gaacgcauguuugcucauc

SEQ ID NO: 760311 - RNA, 19 nt, Homo sapiens
ccauaguccuuuagaaaug

SEQ ID NO: 760312 - RNA, 19 nt, Homo sapiens
gaaauaccgcccacgaaug

SEQ ID NO: 760313 - RNA, 19 nt, Homo sapiens
ugaauuagagcaacucaaa

SEQ ID NO: 760314 - RNA, 19 nt, Homo sapiens
aggagaaacuuguagacua

SEQ ID NO: 760315 - RNA, 19 nt, Homo sapiens
caaacucuuucccagauga

SEQ ID NO: 760316 - RNA, 19 nt, Homo sapiens
gcaacucaaagaaacauuu

SEQ ID NO: 760317 - RNA, 19 nt, Homo sapiens
gaaaugcuacacuaucuca

SEQ ID NO: 760318 - RNA, 19 nt, Homo sapiens
ggauaauguuuccaaagau

SEQ ID NO: 760319 - RNA, 19 nt, Homo sapiens
gaguaaaucagaaccugua

SEQ ID NO: 760320 - RNA, 19 nt, Homo sapiens
gaggaauucuugucguugu

SEQ ID NO: 760321 - RNA, 19 nt, Homo sapiens
gcuacacuaucucagguuu

SEQ ID NO: 760322 - RNA, 19 nt, Homo sapiens
uaaaucagaaccuguaguu

SEQ ID NO: 760323 - RNA, 19 nt, Homo sapiens
ggccauaguccuuuagaaa

SEQ ID NO: 760324 - RNA, 19 nt, Homo sapiens
gaagugggccauaguccuu

SEQ ID NO: 760325 - RNA, 19 nt, Homo sapiens
gccauguacuuucuccuuu

SEQ ID NO: 760326 - RNA, 19 nt, Homo sapiens
gccaaacucuuucccagau

SEQ ID NO: 760327 - RNA, 19 nt, Homo sapiens
agacuccacugcuaacuga

SEQ ID NO: 760328 - RNA, 19 nt, Homo sapiens
caagugauagcagcuguua

SEQ ID NO: 760329 - RNA, 19 nt, Homo sapiens
aaacugagcauauguaaac

SEQ ID NO: 760330 - RNA, 19 nt, Homo sapiens
ggguuuggaugccuuagaa

SEQ ID NO: 760331 - RNA, 19 nt, Homo sapiens
aggauaauguuuccaaaga

SEQ ID NO: 760332 - RNA, 19 nt, Homo sapiens
acagcaaacuccaaaggaa

SEQ ID NO: 760333 - RNA, 19 nt, Homo sapiens
guagauauuuggcauugag

SEQ ID NO: 760334 - RNA, 19 nt, Homo sapiens
caugugugguuuauuaaug

SEQ ID NO: 760335 - RNA, 19 nt, Homo sapiens
gagaugguuuaaagaggaa

SEQ ID NO: 760336 - RNA, 19 nt, Homo sapiens
gaaauggcagauguccuua

SEQ ID NO: 760337 - RNA, 19 nt, Homo sapiens
gggcuacucuuugaugaau

SEQ ID NO: 760338 - RNA, 19 nt, Homo sapiens
gacaauggaugugauagca

SEQ ID NO: 760339 - RNA, 19 nt, Homo sapiens
agacaaaugccaaagagaa

SEQ ID NO: 760340 - RNA, 19 nt, Homo sapiens
ccaaaggaauguugaagcu

SEQ ID NO: 760341 - RNA, 19 nt, Homo sapiens
gaacccuacucuacuggau

SEQ ID NO: 760342 - RNA, 19 nt, Homo sapiens
gccagaaaccuuuguuaga

SEQ ID NO: 760343 - RNA, 19 nt, Homo sapiens
cagauguccuuaacccauu

SEQ ID NO: 760344 - RNA, 19 nt, Homo sapiens
uuucaaaugucaucgagaa

SEQ ID NO: 760345 - RNA, 19 nt, Homo sapiens
caaaaguucucucuauuca

SEQ ID NO: 760346 - RNA, 19 nt, Homo sapiens
caagaauucugagucuguu

SEQ ID NO: 760347 - RNA, 19 nt, Homo sapiens
acaguauucuuuccaguug

SEQ ID NO: 760348 - RNA, 19 nt, Homo sapiens
ggagagaugguuuaaagag

SEQ ID NO: 760349 - RNA, 19 nt, Homo sapiens
ucuagagacagccguauua

SEQ ID NO: 760350 - RNA, 19 nt, Homo sapiens
ccaggacgccuuucagcua

SEQ ID NO: 760351 - RNA, 19 nt, Homo sapiens
ucuagaagcucuggagaug

SEQ ID NO: 760352 - RNA, 19 nt, Homo sapiens
gauaggauacaaaccauca

SEQ ID NO: 760353 - RNA, 19 nt, Homo sapiens
cauaguccuuuagaaauga

SEQ ID NO: 760354 - RNA, 19 nt, Homo sapiens
uauguaaacucugucauca

SEQ ID NO: 760355 - RNA, 19 nt, Homo sapiens
gugaggaauucuugucguu

SEQ ID NO: 760356 - RNA, 19 nt, Homo sapiens
ucaaggccuuucacaucua

SEQ ID NO: 760357 - RNA, 19 nt, Homo sapiens
gagaggcgaaggagaaaga

SEQ ID NO: 760358 - RNA, 19 nt, Homo sapiens
caaaugccaaagagaauga

SEQ ID NO: 760359 - RNA, 19 nt, Homo sapiens
gauugaagcgcuacguuug

SEQ ID NO: 760360 - RNA, 19 nt, Homo sapiens
cgucgaaucucucguuugg

SEQ ID NO: 760361 - RNA, 19 nt, Homo sapiens
uaaacucugucaucauuac

SEQ ID NO: 760362 - RNA, 19 nt, Homo sapiens
ugugaaagcgguuuaguga

SEQ ID NO: 760363 - RNA, 19 nt, Homo sapiens
guucagagcacaggaaaga

SEQ ID NO: 760364 - RNA, 19 nt, Homo sapiens
ggacccagaacuccauuug

SEQ ID NO: 760365 - RNA, 19 nt, Homo sapiens
uaaacacgagcccuaauau

SEQ ID NO: 760366 - RNA, 19 nt, Homo sapiens
gcugaacccuacucuacug

SEQ ID NO: 760367 - RNA, 19 nt, Homo sapiens
ccaagaauaauaacucuag

SEQ ID NO: 760368 - RNA, 19 nt, Homo sapiens
guauucagguucucacagu

SEQ ID NO: 760369 - RNA, 19 nt, Homo sapiens
caaaggagaugaacaguuu

SEQ ID NO: 760370 - RNA, 19 nt, Homo sapiens
caacuuaccuucggauaua

SEQ ID NO: 760371 - RNA, 19 nt, Homo sapiens
guacagcugucauuugaua

SEQ ID NO: 760372 - RNA, 19 nt, Homo sapiens
gaaagucgaugccuucuag

SEQ ID NO: 760373 - RNA, 19 nt, Homo sapiens
gcauagagcugacagaaca

SEQ ID NO: 760374 - RNA, 19 nt, Homo sapiens
agaaagagauugguucaua

SEQ ID NO: 760375 - RNA, 19 nt, Homo sapiens
caaaagcacuuguuacaua

SEQ ID NO: 760376 - RNA, 19 nt, Homo sapiens
gagagaagcccuuugauug

SEQ ID NO: 760377 - RNA, 19 nt, Homo sapiens
agagggcacuggaauauua

SEQ ID NO: 760378 - RNA, 19 nt, Homo sapiens
gaaacugucucuuuaaacu

SEQ ID NO: 760379 - RNA, 19 nt, Homo sapiens
uaacguguguccuguaauu

SEQ ID NO: 760380 - RNA, 19 nt, Homo sapiens
gggcaagucuggcaccuuu

SEQ ID NO: 760381 - RNA, 19 nt, Homo sapiens
gaaagagauugguucauag

SEQ ID NO: 760382 - RNA, 19 nt, Homo sapiens
cuacguauauuguuccuuu

SEQ ID NO: 760383 - RNA, 19 nt, Homo sapiens
gaaguacucugccaugucu

SEQ ID NO: 760384 - RNA, 19 nt, Homo sapiens
gcaguucuuucuauauuga

SEQ ID NO: 760385 - RNA, 19 nt, Homo sapiens
cagaaacugucucuuuaaa

SEQ ID NO: 760386 - RNA, 19 nt, Homo sapiens
ccacaugccuugaauccaa

SEQ ID NO: 760387 - RNA, 19 nt, Homo sapiens
aagaguagcuuguaccauu

SEQ ID NO: 760388 - RNA, 19 nt, Homo sapiens
cuucaaaccuuguuacuau

SEQ ID NO: 760389 - RNA, 19 nt, Homo sapiens
gaucugaaaugcaaacaag

SEQ ID NO: 760390 - RNA, 19 nt, Homo sapiens
ccaaacaaaugcucuuuua

SEQ ID NO: 760391 - RNA, 19 nt, Homo sapiens
caucauagauuagccagaa

SEQ ID NO: 760392 - RNA, 19 nt, Homo sapiens
gcagagagaagcccuuuga

SEQ ID NO: 760393 - RNA, 19 nt, Homo sapiens
gaacagagggcacuggaau

SEQ ID NO: 760394 - RNA, 19 nt, Homo sapiens
acacugauccugcuaagua

SEQ ID NO: 760395 - RNA, 19 nt, Homo sapiens
gcagaaacugucucuuuaa

SEQ ID NO: 760396 - RNA, 19 nt, Homo sapiens
ugaaacccguguucucuuu

SEQ ID NO: 760397 - RNA, 19 nt, Homo sapiens
ugucugaaaucacuacuuu

SEQ ID NO: 760398 - RNA, 19 nt, Homo sapiens
gaccaccagucucaucuuu

SEQ ID NO: 760399 - RNA, 19 nt, Homo sapiens
gagaagggcugggaaugug

SEQ ID NO: 760400 - RNA, 19 nt, Homo sapiens
gcacccuguucucuuauuu

SEQ ID NO: 760401 - RNA, 19 nt, Homo sapiens
gcaccugacugcaugaaca

SEQ ID NO: 760402 - RNA, 19 nt, Homo sapiens
gcuuguaccauuuaacuua

SEQ ID NO: 760403 - RNA, 19 nt, Homo sapiens
agcagaaacugucucuuua

SEQ ID NO: 760404 - RNA, 19 nt, Homo sapiens
gaaaugggccagagaagca

SEQ ID NO: 760405 - RNA, 19 nt, Homo sapiens
gaauagucccuacccaauu

SEQ ID NO: 760406 - RNA, 19 nt, Homo sapiens
ccacuuaaggucauacuuu

SEQ ID NO: 760407 - RNA, 19 nt, Homo sapiens
gaucccagcuuuccugaag

SEQ ID NO: 760408 - RNA, 19 nt, Homo sapiens
cucauuaccuugucuguuu

SEQ ID NO: 760409 - RNA, 19 nt, Homo sapiens
gaugagcuguguccauuag

SEQ ID NO: 760410 - RNA, 19 nt, Homo sapiens
gugaggaaauguguucuuu

SEQ ID NO: 760411 - RNA, 19 nt, Homo sapiens
caucuccuuugacuaguua

SEQ ID NO: 760412 - RNA, 19 nt, Homo sapiens
uccgauggcuugugcguua

SEQ ID NO: 760413 - RNA, 19 nt, Homo sapiens
cagaggauuuggugacauu

SEQ ID NO: 760414 - RNA, 19 nt, Homo sapiens
uaacucagaacguagcaua

SEQ ID NO: 760415 - RNA, 19 nt, Homo sapiens
caugagggaucccauugaa

SEQ ID NO: 760416 - RNA, 19 nt, Homo sapiens
ugacuuaaaugguguuucu

SEQ ID NO: 760417 - RNA, 19 nt, Homo sapiens
aaaugagccucuccuggua

SEQ ID NO: 760418 - RNA, 19 nt, Homo sapiens
gaccauauuugcagaacau

SEQ ID NO: 760419 - RNA, 19 nt, Homo sapiens
uguguucucuguucucuaa

SEQ ID NO: 760420 - RNA, 19 nt, Homo sapiens
aaacguguguucucuguuc

SEQ ID NO: 760421 - RNA, 19 nt, Homo sapiens
caugguauguucuuggauu

SEQ ID NO: 760422 - RNA, 19 nt, Homo sapiens
gcacgugcaugagauguuc

SEQ ID NO: 760423 - RNA, 19 nt, Homo sapiens
guucauuuaucguuuguug

SEQ ID NO: 760424 - RNA, 19 nt, Homo sapiens
uaacuucucucuuacucau

SEQ ID NO: 760425 - RNA, 19 nt, Homo sapiens
gcugggacguggugucuug

SEQ ID NO: 760426 - RNA, 19 nt, Homo sapiens
gccggugacucuagaacua

SEQ ID NO: 760427 - RNA, 19 nt, Homo sapiens
gaacaucauuuugcuugua

SEQ ID NO: 760428 - RNA, 19 nt, Homo sapiens
gcugucauuugauaaagaa

SEQ ID NO: 760429 - RNA, 19 nt, Homo sapiens
gugaaucugugucugaaau

SEQ ID NO: 760430 - RNA, 19 nt, Homo sapiens
gaggagcacuaaagcaaag

SEQ ID NO: 760431 - RNA, 19 nt, Homo sapiens
ucucuuaugcgaugacuua

SEQ ID NO: 760432 - RNA, 19 nt, Homo sapiens
ggacugaaacccuaugagu

SEQ ID NO: 760433 - RNA, 19 nt, Homo sapiens
ggacaccuuucggcuuaaa

SEQ ID NO: 760434 - RNA, 19 nt, Homo sapiens
aagcagaaacugucucuuu

SEQ ID NO: 760435 - RNA, 19 nt, Homo sapiens
gagauguuccuccuucaaa

SEQ ID NO: 760436 - RNA, 19 nt, Homo sapiens
ggccucaguucuugcagua

SEQ ID NO: 760437 - RNA, 19 nt, Homo sapiens
uaacuuucauugcuucugu

SEQ ID NO: 760438 - RNA, 19 nt, Homo sapiens
auugcuaacuucucucuua

SEQ ID NO: 760439 - RNA, 19 nt, Homo sapiens
gagcagcacaguacucaga

SEQ ID NO: 760440 - RNA, 19 nt, Homo sapiens
aauagucccuacccaauug

SEQ ID NO: 760441 - RNA, 19 nt, Homo sapiens
gcaccuuuaccuagaagua

SEQ ID NO: 760442 - RNA, 19 nt, Homo sapiens
uguagcaguucuuucuaua

SEQ ID NO: 760443 - RNA, 19 nt, Homo sapiens
guauggagguacacacuca

SEQ ID NO: 760444 - RNA, 19 nt, Homo sapiens
caccagcaauuuauaagug

SEQ ID NO: 760445 - RNA, 19 nt, Homo sapiens
cacuuuggauguuuacuuu

SEQ ID NO: 760446 - RNA, 19 nt, Homo sapiens
ugaaguagaucccuuuuau

SEQ ID NO: 760447 - RNA, 19 nt, Homo sapiens
ugucuugcccguucauuua

SEQ ID NO: 760448 - RNA, 19 nt, Homo sapiens
caccagggcugugcuguga

SEQ ID NO: 760449 - RNA, 19 nt, Homo sapiens
ccacagaagccacagauag

SEQ ID NO: 760450 - RNA, 19 nt, Homo sapiens
gaaagccuguguggcauag

SEQ ID NO: 760451 - RNA, 19 nt, Homo sapiens
ugacugagcagcagauuca

SEQ ID NO: 760452 - RNA, 19 nt, Homo sapiens
gauguucucuuuuccaauu

SEQ ID NO: 760453 - RNA, 19 nt, Homo sapiens
gagcauagagcugacagaa

SEQ ID NO: 760454 - RNA, 19 nt, Homo sapiens
ggcagucccucuugagaug

SEQ ID NO: 760455 - RNA, 19 nt, Homo sapiens
gaaucugugucugaaauca

SEQ ID NO: 760456 - RNA, 19 nt, Homo sapiens
gcaaaugguccguucaucu

SEQ ID NO: 760457 - RNA, 19 nt, Homo sapiens
gcuuagaggucaucaacuc

SEQ ID NO: 760458 - RNA, 19 nt, Homo sapiens
ccucugaccucaucaagca

SEQ ID NO: 760459 - RNA, 19 nt, Homo sapiens
ucaaacguguguucucugu

SEQ ID NO: 760460 - RNA, 19 nt, Homo sapiens
ugauggugauguucucuuu

SEQ ID NO: 760461 - RNA, 19 nt, Homo sapiens
cuuaugcgaugacuuaaau

SEQ ID NO: 760462 - RNA, 19 nt, Homo sapiens
uggccuacuugaauuuaua

SEQ ID NO: 760463 - RNA, 19 nt, Homo sapiens
gcucggcacugcagaagca

SEQ ID NO: 760464 - RNA, 19 nt, Homo sapiens
gcagcaagcaaucaucaga

SEQ ID NO: 760465 - RNA, 19 nt, Homo sapiens
guucuggcaucacuuccua

SEQ ID NO: 760466 - RNA, 19 nt, Homo sapiens
gcaaugcuccgaguggauu

SEQ ID NO: 760467 - RNA, 19 nt, Homo sapiens
gaagaaugcaggccugagu

SEQ ID NO: 760468 - RNA, 19 nt, Homo sapiens
ggggacaccuuucggcuua

SEQ ID NO: 760469 - RNA, 19 nt, Homo sapiens
caacaaggcugugcagaug

SEQ ID NO: 760470 - RNA, 19 nt, Homo sapiens
uugcagagcugacauuaaa

SEQ ID NO: 760471 - RNA, 19 nt, Homo sapiens
gaacagaaacugacauuuu

SEQ ID NO: 760472 - RNA, 19 nt, Homo sapiens
guacauggcauccaccuuu

SEQ ID NO: 760473 - RNA, 19 nt, Homo sapiens
gaagaggugcggaagauga

SEQ ID NO: 760474 - RNA, 19 nt, Homo sapiens
guugaagacuccacugauu

SEQ ID NO: 760475 - RNA, 19 nt, Homo sapiens
ccaaaguccuggagguuga

SEQ ID NO: 760476 - RNA, 19 nt, Homo sapiens
gaaaagcugugccauaagu

SEQ ID NO: 760477 - RNA, 19 nt, Homo sapiens
ggccaggguucuucuuuga

SEQ ID NO: 760478 - RNA, 19 nt, Homo sapiens
uaaguaacgugaagaaggu

SEQ ID NO: 760479 - RNA, 19 nt, Homo sapiens
ggaacacaguggugaucaa

SEQ ID NO: 760480 - RNA, 19 nt, Homo sapiens
gcugaucgcugagggcaaa

SEQ ID NO: 760481 - RNA, 19 nt, Homo sapiens
ggacuucauccagcuguua

SEQ ID NO: 760482 - RNA, 19 nt, Homo sapiens
ccacugauuucuucaaguc

SEQ ID NO: 760483 - RNA, 19 nt, Homo sapiens
acucaacgcugaacacuuc

SEQ ID NO: 760484 - RNA, 19 nt, Homo sapiens
gaagaccacauguucauag

SEQ ID NO: 760485 - RNA, 19 nt, Homo sapiens
caaaggagagaauugcauu

SEQ ID NO: 760486 - RNA, 19 nt, Homo sapiens
gaaggagggccacgaagug

SEQ ID NO: 760487 - RNA, 19 nt, Homo sapiens
gaagaaggugucccuggaa

SEQ ID NO: 760488 - RNA, 19 nt, Homo sapiens
gugauggccuggaguuaga

SEQ ID NO: 760489 - RNA, 19 nt, Homo sapiens
agacagugaccuucgaaua

SEQ ID NO: 760490 - RNA, 19 nt, Homo sapiens
ggaaggagccaccuaugag

SEQ ID NO: 760491 - RNA, 19 nt, Homo sapiens
gagugccgguauucaagua

SEQ ID NO: 760492 - RNA, 19 nt, Homo sapiens
caugaagauugcagugauu

SEQ ID NO: 760493 - RNA, 19 nt, Homo sapiens
ggaagaccacauguucaua

SEQ ID NO: 760494 - RNA, 19 nt, Homo sapiens
uagaagaggugcggaagau

SEQ ID NO: 760495 - RNA, 19 nt, Homo sapiens
ccaaaggugugguuaacgu

SEQ ID NO: 760496 - RNA, 19 nt, Homo sapiens
ggaaauggcagugaacaag

SEQ ID NO: 760497 - RNA, 19 nt, Homo sapiens
agacuccacugauuucuuc

SEQ ID NO: 760498 - RNA, 19 nt, Homo sapiens
uugugaagcugauggagua

SEQ ID NO: 760499 - RNA, 19 nt, Homo sapiens
guacaaccgcuuccucuuc

SEQ ID NO: 760500 - RNA, 19 nt, Homo sapiens
gcagcaggccgacucuuug

SEQ ID NO: 760501 - RNA, 19 nt, Homo sapiens
caucaucuuugcugacugu

SEQ ID NO: 760502 - RNA, 19 nt, Homo sapiens
gaaggagacagccaagauc

SEQ ID NO: 760503 - RNA, 19 nt, Homo sapiens
ggaaggagggccacgaagu

SEQ ID NO: 760504 - RNA, 19 nt, Homo sapiens
gcauguccauccagaccuu

SEQ ID NO: 760505 - RNA, 19 nt, Homo sapiens
ccaugaagauugcagugau

SEQ ID NO: 760506 - RNA, 19 nt, Homo sapiens
caacaaggcccuguauguc

SEQ ID NO: 760507 - RNA, 19 nt, Homo sapiens
gaagauugcagugauugga

SEQ ID NO: 760508 - RNA, 19 nt, Homo sapiens
ucaacaaggcccuguaugu

SEQ ID NO: 760509 - RNA, 19 nt, Homo sapiens
aggcggcucugaacgagua

SEQ ID NO: 760510 - RNA, 19 nt, Homo sapiens
gaaucaccaugcccaccuu

SEQ ID NO: 760511 - RNA, 19 nt, Homo sapiens
gagggcgagugcagcauug

SEQ ID NO: 760512 - RNA, 19 nt, Homo sapiens
aaaugcugcuggugaagaa

SEQ ID NO: 760513 - RNA, 19 nt, Homo sapiens
gaucaucucucgguuugcu

SEQ ID NO: 760514 - RNA, 19 nt, Homo sapiens
gcaagcacaucaugaaaag

SEQ ID NO: 760515 - RNA, 19 nt, Homo sapiens
ugaugaugcuguccuggaa

SEQ ID NO: 760516 - RNA, 19 nt, Homo sapiens
gacagugaccuucgaauac

SEQ ID NO: 760517 - RNA, 19 nt, Homo sapiens
gggcaagcacaucaugaaa

SEQ ID NO: 760518 - RNA, 19 nt, Homo sapiens
ucaagacagugaccuucga

SEQ ID NO: 760519 - RNA, 19 nt, Homo sapiens
gaugaguucuguuuucuuc

SEQ ID NO: 760520 - RNA, 19 nt, Homo sapiens
gaaggugucccuggaacug

SEQ ID NO: 760521 - RNA, 19 nt, Homo sapiens
acucacagccuugaaguuu

SEQ ID NO: 760522 - RNA, 19 nt, Homo sapiens
gaacacaguggugaucaag

SEQ ID NO: 760523 - RNA, 19 nt, Homo sapiens
ggagggcgagugcagcauu

SEQ ID NO: 760524 - RNA, 19 nt, Homo sapiens
caccaaagcaggacucauc

SEQ ID NO: 760525 - RNA, 19 nt, Homo sapiens
cagaggccauucacaacug

SEQ ID NO: 760526 - RNA, 19 nt, Homo sapiens
ccaggcaggcacuguguuu

SEQ ID NO: 760527 - RNA, 19 nt, Homo sapiens
caacaaaggagagaauugc

SEQ ID NO: 760528 - RNA, 19 nt, Homo sapiens
gaggaaggagggccacgaa

SEQ ID NO: 760529 - RNA, 19 nt, Homo sapiens
gucaacacguacaacaaga

SEQ ID NO: 760530 - RNA, 19 nt, Homo sapiens
gggccaaugccacggaauu

SEQ ID NO: 760531 - RNA, 19 nt, Homo sapiens
aaagcugugccauaaguaa

SEQ ID NO: 760532 - RNA, 19 nt, Homo sapiens
cggcagaggccauucacaa

SEQ ID NO: 760533 - RNA, 19 nt, Homo sapiens
gcagagcugacauuaaagg

SEQ ID NO: 760534 - RNA, 19 nt, Homo sapiens
cagcauugacuacguggaa

SEQ ID NO: 760535 - RNA, 19 nt, Homo sapiens
ugaagacuccacugauuuc

SEQ ID NO: 760536 - RNA, 19 nt, Homo sapiens
aaaugauccuggccucgaa

SEQ ID NO: 760537 - RNA, 19 nt, Homo sapiens
gugaacagaaacugacauu

SEQ ID NO: 760538 - RNA, 19 nt, Homo sapiens
gauucaaacagucuggauu

SEQ ID NO: 760539 - RNA, 19 nt, Homo sapiens
ggccaaugccacggaauuu

SEQ ID NO: 760540 - RNA, 19 nt, Homo sapiens
gaggagcuggccaccauug

SEQ ID NO: 760541 - RNA, 19 nt, Homo sapiens
gauccuggccucgaacuuc

SEQ ID NO: 760542 - RNA, 19 nt, Homo sapiens
gcagaggccauucacaacu

SEQ ID NO: 760543 - RNA, 19 nt, Homo sapiens
gaauuuggccuggcuucug

SEQ ID NO: 760544 - RNA, 19 nt, Homo sapiens
cggccaggguucuucuuug

SEQ ID NO: 760545 - RNA, 19 nt, Homo sapiens
guagaagaggugcggaaga

SEQ ID NO: 760546 - RNA, 19 nt, Homo sapiens
ucaacaaaggagagaauug

SEQ ID NO: 760547 - RNA, 19 nt, Homo sapiens
ccauaaguaacgugaagaa

SEQ ID NO: 760548 - RNA, 19 nt, Homo sapiens
ucacagccuugaaguuugc

SEQ ID NO: 760549 - RNA, 19 nt, Homo sapiens
gaggcugugcggaguguuu

SEQ ID NO: 760550 - RNA, 19 nt, Homo sapiens
guggguguguucacuguuc

SEQ ID NO: 760551 - RNA, 19 nt, Homo sapiens
caucaacaaggcccuguau

SEQ ID NO: 760552 - RNA, 19 nt, Homo sapiens
gaggaaggagccaccuaug

SEQ ID NO: 760553 - RNA, 19 nt, Homo sapiens
ugaagcugauggaguacug

SEQ ID NO: 760554 - RNA, 19 nt, Homo sapiens
gcggcucacagaagucuaa

SEQ ID NO: 760555 - RNA, 19 nt, Homo sapiens
ucaacaaggcugugcagau

SEQ ID NO: 760556 - RNA, 19 nt, Homo sapiens
gaaguuugcagagcugaca

SEQ ID NO: 760557 - RNA, 19 nt, Homo sapiens
ucuacacgcuggcccugaa

SEQ ID NO: 760558 - RNA, 19 nt, Homo sapiens
aggaggagcuggccaccau

SEQ ID NO: 760559 - RNA, 19 nt, Homo sapiens
uacauggcauccaccuuug

SEQ ID NO: 760560 - RNA, 19 nt, Homo sapiens
uugaagacuccacugauuu

SEQ ID NO: 760561 - RNA, 19 nt, Homo sapiens
ucuggaagcugagaaggau

SEQ ID NO: 760562 - RNA, 19 nt, Homo sapiens
agaaggagacagccaagau

SEQ ID NO: 760563 - RNA, 19 nt, Homo sapiens
caagacagugaccuucgaa

SEQ ID NO: 760564 - RNA, 19 nt, Homo sapiens
augaucaucucucgguuug

SEQ ID NO: 760565 - RNA, 19 nt, Homo sapiens
caugaucaucucucgguuu

SEQ ID NO: 760566 - RNA, 19 nt, Homo sapiens
caccaugcccaccuuguga

SEQ ID NO: 760567 - RNA, 19 nt, Homo sapiens
augaaaagcugugccauaa

SEQ ID NO: 760568 - RNA, 19 nt, Homo sapiens
gaggugggcaagcacauca

SEQ ID NO: 760569 - RNA, 19 nt, Homo sapiens
uugcagagcugacauuaaa

SEQ ID NO: 760570 - RNA, 19 nt, Homo sapiens
gaacagaaacugacauuuu

SEQ ID NO: 760571 - RNA, 19 nt, Homo sapiens
guacauggcauccaccuuu

SEQ ID NO: 760572 - RNA, 19 nt, Homo sapiens
gaagaggugcggaagauga

SEQ ID NO: 760573 - RNA, 19 nt, Homo sapiens
guugaagacuccacugauu

SEQ ID NO: 760574 - RNA, 19 nt, Homo sapiens
ccaaaguccuggagguuga

SEQ ID NO: 760575 - RNA, 19 nt, Homo sapiens
ggccaggguucuucuuuga

SEQ ID NO: 760576 - RNA, 19 nt, Homo sapiens
ggaacacaguggugaucaa

SEQ ID NO: 760577 - RNA, 19 nt, Homo sapiens
gcugaucgcugagggcaaa

SEQ ID NO: 760578 - RNA, 19 nt, Homo sapiens
ggacuucauccagcuguua

SEQ ID NO: 760579 - RNA, 19 nt, Homo sapiens
ccacugauuucuucaaguc

SEQ ID NO: 760580 - RNA, 19 nt, Homo sapiens
acucaacgcugaacacuuc

SEQ ID NO: 760581 - RNA, 19 nt, Homo sapiens
gaagaccacauguucauag

SEQ ID NO: 760582 - RNA, 19 nt, Homo sapiens
caaaggagagaauugcauu

SEQ ID NO: 760583 - RNA, 19 nt, Homo sapiens
gaaggagggccacgaagug

SEQ ID NO: 760584 - RNA, 19 nt, Homo sapiens
gugauggccuggaguuaga

SEQ ID NO: 760585 - RNA, 19 nt, Homo sapiens
agacagugaccuucgaaua

SEQ ID NO: 760586 - RNA, 19 nt, Homo sapiens
ggaaggagccaccuaugag

SEQ ID NO: 760587 - RNA, 19 nt, Homo sapiens
gagugccgguauucaagua

SEQ ID NO: 760588 - RNA, 19 nt, Homo sapiens
caugaagauugcagugauu

SEQ ID NO: 760589 - RNA, 19 nt, Homo sapiens
ggaagaccacauguucaua

SEQ ID NO: 760590 - RNA, 19 nt, Homo sapiens
uagaagaggugcggaagau

SEQ ID NO: 760591 - RNA, 19 nt, Homo sapiens
ccaaaggugugguuaacgu

SEQ ID NO: 760592 - RNA, 19 nt, Homo sapiens
ggaaauggcagugaacaag

SEQ ID NO: 760593 - RNA, 19 nt, Homo sapiens
agacuccacugauuucuuc

SEQ ID NO: 760594 - RNA, 19 nt, Homo sapiens
uugugaagcugauggagua

SEQ ID NO: 760595 - RNA, 19 nt, Homo sapiens
guacaaccgcuuccucuuc

SEQ ID NO: 760596 - RNA, 19 nt, Homo sapiens
gcagcaggccgacucuuug

SEQ ID NO: 760597 - RNA, 19 nt, Homo sapiens
gaaggagacagccaagauc

SEQ ID NO: 760598 - RNA, 19 nt, Homo sapiens
ggaaggagggccacgaagu

SEQ ID NO: 760599 - RNA, 19 nt, Homo sapiens
ccaugaagauugcagugau

SEQ ID NO: 760600 - RNA, 19 nt, Homo sapiens
caacaaggcccuguauguc

SEQ ID NO: 760601 - RNA, 19 nt, Homo sapiens
ucaacaaggcccuguaugu

SEQ ID NO: 760602 - RNA, 19 nt, Homo sapiens
gaagauugcagugauugga

SEQ ID NO: 760603 - RNA, 19 nt, Homo sapiens
aggcggcucugaacgagua

SEQ ID NO: 760604 - RNA, 19 nt, Homo sapiens
gaaucaccaugcccaccuu

SEQ ID NO: 760605 - RNA, 19 nt, Homo sapiens
gagggcgagugcagcauug

SEQ ID NO: 760606 - RNA, 19 nt, Homo sapiens
aaaugcugcuggugaagaa

SEQ ID NO: 760607 - RNA, 19 nt, Homo sapiens
gaucaucucucgguuugcu

SEQ ID NO: 760608 - RNA, 19 nt, Homo sapiens
gcaagcacaucaugaaaag

SEQ ID NO: 760609 - RNA, 19 nt, Homo sapiens
ugaugaugcuguccuggaa

SEQ ID NO: 760610 - RNA, 19 nt, Homo sapiens
gacagugaccuucgaauac

SEQ ID NO: 760611 - RNA, 19 nt, Homo sapiens
gggcaagcacaucaugaaa

SEQ ID NO: 760612 - RNA, 19 nt, Homo sapiens
ucaagacagugaccuucga

SEQ ID NO: 760613 - RNA, 19 nt, Homo sapiens
gaugaguucuguuuucuuc

SEQ ID NO: 760614 - RNA, 19 nt, Homo sapiens
acucacagccuugaaguuu

SEQ ID NO: 760615 - RNA, 19 nt, Homo sapiens
gaacacaguggugaucaag

SEQ ID NO: 760616 - RNA, 19 nt, Homo sapiens
ggagggcgagugcagcauu

SEQ ID NO: 760617 - RNA, 19 nt, Homo sapiens
caccaaagcaggacucauc

SEQ ID NO: 760618 - RNA, 19 nt, Homo sapiens
cagaggccauucacaacug

SEQ ID NO: 760619 - RNA, 19 nt, Homo sapiens
ccaggcaggcacuguguuu

SEQ ID NO: 760620 - RNA, 19 nt, Homo sapiens
caacaaaggagagaauugc

SEQ ID NO: 760621 - RNA, 19 nt, Homo sapiens
gaggaaggagggccacgaa

SEQ ID NO: 760622 - RNA, 19 nt, Homo sapiens
gucaacacguacaacaaga

SEQ ID NO: 760623 - RNA, 19 nt, Homo sapiens
gggccaaugccacggaauu

SEQ ID NO: 760624 - RNA, 19 nt, Homo sapiens
cggcagaggccauucacaa

SEQ ID NO: 760625 - RNA, 19 nt, Homo sapiens
gcagagcugacauuaaagg

SEQ ID NO: 760626 - RNA, 19 nt, Homo sapiens
cagcauugacuacguggaa

SEQ ID NO: 760627 - RNA, 19 nt, Homo sapiens
ugaagacuccacugauuuc

SEQ ID NO: 760628 - RNA, 19 nt, Homo sapiens
aaaugauccuggccucgaa

SEQ ID NO: 760629 - RNA, 19 nt, Homo sapiens
gugaacagaaacugacauu

SEQ ID NO: 760630 - RNA, 19 nt, Homo sapiens
gauucaaacagucuggauu

SEQ ID NO: 760631 - RNA, 19 nt, Homo sapiens
ggccaaugccacggaauuu

SEQ ID NO: 760632 - RNA, 19 nt, Homo sapiens
gauccuggccucgaacuuc

SEQ ID NO: 760633 - RNA, 19 nt, Homo sapiens
gcagaggccauucacaacu

SEQ ID NO: 760634 - RNA, 19 nt, Homo sapiens
gaauuuggccuggcuucug

SEQ ID NO: 760635 - RNA, 19 nt, Homo sapiens
cggccaggguucuucuuug

SEQ ID NO: 760636 - RNA, 19 nt, Homo sapiens
guagaagaggugcggaaga

SEQ ID NO: 760637 - RNA, 19 nt, Homo sapiens
ucaacaaaggagagaauug

SEQ ID NO: 760638 - RNA, 19 nt, Homo sapiens
guggguguguucacuguuc

SEQ ID NO: 760639 - RNA, 19 nt, Homo sapiens
ucacagccuugaaguuugc

SEQ ID NO: 760640 - RNA, 19 nt, Homo sapiens
gaggcugugcggaguguuu

SEQ ID NO: 760641 - RNA, 19 nt, Homo sapiens
caucaacaaggcccuguau

SEQ ID NO: 760642 - RNA, 19 nt, Homo sapiens
gaggaaggagccaccuaug

SEQ ID NO: 760643 - RNA, 19 nt, Homo sapiens
gcggcucacagaagucuaa

SEQ ID NO: 760644 - RNA, 19 nt, Homo sapiens
ugaagcugauggaguacug

SEQ ID NO: 760645 - RNA, 19 nt, Homo sapiens
ucuggaagcugagaaggau

SEQ ID NO: 760646 - RNA, 19 nt, Homo sapiens
gaaguuugcagagcugaca

SEQ ID NO: 760647 - RNA, 19 nt, Homo sapiens
uacauggcauccaccuuug

SEQ ID NO: 760648 - RNA, 19 nt, Homo sapiens
uugaagacuccacugauuu

SEQ ID NO: 760649 - RNA, 19 nt, Homo sapiens
agaaggagacagccaagau

SEQ ID NO: 760650 - RNA, 19 nt, Homo sapiens
caagacagugaccuucgaa

SEQ ID NO: 760651 - RNA, 19 nt, Homo sapiens
augaucaucucucgguuug

SEQ ID NO: 760652 - RNA, 19 nt, Homo sapiens
caugaucaucucucgguuu

SEQ ID NO: 760653 - RNA, 19 nt, Homo sapiens
caccaugcccaccuuguga

SEQ ID NO: 760654 - RNA, 19 nt, Homo sapiens
gaggugggcaagcacauca

SEQ ID NO: 760655 - RNA, 19 nt, Homo sapiens
gugaaggagcugugugaug

SEQ ID NO: 760656 - RNA, 19 nt, Homo sapiens
ggagacagccaagaucaac

SEQ ID NO: 760657 - RNA, 19 nt, Homo sapiens
caucuuggacgcccucugu

SEQ ID NO: 760658 - RNA, 19 nt, Homo sapiens
auucaaacagucuggauuu

SEQ ID NO: 760659 - RNA, 19 nt, Homo sapiens
gcgagugcagcauugacua

SEQ ID NO: 760660 - RNA, 19 nt, Homo sapiens
gcuggaggauggcaaaaug

SEQ ID NO: 760661 - RNA, 19 nt, Homo sapiens
ucaacuggacccucauuca

SEQ ID NO: 760662 - RNA, 19 nt, Homo sapiens
gccucgaacuucuuuaagg

SEQ ID NO: 760663 - RNA, 19 nt, Homo sapiens
acaaaaugcugcuggugaa

SEQ ID NO: 760664 - RNA, 19 nt, Homo sapiens
ugaggaaggagccaccuau

SEQ ID NO: 760665 - RNA, 19 nt, Homo sapiens
acagugaccuucgaauacu

SEQ ID NO: 760666 - RNA, 19 nt, Homo sapiens
cuucgggccugucaugauc

SEQ ID NO: 760667 - RNA, 19 nt, Homo sapiens
agugucaucugccagguau

SEQ ID NO: 760668 - RNA, 19 nt, Homo sapiens
gcauugacuacguggaaau

SEQ ID NO: 760669 - RNA, 19 nt, Homo sapiens
gaagaaaguucagggcauu

SEQ ID NO: 760670 - RNA, 19 nt, Homo sapiens
gcugguaccuggaugagaa

SEQ ID NO: 760671 - RNA, 19 nt, Homo sapiens
gaggagaccugccgagaag

SEQ ID NO: 760672 - RNA, 19 nt, Homo sapiens
ccaccaaucuucuggacuu

SEQ ID NO: 760673 - RNA, 19 nt, Homo sapiens
gagaggagcaucuggauca

SEQ ID NO: 760674 - RNA, 19 nt, Homo sapiens
ucacagacgaggcauuuaa

SEQ ID NO: 760675 - RNA, 19 nt, Homo sapiens
ccaaucuucuggacuuuga

SEQ ID NO: 760676 - RNA, 19 nt, Homo sapiens
gaacacaccugaggaaaag

SEQ ID NO: 760677 - RNA, 19 nt, Homo sapiens
cggcaggucuggacaguuc

SEQ ID NO: 760678 - RNA, 19 nt, Homo sapiens
caagaacacaccugaggaa

SEQ ID NO: 760679 - RNA, 19 nt, Homo sapiens
ggaagaaccaggaggugau

SEQ ID NO: 760680 - RNA, 19 nt, Homo sapiens
caucacagacgaggcauuu

SEQ ID NO: 760681 - RNA, 19 nt, Homo sapiens
caggacgucugaagaaagu

SEQ ID NO: 760682 - RNA, 19 nt, Homo sapiens
gccaggacgucugaagaaa

SEQ ID NO: 760683 - RNA, 19 nt, Homo sapiens
gggcguguuuggcgcauau

SEQ ID NO: 760684 - RNA, 19 nt, Homo sapiens
caaugaggcuccccaagaa

SEQ ID NO: 760685 - RNA, 19 nt, Homo sapiens
ggccaaagcccuggagaug

SEQ ID NO: 760686 - RNA, 19 nt, Homo sapiens
ucaaggugcuggccauguc

SEQ ID NO: 760687 - RNA, 19 nt, Homo sapiens
gcaaugaggcuccccaaga

SEQ ID NO: 760688 - RNA, 19 nt, Homo sapiens
ugucccagcugguggaaug

SEQ ID NO: 760689 - RNA, 19 nt, Homo sapiens
ccaccaaccgcaccgugua

SEQ ID NO: 760690 - RNA, 19 nt, Homo sapiens
ccgccuaccuggaagcaau

SEQ ID NO: 760691 - RNA, 19 nt, Homo sapiens
ggacgucugaagaaaguuc

SEQ ID NO: 760692 - RNA, 19 nt, Homo sapiens
aggagcggaucaucgagua

SEQ ID NO: 760693 - RNA, 19 nt, Homo sapiens
cuaaggagcggaucaucga

SEQ ID NO: 760694 - RNA, 19 nt, Homo sapiens
cgaggagaccugccgagaa

SEQ ID NO: 760695 - RNA, 19 nt, Homo sapiens
ggaaugcguccccaacuuu

SEQ ID NO: 760696 - RNA, 19 nt, Homo sapiens
cagauccaccaucguguuu

SEQ ID NO: 760697 - RNA, 19 nt, Homo sapiens
gaccagccaggacgucuga

SEQ ID NO: 760698 - RNA, 19 nt, Homo sapiens
gcugcgugcugcuggaugu

SEQ ID NO: 760699 - RNA, 19 nt, Homo sapiens
ccugaaggcucugcuggau

SEQ ID NO: 760700 - RNA, 19 nt, Homo sapiens
guaccuggaugagaagaac

SEQ ID NO: 760701 - RNA, 19 nt, Homo sapiens
gaagaaccaggaggugauc

SEQ ID NO: 760702 - RNA, 19 nt, Homo sapiens
ccagauccaccaucguguu

SEQ ID NO: 760703 - RNA, 19 nt, Homo sapiens
cagacgaggcauuuaagga

SEQ ID NO: 760704 - RNA, 19 nt, Homo sapiens
gcgagaaggagaaccucuu

SEQ ID NO: 760705 - RNA, 19 nt, Homo sapiens
ucaaccugcucggcacaaa

SEQ ID NO: 760706 - RNA, 19 nt, Homo sapiens
ggagaccugccgagaagca

SEQ ID NO: 760707 - RNA, 19 nt, Homo sapiens
caccaaucuucuggacuuu

SEQ ID NO: 760708 - RNA, 19 nt, Homo sapiens
ggugaucgacgccaucucu

SEQ ID NO: 760709 - RNA, 19 nt, Homo sapiens
ccucauugcuuuuaacauc

SEQ ID NO: 760710 - RNA, 19 nt, Homo sapiens
gauccaccaucguguuucc

SEQ ID NO: 760711 - RNA, 19 nt, Homo sapiens
uggugggccucaugaccua

SEQ ID NO: 760712 - RNA, 19 nt, Homo sapiens
gaggaggagcagcggauca

SEQ ID NO: 760713 - RNA, 19 nt, Homo sapiens
ucaacgugcucaucaaccu

SEQ ID NO: 760714 - RNA, 19 nt, Homo sapiens
cuucaccgccuaccuggaa

SEQ ID NO: 760715 - RNA, 19 nt, Homo sapiens
cagccaggacgucugaaga

SEQ ID NO: 760716 - RNA, 19 nt, Homo sapiens
gaacagagaucguggauua

SEQ ID NO: 760717 - RNA, 19 nt, Homo sapiens
gagaauguuuggacucuaa

SEQ ID NO: 760718 - RNA, 19 nt, Homo sapiens
ggagagaggugagaacuau

SEQ ID NO: 760719 - RNA, 19 nt, Homo sapiens
gcacaucccaccuuucaua

SEQ ID NO: 760720 - RNA, 19 nt, Homo sapiens
ggacuugacuuagcauuau

SEQ ID NO: 760721 - RNA, 19 nt, Homo sapiens
ggaaauaaagcuacaucua

SEQ ID NO: 760722 - RNA, 19 nt, Homo sapiens
gaaagccauucuguuauuu

SEQ ID NO: 760723 - RNA, 19 nt, Homo sapiens
gugacaagauagcuauuua

SEQ ID NO: 760724 - RNA, 19 nt, Homo sapiens
ugaaagccauucuguuauu

SEQ ID NO: 760725 - RNA, 19 nt, Homo sapiens
agaaacagaucauccuaaa

SEQ ID NO: 760726 - RNA, 19 nt, Homo sapiens
aaagauaguuucccugaga

SEQ ID NO: 760727 - RNA, 19 nt, Homo sapiens
aaacagaucauccuaaaug

SEQ ID NO: 760728 - RNA, 19 nt, Homo sapiens
guaaauagguuagauuggu

SEQ ID NO: 760729 - RNA, 19 nt, Homo sapiens
ccaaagcaaucguggaaga

SEQ ID NO: 760730 - RNA, 19 nt, Homo sapiens
acacugaccuggaacagaa

SEQ ID NO: 760731 - RNA, 19 nt, Homo sapiens
aaaggauggugacaagaua

SEQ ID NO: 760732 - RNA, 19 nt, Homo sapiens
uaaggacugugaucucaaa

SEQ ID NO: 760733 - RNA, 19 nt, Homo sapiens
uuuaaucccuucugucuuu

SEQ ID NO: 760734 - RNA, 19 nt, Homo sapiens
ccaaaugucucuggugaug

SEQ ID NO: 760735 - RNA, 19 nt, Homo sapiens
ugagaccacuuguaaauag

SEQ ID NO: 760736 - RNA, 19 nt, Homo sapiens
ugacauugcucagggauga

SEQ ID NO: 760737 - RNA, 19 nt, Homo sapiens
gaugagagacccaaagcaa

SEQ ID NO: 760738 - RNA, 19 nt, Homo sapiens
aaaccaaggaggaaagaua

SEQ ID NO: 760739 - RNA, 19 nt, Homo sapiens
ucauaacacugaccuggaa

SEQ ID NO: 760740 - RNA, 19 nt, Homo sapiens
ccagauacucuaaauguga

SEQ ID NO: 760741 - RNA, 19 nt, Homo sapiens
ucacaaagauggaaaagau

SEQ ID NO: 760742 - RNA, 19 nt, Homo sapiens
gacucuaacucaccgauug

SEQ ID NO: 760743 - RNA, 19 nt, Homo sapiens
uaaacaugcugucccaaca

SEQ ID NO: 760744 - RNA, 19 nt, Homo sapiens
cagauacucuaaaugugaa

SEQ ID NO: 760745 - RNA, 19 nt, Homo sapiens
gcaaaugcagccacuggaa

SEQ ID NO: 760746 - RNA, 19 nt, Homo sapiens
aaaugucucuggugauguu

SEQ ID NO: 760747 - RNA, 19 nt, Homo sapiens
ugauugugcuggagaagaa

SEQ ID NO: 760748 - RNA, 19 nt, Homo sapiens
uuagagaggugagaauguu

SEQ ID NO: 760749 - RNA, 19 nt, Homo sapiens
guagauacgcaaauuguca

SEQ ID NO: 760750 - RNA, 19 nt, Homo sapiens
gauguccacugagcaaaug

SEQ ID NO: 760751 - RNA, 19 nt, Homo sapiens
acaagugagucauuaucaa

SEQ ID NO: 760752 - RNA, 19 nt, Homo sapiens
uuugguagcucuguaugua

SEQ ID NO: 760753 - RNA, 19 nt, Homo sapiens
caagagagacauccaaagg

SEQ ID NO: 760754 - RNA, 19 nt, Homo sapiens
uuacaugggcuccuucuug

SEQ ID NO: 760755 - RNA, 19 nt, Homo sapiens
gaguaugguuucuauucug

SEQ ID NO: 760756 - RNA, 19 nt, Homo sapiens
aaagauacgauguucaaga

SEQ ID NO: 760757 - RNA, 19 nt, Homo sapiens
uuucagaccaguucauuaa

SEQ ID NO: 760758 - RNA, 19 nt, Homo sapiens
caagugagucauuaucaau

SEQ ID NO: 760759 - RNA, 19 nt, Homo sapiens
gggcaggacuugacuuagc

SEQ ID NO: 760760 - RNA, 19 nt, Homo sapiens
gaaacagaucauccuaaau

SEQ ID NO: 760761 - RNA, 19 nt, Homo sapiens
gccaucaaauugccaguca

SEQ ID NO: 760762 - RNA, 19 nt, Homo sapiens
gagcuugccggaaauaaag

SEQ ID NO: 760763 - RNA, 19 nt, Homo sapiens
gcuuagcaauguaucuuca

SEQ ID NO: 760764 - RNA, 19 nt, Homo sapiens
agagaggugagaacuauuu

SEQ ID NO: 760765 - RNA, 19 nt, Homo sapiens
uuucuccuguccuaucuua

SEQ ID NO: 760766 - RNA, 19 nt, Homo sapiens
aagcaaucguggaagauga

SEQ ID NO: 760767 - RNA, 19 nt, Homo sapiens
uuucauaccagguguguuu

SEQ ID NO: 760768 - RNA, 19 nt, Homo sapiens
cagaccaguucauuaagga

SEQ ID NO: 760769 - RNA, 19 nt, Homo sapiens
cuuugucucucucuucuuu

SEQ ID NO: 760770 - RNA, 19 nt, Homo sapiens
gagagugugguguuagcua

SEQ ID NO: 760771 - RNA, 19 nt, Homo sapiens
cugggaagcuuagcaaugu

SEQ ID NO: 760772 - RNA, 19 nt, Homo sapiens
aagauacgauguucaagag

SEQ ID NO: 760773 - RNA, 19 nt, Homo sapiens
cuauuacacuuucuuggau

SEQ ID NO: 760774 - RNA, 19 nt, Homo sapiens
cuaacucaccgauugcuuu

SEQ ID NO: 760775 - RNA, 19 nt, Homo sapiens
ucaauucacggaacagaga

SEQ ID NO: 760776 - RNA, 19 nt, Homo sapiens
aaagaaacagaucauccua

SEQ ID NO: 760777 - RNA, 19 nt, Homo sapiens
ucucucuucuuucugagua

SEQ ID NO: 760778 - RNA, 19 nt, Homo sapiens
gaugauguccacugagcaa

SEQ ID NO: 760779 - RNA, 19 nt, Homo sapiens
agagagugcuggucugucu

SEQ ID NO: 760780 - RNA, 19 nt, Homo sapiens
uaucuuaagaguccaaaug

SEQ ID NO: 760781 - RNA, 19 nt, Homo sapiens
gguucccuguugccaguua

SEQ ID NO: 760782 - RNA, 19 nt, Homo sapiens
caagugggguucccuguug

SEQ ID NO: 760783 - RNA, 19 nt, Homo sapiens
ccugagaccacuuguaaau

SEQ ID NO: 760784 - RNA, 19 nt, Homo sapiens
ggugacaagauagcuauuu

SEQ ID NO: 760785 - RNA, 19 nt, Homo sapiens
ugguuucuauucuguguuu

SEQ ID NO: 760786 - RNA, 19 nt, Homo sapiens
ucccugagaccacuuguaa

SEQ ID NO: 760787 - RNA, 19 nt, Homo sapiens
uaacucaccgauugcuuug

SEQ ID NO: 760788 - RNA, 19 nt, Homo sapiens
ugaguaugguuucuauucu

SEQ ID NO: 760789 - RNA, 19 nt, Homo sapiens
ugagagacccaaagcaauc

SEQ ID NO: 760790 - RNA, 19 nt, Homo sapiens
ccaagcaccaguccaagug

SEQ ID NO: 760791 - RNA, 19 nt, Homo sapiens
ggcaggacuugacuuagca

SEQ ID NO: 760792 - RNA, 19 nt, Homo sapiens
gaccacuuguaaauagguu

SEQ ID NO: 760793 - RNA, 19 nt, Homo sapiens
gauggugacaagauagcua

SEQ ID NO: 760794 - RNA, 19 nt, Homo sapiens
cgaaaaggauggugacaag

SEQ ID NO: 760795 - RNA, 19 nt, Homo sapiens
auaauuugguagcucugua

SEQ ID NO: 760796 - RNA, 19 nt, Homo sapiens
aacaugcugucccaacauu

SEQ ID NO: 760797 - RNA, 19 nt, Homo sapiens
ucagaccaguucauuaagg

SEQ ID NO: 760798 - RNA, 19 nt, Homo sapiens
caucccaccuuucauacca

SEQ ID NO: 760799 - RNA, 19 nt, Homo sapiens
ggagguaacagggaaagca

SEQ ID NO: 760800 - RNA, 19 nt, Homo sapiens
cacccacccuccuuugaug

SEQ ID NO: 760801 - RNA, 19 nt, Homo sapiens
ugaucccuguucuucauaa

SEQ ID NO: 760802 - RNA, 19 nt, Homo sapiens
gggaagcuuagcaauguau

SEQ ID NO: 760803 - RNA, 19 nt, Homo sapiens
ggacucuaacucaccgauu

SEQ ID NO: 760804 - RNA, 19 nt, Homo sapiens
gaucaauucacggaacaga

SEQ ID NO: 760805 - RNA, 19 nt, Homo sapiens
aagaaacagaucauccuaa

SEQ ID NO: 760806 - RNA, 19 nt, Homo sapiens
gcaaaaugaucccuguucu

SEQ ID NO: 760807 - RNA, 19 nt, Homo sapiens
ucccagauacucuaaaugu

SEQ ID NO: 760808 - RNA, 19 nt, Homo sapiens
gugagaauguuuggacucu

SEQ ID NO: 760809 - RNA, 19 nt, Homo sapiens
agacagacuggacaagcua

SEQ ID NO: 760810 - RNA, 19 nt, Homo sapiens
cacuggaagucucagaaga

SEQ ID NO: 760811 - RNA, 19 nt, Homo sapiens
ugguagcucuguauguaug

SEQ ID NO: 760812 - RNA, 19 nt, Homo sapiens
aaaguagauacgcaaauug

SEQ ID NO: 760813 - RNA, 19 nt, Homo sapiens
gaauguugagucagaccaa

SEQ ID NO: 760814 - RNA, 19 nt, Homo sapiens
ugucccagauacucuaaau

SEQ ID NO: 760815 - RNA, 19 nt, Homo sapiens
uaagacccuugucccagau

SEQ ID NO: 760816 - RNA, 19 nt, Homo sapiens
ggaaggagcucgccaggaa

SEQ ID NO: 760817 - RNA, 19 nt, Homo sapiens
gaaauccgccuccaacauu

SEQ ID NO: 760818 - RNA, 19 nt, Homo sapiens
gggcugaggucuacauuga

SEQ ID NO: 760819 - RNA, 19 nt, Homo sapiens
gaaagaugcuucgagacaa

SEQ ID NO: 760820 - RNA, 19 nt, Homo sapiens
ugucaaagcucacggaaga

SEQ ID NO: 760821 - RNA, 19 nt, Homo sapiens
gcaaggugcugcuggacuu

SEQ ID NO: 760822 - RNA, 19 nt, Homo sapiens
gagcuaugccuguaccuaa

SEQ ID NO: 760823 - RNA, 19 nt, Homo sapiens
ucaggcacauguucuauug

SEQ ID NO: 760824 - RNA, 19 nt, Homo sapiens
ugagagaccugcccugauc

SEQ ID NO: 760825 - RNA, 19 nt, Homo sapiens
ggacugcggagaacauauu

SEQ ID NO: 760826 - RNA, 19 nt, Homo sapiens
acacagagcaugaaauuag

SEQ ID NO: 760827 - RNA, 19 nt, Homo sapiens
agacaccgcuuugccgaua

SEQ ID NO: 760828 - RNA, 19 nt, Homo sapiens
caacaaguuugacaagaac

SEQ ID NO: 760829 - RNA, 19 nt, Homo sapiens
ggccagugcucccuacuuc

SEQ ID NO: 760830 - RNA, 19 nt, Homo sapiens
uuacacagagcaugaaauu

SEQ ID NO: 760831 - RNA, 19 nt, Homo sapiens
gcucacagugccaagguua

SEQ ID NO: 760832 - RNA, 19 nt, Homo sapiens
ucuccaagcucaugucugu

SEQ ID NO: 760833 - RNA, 19 nt, Homo sapiens
ccucaucacucagcucuug

SEQ ID NO: 760834 - RNA, 19 nt, Homo sapiens
gggcguauguggagcagau

SEQ ID NO: 760835 - RNA, 19 nt, Homo sapiens
gaucggggauuuccugauu

SEQ ID NO: 760836 - RNA, 19 nt, Homo sapiens
gcagcagucucuggaacuu

SEQ ID NO: 760837 - RNA, 19 nt, Homo sapiens
ugacuucaaugguuucuac

SEQ ID NO: 760838 - RNA, 19 nt, Homo sapiens
ugacgucaaugaacugcuu

SEQ ID NO: 760839 - RNA, 19 nt, Homo sapiens
guucgugccucagagcuaa

SEQ ID NO: 760840 - RNA, 19 nt, Homo sapiens
ggaagccgguggaggacau

SEQ ID NO: 760841 - RNA, 19 nt, Homo sapiens
ucgagaaggcguuuaacua

SEQ ID NO: 760842 - RNA, 19 nt, Homo sapiens
ugguguaccuguugucaaa

SEQ ID NO: 760843 - RNA, 19 nt, Homo sapiens
gaaaauggcggacaagauc

SEQ ID NO: 760844 - RNA, 19 nt, Homo sapiens
cacagagcaugaaauuaga

SEQ ID NO: 760845 - RNA, 19 nt, Homo sapiens
augcagaaauuuacacaga

SEQ ID NO: 760846 - RNA, 19 nt, Homo sapiens
caacuucguccagaauauu

SEQ ID NO: 760847 - RNA, 19 nt, Homo sapiens
ucaacuucguccagaauau

SEQ ID NO: 760848 - RNA, 19 nt, Homo sapiens
ggaccagggcgacuucuuc

SEQ ID NO: 760849 - RNA, 19 nt, Homo sapiens
gcugugaccagguucauug

SEQ ID NO: 760850 - RNA, 19 nt, Homo sapiens
ggccuucucuuucgacuac

SEQ ID NO: 760851 - RNA, 19 nt, Homo sapiens
cggagaacauauugugaug

SEQ ID NO: 760852 - RNA, 19 nt, Homo sapiens
cgagaaggcguuuaacuac

SEQ ID NO: 760853 - RNA, 19 nt, Homo sapiens
ugaaggagcaccugauucu

SEQ ID NO: 760854 - RNA, 19 nt, Homo sapiens
cugcaguacuuacaacaga

SEQ ID NO: 760855 - RNA, 19 nt, Homo sapiens
agaaagaugcuucgagaca

SEQ ID NO: 760856 - RNA, 19 nt, Homo sapiens
gagcuaaaacuaugaguga

SEQ ID NO: 760857 - RNA, 19 nt, Homo sapiens
caaggacgaccucaagauc

SEQ ID NO: 760858 - RNA, 19 nt, Homo sapiens
agcagucucuggaacuuaa

SEQ ID NO: 760859 - RNA, 19 nt, Homo sapiens
gguuaaaauugcagaguuu

SEQ ID NO: 760860 - RNA, 19 nt, Homo sapiens
aaagaugcuucgagacaag

SEQ ID NO: 760861 - RNA, 19 nt, Homo sapiens
gcaucuauagcaccaguga

SEQ ID NO: 760862 - RNA, 19 nt, Homo sapiens
gcagaucgagaaggcguuu

SEQ ID NO: 760863 - RNA, 19 nt, Homo sapiens
gauucaccaugacgucaau

SEQ ID NO: 760864 - RNA, 19 nt, Homo sapiens
ccucagagcuaaaacuaug

SEQ ID NO: 760865 - RNA, 19 nt, Homo sapiens
gcggagaacauauugugau

SEQ ID NO: 760866 - RNA, 19 nt, Homo sapiens
caacagaaugcaaaagaaa

SEQ ID NO: 760867 - RNA, 19 nt, Homo sapiens
aaauuuacacagagcauga

SEQ ID NO: 760868 - RNA, 19 nt, Homo sapiens
aaauccgccuccaacauug

SEQ ID NO: 760869 - RNA, 19 nt, Homo sapiens
ucgacuacaucgucaagug

SEQ ID NO: 760870 - RNA, 19 nt, Homo sapiens
ggagcuaugccuguaccua

SEQ ID NO: 760871 - RNA, 19 nt, Homo sapiens
ucacagugccaagguuaaa

SEQ ID NO: 760872 - RNA, 19 nt, Homo sapiens
aggauuacaacgacaagua

SEQ ID NO: 760873 - RNA, 19 nt, Homo sapiens
cgacccauacagugaguuu

SEQ ID NO: 760874 - RNA, 19 nt, Homo sapiens
gugcaaauggguccagaau

SEQ ID NO: 760875 - RNA, 19 nt, Homo sapiens
gagcgccugucugcagaga

SEQ ID NO: 760876 - RNA, 19 nt, Homo sapiens
cggcugagcaucuauagca

SEQ ID NO: 760877 - RNA, 19 nt, Homo sapiens
gcucaacuucguccagaau

SEQ ID NO: 760878 - RNA, 19 nt, Homo sapiens
ggcagcgaaugcucaacuu

SEQ ID NO: 760879 - RNA, 19 nt, Homo sapiens
uggaggaccugcuguacgu

SEQ ID NO: 760880 - RNA, 19 nt, Homo sapiens
ugcaggagcuugaggaacu

SEQ ID NO: 760881 - RNA, 19 nt, Homo sapiens
ccuccaagaucuccaugca

SEQ ID NO: 760882 - RNA, 19 nt, Homo sapiens
aauuucggauucaccauga

SEQ ID NO: 760883 - RNA, 19 nt, Homo sapiens
cagcacagacaccgcuuug

SEQ ID NO: 760884 - RNA, 19 nt, Homo sapiens
gcaguacuuacaacagaau

SEQ ID NO: 760885 - RNA, 19 nt, Homo sapiens
ugaaauccgccuccaacau

SEQ ID NO: 760886 - RNA, 19 nt, Homo sapiens
gcucaucaucaacaggaaa

SEQ ID NO: 760887 - RNA, 19 nt, Homo sapiens
ucaaggacgaccucaagau

SEQ ID NO: 760888 - RNA, 19 nt, Homo sapiens
ggauuacaacgacaaguac

SEQ ID NO: 760889 - RNA, 19 nt, Homo sapiens
gaagcucugguucuacauc

SEQ ID NO: 760890 - RNA, 19 nt, Homo sapiens
gcaggagcuugaggaacug

SEQ ID NO: 760891 - RNA, 19 nt, Homo sapiens
aaagcucacggaagacaaa

SEQ ID NO: 760892 - RNA, 19 nt, Homo sapiens
cagcagggacuggugcaaa

SEQ ID NO: 760893 - RNA, 19 nt, Homo sapiens
ccuggcacauccuggagaa

SEQ ID NO: 760894 - RNA, 19 nt, Homo sapiens
gcuaccagaugcucuucag

SEQ ID NO: 760895 - RNA, 19 nt, Homo sapiens
gauguucgaagugauggaa

SEQ ID NO: 760896 - RNA, 19 nt, Homo sapiens
gcagcgaaugcucaacuuc

SEQ ID NO: 760897 - RNA, 19 nt, Homo sapiens
caagcgcuacuuccucaug

SEQ ID NO: 760898 - RNA, 19 nt, Homo sapiens
cagcagucucuggaacuua

SEQ ID NO: 760899 - RNA, 19 nt, Homo sapiens
gcagggacuggugcaaaug

SEQ ID NO: 760900 - RNA, 19 nt, Homo sapiens
ggauucaccaugacgucaa

SEQ ID NO: 760901 - RNA, 19 nt, Homo sapiens
gcucuucaggcacauguuc

SEQ ID NO: 760902 - RNA, 19 nt, Homo sapiens
cccuuucgcucaucaucaa

SEQ ID NO: 760903 - RNA, 19 nt, Homo sapiens
ugagcacggccaacacuga

SEQ ID NO: 760904 - RNA, 19 nt, Homo sapiens
ucagagaguguggccauga

SEQ ID NO: 760905 - RNA, 19 nt, Homo sapiens
gcaugcagaaauuuacaca

SEQ ID NO: 760906 - RNA, 19 nt, Homo sapiens
caacaggaaagcccucacu

SEQ ID NO: 760907 - RNA, 19 nt, Homo sapiens
agaucgagaaggcguuuaa

SEQ ID NO: 760908 - RNA, 19 nt, Homo sapiens
caucauccacgacccauac

SEQ ID NO: 760909 - RNA, 19 nt, Homo sapiens
gcaucauccacgacccaua

SEQ ID NO: 760910 - RNA, 19 nt, Homo sapiens
cuggagaaguggaucuaca

SEQ ID NO: 760911 - RNA, 19 nt, Homo sapiens
aggccaccaucaacaaguu

SEQ ID NO: 760912 - RNA, 19 nt, Homo sapiens
caugauguucgaagugaug

SEQ ID NO: 760913 - RNA, 19 nt, Homo sapiens
aggcacauguucuauugca

SEQ ID NO: 760914 - RNA, 19 nt, Homo sapiens
ccagugcucccuacuucga

SEQ ID NO: 760915 - RNA, 19 nt, Homo sapiens
gaaggagcaccugauucug

SEQ ID NO: 760916 - RNA, 19 nt, Homo sapiens
ggaauuagcccacauggua

SEQ ID NO: 760917 - RNA, 19 nt, Homo sapiens
cagcuaaacugucauauug

SEQ ID NO: 760918 - RNA, 19 nt, Homo sapiens
gaggaugaguacagauuua

SEQ ID NO: 760919 - RNA, 19 nt, Homo sapiens
gacacaauguuuagagaua

SEQ ID NO: 760920 - RNA, 19 nt, Homo sapiens
gcacaaacccuagcuaaau

SEQ ID NO: 760921 - RNA, 19 nt, Homo sapiens
ccaagagaguuagaaauaa

SEQ ID NO: 760922 - RNA, 19 nt, Homo sapiens
caacaaauaccucaggaaa

SEQ ID NO: 760923 - RNA, 19 nt, Homo sapiens
gccaggcauucaucaauua

SEQ ID NO: 760924 - RNA, 19 nt, Homo sapiens
auaacuaccucgacaagua

SEQ ID NO: 760925 - RNA, 19 nt, Homo sapiens
ggacuuuaaugacacaaug

SEQ ID NO: 760926 - RNA, 19 nt, Homo sapiens
uaucauacauggucagaga

SEQ ID NO: 760927 - RNA, 19 nt, Homo sapiens
gaucauaauugucucuaca

SEQ ID NO: 760928 - RNA, 19 nt, Homo sapiens
ugacaaagaaguaguagaa

SEQ ID NO: 760929 - RNA, 19 nt, Homo sapiens
ggagaaacaguucaaguug

SEQ ID NO: 760930 - RNA, 19 nt, Homo sapiens
ggauaagugugaacugaau

SEQ ID NO: 760931 - RNA, 19 nt, Homo sapiens
caagagaguuagaaauaag

SEQ ID NO: 760932 - RNA, 19 nt, Homo sapiens
gcacacauguagagaccuu

SEQ ID NO: 760933 - RNA, 19 nt, Homo sapiens
gcaagugagggaaguagua

SEQ ID NO: 760934 - RNA, 19 nt, Homo sapiens
ggagaagaaucagaucaug

SEQ ID NO: 760935 - RNA, 19 nt, Homo sapiens
gagaagcagacaucauuaa

SEQ ID NO: 760936 - RNA, 19 nt, Homo sapiens
ucauauugcugucuuguau

SEQ ID NO: 760937 - RNA, 19 nt, Homo sapiens
ugaaagcuauagccagauu

SEQ ID NO: 760938 - RNA, 19 nt, Homo sapiens
gaaaucaggcucugggaau

SEQ ID NO: 760939 - RNA, 19 nt, Homo sapiens
agagaagccuuuaggagaa

SEQ ID NO: 760940 - RNA, 19 nt, Homo sapiens
gaagacgggaggaugagua

SEQ ID NO: 760941 - RNA, 19 nt, Homo sapiens
acgaggaggugaaguauug

SEQ ID NO: 760942 - RNA, 19 nt, Homo sapiens
cuaagaaggugcuuucagu

SEQ ID NO: 760943 - RNA, 19 nt, Homo sapiens
ucucuacagucugauauua

SEQ ID NO: 760944 - RNA, 19 nt, Homo sapiens
gaggugaaguauuggauuc

SEQ ID NO: 760945 - RNA, 19 nt, Homo sapiens
agaagaaucagaucaugua

SEQ ID NO: 760946 - RNA, 19 nt, Homo sapiens
gaagcagacucaaagaaaa

SEQ ID NO: 760947 - RNA, 19 nt, Homo sapiens
guagagaccuuuguaucau

SEQ ID NO: 760948 - RNA, 19 nt, Homo sapiens
gaauugucuuucuggauga

SEQ ID NO: 760949 - RNA, 19 nt, Homo sapiens
cacaaacccuagcuaaaug

SEQ ID NO: 760950 - RNA, 19 nt, Homo sapiens
gaauuagcccacaugguaa

SEQ ID NO: 760951 - RNA, 19 nt, Homo sapiens
ugagggaaguaguaagaaa

SEQ ID NO: 760952 - RNA, 19 nt, Homo sapiens
ggaaauaagaaaucagcaa

SEQ ID NO: 760953 - RNA, 19 nt, Homo sapiens
caaagaaguaguagaagga

SEQ ID NO: 760954 - RNA, 19 nt, Homo sapiens
gacucaggcuggauaugua

SEQ ID NO: 760955 - RNA, 19 nt, Homo sapiens
agaaacaccagcauacuuu

SEQ ID NO: 760956 - RNA, 19 nt, Homo sapiens
caagaugccaauuauaaug

SEQ ID NO: 760957 - RNA, 19 nt, Homo sapiens
aagcagagguugagaagca

SEQ ID NO: 760958 - RNA, 19 nt, Homo sapiens
ugaagcagacucaaagaaa

SEQ ID NO: 760959 - RNA, 19 nt, Homo sapiens
uaggaaggcuugggacauu

SEQ ID NO: 760960 - RNA, 19 nt, Homo sapiens
ggagguugacaaagaagua

SEQ ID NO: 760961 - RNA, 19 nt, Homo sapiens
gccacgaaaugcuguuauu

SEQ ID NO: 760962 - RNA, 19 nt, Homo sapiens
guguggagguugacaaaga

SEQ ID NO: 760963 - RNA, 19 nt, Homo sapiens
ggaugaaguagauaagauu

SEQ ID NO: 760964 - RNA, 19 nt, Homo sapiens
caacagguaaaucaacaaa

SEQ ID NO: 760965 - RNA, 19 nt, Homo sapiens
uaaagaugguucuggagau

SEQ ID NO: 760966 - RNA, 19 nt, Homo sapiens
gaucgguuauugcgucaug

SEQ ID NO: 760967 - RNA, 19 nt, Homo sapiens
uccaagaugccaauuauaa

SEQ ID NO: 760968 - RNA, 19 nt, Homo sapiens
ggaggaugaguacagauuu

SEQ ID NO: 760969 - RNA, 19 nt, Homo sapiens
uaagaagacgggaggauga

SEQ ID NO: 760970 - RNA, 19 nt, Homo sapiens
gauuggcacuagaacgaaa

SEQ ID NO: 760971 - RNA, 19 nt, Homo sapiens
ggaaucgaauacucaccaa

SEQ ID NO: 760972 - RNA, 19 nt, Homo sapiens
gaagcagacaucauuaaca

SEQ ID NO: 760973 - RNA, 19 nt, Homo sapiens
caaaagaugggauaaguaa

SEQ ID NO: 760974 - RNA, 19 nt, Homo sapiens
uagauaagauuggcagugu

SEQ ID NO: 760975 - RNA, 19 nt, Homo sapiens
accaagagaguuagaaaua

SEQ ID NO: 760976 - RNA, 19 nt, Homo sapiens
ggagauggaaauaagaaau

SEQ ID NO: 760977 - RNA, 19 nt, Homo sapiens
gaaaagcuguuacuagaac

SEQ ID NO: 760978 - RNA, 19 nt, Homo sapiens
uggcaugauuccugaguuu

SEQ ID NO: 760979 - RNA, 19 nt, Homo sapiens
gauugaguuuggcaugauu

SEQ ID NO: 760980 - RNA, 19 nt, Homo sapiens
guuauugcgucauguggaa

SEQ ID NO: 760981 - RNA, 19 nt, Homo sapiens
aauaagaaaucagcaagug

SEQ ID NO: 760982 - RNA, 19 nt, Homo sapiens
guuacuagaaccaauguuu

SEQ ID NO: 760983 - RNA, 19 nt, Homo sapiens
gaaacaccagcauacuuug

SEQ ID NO: 760984 - RNA, 19 nt, Homo sapiens
gaagauguuauauggacuu

SEQ ID NO: 760985 - RNA, 19 nt, Homo sapiens
gagaagaaucagaucaugu

SEQ ID NO: 760986 - RNA, 19 nt, Homo sapiens
uuaaaggcauuggaucuau

SEQ ID NO: 760987 - RNA, 19 nt, Homo sapiens
uuacagaaacaccagcaua

SEQ ID NO: 760988 - RNA, 19 nt, Homo sapiens
gaaaagaauucccgaaagc

SEQ ID NO: 760989 - RNA, 19 nt, Homo sapiens
gccagucauuugcuaagaa

SEQ ID NO: 760990 - RNA, 19 nt, Homo sapiens
uacggaagauguuauaugg

SEQ ID NO: 760991 - RNA, 19 nt, Homo sapiens
gauauuaaaggcauuggau

SEQ ID NO: 760992 - RNA, 19 nt, Homo sapiens
aauagucaauguuccagaa

SEQ ID NO: 760993 - RNA, 19 nt, Homo sapiens
uaucccagcuaaucugaga

SEQ ID NO: 760994 - RNA, 19 nt, Homo sapiens
ccucuuagauccuuuacag

SEQ ID NO: 760995 - RNA, 19 nt, Homo sapiens
gaagaaucagaucauguau

SEQ ID NO: 760996 - RNA, 19 nt, Homo sapiens
ucaccaagacauugaagaa

SEQ ID NO: 760997 - RNA, 19 nt, Homo sapiens
guucagcaaggcuuauuaa

SEQ ID NO: 760998 - RNA, 19 nt, Homo sapiens
acuccaagaugccaauuau

SEQ ID NO: 760999 - RNA, 19 nt, Homo sapiens
cuuagauccuuuacagaaa

SEQ ID NO: 761000 - RNA, 19 nt, Homo sapiens
ugagaagcagacaucauua

SEQ ID NO: 761001 - RNA, 19 nt, Homo sapiens
guauugcgauaacuguaga

SEQ ID NO: 761002 - RNA, 19 nt, Homo sapiens
ggaauucuuuuaagcaaug

SEQ ID NO: 761003 - RNA, 19 nt, Homo sapiens
gaugggauaaguaaagaug

SEQ ID NO: 761004 - RNA, 19 nt, Homo sapiens
gcuaaacugucauauugcu

SEQ ID NO: 761005 - RNA, 19 nt, Homo sapiens
gagcuccucuuagauccuu

SEQ ID NO: 761006 - RNA, 19 nt, Homo sapiens
gagaucugauugaguuugg

SEQ ID NO: 761007 - RNA, 19 nt, Homo sapiens
cugcagaccuugcuaaucg

SEQ ID NO: 761008 - RNA, 19 nt, Homo sapiens
gaugaguacagauuuacaa

SEQ ID NO: 761009 - RNA, 19 nt, Homo sapiens
gagauggaaauaagaaauc

SEQ ID NO: 761010 - RNA, 19 nt, Homo sapiens
gggaggaugaguacagauu

SEQ ID NO: 761011 - RNA, 19 nt, Homo sapiens
caagugagggaaguaguaa

SEQ ID NO: 761012 - RNA, 19 nt, Homo sapiens
gguggucgcauucauaugu

SEQ ID NO: 761013 - RNA, 19 nt, Homo sapiens
uaaaggcauuggaucuauc

SEQ ID NO: 761014 - RNA, 19 nt, Homo sapiens
auaauugucucuacagucu

SEQ ID NO: 761015 - RNA, 19 nt, Homo sapiens
aaagaugguucuggagaug

SEQ ID NO: 761016 - RNA, 19 nt, Homo sapiens
gaacugagcagcaucauua

SEQ ID NO: 761017 - RNA, 19 nt, Homo sapiens
ccacagaccuugcuuuaua

SEQ ID NO: 761018 - RNA, 19 nt, Homo sapiens
gaaaucagcuggccaagug

SEQ ID NO: 761019 - RNA, 19 nt, Homo sapiens
gggcugagaucaauaaauu

SEQ ID NO: 761020 - RNA, 19 nt, Homo sapiens
gagaagagaugagguauau

SEQ ID NO: 761021 - RNA, 19 nt, Homo sapiens
ccacagagauguuacaguu

SEQ ID NO: 761022 - RNA, 19 nt, Homo sapiens
gaacuaaacagcuauauag

SEQ ID NO: 761023 - RNA, 19 nt, Homo sapiens
ggacaagucuuauggauac

SEQ ID NO: 761024 - RNA, 19 nt, Homo sapiens
gaaggcagcugcaucugaa

SEQ ID NO: 761025 - RNA, 19 nt, Homo sapiens
gagaggaaaucccaacauu

SEQ ID NO: 761026 - RNA, 19 nt, Homo sapiens
aaaguuggcucuacauaaa

SEQ ID NO: 761027 - RNA, 19 nt, Homo sapiens
guaauugguuugaugauga

SEQ ID NO: 761028 - RNA, 19 nt, Homo sapiens
gagaagacuuugaaggaaa

SEQ ID NO: 761029 - RNA, 19 nt, Homo sapiens
gaacaaggaguuauauuca

SEQ ID NO: 761030 - RNA, 19 nt, Homo sapiens
gcagggaguuguauaugaa

SEQ ID NO: 761031 - RNA, 19 nt, Homo sapiens
agaaauggcugaagaggaa

SEQ ID NO: 761032 - RNA, 19 nt, Homo sapiens
ucaagaagguaacaucaaa

SEQ ID NO: 761033 - RNA, 19 nt, Homo sapiens
gcagaggccuugccaaaca

SEQ ID NO: 761034 - RNA, 19 nt, Homo sapiens
caacaaaucagaagaugaa

SEQ ID NO: 761035 - RNA, 19 nt, Homo sapiens
guagagaaauggcugaaga

SEQ ID NO: 761036 - RNA, 19 nt, Homo sapiens
gaagagagaagcaaacaug

SEQ ID NO: 761037 - RNA, 19 nt, Homo sapiens
cuacaaagaugauaaagca

SEQ ID NO: 761038 - RNA, 19 nt, Homo sapiens
gcaccaccgucucugcuua

SEQ ID NO: 761039 - RNA, 19 nt, Homo sapiens
ggaaagagaggaagagaga

SEQ ID NO: 761040 - RNA, 19 nt, Homo sapiens
gcaggaaacuggaauaucg

SEQ ID NO: 761041 - RNA, 19 nt, Homo sapiens
ggaguuauauucagaccuu

SEQ ID NO: 761042 - RNA, 19 nt, Homo sapiens
gaagaugaaucagcuccua

SEQ ID NO: 761043 - RNA, 19 nt, Homo sapiens
ggaaaagaauguagaauga

SEQ ID NO: 761044 - RNA, 19 nt, Homo sapiens
gaaaagcuguccuaccaua

SEQ ID NO: 761045 - RNA, 19 nt, Homo sapiens
gcagucaccucucacuuau

SEQ ID NO: 761046 - RNA, 19 nt, Homo sapiens
caauaaaucucagaacuuc

SEQ ID NO: 761047 - RNA, 19 nt, Homo sapiens
gaagagaugagguauaugu

SEQ ID NO: 761048 - RNA, 19 nt, Homo sapiens
uaacagguuugacagauga

SEQ ID NO: 761049 - RNA, 19 nt, Homo sapiens
caagaagaccaaagagaua

SEQ ID NO: 761050 - RNA, 19 nt, Homo sapiens
guucuuugcuuaccaauug

SEQ ID NO: 761051 - RNA, 19 nt, Homo sapiens
ggcaaggucucaugcaauu

SEQ ID NO: 761052 - RNA, 19 nt, Homo sapiens
gaaaguaguacaaucaugu

SEQ ID NO: 761053 - RNA, 19 nt, Homo sapiens
ggauggauguaauauaugu

SEQ ID NO: 761054 - RNA, 19 nt, Homo sapiens
uaauauugcugaggccuua

SEQ ID NO: 761055 - RNA, 19 nt, Homo sapiens
cuacauauuuaccaccaua

SEQ ID NO: 761056 - RNA, 19 nt, Homo sapiens
cauagaagccuguggguuu

SEQ ID NO: 761057 - RNA, 19 nt, Homo sapiens
gcagaaaguaguacaauca

SEQ ID NO: 761058 - RNA, 19 nt, Homo sapiens
gaacaacaaaucagaagau

SEQ ID NO: 761059 - RNA, 19 nt, Homo sapiens
gaaacuggaauaucgcuuu

SEQ ID NO: 761060 - RNA, 19 nt, Homo sapiens
guacugcacggucguauuu

SEQ ID NO: 761061 - RNA, 19 nt, Homo sapiens
agaccuugcuuuauacuuu

SEQ ID NO: 761062 - RNA, 19 nt, Homo sapiens
gaccaaagagauaagauuu

SEQ ID NO: 761063 - RNA, 19 nt, Homo sapiens
gaugaacgauuuccaagag

SEQ ID NO: 761064 - RNA, 19 nt, Homo sapiens
gcaauaauagccuguguau

SEQ ID NO: 761065 - RNA, 19 nt, Homo sapiens
gaaggcauaucuuucucuu

SEQ ID NO: 761066 - RNA, 19 nt, Homo sapiens
caaaguuggcucuacauaa

SEQ ID NO: 761067 - RNA, 19 nt, Homo sapiens
gcuuugauguuguuggaua

SEQ ID NO: 761068 - RNA, 19 nt, Homo sapiens
gaagcaaacauguaggaaa

SEQ ID NO: 761069 - RNA, 19 nt, Homo sapiens
ggagcuccauuugcuauuu

SEQ ID NO: 761070 - RNA, 19 nt, Homo sapiens
gcacagaaacagagcagaa

SEQ ID NO: 761071 - RNA, 19 nt, Homo sapiens
gucaaacucuuauuucaga

SEQ ID NO: 761072 - RNA, 19 nt, Homo sapiens
gacggcaaaugauauauau

SEQ ID NO: 761073 - RNA, 19 nt, Homo sapiens
ggaagcaguuggaagagau

SEQ ID NO: 761074 - RNA, 19 nt, Homo sapiens
gcaaaguuggcucuacaua

SEQ ID NO: 761075 - RNA, 19 nt, Homo sapiens
gugcgucucugcaaagaaa

SEQ ID NO: 761076 - RNA, 19 nt, Homo sapiens
acagagauguuacaguuga

SEQ ID NO: 761077 - RNA, 19 nt, Homo sapiens
gaagaacaacaaaucagaa

SEQ ID NO: 761078 - RNA, 19 nt, Homo sapiens
ggaagaacaacaaaucaga

SEQ ID NO: 761079 - RNA, 19 nt, Homo sapiens
gagaugagguauauguuac

SEQ ID NO: 761080 - RNA, 19 nt, Homo sapiens
caaaucagaagaugaauca

SEQ ID NO: 761081 - RNA, 19 nt, Homo sapiens
cuaaagggcugagaucaau

SEQ ID NO: 761082 - RNA, 19 nt, Homo sapiens
gaaaacauguggccuggaa

SEQ ID NO: 761083 - RNA, 19 nt, Homo sapiens
gaacauuccagaugccuau

SEQ ID NO: 761084 - RNA, 19 nt, Homo sapiens
aggaauugcuggccaagua

SEQ ID NO: 761085 - RNA, 19 nt, Homo sapiens
gcacggucguauuucauga

SEQ ID NO: 761086 - RNA, 19 nt, Homo sapiens
uuacugaacccuuugcaua

SEQ ID NO: 761087 - RNA, 19 nt, Homo sapiens
ggaaaacacugcuaguaga

SEQ ID NO: 761088 - RNA, 19 nt, Homo sapiens
ucacauagagaccguguaa

SEQ ID NO: 761089 - RNA, 19 nt, Homo sapiens
agaauugaaugacuuccua

SEQ ID NO: 761090 - RNA, 19 nt, Homo sapiens
gauggaccuucuaauaaug

SEQ ID NO: 761091 - RNA, 19 nt, Homo sapiens
gaauuuguaucugaaagug

SEQ ID NO: 761092 - RNA, 19 nt, Homo sapiens
ccacggagccucuucugaa

SEQ ID NO: 761093 - RNA, 19 nt, Homo sapiens
cagcuuggguucuacaaug

SEQ ID NO: 761094 - RNA, 19 nt, Homo sapiens
gaauguagaaugaggauag

SEQ ID NO: 761095 - RNA, 19 nt, Homo sapiens
ccuuggagaugaacgauuu

SEQ ID NO: 761096 - RNA, 19 nt, Homo sapiens
cuaaacagcuauauagaac

SEQ ID NO: 761097 - RNA, 19 nt, Homo sapiens
gaauaugcagggaguugua

SEQ ID NO: 761098 - RNA, 19 nt, Homo sapiens
gaagaggaagaacaacaaa

SEQ ID NO: 761099 - RNA, 19 nt, Homo sapiens
aagauggaccuucuaauaa

SEQ ID NO: 761100 - RNA, 19 nt, Homo sapiens
aaaccagccuuuucuaaua

SEQ ID NO: 761101 - RNA, 19 nt, Homo sapiens
gccauucccugcuauacaa

SEQ ID NO: 761102 - RNA, 19 nt, Homo sapiens
agacagaauugaaugacuu

SEQ ID NO: 761103 - RNA, 19 nt, Homo sapiens
aaacacugcuaguagaaga

SEQ ID NO: 761104 - RNA, 19 nt, Homo sapiens
gagagaagcaaacauguag

SEQ ID NO: 761105 - RNA, 19 nt, Homo sapiens
acucauguauguaaacgua

SEQ ID NO: 761106 - RNA, 19 nt, Homo sapiens
ucagaucacuccauagaag

SEQ ID NO: 761107 - RNA, 19 nt, Homo sapiens
aguaagaaaugauggcaaa

SEQ ID NO: 761108 - RNA, 19 nt, Homo sapiens
caauguugcuuugauguug

SEQ ID NO: 761109 - RNA, 19 nt, Homo sapiens
acacugugcuaauauguau

SEQ ID NO: 761110 - RNA, 19 nt, Homo sapiens
acaaggaguuauauucaga

SEQ ID NO: 761111 - RNA, 19 nt, Homo sapiens
gaacgauuuccaagaggua

SEQ ID NO: 761112 - RNA, 19 nt, Homo sapiens
guaguacaaucauguugga

SEQ ID NO: 761113 - RNA, 19 nt, Homo sapiens
aggcauaucuuucucuuca

SEQ ID NO: 761114 - RNA, 19 nt, Homo sapiens
acagcuaccugcagaaguu

SEQ ID NO: 761115 - RNA, 19 nt, Homo sapiens
cuaaggaagucagcaggua

SEQ ID NO: 761116 - RNA, 19 nt, Homo sapiens
ggaaauugcugcccucgua

SEQ ID NO: 761117 - RNA, 19 nt, Homo sapiens
ucagaaaccuccucacuuu

SEQ ID NO: 761118 - RNA, 19 nt, Homo sapiens
gcccaaaccugucuuguaa

SEQ ID NO: 761119 - RNA, 19 nt, Homo sapiens
gaacaggucuccagcagau

SEQ ID NO: 761120 - RNA, 19 nt, Homo sapiens
ccacuuggcuugugagaaa

SEQ ID NO: 761121 - RNA, 19 nt, Homo sapiens
ggaagaggaugaugaggaa

SEQ ID NO: 761122 - RNA, 19 nt, Homo sapiens
gaacggauuuuccaacuua

SEQ ID NO: 761123 - RNA, 19 nt, Homo sapiens
ugaagaaggugcugaagaa

SEQ ID NO: 761124 - RNA, 19 nt, Homo sapiens
uauauaggcuuaucaguga

SEQ ID NO: 761125 - RNA, 19 nt, Homo sapiens
gggcuagacuggcugguua

SEQ ID NO: 761126 - RNA, 19 nt, Homo sapiens
uaaugaaggucuagucaaa

SEQ ID NO: 761127 - RNA, 19 nt, Homo sapiens
ccaccgggcuguacuguuu

SEQ ID NO: 761128 - RNA, 19 nt, Homo sapiens
aaaccacacuccugucaua

SEQ ID NO: 761129 - RNA, 19 nt, Homo sapiens
ggaggaagaugaugauuuu

SEQ ID NO: 761130 - RNA, 19 nt, Homo sapiens
ugaagaugaugaagaguuu

SEQ ID NO: 761131 - RNA, 19 nt, Homo sapiens
uggcugagcuugcagaauu

SEQ ID NO: 761132 - RNA, 19 nt, Homo sapiens
gcaacaagcugacuuugac

SEQ ID NO: 761133 - RNA, 19 nt, Homo sapiens
ccaguucccugacuuaaga

SEQ ID NO: 761134 - RNA, 19 nt, Homo sapiens
gaguuaagguggauguuga

SEQ ID NO: 761135 - RNA, 19 nt, Homo sapiens
gaacuggcgcuaucucauu

SEQ ID NO: 761136 - RNA, 19 nt, Homo sapiens
aagaugagguugaugcuaa

SEQ ID NO: 761137 - RNA, 19 nt, Homo sapiens
ggaaacgauugaaguugaa

SEQ ID NO: 761138 - RNA, 19 nt, Homo sapiens
gaccuggacuuagcagaua

SEQ ID NO: 761139 - RNA, 19 nt, Homo sapiens
ccacagcgccucauucuau

SEQ ID NO: 761140 - RNA, 19 nt, Homo sapiens
ggacaguggugguggugaa

SEQ ID NO: 761141 - RNA, 19 nt, Homo sapiens
gagauggaguugaaacguu

SEQ ID NO: 761142 - RNA, 19 nt, Homo sapiens
gauugaaguugaagaacaa

SEQ ID NO: 761143 - RNA, 19 nt, Homo sapiens
aaagaucuguugccaguug

SEQ ID NO: 761144 - RNA, 19 nt, Homo sapiens
ggaccgcugucaccgaauu

SEQ ID NO: 761145 - RNA, 19 nt, Homo sapiens
gaacagagacaggccuuga

SEQ ID NO: 761146 - RNA, 19 nt, Homo sapiens
ggaacucccuugcagaaca

SEQ ID NO: 761147 - RNA, 19 nt, Homo sapiens
ggaugaagaggauacuaua

SEQ ID NO: 761148 - RNA, 19 nt, Homo sapiens
gcggaaaguugcagacguu

SEQ ID NO: 761149 - RNA, 19 nt, Homo sapiens
gauaugaggcagacacauu

SEQ ID NO: 761150 - RNA, 19 nt, Homo sapiens
ggucgugucucucgauaug

SEQ ID NO: 761151 - RNA, 19 nt, Homo sapiens
gcacagaccacaacuaagg

SEQ ID NO: 761152 - RNA, 19 nt, Homo sapiens
gaagaaacaaguggaaguu

SEQ ID NO: 761153 - RNA, 19 nt, Homo sapiens
uaauagcucugacugugaa

SEQ ID NO: 761154 - RNA, 19 nt, Homo sapiens
uccgagagcuguuugauau

SEQ ID NO: 761155 - RNA, 19 nt, Homo sapiens
ggauagacaugggucgauu

SEQ ID NO: 761156 - RNA, 19 nt, Homo sapiens
gaagcaaaccucucaccuu

SEQ ID NO: 761157 - RNA, 19 nt, Homo sapiens
cgucaacgcugucucuaug

SEQ ID NO: 761158 - RNA, 19 nt, Homo sapiens
uggagaagguggugcaauu

SEQ ID NO: 761159 - RNA, 19 nt, Homo sapiens
caccacagccuauuucaaa

SEQ ID NO: 761160 - RNA, 19 nt, Homo sapiens
gucauuaacuccagcauca

SEQ ID NO: 761161 - RNA, 19 nt, Homo sapiens
gcaaaccucucaccuucca

SEQ ID NO: 761162 - RNA, 19 nt, Homo sapiens
guccacauauauaggcuua

SEQ ID NO: 761163 - RNA, 19 nt, Homo sapiens
caaccauggugaauaauac

SEQ ID NO: 761164 - RNA, 19 nt, Homo sapiens
gcagugaagaugaggauga

SEQ ID NO: 761165 - RNA, 19 nt, Homo sapiens
ggcagaagaugaagaggau

SEQ ID NO: 761166 - RNA, 19 nt, Homo sapiens
gcaaucauccaaaucuguu

SEQ ID NO: 761167 - RNA, 19 nt, Homo sapiens
ggagugaggaugaggaaga

SEQ ID NO: 761168 - RNA, 19 nt, Homo sapiens
gggccgaccucccaagaau

SEQ ID NO: 761169 - RNA, 19 nt, Homo sapiens
gugcugauguggaaauuag

SEQ ID NO: 761170 - RNA, 19 nt, Homo sapiens
gcaagcagacucauauucu

SEQ ID NO: 761171 - RNA, 19 nt, Homo sapiens
uaagguggauguugagaag

SEQ ID NO: 761172 - RNA, 19 nt, Homo sapiens
ggaagaccauccagaccau

SEQ ID NO: 761173 - RNA, 19 nt, Homo sapiens
caccagugcugauguggaa

SEQ ID NO: 761174 - RNA, 19 nt, Homo sapiens
gcaaaucagaagagaaugu

SEQ ID NO: 761175 - RNA, 19 nt, Homo sapiens
gaccagcugucagaaauca

SEQ ID NO: 761176 - RNA, 19 nt, Homo sapiens
caucuucccuugugguuuc

SEQ ID NO: 761177 - RNA, 19 nt, Homo sapiens
ggcagucacuccucaacuu

SEQ ID NO: 761178 - RNA, 19 nt, Homo sapiens
ggagcaauguggagaaggu

SEQ ID NO: 761179 - RNA, 19 nt, Homo sapiens
ggaugaagaugagguugau

SEQ ID NO: 761180 - RNA, 19 nt, Homo sapiens
aaacgcauauucugcuuca

SEQ ID NO: 761181 - RNA, 19 nt, Homo sapiens
ccaaggaugucaggcaguu

SEQ ID NO: 761182 - RNA, 19 nt, Homo sapiens
ucaaggagugguucucuaa

SEQ ID NO: 761183 - RNA, 19 nt, Homo sapiens
agaaacaaguggaaguuca

SEQ ID NO: 761184 - RNA, 19 nt, Homo sapiens
aaggugagcuuuccaugga

SEQ ID NO: 761185 - RNA, 19 nt, Homo sapiens
gagaauugccacuggaaga

SEQ ID NO: 761186 - RNA, 19 nt, Homo sapiens
aggaaacgauugaaguuga

SEQ ID NO: 761187 - RNA, 19 nt, Homo sapiens
ccauuaaccuccagcaaag

SEQ ID NO: 761188 - RNA, 19 nt, Homo sapiens
ggaaugcgaggacggaaga

SEQ ID NO: 761189 - RNA, 19 nt, Homo sapiens
gcaaaccacacuccuguca

SEQ ID NO: 761190 - RNA, 19 nt, Homo sapiens
ccacauauauaggcuuauc

SEQ ID NO: 761191 - RNA, 19 nt, Homo sapiens
gcacccaguucccugacuu

SEQ ID NO: 761192 - RNA, 19 nt, Homo sapiens
cagaaaucauugagagguu

SEQ ID NO: 761193 - RNA, 19 nt, Homo sapiens
uagaccagcugucagaaau

SEQ ID NO: 761194 - RNA, 19 nt, Homo sapiens
gcucccaccucuucacaug

SEQ ID NO: 761195 - RNA, 19 nt, Homo sapiens
gcaucagccuugacucuag

SEQ ID NO: 761196 - RNA, 19 nt, Homo sapiens
ggugaagauuguagugaga

SEQ ID NO: 761197 - RNA, 19 nt, Homo sapiens
ccaaccauggugaauaaua

SEQ ID NO: 761198 - RNA, 19 nt, Homo sapiens
gcuuuaaaauccucacuua

SEQ ID NO: 761199 - RNA, 19 nt, Homo sapiens
ccauggagcugagcgaguu

SEQ ID NO: 761200 - RNA, 19 nt, Homo sapiens
ucacacagcgcaacaaaca

SEQ ID NO: 761201 - RNA, 19 nt, Homo sapiens
ccugagacccuaauuguug

SEQ ID NO: 761202 - RNA, 19 nt, Homo sapiens
caggacggcugguaacugu

SEQ ID NO: 761203 - RNA, 19 nt, Homo sapiens
caucaucaacucaaacuau

SEQ ID NO: 761204 - RNA, 19 nt, Homo sapiens
gccaguaccuaagcaagaa

SEQ ID NO: 761205 - RNA, 19 nt, Homo sapiens
ggaagaaacaaguggaagu

SEQ ID NO: 761206 - RNA, 19 nt, Homo sapiens
ccaggcaucuucccuugug

SEQ ID NO: 761207 - RNA, 19 nt, Homo sapiens
ccaagccagucaagaugaa

SEQ ID NO: 761208 - RNA, 19 nt, Homo sapiens
gaacaucaagaacuucaag

SEQ ID NO: 761209 - RNA, 19 nt, Homo sapiens
ugaagaggauacuauagca

SEQ ID NO: 761210 - RNA, 19 nt, Homo sapiens
ccucagguguuggagauaa

SEQ ID NO: 761211 - RNA, 19 nt, Homo sapiens
cgauugaaguugaagaaca

SEQ ID NO: 761212 - RNA, 19 nt, Homo sapiens
gccauuaaccuccagcaaa

SEQ ID NO: 761213 - RNA, 19 nt, Homo sapiens
guggcucucugcugacuuu

SEQ ID NO: 761214 - RNA, 19 nt, Homo sapiens
ucaaacgccuccacaaggu

SEQ ID NO: 761215 - RNA, 19 nt, Homo sapiens
gaccaagcccaaugccuuu

SEQ ID NO: 761216 - RNA, 19 nt, Homo sapiens
cauacuaacugcucaauaa

SEQ ID NO: 761217 - RNA, 19 nt, Homo sapiens
gcacggcgcugcaaucuuc

SEQ ID NO: 761218 - RNA, 19 nt, Homo sapiens
caaaucagaucccguccaa

SEQ ID NO: 761219 - RNA, 19 nt, Homo sapiens
ccaauuaagugccuucaca

SEQ ID NO: 761220 - RNA, 19 nt, Homo sapiens
acaaagcaguggugagauu

SEQ ID NO: 761221 - RNA, 19 nt, Homo sapiens
uaaaugggaggcaucauaa

SEQ ID NO: 761222 - RNA, 19 nt, Homo sapiens
guaaagcgccaggcacaua

SEQ ID NO: 761223 - RNA, 19 nt, Homo sapiens
caacuacucuaucguggau

SEQ ID NO: 761224 - RNA, 19 nt, Homo sapiens
gcaacugacuguccucucu

SEQ ID NO: 761225 - RNA, 19 nt, Homo sapiens
agacagagaagaaaucauu

SEQ ID NO: 761226 - RNA, 19 nt, Homo sapiens
ggaggcaucauaauuguau

SEQ ID NO: 761227 - RNA, 19 nt, Homo sapiens
acaauaagguaggcaugua

SEQ ID NO: 761228 - RNA, 19 nt, Homo sapiens
cuacuugccugcuggaguu

SEQ ID NO: 761229 - RNA, 19 nt, Homo sapiens
aguaaagucuagcaggaua

SEQ ID NO: 761230 - RNA, 19 nt, Homo sapiens
aaaguaguuugcacagaaa

SEQ ID NO: 761231 - RNA, 19 nt, Homo sapiens
ucaaaggaguaaagucuag

SEQ ID NO: 761232 - RNA, 19 nt, Homo sapiens
caaagcaguggugagauua

SEQ ID NO: 761233 - RNA, 19 nt, Homo sapiens
gcacggguguuggcggaaa

SEQ ID NO: 761234 - RNA, 19 nt, Homo sapiens
cagauucccuuucgguaau

SEQ ID NO: 761235 - RNA, 19 nt, Homo sapiens
guggugagauuacaauaag

SEQ ID NO: 761236 - RNA, 19 nt, Homo sapiens
guaucuaccucacaaagca

SEQ ID NO: 761237 - RNA, 19 nt, Homo sapiens
gacagagaagaaaucauua

SEQ ID NO: 761238 - RNA, 19 nt, Homo sapiens
acuaacugcucaauaaaug

SEQ ID NO: 761239 - RNA, 19 nt, Homo sapiens
caauaagguaggcauguaa

SEQ ID NO: 761240 - RNA, 19 nt, Homo sapiens
gggaagggcuggaaaucac

SEQ ID NO: 761241 - RNA, 19 nt, Homo sapiens
uaucguggauuuccucauc

SEQ ID NO: 761242 - RNA, 19 nt, Homo sapiens
gaucaucagccgccucuuc

SEQ ID NO: 761243 - RNA, 19 nt, Homo sapiens
auaaaugggaggcaucaua

SEQ ID NO: 761244 - RNA, 19 nt, Homo sapiens
ccagauucccuuucgguaa

SEQ ID NO: 761245 - RNA, 19 nt, Homo sapiens
ugaguaagacagagaagaa

SEQ ID NO: 761246 - RNA, 19 nt, Homo sapiens
gagacaggguucuuaccau

SEQ ID NO: 761247 - RNA, 19 nt, Homo sapiens
ggacuacagcgccgaguuc

SEQ ID NO: 761248 - RNA, 19 nt, Homo sapiens
ccaaaguucugggauuaca

SEQ ID NO: 761249 - RNA, 19 nt, Homo sapiens
gggaaacauuggucucuac

SEQ ID NO: 761250 - RNA, 19 nt, Homo sapiens
aaaaguaguuugcacagaa

SEQ ID NO: 761251 - RNA, 19 nt, Homo sapiens
gcagacgucgagcagagua

SEQ ID NO: 761252 - RNA, 19 nt, Homo sapiens
gaugaaggacccuguagca

SEQ ID NO: 761253 - RNA, 19 nt, Homo sapiens
gaggcaucauaauuguaua

SEQ ID NO: 761254 - RNA, 19 nt, Homo sapiens
gaaugaguaagacagagaa

SEQ ID NO: 761255 - RNA, 19 nt, Homo sapiens
ucaaacuccugaucucaag

SEQ ID NO: 761256 - RNA, 19 nt, Homo sapiens
ggaacuacuucgggcuguu

SEQ ID NO: 761257 - RNA, 19 nt, Homo sapiens
ggaaaguguagcccagaga

SEQ ID NO: 761258 - RNA, 19 nt, Homo sapiens
guaagacagagaagaaauc

SEQ ID NO: 761259 - RNA, 19 nt, Homo sapiens
ccacaccacuggauauucc

SEQ ID NO: 761260 - RNA, 19 nt, Homo sapiens
acaggguucuuaccauguu

SEQ ID NO: 761261 - RNA, 19 nt, Homo sapiens
ccuccggccucccaaaguu

SEQ ID NO: 761262 - RNA, 19 nt, Homo sapiens
caguguaucuaccucacaa

SEQ ID NO: 761263 - RNA, 19 nt, Homo sapiens
accaagcucugucuccaaa

SEQ ID NO: 761264 - RNA, 19 nt, Homo sapiens
acuacucuaucguggauuu

SEQ ID NO: 761265 - RNA, 19 nt, Homo sapiens
gcaguggugagauuacaau

SEQ ID NO: 761266 - RNA, 19 nt, Homo sapiens
aaucagaucccguccaaag

SEQ ID NO: 761267 - RNA, 19 nt, Homo sapiens
ccgaguagcugggauugca

SEQ ID NO: 761268 - RNA, 19 nt, Homo sapiens
aaugggaggcaucauaauu

SEQ ID NO: 761269 - RNA, 19 nt, Homo sapiens
gaguaagacagagaagaaa

SEQ ID NO: 761270 - RNA, 19 nt, Homo sapiens
gaaguccagggaagaagga

SEQ ID NO: 761271 - RNA, 19 nt, Homo sapiens
uguaugcccuggaaguugu

SEQ ID NO: 761272 - RNA, 19 nt, Homo sapiens
acccugaggucaacacaga

SEQ ID NO: 761273 - RNA, 19 nt, Homo sapiens
gcacauacuaacugcucaa

SEQ ID NO: 761274 - RNA, 19 nt, Homo sapiens
ccccaccucuccccaauua

SEQ ID NO: 761275 - RNA, 19 nt, Homo sapiens
aaacaguaccagcagauca

SEQ ID NO: 761276 - RNA, 19 nt, Homo sapiens
cagaaaaucacaucuauca

SEQ ID NO: 761277 - RNA, 19 nt, Homo sapiens
gaggaaacucucaggaucu

SEQ ID NO: 761278 - RNA, 19 nt, Homo sapiens
ucagaucccguccaaagug

SEQ ID NO: 761279 - RNA, 19 nt, Homo sapiens
caggauagaaggagguuuc

SEQ ID NO: 761280 - RNA, 19 nt, Homo sapiens
ugggaggcaucauaauugu

SEQ ID NO: 761281 - RNA, 19 nt, Homo sapiens
uaucacgguugguagaagu

SEQ ID NO: 761282 - RNA, 19 nt, Homo sapiens
ucauuaaacaccaggauuc

SEQ ID NO: 761283 - RNA, 19 nt, Homo sapiens
ggucugggugggaaacauu

SEQ ID NO: 761284 - RNA, 19 nt, Homo sapiens
ucgagaagugcgacccuua

SEQ ID NO: 761285 - RNA, 19 nt, Homo sapiens
gaaacaguaccagcagauc

SEQ ID NO: 761286 - RNA, 19 nt, Homo sapiens
cugcuuuacugucagaaug

SEQ ID NO: 761287 - RNA, 19 nt, Homo sapiens
uaagacagagaagaaauca

SEQ ID NO: 761288 - RNA, 19 nt, Homo sapiens
ccaccacaccacuggauau

SEQ ID NO: 761289 - RNA, 19 nt, Homo sapiens
cuaccaccaucaucacauc

SEQ ID NO: 761290 - RNA, 19 nt, Homo sapiens
ugacucagccaauaaugca

SEQ ID NO: 761291 - RNA, 19 nt, Homo sapiens
ccucaaaggaguaaagucu

SEQ ID NO: 761292 - RNA, 19 nt, Homo sapiens
gggaggcaucauaauugua

SEQ ID NO: 761293 - RNA, 19 nt, Homo sapiens
ugggaaacauuggucucua

SEQ ID NO: 761294 - RNA, 19 nt, Homo sapiens
ggccccagccuuaaauuua

SEQ ID NO: 761295 - RNA, 19 nt, Homo sapiens
gcugacagaaacaagcauu

SEQ ID NO: 761296 - RNA, 19 nt, Homo sapiens
ucagaaugaguaagacaga

SEQ ID NO: 761297 - RNA, 19 nt, Homo sapiens
guagagacaggguucuuac

SEQ ID NO: 761298 - RNA, 19 nt, Homo sapiens
gcaacgacacagucaucug

SEQ ID NO: 761299 - RNA, 19 nt, Homo sapiens
caauaaaugggaggcauca

SEQ ID NO: 761300 - RNA, 19 nt, Homo sapiens
guucaagucccaacugcau

SEQ ID NO: 761301 - RNA, 19 nt, Homo sapiens
uuaaacaccaggauucuac

SEQ ID NO: 761302 - RNA, 19 nt, Homo sapiens
gugaagccucaaaggagua

SEQ ID NO: 761303 - RNA, 19 nt, Homo sapiens
ccagagagggcaaggaacu

SEQ ID NO: 761304 - RNA, 19 nt, Homo sapiens
aauaagguaggcauguaaa

SEQ ID NO: 761305 - RNA, 19 nt, Homo sapiens
ggucucaaacuccugaucu

SEQ ID NO: 761306 - RNA, 19 nt, Homo sapiens
ugccaccgguucucuguuc

SEQ ID NO: 761307 - RNA, 19 nt, Homo sapiens
agaaugaguaagacagaga

SEQ ID NO: 761308 - RNA, 19 nt, Homo sapiens
acucagccaauaaugcaua

SEQ ID NO: 761309 - RNA, 19 nt, Homo sapiens
ggugagauuacaauaaggu

SEQ ID NO: 761310 - RNA, 19 nt, Homo sapiens
ggaguuuucugccugagau

SEQ ID NO: 761311 - RNA, 19 nt, Homo sapiens
guucucuguucuccuggaa

SEQ ID NO: 761312 - RNA, 19 nt, Homo sapiens
gaguaaagucuagcaggau

SEQ ID NO: 761313 - RNA, 19 nt, Homo sapiens
caacgaggagggcaucacu

SEQ ID NO: 761314 - RNA, 19 nt, Homo sapiens
cagagcagccgcagagcau

SEQ ID NO: 761315 - RNA, 19 nt, Homo sapiens
cuacccacaagaaacagua

SEQ ID NO: 761316 - RNA, 19 nt, Homo sapiens
ggaggacgauuuauuauua

SEQ ID NO: 761317 - RNA, 19 nt, Homo sapiens
gcauuuauccauugaguua

SEQ ID NO: 761318 - RNA, 19 nt, Homo sapiens
gcacagcccuacuaacuag

SEQ ID NO: 761319 - RNA, 19 nt, Homo sapiens
gaagacauuuaacacagaa

SEQ ID NO: 761320 - RNA, 19 nt, Homo sapiens
gcgccuggcuaaguuauua

SEQ ID NO: 761321 - RNA, 19 nt, Homo sapiens
gaaagcacagcccuacuaa

SEQ ID NO: 761322 - RNA, 19 nt, Homo sapiens
ccuauacccucaagcauuu

SEQ ID NO: 761323 - RNA, 19 nt, Homo sapiens
ccaagaagaagaagaagaa

SEQ ID NO: 761324 - RNA, 19 nt, Homo sapiens
cgaccguccugucucuuua

SEQ ID NO: 761325 - RNA, 19 nt, Homo sapiens
aggaacagauuaacacuga

SEQ ID NO: 761326 - RNA, 19 nt, Homo sapiens
acacugagccucuagaaga

SEQ ID NO: 761327 - RNA, 19 nt, Homo sapiens
gaucgggagucgagcaaug

SEQ ID NO: 761328 - RNA, 19 nt, Homo sapiens
uccaugaguucaauuguuu

SEQ ID NO: 761329 - RNA, 19 nt, Homo sapiens
ccucaagcauuuauccauu

SEQ ID NO: 761330 - RNA, 19 nt, Homo sapiens
ccacauccaccaagaagaa

SEQ ID NO: 761331 - RNA, 19 nt, Homo sapiens
cugguuguguuaucaaaua

SEQ ID NO: 761332 - RNA, 19 nt, Homo sapiens
caaacaauccaguuacaau

SEQ ID NO: 761333 - RNA, 19 nt, Homo sapiens
cacuauacccggcuaauuu

SEQ ID NO: 761334 - RNA, 19 nt, Homo sapiens
ggagugcaguggugugauc

SEQ ID NO: 761335 - RNA, 19 nt, Homo sapiens
agaagaagaagaagaaaga

SEQ ID NO: 761336 - RNA, 19 nt, Homo sapiens
agaagaagaagaagaagaa

SEQ ID NO: 761337 - RNA, 19 nt, Homo sapiens
ccaaagugcuaggauaaca

SEQ ID NO: 761338 - RNA, 19 nt, Homo sapiens
ggagcuguuuccuggguaa

SEQ ID NO: 761339 - RNA, 19 nt, Homo sapiens
gaagaagaagaaagagaga

SEQ ID NO: 761340 - RNA, 19 nt, Homo sapiens
ccgaguagcugggccuaaa

SEQ ID NO: 761341 - RNA, 19 nt, Homo sapiens
caauccaguuacaaucuuu

SEQ ID NO: 761342 - RNA, 19 nt, Homo sapiens
guuacaaacaauccaguua

SEQ ID NO: 761343 - RNA, 19 nt, Homo sapiens
aaacugaggaacuaaagaa

SEQ ID NO: 761344 - RNA, 19 nt, Homo sapiens
gauuaacacugagccucua

SEQ ID NO: 761345 - RNA, 19 nt, Homo sapiens
ggagugcaguggcgcaauc

SEQ ID NO: 761346 - RNA, 19 nt, Homo sapiens
ccaccaagaagaagaagaa

SEQ ID NO: 761347 - RNA, 19 nt, Homo sapiens
gaucgucaagggcaaauug

SEQ ID NO: 761348 - RNA, 19 nt, Homo sapiens
gauacggagcuguggcuua

SEQ ID NO: 761349 - RNA, 19 nt, Homo sapiens
ugaggaaccagucauuaaa

SEQ ID NO: 761350 - RNA, 19 nt, Homo sapiens
gggaggacgauuuauuauu

SEQ ID NO: 761351 - RNA, 19 nt, Homo sapiens
gaaacugaggaacuaaaga

SEQ ID NO: 761352 - RNA, 19 nt, Homo sapiens
gaaagccggaugccagaga

SEQ ID NO: 761353 - RNA, 19 nt, Homo sapiens
agaaagcacagcccuacua

SEQ ID NO: 761354 - RNA, 19 nt, Homo sapiens
ccgggaaacugaggaacua

SEQ ID NO: 761355 - RNA, 19 nt, Homo sapiens
gaagaagaagaagaagaaa

SEQ ID NO: 761356 - RNA, 19 nt, Homo sapiens
gaaauggaugugcggaaga

SEQ ID NO: 761357 - RNA, 19 nt, Homo sapiens
auacggagcuguggcuuau

SEQ ID NO: 761358 - RNA, 19 nt, Homo sapiens
gcgcugacggguccagaua

SEQ ID NO: 761359 - RNA, 19 nt, Homo sapiens
agaagacauuuaacacaga

SEQ ID NO: 761360 - RNA, 19 nt, Homo sapiens
aacuauccauccacucuua

SEQ ID NO: 761361 - RNA, 19 nt, Homo sapiens
gaagaagcagagucaggaa

SEQ ID NO: 761362 - RNA, 19 nt, Homo sapiens
gaaagagagaggucacaca

SEQ ID NO: 761363 - RNA, 19 nt, Homo sapiens
cugggaggacgauuuauua

SEQ ID NO: 761364 - RNA, 19 nt, Homo sapiens
ggccugggaggacgauuua

SEQ ID NO: 761365 - RNA, 19 nt, Homo sapiens
ggaacuauccauccacucu

SEQ ID NO: 761366 - RNA, 19 nt, Homo sapiens
agacagggguuucaccaua

SEQ ID NO: 761367 - RNA, 19 nt, Homo sapiens
gccuugaccucccaaagug

SEQ ID NO: 761368 - RNA, 19 nt, Homo sapiens
aaggaggcguugcaacaaa

SEQ ID NO: 761369 - RNA, 19 nt, Homo sapiens
gaggacgauuuauuauuac

SEQ ID NO: 761370 - RNA, 19 nt, Homo sapiens
ccaagaagaggaagaagca

SEQ ID NO: 761371 - RNA, 19 nt, Homo sapiens
gugaagcaggaacagauua

SEQ ID NO: 761372 - RNA, 19 nt, Homo sapiens
gccucugacuccagcaaua

SEQ ID NO: 761373 - RNA, 19 nt, Homo sapiens
gaacuauccauccacucuu

SEQ ID NO: 761374 - RNA, 19 nt, Homo sapiens
ugaagcaggaacagauuaa

SEQ ID NO: 761375 - RNA, 19 nt, Homo sapiens
aaauggaugugcggaagaa

SEQ ID NO: 761376 - RNA, 19 nt, Homo sapiens
ggaaacugaggaacuaaag

SEQ ID NO: 761377 - RNA, 19 nt, Homo sapiens
gcucccacauccaccaaga

SEQ ID NO: 761378 - RNA, 19 nt, Homo sapiens
gugcaguggugugaucuug

SEQ ID NO: 761379 - RNA, 19 nt, Homo sapiens
uacaaacaauccaguuaca

SEQ ID NO: 761380 - RNA, 19 nt, Homo sapiens
aaaagaagacgaagaaaga

SEQ ID NO: 761381 - RNA, 19 nt, Homo sapiens
ccagaagacauuuaacaca

SEQ ID NO: 761382 - RNA, 19 nt, Homo sapiens
ccagaagacaagacaguga

SEQ ID NO: 761383 - RNA, 19 nt, Homo sapiens
ggaaccagucauuaaagga

SEQ ID NO: 761384 - RNA, 19 nt, Homo sapiens
gggaaacugaggaacuaaa

SEQ ID NO: 761385 - RNA, 19 nt, Homo sapiens
gcacccugccaaguuauuu

SEQ ID NO: 761386 - RNA, 19 nt, Homo sapiens
uaacacugagccucuagaa

SEQ ID NO: 761387 - RNA, 19 nt, Homo sapiens
ucaagaauuucagaccaau

SEQ ID NO: 761388 - RNA, 19 nt, Homo sapiens
ccacuauacccggcuaauu

SEQ ID NO: 761389 - RNA, 19 nt, Homo sapiens
acaauccaguuacaaucuu

SEQ ID NO: 761390 - RNA, 19 nt, Homo sapiens
ggaacuaaagaaagcugaa

SEQ ID NO: 761391 - RNA, 19 nt, Homo sapiens
gugccuggcuuauuucacu

SEQ ID NO: 761392 - RNA, 19 nt, Homo sapiens
cauccacucuuaucuccau

SEQ ID NO: 761393 - RNA, 19 nt, Homo sapiens
ucaccugguuguguuauca

SEQ ID NO: 761394 - RNA, 19 nt, Homo sapiens
gaggaaccagucauuaaag

SEQ ID NO: 761395 - RNA, 19 nt, Homo sapiens
ucaggguacuuucaagaag

SEQ ID NO: 761396 - RNA, 19 nt, Homo sapiens
gaacuaaagaaagcugaag

SEQ ID NO: 761397 - RNA, 19 nt, Homo sapiens
caguggagccggagaugaa

SEQ ID NO: 761398 - RNA, 19 nt, Homo sapiens
auucuuaccugucucuuca

SEQ ID NO: 761399 - RNA, 19 nt, Homo sapiens
cagaagacaagacagugaa

SEQ ID NO: 761400 - RNA, 19 nt, Homo sapiens
aaacaauccaguuacaauc

SEQ ID NO: 761401 - RNA, 19 nt, Homo sapiens
ggucaucaggguacuuuca

SEQ ID NO: 761402 - RNA, 19 nt, Homo sapiens
gcagcagccuguguagucu

SEQ ID NO: 761403 - RNA, 19 nt, Homo sapiens
gcucugcacacguugaaau

SEQ ID NO: 761404 - RNA, 19 nt, Homo sapiens
auagucaccugguuguguu

SEQ ID NO: 761405 - RNA, 19 nt, Homo sapiens
uuucugcucugcacacguu

SEQ ID NO: 761406 - RNA, 19 nt, Homo sapiens
ggauccacguggucugcaa

SEQ ID NO: 761407 - RNA, 19 nt, Homo sapiens
cuccaugaguucaauuguu

SEQ ID NO: 761408 - RNA, 19 nt, Homo sapiens
uuaaggaggcguugcaaca

SEQ ID NO: 761409 - RNA, 19 nt, Homo sapiens
cuaguauucuuaccugucu

SEQ ID NO: 761410 - RNA, 19 nt, Homo sapiens
ccacugcgccuggcuaagu

SEQ ID NO: 761411 - RNA, 19 nt, Homo sapiens
uccauugaguuacaaacaa

SEQ ID NO: 761412 - RNA, 19 nt, Homo sapiens
ggguuuugguucuuuauuu

SEQ ID NO: 761413 - RNA, 19 nt, Homo sapiens
gcucgugcaggacaucaaa

SEQ ID NO: 761414 - RNA, 19 nt, Homo sapiens
caucaggguacuuucaaga

SEQ ID NO: 761415 - RNA, 19 nt, Homo sapiens
cagaaucccuccccagaga

SEQ ID NO: 761416 - RNA, 19 nt, Homo sapiens
guacucagcucuaccgaaa

SEQ ID NO: 761417 - RNA, 19 nt, Homo sapiens
gaaagccacucucagacaa

SEQ ID NO: 761418 - RNA, 19 nt, Homo sapiens
cccaauagccaaauaauaa

SEQ ID NO: 761419 - RNA, 19 nt, Homo sapiens
aagcagcauuggauaauaa

SEQ ID NO: 761420 - RNA, 19 nt, Homo sapiens
cagacaagcuacugaggaa

SEQ ID NO: 761421 - RNA, 19 nt, Homo sapiens
aaagcagcauuggauaaua

SEQ ID NO: 761422 - RNA, 19 nt, Homo sapiens
uaauaaagcagcauuggau

SEQ ID NO: 761423 - RNA, 19 nt, Homo sapiens
gaggagagagagagaagga

SEQ ID NO: 761424 - RNA, 19 nt, Homo sapiens
uaaagcagcauuggauaau

SEQ ID NO: 761425 - RNA, 19 nt, Homo sapiens
gagagaaggaagagucuag

SEQ ID NO: 761426 - RNA, 19 nt, Homo sapiens
ggacucugcccaagcugaa

SEQ ID NO: 761427 - RNA, 19 nt, Homo sapiens
ccuccaggcuuucgugcuu

SEQ ID NO: 761428 - RNA, 19 nt, Homo sapiens
gagagagagagaaggaaga

SEQ ID NO: 761429 - RNA, 19 nt, Homo sapiens
auaaagcagcauuggauaa

SEQ ID NO: 761430 - RNA, 19 nt, Homo sapiens
aauaaagcagcauuggaua

SEQ ID NO: 761431 - RNA, 19 nt, Homo sapiens
cgaaagccacucucagaca

SEQ ID NO: 761432 - RNA, 19 nt, Homo sapiens
acugucaccuccaggcuuu

SEQ ID NO: 761433 - RNA, 19 nt, Homo sapiens
ggaggaggagagagagaga

SEQ ID NO: 761434 - RNA, 19 nt, Homo sapiens
gcagcauuggauaauaauu

SEQ ID NO: 761435 - RNA, 19 nt, Homo sapiens
gagagagaaggaagagucu

SEQ ID NO: 761436 - RNA, 19 nt, Homo sapiens
gagucuaggcugagcaaca

SEQ ID NO: 761437 - RNA, 19 nt, Homo sapiens
agucuaggcugagcaacau

SEQ ID NO: 761438 - RNA, 19 nt, Homo sapiens
gugcuuagcuguauauuua

SEQ ID NO: 761439 - RNA, 19 nt, Homo sapiens
ucaaauggcuuaagcaaua

SEQ ID NO: 761440 - RNA, 19 nt, Homo sapiens
gauaagaaaugccaaaguu

SEQ ID NO: 761441 - RNA, 19 nt, Homo sapiens
gaggacagauuguuagaua

SEQ ID NO: 761442 - RNA, 19 nt, Homo sapiens
gcaaugaaccuaacaguuu

SEQ ID NO: 761443 - RNA, 19 nt, Homo sapiens
gaaacaagcucugcauaug

SEQ ID NO: 761444 - RNA, 19 nt, Homo sapiens
gaaccuaacaguuuccuua

SEQ ID NO: 761445 - RNA, 19 nt, Homo sapiens
gcagauaccuugcaaagca

SEQ ID NO: 761446 - RNA, 19 nt, Homo sapiens
gaucaaaccuugccaccuu

SEQ ID NO: 761447 - RNA, 19 nt, Homo sapiens
caacgagguuccuauaauu

SEQ ID NO: 761448 - RNA, 19 nt, Homo sapiens
ggacuggacuugaucuuug

SEQ ID NO: 761449 - RNA, 19 nt, Homo sapiens
gaacagcaccuacucaaga

SEQ ID NO: 761450 - RNA, 19 nt, Homo sapiens
gaagaaagacggcuaagau

SEQ ID NO: 761451 - RNA, 19 nt, Homo sapiens
gugagaacaugcaguauuu

SEQ ID NO: 761452 - RNA, 19 nt, Homo sapiens
ccauaaaccuccauaaugu

SEQ ID NO: 761453 - RNA, 19 nt, Homo sapiens
guagaacacugcuaauaau

SEQ ID NO: 761454 - RNA, 19 nt, Homo sapiens
acaagcaaguggauaaaua

SEQ ID NO: 761455 - RNA, 19 nt, Homo sapiens
gcaggaaacuaccauuuag

SEQ ID NO: 761456 - RNA, 19 nt, Homo sapiens
cagcaaaccucuccucaug

SEQ ID NO: 761457 - RNA, 19 nt, Homo sapiens
caagacagacuuccuaauu

SEQ ID NO: 761458 - RNA, 19 nt, Homo sapiens
uaacagaaacuccuaauuc

SEQ ID NO: 761459 - RNA, 19 nt, Homo sapiens
ccacauaacuagacguuca

SEQ ID NO: 761460 - RNA, 19 nt, Homo sapiens
ggaagcgaaggauauauua

SEQ ID NO: 761461 - RNA, 19 nt, Homo sapiens
gguagaacacugcuaauaa

SEQ ID NO: 761462 - RNA, 19 nt, Homo sapiens
gcaaguggauaaauaccuu

SEQ ID NO: 761463 - RNA, 19 nt, Homo sapiens
ucuaaacccugauguauug

SEQ ID NO: 761464 - RNA, 19 nt, Homo sapiens
uaacauuucuugggaacua

SEQ ID NO: 761465 - RNA, 19 nt, Homo sapiens
ggauaaauaccuucuaaga

SEQ ID NO: 761466 - RNA, 19 nt, Homo sapiens
gaagugauugauucaguua

SEQ ID NO: 761467 - RNA, 19 nt, Homo sapiens
ucaagaagcucuguagaug

SEQ ID NO: 761468 - RNA, 19 nt, Homo sapiens
caacaacgagguuccuaua

SEQ ID NO: 761469 - RNA, 19 nt, Homo sapiens
gaacaugcaguauuugguu

SEQ ID NO: 761470 - RNA, 19 nt, Homo sapiens
gaaggugcuuagcuguaua

SEQ ID NO: 761471 - RNA, 19 nt, Homo sapiens
gcaaggaagcgaaggauau

SEQ ID NO: 761472 - RNA, 19 nt, Homo sapiens
guggauaaauaccuucuaa

SEQ ID NO: 761473 - RNA, 19 nt, Homo sapiens
gaaggagauuuaacucugu

SEQ ID NO: 761474 - RNA, 19 nt, Homo sapiens
gaauagaaguggugaugag

SEQ ID NO: 761475 - RNA, 19 nt, Homo sapiens
ggaagcagauaccuugcaa

SEQ ID NO: 761476 - RNA, 19 nt, Homo sapiens
gcaaaccucuccucauguc

SEQ ID NO: 761477 - RNA, 19 nt, Homo sapiens
gaaaacacccaauaccuua

SEQ ID NO: 761478 - RNA, 19 nt, Homo sapiens
gagaaacuaucuauuugca

SEQ ID NO: 761479 - RNA, 19 nt, Homo sapiens
ucaaauguaugccuguuau

SEQ ID NO: 761480 - RNA, 19 nt, Homo sapiens
cagaaacuccuaauucaaa

SEQ ID NO: 761481 - RNA, 19 nt, Homo sapiens
gagaagugauugauucagu

SEQ ID NO: 761482 - RNA, 19 nt, Homo sapiens
aagacagacuuccuaauuu

SEQ ID NO: 761483 - RNA, 19 nt, Homo sapiens
gcgaggagauucuguaaac

SEQ ID NO: 761484 - RNA, 19 nt, Homo sapiens
caaauggcuuaagcaauaa

SEQ ID NO: 761485 - RNA, 19 nt, Homo sapiens
cccaauaccuuauaacugu

SEQ ID NO: 761486 - RNA, 19 nt, Homo sapiens
uuugggaccucauggauua

SEQ ID NO: 761487 - RNA, 19 nt, Homo sapiens
caaccaggauauuugcaaa

SEQ ID NO: 761488 - RNA, 19 nt, Homo sapiens
caugauggcuguagcuguu

SEQ ID NO: 761489 - RNA, 19 nt, Homo sapiens
uaaagaugguggaugauca

SEQ ID NO: 761490 - RNA, 19 nt, Homo sapiens
ucaauggucuaacucuaaa

SEQ ID NO: 761491 - RNA, 19 nt, Homo sapiens
ccuaacaguuuccuuaaga

SEQ ID NO: 761492 - RNA, 19 nt, Homo sapiens
uagaugugcuauacacuuu

SEQ ID NO: 761493 - RNA, 19 nt, Homo sapiens
ggacagauuguuagauaug

SEQ ID NO: 761494 - RNA, 19 nt, Homo sapiens
gcucaggacuggacuugau

SEQ ID NO: 761495 - RNA, 19 nt, Homo sapiens
uaagugagaacaugcagua

SEQ ID NO: 761496 - RNA, 19 nt, Homo sapiens
aggagauucuguaaacuua

SEQ ID NO: 761497 - RNA, 19 nt, Homo sapiens
gagcaggaaacuaccauuu

SEQ ID NO: 761498 - RNA, 19 nt, Homo sapiens
gagaaacaagcucugcaua

SEQ ID NO: 761499 - RNA, 19 nt, Homo sapiens
gcaagaaggucugguuagg

SEQ ID NO: 761500 - RNA, 19 nt, Homo sapiens
caaugaaccuaacaguuuc

SEQ ID NO: 761501 - RNA, 19 nt, Homo sapiens
cagcagauuugcaguggaa

SEQ ID NO: 761502 - RNA, 19 nt, Homo sapiens
guucagaaauggguaaugu

SEQ ID NO: 761503 - RNA, 19 nt, Homo sapiens
ccucaugucuuauuguuca

SEQ ID NO: 761504 - RNA, 19 nt, Homo sapiens
ucucugcucugccaucuuu

SEQ ID NO: 761505 - RNA, 19 nt, Homo sapiens
cgaaggauauauuaugagu

SEQ ID NO: 761506 - RNA, 19 nt, Homo sapiens
uaugaaugcuccuaauaug

SEQ ID NO: 761507 - RNA, 19 nt, Homo sapiens
guggagaagugauugauuc

SEQ ID NO: 761508 - RNA, 19 nt, Homo sapiens
uaagaaggcugauauuuuc

SEQ ID NO: 761509 - RNA, 19 nt, Homo sapiens
acacuuagguuaauuccau

SEQ ID NO: 761510 - RNA, 19 nt, Homo sapiens
caaggaagcgaaggauaua

SEQ ID NO: 761511 - RNA, 19 nt, Homo sapiens
ccaaaucuguccaacucaa

SEQ ID NO: 761512 - RNA, 19 nt, Homo sapiens
uccauaaugucaccaagua

SEQ ID NO: 761513 - RNA, 19 nt, Homo sapiens
gccauaaaccuccauaaug

SEQ ID NO: 761514 - RNA, 19 nt, Homo sapiens
gugcaagguucaaagagaa

SEQ ID NO: 761515 - RNA, 19 nt, Homo sapiens
uuacauggcaucacuacua

SEQ ID NO: 761516 - RNA, 19 nt, Homo sapiens
gagagaaguuacuggcaau

SEQ ID NO: 761517 - RNA, 19 nt, Homo sapiens
acaacgagguuccuauaau

SEQ ID NO: 761518 - RNA, 19 nt, Homo sapiens
cuaccuuucuuccuuguuu

SEQ ID NO: 761519 - RNA, 19 nt, Homo sapiens
uggcaucacuacuauuuga

SEQ ID NO: 761520 - RNA, 19 nt, Homo sapiens
ccugaaggcugguggagaa

SEQ ID NO: 761521 - RNA, 19 nt, Homo sapiens
uggccuaaaugcguuauua

SEQ ID NO: 761522 - RNA, 19 nt, Homo sapiens
gaugaggcaaguauucuuu

SEQ ID NO: 761523 - RNA, 19 nt, Homo sapiens
gaaggcugguggagaagug

SEQ ID NO: 761524 - RNA, 19 nt, Homo sapiens
gauggacacuuagguuaau

SEQ ID NO: 761525 - RNA, 19 nt, Homo sapiens
aacagaaacuccuaauuca

SEQ ID NO: 761526 - RNA, 19 nt, Homo sapiens
gcacaaacacugacaaucc

SEQ ID NO: 761527 - RNA, 19 nt, Homo sapiens
gacuugaucuuuggccuaa

SEQ ID NO: 761528 - RNA, 19 nt, Homo sapiens
cuaagaaaguccaccuuca

SEQ ID NO: 761529 - RNA, 19 nt, Homo sapiens
gugagaggacagauuguua

SEQ ID NO: 761530 - RNA, 19 nt, Homo sapiens
ccagcuuucucauauaguu

SEQ ID NO: 761531 - RNA, 19 nt, Homo sapiens
cuaagaugcugaagagcuu

SEQ ID NO: 761532 - RNA, 19 nt, Homo sapiens
caagucaaccaggauauuu

SEQ ID NO: 761533 - RNA, 19 nt, Homo sapiens
gaggagauucuguaaacuu

SEQ ID NO: 761534 - RNA, 19 nt, Homo sapiens
gacagauuguuagauauga

SEQ ID NO: 761535 - RNA, 19 nt, Homo sapiens
guauaugaaugcuccuaau

SEQ ID NO: 761536 - RNA, 19 nt, Homo sapiens
aagaagcucuguagaugug

SEQ ID NO: 761537 - RNA, 19 nt, Homo sapiens
cuaacaagcaaguggauaa

SEQ ID NO: 761538 - RNA, 19 nt, Homo sapiens
ggaagaagauguggagaug

SEQ ID NO: 761539 - RNA, 19 nt, Homo sapiens
uaacaaggauugagcgaau

SEQ ID NO: 761540 - RNA, 19 nt, Homo sapiens
ggagauccgugauguaaca

SEQ ID NO: 761541 - RNA, 19 nt, Homo sapiens
caaccaaagucccggagau

SEQ ID NO: 761542 - RNA, 19 nt, Homo sapiens
ggacaccuccugaguugga

SEQ ID NO: 761543 - RNA, 19 nt, Homo sapiens
cgcaguacaugaaggagua

SEQ ID NO: 761544 - RNA, 19 nt, Homo sapiens
acacugugacucuguauaa

SEQ ID NO: 761545 - RNA, 19 nt, Homo sapiens
gaccugggcaccaagauga

SEQ ID NO: 761546 - RNA, 19 nt, Homo sapiens
gaaacgcaaggguacagaa

SEQ ID NO: 761547 - RNA, 19 nt, Homo sapiens
gaagaagauguggagauga

SEQ ID NO: 761548 - RNA, 19 nt, Homo sapiens
cagaagugcagguggauga

SEQ ID NO: 761549 - RNA, 19 nt, Homo sapiens
aagaagauguggagaugag

SEQ ID NO: 761550 - RNA, 19 nt, Homo sapiens
ggagaucaagucagaaguc

SEQ ID NO: 761551 - RNA, 19 nt, Homo sapiens
agaaagacacgaagcagau

SEQ ID NO: 761552 - RNA, 19 nt, Homo sapiens
gagcuucuccuuccucaac

SEQ ID NO: 761553 - RNA, 19 nt, Homo sapiens
caacagggacgggcuccaa

SEQ ID NO: 761554 - RNA, 19 nt, Homo sapiens
ggucgggcaguccuuauug

SEQ ID NO: 761555 - RNA, 19 nt, Homo sapiens
gcuccacgcaguacaugaa

SEQ ID NO: 761556 - RNA, 19 nt, Homo sapiens
gaaagacacgaagcagauc

SEQ ID NO: 761557 - RNA, 19 nt, Homo sapiens
ggagacggagaucaucgaa

SEQ ID NO: 761558 - RNA, 19 nt, Homo sapiens
gcacgagaucgacgucauc

SEQ ID NO: 761559 - RNA, 19 nt, Homo sapiens
caucggcguucgcaucaag

SEQ ID NO: 761560 - RNA, 19 nt, Homo sapiens
auggacaccuccugaguug

SEQ ID NO: 761561 - RNA, 19 nt, Homo sapiens
ccucuucaacgaacucaaa

SEQ ID NO: 761562 - RNA, 19 nt, Homo sapiens
acgcaaggguacagaagug

SEQ ID NO: 761563 - RNA, 19 nt, Homo sapiens
uugagucccugaccaagga

SEQ ID NO: 761564 - RNA, 19 nt, Homo sapiens
gcuccaaggugggcaaacu

SEQ ID NO: 761565 - RNA, 19 nt, Homo sapiens
cugcuggaccggcugcuua

SEQ ID NO: 761566 - RNA, 19 nt, Homo sapiens
cacugugacucuguauaaa

SEQ ID NO: 761567 - RNA, 19 nt, Homo sapiens
cauggacaccuccugaguu

SEQ ID NO: 761568 - RNA, 19 nt, Homo sapiens
caucauggcaaccguuaca

SEQ ID NO: 761569 - RNA, 19 nt, Homo sapiens
gcaaacugacccucaagac

SEQ ID NO: 761570 - RNA, 19 nt, Homo sapiens
ucaaggaggagacggagau

SEQ ID NO: 761571 - RNA, 19 nt, Homo sapiens
gacacugugacucuguaua

SEQ ID NO: 761572 - RNA, 19 nt, Homo sapiens
ccacgcaguacaugaagga

SEQ ID NO: 761573 - RNA, 19 nt, Homo sapiens
ucaagcgggucuacucacu

SEQ ID NO: 761574 - RNA, 19 nt, Homo sapiens
gcguggugcuggagaugau

SEQ ID NO: 761575 - RNA, 19 nt, Homo sapiens
cgagaucgacgucaucaac

SEQ ID NO: 761576 - RNA, 19 nt, Homo sapiens
ggaaacgcaaggguacaga

SEQ ID NO: 761577 - RNA, 19 nt, Homo sapiens
caggggagaucaagucaga

SEQ ID NO: 761578 - RNA, 19 nt, Homo sapiens
gcucuucucaggugacaca

SEQ ID NO: 761579 - RNA, 19 nt, Homo sapiens
ccucaagaccacagagaug

SEQ ID NO: 761580 - RNA, 19 nt, Homo sapiens
gcgagaaagacacgaagca

SEQ ID NO: 761581 - RNA, 19 nt, Homo sapiens
gggcaaggcggagaucauc

SEQ ID NO: 761582 - RNA, 19 nt, Homo sapiens
caucaagcgggucuacuca

SEQ ID NO: 761583 - RNA, 19 nt, Homo sapiens
cauggcgccuguccugauc

SEQ ID NO: 761584 - RNA, 19 nt, Homo sapiens
caucgacgagguccacaug

SEQ ID NO: 761585 - RNA, 19 nt, Homo sapiens
cugacacugugacucugua

SEQ ID NO: 761586 - RNA, 19 nt, Homo sapiens
guucugacacugugacucu

SEQ ID NO: 761587 - RNA, 19 nt, Homo sapiens
gauccgggaagggaagauu

SEQ ID NO: 761588 - RNA, 19 nt, Homo sapiens
gggacgugaucaccaucga

SEQ ID NO: 761589 - RNA, 19 nt, Homo sapiens
ggcaaacugacccucaaga

SEQ ID NO: 761590 - RNA, 19 nt, Homo sapiens
ucaaaggcgagaccaugga

SEQ ID NO: 761591 - RNA, 19 nt, Homo sapiens
gcgggucuacucacucuuc

SEQ ID NO: 761592 - RNA, 19 nt, Homo sapiens
cguuacagccacaaccaaa

SEQ ID NO: 761593 - RNA, 19 nt, Homo sapiens
gaaguccgugagcagauca

SEQ ID NO: 761594 - RNA, 19 nt, Homo sapiens
gaucgacgucaucaacucu

SEQ ID NO: 761595 - RNA, 19 nt, Homo sapiens
cgugauguaacaaggauug

SEQ ID NO: 761596 - RNA, 19 nt, Homo sapiens
ggaggagacggagaucauc

SEQ ID NO: 761597 - RNA, 19 nt, Homo sapiens
gaacugcagugcuguaaua

SEQ ID NO: 761598 - RNA, 19 nt, Homo sapiens
ugacuuaacugcaugauuu

SEQ ID NO: 761599 - RNA, 19 nt, Homo sapiens
gaucauggcugccgaggau

SEQ ID NO: 761600 - RNA, 19 nt, Homo sapiens
acacaguagucuauaguua

SEQ ID NO: 761601 - RNA, 19 nt, Homo sapiens
gaugugcuuuggucaguua

SEQ ID NO: 761602 - RNA, 19 nt, Homo sapiens
uagaaugcaugauguguuu

SEQ ID NO: 761603 - RNA, 19 nt, Homo sapiens
uaaguagacuauacaguug

SEQ ID NO: 761604 - RNA, 19 nt, Homo sapiens
ggagggacauacagaauag

SEQ ID NO: 761605 - RNA, 19 nt, Homo sapiens
ggcaaugguuauuugguua

SEQ ID NO: 761606 - RNA, 19 nt, Homo sapiens
aagcaaaucugcaguguuc

SEQ ID NO: 761607 - RNA, 19 nt, Homo sapiens
cuagugagauuucaaacuu

SEQ ID NO: 761608 - RNA, 19 nt, Homo sapiens
gaaaugagggagggacaua

SEQ ID NO: 761609 - RNA, 19 nt, Homo sapiens
acacuaagcuuaaguagac

SEQ ID NO: 761610 - RNA, 19 nt, Homo sapiens
gaaccacgaggaaacagua

SEQ ID NO: 761611 - RNA, 19 nt, Homo sapiens
gaccaaaggccgcaaauuc

SEQ ID NO: 761612 - RNA, 19 nt, Homo sapiens
gggcaaugguuauuugguu

SEQ ID NO: 761613 - RNA, 19 nt, Homo sapiens
gguguuugcucuccuaaga

SEQ ID NO: 761614 - RNA, 19 nt, Homo sapiens
auuaagcgcuguccaguaa

SEQ ID NO: 761615 - RNA, 19 nt, Homo sapiens
gggaggagcccacugugua

SEQ ID NO: 761616 - RNA, 19 nt, Homo sapiens
aaggaagacuuggguauuu

SEQ ID NO: 761617 - RNA, 19 nt, Homo sapiens
gugcuuuggucaguuaaua

SEQ ID NO: 761618 - RNA, 19 nt, Homo sapiens
ucaauugguuacucucauu

SEQ ID NO: 761619 - RNA, 19 nt, Homo sapiens
gggagggacauacagaaua

SEQ ID NO: 761620 - RNA, 19 nt, Homo sapiens
caaacacaguagucuauag

SEQ ID NO: 761621 - RNA, 19 nt, Homo sapiens
guuaguacaggaugaauuu

SEQ ID NO: 761622 - RNA, 19 nt, Homo sapiens
ucaauugacuuaacugcau

SEQ ID NO: 761623 - RNA, 19 nt, Homo sapiens
aggaagcacugaaggauga

SEQ ID NO: 761624 - RNA, 19 nt, Homo sapiens
ccaaaggccgcaaauucua

SEQ ID NO: 761625 - RNA, 19 nt, Homo sapiens
gggagucucaguucacuuu

SEQ ID NO: 761626 - RNA, 19 nt, Homo sapiens
caggaugaauuuaaaugug

SEQ ID NO: 761627 - RNA, 19 nt, Homo sapiens
uaaagcaaaucugcagugu

SEQ ID NO: 761628 - RNA, 19 nt, Homo sapiens
gucaugauguucuguaaag

SEQ ID NO: 761629 - RNA, 19 nt, Homo sapiens
gauuaagcgcuguccagua

SEQ ID NO: 761630 - RNA, 19 nt, Homo sapiens
gugucuaggucuuugauau

SEQ ID NO: 761631 - RNA, 19 nt, Homo sapiens
ucacauagacacucagaca

SEQ ID NO: 761632 - RNA, 19 nt, Homo sapiens
gcaucuuccugcucuacaa

SEQ ID NO: 761633 - RNA, 19 nt, Homo sapiens
ugaaggaugaguacgauga

SEQ ID NO: 761634 - RNA, 19 nt, Homo sapiens
ggcaagguguucgauguga

SEQ ID NO: 761635 - RNA, 19 nt, Homo sapiens
ucacaaacacaguagucua

SEQ ID NO: 761636 - RNA, 19 nt, Homo sapiens
ugucacaaauccagaaagu

SEQ ID NO: 761637 - RNA, 19 nt, Homo sapiens
gcauucaguggaaguauau

SEQ ID NO: 761638 - RNA, 19 nt, Homo sapiens
gguguucgaugugaccaaa

SEQ ID NO: 761639 - RNA, 19 nt, Homo sapiens
ugguuacucucauuugaaa

SEQ ID NO: 761640 - RNA, 19 nt, Homo sapiens
ugaguacgaugaccuuucu

SEQ ID NO: 761641 - RNA, 19 nt, Homo sapiens
gugguuaaauagucauugu

SEQ ID NO: 761642 - RNA, 19 nt, Homo sapiens
ucaagugucuaggucuuug

SEQ ID NO: 761643 - RNA, 19 nt, Homo sapiens
uacagucgcuagucaagug

SEQ ID NO: 761644 - RNA, 19 nt, Homo sapiens
gcaaugguuauuugguuau

SEQ ID NO: 761645 - RNA, 19 nt, Homo sapiens
ucagacacccucacaaaca

SEQ ID NO: 761646 - RNA, 19 nt, Homo sapiens
aagcuuaaguagacuauac

SEQ ID NO: 761647 - RNA, 19 nt, Homo sapiens
gucuaggucuuugauauug

SEQ ID NO: 761648 - RNA, 19 nt, Homo sapiens
uuucuggacugcacuguug

SEQ ID NO: 761649 - RNA, 19 nt, Homo sapiens
agacuuugguauggauuaa

SEQ ID NO: 761650 - RNA, 19 nt, Homo sapiens
aguccacucugucuuuaaa

SEQ ID NO: 761651 - RNA, 19 nt, Homo sapiens
uaagcgcuguccaguaaca

SEQ ID NO: 761652 - RNA, 19 nt, Homo sapiens
cacaaacacaguagucuau

SEQ ID NO: 761653 - RNA, 19 nt, Homo sapiens
caguggaaguauaucuauu

SEQ ID NO: 761654 - RNA, 19 nt, Homo sapiens
gaaugcaugauguguuugu

SEQ ID NO: 761655 - RNA, 19 nt, Homo sapiens
acaguacagucgcuaguca

SEQ ID NO: 761656 - RNA, 19 nt, Homo sapiens
uuaucuaccucuaaagcaa

SEQ ID NO: 761657 - RNA, 19 nt, Homo sapiens
uuaacugcaugauuucugu

SEQ ID NO: 761658 - RNA, 19 nt, Homo sapiens
gagucucaguucacuuuca

SEQ ID NO: 761659 - RNA, 19 nt, Homo sapiens
gcuuuggucaguuaauaaa

SEQ ID NO: 761660 - RNA, 19 nt, Homo sapiens
gaucaacuuuuagucauga

SEQ ID NO: 761661 - RNA, 19 nt, Homo sapiens
ggagcccacuguguacuca

SEQ ID NO: 761662 - RNA, 19 nt, Homo sapiens
uugguuaacacuaagcuua

SEQ ID NO: 761663 - RNA, 19 nt, Homo sapiens
ggucuuugauauugcucuu

SEQ ID NO: 761664 - RNA, 19 nt, Homo sapiens
gcauacucauggccaucaa

SEQ ID NO: 761665 - RNA, 19 nt, Homo sapiens
gagggagggacauacagaa

SEQ ID NO: 761666 - RNA, 19 nt, Homo sapiens
aggagaaaguggcgaguuc

SEQ ID NO: 761667 - RNA, 19 nt, Homo sapiens
gauguucuguaaagacaac

SEQ ID NO: 761668 - RNA, 19 nt, Homo sapiens
aaucuuaaaugugcaccaa

SEQ ID NO: 761669 - RNA, 19 nt, Homo sapiens
auuaaagcauucaguggaa

SEQ ID NO: 761670 - RNA, 19 nt, Homo sapiens
ugggcaaacugcugaagga

SEQ ID NO: 761671 - RNA, 19 nt, Homo sapiens
ggauaaggaagcacugaag

SEQ ID NO: 761672 - RNA, 19 nt, Homo sapiens
caauugguuacucucauuu

SEQ ID NO: 761673 - RNA, 19 nt, Homo sapiens
acucagacacccucacaaa

SEQ ID NO: 761674 - RNA, 19 nt, Homo sapiens
uagucaugauguucuguaa

SEQ ID NO: 761675 - RNA, 19 nt, Homo sapiens
agcauucaguggaaguaua

SEQ ID NO: 761676 - RNA, 19 nt, Homo sapiens
cagaugaggaagaaccaaa

SEQ ID NO: 761677 - RNA, 19 nt, Homo sapiens
gauauugcucuuuugguua

SEQ ID NO: 761678 - RNA, 19 nt, Homo sapiens
acagguguuugcucuccua

SEQ ID NO: 761679 - RNA, 19 nt, Homo sapiens
gaagauuguaggacugucu

SEQ ID NO: 761680 - RNA, 19 nt, Homo sapiens
uaaggaagcacugaaggau

SEQ ID NO: 761681 - RNA, 19 nt, Homo sapiens
aaacacaguagucuauagu

SEQ ID NO: 761682 - RNA, 19 nt, Homo sapiens
acaaacacaguagucuaua

SEQ ID NO: 761683 - RNA, 19 nt, Homo sapiens
gcccucacauagacacuca

SEQ ID NO: 761684 - RNA, 19 nt, Homo sapiens
uagugagauuucaaacuug

SEQ ID NO: 761685 - RNA, 19 nt, Homo sapiens
gcaaaucugcaguguucca

SEQ ID NO: 761686 - RNA, 19 nt, Homo sapiens
cugcaugauuucuguuuua

SEQ ID NO: 761687 - RNA, 19 nt, Homo sapiens
gaggagaaaguggcgaguu

SEQ ID NO: 761688 - RNA, 19 nt, Homo sapiens
ugagagacaaggaagacuu

SEQ ID NO: 761689 - RNA, 19 nt, Homo sapiens
ggaugaguacgaugaccuu

SEQ ID NO: 761690 - RNA, 19 nt, Homo sapiens
ccaggggccuugccacauu

SEQ ID NO: 761691 - RNA, 19 nt, Homo sapiens
ugauauugcucuuuugguu

SEQ ID NO: 761692 - RNA, 19 nt, Homo sapiens
ugucuaggucuuugauauu

SEQ ID NO: 761693 - RNA, 19 nt, Homo sapiens
caaaaguaguagucaagug

SEQ ID NO: 761694 - RNA, 19 nt, Homo sapiens
uuacucaauugguuacucu

SEQ ID NO: 761695 - RNA, 19 nt, Homo sapiens
ggauuaaaauaggaucuga

SEQ ID NO: 761696 - RNA, 19 nt, Homo sapiens
aaucugcaguguuccaaag

SEQ ID NO: 761697 - RNA, 19 nt, Homo sapiens
gaggagaccuugauugaug

SEQ ID NO: 761698 - RNA, 19 nt, Homo sapiens
cagagucgaugcucaauaa

SEQ ID NO: 761699 - RNA, 19 nt, Homo sapiens
gcaacacucuggcaaaguu

SEQ ID NO: 761700 - RNA, 19 nt, Homo sapiens
guuaagaaguuccugaugu

SEQ ID NO: 761701 - RNA, 19 nt, Homo sapiens
caacaaggacuccaagaug

SEQ ID NO: 761702 - RNA, 19 nt, Homo sapiens
gaagaggagaccuugauug

SEQ ID NO: 761703 - RNA, 19 nt, Homo sapiens
agccggagcuccuugguua

SEQ ID NO: 761704 - RNA, 19 nt, Homo sapiens
uaagaaguauggaccuguu

SEQ ID NO: 761705 - RNA, 19 nt, Homo sapiens
ggauugggcuaagaaguau

SEQ ID NO: 761706 - RNA, 19 nt, Homo sapiens
gcacagagucgaugcucaa

SEQ ID NO: 761707 - RNA, 19 nt, Homo sapiens
cgagacacccuaacucuug

SEQ ID NO: 761708 - RNA, 19 nt, Homo sapiens
uugguuagcuuaauggaaa

SEQ ID NO: 761709 - RNA, 19 nt, Homo sapiens
ucuaagagguaccuggauu

SEQ ID NO: 761710 - RNA, 19 nt, Homo sapiens
ggaagaggagaccuugauu

SEQ ID NO: 761711 - RNA, 19 nt, Homo sapiens
cagugaaacuuauguugga

SEQ ID NO: 761712 - RNA, 19 nt, Homo sapiens
ggucaacgucuuccacaaa

SEQ ID NO: 761713 - RNA, 19 nt, Homo sapiens
ugaagguggucauggcaaa

SEQ ID NO: 761714 - RNA, 19 nt, Homo sapiens
gcggauggacacauacuuu

SEQ ID NO: 761715 - RNA, 19 nt, Homo sapiens
ggagguuccugccgacauc

SEQ ID NO: 761716 - RNA, 19 nt, Homo sapiens
agucgaugcucaauaaaug

SEQ ID NO: 761717 - RNA, 19 nt, Homo sapiens
cugagucgguuaagaaguu

SEQ ID NO: 761718 - RNA, 19 nt, Homo sapiens
ggauggacacauacuuuga

SEQ ID NO: 761719 - RNA, 19 nt, Homo sapiens
aagaggagaccuugauuga

SEQ ID NO: 761720 - RNA, 19 nt, Homo sapiens
agagguaccuggauuucga

SEQ ID NO: 761721 - RNA, 19 nt, Homo sapiens
guucagcaccuaugucaug

SEQ ID NO: 761722 - RNA, 19 nt, Homo sapiens
aacaaggacuccaagaugu

SEQ ID NO: 761723 - RNA, 19 nt, Homo sapiens
uggauugggcuaagaagua

SEQ ID NO: 761724 - RNA, 19 nt, Homo sapiens
caauaaauguguguugacu

SEQ ID NO: 761725 - RNA, 19 nt, Homo sapiens
ccguugacgugaccaauug

SEQ ID NO: 761726 - RNA, 19 nt, Homo sapiens
uaucgugaguguccguuga

SEQ ID NO: 761727 - RNA, 19 nt, Homo sapiens
aagagucgcugaggcugua

SEQ ID NO: 761728 - RNA, 19 nt, Homo sapiens
caaccaaguacaacaagga

SEQ ID NO: 761729 - RNA, 19 nt, Homo sapiens
uuaagaaguuccugauguc

SEQ ID NO: 761730 - RNA, 19 nt, Homo sapiens
ccacugucccuaccacuga

SEQ ID NO: 761731 - RNA, 19 nt, Homo sapiens
acaaggacuccaagaugua

SEQ ID NO: 761732 - RNA, 19 nt, Homo sapiens
uggaaacauucaacgagaa

SEQ ID NO: 761733 - RNA, 19 nt, Homo sapiens
caacuucgucaccuucuuc

SEQ ID NO: 761734 - RNA, 19 nt, Homo sapiens
gcucaauaaauguguguug

SEQ ID NO: 761735 - RNA, 19 nt, Homo sapiens
gcgugugauuugucucuga

SEQ ID NO: 761736 - RNA, 19 nt, Homo sapiens
ucaccugugcuaccucuaa

SEQ ID NO: 761737 - RNA, 19 nt, Homo sapiens
gccgugugcuccaagaugu

SEQ ID NO: 761738 - RNA, 19 nt, Homo sapiens
ugucccagguccucaaaga

SEQ ID NO: 761739 - RNA, 19 nt, Homo sapiens
ggaaacauucaacgagaag

SEQ ID NO: 761740 - RNA, 19 nt, Homo sapiens
aaauguguguugacugcaa

SEQ ID NO: 761741 - RNA, 19 nt, Homo sapiens
ccacacugaccacacugua

SEQ ID NO: 761742 - RNA, 19 nt, Homo sapiens
cuaagagguaccuggauuu

SEQ ID NO: 761743 - RNA, 19 nt, Homo sapiens
ucauagaccuggccuucag

SEQ ID NO: 761744 - RNA, 19 nt, Homo sapiens
gaaguauggaccuguugug

SEQ ID NO: 761745 - RNA, 19 nt, Homo sapiens
gagucgaugcucaauaaau

SEQ ID NO: 761746 - RNA, 19 nt, Homo sapiens
uugaggacccgcugacuuu

SEQ ID NO: 761747 - RNA, 19 nt, Homo sapiens
cgacauccucacacagauu

SEQ ID NO: 761748 - RNA, 19 nt, Homo sapiens
ugcaggacaugcugaccua

SEQ ID NO: 761749 - RNA, 19 nt, Homo sapiens
cugagcagcugguggagau

SEQ ID NO: 761750 - RNA, 19 nt, Homo sapiens
ggacaccuccccugcuuuu

SEQ ID NO: 761751 - RNA, 19 nt, Homo sapiens
gccgacauccucacacaga

SEQ ID NO: 761752 - RNA, 19 nt, Homo sapiens
guccugagucgguuaagaa

SEQ ID NO: 761753 - RNA, 19 nt, Homo sapiens
ccacaaaaccucagucauc

SEQ ID NO: 761754 - RNA, 19 nt, Homo sapiens
ccaagccacgguucaccua

SEQ ID NO: 761755 - RNA, 19 nt, Homo sapiens
cuucgucaccuucuucauu

SEQ ID NO: 761756 - RNA, 19 nt, Homo sapiens
agaaguuccugaugucaac

SEQ ID NO: 761757 - RNA, 19 nt, Homo sapiens
gguagggucugcgugugau

SEQ ID NO: 761758 - RNA, 19 nt, Homo sapiens
ggucaccuccuccaagaag

SEQ ID NO: 761759 - RNA, 19 nt, Homo sapiens
gacgagacacccuaacucu

SEQ ID NO: 761760 - RNA, 19 nt, Homo sapiens
gaggucauugguucuaaga

SEQ ID NO: 761761 - RNA, 19 nt, Homo sapiens
ccgcaacacucuggcaaag

SEQ ID NO: 761762 - RNA, 19 nt, Homo sapiens
gggucaacgucuuccacaa

SEQ ID NO: 761763 - RNA, 19 nt, Homo sapiens
uaagagguaccuggauuuc

SEQ ID NO: 761764 - RNA, 19 nt, Homo sapiens
ucccaggcagugaaacuua

SEQ ID NO: 761765 - RNA, 19 nt, Homo sapiens
ggagcaggccacacucaag

SEQ ID NO: 761766 - RNA, 19 nt, Homo sapiens
gcacccaagccacgguuca

SEQ ID NO: 761767 - RNA, 19 nt, Homo sapiens
ggcagugaaacuuauguug

SEQ ID NO: 761768 - RNA, 19 nt, Homo sapiens
gacuguguuuggugagaga

SEQ ID NO: 761769 - RNA, 19 nt, Homo sapiens
gaggacccgcugacuuuca

SEQ ID NO: 761770 - RNA, 19 nt, Homo sapiens
acgagggucugcuggacaa

SEQ ID NO: 761771 - RNA, 19 nt, Homo sapiens
gacauccucacacagauuc

SEQ ID NO: 761772 - RNA, 19 nt, Homo sapiens
cccaggcagugaaacuuau

SEQ ID NO: 761773 - RNA, 19 nt, Homo sapiens
gcugguggagauucuagaa

SEQ ID NO: 761774 - RNA, 19 nt, Homo sapiens
gcuccuugguuagcuuaau

SEQ ID NO: 761775 - RNA, 19 nt, Homo sapiens
acagagucgaugcucaaua

SEQ ID NO: 761776 - RNA, 19 nt, Homo sapiens
ggguagggucugcguguga

SEQ ID NO: 761777 - RNA, 19 nt, Homo sapiens
uugcucagauggaggugaa

SEQ ID NO: 761778 - RNA, 19 nt, Homo sapiens
acaacaaggacuccaagau

SEQ ID NO: 761779 - RNA, 19 nt, Homo sapiens
uucgucaccuucuucauug

SEQ ID NO: 761780 - RNA, 19 nt, Homo sapiens
caagcagcggagagucaua

SEQ ID NO: 761781 - RNA, 19 nt, Homo sapiens
cagacuguguuuggugaga

SEQ ID NO: 761782 - RNA, 19 nt, Homo sapiens
acacugaccacacuguauc

SEQ ID NO: 761783 - RNA, 19 nt, Homo sapiens
acaccacacugaccacacu

SEQ ID NO: 761784 - RNA, 19 nt, Homo sapiens
gauggacacauacuuugag

SEQ ID NO: 761785 - RNA, 19 nt, Homo sapiens
gagcagcugguggagauuc

SEQ ID NO: 761786 - RNA, 19 nt, Homo sapiens
cggauggacacauacuuug

SEQ ID NO: 761787 - RNA, 19 nt, Homo sapiens
gucaacgucuuccacaaaa

SEQ ID NO: 761788 - RNA, 19 nt, Homo sapiens
gaccucugccaaccacuug

SEQ ID NO: 761789 - RNA, 19 nt, Homo sapiens
aauguguguugacugcaaa

SEQ ID NO: 761790 - RNA, 19 nt, Homo sapiens
gcuccagacuguguuuggu

SEQ ID NO: 761791 - RNA, 19 nt, Homo sapiens
ucauugguucuaagaggua

SEQ ID NO: 761792 - RNA, 19 nt, Homo sapiens
uaagaaguuccugauguca

SEQ ID NO: 761793 - RNA, 19 nt, Homo sapiens
gaucuuggcuuuccuauaa

SEQ ID NO: 761794 - RNA, 19 nt, Homo sapiens
gcaacagacuucucaauaa

SEQ ID NO: 761795 - RNA, 19 nt, Homo sapiens
gaaagugcauuaaacugaa

SEQ ID NO: 761796 - RNA, 19 nt, Homo sapiens
gaaauggccucuccuccuu

SEQ ID NO: 761797 - RNA, 19 nt, Homo sapiens
gcauuaaacugaaucacaa

SEQ ID NO: 761798 - RNA, 19 nt, Homo sapiens
caacagacuucucaauaau

SEQ ID NO: 761799 - RNA, 19 nt, Homo sapiens
ggacaucgacccagagaaa

SEQ ID NO: 761800 - RNA, 19 nt, Homo sapiens
gaaccaggcucugugauca

SEQ ID NO: 761801 - RNA, 19 nt, Homo sapiens
gacaggagccuacaucaaa

SEQ ID NO: 761802 - RNA, 19 nt, Homo sapiens
gaaacccugucucuccuaa

SEQ ID NO: 761803 - RNA, 19 nt, Homo sapiens
gggaauuccuggacacaaa

SEQ ID NO: 761804 - RNA, 19 nt, Homo sapiens
ucacagggauggaugcaaa

SEQ ID NO: 761805 - RNA, 19 nt, Homo sapiens
gugaaacacuccagaccua

SEQ ID NO: 761806 - RNA, 19 nt, Homo sapiens
gaaauaaagcaacagacuu

SEQ ID NO: 761807 - RNA, 19 nt, Homo sapiens
gaugacccauggcgucuaa

SEQ ID NO: 761808 - RNA, 19 nt, Homo sapiens
acucaauucugcaguauaa

SEQ ID NO: 761809 - RNA, 19 nt, Homo sapiens
gaauguaacccuccagugu

SEQ ID NO: 761810 - RNA, 19 nt, Homo sapiens
ucaaugaaguagcugagaa

SEQ ID NO: 761811 - RNA, 19 nt, Homo sapiens
gaacucaggagggaaugua

SEQ ID NO: 761812 - RNA, 19 nt, Homo sapiens
gcaggacaguucuaugaca

SEQ ID NO: 761813 - RNA, 19 nt, Homo sapiens
uaagucagaaagugcauua

SEQ ID NO: 761814 - RNA, 19 nt, Homo sapiens
gaugcaaacuuuccuucug

SEQ ID NO: 761815 - RNA, 19 nt, Homo sapiens
gagaaagcaagaagaguga

SEQ ID NO: 761816 - RNA, 19 nt, Homo sapiens
gauuuguucuguauaagga

SEQ ID NO: 761817 - RNA, 19 nt, Homo sapiens
aaacuuuccuucugaccaa

SEQ ID NO: 761818 - RNA, 19 nt, Homo sapiens
agggauggaugcaaacuuu

SEQ ID NO: 761819 - RNA, 19 nt, Homo sapiens
gacuccaucucaaauuaaa

SEQ ID NO: 761820 - RNA, 19 nt, Homo sapiens
gaucacgaguucaggagau

SEQ ID NO: 761821 - RNA, 19 nt, Homo sapiens
ggcauuugauggcuucauu

SEQ ID NO: 761822 - RNA, 19 nt, Homo sapiens
acucacagguggcauuuga

SEQ ID NO: 761823 - RNA, 19 nt, Homo sapiens
gaaaacagcacccuggauu

SEQ ID NO: 761824 - RNA, 19 nt, Homo sapiens
agaaagugcauuaaacuga

SEQ ID NO: 761825 - RNA, 19 nt, Homo sapiens
gaacgugacccugcugugu

SEQ ID NO: 761826 - RNA, 19 nt, Homo sapiens
guacaggugcuaugcuuau

SEQ ID NO: 761827 - RNA, 19 nt, Homo sapiens
aaugaaugaucuuggcuuu

SEQ ID NO: 761828 - RNA, 19 nt, Homo sapiens
acagacuucucaauaauca

SEQ ID NO: 761829 - RNA, 19 nt, Homo sapiens
ggcaaacacuggacaucga

SEQ ID NO: 761830 - RNA, 19 nt, Homo sapiens
gcagggcgguaucgcuguu

SEQ ID NO: 761831 - RNA, 19 nt, Homo sapiens
gcgggcagaucacgaguuc

SEQ ID NO: 761832 - RNA, 19 nt, Homo sapiens
cgaugaaacuggaaaacua

SEQ ID NO: 761833 - RNA, 19 nt, Homo sapiens
uaaagcaacagacuucuca

SEQ ID NO: 761834 - RNA, 19 nt, Homo sapiens
gguccuagguguuucuaag

SEQ ID NO: 761835 - RNA, 19 nt, Homo sapiens
caggaguaccgucuauaua

SEQ ID NO: 761836 - RNA, 19 nt, Homo sapiens
gccaggagacccaggagua

SEQ ID NO: 761837 - RNA, 19 nt, Homo sapiens
gcaggagaaucgcuugaac

SEQ ID NO: 761838 - RNA, 19 nt, Homo sapiens
acgaaugaaugaauuagga

SEQ ID NO: 761839 - RNA, 19 nt, Homo sapiens
gaucaacguaccaaucuca

SEQ ID NO: 761840 - RNA, 19 nt, Homo sapiens
gaugcuggcuacaacagau

SEQ ID NO: 761841 - RNA, 19 nt, Homo sapiens
uuugauggcuucauucugu

SEQ ID NO: 761842 - RNA, 19 nt, Homo sapiens
aaauaaagcaacagacuuc

SEQ ID NO: 761843 - RNA, 19 nt, Homo sapiens
uaagaagccaucacucuca

SEQ ID NO: 761844 - RNA, 19 nt, Homo sapiens
caucaaacccacccucuca

SEQ ID NO: 761845 - RNA, 19 nt, Homo sapiens
caaugaaguagcugagaaa

SEQ ID NO: 761846 - RNA, 19 nt, Homo sapiens
cgguaucgcuguuacuaug

SEQ ID NO: 761847 - RNA, 19 nt, Homo sapiens
ccuguaaucccagcuauuu

SEQ ID NO: 761848 - RNA, 19 nt, Homo sapiens
gaacaugcagggcgguauc

SEQ ID NO: 761849 - RNA, 19 nt, Homo sapiens
ccaggaguaccgucuauau

SEQ ID NO: 761850 - RNA, 19 nt, Homo sapiens
gagaccaucuuggccaaca

SEQ ID NO: 761851 - RNA, 19 nt, Homo sapiens
gcucacgccuguaauucca

SEQ ID NO: 761852 - RNA, 19 nt, Homo sapiens
gucagaaagugcauuaaac

SEQ ID NO: 761853 - RNA, 19 nt, Homo sapiens
uaagaucaacguaccaauc

SEQ ID NO: 761854 - RNA, 19 nt, Homo sapiens
gaaugaggagaaagcaaga

SEQ ID NO: 761855 - RNA, 19 nt, Homo sapiens
augcaaacuuuccuucuga

SEQ ID NO: 761856 - RNA, 19 nt, Homo sapiens
agcaacagacuucucaaua

SEQ ID NO: 761857 - RNA, 19 nt, Homo sapiens
gucacucaauucugcagua

SEQ ID NO: 761858 - RNA, 19 nt, Homo sapiens
gcacacacagccugaggau

SEQ ID NO: 761859 - RNA, 19 nt, Homo sapiens
ucgcaggacaguucuauga

SEQ ID NO: 761860 - RNA, 19 nt, Homo sapiens
cuacaagccacgaaugaau

SEQ ID NO: 761861 - RNA, 19 nt, Homo sapiens
ucacucaauucugcaguau

SEQ ID NO: 761862 - RNA, 19 nt, Homo sapiens
aggagacucugggaacuuu

SEQ ID NO: 761863 - RNA, 19 nt, Homo sapiens
gacucgaacucucccuaug

SEQ ID NO: 761864 - RNA, 19 nt, Homo sapiens
gguacaggugcuaugcuua

SEQ ID NO: 761865 - RNA, 19 nt, Homo sapiens
gaggagaaagcaagaagag

SEQ ID NO: 761866 - RNA, 19 nt, Homo sapiens
aaucuaagaaugaggagaa

SEQ ID NO: 761867 - RNA, 19 nt, Homo sapiens
ugaaugaucuuggcuuucc

SEQ ID NO: 761868 - RNA, 19 nt, Homo sapiens
gccacgaaugaaugaauua

SEQ ID NO: 761869 - RNA, 19 nt, Homo sapiens
ucacgguccugaucugucu

SEQ ID NO: 761870 - RNA, 19 nt, Homo sapiens
aguaggaaaugaaugaucu

SEQ ID NO: 761871 - RNA, 19 nt, Homo sapiens
cauggagucuggaaugcau

SEQ ID NO: 761872 - RNA, 19 nt, Homo sapiens
ugugggcacuccauugguu

SEQ ID NO: 761873 - RNA, 19 nt, Homo sapiens
agucagaaagugcauuaaa

SEQ ID NO: 761874 - RNA, 19 nt, Homo sapiens
ugacguaugccgaggugaa

SEQ ID NO: 761875 - RNA, 19 nt, Homo sapiens
gaucgcaggacaguucuau

SEQ ID NO: 761876 - RNA, 19 nt, Homo sapiens
ccucuacuuucuggaguuu

SEQ ID NO: 761877 - RNA, 19 nt, Homo sapiens
ugacaggagccuacaucaa

SEQ ID NO: 761878 - RNA, 19 nt, Homo sapiens
cgaaugaaugaauuaggaa

SEQ ID NO: 761879 - RNA, 19 nt, Homo sapiens
ugaaauaaagcaacagacu

SEQ ID NO: 761880 - RNA, 19 nt, Homo sapiens
ugaggcugcugcaucugaa

SEQ ID NO: 761881 - RNA, 19 nt, Homo sapiens
ccucuaugcugccgugaag

SEQ ID NO: 761882 - RNA, 19 nt, Homo sapiens
aacccuaccugcugacuca

SEQ ID NO: 761883 - RNA, 19 nt, Homo sapiens
caacguaccaaucucaaaa

SEQ ID NO: 761884 - RNA, 19 nt, Homo sapiens
ucacagguggcauuugaug

SEQ ID NO: 761885 - RNA, 19 nt, Homo sapiens
gggcucauccauccacaga

SEQ ID NO: 761886 - RNA, 19 nt, Homo sapiens
gugggaaacaaauaaucua

SEQ ID NO: 761887 - RNA, 19 nt, Homo sapiens
gacccugacucugcagugu

SEQ ID NO: 761888 - RNA, 19 nt, Homo sapiens
ucagaaagugcauuaaacu

SEQ ID NO: 761889 - RNA, 19 nt, Homo sapiens
ugaaguagcugagaaaacu

SEQ ID NO: 761890 - RNA, 19 nt, Homo sapiens
gcugaaccaggcucuguga

SEQ ID NO: 761891 - RNA, 19 nt, Homo sapiens
agacuccaucucaaauuaa

SEQ ID NO: 761892 - RNA, 19 nt, Homo sapiens
gcaccgagggcucauccau

SEQ ID NO: 761893 - RNA, 19 nt, Homo sapiens
gcucaggguugacaucuua

SEQ ID NO: 761894 - RNA, 19 nt, Homo sapiens
gcacgagggucucuguguu

SEQ ID NO: 761895 - RNA, 19 nt, Homo sapiens
ggguugacaucuuauuuga

SEQ ID NO: 761896 - RNA, 19 nt, Homo sapiens
ccacggagcugcuggucau

SEQ ID NO: 761897 - RNA, 19 nt, Homo sapiens
ggccaucgccuacucauug

SEQ ID NO: 761898 - RNA, 19 nt, Homo sapiens
guugacaucuuauuugaac

SEQ ID NO: 761899 - RNA, 19 nt, Homo sapiens
ccaagagccuggugaagac

SEQ ID NO: 761900 - RNA, 19 nt, Homo sapiens
gccaagagccuggugaaga

SEQ ID NO: 761901 - RNA, 19 nt, Homo sapiens
cccaaacacucagaaauca

SEQ ID NO: 761902 - RNA, 19 nt, Homo sapiens
ucgccaaccucaucuacuu

SEQ ID NO: 761903 - RNA, 19 nt, Homo sapiens
ugcguucagugacuaauaa

SEQ ID NO: 761904 - RNA, 19 nt, Homo sapiens
ggacccaaacacucagaaa

SEQ ID NO: 761905 - RNA, 19 nt, Homo sapiens
gcuguacuaugccaacaag

SEQ ID NO: 761906 - RNA, 19 nt, Homo sapiens
caaacacucagaaaucaag

SEQ ID NO: 761907 - RNA, 19 nt, Homo sapiens
gacccaaacacucagaaau

SEQ ID NO: 761908 - RNA, 19 nt, Homo sapiens
cacgggaccugacgcaaca

SEQ ID NO: 761909 - RNA, 19 nt, Homo sapiens
caggguugacaucuuauuu

SEQ ID NO: 761910 - RNA, 19 nt, Homo sapiens
ucccaucugugccucugua

SEQ ID NO: 761911 - RNA, 19 nt, Homo sapiens
ccaagaggacucccuaugc

SEQ ID NO: 761912 - RNA, 19 nt, Homo sapiens
gugcguucagugacuaaua

SEQ ID NO: 761913 - RNA, 19 nt, Homo sapiens
gccaagaggacucccuaug

SEQ ID NO: 761914 - RNA, 19 nt, Homo sapiens
ugaugcagcguguggcuuu

SEQ ID NO: 761915 - RNA, 19 nt, Homo sapiens
ccacauaggcgagguugag

SEQ ID NO: 761916 - RNA, 19 nt, Homo sapiens
cacgagggucucuguguuu

SEQ ID NO: 761917 - RNA, 19 nt, Homo sapiens
gcagucacggcuacucugu

SEQ ID NO: 761918 - RNA, 19 nt, Homo sapiens
ccucaucuacuuccucaug

SEQ ID NO: 761919 - RNA, 19 nt, Homo sapiens
ugaccucgcagcucaaaca

SEQ ID NO: 761920 - RNA, 19 nt, Homo sapiens
gagggucucuguguuucca

SEQ ID NO: 761921 - RNA, 19 nt, Homo sapiens
ccaaacacucagaaaucaa

SEQ ID NO: 761922 - RNA, 19 nt, Homo sapiens
acucagaaaucaagaaccu

SEQ ID NO: 761923 - RNA, 19 nt, Homo sapiens
gaugcagcguguggcuuug

SEQ ID NO: 761924 - RNA, 19 nt, Homo sapiens
caucugugccucuguaagg

SEQ ID NO: 761925 - RNA, 19 nt, Homo sapiens
gcccaucuacagccucuau

SEQ ID NO: 761926 - RNA, 19 nt, Homo sapiens
cgaggaugccacagaguuc

SEQ ID NO: 761927 - RNA, 19 nt, Homo sapiens
ccgcgaaggagcucucaga

SEQ ID NO: 761928 - RNA, 19 nt, Homo sapiens
cagccugcuuugccucaug

SEQ ID NO: 761929 - RNA, 19 nt, Homo sapiens
ccugugagagacauucuga

SEQ ID NO: 761930 - RNA, 19 nt, Homo sapiens
caacagcagcacccucaac

SEQ ID NO: 761931 - RNA, 19 nt, Homo sapiens
ggaaagaucuugcugauuu

SEQ ID NO: 761932 - RNA, 19 nt, Homo sapiens
gaaagaucuugcugauuua

SEQ ID NO: 761933 - RNA, 19 nt, Homo sapiens
caacacccauggcaauuaa

SEQ ID NO: 761934 - RNA, 19 nt, Homo sapiens
gcaagcguccuccaaauuu

SEQ ID NO: 761935 - RNA, 19 nt, Homo sapiens
gaggaaagaucuugcugau

SEQ ID NO: 761936 - RNA, 19 nt, Homo sapiens
gagcaagcguccuccaaau

SEQ ID NO: 761937 - RNA, 19 nt, Homo sapiens
gcaacacccauggcaauua

SEQ ID NO: 761938 - RNA, 19 nt, Homo sapiens
cuagugggccugaggauua

SEQ ID NO: 761939 - RNA, 19 nt, Homo sapiens
caacaggcuuuaccaugug

SEQ ID NO: 761940 - RNA, 19 nt, Homo sapiens
acaacaggcuuuaccaugu

SEQ ID NO: 761941 - RNA, 19 nt, Homo sapiens
ggccaucgccuacucauug

SEQ ID NO: 761942 - RNA, 19 nt, Homo sapiens
gaaacagcuuccagcaaca

SEQ ID NO: 761943 - RNA, 19 nt, Homo sapiens
aggauuaccuuucgucuuc

SEQ ID NO: 761944 - RNA, 19 nt, Homo sapiens
gaaaugccgacaucaacga

SEQ ID NO: 761945 - RNA, 19 nt, Homo sapiens
ggaagaugauauugcaaaa

SEQ ID NO: 761946 - RNA, 19 nt, Homo sapiens
caagcguccuccaaauuuc

SEQ ID NO: 761947 - RNA, 19 nt, Homo sapiens
ccauggcaauuaacacaga

SEQ ID NO: 761948 - RNA, 19 nt, Homo sapiens
ggaagaggaggaaagaucu

SEQ ID NO: 761949 - RNA, 19 nt, Homo sapiens
ucgccaaccucaucuacuu

SEQ ID NO: 761950 - RNA, 19 nt, Homo sapiens
ucaacgacaucgagaaugc

SEQ ID NO: 761951 - RNA, 19 nt, Homo sapiens
uguggaagaugauauugca

SEQ ID NO: 761952 - RNA, 19 nt, Homo sapiens
ccagucaucaguacauuuc

SEQ ID NO: 761953 - RNA, 19 nt, Homo sapiens
uggaugauguaaccaguca

SEQ ID NO: 761954 - RNA, 19 nt, Homo sapiens
caucaacgacaucgagaau

SEQ ID NO: 761955 - RNA, 19 nt, Homo sapiens
cagcaacacccauggcaau

SEQ ID NO: 761956 - RNA, 19 nt, Homo sapiens
cacgggaccugacgcaaca

SEQ ID NO: 761957 - RNA, 19 nt, Homo sapiens
ugagcaagcguccuccaaa

SEQ ID NO: 761958 - RNA, 19 nt, Homo sapiens
uggaagaugauauugcaaa

SEQ ID NO: 761959 - RNA, 19 nt, Homo sapiens
gaggauuaccuuucgucuu

SEQ ID NO: 761960 - RNA, 19 nt, Homo sapiens
caggaaaugccgacaucaa

SEQ ID NO: 761961 - RNA, 19 nt, Homo sapiens
agaucuugcugauuuaaca

SEQ ID NO: 761962 - RNA, 19 nt, Homo sapiens
acaccagccucacgagaag

SEQ ID NO: 761963 - RNA, 19 nt, Homo sapiens
gccgguggauacagcuuau

SEQ ID NO: 761964 - RNA, 19 nt, Homo sapiens
ccucaucuacuuccucaug

SEQ ID NO: 761965 - RNA, 19 nt, Homo sapiens
ggcuuuaccauguggauga

SEQ ID NO: 761966 - RNA, 19 nt, Homo sapiens
aacaggaaaugccgacauc

SEQ ID NO: 761967 - RNA, 19 nt, Homo sapiens
uaaccagucaucaguacau

SEQ ID NO: 761968 - RNA, 19 nt, Homo sapiens
uagaaacagcuuccagcaa

SEQ ID NO: 761969 - RNA, 19 nt, Homo sapiens
ggccugaggauuaccuuuc

SEQ ID NO: 761970 - RNA, 19 nt, Homo sapiens
gcuagugggccugaggauu

SEQ ID NO: 761971 - RNA, 19 nt, Homo sapiens
uaacaggaaaugccgacau

SEQ ID NO: 761972 - RNA, 19 nt, Homo sapiens
uggaagaggaggaaagauc

SEQ ID NO: 761973 - RNA, 19 nt, Homo sapiens
gcccaucuacagccucuau

SEQ ID NO: 761974 - RNA, 19 nt, Homo sapiens
uguaaccagucaucaguac

SEQ ID NO: 761975 - RNA, 19 nt, Homo sapiens
aaauuucacaacaggcuuu

SEQ ID NO: 761976 - RNA, 19 nt, Homo sapiens
cacaccagccucacgagaa

SEQ ID NO: 761977 - RNA, 19 nt, Homo sapiens
ccauguggaugauguaacc

SEQ ID NO: 761978 - RNA, 19 nt, Homo sapiens
gaucagcaccuggggaaaa

SEQ ID NO: 761979 - RNA, 19 nt, Homo sapiens
uugcugauuuaacaggaaa

SEQ ID NO: 761980 - RNA, 19 nt, Homo sapiens
cagccugcuuugccucaug

SEQ ID NO: 761981 - RNA, 19 nt, Homo sapiens
acgagaagccgguggauac

SEQ ID NO: 761982 - RNA, 19 nt, Homo sapiens
caacagcagcacccucaac

SEQ ID NO: 761983 - RNA, 19 nt, Homo sapiens
gaacugagguugcagauaa

SEQ ID NO: 761984 - RNA, 19 nt, Homo sapiens
gcacugagcuucuauauac

SEQ ID NO: 761985 - RNA, 19 nt, Homo sapiens
gaaggaagaugauuguaaa

SEQ ID NO: 761986 - RNA, 19 nt, Homo sapiens
agaaauaucuccgaaguua

SEQ ID NO: 761987 - RNA, 19 nt, Homo sapiens
gaagaaagcgucaugauau

SEQ ID NO: 761988 - RNA, 19 nt, Homo sapiens
gaaaggagaucaccacaag

SEQ ID NO: 761989 - RNA, 19 nt, Homo sapiens
gaugauagauuccaaguca

SEQ ID NO: 761990 - RNA, 19 nt, Homo sapiens
gaagaaguaugaagugguu

SEQ ID NO: 761991 - RNA, 19 nt, Homo sapiens
ggaagaugauuguaaagaa

SEQ ID NO: 761992 - RNA, 19 nt, Homo sapiens
agacacaagucaagaaaua

SEQ ID NO: 761993 - RNA, 19 nt, Homo sapiens
caccagagcuccagagaaa

SEQ ID NO: 761994 - RNA, 19 nt, Homo sapiens
gcagauaagucauguuaca

SEQ ID NO: 761995 - RNA, 19 nt, Homo sapiens
caaguguccuucuacaaua

SEQ ID NO: 761996 - RNA, 19 nt, Homo sapiens
gauaacaagguuugcauua

SEQ ID NO: 761997 - RNA, 19 nt, Homo sapiens
gcagagaaauauacuaucu

SEQ ID NO: 761998 - RNA, 19 nt, Homo sapiens
ccacaacuuuggaauguuu

SEQ ID NO: 761999 - RNA, 19 nt, Homo sapiens
gaaagaggguauuugagau

SEQ ID NO: 762000 - RNA, 19 nt, Homo sapiens
gaucagaggccacuaucua

SEQ ID NO: 762001 - RNA, 19 nt, Homo sapiens
caaaggacaugcugugugu

SEQ ID NO: 762002 - RNA, 19 nt, Homo sapiens
ugagaaagccuacaaauca

SEQ ID NO: 762003 - RNA, 19 nt, Homo sapiens
caaauugccucuuuaaugc

SEQ ID NO: 762004 - RNA, 19 nt, Homo sapiens
gaaaugggccacaacuuug

SEQ ID NO: 762005 - RNA, 19 nt, Homo sapiens
gcgauaaucuucuuagagu

SEQ ID NO: 762006 - RNA, 19 nt, Homo sapiens
gagaaagccuacaaaucaa

SEQ ID NO: 762007 - RNA, 19 nt, Homo sapiens
ggaacuaaguguggcgaua

SEQ ID NO: 762008 - RNA, 19 nt, Homo sapiens
ugacuuuccugacauguaa

SEQ ID NO: 762009 - RNA, 19 nt, Homo sapiens
ugaagugguuuauccuaua

SEQ ID NO: 762010 - RNA, 19 nt, Homo sapiens
cagaauguguggauauuga

SEQ ID NO: 762011 - RNA, 19 nt, Homo sapiens
gauagugacuuuccugaca

SEQ ID NO: 762012 - RNA, 19 nt, Homo sapiens
gcaccaggcuacacggaaa

SEQ ID NO: 762013 - RNA, 19 nt, Homo sapiens
gaacuaaguguggcgauaa

SEQ ID NO: 762014 - RNA, 19 nt, Homo sapiens
ccugaaauguguaauggua

SEQ ID NO: 762015 - RNA, 19 nt, Homo sapiens
ggaacaauuugaaacugaa

SEQ ID NO: 762016 - RNA, 19 nt, Homo sapiens
gaagacacaagucaagaaa

SEQ ID NO: 762017 - RNA, 19 nt, Homo sapiens
caaggugggucggauaauu

SEQ ID NO: 762018 - RNA, 19 nt, Homo sapiens
ugaaaugggccacaacuuu

SEQ ID NO: 762019 - RNA, 19 nt, Homo sapiens
gaaucaagaugagaucaga

SEQ ID NO: 762020 - RNA, 19 nt, Homo sapiens
gagaaccuuugcaugaauu

SEQ ID NO: 762021 - RNA, 19 nt, Homo sapiens
gcaaguguccuucuacaau

SEQ ID NO: 762022 - RNA, 19 nt, Homo sapiens
gcccacaaauuauggauga

SEQ ID NO: 762023 - RNA, 19 nt, Homo sapiens
ucaaauugccucuuuaaug

SEQ ID NO: 762024 - RNA, 19 nt, Homo sapiens
aaagaaauaucuccgaagu

SEQ ID NO: 762025 - RNA, 19 nt, Homo sapiens
guaccaauauuugcuguga

SEQ ID NO: 762026 - RNA, 19 nt, Homo sapiens
gacaauggcacaugaaaug

SEQ ID NO: 762027 - RNA, 19 nt, Homo sapiens
ggauaauggugaguuuaaa

SEQ ID NO: 762028 - RNA, 19 nt, Homo sapiens
caacaggaacaauuugaaa

SEQ ID NO: 762029 - RNA, 19 nt, Homo sapiens
aaacaucacacuaaucuug

SEQ ID NO: 762030 - RNA, 19 nt, Homo sapiens
ggagaggacugugauugug

SEQ ID NO: 762031 - RNA, 19 nt, Homo sapiens
ucucagcuaugacaaguuu

SEQ ID NO: 762032 - RNA, 19 nt, Homo sapiens
ccacagcgauaaucuucuu

SEQ ID NO: 762033 - RNA, 19 nt, Homo sapiens
caagagaugagucagauga

SEQ ID NO: 762034 - RNA, 19 nt, Homo sapiens
ggaaucacccagcauguug

SEQ ID NO: 762035 - RNA, 19 nt, Homo sapiens
gauaaucuucuuagaguug

SEQ ID NO: 762036 - RNA, 19 nt, Homo sapiens
agaagaaagcgucaugaua

SEQ ID NO: 762037 - RNA, 19 nt, Homo sapiens
gaaugaaggugggucaaag

SEQ ID NO: 762038 - RNA, 19 nt, Homo sapiens
ggucuugcauuuaugucua

SEQ ID NO: 762039 - RNA, 19 nt, Homo sapiens
gaaauaucuccgaaguuaa

SEQ ID NO: 762040 - RNA, 19 nt, Homo sapiens
guaauuguccugaugauag

SEQ ID NO: 762041 - RNA, 19 nt, Homo sapiens
gcuaagacauguaaaauca

SEQ ID NO: 762042 - RNA, 19 nt, Homo sapiens
ugaggaauguaccaauauu

SEQ ID NO: 762043 - RNA, 19 nt, Homo sapiens
cgacuauucuugcaagugu

SEQ ID NO: 762044 - RNA, 19 nt, Homo sapiens
gacugugggucuugcauuu

SEQ ID NO: 762045 - RNA, 19 nt, Homo sapiens
aagaaagcgucaugauauu

SEQ ID NO: 762046 - RNA, 19 nt, Homo sapiens
gaacaugagaaauacauag

SEQ ID NO: 762047 - RNA, 19 nt, Homo sapiens
caugcacucuucaaguaua

SEQ ID NO: 762048 - RNA, 19 nt, Homo sapiens
ccuaaggacucaaauccaa

SEQ ID NO: 762049 - RNA, 19 nt, Homo sapiens
gagaaaagcagaagaaaga

SEQ ID NO: 762050 - RNA, 19 nt, Homo sapiens
ucugaggaauguaccaaua

SEQ ID NO: 762051 - RNA, 19 nt, Homo sapiens
uaucauauccacuccaauu

SEQ ID NO: 762052 - RNA, 19 nt, Homo sapiens
caauaugugugauggacaa

SEQ ID NO: 762053 - RNA, 19 nt, Homo sapiens
ggccuuaguugguauggaa

SEQ ID NO: 762054 - RNA, 19 nt, Homo sapiens
ucagaaagaggguauuuga

SEQ ID NO: 762055 - RNA, 19 nt, Homo sapiens
ccaaagagccagagcaaca

SEQ ID NO: 762056 - RNA, 19 nt, Homo sapiens
gaucagaaagaggguauuu

SEQ ID NO: 762057 - RNA, 19 nt, Homo sapiens
gcuaaauuaucaacuugga

SEQ ID NO: 762058 - RNA, 19 nt, Homo sapiens
ggacugacaaggauaagau

SEQ ID NO: 762059 - RNA, 19 nt, Homo sapiens
cgaccugccugaaaugugu

SEQ ID NO: 762060 - RNA, 19 nt, Homo sapiens
ggccacaacuuuggaaugu

SEQ ID NO: 762061 - RNA, 19 nt, Homo sapiens
ugagauggcuaauuauguc

SEQ ID NO: 762062 - RNA, 19 nt, Homo sapiens
acaaugagaaucaagauga

SEQ ID NO: 762063 - RNA, 19 nt, Homo sapiens
ccacaagcccacaaauuau

SEQ ID NO: 762064 - RNA, 19 nt, Homo sapiens
agaaagaggguauuugaga

SEQ ID NO: 762065 - RNA, 19 nt, Homo sapiens
gcuacacggaaacauauua

SEQ ID NO: 762066 - RNA, 19 nt, Homo sapiens
uguaugaucugccaguaga

SEQ ID NO: 762067 - RNA, 19 nt, Homo sapiens
gaggaauguaccaauauuu

SEQ ID NO: 762068 - RNA, 19 nt, Homo sapiens
cauauccacuccaauuugu

SEQ ID NO: 762069 - RNA, 19 nt, Homo sapiens
guauggaaaucuggacuga

SEQ ID NO: 762070 - RNA, 19 nt, Homo sapiens
caagaugagaucagaaaga

SEQ ID NO: 762071 - RNA, 19 nt, Homo sapiens
accacaagcccacaaauua

SEQ ID NO: 762072 - RNA, 19 nt, Homo sapiens
agaaggaagaugauuguaa

SEQ ID NO: 762073 - RNA, 19 nt, Homo sapiens
ccugagaaccuuugcauga

SEQ ID NO: 762074 - RNA, 19 nt, Homo sapiens
agcaagaacuaauggcuaa

SEQ ID NO: 762075 - RNA, 19 nt, Homo sapiens
caaccaauugcucaucuaa

SEQ ID NO: 762076 - RNA, 19 nt, Homo sapiens
gcaacaggaacaauuugaa

SEQ ID NO: 762077 - RNA, 19 nt, Homo sapiens
gcagccgucucagcuauga

SEQ ID NO: 762078 - RNA, 19 nt, Homo sapiens
gucaugauauugcucaguu

SEQ ID NO: 762079 - RNA, 19 nt, Homo sapiens
ccaccaaacuaguaaaauu

SEQ ID NO: 762080 - RNA, 19 nt, Homo sapiens
cacaaauuauggaugauug

SEQ ID NO: 762081 - RNA, 19 nt, Homo sapiens
ccuccucucuguugcagua

SEQ ID NO: 762082 - RNA, 19 nt, Homo sapiens
ggaaugaaggugggucaaa

SEQ ID NO: 762083 - RNA, 19 nt, Homo sapiens
gcacugagcuucuauauac

SEQ ID NO: 762084 - RNA, 19 nt, Homo sapiens
gaagaaagcgucaugauau

SEQ ID NO: 762085 - RNA, 19 nt, Homo sapiens
gaaaggagaucaccacaag

SEQ ID NO: 762086 - RNA, 19 nt, Homo sapiens
gaugauagauuccaaguca

SEQ ID NO: 762087 - RNA, 19 nt, Homo sapiens
gaagaaguaugaagugguu

SEQ ID NO: 762088 - RNA, 19 nt, Homo sapiens
caaguguccuucuacaaua

SEQ ID NO: 762089 - RNA, 19 nt, Homo sapiens
ccacaacuuuggaauguuu

SEQ ID NO: 762090 - RNA, 19 nt, Homo sapiens
gaaagaggguauuugagau

SEQ ID NO: 762091 - RNA, 19 nt, Homo sapiens
caaauugccucuuuaaugc

SEQ ID NO: 762092 - RNA, 19 nt, Homo sapiens
gaaaugggccacaacuuug

SEQ ID NO: 762093 - RNA, 19 nt, Homo sapiens
gcgauaaucuucuuagagu

SEQ ID NO: 762094 - RNA, 19 nt, Homo sapiens
ugaagugguuuauccuaua

SEQ ID NO: 762095 - RNA, 19 nt, Homo sapiens
gaucauaaacccuuggaaa

SEQ ID NO: 762096 - RNA, 19 nt, Homo sapiens
gcaccaggcuacacggaaa

SEQ ID NO: 762097 - RNA, 19 nt, Homo sapiens
ccugaaauguguaauggua

SEQ ID NO: 762098 - RNA, 19 nt, Homo sapiens
ggaacaauuugaaacugaa

SEQ ID NO: 762099 - RNA, 19 nt, Homo sapiens
gaggugugcucauacuaaa

SEQ ID NO: 762100 - RNA, 19 nt, Homo sapiens
ugaaaugggccacaacuuu

SEQ ID NO: 762101 - RNA, 19 nt, Homo sapiens
gaaucaagaugagaucaga

SEQ ID NO: 762102 - RNA, 19 nt, Homo sapiens
gcaaguguccuucuacaau

SEQ ID NO: 762103 - RNA, 19 nt, Homo sapiens
gcccacaaauuauggauga

SEQ ID NO: 762104 - RNA, 19 nt, Homo sapiens
caguauaucccaugcaaua

SEQ ID NO: 762105 - RNA, 19 nt, Homo sapiens
ucaaauugccucuuuaaug

SEQ ID NO: 762106 - RNA, 19 nt, Homo sapiens
guaccaauauuugcuguga

SEQ ID NO: 762107 - RNA, 19 nt, Homo sapiens
gacaauggcacaugaaaug

SEQ ID NO: 762108 - RNA, 19 nt, Homo sapiens
ggauaauggugaguuuaaa

SEQ ID NO: 762109 - RNA, 19 nt, Homo sapiens
caacaggaacaauuugaaa

SEQ ID NO: 762110 - RNA, 19 nt, Homo sapiens
ggagaggacugugauugug

SEQ ID NO: 762111 - RNA, 19 nt, Homo sapiens
ucucagcuaugacaaguuu

SEQ ID NO: 762112 - RNA, 19 nt, Homo sapiens
ccacagcgauaaucuucuu

SEQ ID NO: 762113 - RNA, 19 nt, Homo sapiens
ggaaucacccagcauguug

SEQ ID NO: 762114 - RNA, 19 nt, Homo sapiens
gauaaucuucuuagaguug

SEQ ID NO: 762115 - RNA, 19 nt, Homo sapiens
agaagaaagcgucaugaua

SEQ ID NO: 762116 - RNA, 19 nt, Homo sapiens
ggucuugcauuuaugucua

SEQ ID NO: 762117 - RNA, 19 nt, Homo sapiens
ggaaagguuuuaagauuug

SEQ ID NO: 762118 - RNA, 19 nt, Homo sapiens
guaauuguccugaugauag

SEQ ID NO: 762119 - RNA, 19 nt, Homo sapiens
gcuaagacauguaaaauca

SEQ ID NO: 762120 - RNA, 19 nt, Homo sapiens
ugaggaauguaccaauauu

SEQ ID NO: 762121 - RNA, 19 nt, Homo sapiens
cgacuauucuugcaagugu

SEQ ID NO: 762122 - RNA, 19 nt, Homo sapiens
gacugugggucuugcauuu

SEQ ID NO: 762123 - RNA, 19 nt, Homo sapiens
aagaaagcgucaugauauu

SEQ ID NO: 762124 - RNA, 19 nt, Homo sapiens
gaacaugagaaauacauag

SEQ ID NO: 762125 - RNA, 19 nt, Homo sapiens
caugcacucuucaaguaua

SEQ ID NO: 762126 - RNA, 19 nt, Homo sapiens
ucugaggaauguaccaaua

SEQ ID NO: 762127 - RNA, 19 nt, Homo sapiens
uaucauauccacuccaauu

SEQ ID NO: 762128 - RNA, 19 nt, Homo sapiens
caauaugugugauggacaa

SEQ ID NO: 762129 - RNA, 19 nt, Homo sapiens
ggccuuaguugguauggaa

SEQ ID NO: 762130 - RNA, 19 nt, Homo sapiens
ucagaaagaggguauuuga

SEQ ID NO: 762131 - RNA, 19 nt, Homo sapiens
ccaaagagccagagcaaca

SEQ ID NO: 762132 - RNA, 19 nt, Homo sapiens
gaucagaaagaggguauuu

SEQ ID NO: 762133 - RNA, 19 nt, Homo sapiens
ggacugacaaggauaagau

SEQ ID NO: 762134 - RNA, 19 nt, Homo sapiens
cauaaacccuuggaaaucu

SEQ ID NO: 762135 - RNA, 19 nt, Homo sapiens
cgaccugccugaaaugugu

SEQ ID NO: 762136 - RNA, 19 nt, Homo sapiens
ggccacaacuuuggaaugu

SEQ ID NO: 762137 - RNA, 19 nt, Homo sapiens
ugagauggcuaauuauguc

SEQ ID NO: 762138 - RNA, 19 nt, Homo sapiens
acaaugagaaucaagauga

SEQ ID NO: 762139 - RNA, 19 nt, Homo sapiens
ccacaagcccacaaauuau

SEQ ID NO: 762140 - RNA, 19 nt, Homo sapiens
agaaagaggguauuugaga

SEQ ID NO: 762141 - RNA, 19 nt, Homo sapiens
gcuacacggaaacauauua

SEQ ID NO: 762142 - RNA, 19 nt, Homo sapiens
gaggaauguaccaauauuu

SEQ ID NO: 762143 - RNA, 19 nt, Homo sapiens
cauauccacuccaauuugu

SEQ ID NO: 762144 - RNA, 19 nt, Homo sapiens
guauggaaaucuggacuga

SEQ ID NO: 762145 - RNA, 19 nt, Homo sapiens
caagaugagaucagaaaga

SEQ ID NO: 762146 - RNA, 19 nt, Homo sapiens
accacaagcccacaaauua

SEQ ID NO: 762147 - RNA, 19 nt, Homo sapiens
gcagccgucucagcuauga

SEQ ID NO: 762148 - RNA, 19 nt, Homo sapiens
gucaugauauugcucaguu

SEQ ID NO: 762149 - RNA, 19 nt, Homo sapiens
ccaccaaacuaguaaaauu

SEQ ID NO: 762150 - RNA, 19 nt, Homo sapiens
cacaaauuauggaugauug

SEQ ID NO: 762151 - RNA, 19 nt, Homo sapiens
gcaacaggaacaauuugaa

SEQ ID NO: 762152 - RNA, 19 nt, Homo sapiens
uaauuguccugaugauaga

SEQ ID NO: 762153 - RNA, 19 nt, Homo sapiens
ugguaaaucugguaauugu

SEQ ID NO: 762154 - RNA, 19 nt, Homo sapiens
ugacaaggauaagauaaag

SEQ ID NO: 762155 - RNA, 19 nt, Homo sapiens
ccuccucucuguugcagua

SEQ ID NO: 762156 - RNA, 19 nt, Homo sapiens
ggaacaugagaaauacaua

SEQ ID NO: 762157 - RNA, 19 nt, Homo sapiens
gaagggccacugcuugaug

SEQ ID NO: 762158 - RNA, 19 nt, Homo sapiens
uuaggagaauguugugaaa

SEQ ID NO: 762159 - RNA, 19 nt, Homo sapiens
ggacaauggcacaugaaau

SEQ ID NO: 762160 - RNA, 19 nt, Homo sapiens
cauguggccuuaguuggua

SEQ ID NO: 762161 - RNA, 19 nt, Homo sapiens
agcaugcacucuucaagua

SEQ ID NO: 762162 - RNA, 19 nt, Homo sapiens
gcuagcaucagcacaugua

SEQ ID NO: 762163 - RNA, 19 nt, Homo sapiens
acaauguguucuccuuauu

SEQ ID NO: 762164 - RNA, 19 nt, Homo sapiens
ucaaguauaacccugauga

SEQ ID NO: 762165 - RNA, 19 nt, Homo sapiens
ggaaaggagaucaccacaa

SEQ ID NO: 762166 - RNA, 19 nt, Homo sapiens
uugcagugcuuuauuugaa

SEQ ID NO: 762167 - RNA, 19 nt, Homo sapiens
gggaagggccacugcuuga

SEQ ID NO: 762168 - RNA, 19 nt, Homo sapiens
ugggauggaugguguguug

SEQ ID NO: 762169 - RNA, 19 nt, Homo sapiens
cagggacaauggcacauga

SEQ ID NO: 762170 - RNA, 19 nt, Homo sapiens
ucaugauauugcucaguua

SEQ ID NO: 762171 - RNA, 19 nt, Homo sapiens
gggaugggacagaaauaaa

SEQ ID NO: 762172 - RNA, 19 nt, Homo sapiens
caacccuacuaagaucaua

SEQ ID NO: 762173 - RNA, 19 nt, Homo sapiens
gaauguuucaugacgacua

SEQ ID NO: 762174 - RNA, 19 nt, Homo sapiens
gaccacagcgauaaucuuc

SEQ ID NO: 762175 - RNA, 19 nt, Homo sapiens
uacaauguguucuccuuau

SEQ ID NO: 762176 - RNA, 19 nt, Homo sapiens
aggaacaauuugaaacuga

SEQ ID NO: 762177 - RNA, 19 nt, Homo sapiens
caaggucuccugccaguca

SEQ ID NO: 762178 - RNA, 19 nt, Homo sapiens
ugauauugcucaguuaauc

SEQ ID NO: 762179 - RNA, 19 nt, Homo sapiens
agaaguaugaagugguuua

SEQ ID NO: 762180 - RNA, 19 nt, Homo sapiens
gagcaacaggaacaauuug

SEQ ID NO: 762181 - RNA, 19 nt, Homo sapiens
aauauuugcugugaugcua

SEQ ID NO: 762182 - RNA, 19 nt, Homo sapiens
ggaaaugggagaggacugu

SEQ ID NO: 762183 - RNA, 19 nt, Homo sapiens
gaacugagguugcagauaa

SEQ ID NO: 762184 - RNA, 19 nt, Homo sapiens
gcacugagcuucuauauac

SEQ ID NO: 762185 - RNA, 19 nt, Homo sapiens
gaaggaagaugauuguaaa

SEQ ID NO: 762186 - RNA, 19 nt, Homo sapiens
agaaauaucuccgaaguua

SEQ ID NO: 762187 - RNA, 19 nt, Homo sapiens
gaagaaagcgucaugauau

SEQ ID NO: 762188 - RNA, 19 nt, Homo sapiens
gaaaggagaucaccacaag

SEQ ID NO: 762189 - RNA, 19 nt, Homo sapiens
gaugauagauuccaaguca

SEQ ID NO: 762190 - RNA, 19 nt, Homo sapiens
gaagaaguaugaagugguu

SEQ ID NO: 762191 - RNA, 19 nt, Homo sapiens
ggaagaugauuguaaagaa

SEQ ID NO: 762192 - RNA, 19 nt, Homo sapiens
agacacaagucaagaaaua

SEQ ID NO: 762193 - RNA, 19 nt, Homo sapiens
caccagagcuccagagaaa

SEQ ID NO: 762194 - RNA, 19 nt, Homo sapiens
gcagauaagucauguuaca

SEQ ID NO: 762195 - RNA, 19 nt, Homo sapiens
caaguguccuucuacaaua

SEQ ID NO: 762196 - RNA, 19 nt, Homo sapiens
gauaacaagguuugcauua

SEQ ID NO: 762197 - RNA, 19 nt, Homo sapiens
ccacaacuuuggaauguuu

SEQ ID NO: 762198 - RNA, 19 nt, Homo sapiens
gaaagaggguauuugagau

SEQ ID NO: 762199 - RNA, 19 nt, Homo sapiens
gaucagaggccacuaucua

SEQ ID NO: 762200 - RNA, 19 nt, Homo sapiens
caaaggacaugcugugugu

SEQ ID NO: 762201 - RNA, 19 nt, Homo sapiens
ugagaaagccuacaaauca

SEQ ID NO: 762202 - RNA, 19 nt, Homo sapiens
caaauugccucuuuaaugc

SEQ ID NO: 762203 - RNA, 19 nt, Homo sapiens
gaaaugggccacaacuuug

SEQ ID NO: 762204 - RNA, 19 nt, Homo sapiens
gcgauaaucuucuuagagu

SEQ ID NO: 762205 - RNA, 19 nt, Homo sapiens
gagaaagccuacaaaucaa

SEQ ID NO: 762206 - RNA, 19 nt, Homo sapiens
ggaacuaaguguggcgaua

SEQ ID NO: 762207 - RNA, 19 nt, Homo sapiens
ugacuuuccugacauguaa

SEQ ID NO: 762208 - RNA, 19 nt, Homo sapiens
ugaagugguuuauccuaua

SEQ ID NO: 762209 - RNA, 19 nt, Homo sapiens
cagaauguguggauauuga

SEQ ID NO: 762210 - RNA, 19 nt, Homo sapiens
gauagugacuuuccugaca

SEQ ID NO: 762211 - RNA, 19 nt, Homo sapiens
gcaccaggcuacacggaaa

SEQ ID NO: 762212 - RNA, 19 nt, Homo sapiens
gaacuaaguguggcgauaa

SEQ ID NO: 762213 - RNA, 19 nt, Homo sapiens
ccugaaauguguaauggua

SEQ ID NO: 762214 - RNA, 19 nt, Homo sapiens
ggaacaauuugaaacugaa

SEQ ID NO: 762215 - RNA, 19 nt, Homo sapiens
gaagacacaagucaagaaa

SEQ ID NO: 762216 - RNA, 19 nt, Homo sapiens
ggacucaaauccagaagca

SEQ ID NO: 762217 - RNA, 19 nt, Homo sapiens
caaggugggucggauaauu

SEQ ID NO: 762218 - RNA, 19 nt, Homo sapiens
ugaaaugggccacaacuuu

SEQ ID NO: 762219 - RNA, 19 nt, Homo sapiens
gaaucaagaugagaucaga

SEQ ID NO: 762220 - RNA, 19 nt, Homo sapiens
gagaaccuuugcaugaauu

SEQ ID NO: 762221 - RNA, 19 nt, Homo sapiens
gcaaguguccuucuacaau

SEQ ID NO: 762222 - RNA, 19 nt, Homo sapiens
gcccacaaauuauggauga

SEQ ID NO: 762223 - RNA, 19 nt, Homo sapiens
ucaaauugccucuuuaaug

SEQ ID NO: 762224 - RNA, 19 nt, Homo sapiens
aaagaaauaucuccgaagu

SEQ ID NO: 762225 - RNA, 19 nt, Homo sapiens
guaccaauauuugcuguga

SEQ ID NO: 762226 - RNA, 19 nt, Homo sapiens
gacaauggcacaugaaaug

SEQ ID NO: 762227 - RNA, 19 nt, Homo sapiens
ccagagaaauauacuaucu

SEQ ID NO: 762228 - RNA, 19 nt, Homo sapiens
ggauaauggugaguuuaaa

SEQ ID NO: 762229 - RNA, 19 nt, Homo sapiens
caacaggaacaauuugaaa

SEQ ID NO: 762230 - RNA, 19 nt, Homo sapiens
ggagaggacugugauugug

SEQ ID NO: 762231 - RNA, 19 nt, Homo sapiens
ucucagcuaugacaaguuu

SEQ ID NO: 762232 - RNA, 19 nt, Homo sapiens
ccacagcgauaaucuucuu

SEQ ID NO: 762233 - RNA, 19 nt, Homo sapiens
caagagaugagucagauga

SEQ ID NO: 762234 - RNA, 19 nt, Homo sapiens
ggaaucacccagcauguug

SEQ ID NO: 762235 - RNA, 19 nt, Homo sapiens
gauaaucuucuuagaguug

SEQ ID NO: 762236 - RNA, 19 nt, Homo sapiens
agaagaaagcgucaugaua

SEQ ID NO: 762237 - RNA, 19 nt, Homo sapiens
gaaugaaggugggucaaag

SEQ ID NO: 762238 - RNA, 19 nt, Homo sapiens
ggucuugcauuuaugucua

SEQ ID NO: 762239 - RNA, 19 nt, Homo sapiens
gaaauaucuccgaaguuaa

SEQ ID NO: 762240 - RNA, 19 nt, Homo sapiens
guaauuguccugaugauag

SEQ ID NO: 762241 - RNA, 19 nt, Homo sapiens
gcuaagacauguaaaauca

SEQ ID NO: 762242 - RNA, 19 nt, Homo sapiens
ugaggaauguaccaauauu

SEQ ID NO: 762243 - RNA, 19 nt, Homo sapiens
cgacuauucuugcaagugu

SEQ ID NO: 762244 - RNA, 19 nt, Homo sapiens
gacugugggucuugcauuu

SEQ ID NO: 762245 - RNA, 19 nt, Homo sapiens
aagaaagcgucaugauauu

SEQ ID NO: 762246 - RNA, 19 nt, Homo sapiens
gaacaugagaaauacauag

SEQ ID NO: 762247 - RNA, 19 nt, Homo sapiens
caugcacucuucaaguaua

SEQ ID NO: 762248 - RNA, 19 nt, Homo sapiens
gagaaaagcagaagaaaga

SEQ ID NO: 762249 - RNA, 19 nt, Homo sapiens
ucugaggaauguaccaaua

SEQ ID NO: 762250 - RNA, 19 nt, Homo sapiens
uaucauauccacuccaauu

SEQ ID NO: 762251 - RNA, 19 nt, Homo sapiens
caauaugugugauggacaa

SEQ ID NO: 762252 - RNA, 19 nt, Homo sapiens
ggccuuaguugguauggaa

SEQ ID NO: 762253 - RNA, 19 nt, Homo sapiens
ucagaaagaggguauuuga

SEQ ID NO: 762254 - RNA, 19 nt, Homo sapiens
ccaaagagccagagcaaca

SEQ ID NO: 762255 - RNA, 19 nt, Homo sapiens
gaucagaaagaggguauuu

SEQ ID NO: 762256 - RNA, 19 nt, Homo sapiens
ggacugacaaggauaagau

SEQ ID NO: 762257 - RNA, 19 nt, Homo sapiens
cgaccugccugaaaugugu

SEQ ID NO: 762258 - RNA, 19 nt, Homo sapiens
ggccacaacuuuggaaugu

SEQ ID NO: 762259 - RNA, 19 nt, Homo sapiens
ugagauggcuaauuauguc

SEQ ID NO: 762260 - RNA, 19 nt, Homo sapiens
acaaugagaaucaagauga

SEQ ID NO: 762261 - RNA, 19 nt, Homo sapiens
ccacaagcccacaaauuau

SEQ ID NO: 762262 - RNA, 19 nt, Homo sapiens
agcaagaacuaaugguuaa

SEQ ID NO: 762263 - RNA, 19 nt, Homo sapiens
agaaagaggguauuugaga

SEQ ID NO: 762264 - RNA, 19 nt, Homo sapiens
gcuacacggaaacauauua

SEQ ID NO: 762265 - RNA, 19 nt, Homo sapiens
aagcaagaacuaaugguua

SEQ ID NO: 762266 - RNA, 19 nt, Homo sapiens
uguaugaucugccaguaga

SEQ ID NO: 762267 - RNA, 19 nt, Homo sapiens
gaggaauguaccaauauuu

SEQ ID NO: 762268 - RNA, 19 nt, Homo sapiens
cauauccacuccaauuugu

SEQ ID NO: 762269 - RNA, 19 nt, Homo sapiens
guauggaaaucuggacuga

SEQ ID NO: 762270 - RNA, 19 nt, Homo sapiens
caagaugagaucagaaaga

SEQ ID NO: 762271 - RNA, 19 nt, Homo sapiens
accacaagcccacaaauua

SEQ ID NO: 762272 - RNA, 19 nt, Homo sapiens
agaaggaagaugauuguaa

SEQ ID NO: 762273 - RNA, 19 nt, Homo sapiens
ccugagaaccuuugcauga

SEQ ID NO: 762274 - RNA, 19 nt, Homo sapiens
ccagaagcaugaagcaaca

SEQ ID NO: 762275 - RNA, 19 nt, Homo sapiens
gcaacaggaacaauuugaa

SEQ ID NO: 762276 - RNA, 19 nt, Homo sapiens
gcagccgucucagcuauga

SEQ ID NO: 762277 - RNA, 19 nt, Homo sapiens
gucaugauauugcucaguu

SEQ ID NO: 762278 - RNA, 19 nt, Homo sapiens
ccaccaaacuaguaaaauu

SEQ ID NO: 762279 - RNA, 19 nt, Homo sapiens
cacaaauuauggaugauug

SEQ ID NO: 762280 - RNA, 19 nt, Homo sapiens
ccuccucucuguugcagua

SEQ ID NO: 762281 - RNA, 19 nt, Homo sapiens
ggaaugaaggugggucaaa

SEQ ID NO: 762282 - RNA, 19 nt, Homo sapiens
uaauuguccugaugauaga

SEQ ID NO: 762283 - RNA, 19 nt, Homo sapiens
gauaaaaccuucaccauua

SEQ ID NO: 762284 - RNA, 19 nt, Homo sapiens
gaagagcccuggauaggaa

SEQ ID NO: 762285 - RNA, 19 nt, Homo sapiens
gcucauccauccuugauua

SEQ ID NO: 762286 - RNA, 19 nt, Homo sapiens
gagugaacuucuccuauua

SEQ ID NO: 762287 - RNA, 19 nt, Homo sapiens
ggaggauucuguaaauaaa

SEQ ID NO: 762288 - RNA, 19 nt, Homo sapiens
agaaaggacuagcauauga

SEQ ID NO: 762289 - RNA, 19 nt, Homo sapiens
ugaagcagguccagaacua

SEQ ID NO: 762290 - RNA, 19 nt, Homo sapiens
ugaaagaggcccacaggua

SEQ ID NO: 762291 - RNA, 19 nt, Homo sapiens
cgucagcuauguaauguuu

SEQ ID NO: 762292 - RNA, 19 nt, Homo sapiens
cauccauccuugauuauuu

SEQ ID NO: 762293 - RNA, 19 nt, Homo sapiens
gggaggauucuguaaauaa

SEQ ID NO: 762294 - RNA, 19 nt, Homo sapiens
gaauucuccucuaccauug

SEQ ID NO: 762295 - RNA, 19 nt, Homo sapiens
gagggaggcugcaccugaa

SEQ ID NO: 762296 - RNA, 19 nt, Homo sapiens
aaagaaaggacuagcauau

SEQ ID NO: 762297 - RNA, 19 nt, Homo sapiens
aggaagagaugcccaugaa

SEQ ID NO: 762298 - RNA, 19 nt, Homo sapiens
uaaagaaaggacuagcaua

SEQ ID NO: 762299 - RNA, 19 nt, Homo sapiens
ccauuaacuugcuguguga

SEQ ID NO: 762300 - RNA, 19 nt, Homo sapiens
ccaagcugcuggucuacuu

SEQ ID NO: 762301 - RNA, 19 nt, Homo sapiens
uagagauggugcuaaagaa

SEQ ID NO: 762302 - RNA, 19 nt, Homo sapiens
ccuccaagcugcuggucua

SEQ ID NO: 762303 - RNA, 19 nt, Homo sapiens
ccaggaggcugugagcaaa

SEQ ID NO: 762304 - RNA, 19 nt, Homo sapiens
ccuguucacuucagaguug

SEQ ID NO: 762305 - RNA, 19 nt, Homo sapiens
aguuugagcuggcuggaua

SEQ ID NO: 762306 - RNA, 19 nt, Homo sapiens
gcauaugagacuucuggua

SEQ ID NO: 762307 - RNA, 19 nt, Homo sapiens
guacgaccacucagaauuc

SEQ ID NO: 762308 - RNA, 19 nt, Homo sapiens
ggcugcaccugaagcauuu

SEQ ID NO: 762309 - RNA, 19 nt, Homo sapiens
ccucuaccauugcaacuga

SEQ ID NO: 762310 - RNA, 19 nt, Homo sapiens
ugagcuggcuggauacuag

SEQ ID NO: 762311 - RNA, 19 nt, Homo sapiens
acaguugacuucccagaau

SEQ ID NO: 762312 - RNA, 19 nt, Homo sapiens
gacccaaggccaugugaaa

SEQ ID NO: 762313 - RNA, 19 nt, Homo sapiens
ggaagagcccuggauagga

SEQ ID NO: 762314 - RNA, 19 nt, Homo sapiens
guucggcacuagacugcua

SEQ ID NO: 762315 - RNA, 19 nt, Homo sapiens
gccaucacccgcacccuua

SEQ ID NO: 762316 - RNA, 19 nt, Homo sapiens
ggacuagcauaugagacuu

SEQ ID NO: 762317 - RNA, 19 nt, Homo sapiens
gugacgagcugugggaaga

SEQ ID NO: 762318 - RNA, 19 nt, Homo sapiens
agugggaucugguguguga

SEQ ID NO: 762319 - RNA, 19 nt, Homo sapiens
gaagcagguccagaacuaa

SEQ ID NO: 762320 - RNA, 19 nt, Homo sapiens
cuucauaccuagaccuguu

SEQ ID NO: 762321 - RNA, 19 nt, Homo sapiens
ccaacccacuggucucaug

SEQ ID NO: 762322 - RNA, 19 nt, Homo sapiens
ucucccaaauggauaauga

SEQ ID NO: 762323 - RNA, 19 nt, Homo sapiens
gcuaguguccuccgauaug

SEQ ID NO: 762324 - RNA, 19 nt, Homo sapiens
agaauucuccucuaccauu

SEQ ID NO: 762325 - RNA, 19 nt, Homo sapiens
gagccaacauuuuauugaa

SEQ ID NO: 762326 - RNA, 19 nt, Homo sapiens
gaaaggacuagcauaugag

SEQ ID NO: 762327 - RNA, 19 nt, Homo sapiens
cuagagauggugcuaaaga

SEQ ID NO: 762328 - RNA, 19 nt, Homo sapiens
gaauaaggugcuucugcuu

SEQ ID NO: 762329 - RNA, 19 nt, Homo sapiens
ccaugaagcagguccagaa

SEQ ID NO: 762330 - RNA, 19 nt, Homo sapiens
gaggaagagaugcccauga

SEQ ID NO: 762331 - RNA, 19 nt, Homo sapiens
ugcccaagcuuacuuaugg

SEQ ID NO: 762332 - RNA, 19 nt, Homo sapiens
gcagggcaaugcaugucau

SEQ ID NO: 762333 - RNA, 19 nt, Homo sapiens
cuaguguccuccgauauga

SEQ ID NO: 762334 - RNA, 19 nt, Homo sapiens
gggcuguggccuuuggaua

SEQ ID NO: 762335 - RNA, 19 nt, Homo sapiens
ucagaauucuccucuacca

SEQ ID NO: 762336 - RNA, 19 nt, Homo sapiens
caugggagccaacauuuua

SEQ ID NO: 762337 - RNA, 19 nt, Homo sapiens
ggcaugggagccaacauuu

SEQ ID NO: 762338 - RNA, 19 nt, Homo sapiens
caacuucagccaucaggau

SEQ ID NO: 762339 - RNA, 19 nt, Homo sapiens
gagauggugcuaaagaaag

SEQ ID NO: 762340 - RNA, 19 nt, Homo sapiens
guucaucucccaaauggau

SEQ ID NO: 762341 - RNA, 19 nt, Homo sapiens
cugccuaccuguucacuuc

SEQ ID NO: 762342 - RNA, 19 nt, Homo sapiens
cugcuaguguccuccgaua

SEQ ID NO: 762343 - RNA, 19 nt, Homo sapiens
ucugcacgcuggcuucuga

SEQ ID NO: 762344 - RNA, 19 nt, Homo sapiens
uauguaauguuugccauca

SEQ ID NO: 762345 - RNA, 19 nt, Homo sapiens
ggcaugcuguccacugugu

SEQ ID NO: 762346 - RNA, 19 nt, Homo sapiens
acagagcugcguccacuuu

SEQ ID NO: 762347 - RNA, 19 nt, Homo sapiens
guggggagcuggaggauga

SEQ ID NO: 762348 - RNA, 19 nt, Homo sapiens
gggaagagcccuggauagg

SEQ ID NO: 762349 - RNA, 19 nt, Homo sapiens
ugagacuucugguaccaau

SEQ ID NO: 762350 - RNA, 19 nt, Homo sapiens
gugggaagagcccuggaua

SEQ ID NO: 762351 - RNA, 19 nt, Homo sapiens
gcuguggccuuuggauauc

SEQ ID NO: 762352 - RNA, 19 nt, Homo sapiens
gagcugcguccacuuucuu

SEQ ID NO: 762353 - RNA, 19 nt, Homo sapiens
ggacguggagagaaagagu

SEQ ID NO: 762354 - RNA, 19 nt, Homo sapiens
ugagugggaucuggugugu

SEQ ID NO: 762355 - RNA, 19 nt, Homo sapiens
agagauggugcuaaagaaa

SEQ ID NO: 762356 - RNA, 19 nt, Homo sapiens
caguugacuucccagaaug

SEQ ID NO: 762357 - RNA, 19 nt, Homo sapiens
ccacagugcccugcucuca

SEQ ID NO: 762358 - RNA, 19 nt, Homo sapiens
ccaaggccaugugaaagag

SEQ ID NO: 762359 - RNA, 19 nt, Homo sapiens
gccaggaggcugugagcaa

SEQ ID NO: 762360 - RNA, 19 nt, Homo sapiens
acucagaauucuccucuac

SEQ ID NO: 762361 - RNA, 19 nt, Homo sapiens
ucuaggaacaguugacuuc

SEQ ID NO: 762362 - RNA, 19 nt, Homo sapiens
uugauuauuuggcuucuag

SEQ ID NO: 762363 - RNA, 19 nt, Homo sapiens
ucuauguggugggcaguuu

SEQ ID NO: 762364 - RNA, 19 nt, Homo sapiens
ccacggcuccgacacaucu

SEQ ID NO: 762365 - RNA, 19 nt, Homo sapiens
ggggaggauucuguaaaua

SEQ ID NO: 762366 - RNA, 19 nt, Homo sapiens
gaacgggugguccgaagac

SEQ ID NO: 762367 - RNA, 19 nt, Homo sapiens
ggaacgggugguccgaaga

SEQ ID NO: 762368 - RNA, 19 nt, Homo sapiens
ggcuguggccuuuggauau

SEQ ID NO: 762369 - RNA, 19 nt, Homo sapiens
cuaaagaaaggacuagcau

SEQ ID NO: 762370 - RNA, 19 nt, Homo sapiens
uucuagagauggugcuaaa

SEQ ID NO: 762371 - RNA, 19 nt, Homo sapiens
auaaggugcuucugcuucu

SEQ ID NO: 762372 - RNA, 19 nt, Homo sapiens
cuugggaggcccuaccaua

SEQ ID NO: 762373 - RNA, 19 nt, Homo sapiens
ugugugaccuugggcaugu

SEQ ID NO: 762374 - RNA, 19 nt, Homo sapiens
aaaggacuagcauaugaga

SEQ ID NO: 762375 - RNA, 19 nt, Homo sapiens
ucucugggccucagucugu

SEQ ID NO: 762376 - RNA, 19 nt, Homo sapiens
gcagguccagaacuaagug

SEQ ID NO: 762377 - RNA, 19 nt, Homo sapiens
gcucucagggcugggagua

SEQ ID NO: 762378 - RNA, 19 nt, Homo sapiens
guaccagacacagcuguug

SEQ ID NO: 762379 - RNA, 19 nt, Homo sapiens
gcugcgugguggugugguu

SEQ ID NO: 762380 - RNA, 19 nt, Homo sapiens
cccaaggccaugugaaaga

SEQ ID NO: 762381 - RNA, 19 nt, Homo sapiens
gccaacauuuuauugaaga

SEQ ID NO: 762382 - RNA, 19 nt, Homo sapiens
aagaaaggacuagcauaug

SEQ ID NO: 762383 - RNA, 19 nt, Homo sapiens
gauaaaaccuucaccauua

SEQ ID NO: 762384 - RNA, 19 nt, Homo sapiens
gaagagcccuggauaggaa

SEQ ID NO: 762385 - RNA, 19 nt, Homo sapiens
gcucauccauccuugauua

SEQ ID NO: 762386 - RNA, 19 nt, Homo sapiens
gagugaacuucuccuauua

SEQ ID NO: 762387 - RNA, 19 nt, Homo sapiens
ggaggauucuguaaauaaa

SEQ ID NO: 762388 - RNA, 19 nt, Homo sapiens
agaaaggacuagcauauga

SEQ ID NO: 762389 - RNA, 19 nt, Homo sapiens
ugaagcagguccagaacua

SEQ ID NO: 762390 - RNA, 19 nt, Homo sapiens
ccaggucgguauuuacaua

SEQ ID NO: 762391 - RNA, 19 nt, Homo sapiens
ggacaaaguuuccuauucc

SEQ ID NO: 762392 - RNA, 19 nt, Homo sapiens
ugaaagaggcccacaggua

SEQ ID NO: 762393 - RNA, 19 nt, Homo sapiens
cgucagcuauguaauguuu

SEQ ID NO: 762394 - RNA, 19 nt, Homo sapiens
cauccauccuugauuauuu

SEQ ID NO: 762395 - RNA, 19 nt, Homo sapiens
gggacaaaguuuccuauuc

SEQ ID NO: 762396 - RNA, 19 nt, Homo sapiens
gggaggauucuguaaauaa

SEQ ID NO: 762397 - RNA, 19 nt, Homo sapiens
gaauucuccucuaccauug

SEQ ID NO: 762398 - RNA, 19 nt, Homo sapiens
gcauggagguaccagaaug

SEQ ID NO: 762399 - RNA, 19 nt, Homo sapiens
gagggaggcugcaccugaa

SEQ ID NO: 762400 - RNA, 19 nt, Homo sapiens
aaagaaaggacuagcauau

SEQ ID NO: 762401 - RNA, 19 nt, Homo sapiens
guugggagguuuauuaucu

SEQ ID NO: 762402 - RNA, 19 nt, Homo sapiens
aggaagagaugcccaugaa

SEQ ID NO: 762403 - RNA, 19 nt, Homo sapiens
uaaagaaaggacuagcaua

SEQ ID NO: 762404 - RNA, 19 nt, Homo sapiens
ccauuaacuugcuguguga

SEQ ID NO: 762405 - RNA, 19 nt, Homo sapiens
ccaagcugcuggucuacuu

SEQ ID NO: 762406 - RNA, 19 nt, Homo sapiens
guaccagaauggcagaguu

SEQ ID NO: 762407 - RNA, 19 nt, Homo sapiens
uagagauggugcuaaagaa

SEQ ID NO: 762408 - RNA, 19 nt, Homo sapiens
ccuccaagcugcuggucua

SEQ ID NO: 762409 - RNA, 19 nt, Homo sapiens
ccaggaggcugugagcaaa

SEQ ID NO: 762410 - RNA, 19 nt, Homo sapiens
gcagugggaucuggugugu

SEQ ID NO: 762411 - RNA, 19 nt, Homo sapiens
aguuugagcuggcuggaua

SEQ ID NO: 762412 - RNA, 19 nt, Homo sapiens
ccuguucacuucagaguug

SEQ ID NO: 762413 - RNA, 19 nt, Homo sapiens
cauaggaggucccuuucug

SEQ ID NO: 762414 - RNA, 19 nt, Homo sapiens
guucauaggaggucccuuu

SEQ ID NO: 762415 - RNA, 19 nt, Homo sapiens
gcauaugagacuucuggua

SEQ ID NO: 762416 - RNA, 19 nt, Homo sapiens
guacgaccacucagaauuc

SEQ ID NO: 762417 - RNA, 19 nt, Homo sapiens
ggcugcaccugaagcauuu

SEQ ID NO: 762418 - RNA, 19 nt, Homo sapiens
ccucuaccauugcaacuga

SEQ ID NO: 762419 - RNA, 19 nt, Homo sapiens
acaguugacuucccagaau

SEQ ID NO: 762420 - RNA, 19 nt, Homo sapiens
gacccaaggccaugugaaa

SEQ ID NO: 762421 - RNA, 19 nt, Homo sapiens
ugagcuggcuggauacuag

SEQ ID NO: 762422 - RNA, 19 nt, Homo sapiens
ggaagagcccuggauagga

SEQ ID NO: 762423 - RNA, 19 nt, Homo sapiens
guucggcacuagacugcua

SEQ ID NO: 762424 - RNA, 19 nt, Homo sapiens
gccaucacccgcacccuua

SEQ ID NO: 762425 - RNA, 19 nt, Homo sapiens
uggcagaguucgccucaga

SEQ ID NO: 762426 - RNA, 19 nt, Homo sapiens
ggacuagcauaugagacuu

SEQ ID NO: 762427 - RNA, 19 nt, Homo sapiens
gugacgagcugugggaaga

SEQ ID NO: 762428 - RNA, 19 nt, Homo sapiens
agugggaucugguguguga

SEQ ID NO: 762429 - RNA, 19 nt, Homo sapiens
gugaaucguugggagguuu

SEQ ID NO: 762430 - RNA, 19 nt, Homo sapiens
gaagcagguccagaacuaa

SEQ ID NO: 762431 - RNA, 19 nt, Homo sapiens
cuucauaccuagaccuguu

SEQ ID NO: 762432 - RNA, 19 nt, Homo sapiens
ccaacccacuggucucaug

SEQ ID NO: 762433 - RNA, 19 nt, Homo sapiens
ucucccaaauggauaauga

SEQ ID NO: 762434 - RNA, 19 nt, Homo sapiens
gcuaguguccuccgauaug

SEQ ID NO: 762435 - RNA, 19 nt, Homo sapiens
agaauucuccucuaccauu

SEQ ID NO: 762436 - RNA, 19 nt, Homo sapiens
gagccaacauuuuauugaa

SEQ ID NO: 762437 - RNA, 19 nt, Homo sapiens
ggagggacaaaguuuccua

SEQ ID NO: 762438 - RNA, 19 nt, Homo sapiens
gaaaggacuagcauaugag

SEQ ID NO: 762439 - RNA, 19 nt, Homo sapiens
cuagagauggugcuaaaga

SEQ ID NO: 762440 - RNA, 19 nt, Homo sapiens
gaauaaggugcuucugcuu

SEQ ID NO: 762441 - RNA, 19 nt, Homo sapiens
ccaugaagcagguccagaa

SEQ ID NO: 762442 - RNA, 19 nt, Homo sapiens
gaggaagagaugcccauga

SEQ ID NO: 762443 - RNA, 19 nt, Homo sapiens
ugcccaagcuuacuuaugg

SEQ ID NO: 762444 - RNA, 19 nt, Homo sapiens
ggucgguauuuacauaauc

SEQ ID NO: 762445 - RNA, 19 nt, Homo sapiens
gcagggcaaugcaugucau

SEQ ID NO: 762446 - RNA, 19 nt, Homo sapiens
cuaguguccuccgauauga

SEQ ID NO: 762447 - RNA, 19 nt, Homo sapiens
gggcuguggccuuuggaua

SEQ ID NO: 762448 - RNA, 19 nt, Homo sapiens
caagcuggcgugaaucguu

SEQ ID NO: 762449 - RNA, 19 nt, Homo sapiens
ucagaauucuccucuacca

SEQ ID NO: 762450 - RNA, 19 nt, Homo sapiens
caugggagccaacauuuua

SEQ ID NO: 762451 - RNA, 19 nt, Homo sapiens
ggcaugggagccaacauuu

SEQ ID NO: 762452 - RNA, 19 nt, Homo sapiens
caacuucagccaucaggau

SEQ ID NO: 762453 - RNA, 19 nt, Homo sapiens
gagauggugcuaaagaaag

SEQ ID NO: 762454 - RNA, 19 nt, Homo sapiens
guucaucucccaaauggau

SEQ ID NO: 762455 - RNA, 19 nt, Homo sapiens
cugccuaccuguucacuuc

SEQ ID NO: 762456 - RNA, 19 nt, Homo sapiens
cugcuaguguccuccgaua

SEQ ID NO: 762457 - RNA, 19 nt, Homo sapiens
ucugcacgcuggcuucuga

SEQ ID NO: 762458 - RNA, 19 nt, Homo sapiens
uauguaauguuugccauca

SEQ ID NO: 762459 - RNA, 19 nt, Homo sapiens
ggcaugcuguccacugugu

SEQ ID NO: 762460 - RNA, 19 nt, Homo sapiens
acagagcugcguccacuuu

SEQ ID NO: 762461 - RNA, 19 nt, Homo sapiens
guggggagcuggaggauga

SEQ ID NO: 762462 - RNA, 19 nt, Homo sapiens
agucccaggucgguauuua

SEQ ID NO: 762463 - RNA, 19 nt, Homo sapiens
gggaagagcccuggauagg

SEQ ID NO: 762464 - RNA, 19 nt, Homo sapiens
ugagacuucugguaccaau

SEQ ID NO: 762465 - RNA, 19 nt, Homo sapiens
gugggaagagcccuggaua

SEQ ID NO: 762466 - RNA, 19 nt, Homo sapiens
gcuguggccuuuggauauc

SEQ ID NO: 762467 - RNA, 19 nt, Homo sapiens
gagcugcguccacuuucuu

SEQ ID NO: 762468 - RNA, 19 nt, Homo sapiens
ggacguggagagaaagagu

SEQ ID NO: 762469 - RNA, 19 nt, Homo sapiens
gagaggggcugauguucau

SEQ ID NO: 762470 - RNA, 19 nt, Homo sapiens
agagauggugcuaaagaaa

SEQ ID NO: 762471 - RNA, 19 nt, Homo sapiens
caguugacuucccagaaug

SEQ ID NO: 762472 - RNA, 19 nt, Homo sapiens
ccacagugcccugcucuca

SEQ ID NO: 762473 - RNA, 19 nt, Homo sapiens
ccaaggccaugugaaagag

SEQ ID NO: 762474 - RNA, 19 nt, Homo sapiens
gcaggucgaggccuuccuu

SEQ ID NO: 762475 - RNA, 19 nt, Homo sapiens
gccaggaggcugugagcaa

SEQ ID NO: 762476 - RNA, 19 nt, Homo sapiens
acucagaauucuccucuac

SEQ ID NO: 762477 - RNA, 19 nt, Homo sapiens
ucuaggaacaguugacuuc

SEQ ID NO: 762478 - RNA, 19 nt, Homo sapiens
uugauuauuuggcuucuag

SEQ ID NO: 762479 - RNA, 19 nt, Homo sapiens
ucuauguggugggcaguuu

SEQ ID NO: 762480 - RNA, 19 nt, Homo sapiens
ccacggcuccgacacaucu

SEQ ID NO: 762481 - RNA, 19 nt, Homo sapiens
gcagaguucgccucagaag

SEQ ID NO: 762482 - RNA, 19 nt, Homo sapiens
ggggaggauucuguaaaua

SEQ ID NO: 762483 - RNA, 19 nt, Homo sapiens
guagagaugucuuugauuu

SEQ ID NO: 762484 - RNA, 19 nt, Homo sapiens
ggucaagcauucuaucuua

SEQ ID NO: 762485 - RNA, 19 nt, Homo sapiens
guagucaacuccucacuua

SEQ ID NO: 762486 - RNA, 19 nt, Homo sapiens
caacauauuucucugcuuu

SEQ ID NO: 762487 - RNA, 19 nt, Homo sapiens
gaacacagguaaucuaagg

SEQ ID NO: 762488 - RNA, 19 nt, Homo sapiens
gaauuaaaguguuguggau

SEQ ID NO: 762489 - RNA, 19 nt, Homo sapiens
ugggaaggcuggcuaauuu

SEQ ID NO: 762490 - RNA, 19 nt, Homo sapiens
gcuggucucuggacacaua

SEQ ID NO: 762491 - RNA, 19 nt, Homo sapiens
gaagaucauuggguucaaa

SEQ ID NO: 762492 - RNA, 19 nt, Homo sapiens
ccagaucucuuaagacugu

SEQ ID NO: 762493 - RNA, 19 nt, Homo sapiens
gaaaugcgacugaaaucuu

SEQ ID NO: 762494 - RNA, 19 nt, Homo sapiens
ggucugggcucuuggaaau

SEQ ID NO: 762495 - RNA, 19 nt, Homo sapiens
gcaauagacugagaugcaa

SEQ ID NO: 762496 - RNA, 19 nt, Homo sapiens
gaggcaaacuaugaauuaa

SEQ ID NO: 762497 - RNA, 19 nt, Homo sapiens
ugaggcaaacuaugaauua

SEQ ID NO: 762498 - RNA, 19 nt, Homo sapiens
ggucaaagcaauacaccua

SEQ ID NO: 762499 - RNA, 19 nt, Homo sapiens
gagaagauguuuuaccaaa

SEQ ID NO: 762500 - RNA, 19 nt, Homo sapiens
cugaaucucuguaagguuu

SEQ ID NO: 762501 - RNA, 19 nt, Homo sapiens
acacagaugcuaauucgua

SEQ ID NO: 762502 - RNA, 19 nt, Homo sapiens
gaacgaggccuugggaaau

SEQ ID NO: 762503 - RNA, 19 nt, Homo sapiens
guucaaaugcugaugagua

SEQ ID NO: 762504 - RNA, 19 nt, Homo sapiens
gcguugagcugugccuaua

SEQ ID NO: 762505 - RNA, 19 nt, Homo sapiens
gaacuguagagaugucuuu

SEQ ID NO: 762506 - RNA, 19 nt, Homo sapiens
gaacagccugagagaagua

SEQ ID NO: 762507 - RNA, 19 nt, Homo sapiens
gggcauguccaauguauga

SEQ ID NO: 762508 - RNA, 19 nt, Homo sapiens
ggcaaacuaugaauuaaag

SEQ ID NO: 762509 - RNA, 19 nt, Homo sapiens
ggaacgaggccuugggaaa

SEQ ID NO: 762510 - RNA, 19 nt, Homo sapiens
uaccaaagccucuagugua

SEQ ID NO: 762511 - RNA, 19 nt, Homo sapiens
gcuguaauguguaguucaa

SEQ ID NO: 762512 - RNA, 19 nt, Homo sapiens
gaaaugguccugcuuuggu

SEQ ID NO: 762513 - RNA, 19 nt, Homo sapiens
ggaaucacaugguuguuuu

SEQ ID NO: 762514 - RNA, 19 nt, Homo sapiens
cuacugagauuacagaacu

SEQ ID NO: 762515 - RNA, 19 nt, Homo sapiens
caagcauucuaucuuauca

SEQ ID NO: 762516 - RNA, 19 nt, Homo sapiens
uguagaaugugaugucaga

SEQ ID NO: 762517 - RNA, 19 nt, Homo sapiens
ucagggccauuucagguuu

SEQ ID NO: 762518 - RNA, 19 nt, Homo sapiens
caggugaguugaaggaaug

SEQ ID NO: 762519 - RNA, 19 nt, Homo sapiens
ggacgauucuccucacacu

SEQ ID NO: 762520 - RNA, 19 nt, Homo sapiens
gcaacaguuugucuucaca

SEQ ID NO: 762521 - RNA, 19 nt, Homo sapiens
aggcucaacucacaagaaa

SEQ ID NO: 762522 - RNA, 19 nt, Homo sapiens
ggagugcaauguagucaac

SEQ ID NO: 762523 - RNA, 19 nt, Homo sapiens
gaaccaggagguccaagga

SEQ ID NO: 762524 - RNA, 19 nt, Homo sapiens
gaacccuccuccugcuguu

SEQ ID NO: 762525 - RNA, 19 nt, Homo sapiens
gauucaggcucaacucaca

SEQ ID NO: 762526 - RNA, 19 nt, Homo sapiens
ccauuuauguacccaccua

SEQ ID NO: 762527 - RNA, 19 nt, Homo sapiens
gcugaugaguaggacauuu

SEQ ID NO: 762528 - RNA, 19 nt, Homo sapiens
uuggucaccuaaagaaaua

SEQ ID NO: 762529 - RNA, 19 nt, Homo sapiens
ggaacagccugagagaagu

SEQ ID NO: 762530 - RNA, 19 nt, Homo sapiens
gcccugaggcaaacuauga

SEQ ID NO: 762531 - RNA, 19 nt, Homo sapiens
ucuuaagacuguacuauag

SEQ ID NO: 762532 - RNA, 19 nt, Homo sapiens
ccacuguguuugcuccauu

SEQ ID NO: 762533 - RNA, 19 nt, Homo sapiens
acgauucuccucacacuua

SEQ ID NO: 762534 - RNA, 19 nt, Homo sapiens
ccucaugugucccaggaaa

SEQ ID NO: 762535 - RNA, 19 nt, Homo sapiens
gguaaucuaaggagaguug

SEQ ID NO: 762536 - RNA, 19 nt, Homo sapiens
gagugugggucaaagcaau

SEQ ID NO: 762537 - RNA, 19 nt, Homo sapiens
uuacacagaugcuaauucg

SEQ ID NO: 762538 - RNA, 19 nt, Homo sapiens
ggaaaaggcaauagacuga

SEQ ID NO: 762539 - RNA, 19 nt, Homo sapiens
ggaaggcuggcuaauuuca

SEQ ID NO: 762540 - RNA, 19 nt, Homo sapiens
guugagcugugccuauaga

SEQ ID NO: 762541 - RNA, 19 nt, Homo sapiens
gagagaagauguuuuacca

SEQ ID NO: 762542 - RNA, 19 nt, Homo sapiens
ccuaaccacuagaccugua

SEQ ID NO: 762543 - RNA, 19 nt, Homo sapiens
ggaagaucauuggguucaa

SEQ ID NO: 762544 - RNA, 19 nt, Homo sapiens
gggcagauuacaauuacaa

SEQ ID NO: 762545 - RNA, 19 nt, Homo sapiens
gcaagaugcaacaguuugu

SEQ ID NO: 762546 - RNA, 19 nt, Homo sapiens
gagggagucaguacuguug

SEQ ID NO: 762547 - RNA, 19 nt, Homo sapiens
caaaugcugaugaguagga

SEQ ID NO: 762548 - RNA, 19 nt, Homo sapiens
aaaugcgacugaaaucuuc

SEQ ID NO: 762549 - RNA, 19 nt, Homo sapiens
gaccugggcagauuacaau

SEQ ID NO: 762550 - RNA, 19 nt, Homo sapiens
caccaaugcugcugaggau

SEQ ID NO: 762551 - RNA, 19 nt, Homo sapiens
gaaucucuguaagguuuau

SEQ ID NO: 762552 - RNA, 19 nt, Homo sapiens
ucaaagcaauacaccuaca

SEQ ID NO: 762553 - RNA, 19 nt, Homo sapiens
cugaugaguaggacauuua

SEQ ID NO: 762554 - RNA, 19 nt, Homo sapiens
uguaauguguaguucaaug

SEQ ID NO: 762555 - RNA, 19 nt, Homo sapiens
ggaaauuaccuggaaaugc

SEQ ID NO: 762556 - RNA, 19 nt, Homo sapiens
caagugaugggcagaagga

SEQ ID NO: 762557 - RNA, 19 nt, Homo sapiens
ggaaggagugcaauguagu

SEQ ID NO: 762558 - RNA, 19 nt, Homo sapiens
guaguucaaugggcacuca

SEQ ID NO: 762559 - RNA, 19 nt, Homo sapiens
gucaagcauucuaucuuau

SEQ ID NO: 762560 - RNA, 19 nt, Homo sapiens
ugaguuacacagaugcuaa

SEQ ID NO: 762561 - RNA, 19 nt, Homo sapiens
ggcaauagacugagaugca

SEQ ID NO: 762562 - RNA, 19 nt, Homo sapiens
uguguuugcuccauuuaug

SEQ ID NO: 762563 - RNA, 19 nt, Homo sapiens
uggaaggagugcaauguag

SEQ ID NO: 762564 - RNA, 19 nt, Homo sapiens
gugccaagccuguggauca

SEQ ID NO: 762565 - RNA, 19 nt, Homo sapiens
caccauguccugaaagaug

SEQ ID NO: 762566 - RNA, 19 nt, Homo sapiens
gcacuuggaaucacauggu

SEQ ID NO: 762567 - RNA, 19 nt, Homo sapiens
gaaggagugcaauguaguc

SEQ ID NO: 762568 - RNA, 19 nt, Homo sapiens
cacguguucuuccuacuga

SEQ ID NO: 762569 - RNA, 19 nt, Homo sapiens
ccugggcagauuacaauua

SEQ ID NO: 762570 - RNA, 19 nt, Homo sapiens
gaaggagagaaggauguuu

SEQ ID NO: 762571 - RNA, 19 nt, Homo sapiens
ucaacucacaagaaacuuu

SEQ ID NO: 762572 - RNA, 19 nt, Homo sapiens
gcucaacucacaagaaacu

SEQ ID NO: 762573 - RNA, 19 nt, Homo sapiens
gggagucaguacuguugga

SEQ ID NO: 762574 - RNA, 19 nt, Homo sapiens
ggagggagucaguacuguu

SEQ ID NO: 762575 - RNA, 19 nt, Homo sapiens
cgacaggugaguugaagga

SEQ ID NO: 762576 - RNA, 19 nt, Homo sapiens
gcagcuguaauguguaguu

SEQ ID NO: 762577 - RNA, 19 nt, Homo sapiens
gaacuccuccuacccucau

SEQ ID NO: 762578 - RNA, 19 nt, Homo sapiens
ggaaaugcgacugaaaucu

SEQ ID NO: 762579 - RNA, 19 nt, Homo sapiens
gauggaaggagugcaaugu

SEQ ID NO: 762580 - RNA, 19 nt, Homo sapiens
ggaaaacccaccuauggaa

SEQ ID NO: 762581 - RNA, 19 nt, Homo sapiens
gcaccuccuucgcugucaa

SEQ ID NO: 762582 - RNA, 19 nt, Homo sapiens
cuugggaaauuaccuggaa

SEQ ID NO: 762583 - RNA, 19 nt, Homo sapiens
gaacagaauuuaagaagug

SEQ ID NO: 762584 - RNA, 19 nt, Homo sapiens
ucagauaaguuuaggguua

SEQ ID NO: 762585 - RNA, 19 nt, Homo sapiens
ggaagaggauugagcuuug

SEQ ID NO: 762586 - RNA, 19 nt, Homo sapiens
agaacgggcugcuaugaaa

SEQ ID NO: 762587 - RNA, 19 nt, Homo sapiens
uagcagagcugaucuuacu

SEQ ID NO: 762588 - RNA, 19 nt, Homo sapiens
ucaggaauauuaucucuca

SEQ ID NO: 762589 - RNA, 19 nt, Homo sapiens
cagauaaguuuaggguuaa

SEQ ID NO: 762590 - RNA, 19 nt, Homo sapiens
ugauguuccucuucaauuu

SEQ ID NO: 762591 - RNA, 19 nt, Homo sapiens
ucagagagaacagaauuua

SEQ ID NO: 762592 - RNA, 19 nt, Homo sapiens
gaagaacgccuggaacauc

SEQ ID NO: 762593 - RNA, 19 nt, Homo sapiens
gaagaggauugagcuuugu

SEQ ID NO: 762594 - RNA, 19 nt, Homo sapiens
ugccugcgcucuccagaua

SEQ ID NO: 762595 - RNA, 19 nt, Homo sapiens
gagagaacagaauuuaaga

SEQ ID NO: 762596 - RNA, 19 nt, Homo sapiens
uaagaaguacgacgcauga

SEQ ID NO: 762597 - RNA, 19 nt, Homo sapiens
gagaacagaauuuaagaag

SEQ ID NO: 762598 - RNA, 19 nt, Homo sapiens
ggagaacgggcugcuauga

SEQ ID NO: 762599 - RNA, 19 nt, Homo sapiens
gaacgagaacgccaagaag

SEQ ID NO: 762600 - RNA, 19 nt, Homo sapiens
gagaacgggcugcuaugaa

SEQ ID NO: 762601 - RNA, 19 nt, Homo sapiens
gggaagaggauugagcuuu

SEQ ID NO: 762602 - RNA, 19 nt, Homo sapiens
ccaagaaggaccugaagga

SEQ ID NO: 762603 - RNA, 19 nt, Homo sapiens
ccaggaaguucagagagaa

SEQ ID NO: 762604 - RNA, 19 nt, Homo sapiens
aggaaggccugcugcugua

SEQ ID NO: 762605 - RNA, 19 nt, Homo sapiens
gcagagcugaucuuacuca

SEQ ID NO: 762606 - RNA, 19 nt, Homo sapiens
ccaccggacugguaagaag

SEQ ID NO: 762607 - RNA, 19 nt, Homo sapiens
aagaacgccuggaacauca

SEQ ID NO: 762608 - RNA, 19 nt, Homo sapiens
caagaaggaccugaaggaa

SEQ ID NO: 762609 - RNA, 19 nt, Homo sapiens
uggacaaggugaacgagaa

SEQ ID NO: 762610 - RNA, 19 nt, Homo sapiens
gcaacgccaccacgccuuu

SEQ ID NO: 762611 - RNA, 19 nt, Homo sapiens
cagagagaacagaauuuaa

SEQ ID NO: 762612 - RNA, 19 nt, Homo sapiens
ggacugguaagaaguacga

SEQ ID NO: 762613 - RNA, 19 nt, Homo sapiens
ugaacgagaacgccaagaa

SEQ ID NO: 762614 - RNA, 19 nt, Homo sapiens
gauguuccucuucaauuug

SEQ ID NO: 762615 - RNA, 19 nt, Homo sapiens
uuacucauccucuucuuug

SEQ ID NO: 762616 - RNA, 19 nt, Homo sapiens
gaucuuacucauccucuuc

SEQ ID NO: 762617 - RNA, 19 nt, Homo sapiens
caaccuggucauugccaua

SEQ ID NO: 762618 - RNA, 19 nt, Homo sapiens
gugguucgaugacaauaag

SEQ ID NO: 762619 - RNA, 19 nt, Homo sapiens
caucugcauaugcguauuu

SEQ ID NO: 762620 - RNA, 19 nt, Homo sapiens
agagagaacagaauuuaag

SEQ ID NO: 762621 - RNA, 19 nt, Homo sapiens
gaauuuaagaagugcaaca

SEQ ID NO: 762622 - RNA, 19 nt, Homo sapiens
cagccaaccuggucauugc

SEQ ID NO: 762623 - RNA, 19 nt, Homo sapiens
uccaggaaguucagagaga

SEQ ID NO: 762624 - RNA, 19 nt, Homo sapiens
ccucuucuuugucuacaug

SEQ ID NO: 762625 - RNA, 19 nt, Homo sapiens
gcagccaaccuggucauug

SEQ ID NO: 762626 - RNA, 19 nt, Homo sapiens
gccauaggcaccauuguca

SEQ ID NO: 762627 - RNA, 19 nt, Homo sapiens
ccuagcagagcugaucuua

SEQ ID NO: 762628 - RNA, 19 nt, Homo sapiens
gaagaugugguucgaugac

SEQ ID NO: 762629 - RNA, 19 nt, Homo sapiens
gcgaugcuguggugucacu

SEQ ID NO: 762630 - RNA, 19 nt, Homo sapiens
cauaggcaccauugucaug

SEQ ID NO: 762631 - RNA, 19 nt, Homo sapiens
cagcuucccuucguugucu

SEQ ID NO: 762632 - RNA, 19 nt, Homo sapiens
cggaauauccuggaaccuu

SEQ ID NO: 762633 - RNA, 19 nt, Homo sapiens
guggagaacgggcugcuau

SEQ ID NO: 762634 - RNA, 19 nt, Homo sapiens
ccugcgcucuccagauaug

SEQ ID NO: 762635 - RNA, 19 nt, Homo sapiens
gaugugguucgaugacaau

SEQ ID NO: 762636 - RNA, 19 nt, Homo sapiens
ccuggaaccuucuuuuguu

SEQ ID NO: 762637 - RNA, 19 nt, Homo sapiens
cacauccaccggacuggua

SEQ ID NO: 762638 - RNA, 19 nt, Homo sapiens
ggaaccuucuuuuguuugu

SEQ ID NO: 762639 - RNA, 19 nt, Homo sapiens
agaugugguucgaugacaa

SEQ ID NO: 762640 - RNA, 19 nt, Homo sapiens
gaacgccuggaacaucauc

SEQ ID NO: 762641 - RNA, 19 nt, Homo sapiens
ggacaaggugaacgagaac

SEQ ID NO: 762642 - RNA, 19 nt, Homo sapiens
ugaagaugugguucgauga

SEQ ID NO: 762643 - RNA, 19 nt, Homo sapiens
gaugcuguggugucacuga

SEQ ID NO: 762644 - RNA, 19 nt, Homo sapiens
gaacgggcugcuaugaaaa

SEQ ID NO: 762645 - RNA, 19 nt, Homo sapiens
caugauguuccucuucaau

SEQ ID NO: 762646 - RNA, 19 nt, Homo sapiens
ggacaaugaugcucaccua

SEQ ID NO: 762647 - RNA, 19 nt, Homo sapiens
gcgaguggcucaacaaguu

SEQ ID NO: 762648 - RNA, 19 nt, Homo sapiens
caagaaagcccagguauug

SEQ ID NO: 762649 - RNA, 19 nt, Homo sapiens
ccaagacucugugacguua

SEQ ID NO: 762650 - RNA, 19 nt, Homo sapiens
ugaagacucuggacucauu

SEQ ID NO: 762651 - RNA, 19 nt, Homo sapiens
gggaguagcugcugcuuca

SEQ ID NO: 762652 - RNA, 19 nt, Homo sapiens
ucugaaagcuguuccuauu

SEQ ID NO: 762653 - RNA, 19 nt, Homo sapiens
uaggagaggugaccaaaga

SEQ ID NO: 762654 - RNA, 19 nt, Homo sapiens
cagaagcccuggccaguga

SEQ ID NO: 762655 - RNA, 19 nt, Homo sapiens
ccucacagcuuggccauuu

SEQ ID NO: 762656 - RNA, 19 nt, Homo sapiens
guuaaagggugacaacaug

SEQ ID NO: 762657 - RNA, 19 nt, Homo sapiens
ggaaccggaugaugaaaca

SEQ ID NO: 762658 - RNA, 19 nt, Homo sapiens
gagcugaugcuaaagaaga

SEQ ID NO: 762659 - RNA, 19 nt, Homo sapiens
ugucugugcugucuaguuu

SEQ ID NO: 762660 - RNA, 19 nt, Homo sapiens
gggaacuccugcuacauga

SEQ ID NO: 762661 - RNA, 19 nt, Homo sapiens
gaggugauguacucauuca

SEQ ID NO: 762662 - RNA, 19 nt, Homo sapiens
caacaaaggaugcgaaugc

SEQ ID NO: 762663 - RNA, 19 nt, Homo sapiens
gaacgccgagggcuacgua

SEQ ID NO: 762664 - RNA, 19 nt, Homo sapiens
ggagugaaguacugcaaag

SEQ ID NO: 762665 - RNA, 19 nt, Homo sapiens
ccagggaaccggaugauga

SEQ ID NO: 762666 - RNA, 19 nt, Homo sapiens
gaaaauauaugcacuucag

SEQ ID NO: 762667 - RNA, 19 nt, Homo sapiens
cgucguacgugcucaagaa

SEQ ID NO: 762668 - RNA, 19 nt, Homo sapiens
cgccagagccggacaauga

SEQ ID NO: 762669 - RNA, 19 nt, Homo sapiens
ccacaaauaccacuacauc

SEQ ID NO: 762670 - RNA, 19 nt, Homo sapiens
ggaacggagugaaguacug

SEQ ID NO: 762671 - RNA, 19 nt, Homo sapiens
caguaacgcugcaacuaga

SEQ ID NO: 762672 - RNA, 19 nt, Homo sapiens
gccagaacgugauuaaugg

SEQ ID NO: 762673 - RNA, 19 nt, Homo sapiens
ggacuuaucacugcccauu

SEQ ID NO: 762674 - RNA, 19 nt, Homo sapiens
ucucugaggucuggcauaa

SEQ ID NO: 762675 - RNA, 19 nt, Homo sapiens
gacguuaauuugggucuuu

SEQ ID NO: 762676 - RNA, 19 nt, Homo sapiens
gaaacgaccaagacucugu

SEQ ID NO: 762677 - RNA, 19 nt, Homo sapiens
gcaggacacccaagaguuc

SEQ ID NO: 762678 - RNA, 19 nt, Homo sapiens
ucugaggucuggcauaaga

SEQ ID NO: 762679 - RNA, 19 nt, Homo sapiens
uaauuugccucgaaguuca

SEQ ID NO: 762680 - RNA, 19 nt, Homo sapiens
ucaacaaguucaacaccuu

SEQ ID NO: 762681 - RNA, 19 nt, Homo sapiens
gugauguacucauucaaga

SEQ ID NO: 762682 - RNA, 19 nt, Homo sapiens
gaugaaggaccgcaaguuc

SEQ ID NO: 762683 - RNA, 19 nt, Homo sapiens
gggcuccucuuccaaguuc

SEQ ID NO: 762684 - RNA, 19 nt, Homo sapiens
gaccacagcaccauucaug

SEQ ID NO: 762685 - RNA, 19 nt, Homo sapiens
ggaggagguuggauuucug

SEQ ID NO: 762686 - RNA, 19 nt, Homo sapiens
caucccagaucaccaccua

SEQ ID NO: 762687 - RNA, 19 nt, Homo sapiens
ugacucaguucuucuugga

SEQ ID NO: 762688 - RNA, 19 nt, Homo sapiens
guucagcaguucaucuuca

SEQ ID NO: 762689 - RNA, 19 nt, Homo sapiens
uaaagggugacaacaugua

SEQ ID NO: 762690 - RNA, 19 nt, Homo sapiens
cgucaucucagacaucuuu

SEQ ID NO: 762691 - RNA, 19 nt, Homo sapiens
ggacgaggacgcugaugug

SEQ ID NO: 762692 - RNA, 19 nt, Homo sapiens
agaaggagcggaugaagga

SEQ ID NO: 762693 - RNA, 19 nt, Homo sapiens
gaucgacaccuucaucaag

SEQ ID NO: 762694 - RNA, 19 nt, Homo sapiens
cuuugccgcugaugaguua

SEQ ID NO: 762695 - RNA, 19 nt, Homo sapiens
gaccggagcccaucagaag

SEQ ID NO: 762696 - RNA, 19 nt, Homo sapiens
ugaaagcuguuccuauugc

SEQ ID NO: 762697 - RNA, 19 nt, Homo sapiens
gaaacagggauaccucaca

SEQ ID NO: 762698 - RNA, 19 nt, Homo sapiens
ucaagaaagcccagguauu

SEQ ID NO: 762699 - RNA, 19 nt, Homo sapiens
agaggaugaugaccugaaa

SEQ ID NO: 762700 - RNA, 19 nt, Homo sapiens
gcucaagaaagcccaggua

SEQ ID NO: 762701 - RNA, 19 nt, Homo sapiens
ccaggaggagguuggauuu

SEQ ID NO: 762702 - RNA, 19 nt, Homo sapiens
cagaaaaguugguuugguu

SEQ ID NO: 762703 - RNA, 19 nt, Homo sapiens
guaaagaggcagaaaaguu

SEQ ID NO: 762704 - RNA, 19 nt, Homo sapiens
gaguacauccgacgguuug

SEQ ID NO: 762705 - RNA, 19 nt, Homo sapiens
guacaaacucggagcaagu

SEQ ID NO: 762706 - RNA, 19 nt, Homo sapiens
ugaaggagagucugaguca

SEQ ID NO: 762707 - RNA, 19 nt, Homo sapiens
ccagaggccuccacucacu

SEQ ID NO: 762708 - RNA, 19 nt, Homo sapiens
gagugcacaucccagauca

SEQ ID NO: 762709 - RNA, 19 nt, Homo sapiens
ggaguacauccgacgguuu

SEQ ID NO: 762710 - RNA, 19 nt, Homo sapiens
ugaagaaccucgggaacuc

SEQ ID NO: 762711 - RNA, 19 nt, Homo sapiens
guaauuugccucgaaguuc

SEQ ID NO: 762712 - RNA, 19 nt, Homo sapiens
gcugugagcgguguaagaa

SEQ ID NO: 762713 - RNA, 19 nt, Homo sapiens
gugcagcgcucagguggau

SEQ ID NO: 762714 - RNA, 19 nt, Homo sapiens
uggauuggcuguaauuugc

SEQ ID NO: 762715 - RNA, 19 nt, Homo sapiens
acaaauaccacuacaucga

SEQ ID NO: 762716 - RNA, 19 nt, Homo sapiens
cgagugacacggaugagaa

SEQ ID NO: 762717 - RNA, 19 nt, Homo sapiens
ccacacuacugcgucuuug

SEQ ID NO: 762718 - RNA, 19 nt, Homo sapiens
gcacagcaaggcaccaaag

SEQ ID NO: 762719 - RNA, 19 nt, Homo sapiens
ccaggaaggcucugaaguc

SEQ ID NO: 762720 - RNA, 19 nt, Homo sapiens
ccacaacuguccucuugcu

SEQ ID NO: 762721 - RNA, 19 nt, Homo sapiens
caaaggaagcggccauguc

SEQ ID NO: 762722 - RNA, 19 nt, Homo sapiens
cgaguuugaugaccaguac

SEQ ID NO: 762723 - RNA, 19 nt, Homo sapiens
gauguacucauucaagauc

SEQ ID NO: 762724 - RNA, 19 nt, Homo sapiens
cugccuugcugccuucuuu

SEQ ID NO: 762725 - RNA, 19 nt, Homo sapiens
cuauugcuguggcugauga

SEQ ID NO: 762726 - RNA, 19 nt, Homo sapiens
gagugacacggaugagaaa

SEQ ID NO: 762727 - RNA, 19 nt, Homo sapiens
gaaagcuguuccuauugcu

SEQ ID NO: 762728 - RNA, 19 nt, Homo sapiens
gaaguucagcaguucaucu

SEQ ID NO: 762729 - RNA, 19 nt, Homo sapiens
gagaucgacaccuucauca

SEQ ID NO: 762730 - RNA, 19 nt, Homo sapiens
ggagugcacaucccagauc

SEQ ID NO: 762731 - RNA, 19 nt, Homo sapiens
uauguuggcugcggagaau

SEQ ID NO: 762732 - RNA, 19 nt, Homo sapiens
ggaugaaggaccgcaaguu

SEQ ID NO: 762733 - RNA, 19 nt, Homo sapiens
auaagaaacggccaagcua

SEQ ID NO: 762734 - RNA, 19 nt, Homo sapiens
gaacuccugcuacaugaac

SEQ ID NO: 762735 - RNA, 19 nt, Homo sapiens
ccaugucugugcugucuag

SEQ ID NO: 762736 - RNA, 19 nt, Homo sapiens
ccgagcugaugcuaaagaa

SEQ ID NO: 762737 - RNA, 19 nt, Homo sapiens
uaaagaggcagaaaaguug

SEQ ID NO: 762738 - RNA, 19 nt, Homo sapiens
ggcgucaucuacugcauca

SEQ ID NO: 762739 - RNA, 19 nt, Homo sapiens
ugccagaacgugauuaaug

SEQ ID NO: 762740 - RNA, 19 nt, Homo sapiens
ggcacgaggugauguacuc

SEQ ID NO: 762741 - RNA, 19 nt, Homo sapiens
ucagccaucuaccagaaug

SEQ ID NO: 762742 - RNA, 19 nt, Homo sapiens
gaaagcccagguauugagu

SEQ ID NO: 762743 - RNA, 19 nt, Homo sapiens
ggccuggugcgcacagaua

SEQ ID NO: 762744 - RNA, 19 nt, Homo sapiens
gcagguggugguggaaauu

SEQ ID NO: 762745 - RNA, 19 nt, Homo sapiens
ccucgaaguucagcaguuc

SEQ ID NO: 762746 - RNA, 19 nt, Homo sapiens
ccaagaagauggcaaaguc

SEQ ID NO: 762747 - RNA, 19 nt, Homo sapiens
ggcaaagucuacaucaaca

SEQ ID NO: 762748 - RNA, 19 nt, Homo sapiens
cacauccucuuccugcuuu

SEQ ID NO: 762749 - RNA, 19 nt, Homo sapiens
caaagucuacaucaacaug

SEQ ID NO: 762750 - RNA, 19 nt, Homo sapiens
gcacuucaggcucuuguuc

SEQ ID NO: 762751 - RNA, 19 nt, Homo sapiens
gaagauggcaaagucuaca

SEQ ID NO: 762752 - RNA, 19 nt, Homo sapiens
gacuacuacuacuaaauuc

SEQ ID NO: 762753 - RNA, 19 nt, Homo sapiens
cagcuuggaccuuugacuu

SEQ ID NO: 762754 - RNA, 19 nt, Homo sapiens
uggcaucgcugcucaucgu

SEQ ID NO: 762755 - RNA, 19 nt, Homo sapiens
aagaagauggcaaagucua

SEQ ID NO: 762756 - RNA, 19 nt, Homo sapiens
gcaaagucuacaucaacau

SEQ ID NO: 762757 - RNA, 19 nt, Homo sapiens
gcuuggaccuuugacuucu

SEQ ID NO: 762758 - RNA, 19 nt, Homo sapiens
ucacauccucuuccugcuu

SEQ ID NO: 762759 - RNA, 19 nt, Homo sapiens
gcaggugacauucguguua

SEQ ID NO: 762760 - RNA, 19 nt, Homo sapiens
agacagggcuggacaagga

SEQ ID NO: 762761 - RNA, 19 nt, Homo sapiens
caaugaugcuuucaaacuu

SEQ ID NO: 762762 - RNA, 19 nt, Homo sapiens
acaggacccucaacaaauu

SEQ ID NO: 762763 - RNA, 19 nt, Homo sapiens
gaacacaggacccucaaca

SEQ ID NO: 762764 - RNA, 19 nt, Homo sapiens
guccaggaguguagaauau

SEQ ID NO: 762765 - RNA, 19 nt, Homo sapiens
gggagaagcaggucuagga

SEQ ID NO: 762766 - RNA, 19 nt, Homo sapiens
acacaggacccucaacaaa

SEQ ID NO: 762767 - RNA, 19 nt, Homo sapiens
gggcugcucucuccacauc

SEQ ID NO: 762768 - RNA, 19 nt, Homo sapiens
gugcagaccaccacagauu

SEQ ID NO: 762769 - RNA, 19 nt, Homo sapiens
caaagggucagcagggaaa

SEQ ID NO: 762770 - RNA, 19 nt, Homo sapiens
gguccaggaguguagaaua

SEQ ID NO: 762771 - RNA, 19 nt, Homo sapiens
ucuagaagcaggcagaauu

SEQ ID NO: 762772 - RNA, 19 nt, Homo sapiens
gugaacagaccucagagaa

SEQ ID NO: 762773 - RNA, 19 nt, Homo sapiens
ggaagcagagagcagaaga

SEQ ID NO: 762774 - RNA, 19 nt, Homo sapiens
ucuccgaugugacaagauu

SEQ ID NO: 762775 - RNA, 19 nt, Homo sapiens
gaagcagagagcagaagaa

SEQ ID NO: 762776 - RNA, 19 nt, Homo sapiens
gcugggaggagacuacauu

SEQ ID NO: 762777 - RNA, 19 nt, Homo sapiens
gcagagagcagaagaaaag

SEQ ID NO: 762778 - RNA, 19 nt, Homo sapiens
agacuuucaugaucccauu

SEQ ID NO: 762779 - RNA, 19 nt, Homo sapiens
ucaaugaugcuuucaaacu

SEQ ID NO: 762780 - RNA, 19 nt, Homo sapiens
gugugucgauucaaugaug

SEQ ID NO: 762781 - RNA, 19 nt, Homo sapiens
ccaagggugagaaccagua

SEQ ID NO: 762782 - RNA, 19 nt, Homo sapiens
gaagcgaagcucagaucug

SEQ ID NO: 762783 - RNA, 19 nt, Homo sapiens
gagugugucgauucaauga

SEQ ID NO: 762784 - RNA, 19 nt, Homo sapiens
ucaaggcccugugcugcaa

SEQ ID NO: 762785 - RNA, 19 nt, Homo sapiens
cacaggacccucaacaaau

SEQ ID NO: 762786 - RNA, 19 nt, Homo sapiens
ggacuccccugcaccuuug

SEQ ID NO: 762787 - RNA, 19 nt, Homo sapiens
ggaggagacuacauuuugu

SEQ ID NO: 762788 - RNA, 19 nt, Homo sapiens
cuagaagcaggcagaauug

SEQ ID NO: 762789 - RNA, 19 nt, Homo sapiens
ggcccagcgugaccagaaa

SEQ ID NO: 762790 - RNA, 19 nt, Homo sapiens
cacaguggcaggugacauu

SEQ ID NO: 762791 - RNA, 19 nt, Homo sapiens
ucgauucaaugaugcuuuc

SEQ ID NO: 762792 - RNA, 19 nt, Homo sapiens
ccucagguccucccacgaa

SEQ ID NO: 762793 - RNA, 19 nt, Homo sapiens
cagugacccuggagaaucu

SEQ ID NO: 762794 - RNA, 19 nt, Homo sapiens
cagauucuccgaugugaca

SEQ ID NO: 762795 - RNA, 19 nt, Homo sapiens
cacccuggcucccuguuca

SEQ ID NO: 762796 - RNA, 19 nt, Homo sapiens
aagcagagagcagaagaaa

SEQ ID NO: 762797 - RNA, 19 nt, Homo sapiens
gggaggagacuacauuuug

SEQ ID NO: 762798 - RNA, 19 nt, Homo sapiens
ccaggaguguagaauaugc

SEQ ID NO: 762799 - RNA, 19 nt, Homo sapiens
gacauucguguuacaggaa

SEQ ID NO: 762800 - RNA, 19 nt, Homo sapiens
gcagaccaccacagauucu

SEQ ID NO: 762801 - RNA, 19 nt, Homo sapiens
cagcuuggcucugccuucu

SEQ ID NO: 762802 - RNA, 19 nt, Homo sapiens
cugagugugucgauucaau

SEQ ID NO: 762803 - RNA, 19 nt, Homo sapiens
gcaccuuugccaccauaau

SEQ ID NO: 762804 - RNA, 19 nt, Homo sapiens
cuccuggaauccuuuguga

SEQ ID NO: 762805 - RNA, 19 nt, Homo sapiens
cagaagcgaagcucagauc

SEQ ID NO: 762806 - RNA, 19 nt, Homo sapiens
auaugcggcugcuuccauu

SEQ ID NO: 762807 - RNA, 19 nt, Homo sapiens
cugcaccuuugccaccaua

SEQ ID NO: 762808 - RNA, 19 nt, Homo sapiens
ugagccuccuucagccuuu

SEQ ID NO: 762809 - RNA, 19 nt, Homo sapiens
ucccugcacccuuccauuu

SEQ ID NO: 762810 - RNA, 19 nt, Homo sapiens
gugagaaccaguagcaucu

SEQ ID NO: 762811 - RNA, 19 nt, Homo sapiens
ggugaacagaccucagaga

SEQ ID NO: 762812 - RNA, 19 nt, Homo sapiens
caccuuugccaccauaaug

SEQ ID NO: 762813 - RNA, 19 nt, Homo sapiens
ugaacagaccucagagaag

SEQ ID NO: 762814 - RNA, 19 nt, Homo sapiens
gcagaagcgaagcucagau

SEQ ID NO: 762815 - RNA, 19 nt, Homo sapiens
acagggagaagcaggucua

SEQ ID NO: 762816 - RNA, 19 nt, Homo sapiens
ugccagacgucaggguuga

SEQ ID NO: 762817 - RNA, 19 nt, Homo sapiens
caacaaugcugaauucuug

SEQ ID NO: 762818 - RNA, 19 nt, Homo sapiens
agagugaccuggacaagua

SEQ ID NO: 762819 - RNA, 19 nt, Homo sapiens
acaaauaccguaacaagua

SEQ ID NO: 762820 - RNA, 19 nt, Homo sapiens
ggagccaccugaaccauga

SEQ ID NO: 762821 - RNA, 19 nt, Homo sapiens
cuaaagggcucauugucaa

SEQ ID NO: 762822 - RNA, 19 nt, Homo sapiens
gauacgaugucaccaggaa

SEQ ID NO: 762823 - RNA, 19 nt, Homo sapiens
caaccuggcuuccuacuac

SEQ ID NO: 762824 - RNA, 19 nt, Homo sapiens
gagaauugccaucaaaguu

SEQ ID NO: 762825 - RNA, 19 nt, Homo sapiens
caacaaauaccguaacaag

SEQ ID NO: 762826 - RNA, 19 nt, Homo sapiens
gaaggcauacgaugacuug

SEQ ID NO: 762827 - RNA, 19 nt, Homo sapiens
gcagaggccacaagaaaga

SEQ ID NO: 762828 - RNA, 19 nt, Homo sapiens
acagacaaguuuggaauaa

SEQ ID NO: 762829 - RNA, 19 nt, Homo sapiens
caucaaaguucucgacuac

SEQ ID NO: 762830 - RNA, 19 nt, Homo sapiens
caaggaggcuuuuguaaga

SEQ ID NO: 762831 - RNA, 19 nt, Homo sapiens
caagaaagaucuggauggu

SEQ ID NO: 762832 - RNA, 19 nt, Homo sapiens
caauauaaauggguuccaa

SEQ ID NO: 762833 - RNA, 19 nt, Homo sapiens
ggccagaagacaauauuaa

SEQ ID NO: 762834 - RNA, 19 nt, Homo sapiens
ccaaggaagccaugaaugu

SEQ ID NO: 762835 - RNA, 19 nt, Homo sapiens
caaauaccguaacaaguac

SEQ ID NO: 762836 - RNA, 19 nt, Homo sapiens
gcaacaaugcugaauucuu

SEQ ID NO: 762837 - RNA, 19 nt, Homo sapiens
gaauugccaucaaaguucu

SEQ ID NO: 762838 - RNA, 19 nt, Homo sapiens
ggaagucucugagcagcau

SEQ ID NO: 762839 - RNA, 19 nt, Homo sapiens
gaagcccacagccaucaua

SEQ ID NO: 762840 - RNA, 19 nt, Homo sapiens
gaaggcagaggccacaaga

SEQ ID NO: 762841 - RNA, 19 nt, Homo sapiens
uggaauaaauugccucauc

SEQ ID NO: 762842 - RNA, 19 nt, Homo sapiens
caucaccauucaugacaaa

SEQ ID NO: 762843 - RNA, 19 nt, Homo sapiens
gaaaggcugcagcuuggaa

SEQ ID NO: 762844 - RNA, 19 nt, Homo sapiens
uagaugaagcccagaguaa

SEQ ID NO: 762845 - RNA, 19 nt, Homo sapiens
gaagaagcgcggauacgau

SEQ ID NO: 762846 - RNA, 19 nt, Homo sapiens
ugucauggcccuagagaaa

SEQ ID NO: 762847 - RNA, 19 nt, Homo sapiens
cagacaaguuuggaauaaa

SEQ ID NO: 762848 - RNA, 19 nt, Homo sapiens
gacagacaaguuuggaaua

SEQ ID NO: 762849 - RNA, 19 nt, Homo sapiens
caaaggucaucuugcaaca

SEQ ID NO: 762850 - RNA, 19 nt, Homo sapiens
ccaagaccauccugaaguc

SEQ ID NO: 762851 - RNA, 19 nt, Homo sapiens
caaggaagccaugaauguu

SEQ ID NO: 762852 - RNA, 19 nt, Homo sapiens
ccaucaaaguucucgacua

SEQ ID NO: 762853 - RNA, 19 nt, Homo sapiens
uaagaucccuggucuacac

SEQ ID NO: 762854 - RNA, 19 nt, Homo sapiens
ggauggccuuuacccuuga

SEQ ID NO: 762855 - RNA, 19 nt, Homo sapiens
ggagauguuugcccaagac

SEQ ID NO: 762856 - RNA, 19 nt, Homo sapiens
ggacuguucaucaccauuc

SEQ ID NO: 762857 - RNA, 19 nt, Homo sapiens
gaugaagcccagaguaaca

SEQ ID NO: 762858 - RNA, 19 nt, Homo sapiens
gcuuuccaaucacguguuu

SEQ ID NO: 762859 - RNA, 19 nt, Homo sapiens
ggacgucggcaccaacaau

SEQ ID NO: 762860 - RNA, 19 nt, Homo sapiens
uugcaacaaugcugaauuc

SEQ ID NO: 762861 - RNA, 19 nt, Homo sapiens
ucauggcccuagagaaaga

SEQ ID NO: 762862 - RNA, 19 nt, Homo sapiens
aacacaaccuggcuuccua

SEQ ID NO: 762863 - RNA, 19 nt, Homo sapiens
gacgugucuuugagaauug

SEQ ID NO: 762864 - RNA, 19 nt, Homo sapiens
cgaggcagcuaugggcauu

SEQ ID NO: 762865 - RNA, 19 nt, Homo sapiens
ccaaucacguguuuguuuu

SEQ ID NO: 762866 - RNA, 19 nt, Homo sapiens
aaggucaucuugcaacaau

SEQ ID NO: 762867 - RNA, 19 nt, Homo sapiens
acaaguacaucauucucau

SEQ ID NO: 762868 - RNA, 19 nt, Homo sapiens
gaacccucaucucaacaag

SEQ ID NO: 762869 - RNA, 19 nt, Homo sapiens
aggcagaggccacaagaaa

SEQ ID NO: 762870 - RNA, 19 nt, Homo sapiens
caggaacccucaucucaac

SEQ ID NO: 762871 - RNA, 19 nt, Homo sapiens
cguaacaaguacugcaugu

SEQ ID NO: 762872 - RNA, 19 nt, Homo sapiens
ccuuuacacuggacagcua

SEQ ID NO: 762873 - RNA, 19 nt, Homo sapiens
aguacugcauguucaauga

SEQ ID NO: 762874 - RNA, 19 nt, Homo sapiens
ugacagacaaguuuggaau

SEQ ID NO: 762875 - RNA, 19 nt, Homo sapiens
gacaaguacaucauucuca

SEQ ID NO: 762876 - RNA, 19 nt, Homo sapiens
auaaauggguuccaaaaug

SEQ ID NO: 762877 - RNA, 19 nt, Homo sapiens
ccaggaacccucaucucaa

SEQ ID NO: 762878 - RNA, 19 nt, Homo sapiens
cuaaggacaaggaggcuuu

SEQ ID NO: 762879 - RNA, 19 nt, Homo sapiens
ggaacccucaucucaacaa

SEQ ID NO: 762880 - RNA, 19 nt, Homo sapiens
ucuggaugguggacucuaa

SEQ ID NO: 762881 - RNA, 19 nt, Homo sapiens
uccgaaucaugagauauua

SEQ ID NO: 762882 - RNA, 19 nt, Homo sapiens
acgaugacuugcuggauga

SEQ ID NO: 762883 - RNA, 19 nt, Homo sapiens
uggagaaguucaugccaau

SEQ ID NO: 762884 - RNA, 19 nt, Homo sapiens
cagcuccuccgaaucauga

SEQ ID NO: 762885 - RNA, 19 nt, Homo sapiens
ggcagggaaacaaugcuua

SEQ ID NO: 762886 - RNA, 19 nt, Homo sapiens
ugggagaccugggcugcua

SEQ ID NO: 762887 - RNA, 19 nt, Homo sapiens
agaauugccaucaaaguuc

SEQ ID NO: 762888 - RNA, 19 nt, Homo sapiens
uccaaucacguguuuguuu

SEQ ID NO: 762889 - RNA, 19 nt, Homo sapiens
ggacaaguacaucauucuc

SEQ ID NO: 762890 - RNA, 19 nt, Homo sapiens
gacuaugacuccuuuacac

SEQ ID NO: 762891 - RNA, 19 nt, Homo sapiens
uccagacuaugacuccuuu

SEQ ID NO: 762892 - RNA, 19 nt, Homo sapiens
guccagcuccuccgaauca

SEQ ID NO: 762893 - RNA, 19 nt, Homo sapiens
ucuaaagggcucauuguca

SEQ ID NO: 762894 - RNA, 19 nt, Homo sapiens
ugacuucggauguggagaa

SEQ ID NO: 762895 - RNA, 19 nt, Homo sapiens
uaaauggguuccaaaaugg

SEQ ID NO: 762896 - RNA, 19 nt, Homo sapiens
ggccuuuacccuugaagaa

SEQ ID NO: 762897 - RNA, 19 nt, Homo sapiens
cuagaugaagcccagagua

SEQ ID NO: 762898 - RNA, 19 nt, Homo sapiens
ugaagaagcgcggauacga

SEQ ID NO: 762899 - RNA, 19 nt, Homo sapiens
ccacaagaaagaucuggau

SEQ ID NO: 762900 - RNA, 19 nt, Homo sapiens
ccugacagcagagcaaauu

SEQ ID NO: 762901 - RNA, 19 nt, Homo sapiens
gcacgggaaggcauacgau

SEQ ID NO: 762902 - RNA, 19 nt, Homo sapiens
gccagaagacaauauuaag

SEQ ID NO: 762903 - RNA, 19 nt, Homo sapiens
gagaaguucaugccaaucg

SEQ ID NO: 762904 - RNA, 19 nt, Homo sapiens
gcagggaaacaaugcuuac

SEQ ID NO: 762905 - RNA, 19 nt, Homo sapiens
gaauaaauugccucaucca

SEQ ID NO: 762906 - RNA, 19 nt, Homo sapiens
ggaaggcauacgaugacuu

SEQ ID NO: 762907 - RNA, 19 nt, Homo sapiens
gacaaaggucaucuugcaa

SEQ ID NO: 762908 - RNA, 19 nt, Homo sapiens
gcccacagccaucauaggu

SEQ ID NO: 762909 - RNA, 19 nt, Homo sapiens
gcccaaggaagccaugaau

SEQ ID NO: 762910 - RNA, 19 nt, Homo sapiens
acccagagccuaaggacaa

SEQ ID NO: 762911 - RNA, 19 nt, Homo sapiens
ccuacuacccagagccuaa

SEQ ID NO: 762912 - RNA, 19 nt, Homo sapiens
gauggcaagaccuucauuc

SEQ ID NO: 762913 - RNA, 19 nt, Homo sapiens
gaaguccuuuuaagagugu

SEQ ID NO: 762914 - RNA, 19 nt, Homo sapiens
gauguuugcccaagaccau

SEQ ID NO: 762915 - RNA, 19 nt, Homo sapiens
ccagaagacaauauuaagg

SEQ ID NO: 762916 - RNA, 19 nt, Homo sapiens
caccauucaugacaaaggu

SEQ ID NO: 762917 - RNA, 19 nt, Homo sapiens
gagcuuugcuuuaugauua

SEQ ID NO: 762918 - RNA, 19 nt, Homo sapiens
gcaaugcuauggaauacaa

SEQ ID NO: 762919 - RNA, 19 nt, Homo sapiens
ggaaugagauagaugauac

SEQ ID NO: 762920 - RNA, 19 nt, Homo sapiens
ccgaggugcuccaauauua

SEQ ID NO: 762921 - RNA, 19 nt, Homo sapiens
gaggagcuuugcuuuauga

SEQ ID NO: 762922 - RNA, 19 nt, Homo sapiens
ugagauagaugauacuugu

SEQ ID NO: 762923 - RNA, 19 nt, Homo sapiens
ggacgaagaauuccaaagu

SEQ ID NO: 762924 - RNA, 19 nt, Homo sapiens
uaaaauggaugccagcuaa

SEQ ID NO: 762925 - RNA, 19 nt, Homo sapiens
agagaagaaugaagagauu

SEQ ID NO: 762926 - RNA, 19 nt, Homo sapiens
ucaauguucucaguuguaa

SEQ ID NO: 762927 - RNA, 19 nt, Homo sapiens
ggucagcaggguucauuua

SEQ ID NO: 762928 - RNA, 19 nt, Homo sapiens
gaaaaucccuguguuguca

SEQ ID NO: 762929 - RNA, 19 nt, Homo sapiens
gaugauacuuguucgucuu

SEQ ID NO: 762930 - RNA, 19 nt, Homo sapiens
ggaggagcuuugcuuuaug

SEQ ID NO: 762931 - RNA, 19 nt, Homo sapiens
ucagcaggguucauuuaaa

SEQ ID NO: 762932 - RNA, 19 nt, Homo sapiens
uggaggagcuuugcuuuau

SEQ ID NO: 762933 - RNA, 19 nt, Homo sapiens
guacugacauuuuguuuuc

SEQ ID NO: 762934 - RNA, 19 nt, Homo sapiens
gagagaagaaugaagagau

SEQ ID NO: 762935 - RNA, 19 nt, Homo sapiens
gacgaagaauuccaaaguc

SEQ ID NO: 762936 - RNA, 19 nt, Homo sapiens
cugccgaggugcuccaaua

SEQ ID NO: 762937 - RNA, 19 nt, Homo sapiens
gauuacagccugaacaaca

SEQ ID NO: 762938 - RNA, 19 nt, Homo sapiens
gcuccaauauuaccucaag

SEQ ID NO: 762939 - RNA, 19 nt, Homo sapiens
cagcuacaguuguggaaug

SEQ ID NO: 762940 - RNA, 19 nt, Homo sapiens
caaauguugugucgucagu

SEQ ID NO: 762941 - RNA, 19 nt, Homo sapiens
cuacaguuguggaaugaga

SEQ ID NO: 762942 - RNA, 19 nt, Homo sapiens
caugagagaagaaugaaga

SEQ ID NO: 762943 - RNA, 19 nt, Homo sapiens
cuaaauguacucuguugaa

SEQ ID NO: 762944 - RNA, 19 nt, Homo sapiens
cagcaggguucauuuaaaa

SEQ ID NO: 762945 - RNA, 19 nt, Homo sapiens
caauauuaccucaaggauu

SEQ ID NO: 762946 - RNA, 19 nt, Homo sapiens
cagaguggacgaagaauuc

SEQ ID NO: 762947 - RNA, 19 nt, Homo sapiens
gagaugcugcgaacagaga

SEQ ID NO: 762948 - RNA, 19 nt, Homo sapiens
uaccaaagccucaggaaca

SEQ ID NO: 762949 - RNA, 19 nt, Homo sapiens
caaagccucaggaacaaga

SEQ ID NO: 762950 - RNA, 19 nt, Homo sapiens
acacagaaguugggcaagu

SEQ ID NO: 762951 - RNA, 19 nt, Homo sapiens
gaaguugggcaagucaaau

SEQ ID NO: 762952 - RNA, 19 nt, Homo sapiens
aauguugugucgucaguug

SEQ ID NO: 762953 - RNA, 19 nt, Homo sapiens
gauucagaguggacgaaga

SEQ ID NO: 762954 - RNA, 19 nt, Homo sapiens
ggagcuuugcuuuaugauu

SEQ ID NO: 762955 - RNA, 19 nt, Homo sapiens
gcaagucaaagucgaggau

SEQ ID NO: 762956 - RNA, 19 nt, Homo sapiens
gcuuuaugauuaugggaau

SEQ ID NO: 762957 - RNA, 19 nt, Homo sapiens
gucagcaggguucauuuaa

SEQ ID NO: 762958 - RNA, 19 nt, Homo sapiens
aauggaugccagcuaauuu

SEQ ID NO: 762959 - RNA, 19 nt, Homo sapiens
caagucaaagucgaggaua

SEQ ID NO: 762960 - RNA, 19 nt, Homo sapiens
gcucguuccucaccugcau

SEQ ID NO: 762961 - RNA, 19 nt, Homo sapiens
gucaauguucucaguugua

SEQ ID NO: 762962 - RNA, 19 nt, Homo sapiens
gcuaaauguacucuguuga

SEQ ID NO: 762963 - RNA, 19 nt, Homo sapiens
aaauggaugccagcuaauu

SEQ ID NO: 762964 - RNA, 19 nt, Homo sapiens
ccgagaugcugcgaacaga

SEQ ID NO: 762965 - RNA, 19 nt, Homo sapiens
ucagaguggacgaagaauu

SEQ ID NO: 762966 - RNA, 19 nt, Homo sapiens
gggcaagucaaauguugug

SEQ ID NO: 762967 - RNA, 19 nt, Homo sapiens
uuaugggaaugcuaccaaa

SEQ ID NO: 762968 - RNA, 19 nt, Homo sapiens
gccgaggugcuccaauauu

SEQ ID NO: 762969 - RNA, 19 nt, Homo sapiens
ucaccugcaugagagaaga

SEQ ID NO: 762970 - RNA, 19 nt, Homo sapiens
gcuauggaauacaaaaugu

SEQ ID NO: 762971 - RNA, 19 nt, Homo sapiens
gucaaagucgaggauauuu

SEQ ID NO: 762972 - RNA, 19 nt, Homo sapiens
cuggaggagcuuugcuuua

SEQ ID NO: 762973 - RNA, 19 nt, Homo sapiens
ugcuaaauguacucuguug

SEQ ID NO: 762974 - RNA, 19 nt, Homo sapiens
agauagaugauacuuguuc

SEQ ID NO: 762975 - RNA, 19 nt, Homo sapiens
aagucaaagucgaggauau

SEQ ID NO: 762976 - RNA, 19 nt, Homo sapiens
cugcaugagagaagaauga

SEQ ID NO: 762977 - RNA, 19 nt, Homo sapiens
ugucaauguucucaguugu

SEQ ID NO: 762978 - RNA, 19 nt, Homo sapiens
uggaaugagauagaugaua

SEQ ID NO: 762979 - RNA, 19 nt, Homo sapiens
agaaguugggcaagucaaa

SEQ ID NO: 762980 - RNA, 19 nt, Homo sapiens
gagauagaugauacuuguu

SEQ ID NO: 762981 - RNA, 19 nt, Homo sapiens
cuugcuaaauguacucugu

SEQ ID NO: 762982 - RNA, 19 nt, Homo sapiens
guuguggaaugagauagau

SEQ ID NO: 762983 - RNA, 19 nt, Homo sapiens
uugggcaagucaaauguug

SEQ ID NO: 762984 - RNA, 19 nt, Homo sapiens
cacagaaguugggcaaguc

SEQ ID NO: 762985 - RNA, 19 nt, Homo sapiens
ccaauauuaccucaaggau

SEQ ID NO: 762986 - RNA, 19 nt, Homo sapiens
agucaaagucgaggauauu

SEQ ID NO: 762987 - RNA, 19 nt, Homo sapiens
acaguuguggaaugagaua

SEQ ID NO: 762988 - RNA, 19 nt, Homo sapiens
cugaacaacagcuacaguu

SEQ ID NO: 762989 - RNA, 19 nt, Homo sapiens
gagauucagaguggacgaa

SEQ ID NO: 762990 - RNA, 19 nt, Homo sapiens
accaaagccucaggaacaa

SEQ ID NO: 762991 - RNA, 19 nt, Homo sapiens
gagcagcacuguaaagaug

SEQ ID NO: 762992 - RNA, 19 nt, Homo sapiens
cagaggaaauuaaagauga

SEQ ID NO: 762993 - RNA, 19 nt, Homo sapiens
ggagaugcauuacguuuca

SEQ ID NO: 762994 - RNA, 19 nt, Homo sapiens
gaacauggcaagacuacaa

SEQ ID NO: 762995 - RNA, 19 nt, Homo sapiens
gaagcugaaucuuguaaau

SEQ ID NO: 762996 - RNA, 19 nt, Homo sapiens
ucaaggaaaucguaaauag

SEQ ID NO: 762997 - RNA, 19 nt, Homo sapiens
uuaacaagcuguccucuga

SEQ ID NO: 762998 - RNA, 19 nt, Homo sapiens
cagcuguucuugccacuua

SEQ ID NO: 762999 - RNA, 19 nt, Homo sapiens
caaccacgaucugaaguuu

SEQ ID NO: 763000 - RNA, 19 nt, Homo sapiens
cuucagcacuuuagaauau

SEQ ID NO: 763001 - RNA, 19 nt, Homo sapiens
caaagaggcuaagaugaug

SEQ ID NO: 763002 - RNA, 19 nt, Homo sapiens
agugagaccuacagaguua

SEQ ID NO: 763003 - RNA, 19 nt, Homo sapiens
ugacauccuuugagauauu

SEQ ID NO: 763004 - RNA, 19 nt, Homo sapiens
ccaagcacuuuaagccaua

SEQ ID NO: 763005 - RNA, 19 nt, Homo sapiens
caaauaucguuuacacguu

SEQ ID NO: 763006 - RNA, 19 nt, Homo sapiens
ccaaagaggagaucaaugu

SEQ ID NO: 763007 - RNA, 19 nt, Homo sapiens
gaucagacccaagcacuuu

SEQ ID NO: 763008 - RNA, 19 nt, Homo sapiens
gcuuugaaguuuacuguga

SEQ ID NO: 763009 - RNA, 19 nt, Homo sapiens
ggagaucaauguacuucau

SEQ ID NO: 763010 - RNA, 19 nt, Homo sapiens
ucgaggagguguucaaaga

SEQ ID NO: 763011 - RNA, 19 nt, Homo sapiens
cuacaaguccuccuucaaa

SEQ ID NO: 763012 - RNA, 19 nt, Homo sapiens
gauggcaaauguucaaagu

SEQ ID NO: 763013 - RNA, 19 nt, Homo sapiens
uggagaagcugaaucuugu

SEQ ID NO: 763014 - RNA, 19 nt, Homo sapiens
gcuaaagaaugccaaagag

SEQ ID NO: 763015 - RNA, 19 nt, Homo sapiens
cgggagagguuggugauaa

SEQ ID NO: 763016 - RNA, 19 nt, Homo sapiens
ucaaagaggcuaagaugau

SEQ ID NO: 763017 - RNA, 19 nt, Homo sapiens
uggcaaauauuaucaccaa

SEQ ID NO: 763018 - RNA, 19 nt, Homo sapiens
uuauguggcuaaugaguuu

SEQ ID NO: 763019 - RNA, 19 nt, Homo sapiens
uggcaaauguucaaagugu

SEQ ID NO: 763020 - RNA, 19 nt, Homo sapiens
caaagaggagaucaaugua

SEQ ID NO: 763021 - RNA, 19 nt, Homo sapiens
guucauuccuccagguauu

SEQ ID NO: 763022 - RNA, 19 nt, Homo sapiens
auacagagguguccguaau

SEQ ID NO: 763023 - RNA, 19 nt, Homo sapiens
gagaagcugaaucuuguaa

SEQ ID NO: 763024 - RNA, 19 nt, Homo sapiens
gaggagguguucaaagaag

SEQ ID NO: 763025 - RNA, 19 nt, Homo sapiens
ccagguauucguuaucuaa

SEQ ID NO: 763026 - RNA, 19 nt, Homo sapiens
gcagugagaccuacagagu

SEQ ID NO: 763027 - RNA, 19 nt, Homo sapiens
caaaguggcaaaucuaaca

SEQ ID NO: 763028 - RNA, 19 nt, Homo sapiens
agaugaagcuggcuaacug

SEQ ID NO: 763029 - RNA, 19 nt, Homo sapiens
ccucugagcuaaagaaugc

SEQ ID NO: 763030 - RNA, 19 nt, Homo sapiens
cagaaacggacuguuguua

SEQ ID NO: 763031 - RNA, 19 nt, Homo sapiens
ugcauuacguuucaacaaa

SEQ ID NO: 763032 - RNA, 19 nt, Homo sapiens
aaauucaucuucugaccaa

SEQ ID NO: 763033 - RNA, 19 nt, Homo sapiens
gaaacggacuguuguuacc

SEQ ID NO: 763034 - RNA, 19 nt, Homo sapiens
ggaaaucguaaauagucua

SEQ ID NO: 763035 - RNA, 19 nt, Homo sapiens
gacauccuuugagauauuu

SEQ ID NO: 763036 - RNA, 19 nt, Homo sapiens
caaugaaacagaggaaauu

SEQ ID NO: 763037 - RNA, 19 nt, Homo sapiens
gcagcacuguaaagaugaa

SEQ ID NO: 763038 - RNA, 19 nt, Homo sapiens
uuagagaauuagagaguga

SEQ ID NO: 763039 - RNA, 19 nt, Homo sapiens
uagaauaugccuuguuuca

SEQ ID NO: 763040 - RNA, 19 nt, Homo sapiens
cuauaugccuuguaugauc

SEQ ID NO: 763041 - RNA, 19 nt, Homo sapiens
gaccaagaguaaggaaaug

SEQ ID NO: 763042 - RNA, 19 nt, Homo sapiens
gaugggagcaccaacuuca

SEQ ID NO: 763043 - RNA, 19 nt, Homo sapiens
cagcaaaguggcaaaucua

SEQ ID NO: 763044 - RNA, 19 nt, Homo sapiens
gaauuagagagugagguua

SEQ ID NO: 763045 - RNA, 19 nt, Homo sapiens
gcagaaacggacuguuguu

SEQ ID NO: 763046 - RNA, 19 nt, Homo sapiens
gcaagcugcaggcugauga

SEQ ID NO: 763047 - RNA, 19 nt, Homo sapiens
ggaaaccucagaagggaau

SEQ ID NO: 763048 - RNA, 19 nt, Homo sapiens
gcaccaacuucaccagaac

SEQ ID NO: 763049 - RNA, 19 nt, Homo sapiens
ggaacugugggcuguacua

SEQ ID NO: 763050 - RNA, 19 nt, Homo sapiens
uuucaccacuccagauaaa

SEQ ID NO: 763051 - RNA, 19 nt, Homo sapiens
ugccuuguaugaucaguuu

SEQ ID NO: 763052 - RNA, 19 nt, Homo sapiens
caagaguaaggaaaugauu

SEQ ID NO: 763053 - RNA, 19 nt, Homo sapiens
uaaagaugaagcuggcuaa

SEQ ID NO: 763054 - RNA, 19 nt, Homo sapiens
caaagugucccagccaaga

SEQ ID NO: 763055 - RNA, 19 nt, Homo sapiens
gcugaaucuuguaaauaug

SEQ ID NO: 763056 - RNA, 19 nt, Homo sapiens
gcacagcuggagaugcauu

SEQ ID NO: 763057 - RNA, 19 nt, Homo sapiens
cuacagaguuacaccugau

SEQ ID NO: 763058 - RNA, 19 nt, Homo sapiens
uuugacauccuuugagaua

SEQ ID NO: 763059 - RNA, 19 nt, Homo sapiens
uaaaucacucuguucauuc

SEQ ID NO: 763060 - RNA, 19 nt, Homo sapiens
uggcacagcuggagaugca

SEQ ID NO: 763061 - RNA, 19 nt, Homo sapiens
uauaugccuuguaugauca

SEQ ID NO: 763062 - RNA, 19 nt, Homo sapiens
ggagaagcugaaucuugua

SEQ ID NO: 763063 - RNA, 19 nt, Homo sapiens
agagugagguuaacaagcu

SEQ ID NO: 763064 - RNA, 19 nt, Homo sapiens
uuaauuccuucagcacuuu

SEQ ID NO: 763065 - RNA, 19 nt, Homo sapiens
ccauaaaucacucuguuca

SEQ ID NO: 763066 - RNA, 19 nt, Homo sapiens
gaaacagaggaaauuaaag

SEQ ID NO: 763067 - RNA, 19 nt, Homo sapiens
ccaguucaacaucuaauau

SEQ ID NO: 763068 - RNA, 19 nt, Homo sapiens
cuauucagcucccgaagca

SEQ ID NO: 763069 - RNA, 19 nt, Homo sapiens
ugggugagcagcacuguaa

SEQ ID NO: 763070 - RNA, 19 nt, Homo sapiens
gaucgaggagguguucaaa

SEQ ID NO: 763071 - RNA, 19 nt, Homo sapiens
agagguuggugauaacaga

SEQ ID NO: 763072 - RNA, 19 nt, Homo sapiens
caaggaaaucguaaauagu

SEQ ID NO: 763073 - RNA, 19 nt, Homo sapiens
acacguugguaacuauaau

SEQ ID NO: 763074 - RNA, 19 nt, Homo sapiens
ucucaaauaucguuuacac

SEQ ID NO: 763075 - RNA, 19 nt, Homo sapiens
caagcacuuuaagccauaa

SEQ ID NO: 763076 - RNA, 19 nt, Homo sapiens
uaccuggccugguguaagu

SEQ ID NO: 763077 - RNA, 19 nt, Homo sapiens
ugaccaagaguaaggaaau

SEQ ID NO: 763078 - RNA, 19 nt, Homo sapiens
ccaagaacaaauacaguca

SEQ ID NO: 763079 - RNA, 19 nt, Homo sapiens
gaggagaucaauguacuuc

SEQ ID NO: 763080 - RNA, 19 nt, Homo sapiens
cuagaaagcagagggaaau

SEQ ID NO: 763081 - RNA, 19 nt, Homo sapiens
agccauaaaucacucuguu

SEQ ID NO: 763082 - RNA, 19 nt, Homo sapiens
acagcaaaguggcaaaucu

SEQ ID NO: 763083 - RNA, 19 nt, Homo sapiens
aagaggagaucaauguacu

SEQ ID NO: 763084 - RNA, 19 nt, Homo sapiens
gggagagguuggugauaac

SEQ ID NO: 763085 - RNA, 19 nt, Homo sapiens
gcugcaggcugaugacaac

SEQ ID NO: 763086 - RNA, 19 nt, Homo sapiens
aaaccucaaggaaaucgua

SEQ ID NO: 763087 - RNA, 19 nt, Homo sapiens
ucaccacuccagauaaaga

SEQ ID NO: 763088 - RNA, 19 nt, Homo sapiens
aaagaagcagugagaccua

SEQ ID NO: 763089 - RNA, 19 nt, Homo sapiens
cuacuacgcaauaggcaaa

SEQ ID NO: 763090 - RNA, 19 nt, Homo sapiens
gagaucaauguacuucaug

SEQ ID NO: 763091 - RNA, 19 nt, Homo sapiens
guagauggauauguugaua

SEQ ID NO: 763092 - RNA, 19 nt, Homo sapiens
caaaugugauguccucaug

SEQ ID NO: 763093 - RNA, 19 nt, Homo sapiens
gacauccucucuaaagauu

SEQ ID NO: 763094 - RNA, 19 nt, Homo sapiens
uagaagaccugaggauuau

SEQ ID NO: 763095 - RNA, 19 nt, Homo sapiens
gaaccuaucagcaacuaga

SEQ ID NO: 763096 - RNA, 19 nt, Homo sapiens
ccuaagacuuuccugauau

SEQ ID NO: 763097 - RNA, 19 nt, Homo sapiens
ucaaagaguacaaauguga

SEQ ID NO: 763098 - RNA, 19 nt, Homo sapiens
ggcccugccuccaucaaua

SEQ ID NO: 763099 - RNA, 19 nt, Homo sapiens
auagaagaccugaggauua

SEQ ID NO: 763100 - RNA, 19 nt, Homo sapiens
ugggagaaguacaacaaua

SEQ ID NO: 763101 - RNA, 19 nt, Homo sapiens
gugcaugcaucaaugagaa

SEQ ID NO: 763102 - RNA, 19 nt, Homo sapiens
gaacgacccuccuuuucuu

SEQ ID NO: 763103 - RNA, 19 nt, Homo sapiens
uggcguagauggauauguu

SEQ ID NO: 763104 - RNA, 19 nt, Homo sapiens
cuaagacuuuccugauauu

SEQ ID NO: 763105 - RNA, 19 nt, Homo sapiens
gucgagaauucaaagagua

SEQ ID NO: 763106 - RNA, 19 nt, Homo sapiens
cgacuaaccuaagacuuuc

SEQ ID NO: 763107 - RNA, 19 nt, Homo sapiens
gguagaguauucagugcuu

SEQ ID NO: 763108 - RNA, 19 nt, Homo sapiens
gaaagucuaugcacauccu

SEQ ID NO: 763109 - RNA, 19 nt, Homo sapiens
cauccucucuaaagauuug

SEQ ID NO: 763110 - RNA, 19 nt, Homo sapiens
cuaugcacauccucagaua

SEQ ID NO: 763111 - RNA, 19 nt, Homo sapiens
gaagaccugaggauuauag

SEQ ID NO: 763112 - RNA, 19 nt, Homo sapiens
aacaauagguacacagaga

SEQ ID NO: 763113 - RNA, 19 nt, Homo sapiens
uuauguaccucgugauuuc

SEQ ID NO: 763114 - RNA, 19 nt, Homo sapiens
agaaguacaacaauaggua

SEQ ID NO: 763115 - RNA, 19 nt, Homo sapiens
ggagcgaccgauauagaaa

SEQ ID NO: 763116 - RNA, 19 nt, Homo sapiens
cagcucauauggcaucugu

SEQ ID NO: 763117 - RNA, 19 nt, Homo sapiens
cagcgugcaugcaucaaug

SEQ ID NO: 763118 - RNA, 19 nt, Homo sapiens
guucaucuauagcuuaugg

SEQ ID NO: 763119 - RNA, 19 nt, Homo sapiens
ucgacuaaccuaagacuuu

SEQ ID NO: 763120 - RNA, 19 nt, Homo sapiens
gugauguccucaugagaga

SEQ ID NO: 763121 - RNA, 19 nt, Homo sapiens
gggagaaguacaacaauag

SEQ ID NO: 763122 - RNA, 19 nt, Homo sapiens
uggcaucuguccucgacua

SEQ ID NO: 763123 - RNA, 19 nt, Homo sapiens
accuaagacuuuccugaua

SEQ ID NO: 763124 - RNA, 19 nt, Homo sapiens
uagaaccuaucagcaacua

SEQ ID NO: 763125 - RNA, 19 nt, Homo sapiens
gggagcgaccgauauagaa

SEQ ID NO: 763126 - RNA, 19 nt, Homo sapiens
cuaauuuacacccacauuu

SEQ ID NO: 763127 - RNA, 19 nt, Homo sapiens
ggagagaauucauaaaacu

SEQ ID NO: 763128 - RNA, 19 nt, Homo sapiens
gcccugcuuugcauccuuu

SEQ ID NO: 763129 - RNA, 19 nt, Homo sapiens
cgugauuucuugauaccaa

SEQ ID NO: 763130 - RNA, 19 nt, Homo sapiens
acagagagcagaagcuuca

SEQ ID NO: 763131 - RNA, 19 nt, Homo sapiens
cuucauuacuuaaguccaa

SEQ ID NO: 763132 - RNA, 19 nt, Homo sapiens
cuacuuagaguuuauguac

SEQ ID NO: 763133 - RNA, 19 nt, Homo sapiens
gauguccucaugagagaaa

SEQ ID NO: 763134 - RNA, 19 nt, Homo sapiens
uuacuggagagaauucaua

SEQ ID NO: 763135 - RNA, 19 nt, Homo sapiens
agauauugguagaguauuc

SEQ ID NO: 763136 - RNA, 19 nt, Homo sapiens
ucagauauugguagaguau

SEQ ID NO: 763137 - RNA, 19 nt, Homo sapiens
ccucagauauugguagagu

SEQ ID NO: 763138 - RNA, 19 nt, Homo sapiens
cauagaagaccugaggauu

SEQ ID NO: 763139 - RNA, 19 nt, Homo sapiens
uugacucucuuuauaccua

SEQ ID NO: 763140 - RNA, 19 nt, Homo sapiens
cgaccgauauagaaaugca

SEQ ID NO: 763141 - RNA, 19 nt, Homo sapiens
caacauuuacuggagagaa

SEQ ID NO: 763142 - RNA, 19 nt, Homo sapiens
auucagugcuuccaaagug

SEQ ID NO: 763143 - RNA, 19 nt, Homo sapiens
aguauucagugcuuccaaa

SEQ ID NO: 763144 - RNA, 19 nt, Homo sapiens
gagcgaccgauauagaaau

SEQ ID NO: 763145 - RNA, 19 nt, Homo sapiens
gugauuucuugauaccaaa

SEQ ID NO: 763146 - RNA, 19 nt, Homo sapiens
ugacauccucucuaaagau

SEQ ID NO: 763147 - RNA, 19 nt, Homo sapiens
gcacauccucagauauugg

SEQ ID NO: 763148 - RNA, 19 nt, Homo sapiens
uacauugaauuccauugug

SEQ ID NO: 763149 - RNA, 19 nt, Homo sapiens
guccucgacuaaccuaaga

SEQ ID NO: 763150 - RNA, 19 nt, Homo sapiens
ccaagauucagcucauaug

SEQ ID NO: 763151 - RNA, 19 nt, Homo sapiens
gaccugaggauuauagaac

SEQ ID NO: 763152 - RNA, 19 nt, Homo sapiens
ggagaaguacaacaauagg

SEQ ID NO: 763153 - RNA, 19 nt, Homo sapiens
ggacguggugacugagaug

SEQ ID NO: 763154 - RNA, 19 nt, Homo sapiens
gagaauucaaagaguacaa

SEQ ID NO: 763155 - RNA, 19 nt, Homo sapiens
aacauuuacuggagagaau

SEQ ID NO: 763156 - RNA, 19 nt, Homo sapiens
cuacauugaauuccauugu

SEQ ID NO: 763157 - RNA, 19 nt, Homo sapiens
caaagaguacaaaugugau

SEQ ID NO: 763158 - RNA, 19 nt, Homo sapiens
gauauugguagaguauuca

SEQ ID NO: 763159 - RNA, 19 nt, Homo sapiens
agauggauauguugauaac

SEQ ID NO: 763160 - RNA, 19 nt, Homo sapiens
cagcuacauugaauuccau

SEQ ID NO: 763161 - RNA, 19 nt, Homo sapiens
gagaaguacaacaauaggu

SEQ ID NO: 763162 - RNA, 19 nt, Homo sapiens
caagauucagcucauaugg

SEQ ID NO: 763163 - RNA, 19 nt, Homo sapiens
guuuauguaccucgugauu

SEQ ID NO: 763164 - RNA, 19 nt, Homo sapiens
augcacauccucagauauu

SEQ ID NO: 763165 - RNA, 19 nt, Homo sapiens
ucagcuacauugaauucca

SEQ ID NO: 763166 - RNA, 19 nt, Homo sapiens
aucuauagcuuaugguuca

SEQ ID NO: 763167 - RNA, 19 nt, Homo sapiens
agacuuuccugauauugac

SEQ ID NO: 763168 - RNA, 19 nt, Homo sapiens
acaacaauagguacacaga

SEQ ID NO: 763169 - RNA, 19 nt, Homo sapiens
ccucgugauuucuugauac

SEQ ID NO: 763170 - RNA, 19 nt, Homo sapiens
acacagagagcagaagcuu

SEQ ID NO: 763171 - RNA, 19 nt, Homo sapiens
ccugauauugacucucuuu

SEQ ID NO: 763172 - RNA, 19 nt, Homo sapiens
ccaagucgagaauucaaag

SEQ ID NO: 763173 - RNA, 19 nt, Homo sapiens
caagucgagaauucaaaga

SEQ ID NO: 763174 - RNA, 19 nt, Homo sapiens
aaagaguacaaaugugaug

SEQ ID NO: 763175 - RNA, 19 nt, Homo sapiens
uuugcaggcuguguguaua

SEQ ID NO: 763176 - RNA, 19 nt, Homo sapiens
agucgagaauucaaagagu

SEQ ID NO: 763177 - RNA, 19 nt, Homo sapiens
aaugugauguccucaugag

SEQ ID NO: 763178 - RNA, 19 nt, Homo sapiens
gcguagauggauauguuga

SEQ ID NO: 763179 - RNA, 19 nt, Homo sapiens
gcuuaugguucaaaauuca

SEQ ID NO: 763180 - RNA, 19 nt, Homo sapiens
gagaauaucuaacauguug

SEQ ID NO: 763181 - RNA, 19 nt, Homo sapiens
gaauaaggcagcauuguua

SEQ ID NO: 763182 - RNA, 19 nt, Homo sapiens
gcacaaccaauuugcauua

SEQ ID NO: 763183 - RNA, 19 nt, Homo sapiens
gaagugaaaccuugugauu

SEQ ID NO: 763184 - RNA, 19 nt, Homo sapiens
cgaaagauagcuucugaua

SEQ ID NO: 763185 - RNA, 19 nt, Homo sapiens
gggaaggcauaguggaaua

SEQ ID NO: 763186 - RNA, 19 nt, Homo sapiens
caacuucacuucucacucu

SEQ ID NO: 763187 - RNA, 19 nt, Homo sapiens
gaauacaucaguucuauca

SEQ ID NO: 763188 - RNA, 19 nt, Homo sapiens
gcgaauacaucaguucuau

SEQ ID NO: 763189 - RNA, 19 nt, Homo sapiens
aaacuacccuuauauugga

SEQ ID NO: 763190 - RNA, 19 nt, Homo sapiens
caacauggaggucuauauu

SEQ ID NO: 763191 - RNA, 19 nt, Homo sapiens
gggcacgagugaaagauuu

SEQ ID NO: 763192 - RNA, 19 nt, Homo sapiens
gggauaccauugaauuuau

SEQ ID NO: 763193 - RNA, 19 nt, Homo sapiens
gauaugaaaucaguuaugg

SEQ ID NO: 763194 - RNA, 19 nt, Homo sapiens
cuaaauguaugucaacuuc

SEQ ID NO: 763195 - RNA, 19 nt, Homo sapiens
gaaaucaguuauggaaaca

SEQ ID NO: 763196 - RNA, 19 nt, Homo sapiens
guaauggcaugcgguuuaa

SEQ ID NO: 763197 - RNA, 19 nt, Homo sapiens
gaaagauagcuucugauau

SEQ ID NO: 763198 - RNA, 19 nt, Homo sapiens
cagguucaauuacauguuu

SEQ ID NO: 763199 - RNA, 19 nt, Homo sapiens
gauggaaauucuucagguu

SEQ ID NO: 763200 - RNA, 19 nt, Homo sapiens
gauagcuucugauauuguu

SEQ ID NO: 763201 - RNA, 19 nt, Homo sapiens
ucucaaagcuucgaaagau

SEQ ID NO: 763202 - RNA, 19 nt, Homo sapiens
ggacaaucuuauuccuauu

SEQ ID NO: 763203 - RNA, 19 nt, Homo sapiens
acauggaggucuauauuau

SEQ ID NO: 763204 - RNA, 19 nt, Homo sapiens
gauauaaugcgaauacauc

SEQ ID NO: 763205 - RNA, 19 nt, Homo sapiens
gauaccaccuccuuucuac

SEQ ID NO: 763206 - RNA, 19 nt, Homo sapiens
caucaguucuaucauuuca

SEQ ID NO: 763207 - RNA, 19 nt, Homo sapiens
ggauaccauugaauuuaug

SEQ ID NO: 763208 - RNA, 19 nt, Homo sapiens
caccacagguuccauagug

SEQ ID NO: 763209 - RNA, 19 nt, Homo sapiens
ggaaguuacugggauuaca

SEQ ID NO: 763210 - RNA, 19 nt, Homo sapiens
ucaggguucuaauuaugua

SEQ ID NO: 763211 - RNA, 19 nt, Homo sapiens
ugaaaucaguuauggaaac

SEQ ID NO: 763212 - RNA, 19 nt, Homo sapiens
uaagcuccaugacacauug

SEQ ID NO: 763213 - RNA, 19 nt, Homo sapiens
cgaauaaggcagcauuguu

SEQ ID NO: 763214 - RNA, 19 nt, Homo sapiens
ggacaagaagugaaaccuu

SEQ ID NO: 763215 - RNA, 19 nt, Homo sapiens
aaacaccacagguuccaua

SEQ ID NO: 763216 - RNA, 19 nt, Homo sapiens
uauaagaguuugcguagac

SEQ ID NO: 763217 - RNA, 19 nt, Homo sapiens
auucugaccuuguggguuu

SEQ ID NO: 763218 - RNA, 19 nt, Homo sapiens
ggaaccaccaagaugcaua

SEQ ID NO: 763219 - RNA, 19 nt, Homo sapiens
cauaguguguggugaagau

SEQ ID NO: 763220 - RNA, 19 nt, Homo sapiens
aguaauggcaugcgguuua

SEQ ID NO: 763221 - RNA, 19 nt, Homo sapiens
gcagcauuguuacccuaaa

SEQ ID NO: 763222 - RNA, 19 nt, Homo sapiens
cgauggauaugaaaucagu

SEQ ID NO: 763223 - RNA, 19 nt, Homo sapiens
ucaggaaguuacugggauu

SEQ ID NO: 763224 - RNA, 19 nt, Homo sapiens
cugagaauaucuaacaugu

SEQ ID NO: 763225 - RNA, 19 nt, Homo sapiens
cgaaugcuacgauggauau

SEQ ID NO: 763226 - RNA, 19 nt, Homo sapiens
ggaaauucuucagguucaa

SEQ ID NO: 763227 - RNA, 19 nt, Homo sapiens
cuacugagaauaucuaaca

SEQ ID NO: 763228 - RNA, 19 nt, Homo sapiens
ggacuacgaaugcuacgau

SEQ ID NO: 763229 - RNA, 19 nt, Homo sapiens
cacaaccaauuugcauuaa

SEQ ID NO: 763230 - RNA, 19 nt, Homo sapiens
ggauaugaaaucaguuaug

SEQ ID NO: 763231 - RNA, 19 nt, Homo sapiens
ucacucuuauggucucaaa

SEQ ID NO: 763232 - RNA, 19 nt, Homo sapiens
cagcauuguuacccuaaau

SEQ ID NO: 763233 - RNA, 19 nt, Homo sapiens
ucaguucuaucauuucaag

SEQ ID NO: 763234 - RNA, 19 nt, Homo sapiens
cuucaggguucuaauuaug

SEQ ID NO: 763235 - RNA, 19 nt, Homo sapiens
ccaccuccuuucuacuaaa

SEQ ID NO: 763236 - RNA, 19 nt, Homo sapiens
ggucagcacaaccaauuug

SEQ ID NO: 763237 - RNA, 19 nt, Homo sapiens
gaaguuacugggauuacau

SEQ ID NO: 763238 - RNA, 19 nt, Homo sapiens
cucaaagcuucgaaagaua

SEQ ID NO: 763239 - RNA, 19 nt, Homo sapiens
ggucggaaccaccaagaug

SEQ ID NO: 763240 - RNA, 19 nt, Homo sapiens
ccuauuagcaauggugaua

SEQ ID NO: 763241 - RNA, 19 nt, Homo sapiens
gggccuccuccaccuauua

SEQ ID NO: 763242 - RNA, 19 nt, Homo sapiens
caacagcagauggaaauuc

SEQ ID NO: 763243 - RNA, 19 nt, Homo sapiens
cugaaucuuccucuauuua

SEQ ID NO: 763244 - RNA, 19 nt, Homo sapiens
gcuaauggacaagaaguga

SEQ ID NO: 763245 - RNA, 19 nt, Homo sapiens
ucugaaucuuccucuauuu

SEQ ID NO: 763246 - RNA, 19 nt, Homo sapiens
agugaaaccuugugauuuu

SEQ ID NO: 763247 - RNA, 19 nt, Homo sapiens
uaauggacaagaagugaaa

SEQ ID NO: 763248 - RNA, 19 nt, Homo sapiens
uggaaauucuucagguuca

SEQ ID NO: 763249 - RNA, 19 nt, Homo sapiens
aacauggaggucuauauua

SEQ ID NO: 763250 - RNA, 19 nt, Homo sapiens
caacugaaacuuuugcauu

SEQ ID NO: 763251 - RNA, 19 nt, Homo sapiens
gcacacaagaugggugguu

SEQ ID NO: 763252 - RNA, 19 nt, Homo sapiens
gcaacuuaauauguucuca

SEQ ID NO: 763253 - RNA, 19 nt, Homo sapiens
uucgaaagauagcuucuga

SEQ ID NO: 763254 - RNA, 19 nt, Homo sapiens
ggauauaaugcgaauacau

SEQ ID NO: 763255 - RNA, 19 nt, Homo sapiens
uacauucacugcacacaag

SEQ ID NO: 763256 - RNA, 19 nt, Homo sapiens
cagcugcaggacaaucuua

SEQ ID NO: 763257 - RNA, 19 nt, Homo sapiens
aagauagcuucugauauug

SEQ ID NO: 763258 - RNA, 19 nt, Homo sapiens
ucaaagcuucgaaagauag

SEQ ID NO: 763259 - RNA, 19 nt, Homo sapiens
ucacuucucacucuuaugg

SEQ ID NO: 763260 - RNA, 19 nt, Homo sapiens
gaguuugcguagacuauac

SEQ ID NO: 763261 - RNA, 19 nt, Homo sapiens
uguaacauguaguaaugga

SEQ ID NO: 763262 - RNA, 19 nt, Homo sapiens
ccaaugccaguccuacuau

SEQ ID NO: 763263 - RNA, 19 nt, Homo sapiens
uaccaccuccuuucuacua

SEQ ID NO: 763264 - RNA, 19 nt, Homo sapiens
gaaauucuucagguucaau

SEQ ID NO: 763265 - RNA, 19 nt, Homo sapiens
ggggauaccauugaauuua

SEQ ID NO: 763266 - RNA, 19 nt, Homo sapiens
gaaccaccaagaugcauac

SEQ ID NO: 763267 - RNA, 19 nt, Homo sapiens
cuacgaaugcuacgaugga

SEQ ID NO: 763268 - RNA, 19 nt, Homo sapiens
cagcagauggaaauucuuc

SEQ ID NO: 763269 - RNA, 19 nt, Homo sapiens
caaugccaguccuacuaug

SEQ ID NO: 763270 - RNA, 19 nt, Homo sapiens
augcuacgauggauaugaa

SEQ ID NO: 763271 - RNA, 19 nt, Homo sapiens
uaaugcgaauacaucaguu

SEQ ID NO: 763272 - RNA, 19 nt, Homo sapiens
uacgauggauaugaaauca

SEQ ID NO: 763273 - RNA, 19 nt, Homo sapiens
uaugucaacuucacuucuc

SEQ ID NO: 763274 - RNA, 19 nt, Homo sapiens
guaaauugggauauaaugc

SEQ ID NO: 763275 - RNA, 19 nt, Homo sapiens
ugauaccaccuccuuucua

SEQ ID NO: 763276 - RNA, 19 nt, Homo sapiens
uauggaaacaccacagguu

SEQ ID NO: 763277 - RNA, 19 nt, Homo sapiens
gagaauuccagagccaaga

SEQ ID NO: 763278 - RNA, 19 nt, Homo sapiens
gcuuaugcuuguacuaaaa

SEQ ID NO: 763279 - RNA, 19 nt, Homo sapiens
cuucacuucucacucuuau

SEQ ID NO: 763280 - RNA, 19 nt, Homo sapiens
gagaauaucuaacauguug

SEQ ID NO: 763281 - RNA, 19 nt, Homo sapiens
gaauaaggcagcauuguua

SEQ ID NO: 763282 - RNA, 19 nt, Homo sapiens
gcaaagauagcuucugaua

SEQ ID NO: 763283 - RNA, 19 nt, Homo sapiens
gcacaaccaauuugcauua

SEQ ID NO: 763284 - RNA, 19 nt, Homo sapiens
gggaagggauaguggaaua

SEQ ID NO: 763285 - RNA, 19 nt, Homo sapiens
ucucaaagcuugcaaagau

SEQ ID NO: 763286 - RNA, 19 nt, Homo sapiens
gaaaguuuguacaggguaa

SEQ ID NO: 763287 - RNA, 19 nt, Homo sapiens
caggaucaauuacauguuu

SEQ ID NO: 763288 - RNA, 19 nt, Homo sapiens
ggaggucuauuucaugaga

SEQ ID NO: 763289 - RNA, 19 nt, Homo sapiens
gggauaccauugaauuuau

SEQ ID NO: 763290 - RNA, 19 nt, Homo sapiens
gcaguaccaugucucagaa

SEQ ID NO: 763291 - RNA, 19 nt, Homo sapiens
cuaaauguauguccaacuu

SEQ ID NO: 763292 - RNA, 19 nt, Homo sapiens
ggaccuccuccaccuauua

SEQ ID NO: 763293 - RNA, 19 nt, Homo sapiens
gauagcuucugauauuguu

SEQ ID NO: 763294 - RNA, 19 nt, Homo sapiens
gagcugagaauaucuaaca

SEQ ID NO: 763295 - RNA, 19 nt, Homo sapiens
gauaccaccuccuuucuac

SEQ ID NO: 763296 - RNA, 19 nt, Homo sapiens
uugcaaagauagcuucuga

SEQ ID NO: 763297 - RNA, 19 nt, Homo sapiens
ggauaccauugaauuuaug

SEQ ID NO: 763298 - RNA, 19 nt, Homo sapiens
gauggaaauucuucaggau

SEQ ID NO: 763299 - RNA, 19 nt, Homo sapiens
ggaaguuacugggauuaca

SEQ ID NO: 763300 - RNA, 19 nt, Homo sapiens
ucaggguucuaauuaugua

SEQ ID NO: 763301 - RNA, 19 nt, Homo sapiens
caggguaacucuacagaag

SEQ ID NO: 763302 - RNA, 19 nt, Homo sapiens
cauuaaacauggaggucua

SEQ ID NO: 763303 - RNA, 19 nt, Homo sapiens
cgaauaaggcagcauuguu

SEQ ID NO: 763304 - RNA, 19 nt, Homo sapiens
gagaauaugcguagaccau

SEQ ID NO: 763305 - RNA, 19 nt, Homo sapiens
aaacauggaggucuauuuc

SEQ ID NO: 763306 - RNA, 19 nt, Homo sapiens
caaagauagcuucugauau

SEQ ID NO: 763307 - RNA, 19 nt, Homo sapiens
auucugaccuuguggguuu

SEQ ID NO: 763308 - RNA, 19 nt, Homo sapiens
gcagcauuguuacccuaaa

SEQ ID NO: 763309 - RNA, 19 nt, Homo sapiens
ucaggaaguuacugggauu

SEQ ID NO: 763310 - RNA, 19 nt, Homo sapiens
uaaacauggaggucuauuu

SEQ ID NO: 763311 - RNA, 19 nt, Homo sapiens
ggaaauucuucaggaucaa

SEQ ID NO: 763312 - RNA, 19 nt, Homo sapiens
uggaaauucuucaggauca

SEQ ID NO: 763313 - RNA, 19 nt, Homo sapiens
cugagaauaucuaacaugu

SEQ ID NO: 763314 - RNA, 19 nt, Homo sapiens
ggcaccaccuagaugcaua

SEQ ID NO: 763315 - RNA, 19 nt, Homo sapiens
cacaaccaauuugcauuaa

SEQ ID NO: 763316 - RNA, 19 nt, Homo sapiens
gggauauaaugcaaauaca

SEQ ID NO: 763317 - RNA, 19 nt, Homo sapiens
ucacucuuauggucucaaa

SEQ ID NO: 763318 - RNA, 19 nt, Homo sapiens
cagcauuguuacccuaaau

SEQ ID NO: 763319 - RNA, 19 nt, Homo sapiens
cuucaggguucuaauuaug

SEQ ID NO: 763320 - RNA, 19 nt, Homo sapiens
ccaccuccuuucuacuaaa

SEQ ID NO: 763321 - RNA, 19 nt, Homo sapiens
ggucagcacaaccaauuug

SEQ ID NO: 763322 - RNA, 19 nt, Homo sapiens
gaaguuacugggauuacau

SEQ ID NO: 763323 - RNA, 19 nt, Homo sapiens
gagacuccgucaggaaguu

SEQ ID NO: 763324 - RNA, 19 nt, Homo sapiens
cucaaagcuugcaaagaua

SEQ ID NO: 763325 - RNA, 19 nt, Homo sapiens
gaagaagugacagaaaaua

SEQ ID NO: 763326 - RNA, 19 nt, Homo sapiens
ccuauuagcaauggugaua

SEQ ID NO: 763327 - RNA, 19 nt, Homo sapiens
caacagcagauggaaauuc

SEQ ID NO: 763328 - RNA, 19 nt, Homo sapiens
cugaaucuuccucuauuua

SEQ ID NO: 763329 - RNA, 19 nt, Homo sapiens
gacagaacaugcucaaaau

SEQ ID NO: 763330 - RNA, 19 nt, Homo sapiens
ucugaaucuuccucuauuu

SEQ ID NO: 763331 - RNA, 19 nt, Homo sapiens
uuacugggauuacauucau

SEQ ID NO: 763332 - RNA, 19 nt, Homo sapiens
agugaaaccuugugauuuu

SEQ ID NO: 763333 - RNA, 19 nt, Homo sapiens
uuacauucauugcacacaa

SEQ ID NO: 763334 - RNA, 19 nt, Homo sapiens
ccacuucucacucuuaugg

SEQ ID NO: 763335 - RNA, 19 nt, Homo sapiens
uacauucauugcacacaaa

SEQ ID NO: 763336 - RNA, 19 nt, Homo sapiens
aagauagcuucugauauug

SEQ ID NO: 763337 - RNA, 19 nt, Homo sapiens
gcugagaauaucuaacaug

SEQ ID NO: 763338 - RNA, 19 nt, Homo sapiens
acauggaggucuauuucau

SEQ ID NO: 763339 - RNA, 19 nt, Homo sapiens
uguaacauguaguaaugga

SEQ ID NO: 763340 - RNA, 19 nt, Homo sapiens
ccaaugccaguccuacuau

SEQ ID NO: 763341 - RNA, 19 nt, Homo sapiens
uaccaccuccuuucuacua

SEQ ID NO: 763342 - RNA, 19 nt, Homo sapiens
gaaauucuucaggaucaau

SEQ ID NO: 763343 - RNA, 19 nt, Homo sapiens
ggggauaccauugaauuua

SEQ ID NO: 763344 - RNA, 19 nt, Homo sapiens
uccaguagcuguaggaaaa

SEQ ID NO: 763345 - RNA, 19 nt, Homo sapiens
cagcagauggaaauucuuc

SEQ ID NO: 763346 - RNA, 19 nt, Homo sapiens
caaugccaguccuacuaug

SEQ ID NO: 763347 - RNA, 19 nt, Homo sapiens
auggaggucuauuucauga

SEQ ID NO: 763348 - RNA, 19 nt, Homo sapiens
gaggucuauuucaugagaa

SEQ ID NO: 763349 - RNA, 19 nt, Homo sapiens
guaaauugggauauaaugc

SEQ ID NO: 763350 - RNA, 19 nt, Homo sapiens
aaaggaagaagugacagaa

SEQ ID NO: 763351 - RNA, 19 nt, Homo sapiens
ugauaccaccuccuuucua

SEQ ID NO: 763352 - RNA, 19 nt, Homo sapiens
agacagaacaugcucaaaa

SEQ ID NO: 763353 - RNA, 19 nt, Homo sapiens
uuacauguacggagaaugg

SEQ ID NO: 763354 - RNA, 19 nt, Homo sapiens
gcuuaugcuuguacuaaaa

SEQ ID NO: 763355 - RNA, 19 nt, Homo sapiens
gcgaauaaggcagcauugu

SEQ ID NO: 763356 - RNA, 19 nt, Homo sapiens
aggaagaagugacagaaaa

SEQ ID NO: 763357 - RNA, 19 nt, Homo sapiens
ggucggcaccaccuagaug

SEQ ID NO: 763358 - RNA, 19 nt, Homo sapiens
aacuucaggguucuaauua

SEQ ID NO: 763359 - RNA, 19 nt, Homo sapiens
uuacauguuugcgaaaugg

SEQ ID NO: 763360 - RNA, 19 nt, Homo sapiens
uaaaccaggauaugcaaca

SEQ ID NO: 763361 - RNA, 19 nt, Homo sapiens
gaacaugcucaaaaucaga

SEQ ID NO: 763362 - RNA, 19 nt, Homo sapiens
agaccacaguuacauguac

SEQ ID NO: 763363 - RNA, 19 nt, Homo sapiens
cauccuggcuacggucuuc

SEQ ID NO: 763364 - RNA, 19 nt, Homo sapiens
aacagcagauggaaauucu

SEQ ID NO: 763365 - RNA, 19 nt, Homo sapiens
gcaacagcagauggaaauu

SEQ ID NO: 763366 - RNA, 19 nt, Homo sapiens
cuauuacugugaugaacau

SEQ ID NO: 763367 - RNA, 19 nt, Homo sapiens
guccgucagaccacaguua

SEQ ID NO: 763368 - RNA, 19 nt, Homo sapiens
aagugaaaccuugugauuu

SEQ ID NO: 763369 - RNA, 19 nt, Homo sapiens
ucaaagcuugcaaagauag

SEQ ID NO: 763370 - RNA, 19 nt, Homo sapiens
caagagucgaguaccaaug

SEQ ID NO: 763371 - RNA, 19 nt, Homo sapiens
cgagacagaacaugcucaa

SEQ ID NO: 763372 - RNA, 19 nt, Homo sapiens
ggaagaagugacagaaaau

SEQ ID NO: 763373 - RNA, 19 nt, Homo sapiens
cagcacaaccaauuugcau

SEQ ID NO: 763374 - RNA, 19 nt, Homo sapiens
cagaccacaguuacaugua

SEQ ID NO: 763375 - RNA, 19 nt, Homo sapiens
ucagaccacaguuacaugu

SEQ ID NO: 763376 - RNA, 19 nt, Homo sapiens
caggaaguuacugggauua

SEQ ID NO: 763377 - RNA, 19 nt, Homo sapiens
uauguccaacuuccacuuu

SEQ ID NO: 763378 - RNA, 19 nt, Homo sapiens
ccaguccuacuaugaacuu

SEQ ID NO: 763379 - RNA, 19 nt, Homo sapiens
gcagauggaaauucuucag

SEQ ID NO: 763380 - RNA, 19 nt, Homo sapiens
gcagauuaaucaacuguaa

SEQ ID NO: 763381 - RNA, 19 nt, Homo sapiens
caacacugcuuccaagaga

SEQ ID NO: 763382 - RNA, 19 nt, Homo sapiens
gaaaggaugaaaucacuga

SEQ ID NO: 763383 - RNA, 19 nt, Homo sapiens
ugaaaucacugacuuggau

SEQ ID NO: 763384 - RNA, 19 nt, Homo sapiens
ccaagagacauuuacauaa

SEQ ID NO: 763385 - RNA, 19 nt, Homo sapiens
ccacuacccuuguaacuac

SEQ ID NO: 763386 - RNA, 19 nt, Homo sapiens
agacaccacuacccuugua

SEQ ID NO: 763387 - RNA, 19 nt, Homo sapiens
caacugaaaggaugaaauc

SEQ ID NO: 763388 - RNA, 19 nt, Homo sapiens
agacggauccucacacaaa

SEQ ID NO: 763389 - RNA, 19 nt, Homo sapiens
uaagacggauccucacaca

SEQ ID NO: 763390 - RNA, 19 nt, Homo sapiens
uccaagagacauuuacaua

SEQ ID NO: 763391 - RNA, 19 nt, Homo sapiens
caugcagacauaacauuua

SEQ ID NO: 763392 - RNA, 19 nt, Homo sapiens
acacaaagaggcaacugaa

SEQ ID NO: 763393 - RNA, 19 nt, Homo sapiens
caacuggcaagagucauuu

SEQ ID NO: 763394 - RNA, 19 nt, Homo sapiens
ccaugcagacauaacauuu

SEQ ID NO: 763395 - RNA, 19 nt, Homo sapiens
caaagaggcaacugaaagg

SEQ ID NO: 763396 - RNA, 19 nt, Homo sapiens
ggaugaaaucacugacuug

SEQ ID NO: 763397 - RNA, 19 nt, Homo sapiens
gcaacugaaaggaugaaau

SEQ ID NO: 763398 - RNA, 19 nt, Homo sapiens
aggaugaaaucacugacuu

SEQ ID NO: 763399 - RNA, 19 nt, Homo sapiens
acaaagaggcaacugaaag

SEQ ID NO: 763400 - RNA, 19 nt, Homo sapiens
gauccuacccucccuacuc

SEQ ID NO: 763401 - RNA, 19 nt, Homo sapiens
gggagaaauaaucuuagaa

SEQ ID NO: 763402 - RNA, 19 nt, Homo sapiens
uaaagaauugagcaccaaa

SEQ ID NO: 763403 - RNA, 19 nt, Homo sapiens
guaacuacugcuucugcua

SEQ ID NO: 763404 - RNA, 19 nt, Homo sapiens
cugaaaggaugaaaucacu

SEQ ID NO: 763405 - RNA, 19 nt, Homo sapiens
auaaagaauugagcaccaa

SEQ ID NO: 763406 - RNA, 19 nt, Homo sapiens
ucaacuggcaagagucauu

SEQ ID NO: 763407 - RNA, 19 nt, Homo sapiens
ggggagaaauaaucuuaga

SEQ ID NO: 763408 - RNA, 19 nt, Homo sapiens
gacggauccucacacaaag

SEQ ID NO: 763409 - RNA, 19 nt, Homo sapiens
cacaaagaggcaacugaaa

SEQ ID NO: 763410 - RNA, 19 nt, Homo sapiens
gcucuugcagcguguuuca

SEQ ID NO: 763411 - RNA, 19 nt, Homo sapiens
acuuggaucuugggccuuu

SEQ ID NO: 763412 - RNA, 19 nt, Homo sapiens
cagcagauuaaucaacugu

SEQ ID NO: 763413 - RNA, 19 nt, Homo sapiens
gcacaggccucucuauaca

SEQ ID NO: 763414 - RNA, 19 nt, Homo sapiens
ccacucagcucaagaugaa

SEQ ID NO: 763415 - RNA, 19 nt, Homo sapiens
ugaugcagcugcucaauga

SEQ ID NO: 763416 - RNA, 19 nt, Homo sapiens
ccaggaaggugcacaagau

SEQ ID NO: 763417 - RNA, 19 nt, Homo sapiens
acgcggagcucauguuuga

SEQ ID NO: 763418 - RNA, 19 nt, Homo sapiens
gcagcaaccgggagaagua

SEQ ID NO: 763419 - RNA, 19 nt, Homo sapiens
ucauagagcacaucaagaa

SEQ ID NO: 763420 - RNA, 19 nt, Homo sapiens
uagagcacaucaagaagaa

SEQ ID NO: 763421 - RNA, 19 nt, Homo sapiens
gaucaaggcggucaucauc

SEQ ID NO: 763422 - RNA, 19 nt, Homo sapiens
gcaaacucaucacuauugg

SEQ ID NO: 763423 - RNA, 19 nt, Homo sapiens
ggcaaacucaucacuauug

SEQ ID NO: 763424 - RNA, 19 nt, Homo sapiens
ggacuuuagugggccauga

SEQ ID NO: 763425 - RNA, 19 nt, Homo sapiens
ggucagcaaggaagaguuu

SEQ ID NO: 763426 - RNA, 19 nt, Homo sapiens
gcucugagaugcucuucca

SEQ ID NO: 763427 - RNA, 19 nt, Homo sapiens
aagaagaagugcugcuaug

SEQ ID NO: 763428 - RNA, 19 nt, Homo sapiens
gugcugagccucggcauuu

SEQ ID NO: 763429 - RNA, 19 nt, Homo sapiens
gaaguacgcggagcucaug

SEQ ID NO: 763430 - RNA, 19 nt, Homo sapiens
ggaaggugcacaagaucaa

SEQ ID NO: 763431 - RNA, 19 nt, Homo sapiens
guacgcggagcucauguuu

SEQ ID NO: 763432 - RNA, 19 nt, Homo sapiens
ucaaggcggucaucaucga

SEQ ID NO: 763433 - RNA, 19 nt, Homo sapiens
caucauagagcacaucaag

SEQ ID NO: 763434 - RNA, 19 nt, Homo sapiens
caagaagaagugcugcuau

SEQ ID NO: 763435 - RNA, 19 nt, Homo sapiens
agucguugcuguccaucua

SEQ ID NO: 763436 - RNA, 19 nt, Homo sapiens
gagcacaucaagaagaagu

SEQ ID NO: 763437 - RNA, 19 nt, Homo sapiens
gccucucuauacacauuua

SEQ ID NO: 763438 - RNA, 19 nt, Homo sapiens
acggcaaacucaucacuau

SEQ ID NO: 763439 - RNA, 19 nt, Homo sapiens
ucaagaagaagugcugcua

SEQ ID NO: 763440 - RNA, 19 nt, Homo sapiens
caggagcgcuuccguugcu

SEQ ID NO: 763441 - RNA, 19 nt, Homo sapiens
acaggccucucuauacaca

SEQ ID NO: 763442 - RNA, 19 nt, Homo sapiens
gacggcaaacucaucacua

SEQ ID NO: 763443 - RNA, 19 nt, Homo sapiens
caucugggaguacaucuuc

SEQ ID NO: 763444 - RNA, 19 nt, Homo sapiens
ggacaucugggaguacauc

SEQ ID NO: 763445 - RNA, 19 nt, Homo sapiens
gacgaccaccugcacauca

SEQ ID NO: 763446 - RNA, 19 nt, Homo sapiens
aggccucucuauacacauu

SEQ ID NO: 763447 - RNA, 19 nt, Homo sapiens
caggacaucugggaguaca

SEQ ID NO: 763448 - RNA, 19 nt, Homo sapiens
ugcaggacaucugggagua

SEQ ID NO: 763449 - RNA, 19 nt, Homo sapiens
cagaauuucacauaaaggu

SEQ ID NO: 763450 - RNA, 19 nt, Homo sapiens
cgaccaccugcacaucaua

SEQ ID NO: 763451 - RNA, 19 nt, Homo sapiens
gcguggccaucuacagcaa

SEQ ID NO: 763452 - RNA, 19 nt, Homo sapiens
acacaggugcggccacuca

SEQ ID NO: 763453 - RNA, 19 nt, Homo sapiens
ucagcaaggaagaguuuga

SEQ ID NO: 763454 - RNA, 19 nt, Homo sapiens
auagagcacaucaagaaga

SEQ ID NO: 763455 - RNA, 19 nt, Homo sapiens
ggacgaccaccugcacauc

SEQ ID NO: 763456 - RNA, 19 nt, Homo sapiens
gcaccgccaugaagauccu

SEQ ID NO: 763457 - RNA, 19 nt, Homo sapiens
ggacggcaaacucaucacu

SEQ ID NO: 763458 - RNA, 19 nt, Homo sapiens
gcacaucauagagcacauc

SEQ ID NO: 763459 - RNA, 19 nt, Homo sapiens
cggcaaacucaucacuauu

SEQ ID NO: 763460 - RNA, 19 nt, Homo sapiens
gaauaucucuuccgacaag

SEQ ID NO: 763461 - RNA, 19 nt, Homo sapiens
gcuuauuccuguagcauua

SEQ ID NO: 763462 - RNA, 19 nt, Homo sapiens
agagaaauaugcugaaaug

SEQ ID NO: 763463 - RNA, 19 nt, Homo sapiens
gaagaaaugcugcuuugug

SEQ ID NO: 763464 - RNA, 19 nt, Homo sapiens
gcucggagauguucuucaa

SEQ ID NO: 763465 - RNA, 19 nt, Homo sapiens
acaagaaccuacugaauca

SEQ ID NO: 763466 - RNA, 19 nt, Homo sapiens
gaagaaagucccucucagu

SEQ ID NO: 763467 - RNA, 19 nt, Homo sapiens
caaaccguguccugccuua

SEQ ID NO: 763468 - RNA, 19 nt, Homo sapiens
aagaagaaaugcugcuuug

SEQ ID NO: 763469 - RNA, 19 nt, Homo sapiens
gggauacagugcaggauau

SEQ ID NO: 763470 - RNA, 19 nt, Homo sapiens
cuacgaggguuauccuuug

SEQ ID NO: 763471 - RNA, 19 nt, Homo sapiens
acacaaacguucaucucaa

SEQ ID NO: 763472 - RNA, 19 nt, Homo sapiens
ccuccagacugccucuuua

SEQ ID NO: 763473 - RNA, 19 nt, Homo sapiens
gggaugggcccaccaagaa

SEQ ID NO: 763474 - RNA, 19 nt, Homo sapiens
uggaggacaucaagaagaa

SEQ ID NO: 763475 - RNA, 19 nt, Homo sapiens
caagaagaaaugcugcuuu

SEQ ID NO: 763476 - RNA, 19 nt, Homo sapiens
caagccaucucucaucaag

SEQ ID NO: 763477 - RNA, 19 nt, Homo sapiens
ggaggagcaugcggucuug

SEQ ID NO: 763478 - RNA, 19 nt, Homo sapiens
guaaacgugcugccugaaa

SEQ ID NO: 763479 - RNA, 19 nt, Homo sapiens
gagcaugcggucuugguuu

SEQ ID NO: 763480 - RNA, 19 nt, Homo sapiens
uaaacgugcugccugaaag

SEQ ID NO: 763481 - RNA, 19 nt, Homo sapiens
agagagaaauaugcugaaa

SEQ ID NO: 763482 - RNA, 19 nt, Homo sapiens
ggcacuggcuacuguaaau

SEQ ID NO: 763483 - RNA, 19 nt, Homo sapiens
guucaucucaagcugguua

SEQ ID NO: 763484 - RNA, 19 nt, Homo sapiens
ccacaagaaccuacugaau

SEQ ID NO: 763485 - RNA, 19 nt, Homo sapiens
cacaagaaccuacugaauc

SEQ ID NO: 763486 - RNA, 19 nt, Homo sapiens
ccaagaaggugggcaacca

SEQ ID NO: 763487 - RNA, 19 nt, Homo sapiens
agaaagucccucucaguga

SEQ ID NO: 763488 - RNA, 19 nt, Homo sapiens
gagagaaauaugcugaaau

SEQ ID NO: 763489 - RNA, 19 nt, Homo sapiens
ggaacacgggccuuucuuc

SEQ ID NO: 763490 - RNA, 19 nt, Homo sapiens
gcugaaaugcuguuugaag

SEQ ID NO: 763491 - RNA, 19 nt, Homo sapiens
augcugaaaugcuguuuga

SEQ ID NO: 763492 - RNA, 19 nt, Homo sapiens
ugcaggauaucugggaaua

SEQ ID NO: 763493 - RNA, 19 nt, Homo sapiens
cacaaacguucaucucaag

SEQ ID NO: 763494 - RNA, 19 nt, Homo sapiens
ggcaggaacucaacaacac

SEQ ID NO: 763495 - RNA, 19 nt, Homo sapiens
gcauuaaacaccccucaua

SEQ ID NO: 763496 - RNA, 19 nt, Homo sapiens
uggccucacuucaggguuu

SEQ ID NO: 763497 - RNA, 19 nt, Homo sapiens
gaggacaucaagaagaaau

SEQ ID NO: 763498 - RNA, 19 nt, Homo sapiens
gaacucaacaacacaaacg

SEQ ID NO: 763499 - RNA, 19 nt, Homo sapiens
acaccaacagagagaaaua

SEQ ID NO: 763500 - RNA, 19 nt, Homo sapiens
caacacaaacguucaucuc

SEQ ID NO: 763501 - RNA, 19 nt, Homo sapiens
cuaaccgucugcagaagga

SEQ ID NO: 763502 - RNA, 19 nt, Homo sapiens
caacagagagaaauaugcu

SEQ ID NO: 763503 - RNA, 19 nt, Homo sapiens
ccaagacccacccacaaga

SEQ ID NO: 763504 - RNA, 19 nt, Homo sapiens
caacaacacaaacguucau

SEQ ID NO: 763505 - RNA, 19 nt, Homo sapiens
agaaggagcuaagcagcau

SEQ ID NO: 763506 - RNA, 19 nt, Homo sapiens
uguccugccuuaacaagug

SEQ ID NO: 763507 - RNA, 19 nt, Homo sapiens
gaguucagagccacaagaa

SEQ ID NO: 763508 - RNA, 19 nt, Homo sapiens
aaucaaaggcagccaagga

SEQ ID NO: 763509 - RNA, 19 nt, Homo sapiens
ccaaggagaggcccaagca

SEQ ID NO: 763510 - RNA, 19 nt, Homo sapiens
gggcaggaacucaacaaca

SEQ ID NO: 763511 - RNA, 19 nt, Homo sapiens
agucgcgccuguccaugua

SEQ ID NO: 763512 - RNA, 19 nt, Homo sapiens
ccugggcacuggcuacugu

SEQ ID NO: 763513 - RNA, 19 nt, Homo sapiens
ggagcuaagcagcaugugu

SEQ ID NO: 763514 - RNA, 19 nt, Homo sapiens
ccauugaggagaagaaagu

SEQ ID NO: 763515 - RNA, 19 nt, Homo sapiens
aagaaccuacugaaucaaa

SEQ ID NO: 763516 - RNA, 19 nt, Homo sapiens
caaugcacaucgccuacca

SEQ ID NO: 763517 - RNA, 19 nt, Homo sapiens
ggagcaugcggucuugguu

SEQ ID NO: 763518 - RNA, 19 nt, Homo sapiens
caagacccacccacaagau

SEQ ID NO: 763519 - RNA, 19 nt, Homo sapiens
cagcaugugucccaaugac

SEQ ID NO: 763520 - RNA, 19 nt, Homo sapiens
agccaucucucaucaaguc

SEQ ID NO: 763521 - RNA, 19 nt, Homo sapiens
gcaggaacucaacaacaca

SEQ ID NO: 763522 - RNA, 19 nt, Homo sapiens
gaggaacacgggccuuucu

SEQ ID NO: 763523 - RNA, 19 nt, Homo sapiens
gggcacuggcuacuguaaa

SEQ ID NO: 763524 - RNA, 19 nt, Homo sapiens
gcacuggcuacuguaaaug

SEQ ID NO: 763525 - RNA, 19 nt, Homo sapiens
guggaggacaucaagaaga

SEQ ID NO: 763526 - RNA, 19 nt, Homo sapiens
gccuguccauguacuccua

SEQ ID NO: 763527 - RNA, 19 nt, Homo sapiens
gaaccuacugaaucaaagg

SEQ ID NO: 763528 - RNA, 19 nt, Homo sapiens
uaucugggaauaucucuuc

SEQ ID NO: 763529 - RNA, 19 nt, Homo sapiens
gcagcaugugucccaauga

SEQ ID NO: 763530 - RNA, 19 nt, Homo sapiens
agaaauaugcugaaaugcu

SEQ ID NO: 763531 - RNA, 19 nt, Homo sapiens
ccaagcaggaggugaccaa

SEQ ID NO: 763532 - RNA, 19 nt, Homo sapiens
ugggauacagugcaggaua

SEQ ID NO: 763533 - RNA, 19 nt, Homo sapiens
gggccuuucuuccucuaca

SEQ ID NO: 763534 - RNA, 19 nt, Homo sapiens
gccaagacccacccacaag

SEQ ID NO: 763535 - RNA, 19 nt, Homo sapiens
ccucaaacgggaccucaug

SEQ ID NO: 763536 - RNA, 19 nt, Homo sapiens
ucuacgaggguuauccuuu

SEQ ID NO: 763537 - RNA, 19 nt, Homo sapiens
gauaaucgcaaggagacau

SEQ ID NO: 763538 - RNA, 19 nt, Homo sapiens
aaacgugcugccugaaaga

SEQ ID NO: 763539 - RNA, 19 nt, Homo sapiens
ccagacugccucuuuaagg

SEQ ID NO: 763540 - RNA, 19 nt, Homo sapiens
uggaucccauugaggagaa

SEQ ID NO: 763541 - RNA, 19 nt, Homo sapiens
ggacaucaagaagaaaugc

SEQ ID NO: 763542 - RNA, 19 nt, Homo sapiens
ggaggacaucaagaagaaa

SEQ ID NO: 763543 - RNA, 19 nt, Homo sapiens
uucaagccaucucucauca

SEQ ID NO: 763544 - RNA, 19 nt, Homo sapiens
cccacaagaucucaacaac

SEQ ID NO: 763545 - RNA, 19 nt, Homo sapiens
gguuaacccucugcgacau

SEQ ID NO: 763546 - RNA, 19 nt, Homo sapiens
ccacgaggguuacgaggua

SEQ ID NO: 763547 - RNA, 19 nt, Homo sapiens
caagcuggauggaggcaaa

SEQ ID NO: 763548 - RNA, 19 nt, Homo sapiens
gcgacgaggucuucaucaa

SEQ ID NO: 763549 - RNA, 19 nt, Homo sapiens
guuacgagguacucaaguu

SEQ ID NO: 763550 - RNA, 19 nt, Homo sapiens
ggaaggccacuaugagaug

SEQ ID NO: 763551 - RNA, 19 nt, Homo sapiens
caucaucuacuccgacuga

SEQ ID NO: 763552 - RNA, 19 nt, Homo sapiens
gcggcaacagcaacaaaua

SEQ ID NO: 763553 - RNA, 19 nt, Homo sapiens
caaguuuacgugcaacauu

SEQ ID NO: 763554 - RNA, 19 nt, Homo sapiens
gcggcaaguuuacgugcaa

SEQ ID NO: 763555 - RNA, 19 nt, Homo sapiens
gcggccagcggcaaguuua

SEQ ID NO: 763556 - RNA, 19 nt, Homo sapiens
ucaccaaccuaggcaacaa

SEQ ID NO: 763557 - RNA, 19 nt, Homo sapiens
caaccuaggcaacaacuac

SEQ ID NO: 763558 - RNA, 19 nt, Homo sapiens
cgucugaccaaaguuauaa

SEQ ID NO: 763559 - RNA, 19 nt, Homo sapiens
acaauaggacuguuuacug

SEQ ID NO: 763560 - RNA, 19 nt, Homo sapiens
gcccggaaggccacuauga

SEQ ID NO: 763561 - RNA, 19 nt, Homo sapiens
aaguuuacgugcaacauuc

SEQ ID NO: 763562 - RNA, 19 nt, Homo sapiens
uguacaauaggacuguuua

SEQ ID NO: 763563 - RNA, 19 nt, Homo sapiens
cacguucucuggcuucauc

SEQ ID NO: 763564 - RNA, 19 nt, Homo sapiens
ggaccagaacuacgacuac

SEQ ID NO: 763565 - RNA, 19 nt, Homo sapiens
uuacgagguacucaaguuu

SEQ ID NO: 763566 - RNA, 19 nt, Homo sapiens
ucucuggcuucaucaucua

SEQ ID NO: 763567 - RNA, 19 nt, Homo sapiens
ggcaacagcaacaaauaca

SEQ ID NO: 763568 - RNA, 19 nt, Homo sapiens
gcaacauucccggcaccua

SEQ ID NO: 763569 - RNA, 19 nt, Homo sapiens
ccggaaggccacuaugaga

SEQ ID NO: 763570 - RNA, 19 nt, Homo sapiens
cgacgaggucuucaucaag

SEQ ID NO: 763571 - RNA, 19 nt, Homo sapiens
gcaacaaauacagcacguu

SEQ ID NO: 763572 - RNA, 19 nt, Homo sapiens
ucuguuaccugacaaauua

SEQ ID NO: 763573 - RNA, 19 nt, Homo sapiens
aaacugugcugaucagaua

SEQ ID NO: 763574 - RNA, 19 nt, Homo sapiens
gauaccagauagaugauaa

SEQ ID NO: 763575 - RNA, 19 nt, Homo sapiens
gauuauagaugcccaguuc

SEQ ID NO: 763576 - RNA, 19 nt, Homo sapiens
gcuaccagcuaaauacuuu

SEQ ID NO: 763577 - RNA, 19 nt, Homo sapiens
ucagauaguucacuuucua

SEQ ID NO: 763578 - RNA, 19 nt, Homo sapiens
cagacaaacuuccauuauu

SEQ ID NO: 763579 - RNA, 19 nt, Homo sapiens
ggauuauucuguuccuaua

SEQ ID NO: 763580 - RNA, 19 nt, Homo sapiens
gaaggaacaauaaugauga

SEQ ID NO: 763581 - RNA, 19 nt, Homo sapiens
agacaaacuuccauuauuc

SEQ ID NO: 763582 - RNA, 19 nt, Homo sapiens
caaaauaacccucguaaaa

SEQ ID NO: 763583 - RNA, 19 nt, Homo sapiens
ccagauagaugauaaacca

SEQ ID NO: 763584 - RNA, 19 nt, Homo sapiens
ucaccaagaugcaguuuau

SEQ ID NO: 763585 - RNA, 19 nt, Homo sapiens
gaagaggucgaauugauga

SEQ ID NO: 763586 - RNA, 19 nt, Homo sapiens
gaacugugggaauauuuaa

SEQ ID NO: 763587 - RNA, 19 nt, Homo sapiens
gaauugaugacuugcgaua

SEQ ID NO: 763588 - RNA, 19 nt, Homo sapiens
agagcgaggucauaucuuu

SEQ ID NO: 763589 - RNA, 19 nt, Homo sapiens
gagcacaagcuauguauca

SEQ ID NO: 763590 - RNA, 19 nt, Homo sapiens
cuaaauacuuuggcacuga

SEQ ID NO: 763591 - RNA, 19 nt, Homo sapiens
auaguucacuuucuacuga

SEQ ID NO: 763592 - RNA, 19 nt, Homo sapiens
gccauuggauuauucuguu

SEQ ID NO: 763593 - RNA, 19 nt, Homo sapiens
agaugcaguuuaugaagua

SEQ ID NO: 763594 - RNA, 19 nt, Homo sapiens
guaagccucuuuaugaaac

SEQ ID NO: 763595 - RNA, 19 nt, Homo sapiens
gaucacagauggaaaauac

SEQ ID NO: 763596 - RNA, 19 nt, Homo sapiens
gaucagauagaaguuguuu

SEQ ID NO: 763597 - RNA, 19 nt, Homo sapiens
ccaaacaaccagauucgaa

SEQ ID NO: 763598 - RNA, 19 nt, Homo sapiens
ucgcagaguuugugccauu

SEQ ID NO: 763599 - RNA, 19 nt, Homo sapiens
aaacaaccagauucgaaua

SEQ ID NO: 763600 - RNA, 19 nt, Homo sapiens
cugcagauccuugcuguua

SEQ ID NO: 763601 - RNA, 19 nt, Homo sapiens
ugagaacugugggaauauu

SEQ ID NO: 763602 - RNA, 19 nt, Homo sapiens
gaaaaccacauauuuguug

SEQ ID NO: 763603 - RNA, 19 nt, Homo sapiens
gagaacugugggaauauuu

SEQ ID NO: 763604 - RNA, 19 nt, Homo sapiens
cauauuugauugagaacug

SEQ ID NO: 763605 - RNA, 19 nt, Homo sapiens
ugaggauaaugaugugaaa

SEQ ID NO: 763606 - RNA, 19 nt, Homo sapiens
caugacagccgacagcaaa

SEQ ID NO: 763607 - RNA, 19 nt, Homo sapiens
caaggauucuggagugaag

SEQ ID NO: 763608 - RNA, 19 nt, Homo sapiens
ccagacaaacuuccauuau

SEQ ID NO: 763609 - RNA, 19 nt, Homo sapiens
auugagaacugugggaaua

SEQ ID NO: 763610 - RNA, 19 nt, Homo sapiens
aaucacagcuguuggaaaa

SEQ ID NO: 763611 - RNA, 19 nt, Homo sapiens
cacccaguuucaucuguua

SEQ ID NO: 763612 - RNA, 19 nt, Homo sapiens
ggugcguggugaagaaauu

SEQ ID NO: 763613 - RNA, 19 nt, Homo sapiens
ggagagcgaggucauaucu

SEQ ID NO: 763614 - RNA, 19 nt, Homo sapiens
caauugaggauaaugaugu

SEQ ID NO: 763615 - RNA, 19 nt, Homo sapiens
aaguaagccucuuuaugaa

SEQ ID NO: 763616 - RNA, 19 nt, Homo sapiens
caaacaaccagauucgaau

SEQ ID NO: 763617 - RNA, 19 nt, Homo sapiens
ggaacaauaaugaugagau

SEQ ID NO: 763618 - RNA, 19 nt, Homo sapiens
gauaaugaugugaaagguu

SEQ ID NO: 763619 - RNA, 19 nt, Homo sapiens
ccaagaugcaguuuaugaa

SEQ ID NO: 763620 - RNA, 19 nt, Homo sapiens
caagcuauguaucaaggau

SEQ ID NO: 763621 - RNA, 19 nt, Homo sapiens
ugaaggaacaauaaugaug

SEQ ID NO: 763622 - RNA, 19 nt, Homo sapiens
ugacuugcgauaccagaua

SEQ ID NO: 763623 - RNA, 19 nt, Homo sapiens
gaugauguucuacuucaga

SEQ ID NO: 763624 - RNA, 19 nt, Homo sapiens
ggauaaugaugugaaaggu

SEQ ID NO: 763625 - RNA, 19 nt, Homo sapiens
gauagaugauaaaccaaac

SEQ ID NO: 763626 - RNA, 19 nt, Homo sapiens
gaggagagcgaggucauau

SEQ ID NO: 763627 - RNA, 19 nt, Homo sapiens
uaccaguacuucaccaaga

SEQ ID NO: 763628 - RNA, 19 nt, Homo sapiens
gaggucgaauugaugacuu

SEQ ID NO: 763629 - RNA, 19 nt, Homo sapiens
agaacugugggaauauuua

SEQ ID NO: 763630 - RNA, 19 nt, Homo sapiens
gaauagaccaaaagaagaa

SEQ ID NO: 763631 - RNA, 19 nt, Homo sapiens
gacaaacuuccauuauuca

SEQ ID NO: 763632 - RNA, 19 nt, Homo sapiens
gauguucuacuucagauag

SEQ ID NO: 763633 - RNA, 19 nt, Homo sapiens
cgaagaggucgaauugaug

SEQ ID NO: 763634 - RNA, 19 nt, Homo sapiens
ggacuggagcacaagcuau

SEQ ID NO: 763635 - RNA, 19 nt, Homo sapiens
gcacaagcuauguaucaag

SEQ ID NO: 763636 - RNA, 19 nt, Homo sapiens
gaaacaauugaggauaaug

SEQ ID NO: 763637 - RNA, 19 nt, Homo sapiens
guccgaggcuuucauugca

SEQ ID NO: 763638 - RNA, 19 nt, Homo sapiens
ggucacacccaguuucauc

SEQ ID NO: 763639 - RNA, 19 nt, Homo sapiens
gcagauccuugcuguuacg

SEQ ID NO: 763640 - RNA, 19 nt, Homo sapiens
caagaugcaguuuaugaag

SEQ ID NO: 763641 - RNA, 19 nt, Homo sapiens
gaaauccccacuauaaaau

SEQ ID NO: 763642 - RNA, 19 nt, Homo sapiens
gauuguggccuccaugaca

SEQ ID NO: 763643 - RNA, 19 nt, Homo sapiens
uaaaccaaacaaccagauu

SEQ ID NO: 763644 - RNA, 19 nt, Homo sapiens
auagaugcccaguucauuu

SEQ ID NO: 763645 - RNA, 19 nt, Homo sapiens
aagaugcaguuuaugaagu

SEQ ID NO: 763646 - RNA, 19 nt, Homo sapiens
cggagucgguagacgagaa

SEQ ID NO: 763647 - RNA, 19 nt, Homo sapiens
gagcgaggucauaucuuug

SEQ ID NO: 763648 - RNA, 19 nt, Homo sapiens
gauuuguaacugucaacua

SEQ ID NO: 763649 - RNA, 19 nt, Homo sapiens
uggaucagcuggugucaac

SEQ ID NO: 763650 - RNA, 19 nt, Homo sapiens
uacacaagcugaucaaaau

SEQ ID NO: 763651 - RNA, 19 nt, Homo sapiens
gcccgaacccgaaccugaa

SEQ ID NO: 763652 - RNA, 19 nt, Homo sapiens
aaaccaaacaaccagauuc

SEQ ID NO: 763653 - RNA, 19 nt, Homo sapiens
acugaaggaacaauaauga

SEQ ID NO: 763654 - RNA, 19 nt, Homo sapiens
gauaguucacuuucuacug

SEQ ID NO: 763655 - RNA, 19 nt, Homo sapiens
gugaaagguuuuaaugaug

SEQ ID NO: 763656 - RNA, 19 nt, Homo sapiens
gacaaauuaagaagggaaa

SEQ ID NO: 763657 - RNA, 19 nt, Homo sapiens
acacccaguuucaucuguu

SEQ ID NO: 763658 - RNA, 19 nt, Homo sapiens
caaccagauucgaauaucc

SEQ ID NO: 763659 - RNA, 19 nt, Homo sapiens
gacuugcgauaccagauag

SEQ ID NO: 763660 - RNA, 19 nt, Homo sapiens
ugaugagauuuguaacugu

SEQ ID NO: 763661 - RNA, 19 nt, Homo sapiens
gagugaagcagauguuacu

SEQ ID NO: 763662 - RNA, 19 nt, Homo sapiens
gugcugaucagauagaagu

SEQ ID NO: 763663 - RNA, 19 nt, Homo sapiens
cagaguuugugccauugga

SEQ ID NO: 763664 - RNA, 19 nt, Homo sapiens
gcagauguuacucgaccuu

SEQ ID NO: 763665 - RNA, 19 nt, Homo sapiens
ggagugaagcagauguuac

SEQ ID NO: 763666 - RNA, 19 nt, Homo sapiens
gaguuugugccauuggauu

SEQ ID NO: 763667 - RNA, 19 nt, Homo sapiens
uuucaucuguuaccugaca

SEQ ID NO: 763668 - RNA, 19 nt, Homo sapiens
acaaccagauucgaauauc

SEQ ID NO: 763669 - RNA, 19 nt, Homo sapiens
uauagaugcccaguucauu

SEQ ID NO: 763670 - RNA, 19 nt, Homo sapiens
cgaggagagcgaggucaua

SEQ ID NO: 763671 - RNA, 19 nt, Homo sapiens
augaugauguucuacuuca

SEQ ID NO: 763672 - RNA, 19 nt, Homo sapiens
gaagaaagcuagaaagaaa

SEQ ID NO: 763673 - RNA, 19 nt, Homo sapiens
ggacauagcuuaucugcaa

SEQ ID NO: 763674 - RNA, 19 nt, Homo sapiens
ggacacagauauuauugua

SEQ ID NO: 763675 - RNA, 19 nt, Homo sapiens
gagccugacugauguauua

SEQ ID NO: 763676 - RNA, 19 nt, Homo sapiens
gaaaagaaccugcuaguua

SEQ ID NO: 763677 - RNA, 19 nt, Homo sapiens
ggaagaaucucuacuugug

SEQ ID NO: 763678 - RNA, 19 nt, Homo sapiens
gaaagcagcugagaggauu

SEQ ID NO: 763679 - RNA, 19 nt, Homo sapiens
ggaaagagaagcagaauau

SEQ ID NO: 763680 - RNA, 19 nt, Homo sapiens
gcaacuagaugaagauguu

SEQ ID NO: 763681 - RNA, 19 nt, Homo sapiens
ggacacaaacugccuguua

SEQ ID NO: 763682 - RNA, 19 nt, Homo sapiens
gcacuuugcucauucuuug

SEQ ID NO: 763683 - RNA, 19 nt, Homo sapiens
gcaacuggcuccgcugaua

SEQ ID NO: 763684 - RNA, 19 nt, Homo sapiens
gaacugaaaugugguaucu

SEQ ID NO: 763685 - RNA, 19 nt, Homo sapiens
gacaauagaugcacaugau

SEQ ID NO: 763686 - RNA, 19 nt, Homo sapiens
gaaaugagucugcaagaug

SEQ ID NO: 763687 - RNA, 19 nt, Homo sapiens
acacuuagcuguuggguau

SEQ ID NO: 763688 - RNA, 19 nt, Homo sapiens
gauguuaucggcuucaaua

SEQ ID NO: 763689 - RNA, 19 nt, Homo sapiens
caauauugcuguucuuuca

SEQ ID NO: 763690 - RNA, 19 nt, Homo sapiens
gcagugaugugcggacuuu

SEQ ID NO: 763691 - RNA, 19 nt, Homo sapiens
cgagugagcuggaagaauc

SEQ ID NO: 763692 - RNA, 19 nt, Homo sapiens
cagaaaagcugguuccaua

SEQ ID NO: 763693 - RNA, 19 nt, Homo sapiens
ggaaagauaccauggugaa

SEQ ID NO: 763694 - RNA, 19 nt, Homo sapiens
caauauggcuggucuugau

SEQ ID NO: 763695 - RNA, 19 nt, Homo sapiens
aaagggagauggaaagaga

SEQ ID NO: 763696 - RNA, 19 nt, Homo sapiens
ggacagaucacuagcaauc

SEQ ID NO: 763697 - RNA, 19 nt, Homo sapiens
gcucugauguugaacuuau

SEQ ID NO: 763698 - RNA, 19 nt, Homo sapiens
gaagaaagggagauggaaa

SEQ ID NO: 763699 - RNA, 19 nt, Homo sapiens
ggaaucugcuggagacaau

SEQ ID NO: 763700 - RNA, 19 nt, Homo sapiens
gaacaagggagccucuuau

SEQ ID NO: 763701 - RNA, 19 nt, Homo sapiens
cccaaagucuuaaguacua

SEQ ID NO: 763702 - RNA, 19 nt, Homo sapiens
uaucagacaucacaacaug

SEQ ID NO: 763703 - RNA, 19 nt, Homo sapiens
gaacuuugcaacuagauga

SEQ ID NO: 763704 - RNA, 19 nt, Homo sapiens
agaacaaccugguggaauu

SEQ ID NO: 763705 - RNA, 19 nt, Homo sapiens
caaggugacaguuacuuua

SEQ ID NO: 763706 - RNA, 19 nt, Homo sapiens
ggugggaccuugauacuca

SEQ ID NO: 763707 - RNA, 19 nt, Homo sapiens
gacacaaacugccuguuau

SEQ ID NO: 763708 - RNA, 19 nt, Homo sapiens
uaugggaugugaucaauga

SEQ ID NO: 763709 - RNA, 19 nt, Homo sapiens
ggaugugguuuccagcuuu

SEQ ID NO: 763710 - RNA, 19 nt, Homo sapiens
gagacuauguuguaucauc

SEQ ID NO: 763711 - RNA, 19 nt, Homo sapiens
ccacaagucucucuuugca

SEQ ID NO: 763712 - RNA, 19 nt, Homo sapiens
ucauucagcucagacaaua

SEQ ID NO: 763713 - RNA, 19 nt, Homo sapiens
agacagaguuguaaaccuu

SEQ ID NO: 763714 - RNA, 19 nt, Homo sapiens
gaaggaagagacagaguug

SEQ ID NO: 763715 - RNA, 19 nt, Homo sapiens
ucacuaccuugaaguauga

SEQ ID NO: 763716 - RNA, 19 nt, Homo sapiens
gggcugggcuccauuucuu

SEQ ID NO: 763717 - RNA, 19 nt, Homo sapiens
gcuauuggcugugucuuug

SEQ ID NO: 763718 - RNA, 19 nt, Homo sapiens
ugacuuggcuucagggaau

SEQ ID NO: 763719 - RNA, 19 nt, Homo sapiens
gaacagcguccucagacuu

SEQ ID NO: 763720 - RNA, 19 nt, Homo sapiens
acaaccaggugcauaauug

SEQ ID NO: 763721 - RNA, 19 nt, Homo sapiens
gagacaaccaggugcauaa

SEQ ID NO: 763722 - RNA, 19 nt, Homo sapiens
caaacugccuguuauaugc

SEQ ID NO: 763723 - RNA, 19 nt, Homo sapiens
aaaugagucugcaagauga

SEQ ID NO: 763724 - RNA, 19 nt, Homo sapiens
gaagagacagaguuguaaa

SEQ ID NO: 763725 - RNA, 19 nt, Homo sapiens
gaaguaugaucagcuagga

SEQ ID NO: 763726 - RNA, 19 nt, Homo sapiens
cauaauugauugcccuuug

SEQ ID NO: 763727 - RNA, 19 nt, Homo sapiens
gaagaucgcauugcagaug

SEQ ID NO: 763728 - RNA, 19 nt, Homo sapiens
acugaaaugugguaucuuu

SEQ ID NO: 763729 - RNA, 19 nt, Homo sapiens
ggaagagacagaguuguaa

SEQ ID NO: 763730 - RNA, 19 nt, Homo sapiens
gaaaugugaccuucaaugg

SEQ ID NO: 763731 - RNA, 19 nt, Homo sapiens
accuucagcuuauguauua

SEQ ID NO: 763732 - RNA, 19 nt, Homo sapiens
ggaauuccaacaugagauu

SEQ ID NO: 763733 - RNA, 19 nt, Homo sapiens
gaagagaagaagaggaaga

SEQ ID NO: 763734 - RNA, 19 nt, Homo sapiens
gaaggaacacaaagccauu

SEQ ID NO: 763735 - RNA, 19 nt, Homo sapiens
aaagagaagcagaauauga

SEQ ID NO: 763736 - RNA, 19 nt, Homo sapiens
gggagccucuuauucuuga

SEQ ID NO: 763737 - RNA, 19 nt, Homo sapiens
gcagacaaauuugaacaca

SEQ ID NO: 763738 - RNA, 19 nt, Homo sapiens
gaaaauaguacccaaaaga

SEQ ID NO: 763739 - RNA, 19 nt, Homo sapiens
acaaugaccugugaauaug

SEQ ID NO: 763740 - RNA, 19 nt, Homo sapiens
gaacugacucugugcuaga

SEQ ID NO: 763741 - RNA, 19 nt, Homo sapiens
cagaagaguuggcgucauc

SEQ ID NO: 763742 - RNA, 19 nt, Homo sapiens
caagggagccucuuauucu

SEQ ID NO: 763743 - RNA, 19 nt, Homo sapiens
gacagguggugcagauaaa

SEQ ID NO: 763744 - RNA, 19 nt, Homo sapiens
ggaagauccugagguuaau

SEQ ID NO: 763745 - RNA, 19 nt, Homo sapiens
ggaaaugugaccuucaaug

SEQ ID NO: 763746 - RNA, 19 nt, Homo sapiens
gcugggcucugauguugaa

SEQ ID NO: 763747 - RNA, 19 nt, Homo sapiens
cagcugggcucugauguug

SEQ ID NO: 763748 - RNA, 19 nt, Homo sapiens
gaagauguucuguguguca

SEQ ID NO: 763749 - RNA, 19 nt, Homo sapiens
ggaaggaagagacagaguu

SEQ ID NO: 763750 - RNA, 19 nt, Homo sapiens
caaggacacagauauuauu

SEQ ID NO: 763751 - RNA, 19 nt, Homo sapiens
gaguuggcgucaucuuaaa

SEQ ID NO: 763752 - RNA, 19 nt, Homo sapiens
guuaucggcuucaauaugg

SEQ ID NO: 763753 - RNA, 19 nt, Homo sapiens
uaucucaccuucagcuuau

SEQ ID NO: 763754 - RNA, 19 nt, Homo sapiens
gguaauauugucuuuguga

SEQ ID NO: 763755 - RNA, 19 nt, Homo sapiens
uauggaggcuauugaguug

SEQ ID NO: 763756 - RNA, 19 nt, Homo sapiens
acagugggaugcagacaaa

SEQ ID NO: 763757 - RNA, 19 nt, Homo sapiens
gaaaauggauaagaagaug

SEQ ID NO: 763758 - RNA, 19 nt, Homo sapiens
gaucgaauccuuucaugca

SEQ ID NO: 763759 - RNA, 19 nt, Homo sapiens
cggaaaagaucauaagauu

SEQ ID NO: 763760 - RNA, 19 nt, Homo sapiens
gaacaaccugguggaauug

SEQ ID NO: 763761 - RNA, 19 nt, Homo sapiens
gauaagaagaugaagaaag

SEQ ID NO: 763762 - RNA, 19 nt, Homo sapiens
gggcuuaaacaagaaguua

SEQ ID NO: 763763 - RNA, 19 nt, Homo sapiens
acuaguagccuguuauuga

SEQ ID NO: 763764 - RNA, 19 nt, Homo sapiens
caggaaauaugguguuugg

SEQ ID NO: 763765 - RNA, 19 nt, Homo sapiens
gcaaaggagaggaggaaga

SEQ ID NO: 763766 - RNA, 19 nt, Homo sapiens
caaugaaaguggucuguac

SEQ ID NO: 763767 - RNA, 19 nt, Homo sapiens
ccaggugcauaauugauug

SEQ ID NO: 763768 - RNA, 19 nt, Homo sapiens
ggacaagcagaaucacuau

SEQ ID NO: 763769 - RNA, 19 nt, Homo sapiens
gaaagauaccauggugaaa

SEQ ID NO: 763770 - RNA, 19 nt, Homo sapiens
acacaaacugccuguuaua

SEQ ID NO: 763771 - RNA, 19 nt, Homo sapiens
agaugaagauguucugugu

SEQ ID NO: 763772 - RNA, 19 nt, Homo sapiens
gcagcaaucuucauuauuu

SEQ ID NO: 763773 - RNA, 19 nt, Homo sapiens
uaacacugcuggacaauau

SEQ ID NO: 763774 - RNA, 19 nt, Homo sapiens
gaaauacugugguuugcuu

SEQ ID NO: 763775 - RNA, 19 nt, Homo sapiens
ggccauaagugauuuacua

SEQ ID NO: 763776 - RNA, 19 nt, Homo sapiens
gacacaaacucuucagaaa

SEQ ID NO: 763777 - RNA, 19 nt, Homo sapiens
agacucaacucccagaaua

SEQ ID NO: 763778 - RNA, 19 nt, Homo sapiens
uaacagcagugagauuuaa

SEQ ID NO: 763779 - RNA, 19 nt, Homo sapiens
ucacuaaucucuucaucuu

SEQ ID NO: 763780 - RNA, 19 nt, Homo sapiens
gaacaaacauaugcacaca

SEQ ID NO: 763781 - RNA, 19 nt, Homo sapiens
guaaugaggaacaaacaua

SEQ ID NO: 763782 - RNA, 19 nt, Homo sapiens
gugguuugcuuuauuguaa

SEQ ID NO: 763783 - RNA, 19 nt, Homo sapiens
ugucgcagcuucagucuuu

SEQ ID NO: 763784 - RNA, 19 nt, Homo sapiens
ggacacaaacucuucagaa

SEQ ID NO: 763785 - RNA, 19 nt, Homo sapiens
ggggaaaccuugcuuuaua

SEQ ID NO: 763786 - RNA, 19 nt, Homo sapiens
gaaacacgaugugcaagau

SEQ ID NO: 763787 - RNA, 19 nt, Homo sapiens
acacaaagcaucaucugua

SEQ ID NO: 763788 - RNA, 19 nt, Homo sapiens
aaacacaucuaaucagcuu

SEQ ID NO: 763789 - RNA, 19 nt, Homo sapiens
gcgcucggauucugaguuu

SEQ ID NO: 763790 - RNA, 19 nt, Homo sapiens
caucauguauggaaggauu

SEQ ID NO: 763791 - RNA, 19 nt, Homo sapiens
aaccaaagcucacuaucaa

SEQ ID NO: 763792 - RNA, 19 nt, Homo sapiens
aaaccuugcuuuauaggaa

SEQ ID NO: 763793 - RNA, 19 nt, Homo sapiens
gggaaaccuugcuuuauag

SEQ ID NO: 763794 - RNA, 19 nt, Homo sapiens
ccaggaaucuacauuucaa

SEQ ID NO: 763795 - RNA, 19 nt, Homo sapiens
uaaugaugcucucagacua

SEQ ID NO: 763796 - RNA, 19 nt, Homo sapiens
uuaccuaugugaacuacua

SEQ ID NO: 763797 - RNA, 19 nt, Homo sapiens
ggauaugaauagcuucuuc

SEQ ID NO: 763798 - RNA, 19 nt, Homo sapiens
gaugggaaauacugugguu

SEQ ID NO: 763799 - RNA, 19 nt, Homo sapiens
cuacaccacugugcuguuu

SEQ ID NO: 763800 - RNA, 19 nt, Homo sapiens
ggaaacacgaugugcaaga

SEQ ID NO: 763801 - RNA, 19 nt, Homo sapiens
caucauuuaugguuucuuc

SEQ ID NO: 763802 - RNA, 19 nt, Homo sapiens
gaaaugaggaagaucuaca

SEQ ID NO: 763803 - RNA, 19 nt, Homo sapiens
ccaaagcucacuaucaaga

SEQ ID NO: 763804 - RNA, 19 nt, Homo sapiens
uaugugaacuacuaucuuc

SEQ ID NO: 763805 - RNA, 19 nt, Homo sapiens
ggucauaagaucauaaaca

SEQ ID NO: 763806 - RNA, 19 nt, Homo sapiens
agacuacgcugaccuuucu

SEQ ID NO: 763807 - RNA, 19 nt, Homo sapiens
gauuggaauuucacucuuc

SEQ ID NO: 763808 - RNA, 19 nt, Homo sapiens
gaaaugggacacaaacucu

SEQ ID NO: 763809 - RNA, 19 nt, Homo sapiens
cagcuucagucuuuacguu

SEQ ID NO: 763810 - RNA, 19 nt, Homo sapiens
gaaagugacgucucaucug

SEQ ID NO: 763811 - RNA, 19 nt, Homo sapiens
uuaagaugcuccugauugu

SEQ ID NO: 763812 - RNA, 19 nt, Homo sapiens
ccaaaugaacugcagauca

SEQ ID NO: 763813 - RNA, 19 nt, Homo sapiens
acgcugaccuuucuccaaa

SEQ ID NO: 763814 - RNA, 19 nt, Homo sapiens
acaaacauaugcacacagu

SEQ ID NO: 763815 - RNA, 19 nt, Homo sapiens
uggcagcaaucuucauuau

SEQ ID NO: 763816 - RNA, 19 nt, Homo sapiens
cuaacucuacuacgcauua

SEQ ID NO: 763817 - RNA, 19 nt, Homo sapiens
gagaauuuccgccgugguu

SEQ ID NO: 763818 - RNA, 19 nt, Homo sapiens
gaacugcagaucaucaaca

SEQ ID NO: 763819 - RNA, 19 nt, Homo sapiens
caucccaucuggaauguca

SEQ ID NO: 763820 - RNA, 19 nt, Homo sapiens
aaagccaugugcucauaaa

SEQ ID NO: 763821 - RNA, 19 nt, Homo sapiens
gugucaaucccaucauuua

SEQ ID NO: 763822 - RNA, 19 nt, Homo sapiens
ggauuggaauuucacucuu

SEQ ID NO: 763823 - RNA, 19 nt, Homo sapiens
cagcguuugucauuauuau

SEQ ID NO: 763824 - RNA, 19 nt, Homo sapiens
aaacauaugcacacaguca

SEQ ID NO: 763825 - RNA, 19 nt, Homo sapiens
ggaaagugacgucucaucu

SEQ ID NO: 763826 - RNA, 19 nt, Homo sapiens
uaaaagccaugugcucaua

SEQ ID NO: 763827 - RNA, 19 nt, Homo sapiens
ugaccuuucuccaaaugaa

SEQ ID NO: 763828 - RNA, 19 nt, Homo sapiens
ggaauuagugauggaagaa

SEQ ID NO: 763829 - RNA, 19 nt, Homo sapiens
ucaucaacaucuacaucua

SEQ ID NO: 763830 - RNA, 19 nt, Homo sapiens
aaaccaaagcucacuauca

SEQ ID NO: 763831 - RNA, 19 nt, Homo sapiens
cuauaacacugcuggacaa

SEQ ID NO: 763832 - RNA, 19 nt, Homo sapiens
guccaggaaucuacauuuc

SEQ ID NO: 763833 - RNA, 19 nt, Homo sapiens
caaaucaggaaaugaggaa

SEQ ID NO: 763834 - RNA, 19 nt, Homo sapiens
cgggaagacuggccaaauc

SEQ ID NO: 763835 - RNA, 19 nt, Homo sapiens
caauugcuguagauagguu

SEQ ID NO: 763836 - RNA, 19 nt, Homo sapiens
acacugcuggacaauauua

SEQ ID NO: 763837 - RNA, 19 nt, Homo sapiens
guagagugacuuagacaug

SEQ ID NO: 763838 - RNA, 19 nt, Homo sapiens
gauaauccuaacucuacua

SEQ ID NO: 763839 - RNA, 19 nt, Homo sapiens
ccuguggacucuaaugaug

SEQ ID NO: 763840 - RNA, 19 nt, Homo sapiens
gguccuagccaucaccauu

SEQ ID NO: 763841 - RNA, 19 nt, Homo sapiens
cagcaaucuucauuauuuc

SEQ ID NO: 763842 - RNA, 19 nt, Homo sapiens
ucaaguggcagcaaucuuc

SEQ ID NO: 763843 - RNA, 19 nt, Homo sapiens
gugauaauccuaacucuac

SEQ ID NO: 763844 - RNA, 19 nt, Homo sapiens
gcucauaaacacaucuaau

SEQ ID NO: 763845 - RNA, 19 nt, Homo sapiens
gcugaccuuucuccaaaug

SEQ ID NO: 763846 - RNA, 19 nt, Homo sapiens
cacagucacuaaucucuuc

SEQ ID NO: 763847 - RNA, 19 nt, Homo sapiens
gauucugaguuucacaaga

SEQ ID NO: 763848 - RNA, 19 nt, Homo sapiens
uagagugacuuagacaugu

SEQ ID NO: 763849 - RNA, 19 nt, Homo sapiens
gaaagcccucucuggcaaa

SEQ ID NO: 763850 - RNA, 19 nt, Homo sapiens
gcuagugugauaauccuaa

SEQ ID NO: 763851 - RNA, 19 nt, Homo sapiens
gaucaucaacaucuacauc

SEQ ID NO: 763852 - RNA, 19 nt, Homo sapiens
ucauuaagaugcuccugau

SEQ ID NO: 763853 - RNA, 19 nt, Homo sapiens
gcagaagaucauuaagaug

SEQ ID NO: 763854 - RNA, 19 nt, Homo sapiens
agcagaagaucauuaagau

SEQ ID NO: 763855 - RNA, 19 nt, Homo sapiens
aagcagaagaucauuaaga

SEQ ID NO: 763856 - RNA, 19 nt, Homo sapiens
gcacgugguguccaggaaa

SEQ ID NO: 763857 - RNA, 19 nt, Homo sapiens
guccuagccaucaccauua

SEQ ID NO: 763858 - RNA, 19 nt, Homo sapiens
uagauagguuccagugugu

SEQ ID NO: 763859 - RNA, 19 nt, Homo sapiens
gcaggauggccauuuggaa

SEQ ID NO: 763860 - RNA, 19 nt, Homo sapiens
ugauacugaugcuuccuuu

SEQ ID NO: 763861 - RNA, 19 nt, Homo sapiens
acaucuacaucuacccuuu

SEQ ID NO: 763862 - RNA, 19 nt, Homo sapiens
caggauggccauuuggaaa

SEQ ID NO: 763863 - RNA, 19 nt, Homo sapiens
cuaacagcagugagauuua

SEQ ID NO: 763864 - RNA, 19 nt, Homo sapiens
gcuggugccuccuggaaag

SEQ ID NO: 763865 - RNA, 19 nt, Homo sapiens
cagugucaaucccaucauu

SEQ ID NO: 763866 - RNA, 19 nt, Homo sapiens
gggaagacuggccaaauca

SEQ ID NO: 763867 - RNA, 19 nt, Homo sapiens
ggauggccauuuggaaaca

SEQ ID NO: 763868 - RNA, 19 nt, Homo sapiens
caucuuaaaccuggccaua

SEQ ID NO: 763869 - RNA, 19 nt, Homo sapiens
cacaaagcaucaucuguac

SEQ ID NO: 763870 - RNA, 19 nt, Homo sapiens
ccuggaaagugacgucuca

SEQ ID NO: 763871 - RNA, 19 nt, Homo sapiens
cagacgggcuugguggauu

SEQ ID NO: 763872 - RNA, 19 nt, Homo sapiens
gcagcaaucuucauuauuu

SEQ ID NO: 763873 - RNA, 19 nt, Homo sapiens
uaacacugcuggacaauau

SEQ ID NO: 763874 - RNA, 19 nt, Homo sapiens
gaaauacugugguuugcuu

SEQ ID NO: 763875 - RNA, 19 nt, Homo sapiens
ggccauaagugauuuacua

SEQ ID NO: 763876 - RNA, 19 nt, Homo sapiens
gacacaaacucuucagaaa

SEQ ID NO: 763877 - RNA, 19 nt, Homo sapiens
agacucaacucccagaaua

SEQ ID NO: 763878 - RNA, 19 nt, Homo sapiens
uaacagcagugagauuuaa

SEQ ID NO: 763879 - RNA, 19 nt, Homo sapiens
ucacuaaucucuucaucuu

SEQ ID NO: 763880 - RNA, 19 nt, Homo sapiens
gaacaaacauaugcacaca

SEQ ID NO: 763881 - RNA, 19 nt, Homo sapiens
guaaugaggaacaaacaua

SEQ ID NO: 763882 - RNA, 19 nt, Homo sapiens
gugguuugcuuuauuguaa

SEQ ID NO: 763883 - RNA, 19 nt, Homo sapiens
ugucgcagcuucagucuuu

SEQ ID NO: 763884 - RNA, 19 nt, Homo sapiens
ggacacaaacucuucagaa

SEQ ID NO: 763885 - RNA, 19 nt, Homo sapiens
ggggaaaccuugcuuuaua

SEQ ID NO: 763886 - RNA, 19 nt, Homo sapiens
gaaacacgaugugcaagau

SEQ ID NO: 763887 - RNA, 19 nt, Homo sapiens
acacaaagcaucaucugua

SEQ ID NO: 763888 - RNA, 19 nt, Homo sapiens
aaacacaucuaaucagcuu

SEQ ID NO: 763889 - RNA, 19 nt, Homo sapiens
caucauguauggaaggauu

SEQ ID NO: 763890 - RNA, 19 nt, Homo sapiens
aaccaaagcucacuaucaa

SEQ ID NO: 763891 - RNA, 19 nt, Homo sapiens
aaaccuugcuuuauaggaa

SEQ ID NO: 763892 - RNA, 19 nt, Homo sapiens
gggaaaccuugcuuuauag

SEQ ID NO: 763893 - RNA, 19 nt, Homo sapiens
ccaggaaucuacauuucaa

SEQ ID NO: 763894 - RNA, 19 nt, Homo sapiens
ggaagaagcagaagaucau

SEQ ID NO: 763895 - RNA, 19 nt, Homo sapiens
uaaugaugcucucagacua

SEQ ID NO: 763896 - RNA, 19 nt, Homo sapiens
uuaccuaugugaacuacua

SEQ ID NO: 763897 - RNA, 19 nt, Homo sapiens
gaugggaaauacugugguu

SEQ ID NO: 763898 - RNA, 19 nt, Homo sapiens
cuacaccacugugcuguuu

SEQ ID NO: 763899 - RNA, 19 nt, Homo sapiens
ggaaacacgaugugcaaga

SEQ ID NO: 763900 - RNA, 19 nt, Homo sapiens
caucauuuaugguuucuuc

SEQ ID NO: 763901 - RNA, 19 nt, Homo sapiens
gaaaugaggaagaucuaca

SEQ ID NO: 763902 - RNA, 19 nt, Homo sapiens
ccaaagcucacuaucaaga

SEQ ID NO: 763903 - RNA, 19 nt, Homo sapiens
uaugugaacuacuaucuuc

SEQ ID NO: 763904 - RNA, 19 nt, Homo sapiens
ggucauaagaucauaaaca

SEQ ID NO: 763905 - RNA, 19 nt, Homo sapiens
agacuacgcugaccuuucu

SEQ ID NO: 763906 - RNA, 19 nt, Homo sapiens
gauuggaauuucacucuuc

SEQ ID NO: 763907 - RNA, 19 nt, Homo sapiens
gaaaugggacacaaacucu

SEQ ID NO: 763908 - RNA, 19 nt, Homo sapiens
cagcuucagucuuuacguu

SEQ ID NO: 763909 - RNA, 19 nt, Homo sapiens
uuaagaugcuccugauugu

SEQ ID NO: 763910 - RNA, 19 nt, Homo sapiens
ccaaaugaacugcagauca

SEQ ID NO: 763911 - RNA, 19 nt, Homo sapiens
acgcugaccuuucuccaaa

SEQ ID NO: 763912 - RNA, 19 nt, Homo sapiens
acaaacauaugcacacagu

SEQ ID NO: 763913 - RNA, 19 nt, Homo sapiens
uggcagcaaucuucauuau

SEQ ID NO: 763914 - RNA, 19 nt, Homo sapiens
cuaacucuacuacgcauua

SEQ ID NO: 763915 - RNA, 19 nt, Homo sapiens
gagaauuuccgccgugguu

SEQ ID NO: 763916 - RNA, 19 nt, Homo sapiens
gaacugcagaucaucaaca

SEQ ID NO: 763917 - RNA, 19 nt, Homo sapiens
agaagcagaagaucauuaa

SEQ ID NO: 763918 - RNA, 19 nt, Homo sapiens
caucccaucuggaauguca

SEQ ID NO: 763919 - RNA, 19 nt, Homo sapiens
aaagccaugugcucauaaa

SEQ ID NO: 763920 - RNA, 19 nt, Homo sapiens
gugucaaucccaucauuua

SEQ ID NO: 763921 - RNA, 19 nt, Homo sapiens
ggauuggaauuucacucuu

SEQ ID NO: 763922 - RNA, 19 nt, Homo sapiens
cagcguuugucauuauuau

SEQ ID NO: 763923 - RNA, 19 nt, Homo sapiens
aaacauaugcacacaguca

SEQ ID NO: 763924 - RNA, 19 nt, Homo sapiens
uaaaagccaugugcucaua

SEQ ID NO: 763925 - RNA, 19 nt, Homo sapiens
ugaccuuucuccaaaugaa

SEQ ID NO: 763926 - RNA, 19 nt, Homo sapiens
ggaauuagugauggaagaa

SEQ ID NO: 763927 - RNA, 19 nt, Homo sapiens
ucaucaacaucuacaucua

SEQ ID NO: 763928 - RNA, 19 nt, Homo sapiens
aaaccaaagcucacuauca

SEQ ID NO: 763929 - RNA, 19 nt, Homo sapiens
cuauaacacugcuggacaa

SEQ ID NO: 763930 - RNA, 19 nt, Homo sapiens
guccaggaaucuacauuuc

SEQ ID NO: 763931 - RNA, 19 nt, Homo sapiens
caaaucaggaaaugaggaa

SEQ ID NO: 763932 - RNA, 19 nt, Homo sapiens
cgggaagacuggccaaauc

SEQ ID NO: 763933 - RNA, 19 nt, Homo sapiens
caauugcuguagauagguu

SEQ ID NO: 763934 - RNA, 19 nt, Homo sapiens
acacugcuggacaauauua

SEQ ID NO: 763935 - RNA, 19 nt, Homo sapiens
guagagugacuuagacaug

SEQ ID NO: 763936 - RNA, 19 nt, Homo sapiens
gauaauccuaacucuacua

SEQ ID NO: 763937 - RNA, 19 nt, Homo sapiens
ccuguggacucuaaugaug

SEQ ID NO: 763938 - RNA, 19 nt, Homo sapiens
gguccuagccaucaccauu

SEQ ID NO: 763939 - RNA, 19 nt, Homo sapiens
cagcaaucuucauuauuuc

SEQ ID NO: 763940 - RNA, 19 nt, Homo sapiens
ucaaguggcagcaaucuuc

SEQ ID NO: 763941 - RNA, 19 nt, Homo sapiens
gugauaauccuaacucuac

SEQ ID NO: 763942 - RNA, 19 nt, Homo sapiens
gcucauaaacacaucuaau

SEQ ID NO: 763943 - RNA, 19 nt, Homo sapiens
gcugaccuuucuccaaaug

SEQ ID NO: 763944 - RNA, 19 nt, Homo sapiens
gaagaagcagaagaucauu

SEQ ID NO: 763945 - RNA, 19 nt, Homo sapiens
cacagucacuaaucucuuc

SEQ ID NO: 763946 - RNA, 19 nt, Homo sapiens
uagagugacuuagacaugu

SEQ ID NO: 763947 - RNA, 19 nt, Homo sapiens
gaaagcccucucuggcaaa

SEQ ID NO: 763948 - RNA, 19 nt, Homo sapiens
gcuagugugauaauccuaa

SEQ ID NO: 763949 - RNA, 19 nt, Homo sapiens
gaucaucaacaucuacauc

SEQ ID NO: 763950 - RNA, 19 nt, Homo sapiens
ucauuaagaugcuccugau

SEQ ID NO: 763951 - RNA, 19 nt, Homo sapiens
gcagaagaucauuaagaug

SEQ ID NO: 763952 - RNA, 19 nt, Homo sapiens
agcagaagaucauuaagau

SEQ ID NO: 763953 - RNA, 19 nt, Homo sapiens
aagcagaagaucauuaaga

SEQ ID NO: 763954 - RNA, 19 nt, Homo sapiens
guccuagccaucaccauua

SEQ ID NO: 763955 - RNA, 19 nt, Homo sapiens
uagauagguuccagugugu

SEQ ID NO: 763956 - RNA, 19 nt, Homo sapiens
gcaggauggccauuuggaa

SEQ ID NO: 763957 - RNA, 19 nt, Homo sapiens
acaucuacaucuacccuuu

SEQ ID NO: 763958 - RNA, 19 nt, Homo sapiens
caggauggccauuuggaaa

SEQ ID NO: 763959 - RNA, 19 nt, Homo sapiens
cuaacagcagugagauuua

SEQ ID NO: 763960 - RNA, 19 nt, Homo sapiens
cagugucaaucccaucauu

SEQ ID NO: 763961 - RNA, 19 nt, Homo sapiens
gggaagacuggccaaauca

SEQ ID NO: 763962 - RNA, 19 nt, Homo sapiens
ggauggccauuuggaaaca

SEQ ID NO: 763963 - RNA, 19 nt, Homo sapiens
cacaaagcaucaucuguac

SEQ ID NO: 763964 - RNA, 19 nt, Homo sapiens
caucuuaaaccuggccaua

SEQ ID NO: 763965 - RNA, 19 nt, Homo sapiens
aagaagcagaagaucauua

SEQ ID NO: 763966 - RNA, 19 nt, Homo sapiens
uauggaaggauuggaauuu

SEQ ID NO: 763967 - RNA, 19 nt, Homo sapiens
caaagcaucaucuguacuc

SEQ ID NO: 763968 - RNA, 19 nt, Homo sapiens
gaaaccuugcuuuauagga

SEQ ID NO: 763969 - RNA, 19 nt, Homo sapiens
ggaagcuuaugcccuaaaa

SEQ ID NO: 763970 - RNA, 19 nt, Homo sapiens
ucaaugacacaaagcauca

SEQ ID NO: 763971 - RNA, 19 nt, Homo sapiens
ccaggaagaagcagaagau

SEQ ID NO: 763972 - RNA, 19 nt, Homo sapiens
gaacgacaccgucaaguac

SEQ ID NO: 763973 - RNA, 19 nt, Homo sapiens
acagguaucuggcuauugu

SEQ ID NO: 763974 - RNA, 19 nt, Homo sapiens
gugcagaccuggaccucaa

SEQ ID NO: 763975 - RNA, 19 nt, Homo sapiens
ucaaggcggucccuggauu

SEQ ID NO: 763976 - RNA, 19 nt, Homo sapiens
ccuuugagauggacuacua

SEQ ID NO: 763977 - RNA, 19 nt, Homo sapiens
ggaugaagaugaggaugug

SEQ ID NO: 763978 - RNA, 19 nt, Homo sapiens
cagcagcucuacuacaagu

SEQ ID NO: 763979 - RNA, 19 nt, Homo sapiens
ugacagguaucuggcuauu

SEQ ID NO: 763980 - RNA, 19 nt, Homo sapiens
cuacagcgacuaugauaug

SEQ ID NO: 763981 - RNA, 19 nt, Homo sapiens
ccgaagagguggacugcau

SEQ ID NO: 763982 - RNA, 19 nt, Homo sapiens
ugauaugccuuuggaugaa

SEQ ID NO: 763983 - RNA, 19 nt, Homo sapiens
agaacgacaccgucaagua

SEQ ID NO: 763984 - RNA, 19 nt, Homo sapiens
cauuggaaacuucaucuuu

SEQ ID NO: 763985 - RNA, 19 nt, Homo sapiens
ucaacuaccugcgcacugu

SEQ ID NO: 763986 - RNA, 19 nt, Homo sapiens
ccacuuccuucccauucaa

SEQ ID NO: 763987 - RNA, 19 nt, Homo sapiens
cuacuuccucuuuaucuuu

SEQ ID NO: 763988 - RNA, 19 nt, Homo sapiens
gaagagguggacugcauca

SEQ ID NO: 763989 - RNA, 19 nt, Homo sapiens
gugcaccucugucaacuac

SEQ ID NO: 763990 - RNA, 19 nt, Homo sapiens
gcaacagcaugaucaacac

SEQ ID NO: 763991 - RNA, 19 nt, Homo sapiens
ccgcugagaccacggauga

SEQ ID NO: 763992 - RNA, 19 nt, Homo sapiens
ccauucaacuucagcuaca

SEQ ID NO: 763993 - RNA, 19 nt, Homo sapiens
ccaucgccauugacaggua

SEQ ID NO: 763994 - RNA, 19 nt, Homo sapiens
gacaaugccaccaacacuu

SEQ ID NO: 763995 - RNA, 19 nt, Homo sapiens
accagcagcucuacuacaa

SEQ ID NO: 763996 - RNA, 19 nt, Homo sapiens
ugagauggacuacuaugug

SEQ ID NO: 763997 - RNA, 19 nt, Homo sapiens
acuaugauaugccuuugga

SEQ ID NO: 763998 - RNA, 19 nt, Homo sapiens
gcgacuaugauaugccuuu

SEQ ID NO: 763999 - RNA, 19 nt, Homo sapiens
gaccuggaccucaagacaa

SEQ ID NO: 764000 - RNA, 19 nt, Homo sapiens
gcacugucucucucuaugu

SEQ ID NO: 764001 - RNA, 19 nt, Homo sapiens
ggaaacuucaucuuuaucg

SEQ ID NO: 764002 - RNA, 19 nt, Homo sapiens
gaugaggaugugaccaauu

SEQ ID NO: 764003 - RNA, 19 nt, Homo sapiens
cuaccucacugccuucuac

SEQ ID NO: 764004 - RNA, 19 nt, Homo sapiens
augaggaugugaccaauuc

SEQ ID NO: 764005 - RNA, 19 nt, Homo sapiens
ccucaccgccuacgugcua

SEQ ID NO: 764006 - RNA, 19 nt, Homo sapiens
gcaccucugucaacuaccu

SEQ ID NO: 764007 - RNA, 19 nt, Homo sapiens
cgacuaugauaugccuuug

SEQ ID NO: 764008 - RNA, 19 nt, Homo sapiens
ccaccagcuuccuuucugu

SEQ ID NO: 764009 - RNA, 19 nt, Homo sapiens
caagaacgacaccgucaag

SEQ ID NO: 764010 - RNA, 19 nt, Homo sapiens
gauaugccuuuggaugaag

SEQ ID NO: 764011 - RNA, 19 nt, Homo sapiens
ggagaagcacuaccucacu

SEQ ID NO: 764012 - RNA, 19 nt, Homo sapiens
ccaccguguucgugaagga

SEQ ID NO: 764013 - RNA, 19 nt, Homo sapiens
ucagcuacagcgacuauga

SEQ ID NO: 764014 - RNA, 19 nt, Homo sapiens
cggaugaagugccaaacag

SEQ ID NO: 764015 - RNA, 19 nt, Homo sapiens
guaucuggcuauuguccau

SEQ ID NO: 764016 - RNA, 19 nt, Homo sapiens
gcccugguccgcuacaaga

SEQ ID NO: 764017 - RNA, 19 nt, Homo sapiens
gccacuuccuucccauuca

SEQ ID NO: 764018 - RNA, 19 nt, Homo sapiens
guggacugcaucagacuaa

SEQ ID NO: 764019 - RNA, 19 nt, Homo sapiens
ccacggaugaagugccaaa

SEQ ID NO: 764020 - RNA, 19 nt, Homo sapiens
cagagcagauccgcaagag

SEQ ID NO: 764021 - RNA, 19 nt, Homo sapiens
ccuacuuccucuuuaucuu

SEQ ID NO: 764022 - RNA, 19 nt, Homo sapiens
cuuuaucuuuggcauagaa

SEQ ID NO: 764023 - RNA, 19 nt, Homo sapiens
aguccuacuuccucuuuau

SEQ ID NO: 764024 - RNA, 19 nt, Homo sapiens
acaaugccaccaacacuuc

SEQ ID NO: 764025 - RNA, 19 nt, Homo sapiens
caucgccauugacagguau

SEQ ID NO: 764026 - RNA, 19 nt, Homo sapiens
acaagaaacugcgcaaccu

SEQ ID NO: 764027 - RNA, 19 nt, Homo sapiens
agagguggacugcaucaga

SEQ ID NO: 764028 - RNA, 19 nt, Homo sapiens
gcauuggaaacuucaucuu

SEQ ID NO: 764029 - RNA, 19 nt, Homo sapiens
uaucuuuggcauagaauuc

SEQ ID NO: 764030 - RNA, 19 nt, Homo sapiens
gaccagcagcucuacuaca

SEQ ID NO: 764031 - RNA, 19 nt, Homo sapiens
caucgugcgcgacuucuuc

SEQ ID NO: 764032 - RNA, 19 nt, Homo sapiens
uacuuccucuuuaucuuug

SEQ ID NO: 764033 - RNA, 19 nt, Homo sapiens
gcuacagcgacuaugauau

SEQ ID NO: 764034 - RNA, 19 nt, Homo sapiens
ccaauuccaggacguucuu

SEQ ID NO: 764035 - RNA, 19 nt, Homo sapiens
aagaugaggaugugaccaa

SEQ ID NO: 764036 - RNA, 19 nt, Homo sapiens
cccgggagcucugguucaa

SEQ ID NO: 764037 - RNA, 19 nt, Homo sapiens
uggaccagcagcucuacua

SEQ ID NO: 764038 - RNA, 19 nt, Homo sapiens
ugagaccacggaugaagug

SEQ ID NO: 764039 - RNA, 19 nt, Homo sapiens
gcgcacugucucucucuau

SEQ ID NO: 764040 - RNA, 19 nt, Homo sapiens
gaaggagaccuaaaucaua

SEQ ID NO: 764041 - RNA, 19 nt, Homo sapiens
gaaacacacuccugcagaa

SEQ ID NO: 764042 - RNA, 19 nt, Homo sapiens
gaacagcacauggauauuu

SEQ ID NO: 764043 - RNA, 19 nt, Homo sapiens
caacaaugcccucuacuuu

SEQ ID NO: 764044 - RNA, 19 nt, Homo sapiens
ggauugagcuaaaggcauu

SEQ ID NO: 764045 - RNA, 19 nt, Homo sapiens
guucauaaauucccaucua

SEQ ID NO: 764046 - RNA, 19 nt, Homo sapiens
gaccauggcuacguucuuu

SEQ ID NO: 764047 - RNA, 19 nt, Homo sapiens
cagcugaccucuucuggaa

SEQ ID NO: 764048 - RNA, 19 nt, Homo sapiens
ugaaagcccugcucauugu

SEQ ID NO: 764049 - RNA, 19 nt, Homo sapiens
ggacaacguuggcccagau

SEQ ID NO: 764050 - RNA, 19 nt, Homo sapiens
gaacgagaacuucaggauu

SEQ ID NO: 764051 - RNA, 19 nt, Homo sapiens
caaauacagugaggacauu

SEQ ID NO: 764052 - RNA, 19 nt, Homo sapiens
cuagacauguguucauaaa

SEQ ID NO: 764053 - RNA, 19 nt, Homo sapiens
aaacuguggcuguguaaua

SEQ ID NO: 764054 - RNA, 19 nt, Homo sapiens
caaagggugucaucuacau

SEQ ID NO: 764055 - RNA, 19 nt, Homo sapiens
gagcuaaaggcauuacuga

SEQ ID NO: 764056 - RNA, 19 nt, Homo sapiens
ucacaaagggugucaucua

SEQ ID NO: 764057 - RNA, 19 nt, Homo sapiens
uuacagcccuuccuacuag

SEQ ID NO: 764058 - RNA, 19 nt, Homo sapiens
gacauguguucauaaauuc

SEQ ID NO: 764059 - RNA, 19 nt, Homo sapiens
aacgagaacuucaggauug

SEQ ID NO: 764060 - RNA, 19 nt, Homo sapiens
uuacugagcaugugucaaa

SEQ ID NO: 764061 - RNA, 19 nt, Homo sapiens
gcaacguccuggucuguca

SEQ ID NO: 764062 - RNA, 19 nt, Homo sapiens
ggugaaagcccugcucauu

SEQ ID NO: 764063 - RNA, 19 nt, Homo sapiens
agaccuaaaucauacuuug

SEQ ID NO: 764064 - RNA, 19 nt, Homo sapiens
gaaacuguccagccuccua

SEQ ID NO: 764065 - RNA, 19 nt, Homo sapiens
gcaguugccgacauaauga

SEQ ID NO: 764066 - RNA, 19 nt, Homo sapiens
cauaaauucccaucuaaga

SEQ ID NO: 764067 - RNA, 19 nt, Homo sapiens
ucagagugcuggaaacaca

SEQ ID NO: 764068 - RNA, 19 nt, Homo sapiens
gaacuucaggauugagcua

SEQ ID NO: 764069 - RNA, 19 nt, Homo sapiens
ggacuuggccaccuucauc

SEQ ID NO: 764070 - RNA, 19 nt, Homo sapiens
aagaaacuguggcugugua

SEQ ID NO: 764071 - RNA, 19 nt, Homo sapiens
gugaacagcacauggauau

SEQ ID NO: 764072 - RNA, 19 nt, Homo sapiens
ccacagagcaguacuuugc

SEQ ID NO: 764073 - RNA, 19 nt, Homo sapiens
guaauaugauuggcgaugu

SEQ ID NO: 764074 - RNA, 19 nt, Homo sapiens
gugaaagcccugcucauug

SEQ ID NO: 764075 - RNA, 19 nt, Homo sapiens
agaagaagaccaucaagau

SEQ ID NO: 764076 - RNA, 19 nt, Homo sapiens
ugagccagcugaccucuuc

SEQ ID NO: 764077 - RNA, 19 nt, Homo sapiens
gcuguaggacucuugaauu

SEQ ID NO: 764078 - RNA, 19 nt, Homo sapiens
ccauugugacgaugaguua

SEQ ID NO: 764079 - RNA, 19 nt, Homo sapiens
cacaaagggugucaucuac

SEQ ID NO: 764080 - RNA, 19 nt, Homo sapiens
uagaagagguugggaagag

SEQ ID NO: 764081 - RNA, 19 nt, Homo sapiens
gcuuacuccuucaucauug

SEQ ID NO: 764082 - RNA, 19 nt, Homo sapiens
cgaaggagaccuaaaucau

SEQ ID NO: 764083 - RNA, 19 nt, Homo sapiens
ggaagaggagcgaggacaa

SEQ ID NO: 764084 - RNA, 19 nt, Homo sapiens
caugugaugugaaaacuaa

SEQ ID NO: 764085 - RNA, 19 nt, Homo sapiens
gaacccauugugacgauga

SEQ ID NO: 764086 - RNA, 19 nt, Homo sapiens
ggucugucaugucaucuuc

SEQ ID NO: 764087 - RNA, 19 nt, Homo sapiens
aaggagaccuaaaucauac

SEQ ID NO: 764088 - RNA, 19 nt, Homo sapiens
gaccacagagcaguacuuu

SEQ ID NO: 764089 - RNA, 19 nt, Homo sapiens
guccuggucugucauguca

SEQ ID NO: 764090 - RNA, 19 nt, Homo sapiens
gggcuccccuugccaauaa

SEQ ID NO: 764091 - RNA, 19 nt, Homo sapiens
gaggagcgaggacaacguu

SEQ ID NO: 764092 - RNA, 19 nt, Homo sapiens
cuguaggacucuugaauuc

SEQ ID NO: 764093 - RNA, 19 nt, Homo sapiens
acaaugcccucuacuuugc

SEQ ID NO: 764094 - RNA, 19 nt, Homo sapiens
gcaccaacaaugcccucua

SEQ ID NO: 764095 - RNA, 19 nt, Homo sapiens
uaauaugauuggcgaugug

SEQ ID NO: 764096 - RNA, 19 nt, Homo sapiens
ccaacaaugcccucuacuu

SEQ ID NO: 764097 - RNA, 19 nt, Homo sapiens
aacuagacauguguucaua

SEQ ID NO: 764098 - RNA, 19 nt, Homo sapiens
caacuagacauguguucau

SEQ ID NO: 764099 - RNA, 19 nt, Homo sapiens
aacagcacauggauauuug

SEQ ID NO: 764100 - RNA, 19 nt, Homo sapiens
ccucgcacuucuucucuug

SEQ ID NO: 764101 - RNA, 19 nt, Homo sapiens
gagccuauucucacacaug

SEQ ID NO: 764102 - RNA, 19 nt, Homo sapiens
gcaaggucauccgcaccaa

SEQ ID NO: 764103 - RNA, 19 nt, Homo sapiens
cuucaucauugucuucuca

SEQ ID NO: 764104 - RNA, 19 nt, Homo sapiens
caccaacaaugcccucuac

SEQ ID NO: 764105 - RNA, 19 nt, Homo sapiens
ucacuuugguucgcuuugu

SEQ ID NO: 764106 - RNA, 19 nt, Homo sapiens
gcaccaccaacuagacaug

SEQ ID NO: 764107 - RNA, 19 nt, Homo sapiens
gcagggaaagagagccuau

SEQ ID NO: 764108 - RNA, 19 nt, Homo sapiens
aagaagaagaccaucaaga

SEQ ID NO: 764109 - RNA, 19 nt, Homo sapiens
uaaaaggcaccaccaacua

SEQ ID NO: 764110 - RNA, 19 nt, Homo sapiens
ucaaauacagugaggacau

SEQ ID NO: 764111 - RNA, 19 nt, Homo sapiens
ggagaccuaaaucauacuu

SEQ ID NO: 764112 - RNA, 19 nt, Homo sapiens
gacugagcaucccgaagga

SEQ ID NO: 764113 - RNA, 19 nt, Homo sapiens
ccaccuucauccugcucua

SEQ ID NO: 764114 - RNA, 19 nt, Homo sapiens
ggaccauggcuacguucuu

SEQ ID NO: 764115 - RNA, 19 nt, Homo sapiens
uaaaggcauuacugagcau

SEQ ID NO: 764116 - RNA, 19 nt, Homo sapiens
gcuggugguaguccucuuu

SEQ ID NO: 764117 - RNA, 19 nt, Homo sapiens
ccaccagccucuucaucgu

SEQ ID NO: 764118 - RNA, 19 nt, Homo sapiens
ggcuuacuccuucaucauu

SEQ ID NO: 764119 - RNA, 19 nt, Homo sapiens
aacaaugcccucuacuuug

SEQ ID NO: 764120 - RNA, 19 nt, Homo sapiens
guggcuguguaauaugauu

SEQ ID NO: 764121 - RNA, 19 nt, Homo sapiens
cuguggcuguguaauauga

SEQ ID NO: 764122 - RNA, 19 nt, Homo sapiens
aacuguggcuguguaauau

SEQ ID NO: 764123 - RNA, 19 nt, Homo sapiens
gaaggcuguaggacucuug

SEQ ID NO: 764124 - RNA, 19 nt, Homo sapiens
agccuauucucacacauga

SEQ ID NO: 764125 - RNA, 19 nt, Homo sapiens
acugcuggcugaacgagaa

SEQ ID NO: 764126 - RNA, 19 nt, Homo sapiens
ggucauccgcaccaacaau

SEQ ID NO: 764127 - RNA, 19 nt, Homo sapiens
guacacgggccagggaaau

SEQ ID NO: 764128 - RNA, 19 nt, Homo sapiens
uggaacaacuacaccuucu

SEQ ID NO: 764129 - RNA, 19 nt, Homo sapiens
gagaccuaaaucauacuuu

SEQ ID NO: 764130 - RNA, 19 nt, Homo sapiens
ccgaaggagaccuaaauca

SEQ ID NO: 764131 - RNA, 19 nt, Homo sapiens
gaagaggagcgaggacaac

SEQ ID NO: 764132 - RNA, 19 nt, Homo sapiens
cagcagccuguaucucuga

SEQ ID NO: 764133 - RNA, 19 nt, Homo sapiens
gaaagcccugcucauugug

SEQ ID NO: 764134 - RNA, 19 nt, Homo sapiens
cccaaugccucgcacuucu

SEQ ID NO: 764135 - RNA, 19 nt, Homo sapiens
acgagaacuucaggauuga

SEQ ID NO: 764136 - RNA, 19 nt, Homo sapiens
ucugucaugucaucuucaa

SEQ ID NO: 764137 - RNA, 19 nt, Homo sapiens
ucgcacuucuucucuugga

SEQ ID NO: 764138 - RNA, 19 nt, Homo sapiens
guggcuuacuccuucauca

SEQ ID NO: 764139 - RNA, 19 nt, Homo sapiens
caagaaacuguggcugugu

SEQ ID NO: 764140 - RNA, 19 nt, Homo sapiens
ggacguaucugcuaugaaa

SEQ ID NO: 764141 - RNA, 19 nt, Homo sapiens
gaaagaauguuacuaggaa

SEQ ID NO: 764142 - RNA, 19 nt, Homo sapiens
uaaguggccuugauauuua

SEQ ID NO: 764143 - RNA, 19 nt, Homo sapiens
gaaagaagaucaagcuaca

SEQ ID NO: 764144 - RNA, 19 nt, Homo sapiens
caaauucgguuucauauuc

SEQ ID NO: 764145 - RNA, 19 nt, Homo sapiens
gaugaugccuucaauacua

SEQ ID NO: 764146 - RNA, 19 nt, Homo sapiens
ggaauagacuucaagauca

SEQ ID NO: 764147 - RNA, 19 nt, Homo sapiens
gaugauaccuuuguugaaa

SEQ ID NO: 764148 - RNA, 19 nt, Homo sapiens
gcaaauggcuuagaaacau

SEQ ID NO: 764149 - RNA, 19 nt, Homo sapiens
gcacugauguaacuugcua

SEQ ID NO: 764150 - RNA, 19 nt, Homo sapiens
gaagaucaagcuacagaua

SEQ ID NO: 764151 - RNA, 19 nt, Homo sapiens
gaauagacuucaagaucaa

SEQ ID NO: 764152 - RNA, 19 nt, Homo sapiens
caaauggcuuagaaacaua

SEQ ID NO: 764153 - RNA, 19 nt, Homo sapiens
acacuugacuuuaucauug

SEQ ID NO: 764154 - RNA, 19 nt, Homo sapiens
ugauguaacuugcuaggua

SEQ ID NO: 764155 - RNA, 19 nt, Homo sapiens
gggaagaccugcguccuuu

SEQ ID NO: 764156 - RNA, 19 nt, Homo sapiens
gauguaacuugcuagguaa

SEQ ID NO: 764157 - RNA, 19 nt, Homo sapiens
gaagugauagcuuugguuu

SEQ ID NO: 764158 - RNA, 19 nt, Homo sapiens
ggaaacaagugugauaugg

SEQ ID NO: 764159 - RNA, 19 nt, Homo sapiens
ggacagcagcuuccauuga

SEQ ID NO: 764160 - RNA, 19 nt, Homo sapiens
caaugaagauguggaaaga

SEQ ID NO: 764161 - RNA, 19 nt, Homo sapiens
aaagcagcauugccaaaua

SEQ ID NO: 764162 - RNA, 19 nt, Homo sapiens
gaaguuugcuaugcugcua

SEQ ID NO: 764163 - RNA, 19 nt, Homo sapiens
guagguuugucaaguuuaa

SEQ ID NO: 764164 - RNA, 19 nt, Homo sapiens
gacaaaggguaaugcagaa

SEQ ID NO: 764165 - RNA, 19 nt, Homo sapiens
cuacaaauucgguuucaua

SEQ ID NO: 764166 - RNA, 19 nt, Homo sapiens
caaaagaguuguaccuaaa

SEQ ID NO: 764167 - RNA, 19 nt, Homo sapiens
ugaaagggacaaacuagua

SEQ ID NO: 764168 - RNA, 19 nt, Homo sapiens
ggaaagaauguuacuagga

SEQ ID NO: 764169 - RNA, 19 nt, Homo sapiens
ggaguuggccguagugaga

SEQ ID NO: 764170 - RNA, 19 nt, Homo sapiens
aagcagcauugccaaauaa

SEQ ID NO: 764171 - RNA, 19 nt, Homo sapiens
gcaagggagcaugguauua

SEQ ID NO: 764172 - RNA, 19 nt, Homo sapiens
uagaugagcaugccaauga

SEQ ID NO: 764173 - RNA, 19 nt, Homo sapiens
uaaaagagcccaacaguga

SEQ ID NO: 764174 - RNA, 19 nt, Homo sapiens
gagcuaaacacugggauuu

SEQ ID NO: 764175 - RNA, 19 nt, Homo sapiens
uuaaguccauucucuggua

SEQ ID NO: 764176 - RNA, 19 nt, Homo sapiens
guaguuaauugaggacaaa

SEQ ID NO: 764177 - RNA, 19 nt, Homo sapiens
caaacaacauagggacgua

SEQ ID NO: 764178 - RNA, 19 nt, Homo sapiens
cacauaagcaaacaacaua

SEQ ID NO: 764179 - RNA, 19 nt, Homo sapiens
gaaagaauugugaauagca

SEQ ID NO: 764180 - RNA, 19 nt, Homo sapiens
uuaaguggccuugauauuu

SEQ ID NO: 764181 - RNA, 19 nt, Homo sapiens
gcagggagaccauaucauc

SEQ ID NO: 764182 - RNA, 19 nt, Homo sapiens
cacguuagcugaagauauc

SEQ ID NO: 764183 - RNA, 19 nt, Homo sapiens
gaaggaggagugaauuuua

SEQ ID NO: 764184 - RNA, 19 nt, Homo sapiens
gaaagggacaaacuaguag

SEQ ID NO: 764185 - RNA, 19 nt, Homo sapiens
gaaacaagugugauaugga

SEQ ID NO: 764186 - RNA, 19 nt, Homo sapiens
uauaugacaucaccaaugg

SEQ ID NO: 764187 - RNA, 19 nt, Homo sapiens
gacagcagcuuccauugag

SEQ ID NO: 764188 - RNA, 19 nt, Homo sapiens
cuagguaaacggaaagaua

SEQ ID NO: 764189 - RNA, 19 nt, Homo sapiens
cauaucauccaaaccauaa

SEQ ID NO: 764190 - RNA, 19 nt, Homo sapiens
gaaagaccccuguaaaaga

SEQ ID NO: 764191 - RNA, 19 nt, Homo sapiens
gaagauguggaaagaaugu

SEQ ID NO: 764192 - RNA, 19 nt, Homo sapiens
cauuugcucucuucccuaa

SEQ ID NO: 764193 - RNA, 19 nt, Homo sapiens
ccugcaugcugcuuuauuu

SEQ ID NO: 764194 - RNA, 19 nt, Homo sapiens
ggagcaugguauuagguuu

SEQ ID NO: 764195 - RNA, 19 nt, Homo sapiens
cuaguagguuugucaaguu

SEQ ID NO: 764196 - RNA, 19 nt, Homo sapiens
cuucauugcuuaucauuag

SEQ ID NO: 764197 - RNA, 19 nt, Homo sapiens
accuuaagauuccgaaaua

SEQ ID NO: 764198 - RNA, 19 nt, Homo sapiens
ucaguuaauuggugucuuc

SEQ ID NO: 764199 - RNA, 19 nt, Homo sapiens
uagguaaacggaaagauaa

SEQ ID NO: 764200 - RNA, 19 nt, Homo sapiens
gaaagccgagugaggaguu

SEQ ID NO: 764201 - RNA, 19 nt, Homo sapiens
gguacuagcuacaaauucg

SEQ ID NO: 764202 - RNA, 19 nt, Homo sapiens
gcaggaaggaggagugaau

SEQ ID NO: 764203 - RNA, 19 nt, Homo sapiens
auaaagcacugauguaacu

SEQ ID NO: 764204 - RNA, 19 nt, Homo sapiens
gcucagcucaacugcauuu

SEQ ID NO: 764205 - RNA, 19 nt, Homo sapiens
ccaaacaguuaaguccauu

SEQ ID NO: 764206 - RNA, 19 nt, Homo sapiens
ucacugguuguuauucuua

SEQ ID NO: 764207 - RNA, 19 nt, Homo sapiens
acaguugaauuacaaggaa

SEQ ID NO: 764208 - RNA, 19 nt, Homo sapiens
ucaauuccaugacuuaagg

SEQ ID NO: 764209 - RNA, 19 nt, Homo sapiens
uaaaccuacuguuguuaga

SEQ ID NO: 764210 - RNA, 19 nt, Homo sapiens
augcagaagugauagcuuu

SEQ ID NO: 764211 - RNA, 19 nt, Homo sapiens
cugcauuucaguuguauua

SEQ ID NO: 764212 - RNA, 19 nt, Homo sapiens
caagccaccuauuuuauuu

SEQ ID NO: 764213 - RNA, 19 nt, Homo sapiens
ugccaaauguauugagauu

SEQ ID NO: 764214 - RNA, 19 nt, Homo sapiens
guaaacggaaagauaaguu

SEQ ID NO: 764215 - RNA, 19 nt, Homo sapiens
gaauuacaaggaaagaaga

SEQ ID NO: 764216 - RNA, 19 nt, Homo sapiens
ccaguucuuaucaacauua

SEQ ID NO: 764217 - RNA, 19 nt, Homo sapiens
uagcagaggcugaguuuag

SEQ ID NO: 764218 - RNA, 19 nt, Homo sapiens
acggaaagauaaguucuaa

SEQ ID NO: 764219 - RNA, 19 nt, Homo sapiens
ggguaaugcagaagugaua

SEQ ID NO: 764220 - RNA, 19 nt, Homo sapiens
guacaacaguggaauuuuc

SEQ ID NO: 764221 - RNA, 19 nt, Homo sapiens
ucaugucugugacuucauu

SEQ ID NO: 764222 - RNA, 19 nt, Homo sapiens
cuaggaaacaagugugaua

SEQ ID NO: 764223 - RNA, 19 nt, Homo sapiens
uaguagguuugucaaguuu

SEQ ID NO: 764224 - RNA, 19 nt, Homo sapiens
gugguuugcuuggcuguaa

SEQ ID NO: 764225 - RNA, 19 nt, Homo sapiens
auagacaugugauagcaaa

SEQ ID NO: 764226 - RNA, 19 nt, Homo sapiens
gguuguuauucuuagguua

SEQ ID NO: 764227 - RNA, 19 nt, Homo sapiens
uaagugaaguuugcuaugc

SEQ ID NO: 764228 - RNA, 19 nt, Homo sapiens
gaaauggaagaguuaacug

SEQ ID NO: 764229 - RNA, 19 nt, Homo sapiens
ccagaugccuucauuugcu

SEQ ID NO: 764230 - RNA, 19 nt, Homo sapiens
gcauucuccuguuccauca

SEQ ID NO: 764231 - RNA, 19 nt, Homo sapiens
gcugagcauucuccuguuc

SEQ ID NO: 764232 - RNA, 19 nt, Homo sapiens
ggauauggcuaccuuuugu

SEQ ID NO: 764233 - RNA, 19 nt, Homo sapiens
cuaagaugauaccuuuguu

SEQ ID NO: 764234 - RNA, 19 nt, Homo sapiens
gagauuuggccucugaaga

SEQ ID NO: 764235 - RNA, 19 nt, Homo sapiens
uuacuucuauguucugcuu

SEQ ID NO: 764236 - RNA, 19 nt, Homo sapiens
gaagacguacgaccugcuu

SEQ ID NO: 764237 - RNA, 19 nt, Homo sapiens
agaucaagcuacagauaug

SEQ ID NO: 764238 - RNA, 19 nt, Homo sapiens
gaccauaucauccaaacca

SEQ ID NO: 764239 - RNA, 19 nt, Homo sapiens
gugcuugagucccuauaau

SEQ ID NO: 764240 - RNA, 19 nt, Homo sapiens
gaagauagaugaagagaau

SEQ ID NO: 764241 - RNA, 19 nt, Homo sapiens
gcauagaucuguaggauuu

SEQ ID NO: 764242 - RNA, 19 nt, Homo sapiens
ucaaauaucugaccacaaa

SEQ ID NO: 764243 - RNA, 19 nt, Homo sapiens
ccacauguguucucuauuu

SEQ ID NO: 764244 - RNA, 19 nt, Homo sapiens
uaaccgaacuggugcuuua

SEQ ID NO: 764245 - RNA, 19 nt, Homo sapiens
gaacuaauauccugucucu

SEQ ID NO: 764246 - RNA, 19 nt, Homo sapiens
gaacaauucuccaaacuac

SEQ ID NO: 764247 - RNA, 19 nt, Homo sapiens
uaggugagcuucaaucuaa

SEQ ID NO: 764248 - RNA, 19 nt, Homo sapiens
gaaauucucccuuguaugu

SEQ ID NO: 764249 - RNA, 19 nt, Homo sapiens
gagaauucauggagcaaua

SEQ ID NO: 764250 - RNA, 19 nt, Homo sapiens
caaugagccuucaaacaua

SEQ ID NO: 764251 - RNA, 19 nt, Homo sapiens
caacaaugguuuacaugaa

SEQ ID NO: 764252 - RNA, 19 nt, Homo sapiens
aaagagauguagcagaaua

SEQ ID NO: 764253 - RNA, 19 nt, Homo sapiens
ggaggcaaauuucagcaua

SEQ ID NO: 764254 - RNA, 19 nt, Homo sapiens
guucacagguucugcguua

SEQ ID NO: 764255 - RNA, 19 nt, Homo sapiens
gagauucgauuacuguuug

SEQ ID NO: 764256 - RNA, 19 nt, Homo sapiens
gaagagcgccgugugauuu

SEQ ID NO: 764257 - RNA, 19 nt, Homo sapiens
aaagaugucuccucugauu

SEQ ID NO: 764258 - RNA, 19 nt, Homo sapiens
gagggaaagugagcgauua

SEQ ID NO: 764259 - RNA, 19 nt, Homo sapiens
gcacuagcauggccucuga

SEQ ID NO: 764260 - RNA, 19 nt, Homo sapiens
ggcaauaacuccaccaaga

SEQ ID NO: 764261 - RNA, 19 nt, Homo sapiens
gaguguaagugcuucauuu

SEQ ID NO: 764262 - RNA, 19 nt, Homo sapiens
caacaacaauacaacaaga

SEQ ID NO: 764263 - RNA, 19 nt, Homo sapiens
ugacauugcuucugcuaaa

SEQ ID NO: 764264 - RNA, 19 nt, Homo sapiens
gaagcaguguuucuacuug

SEQ ID NO: 764265 - RNA, 19 nt, Homo sapiens
ggacagugauuucaguaau

SEQ ID NO: 764266 - RNA, 19 nt, Homo sapiens
gcaauaaagcgaagaguau

SEQ ID NO: 764267 - RNA, 19 nt, Homo sapiens
gaaagugagcgauuaguug

SEQ ID NO: 764268 - RNA, 19 nt, Homo sapiens
gcaccagaaugcuaaaguu

SEQ ID NO: 764269 - RNA, 19 nt, Homo sapiens
ccaagacucuagacaacua

SEQ ID NO: 764270 - RNA, 19 nt, Homo sapiens
ucuaagaccugaucuauag

SEQ ID NO: 764271 - RNA, 19 nt, Homo sapiens
gaacuucaaucacuguagu

SEQ ID NO: 764272 - RNA, 19 nt, Homo sapiens
acacucagcuaaguuauaa

SEQ ID NO: 764273 - RNA, 19 nt, Homo sapiens
gaucuuccacugcaaauuu

SEQ ID NO: 764274 - RNA, 19 nt, Homo sapiens
gcuaaaguuuccuaacauu

SEQ ID NO: 764275 - RNA, 19 nt, Homo sapiens
guaagcacauguuuauuca

SEQ ID NO: 764276 - RNA, 19 nt, Homo sapiens
gagccgagcugaacaagca

SEQ ID NO: 764277 - RNA, 19 nt, Homo sapiens
ggagcuacuuuaagauuug

SEQ ID NO: 764278 - RNA, 19 nt, Homo sapiens
caucaucacuggaggcaaa

SEQ ID NO: 764279 - RNA, 19 nt, Homo sapiens
aaagacagcacuacagaua

SEQ ID NO: 764280 - RNA, 19 nt, Homo sapiens
gcacauccaucccuuaggu

SEQ ID NO: 764281 - RNA, 19 nt, Homo sapiens
guaaugagaacuucaauca

SEQ ID NO: 764282 - RNA, 19 nt, Homo sapiens
gaccacauguguucucuau

SEQ ID NO: 764283 - RNA, 19 nt, Homo sapiens
uuugauagcugcauucauu

SEQ ID NO: 764284 - RNA, 19 nt, Homo sapiens
ggagacagcuaugguuuca

SEQ ID NO: 764285 - RNA, 19 nt, Homo sapiens
ugauggagcuacuuuaaga

SEQ ID NO: 764286 - RNA, 19 nt, Homo sapiens
gauuauguguccuuucuug

SEQ ID NO: 764287 - RNA, 19 nt, Homo sapiens
uaaaagagauguagcagaa

SEQ ID NO: 764288 - RNA, 19 nt, Homo sapiens
gaagauaguuuuccucaau

SEQ ID NO: 764289 - RNA, 19 nt, Homo sapiens
auaaagaugucuccucuga

SEQ ID NO: 764290 - RNA, 19 nt, Homo sapiens
ggauugcccucauuugaug

SEQ ID NO: 764291 - RNA, 19 nt, Homo sapiens
gcaagagacagaaugauau

SEQ ID NO: 764292 - RNA, 19 nt, Homo sapiens
agacagcuaugguuucauu

SEQ ID NO: 764293 - RNA, 19 nt, Homo sapiens
gcaauaacuccaccaagaa

SEQ ID NO: 764294 - RNA, 19 nt, Homo sapiens
uggaauacuugguuucuuu

SEQ ID NO: 764295 - RNA, 19 nt, Homo sapiens
ugacaugaguggaauacuu

SEQ ID NO: 764296 - RNA, 19 nt, Homo sapiens
guaugacgaugguauuuau

SEQ ID NO: 764297 - RNA, 19 nt, Homo sapiens
uuaagaaagugcagaauca

SEQ ID NO: 764298 - RNA, 19 nt, Homo sapiens
aaacugacuuugagcugua

SEQ ID NO: 764299 - RNA, 19 nt, Homo sapiens
ggcaagagacagaaugaua

SEQ ID NO: 764300 - RNA, 19 nt, Homo sapiens
aaacgaaacugacuuugag

SEQ ID NO: 764301 - RNA, 19 nt, Homo sapiens
uugaguaucuucuguugua

SEQ ID NO: 764302 - RNA, 19 nt, Homo sapiens
guaaguaccacaucuacaa

SEQ ID NO: 764303 - RNA, 19 nt, Homo sapiens
ggaaagugagcgauuaguu

SEQ ID NO: 764304 - RNA, 19 nt, Homo sapiens
aaugugaacugcugauuug

SEQ ID NO: 764305 - RNA, 19 nt, Homo sapiens
ccaguaagcacauguuuau

SEQ ID NO: 764306 - RNA, 19 nt, Homo sapiens
caacaguaacacaucuuua

SEQ ID NO: 764307 - RNA, 19 nt, Homo sapiens
cuaaguagauagaaagcaa

SEQ ID NO: 764308 - RNA, 19 nt, Homo sapiens
ggaauucaguaacauuugg

SEQ ID NO: 764309 - RNA, 19 nt, Homo sapiens
ucucugauguaguuaagua

SEQ ID NO: 764310 - RNA, 19 nt, Homo sapiens
agaccuagauucaaacuca

SEQ ID NO: 764311 - RNA, 19 nt, Homo sapiens
gagggaacuuugcacuauu

SEQ ID NO: 764312 - RNA, 19 nt, Homo sapiens
uaagacaggugccuucagu

SEQ ID NO: 764313 - RNA, 19 nt, Homo sapiens
gcauguaugugugugugua

SEQ ID NO: 764314 - RNA, 19 nt, Homo sapiens
caucaaagaagcccaggua

SEQ ID NO: 764315 - RNA, 19 nt, Homo sapiens
ccaacacucagcuaaguua

SEQ ID NO: 764316 - RNA, 19 nt, Homo sapiens
gaacuggugcuuuaguaau

SEQ ID NO: 764317 - RNA, 19 nt, Homo sapiens
ccuauuauguguucaagga

SEQ ID NO: 764318 - RNA, 19 nt, Homo sapiens
cuaaagguauuaaccacuu

SEQ ID NO: 764319 - RNA, 19 nt, Homo sapiens
ggcaguagauccucuucaa

SEQ ID NO: 764320 - RNA, 19 nt, Homo sapiens
gaccuagaauagccaugua

SEQ ID NO: 764321 - RNA, 19 nt, Homo sapiens
gcuaugguuucauuaccua

SEQ ID NO: 764322 - RNA, 19 nt, Homo sapiens
gacagugauuucaguaaug

SEQ ID NO: 764323 - RNA, 19 nt, Homo sapiens
uaauaaagccaguggaaau

SEQ ID NO: 764324 - RNA, 19 nt, Homo sapiens
acagaaugauauccaguaa

SEQ ID NO: 764325 - RNA, 19 nt, Homo sapiens
gaauuucuccuacuuuaca

SEQ ID NO: 764326 - RNA, 19 nt, Homo sapiens
ccaacaacuuuaucucuuc

SEQ ID NO: 764327 - RNA, 19 nt, Homo sapiens
uucaaucacuguagucuaa

SEQ ID NO: 764328 - RNA, 19 nt, Homo sapiens
cagcauagaucuguaggau

SEQ ID NO: 764329 - RNA, 19 nt, Homo sapiens
ggaaguauguguggguaca

SEQ ID NO: 764330 - RNA, 19 nt, Homo sapiens
ccaccaagagcaaguauga

SEQ ID NO: 764331 - RNA, 19 nt, Homo sapiens
caaaggaugcgcucucguu

SEQ ID NO: 764332 - RNA, 19 nt, Homo sapiens
gcuaauaaagggaaacgaa

SEQ ID NO: 764333 - RNA, 19 nt, Homo sapiens
gugaacugcugauuugaug

SEQ ID NO: 764334 - RNA, 19 nt, Homo sapiens
gaugugaacgacuuggaua

SEQ ID NO: 764335 - RNA, 19 nt, Homo sapiens
cuugauggcuguaaugaga

SEQ ID NO: 764336 - RNA, 19 nt, Homo sapiens
gcgcaagggcaaaccauuu

SEQ ID NO: 764337 - RNA, 19 nt, Homo sapiens
caguaaaucugcgggauga

SEQ ID NO: 764338 - RNA, 19 nt, Homo sapiens
ccgaaauucucccuuguau

SEQ ID NO: 764339 - RNA, 19 nt, Homo sapiens
gaugaaagugauaaacuga

SEQ ID NO: 764340 - RNA, 19 nt, Homo sapiens
gaaagaaccuugccgauca

SEQ ID NO: 764341 - RNA, 19 nt, Homo sapiens
ggaaauacaucagagcuua

SEQ ID NO: 764342 - RNA, 19 nt, Homo sapiens
gaaaguaugugucuuaagu

SEQ ID NO: 764343 - RNA, 19 nt, Homo sapiens
ggaaaccucucauugcuaa

SEQ ID NO: 764344 - RNA, 19 nt, Homo sapiens
gaucaacuguaccauauuu

SEQ ID NO: 764345 - RNA, 19 nt, Homo sapiens
gaacugagaccuccagaaa

SEQ ID NO: 764346 - RNA, 19 nt, Homo sapiens
agagacaacugaugaaaua

SEQ ID NO: 764347 - RNA, 19 nt, Homo sapiens
gcagauagcugucauugca

SEQ ID NO: 764348 - RNA, 19 nt, Homo sapiens
gggaguauauggguuauua

SEQ ID NO: 764349 - RNA, 19 nt, Homo sapiens
ccacacagauugucuuauu

SEQ ID NO: 764350 - RNA, 19 nt, Homo sapiens
ccagaaaucuauuccagua

SEQ ID NO: 764351 - RNA, 19 nt, Homo sapiens
ccagagagcuuccagagaa

SEQ ID NO: 764352 - RNA, 19 nt, Homo sapiens
caaacaggcucuagagauu

SEQ ID NO: 764353 - RNA, 19 nt, Homo sapiens
gcaaauggaaucuuuauga

SEQ ID NO: 764354 - RNA, 19 nt, Homo sapiens
gaauuucacuggccuaaug

SEQ ID NO: 764355 - RNA, 19 nt, Homo sapiens
cggcaaaccugucuaauug

SEQ ID NO: 764356 - RNA, 19 nt, Homo sapiens
caaggaauguacaaacuuu

SEQ ID NO: 764357 - RNA, 19 nt, Homo sapiens
gaaguaaugugccaguaga

SEQ ID NO: 764358 - RNA, 19 nt, Homo sapiens
gaagguagaaaucaucaua

SEQ ID NO: 764359 - RNA, 19 nt, Homo sapiens
ggucacagcuggauguuug

SEQ ID NO: 764360 - RNA, 19 nt, Homo sapiens
gcaguuagguuaggaauuc

SEQ ID NO: 764361 - RNA, 19 nt, Homo sapiens
caaaggaucuucccaagca

SEQ ID NO: 764362 - RNA, 19 nt, Homo sapiens
cagaaaggcaucuaaguua

SEQ ID NO: 764363 - RNA, 19 nt, Homo sapiens
gcaguguucucuuaaggua

SEQ ID NO: 764364 - RNA, 19 nt, Homo sapiens
ggaagugaauguugggaaa

SEQ ID NO: 764365 - RNA, 19 nt, Homo sapiens
uaucagaaguguuaaguga

SEQ ID NO: 764366 - RNA, 19 nt, Homo sapiens
ggagugcacugaagaugaa

SEQ ID NO: 764367 - RNA, 19 nt, Homo sapiens
guacugcacuuacauaaag

SEQ ID NO: 764368 - RNA, 19 nt, Homo sapiens
cgaaguaguuuaucugaga

SEQ ID NO: 764369 - RNA, 19 nt, Homo sapiens
gagaaaguguauuugugua

SEQ ID NO: 764370 - RNA, 19 nt, Homo sapiens
cuagauggcugcauuguug

SEQ ID NO: 764371 - RNA, 19 nt, Homo sapiens
gcccacaccuaacauuaua

SEQ ID NO: 764372 - RNA, 19 nt, Homo sapiens
ucacuggccuaaugagaua

SEQ ID NO: 764373 - RNA, 19 nt, Homo sapiens
gaauuaccauuaacacaug

SEQ ID NO: 764374 - RNA, 19 nt, Homo sapiens
guaugugucuuaaguuuga

SEQ ID NO: 764375 - RNA, 19 nt, Homo sapiens
ccagaaaguaugugucuua

SEQ ID NO: 764376 - RNA, 19 nt, Homo sapiens
gcacugaagaugaauuaaa

SEQ ID NO: 764377 - RNA, 19 nt, Homo sapiens
gcaagaagguagaaaucau

SEQ ID NO: 764378 - RNA, 19 nt, Homo sapiens
aaagaacacuucccaacuu

SEQ ID NO: 764379 - RNA, 19 nt, Homo sapiens
ggccaaggcucaugaacuu

SEQ ID NO: 764380 - RNA, 19 nt, Homo sapiens
gaagagagcacuuacugau

SEQ ID NO: 764381 - RNA, 19 nt, Homo sapiens
gcaaaucuguguugaacca

SEQ ID NO: 764382 - RNA, 19 nt, Homo sapiens
agauagagguuaagaauca

SEQ ID NO: 764383 - RNA, 19 nt, Homo sapiens
gaaaccacaugagaaguga

SEQ ID NO: 764384 - RNA, 19 nt, Homo sapiens
gguaauccaaguaauguua

SEQ ID NO: 764385 - RNA, 19 nt, Homo sapiens
caucuagucuucacaguau

SEQ ID NO: 764386 - RNA, 19 nt, Homo sapiens
gaaaagaaaugacuacgau

SEQ ID NO: 764387 - RNA, 19 nt, Homo sapiens
auaaagagauuccaaaugg

SEQ ID NO: 764388 - RNA, 19 nt, Homo sapiens
ugagguaucagaaguguua

SEQ ID NO: 764389 - RNA, 19 nt, Homo sapiens
gacuagacaucacaagaaa

SEQ ID NO: 764390 - RNA, 19 nt, Homo sapiens
ccaaauauuuagcaucuuc

SEQ ID NO: 764391 - RNA, 19 nt, Homo sapiens
gcagcuacuugguaucaaa

SEQ ID NO: 764392 - RNA, 19 nt, Homo sapiens
ugacuacgaugauaccauu

SEQ ID NO: 764393 - RNA, 19 nt, Homo sapiens
agaaaugacuacgaugaua

SEQ ID NO: 764394 - RNA, 19 nt, Homo sapiens
aaacuggacuuaauguguu

SEQ ID NO: 764395 - RNA, 19 nt, Homo sapiens
gaaaucaucauaggaagaa

SEQ ID NO: 764396 - RNA, 19 nt, Homo sapiens
gaucgagacagucaagaua

SEQ ID NO: 764397 - RNA, 19 nt, Homo sapiens
ugaauucugccaaacauua

SEQ ID NO: 764398 - RNA, 19 nt, Homo sapiens
guaaugcuguggaugaguu

SEQ ID NO: 764399 - RNA, 19 nt, Homo sapiens
guagaaaucaucauaggaa

SEQ ID NO: 764400 - RNA, 19 nt, Homo sapiens
ccuagcaaauucuaccuua

SEQ ID NO: 764401 - RNA, 19 nt, Homo sapiens
aagaacacuucccaacuua

SEQ ID NO: 764402 - RNA, 19 nt, Homo sapiens
gugaauugguugaauaguu

SEQ ID NO: 764403 - RNA, 19 nt, Homo sapiens
gaaguaguuuaucugagaa

SEQ ID NO: 764404 - RNA, 19 nt, Homo sapiens
ggaugaaguugcagaagau

SEQ ID NO: 764405 - RNA, 19 nt, Homo sapiens
gaaacuggacuuaaugugu

SEQ ID NO: 764406 - RNA, 19 nt, Homo sapiens
ugagacagcuggacuucaa

SEQ ID NO: 764407 - RNA, 19 nt, Homo sapiens
uuacacauauccacaaaug

SEQ ID NO: 764408 - RNA, 19 nt, Homo sapiens
uguauuaucucaaggaaug

SEQ ID NO: 764409 - RNA, 19 nt, Homo sapiens
ggagguguguauguuuaua

SEQ ID NO: 764410 - RNA, 19 nt, Homo sapiens
gcaucuuccuugauaauau

SEQ ID NO: 764411 - RNA, 19 nt, Homo sapiens
ugaccacucugaaguaaga

SEQ ID NO: 764412 - RNA, 19 nt, Homo sapiens
uguuggaucuuacugaaua

SEQ ID NO: 764413 - RNA, 19 nt, Homo sapiens
cuacuggugucauguauau

SEQ ID NO: 764414 - RNA, 19 nt, Homo sapiens
ggaagaaggacaaggaugu

SEQ ID NO: 764415 - RNA, 19 nt, Homo sapiens
aaaggaacaucuagucuuc

SEQ ID NO: 764416 - RNA, 19 nt, Homo sapiens
gcaaacaggcucuagagau

SEQ ID NO: 764417 - RNA, 19 nt, Homo sapiens
caagggaguauauggguua

SEQ ID NO: 764418 - RNA, 19 nt, Homo sapiens
cuacuucuauucagcauug

SEQ ID NO: 764419 - RNA, 19 nt, Homo sapiens
aaagcuagauagagguuaa

SEQ ID NO: 764420 - RNA, 19 nt, Homo sapiens
uauaaggacuucacugcaa

SEQ ID NO: 764421 - RNA, 19 nt, Homo sapiens
ugaauugguugaauaguuc

SEQ ID NO: 764422 - RNA, 19 nt, Homo sapiens
ugaaauaguacugcacuua

SEQ ID NO: 764423 - RNA, 19 nt, Homo sapiens
ccagaugcauuuauuucaa

SEQ ID NO: 764424 - RNA, 19 nt, Homo sapiens
gaaggaagacuugcuuuca

SEQ ID NO: 764425 - RNA, 19 nt, Homo sapiens
agucuuggcuggacaguuu

SEQ ID NO: 764426 - RNA, 19 nt, Homo sapiens
ggagaaaguguauuugugu

SEQ ID NO: 764427 - RNA, 19 nt, Homo sapiens
uuuagcaucuuccuugaua

SEQ ID NO: 764428 - RNA, 19 nt, Homo sapiens
guacgaauugacuaacuua

SEQ ID NO: 764429 - RNA, 19 nt, Homo sapiens
gguuaggaauucaagguuu

SEQ ID NO: 764430 - RNA, 19 nt, Homo sapiens
cacacagauugucuuauua

SEQ ID NO: 764431 - RNA, 19 nt, Homo sapiens
gaggaucaacuguaccaua

SEQ ID NO: 764432 - RNA, 19 nt, Homo sapiens
gcaaguugguaaauucaca

SEQ ID NO: 764433 - RNA, 19 nt, Homo sapiens
ucacacacauuaugagcuu

SEQ ID NO: 764434 - RNA, 19 nt, Homo sapiens
cagaaaguaugugucuuaa

SEQ ID NO: 764435 - RNA, 19 nt, Homo sapiens
cgaauugacuaacuuacug

SEQ ID NO: 764436 - RNA, 19 nt, Homo sapiens
ugacugugguguucagauu

SEQ ID NO: 764437 - RNA, 19 nt, Homo sapiens
gaagcccuauuccucacua

SEQ ID NO: 764438 - RNA, 19 nt, Homo sapiens
gaaagaacacuucccaacu

SEQ ID NO: 764439 - RNA, 19 nt, Homo sapiens
ucagcgagcuccuggauca

SEQ ID NO: 764440 - RNA, 19 nt, Homo sapiens
gaaagaaccuugccgauca

SEQ ID NO: 764441 - RNA, 19 nt, Homo sapiens
ggaaauacaucagagcuua

SEQ ID NO: 764442 - RNA, 19 nt, Homo sapiens
gaaaguaugugucuuaagu

SEQ ID NO: 764443 - RNA, 19 nt, Homo sapiens
ggaaaccucucauugcuaa

SEQ ID NO: 764444 - RNA, 19 nt, Homo sapiens
gaucaacuguaccauauuu

SEQ ID NO: 764445 - RNA, 19 nt, Homo sapiens
gaacugagaccuccagaaa

SEQ ID NO: 764446 - RNA, 19 nt, Homo sapiens
agagacaacugaugaaaua

SEQ ID NO: 764447 - RNA, 19 nt, Homo sapiens
gcagauagcugucauugca

SEQ ID NO: 764448 - RNA, 19 nt, Homo sapiens
gggaguauauggguuauua

SEQ ID NO: 764449 - RNA, 19 nt, Homo sapiens
ccacacagauugucuuauu

SEQ ID NO: 764450 - RNA, 19 nt, Homo sapiens
ccagaaaucuauuccagua

SEQ ID NO: 764451 - RNA, 19 nt, Homo sapiens
ccagagagcuuccagagaa

SEQ ID NO: 764452 - RNA, 19 nt, Homo sapiens
caaacaggcucuagagauu

SEQ ID NO: 764453 - RNA, 19 nt, Homo sapiens
gcaaauggaaucuuuauga

SEQ ID NO: 764454 - RNA, 19 nt, Homo sapiens
gaauuucacuggccuaaug

SEQ ID NO: 764455 - RNA, 19 nt, Homo sapiens
cggcaaaccugucuaauug

SEQ ID NO: 764456 - RNA, 19 nt, Homo sapiens
caaggaauguacaaacuuu

SEQ ID NO: 764457 - RNA, 19 nt, Homo sapiens
gaaguaaugugccaguaga

SEQ ID NO: 764458 - RNA, 19 nt, Homo sapiens
gaagguagaaaucaucaua

SEQ ID NO: 764459 - RNA, 19 nt, Homo sapiens
ggucacagcuggauguuug

SEQ ID NO: 764460 - RNA, 19 nt, Homo sapiens
gcaguuagguuaggaauuc

SEQ ID NO: 764461 - RNA, 19 nt, Homo sapiens
caaaggaucuucccaagca

SEQ ID NO: 764462 - RNA, 19 nt, Homo sapiens
cagaaaggcaucuaaguua

SEQ ID NO: 764463 - RNA, 19 nt, Homo sapiens
gcaguguucucuuaaggua

SEQ ID NO: 764464 - RNA, 19 nt, Homo sapiens
ggaagugaauguugggaaa

SEQ ID NO: 764465 - RNA, 19 nt, Homo sapiens
uaucagaaguguuaaguga

SEQ ID NO: 764466 - RNA, 19 nt, Homo sapiens
guacugcacuuacauaaag

SEQ ID NO: 764467 - RNA, 19 nt, Homo sapiens
cgaaguaguuuaucugaga

SEQ ID NO: 764468 - RNA, 19 nt, Homo sapiens
gagaaaguguauuugugua

SEQ ID NO: 764469 - RNA, 19 nt, Homo sapiens
cuagauggcugcauuguug

SEQ ID NO: 764470 - RNA, 19 nt, Homo sapiens
gcccacaccuaacauuaua

SEQ ID NO: 764471 - RNA, 19 nt, Homo sapiens
ucacuggccuaaugagaua

SEQ ID NO: 764472 - RNA, 19 nt, Homo sapiens
gaauuaccauuaacacaug

SEQ ID NO: 764473 - RNA, 19 nt, Homo sapiens
guaugugucuuaaguuuga

SEQ ID NO: 764474 - RNA, 19 nt, Homo sapiens
ccagaaaguaugugucuua

SEQ ID NO: 764475 - RNA, 19 nt, Homo sapiens
gcaagaagguagaaaucau

SEQ ID NO: 764476 - RNA, 19 nt, Homo sapiens
aaagaacacuucccaacuu

SEQ ID NO: 764477 - RNA, 19 nt, Homo sapiens
ggccaaggcucaugaacuu

SEQ ID NO: 764478 - RNA, 19 nt, Homo sapiens
gaagagagcacuuacugau

SEQ ID NO: 764479 - RNA, 19 nt, Homo sapiens
gcaaaucuguguugaacca

SEQ ID NO: 764480 - RNA, 19 nt, Homo sapiens
agauagagguuaagaauca

SEQ ID NO: 764481 - RNA, 19 nt, Homo sapiens
gaaaccacaugagaaguga

SEQ ID NO: 764482 - RNA, 19 nt, Homo sapiens
gguaauccaaguaauguua

SEQ ID NO: 764483 - RNA, 19 nt, Homo sapiens
caucuagucuucacaguau

SEQ ID NO: 764484 - RNA, 19 nt, Homo sapiens
gaaaagaaaugacuacgau

SEQ ID NO: 764485 - RNA, 19 nt, Homo sapiens
auaaagagauuccaaaugg

SEQ ID NO: 764486 - RNA, 19 nt, Homo sapiens
ugagguaucagaaguguua

SEQ ID NO: 764487 - RNA, 19 nt, Homo sapiens
gacuagacaucacaagaaa

SEQ ID NO: 764488 - RNA, 19 nt, Homo sapiens
ccaaauauuuagcaucuuc

SEQ ID NO: 764489 - RNA, 19 nt, Homo sapiens
gcagcuacuugguaucaaa

SEQ ID NO: 764490 - RNA, 19 nt, Homo sapiens
ugacuacgaugauaccauu

SEQ ID NO: 764491 - RNA, 19 nt, Homo sapiens
agaaaugacuacgaugaua

SEQ ID NO: 764492 - RNA, 19 nt, Homo sapiens
aaacuggacuuaauguguu

SEQ ID NO: 764493 - RNA, 19 nt, Homo sapiens
gaucgagacagucaagaua

SEQ ID NO: 764494 - RNA, 19 nt, Homo sapiens
ugaauucugccaaacauua

SEQ ID NO: 764495 - RNA, 19 nt, Homo sapiens
guaaugcuguggaugaguu

SEQ ID NO: 764496 - RNA, 19 nt, Homo sapiens
ccuagcaaauucuaccuua

SEQ ID NO: 764497 - RNA, 19 nt, Homo sapiens
aagaacacuucccaacuua

SEQ ID NO: 764498 - RNA, 19 nt, Homo sapiens
gugaauugguugaauaguu

SEQ ID NO: 764499 - RNA, 19 nt, Homo sapiens
gaaguaguuuaucugagaa

SEQ ID NO: 764500 - RNA, 19 nt, Homo sapiens
ggaugaaguugcagaagau

SEQ ID NO: 764501 - RNA, 19 nt, Homo sapiens
gaaacuggacuuaaugugu

SEQ ID NO: 764502 - RNA, 19 nt, Homo sapiens
ugagacagcuggacuucaa

SEQ ID NO: 764503 - RNA, 19 nt, Homo sapiens
uuacacauauccacaaaug

SEQ ID NO: 764504 - RNA, 19 nt, Homo sapiens
uguauuaucucaaggaaug

SEQ ID NO: 764505 - RNA, 19 nt, Homo sapiens
ggagguguguauguuuaua

SEQ ID NO: 764506 - RNA, 19 nt, Homo sapiens
gcaucuuccuugauaauau

SEQ ID NO: 764507 - RNA, 19 nt, Homo sapiens
ugaccacucugaaguaaga

SEQ ID NO: 764508 - RNA, 19 nt, Homo sapiens
uguuggaucuuacugaaua

SEQ ID NO: 764509 - RNA, 19 nt, Homo sapiens
cuacuggugucauguauau

SEQ ID NO: 764510 - RNA, 19 nt, Homo sapiens
ggaagaaggacaaggaugu

SEQ ID NO: 764511 - RNA, 19 nt, Homo sapiens
aaaggaacaucuagucuuc

SEQ ID NO: 764512 - RNA, 19 nt, Homo sapiens
gcaaacaggcucuagagau

SEQ ID NO: 764513 - RNA, 19 nt, Homo sapiens
caagggaguauauggguua

SEQ ID NO: 764514 - RNA, 19 nt, Homo sapiens
cuacuucuauucagcauug

SEQ ID NO: 764515 - RNA, 19 nt, Homo sapiens
aaagcuagauagagguuaa

SEQ ID NO: 764516 - RNA, 19 nt, Homo sapiens
uauaaggacuucacugcaa

SEQ ID NO: 764517 - RNA, 19 nt, Homo sapiens
ugaauugguugaauaguuc

SEQ ID NO: 764518 - RNA, 19 nt, Homo sapiens
ugaaauaguacugcacuua

SEQ ID NO: 764519 - RNA, 19 nt, Homo sapiens
ccagaugcauuuauuucaa

SEQ ID NO: 764520 - RNA, 19 nt, Homo sapiens
gaaggaagacuugcuuuca

SEQ ID NO: 764521 - RNA, 19 nt, Homo sapiens
agucuuggcuggacaguuu

SEQ ID NO: 764522 - RNA, 19 nt, Homo sapiens
ggagaaaguguauuugugu

SEQ ID NO: 764523 - RNA, 19 nt, Homo sapiens
uuuagcaucuuccuugaua

SEQ ID NO: 764524 - RNA, 19 nt, Homo sapiens
guacgaauugacuaacuua

SEQ ID NO: 764525 - RNA, 19 nt, Homo sapiens
gguuaggaauucaagguuu

SEQ ID NO: 764526 - RNA, 19 nt, Homo sapiens
cacacagauugucuuauua

SEQ ID NO: 764527 - RNA, 19 nt, Homo sapiens
gaggaucaacuguaccaua

SEQ ID NO: 764528 - RNA, 19 nt, Homo sapiens
gcaaguugguaaauucaca

SEQ ID NO: 764529 - RNA, 19 nt, Homo sapiens
ucacacacauuaugagcuu

SEQ ID NO: 764530 - RNA, 19 nt, Homo sapiens
cagaaaguaugugucuuaa

SEQ ID NO: 764531 - RNA, 19 nt, Homo sapiens
cgaauugacuaacuuacug

SEQ ID NO: 764532 - RNA, 19 nt, Homo sapiens
ugacugugguguucagauu

SEQ ID NO: 764533 - RNA, 19 nt, Homo sapiens
gaagcccuauuccucacua

SEQ ID NO: 764534 - RNA, 19 nt, Homo sapiens
gaaagaacacuucccaacu

SEQ ID NO: 764535 - RNA, 19 nt, Homo sapiens
ucagcgagcuccuggauca

SEQ ID NO: 764536 - RNA, 19 nt, Homo sapiens
gagaagagagcacuuacug

SEQ ID NO: 764537 - RNA, 19 nt, Homo sapiens
gaugauaccauuccaaucu

SEQ ID NO: 764538 - RNA, 19 nt, Homo sapiens
caauuggcauuaacaagga

SEQ ID NO: 764539 - RNA, 19 nt, Homo sapiens
uagcaaacuucaggacuuu

SEQ ID NO: 764540 - RNA, 19 nt, Homo sapiens
gcaaacuacucccuacuua

SEQ ID NO: 764541 - RNA, 19 nt, Homo sapiens
ggacagaaguggaggcaaa

SEQ ID NO: 764542 - RNA, 19 nt, Homo sapiens
ggaaggauauuacaccuau

SEQ ID NO: 764543 - RNA, 19 nt, Homo sapiens
gggcagaacugguuaaagu

SEQ ID NO: 764544 - RNA, 19 nt, Homo sapiens
gcuaucugcuucccuauga

SEQ ID NO: 764545 - RNA, 19 nt, Homo sapiens
cuucaaaggugacaaguau

SEQ ID NO: 764546 - RNA, 19 nt, Homo sapiens
ugacaaguauuggguguuu

SEQ ID NO: 764547 - RNA, 19 nt, Homo sapiens
gcgagauguuugucuuuaa

SEQ ID NO: 764548 - RNA, 19 nt, Homo sapiens
gaaggaggcagacaucaug

SEQ ID NO: 764549 - RNA, 19 nt, Homo sapiens
ggcgagauguuugucuuua

SEQ ID NO: 764550 - RNA, 19 nt, Homo sapiens
ggagauuugucuucuucaa

SEQ ID NO: 764551 - RNA, 19 nt, Homo sapiens
gaggagacacccacuuuga

SEQ ID NO: 764552 - RNA, 19 nt, Homo sapiens
cuacagcauucacaacuau

SEQ ID NO: 764553 - RNA, 19 nt, Homo sapiens
gaaguuugacaaccagaaa

SEQ ID NO: 764554 - RNA, 19 nt, Homo sapiens
gaaaccugcuccacuuguc

SEQ ID NO: 764555 - RNA, 19 nt, Homo sapiens
agacaacgaucgaguggau

SEQ ID NO: 764556 - RNA, 19 nt, Homo sapiens
caaacuacucccuacuuaa

SEQ ID NO: 764557 - RNA, 19 nt, Homo sapiens
gauguggugucccugauca

SEQ ID NO: 764558 - RNA, 19 nt, Homo sapiens
gaaggauauuacaccuauu

SEQ ID NO: 764559 - RNA, 19 nt, Homo sapiens
ucaaaggugacaaguauug

SEQ ID NO: 764560 - RNA, 19 nt, Homo sapiens
gacaaguauuggguguuua

SEQ ID NO: 764561 - RNA, 19 nt, Homo sapiens
gagcaacaagccuggguuu

SEQ ID NO: 764562 - RNA, 19 nt, Homo sapiens
gcaccaaacccaacaucug

SEQ ID NO: 764563 - RNA, 19 nt, Homo sapiens
acacaucaccuacagcauu

SEQ ID NO: 764564 - RNA, 19 nt, Homo sapiens
guuaaaguccuauggcuau

SEQ ID NO: 764565 - RNA, 19 nt, Homo sapiens
ccaugcagaucgagcaguu

SEQ ID NO: 764566 - RNA, 19 nt, Homo sapiens
cggcagaucccucaggaaa

SEQ ID NO: 764567 - RNA, 19 nt, Homo sapiens
gaugggagauuugucuucu

SEQ ID NO: 764568 - RNA, 19 nt, Homo sapiens
cgagauguuugucuuuaag

SEQ ID NO: 764569 - RNA, 19 nt, Homo sapiens
aguauuggguguuuaagga

SEQ ID NO: 764570 - RNA, 19 nt, Homo sapiens
cgacgcagccuaugaaagg

SEQ ID NO: 764571 - RNA, 19 nt, Homo sapiens
gaggugccauaccaugaga

SEQ ID NO: 764572 - RNA, 19 nt, Homo sapiens
ccuacagcauucacaacua

SEQ ID NO: 764573 - RNA, 19 nt, Homo sapiens
ggaggagacacccacuuug

SEQ ID NO: 764574 - RNA, 19 nt, Homo sapiens
ggaaggaggcagacaucau

SEQ ID NO: 764575 - RNA, 19 nt, Homo sapiens
gcccucagccugucaccua

SEQ ID NO: 764576 - RNA, 19 nt, Homo sapiens
acaaguauuggguguuuaa

SEQ ID NO: 764577 - RNA, 19 nt, Homo sapiens
caacacaguggcccucuuc

SEQ ID NO: 764578 - RNA, 19 nt, Homo sapiens
gccauaccaugagaucaaa

SEQ ID NO: 764579 - RNA, 19 nt, Homo sapiens
aaacuacucccuacuuaag

SEQ ID NO: 764580 - RNA, 19 nt, Homo sapiens
ggacgacguggacaucaug

SEQ ID NO: 764581 - RNA, 19 nt, Homo sapiens
uaggaaacgccaaccauga

SEQ ID NO: 764582 - RNA, 19 nt, Homo sapiens
aggcagacaucaugaucuu

SEQ ID NO: 764583 - RNA, 19 nt, Homo sapiens
cuucggagacccaggauuu

SEQ ID NO: 764584 - RNA, 19 nt, Homo sapiens
ggaaaccugcuccacuugu

SEQ ID NO: 764585 - RNA, 19 nt, Homo sapiens
cacaucaccuacagcauuc

SEQ ID NO: 764586 - RNA, 19 nt, Homo sapiens
gcagaucccucaggaaacc

SEQ ID NO: 764587 - RNA, 19 nt, Homo sapiens
gcagacaucaugaucuuuu

SEQ ID NO: 764588 - RNA, 19 nt, Homo sapiens
ggaaguuugacaaccagaa

SEQ ID NO: 764589 - RNA, 19 nt, Homo sapiens
uuacaccuauuucuacaag

SEQ ID NO: 764590 - RNA, 19 nt, Homo sapiens
ucaccgguguguuggauca

SEQ ID NO: 764591 - RNA, 19 nt, Homo sapiens
ugggagauuugucuucuuc

SEQ ID NO: 764592 - RNA, 19 nt, Homo sapiens
caucgacgcagccuaugaa

SEQ ID NO: 764593 - RNA, 19 nt, Homo sapiens
ucguacagcugaaguugug

SEQ ID NO: 764594 - RNA, 19 nt, Homo sapiens
ucagcaaggaaggauauua

SEQ ID NO: 764595 - RNA, 19 nt, Homo sapiens
ccaaacccaacaucuguga

SEQ ID NO: 764596 - RNA, 19 nt, Homo sapiens
caucagcaaggaaggauau

SEQ ID NO: 764597 - RNA, 19 nt, Homo sapiens
caccaaacccaacaucugu

SEQ ID NO: 764598 - RNA, 19 nt, Homo sapiens
agaacugguuaaaguccua

SEQ ID NO: 764599 - RNA, 19 nt, Homo sapiens
ggaggcagacaucaugauc

SEQ ID NO: 764600 - RNA, 19 nt, Homo sapiens
gcaucgacgcagccuauga

SEQ ID NO: 764601 - RNA, 19 nt, Homo sapiens
caaggccacucccuacacu

SEQ ID NO: 764602 - RNA, 19 nt, Homo sapiens
uugaagaggugccauacca

SEQ ID NO: 764603 - RNA, 19 nt, Homo sapiens
ccacuaugcagcaguuuua

SEQ ID NO: 764604 - RNA, 19 nt, Homo sapiens
ggcaaacuacucccuacuu

SEQ ID NO: 764605 - RNA, 19 nt, Homo sapiens
ggagacacccacuuugacu

SEQ ID NO: 764606 - RNA, 19 nt, Homo sapiens
uggaggagacacccacuuu

SEQ ID NO: 764607 - RNA, 19 nt, Homo sapiens
ggucaccgguguguuggau

SEQ ID NO: 764608 - RNA, 19 nt, Homo sapiens
gggcgagauguuugucuuu

SEQ ID NO: 764609 - RNA, 19 nt, Homo sapiens
ggcgacagcuccccauuug

SEQ ID NO: 764610 - RNA, 19 nt, Homo sapiens
ucacaacuauaccccaaaa

SEQ ID NO: 764611 - RNA, 19 nt, Homo sapiens
cagccugucaccuacuaua

SEQ ID NO: 764612 - RNA, 19 nt, Homo sapiens
ggauauuacaccuauuucu

SEQ ID NO: 764613 - RNA, 19 nt, Homo sapiens
ucgccaggcuuucgaugug

SEQ ID NO: 764614 - RNA, 19 nt, Homo sapiens
gagcuagacacgcggaaag

SEQ ID NO: 764615 - RNA, 19 nt, Homo sapiens
caaggacccgugucacauc

SEQ ID NO: 764616 - RNA, 19 nt, Homo sapiens
cagcaaggaaggauauuac

SEQ ID NO: 764617 - RNA, 19 nt, Homo sapiens
ucuggcgucugcgcaauaa

SEQ ID NO: 764618 - RNA, 19 nt, Homo sapiens
cuagacacgcggaaagcua

SEQ ID NO: 764619 - RNA, 19 nt, Homo sapiens
gcaacaagccuggguuucc

SEQ ID NO: 764620 - RNA, 19 nt, Homo sapiens
ggagaaacaagcgcuaugc

SEQ ID NO: 764621 - RNA, 19 nt, Homo sapiens
ggucguacagcugaaguug

SEQ ID NO: 764622 - RNA, 19 nt, Homo sapiens
ggaauaggccaggcuccau

SEQ ID NO: 764623 - RNA, 19 nt, Homo sapiens
uacaccaucuuccaguuca

SEQ ID NO: 764624 - RNA, 19 nt, Homo sapiens
gacccuggcuacccuaagc

SEQ ID NO: 764625 - RNA, 19 nt, Homo sapiens
agucggcagucuccacuau

SEQ ID NO: 764626 - RNA, 19 nt, Homo sapiens
acaacgaucgaguggauga

SEQ ID NO: 764627 - RNA, 19 nt, Homo sapiens
ucuacaccaucuuccaguu

SEQ ID NO: 764628 - RNA, 19 nt, Homo sapiens
gggacuacuggaaguuuga

SEQ ID NO: 764629 - RNA, 19 nt, Homo sapiens
cgggacuacuggaaguuug

SEQ ID NO: 764630 - RNA, 19 nt, Homo sapiens
ccgcaucgacgcagccuau

SEQ ID NO: 764631 - RNA, 19 nt, Homo sapiens
acauggagacgcacaacuu

SEQ ID NO: 764632 - RNA, 19 nt, Homo sapiens
ugacgggaacgaccucuuc

SEQ ID NO: 764633 - RNA, 19 nt, Homo sapiens
gcuaggaaacgccaaccau

SEQ ID NO: 764634 - RNA, 19 nt, Homo sapiens
gcaaggaaggauauuacac

SEQ ID NO: 764635 - RNA, 19 nt, Homo sapiens
gaaagggccgaugggagau

SEQ ID NO: 764636 - RNA, 19 nt, Homo sapiens
agauguuugucuuuaagga

SEQ ID NO: 764637 - RNA, 19 nt, Homo sapiens
cagcugggucugacaagga

SEQ ID NO: 764638 - RNA, 19 nt, Homo sapiens
ucaacacaguggcccucuu

SEQ ID NO: 764639 - RNA, 19 nt, Homo sapiens
ugacggcaacuucaacaca

SEQ ID NO: 764640 - RNA, 19 nt, Homo sapiens
gaaugaagcugcuggguuu

SEQ ID NO: 764641 - RNA, 19 nt, Homo sapiens
ccuaagaaguacauuguua

SEQ ID NO: 764642 - RNA, 19 nt, Homo sapiens
gaacacacacacuuacuuu

SEQ ID NO: 764643 - RNA, 19 nt, Homo sapiens
gaucgaaaccaaaguagua

SEQ ID NO: 764644 - RNA, 19 nt, Homo sapiens
acugagagaugcagaaaua

SEQ ID NO: 764645 - RNA, 19 nt, Homo sapiens
uacagaaacugaaccauuu

SEQ ID NO: 764646 - RNA, 19 nt, Homo sapiens
caccaaagaucccauauuc

SEQ ID NO: 764647 - RNA, 19 nt, Homo sapiens
guggucaucucuaggauua

SEQ ID NO: 764648 - RNA, 19 nt, Homo sapiens
gaaacuagcaccaugucua

SEQ ID NO: 764649 - RNA, 19 nt, Homo sapiens
gagagaugcagaaauauuu

SEQ ID NO: 764650 - RNA, 19 nt, Homo sapiens
ccaaagaaccaaagaagaa

SEQ ID NO: 764651 - RNA, 19 nt, Homo sapiens
gaaauuaucaccaccaaag

SEQ ID NO: 764652 - RNA, 19 nt, Homo sapiens
ccuaaucucuguaaagcua

SEQ ID NO: 764653 - RNA, 19 nt, Homo sapiens
gaguuggaaucacuguuua

SEQ ID NO: 764654 - RNA, 19 nt, Homo sapiens
guacauuguuaccucuaua

SEQ ID NO: 764655 - RNA, 19 nt, Homo sapiens
ccaaagaucccauauucaa

SEQ ID NO: 764656 - RNA, 19 nt, Homo sapiens
gaacaaggcugaggauacg

SEQ ID NO: 764657 - RNA, 19 nt, Homo sapiens
gaaacugaaccauuuguug

SEQ ID NO: 764658 - RNA, 19 nt, Homo sapiens
gcaaaagaauggcagaaaa

SEQ ID NO: 764659 - RNA, 19 nt, Homo sapiens
cagaagagcuuuccaucca

SEQ ID NO: 764660 - RNA, 19 nt, Homo sapiens
uaacauaccuaagaaguac

SEQ ID NO: 764661 - RNA, 19 nt, Homo sapiens
cagaaaugauuacuaagga

SEQ ID NO: 764662 - RNA, 19 nt, Homo sapiens
gaggagaaggccaaugaua

SEQ ID NO: 764663 - RNA, 19 nt, Homo sapiens
uagcuuaucuacuuccaaa

SEQ ID NO: 764664 - RNA, 19 nt, Homo sapiens
gcucaggacugccauugga

SEQ ID NO: 764665 - RNA, 19 nt, Homo sapiens
gcaucugccucucauauca

SEQ ID NO: 764666 - RNA, 19 nt, Homo sapiens
gaaaugaucgaaaccaaag

SEQ ID NO: 764667 - RNA, 19 nt, Homo sapiens
cagaauuuauugucaguga

SEQ ID NO: 764668 - RNA, 19 nt, Homo sapiens
caggugucaugcagaauua

SEQ ID NO: 764669 - RNA, 19 nt, Homo sapiens
ggaaaugaucgaaaccaaa

SEQ ID NO: 764670 - RNA, 19 nt, Homo sapiens
caacacaaacaacagaauu

SEQ ID NO: 764671 - RNA, 19 nt, Homo sapiens
uguuacaacucaucugaua

SEQ ID NO: 764672 - RNA, 19 nt, Homo sapiens
ucacugagaccaaggcuuu

SEQ ID NO: 764673 - RNA, 19 nt, Homo sapiens
ccuggaagcugaaguuuag

SEQ ID NO: 764674 - RNA, 19 nt, Homo sapiens
gacacagccuugaaagcua

SEQ ID NO: 764675 - RNA, 19 nt, Homo sapiens
ccaaggcuuucucuacuga

SEQ ID NO: 764676 - RNA, 19 nt, Homo sapiens
caagugcugugcaagguau

SEQ ID NO: 764677 - RNA, 19 nt, Homo sapiens
gaccaaggcuuucucuacu

SEQ ID NO: 764678 - RNA, 19 nt, Homo sapiens
aaacugaaccauuuguuga

SEQ ID NO: 764679 - RNA, 19 nt, Homo sapiens
gagcaucugccucucauau

SEQ ID NO: 764680 - RNA, 19 nt, Homo sapiens
ccagugagccgacaguuug

SEQ ID NO: 764681 - RNA, 19 nt, Homo sapiens
gaggcuagguggguugaaa

SEQ ID NO: 764682 - RNA, 19 nt, Homo sapiens
gcccuucuccuuauuguaa

SEQ ID NO: 764683 - RNA, 19 nt, Homo sapiens
uagcaacccuaaugaggaa

SEQ ID NO: 764684 - RNA, 19 nt, Homo sapiens
caaacaagaaucagcagaa

SEQ ID NO: 764685 - RNA, 19 nt, Homo sapiens
aaaccaaaguaguaaagga

SEQ ID NO: 764686 - RNA, 19 nt, Homo sapiens
gaaugcccuucuccuuauu

SEQ ID NO: 764687 - RNA, 19 nt, Homo sapiens
ccaaugauagcaacccuaa

SEQ ID NO: 764688 - RNA, 19 nt, Homo sapiens
cuacagaaacugaaccauu

SEQ ID NO: 764689 - RNA, 19 nt, Homo sapiens
caaagaaccaaagaagaaa

SEQ ID NO: 764690 - RNA, 19 nt, Homo sapiens
gccuggcuauguccuaaua

SEQ ID NO: 764691 - RNA, 19 nt, Homo sapiens
gaagcugaaguuuagauga

SEQ ID NO: 764692 - RNA, 19 nt, Homo sapiens
ugaaagccauggagauucu

SEQ ID NO: 764693 - RNA, 19 nt, Homo sapiens
gaaaggaguuuugcaaagu

SEQ ID NO: 764694 - RNA, 19 nt, Homo sapiens
ggacugccauuggacuaug

SEQ ID NO: 764695 - RNA, 19 nt, Homo sapiens
cauccggacuaguuauuga

SEQ ID NO: 764696 - RNA, 19 nt, Homo sapiens
ggacugagagaugcagaaa

SEQ ID NO: 764697 - RNA, 19 nt, Homo sapiens
caacaagaagggacugaga

SEQ ID NO: 764698 - RNA, 19 nt, Homo sapiens
ggcaaccauuauaaccuua

SEQ ID NO: 764699 - RNA, 19 nt, Homo sapiens
agacaggguccaaguguuu

SEQ ID NO: 764700 - RNA, 19 nt, Homo sapiens
ugagagaugcagaaauauu

SEQ ID NO: 764701 - RNA, 19 nt, Homo sapiens
aacauuugcugaauagcua

SEQ ID NO: 764702 - RNA, 19 nt, Homo sapiens
gaccuaaucucuguaaagc

SEQ ID NO: 764703 - RNA, 19 nt, Homo sapiens
gcaaggaccuaaaacaucu

SEQ ID NO: 764704 - RNA, 19 nt, Homo sapiens
gcaaagugcaaggaccuaa

SEQ ID NO: 764705 - RNA, 19 nt, Homo sapiens
gcuauguccuaauaauauc

SEQ ID NO: 764706 - RNA, 19 nt, Homo sapiens
ggcuauguccuaauaauau

SEQ ID NO: 764707 - RNA, 19 nt, Homo sapiens
gaggcugguuucuuucaug

SEQ ID NO: 764708 - RNA, 19 nt, Homo sapiens
caucugauacuuggacuaa

SEQ ID NO: 764709 - RNA, 19 nt, Homo sapiens
agacagaaaugaggagaca

SEQ ID NO: 764710 - RNA, 19 nt, Homo sapiens
cuaaugaggaaucaaagaa

SEQ ID NO: 764711 - RNA, 19 nt, Homo sapiens
agaaggaaaugaucgaaac

SEQ ID NO: 764712 - RNA, 19 nt, Homo sapiens
aaauaaagcagcauucaag

SEQ ID NO: 764713 - RNA, 19 nt, Homo sapiens
cagaaauuaucaccaccaa

SEQ ID NO: 764714 - RNA, 19 nt, Homo sapiens
ugaguuggaaucacuguuu

SEQ ID NO: 764715 - RNA, 19 nt, Homo sapiens
ggagugcaccaaagagaau

SEQ ID NO: 764716 - RNA, 19 nt, Homo sapiens
guccaagaguccaagcaaa

SEQ ID NO: 764717 - RNA, 19 nt, Homo sapiens
aaacaagaaucagcagaag

SEQ ID NO: 764718 - RNA, 19 nt, Homo sapiens
gcaaccauuauaaccuuaa

SEQ ID NO: 764719 - RNA, 19 nt, Homo sapiens
gcaagguauuacacucugu

SEQ ID NO: 764720 - RNA, 19 nt, Homo sapiens
acaagaaucagcagaagga

SEQ ID NO: 764721 - RNA, 19 nt, Homo sapiens
uggaaucacuguuuagaac

SEQ ID NO: 764722 - RNA, 19 nt, Homo sapiens
caaagugcaaggaccuaaa

SEQ ID NO: 764723 - RNA, 19 nt, Homo sapiens
ccuccuaccuccaaagcuu

SEQ ID NO: 764724 - RNA, 19 nt, Homo sapiens
uggacuaacucgcgcauuc

SEQ ID NO: 764725 - RNA, 19 nt, Homo sapiens
uggcaaccauuauaaccuu

SEQ ID NO: 764726 - RNA, 19 nt, Homo sapiens
gaaguuuagaugagacaga

SEQ ID NO: 764727 - RNA, 19 nt, Homo sapiens
gaacacauugaguuggaau

SEQ ID NO: 764728 - RNA, 19 nt, Homo sapiens
ccaggugucaugcagaauu

SEQ ID NO: 764729 - RNA, 19 nt, Homo sapiens
aaugauagcaacccuaaug

SEQ ID NO: 764730 - RNA, 19 nt, Homo sapiens
agaaucagcagaaggaaau

SEQ ID NO: 764731 - RNA, 19 nt, Homo sapiens
gcucagacccuuucuucag

SEQ ID NO: 764732 - RNA, 19 nt, Homo sapiens
gccaaagaaccaaagaaga

SEQ ID NO: 764733 - RNA, 19 nt, Homo sapiens
ccaccaaagaucccauauu

SEQ ID NO: 764734 - RNA, 19 nt, Homo sapiens
cuuaucuacuuccaaacua

SEQ ID NO: 764735 - RNA, 19 nt, Homo sapiens
cagacaggguccaaguguu

SEQ ID NO: 764736 - RNA, 19 nt, Homo sapiens
gaaagagaaacacguaucc

SEQ ID NO: 764737 - RNA, 19 nt, Homo sapiens
ucaucaguauccaguggua

SEQ ID NO: 764738 - RNA, 19 nt, Homo sapiens
ggagaaggccaaugauagc

SEQ ID NO: 764739 - RNA, 19 nt, Homo sapiens
caccaugucuacagaaacu

SEQ ID NO: 764740 - RNA, 19 nt, Homo sapiens
ggagauagguauugagaaa

SEQ ID NO: 764741 - RNA, 19 nt, Homo sapiens
ccagaaacauccacaauuu

SEQ ID NO: 764742 - RNA, 19 nt, Homo sapiens
ccacuuaacugcagacuug

SEQ ID NO: 764743 - RNA, 19 nt, Homo sapiens
ggaaagacagcacauauug

SEQ ID NO: 764744 - RNA, 19 nt, Homo sapiens
gaacugcgcugcguguaug

SEQ ID NO: 764745 - RNA, 19 nt, Homo sapiens
aaacaaagccuauaaacug

SEQ ID NO: 764746 - RNA, 19 nt, Homo sapiens
uaugagagagguacaauua

SEQ ID NO: 764747 - RNA, 19 nt, Homo sapiens
gcauauaaaugacaucaag

SEQ ID NO: 764748 - RNA, 19 nt, Homo sapiens
caaagacgaaguaauguaa

SEQ ID NO: 764749 - RNA, 19 nt, Homo sapiens
guugaaaguugaugaauuc

SEQ ID NO: 764750 - RNA, 19 nt, Homo sapiens
gcaaagacgaaguaaugua

SEQ ID NO: 764751 - RNA, 19 nt, Homo sapiens
caaaguaagccucugauga

SEQ ID NO: 764752 - RNA, 19 nt, Homo sapiens
cagcaaagacgaaguaaug

SEQ ID NO: 764753 - RNA, 19 nt, Homo sapiens
guaagccucugaugauaau

SEQ ID NO: 764754 - RNA, 19 nt, Homo sapiens
gcuggagagugccauuaua

SEQ ID NO: 764755 - RNA, 19 nt, Homo sapiens
ggccauauauuugugguuu

SEQ ID NO: 764756 - RNA, 19 nt, Homo sapiens
guagaguccuuacacaugu

SEQ ID NO: 764757 - RNA, 19 nt, Homo sapiens
aaugugaagugaugcauaa

SEQ ID NO: 764758 - RNA, 19 nt, Homo sapiens
gaacaucugcugucuuugg

SEQ ID NO: 764759 - RNA, 19 nt, Homo sapiens
uaagggagauagguauuga

SEQ ID NO: 764760 - RNA, 19 nt, Homo sapiens
uaaacuguguuguaggaaa

SEQ ID NO: 764761 - RNA, 19 nt, Homo sapiens
uauaaacuguguuguagga

SEQ ID NO: 764762 - RNA, 19 nt, Homo sapiens
caagggagagcauauaaau

SEQ ID NO: 764763 - RNA, 19 nt, Homo sapiens
gcgcagggccauauauuug

SEQ ID NO: 764764 - RNA, 19 nt, Homo sapiens
gaaagacagcacauauugu

SEQ ID NO: 764765 - RNA, 19 nt, Homo sapiens
ccaggacacccacagauaa

SEQ ID NO: 764766 - RNA, 19 nt, Homo sapiens
ggagagugccauuauaaca

SEQ ID NO: 764767 - RNA, 19 nt, Homo sapiens
cauaacaugcaacuuagua

SEQ ID NO: 764768 - RNA, 19 nt, Homo sapiens
gaaugugaagugaugcaua

SEQ ID NO: 764769 - RNA, 19 nt, Homo sapiens
aaagacagcacauauuguu

SEQ ID NO: 764770 - RNA, 19 nt, Homo sapiens
caaagaacaucugcugucu

SEQ ID NO: 764771 - RNA, 19 nt, Homo sapiens
cagaaaauguugaaaguug

SEQ ID NO: 764772 - RNA, 19 nt, Homo sapiens
gagagugccauuauaacaa

SEQ ID NO: 764773 - RNA, 19 nt, Homo sapiens
aaaguaagccucugaugau

SEQ ID NO: 764774 - RNA, 19 nt, Homo sapiens
cagaucauauucacaaugg

SEQ ID NO: 764775 - RNA, 19 nt, Homo sapiens
uaagagaaacauagggaaa

SEQ ID NO: 764776 - RNA, 19 nt, Homo sapiens
ccuauaaacuguguuguag

SEQ ID NO: 764777 - RNA, 19 nt, Homo sapiens
uaugugaagucaaccuuug

SEQ ID NO: 764778 - RNA, 19 nt, Homo sapiens
gcauucugcugggcacuuu

SEQ ID NO: 764779 - RNA, 19 nt, Homo sapiens
gcucuagaaacaucuuuaa

SEQ ID NO: 764780 - RNA, 19 nt, Homo sapiens
agggagagcauauaaauga

SEQ ID NO: 764781 - RNA, 19 nt, Homo sapiens
caaagccuauaaacugugu

SEQ ID NO: 764782 - RNA, 19 nt, Homo sapiens
gaugcucccagaaucaaua

SEQ ID NO: 764783 - RNA, 19 nt, Homo sapiens
ggacacccacagauaauuc

SEQ ID NO: 764784 - RNA, 19 nt, Homo sapiens
gcagggccauauauuugug

SEQ ID NO: 764785 - RNA, 19 nt, Homo sapiens
ggacaaacuaagagaaaca

SEQ ID NO: 764786 - RNA, 19 nt, Homo sapiens
gccaggacacccacagaua

SEQ ID NO: 764787 - RNA, 19 nt, Homo sapiens
gaaauguagagaucuguuc

SEQ ID NO: 764788 - RNA, 19 nt, Homo sapiens
guuacaggcucauacaaag

SEQ ID NO: 764789 - RNA, 19 nt, Homo sapiens
gugggaaugugaagugaug

SEQ ID NO: 764790 - RNA, 19 nt, Homo sapiens
aaguaagccucugaugaua

SEQ ID NO: 764791 - RNA, 19 nt, Homo sapiens
gagagcauauaaaugacau

SEQ ID NO: 764792 - RNA, 19 nt, Homo sapiens
ccacagauaauucuauucu

SEQ ID NO: 764793 - RNA, 19 nt, Homo sapiens
ucacaauggcuuuaugaga

SEQ ID NO: 764794 - RNA, 19 nt, Homo sapiens
caaacuaagagaaacauag

SEQ ID NO: 764795 - RNA, 19 nt, Homo sapiens
gugaagugaugcauaacau

SEQ ID NO: 764796 - RNA, 19 nt, Homo sapiens
acaauggcuuuaugagaga

SEQ ID NO: 764797 - RNA, 19 nt, Homo sapiens
ggaaauguagagaucuguu

SEQ ID NO: 764798 - RNA, 19 nt, Homo sapiens
ccauauauuugugguuuca

SEQ ID NO: 764799 - RNA, 19 nt, Homo sapiens
guaggaaagacagcacaua

SEQ ID NO: 764800 - RNA, 19 nt, Homo sapiens
gccuauaaacuguguugua

SEQ ID NO: 764801 - RNA, 19 nt, Homo sapiens
gugcugcuguugacuguuc

SEQ ID NO: 764802 - RNA, 19 nt, Homo sapiens
cagaaacauccacaauuug

SEQ ID NO: 764803 - RNA, 19 nt, Homo sapiens
gacagcacauauuguuaca

SEQ ID NO: 764804 - RNA, 19 nt, Homo sapiens
aacaaagccuauaaacugu

SEQ ID NO: 764805 - RNA, 19 nt, Homo sapiens
uaggaaagacagcacauau

SEQ ID NO: 764806 - RNA, 19 nt, Homo sapiens
ugaugauaauuggcucuua

SEQ ID NO: 764807 - RNA, 19 nt, Homo sapiens
uccauacggucccaaagaa

SEQ ID NO: 764808 - RNA, 19 nt, Homo sapiens
ggagaaagacuggcuuggu

SEQ ID NO: 764809 - RNA, 19 nt, Homo sapiens
cccuaccucuuucuccuua

SEQ ID NO: 764810 - RNA, 19 nt, Homo sapiens
gagugggaaugugaaguga

SEQ ID NO: 764811 - RNA, 19 nt, Homo sapiens
uauguaguguuucagucua

SEQ ID NO: 764812 - RNA, 19 nt, Homo sapiens
ccaccaauggacaaacuaa

SEQ ID NO: 764813 - RNA, 19 nt, Homo sapiens
caauugagagaacugagaa

SEQ ID NO: 764814 - RNA, 19 nt, Homo sapiens
aaacuguguuguaggaaag

SEQ ID NO: 764815 - RNA, 19 nt, Homo sapiens
cagcaacucacccucaaga

SEQ ID NO: 764816 - RNA, 19 nt, Homo sapiens
ggcagcaacucacccucaa

SEQ ID NO: 764817 - RNA, 19 nt, Homo sapiens
gagcauauaaaugacauca

SEQ ID NO: 764818 - RNA, 19 nt, Homo sapiens
ucaguaagcuaaaauccaa

SEQ ID NO: 764819 - RNA, 19 nt, Homo sapiens
gaaagggagagugggaaug

SEQ ID NO: 764820 - RNA, 19 nt, Homo sapiens
guaagggagauagguauug

SEQ ID NO: 764821 - RNA, 19 nt, Homo sapiens
guacuucaucccagaaaca

SEQ ID NO: 764822 - RNA, 19 nt, Homo sapiens
aaauauucacgaccacuaa

SEQ ID NO: 764823 - RNA, 19 nt, Homo sapiens
cugcugggcacuuuacuaa

SEQ ID NO: 764824 - RNA, 19 nt, Homo sapiens
gccauuauaacaacaaauc

SEQ ID NO: 764825 - RNA, 19 nt, Homo sapiens
cuggagagugccauuauaa

SEQ ID NO: 764826 - RNA, 19 nt, Homo sapiens
aaaaggaaauguagagauc

SEQ ID NO: 764827 - RNA, 19 nt, Homo sapiens
ucaagggagagcauauaaa

SEQ ID NO: 764828 - RNA, 19 nt, Homo sapiens
ggagagcauauaaaugaca

SEQ ID NO: 764829 - RNA, 19 nt, Homo sapiens
cauauucacaauggcuuua

SEQ ID NO: 764830 - RNA, 19 nt, Homo sapiens
ggcgcagggccauauauuu

SEQ ID NO: 764831 - RNA, 19 nt, Homo sapiens
caacuuaguaggaauuuug

SEQ ID NO: 764832 - RNA, 19 nt, Homo sapiens
ccagaugcucccagaauca

SEQ ID NO: 764833 - RNA, 19 nt, Homo sapiens
acccacagauaauucuauu

SEQ ID NO: 764834 - RNA, 19 nt, Homo sapiens
cccagaaacauccacaauu

SEQ ID NO: 764835 - RNA, 19 nt, Homo sapiens
ccauaagccucagacucaa

SEQ ID NO: 764836 - RNA, 19 nt, Homo sapiens
agccacugcuucugucgua

SEQ ID NO: 764837 - RNA, 19 nt, Homo sapiens
agaaacauccacaauuugg

SEQ ID NO: 764838 - RNA, 19 nt, Homo sapiens
cacgaccacuaauagauca

SEQ ID NO: 764839 - RNA, 19 nt, Homo sapiens
gggcuggagagugccauua

SEQ ID NO: 764840 - RNA, 19 nt, Homo sapiens
gagcaacaguguauauuau

SEQ ID NO: 764841 - RNA, 19 nt, Homo sapiens
gcuaguauguuaaguuuga

SEQ ID NO: 764842 - RNA, 19 nt, Homo sapiens
acugauagcuaguauguua

SEQ ID NO: 764843 - RNA, 19 nt, Homo sapiens
gagcauagacuguaguuug

SEQ ID NO: 764844 - RNA, 19 nt, Homo sapiens
gcaauuugacuuugaguuu

SEQ ID NO: 764845 - RNA, 19 nt, Homo sapiens
ucaggcaaaugacuuuaua

SEQ ID NO: 764846 - RNA, 19 nt, Homo sapiens
uaccuuagcagacacauua

SEQ ID NO: 764847 - RNA, 19 nt, Homo sapiens
gcuggaacaugaauuugaa

SEQ ID NO: 764848 - RNA, 19 nt, Homo sapiens
guuaaagccuaauccuaaa

SEQ ID NO: 764849 - RNA, 19 nt, Homo sapiens
uuauauggcuauccuggua

SEQ ID NO: 764850 - RNA, 19 nt, Homo sapiens
uaacuccugugguguaaau

SEQ ID NO: 764851 - RNA, 19 nt, Homo sapiens
cuaguaugcuggauucuau

SEQ ID NO: 764852 - RNA, 19 nt, Homo sapiens
ugagcaacaguguauauua

SEQ ID NO: 764853 - RNA, 19 nt, Homo sapiens
caauuugacuuugaguuug

SEQ ID NO: 764854 - RNA, 19 nt, Homo sapiens
uaagagugguauuauaugg

SEQ ID NO: 764855 - RNA, 19 nt, Homo sapiens
ccaccauuauuguuaaaga

SEQ ID NO: 764856 - RNA, 19 nt, Homo sapiens
gguaacuccugugguguaa

SEQ ID NO: 764857 - RNA, 19 nt, Homo sapiens
uguuaaagccuaauccuaa

SEQ ID NO: 764858 - RNA, 19 nt, Homo sapiens
guauccaccauuauuguua

SEQ ID NO: 764859 - RNA, 19 nt, Homo sapiens
uagcagacacauuaguaua

SEQ ID NO: 764860 - RNA, 19 nt, Homo sapiens
gugaagagcauagacugua

SEQ ID NO: 764861 - RNA, 19 nt, Homo sapiens
uaugcuggauucuaugauu

SEQ ID NO: 764862 - RNA, 19 nt, Homo sapiens
acauuuauccuucucguaa

SEQ ID NO: 764863 - RNA, 19 nt, Homo sapiens
gcagacacauuaguauacu

SEQ ID NO: 764864 - RNA, 19 nt, Homo sapiens
gauguauccaccauuauug

SEQ ID NO: 764865 - RNA, 19 nt, Homo sapiens
ccuauaaucccagcacuuu

SEQ ID NO: 764866 - RNA, 19 nt, Homo sapiens
ggaccugugugaagagcau

SEQ ID NO: 764867 - RNA, 19 nt, Homo sapiens
cugguauucuuucauauug

SEQ ID NO: 764868 - RNA, 19 nt, Homo sapiens
cauugcagguuucaggauu

SEQ ID NO: 764869 - RNA, 19 nt, Homo sapiens
guucugagcaacaguguau

SEQ ID NO: 764870 - RNA, 19 nt, Homo sapiens
ugaagagcauagacuguag

SEQ ID NO: 764871 - RNA, 19 nt, Homo sapiens
ucacauaguccaucagucu

SEQ ID NO: 764872 - RNA, 19 nt, Homo sapiens
ucacaacccuaaaguucca

SEQ ID NO: 764873 - RNA, 19 nt, Homo sapiens
cgagguggguggaucaucu

SEQ ID NO: 764874 - RNA, 19 nt, Homo sapiens
agagugaccucaggcaaau

SEQ ID NO: 764875 - RNA, 19 nt, Homo sapiens
guucucggauucugugugu

SEQ ID NO: 764876 - RNA, 19 nt, Homo sapiens
gcugauguucaauuaguaa

SEQ ID NO: 764877 - RNA, 19 nt, Homo sapiens
acacauuaguauacucuuc

SEQ ID NO: 764878 - RNA, 19 nt, Homo sapiens
ucuaugauuggcagauuua

SEQ ID NO: 764879 - RNA, 19 nt, Homo sapiens
cagagugaccucaggcaaa

SEQ ID NO: 764880 - RNA, 19 nt, Homo sapiens
gguauuauauggcuauccu

SEQ ID NO: 764881 - RNA, 19 nt, Homo sapiens
aaucauugcuucagguucu

SEQ ID NO: 764882 - RNA, 19 nt, Homo sapiens
ugacuuugaguuuguggua

SEQ ID NO: 764883 - RNA, 19 nt, Homo sapiens
guaauucacaacccuaaag

SEQ ID NO: 764884 - RNA, 19 nt, Homo sapiens
uaauuuugcuggaacauga

SEQ ID NO: 764885 - RNA, 19 nt, Homo sapiens
gacuguaguuugguggaaa

SEQ ID NO: 764886 - RNA, 19 nt, Homo sapiens
gacuuugaguuugugguaa

SEQ ID NO: 764887 - RNA, 19 nt, Homo sapiens
ggaacaugaauuugaaucu

SEQ ID NO: 764888 - RNA, 19 nt, Homo sapiens
guggaaagagcaaagacuu

SEQ ID NO: 764889 - RNA, 19 nt, Homo sapiens
auccugguauucuuucaua

SEQ ID NO: 764890 - RNA, 19 nt, Homo sapiens
cuuagcagacacauuagua

SEQ ID NO: 764891 - RNA, 19 nt, Homo sapiens
agauuuaccuuagcagaca

SEQ ID NO: 764892 - RNA, 19 nt, Homo sapiens
uaaaucauugcuucagguu

SEQ ID NO: 764893 - RNA, 19 nt, Homo sapiens
ccugugguguaaaucauug

SEQ ID NO: 764894 - RNA, 19 nt, Homo sapiens
gauuggcagauuuaacauu

SEQ ID NO: 764895 - RNA, 19 nt, Homo sapiens
gaagagcauagacuguagu

SEQ ID NO: 764896 - RNA, 19 nt, Homo sapiens
guuguacuguuuguauguu

SEQ ID NO: 764897 - RNA, 19 nt, Homo sapiens
uugcugauguucaauuagu

SEQ ID NO: 764898 - RNA, 19 nt, Homo sapiens
gaaucuuacaugcaacaau

SEQ ID NO: 764899 - RNA, 19 nt, Homo sapiens
ccugguauucuuucauauu

SEQ ID NO: 764900 - RNA, 19 nt, Homo sapiens
uggcuauccugguauucuu

SEQ ID NO: 764901 - RNA, 19 nt, Homo sapiens
uguuaaguuugauggacua

SEQ ID NO: 764902 - RNA, 19 nt, Homo sapiens
cauuuauccuucucguaau

SEQ ID NO: 764903 - RNA, 19 nt, Homo sapiens
gaccucaggcaaaugacuu

SEQ ID NO: 764904 - RNA, 19 nt, Homo sapiens
cuugggaccugugugaaga

SEQ ID NO: 764905 - RNA, 19 nt, Homo sapiens
ggccuugggaccuguguga

SEQ ID NO: 764906 - RNA, 19 nt, Homo sapiens
uauaaucccagcacuuugg

SEQ ID NO: 764907 - RNA, 19 nt, Homo sapiens
caacccuaaaguuccauuu

SEQ ID NO: 764908 - RNA, 19 nt, Homo sapiens
cuuugaaguucucggauuc

SEQ ID NO: 764909 - RNA, 19 nt, Homo sapiens
agacuguaguuugguggaa

SEQ ID NO: 764910 - RNA, 19 nt, Homo sapiens
ccuaguaugcuggauucua

SEQ ID NO: 764911 - RNA, 19 nt, Homo sapiens
gcccagcccacauuagcuu

SEQ ID NO: 764912 - RNA, 19 nt, Homo sapiens
uagcuccucuauauaacca

SEQ ID NO: 764913 - RNA, 19 nt, Homo sapiens
gcagauuuaacauuuaucc

SEQ ID NO: 764914 - RNA, 19 nt, Homo sapiens
gauagcuaguauguuaagu

SEQ ID NO: 764915 - RNA, 19 nt, Homo sapiens
auucacaacccuaaaguuc

SEQ ID NO: 764916 - RNA, 19 nt, Homo sapiens
acaaggagcugcaccguuu

SEQ ID NO: 764917 - RNA, 19 nt, Homo sapiens
cggacgagcugccucauua

SEQ ID NO: 764918 - RNA, 19 nt, Homo sapiens
ggaaggacauggugcacaa

SEQ ID NO: 764919 - RNA, 19 nt, Homo sapiens
caucggcgcucauguacuu

SEQ ID NO: 764920 - RNA, 19 nt, Homo sapiens
gcagugaccugagcaccuu

SEQ ID NO: 764921 - RNA, 19 nt, Homo sapiens
cgagcugccucauuaguau

SEQ ID NO: 764922 - RNA, 19 nt, Homo sapiens
gcgcucauguacuucauug

SEQ ID NO: 764923 - RNA, 19 nt, Homo sapiens
gaagauuugauuuccuuga

SEQ ID NO: 764924 - RNA, 19 nt, Homo sapiens
ggccuacaguggcuacaaa

SEQ ID NO: 764925 - RNA, 19 nt, Homo sapiens
cagccuacguggccaagaa

SEQ ID NO: 764926 - RNA, 19 nt, Homo sapiens
gacguggccuucaguguca

SEQ ID NO: 764927 - RNA, 19 nt, Homo sapiens
gagcagacguggccuucag

SEQ ID NO: 764928 - RNA, 19 nt, Homo sapiens
acaaauacgugggaaugau

SEQ ID NO: 764929 - RNA, 19 nt, Homo sapiens
ggauggcacugggcauuca

SEQ ID NO: 764930 - RNA, 19 nt, Homo sapiens
ccucaucggcgcucaugua

SEQ ID NO: 764931 - RNA, 19 nt, Homo sapiens
gcacugggcauucagaaaa

SEQ ID NO: 764932 - RNA, 19 nt, Homo sapiens
caauguggcuauggccuau

SEQ ID NO: 764933 - RNA, 19 nt, Homo sapiens
gcucauguacuucauugug

SEQ ID NO: 764934 - RNA, 19 nt, Homo sapiens
cggcagcgauggcuacuac

SEQ ID NO: 764935 - RNA, 19 nt, Homo sapiens
gacacaagcggugguuauu

SEQ ID NO: 764936 - RNA, 19 nt, Homo sapiens
gcaguacagucgugaugcu

SEQ ID NO: 764937 - RNA, 19 nt, Homo sapiens
ugacacaagcggugguuau

SEQ ID NO: 764938 - RNA, 19 nt, Homo sapiens
caaauacgugggaaugauc

SEQ ID NO: 764939 - RNA, 19 nt, Homo sapiens
cuacaaauacgugggaaug

SEQ ID NO: 764940 - RNA, 19 nt, Homo sapiens
ucauauacuggcugacuuu

SEQ ID NO: 764941 - RNA, 19 nt, Homo sapiens
caacgccccugaccucuau

SEQ ID NO: 764942 - RNA, 19 nt, Homo sapiens
uauacuggcugacuuucca

SEQ ID NO: 764943 - RNA, 19 nt, Homo sapiens
cuacaguggcuacaaauac

SEQ ID NO: 764944 - RNA, 19 nt, Homo sapiens
gggacccaauggccaaugu

SEQ ID NO: 764945 - RNA, 19 nt, Homo sapiens
gugcugggccugugugcaa

SEQ ID NO: 764946 - RNA, 19 nt, Homo sapiens
ccuacaguggcuacaaaua

SEQ ID NO: 764947 - RNA, 19 nt, Homo sapiens
gagcugccucauuaguauu

SEQ ID NO: 764948 - RNA, 19 nt, Homo sapiens
ugggaaugauccucagugu

SEQ ID NO: 764949 - RNA, 19 nt, Homo sapiens
ggacgagcugccucauuag

SEQ ID NO: 764950 - RNA, 19 nt, Homo sapiens
cacaagcggugguuauucc

SEQ ID NO: 764951 - RNA, 19 nt, Homo sapiens
cuacguggccaagaagcua

SEQ ID NO: 764952 - RNA, 19 nt, Homo sapiens
acgagcugccucauuagua

SEQ ID NO: 764953 - RNA, 19 nt, Homo sapiens
gcggacgagcugccucauu

SEQ ID NO: 764954 - RNA, 19 nt, Homo sapiens
ugaauuaccucgugggauu

SEQ ID NO: 764955 - RNA, 19 nt, Homo sapiens
gaagacaguugugugcaaa

SEQ ID NO: 764956 - RNA, 19 nt, Homo sapiens
guacgugccugacaguguu

SEQ ID NO: 764957 - RNA, 19 nt, Homo sapiens
gaaauggauuaaagcuugu

SEQ ID NO: 764958 - RNA, 19 nt, Homo sapiens
gcacuuggccuuucucagu

SEQ ID NO: 764959 - RNA, 19 nt, Homo sapiens
uuacaaguguggcgagaaa

SEQ ID NO: 764960 - RNA, 19 nt, Homo sapiens
gcugguaggucauucaaag

SEQ ID NO: 764961 - RNA, 19 nt, Homo sapiens
gccuauaucugugauuuga

SEQ ID NO: 764962 - RNA, 19 nt, Homo sapiens
gugaguuccugcaugagua

SEQ ID NO: 764963 - RNA, 19 nt, Homo sapiens
gcaaagcaaaguaacaauc

SEQ ID NO: 764964 - RNA, 19 nt, Homo sapiens
agacacagccuccagcaaa

SEQ ID NO: 764965 - RNA, 19 nt, Homo sapiens
caucaggcgucuacacugu

SEQ ID NO: 764966 - RNA, 19 nt, Homo sapiens
cuaaagcugugccuauauc

SEQ ID NO: 764967 - RNA, 19 nt, Homo sapiens
ggucaccuguuacaagugu

SEQ ID NO: 764968 - RNA, 19 nt, Homo sapiens
gugccuauaucugugauuu

SEQ ID NO: 764969 - RNA, 19 nt, Homo sapiens
gccaacagaugcaccaaag

SEQ ID NO: 764970 - RNA, 19 nt, Homo sapiens
gugaaacugucuccugcaa

SEQ ID NO: 764971 - RNA, 19 nt, Homo sapiens
gaacucuucucccaaucag

SEQ ID NO: 764972 - RNA, 19 nt, Homo sapiens
agagucaucugugugaauu

SEQ ID NO: 764973 - RNA, 19 nt, Homo sapiens
gggcuuggcuagguaguuc

SEQ ID NO: 764974 - RNA, 19 nt, Homo sapiens
ggagugugcauuuaacugu

SEQ ID NO: 764975 - RNA, 19 nt, Homo sapiens
uaacaauccgccauuacaa

SEQ ID NO: 764976 - RNA, 19 nt, Homo sapiens
ccaagaugcccgagugcua

SEQ ID NO: 764977 - RNA, 19 nt, Homo sapiens
ggccacgucuguuaguuuc

SEQ ID NO: 764978 - RNA, 19 nt, Homo sapiens
gagugugcauuuaacuguu

SEQ ID NO: 764979 - RNA, 19 nt, Homo sapiens
gcgcugcugucugugaauu

SEQ ID NO: 764980 - RNA, 19 nt, Homo sapiens
ucagacaccuguggcaugu

SEQ ID NO: 764981 - RNA, 19 nt, Homo sapiens
uccuaaagcugugccuaua

SEQ ID NO: 764982 - RNA, 19 nt, Homo sapiens
agaagacaguugugugcaa

SEQ ID NO: 764983 - RNA, 19 nt, Homo sapiens
gggccuggcuguguucaau

SEQ ID NO: 764984 - RNA, 19 nt, Homo sapiens
aaguaacaauccgccauua

SEQ ID NO: 764985 - RNA, 19 nt, Homo sapiens
caugcacccucgauuugaa

SEQ ID NO: 764986 - RNA, 19 nt, Homo sapiens
ggagagucaucugugugaa

SEQ ID NO: 764987 - RNA, 19 nt, Homo sapiens
cagcaaagcaaaguaacaa

SEQ ID NO: 764988 - RNA, 19 nt, Homo sapiens
gaguaugacaugaccaaga

SEQ ID NO: 764989 - RNA, 19 nt, Homo sapiens
aguaugacaugaccaagau

SEQ ID NO: 764990 - RNA, 19 nt, Homo sapiens
gggcgcugcugucugugaa

SEQ ID NO: 764991 - RNA, 19 nt, Homo sapiens
uguuuaagguguccguuga

SEQ ID NO: 764992 - RNA, 19 nt, Homo sapiens
gcagacacguggguuucau

SEQ ID NO: 764993 - RNA, 19 nt, Homo sapiens
gacacagccuccagcaaag

SEQ ID NO: 764994 - RNA, 19 nt, Homo sapiens
gccuggcuguguucaauug

SEQ ID NO: 764995 - RNA, 19 nt, Homo sapiens
agugugaguuccugcauga

SEQ ID NO: 764996 - RNA, 19 nt, Homo sapiens
uaagguguccguugaacug

SEQ ID NO: 764997 - RNA, 19 nt, Homo sapiens
gggccacgucuguuaguuu

SEQ ID NO: 764998 - RNA, 19 nt, Homo sapiens
acacguggguuucaucacu

SEQ ID NO: 764999 - RNA, 19 nt, Homo sapiens
guugggagugugcauuuaa

SEQ ID NO: 765000 - RNA, 19 nt, Homo sapiens
gagagucaucugugugaau

SEQ ID NO: 765001 - RNA, 19 nt, Homo sapiens
ggagugcagcaacaaggaa

SEQ ID NO: 765002 - RNA, 19 nt, Homo sapiens
aaaguaacaauccgccauu

SEQ ID NO: 765003 - RNA, 19 nt, Homo sapiens
agugugcauuuaacuguuu

SEQ ID NO: 765004 - RNA, 19 nt, Homo sapiens
gacacuacgccaacagaug

SEQ ID NO: 765005 - RNA, 19 nt, Homo sapiens
caucaguggugagaagaca

SEQ ID NO: 765006 - RNA, 19 nt, Homo sapiens
gcacacacggagagucauc

SEQ ID NO: 765007 - RNA, 19 nt, Homo sapiens
ucaggcgucuacacuguca

SEQ ID NO: 765008 - RNA, 19 nt, Homo sapiens
ggacacuacgccaacagau

SEQ ID NO: 765009 - RNA, 19 nt, Homo sapiens
gaacugcccaugggaacca

SEQ ID NO: 765010 - RNA, 19 nt, Homo sapiens
cauuaaacaccaguucuug

SEQ ID NO: 765011 - RNA, 19 nt, Homo sapiens
ggaggggcuuggcuaggua

SEQ ID NO: 765012 - RNA, 19 nt, Homo sapiens
agacaguugugugcaaaca

SEQ ID NO: 765013 - RNA, 19 nt, Homo sapiens
cggagagucaucuguguga

SEQ ID NO: 765014 - RNA, 19 nt, Homo sapiens
ucauuaaacaccaguucuu

SEQ ID NO: 765015 - RNA, 19 nt, Homo sapiens
uguugggagugugcauuua

SEQ ID NO: 765016 - RNA, 19 nt, Homo sapiens
aacaauccgccauuacaaa

SEQ ID NO: 765017 - RNA, 19 nt, Homo sapiens
ucuguuaguuuccuaucau

SEQ ID NO: 765018 - RNA, 19 nt, Homo sapiens
caaagcaaaguaacaaucc

SEQ ID NO: 765019 - RNA, 19 nt, Homo sapiens
gguacgugccugacagugu

SEQ ID NO: 765020 - RNA, 19 nt, Homo sapiens
cugcguggccuaugcaaga

SEQ ID NO: 765021 - RNA, 19 nt, Homo sapiens
gcccucguguaaauucaug

SEQ ID NO: 765022 - RNA, 19 nt, Homo sapiens
aagcugugccuauaucugu

SEQ ID NO: 765023 - RNA, 19 nt, Homo sapiens
ccuaaagcugugccuauau

SEQ ID NO: 765024 - RNA, 19 nt, Homo sapiens
aaaggacacuacgccaaca

SEQ ID NO: 765025 - RNA, 19 nt, Homo sapiens
ugcugucugugaauucuuu

SEQ ID NO: 765026 - RNA, 19 nt, Homo sapiens
cacggagagucaucugugu

SEQ ID NO: 765027 - RNA, 19 nt, Homo sapiens
gagucaucugugugaauua

SEQ ID NO: 765028 - RNA, 19 nt, Homo sapiens
gggagugcagcaacaagga

SEQ ID NO: 765029 - RNA, 19 nt, Homo sapiens
cugcccugcugaauccuaa

SEQ ID NO: 765030 - RNA, 19 nt, Homo sapiens
ggucauuccccucauuaaa

SEQ ID NO: 765031 - RNA, 19 nt, Homo sapiens
caagaaaggggaccagugu

SEQ ID NO: 765032 - RNA, 19 nt, Homo sapiens
ccagcaaagcaaaguaaca

SEQ ID NO: 765033 - RNA, 19 nt, Homo sapiens
ggacugauuugcacucuug

SEQ ID NO: 765034 - RNA, 19 nt, Homo sapiens
gcucugugcuuucaccuua

SEQ ID NO: 765035 - RNA, 19 nt, Homo sapiens
gaacaacgcuuauuuugga

SEQ ID NO: 765036 - RNA, 19 nt, Homo sapiens
gcacgaggccuguggagua

SEQ ID NO: 765037 - RNA, 19 nt, Homo sapiens
aaagugaaauggacugauu

SEQ ID NO: 765038 - RNA, 19 nt, Homo sapiens
gcaaaucgaguccauauag

SEQ ID NO: 765039 - RNA, 19 nt, Homo sapiens
gaucuucgcuugucuuguc

SEQ ID NO: 765040 - RNA, 19 nt, Homo sapiens
gauggaacaacgcuuauuu

SEQ ID NO: 765041 - RNA, 19 nt, Homo sapiens
uagauccucugcuccaaua

SEQ ID NO: 765042 - RNA, 19 nt, Homo sapiens
cacaggauauguagagaaa

SEQ ID NO: 765043 - RNA, 19 nt, Homo sapiens
ugggagggcugcagaguaa

SEQ ID NO: 765044 - RNA, 19 nt, Homo sapiens
cagcaagcaccucaaauuu

SEQ ID NO: 765045 - RNA, 19 nt, Homo sapiens
acaugcagcucaucuaaga

SEQ ID NO: 765046 - RNA, 19 nt, Homo sapiens
ggaagcaaaucgaguccau

SEQ ID NO: 765047 - RNA, 19 nt, Homo sapiens
gaaaagguccggaagcaaa

SEQ ID NO: 765048 - RNA, 19 nt, Homo sapiens
gcucuaauuuccgggcuaa

SEQ ID NO: 765049 - RNA, 19 nt, Homo sapiens
gguggaagaguuuguggua

SEQ ID NO: 765050 - RNA, 19 nt, Homo sapiens
ucagcaagcaccucaaauu

SEQ ID NO: 765051 - RNA, 19 nt, Homo sapiens
ucacaugcagcucaucuaa

SEQ ID NO: 765052 - RNA, 19 nt, Homo sapiens
gcucagcuuugauggaaca

SEQ ID NO: 765053 - RNA, 19 nt, Homo sapiens
gaagcaaaucgaguccaua

SEQ ID NO: 765054 - RNA, 19 nt, Homo sapiens
caugcuggcugguggaaga

SEQ ID NO: 765055 - RNA, 19 nt, Homo sapiens
gcugguugcucugugcuuu

SEQ ID NO: 765056 - RNA, 19 nt, Homo sapiens
ccgcucagcuuugauggaa

SEQ ID NO: 765057 - RNA, 19 nt, Homo sapiens
ggaagaguuugugguagca

SEQ ID NO: 765058 - RNA, 19 nt, Homo sapiens
gauagauccucugcuccaa

SEQ ID NO: 765059 - RNA, 19 nt, Homo sapiens
uggaguaggucccucuguu

SEQ ID NO: 765060 - RNA, 19 nt, Homo sapiens
gauuugcacucuugguucu

SEQ ID NO: 765061 - RNA, 19 nt, Homo sapiens
ggaguaggucccucuguuc

SEQ ID NO: 765062 - RNA, 19 nt, Homo sapiens
caucuaagagaaaugaguu

SEQ ID NO: 765063 - RNA, 19 nt, Homo sapiens
gaguccauauagcuacauu

SEQ ID NO: 765064 - RNA, 19 nt, Homo sapiens
cagcucaucuaagagaaau

SEQ ID NO: 765065 - RNA, 19 nt, Homo sapiens
gcagcucaucuaagagaaa

SEQ ID NO: 765066 - RNA, 19 nt, Homo sapiens
caacggggacguccugaua

SEQ ID NO: 765067 - RNA, 19 nt, Homo sapiens
aagcaaaucgaguccauau

SEQ ID NO: 765068 - RNA, 19 nt, Homo sapiens
cgaaggggcugucgugugu

SEQ ID NO: 765069 - RNA, 19 nt, Homo sapiens
ucucagacagugaaaguga

SEQ ID NO: 765070 - RNA, 19 nt, Homo sapiens
caaaucgaguccauauagc

SEQ ID NO: 765071 - RNA, 19 nt, Homo sapiens
cagcgacaauuggacagaa

SEQ ID NO: 765072 - RNA, 19 nt, Homo sapiens
ccaccgacgcggaagacua

SEQ ID NO: 765073 - RNA, 19 nt, Homo sapiens
ccuuguauccugggucuua

SEQ ID NO: 765074 - RNA, 19 nt, Homo sapiens
ccacaggauauguagagaa

SEQ ID NO: 765075 - RNA, 19 nt, Homo sapiens
gcccugaucuucgcuuguc

SEQ ID NO: 765076 - RNA, 19 nt, Homo sapiens
gcucuccaugcucuaauuu

SEQ ID NO: 765077 - RNA, 19 nt, Homo sapiens
ucgcuugucuugucaucau

SEQ ID NO: 765078 - RNA, 19 nt, Homo sapiens
caggauauguagagaaaau

SEQ ID NO: 765079 - RNA, 19 nt, Homo sapiens
gcaggaagagaagcuguca

SEQ ID NO: 765080 - RNA, 19 nt, Homo sapiens
gaaagugaaauggacugau

SEQ ID NO: 765081 - RNA, 19 nt, Homo sapiens
gcuggcugguggaagaguu

SEQ ID NO: 765082 - RNA, 19 nt, Homo sapiens
ucugugcuuucaccuuaaa

SEQ ID NO: 765083 - RNA, 19 nt, Homo sapiens
caccgacgcggaagacuau

SEQ ID NO: 765084 - RNA, 19 nt, Homo sapiens
ucagacagugaaagugaaa

SEQ ID NO: 765085 - RNA, 19 nt, Homo sapiens
aaucgaguccauauagcua

SEQ ID NO: 765086 - RNA, 19 nt, Homo sapiens
uuugauggaacaacgcuua

SEQ ID NO: 765087 - RNA, 19 nt, Homo sapiens
ggagggcugcagaguaagu

SEQ ID NO: 765088 - RNA, 19 nt, Homo sapiens
ucccugcccugaccuggaa

SEQ ID NO: 765089 - RNA, 19 nt, Homo sapiens
agcaagcaccucaaauuug

SEQ ID NO: 765090 - RNA, 19 nt, Homo sapiens
agacagugaaagugaaaug

SEQ ID NO: 765091 - RNA, 19 nt, Homo sapiens
caucauucgucagcgacaa

SEQ ID NO: 765092 - RNA, 19 nt, Homo sapiens
cccaucuucuucuuucaga

SEQ ID NO: 765093 - RNA, 19 nt, Homo sapiens
uaucucagacagugaaagu

SEQ ID NO: 765094 - RNA, 19 nt, Homo sapiens
cacgaggccuguggaguag

SEQ ID NO: 765095 - RNA, 19 nt, Homo sapiens
gacccuagaucuucuuuga

SEQ ID NO: 765096 - RNA, 19 nt, Homo sapiens
gacuucagcuucugucuaa

SEQ ID NO: 765097 - RNA, 19 nt, Homo sapiens
cggaggaguuugucaauuu

SEQ ID NO: 765098 - RNA, 19 nt, Homo sapiens
ggacaaagagagaggauga

SEQ ID NO: 765099 - RNA, 19 nt, Homo sapiens
aaacgcugcuggagaagua

SEQ ID NO: 765100 - RNA, 19 nt, Homo sapiens
gcagcaaagugcccaacaa

SEQ ID NO: 765101 - RNA, 19 nt, Homo sapiens
caaccacacuguauuggau

SEQ ID NO: 765102 - RNA, 19 nt, Homo sapiens
gcaaagugcccaacaacug

SEQ ID NO: 765103 - RNA, 19 nt, Homo sapiens
gagaagcgcaugucagaau

SEQ ID NO: 765104 - RNA, 19 nt, Homo sapiens
cagcggagcccaucgauga

SEQ ID NO: 765105 - RNA, 19 nt, Homo sapiens
gcaaguggcacaagaugga

SEQ ID NO: 765106 - RNA, 19 nt, Homo sapiens
agaagcgcaugucagaaua

SEQ ID NO: 765107 - RNA, 19 nt, Homo sapiens
gccugaauauccugucuuu

SEQ ID NO: 765108 - RNA, 19 nt, Homo sapiens
ggcacaagauggagcagaa

SEQ ID NO: 765109 - RNA, 19 nt, Homo sapiens
ugaaaacgcugcuggagaa

SEQ ID NO: 765110 - RNA, 19 nt, Homo sapiens
gcagaaccagcgcgagaaa

SEQ ID NO: 765111 - RNA, 19 nt, Homo sapiens
ggcaggcuguggccaugua

SEQ ID NO: 765112 - RNA, 19 nt, Homo sapiens
cccuagaucuucuuugaga

SEQ ID NO: 765113 - RNA, 19 nt, Homo sapiens
caaagugcccaacaacugu

SEQ ID NO: 765114 - RNA, 19 nt, Homo sapiens
ggaggaguuugucaauuuu

SEQ ID NO: 765115 - RNA, 19 nt, Homo sapiens
ccaccagacgguucuauga

SEQ ID NO: 765116 - RNA, 19 nt, Homo sapiens
ggguggcacugauggagaa

SEQ ID NO: 765117 - RNA, 19 nt, Homo sapiens
gauuacacgcccuaccuaa

SEQ ID NO: 765118 - RNA, 19 nt, Homo sapiens
cauccuaguucucccuaug

SEQ ID NO: 765119 - RNA, 19 nt, Homo sapiens
gagcgaaugcccaggacuu

SEQ ID NO: 765120 - RNA, 19 nt, Homo sapiens
uauaagcaaccacacugua

SEQ ID NO: 765121 - RNA, 19 nt, Homo sapiens
gugugcagguucucuguga

SEQ ID NO: 765122 - RNA, 19 nt, Homo sapiens
uguauuggaugacccuaga

SEQ ID NO: 765123 - RNA, 19 nt, Homo sapiens
uaagcaaccacacuguauu

SEQ ID NO: 765124 - RNA, 19 nt, Homo sapiens
gcaaccacacuguauugga

SEQ ID NO: 765125 - RNA, 19 nt, Homo sapiens
ucacugggaacgcuuaaug

SEQ ID NO: 765126 - RNA, 19 nt, Homo sapiens
gggcuguccuccaagaaag

SEQ ID NO: 765127 - RNA, 19 nt, Homo sapiens
ggaugacccuagaucuucu

SEQ ID NO: 765128 - RNA, 19 nt, Homo sapiens
gcaucgagaacauggagaa

SEQ ID NO: 765129 - RNA, 19 nt, Homo sapiens
gcagggaccgugucuuguc

SEQ ID NO: 765130 - RNA, 19 nt, Homo sapiens
cgacuucagcuucugucua

SEQ ID NO: 765131 - RNA, 19 nt, Homo sapiens
ggaaugcugaucggacuga

SEQ ID NO: 765132 - RNA, 19 nt, Homo sapiens
gagaacauggagaacauca

SEQ ID NO: 765133 - RNA, 19 nt, Homo sapiens
uaaaguucacgcagagcua

SEQ ID NO: 765134 - RNA, 19 nt, Homo sapiens
ucgagaacauggagaacau

SEQ ID NO: 765135 - RNA, 19 nt, Homo sapiens
caacgcaugcacuuugugu

SEQ ID NO: 765136 - RNA, 19 nt, Homo sapiens
gagcguaagaaccugauca

SEQ ID NO: 765137 - RNA, 19 nt, Homo sapiens
caagauggagcagaaguuc

SEQ ID NO: 765138 - RNA, 19 nt, Homo sapiens
ucacgcagagcuacgacua

SEQ ID NO: 765139 - RNA, 19 nt, Homo sapiens
uggagaagcgcaugucaga

SEQ ID NO: 765140 - RNA, 19 nt, Homo sapiens
auaaauggacaaagagaga

SEQ ID NO: 765141 - RNA, 19 nt, Homo sapiens
uacagcaaguggcacaaga

SEQ ID NO: 765142 - RNA, 19 nt, Homo sapiens
cgaaugcccaggacuucaa

SEQ ID NO: 765143 - RNA, 19 nt, Homo sapiens
gagcagcugacaggucuga

SEQ ID NO: 765144 - RNA, 19 nt, Homo sapiens
gaaguuccgcaucgucuac

SEQ ID NO: 765145 - RNA, 19 nt, Homo sapiens
ccaccauccucaccggaau

SEQ ID NO: 765146 - RNA, 19 nt, Homo sapiens
gugcagguucucugugaaa

SEQ ID NO: 765147 - RNA, 19 nt, Homo sapiens
aagcaaccacacuguauug

SEQ ID NO: 765148 - RNA, 19 nt, Homo sapiens
ccucagccaccgcuucaaa

SEQ ID NO: 765149 - RNA, 19 nt, Homo sapiens
caauuuugcagccauuuua

SEQ ID NO: 765150 - RNA, 19 nt, Homo sapiens
cuucaacgcaugcacuuug

SEQ ID NO: 765151 - RNA, 19 nt, Homo sapiens
cgcaugcacuuuguguuga

SEQ ID NO: 765152 - RNA, 19 nt, Homo sapiens
ucggaggaguuugucaauu

SEQ ID NO: 765153 - RNA, 19 nt, Homo sapiens
cggagacacagcuucauga

SEQ ID NO: 765154 - RNA, 19 nt, Homo sapiens
cuacaccccuggucaauca

SEQ ID NO: 765155 - RNA, 19 nt, Homo sapiens
ggagaagcgcaugucagaa

SEQ ID NO: 765156 - RNA, 19 nt, Homo sapiens
gugcucacuguguauuuaa

SEQ ID NO: 765157 - RNA, 19 nt, Homo sapiens
ggagacacagcuucaugag

SEQ ID NO: 765158 - RNA, 19 nt, Homo sapiens
cagcaaguggcacaagaug

SEQ ID NO: 765159 - RNA, 19 nt, Homo sapiens
uuacacgcccuaccuaaag

SEQ ID NO: 765160 - RNA, 19 nt, Homo sapiens
gagcagcaucgagaacaug

SEQ ID NO: 765161 - RNA, 19 nt, Homo sapiens
caucggaggaguuugucaa

SEQ ID NO: 765162 - RNA, 19 nt, Homo sapiens
auaagcaaccacacuguau

SEQ ID NO: 765163 - RNA, 19 nt, Homo sapiens
gcagcugacaggucugauc

SEQ ID NO: 765164 - RNA, 19 nt, Homo sapiens
cgauuacacgcccuaccua

SEQ ID NO: 765165 - RNA, 19 nt, Homo sapiens
gccaucgacuucagcuucu

SEQ ID NO: 765166 - RNA, 19 nt, Homo sapiens
gauggagaagcgcauguca

SEQ ID NO: 765167 - RNA, 19 nt, Homo sapiens
acgcaugcacuuuguguug

SEQ ID NO: 765168 - RNA, 19 nt, Homo sapiens
acaagauggagcagaaguu

SEQ ID NO: 765169 - RNA, 19 nt, Homo sapiens
gaagcgcaugucagaauac

SEQ ID NO: 765170 - RNA, 19 nt, Homo sapiens
ugucuuguccguucucugu

SEQ ID NO: 765171 - RNA, 19 nt, Homo sapiens
gcaugcacuuuguguugac

SEQ ID NO: 765172 - RNA, 19 nt, Homo sapiens
cgagaaacgggagcuggaa

SEQ ID NO: 765173 - RNA, 19 nt, Homo sapiens
gcacgagcgaggacaacuc

SEQ ID NO: 765174 - RNA, 19 nt, Homo sapiens
gcagcacgagcgaggacaa

SEQ ID NO: 765175 - RNA, 19 nt, Homo sapiens
ugagcagcaucgagaacau

SEQ ID NO: 765176 - RNA, 19 nt, Homo sapiens
gagcagaguugcaaauuaa

SEQ ID NO: 765177 - RNA, 19 nt, Homo sapiens
gaaggaaccuggaguggaa

SEQ ID NO: 765178 - RNA, 19 nt, Homo sapiens
ggagcagaguugcaaauua

SEQ ID NO: 765179 - RNA, 19 nt, Homo sapiens
ggacaagacucuggacauu

SEQ ID NO: 765180 - RNA, 19 nt, Homo sapiens
gaaagaaacccugcggaua

SEQ ID NO: 765181 - RNA, 19 nt, Homo sapiens
gaggaaagcaugaaagaaa

SEQ ID NO: 765182 - RNA, 19 nt, Homo sapiens
acaagacucuggacauuaa

SEQ ID NO: 765183 - RNA, 19 nt, Homo sapiens
ggacaggccugcugacaag

SEQ ID NO: 765184 - RNA, 19 nt, Homo sapiens
guaaaugaggugcaaauaa

SEQ ID NO: 765185 - RNA, 19 nt, Homo sapiens
aaagaaacccugcggauaa

SEQ ID NO: 765186 - RNA, 19 nt, Homo sapiens
gaucgugucuuccauagca

SEQ ID NO: 765187 - RNA, 19 nt, Homo sapiens
ccaagacccuggccauaga

SEQ ID NO: 765188 - RNA, 19 nt, Homo sapiens
gacaagacucuggacauua

SEQ ID NO: 765189 - RNA, 19 nt, Homo sapiens
gcaaagaccaagauauuuu

SEQ ID NO: 765190 - RNA, 19 nt, Homo sapiens
gugcuggcaucgugucuuu

SEQ ID NO: 765191 - RNA, 19 nt, Homo sapiens
gcaccuggacuuaucaaga

SEQ ID NO: 765192 - RNA, 19 nt, Homo sapiens
ggaaggagcagaguugcaa

SEQ ID NO: 765193 - RNA, 19 nt, Homo sapiens
uggcaaagaccaagauauu

SEQ ID NO: 765194 - RNA, 19 nt, Homo sapiens
caaggaacauuagggugaa

SEQ ID NO: 765195 - RNA, 19 nt, Homo sapiens
gcaaauaaaaugcagauga

SEQ ID NO: 765196 - RNA, 19 nt, Homo sapiens
gagucuaccuuggcaaaga

SEQ ID NO: 765197 - RNA, 19 nt, Homo sapiens
ccgucaagguggcgucuua

SEQ ID NO: 765198 - RNA, 19 nt, Homo sapiens
gaaacccugcggauaagaa

SEQ ID NO: 765199 - RNA, 19 nt, Homo sapiens
ugucaacccuuucuuugga

SEQ ID NO: 765200 - RNA, 19 nt, Homo sapiens
gcaggaugcucuggaugga

SEQ ID NO: 765201 - RNA, 19 nt, Homo sapiens
ggcaaagaccaagauauuu

SEQ ID NO: 765202 - RNA, 19 nt, Homo sapiens
guaaaggccuccccugaga

SEQ ID NO: 765203 - RNA, 19 nt, Homo sapiens
ggccauggcugugaagcuu

SEQ ID NO: 765204 - RNA, 19 nt, Homo sapiens
gaccaagacccuggccaua

SEQ ID NO: 765205 - RNA, 19 nt, Homo sapiens
gaggaggugugggacaaga

SEQ ID NO: 765206 - RNA, 19 nt, Homo sapiens
ggacuuaucaagacuagcu

SEQ ID NO: 765207 - RNA, 19 nt, Homo sapiens
ccuagcaccuggacuuauc

SEQ ID NO: 765208 - RNA, 19 nt, Homo sapiens
cauacuugcuggucugauc

SEQ ID NO: 765209 - RNA, 19 nt, Homo sapiens
ggugaucgugucuuccaua

SEQ ID NO: 765210 - RNA, 19 nt, Homo sapiens
gcugucaacccuuucuuug

SEQ ID NO: 765211 - RNA, 19 nt, Homo sapiens
gcucugaagaugccagcua

SEQ ID NO: 765212 - RNA, 19 nt, Homo sapiens
gaaggagcagaguugcaaa

SEQ ID NO: 765213 - RNA, 19 nt, Homo sapiens
gaagcuucauggagguauc

SEQ ID NO: 765214 - RNA, 19 nt, Homo sapiens
ucauggagguaucgauauc

SEQ ID NO: 765215 - RNA, 19 nt, Homo sapiens
gcagaguugcaaauuaaca

SEQ ID NO: 765216 - RNA, 19 nt, Homo sapiens
gccggaagcagcagaaugu

SEQ ID NO: 765217 - RNA, 19 nt, Homo sapiens
cuucauggagguaucgaua

SEQ ID NO: 765218 - RNA, 19 nt, Homo sapiens
ucuccuggcuucaguccuu

SEQ ID NO: 765219 - RNA, 19 nt, Homo sapiens
cugcucaccuuacuguuca

SEQ ID NO: 765220 - RNA, 19 nt, Homo sapiens
caccuggacuuaucaagac

SEQ ID NO: 765221 - RNA, 19 nt, Homo sapiens
uggcuucaguccuuacaau

SEQ ID NO: 765222 - RNA, 19 nt, Homo sapiens
aagaggaaagcaugaaaga

SEQ ID NO: 765223 - RNA, 19 nt, Homo sapiens
gugaucgugucuuccauag

SEQ ID NO: 765224 - RNA, 19 nt, Homo sapiens
uguaaaugaggugcaaaua

SEQ ID NO: 765225 - RNA, 19 nt, Homo sapiens
gauauccuagucuccaaug

SEQ ID NO: 765226 - RNA, 19 nt, Homo sapiens
aagaaacccugcggauaag

SEQ ID NO: 765227 - RNA, 19 nt, Homo sapiens
cagaguugcaaauuaacaa

SEQ ID NO: 765228 - RNA, 19 nt, Homo sapiens
gucaacccuuucuuuggaa

SEQ ID NO: 765229 - RNA, 19 nt, Homo sapiens
guuguggccuuggguaaag

SEQ ID NO: 765230 - RNA, 19 nt, Homo sapiens
ugucuuuccugugcucuga

SEQ ID NO: 765231 - RNA, 19 nt, Homo sapiens
uaggcgagccagaggauug

SEQ ID NO: 765232 - RNA, 19 nt, Homo sapiens
cuucaguccuuacaauguc

SEQ ID NO: 765233 - RNA, 19 nt, Homo sapiens
gcuucaguccuuacaaugu

SEQ ID NO: 765234 - RNA, 19 nt, Homo sapiens
gggacaagacucuggacau

SEQ ID NO: 765235 - RNA, 19 nt, Homo sapiens
aauaagguggcccugguaa

SEQ ID NO: 765236 - RNA, 19 nt, Homo sapiens
cuguucaccucaucaaauc

SEQ ID NO: 765237 - RNA, 19 nt, Homo sapiens
aggaaagcaugaaagaaac

SEQ ID NO: 765238 - RNA, 19 nt, Homo sapiens
caguggugaucgugucuuc

SEQ ID NO: 765239 - RNA, 19 nt, Homo sapiens
augcugcugucaacccuuu

SEQ ID NO: 765240 - RNA, 19 nt, Homo sapiens
gcaguggugccagaaaugg

SEQ ID NO: 765241 - RNA, 19 nt, Homo sapiens
cugaggaggugugggacaa

SEQ ID NO: 765242 - RNA, 19 nt, Homo sapiens
ugccagaaauggagaaacg

SEQ ID NO: 765243 - RNA, 19 nt, Homo sapiens
gaucguagcuaguuuguau

SEQ ID NO: 765244 - RNA, 19 nt, Homo sapiens
aaagagagaugcagaacua

SEQ ID NO: 765245 - RNA, 19 nt, Homo sapiens
ggaagaggaucaaggagaa

SEQ ID NO: 765246 - RNA, 19 nt, Homo sapiens
gcacaaguuugaaauguca

SEQ ID NO: 765247 - RNA, 19 nt, Homo sapiens
ugucagaaauggauaauga

SEQ ID NO: 765248 - RNA, 19 nt, Homo sapiens
gaugauggcuucagcauac

SEQ ID NO: 765249 - RNA, 19 nt, Homo sapiens
gcagcgagaugucuuggaa

SEQ ID NO: 765250 - RNA, 19 nt, Homo sapiens
gaaggcuacuugucagaaa

SEQ ID NO: 765251 - RNA, 19 nt, Homo sapiens
gaaaccaugggcuauguua

SEQ ID NO: 765252 - RNA, 19 nt, Homo sapiens
gaacagauccagcaauucu

SEQ ID NO: 765253 - RNA, 19 nt, Homo sapiens
ggaggaagauggugucagu

SEQ ID NO: 765254 - RNA, 19 nt, Homo sapiens
ggacuuagaugaggaacug

SEQ ID NO: 765255 - RNA, 19 nt, Homo sapiens
aauaguagcuggaguuguu

SEQ ID NO: 765256 - RNA, 19 nt, Homo sapiens
uuacaaaugugaagacaga

SEQ ID NO: 765257 - RNA, 19 nt, Homo sapiens
gaagaaucagggacuauuu

SEQ ID NO: 765258 - RNA, 19 nt, Homo sapiens
gaaagcauguugucuccau

SEQ ID NO: 765259 - RNA, 19 nt, Homo sapiens
gguggaaacuguugaagau

SEQ ID NO: 765260 - RNA, 19 nt, Homo sapiens
uggaugagcuuugcaauga

SEQ ID NO: 765261 - RNA, 19 nt, Homo sapiens
ccagugagccuccaguuaa

SEQ ID NO: 765262 - RNA, 19 nt, Homo sapiens
gagaagugguggaaacugu

SEQ ID NO: 765263 - RNA, 19 nt, Homo sapiens
ggaagauggugucagugaa

SEQ ID NO: 765264 - RNA, 19 nt, Homo sapiens
ggaagcagcacugucauuu

SEQ ID NO: 765265 - RNA, 19 nt, Homo sapiens
ggaaacuguugaagauguu

SEQ ID NO: 765266 - RNA, 19 nt, Homo sapiens
gcaaacaggaugcuucaga

SEQ ID NO: 765267 - RNA, 19 nt, Homo sapiens
gcagaggccuauggauuug

SEQ ID NO: 765268 - RNA, 19 nt, Homo sapiens
gauaaugaaccuccuguga

SEQ ID NO: 765269 - RNA, 19 nt, Homo sapiens
ugaagcagauguugccauu

SEQ ID NO: 765270 - RNA, 19 nt, Homo sapiens
aagcagauaugaagaugaa

SEQ ID NO: 765271 - RNA, 19 nt, Homo sapiens
gugaagagcuggauuuuga

SEQ ID NO: 765272 - RNA, 19 nt, Homo sapiens
cagcauagaugggaaggaa

SEQ ID NO: 765273 - RNA, 19 nt, Homo sapiens
ggacagcagugaaauaucc

SEQ ID NO: 765274 - RNA, 19 nt, Homo sapiens
gaaaguguagcuccaguga

SEQ ID NO: 765275 - RNA, 19 nt, Homo sapiens
gagagaugcagaacuaauu

SEQ ID NO: 765276 - RNA, 19 nt, Homo sapiens
guagcacaauugccuguuu

SEQ ID NO: 765277 - RNA, 19 nt, Homo sapiens
gaauuucagcgugacauua

SEQ ID NO: 765278 - RNA, 19 nt, Homo sapiens
gcagugaaauauccaugau

SEQ ID NO: 765279 - RNA, 19 nt, Homo sapiens
gaagaacuaaagaaaguga

SEQ ID NO: 765280 - RNA, 19 nt, Homo sapiens
guuaauguccuaaugugua

SEQ ID NO: 765281 - RNA, 19 nt, Homo sapiens
ccacaccucuugcuuccuu

SEQ ID NO: 765282 - RNA, 19 nt, Homo sapiens
aaagaugcuuggacagaaa

SEQ ID NO: 765283 - RNA, 19 nt, Homo sapiens
cgagaugucuuggaacaga

SEQ ID NO: 765284 - RNA, 19 nt, Homo sapiens
aagagagacuggacuuuga

SEQ ID NO: 765285 - RNA, 19 nt, Homo sapiens
agacaucauugccaucauu

SEQ ID NO: 765286 - RNA, 19 nt, Homo sapiens
gaaggaagaauuagaucug

SEQ ID NO: 765287 - RNA, 19 nt, Homo sapiens
aagugaagccucagaguua

SEQ ID NO: 765288 - RNA, 19 nt, Homo sapiens
ucagaaugcuguaauguac

SEQ ID NO: 765289 - RNA, 19 nt, Homo sapiens
agacuccacuuacaaaugu

SEQ ID NO: 765290 - RNA, 19 nt, Homo sapiens
gaagaggaggcugaaguaa

SEQ ID NO: 765291 - RNA, 19 nt, Homo sapiens
ccagugaaaugugugugua

SEQ ID NO: 765292 - RNA, 19 nt, Homo sapiens
gagagauucuacccgcaaa

SEQ ID NO: 765293 - RNA, 19 nt, Homo sapiens
uagaggagccuaaggaaga

SEQ ID NO: 765294 - RNA, 19 nt, Homo sapiens
aauuagaucuggcugagaa

SEQ ID NO: 765295 - RNA, 19 nt, Homo sapiens
ggaggugauuauccacuug

SEQ ID NO: 765296 - RNA, 19 nt, Homo sapiens
agaggaggcugaaguaaag

SEQ ID NO: 765297 - RNA, 19 nt, Homo sapiens
caagagagacuggacuuug

SEQ ID NO: 765298 - RNA, 19 nt, Homo sapiens
gaaauguguguguauacaa

SEQ ID NO: 765299 - RNA, 19 nt, Homo sapiens
cagcacaaguuugaaaugu

SEQ ID NO: 765300 - RNA, 19 nt, Homo sapiens
cgaaauaguagcuggaguu

SEQ ID NO: 765301 - RNA, 19 nt, Homo sapiens
gaaccagagccagucauuu

SEQ ID NO: 765302 - RNA, 19 nt, Homo sapiens
caugagaaguggcgaucaa

SEQ ID NO: 765303 - RNA, 19 nt, Homo sapiens
gaucaaaggcucccagcau

SEQ ID NO: 765304 - RNA, 19 nt, Homo sapiens
gacaugagcuggaaaaucu

SEQ ID NO: 765305 - RNA, 19 nt, Homo sapiens
ccgaagcacagcugaauuu

SEQ ID NO: 765306 - RNA, 19 nt, Homo sapiens
gaaauaguagcuggaguug

SEQ ID NO: 765307 - RNA, 19 nt, Homo sapiens
gugcagaggccuauggauu

SEQ ID NO: 765308 - RNA, 19 nt, Homo sapiens
aaagaagaaucagggacua

SEQ ID NO: 765309 - RNA, 19 nt, Homo sapiens
gaugagcuuugcaaugaca

SEQ ID NO: 765310 - RNA, 19 nt, Homo sapiens
gaugagacuccacuuacaa

SEQ ID NO: 765311 - RNA, 19 nt, Homo sapiens
agauauagacggcuaaaga

SEQ ID NO: 765312 - RNA, 19 nt, Homo sapiens
cgagagaagcuauguuuag

SEQ ID NO: 765313 - RNA, 19 nt, Homo sapiens
ccuauggauuugucaacua

SEQ ID NO: 765314 - RNA, 19 nt, Homo sapiens
uaaggaagaggaucaagga

SEQ ID NO: 765315 - RNA, 19 nt, Homo sapiens
agacucagcacaaguuuga

SEQ ID NO: 765316 - RNA, 19 nt, Homo sapiens
gaugaggaacugggaagua

SEQ ID NO: 765317 - RNA, 19 nt, Homo sapiens
gguggaaccugcagaacca

SEQ ID NO: 765318 - RNA, 19 nt, Homo sapiens
caaaauuggguaucaguua

SEQ ID NO: 765319 - RNA, 19 nt, Homo sapiens
gcauagaugggaaggaaga

SEQ ID NO: 765320 - RNA, 19 nt, Homo sapiens
cagugagccuccaguuaaa

SEQ ID NO: 765321 - RNA, 19 nt, Homo sapiens
gcuaguuuguauugucuug

SEQ ID NO: 765322 - RNA, 19 nt, Homo sapiens
guagcuaguuuguauuguc

SEQ ID NO: 765323 - RNA, 19 nt, Homo sapiens
agacuggacuuugaggaaa

SEQ ID NO: 765324 - RNA, 19 nt, Homo sapiens
ugaaauggcuguggcuucu

SEQ ID NO: 765325 - RNA, 19 nt, Homo sapiens
uccaggcucugcacccuua

SEQ ID NO: 765326 - RNA, 19 nt, Homo sapiens
ugaaauguguguguauaca

SEQ ID NO: 765327 - RNA, 19 nt, Homo sapiens
gcagaucguagcuaguuug

SEQ ID NO: 765328 - RNA, 19 nt, Homo sapiens
cagaaaccaugggcuaugu

SEQ ID NO: 765329 - RNA, 19 nt, Homo sapiens
uuagagaguuggaguagca

SEQ ID NO: 765330 - RNA, 19 nt, Homo sapiens
cauugaagauccuuuagag

SEQ ID NO: 765331 - RNA, 19 nt, Homo sapiens
aucaaaggcucccagcaua

SEQ ID NO: 765332 - RNA, 19 nt, Homo sapiens
agugaaauauccaugauca

SEQ ID NO: 765333 - RNA, 19 nt, Homo sapiens
gaguuggaguagcacaauu

SEQ ID NO: 765334 - RNA, 19 nt, Homo sapiens
gaagauggugucagugaag

SEQ ID NO: 765335 - RNA, 19 nt, Homo sapiens
gagacuggacuuugaggaa

SEQ ID NO: 765336 - RNA, 19 nt, Homo sapiens
gcaagagagacuggacuuu

SEQ ID NO: 765337 - RNA, 19 nt, Homo sapiens
gccagugagccuccaguua

SEQ ID NO: 765338 - RNA, 19 nt, Homo sapiens
gagguuacccacugugaug

SEQ ID NO: 765339 - RNA, 19 nt, Homo sapiens
gaggaaggcuacagaugcu

SEQ ID NO: 765340 - RNA, 19 nt, Homo sapiens
uaaagaggaaggcuacaga

SEQ ID NO: 765341 - RNA, 19 nt, Homo sapiens
agaagaggaggcugaagua

SEQ ID NO: 765342 - RNA, 19 nt, Homo sapiens
gaaacuguugaagauguua

SEQ ID NO: 765343 - RNA, 19 nt, Homo sapiens
ggaaagugcuuguggcuua

SEQ ID NO: 765344 - RNA, 19 nt, Homo sapiens
gaaaggacaccaagaauau

SEQ ID NO: 765345 - RNA, 19 nt, Homo sapiens
ggaaaggacaccaagaaua

SEQ ID NO: 765346 - RNA, 19 nt, Homo sapiens
gaaguuuggucuugauuug

SEQ ID NO: 765347 - RNA, 19 nt, Homo sapiens
ggccagagcuacaacagua

SEQ ID NO: 765348 - RNA, 19 nt, Homo sapiens
ggacugggauuuacguuau

SEQ ID NO: 765349 - RNA, 19 nt, Homo sapiens
ggucaacauuggacgauua

SEQ ID NO: 765350 - RNA, 19 nt, Homo sapiens
gggcagaguuucaacauug

SEQ ID NO: 765351 - RNA, 19 nt, Homo sapiens
gaucagagaugcuguucau

SEQ ID NO: 765352 - RNA, 19 nt, Homo sapiens
gagggaggguucugucuaa

SEQ ID NO: 765353 - RNA, 19 nt, Homo sapiens
ccagaacacuguccagauu

SEQ ID NO: 765354 - RNA, 19 nt, Homo sapiens
ccaacaagauggccuagaa

SEQ ID NO: 765355 - RNA, 19 nt, Homo sapiens
cuacaucuuuccuagaaua

SEQ ID NO: 765356 - RNA, 19 nt, Homo sapiens
gauguacucucugaaguuu

SEQ ID NO: 765357 - RNA, 19 nt, Homo sapiens
gauguuaaaucaugagauc

SEQ ID NO: 765358 - RNA, 19 nt, Homo sapiens
gcaaucaagcccaacagua

SEQ ID NO: 765359 - RNA, 19 nt, Homo sapiens
ggauuuacguuauagcaau

SEQ ID NO: 765360 - RNA, 19 nt, Homo sapiens
ggaaacagaauuaaagaca

SEQ ID NO: 765361 - RNA, 19 nt, Homo sapiens
gugggaggauuguguguaa

SEQ ID NO: 765362 - RNA, 19 nt, Homo sapiens
ggauggagccagagaaaug

SEQ ID NO: 765363 - RNA, 19 nt, Homo sapiens
ggaggguucugucuaaucu

SEQ ID NO: 765364 - RNA, 19 nt, Homo sapiens
gaaaggggaaacagaauua

SEQ ID NO: 765365 - RNA, 19 nt, Homo sapiens
gaccugcuaucuccucuga

SEQ ID NO: 765366 - RNA, 19 nt, Homo sapiens
uuauagcaaugcacagaua

SEQ ID NO: 765367 - RNA, 19 nt, Homo sapiens
ccacauaccauucucaauc

SEQ ID NO: 765368 - RNA, 19 nt, Homo sapiens
caaucaagcccaacaguau

SEQ ID NO: 765369 - RNA, 19 nt, Homo sapiens
gaggaucacuccaagaaaa

SEQ ID NO: 765370 - RNA, 19 nt, Homo sapiens
aaccagauguuaaaucaug

SEQ ID NO: 765371 - RNA, 19 nt, Homo sapiens
gcacgucaaaugcuccuuu

SEQ ID NO: 765372 - RNA, 19 nt, Homo sapiens
acucuugucuugcuuaguu

SEQ ID NO: 765373 - RNA, 19 nt, Homo sapiens
ggacuugacucugcugaac

SEQ ID NO: 765374 - RNA, 19 nt, Homo sapiens
ccugcuaucuccucugaaa

SEQ ID NO: 765375 - RNA, 19 nt, Homo sapiens
gguguuaacugcuccaacu

SEQ ID NO: 765376 - RNA, 19 nt, Homo sapiens
ugaaauugcuggcauucuc

SEQ ID NO: 765377 - RNA, 19 nt, Homo sapiens
gcacagauacuacaauucc

SEQ ID NO: 765378 - RNA, 19 nt, Homo sapiens
cugaggagauucugauuca

SEQ ID NO: 765379 - RNA, 19 nt, Homo sapiens
gaacagugaauacgauuuu

SEQ ID NO: 765380 - RNA, 19 nt, Homo sapiens
gaaggaggagccagagaug

SEQ ID NO: 765381 - RNA, 19 nt, Homo sapiens
caacaagauggccuagaaa

SEQ ID NO: 765382 - RNA, 19 nt, Homo sapiens
cuaagaaggucugaguuuc

SEQ ID NO: 765383 - RNA, 19 nt, Homo sapiens
gaaaagagauccacauacc

SEQ ID NO: 765384 - RNA, 19 nt, Homo sapiens
gaaagugcuuguggcuuag

SEQ ID NO: 765385 - RNA, 19 nt, Homo sapiens
gacugggauuuacguuaua

SEQ ID NO: 765386 - RNA, 19 nt, Homo sapiens
gaggagauucugauucaug

SEQ ID NO: 765387 - RNA, 19 nt, Homo sapiens
gaaauugcuggcauucuca

SEQ ID NO: 765388 - RNA, 19 nt, Homo sapiens
caccagaaguagcagagaa

SEQ ID NO: 765389 - RNA, 19 nt, Homo sapiens
guuaaacuccuauacacaa

SEQ ID NO: 765390 - RNA, 19 nt, Homo sapiens
caacgagagguucgacgua

SEQ ID NO: 765391 - RNA, 19 nt, Homo sapiens
ccugaucuguaccaacuuu

SEQ ID NO: 765392 - RNA, 19 nt, Homo sapiens
ucgccuugcugcugcuuua

SEQ ID NO: 765393 - RNA, 19 nt, Homo sapiens
cuugucauuugaaggauua

SEQ ID NO: 765394 - RNA, 19 nt, Homo sapiens
uaucccaucuucaggaguu

SEQ ID NO: 765395 - RNA, 19 nt, Homo sapiens
gugcuuguggcuuagauua

SEQ ID NO: 765396 - RNA, 19 nt, Homo sapiens
ggaaaggcaaggagcugaa

SEQ ID NO: 765397 - RNA, 19 nt, Homo sapiens
gcaaugcacagauacuaca

SEQ ID NO: 765398 - RNA, 19 nt, Homo sapiens
gauuuacguuauagcaaug

SEQ ID NO: 765399 - RNA, 19 nt, Homo sapiens
gggacugggauuuacguua

SEQ ID NO: 765400 - RNA, 19 nt, Homo sapiens
gaauaagaggugagaaucu

SEQ ID NO: 765401 - RNA, 19 nt, Homo sapiens
ugauuugucucuagaugug

SEQ ID NO: 765402 - RNA, 19 nt, Homo sapiens
gaccauggccauuguccaa

SEQ ID NO: 765403 - RNA, 19 nt, Homo sapiens
guucaucagucccaacaag

SEQ ID NO: 765404 - RNA, 19 nt, Homo sapiens
caugauuugucucuagaug

SEQ ID NO: 765405 - RNA, 19 nt, Homo sapiens
caagauggccuagaaaucg

SEQ ID NO: 765406 - RNA, 19 nt, Homo sapiens
uaaaucaugagaucagaga

SEQ ID NO: 765407 - RNA, 19 nt, Homo sapiens
ccucucaucucccacaauc

SEQ ID NO: 765408 - RNA, 19 nt, Homo sapiens
gaauuaaagacaccagaag

SEQ ID NO: 765409 - RNA, 19 nt, Homo sapiens
ucugggaagugaaguucua

SEQ ID NO: 765410 - RNA, 19 nt, Homo sapiens
cccuacaucuuuccuagaa

SEQ ID NO: 765411 - RNA, 19 nt, Homo sapiens
guuaacugcuccaacucuu

SEQ ID NO: 765412 - RNA, 19 nt, Homo sapiens
ucucugaaguuuggucuug

SEQ ID NO: 765413 - RNA, 19 nt, Homo sapiens
acccuuaccuuccugagaa

SEQ ID NO: 765414 - RNA, 19 nt, Homo sapiens
aggguucugucuaaucuuu

SEQ ID NO: 765415 - RNA, 19 nt, Homo sapiens
augcacagauacuacaauu

SEQ ID NO: 765416 - RNA, 19 nt, Homo sapiens
gaacccugaucuguaccaa

SEQ ID NO: 765417 - RNA, 19 nt, Homo sapiens
uccagaaauugaucgguuu

SEQ ID NO: 765418 - RNA, 19 nt, Homo sapiens
caacucuugucuugcuuag

SEQ ID NO: 765419 - RNA, 19 nt, Homo sapiens
acuaagaaggucugaguuu

SEQ ID NO: 765420 - RNA, 19 nt, Homo sapiens
uaugagaagugaggucugu

SEQ ID NO: 765421 - RNA, 19 nt, Homo sapiens
agacugagcggaagaagca

SEQ ID NO: 765422 - RNA, 19 nt, Homo sapiens
guuaaaucaugagaucaga

SEQ ID NO: 765423 - RNA, 19 nt, Homo sapiens
uagaauaagaggugagaau

SEQ ID NO: 765424 - RNA, 19 nt, Homo sapiens
caacauuggacgauuagag

SEQ ID NO: 765425 - RNA, 19 nt, Homo sapiens
gcucauuaaagcauaguau

SEQ ID NO: 765426 - RNA, 19 nt, Homo sapiens
ccuugcugcugcuuuaauu

SEQ ID NO: 765427 - RNA, 19 nt, Homo sapiens
ucacuaagaaggucugagu

SEQ ID NO: 765428 - RNA, 19 nt, Homo sapiens
ucucaugauuugucucuag

SEQ ID NO: 765429 - RNA, 19 nt, Homo sapiens
uuucuccucuuccuugauu

SEQ ID NO: 765430 - RNA, 19 nt, Homo sapiens
uaacugcuccaacucuugu

SEQ ID NO: 765431 - RNA, 19 nt, Homo sapiens
aaagagauccacauaccau

SEQ ID NO: 765432 - RNA, 19 nt, Homo sapiens
ugaaguuuggucuugauuu

SEQ ID NO: 765433 - RNA, 19 nt, Homo sapiens
ucaggacacucccuugaac

SEQ ID NO: 765434 - RNA, 19 nt, Homo sapiens
ccaacucuugucuugcuua

SEQ ID NO: 765435 - RNA, 19 nt, Homo sapiens
gcacuugcagccucagcuu

SEQ ID NO: 765436 - RNA, 19 nt, Homo sapiens
auuaaagacaccagaagua

SEQ ID NO: 765437 - RNA, 19 nt, Homo sapiens
gcagauagugguguuaacu

SEQ ID NO: 765438 - RNA, 19 nt, Homo sapiens
gagcuacaacaguauucuu

SEQ ID NO: 765439 - RNA, 19 nt, Homo sapiens
ugucugggacugggauuua

SEQ ID NO: 765440 - RNA, 19 nt, Homo sapiens
aaacuccuauacacaaguc

SEQ ID NO: 765441 - RNA, 19 nt, Homo sapiens
gcuuuaauuccaaguucua

SEQ ID NO: 765442 - RNA, 19 nt, Homo sapiens
ucuggaacccugaucugua

SEQ ID NO: 765443 - RNA, 19 nt, Homo sapiens
gcacuuaucucgaauuuga

SEQ ID NO: 765444 - RNA, 19 nt, Homo sapiens
cggcagagaucauguauug

SEQ ID NO: 765445 - RNA, 19 nt, Homo sapiens
cuugauagauguuuggaua

SEQ ID NO: 765446 - RNA, 19 nt, Homo sapiens
ugaaacgucuggacugcua

SEQ ID NO: 765447 - RNA, 19 nt, Homo sapiens
ccuguuagcuuuccaagga

SEQ ID NO: 765448 - RNA, 19 nt, Homo sapiens
gaacggaagccuugcacaa

SEQ ID NO: 765449 - RNA, 19 nt, Homo sapiens
cagcaugccuguccuuuca

SEQ ID NO: 765450 - RNA, 19 nt, Homo sapiens
gaaaggaagcaacagauag

SEQ ID NO: 765451 - RNA, 19 nt, Homo sapiens
uaucgaacguggucugauu

SEQ ID NO: 765452 - RNA, 19 nt, Homo sapiens
cggaagccuugcacaauuu

SEQ ID NO: 765453 - RNA, 19 nt, Homo sapiens
ggccugcccuguuagcuuu

SEQ ID NO: 765454 - RNA, 19 nt, Homo sapiens
acagauagauguugcucuu

SEQ ID NO: 765455 - RNA, 19 nt, Homo sapiens
ggaagcaacagauagaugu

SEQ ID NO: 765456 - RNA, 19 nt, Homo sapiens
agaaacaugucuugacugu

SEQ ID NO: 765457 - RNA, 19 nt, Homo sapiens
guguguguguguacaaaua

SEQ ID NO: 765458 - RNA, 19 nt, Homo sapiens
gauagauguugcucuuuca

SEQ ID NO: 765459 - RNA, 19 nt, Homo sapiens
cgucuggacugcuauucua

SEQ ID NO: 765460 - RNA, 19 nt, Homo sapiens
gacugucacuugcugcuuu

SEQ ID NO: 765461 - RNA, 19 nt, Homo sapiens
gggaguaccuguccaagac

SEQ ID NO: 765462 - RNA, 19 nt, Homo sapiens
guccacaaaucuucaguau

SEQ ID NO: 765463 - RNA, 19 nt, Homo sapiens
ucauaaagcauuggaguuu

SEQ ID NO: 765464 - RNA, 19 nt, Homo sapiens
gaauacccaggaagacuuu

SEQ ID NO: 765465 - RNA, 19 nt, Homo sapiens
ucagcaggcuagacagaaa

SEQ ID NO: 765466 - RNA, 19 nt, Homo sapiens
ggucugauuuugagguuua

SEQ ID NO: 765467 - RNA, 19 nt, Homo sapiens
agaaaggaagcaacagaua

SEQ ID NO: 765468 - RNA, 19 nt, Homo sapiens
uaagaaaggaagcaacaga

SEQ ID NO: 765469 - RNA, 19 nt, Homo sapiens
ugaagaauacccaggaaga

SEQ ID NO: 765470 - RNA, 19 nt, Homo sapiens
uggcagcccuguuccuuau

SEQ ID NO: 765471 - RNA, 19 nt, Homo sapiens
agauagauguugcucuuuc

SEQ ID NO: 765472 - RNA, 19 nt, Homo sapiens
gaccggugcuuuuauugua

SEQ ID NO: 765473 - RNA, 19 nt, Homo sapiens
gagugaggguugaagaaag

SEQ ID NO: 765474 - RNA, 19 nt, Homo sapiens
acggaagccuugcacaauu

SEQ ID NO: 765475 - RNA, 19 nt, Homo sapiens
uuucugcgcuucaguaaca

SEQ ID NO: 765476 - RNA, 19 nt, Homo sapiens
gagagugaggguugaagaa

SEQ ID NO: 765477 - RNA, 19 nt, Homo sapiens
gcucugcagcauugaagua

SEQ ID NO: 765478 - RNA, 19 nt, Homo sapiens
ugucugggcucaagcuuuc

SEQ ID NO: 765479 - RNA, 19 nt, Homo sapiens
aaaggaagcaacagauaga

SEQ ID NO: 765480 - RNA, 19 nt, Homo sapiens
gcgcuucaguaacaagugu

SEQ ID NO: 765481 - RNA, 19 nt, Homo sapiens
gaacguggucugauuuuga

SEQ ID NO: 765482 - RNA, 19 nt, Homo sapiens
acagaaacaugucuugacu

SEQ ID NO: 765483 - RNA, 19 nt, Homo sapiens
aguaugguguguucacgua

SEQ ID NO: 765484 - RNA, 19 nt, Homo sapiens
gcauugaaguauggugugu

SEQ ID NO: 765485 - RNA, 19 nt, Homo sapiens
ggagagugaggguugaaga

SEQ ID NO: 765486 - RNA, 19 nt, Homo sapiens
cauaaagcauuggaguuuc

SEQ ID NO: 765487 - RNA, 19 nt, Homo sapiens
ugucuugacuguuaguugu

SEQ ID NO: 765488 - RNA, 19 nt, Homo sapiens
auaaagcauuggaguuuca

SEQ ID NO: 765489 - RNA, 19 nt, Homo sapiens
ggacugugaggccauacuu

SEQ ID NO: 765490 - RNA, 19 nt, Homo sapiens
gcauuggaguuucaaaucc

SEQ ID NO: 765491 - RNA, 19 nt, Homo sapiens
cauaggucauaaagcauug

SEQ ID NO: 765492 - RNA, 19 nt, Homo sapiens
uaugaagaauacccaggaa

SEQ ID NO: 765493 - RNA, 19 nt, Homo sapiens
gcuucuaccugcucagcuu

SEQ ID NO: 765494 - RNA, 19 nt, Homo sapiens
gcagcccuguuccuuaucu

SEQ ID NO: 765495 - RNA, 19 nt, Homo sapiens
aggaagacuuugugacugu

SEQ ID NO: 765496 - RNA, 19 nt, Homo sapiens
uugcacuuaucucgaauuu

SEQ ID NO: 765497 - RNA, 19 nt, Homo sapiens
ccucucgccucauuacugu

SEQ ID NO: 765498 - RNA, 19 nt, Homo sapiens
cuuacaaugugaauaaugg

SEQ ID NO: 765499 - RNA, 19 nt, Homo sapiens
cgaggugguucagacaaga

SEQ ID NO: 765500 - RNA, 19 nt, Homo sapiens
ggaagccuugcacaauuug

SEQ ID NO: 765501 - RNA, 19 nt, Homo sapiens
gggaggcauugacauaggu

SEQ ID NO: 765502 - RNA, 19 nt, Homo sapiens
ggcaguccaucuagggaau

SEQ ID NO: 765503 - RNA, 19 nt, Homo sapiens
gagaugggccaggcagaga

SEQ ID NO: 765504 - RNA, 19 nt, Homo sapiens
gcaugccuguccuuucagu

SEQ ID NO: 765505 - RNA, 19 nt, Homo sapiens
ccaggaagacuuugugacu

SEQ ID NO: 765506 - RNA, 19 nt, Homo sapiens
cuucugguuucccuuuauu

SEQ ID NO: 765507 - RNA, 19 nt, Homo sapiens
gaagaauacccaggaagac

SEQ ID NO: 765508 - RNA, 19 nt, Homo sapiens
cuucguuccugcgcauaua

SEQ ID NO: 765509 - RNA, 19 nt, Homo sapiens
guucagccacuccauguuc

SEQ ID NO: 765510 - RNA, 19 nt, Homo sapiens
ccucgcgggugucacauuc

SEQ ID NO: 765511 - RNA, 19 nt, Homo sapiens
gaggggaggcauugacaua

SEQ ID NO: 765512 - RNA, 19 nt, Homo sapiens
gugaggccauacuugugaa

SEQ ID NO: 765513 - RNA, 19 nt, Homo sapiens
uccaagacagggcucauuu

SEQ ID NO: 765514 - RNA, 19 nt, Homo sapiens
cucagucccucuucugguu

SEQ ID NO: 765515 - RNA, 19 nt, Homo sapiens
acauaggucauaaagcauu

SEQ ID NO: 765516 - RNA, 19 nt, Homo sapiens
gaucagcaugccuguccuu

SEQ ID NO: 765517 - RNA, 19 nt, Homo sapiens
agagugaggguugaagaaa

SEQ ID NO: 765518 - RNA, 19 nt, Homo sapiens
cugcagcauugaaguaugg

SEQ ID NO: 765519 - RNA, 19 nt, Homo sapiens
ugugaggccauacuuguga

SEQ ID NO: 765520 - RNA, 19 nt, Homo sapiens
agaauacccaggaagacuu

SEQ ID NO: 765521 - RNA, 19 nt, Homo sapiens
ggccauacuugugaaacgu

SEQ ID NO: 765522 - RNA, 19 nt, Homo sapiens
cugagugagugggagagua

SEQ ID NO: 765523 - RNA, 19 nt, Homo sapiens
guucagcaggcuagacaga

SEQ ID NO: 765524 - RNA, 19 nt, Homo sapiens
ccuaacggccugcccuguu

SEQ ID NO: 765525 - RNA, 19 nt, Homo sapiens
uggguggucuugugguugu

SEQ ID NO: 765526 - RNA, 19 nt, Homo sapiens
cguggguggucuugugguu

SEQ ID NO: 765527 - RNA, 19 nt, Homo sapiens
agucguggguggucuugug

SEQ ID NO: 765528 - RNA, 19 nt, Homo sapiens
guguguguguguguacaaa

SEQ ID NO: 765529 - RNA, 19 nt, Homo sapiens
auugaaguaugguguguuc

SEQ ID NO: 765530 - RNA, 19 nt, Homo sapiens
cuucuacccuuuuccuuuu

SEQ ID NO: 765531 - RNA, 19 nt, Homo sapiens
gaggagauauucaagauua

SEQ ID NO: 765532 - RNA, 19 nt, Homo sapiens
caagaaagauguaugauga

SEQ ID NO: 765533 - RNA, 19 nt, Homo sapiens
gaaagcaagucaagaauau

SEQ ID NO: 765534 - RNA, 19 nt, Homo sapiens
gaagaacgucugagaaaua

SEQ ID NO: 765535 - RNA, 19 nt, Homo sapiens
guaauaauccgaugaagua

SEQ ID NO: 765536 - RNA, 19 nt, Homo sapiens
gaagacaguucaauguauu

SEQ ID NO: 765537 - RNA, 19 nt, Homo sapiens
gaagucaacauucgauuua

SEQ ID NO: 765538 - RNA, 19 nt, Homo sapiens
caaauggucuuuauccaaa

SEQ ID NO: 765539 - RNA, 19 nt, Homo sapiens
gaacccaccuugcagcuuu

SEQ ID NO: 765540 - RNA, 19 nt, Homo sapiens
gagcagaaauucagacaga

SEQ ID NO: 765541 - RNA, 19 nt, Homo sapiens
ugaaugacgugcccucuua

SEQ ID NO: 765542 - RNA, 19 nt, Homo sapiens
ggaccugacuuacuacaaa

SEQ ID NO: 765543 - RNA, 19 nt, Homo sapiens
gaaagcaguuccagaagga

SEQ ID NO: 765544 - RNA, 19 nt, Homo sapiens
ugacagaacugcauuaaag

SEQ ID NO: 765545 - RNA, 19 nt, Homo sapiens
gacauaagaugagaacuuu

SEQ ID NO: 765546 - RNA, 19 nt, Homo sapiens
gaagaggaggcuuguaaua

SEQ ID NO: 765547 - RNA, 19 nt, Homo sapiens
gagaggagauauucaagau

SEQ ID NO: 765548 - RNA, 19 nt, Homo sapiens
gggcaaagauggauugaag

SEQ ID NO: 765549 - RNA, 19 nt, Homo sapiens
uaacacaccuacugggauu

SEQ ID NO: 765550 - RNA, 19 nt, Homo sapiens
gaugaaagcaguuccagaa

SEQ ID NO: 765551 - RNA, 19 nt, Homo sapiens
gaaacuccuuccugccuuu

SEQ ID NO: 765552 - RNA, 19 nt, Homo sapiens
gaaaaguauugccgaguua

SEQ ID NO: 765553 - RNA, 19 nt, Homo sapiens
ccgcuaagguuaagagauu

SEQ ID NO: 765554 - RNA, 19 nt, Homo sapiens
gaacucagaccuauugcaa

SEQ ID NO: 765555 - RNA, 19 nt, Homo sapiens
ggaagaacgucugagaaau

SEQ ID NO: 765556 - RNA, 19 nt, Homo sapiens
ggaugugcuuugaucguua

SEQ ID NO: 765557 - RNA, 19 nt, Homo sapiens
ucacagggcuaccuugaga

SEQ ID NO: 765558 - RNA, 19 nt, Homo sapiens
ucacugaggugcaggaaug

SEQ ID NO: 765559 - RNA, 19 nt, Homo sapiens
gaagugauaccuguuacua

SEQ ID NO: 765560 - RNA, 19 nt, Homo sapiens
gcaauuggcugagaaacuc

SEQ ID NO: 765561 - RNA, 19 nt, Homo sapiens
aaagauggauugaagacaa

SEQ ID NO: 765562 - RNA, 19 nt, Homo sapiens
gcacguacuugucaugagu

SEQ ID NO: 765563 - RNA, 19 nt, Homo sapiens
gauaaugacauaagagaga

SEQ ID NO: 765564 - RNA, 19 nt, Homo sapiens
gggcaauggugaauuugaa

SEQ ID NO: 765565 - RNA, 19 nt, Homo sapiens
gaauagaagcgucgaagga

SEQ ID NO: 765566 - RNA, 19 nt, Homo sapiens
gaagacaaccuugauuuca

SEQ ID NO: 765567 - RNA, 19 nt, Homo sapiens
cauaguagaugcuuuggau

SEQ ID NO: 765568 - RNA, 19 nt, Homo sapiens
uuaaugagguggucacaug

SEQ ID NO: 765569 - RNA, 19 nt, Homo sapiens
aaagcuagguccugaauca

SEQ ID NO: 765570 - RNA, 19 nt, Homo sapiens
cccagaagauaaugacaua

SEQ ID NO: 765571 - RNA, 19 nt, Homo sapiens
gugcuuugaucguuaauga

SEQ ID NO: 765572 - RNA, 19 nt, Homo sapiens
guauauuccucuacuccua

SEQ ID NO: 765573 - RNA, 19 nt, Homo sapiens
gcaagaaagauguaugaug

SEQ ID NO: 765574 - RNA, 19 nt, Homo sapiens
gaauuugguacacuacaua

SEQ ID NO: 765575 - RNA, 19 nt, Homo sapiens
gauguaugaugaugcuauu

SEQ ID NO: 765576 - RNA, 19 nt, Homo sapiens
gauuaaagcagugcaauug

SEQ ID NO: 765577 - RNA, 19 nt, Homo sapiens
cgaaggagaucaagugaac

SEQ ID NO: 765578 - RNA, 19 nt, Homo sapiens
gaugugcuuugaucguuaa

SEQ ID NO: 765579 - RNA, 19 nt, Homo sapiens
aagaacgucugagaaauaa

SEQ ID NO: 765580 - RNA, 19 nt, Homo sapiens
ugaaagcaagucaagaaua

SEQ ID NO: 765581 - RNA, 19 nt, Homo sapiens
aagcagcacuggccauuga

SEQ ID NO: 765582 - RNA, 19 nt, Homo sapiens
ggguuuagaagauguguua

SEQ ID NO: 765583 - RNA, 19 nt, Homo sapiens
agaggaggcuuguaauaau

SEQ ID NO: 765584 - RNA, 19 nt, Homo sapiens
acaccacacuuucagguaa

SEQ ID NO: 765585 - RNA, 19 nt, Homo sapiens
cagaaguaauugaaaccua

SEQ ID NO: 765586 - RNA, 19 nt, Homo sapiens
caugguugaugucagauaa

SEQ ID NO: 765587 - RNA, 19 nt, Homo sapiens
uaagacuguucaacuugua

SEQ ID NO: 765588 - RNA, 19 nt, Homo sapiens
ggaccauucucaccugugu

SEQ ID NO: 765589 - RNA, 19 nt, Homo sapiens
ccaagagcguaaacgauga

SEQ ID NO: 765590 - RNA, 19 nt, Homo sapiens
gaggaggcuuguaauaauc

SEQ ID NO: 765591 - RNA, 19 nt, Homo sapiens
cagauaaagcuggucauua

SEQ ID NO: 765592 - RNA, 19 nt, Homo sapiens
gggaauguuugcacuagga

SEQ ID NO: 765593 - RNA, 19 nt, Homo sapiens
gagaaggccuuggaagaag

SEQ ID NO: 765594 - RNA, 19 nt, Homo sapiens
ggauaucgcaggaccuaaa

SEQ ID NO: 765595 - RNA, 19 nt, Homo sapiens
ggacagagaccuggaugug

SEQ ID NO: 765596 - RNA, 19 nt, Homo sapiens
caugaugaauuccuagaug

SEQ ID NO: 765597 - RNA, 19 nt, Homo sapiens
uaagguaguccaagaaaug

SEQ ID NO: 765598 - RNA, 19 nt, Homo sapiens
ugagaagugauaccuguua

SEQ ID NO: 765599 - RNA, 19 nt, Homo sapiens
gaccuaaacuugugaucgu

SEQ ID NO: 765600 - RNA, 19 nt, Homo sapiens
gaggcuagacuuccugaaa

SEQ ID NO: 765601 - RNA, 19 nt, Homo sapiens
caaaacauguucugauaug

SEQ ID NO: 765602 - RNA, 19 nt, Homo sapiens
gaagaaugggcacuuggaa

SEQ ID NO: 765603 - RNA, 19 nt, Homo sapiens
gaagaggaagaacgucuga

SEQ ID NO: 765604 - RNA, 19 nt, Homo sapiens
gaaguacagauguugaaga

SEQ ID NO: 765605 - RNA, 19 nt, Homo sapiens
gaaauugcacguacuuguc

SEQ ID NO: 765606 - RNA, 19 nt, Homo sapiens
gcagauaaagcuggucauu

SEQ ID NO: 765607 - RNA, 19 nt, Homo sapiens
ggaaacuacuucagaaaau

SEQ ID NO: 765608 - RNA, 19 nt, Homo sapiens
ggauaacuauaggacauau

SEQ ID NO: 765609 - RNA, 19 nt, Homo sapiens
uaaaguauucucuccaaga

SEQ ID NO: 765610 - RNA, 19 nt, Homo sapiens
gaaacaugcuugggauaac

SEQ ID NO: 765611 - RNA, 19 nt, Homo sapiens
guggagacccagaagauaa

SEQ ID NO: 765612 - RNA, 19 nt, Homo sapiens
gcagaaauugcacguacuu

SEQ ID NO: 765613 - RNA, 19 nt, Homo sapiens
gcagugcaauuggcugaga

SEQ ID NO: 765614 - RNA, 19 nt, Homo sapiens
ggagaggagauauucaaga

SEQ ID NO: 765615 - RNA, 19 nt, Homo sapiens
ccuaacauauuuggaaguu

SEQ ID NO: 765616 - RNA, 19 nt, Homo sapiens
gcagaaauucagacagaga

SEQ ID NO: 765617 - RNA, 19 nt, Homo sapiens
acauguagaugccgguaaa

SEQ ID NO: 765618 - RNA, 19 nt, Homo sapiens
ugacauaagaugagaacuu

SEQ ID NO: 765619 - RNA, 19 nt, Homo sapiens
gugaugaccuuuuaccuuu

SEQ ID NO: 765620 - RNA, 19 nt, Homo sapiens
uauccuccguccagaagua

SEQ ID NO: 765621 - RNA, 19 nt, Homo sapiens
agaaagauguaugaugaug

SEQ ID NO: 765622 - RNA, 19 nt, Homo sapiens
gaccacuggguguuuaaua

SEQ ID NO: 765623 - RNA, 19 nt, Homo sapiens
uuagaccacuggguguuua

SEQ ID NO: 765624 - RNA, 19 nt, Homo sapiens
ggaagaaugggcacuugga

SEQ ID NO: 765625 - RNA, 19 nt, Homo sapiens
aagaggaggcuuguaauaa

SEQ ID NO: 765626 - RNA, 19 nt, Homo sapiens
aagcaugguugaugucaga

SEQ ID NO: 765627 - RNA, 19 nt, Homo sapiens
ccaaauggucuuuauccaa

SEQ ID NO: 765628 - RNA, 19 nt, Homo sapiens
gagaucaagugaaccuucu

SEQ ID NO: 765629 - RNA, 19 nt, Homo sapiens
auaaugaacucagaccuau

SEQ ID NO: 765630 - RNA, 19 nt, Homo sapiens
cauaaugaacucagaccua

SEQ ID NO: 765631 - RNA, 19 nt, Homo sapiens
gaggaacgcuucagccuua

SEQ ID NO: 765632 - RNA, 19 nt, Homo sapiens
gaaggaacaugaagauuau

SEQ ID NO: 765633 - RNA, 19 nt, Homo sapiens
ugaaagaucugaagacuca

SEQ ID NO: 765634 - RNA, 19 nt, Homo sapiens
aaagauggcugaauuucua

SEQ ID NO: 765635 - RNA, 19 nt, Homo sapiens
gcaauguccuugugaaaga

SEQ ID NO: 765636 - RNA, 19 nt, Homo sapiens
gagaagaggcuguuaaaga

SEQ ID NO: 765637 - RNA, 19 nt, Homo sapiens
agaagaggcuguuaaagaa

SEQ ID NO: 765638 - RNA, 19 nt, Homo sapiens
ugaaggaacaugaagauua

SEQ ID NO: 765639 - RNA, 19 nt, Homo sapiens
cagaggaacugcugauuga

SEQ ID NO: 765640 - RNA, 19 nt, Homo sapiens
cauguugccuugugaauuu

SEQ ID NO: 765641 - RNA, 19 nt, Homo sapiens
gcacugugauuuagaacuu

SEQ ID NO: 765642 - RNA, 19 nt, Homo sapiens
ggaacuauguggcaacugu

SEQ ID NO: 765643 - RNA, 19 nt, Homo sapiens
gcaaauguaacaagaaguu

SEQ ID NO: 765644 - RNA, 19 nt, Homo sapiens
caauagaacuaccaaccaa

SEQ ID NO: 765645 - RNA, 19 nt, Homo sapiens
gaaaugagguugccauacc

SEQ ID NO: 765646 - RNA, 19 nt, Homo sapiens
gagauccacugucaaagga

SEQ ID NO: 765647 - RNA, 19 nt, Homo sapiens
ccaggaaacucgacugugu

SEQ ID NO: 765648 - RNA, 19 nt, Homo sapiens
caaagaggguggugaagag

SEQ ID NO: 765649 - RNA, 19 nt, Homo sapiens
gaacaagagaggcaggaaa

SEQ ID NO: 765650 - RNA, 19 nt, Homo sapiens
ugaagagagugcaaacuug

SEQ ID NO: 765651 - RNA, 19 nt, Homo sapiens
gaacauuacagcccagguu

SEQ ID NO: 765652 - RNA, 19 nt, Homo sapiens
gugauucucugcccuguug

SEQ ID NO: 765653 - RNA, 19 nt, Homo sapiens
caaaaucucuacccagaaa

SEQ ID NO: 765654 - RNA, 19 nt, Homo sapiens
gaacuaccaaccaaaggaa

SEQ ID NO: 765655 - RNA, 19 nt, Homo sapiens
gcaacaggcugcaaguaac

SEQ ID NO: 765656 - RNA, 19 nt, Homo sapiens
gagaucauguugccuugug

SEQ ID NO: 765657 - RNA, 19 nt, Homo sapiens
aaacuuggacuucauguug

SEQ ID NO: 765658 - RNA, 19 nt, Homo sapiens
ccugagagccuuugaauca

SEQ ID NO: 765659 - RNA, 19 nt, Homo sapiens
ggcaaagccuuccaagcaa

SEQ ID NO: 765660 - RNA, 19 nt, Homo sapiens
caacuccucagacaaauug

SEQ ID NO: 765661 - RNA, 19 nt, Homo sapiens
gagaaaugagguugccaua

SEQ ID NO: 765662 - RNA, 19 nt, Homo sapiens
gaacaugaagauuauugug

SEQ ID NO: 765663 - RNA, 19 nt, Homo sapiens
ccaguuagacucuuugaug

SEQ ID NO: 765664 - RNA, 19 nt, Homo sapiens
guauguguccuaccuguaa

SEQ ID NO: 765665 - RNA, 19 nt, Homo sapiens
gaaacucgacugugugaca

SEQ ID NO: 765666 - RNA, 19 nt, Homo sapiens
gagcaucauuaucccaugu

SEQ ID NO: 765667 - RNA, 19 nt, Homo sapiens
gcuaaagauggcugaauuu

SEQ ID NO: 765668 - RNA, 19 nt, Homo sapiens
ucacauggcugcagaacac

SEQ ID NO: 765669 - RNA, 19 nt, Homo sapiens
uguccucacugcuuucuaa

SEQ ID NO: 765670 - RNA, 19 nt, Homo sapiens
gagugaagguggcaggaau

SEQ ID NO: 765671 - RNA, 19 nt, Homo sapiens
caaccaaccaugugacaga

SEQ ID NO: 765672 - RNA, 19 nt, Homo sapiens
ccagcacugugauuuagaa

SEQ ID NO: 765673 - RNA, 19 nt, Homo sapiens
guaacaagaaguuggagaa

SEQ ID NO: 765674 - RNA, 19 nt, Homo sapiens
caugagauccacugucaaa

SEQ ID NO: 765675 - RNA, 19 nt, Homo sapiens
gugauucgcccuccucaaa

SEQ ID NO: 765676 - RNA, 19 nt, Homo sapiens
cggcagcagugaaauacaa

SEQ ID NO: 765677 - RNA, 19 nt, Homo sapiens
uggcugaauuucuagauga

SEQ ID NO: 765678 - RNA, 19 nt, Homo sapiens
acaagaaguuggagaagag

SEQ ID NO: 765679 - RNA, 19 nt, Homo sapiens
ggaaggaggggaagauuuu

SEQ ID NO: 765680 - RNA, 19 nt, Homo sapiens
cagcuagugugucaacuca

SEQ ID NO: 765681 - RNA, 19 nt, Homo sapiens
gccgacccauuaacaauau

SEQ ID NO: 765682 - RNA, 19 nt, Homo sapiens
aaucugacauggagacuca

SEQ ID NO: 765683 - RNA, 19 nt, Homo sapiens
uuacaucgguuccugucuu

SEQ ID NO: 765684 - RNA, 19 nt, Homo sapiens
ccucccagccgacccauua

SEQ ID NO: 765685 - RNA, 19 nt, Homo sapiens
gaggagagcaucauuaucc

SEQ ID NO: 765686 - RNA, 19 nt, Homo sapiens
gugaagagagugcaaacuu

SEQ ID NO: 765687 - RNA, 19 nt, Homo sapiens
ugagagccuuugaaucaga

SEQ ID NO: 765688 - RNA, 19 nt, Homo sapiens
gcucuggacccacccauga

SEQ ID NO: 765689 - RNA, 19 nt, Homo sapiens
gaagacucacccugaaguu

SEQ ID NO: 765690 - RNA, 19 nt, Homo sapiens
caacuguggucgcaauguc

SEQ ID NO: 765691 - RNA, 19 nt, Homo sapiens
uaacgaggcuuuugaugug

SEQ ID NO: 765692 - RNA, 19 nt, Homo sapiens
gcccagguuucaauucaga

SEQ ID NO: 765693 - RNA, 19 nt, Homo sapiens
cagcccagguuucaauuca

SEQ ID NO: 765694 - RNA, 19 nt, Homo sapiens
gcaucauuaucccauguga

SEQ ID NO: 765695 - RNA, 19 nt, Homo sapiens
ccauaccuccuaaugcaua

SEQ ID NO: 765696 - RNA, 19 nt, Homo sapiens
ccucacugcuuucuaaugg

SEQ ID NO: 765697 - RNA, 19 nt, Homo sapiens
ugccuuaccuucacucaau

SEQ ID NO: 765698 - RNA, 19 nt, Homo sapiens
gacaagcuguaacccuuca

SEQ ID NO: 765699 - RNA, 19 nt, Homo sapiens
ccagaggaacugcugauug

SEQ ID NO: 765700 - RNA, 19 nt, Homo sapiens
gagaggcaggaaaggaaua

SEQ ID NO: 765701 - RNA, 19 nt, Homo sapiens
guaugaggcgcucugguaa

SEQ ID NO: 765702 - RNA, 19 nt, Homo sapiens
cagcccagcucuccuugug

SEQ ID NO: 765703 - RNA, 19 nt, Homo sapiens
caauaugacagcuaccuau

SEQ ID NO: 765704 - RNA, 19 nt, Homo sapiens
ccaaagaggguggugaaga

SEQ ID NO: 765705 - RNA, 19 nt, Homo sapiens
uguaugaggcgcucuggua

SEQ ID NO: 765706 - RNA, 19 nt, Homo sapiens
gggugcagcugacgagauc

SEQ ID NO: 765707 - RNA, 19 nt, Homo sapiens
uccaugagauccacuguca

SEQ ID NO: 765708 - RNA, 19 nt, Homo sapiens
gaaauuccuguguuuaacu

SEQ ID NO: 765709 - RNA, 19 nt, Homo sapiens
gaacuuuccauucucaaac

SEQ ID NO: 765710 - RNA, 19 nt, Homo sapiens
gcucaggccaguugcaaug

SEQ ID NO: 765711 - RNA, 19 nt, Homo sapiens
guggaggagagcaucauua

SEQ ID NO: 765712 - RNA, 19 nt, Homo sapiens
caagagaggcaggaaagga

SEQ ID NO: 765713 - RNA, 19 nt, Homo sapiens
ugucaaaggaacauuggua

SEQ ID NO: 765714 - RNA, 19 nt, Homo sapiens
ucagggagauacggagcua

SEQ ID NO: 765715 - RNA, 19 nt, Homo sapiens
gaaucgagacagccagaau

SEQ ID NO: 765716 - RNA, 19 nt, Homo sapiens
uaugacagcuaccuauaac

SEQ ID NO: 765717 - RNA, 19 nt, Homo sapiens
uugcaucacugccuucugu

SEQ ID NO: 765718 - RNA, 19 nt, Homo sapiens
agcuaaagauggcugaauu

SEQ ID NO: 765719 - RNA, 19 nt, Homo sapiens
gccuuaccuucacucaaua

SEQ ID NO: 765720 - RNA, 19 nt, Homo sapiens
gugcaaacuuggacuucau

SEQ ID NO: 765721 - RNA, 19 nt, Homo sapiens
ucagauguuuuccacaaua

SEQ ID NO: 765722 - RNA, 19 nt, Homo sapiens
caucccaacuccucagaca

SEQ ID NO: 765723 - RNA, 19 nt, Homo sapiens
ucugaagacucacccugaa

SEQ ID NO: 765724 - RNA, 19 nt, Homo sapiens
gaagaggcuguuaaagaag

SEQ ID NO: 765725 - RNA, 19 nt, Homo sapiens
aauaugacagcuaccuaua

SEQ ID NO: 765726 - RNA, 19 nt, Homo sapiens
aaacucgacugugugacaa

SEQ ID NO: 765727 - RNA, 19 nt, Homo sapiens
gaccaucagacaagcugua

SEQ ID NO: 765728 - RNA, 19 nt, Homo sapiens
gagagccuuugaaucagau

SEQ ID NO: 765729 - RNA, 19 nt, Homo sapiens
ugccauaccuccuaaugca

SEQ ID NO: 765730 - RNA, 19 nt, Homo sapiens
agacucacccugaaguuug

SEQ ID NO: 765731 - RNA, 19 nt, Homo sapiens
ggccuaaucuuaacuaauu

SEQ ID NO: 765732 - RNA, 19 nt, Homo sapiens
ggucuuaacucaccgaaau

SEQ ID NO: 765733 - RNA, 19 nt, Homo sapiens
gguuaggacuucaauauau

SEQ ID NO: 765734 - RNA, 19 nt, Homo sapiens
gaacaagcacaucaugauu

SEQ ID NO: 765735 - RNA, 19 nt, Homo sapiens
gagcaggccuacuuguuug

SEQ ID NO: 765736 - RNA, 19 nt, Homo sapiens
gacagaauccaaagguuua

SEQ ID NO: 765737 - RNA, 19 nt, Homo sapiens
cagcauggccuaaucuuaa

SEQ ID NO: 765738 - RNA, 19 nt, Homo sapiens
gcaacaacaacaagauuaa

SEQ ID NO: 765739 - RNA, 19 nt, Homo sapiens
ggagcaggccuacuuguuu

SEQ ID NO: 765740 - RNA, 19 nt, Homo sapiens
gaagguguuuauccuguga

SEQ ID NO: 765741 - RNA, 19 nt, Homo sapiens
gauccuacgugcaugaaga

SEQ ID NO: 765742 - RNA, 19 nt, Homo sapiens
gagauggaauugauaacau

SEQ ID NO: 765743 - RNA, 19 nt, Homo sapiens
gagaggagcaggccuacuu

SEQ ID NO: 765744 - RNA, 19 nt, Homo sapiens
acaagcacaucaugauuga

SEQ ID NO: 765745 - RNA, 19 nt, Homo sapiens
ggaacaagcacaucaugau

SEQ ID NO: 765746 - RNA, 19 nt, Homo sapiens
gagcaccucugagauggaa

SEQ ID NO: 765747 - RNA, 19 nt, Homo sapiens
ggcaacaacaacaagauua

SEQ ID NO: 765748 - RNA, 19 nt, Homo sapiens
ugacagaauccaaagguuu

SEQ ID NO: 765749 - RNA, 19 nt, Homo sapiens
uuuauagccuucccuguaa

SEQ ID NO: 765750 - RNA, 19 nt, Homo sapiens
cuaauuacauuugcaagga

SEQ ID NO: 765751 - RNA, 19 nt, Homo sapiens
guuuauagccuucccugua

SEQ ID NO: 765752 - RNA, 19 nt, Homo sapiens
caggaaacuuaaugaauag

SEQ ID NO: 765753 - RNA, 19 nt, Homo sapiens
ccucugagauggaauugau

SEQ ID NO: 765754 - RNA, 19 nt, Homo sapiens
ccaaagguuuacucugguu

SEQ ID NO: 765755 - RNA, 19 nt, Homo sapiens
caccagcuguguuggauug

SEQ ID NO: 765756 - RNA, 19 nt, Homo sapiens
ggguuaggacuucaauaua

SEQ ID NO: 765757 - RNA, 19 nt, Homo sapiens
gccgcgagcugggcuuuaa

SEQ ID NO: 765758 - RNA, 19 nt, Homo sapiens
gaucuuauguccacaaaag

SEQ ID NO: 765759 - RNA, 19 nt, Homo sapiens
ggacuggcaacaacaacaa

SEQ ID NO: 765760 - RNA, 19 nt, Homo sapiens
gcacaucaugauugacuug

SEQ ID NO: 765761 - RNA, 19 nt, Homo sapiens
ccugugagccugugcguuu

SEQ ID NO: 765762 - RNA, 19 nt, Homo sapiens
ccagcauggccuaaucuua

SEQ ID NO: 765763 - RNA, 19 nt, Homo sapiens
caaagguuuacucugguua

SEQ ID NO: 765764 - RNA, 19 nt, Homo sapiens
cuacgugcaugaagaugga

SEQ ID NO: 765765 - RNA, 19 nt, Homo sapiens
gcaccucugagauggaauu

SEQ ID NO: 765766 - RNA, 19 nt, Homo sapiens
uaacucaccgaaauaaaca

SEQ ID NO: 765767 - RNA, 19 nt, Homo sapiens
gaauugauaacauggucuu

SEQ ID NO: 765768 - RNA, 19 nt, Homo sapiens
ggaaacguuuuaagcuauu

SEQ ID NO: 765769 - RNA, 19 nt, Homo sapiens
ucaccgaaauaaacaagca

SEQ ID NO: 765770 - RNA, 19 nt, Homo sapiens
gcuccagcauggccuaauc

SEQ ID NO: 765771 - RNA, 19 nt, Homo sapiens
aagguuuacucugguuaua

SEQ ID NO: 765772 - RNA, 19 nt, Homo sapiens
agauggaauugauaacaug

SEQ ID NO: 765773 - RNA, 19 nt, Homo sapiens
ugaguuauacgauccaugu

SEQ ID NO: 765774 - RNA, 19 nt, Homo sapiens
cagcaucgccgagaagguu

SEQ ID NO: 765775 - RNA, 19 nt, Homo sapiens
gugcugguguccaaaauuu

SEQ ID NO: 765776 - RNA, 19 nt, Homo sapiens
gauaacauggucuuaacuc

SEQ ID NO: 765777 - RNA, 19 nt, Homo sapiens
ggccacgacugggauccua

SEQ ID NO: 765778 - RNA, 19 nt, Homo sapiens
guuauacgauccauguacu

SEQ ID NO: 765779 - RNA, 19 nt, Homo sapiens
uacgauccauguacuguca

SEQ ID NO: 765780 - RNA, 19 nt, Homo sapiens
uuuguucucaggaaacuua

SEQ ID NO: 765781 - RNA, 19 nt, Homo sapiens
aaacaagcacguggugaga

SEQ ID NO: 765782 - RNA, 19 nt, Homo sapiens
auaacauggucuuaacuca

SEQ ID NO: 765783 - RNA, 19 nt, Homo sapiens
ucugagauggaauugauaa

SEQ ID NO: 765784 - RNA, 19 nt, Homo sapiens
aacaagcacaucaugauug

SEQ ID NO: 765785 - RNA, 19 nt, Homo sapiens
guuccuugguguguggaua

SEQ ID NO: 765786 - RNA, 19 nt, Homo sapiens
cgagcugggcuuuaacaga

SEQ ID NO: 765787 - RNA, 19 nt, Homo sapiens
caauucaauccaugacaga

SEQ ID NO: 765788 - RNA, 19 nt, Homo sapiens
guucucaggaaacuuaaug

SEQ ID NO: 765789 - RNA, 19 nt, Homo sapiens
guuacacaauucaauccau

SEQ ID NO: 765790 - RNA, 19 nt, Homo sapiens
guacagcaucgccgagaag

SEQ ID NO: 765791 - RNA, 19 nt, Homo sapiens
gugccugacuucaacaaaa

SEQ ID NO: 765792 - RNA, 19 nt, Homo sapiens
ugagauggaauugauaaca

SEQ ID NO: 765793 - RNA, 19 nt, Homo sapiens
ucuuguggauauuacagaa

SEQ ID NO: 765794 - RNA, 19 nt, Homo sapiens
gcgguuacacaauucaauc

SEQ ID NO: 765795 - RNA, 19 nt, Homo sapiens
uggcaacaacaacaagauu

SEQ ID NO: 765796 - RNA, 19 nt, Homo sapiens
gaguuauacgauccaugua

SEQ ID NO: 765797 - RNA, 19 nt, Homo sapiens
uugauaacauggucuuaac

SEQ ID NO: 765798 - RNA, 19 nt, Homo sapiens
agucugcgcggauaaaugu

SEQ ID NO: 765799 - RNA, 19 nt, Homo sapiens
caugacagaauccaaaggu

SEQ ID NO: 765800 - RNA, 19 nt, Homo sapiens
ggaguaaaacgaagguguu

SEQ ID NO: 765801 - RNA, 19 nt, Homo sapiens
ucucaggaaacuuaaugaa

SEQ ID NO: 765802 - RNA, 19 nt, Homo sapiens
ccaaggacuacuccaccaa

SEQ ID NO: 765803 - RNA, 19 nt, Homo sapiens
caacaacaacaagauuaac

SEQ ID NO: 765804 - RNA, 19 nt, Homo sapiens
ccaauaaacucgccucuug

SEQ ID NO: 765805 - RNA, 19 nt, Homo sapiens
ggaagaaacugaagaugcu

SEQ ID NO: 765806 - RNA, 19 nt, Homo sapiens
ggacaaagugcucuucuau

SEQ ID NO: 765807 - RNA, 19 nt, Homo sapiens
gcacguccauuggcucuuu

SEQ ID NO: 765808 - RNA, 19 nt, Homo sapiens
gagauugugucccggauug

SEQ ID NO: 765809 - RNA, 19 nt, Homo sapiens
caucgggucuuccaggaua

SEQ ID NO: 765810 - RNA, 19 nt, Homo sapiens
ccucugaagugcuuuauau

SEQ ID NO: 765811 - RNA, 19 nt, Homo sapiens
gguaaagguuccagacaug

SEQ ID NO: 765812 - RNA, 19 nt, Homo sapiens
acaaagugcucuucuaugg

SEQ ID NO: 765813 - RNA, 19 nt, Homo sapiens
gaacaccauugcccuugug

SEQ ID NO: 765814 - RNA, 19 nt, Homo sapiens
gcugguggcugcuguggaa

SEQ ID NO: 765815 - RNA, 19 nt, Homo sapiens
ccaggacucuucugaaaca

SEQ ID NO: 765816 - RNA, 19 nt, Homo sapiens
gcacaucggaguacuaaag

SEQ ID NO: 765817 - RNA, 19 nt, Homo sapiens
gggacaaagugcucuucua

SEQ ID NO: 765818 - RNA, 19 nt, Homo sapiens
gaaguucgaccagaucuau

SEQ ID NO: 765819 - RNA, 19 nt, Homo sapiens
uaaacucgccucuuggaaa

SEQ ID NO: 765820 - RNA, 19 nt, Homo sapiens
ugcaugagcucuacgagaa

SEQ ID NO: 765821 - RNA, 19 nt, Homo sapiens
caccuugggucacaucaaa

SEQ ID NO: 765822 - RNA, 19 nt, Homo sapiens
uggcgaaccucucaucuuc

SEQ ID NO: 765823 - RNA, 19 nt, Homo sapiens
agacggaccucagcaccua

SEQ ID NO: 765824 - RNA, 19 nt, Homo sapiens
ccagucaccuccauguuca

SEQ ID NO: 765825 - RNA, 19 nt, Homo sapiens
ggaacaccauugcccuugu

SEQ ID NO: 765826 - RNA, 19 nt, Homo sapiens
ucccaggacucuucugaaa

SEQ ID NO: 765827 - RNA, 19 nt, Homo sapiens
ucccugggcugacaaggua

SEQ ID NO: 765828 - RNA, 19 nt, Homo sapiens
aaacggucaucgccauuga

SEQ ID NO: 765829 - RNA, 19 nt, Homo sapiens
guccgacgcuacuccuuaa

SEQ ID NO: 765830 - RNA, 19 nt, Homo sapiens
gguccgacgcuacuccuua

SEQ ID NO: 765831 - RNA, 19 nt, Homo sapiens
ccaaguacccggagagcuu

SEQ ID NO: 765832 - RNA, 19 nt, Homo sapiens
ggaaggaguguguggugaa

SEQ ID NO: 765833 - RNA, 19 nt, Homo sapiens
gaaggaguguguggugaag

SEQ ID NO: 765834 - RNA, 19 nt, Homo sapiens
ggacgggcaccuacucaug

SEQ ID NO: 765835 - RNA, 19 nt, Homo sapiens
ucacugggucugccuuuaa

SEQ ID NO: 765836 - RNA, 19 nt, Homo sapiens
ggacgugugccuguucgua

SEQ ID NO: 765837 - RNA, 19 nt, Homo sapiens
ugaagaugcucaacauugc

SEQ ID NO: 765838 - RNA, 19 nt, Homo sapiens
guguugcacugaugacuug

SEQ ID NO: 765839 - RNA, 19 nt, Homo sapiens
ggaugcacaccguaucgua

SEQ ID NO: 765840 - RNA, 19 nt, Homo sapiens
gcucaacauugccaagaag

SEQ ID NO: 765841 - RNA, 19 nt, Homo sapiens
ggagaggagucagauuguc

SEQ ID NO: 765842 - RNA, 19 nt, Homo sapiens
ucacugacuuggcagagau

SEQ ID NO: 765843 - RNA, 19 nt, Homo sapiens
ucaagaccauggacuuugg

SEQ ID NO: 765844 - RNA, 19 nt, Homo sapiens
gcggcuacaucaacaaucu

SEQ ID NO: 765845 - RNA, 19 nt, Homo sapiens
gagcggggaugcaguguug

SEQ ID NO: 765846 - RNA, 19 nt, Homo sapiens
caacgugaccacagauauc

SEQ ID NO: 765847 - RNA, 19 nt, Homo sapiens
cugaagaugcucaacauug

SEQ ID NO: 765848 - RNA, 19 nt, Homo sapiens
gacaaagugcucuucuaug

SEQ ID NO: 765849 - RNA, 19 nt, Homo sapiens
guggcaacgucauugagaa

SEQ ID NO: 765850 - RNA, 19 nt, Homo sapiens
gaauggugcuuggcgugau

SEQ ID NO: 765851 - RNA, 19 nt, Homo sapiens
ggaagauuaugcggaaggu

SEQ ID NO: 765852 - RNA, 19 nt, Homo sapiens
gcucuggcuucacugacuu

SEQ ID NO: 765853 - RNA, 19 nt, Homo sapiens
ggaaguucgaccagaucua

SEQ ID NO: 765854 - RNA, 19 nt, Homo sapiens
cagcauccaucgggucuuc

SEQ ID NO: 765855 - RNA, 19 nt, Homo sapiens
gaccucacguacccaguca

SEQ ID NO: 765856 - RNA, 19 nt, Homo sapiens
caccauugcccuugugcua

SEQ ID NO: 765857 - RNA, 19 nt, Homo sapiens
gcgaggcaguggcaagaag

SEQ ID NO: 765858 - RNA, 19 nt, Homo sapiens
gagggcaccuugggucaca

SEQ ID NO: 765859 - RNA, 19 nt, Homo sapiens
ccaagcugaugcggauuga

SEQ ID NO: 765860 - RNA, 19 nt, Homo sapiens
ucaacagccuucucagcau

SEQ ID NO: 765861 - RNA, 19 nt, Homo sapiens
caacauugccaagaagauc

SEQ ID NO: 765862 - RNA, 19 nt, Homo sapiens
gcagcuagagguugucaag

SEQ ID NO: 765863 - RNA, 19 nt, Homo sapiens
ccaugcgaguccacaaaga

SEQ ID NO: 765864 - RNA, 19 nt, Homo sapiens
cgguaucgguuccggaaga

SEQ ID NO: 765865 - RNA, 19 nt, Homo sapiens
aaagcuggcaccaucauug

SEQ ID NO: 765866 - RNA, 19 nt, Homo sapiens
ggucagcaccucagcuaca

SEQ ID NO: 765867 - RNA, 19 nt, Homo sapiens
aaacugaagaugcucaaca

SEQ ID NO: 765868 - RNA, 19 nt, Homo sapiens
gcaugaggaagaaacugaa

SEQ ID NO: 765869 - RNA, 19 nt, Homo sapiens
gagaggagucagauugucu

SEQ ID NO: 765870 - RNA, 19 nt, Homo sapiens
ucgaccagaucuaugaugu

SEQ ID NO: 765871 - RNA, 19 nt, Homo sapiens
accguggaguggcuaaaua

SEQ ID NO: 765872 - RNA, 19 nt, Homo sapiens
caucaccggucaccagcau

SEQ ID NO: 765873 - RNA, 19 nt, Homo sapiens
gggccaagagcaugacuuc

SEQ ID NO: 765874 - RNA, 19 nt, Homo sapiens
ggacgugagccugcacuuc

SEQ ID NO: 765875 - RNA, 19 nt, Homo sapiens
gaagcccacaucccuggaa

SEQ ID NO: 765876 - RNA, 19 nt, Homo sapiens
ugcuuuauaugcucaagaa

SEQ ID NO: 765877 - RNA, 19 nt, Homo sapiens
gcacugccuccgagaugga

SEQ ID NO: 765878 - RNA, 19 nt, Homo sapiens
ggccacgcaugaggaagaa

SEQ ID NO: 765879 - RNA, 19 nt, Homo sapiens
uucuauggccggaagauua

SEQ ID NO: 765880 - RNA, 19 nt, Homo sapiens
gcgaaccucucaucuucac

SEQ ID NO: 765881 - RNA, 19 nt, Homo sapiens
caaagcuggcaccaucauu

SEQ ID NO: 765882 - RNA, 19 nt, Homo sapiens
ccgcggucuucaccaagua

SEQ ID NO: 765883 - RNA, 19 nt, Homo sapiens
acucccaucugcccucuga

SEQ ID NO: 765884 - RNA, 19 nt, Homo sapiens
gcaacgucauugagaaaau

SEQ ID NO: 765885 - RNA, 19 nt, Homo sapiens
cccaucgacugcuucaaga

SEQ ID NO: 765886 - RNA, 19 nt, Homo sapiens
uuccagacauggcugaaau

SEQ ID NO: 765887 - RNA, 19 nt, Homo sapiens
ggaggacgugugccuguuc

SEQ ID NO: 765888 - RNA, 19 nt, Homo sapiens
guacgggaaggcgguguuu

SEQ ID NO: 765889 - RNA, 19 nt, Homo sapiens
gauccugcgcauccagaaa

SEQ ID NO: 765890 - RNA, 19 nt, Homo sapiens
gcccaucgacugcuucaag

SEQ ID NO: 765891 - RNA, 19 nt, Homo sapiens
cgacgcuacuccuuaacag

SEQ ID NO: 765892 - RNA, 19 nt, Homo sapiens
cuacugagccagaaaauuc

SEQ ID NO: 765893 - RNA, 19 nt, Homo sapiens
cgccuuauccaccuacuga

SEQ ID NO: 765894 - RNA, 19 nt, Homo sapiens
cagcacugccuccgagaug

SEQ ID NO: 765895 - RNA, 19 nt, Homo sapiens
ugaggaagaaacugaagau

SEQ ID NO: 765896 - RNA, 19 nt, Homo sapiens
ccacgagcuaugucucuga

SEQ ID NO: 765897 - RNA, 19 nt, Homo sapiens
ccuuaacagugacaucauc

SEQ ID NO: 765898 - RNA, 19 nt, Homo sapiens
gccaagcugaugcggauug

SEQ ID NO: 765899 - RNA, 19 nt, Homo sapiens
ucaacgugaccacagauau

SEQ ID NO: 765900 - RNA, 19 nt, Homo sapiens
ucggaguacuaaaggcauu

SEQ ID NO: 765901 - RNA, 19 nt, Homo sapiens
ucgcacaucggaguacuaa

SEQ ID NO: 765902 - RNA, 19 nt, Homo sapiens
ggaggaugcacaccguauc

SEQ ID NO: 765903 - RNA, 19 nt, Homo sapiens
ccgugucccugcaggaaga

SEQ ID NO: 765904 - RNA, 19 nt, Homo sapiens
ggagaaaucuuuaauggua

SEQ ID NO: 765905 - RNA, 19 nt, Homo sapiens
ggagggagaugcagcuuua

SEQ ID NO: 765906 - RNA, 19 nt, Homo sapiens
gaacagagcacguuuaaag

SEQ ID NO: 765907 - RNA, 19 nt, Homo sapiens
gaauaaagcaugucauuug

SEQ ID NO: 765908 - RNA, 19 nt, Homo sapiens
gaaccuauauccaucauca

SEQ ID NO: 765909 - RNA, 19 nt, Homo sapiens
gaagaaugauguaaaugug

SEQ ID NO: 765910 - RNA, 19 nt, Homo sapiens
ucaagaauguucagaagaa

SEQ ID NO: 765911 - RNA, 19 nt, Homo sapiens
ccaaauaauuccacugcua

SEQ ID NO: 765912 - RNA, 19 nt, Homo sapiens
gcaaagaagucucuagaac

SEQ ID NO: 765913 - RNA, 19 nt, Homo sapiens
gaacuucuucauccuauaa

SEQ ID NO: 765914 - RNA, 19 nt, Homo sapiens
gaacagaaaccagaugaug

SEQ ID NO: 765915 - RNA, 19 nt, Homo sapiens
uuaauuugcucucaucgua

SEQ ID NO: 765916 - RNA, 19 nt, Homo sapiens
gaaacugaauaaagcaugu

SEQ ID NO: 765917 - RNA, 19 nt, Homo sapiens
caacuggucugauguaggu

SEQ ID NO: 765918 - RNA, 19 nt, Homo sapiens
ggagaggauuacaauuuga

SEQ ID NO: 765919 - RNA, 19 nt, Homo sapiens
gaucaagaauguucagaag

SEQ ID NO: 765920 - RNA, 19 nt, Homo sapiens
gcuccuagauagauucauu

SEQ ID NO: 765921 - RNA, 19 nt, Homo sapiens
ucaaacagaaucucaagua

SEQ ID NO: 765922 - RNA, 19 nt, Homo sapiens
gcacaguauuauugucaaa

SEQ ID NO: 765923 - RNA, 19 nt, Homo sapiens
ccacugcuaugcugagaaa

SEQ ID NO: 765924 - RNA, 19 nt, Homo sapiens
cagaugaugcacaguauua

SEQ ID NO: 765925 - RNA, 19 nt, Homo sapiens
ucacuucuguccuuaaaga

SEQ ID NO: 765926 - RNA, 19 nt, Homo sapiens
guaaagaaccuauauccau

SEQ ID NO: 765927 - RNA, 19 nt, Homo sapiens
uauuagaccuggcagcuuu

SEQ ID NO: 765928 - RNA, 19 nt, Homo sapiens
gaauuacuguguugcuguu

SEQ ID NO: 765929 - RNA, 19 nt, Homo sapiens
caagucuaaugaagaauga

SEQ ID NO: 765930 - RNA, 19 nt, Homo sapiens
caaacagaaucucaaguag

SEQ ID NO: 765931 - RNA, 19 nt, Homo sapiens
gaagugaaacgugccauga

SEQ ID NO: 765932 - RNA, 19 nt, Homo sapiens
uaaauugguuggugagauc

SEQ ID NO: 765933 - RNA, 19 nt, Homo sapiens
ggaacuucuucauccuaua

SEQ ID NO: 765934 - RNA, 19 nt, Homo sapiens
ugacugguaucaaacagaa

SEQ ID NO: 765935 - RNA, 19 nt, Homo sapiens
ugaauggaguuguaaauac

SEQ ID NO: 765936 - RNA, 19 nt, Homo sapiens
aaagaagucucuagaacuc

SEQ ID NO: 765937 - RNA, 19 nt, Homo sapiens
agaugcagcuuuaaacaga

SEQ ID NO: 765938 - RNA, 19 nt, Homo sapiens
cagaacagagcacguuuaa

SEQ ID NO: 765939 - RNA, 19 nt, Homo sapiens
uggagaggauuacaauuug

SEQ ID NO: 765940 - RNA, 19 nt, Homo sapiens
caaauaauuccacugcuau

SEQ ID NO: 765941 - RNA, 19 nt, Homo sapiens
uaucacuucuguccuuaaa

SEQ ID NO: 765942 - RNA, 19 nt, Homo sapiens
ggugguaaccgugauagua

SEQ ID NO: 765943 - RNA, 19 nt, Homo sapiens
acagagcacguuuaaagua

SEQ ID NO: 765944 - RNA, 19 nt, Homo sapiens
aaguaugacugguaucaaa

SEQ ID NO: 765945 - RNA, 19 nt, Homo sapiens
cuagaacucaauccaaaua

SEQ ID NO: 765946 - RNA, 19 nt, Homo sapiens
gccaugaacaaauccuuua

SEQ ID NO: 765947 - RNA, 19 nt, Homo sapiens
agaguugucugcuuugguu

SEQ ID NO: 765948 - RNA, 19 nt, Homo sapiens
cuucuguccuuaaagauuu

SEQ ID NO: 765949 - RNA, 19 nt, Homo sapiens
gagaugugccuacgccaaa

SEQ ID NO: 765950 - RNA, 19 nt, Homo sapiens
uaauuucagugucuggauu

SEQ ID NO: 765951 - RNA, 19 nt, Homo sapiens
gaauaugugaauaccauga

SEQ ID NO: 765952 - RNA, 19 nt, Homo sapiens
aaucaaguaugacugguau

SEQ ID NO: 765953 - RNA, 19 nt, Homo sapiens
caccuucaguguuacauug

SEQ ID NO: 765954 - RNA, 19 nt, Homo sapiens
gaugaugcacaguauuauu

SEQ ID NO: 765955 - RNA, 19 nt, Homo sapiens
ggagaugcagcuuuaaaca

SEQ ID NO: 765956 - RNA, 19 nt, Homo sapiens
gagcacguuuaaaguacuu

SEQ ID NO: 765957 - RNA, 19 nt, Homo sapiens
ccagaacagagcacguuua

SEQ ID NO: 765958 - RNA, 19 nt, Homo sapiens
ugacuaaggcuuuggaaca

SEQ ID NO: 765959 - RNA, 19 nt, Homo sapiens
gcucucaucguauugugua

SEQ ID NO: 765960 - RNA, 19 nt, Homo sapiens
cugaugauauggaauggaa

SEQ ID NO: 765961 - RNA, 19 nt, Homo sapiens
gaaacgugccaugaacaaa

SEQ ID NO: 765962 - RNA, 19 nt, Homo sapiens
caaagagcuuauugucaca

SEQ ID NO: 765963 - RNA, 19 nt, Homo sapiens
gagaggauuacaauuugaa

SEQ ID NO: 765964 - RNA, 19 nt, Homo sapiens
cuggagaggauuacaauuu

SEQ ID NO: 765965 - RNA, 19 nt, Homo sapiens
caagaauguucagaagaau

SEQ ID NO: 765966 - RNA, 19 nt, Homo sapiens
gaaucucaaguagucauua

SEQ ID NO: 765967 - RNA, 19 nt, Homo sapiens
aacagaaucucaaguaguc

SEQ ID NO: 765968 - RNA, 19 nt, Homo sapiens
caucaucuccuuauacaag

SEQ ID NO: 765969 - RNA, 19 nt, Homo sapiens
caaagaagucucuagaacu

SEQ ID NO: 765970 - RNA, 19 nt, Homo sapiens
ggauuacaauuugaaacug

SEQ ID NO: 765971 - RNA, 19 nt, Homo sapiens
cugcugcccuagaaacuuu

SEQ ID NO: 765972 - RNA, 19 nt, Homo sapiens
gauggagaaaucuuuaaug

SEQ ID NO: 765973 - RNA, 19 nt, Homo sapiens
gucauuugcuccuagauag

SEQ ID NO: 765974 - RNA, 19 nt, Homo sapiens
cuaaggcuuuggaacagaa

SEQ ID NO: 765975 - RNA, 19 nt, Homo sapiens
ucaauccuccugaugauau

SEQ ID NO: 765976 - RNA, 19 nt, Homo sapiens
ccuuaaagauuucagacau

SEQ ID NO: 765977 - RNA, 19 nt, Homo sapiens
cagagcacguuuaaaguac

SEQ ID NO: 765978 - RNA, 19 nt, Homo sapiens
ccuagaaacuuuuacagaa

SEQ ID NO: 765979 - RNA, 19 nt, Homo sapiens
ggauggagaaaucuuuaau

SEQ ID NO: 765980 - RNA, 19 nt, Homo sapiens
gauucauucuaucuaguug

SEQ ID NO: 765981 - RNA, 19 nt, Homo sapiens
cuucaaguguucaagucua

SEQ ID NO: 765982 - RNA, 19 nt, Homo sapiens
uuggugagaucaaagaaga

SEQ ID NO: 765983 - RNA, 19 nt, Homo sapiens
ccaucaucaucuccuuaua

SEQ ID NO: 765984 - RNA, 19 nt, Homo sapiens
gaaacuggaacuucuucau

SEQ ID NO: 765985 - RNA, 19 nt, Homo sapiens
gaugcuaauuucagugucu

SEQ ID NO: 765986 - RNA, 19 nt, Homo sapiens
ugagaucaaagaagaagaa

SEQ ID NO: 765987 - RNA, 19 nt, Homo sapiens
agaauguucagaagaauga

SEQ ID NO: 765988 - RNA, 19 nt, Homo sapiens
ggagcugacuaaggcuuug

SEQ ID NO: 765989 - RNA, 19 nt, Homo sapiens
agaagucucuagaacucaa

SEQ ID NO: 765990 - RNA, 19 nt, Homo sapiens
guuacauuguguuugcuuu

SEQ ID NO: 765991 - RNA, 19 nt, Homo sapiens
gacauggugaaacugaaua

SEQ ID NO: 765992 - RNA, 19 nt, Homo sapiens
aaacgugccaugaacaaau

SEQ ID NO: 765993 - RNA, 19 nt, Homo sapiens
gcagauguaaagaaccuau

SEQ ID NO: 765994 - RNA, 19 nt, Homo sapiens
cuuaaagauuucagacaug

SEQ ID NO: 765995 - RNA, 19 nt, Homo sapiens
caucguauuguguauauuc

SEQ ID NO: 765996 - RNA, 19 nt, Homo sapiens
cucuagaacucaauccaaa

SEQ ID NO: 765997 - RNA, 19 nt, Homo sapiens
gaucaaagaagaagaaaag

SEQ ID NO: 765998 - RNA, 19 nt, Homo sapiens
uagugcagaugcuaauuuc

SEQ ID NO: 765999 - RNA, 19 nt, Homo sapiens
aggaauaugugaauaccau

SEQ ID NO: 766000 - RNA, 19 nt, Homo sapiens
gggauggagaaaucuuuaa

SEQ ID NO: 766001 - RNA, 19 nt, Homo sapiens
aauuugcucucaucguauu

SEQ ID NO: 766002 - RNA, 19 nt, Homo sapiens
gauuauuucagcagaucua

SEQ ID NO: 766003 - RNA, 19 nt, Homo sapiens
acacuuaugaucaagaaug

SEQ ID NO: 766004 - RNA, 19 nt, Homo sapiens
gaaauaagcaucuguuagu

SEQ ID NO: 766005 - RNA, 19 nt, Homo sapiens
aaacacccaucuuagaaua

SEQ ID NO: 766006 - RNA, 19 nt, Homo sapiens
gaaauacugugucugaagu

SEQ ID NO: 766007 - RNA, 19 nt, Homo sapiens
gaaggaagccgucuaucuu

SEQ ID NO: 766008 - RNA, 19 nt, Homo sapiens
ggacaagauccuaacauuu

SEQ ID NO: 766009 - RNA, 19 nt, Homo sapiens
acacaaugcuugauuugaa

SEQ ID NO: 766010 - RNA, 19 nt, Homo sapiens
ggauuucucuggacaagau

SEQ ID NO: 766011 - RNA, 19 nt, Homo sapiens
gaggaaauuugagaaaguu

SEQ ID NO: 766012 - RNA, 19 nt, Homo sapiens
gagcuucccuucuacagau

SEQ ID NO: 766013 - RNA, 19 nt, Homo sapiens
gaaagagcuucccuucuac

SEQ ID NO: 766014 - RNA, 19 nt, Homo sapiens
gaugcugggugcagaaaga

SEQ ID NO: 766015 - RNA, 19 nt, Homo sapiens
uaaauccucucuuaucucu

SEQ ID NO: 766016 - RNA, 19 nt, Homo sapiens
gaaacacccaucuuagaau

SEQ ID NO: 766017 - RNA, 19 nt, Homo sapiens
gacaagauccuaacauuuu

SEQ ID NO: 766018 - RNA, 19 nt, Homo sapiens
uggacaagauccuaacauu

SEQ ID NO: 766019 - RNA, 19 nt, Homo sapiens
caagaggaaauuugagaaa

SEQ ID NO: 766020 - RNA, 19 nt, Homo sapiens
cacaaugcuugauuugaaa

SEQ ID NO: 766021 - RNA, 19 nt, Homo sapiens
cagaaacacccaucuuaga

SEQ ID NO: 766022 - RNA, 19 nt, Homo sapiens
gaagugaaauaagcaucug

SEQ ID NO: 766023 - RNA, 19 nt, Homo sapiens
agaaacacccaucuuagaa

SEQ ID NO: 766024 - RNA, 19 nt, Homo sapiens
ggaaauacugugucugaag

SEQ ID NO: 766025 - RNA, 19 nt, Homo sapiens
ccugauugcuucuggaaau

SEQ ID NO: 766026 - RNA, 19 nt, Homo sapiens
agacucaaguaccaacauu

SEQ ID NO: 766027 - RNA, 19 nt, Homo sapiens
cuacagauacugccagaga

SEQ ID NO: 766028 - RNA, 19 nt, Homo sapiens
uaacacaaugcuugauuug

SEQ ID NO: 766029 - RNA, 19 nt, Homo sapiens
gugaaauaagcaucuguua

SEQ ID NO: 766030 - RNA, 19 nt, Homo sapiens
aaacuacacccuguucauu

SEQ ID NO: 766031 - RNA, 19 nt, Homo sapiens
agaggaaauuugagaaagu

SEQ ID NO: 766032 - RNA, 19 nt, Homo sapiens
ggaaagcagacucaaguac

SEQ ID NO: 766033 - RNA, 19 nt, Homo sapiens
aauccucucuuaucucuuc

SEQ ID NO: 766034 - RNA, 19 nt, Homo sapiens
uacacccuguucauuguua

SEQ ID NO: 766035 - RNA, 19 nt, Homo sapiens
caggaaagcagacucaagu

SEQ ID NO: 766036 - RNA, 19 nt, Homo sapiens
cucagaaacacccaucuua

SEQ ID NO: 766037 - RNA, 19 nt, Homo sapiens
ugaaauaagcaucuguuag

SEQ ID NO: 766038 - RNA, 19 nt, Homo sapiens
uuguggcgaucauguauaa

SEQ ID NO: 766039 - RNA, 19 nt, Homo sapiens
cuuaaauccucucuuaucu

SEQ ID NO: 766040 - RNA, 19 nt, Homo sapiens
guucauuguuaccuggaaa

SEQ ID NO: 766041 - RNA, 19 nt, Homo sapiens
acacccaucuuagaauaug

SEQ ID NO: 766042 - RNA, 19 nt, Homo sapiens
uacugugucugaagugaaa

SEQ ID NO: 766043 - RNA, 19 nt, Homo sapiens
gcucagaaacacccaucuu

SEQ ID NO: 766044 - RNA, 19 nt, Homo sapiens
ccaagaggaaauuugagaa

SEQ ID NO: 766045 - RNA, 19 nt, Homo sapiens
gaggggauauucucaggaa

SEQ ID NO: 766046 - RNA, 19 nt, Homo sapiens
ucagaaacacccaucuuag

SEQ ID NO: 766047 - RNA, 19 nt, Homo sapiens
cugauugcuucuggaaaua

SEQ ID NO: 766048 - RNA, 19 nt, Homo sapiens
cuggaaaccauacaagaaa

SEQ ID NO: 766049 - RNA, 19 nt, Homo sapiens
gcaaacuacacccuguuca

SEQ ID NO: 766050 - RNA, 19 nt, Homo sapiens
ggaagccgucuaucuugug

SEQ ID NO: 766051 - RNA, 19 nt, Homo sapiens
aaacgugagacuccugauu

SEQ ID NO: 766052 - RNA, 19 nt, Homo sapiens
aaagcagacucaaguacca

SEQ ID NO: 766053 - RNA, 19 nt, Homo sapiens
ucucagcaccucaugaaga

SEQ ID NO: 766054 - RNA, 19 nt, Homo sapiens
aagcuggccuccugcuguu

SEQ ID NO: 766055 - RNA, 19 nt, Homo sapiens
gauccuaacauuuuacuga

SEQ ID NO: 766056 - RNA, 19 nt, Homo sapiens
uaacccaagaggaaauuug

SEQ ID NO: 766057 - RNA, 19 nt, Homo sapiens
caaacuacacccuguucau

SEQ ID NO: 766058 - RNA, 19 nt, Homo sapiens
ugucugaagugaaauaagc

SEQ ID NO: 766059 - RNA, 19 nt, Homo sapiens
gaaaacaguguggagaaaa

SEQ ID NO: 766060 - RNA, 19 nt, Homo sapiens
aaauaagcaucuguuaguc

SEQ ID NO: 766061 - RNA, 19 nt, Homo sapiens
cuggaaauacugugucuga

SEQ ID NO: 766062 - RNA, 19 nt, Homo sapiens
agaaggaagccgucuaucu

SEQ ID NO: 766063 - RNA, 19 nt, Homo sapiens
ucuggaaaccauacaagaa

SEQ ID NO: 766064 - RNA, 19 nt, Homo sapiens
gaaucuggaaaccauacaa

SEQ ID NO: 766065 - RNA, 19 nt, Homo sapiens
aagaggaaauuugagaaag

SEQ ID NO: 766066 - RNA, 19 nt, Homo sapiens
gugagacuccugauugcuu

SEQ ID NO: 766067 - RNA, 19 nt, Homo sapiens
ugaaaacaguguggagaaa

SEQ ID NO: 766068 - RNA, 19 nt, Homo sapiens
cuccuugacuccagggaaa

SEQ ID NO: 766069 - RNA, 19 nt, Homo sapiens
acuacacccuguucauugu

SEQ ID NO: 766070 - RNA, 19 nt, Homo sapiens
gcagaaagaggggauauuc

SEQ ID NO: 766071 - RNA, 19 nt, Homo sapiens
guuagucagcucagaaaca

SEQ ID NO: 766072 - RNA, 19 nt, Homo sapiens
ucuuaaauccucucuuauc

SEQ ID NO: 766073 - RNA, 19 nt, Homo sapiens
aaggaagccgucuaucuug

SEQ ID NO: 766074 - RNA, 19 nt, Homo sapiens
uggaaauacugugucugaa

SEQ ID NO: 766075 - RNA, 19 nt, Homo sapiens
gacucaaguaccaacauuu

SEQ ID NO: 766076 - RNA, 19 nt, Homo sapiens
gagaugcugggugcagaaa

SEQ ID NO: 766077 - RNA, 19 nt, Homo sapiens
aauacugugucugaaguga

SEQ ID NO: 766078 - RNA, 19 nt, Homo sapiens
aggaagccgucuaucuugu

SEQ ID NO: 766079 - RNA, 19 nt, Homo sapiens
gaaagaggggauauucuca

SEQ ID NO: 766080 - RNA, 19 nt, Homo sapiens
aauauccuuucaacucuca

SEQ ID NO: 766081 - RNA, 19 nt, Homo sapiens
aacgugagacuccugauug

SEQ ID NO: 766082 - RNA, 19 nt, Homo sapiens
aauaagcaucuguuaguca

SEQ ID NO: 766083 - RNA, 19 nt, Homo sapiens
uacagauacugccagagau

SEQ ID NO: 766084 - RNA, 19 nt, Homo sapiens
caggauuucucuggacaag

SEQ ID NO: 766085 - RNA, 19 nt, Homo sapiens
cccaagaggaaauuugaga

SEQ ID NO: 766086 - RNA, 19 nt, Homo sapiens
gggauauucucaggaaagc

SEQ ID NO: 766087 - RNA, 19 nt, Homo sapiens
gaaauaagcaucuguuagu

SEQ ID NO: 766088 - RNA, 19 nt, Homo sapiens
aaacacccaucuuagaaua

SEQ ID NO: 766089 - RNA, 19 nt, Homo sapiens
gaaauacugugucugaagu

SEQ ID NO: 766090 - RNA, 19 nt, Homo sapiens
caacguauuucaucuuaug

SEQ ID NO: 766091 - RNA, 19 nt, Homo sapiens
ggacaagauccuaacauuu

SEQ ID NO: 766092 - RNA, 19 nt, Homo sapiens
acacaaugcuugauuugaa

SEQ ID NO: 766093 - RNA, 19 nt, Homo sapiens
caacucaucuacucacuca

SEQ ID NO: 766094 - RNA, 19 nt, Homo sapiens
ggauuucucuggacaagau

SEQ ID NO: 766095 - RNA, 19 nt, Homo sapiens
gaggaaauuugagaaaguu

SEQ ID NO: 766096 - RNA, 19 nt, Homo sapiens
gagcuucccuucuacagau

SEQ ID NO: 766097 - RNA, 19 nt, Homo sapiens
gaaagagcuucccuucuac

SEQ ID NO: 766098 - RNA, 19 nt, Homo sapiens
uauccaagccuuccuuuaa

SEQ ID NO: 766099 - RNA, 19 nt, Homo sapiens
gaugcugggugcagaaaga

SEQ ID NO: 766100 - RNA, 19 nt, Homo sapiens
gaaacacccaucuuagaau

SEQ ID NO: 766101 - RNA, 19 nt, Homo sapiens
gacaagauccuaacauuuu

SEQ ID NO: 766102 - RNA, 19 nt, Homo sapiens
uggacaagauccuaacauu

SEQ ID NO: 766103 - RNA, 19 nt, Homo sapiens
caagaggaaauuugagaaa

SEQ ID NO: 766104 - RNA, 19 nt, Homo sapiens
cacaaugcuugauuugaaa

SEQ ID NO: 766105 - RNA, 19 nt, Homo sapiens
cagaaacacccaucuuaga

SEQ ID NO: 766106 - RNA, 19 nt, Homo sapiens
gaagugaaauaagcaucug

SEQ ID NO: 766107 - RNA, 19 nt, Homo sapiens
agaaacacccaucuuagaa

SEQ ID NO: 766108 - RNA, 19 nt, Homo sapiens
ggaaauacugugucugaag

SEQ ID NO: 766109 - RNA, 19 nt, Homo sapiens
accaacguauuucaucuua

SEQ ID NO: 766110 - RNA, 19 nt, Homo sapiens
ccugauugcuucuggaaau

SEQ ID NO: 766111 - RNA, 19 nt, Homo sapiens
ucuacucacucaugaaaga

SEQ ID NO: 766112 - RNA, 19 nt, Homo sapiens
agacucaaguaccaacauu

SEQ ID NO: 766113 - RNA, 19 nt, Homo sapiens
cuacagauacugccagaga

SEQ ID NO: 766114 - RNA, 19 nt, Homo sapiens
aauggaaaccaacguauuu

SEQ ID NO: 766115 - RNA, 19 nt, Homo sapiens
uaacacaaugcuugauuug

SEQ ID NO: 766116 - RNA, 19 nt, Homo sapiens
gugaaauaagcaucuguua

SEQ ID NO: 766117 - RNA, 19 nt, Homo sapiens
acucacucaugaaagauua

SEQ ID NO: 766118 - RNA, 19 nt, Homo sapiens
caugauuuauugcuggaaa

SEQ ID NO: 766119 - RNA, 19 nt, Homo sapiens
gauggcagcccuaaacaca

SEQ ID NO: 766120 - RNA, 19 nt, Homo sapiens
caucuacucacucaugaaa

SEQ ID NO: 766121 - RNA, 19 nt, Homo sapiens
aaacuacacccuguucauu

SEQ ID NO: 766122 - RNA, 19 nt, Homo sapiens
agaggaaauuugagaaagu

SEQ ID NO: 766123 - RNA, 19 nt, Homo sapiens
ggaaagcagacucaaguac

SEQ ID NO: 766124 - RNA, 19 nt, Homo sapiens
uacacccuguucauuguua

SEQ ID NO: 766125 - RNA, 19 nt, Homo sapiens
cagcauggcaacucaucua

SEQ ID NO: 766126 - RNA, 19 nt, Homo sapiens
caggaaagcagacucaagu

SEQ ID NO: 766127 - RNA, 19 nt, Homo sapiens
aaaccaacguauuucaucu

SEQ ID NO: 766128 - RNA, 19 nt, Homo sapiens
uccaagccuuccuuuaauu

SEQ ID NO: 766129 - RNA, 19 nt, Homo sapiens
cucagaaacacccaucuua

SEQ ID NO: 766130 - RNA, 19 nt, Homo sapiens
ugaaauaagcaucuguuag

SEQ ID NO: 766131 - RNA, 19 nt, Homo sapiens
guucauuguuaccuggaaa

SEQ ID NO: 766132 - RNA, 19 nt, Homo sapiens
acacccaucuuagaauaug

SEQ ID NO: 766133 - RNA, 19 nt, Homo sapiens
uacugugucugaagugaaa

SEQ ID NO: 766134 - RNA, 19 nt, Homo sapiens
cauggcaacucaucuacuc

SEQ ID NO: 766135 - RNA, 19 nt, Homo sapiens
gcucagaaacacccaucuu

SEQ ID NO: 766136 - RNA, 19 nt, Homo sapiens
ccaagaggaaauuugagaa

SEQ ID NO: 766137 - RNA, 19 nt, Homo sapiens
gaggggauauucucaggaa

SEQ ID NO: 766138 - RNA, 19 nt, Homo sapiens
ucagaaacacccaucuuag

SEQ ID NO: 766139 - RNA, 19 nt, Homo sapiens
cugauugcuucuggaaaua

SEQ ID NO: 766140 - RNA, 19 nt, Homo sapiens
cuggaaaccauacaagaaa

SEQ ID NO: 766141 - RNA, 19 nt, Homo sapiens
gcaaacuacacccuguuca

SEQ ID NO: 766142 - RNA, 19 nt, Homo sapiens
aaauggaaaccaacguauu

SEQ ID NO: 766143 - RNA, 19 nt, Homo sapiens
aaacgugagacuccugauu

SEQ ID NO: 766144 - RNA, 19 nt, Homo sapiens
aaagcagacucaaguacca

SEQ ID NO: 766145 - RNA, 19 nt, Homo sapiens
ucucagcaccucaugaaga

SEQ ID NO: 766146 - RNA, 19 nt, Homo sapiens
gauccuaacauuuuacuga

SEQ ID NO: 766147 - RNA, 19 nt, Homo sapiens
uaacccaagaggaaauuug

SEQ ID NO: 766148 - RNA, 19 nt, Homo sapiens
ccaacguauuucaucuuau

SEQ ID NO: 766149 - RNA, 19 nt, Homo sapiens
caaacuacacccuguucau

SEQ ID NO: 766150 - RNA, 19 nt, Homo sapiens
ugucugaagugaaauaagc

SEQ ID NO: 766151 - RNA, 19 nt, Homo sapiens
gaaaacaguguggagaaaa

SEQ ID NO: 766152 - RNA, 19 nt, Homo sapiens
aaauaagcaucuguuaguc

SEQ ID NO: 766153 - RNA, 19 nt, Homo sapiens
cuggaaauacugugucuga

SEQ ID NO: 766154 - RNA, 19 nt, Homo sapiens
cacuucaacucauauccaa

SEQ ID NO: 766155 - RNA, 19 nt, Homo sapiens
ucuggaaaccauacaagaa

SEQ ID NO: 766156 - RNA, 19 nt, Homo sapiens
gaaucuggaaaccauacaa

SEQ ID NO: 766157 - RNA, 19 nt, Homo sapiens
aagaggaaauuugagaaag

SEQ ID NO: 766158 - RNA, 19 nt, Homo sapiens
gugagacuccugauugcuu

SEQ ID NO: 766159 - RNA, 19 nt, Homo sapiens
ccaagccuuccuuuaauuc

SEQ ID NO: 766160 - RNA, 19 nt, Homo sapiens
ugaaaacaguguggagaaa

SEQ ID NO: 766161 - RNA, 19 nt, Homo sapiens
acuacacccuguucauugu

SEQ ID NO: 766162 - RNA, 19 nt, Homo sapiens
cuucugcucggacucauaa

SEQ ID NO: 766163 - RNA, 19 nt, Homo sapiens
gcagaaagaggggauauuc

SEQ ID NO: 766164 - RNA, 19 nt, Homo sapiens
auccaagccuuccuuuaau

SEQ ID NO: 766165 - RNA, 19 nt, Homo sapiens
guuagucagcucagaaaca

SEQ ID NO: 766166 - RNA, 19 nt, Homo sapiens
uggaaauacugugucugaa

SEQ ID NO: 766167 - RNA, 19 nt, Homo sapiens
gacucaaguaccaacauuu

SEQ ID NO: 766168 - RNA, 19 nt, Homo sapiens
gagaugcugggugcagaaa

SEQ ID NO: 766169 - RNA, 19 nt, Homo sapiens
aauacugugucugaaguga

SEQ ID NO: 766170 - RNA, 19 nt, Homo sapiens
aaacacagcauggcaacuc

SEQ ID NO: 766171 - RNA, 19 nt, Homo sapiens
gaaagaggggauauucuca

SEQ ID NO: 766172 - RNA, 19 nt, Homo sapiens
aacgugagacuccugauug

SEQ ID NO: 766173 - RNA, 19 nt, Homo sapiens
aauauccuuucaacucuca

SEQ ID NO: 766174 - RNA, 19 nt, Homo sapiens
aauaagcaucuguuaguca

SEQ ID NO: 766175 - RNA, 19 nt, Homo sapiens
caggauuucucuggacaag

SEQ ID NO: 766176 - RNA, 19 nt, Homo sapiens
cccaagaggaaauuugaga

SEQ ID NO: 766177 - RNA, 19 nt, Homo sapiens
gggauauucucaggaaagc

SEQ ID NO: 766178 - RNA, 19 nt, Homo sapiens
uacagauacugccagagau

SEQ ID NO: 766179 - RNA, 19 nt, Homo sapiens
caagccuuccuuuaauuca

SEQ ID NO: 766180 - RNA, 19 nt, Homo sapiens
ggaaagcgcugcaugaguu

SEQ ID NO: 766181 - RNA, 19 nt, Homo sapiens
gaggagagccgcagcguua

SEQ ID NO: 766182 - RNA, 19 nt, Homo sapiens
gcucuccgcuuguggauaa

SEQ ID NO: 766183 - RNA, 19 nt, Homo sapiens
auaacuagcugcugguuga

SEQ ID NO: 766184 - RNA, 19 nt, Homo sapiens
aaaggaugcugcuguugaa

SEQ ID NO: 766185 - RNA, 19 nt, Homo sapiens
cgagaacgacaucgacaua

SEQ ID NO: 766186 - RNA, 19 nt, Homo sapiens
uaaaggaugcugcuguuga

SEQ ID NO: 766187 - RNA, 19 nt, Homo sapiens
gaacgacaucgacauagug

SEQ ID NO: 766188 - RNA, 19 nt, Homo sapiens
gcacuaugacucuggaaga

SEQ ID NO: 766189 - RNA, 19 nt, Homo sapiens
ucuaaaggaugcugcuguu

SEQ ID NO: 766190 - RNA, 19 nt, Homo sapiens
gcugaggacucugcaagug

SEQ ID NO: 766191 - RNA, 19 nt, Homo sapiens
gaugcagggugccgggaaa

SEQ ID NO: 766192 - RNA, 19 nt, Homo sapiens
ggagaagcucagccuguuu

SEQ ID NO: 766193 - RNA, 19 nt, Homo sapiens
cgagucagccaaagucuug

SEQ ID NO: 766194 - RNA, 19 nt, Homo sapiens
ggacacaguuccggaaagc

SEQ ID NO: 766195 - RNA, 19 nt, Homo sapiens
uggagaagcucagccuguu

SEQ ID NO: 766196 - RNA, 19 nt, Homo sapiens
gaaagcgcugcaugaguug

SEQ ID NO: 766197 - RNA, 19 nt, Homo sapiens
agaacgacaucgacauagu

SEQ ID NO: 766198 - RNA, 19 nt, Homo sapiens
gcaaugcuucguuuucuaa

SEQ ID NO: 766199 - RNA, 19 nt, Homo sapiens
cacuaugacucuggaagaa

SEQ ID NO: 766200 - RNA, 19 nt, Homo sapiens
uuacgcugauccaggcuuu

SEQ ID NO: 766201 - RNA, 19 nt, Homo sapiens
gcugguugaucgcacuaug

SEQ ID NO: 766202 - RNA, 19 nt, Homo sapiens
ucaggagcgugaaggacuu

SEQ ID NO: 766203 - RNA, 19 nt, Homo sapiens
cuaugacucuggaagaagu

SEQ ID NO: 766204 - RNA, 19 nt, Homo sapiens
gcuguugaagcuuugaauu

SEQ ID NO: 766205 - RNA, 19 nt, Homo sapiens
ggaugcugcuguugaagcu

SEQ ID NO: 766206 - RNA, 19 nt, Homo sapiens
ccaacgaggacgccuggaa

SEQ ID NO: 766207 - RNA, 19 nt, Homo sapiens
gaacguggaccccgacaau

SEQ ID NO: 766208 - RNA, 19 nt, Homo sapiens
cagccaaagucuugaacgu

SEQ ID NO: 766209 - RNA, 19 nt, Homo sapiens
cuguugaagcuuugaauuu

SEQ ID NO: 766210 - RNA, 19 nt, Homo sapiens
gagaagcucagccuguuuu

SEQ ID NO: 766211 - RNA, 19 nt, Homo sapiens
cgacaucgcgcugcagauc

SEQ ID NO: 766212 - RNA, 19 nt, Homo sapiens
gggaaagcgcugcaugagu

SEQ ID NO: 766213 - RNA, 19 nt, Homo sapiens
gagaacgacaucgacauag

SEQ ID NO: 766214 - RNA, 19 nt, Homo sapiens
augcugcuguugaagcuuu

SEQ ID NO: 766215 - RNA, 19 nt, Homo sapiens
gcccuggacuugguacagu

SEQ ID NO: 766216 - RNA, 19 nt, Homo sapiens
aaacggauccgggcaaugc

SEQ ID NO: 766217 - RNA, 19 nt, Homo sapiens
gcacugcauccucauuucg

SEQ ID NO: 766218 - RNA, 19 nt, Homo sapiens
acaaugugaccuucugugu

SEQ ID NO: 766219 - RNA, 19 nt, Homo sapiens
ccgacaaugugaccuucug

SEQ ID NO: 766220 - RNA, 19 nt, Homo sapiens
gagcucuggcugucagugu

SEQ ID NO: 766221 - RNA, 19 nt, Homo sapiens
ccgggaaagcgcugcauga

SEQ ID NO: 766222 - RNA, 19 nt, Homo sapiens
ggauaacuagcugcugguu

SEQ ID NO: 766223 - RNA, 19 nt, Homo sapiens
guaaauaucuacucacuca

SEQ ID NO: 766224 - RNA, 19 nt, Homo sapiens
ccacggagcugccauuuga

SEQ ID NO: 766225 - RNA, 19 nt, Homo sapiens
guaccugacuuucuucaua

SEQ ID NO: 766226 - RNA, 19 nt, Homo sapiens
agaagcagcucaaacauuu

SEQ ID NO: 766227 - RNA, 19 nt, Homo sapiens
caaaggaggcuaccagaua

SEQ ID NO: 766228 - RNA, 19 nt, Homo sapiens
guagucagcuguaauuaga

SEQ ID NO: 766229 - RNA, 19 nt, Homo sapiens
gagaaaugaugacuuccua

SEQ ID NO: 766230 - RNA, 19 nt, Homo sapiens
gaaggacacagcaauuuaa

SEQ ID NO: 766231 - RNA, 19 nt, Homo sapiens
cacaauaacugcaaugguu

SEQ ID NO: 766232 - RNA, 19 nt, Homo sapiens
ccaaugagauguuaguuag

SEQ ID NO: 766233 - RNA, 19 nt, Homo sapiens
auaaugagguccugaauau

SEQ ID NO: 766234 - RNA, 19 nt, Homo sapiens
gaugguaccugacuuucuu

SEQ ID NO: 766235 - RNA, 19 nt, Homo sapiens
guggagauauucauaauuc

SEQ ID NO: 766236 - RNA, 19 nt, Homo sapiens
ugacagaagugaagaaucu

SEQ ID NO: 766237 - RNA, 19 nt, Homo sapiens
gcaaugguuugacauaaca

SEQ ID NO: 766238 - RNA, 19 nt, Homo sapiens
ggaaaugccaggccuuuga

SEQ ID NO: 766239 - RNA, 19 nt, Homo sapiens
cgagggagcuggcuucuag

SEQ ID NO: 766240 - RNA, 19 nt, Homo sapiens
gauggcaggucuguguuua

SEQ ID NO: 766241 - RNA, 19 nt, Homo sapiens
gaaaguggagcuauaggaa

SEQ ID NO: 766242 - RNA, 19 nt, Homo sapiens
cuucaaacauguaugagua

SEQ ID NO: 766243 - RNA, 19 nt, Homo sapiens
gaggucauccauauucuua

SEQ ID NO: 766244 - RNA, 19 nt, Homo sapiens
ggacauagaguaccugcuu

SEQ ID NO: 766245 - RNA, 19 nt, Homo sapiens
gcaggugaguuugcaauga

SEQ ID NO: 766246 - RNA, 19 nt, Homo sapiens
uuaacucacugaacaauga

SEQ ID NO: 766247 - RNA, 19 nt, Homo sapiens
caaggagccagacgaaaua

SEQ ID NO: 766248 - RNA, 19 nt, Homo sapiens
ggagcuggcuucuaguugu

SEQ ID NO: 766249 - RNA, 19 nt, Homo sapiens
gaagacagaaggaacguau

SEQ ID NO: 766250 - RNA, 19 nt, Homo sapiens
ggacucaaaugaaucaaac

SEQ ID NO: 766251 - RNA, 19 nt, Homo sapiens
ugaaggacacagcaauuua

SEQ ID NO: 766252 - RNA, 19 nt, Homo sapiens
aaaggaggcuaccagauau

SEQ ID NO: 766253 - RNA, 19 nt, Homo sapiens
ccacggcagagcuuaauua

SEQ ID NO: 766254 - RNA, 19 nt, Homo sapiens
guuaauacccuaugugguu

SEQ ID NO: 766255 - RNA, 19 nt, Homo sapiens
cagaaggaacguauguuua

SEQ ID NO: 766256 - RNA, 19 nt, Homo sapiens
gcagggagcggucaaggaa

SEQ ID NO: 766257 - RNA, 19 nt, Homo sapiens
guuaugggauucagaacaa

SEQ ID NO: 766258 - RNA, 19 nt, Homo sapiens
cggcagagcuuaauuaucc

SEQ ID NO: 766259 - RNA, 19 nt, Homo sapiens
uuagagaaaugaugacuuc

SEQ ID NO: 766260 - RNA, 19 nt, Homo sapiens
gcaaggacgaggagaagaa

SEQ ID NO: 766261 - RNA, 19 nt, Homo sapiens
acaaaccacuucacuggaa

SEQ ID NO: 766262 - RNA, 19 nt, Homo sapiens
gcaggucuguguuuauuac

SEQ ID NO: 766263 - RNA, 19 nt, Homo sapiens
uaacugcaaugguuugaca

SEQ ID NO: 766264 - RNA, 19 nt, Homo sapiens
gcaguagccaauuucauuu

SEQ ID NO: 766265 - RNA, 19 nt, Homo sapiens
cuacugggaugaugaagga

SEQ ID NO: 766266 - RNA, 19 nt, Homo sapiens
aagcugaccuccaacagaa

SEQ ID NO: 766267 - RNA, 19 nt, Homo sapiens
gguuuacccugcaagcuaa

SEQ ID NO: 766268 - RNA, 19 nt, Homo sapiens
gaaggaacguauguuuaca

SEQ ID NO: 766269 - RNA, 19 nt, Homo sapiens
cgagaagacuagccgaaug

SEQ ID NO: 766270 - RNA, 19 nt, Homo sapiens
gcuacuacaugcuggagaa

SEQ ID NO: 766271 - RNA, 19 nt, Homo sapiens
gacugaagcugaccuccaa

SEQ ID NO: 766272 - RNA, 19 nt, Homo sapiens
gauuuacucugacaagcuu

SEQ ID NO: 766273 - RNA, 19 nt, Homo sapiens
aaugagguccugaauauuu

SEQ ID NO: 766274 - RNA, 19 nt, Homo sapiens
gccaaugagauguuaguua

SEQ ID NO: 766275 - RNA, 19 nt, Homo sapiens
aaacauguaugaguaguca

SEQ ID NO: 766276 - RNA, 19 nt, Homo sapiens
aaccaaagauaaaggacua

SEQ ID NO: 766277 - RNA, 19 nt, Homo sapiens
uuagggagcuauuccuuau

SEQ ID NO: 766278 - RNA, 19 nt, Homo sapiens
guacaagucuguuaauacc

SEQ ID NO: 766279 - RNA, 19 nt, Homo sapiens
ugaagaagcagcucaaaca

SEQ ID NO: 766280 - RNA, 19 nt, Homo sapiens
aggccugucuuccaauuua

SEQ ID NO: 766281 - RNA, 19 nt, Homo sapiens
caacaagucagccgggauu

SEQ ID NO: 766282 - RNA, 19 nt, Homo sapiens
cgagaaggaugaauuugag

SEQ ID NO: 766283 - RNA, 19 nt, Homo sapiens
gaagcugaccuccaacaga

SEQ ID NO: 766284 - RNA, 19 nt, Homo sapiens
acagugaagucuuaauugu

SEQ ID NO: 766285 - RNA, 19 nt, Homo sapiens
cauaaugagguccugaaua

SEQ ID NO: 766286 - RNA, 19 nt, Homo sapiens
aaaagaaaguggagcuaua

SEQ ID NO: 766287 - RNA, 19 nt, Homo sapiens
gaaaugaugacuuccuaag

SEQ ID NO: 766288 - RNA, 19 nt, Homo sapiens
gccuuccacuucagucuua

SEQ ID NO: 766289 - RNA, 19 nt, Homo sapiens
gcauuguucuuggcauauu

SEQ ID NO: 766290 - RNA, 19 nt, Homo sapiens
gauguuaguuagugauucu

SEQ ID NO: 766291 - RNA, 19 nt, Homo sapiens
aauaaggccugucuuccaa

SEQ ID NO: 766292 - RNA, 19 nt, Homo sapiens
guccuugugugcagacaua

SEQ ID NO: 766293 - RNA, 19 nt, Homo sapiens
cagcaaagcccaccaagag

SEQ ID NO: 766294 - RNA, 19 nt, Homo sapiens
gacagcaacuccagcaaag

SEQ ID NO: 766295 - RNA, 19 nt, Homo sapiens
ucaagagcaucuaagacuu

SEQ ID NO: 766296 - RNA, 19 nt, Homo sapiens
gugaauggccuuccacuuc

SEQ ID NO: 766297 - RNA, 19 nt, Homo sapiens
ggucugcacuacaugugaa

SEQ ID NO: 766298 - RNA, 19 nt, Homo sapiens
ggucauccauauucuuaca

SEQ ID NO: 766299 - RNA, 19 nt, Homo sapiens
gagccgggauacuuucaga

SEQ ID NO: 766300 - RNA, 19 nt, Homo sapiens
uaaggccugucuuccaauu

SEQ ID NO: 766301 - RNA, 19 nt, Homo sapiens
gagaacagaccgaggaaca

SEQ ID NO: 766302 - RNA, 19 nt, Homo sapiens
cugacaagcuuuagccuau

SEQ ID NO: 766303 - RNA, 19 nt, Homo sapiens
cgaaauaaggccugucuuc

SEQ ID NO: 766304 - RNA, 19 nt, Homo sapiens
gaacagaccgaggaacauc

SEQ ID NO: 766305 - RNA, 19 nt, Homo sapiens
gacaagcuuuagccuaugu

SEQ ID NO: 766306 - RNA, 19 nt, Homo sapiens
aacaugggauuuacucuga

SEQ ID NO: 766307 - RNA, 19 nt, Homo sapiens
cauuguucuuggcauauua

SEQ ID NO: 766308 - RNA, 19 nt, Homo sapiens
aaacucagacuuggcauuu

SEQ ID NO: 766309 - RNA, 19 nt, Homo sapiens
ucaaggagccagacgaaau

SEQ ID NO: 766310 - RNA, 19 nt, Homo sapiens
uagccuauguuaugggauu

SEQ ID NO: 766311 - RNA, 19 nt, Homo sapiens
uaauuagacugcaaauguc

SEQ ID NO: 766312 - RNA, 19 nt, Homo sapiens
augagguccugaauauuua

SEQ ID NO: 766313 - RNA, 19 nt, Homo sapiens
gguauuauuucagguuuag

SEQ ID NO: 766314 - RNA, 19 nt, Homo sapiens
cgucaaacaagcugaauga

SEQ ID NO: 766315 - RNA, 19 nt, Homo sapiens
gaaucuggucccugucuuu

SEQ ID NO: 766316 - RNA, 19 nt, Homo sapiens
cagacaacguggugauguu

SEQ ID NO: 766317 - RNA, 19 nt, Homo sapiens
agugaagucuuaauuguca

SEQ ID NO: 766318 - RNA, 19 nt, Homo sapiens
gggagcuauuccuuauaua

SEQ ID NO: 766319 - RNA, 19 nt, Homo sapiens
uggcaggucuguguuuauu

SEQ ID NO: 766320 - RNA, 19 nt, Homo sapiens
cagugugguuuguccauuu

SEQ ID NO: 766321 - RNA, 19 nt, Homo sapiens
ucacuucaaacauguauga

SEQ ID NO: 766322 - RNA, 19 nt, Homo sapiens
uuacaggccuuccagucaa

SEQ ID NO: 766323 - RNA, 19 nt, Homo sapiens
caucaacucuuguacauaa

SEQ ID NO: 766324 - RNA, 19 nt, Homo sapiens
gaaauuacaggaagaagua

SEQ ID NO: 766325 - RNA, 19 nt, Homo sapiens
gcaauagcaucaacucuug

SEQ ID NO: 766326 - RNA, 19 nt, Homo sapiens
gaaacuaauugagacauug

SEQ ID NO: 766327 - RNA, 19 nt, Homo sapiens
gagacugacugcguacuua

SEQ ID NO: 766328 - RNA, 19 nt, Homo sapiens
gacaauuccugaagauuug

SEQ ID NO: 766329 - RNA, 19 nt, Homo sapiens
acacagggaucacaacaaa

SEQ ID NO: 766330 - RNA, 19 nt, Homo sapiens
cagaagcacuauggcauua

SEQ ID NO: 766331 - RNA, 19 nt, Homo sapiens
ucugagagcuaucaaacua

SEQ ID NO: 766332 - RNA, 19 nt, Homo sapiens
gauuaggagugcauacaaa

SEQ ID NO: 766333 - RNA, 19 nt, Homo sapiens
guacuuacacagaaacuaa

SEQ ID NO: 766334 - RNA, 19 nt, Homo sapiens
gguaaccgaugaaauuuua

SEQ ID NO: 766335 - RNA, 19 nt, Homo sapiens
gcagacaauuccugaagau

SEQ ID NO: 766336 - RNA, 19 nt, Homo sapiens
gauuagcacugcagacaau

SEQ ID NO: 766337 - RNA, 19 nt, Homo sapiens
uaccaaacauugacaacuu

SEQ ID NO: 766338 - RNA, 19 nt, Homo sapiens
caggguaaccgaugaaauu

SEQ ID NO: 766339 - RNA, 19 nt, Homo sapiens
uuuaagagcuguugaagag

SEQ ID NO: 766340 - RNA, 19 nt, Homo sapiens
agacaauuccugaagauuu

SEQ ID NO: 766341 - RNA, 19 nt, Homo sapiens
acacagaaacuaauugaga

SEQ ID NO: 766342 - RNA, 19 nt, Homo sapiens
ggcauuacuucuccuauca

SEQ ID NO: 766343 - RNA, 19 nt, Homo sapiens
aaacacaaccgccacagaa

SEQ ID NO: 766344 - RNA, 19 nt, Homo sapiens
acgaugccguuuccaguua

SEQ ID NO: 766345 - RNA, 19 nt, Homo sapiens
gaugggauagagauugaua

SEQ ID NO: 766346 - RNA, 19 nt, Homo sapiens
gaaaucagugaaagcaaga

SEQ ID NO: 766347 - RNA, 19 nt, Homo sapiens
ugagagcuaucaaacuaug

SEQ ID NO: 766348 - RNA, 19 nt, Homo sapiens
gagaugacagucugcuaaa

SEQ ID NO: 766349 - RNA, 19 nt, Homo sapiens
cgagaugacagucugcuaa

SEQ ID NO: 766350 - RNA, 19 nt, Homo sapiens
gcauucguaccaguuauua

SEQ ID NO: 766351 - RNA, 19 nt, Homo sapiens
gaaggaggagaagcgcuua

SEQ ID NO: 766352 - RNA, 19 nt, Homo sapiens
gaagcacuauggcauuacu

SEQ ID NO: 766353 - RNA, 19 nt, Homo sapiens
gaacuugccagcuuuaucc

SEQ ID NO: 766354 - RNA, 19 nt, Homo sapiens
auugacaacuucagguuaa

SEQ ID NO: 766355 - RNA, 19 nt, Homo sapiens
gccacaacaucuauuccaa

SEQ ID NO: 766356 - RNA, 19 nt, Homo sapiens
ccaaacgccacaacaucua

SEQ ID NO: 766357 - RNA, 19 nt, Homo sapiens
caucuaguaccaaacauug

SEQ ID NO: 766358 - RNA, 19 nt, Homo sapiens
uacaaaaggugcugauauu

SEQ ID NO: 766359 - RNA, 19 nt, Homo sapiens
gggauagagauugauauuu

SEQ ID NO: 766360 - RNA, 19 nt, Homo sapiens
gaggcauucguaccaguua

SEQ ID NO: 766361 - RNA, 19 nt, Homo sapiens
caacacagggaucacaaca

SEQ ID NO: 766362 - RNA, 19 nt, Homo sapiens
caaaaggugcugauauuga

SEQ ID NO: 766363 - RNA, 19 nt, Homo sapiens
ggagacugacugcguacuu

SEQ ID NO: 766364 - RNA, 19 nt, Homo sapiens
gcaucaacucuuguacaua

SEQ ID NO: 766365 - RNA, 19 nt, Homo sapiens
gcgcaggauuuuaauuuug

SEQ ID NO: 766366 - RNA, 19 nt, Homo sapiens
cuugccagcuuuauccaaa

SEQ ID NO: 766367 - RNA, 19 nt, Homo sapiens
cauugacaacuucagguua

SEQ ID NO: 766368 - RNA, 19 nt, Homo sapiens
caaacacaaccgccacaga

SEQ ID NO: 766369 - RNA, 19 nt, Homo sapiens
cuuaacgguugcaggguaa

SEQ ID NO: 766370 - RNA, 19 nt, Homo sapiens
aaagaguggauacgagaaa

SEQ ID NO: 766371 - RNA, 19 nt, Homo sapiens
ccacaacaucuauuccaau

SEQ ID NO: 766372 - RNA, 19 nt, Homo sapiens
gacgaugccguuuccaguu

SEQ ID NO: 766373 - RNA, 19 nt, Homo sapiens
uugaugggauagagauuga

SEQ ID NO: 766374 - RNA, 19 nt, Homo sapiens
gaaucuuccacaaucugua

SEQ ID NO: 766375 - RNA, 19 nt, Homo sapiens
gauacgagaaaucagugaa

SEQ ID NO: 766376 - RNA, 19 nt, Homo sapiens
caaacgccacaacaucuau

SEQ ID NO: 766377 - RNA, 19 nt, Homo sapiens
ugaaaauguuggaggaaaa

SEQ ID NO: 766378 - RNA, 19 nt, Homo sapiens
gcaccaagacauguugauc

SEQ ID NO: 766379 - RNA, 19 nt, Homo sapiens
gagaaaucagugaaagcaa

SEQ ID NO: 766380 - RNA, 19 nt, Homo sapiens
cgagaaaucagugaaagca

SEQ ID NO: 766381 - RNA, 19 nt, Homo sapiens
ggccaaacgccacaacauc

SEQ ID NO: 766382 - RNA, 19 nt, Homo sapiens
acagggaucacaacaaaca

SEQ ID NO: 766383 - RNA, 19 nt, Homo sapiens
uuacuucuccuaucagcuu

SEQ ID NO: 766384 - RNA, 19 nt, Homo sapiens
ggaggagaagcgcuuaaag

SEQ ID NO: 766385 - RNA, 19 nt, Homo sapiens
gcaggguaaccgaugaaau

SEQ ID NO: 766386 - RNA, 19 nt, Homo sapiens
guugcaggguaaccgauga

SEQ ID NO: 766387 - RNA, 19 nt, Homo sapiens
gaguggauacgagaaauca

SEQ ID NO: 766388 - RNA, 19 nt, Homo sapiens
cugcguacuuacacagaaa

SEQ ID NO: 766389 - RNA, 19 nt, Homo sapiens
gccaaacgccacaacaucu

SEQ ID NO: 766390 - RNA, 19 nt, Homo sapiens
ugggauagagauugauauu

SEQ ID NO: 766391 - RNA, 19 nt, Homo sapiens
ugaaauuacaggaagaagu

SEQ ID NO: 766392 - RNA, 19 nt, Homo sapiens
aaaaggugcugauauugau

SEQ ID NO: 766393 - RNA, 19 nt, Homo sapiens
aaucuuccacaaucuguaa

SEQ ID NO: 766394 - RNA, 19 nt, Homo sapiens
uggcauuacuucuccuauc

SEQ ID NO: 766395 - RNA, 19 nt, Homo sapiens
acagaagcacuauggcauu

SEQ ID NO: 766396 - RNA, 19 nt, Homo sapiens
uuacaucuaguaccaaaca

SEQ ID NO: 766397 - RNA, 19 nt, Homo sapiens
ugaagaggcauucguacca

SEQ ID NO: 766398 - RNA, 19 nt, Homo sapiens
aauagcaucaacucuugua

SEQ ID NO: 766399 - RNA, 19 nt, Homo sapiens
ugcagacaauuccugaaga

SEQ ID NO: 766400 - RNA, 19 nt, Homo sapiens
ugauauugaugcguugugu

SEQ ID NO: 766401 - RNA, 19 nt, Homo sapiens
auugaugcguuguguguug

SEQ ID NO: 766402 - RNA, 19 nt, Homo sapiens
ucagugaaagcaagaaucu

SEQ ID NO: 766403 - RNA, 19 nt, Homo sapiens
ggauacgagaaaucaguga

SEQ ID NO: 766404 - RNA, 19 nt, Homo sapiens
ugcaauagcaucaacucuu

SEQ ID NO: 766405 - RNA, 19 nt, Homo sapiens
uuccugggcuaugcuagua

SEQ ID NO: 766406 - RNA, 19 nt, Homo sapiens
gcacuauggcauuacuucu

SEQ ID NO: 766407 - RNA, 19 nt, Homo sapiens
ggcauucguaccaguuauu

SEQ ID NO: 766408 - RNA, 19 nt, Homo sapiens
accaagacauguugaucga

SEQ ID NO: 766409 - RNA, 19 nt, Homo sapiens
guuguguguugcaccaaga

SEQ ID NO: 766410 - RNA, 19 nt, Homo sapiens
gcuuuauccaaaugcaaua

SEQ ID NO: 766411 - RNA, 19 nt, Homo sapiens
gggaucacaacaaacacaa

SEQ ID NO: 766412 - RNA, 19 nt, Homo sapiens
cagcgcaggauuuuaauuu

SEQ ID NO: 766413 - RNA, 19 nt, Homo sapiens
agcaucaacucuuguacau

SEQ ID NO: 766414 - RNA, 19 nt, Homo sapiens
uacgagaaaucagugaaag

SEQ ID NO: 766415 - RNA, 19 nt, Homo sapiens
gggccaaacgccacaacau

SEQ ID NO: 766416 - RNA, 19 nt, Homo sapiens
accaaacauugacaacuuc

SEQ ID NO: 766417 - RNA, 19 nt, Homo sapiens
auacgagaaaucagugaaa

SEQ ID NO: 766418 - RNA, 19 nt, Homo sapiens
aagaguggauacgagaaau

SEQ ID NO: 766419 - RNA, 19 nt, Homo sapiens
gaaagaagcugccauggaa

SEQ ID NO: 766420 - RNA, 19 nt, Homo sapiens
gaaccacggucauaacuaa

SEQ ID NO: 766421 - RNA, 19 nt, Homo sapiens
gaagagagacgauaauaaa

SEQ ID NO: 766422 - RNA, 19 nt, Homo sapiens
ggagaugacugaagaagaa

SEQ ID NO: 766423 - RNA, 19 nt, Homo sapiens
gaacagaacacuuuggaaa

SEQ ID NO: 766424 - RNA, 19 nt, Homo sapiens
gaagauccucgauguauua

SEQ ID NO: 766425 - RNA, 19 nt, Homo sapiens
gaugaaacuucugcaauua

SEQ ID NO: 766426 - RNA, 19 nt, Homo sapiens
ggaugaaacuucugcaauu

SEQ ID NO: 766427 - RNA, 19 nt, Homo sapiens
ggucauaacuaacauguug

SEQ ID NO: 766428 - RNA, 19 nt, Homo sapiens
cauggaagcugaaauuaaa

SEQ ID NO: 766429 - RNA, 19 nt, Homo sapiens
gaccgagucuuguuguuua

SEQ ID NO: 766430 - RNA, 19 nt, Homo sapiens
gagaagccuuguuuaauga

SEQ ID NO: 766431 - RNA, 19 nt, Homo sapiens
ucaaagcucuucugucuga

SEQ ID NO: 766432 - RNA, 19 nt, Homo sapiens
agaaauagaucgagagaga

SEQ ID NO: 766433 - RNA, 19 nt, Homo sapiens
gcaauuaccuuaacaucca

SEQ ID NO: 766434 - RNA, 19 nt, Homo sapiens
cgagaagccuuguuuaaug

SEQ ID NO: 766435 - RNA, 19 nt, Homo sapiens
caacagcaguuucugaaug

SEQ ID NO: 766436 - RNA, 19 nt, Homo sapiens
acagaacacuuuggaaaua

SEQ ID NO: 766437 - RNA, 19 nt, Homo sapiens
guaaacugauuguggcaua

SEQ ID NO: 766438 - RNA, 19 nt, Homo sapiens
ggaagauccucgauguauu

SEQ ID NO: 766439 - RNA, 19 nt, Homo sapiens
ucacuuacgugcuuugauu

SEQ ID NO: 766440 - RNA, 19 nt, Homo sapiens
gaccagaggugagaagauu

SEQ ID NO: 766441 - RNA, 19 nt, Homo sapiens
gagaaggaguugcacaaga

SEQ ID NO: 766442 - RNA, 19 nt, Homo sapiens
aagaagcuauccagaauuu

SEQ ID NO: 766443 - RNA, 19 nt, Homo sapiens
ggaagagagacgauaauaa

SEQ ID NO: 766444 - RNA, 19 nt, Homo sapiens
ggagaggcguaaacugauu

SEQ ID NO: 766445 - RNA, 19 nt, Homo sapiens
gaggagauauggguugaaa

SEQ ID NO: 766446 - RNA, 19 nt, Homo sapiens
gaaaccaucugacaaacag

SEQ ID NO: 766447 - RNA, 19 nt, Homo sapiens
gaggagaggcguaaacuga

SEQ ID NO: 766448 - RNA, 19 nt, Homo sapiens
gaagaaagagaaagaagau

SEQ ID NO: 766449 - RNA, 19 nt, Homo sapiens
agaagaagcuauccagaau

SEQ ID NO: 766450 - RNA, 19 nt, Homo sapiens
ggacaauacuuuuaccuuu

SEQ ID NO: 766451 - RNA, 19 nt, Homo sapiens
gagaagaagcuauccagaa

SEQ ID NO: 766452 - RNA, 19 nt, Homo sapiens
gagaagaccuuuucaaaca

SEQ ID NO: 766453 - RNA, 19 nt, Homo sapiens
ugacaaacgguaucuagua

SEQ ID NO: 766454 - RNA, 19 nt, Homo sapiens
cagaugggaagacauauua

SEQ ID NO: 766455 - RNA, 19 nt, Homo sapiens
cagaugggaagguuuauua

SEQ ID NO: 766456 - RNA, 19 nt, Homo sapiens
gcaagaaguaagagcauuu

SEQ ID NO: 766457 - RNA, 19 nt, Homo sapiens
gauccucgauguauuaagu

SEQ ID NO: 766458 - RNA, 19 nt, Homo sapiens
ggaacaagaauuaauggaa

SEQ ID NO: 766459 - RNA, 19 nt, Homo sapiens
ggaccgaccugaugaucug

SEQ ID NO: 766460 - RNA, 19 nt, Homo sapiens
gaugugucauggucugaua

SEQ ID NO: 766461 - RNA, 19 nt, Homo sapiens
gagcgggucuucuuuuaua

SEQ ID NO: 766462 - RNA, 19 nt, Homo sapiens
ggaagaaagagaaagaaga

SEQ ID NO: 766463 - RNA, 19 nt, Homo sapiens
auaaagacauugacucaga

SEQ ID NO: 766464 - RNA, 19 nt, Homo sapiens
guuaauacaugcaagaagu

SEQ ID NO: 766465 - RNA, 19 nt, Homo sapiens
uauaggcugucucuaguaa

SEQ ID NO: 766466 - RNA, 19 nt, Homo sapiens
gcuaaagauucaagauuca

SEQ ID NO: 766467 - RNA, 19 nt, Homo sapiens
aagaagagccuauaaagga

SEQ ID NO: 766468 - RNA, 19 nt, Homo sapiens
ccagauggaguuaagguua

SEQ ID NO: 766469 - RNA, 19 nt, Homo sapiens
cugggaaucuggauccuua

SEQ ID NO: 766470 - RNA, 19 nt, Homo sapiens
gaacacauugaagcacuua

SEQ ID NO: 766471 - RNA, 19 nt, Homo sapiens
gaagcuauccagaauuuca

SEQ ID NO: 766472 - RNA, 19 nt, Homo sapiens
aauuaaagcugcccgagaa

SEQ ID NO: 766473 - RNA, 19 nt, Homo sapiens
gcaaugaugcaaauaguca

SEQ ID NO: 766474 - RNA, 19 nt, Homo sapiens
aagaggagaugacugaaga

SEQ ID NO: 766475 - RNA, 19 nt, Homo sapiens
ccagaggcuacaauuauua

SEQ ID NO: 766476 - RNA, 19 nt, Homo sapiens
gaaggagaagcauuuguga

SEQ ID NO: 766477 - RNA, 19 nt, Homo sapiens
gauucaagauucaaagcaa

SEQ ID NO: 766478 - RNA, 19 nt, Homo sapiens
gaaggaguugcacaagaua

SEQ ID NO: 766479 - RNA, 19 nt, Homo sapiens
gaauggaggaauugaagaa

SEQ ID NO: 766480 - RNA, 19 nt, Homo sapiens
uaaaggaggagcccaaaga

SEQ ID NO: 766481 - RNA, 19 nt, Homo sapiens
uuaaagaacccucugaaga

SEQ ID NO: 766482 - RNA, 19 nt, Homo sapiens
ugacugacauacauacuca

SEQ ID NO: 766483 - RNA, 19 nt, Homo sapiens
gaagaagcuauccagaauu

SEQ ID NO: 766484 - RNA, 19 nt, Homo sapiens
ccaagaauuuagacucaga

SEQ ID NO: 766485 - RNA, 19 nt, Homo sapiens
cagggcagauguugacaaa

SEQ ID NO: 766486 - RNA, 19 nt, Homo sapiens
uaaagaagagccuauaaag

SEQ ID NO: 766487 - RNA, 19 nt, Homo sapiens
cagcagaugggaagacaua

SEQ ID NO: 766488 - RNA, 19 nt, Homo sapiens
cugaauggacugaauauaa

SEQ ID NO: 766489 - RNA, 19 nt, Homo sapiens
gacguuaccuccugcuguu

SEQ ID NO: 766490 - RNA, 19 nt, Homo sapiens
gaaucuggauccuuauugg

SEQ ID NO: 766491 - RNA, 19 nt, Homo sapiens
gaaaggcaagcccgcauug

SEQ ID NO: 766492 - RNA, 19 nt, Homo sapiens
ucaaggacaugcugcuaga

SEQ ID NO: 766493 - RNA, 19 nt, Homo sapiens
aguaauuucuucucaggua

SEQ ID NO: 766494 - RNA, 19 nt, Homo sapiens
gagaaaacacugaaaauug

SEQ ID NO: 766495 - RNA, 19 nt, Homo sapiens
ggagaagcauuugugaaca

SEQ ID NO: 766496 - RNA, 19 nt, Homo sapiens
uuaggcaacuucuggauga

SEQ ID NO: 766497 - RNA, 19 nt, Homo sapiens
uuucaaagcucuucugucu

SEQ ID NO: 766498 - RNA, 19 nt, Homo sapiens
agaaggaguugcacaagau

SEQ ID NO: 766499 - RNA, 19 nt, Homo sapiens
gcacccaacuccgacaaug

SEQ ID NO: 766500 - RNA, 19 nt, Homo sapiens
aagcauuugugaacaguuu

SEQ ID NO: 766501 - RNA, 19 nt, Homo sapiens
gacaaacgguaucuaguac

SEQ ID NO: 766502 - RNA, 19 nt, Homo sapiens
uaccuuagcuggagcaaca

SEQ ID NO: 766503 - RNA, 19 nt, Homo sapiens
caaacgguaucuaguacug

SEQ ID NO: 766504 - RNA, 19 nt, Homo sapiens
ccacucgucuuucuaugug

SEQ ID NO: 766505 - RNA, 19 nt, Homo sapiens
cuaaagaagagccuauaaa

SEQ ID NO: 766506 - RNA, 19 nt, Homo sapiens
gcagaugggaagacauauu

SEQ ID NO: 766507 - RNA, 19 nt, Homo sapiens
gaugggaagguuuauuauu

SEQ ID NO: 766508 - RNA, 19 nt, Homo sapiens
cacaacaacugcuacuuca

SEQ ID NO: 766509 - RNA, 19 nt, Homo sapiens
ccuaagagaagauuuaugu

SEQ ID NO: 766510 - RNA, 19 nt, Homo sapiens
gauuauccccucugaauua

SEQ ID NO: 766511 - RNA, 19 nt, Homo sapiens
cagaacacuuuggaaauau

SEQ ID NO: 766512 - RNA, 19 nt, Homo sapiens
aaagagaggagaaagagaa

SEQ ID NO: 766513 - RNA, 19 nt, Homo sapiens
gagagacgauaauaaagac

SEQ ID NO: 766514 - RNA, 19 nt, Homo sapiens
gaugggaagacauauuauu

SEQ ID NO: 766515 - RNA, 19 nt, Homo sapiens
gaaaauaaaacuccagaug

SEQ ID NO: 766516 - RNA, 19 nt, Homo sapiens
caagcaugcuaaagauuca

SEQ ID NO: 766517 - RNA, 19 nt, Homo sapiens
ccauggaagcugaaauuaa

SEQ ID NO: 766518 - RNA, 19 nt, Homo sapiens
gagcaacagcaguuucuga

SEQ ID NO: 766519 - RNA, 19 nt, Homo sapiens
ugaagaagcucaucacuga

SEQ ID NO: 766520 - RNA, 19 nt, Homo sapiens
ggacgaggcucagcucuug

SEQ ID NO: 766521 - RNA, 19 nt, Homo sapiens
ugaaggacaucaucaaaga

SEQ ID NO: 766522 - RNA, 19 nt, Homo sapiens
gaugaaaguccucaaguuu

SEQ ID NO: 766523 - RNA, 19 nt, Homo sapiens
aaagaaggaucccaaggaa

SEQ ID NO: 766524 - RNA, 19 nt, Homo sapiens
gaccgccacucucacauuu

SEQ ID NO: 766525 - RNA, 19 nt, Homo sapiens
gauacaucauucacucuuu

SEQ ID NO: 766526 - RNA, 19 nt, Homo sapiens
gagaagguauuugggauuc

SEQ ID NO: 766527 - RNA, 19 nt, Homo sapiens
gcucggacaugcugaagga

SEQ ID NO: 766528 - RNA, 19 nt, Homo sapiens
agacgaagauucccaucaa

SEQ ID NO: 766529 - RNA, 19 nt, Homo sapiens
gaaguugacacucugcauu

SEQ ID NO: 766530 - RNA, 19 nt, Homo sapiens
gaagguauuugggauucaa

SEQ ID NO: 766531 - RNA, 19 nt, Homo sapiens
agaaguaccuggacuaugc

SEQ ID NO: 766532 - RNA, 19 nt, Homo sapiens
ugaaguaccuuuuggcuaa

SEQ ID NO: 766533 - RNA, 19 nt, Homo sapiens
caagggagggcaaaugauu

SEQ ID NO: 766534 - RNA, 19 nt, Homo sapiens
ugauaagaaugaccacuug

SEQ ID NO: 766535 - RNA, 19 nt, Homo sapiens
ugacaaugccugccacuga

SEQ ID NO: 766536 - RNA, 19 nt, Homo sapiens
caauugaaguugacacucu

SEQ ID NO: 766537 - RNA, 19 nt, Homo sapiens
gagauuagagcucgaaugg

SEQ ID NO: 766538 - RNA, 19 nt, Homo sapiens
ggccugcgcucuuacuaug

SEQ ID NO: 766539 - RNA, 19 nt, Homo sapiens
cagccacuaucaaucaauu

SEQ ID NO: 766540 - RNA, 19 nt, Homo sapiens
gcucuucgcuggccuuggu

SEQ ID NO: 766541 - RNA, 19 nt, Homo sapiens
ggaaugggcagcucaguac

SEQ ID NO: 766542 - RNA, 19 nt, Homo sapiens
agaugaaaguccucaaguu

SEQ ID NO: 766543 - RNA, 19 nt, Homo sapiens
gauggaagcggauuugaag

SEQ ID NO: 766544 - RNA, 19 nt, Homo sapiens
ggagaagguauuugggauu

SEQ ID NO: 766545 - RNA, 19 nt, Homo sapiens
gaaggacaucaucaaagaa

SEQ ID NO: 766546 - RNA, 19 nt, Homo sapiens
agaaggaucccaaggaaug

SEQ ID NO: 766547 - RNA, 19 nt, Homo sapiens
gcucuugccaggccaaauu

SEQ ID NO: 766548 - RNA, 19 nt, Homo sapiens
cuaaagaccagacgaagau

SEQ ID NO: 766549 - RNA, 19 nt, Homo sapiens
gggaggugcugcgcaaguu

SEQ ID NO: 766550 - RNA, 19 nt, Homo sapiens
caaagaauacacugaugug

SEQ ID NO: 766551 - RNA, 19 nt, Homo sapiens
cgagaguggugcaggucua

SEQ ID NO: 766552 - RNA, 19 nt, Homo sapiens
gcuaaagaccagacgaaga

SEQ ID NO: 766553 - RNA, 19 nt, Homo sapiens
uaugagaccagcaagauga

SEQ ID NO: 766554 - RNA, 19 nt, Homo sapiens
ggacaucaucaaagaauac

SEQ ID NO: 766555 - RNA, 19 nt, Homo sapiens
gcugaaggacaucaucaaa

SEQ ID NO: 766556 - RNA, 19 nt, Homo sapiens
cagggugcauccucagaaa

SEQ ID NO: 766557 - RNA, 19 nt, Homo sapiens
ugaaaguccucaaguuugc

SEQ ID NO: 766558 - RNA, 19 nt, Homo sapiens
gagugcagcugcccagucu

SEQ ID NO: 766559 - RNA, 19 nt, Homo sapiens
gcagaaguaccuggacuau

SEQ ID NO: 766560 - RNA, 19 nt, Homo sapiens
auacaucauucacucuuug

SEQ ID NO: 766561 - RNA, 19 nt, Homo sapiens
gaggauggcagcagugauc

SEQ ID NO: 766562 - RNA, 19 nt, Homo sapiens
ucagaaaccuacucaacac

SEQ ID NO: 766563 - RNA, 19 nt, Homo sapiens
agcagaagcuaaagccaaa

SEQ ID NO: 766564 - RNA, 19 nt, Homo sapiens
gcccugggauacaucauuc

SEQ ID NO: 766565 - RNA, 19 nt, Homo sapiens
guauuugggauucaauuga

SEQ ID NO: 766566 - RNA, 19 nt, Homo sapiens
caaggucaaagccaagaaa

SEQ ID NO: 766567 - RNA, 19 nt, Homo sapiens
ugacagugacccagaaugu

SEQ ID NO: 766568 - RNA, 19 nt, Homo sapiens
ggaaauugauaagaaugac

SEQ ID NO: 766569 - RNA, 19 nt, Homo sapiens
aaguugacacucugcauua

SEQ ID NO: 766570 - RNA, 19 nt, Homo sapiens
gauccaggcgggagcagaa

SEQ ID NO: 766571 - RNA, 19 nt, Homo sapiens
ggauacaucauucacucuu

SEQ ID NO: 766572 - RNA, 19 nt, Homo sapiens
ucaaagaauacacugaugu

SEQ ID NO: 766573 - RNA, 19 nt, Homo sapiens
ucccugagaucaccuaaag

SEQ ID NO: 766574 - RNA, 19 nt, Homo sapiens
gcucgaugaugcagacucu

SEQ ID NO: 766575 - RNA, 19 nt, Homo sapiens
caagcugggucugcucaug

SEQ ID NO: 766576 - RNA, 19 nt, Homo sapiens
cagcugacaccaagaaaca

SEQ ID NO: 766577 - RNA, 19 nt, Homo sapiens
caacugggacgaagcugau

SEQ ID NO: 766578 - RNA, 19 nt, Homo sapiens
gggaacgacuaaggacuca

SEQ ID NO: 766579 - RNA, 19 nt, Homo sapiens
cugccaagcuccagucauc

SEQ ID NO: 766580 - RNA, 19 nt, Homo sapiens
auaagaaugaccacuugua

SEQ ID NO: 766581 - RNA, 19 nt, Homo sapiens
uugacacucugcauuaaau

SEQ ID NO: 766582 - RNA, 19 nt, Homo sapiens
cugaugaguuugugaagca

SEQ ID NO: 766583 - RNA, 19 nt, Homo sapiens
gguauuugggauucaauug

SEQ ID NO: 766584 - RNA, 19 nt, Homo sapiens
gacgaagauucccaucaag

SEQ ID NO: 766585 - RNA, 19 nt, Homo sapiens
cccgaaaggugaagcaucu

SEQ ID NO: 766586 - RNA, 19 nt, Homo sapiens
ggcgggagcagaagcuaaa

SEQ ID NO: 766587 - RNA, 19 nt, Homo sapiens
gagaguggugcaggucuaa

SEQ ID NO: 766588 - RNA, 19 nt, Homo sapiens
ggacaguagcucgaugaug

SEQ ID NO: 766589 - RNA, 19 nt, Homo sapiens
agaaugaccacuuguacau

SEQ ID NO: 766590 - RNA, 19 nt, Homo sapiens
uaagaaugaccacuuguac

SEQ ID NO: 766591 - RNA, 19 nt, Homo sapiens
gcacucgggaauuguagga

SEQ ID NO: 766592 - RNA, 19 nt, Homo sapiens
gaccacuuguacauucuuc

SEQ ID NO: 766593 - RNA, 19 nt, Homo sapiens
gcaagggagggcaaaugau

SEQ ID NO: 766594 - RNA, 19 nt, Homo sapiens
cgauggaagcggauuugaa

SEQ ID NO: 766595 - RNA, 19 nt, Homo sapiens
caagaugaaaguccucaag

SEQ ID NO: 766596 - RNA, 19 nt, Homo sapiens
gauaagaaugaccacuugu

SEQ ID NO: 766597 - RNA, 19 nt, Homo sapiens
aggacaucaucaaagaaua

SEQ ID NO: 766598 - RNA, 19 nt, Homo sapiens
gauggcagcagugaucaga

SEQ ID NO: 766599 - RNA, 19 nt, Homo sapiens
caggccaaauugagacaug

SEQ ID NO: 766600 - RNA, 19 nt, Homo sapiens
ccagugaggcugucaucug

SEQ ID NO: 766601 - RNA, 19 nt, Homo sapiens
ggcagccacuaucaaucaa

SEQ ID NO: 766602 - RNA, 19 nt, Homo sapiens
gcugacugauacccagguu

SEQ ID NO: 766603 - RNA, 19 nt, Homo sapiens
cuucuuagcaucaucuuca

SEQ ID NO: 766604 - RNA, 19 nt, Homo sapiens
gcugacaccaagaaacaga

SEQ ID NO: 766605 - RNA, 19 nt, Homo sapiens
guugacacucugcauuaaa

SEQ ID NO: 766606 - RNA, 19 nt, Homo sapiens
agacaccgaaggccucaaa

SEQ ID NO: 766607 - RNA, 19 nt, Homo sapiens
uggcagcagugaucagagu

SEQ ID NO: 766608 - RNA, 19 nt, Homo sapiens
uagcagcugacaccaagaa

SEQ ID NO: 766609 - RNA, 19 nt, Homo sapiens
acacucugcauuaaaucua

SEQ ID NO: 766610 - RNA, 19 nt, Homo sapiens
uggacgcacucgggaauug

SEQ ID NO: 766611 - RNA, 19 nt, Homo sapiens
ggaggugcugcgcaaguug

SEQ ID NO: 766612 - RNA, 19 nt, Homo sapiens
gcauacugggaacgacuaa

SEQ ID NO: 766613 - RNA, 19 nt, Homo sapiens
cuaggcagccacuaucaau

SEQ ID NO: 766614 - RNA, 19 nt, Homo sapiens
gccagucuuucucuucaag

SEQ ID NO: 766615 - RNA, 19 nt, Homo sapiens
cugcucauggugcuucuua

SEQ ID NO: 766616 - RNA, 19 nt, Homo sapiens
gacgcacucgggaauugua

SEQ ID NO: 766617 - RNA, 19 nt, Homo sapiens
gaaguaccuuuuggcuaaa

SEQ ID NO: 766618 - RNA, 19 nt, Homo sapiens
uacaaaggcucaggagacu

SEQ ID NO: 766619 - RNA, 19 nt, Homo sapiens
gagaagagauuuacaagga

SEQ ID NO: 766620 - RNA, 19 nt, Homo sapiens
gcacaguguuugcuaauga

SEQ ID NO: 766621 - RNA, 19 nt, Homo sapiens
ugacggagguauccaguua

SEQ ID NO: 766622 - RNA, 19 nt, Homo sapiens
gcuaagcgaucuugaacaa

SEQ ID NO: 766623 - RNA, 19 nt, Homo sapiens
ggaagaacaaugugacuuu

SEQ ID NO: 766624 - RNA, 19 nt, Homo sapiens
gaagaacaaugugacuuug

SEQ ID NO: 766625 - RNA, 19 nt, Homo sapiens
gaaucaugcuugcagguuu

SEQ ID NO: 766626 - RNA, 19 nt, Homo sapiens
ggaauagacucacauuagg

SEQ ID NO: 766627 - RNA, 19 nt, Homo sapiens
gagaagacccugcuuaaag

SEQ ID NO: 766628 - RNA, 19 nt, Homo sapiens
cuaagcagaugccacagua

SEQ ID NO: 766629 - RNA, 19 nt, Homo sapiens
agucacagcuuccagauga

SEQ ID NO: 766630 - RNA, 19 nt, Homo sapiens
gaccagucccuuauuuaua

SEQ ID NO: 766631 - RNA, 19 nt, Homo sapiens
gcacggacaggcagaauug

SEQ ID NO: 766632 - RNA, 19 nt, Homo sapiens
cacauuagguuuaguuugu

SEQ ID NO: 766633 - RNA, 19 nt, Homo sapiens
caaaugaccagucccuuau

SEQ ID NO: 766634 - RNA, 19 nt, Homo sapiens
gcgccuggcuucuauuuua

SEQ ID NO: 766635 - RNA, 19 nt, Homo sapiens
uuagggagcugaaguucuu

SEQ ID NO: 766636 - RNA, 19 nt, Homo sapiens
acaaaugaccagucccuua

SEQ ID NO: 766637 - RNA, 19 nt, Homo sapiens
cagagaagacccugcuuaa

SEQ ID NO: 766638 - RNA, 19 nt, Homo sapiens
guucccagauuuacgauga

SEQ ID NO: 766639 - RNA, 19 nt, Homo sapiens
gaacuggguaugugucaug

SEQ ID NO: 766640 - RNA, 19 nt, Homo sapiens
ugacaucguucaugaagag

SEQ ID NO: 766641 - RNA, 19 nt, Homo sapiens
gaccaucuccuucuucaau

SEQ ID NO: 766642 - RNA, 19 nt, Homo sapiens
gaucaacccacaggaauau

SEQ ID NO: 766643 - RNA, 19 nt, Homo sapiens
gggaagacugggaaucuaa

SEQ ID NO: 766644 - RNA, 19 nt, Homo sapiens
gcugucaucuguuuucaua

SEQ ID NO: 766645 - RNA, 19 nt, Homo sapiens
uuaaagagacaacgaaugu

SEQ ID NO: 766646 - RNA, 19 nt, Homo sapiens
aaugaccagucccuuauuu

SEQ ID NO: 766647 - RNA, 19 nt, Homo sapiens
aaagagacaacgaauguga

SEQ ID NO: 766648 - RNA, 19 nt, Homo sapiens
gcugcaggcuggacaggaa

SEQ ID NO: 766649 - RNA, 19 nt, Homo sapiens
gggcucacuuccucucauu

SEQ ID NO: 766650 - RNA, 19 nt, Homo sapiens
cggaauagacucacauuag

SEQ ID NO: 766651 - RNA, 19 nt, Homo sapiens
ucauuuccaucgugggaua

SEQ ID NO: 766652 - RNA, 19 nt, Homo sapiens
agaagacccugcuuaaagg

SEQ ID NO: 766653 - RNA, 19 nt, Homo sapiens
agaagagauuuacaaggaa

SEQ ID NO: 766654 - RNA, 19 nt, Homo sapiens
agacaacgaaugugaauca

SEQ ID NO: 766655 - RNA, 19 nt, Homo sapiens
acagagaagacccugcuua

SEQ ID NO: 766656 - RNA, 19 nt, Homo sapiens
gggaccaucuccuucuuca

SEQ ID NO: 766657 - RNA, 19 nt, Homo sapiens
ggagguauccaguuacucu

SEQ ID NO: 766658 - RNA, 19 nt, Homo sapiens
ggccugaccuccaaaucau

SEQ ID NO: 766659 - RNA, 19 nt, Homo sapiens
gagaucaacccacaggaau

SEQ ID NO: 766660 - RNA, 19 nt, Homo sapiens
cagcuggccugaccuccaa

SEQ ID NO: 766661 - RNA, 19 nt, Homo sapiens
gaauauccauggcuuuugu

SEQ ID NO: 766662 - RNA, 19 nt, Homo sapiens
gguauuggguccucagacu

SEQ ID NO: 766663 - RNA, 19 nt, Homo sapiens
ggaagcaccgacuggagaa

SEQ ID NO: 766664 - RNA, 19 nt, Homo sapiens
ugaccagucccuuauuuau

SEQ ID NO: 766665 - RNA, 19 nt, Homo sapiens
uaugggugcugguucaguu

SEQ ID NO: 766666 - RNA, 19 nt, Homo sapiens
ccaggcuccucauuugcua

SEQ ID NO: 766667 - RNA, 19 nt, Homo sapiens
uagacucacauuagguuua

SEQ ID NO: 766668 - RNA, 19 nt, Homo sapiens
gaauagacucacauuaggu

SEQ ID NO: 766669 - RNA, 19 nt, Homo sapiens
gugcagaggcuauggaagu

SEQ ID NO: 766670 - RNA, 19 nt, Homo sapiens
ucaggacaguggcaaguca

SEQ ID NO: 766671 - RNA, 19 nt, Homo sapiens
aaacuguaacccauagaaa

SEQ ID NO: 766672 - RNA, 19 nt, Homo sapiens
gcucugcguuucugaucug

SEQ ID NO: 766673 - RNA, 19 nt, Homo sapiens
aaucaugcuugcagguuug

SEQ ID NO: 766674 - RNA, 19 nt, Homo sapiens
gggucuuccuggacuauga

SEQ ID NO: 766675 - RNA, 19 nt, Homo sapiens
cauuagguuuaguuuguga

SEQ ID NO: 766676 - RNA, 19 nt, Homo sapiens
uuuauacccugcugacaug

SEQ ID NO: 766677 - RNA, 19 nt, Homo sapiens
ugguugacaucguucauga

SEQ ID NO: 766678 - RNA, 19 nt, Homo sapiens
cuucaaauccaaagggaaa

SEQ ID NO: 766679 - RNA, 19 nt, Homo sapiens
gcuccucauuugcuaguca

SEQ ID NO: 766680 - RNA, 19 nt, Homo sapiens
gauuaaagagacaacgaau

SEQ ID NO: 766681 - RNA, 19 nt, Homo sapiens
ggugaagauuaaagagaca

SEQ ID NO: 766682 - RNA, 19 nt, Homo sapiens
ggacgugggacaaaaugua

SEQ ID NO: 766683 - RNA, 19 nt, Homo sapiens
gaauuccucgacacuguug

SEQ ID NO: 766684 - RNA, 19 nt, Homo sapiens
ggaggugacucuggaucca

SEQ ID NO: 766685 - RNA, 19 nt, Homo sapiens
agacucacauuagguuuag

SEQ ID NO: 766686 - RNA, 19 nt, Homo sapiens
ugagaucaacccacaggaa

SEQ ID NO: 766687 - RNA, 19 nt, Homo sapiens
gugcgguucuucaggaauc

SEQ ID NO: 766688 - RNA, 19 nt, Homo sapiens
agagaagacccugcuuaaa

SEQ ID NO: 766689 - RNA, 19 nt, Homo sapiens
gcucacuuccucucauuuc

SEQ ID NO: 766690 - RNA, 19 nt, Homo sapiens
ccagcuaagcgaucuugaa

SEQ ID NO: 766691 - RNA, 19 nt, Homo sapiens
gaaaacuccauccagcuaa

SEQ ID NO: 766692 - RNA, 19 nt, Homo sapiens
gacaaaauguaggguggua

SEQ ID NO: 766693 - RNA, 19 nt, Homo sapiens
uccaagcagggaaacauua

SEQ ID NO: 766694 - RNA, 19 nt, Homo sapiens
cgacacuguuggccuacug

SEQ ID NO: 766695 - RNA, 19 nt, Homo sapiens
ugguucaguucccagauuu

SEQ ID NO: 766696 - RNA, 19 nt, Homo sapiens
ccucggacaucggccugua

SEQ ID NO: 766697 - RNA, 19 nt, Homo sapiens
ccuacugguugacaucguu

SEQ ID NO: 766698 - RNA, 19 nt, Homo sapiens
accagucccuuauuuauac

SEQ ID NO: 766699 - RNA, 19 nt, Homo sapiens
agagugugguggcuucuca

SEQ ID NO: 766700 - RNA, 19 nt, Homo sapiens
gagccucccacacaugguu

SEQ ID NO: 766701 - RNA, 19 nt, Homo sapiens
gagggcacaguguuugcua

SEQ ID NO: 766702 - RNA, 19 nt, Homo sapiens
caggugaagauuaaagaga

SEQ ID NO: 766703 - RNA, 19 nt, Homo sapiens
cucccaggcuccucauuug

SEQ ID NO: 766704 - RNA, 19 nt, Homo sapiens
ucacauuagguuuaguuug

SEQ ID NO: 766705 - RNA, 19 nt, Homo sapiens
ggacggaauagacucacau

SEQ ID NO: 766706 - RNA, 19 nt, Homo sapiens
accaucuccuucuucaaua

SEQ ID NO: 766707 - RNA, 19 nt, Homo sapiens
agaucaacccacaggaaua

SEQ ID NO: 766708 - RNA, 19 nt, Homo sapiens
ggaagacugggaaucuaag

SEQ ID NO: 766709 - RNA, 19 nt, Homo sapiens
ucacuggaccgggcaaguu

SEQ ID NO: 766710 - RNA, 19 nt, Homo sapiens
gggaagaacaaugugacuu

SEQ ID NO: 766711 - RNA, 19 nt, Homo sapiens
guccugagccucccacaca

SEQ ID NO: 766712 - RNA, 19 nt, Homo sapiens
ggcacaguguuugcuaaug

SEQ ID NO: 766713 - RNA, 19 nt, Homo sapiens
ccucccaggcuccucauuu

SEQ ID NO: 766714 - RNA, 19 nt, Homo sapiens
aauagacucacauuagguu

SEQ ID NO: 766715 - RNA, 19 nt, Homo sapiens
gacggaauagacucacauu

SEQ ID NO: 766716 - RNA, 19 nt, Homo sapiens
gaagcucugcguuucugau

SEQ ID NO: 766717 - RNA, 19 nt, Homo sapiens
gcaccgacuggagaagaaa

SEQ ID NO: 766718 - RNA, 19 nt, Homo sapiens
ccucccugauccacaguuu

SEQ ID NO: 766719 - RNA, 19 nt, Homo sapiens
gaacaucgaucgcaacauc

SEQ ID NO: 766720 - RNA, 19 nt, Homo sapiens
ugagagaggaugauucuua

SEQ ID NO: 766721 - RNA, 19 nt, Homo sapiens
ggagguagcccguuacaug

SEQ ID NO: 766722 - RNA, 19 nt, Homo sapiens
cagcaagucugaaguugaa

SEQ ID NO: 766723 - RNA, 19 nt, Homo sapiens
gaaguuugaugaauugaag

SEQ ID NO: 766724 - RNA, 19 nt, Homo sapiens
gcacucagccgaagccauu

SEQ ID NO: 766725 - RNA, 19 nt, Homo sapiens
ggaagaagaagaagaggaa

SEQ ID NO: 766726 - RNA, 19 nt, Homo sapiens
caucuucgcuggagacaga

SEQ ID NO: 766727 - RNA, 19 nt, Homo sapiens
ggaggaagaggaagaagaa

SEQ ID NO: 766728 - RNA, 19 nt, Homo sapiens
uaaaugcaguggacaaaca

SEQ ID NO: 766729 - RNA, 19 nt, Homo sapiens
gggaggagcuaggguuuga

SEQ ID NO: 766730 - RNA, 19 nt, Homo sapiens
ggaagaggaggaagaagaa

SEQ ID NO: 766731 - RNA, 19 nt, Homo sapiens
gaagugacccugacgaaag

SEQ ID NO: 766732 - RNA, 19 nt, Homo sapiens
ggaugaaucugagaaucuu

SEQ ID NO: 766733 - RNA, 19 nt, Homo sapiens
gcaccaagaccugcgauuu

SEQ ID NO: 766734 - RNA, 19 nt, Homo sapiens
uaacugaacaacuaaguga

SEQ ID NO: 766735 - RNA, 19 nt, Homo sapiens
gagagaggaugauucuuac

SEQ ID NO: 766736 - RNA, 19 nt, Homo sapiens
ugacaaggaugggcgauug

SEQ ID NO: 766737 - RNA, 19 nt, Homo sapiens
guugaaguuugaugaauug

SEQ ID NO: 766738 - RNA, 19 nt, Homo sapiens
ggagagguguacugcauag

SEQ ID NO: 766739 - RNA, 19 nt, Homo sapiens
ggaugauucuuaccucuuc

SEQ ID NO: 766740 - RNA, 19 nt, Homo sapiens
ccaggaauuuaacaagauu

SEQ ID NO: 766741 - RNA, 19 nt, Homo sapiens
ggcgauugcuccaggaauu

SEQ ID NO: 766742 - RNA, 19 nt, Homo sapiens
ggagacagagcgaggguuu

SEQ ID NO: 766743 - RNA, 19 nt, Homo sapiens
gagguguacugcauagaug

SEQ ID NO: 766744 - RNA, 19 nt, Homo sapiens
cucaauaaauguuggguuu

SEQ ID NO: 766745 - RNA, 19 nt, Homo sapiens
acacauuccugaccagaga

SEQ ID NO: 766746 - RNA, 19 nt, Homo sapiens
gcccugaggauuacaagua

SEQ ID NO: 766747 - RNA, 19 nt, Homo sapiens
guccagaguuuggcuauga

SEQ ID NO: 766748 - RNA, 19 nt, Homo sapiens
gagcuaggguuugacuaug

SEQ ID NO: 766749 - RNA, 19 nt, Homo sapiens
gcaaggccaagaagaaaug

SEQ ID NO: 766750 - RNA, 19 nt, Homo sapiens
gaaaaucaccuccaucugu

SEQ ID NO: 766751 - RNA, 19 nt, Homo sapiens
ggagcuaggguuugacuau

SEQ ID NO: 766752 - RNA, 19 nt, Homo sapiens
gggaaucagucagauagga

SEQ ID NO: 766753 - RNA, 19 nt, Homo sapiens
gguggugggugaugacuuc

SEQ ID NO: 766754 - RNA, 19 nt, Homo sapiens
ggaagaagaagaggaagau

SEQ ID NO: 766755 - RNA, 19 nt, Homo sapiens
caauaaauguuggguuugg

SEQ ID NO: 766756 - RNA, 19 nt, Homo sapiens
ggaggaagaggaggaagaa

SEQ ID NO: 766757 - RNA, 19 nt, Homo sapiens
gagaagugacccugacgaa

SEQ ID NO: 766758 - RNA, 19 nt, Homo sapiens
gcaagaaccgggucguaca

SEQ ID NO: 766759 - RNA, 19 nt, Homo sapiens
ugaaugggauggucuucug

SEQ ID NO: 766760 - RNA, 19 nt, Homo sapiens
ggaggaagaagaagaagag

SEQ ID NO: 766761 - RNA, 19 nt, Homo sapiens
gacagcaagucugaaguug

SEQ ID NO: 766762 - RNA, 19 nt, Homo sapiens
gaccucagaucuggccaaa

SEQ ID NO: 766763 - RNA, 19 nt, Homo sapiens
caacaucagccgcuucauc

SEQ ID NO: 766764 - RNA, 19 nt, Homo sapiens
ggaccuucaucugcgagua

SEQ ID NO: 766765 - RNA, 19 nt, Homo sapiens
gauugagccuccgcugauu

SEQ ID NO: 766766 - RNA, 19 nt, Homo sapiens
cgugguggcugugucuaua

SEQ ID NO: 766767 - RNA, 19 nt, Homo sapiens
cgacagcaagucugaaguu

SEQ ID NO: 766768 - RNA, 19 nt, Homo sapiens
uaugccaacugguuccuuu

SEQ ID NO: 766769 - RNA, 19 nt, Homo sapiens
caauguggcucugagaagu

SEQ ID NO: 766770 - RNA, 19 nt, Homo sapiens
gguuugcgcuucaacucaa

SEQ ID NO: 766771 - RNA, 19 nt, Homo sapiens
gcgcaaggccaagaagaaa

SEQ ID NO: 766772 - RNA, 19 nt, Homo sapiens
ggaagaggaagaagaagag

SEQ ID NO: 766773 - RNA, 19 nt, Homo sapiens
auacagcauuuccgcauga

SEQ ID NO: 766774 - RNA, 19 nt, Homo sapiens
cauccucaguugaaguuug

SEQ ID NO: 766775 - RNA, 19 nt, Homo sapiens
cgacuuagacaacaaggau

SEQ ID NO: 766776 - RNA, 19 nt, Homo sapiens
agaggaagaugaggaguca

SEQ ID NO: 766777 - RNA, 19 nt, Homo sapiens
cagaggagccaccgagaga

SEQ ID NO: 766778 - RNA, 19 nt, Homo sapiens
ggacaccccucguagugaa

SEQ ID NO: 766779 - RNA, 19 nt, Homo sapiens
ccaccacccuuucacacau

SEQ ID NO: 766780 - RNA, 19 nt, Homo sapiens
gaugaggagucagggaauc

SEQ ID NO: 766781 - RNA, 19 nt, Homo sapiens
aagaagaagaggaagauga

SEQ ID NO: 766782 - RNA, 19 nt, Homo sapiens
gcucuaacugaacaacuaa

SEQ ID NO: 766783 - RNA, 19 nt, Homo sapiens
caggacagguggacgucaa

SEQ ID NO: 766784 - RNA, 19 nt, Homo sapiens
cuacuaugauuccuacucu

SEQ ID NO: 766785 - RNA, 19 nt, Homo sapiens
uaaauguuggguuugguaa

SEQ ID NO: 766786 - RNA, 19 nt, Homo sapiens
ggagugccacccugacuuc

SEQ ID NO: 766787 - RNA, 19 nt, Homo sapiens
auucuuaccucuucgacuu

SEQ ID NO: 766788 - RNA, 19 nt, Homo sapiens
cuacagcucuaccgaacag

SEQ ID NO: 766789 - RNA, 19 nt, Homo sapiens
gaaccgggucguacagagu

SEQ ID NO: 766790 - RNA, 19 nt, Homo sapiens
agacagagcgaggguuuga

SEQ ID NO: 766791 - RNA, 19 nt, Homo sapiens
ggaggaggaagaggaagaa

SEQ ID NO: 766792 - RNA, 19 nt, Homo sapiens
ugcgagacguccaccauga

SEQ ID NO: 766793 - RNA, 19 nt, Homo sapiens
uaugagaacgugcccauuc

SEQ ID NO: 766794 - RNA, 19 nt, Homo sapiens
cgggagagcuaccaugacu

SEQ ID NO: 766795 - RNA, 19 nt, Homo sapiens
cauaaaugcaguggacaaa

SEQ ID NO: 766796 - RNA, 19 nt, Homo sapiens
gcaaugccgccauccucaa

SEQ ID NO: 766797 - RNA, 19 nt, Homo sapiens
cauggaggcacccaagauu

SEQ ID NO: 766798 - RNA, 19 nt, Homo sapiens
gcauggaggcacccaagau

SEQ ID NO: 766799 - RNA, 19 nt, Homo sapiens
ucagggaaucagucagaua

SEQ ID NO: 766800 - RNA, 19 nt, Homo sapiens
caccaagaccugcgauuuc

SEQ ID NO: 766801 - RNA, 19 nt, Homo sapiens
gggaugaaucugagaaucu

SEQ ID NO: 766802 - RNA, 19 nt, Homo sapiens
cuccaggaauuuaacaaga

SEQ ID NO: 766803 - RNA, 19 nt, Homo sapiens
cgauugcuccaggaauuua

SEQ ID NO: 766804 - RNA, 19 nt, Homo sapiens
gugcugguaugacaaggau

SEQ ID NO: 766805 - RNA, 19 nt, Homo sapiens
ggugaagccgucucggaaa

SEQ ID NO: 766806 - RNA, 19 nt, Homo sapiens
caccacccuuucacacauu

SEQ ID NO: 766807 - RNA, 19 nt, Homo sapiens
gcaucgccuucuucaguuc

SEQ ID NO: 766808 - RNA, 19 nt, Homo sapiens
ggauuacaaguacaucuca

SEQ ID NO: 766809 - RNA, 19 nt, Homo sapiens
gcagaaggugauccugaug

SEQ ID NO: 766810 - RNA, 19 nt, Homo sapiens
gcgaggguuugaggaguug

SEQ ID NO: 766811 - RNA, 19 nt, Homo sapiens
ggagucagggaaucaguca

SEQ ID NO: 766812 - RNA, 19 nt, Homo sapiens
gaagaagaagaggaagaug

SEQ ID NO: 766813 - RNA, 19 nt, Homo sapiens
gaugugagagaggaugauu

SEQ ID NO: 766814 - RNA, 19 nt, Homo sapiens
gcgauugcuccaggaauuu

SEQ ID NO: 766815 - RNA, 19 nt, Homo sapiens
agaggaagaagaagaggaa

SEQ ID NO: 766816 - RNA, 19 nt, Homo sapiens
ccucagaucuggccaaaag

SEQ ID NO: 766817 - RNA, 19 nt, Homo sapiens
caguugaaguuugaugaau

SEQ ID NO: 766818 - RNA, 19 nt, Homo sapiens
ccgcaugagugaugauguc

SEQ ID NO: 766819 - RNA, 19 nt, Homo sapiens
gaacaucgaucgcaacauc

SEQ ID NO: 766820 - RNA, 19 nt, Homo sapiens
ugagagaggaugauucuua

SEQ ID NO: 766821 - RNA, 19 nt, Homo sapiens
ggagguagcccguuacaug

SEQ ID NO: 766822 - RNA, 19 nt, Homo sapiens
cagcaagucugaaguugaa

SEQ ID NO: 766823 - RNA, 19 nt, Homo sapiens
gaaguuugaugaauugaag

SEQ ID NO: 766824 - RNA, 19 nt, Homo sapiens
gcacucagccgaagccauu

SEQ ID NO: 766825 - RNA, 19 nt, Homo sapiens
ggaagaagaagaagaggaa

SEQ ID NO: 766826 - RNA, 19 nt, Homo sapiens
caucuucgcuggagacaga

SEQ ID NO: 766827 - RNA, 19 nt, Homo sapiens
ggaggaagaggaagaagaa

SEQ ID NO: 766828 - RNA, 19 nt, Homo sapiens
uaaaugcaguggacaaaca

SEQ ID NO: 766829 - RNA, 19 nt, Homo sapiens
gggaggagcuaggguuuga

SEQ ID NO: 766830 - RNA, 19 nt, Homo sapiens
ggaagaggaggaagaagaa

SEQ ID NO: 766831 - RNA, 19 nt, Homo sapiens
gaagugacccugacgaaag

SEQ ID NO: 766832 - RNA, 19 nt, Homo sapiens
ggaugaaucugagaaucuu

SEQ ID NO: 766833 - RNA, 19 nt, Homo sapiens
gcaccaagaccugcgauuu

SEQ ID NO: 766834 - RNA, 19 nt, Homo sapiens
uaacugaacaacuaaguga

SEQ ID NO: 766835 - RNA, 19 nt, Homo sapiens
gagagaggaugauucuuac

SEQ ID NO: 766836 - RNA, 19 nt, Homo sapiens
ugacaaggaugggcgauug

SEQ ID NO: 766837 - RNA, 19 nt, Homo sapiens
guugaaguuugaugaauug

SEQ ID NO: 766838 - RNA, 19 nt, Homo sapiens
ggagagguguacugcauag

SEQ ID NO: 766839 - RNA, 19 nt, Homo sapiens
ggaugauucuuaccucuuc

SEQ ID NO: 766840 - RNA, 19 nt, Homo sapiens
ccaggaauuuaacaagauu

SEQ ID NO: 766841 - RNA, 19 nt, Homo sapiens
ggcgauugcuccaggaauu

SEQ ID NO: 766842 - RNA, 19 nt, Homo sapiens
ggagacagagcgaggguuu

SEQ ID NO: 766843 - RNA, 19 nt, Homo sapiens
gagguguacugcauagaug

SEQ ID NO: 766844 - RNA, 19 nt, Homo sapiens
cucaauaaauguuggguuu

SEQ ID NO: 766845 - RNA, 19 nt, Homo sapiens
acacauuccugaccagaga

SEQ ID NO: 766846 - RNA, 19 nt, Homo sapiens
gcccugaggauuacaagua

SEQ ID NO: 766847 - RNA, 19 nt, Homo sapiens
guccagaguuuggcuauga

SEQ ID NO: 766848 - RNA, 19 nt, Homo sapiens
gagcuaggguuugacuaug

SEQ ID NO: 766849 - RNA, 19 nt, Homo sapiens
gcaaggccaagaagaaaug

SEQ ID NO: 766850 - RNA, 19 nt, Homo sapiens
gaaaaucaccuccaucugu

SEQ ID NO: 766851 - RNA, 19 nt, Homo sapiens
ggagcuaggguuugacuau

SEQ ID NO: 766852 - RNA, 19 nt, Homo sapiens
gggaaucagucagauagga

SEQ ID NO: 766853 - RNA, 19 nt, Homo sapiens
gguggugggugaugacuuc

SEQ ID NO: 766854 - RNA, 19 nt, Homo sapiens
cacgaggaguguccaauga

SEQ ID NO: 766855 - RNA, 19 nt, Homo sapiens
ggaagaagaagaggaagau

SEQ ID NO: 766856 - RNA, 19 nt, Homo sapiens
caauaaauguuggguuugg

SEQ ID NO: 766857 - RNA, 19 nt, Homo sapiens
ggaggaagaggaggaagaa

SEQ ID NO: 766858 - RNA, 19 nt, Homo sapiens
gagaagugacccugacgaa

SEQ ID NO: 766859 - RNA, 19 nt, Homo sapiens
gcaagaaccgggucguaca

SEQ ID NO: 766860 - RNA, 19 nt, Homo sapiens
ugaaugggauggucuucug

SEQ ID NO: 766861 - RNA, 19 nt, Homo sapiens
ggaggaagaagaagaagag

SEQ ID NO: 766862 - RNA, 19 nt, Homo sapiens
gacagcaagucugaaguug

SEQ ID NO: 766863 - RNA, 19 nt, Homo sapiens
gaccucagaucuggccaaa

SEQ ID NO: 766864 - RNA, 19 nt, Homo sapiens
caacaucagccgcuucauc

SEQ ID NO: 766865 - RNA, 19 nt, Homo sapiens
ggaccuucaucugcgagua

SEQ ID NO: 766866 - RNA, 19 nt, Homo sapiens
gauugagccuccgcugauu

SEQ ID NO: 766867 - RNA, 19 nt, Homo sapiens
cgugguggcugugucuaua

SEQ ID NO: 766868 - RNA, 19 nt, Homo sapiens
cgacagcaagucugaaguu

SEQ ID NO: 766869 - RNA, 19 nt, Homo sapiens
uaugccaacugguuccuuu

SEQ ID NO: 766870 - RNA, 19 nt, Homo sapiens
caauguggcucugagaagu

SEQ ID NO: 766871 - RNA, 19 nt, Homo sapiens
gguuugcgcuucaacucaa

SEQ ID NO: 766872 - RNA, 19 nt, Homo sapiens
gcgcaaggccaagaagaaa

SEQ ID NO: 766873 - RNA, 19 nt, Homo sapiens
ggaagaggaagaagaagag

SEQ ID NO: 766874 - RNA, 19 nt, Homo sapiens
auacagcauuuccgcauga

SEQ ID NO: 766875 - RNA, 19 nt, Homo sapiens
cauccucaguugaaguuug

SEQ ID NO: 766876 - RNA, 19 nt, Homo sapiens
cgacuuagacaacaaggau

SEQ ID NO: 766877 - RNA, 19 nt, Homo sapiens
agaggaagaugaggaguca

SEQ ID NO: 766878 - RNA, 19 nt, Homo sapiens
cagaggagccaccgagaga

SEQ ID NO: 766879 - RNA, 19 nt, Homo sapiens
ggacaccccucguagugaa

SEQ ID NO: 766880 - RNA, 19 nt, Homo sapiens
ccaccacccuuucacacau

SEQ ID NO: 766881 - RNA, 19 nt, Homo sapiens
gaugaggagucagggaauc

SEQ ID NO: 766882 - RNA, 19 nt, Homo sapiens
aagaagaagaggaagauga

SEQ ID NO: 766883 - RNA, 19 nt, Homo sapiens
gcucuaacugaacaacuaa

SEQ ID NO: 766884 - RNA, 19 nt, Homo sapiens
caggacagguggacgucaa

SEQ ID NO: 766885 - RNA, 19 nt, Homo sapiens
cuacuaugauuccuacucu

SEQ ID NO: 766886 - RNA, 19 nt, Homo sapiens
uaaauguuggguuugguaa

SEQ ID NO: 766887 - RNA, 19 nt, Homo sapiens
ggagugccacccugacuuc

SEQ ID NO: 766888 - RNA, 19 nt, Homo sapiens
auucuuaccucuucgacuu

SEQ ID NO: 766889 - RNA, 19 nt, Homo sapiens
cuacagcucuaccgaacag

SEQ ID NO: 766890 - RNA, 19 nt, Homo sapiens
gaaccgggucguacagagu

SEQ ID NO: 766891 - RNA, 19 nt, Homo sapiens
agacagagcgaggguuuga

SEQ ID NO: 766892 - RNA, 19 nt, Homo sapiens
ggaggaggaagaggaagaa

SEQ ID NO: 766893 - RNA, 19 nt, Homo sapiens
ugcgagacguccaccauga

SEQ ID NO: 766894 - RNA, 19 nt, Homo sapiens
uaugagaacgugcccauuc

SEQ ID NO: 766895 - RNA, 19 nt, Homo sapiens
cgggagagcuaccaugacu

SEQ ID NO: 766896 - RNA, 19 nt, Homo sapiens
cauaaaugcaguggacaaa

SEQ ID NO: 766897 - RNA, 19 nt, Homo sapiens
gcaaugccgccauccucaa

SEQ ID NO: 766898 - RNA, 19 nt, Homo sapiens
cauggaggcacccaagauu

SEQ ID NO: 766899 - RNA, 19 nt, Homo sapiens
gcauggaggcacccaagau

SEQ ID NO: 766900 - RNA, 19 nt, Homo sapiens
ucagggaaucagucagaua

SEQ ID NO: 766901 - RNA, 19 nt, Homo sapiens
caccaagaccugcgauuuc

SEQ ID NO: 766902 - RNA, 19 nt, Homo sapiens
cuccaggaauuuaacaaga

SEQ ID NO: 766903 - RNA, 19 nt, Homo sapiens
cgauugcuccaggaauuua

SEQ ID NO: 766904 - RNA, 19 nt, Homo sapiens
gugcugguaugacaaggau

SEQ ID NO: 766905 - RNA, 19 nt, Homo sapiens
ccacgaggaguguccaaug

SEQ ID NO: 766906 - RNA, 19 nt, Homo sapiens
ggugaagccgucucggaaa

SEQ ID NO: 766907 - RNA, 19 nt, Homo sapiens
gggaugaaucugagaaucu

SEQ ID NO: 766908 - RNA, 19 nt, Homo sapiens
caccacccuuucacacauu

SEQ ID NO: 766909 - RNA, 19 nt, Homo sapiens
gcaucgccuucuucaguuc

SEQ ID NO: 766910 - RNA, 19 nt, Homo sapiens
ggauuacaaguacaucuca

SEQ ID NO: 766911 - RNA, 19 nt, Homo sapiens
gcagaaggugauccugaug

SEQ ID NO: 766912 - RNA, 19 nt, Homo sapiens
gcgaggguuugaggaguug

SEQ ID NO: 766913 - RNA, 19 nt, Homo sapiens
ggagucagggaaucaguca

SEQ ID NO: 766914 - RNA, 19 nt, Homo sapiens
gaagaagaagaggaagaug

SEQ ID NO: 766915 - RNA, 19 nt, Homo sapiens
gaugugagagaggaugauu

SEQ ID NO: 766916 - RNA, 19 nt, Homo sapiens
gcgauugcuccaggaauuu

SEQ ID NO: 766917 - RNA, 19 nt, Homo sapiens
agaggaagaagaagaggaa

SEQ ID NO: 766918 - RNA, 19 nt, Homo sapiens
ccucagaucuggccaaaag

SEQ ID NO: 766919 - RNA, 19 nt, Homo sapiens
caaagaagcuaugaagaua

SEQ ID NO: 766920 - RNA, 19 nt, Homo sapiens
gaagauacaugauacacuu

SEQ ID NO: 766921 - RNA, 19 nt, Homo sapiens
aaacauagcugaggaacaa

SEQ ID NO: 766922 - RNA, 19 nt, Homo sapiens
ugacaaacguagaaaugua

SEQ ID NO: 766923 - RNA, 19 nt, Homo sapiens
uaacagcccuuaguucauu

SEQ ID NO: 766924 - RNA, 19 nt, Homo sapiens
gcaaagaagcuaugaagau

SEQ ID NO: 766925 - RNA, 19 nt, Homo sapiens
gcuucuagcuuuauauuug

SEQ ID NO: 766926 - RNA, 19 nt, Homo sapiens
ggauggagccugucaguau

SEQ ID NO: 766927 - RNA, 19 nt, Homo sapiens
uagccagacugacggauua

SEQ ID NO: 766928 - RNA, 19 nt, Homo sapiens
gauggagccugucaguauu

SEQ ID NO: 766929 - RNA, 19 nt, Homo sapiens
ugacagcccucugaauauu

SEQ ID NO: 766930 - RNA, 19 nt, Homo sapiens
gagcaagucuuucauucuc

SEQ ID NO: 766931 - RNA, 19 nt, Homo sapiens
gagagccacuaauguaaga

SEQ ID NO: 766932 - RNA, 19 nt, Homo sapiens
gcuaugaagauacaugaua

SEQ ID NO: 766933 - RNA, 19 nt, Homo sapiens
gcccauugguugcuuauau

SEQ ID NO: 766934 - RNA, 19 nt, Homo sapiens
gagacgguccagccaauua

SEQ ID NO: 766935 - RNA, 19 nt, Homo sapiens
gcacaugccguacucuuau

SEQ ID NO: 766936 - RNA, 19 nt, Homo sapiens
ugacaugaauaaugcaaga

SEQ ID NO: 766937 - RNA, 19 nt, Homo sapiens
guggagggcuugccaugaa

SEQ ID NO: 766938 - RNA, 19 nt, Homo sapiens
gaauaguguuugucaacug

SEQ ID NO: 766939 - RNA, 19 nt, Homo sapiens
ggagaaauacugagcaagu

SEQ ID NO: 766940 - RNA, 19 nt, Homo sapiens
gacaaacguagaaauguaa

SEQ ID NO: 766941 - RNA, 19 nt, Homo sapiens
acucuuauauguaccauug

SEQ ID NO: 766942 - RNA, 19 nt, Homo sapiens
gaaaggcauauuagaacaa

SEQ ID NO: 766943 - RNA, 19 nt, Homo sapiens
gagaaauacugagcaaguc

SEQ ID NO: 766944 - RNA, 19 nt, Homo sapiens
ugugacagcccucugaaua

SEQ ID NO: 766945 - RNA, 19 nt, Homo sapiens
gcagcccauugguugcuua

SEQ ID NO: 766946 - RNA, 19 nt, Homo sapiens
ccugagagccacuaaugua

SEQ ID NO: 766947 - RNA, 19 nt, Homo sapiens
cagcauuccuuacuaugug

SEQ ID NO: 766948 - RNA, 19 nt, Homo sapiens
caaguuuauucccuuauca

SEQ ID NO: 766949 - RNA, 19 nt, Homo sapiens
ugaaaggcauauuagaaca

SEQ ID NO: 766950 - RNA, 19 nt, Homo sapiens
cauuuacucugcauuuguu

SEQ ID NO: 766951 - RNA, 19 nt, Homo sapiens
guugaaacaguucucauuu

SEQ ID NO: 766952 - RNA, 19 nt, Homo sapiens
uaaacguuaugcugaauag

SEQ ID NO: 766953 - RNA, 19 nt, Homo sapiens
uauaacagcccuuaguuca

SEQ ID NO: 766954 - RNA, 19 nt, Homo sapiens
gaaggagaaacuuaagugu

SEQ ID NO: 766955 - RNA, 19 nt, Homo sapiens
gagccacuaauguaagaua

SEQ ID NO: 766956 - RNA, 19 nt, Homo sapiens
uaagauuuccuguuucaug

SEQ ID NO: 766957 - RNA, 19 nt, Homo sapiens
uuauguggcuuuccuugaa

SEQ ID NO: 766958 - RNA, 19 nt, Homo sapiens
ggcccuggauguuuccuuu

SEQ ID NO: 766959 - RNA, 19 nt, Homo sapiens
cacaugccguacucuuaua

SEQ ID NO: 766960 - RNA, 19 nt, Homo sapiens
ccaauuauggaagcacuua

SEQ ID NO: 766961 - RNA, 19 nt, Homo sapiens
guagaauaguguuugucaa

SEQ ID NO: 766962 - RNA, 19 nt, Homo sapiens
gaaauacugagcaagucuu

SEQ ID NO: 766963 - RNA, 19 nt, Homo sapiens
gauacaugauacacuuugu

SEQ ID NO: 766964 - RNA, 19 nt, Homo sapiens
aaacuuaaguguggaaugc

SEQ ID NO: 766965 - RNA, 19 nt, Homo sapiens
uagaccauuuccauacuaa

SEQ ID NO: 766966 - RNA, 19 nt, Homo sapiens
ccucagcauuccuuacuau

SEQ ID NO: 766967 - RNA, 19 nt, Homo sapiens
acucugcauuuguucaaua

SEQ ID NO: 766968 - RNA, 19 nt, Homo sapiens
gcccuuaguucauuuacuc

SEQ ID NO: 766969 - RNA, 19 nt, Homo sapiens
gggcaaagaagcuaugaag

SEQ ID NO: 766970 - RNA, 19 nt, Homo sapiens
ugaaacaguucucauuuug

SEQ ID NO: 766971 - RNA, 19 nt, Homo sapiens
gcacuuagagaugcaacaa

SEQ ID NO: 766972 - RNA, 19 nt, Homo sapiens
guucauuuacucugcauuu

SEQ ID NO: 766973 - RNA, 19 nt, Homo sapiens
aagaagcuaugaagauaca

SEQ ID NO: 766974 - RNA, 19 nt, Homo sapiens
ccaauagugugaguauauc

SEQ ID NO: 766975 - RNA, 19 nt, Homo sapiens
cccauugguugcuuauauu

SEQ ID NO: 766976 - RNA, 19 nt, Homo sapiens
gaagcuaugaagauacaug

SEQ ID NO: 766977 - RNA, 19 nt, Homo sapiens
aagauuuccuguuucaugu

SEQ ID NO: 766978 - RNA, 19 nt, Homo sapiens
guuauaacagcccuuaguu

SEQ ID NO: 766979 - RNA, 19 nt, Homo sapiens
guaagauacagaaacauag

SEQ ID NO: 766980 - RNA, 19 nt, Homo sapiens
ggaagcacuuagagaugca

SEQ ID NO: 766981 - RNA, 19 nt, Homo sapiens
ugugaaaggcauauuagaa

SEQ ID NO: 766982 - RNA, 19 nt, Homo sapiens
uagaagaggcugugaaagg

SEQ ID NO: 766983 - RNA, 19 nt, Homo sapiens
gaaacuuaaguguggaaug

SEQ ID NO: 766984 - RNA, 19 nt, Homo sapiens
ggacuugaagaaagauugu

SEQ ID NO: 766985 - RNA, 19 nt, Homo sapiens
gauuuccuguuucauguag

SEQ ID NO: 766986 - RNA, 19 nt, Homo sapiens
cccuggauguuuccuuuaa

SEQ ID NO: 766987 - RNA, 19 nt, Homo sapiens
acagcccucugaauauuug

SEQ ID NO: 766988 - RNA, 19 nt, Homo sapiens
gacagcccucugaauauuu

SEQ ID NO: 766989 - RNA, 19 nt, Homo sapiens
cuaugaagauacaugauac

SEQ ID NO: 766990 - RNA, 19 nt, Homo sapiens
ccuggucucucaagcguau

SEQ ID NO: 766991 - RNA, 19 nt, Homo sapiens
aguguggaaugcauuauau

SEQ ID NO: 766992 - RNA, 19 nt, Homo sapiens
cauagcugaggaacaaaua

SEQ ID NO: 766993 - RNA, 19 nt, Homo sapiens
cauuuggacuugaagaaag

SEQ ID NO: 766994 - RNA, 19 nt, Homo sapiens
uuaaguguggaaugcauua

SEQ ID NO: 766995 - RNA, 19 nt, Homo sapiens
gauuaugauucacccucuu

SEQ ID NO: 766996 - RNA, 19 nt, Homo sapiens
gcuuuauauuugcuccaua

SEQ ID NO: 766997 - RNA, 19 nt, Homo sapiens
gugacagcccucugaauau

SEQ ID NO: 766998 - RNA, 19 nt, Homo sapiens
gaaacauagcugaggaaca

SEQ ID NO: 766999 - RNA, 19 nt, Homo sapiens
cauguagaauaguguuugu

SEQ ID NO: 767000 - RNA, 19 nt, Homo sapiens
gcuccauaaugacaugaau

SEQ ID NO: 767001 - RNA, 19 nt, Homo sapiens
uguagaagaggcugugaaa

SEQ ID NO: 767002 - RNA, 19 nt, Homo sapiens
auagaccauuuccauacua

SEQ ID NO: 767003 - RNA, 19 nt, Homo sapiens
acaguuaguuuucuaguga

SEQ ID NO: 767004 - RNA, 19 nt, Homo sapiens
ugacggauuauguggcuuu

SEQ ID NO: 767005 - RNA, 19 nt, Homo sapiens
acaaguuuauucccuuauc

SEQ ID NO: 767006 - RNA, 19 nt, Homo sapiens
gcugauuccaccacaagaa

SEQ ID NO: 767007 - RNA, 19 nt, Homo sapiens
caagcugauuccaccacaa

SEQ ID NO: 767008 - RNA, 19 nt, Homo sapiens
gugaaaggcauauuagaac

SEQ ID NO: 767009 - RNA, 19 nt, Homo sapiens
cugagcaagucuuucauuc

SEQ ID NO: 767010 - RNA, 19 nt, Homo sapiens
gcucaaguucugcccuuug

SEQ ID NO: 767011 - RNA, 19 nt, Homo sapiens
ccauugguugcuuauauuu

SEQ ID NO: 767012 - RNA, 19 nt, Homo sapiens
ugcauuauaugggcaaaga

SEQ ID NO: 767013 - RNA, 19 nt, Homo sapiens
agaaggagaaacuuaagug

SEQ ID NO: 767014 - RNA, 19 nt, Homo sapiens
uccaauagugugaguauau

SEQ ID NO: 767015 - RNA, 19 nt, Homo sapiens
aauaguguuugucaacugu

SEQ ID NO: 767016 - RNA, 19 nt, Homo sapiens
gcugaauaguuguugaaac

SEQ ID NO: 767017 - RNA, 19 nt, Homo sapiens
ggcugugaaaggcauauua

SEQ ID NO: 767018 - RNA, 19 nt, Homo sapiens
gagaaacuuaaguguggaa

SEQ ID NO: 767019 - RNA, 19 nt, Homo sapiens
cuagaaagcucauccguuu

SEQ ID NO: 767020 - RNA, 19 nt, Homo sapiens
gaagugagaguucagauaa

SEQ ID NO: 767021 - RNA, 19 nt, Homo sapiens
gcacauggauggaggacaa

SEQ ID NO: 767022 - RNA, 19 nt, Homo sapiens
gcaaagaccgcucagauga

SEQ ID NO: 767023 - RNA, 19 nt, Homo sapiens
ggaagaauuguguugaaua

SEQ ID NO: 767024 - RNA, 19 nt, Homo sapiens
gacaaaggaucacaucaug

SEQ ID NO: 767025 - RNA, 19 nt, Homo sapiens
gcucauccguuuccgguuu

SEQ ID NO: 767026 - RNA, 19 nt, Homo sapiens
cagaagugcuguugguuug

SEQ ID NO: 767027 - RNA, 19 nt, Homo sapiens
gauuagggaucguuucuca

SEQ ID NO: 767028 - RNA, 19 nt, Homo sapiens
caaaggcuaugcguacgua

SEQ ID NO: 767029 - RNA, 19 nt, Homo sapiens
gacauuguguuuguacuuu

SEQ ID NO: 767030 - RNA, 19 nt, Homo sapiens
gcagaagugcuguugguuu

SEQ ID NO: 767031 - RNA, 19 nt, Homo sapiens
ggauuuaucaggagugaaa

SEQ ID NO: 767032 - RNA, 19 nt, Homo sapiens
ccacuguacucugaaauug

SEQ ID NO: 767033 - RNA, 19 nt, Homo sapiens
uagaugacauuguguuugu

SEQ ID NO: 767034 - RNA, 19 nt, Homo sapiens
guacguagaguuugagaau

SEQ ID NO: 767035 - RNA, 19 nt, Homo sapiens
caaaggaucacaucaugga

SEQ ID NO: 767036 - RNA, 19 nt, Homo sapiens
gaagugcuguugguuugga

SEQ ID NO: 767037 - RNA, 19 nt, Homo sapiens
guggaagaauuguguugaa

SEQ ID NO: 767038 - RNA, 19 nt, Homo sapiens
caaaggaagaccaguagga

SEQ ID NO: 767039 - RNA, 19 nt, Homo sapiens
gaucacaucauggagauau

SEQ ID NO: 767040 - RNA, 19 nt, Homo sapiens
aaggaucgcucaaaagaua

SEQ ID NO: 767041 - RNA, 19 nt, Homo sapiens
agaaucaaguuagaaguga

SEQ ID NO: 767042 - RNA, 19 nt, Homo sapiens
ggagauauuuuccaccuau

SEQ ID NO: 767043 - RNA, 19 nt, Homo sapiens
gggaguugcugcucuuugg

SEQ ID NO: 767044 - RNA, 19 nt, Homo sapiens
gcagcugccaacccuguua

SEQ ID NO: 767045 - RNA, 19 nt, Homo sapiens
caacuccucccgauaaaca

SEQ ID NO: 767046 - RNA, 19 nt, Homo sapiens
ccaccacuguacucugaaa

SEQ ID NO: 767047 - RNA, 19 nt, Homo sapiens
guaaauugcaaucgauuag

SEQ ID NO: 767048 - RNA, 19 nt, Homo sapiens
agaaggcgcugaagcacau

SEQ ID NO: 767049 - RNA, 19 nt, Homo sapiens
ggaaugugacaaaggauca

SEQ ID NO: 767050 - RNA, 19 nt, Homo sapiens
caaguuagaagugagaguu

SEQ ID NO: 767051 - RNA, 19 nt, Homo sapiens
ccaccaaggagucgaguga

SEQ ID NO: 767052 - RNA, 19 nt, Homo sapiens
augguggucuuucagguua

SEQ ID NO: 767053 - RNA, 19 nt, Homo sapiens
cguaaauugcaaucgauua

SEQ ID NO: 767054 - RNA, 19 nt, Homo sapiens
agaagugagaguucagaua

SEQ ID NO: 767055 - RNA, 19 nt, Homo sapiens
cagaugagaaguccaagga

SEQ ID NO: 767056 - RNA, 19 nt, Homo sapiens
cagguuaucuuggcaacau

SEQ ID NO: 767057 - RNA, 19 nt, Homo sapiens
gaagaccaguaggaaagca

SEQ ID NO: 767058 - RNA, 19 nt, Homo sapiens
ccaaauccaaaccaccuaa

SEQ ID NO: 767059 - RNA, 19 nt, Homo sapiens
ucaagauucccuccgguuu

SEQ ID NO: 767060 - RNA, 19 nt, Homo sapiens
ccgauaaacaggccacuga

SEQ ID NO: 767061 - RNA, 19 nt, Homo sapiens
gauggaggacaaauugaug

SEQ ID NO: 767062 - RNA, 19 nt, Homo sapiens
ggauggaggacaaauugau

SEQ ID NO: 767063 - RNA, 19 nt, Homo sapiens
ugacaaaggaucacaucau

SEQ ID NO: 767064 - RNA, 19 nt, Homo sapiens
gcauccagccgcucaggaa

SEQ ID NO: 767065 - RNA, 19 nt, Homo sapiens
uaggaaagcaaacccuuga

SEQ ID NO: 767066 - RNA, 19 nt, Homo sapiens
ucacaucauggagauauuu

SEQ ID NO: 767067 - RNA, 19 nt, Homo sapiens
ugagaguucagauaaguga

SEQ ID NO: 767068 - RNA, 19 nt, Homo sapiens
aaaggaagaccaguaggaa

SEQ ID NO: 767069 - RNA, 19 nt, Homo sapiens
cagaaucaaguuagaagug

SEQ ID NO: 767070 - RNA, 19 nt, Homo sapiens
gaauuguguugaauaaacc

SEQ ID NO: 767071 - RNA, 19 nt, Homo sapiens
ggaaagcaaacccuugacu

SEQ ID NO: 767072 - RNA, 19 nt, Homo sapiens
gauaaacaggccacugaag

SEQ ID NO: 767073 - RNA, 19 nt, Homo sapiens
caaauccaaaccaccuaaa

SEQ ID NO: 767074 - RNA, 19 nt, Homo sapiens
cccaagaucggaaugcaaa

SEQ ID NO: 767075 - RNA, 19 nt, Homo sapiens
uggaagaauuguguugaau

SEQ ID NO: 767076 - RNA, 19 nt, Homo sapiens
uggcguaaauugcaaucga

SEQ ID NO: 767077 - RNA, 19 nt, Homo sapiens
ccaaggagucgagugagaa

SEQ ID NO: 767078 - RNA, 19 nt, Homo sapiens
gagcuugcuaggagucaaa

SEQ ID NO: 767079 - RNA, 19 nt, Homo sapiens
gcuccaacuccucccgaua

SEQ ID NO: 767080 - RNA, 19 nt, Homo sapiens
guuugagaauccagaugaa

SEQ ID NO: 767081 - RNA, 19 nt, Homo sapiens
ggcguaaauugcaaucgau

SEQ ID NO: 767082 - RNA, 19 nt, Homo sapiens
gcugcucuuuggcguaaau

SEQ ID NO: 767083 - RNA, 19 nt, Homo sapiens
caacauguacauugcuuuu

SEQ ID NO: 767084 - RNA, 19 nt, Homo sapiens
ccuugacucuggcaggauu

SEQ ID NO: 767085 - RNA, 19 nt, Homo sapiens
cuccaacuccucccgauaa

SEQ ID NO: 767086 - RNA, 19 nt, Homo sapiens
uuagggaucguuucucaga

SEQ ID NO: 767087 - RNA, 19 nt, Homo sapiens
cccggaaugugacaaagga

SEQ ID NO: 767088 - RNA, 19 nt, Homo sapiens
gcugugugccugucaagau

SEQ ID NO: 767089 - RNA, 19 nt, Homo sapiens
gaugcugugugccugucaa

SEQ ID NO: 767090 - RNA, 19 nt, Homo sapiens
gggagacucacccggaaug

SEQ ID NO: 767091 - RNA, 19 nt, Homo sapiens
ccaaggaucgcucaaaaga

SEQ ID NO: 767092 - RNA, 19 nt, Homo sapiens
ugacauuguguuuguacuu

SEQ ID NO: 767093 - RNA, 19 nt, Homo sapiens
cugugugccugucaagauu

SEQ ID NO: 767094 - RNA, 19 nt, Homo sapiens
aaagcaaacccuugacucu

SEQ ID NO: 767095 - RNA, 19 nt, Homo sapiens
gccaaaggaagaccaguag

SEQ ID NO: 767096 - RNA, 19 nt, Homo sapiens
ggagucgagugagaaggau

SEQ ID NO: 767097 - RNA, 19 nt, Homo sapiens
guccaaggaucgcucaaaa

SEQ ID NO: 767098 - RNA, 19 nt, Homo sapiens
gaguggaagaauuguguug

SEQ ID NO: 767099 - RNA, 19 nt, Homo sapiens
cugcagaagugcuguuggu

SEQ ID NO: 767100 - RNA, 19 nt, Homo sapiens
uugcugcucuuuggcguaa

SEQ ID NO: 767101 - RNA, 19 nt, Homo sapiens
gcuaugcguacguagaguu

SEQ ID NO: 767102 - RNA, 19 nt, Homo sapiens
cauuguguuuguacuuugu

SEQ ID NO: 767103 - RNA, 19 nt, Homo sapiens
ggucuuucagguuaucuug

SEQ ID NO: 767104 - RNA, 19 nt, Homo sapiens
uccaacuccucccgauaaa

SEQ ID NO: 767105 - RNA, 19 nt, Homo sapiens
cgccauugcugcuuugaac

SEQ ID NO: 767106 - RNA, 19 nt, Homo sapiens
augcguacguagaguuuga

SEQ ID NO: 767107 - RNA, 19 nt, Homo sapiens
agugagaguucagauaagu

SEQ ID NO: 767108 - RNA, 19 nt, Homo sapiens
gaagcucucgccccuguaa

SEQ ID NO: 767109 - RNA, 19 nt, Homo sapiens
cgauaaacaggccacugaa

SEQ ID NO: 767110 - RNA, 19 nt, Homo sapiens
gcguaaauugcaaucgauu

SEQ ID NO: 767111 - RNA, 19 nt, Homo sapiens
acauuguguuuguacuuug

SEQ ID NO: 767112 - RNA, 19 nt, Homo sapiens
gguugugccugccguucau

SEQ ID NO: 767113 - RNA, 19 nt, Homo sapiens
uuaccugggagcacacuuu

SEQ ID NO: 767114 - RNA, 19 nt, Homo sapiens
aaagaagagcuugcuagga

SEQ ID NO: 767115 - RNA, 19 nt, Homo sapiens
gcucaguuuugucacuuuu

SEQ ID NO: 767116 - RNA, 19 nt, Homo sapiens
cgcaaagaccgcucagaug

SEQ ID NO: 767117 - RNA, 19 nt, Homo sapiens
ccacggaugaggagaaggu

SEQ ID NO: 767118 - RNA, 19 nt, Homo sapiens
cauggauggaggacaaauu

SEQ ID NO: 767119 - RNA, 19 nt, Homo sapiens
cuagaaagcucauccguuu

SEQ ID NO: 767120 - RNA, 19 nt, Homo sapiens
gaagugagaguucagauaa

SEQ ID NO: 767121 - RNA, 19 nt, Homo sapiens
gcacauggauggaggacaa

SEQ ID NO: 767122 - RNA, 19 nt, Homo sapiens
gcaaagaccgcucagauga

SEQ ID NO: 767123 - RNA, 19 nt, Homo sapiens
ggaagaauuguguugaaua

SEQ ID NO: 767124 - RNA, 19 nt, Homo sapiens
gacaaaggaucacaucaug

SEQ ID NO: 767125 - RNA, 19 nt, Homo sapiens
gcucauccguuuccgguuu

SEQ ID NO: 767126 - RNA, 19 nt, Homo sapiens
cagaagugcuguugguuug

SEQ ID NO: 767127 - RNA, 19 nt, Homo sapiens
gauuagggaucguuucuca

SEQ ID NO: 767128 - RNA, 19 nt, Homo sapiens
caaaggcuaugcguacgua

SEQ ID NO: 767129 - RNA, 19 nt, Homo sapiens
gacauuguguuuguacuuu

SEQ ID NO: 767130 - RNA, 19 nt, Homo sapiens
gcagaagugcuguugguuu

SEQ ID NO: 767131 - RNA, 19 nt, Homo sapiens
ggauuuaucaggagugaaa

SEQ ID NO: 767132 - RNA, 19 nt, Homo sapiens
ccacuguacucugaaauug

SEQ ID NO: 767133 - RNA, 19 nt, Homo sapiens
uagaugacauuguguuugu

SEQ ID NO: 767134 - RNA, 19 nt, Homo sapiens
guacguagaguuugagaau

SEQ ID NO: 767135 - RNA, 19 nt, Homo sapiens
caaaggaucacaucaugga

SEQ ID NO: 767136 - RNA, 19 nt, Homo sapiens
gaagugcuguugguuugga

SEQ ID NO: 767137 - RNA, 19 nt, Homo sapiens
guggaagaauuguguugaa

SEQ ID NO: 767138 - RNA, 19 nt, Homo sapiens
caaaggaagaccaguagga

SEQ ID NO: 767139 - RNA, 19 nt, Homo sapiens
gaucacaucauggagauau

SEQ ID NO: 767140 - RNA, 19 nt, Homo sapiens
aaggaucgcucaaaagaua

SEQ ID NO: 767141 - RNA, 19 nt, Homo sapiens
agaaucaaguuagaaguga

SEQ ID NO: 767142 - RNA, 19 nt, Homo sapiens
ggagauauuuuccaccuau

SEQ ID NO: 767143 - RNA, 19 nt, Homo sapiens
gcagcugccaacccuguua

SEQ ID NO: 767144 - RNA, 19 nt, Homo sapiens
caacuccucccgauaaaca

SEQ ID NO: 767145 - RNA, 19 nt, Homo sapiens
ccaccacuguacucugaaa

SEQ ID NO: 767146 - RNA, 19 nt, Homo sapiens
agaaggcgcugaagcacau

SEQ ID NO: 767147 - RNA, 19 nt, Homo sapiens
guaaauugcaaucgauuag

SEQ ID NO: 767148 - RNA, 19 nt, Homo sapiens
ggaaugugacaaaggauca

SEQ ID NO: 767149 - RNA, 19 nt, Homo sapiens
caaguuagaagugagaguu

SEQ ID NO: 767150 - RNA, 19 nt, Homo sapiens
ccaccaaggagucgaguga

SEQ ID NO: 767151 - RNA, 19 nt, Homo sapiens
cguaaauugcaaucgauua

SEQ ID NO: 767152 - RNA, 19 nt, Homo sapiens
agaagugagaguucagaua

SEQ ID NO: 767153 - RNA, 19 nt, Homo sapiens
augguggucuuucagguua

SEQ ID NO: 767154 - RNA, 19 nt, Homo sapiens
cagaugagaaguccaagga

SEQ ID NO: 767155 - RNA, 19 nt, Homo sapiens
cagguuaucuuggcaacau

SEQ ID NO: 767156 - RNA, 19 nt, Homo sapiens
gaagaccaguaggaaagca

SEQ ID NO: 767157 - RNA, 19 nt, Homo sapiens
ccaaauccaaaccaccuaa

SEQ ID NO: 767158 - RNA, 19 nt, Homo sapiens
ucaagauucccuccgguuu

SEQ ID NO: 767159 - RNA, 19 nt, Homo sapiens
ccgauaaacaggccacuga

SEQ ID NO: 767160 - RNA, 19 nt, Homo sapiens
gauggaggacaaauugaug

SEQ ID NO: 767161 - RNA, 19 nt, Homo sapiens
ggauggaggacaaauugau

SEQ ID NO: 767162 - RNA, 19 nt, Homo sapiens
ugacaaaggaucacaucau

SEQ ID NO: 767163 - RNA, 19 nt, Homo sapiens
gcauccagccgcucaggaa

SEQ ID NO: 767164 - RNA, 19 nt, Homo sapiens
uaggaaagcaaacccuuga

SEQ ID NO: 767165 - RNA, 19 nt, Homo sapiens
ucacaucauggagauauuu

SEQ ID NO: 767166 - RNA, 19 nt, Homo sapiens
ugagaguucagauaaguga

SEQ ID NO: 767167 - RNA, 19 nt, Homo sapiens
aaaggaagaccaguaggaa

SEQ ID NO: 767168 - RNA, 19 nt, Homo sapiens
cagaaucaaguuagaagug

SEQ ID NO: 767169 - RNA, 19 nt, Homo sapiens
gaauuguguugaauaaacc

SEQ ID NO: 767170 - RNA, 19 nt, Homo sapiens
ggaaagcaaacccuugacu

SEQ ID NO: 767171 - RNA, 19 nt, Homo sapiens
gauaaacaggccacugaag

SEQ ID NO: 767172 - RNA, 19 nt, Homo sapiens
caaauccaaaccaccuaaa

SEQ ID NO: 767173 - RNA, 19 nt, Homo sapiens
cccaagaucggaaugcaaa

SEQ ID NO: 767174 - RNA, 19 nt, Homo sapiens
uggaagaauuguguugaau

SEQ ID NO: 767175 - RNA, 19 nt, Homo sapiens
uggcguaaauugcaaucga

SEQ ID NO: 767176 - RNA, 19 nt, Homo sapiens
ccaaggagucgagugagaa

SEQ ID NO: 767177 - RNA, 19 nt, Homo sapiens
gagcuugcuaggagucaaa

SEQ ID NO: 767178 - RNA, 19 nt, Homo sapiens
gcuccaacuccucccgaua

SEQ ID NO: 767179 - RNA, 19 nt, Homo sapiens
guuugagaauccagaugaa

SEQ ID NO: 767180 - RNA, 19 nt, Homo sapiens
ggcguaaauugcaaucgau

SEQ ID NO: 767181 - RNA, 19 nt, Homo sapiens
uuagggaucguuucucaga

SEQ ID NO: 767182 - RNA, 19 nt, Homo sapiens
caacauguacauugcuuuu

SEQ ID NO: 767183 - RNA, 19 nt, Homo sapiens
ccuugacucuggcaggauu

SEQ ID NO: 767184 - RNA, 19 nt, Homo sapiens
cuccaacuccucccgauaa

SEQ ID NO: 767185 - RNA, 19 nt, Homo sapiens
gcugcucuuuggcguaaau

SEQ ID NO: 767186 - RNA, 19 nt, Homo sapiens
cccggaaugugacaaagga

SEQ ID NO: 767187 - RNA, 19 nt, Homo sapiens
gcugugugccugucaagau

SEQ ID NO: 767188 - RNA, 19 nt, Homo sapiens
gaugcugugugccugucaa

SEQ ID NO: 767189 - RNA, 19 nt, Homo sapiens
gggagacucacccggaaug

SEQ ID NO: 767190 - RNA, 19 nt, Homo sapiens
ccaaggaucgcucaaaaga

SEQ ID NO: 767191 - RNA, 19 nt, Homo sapiens
ugacauuguguuuguacuu

SEQ ID NO: 767192 - RNA, 19 nt, Homo sapiens
cugugugccugucaagauu

SEQ ID NO: 767193 - RNA, 19 nt, Homo sapiens
aaagcaaacccuugacucu

SEQ ID NO: 767194 - RNA, 19 nt, Homo sapiens
gccaaaggaagaccaguag

SEQ ID NO: 767195 - RNA, 19 nt, Homo sapiens
ggagucgagugagaaggau

SEQ ID NO: 767196 - RNA, 19 nt, Homo sapiens
guccaaggaucgcucaaaa

SEQ ID NO: 767197 - RNA, 19 nt, Homo sapiens
gaguggaagaauuguguug

SEQ ID NO: 767198 - RNA, 19 nt, Homo sapiens
cugcagaagugcuguuggu

SEQ ID NO: 767199 - RNA, 19 nt, Homo sapiens
gcuaugcguacguagaguu

SEQ ID NO: 767200 - RNA, 19 nt, Homo sapiens
cauuguguuuguacuuugu

SEQ ID NO: 767201 - RNA, 19 nt, Homo sapiens
ggucuuucagguuaucuug

SEQ ID NO: 767202 - RNA, 19 nt, Homo sapiens
cgccauugcugcuuugaac

SEQ ID NO: 767203 - RNA, 19 nt, Homo sapiens
uccaacuccucccgauaaa

SEQ ID NO: 767204 - RNA, 19 nt, Homo sapiens
augcguacguagaguuuga

SEQ ID NO: 767205 - RNA, 19 nt, Homo sapiens
gcguaaauugcaaucgauu

SEQ ID NO: 767206 - RNA, 19 nt, Homo sapiens
gaagcucucgccccuguaa

SEQ ID NO: 767207 - RNA, 19 nt, Homo sapiens
cgauaaacaggccacugaa

SEQ ID NO: 767208 - RNA, 19 nt, Homo sapiens
agugagaguucagauaagu

SEQ ID NO: 767209 - RNA, 19 nt, Homo sapiens
acauuguguuuguacuuug

SEQ ID NO: 767210 - RNA, 19 nt, Homo sapiens
aaagaagagcuugcuagga

SEQ ID NO: 767211 - RNA, 19 nt, Homo sapiens
gguugugccugccguucau

SEQ ID NO: 767212 - RNA, 19 nt, Homo sapiens
uuaccugggagcacacuuu

SEQ ID NO: 767213 - RNA, 19 nt, Homo sapiens
gcucaguuuugucacuuuu

SEQ ID NO: 767214 - RNA, 19 nt, Homo sapiens
cgcaaagaccgcucagaug

SEQ ID NO: 767215 - RNA, 19 nt, Homo sapiens
ccacggaugaggagaaggu

SEQ ID NO: 767216 - RNA, 19 nt, Homo sapiens
cauggauggaggacaaauu

SEQ ID NO: 767217 - RNA, 19 nt, Homo sapiens
gaugacauuguguuuguac

SEQ ID NO: 767218 - RNA, 19 nt, Homo sapiens
agaugacauuguguuugua

SEQ ID NO: 767219 - RNA, 19 nt, Homo sapiens
gcagcaaggugguacagaa

SEQ ID NO: 767220 - RNA, 19 nt, Homo sapiens
gcaaggugguacagaaguu

SEQ ID NO: 767221 - RNA, 19 nt, Homo sapiens
gcacuuugguucccugugu

SEQ ID NO: 767222 - RNA, 19 nt, Homo sapiens
gcaaguacagucacaagga

SEQ ID NO: 767223 - RNA, 19 nt, Homo sapiens
ucagagcccugcacuuugu

SEQ ID NO: 767224 - RNA, 19 nt, Homo sapiens
uaaaguuccuggccuucaa

SEQ ID NO: 767225 - RNA, 19 nt, Homo sapiens
uuacuuggcuuuccaucug

SEQ ID NO: 767226 - RNA, 19 nt, Homo sapiens
gcagcaagugcccaucuuu

SEQ ID NO: 767227 - RNA, 19 nt, Homo sapiens
gguggaugauuugcacuuu

SEQ ID NO: 767228 - RNA, 19 nt, Homo sapiens
guuggaagcugcucuaagc

SEQ ID NO: 767229 - RNA, 19 nt, Homo sapiens
cuucagagcccugcacuuu

SEQ ID NO: 767230 - RNA, 19 nt, Homo sapiens
gaaguugguccugcccuuu

SEQ ID NO: 767231 - RNA, 19 nt, Homo sapiens
aaacgcaacucagcagcaa

SEQ ID NO: 767232 - RNA, 19 nt, Homo sapiens
gcugaucccuccaguacag

SEQ ID NO: 767233 - RNA, 19 nt, Homo sapiens
gauccuggcucgggaagca

SEQ ID NO: 767234 - RNA, 19 nt, Homo sapiens
gcaccuugcagucuuacuu

SEQ ID NO: 767235 - RNA, 19 nt, Homo sapiens
cgggaacgcuggcauuucu

SEQ ID NO: 767236 - RNA, 19 nt, Homo sapiens
guggaugauuugcacuuug

SEQ ID NO: 767237 - RNA, 19 nt, Homo sapiens
gaaacugccccuccuuuga

SEQ ID NO: 767238 - RNA, 19 nt, Homo sapiens
guacagucacaaggacaua

SEQ ID NO: 767239 - RNA, 19 nt, Homo sapiens
uuuaugcccugccuugaga

SEQ ID NO: 767240 - RNA, 19 nt, Homo sapiens
agagcuaccugaggcagaa

SEQ ID NO: 767241 - RNA, 19 nt, Homo sapiens
uggaagccauugcccacuu

SEQ ID NO: 767242 - RNA, 19 nt, Homo sapiens
ccacgugugucugcaccuu

SEQ ID NO: 767243 - RNA, 19 nt, Homo sapiens
gaugauuugcacuuugguu

SEQ ID NO: 767244 - RNA, 19 nt, Homo sapiens
uggcuacagucaacaucuu

SEQ ID NO: 767245 - RNA, 19 nt, Homo sapiens
uggaugauuugcacuuugg

SEQ ID NO: 767246 - RNA, 19 nt, Homo sapiens
cagcaagugcccaucuuuc

SEQ ID NO: 767247 - RNA, 19 nt, Homo sapiens
gcaaggccagaggaacuga

SEQ ID NO: 767248 - RNA, 19 nt, Homo sapiens
ccuggugugugcccuggaa

SEQ ID NO: 767249 - RNA, 19 nt, Homo sapiens
ucacaaggacauaguagcu

SEQ ID NO: 767250 - RNA, 19 nt, Homo sapiens
caaggugguacagaaguug

SEQ ID NO: 767251 - RNA, 19 nt, Homo sapiens
guucaggaaacgcaacuca

SEQ ID NO: 767252 - RNA, 19 nt, Homo sapiens
ccacggcagcaucugauca

SEQ ID NO: 767253 - RNA, 19 nt, Homo sapiens
gaaaugagggucuccauca

SEQ ID NO: 767254 - RNA, 19 nt, Homo sapiens
gcacuuugguucccugugu

SEQ ID NO: 767255 - RNA, 19 nt, Homo sapiens
gcacuagacugggacagau

SEQ ID NO: 767256 - RNA, 19 nt, Homo sapiens
ucagagcccugcacuuugu

SEQ ID NO: 767257 - RNA, 19 nt, Homo sapiens
gcagcaagugcccaucuuu

SEQ ID NO: 767258 - RNA, 19 nt, Homo sapiens
guuaaugaccucgggcuua

SEQ ID NO: 767259 - RNA, 19 nt, Homo sapiens
ugaccucgggcuuaacuua

SEQ ID NO: 767260 - RNA, 19 nt, Homo sapiens
gguggaugauuugcacuuu

SEQ ID NO: 767261 - RNA, 19 nt, Homo sapiens
gcaggguggugcugguguu

SEQ ID NO: 767262 - RNA, 19 nt, Homo sapiens
gugaggagacuuagagaga

SEQ ID NO: 767263 - RNA, 19 nt, Homo sapiens
ccaugaagcgccaaagcua

SEQ ID NO: 767264 - RNA, 19 nt, Homo sapiens
cuucagagcccugcacuuu

SEQ ID NO: 767265 - RNA, 19 nt, Homo sapiens
gaaguugguccugcccuuu

SEQ ID NO: 767266 - RNA, 19 nt, Homo sapiens
gcugaucccuccaguacag

SEQ ID NO: 767267 - RNA, 19 nt, Homo sapiens
gauccuggcucgggaagca

SEQ ID NO: 767268 - RNA, 19 nt, Homo sapiens
gcaccuugcagucuuacuu

SEQ ID NO: 767269 - RNA, 19 nt, Homo sapiens
cgggaacgcuggcauuucu

SEQ ID NO: 767270 - RNA, 19 nt, Homo sapiens
ggagcucucggccaccaua

SEQ ID NO: 767271 - RNA, 19 nt, Homo sapiens
guggaugauuugcacuuug

SEQ ID NO: 767272 - RNA, 19 nt, Homo sapiens
caugaagcgccaaagcuaa

SEQ ID NO: 767273 - RNA, 19 nt, Homo sapiens
gaaacugccccuccuuuga

SEQ ID NO: 767274 - RNA, 19 nt, Homo sapiens
uuuaugcccugccuugaga

SEQ ID NO: 767275 - RNA, 19 nt, Homo sapiens
gcucugggccugcguuucu

SEQ ID NO: 767276 - RNA, 19 nt, Homo sapiens
agagcuaccugaggcagaa

SEQ ID NO: 767277 - RNA, 19 nt, Homo sapiens
ccagggugguggcacuaga

SEQ ID NO: 767278 - RNA, 19 nt, Homo sapiens
gagagacgaagccacuugu

SEQ ID NO: 767279 - RNA, 19 nt, Homo sapiens
ccacgugugucugcaccuu

SEQ ID NO: 767280 - RNA, 19 nt, Homo sapiens
gaugauuugcacuuugguu

SEQ ID NO: 767281 - RNA, 19 nt, Homo sapiens
uggcuacagucaacaucuu

SEQ ID NO: 767282 - RNA, 19 nt, Homo sapiens
uggaugauuugcacuuugg

SEQ ID NO: 767283 - RNA, 19 nt, Homo sapiens
acagcuacccuucgaggaa

SEQ ID NO: 767284 - RNA, 19 nt, Homo sapiens
acuagacugggacagauua

SEQ ID NO: 767285 - RNA, 19 nt, Homo sapiens
cagcaagugcccaucuuuc

SEQ ID NO: 767286 - RNA, 19 nt, Homo sapiens
gacgaagccacuuguccaa

SEQ ID NO: 767287 - RNA, 19 nt, Homo sapiens
agacugggacagauuagga

SEQ ID NO: 767288 - RNA, 19 nt, Homo sapiens
gcgcugcguuuucauuuca

SEQ ID NO: 767289 - RNA, 19 nt, Homo sapiens
ucacaaggacauaguagcu

SEQ ID NO: 767290 - RNA, 19 nt, Homo sapiens
gaagcgccaaagcuaagga

SEQ ID NO: 767291 - RNA, 19 nt, Homo sapiens
gagcucucggccaccauaa

SEQ ID NO: 767292 - RNA, 19 nt, Homo sapiens
aaagccagagggaccauga

SEQ ID NO: 767293 - RNA, 19 nt, Homo sapiens
gcagcaaggugguacagaa

SEQ ID NO: 767294 - RNA, 19 nt, Homo sapiens
gcaaggugguacagaaguu

SEQ ID NO: 767295 - RNA, 19 nt, Homo sapiens
gcacuuugguucccugugu

SEQ ID NO: 767296 - RNA, 19 nt, Homo sapiens
gcaaguacagucacaagga

SEQ ID NO: 767297 - RNA, 19 nt, Homo sapiens
ucagagcccugcacuuugu

SEQ ID NO: 767298 - RNA, 19 nt, Homo sapiens
uuacuuggcuuuccaucug

SEQ ID NO: 767299 - RNA, 19 nt, Homo sapiens
gcagcaagugcccaucuuu

SEQ ID NO: 767300 - RNA, 19 nt, Homo sapiens
gguggaugauuugcacuuu

SEQ ID NO: 767301 - RNA, 19 nt, Homo sapiens
guuggaagcugcucuaagc

SEQ ID NO: 767302 - RNA, 19 nt, Homo sapiens
cuucagagcccugcacuuu

SEQ ID NO: 767303 - RNA, 19 nt, Homo sapiens
gaaguugguccugcccuuu

SEQ ID NO: 767304 - RNA, 19 nt, Homo sapiens
aaacgcaacucagcagcaa

SEQ ID NO: 767305 - RNA, 19 nt, Homo sapiens
gcugaucccuccaguacag

SEQ ID NO: 767306 - RNA, 19 nt, Homo sapiens
gauccuggcucgggaagca

SEQ ID NO: 767307 - RNA, 19 nt, Homo sapiens
gcaccuugcagucuuacuu

SEQ ID NO: 767308 - RNA, 19 nt, Homo sapiens
guggaugauuugcacuuug

SEQ ID NO: 767309 - RNA, 19 nt, Homo sapiens
gaaacugccccuccuuuga

SEQ ID NO: 767310 - RNA, 19 nt, Homo sapiens
guacagucacaaggacaua

SEQ ID NO: 767311 - RNA, 19 nt, Homo sapiens
uuuaugcccugccuugaga

SEQ ID NO: 767312 - RNA, 19 nt, Homo sapiens
agagcuaccugaggcagaa

SEQ ID NO: 767313 - RNA, 19 nt, Homo sapiens
uggaagccauugcccacuu

SEQ ID NO: 767314 - RNA, 19 nt, Homo sapiens
ccacgugugucugcaccuu

SEQ ID NO: 767315 - RNA, 19 nt, Homo sapiens
gaugauuugcacuuugguu

SEQ ID NO: 767316 - RNA, 19 nt, Homo sapiens
uggcuacagucaacaucuu

SEQ ID NO: 767317 - RNA, 19 nt, Homo sapiens
uggaugauuugcacuuugg

SEQ ID NO: 767318 - RNA, 19 nt, Homo sapiens
cagcaagugcccaucuuuc

SEQ ID NO: 767319 - RNA, 19 nt, Homo sapiens
gcaaggccagaggaacuga

SEQ ID NO: 767320 - RNA, 19 nt, Homo sapiens
ccuggugugugcccuggaa

SEQ ID NO: 767321 - RNA, 19 nt, Homo sapiens
ucacaaggacauaguagcu

SEQ ID NO: 767322 - RNA, 19 nt, Homo sapiens
caaggugguacagaaguug

SEQ ID NO: 767323 - RNA, 19 nt, Homo sapiens
guucaggaaacgcaacuca

SEQ ID NO: 767324 - RNA, 19 nt, Homo sapiens
ccacggcagcaucugauca

SEQ ID NO: 767325 - RNA, 19 nt, Homo sapiens
caacauggcuugugugaaa

SEQ ID NO: 767326 - RNA, 19 nt, Homo sapiens
caaaggaacuuguuucuuc

SEQ ID NO: 767327 - RNA, 19 nt, Homo sapiens
gcaaagugcuaauugauau

SEQ ID NO: 767328 - RNA, 19 nt, Homo sapiens
gauaacauguuucagauug

SEQ ID NO: 767329 - RNA, 19 nt, Homo sapiens
caacucagcuuuuacaaua

SEQ ID NO: 767330 - RNA, 19 nt, Homo sapiens
cagcagagaugauaacaug

SEQ ID NO: 767331 - RNA, 19 nt, Homo sapiens
gaacuacaaucaccgaauc

SEQ ID NO: 767332 - RNA, 19 nt, Homo sapiens
gaaaugaaaccaggaagaa

SEQ ID NO: 767333 - RNA, 19 nt, Homo sapiens
gcgaagcgaugccuaaauc

SEQ ID NO: 767334 - RNA, 19 nt, Homo sapiens
cagaagaauuuguaagaug

SEQ ID NO: 767335 - RNA, 19 nt, Homo sapiens
gaugauaacauguuucaga

SEQ ID NO: 767336 - RNA, 19 nt, Homo sapiens
gacuugcuuucacuuauua

SEQ ID NO: 767337 - RNA, 19 nt, Homo sapiens
cauaagaguugguacuguu

SEQ ID NO: 767338 - RNA, 19 nt, Homo sapiens
gcagaagaauuuguaagau

SEQ ID NO: 767339 - RNA, 19 nt, Homo sapiens
gcuauuguauguuuggauu

SEQ ID NO: 767340 - RNA, 19 nt, Homo sapiens
uaaauguucuccaagcuau

SEQ ID NO: 767341 - RNA, 19 nt, Homo sapiens
cgagagcccugucaucuuc

SEQ ID NO: 767342 - RNA, 19 nt, Homo sapiens
ggagccagcugaaggaaca

SEQ ID NO: 767343 - RNA, 19 nt, Homo sapiens
gcagagaugauaacauguu

SEQ ID NO: 767344 - RNA, 19 nt, Homo sapiens
uagaugagaugucugacuu

SEQ ID NO: 767345 - RNA, 19 nt, Homo sapiens
ugagaugucugacuugcuu

SEQ ID NO: 767346 - RNA, 19 nt, Homo sapiens
cugagcagguguuuguuua

SEQ ID NO: 767347 - RNA, 19 nt, Homo sapiens
gagugaagcuaauugucaa

SEQ ID NO: 767348 - RNA, 19 nt, Homo sapiens
ggcaaagugcuaauugaua

SEQ ID NO: 767349 - RNA, 19 nt, Homo sapiens
cagagaugauaacauguuu

SEQ ID NO: 767350 - RNA, 19 nt, Homo sapiens
caucagauauuguucaacu

SEQ ID NO: 767351 - RNA, 19 nt, Homo sapiens
ugacuugcuuucacuuauu

SEQ ID NO: 767352 - RNA, 19 nt, Homo sapiens
gcagugauucugacaguga

SEQ ID NO: 767353 - RNA, 19 nt, Homo sapiens
uccaagcuauuguauguuu

SEQ ID NO: 767354 - RNA, 19 nt, Homo sapiens
ucuccaagcuauuguaugu

SEQ ID NO: 767355 - RNA, 19 nt, Homo sapiens
gagaugauaacauguuuca

SEQ ID NO: 767356 - RNA, 19 nt, Homo sapiens
ucaaaugucuaggcuuguu

SEQ ID NO: 767357 - RNA, 19 nt, Homo sapiens
ugacuuagaugagaugucu

SEQ ID NO: 767358 - RNA, 19 nt, Homo sapiens
gaagcgaugccuaaaucaa

SEQ ID NO: 767359 - RNA, 19 nt, Homo sapiens
cuuaaucucuucauguuca

SEQ ID NO: 767360 - RNA, 19 nt, Homo sapiens
gauggauccugaaggugaa

SEQ ID NO: 767361 - RNA, 19 nt, Homo sapiens
aaaggaacuuguuucuuca

SEQ ID NO: 767362 - RNA, 19 nt, Homo sapiens
uaagaguugguacuguuua

SEQ ID NO: 767363 - RNA, 19 nt, Homo sapiens
gauugcagaagaauuugua

SEQ ID NO: 767364 - RNA, 19 nt, Homo sapiens
auaguguucuguguaguua

SEQ ID NO: 767365 - RNA, 19 nt, Homo sapiens
ggauuuguauugcauugag

SEQ ID NO: 767366 - RNA, 19 nt, Homo sapiens
aagaguugguacuguuuaa

SEQ ID NO: 767367 - RNA, 19 nt, Homo sapiens
aauaaaaccuguacuguuc

SEQ ID NO: 767368 - RNA, 19 nt, Homo sapiens
ucuguguaguuauugcuua

SEQ ID NO: 767369 - RNA, 19 nt, Homo sapiens
aaggcaaagugcuaauuga

SEQ ID NO: 767370 - RNA, 19 nt, Homo sapiens
cagauauuguucaacuaga

SEQ ID NO: 767371 - RNA, 19 nt, Homo sapiens
caugggaugaugucuguaa

SEQ ID NO: 767372 - RNA, 19 nt, Homo sapiens
ugagugaagcuaauuguca

SEQ ID NO: 767373 - RNA, 19 nt, Homo sapiens
gagcgaagcgaugccuaaa

SEQ ID NO: 767374 - RNA, 19 nt, Homo sapiens
ugacagugagguugacaaa

SEQ ID NO: 767375 - RNA, 19 nt, Homo sapiens
ugaaaugaaaccaggaaga

SEQ ID NO: 767376 - RNA, 19 nt, Homo sapiens
uaaaggcaaagugcuaauu

SEQ ID NO: 767377 - RNA, 19 nt, Homo sapiens
ugucuaggcuuguuugacu

SEQ ID NO: 767378 - RNA, 19 nt, Homo sapiens
aagcgaugccuaaaucaaa

SEQ ID NO: 767379 - RNA, 19 nt, Homo sapiens
cuaaauguucuccaagcua

SEQ ID NO: 767380 - RNA, 19 nt, Homo sapiens
cagcugaaggaacagauuu

SEQ ID NO: 767381 - RNA, 19 nt, Homo sapiens
uccugaaggugaaaugaaa

SEQ ID NO: 767382 - RNA, 19 nt, Homo sapiens
aaaggcaaagugcuaauug

SEQ ID NO: 767383 - RNA, 19 nt, Homo sapiens
caaaugucuaggcuuguuu

SEQ ID NO: 767384 - RNA, 19 nt, Homo sapiens
guacuguucuaguuguuuu

SEQ ID NO: 767385 - RNA, 19 nt, Homo sapiens
aaccuguacuguucuaguu

SEQ ID NO: 767386 - RNA, 19 nt, Homo sapiens
uagagaauauuggauggau

SEQ ID NO: 767387 - RNA, 19 nt, Homo sapiens
gggaaaaugagguacguua

SEQ ID NO: 767388 - RNA, 19 nt, Homo sapiens
gguguuuguuuacccauag

SEQ ID NO: 767389 - RNA, 19 nt, Homo sapiens
cgagcgaagcgaugccuaa

SEQ ID NO: 767390 - RNA, 19 nt, Homo sapiens
aguguucuguguaguuauu

SEQ ID NO: 767391 - RNA, 19 nt, Homo sapiens
gaucauaagaguugguacu

SEQ ID NO: 767392 - RNA, 19 nt, Homo sapiens
ccaagcuauuguauguuug

SEQ ID NO: 767393 - RNA, 19 nt, Homo sapiens
cauaguguucuguguaguu

SEQ ID NO: 767394 - RNA, 19 nt, Homo sapiens
gcagcagcagagaugauaa

SEQ ID NO: 767395 - RNA, 19 nt, Homo sapiens
ucagauauuguucaacuag

SEQ ID NO: 767396 - RNA, 19 nt, Homo sapiens
gaucuuuucucuuccaauc

SEQ ID NO: 767397 - RNA, 19 nt, Homo sapiens
ggugaaaugaaaccaggaa

SEQ ID NO: 767398 - RNA, 19 nt, Homo sapiens
gugaaacugucaaaauguu

SEQ ID NO: 767399 - RNA, 19 nt, Homo sapiens
ucauaagaguugguacugu

SEQ ID NO: 767400 - RNA, 19 nt, Homo sapiens
ugcagaagaauuuguaaga

SEQ ID NO: 767401 - RNA, 19 nt, Homo sapiens
uuggauugcagaagaauuu

SEQ ID NO: 767402 - RNA, 19 nt, Homo sapiens
cugacuugcuuucacuuau

SEQ ID NO: 767403 - RNA, 19 nt, Homo sapiens
aaggauuuguauugcauug

SEQ ID NO: 767404 - RNA, 19 nt, Homo sapiens
uaaaaccuguacuguucua

SEQ ID NO: 767405 - RNA, 19 nt, Homo sapiens
aaaugaaaccaggaagaaa

SEQ ID NO: 767406 - RNA, 19 nt, Homo sapiens
gauccugaaggugaaauga

SEQ ID NO: 767407 - RNA, 19 nt, Homo sapiens
gaacgaccaagaggguguu

SEQ ID NO: 767408 - RNA, 19 nt, Homo sapiens
ucaccgaaucuacuguauu

SEQ ID NO: 767409 - RNA, 19 nt, Homo sapiens
uggcagugauucugacagu

SEQ ID NO: 767410 - RNA, 19 nt, Homo sapiens
ucaaaggaacuuguuucuu

SEQ ID NO: 767411 - RNA, 19 nt, Homo sapiens
cccauaguguucuguguag

SEQ ID NO: 767412 - RNA, 19 nt, Homo sapiens
uaugguaugcuuauuugga

SEQ ID NO: 767413 - RNA, 19 nt, Homo sapiens
guaaaauucgagccauaua

SEQ ID NO: 767414 - RNA, 19 nt, Homo sapiens
gaaaaugagguacguuagu

SEQ ID NO: 767415 - RNA, 19 nt, Homo sapiens
gagcagcagcagcagagau

SEQ ID NO: 767416 - RNA, 19 nt, Homo sapiens
augguaugcuuauuuggaa

SEQ ID NO: 767417 - RNA, 19 nt, Homo sapiens
cuaaaucaaaggaacuugu

SEQ ID NO: 767418 - RNA, 19 nt, Homo sapiens
agaggguguucgacugcua

SEQ ID NO: 767419 - RNA, 19 nt, Homo sapiens
aaucaaaggaacuuguuuc

SEQ ID NO: 767420 - RNA, 19 nt, Homo sapiens
augcuuauuuggaaaguca

SEQ ID NO: 767421 - RNA, 19 nt, Homo sapiens
ccuguacuguucuaguugu

SEQ ID NO: 767422 - RNA, 19 nt, Homo sapiens
gagcagguguuuguuuacc

SEQ ID NO: 767423 - RNA, 19 nt, Homo sapiens
aaucaccgaaucuacugua

SEQ ID NO: 767424 - RNA, 19 nt, Homo sapiens
aaaaugagguacguuagug

SEQ ID NO: 767425 - RNA, 19 nt, Homo sapiens
gaacaacucucagcagaau

SEQ ID NO: 767426 - RNA, 19 nt, Homo sapiens
agaagcaucuuucaugaua

SEQ ID NO: 767427 - RNA, 19 nt, Homo sapiens
gaaaguacauugaacaacu

SEQ ID NO: 767428 - RNA, 19 nt, Homo sapiens
caacaauccugguaucaga

SEQ ID NO: 767429 - RNA, 19 nt, Homo sapiens
gaacaucacagcaaugaga

SEQ ID NO: 767430 - RNA, 19 nt, Homo sapiens
gaaguccaguaaauucuuu

SEQ ID NO: 767431 - RNA, 19 nt, Homo sapiens
ggauguaaauuggauguaa

SEQ ID NO: 767432 - RNA, 19 nt, Homo sapiens
gcaaugagagaauacuaua

SEQ ID NO: 767433 - RNA, 19 nt, Homo sapiens
uguaaggccuuucagauuu

SEQ ID NO: 767434 - RNA, 19 nt, Homo sapiens
guacuacggcccaaauaua

SEQ ID NO: 767435 - RNA, 19 nt, Homo sapiens
ggagaagguguauaucaua

SEQ ID NO: 767436 - RNA, 19 nt, Homo sapiens
gaucaucagucuaaacaca

SEQ ID NO: 767437 - RNA, 19 nt, Homo sapiens
ucacagcaaugagagaaua

SEQ ID NO: 767438 - RNA, 19 nt, Homo sapiens
ucuggaagcuggaguauau

SEQ ID NO: 767439 - RNA, 19 nt, Homo sapiens
gcgaauucuuuaucucuaa

SEQ ID NO: 767440 - RNA, 19 nt, Homo sapiens
ccaaauauaaugacacuga

SEQ ID NO: 767441 - RNA, 19 nt, Homo sapiens
gcaaaccucuggaaaccau

SEQ ID NO: 767442 - RNA, 19 nt, Homo sapiens
gagaagguguauaucauag

SEQ ID NO: 767443 - RNA, 19 nt, Homo sapiens
gacaguaagcaguuuauaa

SEQ ID NO: 767444 - RNA, 19 nt, Homo sapiens
guaaggccuuucagauuug

SEQ ID NO: 767445 - RNA, 19 nt, Homo sapiens
ugacagaggcgaaucuaaa

SEQ ID NO: 767446 - RNA, 19 nt, Homo sapiens
gaugaagaagcuauuagua

SEQ ID NO: 767447 - RNA, 19 nt, Homo sapiens
gaagguguauaucauagca

SEQ ID NO: 767448 - RNA, 19 nt, Homo sapiens
uggauauguugcaguauua

SEQ ID NO: 767449 - RNA, 19 nt, Homo sapiens
ccaguaaauucuuuguuug

SEQ ID NO: 767450 - RNA, 19 nt, Homo sapiens
ugacagcaguguaacaugu

SEQ ID NO: 767451 - RNA, 19 nt, Homo sapiens
ccuacgacauugaagauuu

SEQ ID NO: 767452 - RNA, 19 nt, Homo sapiens
gcauuaugguucuuucaga

SEQ ID NO: 767453 - RNA, 19 nt, Homo sapiens
gauucuccauaucaacuua

SEQ ID NO: 767454 - RNA, 19 nt, Homo sapiens
ccucaaacagcuuuauaua

SEQ ID NO: 767455 - RNA, 19 nt, Homo sapiens
uaccugaacucucaacaga

SEQ ID NO: 767456 - RNA, 19 nt, Homo sapiens
gaaugauggauguaaauug

SEQ ID NO: 767457 - RNA, 19 nt, Homo sapiens
ugaagaagcuauuaguacu

SEQ ID NO: 767458 - RNA, 19 nt, Homo sapiens
gaagcaucuuucaugauau

SEQ ID NO: 767459 - RNA, 19 nt, Homo sapiens
ggagauguucugugugauu

SEQ ID NO: 767460 - RNA, 19 nt, Homo sapiens
uauuggauauguugcagua

SEQ ID NO: 767461 - RNA, 19 nt, Homo sapiens
ccaguaaaguguacaaugc

SEQ ID NO: 767462 - RNA, 19 nt, Homo sapiens
gaagaagcuauuaguacuu

SEQ ID NO: 767463 - RNA, 19 nt, Homo sapiens
guaugauccucgugauuau

SEQ ID NO: 767464 - RNA, 19 nt, Homo sapiens
ucacagagacagcauuaug

SEQ ID NO: 767465 - RNA, 19 nt, Homo sapiens
gagauguucugugugauuc

SEQ ID NO: 767466 - RNA, 19 nt, Homo sapiens
ucacagaugaccacacaaa

SEQ ID NO: 767467 - RNA, 19 nt, Homo sapiens
gagaucaauuugugggaau

SEQ ID NO: 767468 - RNA, 19 nt, Homo sapiens
gugcaauuaugaaucuuga

SEQ ID NO: 767469 - RNA, 19 nt, Homo sapiens
cuacgacauugaagauuug

SEQ ID NO: 767470 - RNA, 19 nt, Homo sapiens
uaaaguguacaaugcagua

SEQ ID NO: 767471 - RNA, 19 nt, Homo sapiens
cagacacuguuauaaaugu

SEQ ID NO: 767472 - RNA, 19 nt, Homo sapiens
ucacagaacaucacagcaa

SEQ ID NO: 767473 - RNA, 19 nt, Homo sapiens
cuaugcagauugccucaaa

SEQ ID NO: 767474 - RNA, 19 nt, Homo sapiens
uaagacauguaaggccuuu

SEQ ID NO: 767475 - RNA, 19 nt, Homo sapiens
ugacugacuuacacuuaga

SEQ ID NO: 767476 - RNA, 19 nt, Homo sapiens
ucagauuugugcaauuaug

SEQ ID NO: 767477 - RNA, 19 nt, Homo sapiens
gcuauuaguacuuuaagga

SEQ ID NO: 767478 - RNA, 19 nt, Homo sapiens
aaccauggcuagaugaaga

SEQ ID NO: 767479 - RNA, 19 nt, Homo sapiens
gaaaccauggcuagaugaa

SEQ ID NO: 767480 - RNA, 19 nt, Homo sapiens
ccggaaaguuuauauggau

SEQ ID NO: 767481 - RNA, 19 nt, Homo sapiens
gagagaauacuauaaugag

SEQ ID NO: 767482 - RNA, 19 nt, Homo sapiens
agaauaaggagaaggugua

SEQ ID NO: 767483 - RNA, 19 nt, Homo sapiens
aguaugauccucgugauua

SEQ ID NO: 767484 - RNA, 19 nt, Homo sapiens
gccggaaaguuuauaugga

SEQ ID NO: 767485 - RNA, 19 nt, Homo sapiens
cuacuuaccacaucacaga

SEQ ID NO: 767486 - RNA, 19 nt, Homo sapiens
ggaaguccaguaaauucuu

SEQ ID NO: 767487 - RNA, 19 nt, Homo sapiens
aaaaggaaguccaguaaau

SEQ ID NO: 767488 - RNA, 19 nt, Homo sapiens
acaacucucagcagaauaa

SEQ ID NO: 767489 - RNA, 19 nt, Homo sapiens
guacauugaacaacucuca

SEQ ID NO: 767490 - RNA, 19 nt, Homo sapiens
gcuagaaaguacauugaac

SEQ ID NO: 767491 - RNA, 19 nt, Homo sapiens
acaacuaauccaaaccuua

SEQ ID NO: 767492 - RNA, 19 nt, Homo sapiens
aaugauggauguaaauugg

SEQ ID NO: 767493 - RNA, 19 nt, Homo sapiens
aaaggaaguccaguaaauu

SEQ ID NO: 767494 - RNA, 19 nt, Homo sapiens
auaaggagaagguguauau

SEQ ID NO: 767495 - RNA, 19 nt, Homo sapiens
caguuugaauggcuagaaa

SEQ ID NO: 767496 - RNA, 19 nt, Homo sapiens
ggaaaccauggcuagauga

SEQ ID NO: 767497 - RNA, 19 nt, Homo sapiens
ccugaacucucaacagaca

SEQ ID NO: 767498 - RNA, 19 nt, Homo sapiens
uuggagauguucuguguga

SEQ ID NO: 767499 - RNA, 19 nt, Homo sapiens
uguaacaugugauaagaca

SEQ ID NO: 767500 - RNA, 19 nt, Homo sapiens
gcaugugacugacuuacac

SEQ ID NO: 767501 - RNA, 19 nt, Homo sapiens
cagaacaucacagcaauga

SEQ ID NO: 767502 - RNA, 19 nt, Homo sapiens
ugacccagccaaccaguuu

SEQ ID NO: 767503 - RNA, 19 nt, Homo sapiens
ggauagcccaccucauguu

SEQ ID NO: 767504 - RNA, 19 nt, Homo sapiens
aagcaucuuucaugauaug

SEQ ID NO: 767505 - RNA, 19 nt, Homo sapiens
gaagauuugcagccggaaa

SEQ ID NO: 767506 - RNA, 19 nt, Homo sapiens
cacagaacaucacagcaau

SEQ ID NO: 767507 - RNA, 19 nt, Homo sapiens
uaaugacacugaacaagac

SEQ ID NO: 767508 - RNA, 19 nt, Homo sapiens
uggaaaccauggcuagaug

SEQ ID NO: 767509 - RNA, 19 nt, Homo sapiens
gcuggguaaucaugacuau

SEQ ID NO: 767510 - RNA, 19 nt, Homo sapiens
caaccaccauccagagucu

SEQ ID NO: 767511 - RNA, 19 nt, Homo sapiens
uuggauauguugcaguauu

SEQ ID NO: 767512 - RNA, 19 nt, Homo sapiens
gcccaaauauaaugacacu

SEQ ID NO: 767513 - RNA, 19 nt, Homo sapiens
ucaucagucuaaacacaaa

SEQ ID NO: 767514 - RNA, 19 nt, Homo sapiens
cggaaaguuuauauggauu

SEQ ID NO: 767515 - RNA, 19 nt, Homo sapiens
gacccagaccuacgacauu

SEQ ID NO: 767516 - RNA, 19 nt, Homo sapiens
gugacugacuuacacuuag

SEQ ID NO: 767517 - RNA, 19 nt, Homo sapiens
ggacaguuuuggcauguga

SEQ ID NO: 767518 - RNA, 19 nt, Homo sapiens
gaauaaggagaagguguau

SEQ ID NO: 767519 - RNA, 19 nt, Homo sapiens
uacuacggcccaaauauaa

SEQ ID NO: 767520 - RNA, 19 nt, Homo sapiens
auucugagaucaauuugug

SEQ ID NO: 767521 - RNA, 19 nt, Homo sapiens
cauuaugguucuuucagau

SEQ ID NO: 767522 - RNA, 19 nt, Homo sapiens
gagacagcauuaugguucu

SEQ ID NO: 767523 - RNA, 19 nt, Homo sapiens
guagucaccaguaaagugu

SEQ ID NO: 767524 - RNA, 19 nt, Homo sapiens
gaucaacugccuguaguca

SEQ ID NO: 767525 - RNA, 19 nt, Homo sapiens
gaacacacauuaagugaaa

SEQ ID NO: 767526 - RNA, 19 nt, Homo sapiens
gaaugugacuucaagaaua

SEQ ID NO: 767527 - RNA, 19 nt, Homo sapiens
gcagaaauaugaagaucua

SEQ ID NO: 767528 - RNA, 19 nt, Homo sapiens
gauaugagccaacuuuaua

SEQ ID NO: 767529 - RNA, 19 nt, Homo sapiens
gagcagaauuuccuguaua

SEQ ID NO: 767530 - RNA, 19 nt, Homo sapiens
gcacaaaccuugggucgaa

SEQ ID NO: 767531 - RNA, 19 nt, Homo sapiens
gaaggaagcuaaauuugca

SEQ ID NO: 767532 - RNA, 19 nt, Homo sapiens
gaagauaugagccaacuuu

SEQ ID NO: 767533 - RNA, 19 nt, Homo sapiens
ggaccuucauucaauauuu

SEQ ID NO: 767534 - RNA, 19 nt, Homo sapiens
gacauuagauacuacauug

SEQ ID NO: 767535 - RNA, 19 nt, Homo sapiens
ugagagggcuuaaugagaa

SEQ ID NO: 767536 - RNA, 19 nt, Homo sapiens
ucagaaagauugccaggaa

SEQ ID NO: 767537 - RNA, 19 nt, Homo sapiens
caaauaagaaggaagcuaa

SEQ ID NO: 767538 - RNA, 19 nt, Homo sapiens
gaauguugcuugcagaaau

SEQ ID NO: 767539 - RNA, 19 nt, Homo sapiens
gaauuucucagcaaagaua

SEQ ID NO: 767540 - RNA, 19 nt, Homo sapiens
gaagaugacauaagacaga

SEQ ID NO: 767541 - RNA, 19 nt, Homo sapiens
aaaguggaauugcaacaua

SEQ ID NO: 767542 - RNA, 19 nt, Homo sapiens
caaaggaucucaaggaaaa

SEQ ID NO: 767543 - RNA, 19 nt, Homo sapiens
gauggaaguucauuuaagu

SEQ ID NO: 767544 - RNA, 19 nt, Homo sapiens
cagcaaagauaucaguuau

SEQ ID NO: 767545 - RNA, 19 nt, Homo sapiens
gaagucagauacugugcuu

SEQ ID NO: 767546 - RNA, 19 nt, Homo sapiens
aaacagauggcgauaagua

SEQ ID NO: 767547 - RNA, 19 nt, Homo sapiens
gaaacucaccuucuaagug

SEQ ID NO: 767548 - RNA, 19 nt, Homo sapiens
gcaaaggcuccauuccaua

SEQ ID NO: 767549 - RNA, 19 nt, Homo sapiens
gaauugagagggcuuaaug

SEQ ID NO: 767550 - RNA, 19 nt, Homo sapiens
ccaggaagaugauacaaca

SEQ ID NO: 767551 - RNA, 19 nt, Homo sapiens
ccaaacagauggcgauaag

SEQ ID NO: 767552 - RNA, 19 nt, Homo sapiens
gaccaucucugaaaucucu

SEQ ID NO: 767553 - RNA, 19 nt, Homo sapiens
ccaugaggauccacaguaa

SEQ ID NO: 767554 - RNA, 19 nt, Homo sapiens
uuacuagacuuguuucaga

SEQ ID NO: 767555 - RNA, 19 nt, Homo sapiens
aaggguagaucacuauaaa

SEQ ID NO: 767556 - RNA, 19 nt, Homo sapiens
ggagcagaauuuccuguau

SEQ ID NO: 767557 - RNA, 19 nt, Homo sapiens
gaaaaggacacaccuaaaa

SEQ ID NO: 767558 - RNA, 19 nt, Homo sapiens
acagcuaccucuacauaaa

SEQ ID NO: 767559 - RNA, 19 nt, Homo sapiens
cagaauugaauaccuguua

SEQ ID NO: 767560 - RNA, 19 nt, Homo sapiens
caagagcaccuaacuguuc

SEQ ID NO: 767561 - RNA, 19 nt, Homo sapiens
gaagaugauacaacaguga

SEQ ID NO: 767562 - RNA, 19 nt, Homo sapiens
gcaaaggaucucaaggaaa

SEQ ID NO: 767563 - RNA, 19 nt, Homo sapiens
uaaccaguaucaaguuguu

SEQ ID NO: 767564 - RNA, 19 nt, Homo sapiens
gagcaacacagaaacuuug

SEQ ID NO: 767565 - RNA, 19 nt, Homo sapiens
aaagcaaacucagguuaaa

SEQ ID NO: 767566 - RNA, 19 nt, Homo sapiens
ugaaaucucugaaaacuga

SEQ ID NO: 767567 - RNA, 19 nt, Homo sapiens
aaacagaagucagauacug

SEQ ID NO: 767568 - RNA, 19 nt, Homo sapiens
uaagugagcaacacagaaa

SEQ ID NO: 767569 - RNA, 19 nt, Homo sapiens
ucaugauucuggucugaua

SEQ ID NO: 767570 - RNA, 19 nt, Homo sapiens
gaaaccacuucaccucauc

SEQ ID NO: 767571 - RNA, 19 nt, Homo sapiens
guucaccgguacagucuuu

SEQ ID NO: 767572 - RNA, 19 nt, Homo sapiens
guacauguuucugauuuca

SEQ ID NO: 767573 - RNA, 19 nt, Homo sapiens
acacagcuaccucuacaua

SEQ ID NO: 767574 - RNA, 19 nt, Homo sapiens
gagagggcuuaaugagaaa

SEQ ID NO: 767575 - RNA, 19 nt, Homo sapiens
aaacucagguuaaacuaag

SEQ ID NO: 767576 - RNA, 19 nt, Homo sapiens
guauggaaauucuuaggau

SEQ ID NO: 767577 - RNA, 19 nt, Homo sapiens
gaauauggauaguuuaccu

SEQ ID NO: 767578 - RNA, 19 nt, Homo sapiens
ggcaaaggcuccauuccau

SEQ ID NO: 767579 - RNA, 19 nt, Homo sapiens
aaacaaacaggaaugcauu

SEQ ID NO: 767580 - RNA, 19 nt, Homo sapiens
caaacucagguuaaacuaa

SEQ ID NO: 767581 - RNA, 19 nt, Homo sapiens
agugguauaugcaauguuu

SEQ ID NO: 767582 - RNA, 19 nt, Homo sapiens
gguggaaccucaauucaac

SEQ ID NO: 767583 - RNA, 19 nt, Homo sapiens
gacaagccaucuaguaugc

SEQ ID NO: 767584 - RNA, 19 nt, Homo sapiens
gagggcgaguugaagaauu

SEQ ID NO: 767585 - RNA, 19 nt, Homo sapiens
ggguagaucacuauaaaug

SEQ ID NO: 767586 - RNA, 19 nt, Homo sapiens
gaugacauaagacagaauu

SEQ ID NO: 767587 - RNA, 19 nt, Homo sapiens
gaaacuuugcacagaguaa

SEQ ID NO: 767588 - RNA, 19 nt, Homo sapiens
aauguugcuugcagaaaua

SEQ ID NO: 767589 - RNA, 19 nt, Homo sapiens
caagaaaucaaguacuuca

SEQ ID NO: 767590 - RNA, 19 nt, Homo sapiens
gauaaggaucauauucuug

SEQ ID NO: 767591 - RNA, 19 nt, Homo sapiens
caauaaacaguucacaaga

SEQ ID NO: 767592 - RNA, 19 nt, Homo sapiens
cacagaaacuuugcacaga

SEQ ID NO: 767593 - RNA, 19 nt, Homo sapiens
gugaagagaaaucagaauu

SEQ ID NO: 767594 - RNA, 19 nt, Homo sapiens
cagcaaaggaucucaagga

SEQ ID NO: 767595 - RNA, 19 nt, Homo sapiens
gaaaaugacuuagaagaac

SEQ ID NO: 767596 - RNA, 19 nt, Homo sapiens
gcaaacucagguuaaacua

SEQ ID NO: 767597 - RNA, 19 nt, Homo sapiens
ucagcaaagauaucaguua

SEQ ID NO: 767598 - RNA, 19 nt, Homo sapiens
agcagaauuuccuguauaa

SEQ ID NO: 767599 - RNA, 19 nt, Homo sapiens
uagaagaacuaaggguaga

SEQ ID NO: 767600 - RNA, 19 nt, Homo sapiens
uuacacagcuaccucuaca

SEQ ID NO: 767601 - RNA, 19 nt, Homo sapiens
uaaguacagcugaagauga

SEQ ID NO: 767602 - RNA, 19 nt, Homo sapiens
caagccaucuaguaugcaa

SEQ ID NO: 767603 - RNA, 19 nt, Homo sapiens
uaucaaaugccuugucaug

SEQ ID NO: 767604 - RNA, 19 nt, Homo sapiens
ggucgaauuucuccuguac

SEQ ID NO: 767605 - RNA, 19 nt, Homo sapiens
ccuucaacuucuacauuua

SEQ ID NO: 767606 - RNA, 19 nt, Homo sapiens
cacaagagcaccuaacugu

SEQ ID NO: 767607 - RNA, 19 nt, Homo sapiens
cuaagaauccaaacagaug

SEQ ID NO: 767608 - RNA, 19 nt, Homo sapiens
uaucuucagcugaccaaua

SEQ ID NO: 767609 - RNA, 19 nt, Homo sapiens
cucaagaaaucaaguacuu

SEQ ID NO: 767610 - RNA, 19 nt, Homo sapiens
aagaaaaucuggaaccaaa

SEQ ID NO: 767611 - RNA, 19 nt, Homo sapiens
gccaugaggauccacagua

SEQ ID NO: 767612 - RNA, 19 nt, Homo sapiens
ggucugauaacaauaaaca

SEQ ID NO: 767613 - RNA, 19 nt, Homo sapiens
aauaguggaucucaaccaa

SEQ ID NO: 767614 - RNA, 19 nt, Homo sapiens
caacagugaaggagcagaa

SEQ ID NO: 767615 - RNA, 19 nt, Homo sapiens
cagaagcccugcaguccau

SEQ ID NO: 767616 - RNA, 19 nt, Homo sapiens
gauaauaguggaucucaac

SEQ ID NO: 767617 - RNA, 19 nt, Homo sapiens
gaacuaaggguagaucacu

SEQ ID NO: 767618 - RNA, 19 nt, Homo sapiens
cagugaaggagcagaauuu

SEQ ID NO: 767619 - RNA, 19 nt, Homo sapiens
augaagaucuagaaacuca

SEQ ID NO: 767620 - RNA, 19 nt, Homo sapiens
gcaguccauuugauguaga

SEQ ID NO: 767621 - RNA, 19 nt, Homo sapiens
uuguaaagguggaagauau

SEQ ID NO: 767622 - RNA, 19 nt, Homo sapiens
gaucugggagggcgaguug

SEQ ID NO: 767623 - RNA, 19 nt, Homo sapiens
cccuucaacuucuacauuu

SEQ ID NO: 767624 - RNA, 19 nt, Homo sapiens
ucagacuagugaagagaaa

SEQ ID NO: 767625 - RNA, 19 nt, Homo sapiens
ggaaguaucugccaacaug

SEQ ID NO: 767626 - RNA, 19 nt, Homo sapiens
caaagaagauggcucgaaa

SEQ ID NO: 767627 - RNA, 19 nt, Homo sapiens
gcaaagcaguggaacauau

SEQ ID NO: 767628 - RNA, 19 nt, Homo sapiens
cacaaacucugccaaauuu

SEQ ID NO: 767629 - RNA, 19 nt, Homo sapiens
acacuuggaugguggauua

SEQ ID NO: 767630 - RNA, 19 nt, Homo sapiens
gcaaacaaguggaauaugc

SEQ ID NO: 767631 - RNA, 19 nt, Homo sapiens
aaagaagucugucuauuuc

SEQ ID NO: 767632 - RNA, 19 nt, Homo sapiens
gaagauggcucgaaaagga

SEQ ID NO: 767633 - RNA, 19 nt, Homo sapiens
gaucagagagugcuuguga

SEQ ID NO: 767634 - RNA, 19 nt, Homo sapiens
gaagaggacaucccacaaa

SEQ ID NO: 767635 - RNA, 19 nt, Homo sapiens
acacuaacauucugugaaa

SEQ ID NO: 767636 - RNA, 19 nt, Homo sapiens
cauaaagacuugauugcuu

SEQ ID NO: 767637 - RNA, 19 nt, Homo sapiens
ggacuggcauggucauuca

SEQ ID NO: 767638 - RNA, 19 nt, Homo sapiens
ggauuaaccagaacacuaa

SEQ ID NO: 767639 - RNA, 19 nt, Homo sapiens
gaggaugguucuaaagaug

SEQ ID NO: 767640 - RNA, 19 nt, Homo sapiens
ccaguuuaaugaaagcuua

SEQ ID NO: 767641 - RNA, 19 nt, Homo sapiens
gacagaggaugguucuaaa

SEQ ID NO: 767642 - RNA, 19 nt, Homo sapiens
ggucauucaucaaguagaa

SEQ ID NO: 767643 - RNA, 19 nt, Homo sapiens
caaguuugaugaugauuuc

SEQ ID NO: 767644 - RNA, 19 nt, Homo sapiens
ucacaaacucugccaaauu

SEQ ID NO: 767645 - RNA, 19 nt, Homo sapiens
aaucagcgaugcacacuug

SEQ ID NO: 767646 - RNA, 19 nt, Homo sapiens
ggacuagaacuuaauaaag

SEQ ID NO: 767647 - RNA, 19 nt, Homo sapiens
cacccuaacucucuuauuc

SEQ ID NO: 767648 - RNA, 19 nt, Homo sapiens
ggauuugacuguguuuaug

SEQ ID NO: 767649 - RNA, 19 nt, Homo sapiens
gcuaguaucauagucauuu

SEQ ID NO: 767650 - RNA, 19 nt, Homo sapiens
cuugauugcuuuccaguuu

SEQ ID NO: 767651 - RNA, 19 nt, Homo sapiens
guggaacuaugaaauguau

SEQ ID NO: 767652 - RNA, 19 nt, Homo sapiens
guaaauccuucuuuguauc

SEQ ID NO: 767653 - RNA, 19 nt, Homo sapiens
agagagugcuugugauuuc

SEQ ID NO: 767654 - RNA, 19 nt, Homo sapiens
cauggucauucaucaagua

SEQ ID NO: 767655 - RNA, 19 nt, Homo sapiens
ggaauaugccaaagaagau

SEQ ID NO: 767656 - RNA, 19 nt, Homo sapiens
guaucuguaucuaccuaua

SEQ ID NO: 767657 - RNA, 19 nt, Homo sapiens
ccaaauuuguggaacuaug

SEQ ID NO: 767658 - RNA, 19 nt, Homo sapiens
gaacacuaacauucuguga

SEQ ID NO: 767659 - RNA, 19 nt, Homo sapiens
gcaagcauaguuugauguu

SEQ ID NO: 767660 - RNA, 19 nt, Homo sapiens
uaccaacucuuagaugauu

SEQ ID NO: 767661 - RNA, 19 nt, Homo sapiens
gacccugucuuguacaugu

SEQ ID NO: 767662 - RNA, 19 nt, Homo sapiens
caaauuuguggaacuauga

SEQ ID NO: 767663 - RNA, 19 nt, Homo sapiens
cagcagaacugguuuuguu

SEQ ID NO: 767664 - RNA, 19 nt, Homo sapiens
ugacuguguuuauggacua

SEQ ID NO: 767665 - RNA, 19 nt, Homo sapiens
ggaguuacaggcaaguuug

SEQ ID NO: 767666 - RNA, 19 nt, Homo sapiens
gaauaguacagauugaugu

SEQ ID NO: 767667 - RNA, 19 nt, Homo sapiens
uguaccaacucuuagauga

SEQ ID NO: 767668 - RNA, 19 nt, Homo sapiens
gaacacaugguuuuacauu

SEQ ID NO: 767669 - RNA, 19 nt, Homo sapiens
agacagaggaugguucuaa

SEQ ID NO: 767670 - RNA, 19 nt, Homo sapiens
gcuccgcugucacuuaaau

SEQ ID NO: 767671 - RNA, 19 nt, Homo sapiens
ugauugcuuuccaguuuaa

SEQ ID NO: 767672 - RNA, 19 nt, Homo sapiens
gguaaaaguuaagcuagua

SEQ ID NO: 767673 - RNA, 19 nt, Homo sapiens
cauuaugccugauuccaau

SEQ ID NO: 767674 - RNA, 19 nt, Homo sapiens
caucguaggcugcaggauu

SEQ ID NO: 767675 - RNA, 19 nt, Homo sapiens
gcagcuuuguggauuagga

SEQ ID NO: 767676 - RNA, 19 nt, Homo sapiens
caagcauaguuugauguuu

SEQ ID NO: 767677 - RNA, 19 nt, Homo sapiens
gaaccccuuucuuuuaaaa

SEQ ID NO: 767678 - RNA, 19 nt, Homo sapiens
uaguacagauugaugugaa

SEQ ID NO: 767679 - RNA, 19 nt, Homo sapiens
gccaagcccuccgucuauu

SEQ ID NO: 767680 - RNA, 19 nt, Homo sapiens
ucagagagugcuugugauu

SEQ ID NO: 767681 - RNA, 19 nt, Homo sapiens
guuuauggacuagaacuua

SEQ ID NO: 767682 - RNA, 19 nt, Homo sapiens
agacauaaagacuugauug

SEQ ID NO: 767683 - RNA, 19 nt, Homo sapiens
aguggaauaugccaaagaa

SEQ ID NO: 767684 - RNA, 19 nt, Homo sapiens
gcacgugcaccugucauga

SEQ ID NO: 767685 - RNA, 19 nt, Homo sapiens
gagagugcuugugauuuca

SEQ ID NO: 767686 - RNA, 19 nt, Homo sapiens
caucacaaacucugccaaa

SEQ ID NO: 767687 - RNA, 19 nt, Homo sapiens
ugucuacgauuuggugaaa

SEQ ID NO: 767688 - RNA, 19 nt, Homo sapiens
cagaggaugguucuaaaga

SEQ ID NO: 767689 - RNA, 19 nt, Homo sapiens
caaagcaguggaacauaug

SEQ ID NO: 767690 - RNA, 19 nt, Homo sapiens
guugcgacaucucgaauca

SEQ ID NO: 767691 - RNA, 19 nt, Homo sapiens
gguuuuacauuaccuauga

SEQ ID NO: 767692 - RNA, 19 nt, Homo sapiens
cuguaaauccuucuuugua

SEQ ID NO: 767693 - RNA, 19 nt, Homo sapiens
gccuguaaauccuucuuug

SEQ ID NO: 767694 - RNA, 19 nt, Homo sapiens
gggaguuacaggcaaguuu

SEQ ID NO: 767695 - RNA, 19 nt, Homo sapiens
uugauugcuuuccaguuua

SEQ ID NO: 767696 - RNA, 19 nt, Homo sapiens
uggaauaugccaaagaaga

SEQ ID NO: 767697 - RNA, 19 nt, Homo sapiens
cugccaacaugaugaagaa

SEQ ID NO: 767698 - RNA, 19 nt, Homo sapiens
agaagucugucuauuucga

SEQ ID NO: 767699 - RNA, 19 nt, Homo sapiens
cuugaaguccucccugaua

SEQ ID NO: 767700 - RNA, 19 nt, Homo sapiens
ccaacaugaugaagaagag

SEQ ID NO: 767701 - RNA, 19 nt, Homo sapiens
gcaaguuugguaaaaguua

SEQ ID NO: 767702 - RNA, 19 nt, Homo sapiens
acacuuggcagacacaaug

SEQ ID NO: 767703 - RNA, 19 nt, Homo sapiens
cgauggauuugacuguguu

SEQ ID NO: 767704 - RNA, 19 nt, Homo sapiens
gaaguaucugccaacauga

SEQ ID NO: 767705 - RNA, 19 nt, Homo sapiens
ccaagcccuccgucuauuu

SEQ ID NO: 767706 - RNA, 19 nt, Homo sapiens
gcauggucauucaucaagu

SEQ ID NO: 767707 - RNA, 19 nt, Homo sapiens
gaauaugccaaagaagaug

SEQ ID NO: 767708 - RNA, 19 nt, Homo sapiens
agaggaugguucuaaagau

SEQ ID NO: 767709 - RNA, 19 nt, Homo sapiens
uggauuaaccagaacacua

SEQ ID NO: 767710 - RNA, 19 nt, Homo sapiens
ccaaagaagauggcucgaa

SEQ ID NO: 767711 - RNA, 19 nt, Homo sapiens
gaaagggaaccaggagaag

SEQ ID NO: 767712 - RNA, 19 nt, Homo sapiens
agaaagggaaccaggagaa

SEQ ID NO: 767713 - RNA, 19 nt, Homo sapiens
uaaccagaacacuaacauu

SEQ ID NO: 767714 - RNA, 19 nt, Homo sapiens
ugccaaauuuguggaacua

SEQ ID NO: 767715 - RNA, 19 nt, Homo sapiens
ggaaccaggagaaguugug

SEQ ID NO: 767716 - RNA, 19 nt, Homo sapiens
acaaguggaauaugccaaa

SEQ ID NO: 767717 - RNA, 19 nt, Homo sapiens
aaccagaacacuaacauuc

SEQ ID NO: 767718 - RNA, 19 nt, Homo sapiens
uaagcuaguaucauaguca

SEQ ID NO: 767719 - RNA, 19 nt, Homo sapiens
ugaauaguacagauugaug

SEQ ID NO: 767720 - RNA, 19 nt, Homo sapiens
cagagagugcuugugauuu

SEQ ID NO: 767721 - RNA, 19 nt, Homo sapiens
ggauucagcauggguggaa

SEQ ID NO: 767722 - RNA, 19 nt, Homo sapiens
gaugcacacuuggcagaca

SEQ ID NO: 767723 - RNA, 19 nt, Homo sapiens
guuacaggcaaguuuggua

SEQ ID NO: 767724 - RNA, 19 nt, Homo sapiens
ggaugguucuaaagaugag

SEQ ID NO: 767725 - RNA, 19 nt, Homo sapiens
caaaggaacuggaaacaaa

SEQ ID NO: 767726 - RNA, 19 nt, Homo sapiens
gaagauagcucuggagaug

SEQ ID NO: 767727 - RNA, 19 nt, Homo sapiens
gaauguaacuaucuucuga

SEQ ID NO: 767728 - RNA, 19 nt, Homo sapiens
gaucagcccuacuaaguuu

SEQ ID NO: 767729 - RNA, 19 nt, Homo sapiens
gaacgaagagcuggaaaua

SEQ ID NO: 767730 - RNA, 19 nt, Homo sapiens
gaagugagacugaggagua

SEQ ID NO: 767731 - RNA, 19 nt, Homo sapiens
gaagagaucagcccuacua

SEQ ID NO: 767732 - RNA, 19 nt, Homo sapiens
ucaaagaacugccagaaug

SEQ ID NO: 767733 - RNA, 19 nt, Homo sapiens
gagcugagauugcugaaau

SEQ ID NO: 767734 - RNA, 19 nt, Homo sapiens
guaacuaucuucugauuuc

SEQ ID NO: 767735 - RNA, 19 nt, Homo sapiens
gaaggcaucuacagaguau

SEQ ID NO: 767736 - RNA, 19 nt, Homo sapiens
acgaagagcuggaaauaaa

SEQ ID NO: 767737 - RNA, 19 nt, Homo sapiens
ggauaaaggauuugucuaa

SEQ ID NO: 767738 - RNA, 19 nt, Homo sapiens
agaaugagauccugacuga

SEQ ID NO: 767739 - RNA, 19 nt, Homo sapiens
cagcauugguuaacuaauu

SEQ ID NO: 767740 - RNA, 19 nt, Homo sapiens
guaaaggugucuucucuuc

SEQ ID NO: 767741 - RNA, 19 nt, Homo sapiens
ggaggagucuacaaacuug

SEQ ID NO: 767742 - RNA, 19 nt, Homo sapiens
ggauuugucuaaagaagaa

SEQ ID NO: 767743 - RNA, 19 nt, Homo sapiens
caagauugcacaagagaua

SEQ ID NO: 767744 - RNA, 19 nt, Homo sapiens
aaaccaagauugcacaaga

SEQ ID NO: 767745 - RNA, 19 nt, Homo sapiens
ucaguacguucacuuuaua

SEQ ID NO: 767746 - RNA, 19 nt, Homo sapiens
ccaaagaagagaugaauga

SEQ ID NO: 767747 - RNA, 19 nt, Homo sapiens
gcacagguguaauggauag

SEQ ID NO: 767748 - RNA, 19 nt, Homo sapiens
gaaagaucaugggaagaaa

SEQ ID NO: 767749 - RNA, 19 nt, Homo sapiens
guucaaaccagaaaucuuu

SEQ ID NO: 767750 - RNA, 19 nt, Homo sapiens
uagauuacguagagaagua

SEQ ID NO: 767751 - RNA, 19 nt, Homo sapiens
gaaaugugguacuaaagca

SEQ ID NO: 767752 - RNA, 19 nt, Homo sapiens
gcaaucgaguccuguaugu

SEQ ID NO: 767753 - RNA, 19 nt, Homo sapiens
cuacaaacuuggaagacua

SEQ ID NO: 767754 - RNA, 19 nt, Homo sapiens
cgacugaccuuccuuaaaa

SEQ ID NO: 767755 - RNA, 19 nt, Homo sapiens
gaaaguccuucuaaaauga

SEQ ID NO: 767756 - RNA, 19 nt, Homo sapiens
aaagaggacugaaggcuau

SEQ ID NO: 767757 - RNA, 19 nt, Homo sapiens
cuacuaaguuuccuggauu

SEQ ID NO: 767758 - RNA, 19 nt, Homo sapiens
caggaucucuuucucauuc

SEQ ID NO: 767759 - RNA, 19 nt, Homo sapiens
gaaggagacguccaucuga

SEQ ID NO: 767760 - RNA, 19 nt, Homo sapiens
ggucgggugucagauauaa

SEQ ID NO: 767761 - RNA, 19 nt, Homo sapiens
ugacagacauuugcauuuc

SEQ ID NO: 767762 - RNA, 19 nt, Homo sapiens
gagaucagcccuacuaagu

SEQ ID NO: 767763 - RNA, 19 nt, Homo sapiens
gagcuuaugcccagauuug

SEQ ID NO: 767764 - RNA, 19 nt, Homo sapiens
guagagaaguauggcauga

SEQ ID NO: 767765 - RNA, 19 nt, Homo sapiens
guuaaacaguggaaggaaa

SEQ ID NO: 767766 - RNA, 19 nt, Homo sapiens
gcacagccaaccauaauca

SEQ ID NO: 767767 - RNA, 19 nt, Homo sapiens
gauagugucagcuuauuug

SEQ ID NO: 767768 - RNA, 19 nt, Homo sapiens
gaaaggacccgugcaucuu

SEQ ID NO: 767769 - RNA, 19 nt, Homo sapiens
aagaggauguuuccaaaga

SEQ ID NO: 767770 - RNA, 19 nt, Homo sapiens
gagcauggcagcgggcuua

SEQ ID NO: 767771 - RNA, 19 nt, Homo sapiens
ccaugagccuccugaugua

SEQ ID NO: 767772 - RNA, 19 nt, Homo sapiens
gaagagcuggaaauaaaga

SEQ ID NO: 767773 - RNA, 19 nt, Homo sapiens
cagaguaucaggaauuaaa

SEQ ID NO: 767774 - RNA, 19 nt, Homo sapiens
uacagaguaucaggaauua

SEQ ID NO: 767775 - RNA, 19 nt, Homo sapiens
gcaccuguuugaugcaguu

SEQ ID NO: 767776 - RNA, 19 nt, Homo sapiens
caugauguaugauggcauu

SEQ ID NO: 767777 - RNA, 19 nt, Homo sapiens
agaggaccaugauguauga

SEQ ID NO: 767778 - RNA, 19 nt, Homo sapiens
aaaggacccgugcaucuua

SEQ ID NO: 767779 - RNA, 19 nt, Homo sapiens
ggaaggagacguccaucug

SEQ ID NO: 767780 - RNA, 19 nt, Homo sapiens
gaucauucuggaagacuua

SEQ ID NO: 767781 - RNA, 19 nt, Homo sapiens
ucagauugauguuccaaau

SEQ ID NO: 767782 - RNA, 19 nt, Homo sapiens
ggugggaacugcacacaag

SEQ ID NO: 767783 - RNA, 19 nt, Homo sapiens
ccaggaccauuauugauca

SEQ ID NO: 767784 - RNA, 19 nt, Homo sapiens
ccagaaaucuuuuaaacga

SEQ ID NO: 767785 - RNA, 19 nt, Homo sapiens
ggucuaacauggccacgau

SEQ ID NO: 767786 - RNA, 19 nt, Homo sapiens
cagaugaguuuuccagaua

SEQ ID NO: 767787 - RNA, 19 nt, Homo sapiens
gaaagauuaugggaaguac

SEQ ID NO: 767788 - RNA, 19 nt, Homo sapiens
gcaaaggaacuggaaacaa

SEQ ID NO: 767789 - RNA, 19 nt, Homo sapiens
ccacggagacugagaaagu

SEQ ID NO: 767790 - RNA, 19 nt, Homo sapiens
gcauugcaauugacagaca

SEQ ID NO: 767791 - RNA, 19 nt, Homo sapiens
gcagaaucaggaucucuuu

SEQ ID NO: 767792 - RNA, 19 nt, Homo sapiens
ugacagcccucaaaagaaa

SEQ ID NO: 767793 - RNA, 19 nt, Homo sapiens
gcaggaauuccagcguuua

SEQ ID NO: 767794 - RNA, 19 nt, Homo sapiens
guagagaggaccaugaugu

SEQ ID NO: 767795 - RNA, 19 nt, Homo sapiens
ggaauuccuuuggcugaug

SEQ ID NO: 767796 - RNA, 19 nt, Homo sapiens
agagaaacccaaagaagaa

SEQ ID NO: 767797 - RNA, 19 nt, Homo sapiens
guuuccagcucacuuugua

SEQ ID NO: 767798 - RNA, 19 nt, Homo sapiens
gugaggagauugaguacuc

SEQ ID NO: 767799 - RNA, 19 nt, Homo sapiens
gauauucuggugacugaaa

SEQ ID NO: 767800 - RNA, 19 nt, Homo sapiens
ccacagaggauguuguuca

SEQ ID NO: 767801 - RNA, 19 nt, Homo sapiens
cagagaauuugcuuaccaa

SEQ ID NO: 767802 - RNA, 19 nt, Homo sapiens
cuacagaguaucaggaauu

SEQ ID NO: 767803 - RNA, 19 nt, Homo sapiens
gagaggaccaugauguaug

SEQ ID NO: 767804 - RNA, 19 nt, Homo sapiens
gacagacauuugcauuuca

SEQ ID NO: 767805 - RNA, 19 nt, Homo sapiens
ucucagcauugguuaacua

SEQ ID NO: 767806 - RNA, 19 nt, Homo sapiens
aagauauucuggugacuga

SEQ ID NO: 767807 - RNA, 19 nt, Homo sapiens
cugagaaagugcaggaauu

SEQ ID NO: 767808 - RNA, 19 nt, Homo sapiens
ugagacggaugcucugaug

SEQ ID NO: 767809 - RNA, 19 nt, Homo sapiens
gaggauguuuccaaagaag

SEQ ID NO: 767810 - RNA, 19 nt, Homo sapiens
agagauagccagucuuuca

SEQ ID NO: 767811 - RNA, 19 nt, Homo sapiens
ccagagaauuugcuuacca

SEQ ID NO: 767812 - RNA, 19 nt, Homo sapiens
aaacgacugaccuuccuua

SEQ ID NO: 767813 - RNA, 19 nt, Homo sapiens
uaaguuuccuggauuguac

SEQ ID NO: 767814 - RNA, 19 nt, Homo sapiens
caaagaacugccagaaugu

SEQ ID NO: 767815 - RNA, 19 nt, Homo sapiens
agaaagaucaugggaagaa

SEQ ID NO: 767816 - RNA, 19 nt, Homo sapiens
ggugucagauauaaaugug

SEQ ID NO: 767817 - RNA, 19 nt, Homo sapiens
guucuaaaccacagucuau

SEQ ID NO: 767818 - RNA, 19 nt, Homo sapiens
cagauagugucagcuuauu

SEQ ID NO: 767819 - RNA, 19 nt, Homo sapiens
ggaggaccacggagacuga

SEQ ID NO: 767820 - RNA, 19 nt, Homo sapiens
gggaggagucuacaaacuu

SEQ ID NO: 767821 - RNA, 19 nt, Homo sapiens
ccauugcuuuguuugcuuu

SEQ ID NO: 767822 - RNA, 19 nt, Homo sapiens
gcucguggcucggaagaca

SEQ ID NO: 767823 - RNA, 19 nt, Homo sapiens
cagaggauguuguucaaac

SEQ ID NO: 767824 - RNA, 19 nt, Homo sapiens
gaaucaggaucucuuucuc

SEQ ID NO: 767825 - RNA, 19 nt, Homo sapiens
gaaaugaacagauugguaa

SEQ ID NO: 767826 - RNA, 19 nt, Homo sapiens
acaaauggcuguccaguuu

SEQ ID NO: 767827 - RNA, 19 nt, Homo sapiens
gaccuaagauuacguuauu

SEQ ID NO: 767828 - RNA, 19 nt, Homo sapiens
gaacagauugguaaccuaa

SEQ ID NO: 767829 - RNA, 19 nt, Homo sapiens
caacgucccuggaagaaga

SEQ ID NO: 767830 - RNA, 19 nt, Homo sapiens
agacauugcuucaacauug

SEQ ID NO: 767831 - RNA, 19 nt, Homo sapiens
ggaccuggcuucauuugga

SEQ ID NO: 767832 - RNA, 19 nt, Homo sapiens
acacaggucuaaucucuuu

SEQ ID NO: 767833 - RNA, 19 nt, Homo sapiens
ggugaacgaccuaagauua

SEQ ID NO: 767834 - RNA, 19 nt, Homo sapiens
ggaaacgugugcagccauu

SEQ ID NO: 767835 - RNA, 19 nt, Homo sapiens
aaacacaggucuaaucucu

SEQ ID NO: 767836 - RNA, 19 nt, Homo sapiens
gguuugaaaugaacagauu

SEQ ID NO: 767837 - RNA, 19 nt, Homo sapiens
gaucacauacucagucuau

SEQ ID NO: 767838 - RNA, 19 nt, Homo sapiens
cagauguccucuuaagaaa

SEQ ID NO: 767839 - RNA, 19 nt, Homo sapiens
gagugaugcugguuagcua

SEQ ID NO: 767840 - RNA, 19 nt, Homo sapiens
aaacacgccuuguccugaa

SEQ ID NO: 767841 - RNA, 19 nt, Homo sapiens
caaaaggugguguaaauua

SEQ ID NO: 767842 - RNA, 19 nt, Homo sapiens
cuauuaagguggccuguug

SEQ ID NO: 767843 - RNA, 19 nt, Homo sapiens
gcuaaccauuguuucugua

SEQ ID NO: 767844 - RNA, 19 nt, Homo sapiens
gaugcugguuagcuauuaa

SEQ ID NO: 767845 - RNA, 19 nt, Homo sapiens
ggacugggguuuuagcaaa

SEQ ID NO: 767846 - RNA, 19 nt, Homo sapiens
acagauugguaaccuaauu

SEQ ID NO: 767847 - RNA, 19 nt, Homo sapiens
guuauuggguuuggauauu

SEQ ID NO: 767848 - RNA, 19 nt, Homo sapiens
gcaucaaccuccaaaucga

SEQ ID NO: 767849 - RNA, 19 nt, Homo sapiens
ugacgauaaucacaccuuu

SEQ ID NO: 767850 - RNA, 19 nt, Homo sapiens
ugaaaggacugggguuuua

SEQ ID NO: 767851 - RNA, 19 nt, Homo sapiens
ggaagcaacgucccuggaa

SEQ ID NO: 767852 - RNA, 19 nt, Homo sapiens
gcacaucuagcugacgaua

SEQ ID NO: 767853 - RNA, 19 nt, Homo sapiens
gcaaacacaggucuaaucu

SEQ ID NO: 767854 - RNA, 19 nt, Homo sapiens
gaagaggaaggacagaugu

SEQ ID NO: 767855 - RNA, 19 nt, Homo sapiens
ggagaauguuauggaagaa

SEQ ID NO: 767856 - RNA, 19 nt, Homo sapiens
uggagaauguuauggaaga

SEQ ID NO: 767857 - RNA, 19 nt, Homo sapiens
caaauggcuguccaguuua

SEQ ID NO: 767858 - RNA, 19 nt, Homo sapiens
ugaaaugaacagauuggua

SEQ ID NO: 767859 - RNA, 19 nt, Homo sapiens
gcaacgugauggaggacuu

SEQ ID NO: 767860 - RNA, 19 nt, Homo sapiens
acagauguccucuuaagaa

SEQ ID NO: 767861 - RNA, 19 nt, Homo sapiens
ggucuaaucucuuuugugu

SEQ ID NO: 767862 - RNA, 19 nt, Homo sapiens
gacccaaauuuguauaaag

SEQ ID NO: 767863 - RNA, 19 nt, Homo sapiens
gguagugugacccaaauuu

SEQ ID NO: 767864 - RNA, 19 nt, Homo sapiens
ggaaaaggaucacauacuc

SEQ ID NO: 767865 - RNA, 19 nt, Homo sapiens
cagcucaucugguuacagu

SEQ ID NO: 767866 - RNA, 19 nt, Homo sapiens
acaucuagcugacgauaau

SEQ ID NO: 767867 - RNA, 19 nt, Homo sapiens
cacuacagcucaucugguu

SEQ ID NO: 767868 - RNA, 19 nt, Homo sapiens
acccaggccuugcagauaa

SEQ ID NO: 767869 - RNA, 19 nt, Homo sapiens
uaacuuaggaggugaacga

SEQ ID NO: 767870 - RNA, 19 nt, Homo sapiens
gcugagcugcuuccuguuu

SEQ ID NO: 767871 - RNA, 19 nt, Homo sapiens
gguguuaucuuuucucaga

SEQ ID NO: 767872 - RNA, 19 nt, Homo sapiens
gcagugagcacaucuagcu

SEQ ID NO: 767873 - RNA, 19 nt, Homo sapiens
guacaaggccaggaucuuc

SEQ ID NO: 767874 - RNA, 19 nt, Homo sapiens
uggaguauuuggccugaaa

SEQ ID NO: 767875 - RNA, 19 nt, Homo sapiens
uauggagaauguuauggaa

SEQ ID NO: 767876 - RNA, 19 nt, Homo sapiens
aaauggcuguccaguuuau

SEQ ID NO: 767877 - RNA, 19 nt, Homo sapiens
ucuggguccuggaguauuu

SEQ ID NO: 767878 - RNA, 19 nt, Homo sapiens
ugaugcugguuagcuauua

SEQ ID NO: 767879 - RNA, 19 nt, Homo sapiens
gcguagcaguugagugaug

SEQ ID NO: 767880 - RNA, 19 nt, Homo sapiens
acauugccuucauuccuua

SEQ ID NO: 767881 - RNA, 19 nt, Homo sapiens
gaaacgugugcagccauua

SEQ ID NO: 767882 - RNA, 19 nt, Homo sapiens
ugaacagauugguaaccua

SEQ ID NO: 767883 - RNA, 19 nt, Homo sapiens
guagugugacccaaauuug

SEQ ID NO: 767884 - RNA, 19 nt, Homo sapiens
cuucaacauugccuucauu

SEQ ID NO: 767885 - RNA, 19 nt, Homo sapiens
ucaagacauugcuucaaca

SEQ ID NO: 767886 - RNA, 19 nt, Homo sapiens
caagaggaaauccaaguca

SEQ ID NO: 767887 - RNA, 19 nt, Homo sapiens
uacaguaacucucgcuaca

SEQ ID NO: 767888 - RNA, 19 nt, Homo sapiens
gcaccucucccgacagcuu

SEQ ID NO: 767889 - RNA, 19 nt, Homo sapiens
gucaagacauugcuucaac

SEQ ID NO: 767890 - RNA, 19 nt, Homo sapiens
uuuguggccuccugacuuu

SEQ ID NO: 767891 - RNA, 19 nt, Homo sapiens
cagauugguaaccuaauuu

SEQ ID NO: 767892 - RNA, 19 nt, Homo sapiens
aagaggaaauccaagucaa

SEQ ID NO: 767893 - RNA, 19 nt, Homo sapiens
gauguccucuuaagaaaau

SEQ ID NO: 767894 - RNA, 19 nt, Homo sapiens
aaccauuguuucuguaguu

SEQ ID NO: 767895 - RNA, 19 nt, Homo sapiens
gagaauguuauggaagaaa

SEQ ID NO: 767896 - RNA, 19 nt, Homo sapiens
cagccgaucucgcuauagg

SEQ ID NO: 767897 - RNA, 19 nt, Homo sapiens
aacauugccuucauuccuu

SEQ ID NO: 767898 - RNA, 19 nt, Homo sapiens
gccauuacacacagccuaa

SEQ ID NO: 767899 - RNA, 19 nt, Homo sapiens
cgcagccgaucucgcuaua

SEQ ID NO: 767900 - RNA, 19 nt, Homo sapiens
caacauugccuucauuccu

SEQ ID NO: 767901 - RNA, 19 nt, Homo sapiens
agauuacguuauuggguuu

SEQ ID NO: 767902 - RNA, 19 nt, Homo sapiens
cgacguggacggcaugauc

SEQ ID NO: 767903 - RNA, 19 nt, Homo sapiens
aaagguagugugacccaaa

SEQ ID NO: 767904 - RNA, 19 nt, Homo sapiens
cgaccuaagauuacguuau

SEQ ID NO: 767905 - RNA, 19 nt, Homo sapiens
ugaagaggaaggacagaug

SEQ ID NO: 767906 - RNA, 19 nt, Homo sapiens
guugagugaugcugguuag

SEQ ID NO: 767907 - RNA, 19 nt, Homo sapiens
gcgcaaccgcgagaaagaa

SEQ ID NO: 767908 - RNA, 19 nt, Homo sapiens
gacauugcuucaacauugc

SEQ ID NO: 767909 - RNA, 19 nt, Homo sapiens
uaaccauuguuucuguagu

SEQ ID NO: 767910 - RNA, 19 nt, Homo sapiens
uauuggguuuggauauuug

SEQ ID NO: 767911 - RNA, 19 nt, Homo sapiens
uucgggaccuggcuucauu

SEQ ID NO: 767912 - RNA, 19 nt, Homo sapiens
ugaggcgcguguucgagaa

SEQ ID NO: 767913 - RNA, 19 nt, Homo sapiens
accauuguuucuguaguua

SEQ ID NO: 767914 - RNA, 19 nt, Homo sapiens
agugugacccaaauuugua

SEQ ID NO: 767915 - RNA, 19 nt, Homo sapiens
ucuauagugaugacuguuu

SEQ ID NO: 767916 - RNA, 19 nt, Homo sapiens
cacccaggccuugcagaua

SEQ ID NO: 767917 - RNA, 19 nt, Homo sapiens
aagguagugugacccaaau

SEQ ID NO: 767918 - RNA, 19 nt, Homo sapiens
gugaacgaccuaagauuac

SEQ ID NO: 767919 - RNA, 19 nt, Homo sapiens
gaaaaggaucacauacuca

SEQ ID NO: 767920 - RNA, 19 nt, Homo sapiens
ggcgcguguucgagaagua

SEQ ID NO: 767921 - RNA, 19 nt, Homo sapiens
gugacccaaauuuguauaa

SEQ ID NO: 767922 - RNA, 19 nt, Homo sapiens
uacagcagaucucgcuaca

SEQ ID NO: 767923 - RNA, 19 nt, Homo sapiens
caagacauugcuucaacau

SEQ ID NO: 767924 - RNA, 19 nt, Homo sapiens
caaggucgcgauccaagag

SEQ ID NO: 767925 - RNA, 19 nt, Homo sapiens
ggagagaaaugcaaccaua

SEQ ID NO: 767926 - RNA, 19 nt, Homo sapiens
gaaggaggcuggcuguaaa

SEQ ID NO: 767927 - RNA, 19 nt, Homo sapiens
ggacgaaagugaccugcaa

SEQ ID NO: 767928 - RNA, 19 nt, Homo sapiens
ggacaacauuugacaccaa

SEQ ID NO: 767929 - RNA, 19 nt, Homo sapiens
uggcagacauccugaagua

SEQ ID NO: 767930 - RNA, 19 nt, Homo sapiens
gguacaaugucaccuggua

SEQ ID NO: 767931 - RNA, 19 nt, Homo sapiens
gaaauauacuucucaugcu

SEQ ID NO: 767932 - RNA, 19 nt, Homo sapiens
gggaggacauucaggagaa

SEQ ID NO: 767933 - RNA, 19 nt, Homo sapiens
gacccgagguuuagauuuc

SEQ ID NO: 767934 - RNA, 19 nt, Homo sapiens
gaaccugcgucugcucauu

SEQ ID NO: 767935 - RNA, 19 nt, Homo sapiens
gauccaggcugcucugaag

SEQ ID NO: 767936 - RNA, 19 nt, Homo sapiens
ccuuagaggacuugaaaua

SEQ ID NO: 767937 - RNA, 19 nt, Homo sapiens
gaggagaaguuggcagaca

SEQ ID NO: 767938 - RNA, 19 nt, Homo sapiens
ugaaggaggcuggcuguaa

SEQ ID NO: 767939 - RNA, 19 nt, Homo sapiens
uagaggacuugaaauauac

SEQ ID NO: 767940 - RNA, 19 nt, Homo sapiens
agacagcaaugacauguac

SEQ ID NO: 767941 - RNA, 19 nt, Homo sapiens
gggaggaucuggagaaccu

SEQ ID NO: 767942 - RNA, 19 nt, Homo sapiens
gcccuuagaggacuugaaa

SEQ ID NO: 767943 - RNA, 19 nt, Homo sapiens
guaaacugcgcaucaugaa

SEQ ID NO: 767944 - RNA, 19 nt, Homo sapiens
gcugugacucucucucuaa

SEQ ID NO: 767945 - RNA, 19 nt, Homo sapiens
gcaagaagagggugaaucc

SEQ ID NO: 767946 - RNA, 19 nt, Homo sapiens
uaacacaaacagccucaga

SEQ ID NO: 767947 - RNA, 19 nt, Homo sapiens
ggagcuggacaacauuuga

SEQ ID NO: 767948 - RNA, 19 nt, Homo sapiens
ggcuuugccucacguauuc

SEQ ID NO: 767949 - RNA, 19 nt, Homo sapiens
ggggauaccuagaggauga

SEQ ID NO: 767950 - RNA, 19 nt, Homo sapiens
cugccaacuucuuuaaauu

SEQ ID NO: 767951 - RNA, 19 nt, Homo sapiens
ccugccaacuucuuuaaau

SEQ ID NO: 767952 - RNA, 19 nt, Homo sapiens
gggcuuugccucacguauu

SEQ ID NO: 767953 - RNA, 19 nt, Homo sapiens
acaagaccuuccucugcua

SEQ ID NO: 767954 - RNA, 19 nt, Homo sapiens
gagacagcaaugacaugua

SEQ ID NO: 767955 - RNA, 19 nt, Homo sapiens
ggagaacuuccuauacuac

SEQ ID NO: 767956 - RNA, 19 nt, Homo sapiens
aaugucaccugguaugugu

SEQ ID NO: 767957 - RNA, 19 nt, Homo sapiens
gacugaagguccuaauugc

SEQ ID NO: 767958 - RNA, 19 nt, Homo sapiens
cucaugcuguaguuuauuu

SEQ ID NO: 767959 - RNA, 19 nt, Homo sapiens
gcccugcgguacaauguca

SEQ ID NO: 767960 - RNA, 19 nt, Homo sapiens
gggcuccagucaacuaugg

SEQ ID NO: 767961 - RNA, 19 nt, Homo sapiens
gagaaaugcaaccauacau

SEQ ID NO: 767962 - RNA, 19 nt, Homo sapiens
guacagccaucugggacau

SEQ ID NO: 767963 - RNA, 19 nt, Homo sapiens
gcuguaaacugcgcaucau

SEQ ID NO: 767964 - RNA, 19 nt, Homo sapiens
gugacucucucucuaaugc

SEQ ID NO: 767965 - RNA, 19 nt, Homo sapiens
ggacuugaaauauacuucu

SEQ ID NO: 767966 - RNA, 19 nt, Homo sapiens
caagagacagcaaugacau

SEQ ID NO: 767967 - RNA, 19 nt, Homo sapiens
cuucucaugcuguaguuua

SEQ ID NO: 767968 - RNA, 19 nt, Homo sapiens
ccaagagacagcaaugaca

SEQ ID NO: 767969 - RNA, 19 nt, Homo sapiens
uguaaacugcgcaucauga

SEQ ID NO: 767970 - RNA, 19 nt, Homo sapiens
ggcugugacucucucucua

SEQ ID NO: 767971 - RNA, 19 nt, Homo sapiens
aagaagagggugaauccaa

SEQ ID NO: 767972 - RNA, 19 nt, Homo sapiens
uacaugggcuccagucaac

SEQ ID NO: 767973 - RNA, 19 nt, Homo sapiens
agaaaugcaaccauacaug

SEQ ID NO: 767974 - RNA, 19 nt, Homo sapiens
gagagaaaugcaaccauac

SEQ ID NO: 767975 - RNA, 19 nt, Homo sapiens
caugggcuccagucaacua

SEQ ID NO: 767976 - RNA, 19 nt, Homo sapiens
guacaaugucaccugguau

SEQ ID NO: 767977 - RNA, 19 nt, Homo sapiens
cgaaagugaccugcaagga

SEQ ID NO: 767978 - RNA, 19 nt, Homo sapiens
ggacauucaggagaacuuc

SEQ ID NO: 767979 - RNA, 19 nt, Homo sapiens
ucuggugggucgacucuuc

SEQ ID NO: 767980 - RNA, 19 nt, Homo sapiens
ccaccaagagacagcaaug

SEQ ID NO: 767981 - RNA, 19 nt, Homo sapiens
ggagaaguuggcagacauc

SEQ ID NO: 767982 - RNA, 19 nt, Homo sapiens
aggcugcuguggccacuga

SEQ ID NO: 767983 - RNA, 19 nt, Homo sapiens
ccucugcuaugugguugaa

SEQ ID NO: 767984 - RNA, 19 nt, Homo sapiens
auauacuucucaugcugua

SEQ ID NO: 767985 - RNA, 19 nt, Homo sapiens
caagaccuuccucugcuau

SEQ ID NO: 767986 - RNA, 19 nt, Homo sapiens
uauacuacgaggagaaguu

SEQ ID NO: 767987 - RNA, 19 nt, Homo sapiens
agaacuuccuauacuacga

SEQ ID NO: 767988 - RNA, 19 nt, Homo sapiens
agagaaaugcaaccauaca

SEQ ID NO: 767989 - RNA, 19 nt, Homo sapiens
agaccuuccucugcuaugu

SEQ ID NO: 767990 - RNA, 19 nt, Homo sapiens
gacuugaaauauacuucuc

SEQ ID NO: 767991 - RNA, 19 nt, Homo sapiens
cuuagaggacuugaaauau

SEQ ID NO: 767992 - RNA, 19 nt, Homo sapiens
ugacaccaaccaaucauac

SEQ ID NO: 767993 - RNA, 19 nt, Homo sapiens
ggagcaagaagagggugaa

SEQ ID NO: 767994 - RNA, 19 nt, Homo sapiens
caacauuugacaccaacca

SEQ ID NO: 767995 - RNA, 19 nt, Homo sapiens
ggaggacauucaggagaac

SEQ ID NO: 767996 - RNA, 19 nt, Homo sapiens
gccaacuucuuuaaauucc

SEQ ID NO: 767997 - RNA, 19 nt, Homo sapiens
gaacagaguugaaguuaaa

SEQ ID NO: 767998 - RNA, 19 nt, Homo sapiens
gaagagccuugcuuuauua

SEQ ID NO: 767999 - RNA, 19 nt, Homo sapiens
gaagaaugguggcuuguuu

SEQ ID NO: 768000 - RNA, 19 nt, Homo sapiens
uaaaguaccuggcaaagaa

SEQ ID NO: 768001 - RNA, 19 nt, Homo sapiens
guacccagcuacucuauaa

SEQ ID NO: 768002 - RNA, 19 nt, Homo sapiens
gcgaaucacuuauaaaugg

SEQ ID NO: 768003 - RNA, 19 nt, Homo sapiens
gcaaagaauucugcaacuu

SEQ ID NO: 768004 - RNA, 19 nt, Homo sapiens
gagaagagccuugcuuuau

SEQ ID NO: 768005 - RNA, 19 nt, Homo sapiens
caagaaaucucguggaaac

SEQ ID NO: 768006 - RNA, 19 nt, Homo sapiens
gauaugcuguagaguguuu

SEQ ID NO: 768007 - RNA, 19 nt, Homo sapiens
ugaacacacucauccauuu

SEQ ID NO: 768008 - RNA, 19 nt, Homo sapiens
gaggaaacauucaugaaca

SEQ ID NO: 768009 - RNA, 19 nt, Homo sapiens
ggagcaauguuggcuuaua

SEQ ID NO: 768010 - RNA, 19 nt, Homo sapiens
uaucuuggcucaaauuguu

SEQ ID NO: 768011 - RNA, 19 nt, Homo sapiens
agaagagccuugcuuuauu

SEQ ID NO: 768012 - RNA, 19 nt, Homo sapiens
gaaaacaccuggaaaugga

SEQ ID NO: 768013 - RNA, 19 nt, Homo sapiens
ggacaccaauuugcagaaa

SEQ ID NO: 768014 - RNA, 19 nt, Homo sapiens
ucaaauacguggacaccaa

SEQ ID NO: 768015 - RNA, 19 nt, Homo sapiens
guguaaagguugccauaaa

SEQ ID NO: 768016 - RNA, 19 nt, Homo sapiens
cagcuacucuauaaauuug

SEQ ID NO: 768017 - RNA, 19 nt, Homo sapiens
guauauaacugaacacacu

SEQ ID NO: 768018 - RNA, 19 nt, Homo sapiens
aaagauuccugaagagcua

SEQ ID NO: 768019 - RNA, 19 nt, Homo sapiens
gaacacacucauccauuug

SEQ ID NO: 768020 - RNA, 19 nt, Homo sapiens
gggauaugcuguagagugu

SEQ ID NO: 768021 - RNA, 19 nt, Homo sapiens
gagcaauguuggcuuauac

SEQ ID NO: 768022 - RNA, 19 nt, Homo sapiens
gcagaguacucaaauacgu

SEQ ID NO: 768023 - RNA, 19 nt, Homo sapiens
ugaacagaguugaaguuaa

SEQ ID NO: 768024 - RNA, 19 nt, Homo sapiens
uacaagaaaucucguggaa

SEQ ID NO: 768025 - RNA, 19 nt, Homo sapiens
acacagauaauaaggagua

SEQ ID NO: 768026 - RNA, 19 nt, Homo sapiens
gcagaaacagcgagaacuu

SEQ ID NO: 768027 - RNA, 19 nt, Homo sapiens
guggaaacacagauaauaa

SEQ ID NO: 768028 - RNA, 19 nt, Homo sapiens
gaaaucucguggaaacaca

SEQ ID NO: 768029 - RNA, 19 nt, Homo sapiens
aaguaaagauuccugaaga

SEQ ID NO: 768030 - RNA, 19 nt, Homo sapiens
gaaacacagauaauaagga

SEQ ID NO: 768031 - RNA, 19 nt, Homo sapiens
aaccguggcuuguugauga

SEQ ID NO: 768032 - RNA, 19 nt, Homo sapiens
gaaugcuggugguucuauu

SEQ ID NO: 768033 - RNA, 19 nt, Homo sapiens
ugagaagagccuugcuuua

SEQ ID NO: 768034 - RNA, 19 nt, Homo sapiens
gagcagaguacucaaauac

SEQ ID NO: 768035 - RNA, 19 nt, Homo sapiens
ggagagcagaguacucaaa

SEQ ID NO: 768036 - RNA, 19 nt, Homo sapiens
gaagcaaaguguguaaagg

SEQ ID NO: 768037 - RNA, 19 nt, Homo sapiens
aaacagcucuuuuaucuuc

SEQ ID NO: 768038 - RNA, 19 nt, Homo sapiens
guugaugacugggacuuaa

SEQ ID NO: 768039 - RNA, 19 nt, Homo sapiens
ggacaaacaagugaaauac

SEQ ID NO: 768040 - RNA, 19 nt, Homo sapiens
aaugguggcuuguuucaug

SEQ ID NO: 768041 - RNA, 19 nt, Homo sapiens
gagccuugcuuuauuacuc

SEQ ID NO: 768042 - RNA, 19 nt, Homo sapiens
ccagcuacucuauaaauuu

SEQ ID NO: 768043 - RNA, 19 nt, Homo sapiens
ggaguaugcgguuaaugaa

SEQ ID NO: 768044 - RNA, 19 nt, Homo sapiens
gaugacugggacuuaauua

SEQ ID NO: 768045 - RNA, 19 nt, Homo sapiens
ucaugggccucuucuuuau

SEQ ID NO: 768046 - RNA, 19 nt, Homo sapiens
guucuuagucuaucucuug

SEQ ID NO: 768047 - RNA, 19 nt, Homo sapiens
aaacauucaugaacagagu

SEQ ID NO: 768048 - RNA, 19 nt, Homo sapiens
cgagugcugugcuuucaug

SEQ ID NO: 768049 - RNA, 19 nt, Homo sapiens
auacaccucuggaugagaa

SEQ ID NO: 768050 - RNA, 19 nt, Homo sapiens
gccaaagguucaauucagu

SEQ ID NO: 768051 - RNA, 19 nt, Homo sapiens
gaggcacucucacucacuu

SEQ ID NO: 768052 - RNA, 19 nt, Homo sapiens
acaguaugcugaaauucuu

SEQ ID NO: 768053 - RNA, 19 nt, Homo sapiens
gaaguuguggcagggauaa

SEQ ID NO: 768054 - RNA, 19 nt, Homo sapiens
aaacagcgagaacuucaaa

SEQ ID NO: 768055 - RNA, 19 nt, Homo sapiens
agagcagaguacucaaaua

SEQ ID NO: 768056 - RNA, 19 nt, Homo sapiens
uuacagugguuggaauaaa

SEQ ID NO: 768057 - RNA, 19 nt, Homo sapiens
ggaucuccguaaacacauu

SEQ ID NO: 768058 - RNA, 19 nt, Homo sapiens
gagagcagaguacucaaau

SEQ ID NO: 768059 - RNA, 19 nt, Homo sapiens
cuuugaagauguuagugua

SEQ ID NO: 768060 - RNA, 19 nt, Homo sapiens
uagucuaucucuuguacaa

SEQ ID NO: 768061 - RNA, 19 nt, Homo sapiens
uguaaagguugccauaaag

SEQ ID NO: 768062 - RNA, 19 nt, Homo sapiens
uuggagcaauguuggcuua

SEQ ID NO: 768063 - RNA, 19 nt, Homo sapiens
aauaaggaguaugcgguua

SEQ ID NO: 768064 - RNA, 19 nt, Homo sapiens
cagaguugaaguuaaagua

SEQ ID NO: 768065 - RNA, 19 nt, Homo sapiens
cauaaaggacaaacaagug

SEQ ID NO: 768066 - RNA, 19 nt, Homo sapiens
cggcgaaucacuuauaaau

SEQ ID NO: 768067 - RNA, 19 nt, Homo sapiens
cugaaauucuugcagauca

SEQ ID NO: 768068 - RNA, 19 nt, Homo sapiens
gcuggugguucuauuccuu

SEQ ID NO: 768069 - RNA, 19 nt, Homo sapiens
ugccagcgauuaugaagug

SEQ ID NO: 768070 - RNA, 19 nt, Homo sapiens
ggaaacacagauaauaagg

SEQ ID NO: 768071 - RNA, 19 nt, Homo sapiens
cguggaaacacagauaaua

SEQ ID NO: 768072 - RNA, 19 nt, Homo sapiens
acaccaauuugcagaaaca

SEQ ID NO: 768073 - RNA, 19 nt, Homo sapiens
aagguucaauucaguguau

SEQ ID NO: 768074 - RNA, 19 nt, Homo sapiens
gaaacagcgagaacuucaa

SEQ ID NO: 768075 - RNA, 19 nt, Homo sapiens
gaugagaagagccuugcuu

SEQ ID NO: 768076 - RNA, 19 nt, Homo sapiens
uaaggaguaugcgguuaau

SEQ ID NO: 768077 - RNA, 19 nt, Homo sapiens
auuccauucuugaggauua

SEQ ID NO: 768078 - RNA, 19 nt, Homo sapiens
agagggauaugcuguagag

SEQ ID NO: 768079 - RNA, 19 nt, Homo sapiens
gauggacaacagagggaua

SEQ ID NO: 768080 - RNA, 19 nt, Homo sapiens
ggcaaagaauucugcaacu

SEQ ID NO: 768081 - RNA, 19 nt, Homo sapiens
cccagcuacucuauaaauu

SEQ ID NO: 768082 - RNA, 19 nt, Homo sapiens
gcuguagaguguuuuauug

SEQ ID NO: 768083 - RNA, 19 nt, Homo sapiens
guaugcgguuaaugaaguu

SEQ ID NO: 768084 - RNA, 19 nt, Homo sapiens
uuucaugggccucuucuuu

SEQ ID NO: 768085 - RNA, 19 nt, Homo sapiens
ggaaacauucaugaacaga

SEQ ID NO: 768086 - RNA, 19 nt, Homo sapiens
ccauaaaggacaaacaagu

SEQ ID NO: 768087 - RNA, 19 nt, Homo sapiens
caauuaucuucacgauuuc

SEQ ID NO: 768088 - RNA, 19 nt, Homo sapiens
uaaagguugccauaaagga

SEQ ID NO: 768089 - RNA, 19 nt, Homo sapiens
aggaguaugcgguuaauga

SEQ ID NO: 768090 - RNA, 19 nt, Homo sapiens
acucauccauuugugcuuu

SEQ ID NO: 768091 - RNA, 19 nt, Homo sapiens
gaucuccguaaacacauuu

SEQ ID NO: 768092 - RNA, 19 nt, Homo sapiens
cuccugagauuauuuguac

SEQ ID NO: 768093 - RNA, 19 nt, Homo sapiens
uaaaggacaaacaagugaa

SEQ ID NO: 768094 - RNA, 19 nt, Homo sapiens
cauuacagugguuggaaua

SEQ ID NO: 768095 - RNA, 19 nt, Homo sapiens
gacugggacuuaauuacca

SEQ ID NO: 768096 - RNA, 19 nt, Homo sapiens
uggcagggauaaaagaaua

SEQ ID NO: 768097 - RNA, 19 nt, Homo sapiens
gaacagaguugaaguuaaa

SEQ ID NO: 768098 - RNA, 19 nt, Homo sapiens
gaagagccuugcuuuauua

SEQ ID NO: 768099 - RNA, 19 nt, Homo sapiens
uaaaguaccuggcaaagaa

SEQ ID NO: 768100 - RNA, 19 nt, Homo sapiens
aaacagcucuucuaucuuc

SEQ ID NO: 768101 - RNA, 19 nt, Homo sapiens
caagaaaucucauggaaac

SEQ ID NO: 768102 - RNA, 19 nt, Homo sapiens
gcaaagaauucugcaacuu

SEQ ID NO: 768103 - RNA, 19 nt, Homo sapiens
gagaagagccuugcuuuau

SEQ ID NO: 768104 - RNA, 19 nt, Homo sapiens
gaggaaacauucaugaaca

SEQ ID NO: 768105 - RNA, 19 nt, Homo sapiens
gcacccagcuacucaacaa

SEQ ID NO: 768106 - RNA, 19 nt, Homo sapiens
agaagagccuugcuuuauu

SEQ ID NO: 768107 - RNA, 19 nt, Homo sapiens
gaaaacaccuggaaaugga

SEQ ID NO: 768108 - RNA, 19 nt, Homo sapiens
aaccauggcuuguugauga

SEQ ID NO: 768109 - RNA, 19 nt, Homo sapiens
aaagauuccugaagagcua

SEQ ID NO: 768110 - RNA, 19 nt, Homo sapiens
ggagcaauguuggccuaua

SEQ ID NO: 768111 - RNA, 19 nt, Homo sapiens
uacaagaaaucucauggaa

SEQ ID NO: 768112 - RNA, 19 nt, Homo sapiens
ccgaaauucuugcagauug

SEQ ID NO: 768113 - RNA, 19 nt, Homo sapiens
gaaaucucauggaaacaca

SEQ ID NO: 768114 - RNA, 19 nt, Homo sapiens
ugaacagaguugaaguuaa

SEQ ID NO: 768115 - RNA, 19 nt, Homo sapiens
gagcaauguuggccuauac

SEQ ID NO: 768116 - RNA, 19 nt, Homo sapiens
uaaggaguaugcaguuaau

SEQ ID NO: 768117 - RNA, 19 nt, Homo sapiens
acacagauaauaaggagua

SEQ ID NO: 768118 - RNA, 19 nt, Homo sapiens
aaguaaagauuccugaaga

SEQ ID NO: 768119 - RNA, 19 nt, Homo sapiens
gaaacacagauaauaagga

SEQ ID NO: 768120 - RNA, 19 nt, Homo sapiens
ugagaagagccuugcuuua

SEQ ID NO: 768121 - RNA, 19 nt, Homo sapiens
aauaaggaguaugcaguua

SEQ ID NO: 768122 - RNA, 19 nt, Homo sapiens
ggaguaugcaguuaaugaa

SEQ ID NO: 768123 - RNA, 19 nt, Homo sapiens
cauggaaacacagauaaua

SEQ ID NO: 768124 - RNA, 19 nt, Homo sapiens
guugaugacugggacuuaa

SEQ ID NO: 768125 - RNA, 19 nt, Homo sapiens
gagccuugcuuuauuacuc

SEQ ID NO: 768126 - RNA, 19 nt, Homo sapiens
auacaccucugaaugagaa

SEQ ID NO: 768127 - RNA, 19 nt, Homo sapiens
ccuauacaccucugaauga

SEQ ID NO: 768128 - RNA, 19 nt, Homo sapiens
guaugcaguuaaugaaguu

SEQ ID NO: 768129 - RNA, 19 nt, Homo sapiens
gaugacugggacuuaauua

SEQ ID NO: 768130 - RNA, 19 nt, Homo sapiens
aaacauucaugaacagagu

SEQ ID NO: 768131 - RNA, 19 nt, Homo sapiens
cgaaauucuugcagauugu

SEQ ID NO: 768132 - RNA, 19 nt, Homo sapiens
gaaguuguggcagggauaa

SEQ ID NO: 768133 - RNA, 19 nt, Homo sapiens
gaauucugcaacuuuguuu

SEQ ID NO: 768134 - RNA, 19 nt, Homo sapiens
cagaguugaaguuaaagua

SEQ ID NO: 768135 - RNA, 19 nt, Homo sapiens
gauuaucuguacaaauugg

SEQ ID NO: 768136 - RNA, 19 nt, Homo sapiens
ugccagcgauuaugaagug

SEQ ID NO: 768137 - RNA, 19 nt, Homo sapiens
uaauaaggaguaugcaguu

SEQ ID NO: 768138 - RNA, 19 nt, Homo sapiens
ggaaacacagauaauaagg

SEQ ID NO: 768139 - RNA, 19 nt, Homo sapiens
aaguggcucuuccugagua

SEQ ID NO: 768140 - RNA, 19 nt, Homo sapiens
ggacuaugcaaauuacaag

SEQ ID NO: 768141 - RNA, 19 nt, Homo sapiens
ugaggacuaugcaaauuac

SEQ ID NO: 768142 - RNA, 19 nt, Homo sapiens
ggcaaagaauucugcaacu

SEQ ID NO: 768143 - RNA, 19 nt, Homo sapiens
ccagcuacucaacaaauuu

SEQ ID NO: 768144 - RNA, 19 nt, Homo sapiens
acaagaaaucucauggaaa

SEQ ID NO: 768145 - RNA, 19 nt, Homo sapiens
ggaaacauucaugaacaga

SEQ ID NO: 768146 - RNA, 19 nt, Homo sapiens
caauuaucuucacgauuuc

SEQ ID NO: 768147 - RNA, 19 nt, Homo sapiens
ucucauggaaacacagaua

SEQ ID NO: 768148 - RNA, 19 nt, Homo sapiens
cuaaaaccauggcuuguug

SEQ ID NO: 768149 - RNA, 19 nt, Homo sapiens
cccagcuacucaacaaauu

SEQ ID NO: 768150 - RNA, 19 nt, Homo sapiens
gaauacuucaaccuaaugu

SEQ ID NO: 768151 - RNA, 19 nt, Homo sapiens
uugaggacuaugcaaauua

SEQ ID NO: 768152 - RNA, 19 nt, Homo sapiens
cuugaggacuaugcaaauu

SEQ ID NO: 768153 - RNA, 19 nt, Homo sapiens
gacugggacuuaauuacca

SEQ ID NO: 768154 - RNA, 19 nt, Homo sapiens
cagcuacucaacaaauuug

SEQ ID NO: 768155 - RNA, 19 nt, Homo sapiens
uggcagggauaaaagaaua

SEQ ID NO: 768156 - RNA, 19 nt, Homo sapiens
uaucuucacgauuuccuaa

SEQ ID NO: 768157 - RNA, 19 nt, Homo sapiens
caugaacagaguugaaguu

SEQ ID NO: 768158 - RNA, 19 nt, Homo sapiens
auaaggaguaugcaguuaa

SEQ ID NO: 768159 - RNA, 19 nt, Homo sapiens
cuaaaguaccuggcaaaga

SEQ ID NO: 768160 - RNA, 19 nt, Homo sapiens
gcaaauuacaagaaaucuc

SEQ ID NO: 768161 - RNA, 19 nt, Homo sapiens
uucacgauuuccuaaagua

SEQ ID NO: 768162 - RNA, 19 nt, Homo sapiens
gaccacaguaugccgaaau

SEQ ID NO: 768163 - RNA, 19 nt, Homo sapiens
aggaguaugcaguuaauga

SEQ ID NO: 768164 - RNA, 19 nt, Homo sapiens
gccuauacaccucugaaug

SEQ ID NO: 768165 - RNA, 19 nt, Homo sapiens
aaaguaaagauuccugaag

SEQ ID NO: 768166 - RNA, 19 nt, Homo sapiens
aguaugcaguuaaugaagu

SEQ ID NO: 768167 - RNA, 19 nt, Homo sapiens
cagauaauaaggaguaugc

SEQ ID NO: 768168 - RNA, 19 nt, Homo sapiens
ugaggaaacauucaugaac

SEQ ID NO: 768169 - RNA, 19 nt, Homo sapiens
augaacagaguugaaguua

SEQ ID NO: 768170 - RNA, 19 nt, Homo sapiens
agaauucugcaacuuuguu

SEQ ID NO: 768171 - RNA, 19 nt, Homo sapiens
acaguaugccgaaauucuu

SEQ ID NO: 768172 - RNA, 19 nt, Homo sapiens
ugaugacugggacuuaauu

SEQ ID NO: 768173 - RNA, 19 nt, Homo sapiens
gaaauucuugcagauuguc

SEQ ID NO: 768174 - RNA, 19 nt, Homo sapiens
ugaaguuguggcagggaua

SEQ ID NO: 768175 - RNA, 19 nt, Homo sapiens
uuacaagaaaucucaugga

SEQ ID NO: 768176 - RNA, 19 nt, Homo sapiens
uuagugccagcgauuauga

SEQ ID NO: 768177 - RNA, 19 nt, Homo sapiens
ucugcaacuuuguuuagug

SEQ ID NO: 768178 - RNA, 19 nt, Homo sapiens
acucaauuaucuucacgau

SEQ ID NO: 768179 - RNA, 19 nt, Homo sapiens
gccgaaauucuugcagauu

SEQ ID NO: 768180 - RNA, 19 nt, Homo sapiens
caguaugccgaaauucuug

SEQ ID NO: 768181 - RNA, 19 nt, Homo sapiens
accacaguaugccgaaauu

SEQ ID NO: 768182 - RNA, 19 nt, Homo sapiens
agaauacuucaaccuaaug

SEQ ID NO: 768183 - RNA, 19 nt, Homo sapiens
gaguaugcaguuaaugaag

SEQ ID NO: 768184 - RNA, 19 nt, Homo sapiens
uggaaacacagauaauaag

SEQ ID NO: 768185 - RNA, 19 nt, Homo sapiens
aguaaagauuccugaagag

SEQ ID NO: 768186 - RNA, 19 nt, Homo sapiens
ugacaaagcuaacgaauuu

SEQ ID NO: 768187 - RNA, 19 nt, Homo sapiens
gaacauaauuugccucuau

SEQ ID NO: 768188 - RNA, 19 nt, Homo sapiens
gaacgagcuugacaaauuu

SEQ ID NO: 768189 - RNA, 19 nt, Homo sapiens
gaucaacgguccugaaauu

SEQ ID NO: 768190 - RNA, 19 nt, Homo sapiens
gaucaugucucaauggaaa

SEQ ID NO: 768191 - RNA, 19 nt, Homo sapiens
caucuugccuggauaaaua

SEQ ID NO: 768192 - RNA, 19 nt, Homo sapiens
agaacgagcuugacaaauu

SEQ ID NO: 768193 - RNA, 19 nt, Homo sapiens
gcaaaugugaaucguauua

SEQ ID NO: 768194 - RNA, 19 nt, Homo sapiens
cuacagaaauuguugcuuu

SEQ ID NO: 768195 - RNA, 19 nt, Homo sapiens
gaacaucgcacucuuguca

SEQ ID NO: 768196 - RNA, 19 nt, Homo sapiens
caacacacauugaaagcuu

SEQ ID NO: 768197 - RNA, 19 nt, Homo sapiens
gaagaacgagcuugacaaa

SEQ ID NO: 768198 - RNA, 19 nt, Homo sapiens
gaagauggcggcugcugua

SEQ ID NO: 768199 - RNA, 19 nt, Homo sapiens
gaaggcaaggaaccaauua

SEQ ID NO: 768200 - RNA, 19 nt, Homo sapiens
gaagguaaaucaguagauc

SEQ ID NO: 768201 - RNA, 19 nt, Homo sapiens
caucuugaaugucuuugua

SEQ ID NO: 768202 - RNA, 19 nt, Homo sapiens
ggaaauauuuggugcuuuu

SEQ ID NO: 768203 - RNA, 19 nt, Homo sapiens
gagaagaaccacaguugaa

SEQ ID NO: 768204 - RNA, 19 nt, Homo sapiens
gcaaugaauguuuauguga

SEQ ID NO: 768205 - RNA, 19 nt, Homo sapiens
agacuacggugugcuguua

SEQ ID NO: 768206 - RNA, 19 nt, Homo sapiens
guacagccguugucaaugg

SEQ ID NO: 768207 - RNA, 19 nt, Homo sapiens
ugacuuaacugaucaugca

SEQ ID NO: 768208 - RNA, 19 nt, Homo sapiens
gagagaagaaccacaguug

SEQ ID NO: 768209 - RNA, 19 nt, Homo sapiens
guagaucacccauguguau

SEQ ID NO: 768210 - RNA, 19 nt, Homo sapiens
ggauaaauacaccaagaaa

SEQ ID NO: 768211 - RNA, 19 nt, Homo sapiens
aagcaaaugugaaucguau

SEQ ID NO: 768212 - RNA, 19 nt, Homo sapiens
acuugaaucuugccuauaa

SEQ ID NO: 768213 - RNA, 19 nt, Homo sapiens
caagaugguuauuuguaga

SEQ ID NO: 768214 - RNA, 19 nt, Homo sapiens
uaacgaauuucacgaugug

SEQ ID NO: 768215 - RNA, 19 nt, Homo sapiens
gagcuugacaaauuuauug

SEQ ID NO: 768216 - RNA, 19 nt, Homo sapiens
gauggcggcugcuguagga

SEQ ID NO: 768217 - RNA, 19 nt, Homo sapiens
gaaccaauuaugcuuguau

SEQ ID NO: 768218 - RNA, 19 nt, Homo sapiens
caagaaagaauggugguuu

SEQ ID NO: 768219 - RNA, 19 nt, Homo sapiens
cagagugacuuaacugauc

SEQ ID NO: 768220 - RNA, 19 nt, Homo sapiens
ccuaagccuugaugacuuu

SEQ ID NO: 768221 - RNA, 19 nt, Homo sapiens
uagcuaacuuugucuaugu

SEQ ID NO: 768222 - RNA, 19 nt, Homo sapiens
gaagcaaaugugaaucgua

SEQ ID NO: 768223 - RNA, 19 nt, Homo sapiens
ucaagaugguuauuuguag

SEQ ID NO: 768224 - RNA, 19 nt, Homo sapiens
gaaaccugcuuuuaucauu

SEQ ID NO: 768225 - RNA, 19 nt, Homo sapiens
ugaaggcguuccaguaugu

SEQ ID NO: 768226 - RNA, 19 nt, Homo sapiens
uaauuugccucuauagaag

SEQ ID NO: 768227 - RNA, 19 nt, Homo sapiens
ccaauggagucaucaagca

SEQ ID NO: 768228 - RNA, 19 nt, Homo sapiens
ggaagaacgagcuugacaa

SEQ ID NO: 768229 - RNA, 19 nt, Homo sapiens
uaaaguagagcaacacaca

SEQ ID NO: 768230 - RNA, 19 nt, Homo sapiens
agaaacacauggagaaguc

SEQ ID NO: 768231 - RNA, 19 nt, Homo sapiens
aagaaagaauggugguuug

SEQ ID NO: 768232 - RNA, 19 nt, Homo sapiens
ggugaaggcguuccaguau

SEQ ID NO: 768233 - RNA, 19 nt, Homo sapiens
gagcaacacacauugaaag

SEQ ID NO: 768234 - RNA, 19 nt, Homo sapiens
gaaggcuauucuuagauca

SEQ ID NO: 768235 - RNA, 19 nt, Homo sapiens
ccucaggccugcugcaugu

SEQ ID NO: 768236 - RNA, 19 nt, Homo sapiens
gcacucuugucagacuuaa

SEQ ID NO: 768237 - RNA, 19 nt, Homo sapiens
ggauuucaccuuugugugu

SEQ ID NO: 768238 - RNA, 19 nt, Homo sapiens
uuacuugaaucuugccuau

SEQ ID NO: 768239 - RNA, 19 nt, Homo sapiens
guggcuggcuagcuaguuu

SEQ ID NO: 768240 - RNA, 19 nt, Homo sapiens
ggaaccaauuaugcuugua

SEQ ID NO: 768241 - RNA, 19 nt, Homo sapiens
uuucuuugcugaaguauuc

SEQ ID NO: 768242 - RNA, 19 nt, Homo sapiens
uaaacaugguuaguugcua

SEQ ID NO: 768243 - RNA, 19 nt, Homo sapiens
ucccugaaauugaguuuau

SEQ ID NO: 768244 - RNA, 19 nt, Homo sapiens
guagagcaacacacauuga

SEQ ID NO: 768245 - RNA, 19 nt, Homo sapiens
uagccuuacuugaaucuug

SEQ ID NO: 768246 - RNA, 19 nt, Homo sapiens
auucuuagaucaugucuca

SEQ ID NO: 768247 - RNA, 19 nt, Homo sapiens
gauugaagcaaaugugaau

SEQ ID NO: 768248 - RNA, 19 nt, Homo sapiens
cuccugcaaugaauguuua

SEQ ID NO: 768249 - RNA, 19 nt, Homo sapiens
uuucuuagccuuacuugaa

SEQ ID NO: 768250 - RNA, 19 nt, Homo sapiens
aauggaaacacucuucuuu

SEQ ID NO: 768251 - RNA, 19 nt, Homo sapiens
ccaauuaugcuuguauuca

SEQ ID NO: 768252 - RNA, 19 nt, Homo sapiens
gcaaggaaccaauuaugcu

SEQ ID NO: 768253 - RNA, 19 nt, Homo sapiens
gugaaggcguuccaguaug

SEQ ID NO: 768254 - RNA, 19 nt, Homo sapiens
uagaucaugucucaaugga

SEQ ID NO: 768255 - RNA, 19 nt, Homo sapiens
gcuaggaccuuuuaaacau

SEQ ID NO: 768256 - RNA, 19 nt, Homo sapiens
uucagaagguaaaucagua

SEQ ID NO: 768257 - RNA, 19 nt, Homo sapiens
gauaaauacaccaagaaag

SEQ ID NO: 768258 - RNA, 19 nt, Homo sapiens
cuaacgaauuucacgaugu

SEQ ID NO: 768259 - RNA, 19 nt, Homo sapiens
gggaaauauuuggugcuuu

SEQ ID NO: 768260 - RNA, 19 nt, Homo sapiens
ccguguaacuccugcaaug

SEQ ID NO: 768261 - RNA, 19 nt, Homo sapiens
caaggaaccaauuaugcuu

SEQ ID NO: 768262 - RNA, 19 nt, Homo sapiens
gcagauuucccgagacuac

SEQ ID NO: 768263 - RNA, 19 nt, Homo sapiens
ggguacagccguugucaau

SEQ ID NO: 768264 - RNA, 19 nt, Homo sapiens
cuugguggcuggcuagcua

SEQ ID NO: 768265 - RNA, 19 nt, Homo sapiens
gaagaaccacaguugaaac

SEQ ID NO: 768266 - RNA, 19 nt, Homo sapiens
guuccaguauguagaaaca

SEQ ID NO: 768267 - RNA, 19 nt, Homo sapiens
guucuggucuugcacuaag

SEQ ID NO: 768268 - RNA, 19 nt, Homo sapiens
gcagagugacuuaacugau

SEQ ID NO: 768269 - RNA, 19 nt, Homo sapiens
gcuagcuaguuucuacaga

SEQ ID NO: 768270 - RNA, 19 nt, Homo sapiens
agaagaaccacaguugaaa

SEQ ID NO: 768271 - RNA, 19 nt, Homo sapiens
gaggucucuucauaauuga

SEQ ID NO: 768272 - RNA, 19 nt, Homo sapiens
gugacaaagcuaacgaauu

SEQ ID NO: 768273 - RNA, 19 nt, Homo sapiens
cuggauaaauacaccaaga

SEQ ID NO: 768274 - RNA, 19 nt, Homo sapiens
ucaauggagaguucaaaga

SEQ ID NO: 768275 - RNA, 19 nt, Homo sapiens
ggccgaagcguggaagaaa

SEQ ID NO: 768276 - RNA, 19 nt, Homo sapiens
cauaauuugccucuauaga

SEQ ID NO: 768277 - RNA, 19 nt, Homo sapiens
gaacuggacaccggauucu

SEQ ID NO: 768278 - RNA, 19 nt, Homo sapiens
agagugacuuaacugauca

SEQ ID NO: 768279 - RNA, 19 nt, Homo sapiens
ugcaaugaauguuuaugug

SEQ ID NO: 768280 - RNA, 19 nt, Homo sapiens
cagcaugcacccuauuuua

SEQ ID NO: 768281 - RNA, 19 nt, Homo sapiens
guugaaaccugcuuuuauc

SEQ ID NO: 768282 - RNA, 19 nt, Homo sapiens
gaucacccauguguaucug

SEQ ID NO: 768283 - RNA, 19 nt, Homo sapiens
uguagaaacacauggagaa

SEQ ID NO: 768284 - RNA, 19 nt, Homo sapiens
ggugugcuguuagaagguu

SEQ ID NO: 768285 - RNA, 19 nt, Homo sapiens
uguaacuccugcaaugaau

SEQ ID NO: 768286 - RNA, 19 nt, Homo sapiens
gaagaacgcucaagucaga

SEQ ID NO: 768287 - RNA, 19 nt, Homo sapiens
gcuauaggaucuuauguaa

SEQ ID NO: 768288 - RNA, 19 nt, Homo sapiens
gaaccagaauuacaacaaa

SEQ ID NO: 768289 - RNA, 19 nt, Homo sapiens
ucacaccacuaaugacuua

SEQ ID NO: 768290 - RNA, 19 nt, Homo sapiens
gagcagcccauguaacuua

SEQ ID NO: 768291 - RNA, 19 nt, Homo sapiens
guaguuuguugacaucuua

SEQ ID NO: 768292 - RNA, 19 nt, Homo sapiens
caacuucauugucuucuug

SEQ ID NO: 768293 - RNA, 19 nt, Homo sapiens
gaggagagcagcccaugua

SEQ ID NO: 768294 - RNA, 19 nt, Homo sapiens
gucaguaucuguugauuug

SEQ ID NO: 768295 - RNA, 19 nt, Homo sapiens
gaaacaaacucugccuaca

SEQ ID NO: 768296 - RNA, 19 nt, Homo sapiens
acacucggauugaaccuua

SEQ ID NO: 768297 - RNA, 19 nt, Homo sapiens
caacuuugauuucaugauc

SEQ ID NO: 768298 - RNA, 19 nt, Homo sapiens
gaaauucagaaccaacuuu

SEQ ID NO: 768299 - RNA, 19 nt, Homo sapiens
gaaccaacuuugauuucau

SEQ ID NO: 768300 - RNA, 19 nt, Homo sapiens
ggacuuuauucuaacuuga

SEQ ID NO: 768301 - RNA, 19 nt, Homo sapiens
cauguucaccuuuguguua

SEQ ID NO: 768302 - RNA, 19 nt, Homo sapiens
gaagucaacagaaacaaau

SEQ ID NO: 768303 - RNA, 19 nt, Homo sapiens
caagaucucugcuggacau

SEQ ID NO: 768304 - RNA, 19 nt, Homo sapiens
gauccagccuucaggaaau

SEQ ID NO: 768305 - RNA, 19 nt, Homo sapiens
gaucaaaaccuacaagauu

SEQ ID NO: 768306 - RNA, 19 nt, Homo sapiens
caaagccacagaagaaauu

SEQ ID NO: 768307 - RNA, 19 nt, Homo sapiens
gcucagacccugcggaaga

SEQ ID NO: 768308 - RNA, 19 nt, Homo sapiens
acauauugcucaucuguga

SEQ ID NO: 768309 - RNA, 19 nt, Homo sapiens
guucagacccguggauaua

SEQ ID NO: 768310 - RNA, 19 nt, Homo sapiens
gaaacaaauccucccauca

SEQ ID NO: 768311 - RNA, 19 nt, Homo sapiens
caccuuggcuaccuugaaa

SEQ ID NO: 768312 - RNA, 19 nt, Homo sapiens
ucugugaccucuucauuug

SEQ ID NO: 768313 - RNA, 19 nt, Homo sapiens
caucaacacuguggucaga

SEQ ID NO: 768314 - RNA, 19 nt, Homo sapiens
gaucucugcuggacaucaa

SEQ ID NO: 768315 - RNA, 19 nt, Homo sapiens
gaacucaacaggccaccuu

SEQ ID NO: 768316 - RNA, 19 nt, Homo sapiens
ggauuugccaauucauaua

SEQ ID NO: 768317 - RNA, 19 nt, Homo sapiens
gaaccucgaagucaacaga

SEQ ID NO: 768318 - RNA, 19 nt, Homo sapiens
gugcagggcugagaaggaa

SEQ ID NO: 768319 - RNA, 19 nt, Homo sapiens
uguauaggaaccagaauua

SEQ ID NO: 768320 - RNA, 19 nt, Homo sapiens
gacuucaccuucuguguug

SEQ ID NO: 768321 - RNA, 19 nt, Homo sapiens
gaaccuuacuacagcaucu

SEQ ID NO: 768322 - RNA, 19 nt, Homo sapiens
caaauccucccaucaugaa

SEQ ID NO: 768323 - RNA, 19 nt, Homo sapiens
aaacaaauccucccaucau

SEQ ID NO: 768324 - RNA, 19 nt, Homo sapiens
cauauauugccaugcauua

SEQ ID NO: 768325 - RNA, 19 nt, Homo sapiens
gaacagugcagggcugaga

SEQ ID NO: 768326 - RNA, 19 nt, Homo sapiens
ggaaccagaauuacaacaa

SEQ ID NO: 768327 - RNA, 19 nt, Homo sapiens
gcaacuucauugucuucuu

SEQ ID NO: 768328 - RNA, 19 nt, Homo sapiens
gagagcagcccauguaacu

SEQ ID NO: 768329 - RNA, 19 nt, Homo sapiens
gcagaagaaggagacauuu

SEQ ID NO: 768330 - RNA, 19 nt, Homo sapiens
aacaaacucugccuacaug

SEQ ID NO: 768331 - RNA, 19 nt, Homo sapiens
ucagaaccaacuuugauuu

SEQ ID NO: 768332 - RNA, 19 nt, Homo sapiens
gugguucucuccagcaaug

SEQ ID NO: 768333 - RNA, 19 nt, Homo sapiens
gaagacaguggcagugauc

SEQ ID NO: 768334 - RNA, 19 nt, Homo sapiens
aaaguuggcaguuaugguu

SEQ ID NO: 768335 - RNA, 19 nt, Homo sapiens
ggauugaaccuuacuacag

SEQ ID NO: 768336 - RNA, 19 nt, Homo sapiens
cgacuucaccuucuguguu

SEQ ID NO: 768337 - RNA, 19 nt, Homo sapiens
ccaggagggucuucaggau

SEQ ID NO: 768338 - RNA, 19 nt, Homo sapiens
ggcuauaggaucuuaugua

SEQ ID NO: 768339 - RNA, 19 nt, Homo sapiens
cgaagucaacagaaacaaa

SEQ ID NO: 768340 - RNA, 19 nt, Homo sapiens
ggaaagccauuuugucucu

SEQ ID NO: 768341 - RNA, 19 nt, Homo sapiens
gauuugcuuuguaguuugu

SEQ ID NO: 768342 - RNA, 19 nt, Homo sapiens
gcacuucagccaagcagau

SEQ ID NO: 768343 - RNA, 19 nt, Homo sapiens
gaugcuuucugcuucacuu

SEQ ID NO: 768344 - RNA, 19 nt, Homo sapiens
uuaaagucauggaggcuau

SEQ ID NO: 768345 - RNA, 19 nt, Homo sapiens
cagcaagucccaccucugu

SEQ ID NO: 768346 - RNA, 19 nt, Homo sapiens
agaaccaacuuugauuuca

SEQ ID NO: 768347 - RNA, 19 nt, Homo sapiens
cauggaggcuauaggaucu

SEQ ID NO: 768348 - RNA, 19 nt, Homo sapiens
aaacaaacucugccuacau

SEQ ID NO: 768349 - RNA, 19 nt, Homo sapiens
cuucauucuuuaccaguuu

SEQ ID NO: 768350 - RNA, 19 nt, Homo sapiens
cggaagaacgcucaaguca

SEQ ID NO: 768351 - RNA, 19 nt, Homo sapiens
gcaagucccaccucugucu

SEQ ID NO: 768352 - RNA, 19 nt, Homo sapiens
uauggcaacuucauugucu

SEQ ID NO: 768353 - RNA, 19 nt, Homo sapiens
ccaguaaacucuuuuggau

SEQ ID NO: 768354 - RNA, 19 nt, Homo sapiens
ggaaauucagaaccaacuu

SEQ ID NO: 768355 - RNA, 19 nt, Homo sapiens
uggaggcuauaggaucuua

SEQ ID NO: 768356 - RNA, 19 nt, Homo sapiens
ggaauaugacagcacuuca

SEQ ID NO: 768357 - RNA, 19 nt, Homo sapiens
ugcauuaucacaccacuaa

SEQ ID NO: 768358 - RNA, 19 nt, Homo sapiens
ccaaagccacagaagaaau

SEQ ID NO: 768359 - RNA, 19 nt, Homo sapiens
acaaauccucccaucauga

SEQ ID NO: 768360 - RNA, 19 nt, Homo sapiens
ucacauauugcucaucugu

SEQ ID NO: 768361 - RNA, 19 nt, Homo sapiens
ucuguugauuugcuuugua

SEQ ID NO: 768362 - RNA, 19 nt, Homo sapiens
ugacuuagugcaggaauau

SEQ ID NO: 768363 - RNA, 19 nt, Homo sapiens
ccaagucauucaaaagaaa

SEQ ID NO: 768364 - RNA, 19 nt, Homo sapiens
cuccaaagccacagaagaa

SEQ ID NO: 768365 - RNA, 19 nt, Homo sapiens
aacaaauccucccaucaug

SEQ ID NO: 768366 - RNA, 19 nt, Homo sapiens
aagggaaccucgaagucaa

SEQ ID NO: 768367 - RNA, 19 nt, Homo sapiens
ugucacauauugcucaucu

SEQ ID NO: 768368 - RNA, 19 nt, Homo sapiens
caacaaacugcagcacguu

SEQ ID NO: 768369 - RNA, 19 nt, Homo sapiens
ugaagacaguggcagugau

SEQ ID NO: 768370 - RNA, 19 nt, Homo sapiens
ugauuugcuuuguaguuug

SEQ ID NO: 768371 - RNA, 19 nt, Homo sapiens
gaauaugacagcacuucag

SEQ ID NO: 768372 - RNA, 19 nt, Homo sapiens
uaccaagagucccaaccaa

SEQ ID NO: 768373 - RNA, 19 nt, Homo sapiens
uauaggaaccagaauuaca

SEQ ID NO: 768374 - RNA, 19 nt, Homo sapiens
aaccaacuuugauuucaug

SEQ ID NO: 768375 - RNA, 19 nt, Homo sapiens
aaagggaaccucgaaguca

SEQ ID NO: 768376 - RNA, 19 nt, Homo sapiens
gcuucauucuuuaccaguu

SEQ ID NO: 768377 - RNA, 19 nt, Homo sapiens
ugccggcucuguauaggaa

SEQ ID NO: 768378 - RNA, 19 nt, Homo sapiens
ucucuuacaucaugauugc

SEQ ID NO: 768379 - RNA, 19 nt, Homo sapiens
cagaaccaacuuugauuuc

SEQ ID NO: 768380 - RNA, 19 nt, Homo sapiens
cagaagaaggagacauuuc

SEQ ID NO: 768381 - RNA, 19 nt, Homo sapiens
cuuacuacagcaucuauaa

SEQ ID NO: 768382 - RNA, 19 nt, Homo sapiens
ggagcuucauucuuuacca

SEQ ID NO: 768383 - RNA, 19 nt, Homo sapiens
guucaccuuuguguuauuc

SEQ ID NO: 768384 - RNA, 19 nt, Homo sapiens
guccuucugugaccucuuc

SEQ ID NO: 768385 - RNA, 19 nt, Homo sapiens
gaggcuauaggaucuuaug

SEQ ID NO: 768386 - RNA, 19 nt, Homo sapiens
ggaagucacuguugaaguu

SEQ ID NO: 768387 - RNA, 19 nt, Homo sapiens
agaaagagcuggugaacaa

SEQ ID NO: 768388 - RNA, 19 nt, Homo sapiens
ggagagaucuaccagaaga

SEQ ID NO: 768389 - RNA, 19 nt, Homo sapiens
agaaagagaugcccaaugu

SEQ ID NO: 768390 - RNA, 19 nt, Homo sapiens
ugaccaaaguucccaauaa

SEQ ID NO: 768391 - RNA, 19 nt, Homo sapiens
ucacuuaacuggagcuuug

SEQ ID NO: 768392 - RNA, 19 nt, Homo sapiens
gcuaguuucuguucuguaa

SEQ ID NO: 768393 - RNA, 19 nt, Homo sapiens
gaacaaggcagaccagauc

SEQ ID NO: 768394 - RNA, 19 nt, Homo sapiens
cagcagaggcuaugacuuu

SEQ ID NO: 768395 - RNA, 19 nt, Homo sapiens
gagaaugucuuccagaaaa

SEQ ID NO: 768396 - RNA, 19 nt, Homo sapiens
guuagaggcugcguucuuu

SEQ ID NO: 768397 - RNA, 19 nt, Homo sapiens
gcccuacccucucacuuaa

SEQ ID NO: 768398 - RNA, 19 nt, Homo sapiens
gaucaaggcucugaagaac

SEQ ID NO: 768399 - RNA, 19 nt, Homo sapiens
gagggcagcucacuuggau

SEQ ID NO: 768400 - RNA, 19 nt, Homo sapiens
caagguccauaaagacuga

SEQ ID NO: 768401 - RNA, 19 nt, Homo sapiens
uacauaagcuaguuucugu

SEQ ID NO: 768402 - RNA, 19 nt, Homo sapiens
agaaggagauggugaaguc

SEQ ID NO: 768403 - RNA, 19 nt, Homo sapiens
gaagaaccaugaggacaag

SEQ ID NO: 768404 - RNA, 19 nt, Homo sapiens
gaccaaaguucccaauaac

SEQ ID NO: 768405 - RNA, 19 nt, Homo sapiens
gaagcucaaugaccugauc

SEQ ID NO: 768406 - RNA, 19 nt, Homo sapiens
gaugaguucucggaaguga

SEQ ID NO: 768407 - RNA, 19 nt, Homo sapiens
caucagcucccucaagaaa

SEQ ID NO: 768408 - RNA, 19 nt, Homo sapiens
ucacuuggauguccuuaca

SEQ ID NO: 768409 - RNA, 19 nt, Homo sapiens
caagaacuguggcuauuuu

SEQ ID NO: 768410 - RNA, 19 nt, Homo sapiens
gcaaggacaagcccaccua

SEQ ID NO: 768411 - RNA, 19 nt, Homo sapiens
ugggagagaucuaccagaa

SEQ ID NO: 768412 - RNA, 19 nt, Homo sapiens
ggagaaugucuuccagaaa

SEQ ID NO: 768413 - RNA, 19 nt, Homo sapiens
ucagcucccucaagaaaga

SEQ ID NO: 768414 - RNA, 19 nt, Homo sapiens
gauccugucuggagagaag

SEQ ID NO: 768415 - RNA, 19 nt, Homo sapiens
gaagugaucaaggcucuga

SEQ ID NO: 768416 - RNA, 19 nt, Homo sapiens
ucaaggcucugaagaacca

SEQ ID NO: 768417 - RNA, 19 nt, Homo sapiens
ggagagaagcagcggauca

SEQ ID NO: 768418 - RNA, 19 nt, Homo sapiens
gugagaggauggaauugug

SEQ ID NO: 768419 - RNA, 19 nt, Homo sapiens
cccaauaacuucccaacca

SEQ ID NO: 768420 - RNA, 19 nt, Homo sapiens
uaagcuaguuucuguucug

SEQ ID NO: 768421 - RNA, 19 nt, Homo sapiens
ccaagaaggagauggugaa

SEQ ID NO: 768422 - RNA, 19 nt, Homo sapiens
gaacaaccugggagagauc

SEQ ID NO: 768423 - RNA, 19 nt, Homo sapiens
agagaugcccaaugucuuu

SEQ ID NO: 768424 - RNA, 19 nt, Homo sapiens
gccgggaagucacuguuga

SEQ ID NO: 768425 - RNA, 19 nt, Homo sapiens
guucacgccuacaucauca

SEQ ID NO: 768426 - RNA, 19 nt, Homo sapiens
ucaaggacauccagucacu

SEQ ID NO: 768427 - RNA, 19 nt, Homo sapiens
ucuguucuguaaagugaua

SEQ ID NO: 768428 - RNA, 19 nt, Homo sapiens
aggagaaugucuuccagaa

SEQ ID NO: 768429 - RNA, 19 nt, Homo sapiens
ugaagaaccaugaggacaa

SEQ ID NO: 768430 - RNA, 19 nt, Homo sapiens
uggcaacgcuuuccucaac

SEQ ID NO: 768431 - RNA, 19 nt, Homo sapiens
gcccgucacuccauacagu

SEQ ID NO: 768432 - RNA, 19 nt, Homo sapiens
ugcaggaacuggccuuguu

SEQ ID NO: 768433 - RNA, 19 nt, Homo sapiens
gaggcugcauggacaggaa

SEQ ID NO: 768434 - RNA, 19 nt, Homo sapiens
gugauaucuuucauacuug

SEQ ID NO: 768435 - RNA, 19 nt, Homo sapiens
uuucuguucuguaaaguga

SEQ ID NO: 768436 - RNA, 19 nt, Homo sapiens
ggacacgguggaugacaug

SEQ ID NO: 768437 - RNA, 19 nt, Homo sapiens
ugaacaaccugggagagau

SEQ ID NO: 768438 - RNA, 19 nt, Homo sapiens
gggcagcucacuuggaugu

SEQ ID NO: 768439 - RNA, 19 nt, Homo sapiens
ggaguaggagaaugucuuc

SEQ ID NO: 768440 - RNA, 19 nt, Homo sapiens
gggcuucccaccaggcuuu

SEQ ID NO: 768441 - RNA, 19 nt, Homo sapiens
ugcccuacccucucacuua

SEQ ID NO: 768442 - RNA, 19 nt, Homo sapiens
agcaggaccucuucaagga

SEQ ID NO: 768443 - RNA, 19 nt, Homo sapiens
agacuuucuccuugcauua

SEQ ID NO: 768444 - RNA, 19 nt, Homo sapiens
cauaagcuaguuucuguuc

SEQ ID NO: 768445 - RNA, 19 nt, Homo sapiens
aaagagaugcccaaugucu

SEQ ID NO: 768446 - RNA, 19 nt, Homo sapiens
gcaacgcuuuccucaacag

SEQ ID NO: 768447 - RNA, 19 nt, Homo sapiens
gaaccaugaggacaagauc

SEQ ID NO: 768448 - RNA, 19 nt, Homo sapiens
gaagucacuguugaaguug

SEQ ID NO: 768449 - RNA, 19 nt, Homo sapiens
ggaccccaguguugcauuu

SEQ ID NO: 768450 - RNA, 19 nt, Homo sapiens
gaacuguggcuauuuuaau

SEQ ID NO: 768451 - RNA, 19 nt, Homo sapiens
cgacaaccgcaagcucuuu

SEQ ID NO: 768452 - RNA, 19 nt, Homo sapiens
ugaucaaggcucugaagaa

SEQ ID NO: 768453 - RNA, 19 nt, Homo sapiens
ggacagcaucagcaucauc

SEQ ID NO: 768454 - RNA, 19 nt, Homo sapiens
cagaggcuaugacuuugca

SEQ ID NO: 768455 - RNA, 19 nt, Homo sapiens
gacuuucuccuugcauuaa

SEQ ID NO: 768456 - RNA, 19 nt, Homo sapiens
gggaguaggagaaugucuu

SEQ ID NO: 768457 - RNA, 19 nt, Homo sapiens
gcaaguuccaggcgcugaa

SEQ ID NO: 768458 - RNA, 19 nt, Homo sapiens
gggcaagaccaccuucauc

SEQ ID NO: 768459 - RNA, 19 nt, Homo sapiens
gaaguugcaguggcuuguu

SEQ ID NO: 768460 - RNA, 19 nt, Homo sapiens
ggagggcagcucacuugga

SEQ ID NO: 768461 - RNA, 19 nt, Homo sapiens
cuuccuuccuccucuguuu

SEQ ID NO: 768462 - RNA, 19 nt, Homo sapiens
ggagccaggucgcccuuuu

SEQ ID NO: 768463 - RNA, 19 nt, Homo sapiens
gaaagagaugcccaauguc

SEQ ID NO: 768464 - RNA, 19 nt, Homo sapiens
aagacuuucuccuugcauu

SEQ ID NO: 768465 - RNA, 19 nt, Homo sapiens
ugaagacuuucuccuugca

SEQ ID NO: 768466 - RNA, 19 nt, Homo sapiens
ccagguugagcaauaagaa

SEQ ID NO: 768467 - RNA, 19 nt, Homo sapiens
acaagaacuguggcuauuu

SEQ ID NO: 768468 - RNA, 19 nt, Homo sapiens
gacaaccgcaagcucuuug

SEQ ID NO: 768469 - RNA, 19 nt, Homo sapiens
aguauuaggugaggaugga

SEQ ID NO: 768470 - RNA, 19 nt, Homo sapiens
gagcaauaagaaaccagaa

SEQ ID NO: 768471 - RNA, 19 nt, Homo sapiens
uaagaggaagcccgugguu

SEQ ID NO: 768472 - RNA, 19 nt, Homo sapiens
gcacgggcaagaccaccuu

SEQ ID NO: 768473 - RNA, 19 nt, Homo sapiens
ggggaagccucaccauuuc

SEQ ID NO: 768474 - RNA, 19 nt, Homo sapiens
ggagcaggaccucuucaag

SEQ ID NO: 768475 - RNA, 19 nt, Homo sapiens
cagccguccuggagugguu

SEQ ID NO: 768476 - RNA, 19 nt, Homo sapiens
acgcugacuucgacaacaa

SEQ ID NO: 768477 - RNA, 19 nt, Homo sapiens
aaggagggcagcucacuug

SEQ ID NO: 768478 - RNA, 19 nt, Homo sapiens
gcaucauccugcucuucga

SEQ ID NO: 768479 - RNA, 19 nt, Homo sapiens
uaacuucccaaccacuguu

SEQ ID NO: 768480 - RNA, 19 nt, Homo sapiens
uaguuucuguucuguaaag

SEQ ID NO: 768481 - RNA, 19 nt, Homo sapiens
ggugagaggauggaauugu

SEQ ID NO: 768482 - RNA, 19 nt, Homo sapiens
aaaccaccaucuuucuuuu

SEQ ID NO: 768483 - RNA, 19 nt, Homo sapiens
gcgccaacgccaagaagga

SEQ ID NO: 768484 - RNA, 19 nt, Homo sapiens
gugaacaaccugggagaga

SEQ ID NO: 768485 - RNA, 19 nt, Homo sapiens
gcuggaggacgcugacuuc

SEQ ID NO: 768486 - RNA, 19 nt, Homo sapiens
ggaaggacuuugucaauaa

SEQ ID NO: 768487 - RNA, 19 nt, Homo sapiens
ggaagacgcugcuagcuaa

SEQ ID NO: 768488 - RNA, 19 nt, Homo sapiens
ggagaaaccuuacagugaa

SEQ ID NO: 768489 - RNA, 19 nt, Homo sapiens
cagaugggcugugaaauua

SEQ ID NO: 768490 - RNA, 19 nt, Homo sapiens
ggagagaaaucacuuggaa

SEQ ID NO: 768491 - RNA, 19 nt, Homo sapiens
gguuucagcuggugcauua

SEQ ID NO: 768492 - RNA, 19 nt, Homo sapiens
gaagggaugcuuucucuuu

SEQ ID NO: 768493 - RNA, 19 nt, Homo sapiens
gcagaugggcugugaaauu

SEQ ID NO: 768494 - RNA, 19 nt, Homo sapiens
gauaggauguguaugacuu

SEQ ID NO: 768495 - RNA, 19 nt, Homo sapiens
gaaauucucuuuugacaga

SEQ ID NO: 768496 - RNA, 19 nt, Homo sapiens
caagauugauagaugauga

SEQ ID NO: 768497 - RNA, 19 nt, Homo sapiens
gcuaaugucuguaaugaag

SEQ ID NO: 768498 - RNA, 19 nt, Homo sapiens
uaaugaagcugcguugauu

SEQ ID NO: 768499 - RNA, 19 nt, Homo sapiens
gaagaagacuguggcauac

SEQ ID NO: 768500 - RNA, 19 nt, Homo sapiens
ggcaauacguuugguuuaa

SEQ ID NO: 768501 - RNA, 19 nt, Homo sapiens
gaugggcugugaaauuaaa

SEQ ID NO: 768502 - RNA, 19 nt, Homo sapiens
gcaagggccagcagaaauu

SEQ ID NO: 768503 - RNA, 19 nt, Homo sapiens
gcaauacguuugguuuaau

SEQ ID NO: 768504 - RNA, 19 nt, Homo sapiens
cagauauaauugcugcuua

SEQ ID NO: 768505 - RNA, 19 nt, Homo sapiens
gcgagugauugguggcuua

SEQ ID NO: 768506 - RNA, 19 nt, Homo sapiens
uggaaggacuuugucaaua

SEQ ID NO: 768507 - RNA, 19 nt, Homo sapiens
gauagaugaugaaguacga

SEQ ID NO: 768508 - RNA, 19 nt, Homo sapiens
gagugcauaugcccaaauu

SEQ ID NO: 768509 - RNA, 19 nt, Homo sapiens
gaacaauaccucuauacca

SEQ ID NO: 768510 - RNA, 19 nt, Homo sapiens
gugcugauguugcuaaugu

SEQ ID NO: 768511 - RNA, 19 nt, Homo sapiens
ugaagccacugcaagauug

SEQ ID NO: 768512 - RNA, 19 nt, Homo sapiens
agaagaagacuguggcaua

SEQ ID NO: 768513 - RNA, 19 nt, Homo sapiens
ggucuuaaaggaugaaauu

SEQ ID NO: 768514 - RNA, 19 nt, Homo sapiens
gcaaaggacuagguuaugc

SEQ ID NO: 768515 - RNA, 19 nt, Homo sapiens
gagaggaagaggcaacuuu

SEQ ID NO: 768516 - RNA, 19 nt, Homo sapiens
gauuggaagucgucaacaa

SEQ ID NO: 768517 - RNA, 19 nt, Homo sapiens
gggaagggaugcuuucucu

SEQ ID NO: 768518 - RNA, 19 nt, Homo sapiens
aacaauaccucuauaccaa

SEQ ID NO: 768519 - RNA, 19 nt, Homo sapiens
gaucauggaauuugugaau

SEQ ID NO: 768520 - RNA, 19 nt, Homo sapiens
aacggaaucuggaaacuuu

SEQ ID NO: 768521 - RNA, 19 nt, Homo sapiens
ggucgagccucugaagaaa

SEQ ID NO: 768522 - RNA, 19 nt, Homo sapiens
uaucaaagauucuguucuc

SEQ ID NO: 768523 - RNA, 19 nt, Homo sapiens
caacuggugcucaagauga

SEQ ID NO: 768524 - RNA, 19 nt, Homo sapiens
gggcaauacguuugguuua

SEQ ID NO: 768525 - RNA, 19 nt, Homo sapiens
ggaauugggcauagaagga

SEQ ID NO: 768526 - RNA, 19 nt, Homo sapiens
ggagauggaugguuuuaau

SEQ ID NO: 768527 - RNA, 19 nt, Homo sapiens
ggacaccucacuuccagaa

SEQ ID NO: 768528 - RNA, 19 nt, Homo sapiens
uagguuaugcucaguauuu

SEQ ID NO: 768529 - RNA, 19 nt, Homo sapiens
gggaagacgcugcuagcua

SEQ ID NO: 768530 - RNA, 19 nt, Homo sapiens
ggaugaaauugaugugaag

SEQ ID NO: 768531 - RNA, 19 nt, Homo sapiens
cuacauugcugaaagugau

SEQ ID NO: 768532 - RNA, 19 nt, Homo sapiens
ggacaccuuugaacggaau

SEQ ID NO: 768533 - RNA, 19 nt, Homo sapiens
gaaggacuuugucaauaac

SEQ ID NO: 768534 - RNA, 19 nt, Homo sapiens
caagagauccgggagagaa

SEQ ID NO: 768535 - RNA, 19 nt, Homo sapiens
gacaaggauuucaggaugu

SEQ ID NO: 768536 - RNA, 19 nt, Homo sapiens
ugaaauugaugugaaguuc

SEQ ID NO: 768537 - RNA, 19 nt, Homo sapiens
gaacggaaucuggaaacuu

SEQ ID NO: 768538 - RNA, 19 nt, Homo sapiens
ugagggaaaugcacacugu

SEQ ID NO: 768539 - RNA, 19 nt, Homo sapiens
caguagcucuucucacaga

SEQ ID NO: 768540 - RNA, 19 nt, Homo sapiens
aacaguagcucuucucaca

SEQ ID NO: 768541 - RNA, 19 nt, Homo sapiens
gcaccaaucgaccagauau

SEQ ID NO: 768542 - RNA, 19 nt, Homo sapiens
ggacaugguauuggagaaa

SEQ ID NO: 768543 - RNA, 19 nt, Homo sapiens
guucaucuccgaccgcuaa

SEQ ID NO: 768544 - RNA, 19 nt, Homo sapiens
uagugaaccuaaagaaguu

SEQ ID NO: 768545 - RNA, 19 nt, Homo sapiens
gcacuggcagcuuggauga

SEQ ID NO: 768546 - RNA, 19 nt, Homo sapiens
gcauaugcccaaauuguuc

SEQ ID NO: 768547 - RNA, 19 nt, Homo sapiens
aaggauaaauuggcaagaa

SEQ ID NO: 768548 - RNA, 19 nt, Homo sapiens
uggagaaaccuuacaguga

SEQ ID NO: 768549 - RNA, 19 nt, Homo sapiens
acaguacccuggagaagga

SEQ ID NO: 768550 - RNA, 19 nt, Homo sapiens
gcaggaauugggcauagaa

SEQ ID NO: 768551 - RNA, 19 nt, Homo sapiens
gcuguggcuuucagaagaa

SEQ ID NO: 768552 - RNA, 19 nt, Homo sapiens
agaaugauaugguugaacu

SEQ ID NO: 768553 - RNA, 19 nt, Homo sapiens
gagaaaccuuacagugaag

SEQ ID NO: 768554 - RNA, 19 nt, Homo sapiens
guaaugaagcugcguugau

SEQ ID NO: 768555 - RNA, 19 nt, Homo sapiens
aaacuggcaucuuuaacuc

SEQ ID NO: 768556 - RNA, 19 nt, Homo sapiens
aaagcaguaucaagaccua

SEQ ID NO: 768557 - RNA, 19 nt, Homo sapiens
gaaaaucgggugccuguug

SEQ ID NO: 768558 - RNA, 19 nt, Homo sapiens
ccucuggacugcucuguuc

SEQ ID NO: 768559 - RNA, 19 nt, Homo sapiens
aggauaaauuggcaagaaa

SEQ ID NO: 768560 - RNA, 19 nt, Homo sapiens
ggacuuugucaauaacuau

SEQ ID NO: 768561 - RNA, 19 nt, Homo sapiens
cagacgugcuggaaagguu

SEQ ID NO: 768562 - RNA, 19 nt, Homo sapiens
ccggaggccuugagggaaa

SEQ ID NO: 768563 - RNA, 19 nt, Homo sapiens
uaggauguguaugacuuua

SEQ ID NO: 768564 - RNA, 19 nt, Homo sapiens
caauaccucuauaccaaag

SEQ ID NO: 768565 - RNA, 19 nt, Homo sapiens
ccauaaaucagaaacacuu

SEQ ID NO: 768566 - RNA, 19 nt, Homo sapiens
cugcaagauugauagauga

SEQ ID NO: 768567 - RNA, 19 nt, Homo sapiens
gugcauaugcccaaauugu

SEQ ID NO: 768568 - RNA, 19 nt, Homo sapiens
aaaacgagguggcaagaaa

SEQ ID NO: 768569 - RNA, 19 nt, Homo sapiens
ggauguguaugacuuuagg

SEQ ID NO: 768570 - RNA, 19 nt, Homo sapiens
uugcuaaugucuguaauga

SEQ ID NO: 768571 - RNA, 19 nt, Homo sapiens
gacaggcagaucuuuauug

SEQ ID NO: 768572 - RNA, 19 nt, Homo sapiens
ugguggagauggaugguuu

SEQ ID NO: 768573 - RNA, 19 nt, Homo sapiens
uggcccagcugaaaugaug

SEQ ID NO: 768574 - RNA, 19 nt, Homo sapiens
gagaucauggaauuuguga

SEQ ID NO: 768575 - RNA, 19 nt, Homo sapiens
aggaugaaauugaugugaa

SEQ ID NO: 768576 - RNA, 19 nt, Homo sapiens
aagagggccugcuggcauu

SEQ ID NO: 768577 - RNA, 19 nt, Homo sapiens
gggguggagucauguuuua

SEQ ID NO: 768578 - RNA, 19 nt, Homo sapiens
gugcagaugggcugugaaa

SEQ ID NO: 768579 - RNA, 19 nt, Homo sapiens
gugaagccacugcaagauu

SEQ ID NO: 768580 - RNA, 19 nt, Homo sapiens
ggacuagguuaugcucagu

SEQ ID NO: 768581 - RNA, 19 nt, Homo sapiens
acaggcagaucuuuauugg

SEQ ID NO: 768582 - RNA, 19 nt, Homo sapiens
cugccaaggucuuaaagga

SEQ ID NO: 768583 - RNA, 19 nt, Homo sapiens
gagaaaccacugccaaggu

SEQ ID NO: 768584 - RNA, 19 nt, Homo sapiens
gcucaucaucgccuucuug

SEQ ID NO: 768585 - RNA, 19 nt, Homo sapiens
aaacuuuacagcaggaauu

SEQ ID NO: 768586 - RNA, 19 nt, Homo sapiens
gggcauagauaauacguua

SEQ ID NO: 768587 - RNA, 19 nt, Homo sapiens
ugaaaucagugcuauguua

SEQ ID NO: 768588 - RNA, 19 nt, Homo sapiens
gaauaaauaucccagagaa

SEQ ID NO: 768589 - RNA, 19 nt, Homo sapiens
ccaaagggauguuuagaaa

SEQ ID NO: 768590 - RNA, 19 nt, Homo sapiens
cauccuaacugaagcaaua

SEQ ID NO: 768591 - RNA, 19 nt, Homo sapiens
gauagaaaccuguaagaaa

SEQ ID NO: 768592 - RNA, 19 nt, Homo sapiens
gaauuuaaccguagacaaa

SEQ ID NO: 768593 - RNA, 19 nt, Homo sapiens
gggcauggcuuucuggauu

SEQ ID NO: 768594 - RNA, 19 nt, Homo sapiens
ggacgugccucuucugaug

SEQ ID NO: 768595 - RNA, 19 nt, Homo sapiens
ccauaaagcucgaagaugu

SEQ ID NO: 768596 - RNA, 19 nt, Homo sapiens
uauaagaggucgccuaaug

SEQ ID NO: 768597 - RNA, 19 nt, Homo sapiens
gcaagauccugaaacagaa

SEQ ID NO: 768598 - RNA, 19 nt, Homo sapiens
gcaggaagcucugacucua

SEQ ID NO: 768599 - RNA, 19 nt, Homo sapiens
gaaaccagccuaccaaugu

SEQ ID NO: 768600 - RNA, 19 nt, Homo sapiens
gaagaacauuugguuagaa

SEQ ID NO: 768601 - RNA, 19 nt, Homo sapiens
gaaccggacgcuagaauuu

SEQ ID NO: 768602 - RNA, 19 nt, Homo sapiens
gaaacucccuggaaacaag

SEQ ID NO: 768603 - RNA, 19 nt, Homo sapiens
ggagcaagauccugaaaca

SEQ ID NO: 768604 - RNA, 19 nt, Homo sapiens
ugaauugccugacgagaaa

SEQ ID NO: 768605 - RNA, 19 nt, Homo sapiens
ccagaucccuuaaauguca

SEQ ID NO: 768606 - RNA, 19 nt, Homo sapiens
gaaaucagugcuauguuaa

SEQ ID NO: 768607 - RNA, 19 nt, Homo sapiens
gcagugcauucucaguaua

SEQ ID NO: 768608 - RNA, 19 nt, Homo sapiens
gaaccaagauaucuguaag

SEQ ID NO: 768609 - RNA, 19 nt, Homo sapiens
gaaaugcuugggccuguua

SEQ ID NO: 768610 - RNA, 19 nt, Homo sapiens
cgauggagaugaacagauu

SEQ ID NO: 768611 - RNA, 19 nt, Homo sapiens
gaauguacgcauagcuuua

SEQ ID NO: 768612 - RNA, 19 nt, Homo sapiens
guaagagugucacagagaa

SEQ ID NO: 768613 - RNA, 19 nt, Homo sapiens
caaagaggaagaaauacua

SEQ ID NO: 768614 - RNA, 19 nt, Homo sapiens
gaacagauuccggcugauu

SEQ ID NO: 768615 - RNA, 19 nt, Homo sapiens
caagauaccuauacuuuug

SEQ ID NO: 768616 - RNA, 19 nt, Homo sapiens
caggauaucuuagaggaaa

SEQ ID NO: 768617 - RNA, 19 nt, Homo sapiens
gaauggcccagaucccuua

SEQ ID NO: 768618 - RNA, 19 nt, Homo sapiens
uaaggagagugaccuaaga

SEQ ID NO: 768619 - RNA, 19 nt, Homo sapiens
aaggaaagaugauggagaa

SEQ ID NO: 768620 - RNA, 19 nt, Homo sapiens
cagcagggcauagauaaua

SEQ ID NO: 768621 - RNA, 19 nt, Homo sapiens
gaagugggcacauccauag

SEQ ID NO: 768622 - RNA, 19 nt, Homo sapiens
gaaagaugauggagaaaau

SEQ ID NO: 768623 - RNA, 19 nt, Homo sapiens
gcccagaucccuuaaaugu

SEQ ID NO: 768624 - RNA, 19 nt, Homo sapiens
ccacagagccugcuaucga

SEQ ID NO: 768625 - RNA, 19 nt, Homo sapiens
gaagagccaugagccacaa

SEQ ID NO: 768626 - RNA, 19 nt, Homo sapiens
ggagaaagccguacaucag

SEQ ID NO: 768627 - RNA, 19 nt, Homo sapiens
caaacacagugacccauuc

SEQ ID NO: 768628 - RNA, 19 nt, Homo sapiens
aggcaaagaggaagaaaua

SEQ ID NO: 768629 - RNA, 19 nt, Homo sapiens
gccaagcgguuucauaugg

SEQ ID NO: 768630 - RNA, 19 nt, Homo sapiens
gagaaagccguacaucaga

SEQ ID NO: 768631 - RNA, 19 nt, Homo sapiens
guauauaacugcuucuacu

SEQ ID NO: 768632 - RNA, 19 nt, Homo sapiens
gugccugggucacagcuua

SEQ ID NO: 768633 - RNA, 19 nt, Homo sapiens
ggaaccaagauaucuguaa

SEQ ID NO: 768634 - RNA, 19 nt, Homo sapiens
ggaauguacgcauagcuuu

SEQ ID NO: 768635 - RNA, 19 nt, Homo sapiens
ccaacaccaucccaagaaa

SEQ ID NO: 768636 - RNA, 19 nt, Homo sapiens
gagagugaccuaagaagau

SEQ ID NO: 768637 - RNA, 19 nt, Homo sapiens
ugacaggcuugcuggauau

SEQ ID NO: 768638 - RNA, 19 nt, Homo sapiens
agucaagaguccaggcuua

SEQ ID NO: 768639 - RNA, 19 nt, Homo sapiens
ggauagaaaccuguaagaa

SEQ ID NO: 768640 - RNA, 19 nt, Homo sapiens
gaaagccguacaucagaaa

SEQ ID NO: 768641 - RNA, 19 nt, Homo sapiens
ggagagugaccuaagaaga

SEQ ID NO: 768642 - RNA, 19 nt, Homo sapiens
gcuugggccuguuacguuu

SEQ ID NO: 768643 - RNA, 19 nt, Homo sapiens
uaacaucaccagcagaaau

SEQ ID NO: 768644 - RNA, 19 nt, Homo sapiens
guucacugcuugucuggaa

SEQ ID NO: 768645 - RNA, 19 nt, Homo sapiens
uacaggagauugcccagaa

SEQ ID NO: 768646 - RNA, 19 nt, Homo sapiens
gcagaggccagcaaggauu

SEQ ID NO: 768647 - RNA, 19 nt, Homo sapiens
gaugcagggugucaagaau

SEQ ID NO: 768648 - RNA, 19 nt, Homo sapiens
gaagagcaagcuaagaauc

SEQ ID NO: 768649 - RNA, 19 nt, Homo sapiens
gaaauuccggcagguacua

SEQ ID NO: 768650 - RNA, 19 nt, Homo sapiens
acacagggcugacguuugc

SEQ ID NO: 768651 - RNA, 19 nt, Homo sapiens
gguuucauauggucaagaa

SEQ ID NO: 768652 - RNA, 19 nt, Homo sapiens
agaagaacauuugguuaga

SEQ ID NO: 768653 - RNA, 19 nt, Homo sapiens
caaaugguaaggagaguga

SEQ ID NO: 768654 - RNA, 19 nt, Homo sapiens
gcagaaauuccggcaggua

SEQ ID NO: 768655 - RNA, 19 nt, Homo sapiens
gaaaggcaaagaggaagaa

SEQ ID NO: 768656 - RNA, 19 nt, Homo sapiens
gaaaauuacugaagcaacu

SEQ ID NO: 768657 - RNA, 19 nt, Homo sapiens
gaaaacacgccaagaaaau

SEQ ID NO: 768658 - RNA, 19 nt, Homo sapiens
gcaggcagcuguggaucug

SEQ ID NO: 768659 - RNA, 19 nt, Homo sapiens
gcaaagaggaagaaauacu

SEQ ID NO: 768660 - RNA, 19 nt, Homo sapiens
cggaagagcaagcuaagaa

SEQ ID NO: 768661 - RNA, 19 nt, Homo sapiens
ccaagauaaugagaaaguu

SEQ ID NO: 768662 - RNA, 19 nt, Homo sapiens
auagaaaccuguaagaaac

SEQ ID NO: 768663 - RNA, 19 nt, Homo sapiens
uaaacaggauaucuuagag

SEQ ID NO: 768664 - RNA, 19 nt, Homo sapiens
agaaagccguacaucagaa

SEQ ID NO: 768665 - RNA, 19 nt, Homo sapiens
ugaaacagaaagagaagaa

SEQ ID NO: 768666 - RNA, 19 nt, Homo sapiens
gggagcaguuaacucaaga

SEQ ID NO: 768667 - RNA, 19 nt, Homo sapiens
ccuuaaacaggauaucuua

SEQ ID NO: 768668 - RNA, 19 nt, Homo sapiens
gaacauuugguuagaaacu

SEQ ID NO: 768669 - RNA, 19 nt, Homo sapiens
gcuagaauuuaaccguaga

SEQ ID NO: 768670 - RNA, 19 nt, Homo sapiens
ccacaggcauuauaaucag

SEQ ID NO: 768671 - RNA, 19 nt, Homo sapiens
ugagcagucuuccuccaaa

SEQ ID NO: 768672 - RNA, 19 nt, Homo sapiens
aaacagaaagagaagaaga

SEQ ID NO: 768673 - RNA, 19 nt, Homo sapiens
aguccaggcuuacgaagaa

SEQ ID NO: 768674 - RNA, 19 nt, Homo sapiens
ggaagagcaagcuaagaau

SEQ ID NO: 768675 - RNA, 19 nt, Homo sapiens
uccaagauaccuauacuuu

SEQ ID NO: 768676 - RNA, 19 nt, Homo sapiens
gggauccucgaauaaauuu

SEQ ID NO: 768677 - RNA, 19 nt, Homo sapiens
ccaaccacaggcauuauaa

SEQ ID NO: 768678 - RNA, 19 nt, Homo sapiens
gaacuagagauccaugucu

SEQ ID NO: 768679 - RNA, 19 nt, Homo sapiens
cugcaucgcugacccacuu

SEQ ID NO: 768680 - RNA, 19 nt, Homo sapiens
ggauaucuuagaggaaaua

SEQ ID NO: 768681 - RNA, 19 nt, Homo sapiens
uaaauaucccagagaaaug

SEQ ID NO: 768682 - RNA, 19 nt, Homo sapiens
uugacaggcuugcuggaua

SEQ ID NO: 768683 - RNA, 19 nt, Homo sapiens
ccuguggaauguacgcaua

SEQ ID NO: 768684 - RNA, 19 nt, Homo sapiens
ccuuaaaugucaaaugcaa

SEQ ID NO: 768685 - RNA, 19 nt, Homo sapiens
gaacucuccuaggcuuugu

SEQ ID NO: 768686 - RNA, 19 nt, Homo sapiens
gcuaugagguuaucaagaa

SEQ ID NO: 768687 - RNA, 19 nt, Homo sapiens
gaaagaaaccagccacauu

SEQ ID NO: 768688 - RNA, 19 nt, Homo sapiens
caucaaaucuucugcauca

SEQ ID NO: 768689 - RNA, 19 nt, Homo sapiens
aaagaaaccagccacauua

SEQ ID NO: 768690 - RNA, 19 nt, Homo sapiens
gaagugaaccuaaacacaa

SEQ ID NO: 768691 - RNA, 19 nt, Homo sapiens
cuaaggaaauggaagaauu

SEQ ID NO: 768692 - RNA, 19 nt, Homo sapiens
uaacauugcucacaugaag

SEQ ID NO: 768693 - RNA, 19 nt, Homo sapiens
aaacaauacucagcucuuu

SEQ ID NO: 768694 - RNA, 19 nt, Homo sapiens
ucagauaagucucauagga

SEQ ID NO: 768695 - RNA, 19 nt, Homo sapiens
auacucagcucuuugauug

SEQ ID NO: 768696 - RNA, 19 nt, Homo sapiens
uaucaagaauucaccauga

SEQ ID NO: 768697 - RNA, 19 nt, Homo sapiens
caaaggagcagcuguggaa

SEQ ID NO: 768698 - RNA, 19 nt, Homo sapiens
uaacccaucucugacauuu

SEQ ID NO: 768699 - RNA, 19 nt, Homo sapiens
gaagguagucauuggcuaa

SEQ ID NO: 768700 - RNA, 19 nt, Homo sapiens
uaaugugacuguccuaguu

SEQ ID NO: 768701 - RNA, 19 nt, Homo sapiens
gaaaccagccacauuagga

SEQ ID NO: 768702 - RNA, 19 nt, Homo sapiens
ggagauggccaaaguaauc

SEQ ID NO: 768703 - RNA, 19 nt, Homo sapiens
gaaagaauagaaggaguaa

SEQ ID NO: 768704 - RNA, 19 nt, Homo sapiens
guaccacucuuuggaugua

SEQ ID NO: 768705 - RNA, 19 nt, Homo sapiens
gagcagcuguggaagugaa

SEQ ID NO: 768706 - RNA, 19 nt, Homo sapiens
gaacuaaugggaucuacga

SEQ ID NO: 768707 - RNA, 19 nt, Homo sapiens
guccauacuuaccuaauuu

SEQ ID NO: 768708 - RNA, 19 nt, Homo sapiens
gaaauuucaucuccuacca

SEQ ID NO: 768709 - RNA, 19 nt, Homo sapiens
gcaaaccugccaaaccuuu

SEQ ID NO: 768710 - RNA, 19 nt, Homo sapiens
cuacaggacuacauguuug

SEQ ID NO: 768711 - RNA, 19 nt, Homo sapiens
cgacauggcuggaaaauag

SEQ ID NO: 768712 - RNA, 19 nt, Homo sapiens
gaacucaccgaccaaaugu

SEQ ID NO: 768713 - RNA, 19 nt, Homo sapiens
gaaaauagaccaucuccuu

SEQ ID NO: 768714 - RNA, 19 nt, Homo sapiens
ccuauuaauuccagacaaa

SEQ ID NO: 768715 - RNA, 19 nt, Homo sapiens
gaaagcugaaauuugguua

SEQ ID NO: 768716 - RNA, 19 nt, Homo sapiens
ggaauuccauuuauguacu

SEQ ID NO: 768717 - RNA, 19 nt, Homo sapiens
gcuguucucccuucagaua

SEQ ID NO: 768718 - RNA, 19 nt, Homo sapiens
ggugucugauccaguauuu

SEQ ID NO: 768719 - RNA, 19 nt, Homo sapiens
gaaacaauacucagcucuu

SEQ ID NO: 768720 - RNA, 19 nt, Homo sapiens
gguaagauaggaaagaaga

SEQ ID NO: 768721 - RNA, 19 nt, Homo sapiens
cuucacaucucaucaaauc

SEQ ID NO: 768722 - RNA, 19 nt, Homo sapiens
agagaaugcuaugagguua

SEQ ID NO: 768723 - RNA, 19 nt, Homo sapiens
gaaacucuuuggaaaucau

SEQ ID NO: 768724 - RNA, 19 nt, Homo sapiens
ggauguaauuggguucuug

SEQ ID NO: 768725 - RNA, 19 nt, Homo sapiens
ggaagacccacuacguuau

SEQ ID NO: 768726 - RNA, 19 nt, Homo sapiens
gaucugugauggcguucuu

SEQ ID NO: 768727 - RNA, 19 nt, Homo sapiens
gagauucuaucaggagaug

SEQ ID NO: 768728 - RNA, 19 nt, Homo sapiens
gagauacaaaggaaagaaa

SEQ ID NO: 768729 - RNA, 19 nt, Homo sapiens
gaagacccacuacguuaug

SEQ ID NO: 768730 - RNA, 19 nt, Homo sapiens
guaauuaaggacuucguuu

SEQ ID NO: 768731 - RNA, 19 nt, Homo sapiens
gaaccuaaacacaaugaca

SEQ ID NO: 768732 - RNA, 19 nt, Homo sapiens
gucuuucacugacagaaua

SEQ ID NO: 768733 - RNA, 19 nt, Homo sapiens
ggaagugaaccuaaacaca

SEQ ID NO: 768734 - RNA, 19 nt, Homo sapiens
gauaacauugcucacauga

SEQ ID NO: 768735 - RNA, 19 nt, Homo sapiens
gaacauauugggauuuuga

SEQ ID NO: 768736 - RNA, 19 nt, Homo sapiens
ggaaagcugaaauuugguu

SEQ ID NO: 768737 - RNA, 19 nt, Homo sapiens
gauccaguauuuccuugug

SEQ ID NO: 768738 - RNA, 19 nt, Homo sapiens
uagaaggaguaauuaagga

SEQ ID NO: 768739 - RNA, 19 nt, Homo sapiens
guggaaguccuauuaauuc

SEQ ID NO: 768740 - RNA, 19 nt, Homo sapiens
gcgauauaguagcuuuaaa

SEQ ID NO: 768741 - RNA, 19 nt, Homo sapiens
caaagaaagaauagaagga

SEQ ID NO: 768742 - RNA, 19 nt, Homo sapiens
cguccauacuuaccuaauu

SEQ ID NO: 768743 - RNA, 19 nt, Homo sapiens
ccauuuauguacuccuuga

SEQ ID NO: 768744 - RNA, 19 nt, Homo sapiens
guaguggaaguccuauuaa

SEQ ID NO: 768745 - RNA, 19 nt, Homo sapiens
ggaucuacgaagcuauuua

SEQ ID NO: 768746 - RNA, 19 nt, Homo sapiens
cagauaagucucauaggaa

SEQ ID NO: 768747 - RNA, 19 nt, Homo sapiens
accaacagcugauggcaaa

SEQ ID NO: 768748 - RNA, 19 nt, Homo sapiens
agaaagaauagaaggagua

SEQ ID NO: 768749 - RNA, 19 nt, Homo sapiens
acccaucucugacauuuga

SEQ ID NO: 768750 - RNA, 19 nt, Homo sapiens
cccaugaccucaccugguu

SEQ ID NO: 768751 - RNA, 19 nt, Homo sapiens
ucaccaugaucaaccugua

SEQ ID NO: 768752 - RNA, 19 nt, Homo sapiens
caaaccugccaaaccuuua

SEQ ID NO: 768753 - RNA, 19 nt, Homo sapiens
ggggaaagcugaaauuugg

SEQ ID NO: 768754 - RNA, 19 nt, Homo sapiens
aggaagacccacuacguua

SEQ ID NO: 768755 - RNA, 19 nt, Homo sapiens
uaccauacccuccuuccua

SEQ ID NO: 768756 - RNA, 19 nt, Homo sapiens
caggagauggccaaaguaa

SEQ ID NO: 768757 - RNA, 19 nt, Homo sapiens
aguaguggaaguccuauua

SEQ ID NO: 768758 - RNA, 19 nt, Homo sapiens
gcuuugagaacagucauua

SEQ ID NO: 768759 - RNA, 19 nt, Homo sapiens
ggagauacaaaggaaagaa

SEQ ID NO: 768760 - RNA, 19 nt, Homo sapiens
gcuuagcgcuuugagaaca

SEQ ID NO: 768761 - RNA, 19 nt, Homo sapiens
gcacugcaaaccugccaaa

SEQ ID NO: 768762 - RNA, 19 nt, Homo sapiens
ugaauuuccucguccauac

SEQ ID NO: 768763 - RNA, 19 nt, Homo sapiens
gcugaaauuugguuaaucc

SEQ ID NO: 768764 - RNA, 19 nt, Homo sapiens
ucaugggauucauacuaua

SEQ ID NO: 768765 - RNA, 19 nt, Homo sapiens
ucacaucucaucaaaucuu

SEQ ID NO: 768766 - RNA, 19 nt, Homo sapiens
caaaagggaguuuaacaaa

SEQ ID NO: 768767 - RNA, 19 nt, Homo sapiens
aaagagaauaggucaagaa

SEQ ID NO: 768768 - RNA, 19 nt, Homo sapiens
ugugacaacggcuauauuu

SEQ ID NO: 768769 - RNA, 19 nt, Homo sapiens
caagaauucaccaugauca

SEQ ID NO: 768770 - RNA, 19 nt, Homo sapiens
ucagcucuuugauuggaua

SEQ ID NO: 768771 - RNA, 19 nt, Homo sapiens
acaauacucagcucuuuga

SEQ ID NO: 768772 - RNA, 19 nt, Homo sapiens
ggaaagaaaccagccacau

SEQ ID NO: 768773 - RNA, 19 nt, Homo sapiens
uuauggagauacaaaggaa

SEQ ID NO: 768774 - RNA, 19 nt, Homo sapiens
ugaguuuguuggaggauug

SEQ ID NO: 768775 - RNA, 19 nt, Homo sapiens
gauggcaaagcuaaagaaa

SEQ ID NO: 768776 - RNA, 19 nt, Homo sapiens
caaugacaaguguggauuu

SEQ ID NO: 768777 - RNA, 19 nt, Homo sapiens
ccucagcccuugcccagau

SEQ ID NO: 768778 - RNA, 19 nt, Homo sapiens
ucacugacagaauaagaaa

SEQ ID NO: 768779 - RNA, 19 nt, Homo sapiens
ucaccgaccaaaugucuuu

SEQ ID NO: 768780 - RNA, 19 nt, Homo sapiens
gaucuacgaagcuauuuac

SEQ ID NO: 768781 - RNA, 19 nt, Homo sapiens
gaauuccauuuauguacuc

SEQ ID NO: 768782 - RNA, 19 nt, Homo sapiens
ugauaacauugcucacaug

SEQ ID NO: 768783 - RNA, 19 nt, Homo sapiens
ugccaaaccuuuaccuaag

SEQ ID NO: 768784 - RNA, 19 nt, Homo sapiens
uggcaaagaaagaauagaa

SEQ ID NO: 768785 - RNA, 19 nt, Homo sapiens
uaguggaaguccuauuaau

SEQ ID NO: 768786 - RNA, 19 nt, Homo sapiens
ggacaucuuuggagacaug

SEQ ID NO: 768787 - RNA, 19 nt, Homo sapiens
gaauucacccuaugacauu

SEQ ID NO: 768788 - RNA, 19 nt, Homo sapiens
gcacugcuuugaaaccuau

SEQ ID NO: 768789 - RNA, 19 nt, Homo sapiens
gcaaccaccucuuccucaa

SEQ ID NO: 768790 - RNA, 19 nt, Homo sapiens
cuacacccguuacuucgua

SEQ ID NO: 768791 - RNA, 19 nt, Homo sapiens
caauaucagccaccacuuu

SEQ ID NO: 768792 - RNA, 19 nt, Homo sapiens
auaaacacauuccaguuga

SEQ ID NO: 768793 - RNA, 19 nt, Homo sapiens
guucucuucugucuuguuu

SEQ ID NO: 768794 - RNA, 19 nt, Homo sapiens
ggaauucacccuaugacau

SEQ ID NO: 768795 - RNA, 19 nt, Homo sapiens
guucaggucgccaucauaa

SEQ ID NO: 768796 - RNA, 19 nt, Homo sapiens
gcaccugucaccuacacua

SEQ ID NO: 768797 - RNA, 19 nt, Homo sapiens
ugacuuccaugccauccuu

SEQ ID NO: 768798 - RNA, 19 nt, Homo sapiens
aauaaacacauuccaguug

SEQ ID NO: 768799 - RNA, 19 nt, Homo sapiens
gcuuugaaaccuauaguga

SEQ ID NO: 768800 - RNA, 19 nt, Homo sapiens
cugguucucuucugucuug

SEQ ID NO: 768801 - RNA, 19 nt, Homo sapiens
gguggacccuuggccugua

SEQ ID NO: 768802 - RNA, 19 nt, Homo sapiens
cuacuacacccguuacuuc

SEQ ID NO: 768803 - RNA, 19 nt, Homo sapiens
uaaacacauuccaguugau

SEQ ID NO: 768804 - RNA, 19 nt, Homo sapiens
ugaaaccuauagugaccuu

SEQ ID NO: 768805 - RNA, 19 nt, Homo sapiens
cuccaggccuccacauuug

SEQ ID NO: 768806 - RNA, 19 nt, Homo sapiens
caccuacacuaaacacauc

SEQ ID NO: 768807 - RNA, 19 nt, Homo sapiens
uaaacaacucuaugugcaa

SEQ ID NO: 768808 - RNA, 19 nt, Homo sapiens
ucuccaggccuccacauuu

SEQ ID NO: 768809 - RNA, 19 nt, Homo sapiens
ucuucugucuuguuuggua

SEQ ID NO: 768810 - RNA, 19 nt, Homo sapiens
guggacccuuggccuguaa

SEQ ID NO: 768811 - RNA, 19 nt, Homo sapiens
ccacauuugaguuugagaa

SEQ ID NO: 768812 - RNA, 19 nt, Homo sapiens
ccuaugacauugccuuggu

SEQ ID NO: 768813 - RNA, 19 nt, Homo sapiens
uugcagggcauucuucaaa

SEQ ID NO: 768814 - RNA, 19 nt, Homo sapiens
acaagaauggacuguggua

SEQ ID NO: 768815 - RNA, 19 nt, Homo sapiens
uauagugaccuuagugauc

SEQ ID NO: 768816 - RNA, 19 nt, Homo sapiens
ccuccacauuugaguuuga

SEQ ID NO: 768817 - RNA, 19 nt, Homo sapiens
ggccuccacauuugaguuu

SEQ ID NO: 768818 - RNA, 19 nt, Homo sapiens
aaacacauccagcccaucu

SEQ ID NO: 768819 - RNA, 19 nt, Homo sapiens
aauaucagccaccacuuug

SEQ ID NO: 768820 - RNA, 19 nt, Homo sapiens
gaaguucaggucgccauca

SEQ ID NO: 768821 - RNA, 19 nt, Homo sapiens
aaggacaucuuuggagaca

SEQ ID NO: 768822 - RNA, 19 nt, Homo sapiens
ucucuucugucuuguuugg

SEQ ID NO: 768823 - RNA, 19 nt, Homo sapiens
ggcccugguucucuucugu

SEQ ID NO: 768824 - RNA, 19 nt, Homo sapiens
ugucugcaccugucaccua

SEQ ID NO: 768825 - RNA, 19 nt, Homo sapiens
aaacacauuccaguugaug

SEQ ID NO: 768826 - RNA, 19 nt, Homo sapiens
aaccaccucuuccucaagu

SEQ ID NO: 768827 - RNA, 19 nt, Homo sapiens
ugacauugccuuggugaag

SEQ ID NO: 768828 - RNA, 19 nt, Homo sapiens
gggaauucacccuaugaca

SEQ ID NO: 768829 - RNA, 19 nt, Homo sapiens
guaucgaauaucuaucuga

SEQ ID NO: 768830 - RNA, 19 nt, Homo sapiens
ucaggucgccaucauaaac

SEQ ID NO: 768831 - RNA, 19 nt, Homo sapiens
ccuauagugaccuuaguga

SEQ ID NO: 768832 - RNA, 19 nt, Homo sapiens
gaaaccuauagugaccuua

SEQ ID NO: 768833 - RNA, 19 nt, Homo sapiens
cuucugucuuguuugguaa

SEQ ID NO: 768834 - RNA, 19 nt, Homo sapiens
gcgggaaggaugccugcuu

SEQ ID NO: 768835 - RNA, 19 nt, Homo sapiens
aaaccuauagugaccuuag

SEQ ID NO: 768836 - RNA, 19 nt, Homo sapiens
ccugucaccuacacuaaac

SEQ ID NO: 768837 - RNA, 19 nt, Homo sapiens
ggacaucuuuggagacaug

SEQ ID NO: 768838 - RNA, 19 nt, Homo sapiens
gaauucacccuaugacauu

SEQ ID NO: 768839 - RNA, 19 nt, Homo sapiens
gaaacugaccuuagugauc

SEQ ID NO: 768840 - RNA, 19 nt, Homo sapiens
gcaaccaccucuuccucaa

SEQ ID NO: 768841 - RNA, 19 nt, Homo sapiens
cuacacccguuacuucgua

SEQ ID NO: 768842 - RNA, 19 nt, Homo sapiens
caauaucagccaccacuuu

SEQ ID NO: 768843 - RNA, 19 nt, Homo sapiens
auaaacacauuccaguuga

SEQ ID NO: 768844 - RNA, 19 nt, Homo sapiens
guucucuucugucuuguuu

SEQ ID NO: 768845 - RNA, 19 nt, Homo sapiens
ggaauucacccuaugacau

SEQ ID NO: 768846 - RNA, 19 nt, Homo sapiens
guucaggucgccaucauaa

SEQ ID NO: 768847 - RNA, 19 nt, Homo sapiens
gcaccugucaccuacacua

SEQ ID NO: 768848 - RNA, 19 nt, Homo sapiens
ugacuuccaugccauccuu

SEQ ID NO: 768849 - RNA, 19 nt, Homo sapiens
aauaaacacauuccaguug

SEQ ID NO: 768850 - RNA, 19 nt, Homo sapiens
cugguucucuucugucuug

SEQ ID NO: 768851 - RNA, 19 nt, Homo sapiens
gguggacccuuggccugua

SEQ ID NO: 768852 - RNA, 19 nt, Homo sapiens
cuacuacacccguuacuuc

SEQ ID NO: 768853 - RNA, 19 nt, Homo sapiens
uaaacacauuccaguugau

SEQ ID NO: 768854 - RNA, 19 nt, Homo sapiens
cuccaggccuccacauuug

SEQ ID NO: 768855 - RNA, 19 nt, Homo sapiens
gcgcacugcuuugaaacug

SEQ ID NO: 768856 - RNA, 19 nt, Homo sapiens
caccuacacuaaacacauc

SEQ ID NO: 768857 - RNA, 19 nt, Homo sapiens
uaaacaacucuaugugcaa

SEQ ID NO: 768858 - RNA, 19 nt, Homo sapiens
ucuccaggccuccacauuu

SEQ ID NO: 768859 - RNA, 19 nt, Homo sapiens
ucuucugucuuguuuggua

SEQ ID NO: 768860 - RNA, 19 nt, Homo sapiens
guggacccuuggccuguaa

SEQ ID NO: 768861 - RNA, 19 nt, Homo sapiens
ccacauuugaguuugagaa

SEQ ID NO: 768862 - RNA, 19 nt, Homo sapiens
ccuaugacauugccuuggu

SEQ ID NO: 768863 - RNA, 19 nt, Homo sapiens
uugcagggcauucuucaaa

SEQ ID NO: 768864 - RNA, 19 nt, Homo sapiens
acaagaauggacuguggua

SEQ ID NO: 768865 - RNA, 19 nt, Homo sapiens
ccuccacauuugaguuuga

SEQ ID NO: 768866 - RNA, 19 nt, Homo sapiens
ggccuccacauuugaguuu

SEQ ID NO: 768867 - RNA, 19 nt, Homo sapiens
aaacacauccagcccaucu

SEQ ID NO: 768868 - RNA, 19 nt, Homo sapiens
aauaucagccaccacuuug

SEQ ID NO: 768869 - RNA, 19 nt, Homo sapiens
gaaguucaggucgccauca

SEQ ID NO: 768870 - RNA, 19 nt, Homo sapiens
cuuugaaacugaccuuagu

SEQ ID NO: 768871 - RNA, 19 nt, Homo sapiens
aaggacaucuuuggagaca

SEQ ID NO: 768872 - RNA, 19 nt, Homo sapiens
ucucuucugucuuguuugg

SEQ ID NO: 768873 - RNA, 19 nt, Homo sapiens
ggcccugguucucuucugu

SEQ ID NO: 768874 - RNA, 19 nt, Homo sapiens
ugucugcaccugucaccua

SEQ ID NO: 768875 - RNA, 19 nt, Homo sapiens
aaacacauuccaguugaug

SEQ ID NO: 768876 - RNA, 19 nt, Homo sapiens
aaccaccucuuccucaagu

SEQ ID NO: 768877 - RNA, 19 nt, Homo sapiens
ugacauugccuuggugaag

SEQ ID NO: 768878 - RNA, 19 nt, Homo sapiens
gggaauucacccuaugaca

SEQ ID NO: 768879 - RNA, 19 nt, Homo sapiens
guaucgaauaucuaucuga

SEQ ID NO: 768880 - RNA, 19 nt, Homo sapiens
ucaggucgccaucauaaac

SEQ ID NO: 768881 - RNA, 19 nt, Homo sapiens
cuucugucuuguuugguaa

SEQ ID NO: 768882 - RNA, 19 nt, Homo sapiens
gcgggaaggaugccugcuu

SEQ ID NO: 768883 - RNA, 19 nt, Homo sapiens
ccugucaccuacacuaaac

SEQ ID NO: 768884 - RNA, 19 nt, Homo sapiens
ggacaucuuuggagacaug

SEQ ID NO: 768885 - RNA, 19 nt, Homo sapiens
gaauucacccuaugacauu

SEQ ID NO: 768886 - RNA, 19 nt, Homo sapiens
gcacugcuuugaaaccuau

SEQ ID NO: 768887 - RNA, 19 nt, Homo sapiens
gcaaccaccucuuccucaa

SEQ ID NO: 768888 - RNA, 19 nt, Homo sapiens
cuacacccguuacuucgua

SEQ ID NO: 768889 - RNA, 19 nt, Homo sapiens
caauaucagccaccacuuu

SEQ ID NO: 768890 - RNA, 19 nt, Homo sapiens
auaaacacauuccaguuga

SEQ ID NO: 768891 - RNA, 19 nt, Homo sapiens
guucucuucugucuuguuu

SEQ ID NO: 768892 - RNA, 19 nt, Homo sapiens
ggaauucacccuaugacau

SEQ ID NO: 768893 - RNA, 19 nt, Homo sapiens
guucaggucgccaucauaa

SEQ ID NO: 768894 - RNA, 19 nt, Homo sapiens
gcaccugucaccuacacua

SEQ ID NO: 768895 - RNA, 19 nt, Homo sapiens
ugacuuccaugccauccuu

SEQ ID NO: 768896 - RNA, 19 nt, Homo sapiens
aauaaacacauuccaguug

SEQ ID NO: 768897 - RNA, 19 nt, Homo sapiens
gcuuugaaaccuauaguga

SEQ ID NO: 768898 - RNA, 19 nt, Homo sapiens
cugguucucuucugucuug

SEQ ID NO: 768899 - RNA, 19 nt, Homo sapiens
gguggacccuuggccugua

SEQ ID NO: 768900 - RNA, 19 nt, Homo sapiens
cuacuacacccguuacuuc

SEQ ID NO: 768901 - RNA, 19 nt, Homo sapiens
uaaacacauuccaguugau

SEQ ID NO: 768902 - RNA, 19 nt, Homo sapiens
ugaaaccuauagugaccuu

SEQ ID NO: 768903 - RNA, 19 nt, Homo sapiens
cuccaggccuccacauuug

SEQ ID NO: 768904 - RNA, 19 nt, Homo sapiens
caccuacacuaaacacauc

SEQ ID NO: 768905 - RNA, 19 nt, Homo sapiens
uaaacaacucuaugugcaa

SEQ ID NO: 768906 - RNA, 19 nt, Homo sapiens
ucuccaggccuccacauuu

SEQ ID NO: 768907 - RNA, 19 nt, Homo sapiens
ucuucugucuuguuuggua

SEQ ID NO: 768908 - RNA, 19 nt, Homo sapiens
guggacccuuggccuguaa

SEQ ID NO: 768909 - RNA, 19 nt, Homo sapiens
ccacauuugaguuugagaa

SEQ ID NO: 768910 - RNA, 19 nt, Homo sapiens
ccuaugacauugccuuggu

SEQ ID NO: 768911 - RNA, 19 nt, Homo sapiens
uugcagggcauucuucaaa

SEQ ID NO: 768912 - RNA, 19 nt, Homo sapiens
acaagaauggacuguggua

SEQ ID NO: 768913 - RNA, 19 nt, Homo sapiens
uauagugaccuuagugauc

SEQ ID NO: 768914 - RNA, 19 nt, Homo sapiens
ccuccacauuugaguuuga

SEQ ID NO: 768915 - RNA, 19 nt, Homo sapiens
ggccuccacauuugaguuu

SEQ ID NO: 768916 - RNA, 19 nt, Homo sapiens
aaacacauccagcccaucu

SEQ ID NO: 768917 - RNA, 19 nt, Homo sapiens
aauaucagccaccacuuug

SEQ ID NO: 768918 - RNA, 19 nt, Homo sapiens
gaaguucaggucgccauca

SEQ ID NO: 768919 - RNA, 19 nt, Homo sapiens
aaggacaucuuuggagaca

SEQ ID NO: 768920 - RNA, 19 nt, Homo sapiens
ucucuucugucuuguuugg

SEQ ID NO: 768921 - RNA, 19 nt, Homo sapiens
ggcccugguucucuucugu

SEQ ID NO: 768922 - RNA, 19 nt, Homo sapiens
ugucugcaccugucaccua

SEQ ID NO: 768923 - RNA, 19 nt, Homo sapiens
aaacacauuccaguugaug

SEQ ID NO: 768924 - RNA, 19 nt, Homo sapiens
aaccaccucuuccucaagu

SEQ ID NO: 768925 - RNA, 19 nt, Homo sapiens
ugacauugccuuggugaag

SEQ ID NO: 768926 - RNA, 19 nt, Homo sapiens
gggaauucacccuaugaca

SEQ ID NO: 768927 - RNA, 19 nt, Homo sapiens
guaucgaauaucuaucuga

SEQ ID NO: 768928 - RNA, 19 nt, Homo sapiens
ucaggucgccaucauaaac

SEQ ID NO: 768929 - RNA, 19 nt, Homo sapiens
ccuauagugaccuuaguga

SEQ ID NO: 768930 - RNA, 19 nt, Homo sapiens
gaaaccuauagugaccuua

SEQ ID NO: 768931 - RNA, 19 nt, Homo sapiens
cuucugucuuguuugguaa

SEQ ID NO: 768932 - RNA, 19 nt, Homo sapiens
aaaccuauagugaccuuag

SEQ ID NO: 768933 - RNA, 19 nt, Homo sapiens
ccugucaccuacacuaaac

SEQ ID NO: 768934 - RNA, 19 nt, Homo sapiens
gcagaaagaucccagaaua

SEQ ID NO: 768935 - RNA, 19 nt, Homo sapiens
gaaccacauugucucuuua

SEQ ID NO: 768936 - RNA, 19 nt, Homo sapiens
ggaagggagugcuguguuu

SEQ ID NO: 768937 - RNA, 19 nt, Homo sapiens
guggauggauuaagaauaa

SEQ ID NO: 768938 - RNA, 19 nt, Homo sapiens
agaagaaucugaaggcuuu

SEQ ID NO: 768939 - RNA, 19 nt, Homo sapiens
aauaaagccugucuuguuu

SEQ ID NO: 768940 - RNA, 19 nt, Homo sapiens
gaagggaaauggaagaaag

SEQ ID NO: 768941 - RNA, 19 nt, Homo sapiens
acacgacacuuguuacuuu

SEQ ID NO: 768942 - RNA, 19 nt, Homo sapiens
gcgcaaagcugagccagaa

SEQ ID NO: 768943 - RNA, 19 nt, Homo sapiens
gaugguggauggauuaaga

SEQ ID NO: 768944 - RNA, 19 nt, Homo sapiens
gaagcacuuugaucucuuu

SEQ ID NO: 768945 - RNA, 19 nt, Homo sapiens
gaagggagaagaacuaaug

SEQ ID NO: 768946 - RNA, 19 nt, Homo sapiens
ugaacaagcucaguauaaa

SEQ ID NO: 768947 - RNA, 19 nt, Homo sapiens
ggagaugguggauggauua

SEQ ID NO: 768948 - RNA, 19 nt, Homo sapiens
gcuauacuuuguuguguaa

SEQ ID NO: 768949 - RNA, 19 nt, Homo sapiens
caaaguagucucaaaguau

SEQ ID NO: 768950 - RNA, 19 nt, Homo sapiens
acaaaguagucucaaagua

SEQ ID NO: 768951 - RNA, 19 nt, Homo sapiens
gcuaugcauuugcuucuaa

SEQ ID NO: 768952 - RNA, 19 nt, Homo sapiens
gaacagaagcugggauaga

SEQ ID NO: 768953 - RNA, 19 nt, Homo sapiens
ggaauagguuaggccauuu

SEQ ID NO: 768954 - RNA, 19 nt, Homo sapiens
cacauugucucuuuauuug

SEQ ID NO: 768955 - RNA, 19 nt, Homo sapiens
ccacauugucucuuuauuu

SEQ ID NO: 768956 - RNA, 19 nt, Homo sapiens
uaaagccugucuuguuuga

SEQ ID NO: 768957 - RNA, 19 nt, Homo sapiens
aaauaaagccugucuuguu

SEQ ID NO: 768958 - RNA, 19 nt, Homo sapiens
agacugaagugaaagaaga

SEQ ID NO: 768959 - RNA, 19 nt, Homo sapiens
ggaaauggaagaaagaaca

SEQ ID NO: 768960 - RNA, 19 nt, Homo sapiens
ggagaagaacuaaugaaau

SEQ ID NO: 768961 - RNA, 19 nt, Homo sapiens
gggagaagaacuaaugaaa

SEQ ID NO: 768962 - RNA, 19 nt, Homo sapiens
gcauugccuuucuuauuug

SEQ ID NO: 768963 - RNA, 19 nt, Homo sapiens
ggaugauuguuacuacauu

SEQ ID NO: 768964 - RNA, 19 nt, Homo sapiens
aauccuaugugaagcauuu

SEQ ID NO: 768965 - RNA, 19 nt, Homo sapiens
agcauugccuuucuuauuu

SEQ ID NO: 768966 - RNA, 19 nt, Homo sapiens
ccagaaauccuuggaaaga

SEQ ID NO: 768967 - RNA, 19 nt, Homo sapiens
ggauuaagaauaaccuuug

SEQ ID NO: 768968 - RNA, 19 nt, Homo sapiens
ggaggaugauuguuacuac

SEQ ID NO: 768969 - RNA, 19 nt, Homo sapiens
uuacagcuauacuuuguug

SEQ ID NO: 768970 - RNA, 19 nt, Homo sapiens
uagagggaaucgauauuga

SEQ ID NO: 768971 - RNA, 19 nt, Homo sapiens
agaaccacauugucucuuu

SEQ ID NO: 768972 - RNA, 19 nt, Homo sapiens
gcaguuauucuguuaggaa

SEQ ID NO: 768973 - RNA, 19 nt, Homo sapiens
ccuccacccucuuacauuu

SEQ ID NO: 768974 - RNA, 19 nt, Homo sapiens
gcacaggaagaaagaagaa

SEQ ID NO: 768975 - RNA, 19 nt, Homo sapiens
cagcguaaauuggcaagaa

SEQ ID NO: 768976 - RNA, 19 nt, Homo sapiens
caacccggcugucggucua

SEQ ID NO: 768977 - RNA, 19 nt, Homo sapiens
gcacauuacagcaccaaga

SEQ ID NO: 768978 - RNA, 19 nt, Homo sapiens
cuaaauaaagccugucuug

SEQ ID NO: 768979 - RNA, 19 nt, Homo sapiens
gcaguuaguuagcaagaac

SEQ ID NO: 768980 - RNA, 19 nt, Homo sapiens
gaagacaccugugcauagc

SEQ ID NO: 768981 - RNA, 19 nt, Homo sapiens
gguguggacucugucuuaa

SEQ ID NO: 768982 - RNA, 19 nt, Homo sapiens
agaaauccuuggaaagaug

SEQ ID NO: 768983 - RNA, 19 nt, Homo sapiens
agaaaagacugaagugaaa

SEQ ID NO: 768984 - RNA, 19 nt, Homo sapiens
aagccugucuuguuugaaa

SEQ ID NO: 768985 - RNA, 19 nt, Homo sapiens
uggaauagguuaggccauu

SEQ ID NO: 768986 - RNA, 19 nt, Homo sapiens
gguuccaggugaauaacua

SEQ ID NO: 768987 - RNA, 19 nt, Homo sapiens
ucugaaggcuuuauugaag

SEQ ID NO: 768988 - RNA, 19 nt, Homo sapiens
aaaggugacuucgucuaaa

SEQ ID NO: 768989 - RNA, 19 nt, Homo sapiens
cauaugaacaagcucagua

SEQ ID NO: 768990 - RNA, 19 nt, Homo sapiens
gaauaaccuuugauuacac

SEQ ID NO: 768991 - RNA, 19 nt, Homo sapiens
aagcauugccuuucuuauu

SEQ ID NO: 768992 - RNA, 19 nt, Homo sapiens
ccaggugaauaacuaacaa

SEQ ID NO: 768993 - RNA, 19 nt, Homo sapiens
uuccugaucuaacuucuaa

SEQ ID NO: 768994 - RNA, 19 nt, Homo sapiens
uguuugaguugcccacaua

SEQ ID NO: 768995 - RNA, 19 nt, Homo sapiens
acaagguggugggucuuua

SEQ ID NO: 768996 - RNA, 19 nt, Homo sapiens
cagaauaccacgaugacuu

SEQ ID NO: 768997 - RNA, 19 nt, Homo sapiens
gaaucugaaggcuuuauug

SEQ ID NO: 768998 - RNA, 19 nt, Homo sapiens
gaggaugauuguuacuaca

SEQ ID NO: 768999 - RNA, 19 nt, Homo sapiens
ggauagaugggcagcagaa

SEQ ID NO: 769000 - RNA, 19 nt, Homo sapiens
cagaaagaucccagaauau

SEQ ID NO: 769001 - RNA, 19 nt, Homo sapiens
cagaaauccuuggaaagau

SEQ ID NO: 769002 - RNA, 19 nt, Homo sapiens
gaacaagcucaguauaaaa

SEQ ID NO: 769003 - RNA, 19 nt, Homo sapiens
gagggaaucgauauugaug

SEQ ID NO: 769004 - RNA, 19 nt, Homo sapiens
ucaguagacauugcaguua

SEQ ID NO: 769005 - RNA, 19 nt, Homo sapiens
gaugacuucuucccagagu

SEQ ID NO: 769006 - RNA, 19 nt, Homo sapiens
uugcugcgauuguuuguga

SEQ ID NO: 769007 - RNA, 19 nt, Homo sapiens
caacauuugcugcgauugu

SEQ ID NO: 769008 - RNA, 19 nt, Homo sapiens
ggugacuucgucuaaauuu

SEQ ID NO: 769009 - RNA, 19 nt, Homo sapiens
ccacaaaguagucucaaag

SEQ ID NO: 769010 - RNA, 19 nt, Homo sapiens
caguagacauugcaguuag

SEQ ID NO: 769011 - RNA, 19 nt, Homo sapiens
guuaggccauuucaguaga

SEQ ID NO: 769012 - RNA, 19 nt, Homo sapiens
gaaacuuccagaaauccuu

SEQ ID NO: 769013 - RNA, 19 nt, Homo sapiens
caagaagggaaauggaaga

SEQ ID NO: 769014 - RNA, 19 nt, Homo sapiens
uuuaaugguuggaacagaa

SEQ ID NO: 769015 - RNA, 19 nt, Homo sapiens
cacaacauuugcugcgauu

SEQ ID NO: 769016 - RNA, 19 nt, Homo sapiens
aacagaagcugggauagau

SEQ ID NO: 769017 - RNA, 19 nt, Homo sapiens
aagggucugugaauuaguu

SEQ ID NO: 769018 - RNA, 19 nt, Homo sapiens
aagcaacuauguucacagu

SEQ ID NO: 769019 - RNA, 19 nt, Homo sapiens
ugugaaacuuccagaaauc

SEQ ID NO: 769020 - RNA, 19 nt, Homo sapiens
gaagggagugcuguguuug

SEQ ID NO: 769021 - RNA, 19 nt, Homo sapiens
gguggauggauuaagaaua

SEQ ID NO: 769022 - RNA, 19 nt, Homo sapiens
cauuauaucccagcagaaa

SEQ ID NO: 769023 - RNA, 19 nt, Homo sapiens
ugagaggccucgucaccau

SEQ ID NO: 769024 - RNA, 19 nt, Homo sapiens
agaaagaucccagaauauc

SEQ ID NO: 769025 - RNA, 19 nt, Homo sapiens
gcuggaggaugauuguuac

SEQ ID NO: 769026 - RNA, 19 nt, Homo sapiens
acucggaaaccacaaagua

SEQ ID NO: 769027 - RNA, 19 nt, Homo sapiens
gaaauccuuggaaagaugu

SEQ ID NO: 769028 - RNA, 19 nt, Homo sapiens
ccaguccgccuuuguugaa

SEQ ID NO: 769029 - RNA, 19 nt, Homo sapiens
ccucgucaccaucacguua

SEQ ID NO: 769030 - RNA, 19 nt, Homo sapiens
cagcuauacuuuguugugu

SEQ ID NO: 769031 - RNA, 19 nt, Homo sapiens
gaauagguuaggccauuuc

SEQ ID NO: 769032 - RNA, 19 nt, Homo sapiens
uacugcaguuauucuguua

SEQ ID NO: 769033 - RNA, 19 nt, Homo sapiens
auacugcaguuauucuguu

SEQ ID NO: 769034 - RNA, 19 nt, Homo sapiens
gcagaaagaucccagaaua

SEQ ID NO: 769035 - RNA, 19 nt, Homo sapiens
guaaaccacugcuaauuaa

SEQ ID NO: 769036 - RNA, 19 nt, Homo sapiens
ggaaaggucuguccugaau

SEQ ID NO: 769037 - RNA, 19 nt, Homo sapiens
guggauggauuaagaauaa

SEQ ID NO: 769038 - RNA, 19 nt, Homo sapiens
aaaggucuguccugaauua

SEQ ID NO: 769039 - RNA, 19 nt, Homo sapiens
gacaaccacuaaucuauuu

SEQ ID NO: 769040 - RNA, 19 nt, Homo sapiens
gaaaguauuugcugauucu

SEQ ID NO: 769041 - RNA, 19 nt, Homo sapiens
gaagggaaauggaagaaag

SEQ ID NO: 769042 - RNA, 19 nt, Homo sapiens
agaaaggucugacuuguug

SEQ ID NO: 769043 - RNA, 19 nt, Homo sapiens
gcgcaaagcugagccagaa

SEQ ID NO: 769044 - RNA, 19 nt, Homo sapiens
gaugguggauggauuaaga

SEQ ID NO: 769045 - RNA, 19 nt, Homo sapiens
ggaaucaucuguauguaag

SEQ ID NO: 769046 - RNA, 19 nt, Homo sapiens
caucagaucuucucaccuu

SEQ ID NO: 769047 - RNA, 19 nt, Homo sapiens
ugaacaagcucaguauaaa

SEQ ID NO: 769048 - RNA, 19 nt, Homo sapiens
gcgagggcaugaaauuuaa

SEQ ID NO: 769049 - RNA, 19 nt, Homo sapiens
ggagaugguggauggauua

SEQ ID NO: 769050 - RNA, 19 nt, Homo sapiens
gagaagcccuuugaauaau

SEQ ID NO: 769051 - RNA, 19 nt, Homo sapiens
aagagaagcccuuugaaua

SEQ ID NO: 769052 - RNA, 19 nt, Homo sapiens
gcacccaacuccagagaug

SEQ ID NO: 769053 - RNA, 19 nt, Homo sapiens
gugaugaugugcaccuaua

SEQ ID NO: 769054 - RNA, 19 nt, Homo sapiens
uaaaacagcuugauugaga

SEQ ID NO: 769055 - RNA, 19 nt, Homo sapiens
ccacaucgacuagcaguua

SEQ ID NO: 769056 - RNA, 19 nt, Homo sapiens
gagcuggaauguuucaaug

SEQ ID NO: 769057 - RNA, 19 nt, Homo sapiens
gaacagaagcugggauaga

SEQ ID NO: 769058 - RNA, 19 nt, Homo sapiens
gaucuucucaccuugauuu

SEQ ID NO: 769059 - RNA, 19 nt, Homo sapiens
ccacauaccuuaaaauuca

SEQ ID NO: 769060 - RNA, 19 nt, Homo sapiens
uguagucucuccauucuaa

SEQ ID NO: 769061 - RNA, 19 nt, Homo sapiens
agagaagcccuuugaauaa

SEQ ID NO: 769062 - RNA, 19 nt, Homo sapiens
aggcauaccuuuaagagaa

SEQ ID NO: 769063 - RNA, 19 nt, Homo sapiens
guagguguaucuuguguau

SEQ ID NO: 769064 - RNA, 19 nt, Homo sapiens
gacuagcaguuacucauuu

SEQ ID NO: 769065 - RNA, 19 nt, Homo sapiens
gcuguacgaugccaagauu

SEQ ID NO: 769066 - RNA, 19 nt, Homo sapiens
ggucuguccugaauuauca

SEQ ID NO: 769067 - RNA, 19 nt, Homo sapiens
agacugaagugaaagaaga

SEQ ID NO: 769068 - RNA, 19 nt, Homo sapiens
guaagaauacucagauuuc

SEQ ID NO: 769069 - RNA, 19 nt, Homo sapiens
gcaaauugaguuaucagaa

SEQ ID NO: 769070 - RNA, 19 nt, Homo sapiens
gaaguaaaccacugcuaau

SEQ ID NO: 769071 - RNA, 19 nt, Homo sapiens
gugcugagguuacaugugu

SEQ ID NO: 769072 - RNA, 19 nt, Homo sapiens
ggaaauggaagaaagaaca

SEQ ID NO: 769073 - RNA, 19 nt, Homo sapiens
gggcaaccaucacugaaau

SEQ ID NO: 769074 - RNA, 19 nt, Homo sapiens
gcucaguguugguggcaua

SEQ ID NO: 769075 - RNA, 19 nt, Homo sapiens
gcucugugcuuauauccuu

SEQ ID NO: 769076 - RNA, 19 nt, Homo sapiens
cauaagcuccugagagaaa

SEQ ID NO: 769077 - RNA, 19 nt, Homo sapiens
ccucuuagcccaacucaaa

SEQ ID NO: 769078 - RNA, 19 nt, Homo sapiens
ggaugauuguuacuacauu

SEQ ID NO: 769079 - RNA, 19 nt, Homo sapiens
gauauaauccacauaccuu

SEQ ID NO: 769080 - RNA, 19 nt, Homo sapiens
ugaaacaccuggcgcagau

SEQ ID NO: 769081 - RNA, 19 nt, Homo sapiens
aauccuaugugaagcauuu

SEQ ID NO: 769082 - RNA, 19 nt, Homo sapiens
cacccugucugauagauaa

SEQ ID NO: 769083 - RNA, 19 nt, Homo sapiens
gaagaccucauucacaaau

SEQ ID NO: 769084 - RNA, 19 nt, Homo sapiens
gaagcccuuugaauaauca

SEQ ID NO: 769085 - RNA, 19 nt, Homo sapiens
ggucugacuuguugauugu

SEQ ID NO: 769086 - RNA, 19 nt, Homo sapiens
gggagaaagugcugugcuu

SEQ ID NO: 769087 - RNA, 19 nt, Homo sapiens
aguaaaccacugcuaauua

SEQ ID NO: 769088 - RNA, 19 nt, Homo sapiens
ggauuaagaauaaccuuug

SEQ ID NO: 769089 - RNA, 19 nt, Homo sapiens
ggaggaugauuguuacuac

SEQ ID NO: 769090 - RNA, 19 nt, Homo sapiens
cagcuugauugagauauaa

SEQ ID NO: 769091 - RNA, 19 nt, Homo sapiens
gagaaaggucugacuuguu

SEQ ID NO: 769092 - RNA, 19 nt, Homo sapiens
uccauaagcuccugagaga

SEQ ID NO: 769093 - RNA, 19 nt, Homo sapiens
gcacaggaagaaagaagaa

SEQ ID NO: 769094 - RNA, 19 nt, Homo sapiens
cagcguaaauuggcaagaa

SEQ ID NO: 769095 - RNA, 19 nt, Homo sapiens
gugaaaguauuugcugauu

SEQ ID NO: 769096 - RNA, 19 nt, Homo sapiens
gagagaaaggucugacuug

SEQ ID NO: 769097 - RNA, 19 nt, Homo sapiens
uaagagaagcccuuugaau

SEQ ID NO: 769098 - RNA, 19 nt, Homo sapiens
gaagggcagaguugaagaa

SEQ ID NO: 769099 - RNA, 19 nt, Homo sapiens
guaguaguauucacuuuac

SEQ ID NO: 769100 - RNA, 19 nt, Homo sapiens
guaagugguuaauaaggau

SEQ ID NO: 769101 - RNA, 19 nt, Homo sapiens
gaucagccugggcaauaua

SEQ ID NO: 769102 - RNA, 19 nt, Homo sapiens
caacucaaacuccaucaga

SEQ ID NO: 769103 - RNA, 19 nt, Homo sapiens
guccugaauuaucaaagua

SEQ ID NO: 769104 - RNA, 19 nt, Homo sapiens
ccaagauuguugauguuau

SEQ ID NO: 769105 - RNA, 19 nt, Homo sapiens
gguguggacucugucuuaa

SEQ ID NO: 769106 - RNA, 19 nt, Homo sapiens
aauaaggauugguugauug

SEQ ID NO: 769107 - RNA, 19 nt, Homo sapiens
agguguaucuuguguauga

SEQ ID NO: 769108 - RNA, 19 nt, Homo sapiens
aaacaggugccaugaauca

SEQ ID NO: 769109 - RNA, 19 nt, Homo sapiens
agaaguaaaccacugcuaa

SEQ ID NO: 769110 - RNA, 19 nt, Homo sapiens
agaaaagacugaagugaaa

SEQ ID NO: 769111 - RNA, 19 nt, Homo sapiens
ggccaggaguucaagauca

SEQ ID NO: 769112 - RNA, 19 nt, Homo sapiens
acagcuugauugagauaua

SEQ ID NO: 769113 - RNA, 19 nt, Homo sapiens
ccaggugcgugaaaguauu

SEQ ID NO: 769114 - RNA, 19 nt, Homo sapiens
uguaagugguuaauaagga

SEQ ID NO: 769115 - RNA, 19 nt, Homo sapiens
ugacaaccacuaaucuauu

SEQ ID NO: 769116 - RNA, 19 nt, Homo sapiens
ugugugaaauggaaaguug

SEQ ID NO: 769117 - RNA, 19 nt, Homo sapiens
caugaaucagguacaauua

SEQ ID NO: 769118 - RNA, 19 nt, Homo sapiens
uaaaacaggugccaugaau

SEQ ID NO: 769119 - RNA, 19 nt, Homo sapiens
gagcgagggcaugaaauuu

SEQ ID NO: 769120 - RNA, 19 nt, Homo sapiens
aaaggugacuucgucuaaa

SEQ ID NO: 769121 - RNA, 19 nt, Homo sapiens
cauaugaacaagcucagua

SEQ ID NO: 769122 - RNA, 19 nt, Homo sapiens
gcaccuauagucccagcua

SEQ ID NO: 769123 - RNA, 19 nt, Homo sapiens
gcucagaagggcagaguug

SEQ ID NO: 769124 - RNA, 19 nt, Homo sapiens
ugaaaguauuugcugauuc

SEQ ID NO: 769125 - RNA, 19 nt, Homo sapiens
ccagugccauucuguguuc

SEQ ID NO: 769126 - RNA, 19 nt, Homo sapiens
gaaaagaguagguucauuc

SEQ ID NO: 769127 - RNA, 19 nt, Homo sapiens
gaauaaccuuugauuacac

SEQ ID NO: 769128 - RNA, 19 nt, Homo sapiens
ucuauagauuugccaguuu

SEQ ID NO: 769129 - RNA, 19 nt, Homo sapiens
gagccagcguguacuuugu

SEQ ID NO: 769130 - RNA, 19 nt, Homo sapiens
ccaugaaucagguacaauu

SEQ ID NO: 769131 - RNA, 19 nt, Homo sapiens
ccacugcuaauuaaucauu

SEQ ID NO: 769132 - RNA, 19 nt, Homo sapiens
caaacuccaucagaucuuc

SEQ ID NO: 769133 - RNA, 19 nt, Homo sapiens
cagcguguacuuuguguuu

SEQ ID NO: 769134 - RNA, 19 nt, Homo sapiens
gcagaaagaucccagaaua

SEQ ID NO: 769135 - RNA, 19 nt, Homo sapiens
gaaccacauugucucuuua

SEQ ID NO: 769136 - RNA, 19 nt, Homo sapiens
ggaagggagugcuguguuu

SEQ ID NO: 769137 - RNA, 19 nt, Homo sapiens
guggauggauuaagaauaa

SEQ ID NO: 769138 - RNA, 19 nt, Homo sapiens
agaagaaucugaaggcuuu

SEQ ID NO: 769139 - RNA, 19 nt, Homo sapiens
aauaaagccugucuuguuu

SEQ ID NO: 769140 - RNA, 19 nt, Homo sapiens
gaagggaaauggaagaaag

SEQ ID NO: 769141 - RNA, 19 nt, Homo sapiens
acacgacacuuguuacuuu

SEQ ID NO: 769142 - RNA, 19 nt, Homo sapiens
gcgcaaagcugagccagaa

SEQ ID NO: 769143 - RNA, 19 nt, Homo sapiens
gaugguggauggauuaaga

SEQ ID NO: 769144 - RNA, 19 nt, Homo sapiens
gaagcacuuugaucucuuu

SEQ ID NO: 769145 - RNA, 19 nt, Homo sapiens
gaagggagaagaacuaaug

SEQ ID NO: 769146 - RNA, 19 nt, Homo sapiens
ugaacaagcucaguauaaa

SEQ ID NO: 769147 - RNA, 19 nt, Homo sapiens
gcgagggcaugaaauuuaa

SEQ ID NO: 769148 - RNA, 19 nt, Homo sapiens
ggagaugguggauggauua

SEQ ID NO: 769149 - RNA, 19 nt, Homo sapiens
gcuauacuuuguuguguaa

SEQ ID NO: 769150 - RNA, 19 nt, Homo sapiens
caaaguagucucaaaguau

SEQ ID NO: 769151 - RNA, 19 nt, Homo sapiens
acaaaguagucucaaagua

SEQ ID NO: 769152 - RNA, 19 nt, Homo sapiens
gcuaugcauuugcuucuaa

SEQ ID NO: 769153 - RNA, 19 nt, Homo sapiens
gaacagaagcugggauaga

SEQ ID NO: 769154 - RNA, 19 nt, Homo sapiens
ggaauagguuaggccauuu

SEQ ID NO: 769155 - RNA, 19 nt, Homo sapiens
cacauugucucuuuauuug

SEQ ID NO: 769156 - RNA, 19 nt, Homo sapiens
ccacauugucucuuuauuu

SEQ ID NO: 769157 - RNA, 19 nt, Homo sapiens
uaaagccugucuuguuuga

SEQ ID NO: 769158 - RNA, 19 nt, Homo sapiens
aaauaaagccugucuuguu

SEQ ID NO: 769159 - RNA, 19 nt, Homo sapiens
agacugaagugaaagaaga

SEQ ID NO: 769160 - RNA, 19 nt, Homo sapiens
gcuguacgaugccaagauu

SEQ ID NO: 769161 - RNA, 19 nt, Homo sapiens
ggaaauggaagaaagaaca

SEQ ID NO: 769162 - RNA, 19 nt, Homo sapiens
ggagaagaacuaaugaaau

SEQ ID NO: 769163 - RNA, 19 nt, Homo sapiens
gggagaagaacuaaugaaa

SEQ ID NO: 769164 - RNA, 19 nt, Homo sapiens
gcauugccuuucuuauuug

SEQ ID NO: 769165 - RNA, 19 nt, Homo sapiens
ggaugauuguuacuacauu

SEQ ID NO: 769166 - RNA, 19 nt, Homo sapiens
aauccuaugugaagcauuu

SEQ ID NO: 769167 - RNA, 19 nt, Homo sapiens
agcauugccuuucuuauuu

SEQ ID NO: 769168 - RNA, 19 nt, Homo sapiens
ccagaaauccuuggaaaga

SEQ ID NO: 769169 - RNA, 19 nt, Homo sapiens
gggagaaagugcugugcuu

SEQ ID NO: 769170 - RNA, 19 nt, Homo sapiens
ggauuaagaauaaccuuug

SEQ ID NO: 769171 - RNA, 19 nt, Homo sapiens
ggaggaugauuguuacuac

SEQ ID NO: 769172 - RNA, 19 nt, Homo sapiens
uuacagcuauacuuuguug

SEQ ID NO: 769173 - RNA, 19 nt, Homo sapiens
uagagggaaucgauauuga

SEQ ID NO: 769174 - RNA, 19 nt, Homo sapiens
agaaccacauugucucuuu

SEQ ID NO: 769175 - RNA, 19 nt, Homo sapiens
gcaguuauucuguuaggaa

SEQ ID NO: 769176 - RNA, 19 nt, Homo sapiens
ccuccacccucuuacauuu

SEQ ID NO: 769177 - RNA, 19 nt, Homo sapiens
gcacaggaagaaagaagaa

SEQ ID NO: 769178 - RNA, 19 nt, Homo sapiens
cagcguaaauuggcaagaa

SEQ ID NO: 769179 - RNA, 19 nt, Homo sapiens
gcacauuacagcaccaaga

SEQ ID NO: 769180 - RNA, 19 nt, Homo sapiens
cuaaauaaagccugucuug

SEQ ID NO: 769181 - RNA, 19 nt, Homo sapiens
ccaagauuguuguaguuau

SEQ ID NO: 769182 - RNA, 19 nt, Homo sapiens
gcaguuaguuagcaagaac

SEQ ID NO: 769183 - RNA, 19 nt, Homo sapiens
gaagacaccugugcauagc

SEQ ID NO: 769184 - RNA, 19 nt, Homo sapiens
gguguggacucugucuuaa

SEQ ID NO: 769185 - RNA, 19 nt, Homo sapiens
agaaauccuuggaaagaug

SEQ ID NO: 769186 - RNA, 19 nt, Homo sapiens
agaaaagacugaagugaaa

SEQ ID NO: 769187 - RNA, 19 nt, Homo sapiens
aagccugucuuguuugaaa

SEQ ID NO: 769188 - RNA, 19 nt, Homo sapiens
uggaauagguuaggccauu

SEQ ID NO: 769189 - RNA, 19 nt, Homo sapiens
gguuccaggugaauaacua

SEQ ID NO: 769190 - RNA, 19 nt, Homo sapiens
ucugaaggcuuuauugaag

SEQ ID NO: 769191 - RNA, 19 nt, Homo sapiens
aaaggugacuucgucuaaa

SEQ ID NO: 769192 - RNA, 19 nt, Homo sapiens
cauaugaacaagcucagua

SEQ ID NO: 769193 - RNA, 19 nt, Homo sapiens
gagcgagggcaugaaauuu

SEQ ID NO: 769194 - RNA, 19 nt, Homo sapiens
gaauaaccuuugauuacac

SEQ ID NO: 769195 - RNA, 19 nt, Homo sapiens
aagcauugccuuucuuauu

SEQ ID NO: 769196 - RNA, 19 nt, Homo sapiens
ccaggugaauaacuaacaa

SEQ ID NO: 769197 - RNA, 19 nt, Homo sapiens
uguuugaguugcccacaua

SEQ ID NO: 769198 - RNA, 19 nt, Homo sapiens
acaagguggugggucuuua

SEQ ID NO: 769199 - RNA, 19 nt, Homo sapiens
cagaauaccacgaugacuu

SEQ ID NO: 769200 - RNA, 19 nt, Homo sapiens
gaaucugaaggcuuuauug

SEQ ID NO: 769201 - RNA, 19 nt, Homo sapiens
gaggaugauuguuacuaca

SEQ ID NO: 769202 - RNA, 19 nt, Homo sapiens
ggauagaugggcagcagaa

SEQ ID NO: 769203 - RNA, 19 nt, Homo sapiens
cagaaauccuuggaaagau

SEQ ID NO: 769204 - RNA, 19 nt, Homo sapiens
cagaaagaucccagaauau

SEQ ID NO: 769205 - RNA, 19 nt, Homo sapiens
gaacaagcucaguauaaaa

SEQ ID NO: 769206 - RNA, 19 nt, Homo sapiens
gccaagauuguuguaguua

SEQ ID NO: 769207 - RNA, 19 nt, Homo sapiens
gagggaaucgauauugaug

SEQ ID NO: 769208 - RNA, 19 nt, Homo sapiens
ucaguagacauugcaguua

SEQ ID NO: 769209 - RNA, 19 nt, Homo sapiens
gaugacuucuucccagagu

SEQ ID NO: 769210 - RNA, 19 nt, Homo sapiens
uugcugcgauuguuuguga

SEQ ID NO: 769211 - RNA, 19 nt, Homo sapiens
caacauuugcugcgauugu

SEQ ID NO: 769212 - RNA, 19 nt, Homo sapiens
ggugacuucgucuaaauuu

SEQ ID NO: 769213 - RNA, 19 nt, Homo sapiens
ccacaaaguagucucaaag

SEQ ID NO: 769214 - RNA, 19 nt, Homo sapiens
caguagacauugcaguuag

SEQ ID NO: 769215 - RNA, 19 nt, Homo sapiens
guuaggccauuucaguaga

SEQ ID NO: 769216 - RNA, 19 nt, Homo sapiens
gaaacuuccagaaauccuu

SEQ ID NO: 769217 - RNA, 19 nt, Homo sapiens
cgagcgagggcaugaaauu

SEQ ID NO: 769218 - RNA, 19 nt, Homo sapiens
caagaagggaaauggaaga

SEQ ID NO: 769219 - RNA, 19 nt, Homo sapiens
uuuaaugguuggaacagaa

SEQ ID NO: 769220 - RNA, 19 nt, Homo sapiens
cacaacauuugcugcgauu

SEQ ID NO: 769221 - RNA, 19 nt, Homo sapiens
aacagaagcugggauagau

SEQ ID NO: 769222 - RNA, 19 nt, Homo sapiens
aagcaacuauguucacagu

SEQ ID NO: 769223 - RNA, 19 nt, Homo sapiens
ugugaaacuuccagaaauc

SEQ ID NO: 769224 - RNA, 19 nt, Homo sapiens
gaagggagugcuguguuug

SEQ ID NO: 769225 - RNA, 19 nt, Homo sapiens
gguggauggauuaagaaua

SEQ ID NO: 769226 - RNA, 19 nt, Homo sapiens
cauuauaucccagcagaaa

SEQ ID NO: 769227 - RNA, 19 nt, Homo sapiens
ugagaggccucgucaccau

SEQ ID NO: 769228 - RNA, 19 nt, Homo sapiens
gcuggaggaugauuguuac

SEQ ID NO: 769229 - RNA, 19 nt, Homo sapiens
agaaagaucccagaauauc

SEQ ID NO: 769230 - RNA, 19 nt, Homo sapiens
acucggaaaccacaaagua

SEQ ID NO: 769231 - RNA, 19 nt, Homo sapiens
gaaauccuuggaaagaugu

SEQ ID NO: 769232 - RNA, 19 nt, Homo sapiens
ccaguccgccuuuguugaa

SEQ ID NO: 769233 - RNA, 19 nt, Homo sapiens
ccucgucaccaucacguua

SEQ ID NO: 769234 - RNA, 19 nt, Homo sapiens
gaaccacauugucucuuua

SEQ ID NO: 769235 - RNA, 19 nt, Homo sapiens
ggaagggagugcuguguuu

SEQ ID NO: 769236 - RNA, 19 nt, Homo sapiens
guggauggauuaagaauaa

SEQ ID NO: 769237 - RNA, 19 nt, Homo sapiens
agaagaaucugaaggcuuu

SEQ ID NO: 769238 - RNA, 19 nt, Homo sapiens
aauaaagccugucuuguuu

SEQ ID NO: 769239 - RNA, 19 nt, Homo sapiens
gaagggaaauggaagaaag

SEQ ID NO: 769240 - RNA, 19 nt, Homo sapiens
acacgacacuuguuacuuu

SEQ ID NO: 769241 - RNA, 19 nt, Homo sapiens
gcgcaaagcugagccagaa

SEQ ID NO: 769242 - RNA, 19 nt, Homo sapiens
gaugguggauggauuaaga

SEQ ID NO: 769243 - RNA, 19 nt, Homo sapiens
gaagcacuuugaucucuuu

SEQ ID NO: 769244 - RNA, 19 nt, Homo sapiens
gaagggagaagaacuaaug

SEQ ID NO: 769245 - RNA, 19 nt, Homo sapiens
ugaacaagcucaguauaaa

SEQ ID NO: 769246 - RNA, 19 nt, Homo sapiens
gcgagggcaugaaauuuaa

SEQ ID NO: 769247 - RNA, 19 nt, Homo sapiens
ggagaugguggauggauua

SEQ ID NO: 769248 - RNA, 19 nt, Homo sapiens
gcuauacuuuguuguguaa

SEQ ID NO: 769249 - RNA, 19 nt, Homo sapiens
caaaguagucucaaaguau

SEQ ID NO: 769250 - RNA, 19 nt, Homo sapiens
acaaaguagucucaaagua

SEQ ID NO: 769251 - RNA, 19 nt, Homo sapiens
gcuaugcauuugcuucuaa

SEQ ID NO: 769252 - RNA, 19 nt, Homo sapiens
ggaauagguuaggccauuu

SEQ ID NO: 769253 - RNA, 19 nt, Homo sapiens
cacauugucucuuuauuug

SEQ ID NO: 769254 - RNA, 19 nt, Homo sapiens
ccacauugucucuuuauuu

SEQ ID NO: 769255 - RNA, 19 nt, Homo sapiens
uaaagccugucuuguuuga

SEQ ID NO: 769256 - RNA, 19 nt, Homo sapiens
aaauaaagccugucuuguu

SEQ ID NO: 769257 - RNA, 19 nt, Homo sapiens
agacugaagugaaagaaga

SEQ ID NO: 769258 - RNA, 19 nt, Homo sapiens
ggaaauggaagaaagaaca

SEQ ID NO: 769259 - RNA, 19 nt, Homo sapiens
ggagaagaacuaaugaaau

SEQ ID NO: 769260 - RNA, 19 nt, Homo sapiens
gggagaagaacuaaugaaa

SEQ ID NO: 769261 - RNA, 19 nt, Homo sapiens
gcauugccuuucuuauuug

SEQ ID NO: 769262 - RNA, 19 nt, Homo sapiens
ggaugauuguuacuacauu

SEQ ID NO: 769263 - RNA, 19 nt, Homo sapiens
aauccuaugugaagcauuu

SEQ ID NO: 769264 - RNA, 19 nt, Homo sapiens
agcauugccuuucuuauuu

SEQ ID NO: 769265 - RNA, 19 nt, Homo sapiens
ccagaaauccuuggaaaga

SEQ ID NO: 769266 - RNA, 19 nt, Homo sapiens
gggagaaagugcugugcuu

SEQ ID NO: 769267 - RNA, 19 nt, Homo sapiens
ggauuaagaauaaccuuug

SEQ ID NO: 769268 - RNA, 19 nt, Homo sapiens
ggaggaugauuguuacuac

SEQ ID NO: 769269 - RNA, 19 nt, Homo sapiens
uuacagcuauacuuuguug

SEQ ID NO: 769270 - RNA, 19 nt, Homo sapiens
uagagggaaucgauauuga

SEQ ID NO: 769271 - RNA, 19 nt, Homo sapiens
agaaccacauugucucuuu

SEQ ID NO: 769272 - RNA, 19 nt, Homo sapiens
gcaguuauucuguuaggaa

SEQ ID NO: 769273 - RNA, 19 nt, Homo sapiens
ccuccacccucuuacauuu

SEQ ID NO: 769274 - RNA, 19 nt, Homo sapiens
gcacaggaagaaagaagaa

SEQ ID NO: 769275 - RNA, 19 nt, Homo sapiens
cagcguaaauuggcaagaa

SEQ ID NO: 769276 - RNA, 19 nt, Homo sapiens
gcacauuacagcaccaaga

SEQ ID NO: 769277 - RNA, 19 nt, Homo sapiens
cuaaauaaagccugucuug

SEQ ID NO: 769278 - RNA, 19 nt, Homo sapiens
gcaguuaguuagcaagaac

SEQ ID NO: 769279 - RNA, 19 nt, Homo sapiens
gaagacaccugugcauagc

SEQ ID NO: 769280 - RNA, 19 nt, Homo sapiens
gguguggacucugucuuaa

SEQ ID NO: 769281 - RNA, 19 nt, Homo sapiens
agaaauccuuggaaagaug

SEQ ID NO: 769282 - RNA, 19 nt, Homo sapiens
agaaaagacugaagugaaa

SEQ ID NO: 769283 - RNA, 19 nt, Homo sapiens
aagccugucuuguuugaaa

SEQ ID NO: 769284 - RNA, 19 nt, Homo sapiens
uggaauagguuaggccauu

SEQ ID NO: 769285 - RNA, 19 nt, Homo sapiens
gguuccaggugaauaacua

SEQ ID NO: 769286 - RNA, 19 nt, Homo sapiens
ucugaaggcuuuauugaag

SEQ ID NO: 769287 - RNA, 19 nt, Homo sapiens
gagcgagggcaugaaauuu

SEQ ID NO: 769288 - RNA, 19 nt, Homo sapiens
aaaggugacuucgucuaaa

SEQ ID NO: 769289 - RNA, 19 nt, Homo sapiens
cauaugaacaagcucagua

SEQ ID NO: 769290 - RNA, 19 nt, Homo sapiens
gaauaaccuuugauuacac

SEQ ID NO: 769291 - RNA, 19 nt, Homo sapiens
aagcauugccuuucuuauu

SEQ ID NO: 769292 - RNA, 19 nt, Homo sapiens
ccaggugaauaacuaacaa

SEQ ID NO: 769293 - RNA, 19 nt, Homo sapiens
uguuugaguugcccacaua

SEQ ID NO: 769294 - RNA, 19 nt, Homo sapiens
acaagguggugggucuuua

SEQ ID NO: 769295 - RNA, 19 nt, Homo sapiens
cagaauaccacgaugacuu

SEQ ID NO: 769296 - RNA, 19 nt, Homo sapiens
gaaucugaaggcuuuauug

SEQ ID NO: 769297 - RNA, 19 nt, Homo sapiens
gaggaugauuguuacuaca

SEQ ID NO: 769298 - RNA, 19 nt, Homo sapiens
ggauagaugggcagcagaa

SEQ ID NO: 769299 - RNA, 19 nt, Homo sapiens
cagaaauccuuggaaagau

SEQ ID NO: 769300 - RNA, 19 nt, Homo sapiens
gaacaagcucaguauaaaa

SEQ ID NO: 769301 - RNA, 19 nt, Homo sapiens
gagggaaucgauauugaug

SEQ ID NO: 769302 - RNA, 19 nt, Homo sapiens
ucaguagacauugcaguua

SEQ ID NO: 769303 - RNA, 19 nt, Homo sapiens
gaugacuucuucccagagu

SEQ ID NO: 769304 - RNA, 19 nt, Homo sapiens
uugcugcgauuguuuguga

SEQ ID NO: 769305 - RNA, 19 nt, Homo sapiens
caacauuugcugcgauugu

SEQ ID NO: 769306 - RNA, 19 nt, Homo sapiens
ggugacuucgucuaaauuu

SEQ ID NO: 769307 - RNA, 19 nt, Homo sapiens
ccacaaaguagucucaaag

SEQ ID NO: 769308 - RNA, 19 nt, Homo sapiens
caguagacauugcaguuag

SEQ ID NO: 769309 - RNA, 19 nt, Homo sapiens
guuaggccauuucaguaga

SEQ ID NO: 769310 - RNA, 19 nt, Homo sapiens
gaaacuuccagaaauccuu

SEQ ID NO: 769311 - RNA, 19 nt, Homo sapiens
cgagcgagggcaugaaauu

SEQ ID NO: 769312 - RNA, 19 nt, Homo sapiens
caagaagggaaauggaaga

SEQ ID NO: 769313 - RNA, 19 nt, Homo sapiens
cacaacauuugcugcgauu

SEQ ID NO: 769314 - RNA, 19 nt, Homo sapiens
aagcaacuauguucacagu

SEQ ID NO: 769315 - RNA, 19 nt, Homo sapiens
ugugaaacuuccagaaauc

SEQ ID NO: 769316 - RNA, 19 nt, Homo sapiens
gaagggagugcuguguuug

SEQ ID NO: 769317 - RNA, 19 nt, Homo sapiens
gguggauggauuaagaaua

SEQ ID NO: 769318 - RNA, 19 nt, Homo sapiens
cauuauaucccagcagaaa

SEQ ID NO: 769319 - RNA, 19 nt, Homo sapiens
ugagaggccucgucaccau

SEQ ID NO: 769320 - RNA, 19 nt, Homo sapiens
gcuggaggaugauuguuac

SEQ ID NO: 769321 - RNA, 19 nt, Homo sapiens
acucggaaaccacaaagua

SEQ ID NO: 769322 - RNA, 19 nt, Homo sapiens
gaaauccuuggaaagaugu

SEQ ID NO: 769323 - RNA, 19 nt, Homo sapiens
ccaguccgccuuuguugaa

SEQ ID NO: 769324 - RNA, 19 nt, Homo sapiens
ccucgucaccaucacguua

SEQ ID NO: 769325 - RNA, 19 nt, Homo sapiens
ccaaggcgcgagugcugua

SEQ ID NO: 769326 - RNA, 19 nt, Homo sapiens
cagcuauacuuuguugugu

SEQ ID NO: 769327 - RNA, 19 nt, Homo sapiens
gaauagguuaggccauuuc

SEQ ID NO: 769328 - RNA, 19 nt, Homo sapiens
uacugcaguuauucuguua

SEQ ID NO: 769329 - RNA, 19 nt, Homo sapiens
auacugcaguuauucuguu

SEQ ID NO: 769330 - RNA, 19 nt, Homo sapiens
aaauguuguugguucugua

SEQ ID NO: 769331 - RNA, 19 nt, Homo sapiens
auaccacgaugacuucuuc

SEQ ID NO: 769332 - RNA, 19 nt, Homo sapiens
uguguuugcuggcuuugaa

SEQ ID NO: 769333 - RNA, 19 nt, Homo sapiens
aagcugagccagaagcauu

SEQ ID NO: 769334 - RNA, 19 nt, Homo sapiens
gcacagaccuuuguauuau

SEQ ID NO: 769335 - RNA, 19 nt, Homo sapiens
ccaaaggucuaaauaaaga

SEQ ID NO: 769336 - RNA, 19 nt, Homo sapiens
agaagaaucugcugaagaa

SEQ ID NO: 769337 - RNA, 19 nt, Homo sapiens
gaacuggagucucaauauc

SEQ ID NO: 769338 - RNA, 19 nt, Homo sapiens
uauaggagaucacaaauca

SEQ ID NO: 769339 - RNA, 19 nt, Homo sapiens
gacaguaaauuaucaggaa

SEQ ID NO: 769340 - RNA, 19 nt, Homo sapiens
uaguagagcuguucauuau

SEQ ID NO: 769341 - RNA, 19 nt, Homo sapiens
uaaauccagugguucauaa

SEQ ID NO: 769342 - RNA, 19 nt, Homo sapiens
gaaagaagaaucugcugaa

SEQ ID NO: 769343 - RNA, 19 nt, Homo sapiens
gaacauacuggucgucuug

SEQ ID NO: 769344 - RNA, 19 nt, Homo sapiens
gaagauaucggcgacauug

SEQ ID NO: 769345 - RNA, 19 nt, Homo sapiens
gggcaugacuauaaccauu

SEQ ID NO: 769346 - RNA, 19 nt, Homo sapiens
uggauuguaucguauguua

SEQ ID NO: 769347 - RNA, 19 nt, Homo sapiens
ucccaaaggucuaaauaaa

SEQ ID NO: 769348 - RNA, 19 nt, Homo sapiens
gagcacagaccuuuguauu

SEQ ID NO: 769349 - RNA, 19 nt, Homo sapiens
guagagcuguucauuaugg

SEQ ID NO: 769350 - RNA, 19 nt, Homo sapiens
caacuuccuuucauauuag

SEQ ID NO: 769351 - RNA, 19 nt, Homo sapiens
ccagucacaaucuaaauua

SEQ ID NO: 769352 - RNA, 19 nt, Homo sapiens
guacucaacuuccuuucau

SEQ ID NO: 769353 - RNA, 19 nt, Homo sapiens
guaaagaguaagaguugua

SEQ ID NO: 769354 - RNA, 19 nt, Homo sapiens
gcaaaagauuggguacuua

SEQ ID NO: 769355 - RNA, 19 nt, Homo sapiens
gcgagaggguucggcauuu

SEQ ID NO: 769356 - RNA, 19 nt, Homo sapiens
acgcuuagucuuuguauua

SEQ ID NO: 769357 - RNA, 19 nt, Homo sapiens
cagcagacuuggguaauga

SEQ ID NO: 769358 - RNA, 19 nt, Homo sapiens
gaucacaaaucaacaucuc

SEQ ID NO: 769359 - RNA, 19 nt, Homo sapiens
caucaucaacccucuaauu

SEQ ID NO: 769360 - RNA, 19 nt, Homo sapiens
guggaggacugcuuauaga

SEQ ID NO: 769361 - RNA, 19 nt, Homo sapiens
caaaucaacaucucacuuc

SEQ ID NO: 769362 - RNA, 19 nt, Homo sapiens
gcagcagacuuggguaaug

SEQ ID NO: 769363 - RNA, 19 nt, Homo sapiens
cacagaccuuuguauuaua

SEQ ID NO: 769364 - RNA, 19 nt, Homo sapiens
ggaaagaaagaacauacug

SEQ ID NO: 769365 - RNA, 19 nt, Homo sapiens
gagcuguucauuauggaua

SEQ ID NO: 769366 - RNA, 19 nt, Homo sapiens
aaagagcaguuucccacaa

SEQ ID NO: 769367 - RNA, 19 nt, Homo sapiens
aguaauaugugaccaaagu

SEQ ID NO: 769368 - RNA, 19 nt, Homo sapiens
gaugaugauucaccugauc

SEQ ID NO: 769369 - RNA, 19 nt, Homo sapiens
caaaguauggacaguaaau

SEQ ID NO: 769370 - RNA, 19 nt, Homo sapiens
gauuguaucguauguuaga

SEQ ID NO: 769371 - RNA, 19 nt, Homo sapiens
augaagaacuggagucuca

SEQ ID NO: 769372 - RNA, 19 nt, Homo sapiens
caaagcaacaugagagcaa

SEQ ID NO: 769373 - RNA, 19 nt, Homo sapiens
gauuguaagcugcugguuu

SEQ ID NO: 769374 - RNA, 19 nt, Homo sapiens
ugaugacgaugaugauuca

SEQ ID NO: 769375 - RNA, 19 nt, Homo sapiens
cauacuggucgucuuguua

SEQ ID NO: 769376 - RNA, 19 nt, Homo sapiens
gcaggaaagaaagaacaua

SEQ ID NO: 769377 - RNA, 19 nt, Homo sapiens
aagagcaguuucccacaaa

SEQ ID NO: 769378 - RNA, 19 nt, Homo sapiens
ggaccaaagcaacaugaga

SEQ ID NO: 769379 - RNA, 19 nt, Homo sapiens
uuucaaaugccauggguua

SEQ ID NO: 769380 - RNA, 19 nt, Homo sapiens
agcaaaguauggacaguaa

SEQ ID NO: 769381 - RNA, 19 nt, Homo sapiens
gaagaacuggagucucaau

SEQ ID NO: 769382 - RNA, 19 nt, Homo sapiens
ugauguggcuggagaugau

SEQ ID NO: 769383 - RNA, 19 nt, Homo sapiens
ugagcacccugaugaagug

SEQ ID NO: 769384 - RNA, 19 nt, Homo sapiens
ggagaucacaaaucaacau

SEQ ID NO: 769385 - RNA, 19 nt, Homo sapiens
uaacugucauacauuugga

SEQ ID NO: 769386 - RNA, 19 nt, Homo sapiens
auaguagagcuguucauua

SEQ ID NO: 769387 - RNA, 19 nt, Homo sapiens
ggaagaagacaagaaaauu

SEQ ID NO: 769388 - RNA, 19 nt, Homo sapiens
caucaacccucuaauucac

SEQ ID NO: 769389 - RNA, 19 nt, Homo sapiens
ggaagauaucggcgacauu

SEQ ID NO: 769390 - RNA, 19 nt, Homo sapiens
gcaaaguauggacaguaaa

SEQ ID NO: 769391 - RNA, 19 nt, Homo sapiens
aaagauuggguacuuaguu

SEQ ID NO: 769392 - RNA, 19 nt, Homo sapiens
ucccaaacgcuuagucuuu

SEQ ID NO: 769393 - RNA, 19 nt, Homo sapiens
cagcaaaguauggacagua

SEQ ID NO: 769394 - RNA, 19 nt, Homo sapiens
ucacacuuguuaagaugga

SEQ ID NO: 769395 - RNA, 19 nt, Homo sapiens
ggcaugacuauaaccauuu

SEQ ID NO: 769396 - RNA, 19 nt, Homo sapiens
cauaacucccaaacgcuua

SEQ ID NO: 769397 - RNA, 19 nt, Homo sapiens
gaagagagaaaacaaaagu

SEQ ID NO: 769398 - RNA, 19 nt, Homo sapiens
agacuuggguaaugaagag

SEQ ID NO: 769399 - RNA, 19 nt, Homo sapiens
guacuuuucacacuuguua

SEQ ID NO: 769400 - RNA, 19 nt, Homo sapiens
gccagucacaaucuaaauu

SEQ ID NO: 769401 - RNA, 19 nt, Homo sapiens
gcaugacuauaaccauuuu

SEQ ID NO: 769402 - RNA, 19 nt, Homo sapiens
agcacagaccuuuguauua

SEQ ID NO: 769403 - RNA, 19 nt, Homo sapiens
aaagaagaaucugcugaag

SEQ ID NO: 769404 - RNA, 19 nt, Homo sapiens
gaugaugacgaugaugauu

SEQ ID NO: 769405 - RNA, 19 nt, Homo sapiens
ggcuggagaugaugaugau

SEQ ID NO: 769406 - RNA, 19 nt, Homo sapiens
uauaguagagcuguucauu

SEQ ID NO: 769407 - RNA, 19 nt, Homo sapiens
ugaaguggaggaucccaaa

SEQ ID NO: 769408 - RNA, 19 nt, Homo sapiens
gucccaaaggucuaaauaa

SEQ ID NO: 769409 - RNA, 19 nt, Homo sapiens
uuaaauccagugguucaua

SEQ ID NO: 769410 - RNA, 19 nt, Homo sapiens
uuuguuaaauccagugguu

SEQ ID NO: 769411 - RNA, 19 nt, Homo sapiens
agaaucugcugaagaacuc

SEQ ID NO: 769412 - RNA, 19 nt, Homo sapiens
aagaagaaucugcugaaga

SEQ ID NO: 769413 - RNA, 19 nt, Homo sapiens
cgauucagagucagagaaa

SEQ ID NO: 769414 - RNA, 19 nt, Homo sapiens
cucaauaucagcaaaguau

SEQ ID NO: 769415 - RNA, 19 nt, Homo sapiens
gagucucaauaucagcaaa

SEQ ID NO: 769416 - RNA, 19 nt, Homo sapiens
agaacuggagucucaauau

SEQ ID NO: 769417 - RNA, 19 nt, Homo sapiens
ggaugagugcugccagaga

SEQ ID NO: 769418 - RNA, 19 nt, Homo sapiens
uugauacugugauauguuc

SEQ ID NO: 769419 - RNA, 19 nt, Homo sapiens
gccauggguuacacuuuua

SEQ ID NO: 769420 - RNA, 19 nt, Homo sapiens
uuauagagcacagaccuuu

SEQ ID NO: 769421 - RNA, 19 nt, Homo sapiens
cgcuuagucuuuguauuaa

SEQ ID NO: 769422 - RNA, 19 nt, Homo sapiens
cuaaauaaagagcaguuuc

SEQ ID NO: 769423 - RNA, 19 nt, Homo sapiens
uuucacacuuguuaagaug

SEQ ID NO: 769424 - RNA, 19 nt, Homo sapiens
ggcaaaagauuggguacuu

SEQ ID NO: 769425 - RNA, 19 nt, Homo sapiens
gauauguucacgaaaagua

SEQ ID NO: 769426 - RNA, 19 nt, Homo sapiens
uacucaacuuccuuucaua

SEQ ID NO: 769427 - RNA, 19 nt, Homo sapiens
caauaucagcaaaguaugg

SEQ ID NO: 769428 - RNA, 19 nt, Homo sapiens
uguuauaggagaucacaaa

SEQ ID NO: 769429 - RNA, 19 nt, Homo sapiens
ucaucaacccucuaauuca

SEQ ID NO: 769430 - RNA, 19 nt, Homo sapiens
guaauaugugaccaaaguu

SEQ ID NO: 769431 - RNA, 19 nt, Homo sapiens
ggcgagaggguucggcauu

SEQ ID NO: 769432 - RNA, 19 nt, Homo sapiens
gcuguucauuauggauauu

SEQ ID NO: 769433 - RNA, 19 nt, Homo sapiens
caaaugccauggguuacac

SEQ ID NO: 769434 - RNA, 19 nt, Homo sapiens
guucaaagcuacuuacgau

SEQ ID NO: 769435 - RNA, 19 nt, Homo sapiens
ccaacuacaucucacucua

SEQ ID NO: 769436 - RNA, 19 nt, Homo sapiens
gguguucacugcccgauau

SEQ ID NO: 769437 - RNA, 19 nt, Homo sapiens
ggacuugggcuguuuguag

SEQ ID NO: 769438 - RNA, 19 nt, Homo sapiens
ggcagaagaugaagagcuu

SEQ ID NO: 769439 - RNA, 19 nt, Homo sapiens
gggaagaaguugaguuugc

SEQ ID NO: 769440 - RNA, 19 nt, Homo sapiens
ggaaggcggcagaagauga

SEQ ID NO: 769441 - RNA, 19 nt, Homo sapiens
guaugaagguggucuacau

SEQ ID NO: 769442 - RNA, 19 nt, Homo sapiens
gaaggcggcagaagaugaa

SEQ ID NO: 769443 - RNA, 19 nt, Homo sapiens
cuacugcgauuucuucuac

SEQ ID NO: 769444 - RNA, 19 nt, Homo sapiens
ggaucuggcgcuaccauuu

SEQ ID NO: 769445 - RNA, 19 nt, Homo sapiens
gcucaggacuugggcuguu

SEQ ID NO: 769446 - RNA, 19 nt, Homo sapiens
gaggaaggcggcagaagau

SEQ ID NO: 769447 - RNA, 19 nt, Homo sapiens
gauuucuucuaccucuaua

SEQ ID NO: 769448 - RNA, 19 nt, Homo sapiens
gagauccucuggaccuucu

SEQ ID NO: 769449 - RNA, 19 nt, Homo sapiens
gaucuggcgcuaccauuuc

SEQ ID NO: 769450 - RNA, 19 nt, Homo sapiens
caccagccacuacuuguuu

SEQ ID NO: 769451 - RNA, 19 nt, Homo sapiens
ggagucaguggccaucuug

SEQ ID NO: 769452 - RNA, 19 nt, Homo sapiens
ucuuuccacucuuuaguuu

SEQ ID NO: 769453 - RNA, 19 nt, Homo sapiens
gacuugggcuguuuguagu

SEQ ID NO: 769454 - RNA, 19 nt, Homo sapiens
ccaucuaccuggagucagu

SEQ ID NO: 769455 - RNA, 19 nt, Homo sapiens
cuaccucuauaucaccaaa

SEQ ID NO: 769456 - RNA, 19 nt, Homo sapiens
gcgauuucuucuaccucua

SEQ ID NO: 769457 - RNA, 19 nt, Homo sapiens
uggcguuccuggucaauca

SEQ ID NO: 769458 - RNA, 19 nt, Homo sapiens
uacauagccugcuccuuca

SEQ ID NO: 769459 - RNA, 19 nt, Homo sapiens
cccgauaucuggaccucuu

SEQ ID NO: 769460 - RNA, 19 nt, Homo sapiens
ugauucugaugacucguuu

SEQ ID NO: 769461 - RNA, 19 nt, Homo sapiens
ccacggucugguugauuua

SEQ ID NO: 769462 - RNA, 19 nt, Homo sapiens
agaggaaggcggcagaaga

SEQ ID NO: 769463 - RNA, 19 nt, Homo sapiens
caucaccagccacuacuug

SEQ ID NO: 769464 - RNA, 19 nt, Homo sapiens
cagcccagcuacccguuca

SEQ ID NO: 769465 - RNA, 19 nt, Homo sapiens
guugauuuauagcaaguuc

SEQ ID NO: 769466 - RNA, 19 nt, Homo sapiens
caacuacaucucacucuac

SEQ ID NO: 769467 - RNA, 19 nt, Homo sapiens
cuauaucaccaaaguccua

SEQ ID NO: 769468 - RNA, 19 nt, Homo sapiens
uguuugcgcuaggcguuua

SEQ ID NO: 769469 - RNA, 19 nt, Homo sapiens
acggucugguugauuuaua

SEQ ID NO: 769470 - RNA, 19 nt, Homo sapiens
gaccaucaccagccacuac

SEQ ID NO: 769471 - RNA, 19 nt, Homo sapiens
ucugguugauuuauagcaa

SEQ ID NO: 769472 - RNA, 19 nt, Homo sapiens
cagaagaugaagagcuuuc

SEQ ID NO: 769473 - RNA, 19 nt, Homo sapiens
gcagaggaaggcggcagaa

SEQ ID NO: 769474 - RNA, 19 nt, Homo sapiens
ugaagguggucuacauagc

SEQ ID NO: 769475 - RNA, 19 nt, Homo sapiens
cuacaucucacucuacaac

SEQ ID NO: 769476 - RNA, 19 nt, Homo sapiens
cuugggcuguuuguaguuu

SEQ ID NO: 769477 - RNA, 19 nt, Homo sapiens
gcagaagaugaagagcuuu

SEQ ID NO: 769478 - RNA, 19 nt, Homo sapiens
ucaccagccacuacuuguu

SEQ ID NO: 769479 - RNA, 19 nt, Homo sapiens
ccuguuugcugugguguuc

SEQ ID NO: 769480 - RNA, 19 nt, Homo sapiens
ccuccucgccaucaucuug

SEQ ID NO: 769481 - RNA, 19 nt, Homo sapiens
uggagucaguggccaucuu

SEQ ID NO: 769482 - RNA, 19 nt, Homo sapiens
gccggaauuucagggaaga

SEQ ID NO: 769483 - RNA, 19 nt, Homo sapiens
gcacugaucugccuuauaa

SEQ ID NO: 769484 - RNA, 19 nt, Homo sapiens
ggaagaauaugaagacuca

SEQ ID NO: 769485 - RNA, 19 nt, Homo sapiens
gaagagaacgagaucauuu

SEQ ID NO: 769486 - RNA, 19 nt, Homo sapiens
ggaagaaugcagaguauaa

SEQ ID NO: 769487 - RNA, 19 nt, Homo sapiens
ccaaugaguuugcugaauu

SEQ ID NO: 769488 - RNA, 19 nt, Homo sapiens
ggaauguugugaauaagaa

SEQ ID NO: 769489 - RNA, 19 nt, Homo sapiens
ccagaucuaugaauaugua

SEQ ID NO: 769490 - RNA, 19 nt, Homo sapiens
gaacuaggaccgacaguga

SEQ ID NO: 769491 - RNA, 19 nt, Homo sapiens
ucacauaccuguccaucuu

SEQ ID NO: 769492 - RNA, 19 nt, Homo sapiens
cugagaagcuggauuauau

SEQ ID NO: 769493 - RNA, 19 nt, Homo sapiens
gagccaggguugcuacuaa

SEQ ID NO: 769494 - RNA, 19 nt, Homo sapiens
uugaguaccuucaggauua

SEQ ID NO: 769495 - RNA, 19 nt, Homo sapiens
gaacuaaggcaaccaggaa

SEQ ID NO: 769496 - RNA, 19 nt, Homo sapiens
aaucugaccugaccucuuu

SEQ ID NO: 769497 - RNA, 19 nt, Homo sapiens
gugggaauguugugaauaa

SEQ ID NO: 769498 - RNA, 19 nt, Homo sapiens
ggagggauauggucguuau

SEQ ID NO: 769499 - RNA, 19 nt, Homo sapiens
cuaaagagaugcucaccaa

SEQ ID NO: 769500 - RNA, 19 nt, Homo sapiens
gaaagucccuggagucacu

SEQ ID NO: 769501 - RNA, 19 nt, Homo sapiens
auugaaaucugcucucuua

SEQ ID NO: 769502 - RNA, 19 nt, Homo sapiens
gagaagaaaugggagaaug

SEQ ID NO: 769503 - RNA, 19 nt, Homo sapiens
gaagcuggauuauaucaca

SEQ ID NO: 769504 - RNA, 19 nt, Homo sapiens
gcaggaggguugcuugaga

SEQ ID NO: 769505 - RNA, 19 nt, Homo sapiens
gacaaggacugcucuagug

SEQ ID NO: 769506 - RNA, 19 nt, Homo sapiens
guccaucuuugaccaauua

SEQ ID NO: 769507 - RNA, 19 nt, Homo sapiens
uauaagagauaccuagaga

SEQ ID NO: 769508 - RNA, 19 nt, Homo sapiens
caucugagaagcuggauua

SEQ ID NO: 769509 - RNA, 19 nt, Homo sapiens
caaauguggugucugaaau

SEQ ID NO: 769510 - RNA, 19 nt, Homo sapiens
acuaguagcugagauuuaa

SEQ ID NO: 769511 - RNA, 19 nt, Homo sapiens
gagaagagcgagaagaaga

SEQ ID NO: 769512 - RNA, 19 nt, Homo sapiens
gcaaaccuauucccuacug

SEQ ID NO: 769513 - RNA, 19 nt, Homo sapiens
gcccagagacuauucagua

SEQ ID NO: 769514 - RNA, 19 nt, Homo sapiens
ucaaguacauuaaccugaa

SEQ ID NO: 769515 - RNA, 19 nt, Homo sapiens
agaacgagaucauuuacaa

SEQ ID NO: 769516 - RNA, 19 nt, Homo sapiens
gaaaggaacaaagacauug

SEQ ID NO: 769517 - RNA, 19 nt, Homo sapiens
gaaaucugcucucuuagcu

SEQ ID NO: 769518 - RNA, 19 nt, Homo sapiens
uagagaugcugcuugagua

SEQ ID NO: 769519 - RNA, 19 nt, Homo sapiens
ugaguuugcugaauucuau

SEQ ID NO: 769520 - RNA, 19 nt, Homo sapiens
ggaaagacuaggaggauga

SEQ ID NO: 769521 - RNA, 19 nt, Homo sapiens
caaugucaguggaauuuga

SEQ ID NO: 769522 - RNA, 19 nt, Homo sapiens
gcuagaagauccuuugaac

SEQ ID NO: 769523 - RNA, 19 nt, Homo sapiens
aaccagaccuuguucuaaa

SEQ ID NO: 769524 - RNA, 19 nt, Homo sapiens
ccaaccaaauccucuuaaa

SEQ ID NO: 769525 - RNA, 19 nt, Homo sapiens
caacuacaacugugagauu

SEQ ID NO: 769526 - RNA, 19 nt, Homo sapiens
cgacaucucacucaugaaa

SEQ ID NO: 769527 - RNA, 19 nt, Homo sapiens
aaucugcucucuuagcuuu

SEQ ID NO: 769528 - RNA, 19 nt, Homo sapiens
gaaaggaggagcucaaugc

SEQ ID NO: 769529 - RNA, 19 nt, Homo sapiens
cagcuuaguuagccauuga

SEQ ID NO: 769530 - RNA, 19 nt, Homo sapiens
gauggcagccugacacuga

SEQ ID NO: 769531 - RNA, 19 nt, Homo sapiens
gcaccaagcgagacacuga

SEQ ID NO: 769532 - RNA, 19 nt, Homo sapiens
cgucauggcuaaagagaug

SEQ ID NO: 769533 - RNA, 19 nt, Homo sapiens
ugagggauuuguaugauga

SEQ ID NO: 769534 - RNA, 19 nt, Homo sapiens
gaggguugcuugagacuag

SEQ ID NO: 769535 - RNA, 19 nt, Homo sapiens
gagaagaagaggaagaaga

SEQ ID NO: 769536 - RNA, 19 nt, Homo sapiens
aagcccagaucuaugaaua

SEQ ID NO: 769537 - RNA, 19 nt, Homo sapiens
aagaagagcagaucaguga

SEQ ID NO: 769538 - RNA, 19 nt, Homo sapiens
cuugauaccucuuuguuug

SEQ ID NO: 769539 - RNA, 19 nt, Homo sapiens
uaagagauaccuagagaug

SEQ ID NO: 769540 - RNA, 19 nt, Homo sapiens
uaagcacagucaucugaaa

SEQ ID NO: 769541 - RNA, 19 nt, Homo sapiens
ucuacaagaucccuauuug

SEQ ID NO: 769542 - RNA, 19 nt, Homo sapiens
gccuaaauaucaacuacaa

SEQ ID NO: 769543 - RNA, 19 nt, Homo sapiens
gaagagcagaucagugaga

SEQ ID NO: 769544 - RNA, 19 nt, Homo sapiens
gagugaagccucuccaaga

SEQ ID NO: 769545 - RNA, 19 nt, Homo sapiens
ggauuuguaugaugauaag

SEQ ID NO: 769546 - RNA, 19 nt, Homo sapiens
guucuaaagcccaggguua

SEQ ID NO: 769547 - RNA, 19 nt, Homo sapiens
cccaaauacugcucacuuu

SEQ ID NO: 769548 - RNA, 19 nt, Homo sapiens
gcuuuaggcuugaaaugug

SEQ ID NO: 769549 - RNA, 19 nt, Homo sapiens
aaaggaagaaugcagagua

SEQ ID NO: 769550 - RNA, 19 nt, Homo sapiens
aagagaugcucaccaagaa

SEQ ID NO: 769551 - RNA, 19 nt, Homo sapiens
ccugaaggcucgagagaau

SEQ ID NO: 769552 - RNA, 19 nt, Homo sapiens
gugggaaccugagggauuu

SEQ ID NO: 769553 - RNA, 19 nt, Homo sapiens
acucagaccuucaacuguu

SEQ ID NO: 769554 - RNA, 19 nt, Homo sapiens
gcccagaucuaugaauaug

SEQ ID NO: 769555 - RNA, 19 nt, Homo sapiens
gaaugcagaguauaagaga

SEQ ID NO: 769556 - RNA, 19 nt, Homo sapiens
ucacagaugaggagggaua

SEQ ID NO: 769557 - RNA, 19 nt, Homo sapiens
cugcuucccugaaugagua

SEQ ID NO: 769558 - RNA, 19 nt, Homo sapiens
gggccaaacugaaauugca

SEQ ID NO: 769559 - RNA, 19 nt, Homo sapiens
ugaagccucuccaagauca

SEQ ID NO: 769560 - RNA, 19 nt, Homo sapiens
caaugaguuugcugaauuc

SEQ ID NO: 769561 - RNA, 19 nt, Homo sapiens
gagugaagaugaagagaac

SEQ ID NO: 769562 - RNA, 19 nt, Homo sapiens
gaaccugagggauuuguau

SEQ ID NO: 769563 - RNA, 19 nt, Homo sapiens
ugauaaggauggauuacga

SEQ ID NO: 769564 - RNA, 19 nt, Homo sapiens
gaaauggaaagaacuaagg

SEQ ID NO: 769565 - RNA, 19 nt, Homo sapiens
ccaaauguggugucugaaa

SEQ ID NO: 769566 - RNA, 19 nt, Homo sapiens
gaguugggcuguguuggaa

SEQ ID NO: 769567 - RNA, 19 nt, Homo sapiens
cuucauggccuaaauauca

SEQ ID NO: 769568 - RNA, 19 nt, Homo sapiens
aagagaacgagaucauuua

SEQ ID NO: 769569 - RNA, 19 nt, Homo sapiens
gaagauggagacaauacug

SEQ ID NO: 769570 - RNA, 19 nt, Homo sapiens
gcacagucaucugaaaguc

SEQ ID NO: 769571 - RNA, 19 nt, Homo sapiens
gagugagagugaagaugaa

SEQ ID NO: 769572 - RNA, 19 nt, Homo sapiens
aaagagaugcucaccaaga

SEQ ID NO: 769573 - RNA, 19 nt, Homo sapiens
uauguagucucauggucua

SEQ ID NO: 769574 - RNA, 19 nt, Homo sapiens
agacauugcuuuucuagaa

SEQ ID NO: 769575 - RNA, 19 nt, Homo sapiens
gggaggaguuggcuucucu

SEQ ID NO: 769576 - RNA, 19 nt, Homo sapiens
aggcugaguuugagaagaa

SEQ ID NO: 769577 - RNA, 19 nt, Homo sapiens
uauaagcacagucaucuga

SEQ ID NO: 769578 - RNA, 19 nt, Homo sapiens
acacugaggaagaauauga

SEQ ID NO: 769579 - RNA, 19 nt, Homo sapiens
gcacccaaaugagaucugu

SEQ ID NO: 769580 - RNA, 19 nt, Homo sapiens
ucaccaacuuuacuaguag

SEQ ID NO: 769581 - RNA, 19 nt, Homo sapiens
ugaaaggaacaaagacauu

SEQ ID NO: 769582 - RNA, 19 nt, Homo sapiens
gcacucgggccaugcaaga

SEQ ID NO: 769583 - RNA, 19 nt, Homo sapiens
gaaauggacuggagacuuu

SEQ ID NO: 769584 - RNA, 19 nt, Homo sapiens
ggaauagucuugcacauuu

SEQ ID NO: 769585 - RNA, 19 nt, Homo sapiens
ggaaguaccuaagaagaua

SEQ ID NO: 769586 - RNA, 19 nt, Homo sapiens
uaagaaacauggcaacuaa

SEQ ID NO: 769587 - RNA, 19 nt, Homo sapiens
uuaaggaucugcucuauga

SEQ ID NO: 769588 - RNA, 19 nt, Homo sapiens
aaaucaggcuccacaauua

SEQ ID NO: 769589 - RNA, 19 nt, Homo sapiens
gaucaaagacaauguaguu

SEQ ID NO: 769590 - RNA, 19 nt, Homo sapiens
aaagaaagaugggaagaaa

SEQ ID NO: 769591 - RNA, 19 nt, Homo sapiens
gaacuggacagaacugaaa

SEQ ID NO: 769592 - RNA, 19 nt, Homo sapiens
gaccaaagcugggaaguuc

SEQ ID NO: 769593 - RNA, 19 nt, Homo sapiens
guuuauagcuuaaggaaug

SEQ ID NO: 769594 - RNA, 19 nt, Homo sapiens
gcucauaucuccauuuguc

SEQ ID NO: 769595 - RNA, 19 nt, Homo sapiens
acaauuaaccugcaguuua

SEQ ID NO: 769596 - RNA, 19 nt, Homo sapiens
gagcucauaucuccauuug

SEQ ID NO: 769597 - RNA, 19 nt, Homo sapiens
gaugaaaaccccacaauua

SEQ ID NO: 769598 - RNA, 19 nt, Homo sapiens
guaggaagauggacugugu

SEQ ID NO: 769599 - RNA, 19 nt, Homo sapiens
guaagagaguuucagagaa

SEQ ID NO: 769600 - RNA, 19 nt, Homo sapiens
caagggaaguaccuaagaa

SEQ ID NO: 769601 - RNA, 19 nt, Homo sapiens
ugaaucgucuggauaugua

SEQ ID NO: 769602 - RNA, 19 nt, Homo sapiens
uagcuucucuguuuaaguu

SEQ ID NO: 769603 - RNA, 19 nt, Homo sapiens
cagagaagccgaucccaua

SEQ ID NO: 769604 - RNA, 19 nt, Homo sapiens
gaacucauccuguuucaag

SEQ ID NO: 769605 - RNA, 19 nt, Homo sapiens
ggacacauuucaggauuau

SEQ ID NO: 769606 - RNA, 19 nt, Homo sapiens
agagaaagcuuaccaucga

SEQ ID NO: 769607 - RNA, 19 nt, Homo sapiens
uaagagaguuucagagaag

SEQ ID NO: 769608 - RNA, 19 nt, Homo sapiens
gaugguaucggacuaguuu

SEQ ID NO: 769609 - RNA, 19 nt, Homo sapiens
ggaggagacacuuaaauga

SEQ ID NO: 769610 - RNA, 19 nt, Homo sapiens
caacaccaguucucaagga

SEQ ID NO: 769611 - RNA, 19 nt, Homo sapiens
guacuccuaucauguauuc

SEQ ID NO: 769612 - RNA, 19 nt, Homo sapiens
cuaggucacugaacaacua

SEQ ID NO: 769613 - RNA, 19 nt, Homo sapiens
gaagauggacuguguugau

SEQ ID NO: 769614 - RNA, 19 nt, Homo sapiens
cuaagaagauauagagugu

SEQ ID NO: 769615 - RNA, 19 nt, Homo sapiens
gaaagaaagaugggaagaa

SEQ ID NO: 769616 - RNA, 19 nt, Homo sapiens
gaaugugggugaccagcuu

SEQ ID NO: 769617 - RNA, 19 nt, Homo sapiens
gcagaguuguguugcuuug

SEQ ID NO: 769618 - RNA, 19 nt, Homo sapiens
uaaaucaggcuccacaauu

SEQ ID NO: 769619 - RNA, 19 nt, Homo sapiens
gaagagaugcuugacaaug

SEQ ID NO: 769620 - RNA, 19 nt, Homo sapiens
gaggagacacuuaaaugaa

SEQ ID NO: 769621 - RNA, 19 nt, Homo sapiens
ggacaguaguucccuugga

SEQ ID NO: 769622 - RNA, 19 nt, Homo sapiens
ggugaaauauaccaacaau

SEQ ID NO: 769623 - RNA, 19 nt, Homo sapiens
cuacaggauucuaagguuu

SEQ ID NO: 769624 - RNA, 19 nt, Homo sapiens
ucuccuaaaucucugaaua

SEQ ID NO: 769625 - RNA, 19 nt, Homo sapiens
gugugucuguuacuauuua

SEQ ID NO: 769626 - RNA, 19 nt, Homo sapiens
gacaaaacauuucuccuaa

SEQ ID NO: 769627 - RNA, 19 nt, Homo sapiens
gaaaaugugccuccgguua

SEQ ID NO: 769628 - RNA, 19 nt, Homo sapiens
aaauuugaguccacuauug

SEQ ID NO: 769629 - RNA, 19 nt, Homo sapiens
gaacugaaacacagcaaca

SEQ ID NO: 769630 - RNA, 19 nt, Homo sapiens
gaaccugaagggagcauuu

SEQ ID NO: 769631 - RNA, 19 nt, Homo sapiens
uggaagagaugcuugacaa

SEQ ID NO: 769632 - RNA, 19 nt, Homo sapiens
uuuaacaugugcagaagua

SEQ ID NO: 769633 - RNA, 19 nt, Homo sapiens
aaacaguucuacucacuuc

SEQ ID NO: 769634 - RNA, 19 nt, Homo sapiens
aaugaaagauuggcaagaa

SEQ ID NO: 769635 - RNA, 19 nt, Homo sapiens
ggucagccguucuguuugu

SEQ ID NO: 769636 - RNA, 19 nt, Homo sapiens
cauggcaacuaaagggaua

SEQ ID NO: 769637 - RNA, 19 nt, Homo sapiens
aaucagugcuguaggaaga

SEQ ID NO: 769638 - RNA, 19 nt, Homo sapiens
cacaaaagcuaccaaguuu

SEQ ID NO: 769639 - RNA, 19 nt, Homo sapiens
caauguaguugugguuuau

SEQ ID NO: 769640 - RNA, 19 nt, Homo sapiens
ugaggaaccuacaggauuc

SEQ ID NO: 769641 - RNA, 19 nt, Homo sapiens
aggagacacuuaaaugaaa

SEQ ID NO: 769642 - RNA, 19 nt, Homo sapiens
ggaaaggccacuuaaggau

SEQ ID NO: 769643 - RNA, 19 nt, Homo sapiens
gaacuaaucaagggaggaa

SEQ ID NO: 769644 - RNA, 19 nt, Homo sapiens
gcuucucuguuuaaguuua

SEQ ID NO: 769645 - RNA, 19 nt, Homo sapiens
gccuguggauucucaagua

SEQ ID NO: 769646 - RNA, 19 nt, Homo sapiens
caugguggcugccuaaagu

SEQ ID NO: 769647 - RNA, 19 nt, Homo sapiens
uaggaaagaccaacauuug

SEQ ID NO: 769648 - RNA, 19 nt, Homo sapiens
cuuggacgcuuugaaauaa

SEQ ID NO: 769649 - RNA, 19 nt, Homo sapiens
gguguaagcaacccaguuu

SEQ ID NO: 769650 - RNA, 19 nt, Homo sapiens
gaugcugucuugggaugua

SEQ ID NO: 769651 - RNA, 19 nt, Homo sapiens
ccaacaaugaggccuauuu

SEQ ID NO: 769652 - RNA, 19 nt, Homo sapiens
uaaucuuggucccugaaua

SEQ ID NO: 769653 - RNA, 19 nt, Homo sapiens
uaucauuuccucagucuuu

SEQ ID NO: 769654 - RNA, 19 nt, Homo sapiens
uaaagccaaugaaagacuu

SEQ ID NO: 769655 - RNA, 19 nt, Homo sapiens
gaagauauagaguguuucu

SEQ ID NO: 769656 - RNA, 19 nt, Homo sapiens
ggccgacucuucccaugaa

SEQ ID NO: 769657 - RNA, 19 nt, Homo sapiens
ggaaauggacuggagacuu

SEQ ID NO: 769658 - RNA, 19 nt, Homo sapiens
ggagacacuuaaaugaaag

SEQ ID NO: 769659 - RNA, 19 nt, Homo sapiens
gccguucuguuugugauua

SEQ ID NO: 769660 - RNA, 19 nt, Homo sapiens
gaacucauaaagccuccua

SEQ ID NO: 769661 - RNA, 19 nt, Homo sapiens
gcacuuggucucuuaucuu

SEQ ID NO: 769662 - RNA, 19 nt, Homo sapiens
gggaauagucuugcacauu

SEQ ID NO: 769663 - RNA, 19 nt, Homo sapiens
ccucaccacuaucucuuaa

SEQ ID NO: 769664 - RNA, 19 nt, Homo sapiens
gguguaagcauagaugaaa

SEQ ID NO: 769665 - RNA, 19 nt, Homo sapiens
caaggugaaucgucuggau

SEQ ID NO: 769666 - RNA, 19 nt, Homo sapiens
ggacuggggugaaauauac

SEQ ID NO: 769667 - RNA, 19 nt, Homo sapiens
cugaauauuucuagguuug

SEQ ID NO: 769668 - RNA, 19 nt, Homo sapiens
guggucagccguucuguuu

SEQ ID NO: 769669 - RNA, 19 nt, Homo sapiens
gguaccagaucguaaccuu

SEQ ID NO: 769670 - RNA, 19 nt, Homo sapiens
guggacacauuucaggauu

SEQ ID NO: 769671 - RNA, 19 nt, Homo sapiens
cagugugucuguuacuauu

SEQ ID NO: 769672 - RNA, 19 nt, Homo sapiens
uaagcaacccaguuuaaga

SEQ ID NO: 769673 - RNA, 19 nt, Homo sapiens
aaacacagcaacaccaguu

SEQ ID NO: 769674 - RNA, 19 nt, Homo sapiens
guucagagccagugaucaa

SEQ ID NO: 769675 - RNA, 19 nt, Homo sapiens
guuaggaggagacacuuaa

SEQ ID NO: 769676 - RNA, 19 nt, Homo sapiens
guccugaacaugagccuua

SEQ ID NO: 769677 - RNA, 19 nt, Homo sapiens
ugccagaccuuacacuuuc

SEQ ID NO: 769678 - RNA, 19 nt, Homo sapiens
cagagccagugaucaaaga

SEQ ID NO: 769679 - RNA, 19 nt, Homo sapiens
gaguuguguugcuuuguga

SEQ ID NO: 769680 - RNA, 19 nt, Homo sapiens
uaaaaucagugcuguagga

SEQ ID NO: 769681 - RNA, 19 nt, Homo sapiens
ggucucuuaucuucaguga

SEQ ID NO: 769682 - RNA, 19 nt, Homo sapiens
cagcaaggccagaguugaa

SEQ ID NO: 769683 - RNA, 19 nt, Homo sapiens
gaggagcgaugguaucuug

SEQ ID NO: 769684 - RNA, 19 nt, Homo sapiens
ugaaucagaugaagaaguu

SEQ ID NO: 769685 - RNA, 19 nt, Homo sapiens
gcaagacguuuauccugaa

SEQ ID NO: 769686 - RNA, 19 nt, Homo sapiens
gaucauccaguacaacuuu

SEQ ID NO: 769687 - RNA, 19 nt, Homo sapiens
ggucuggccuguugauguu

SEQ ID NO: 769688 - RNA, 19 nt, Homo sapiens
caagggacuucgugaaugu

SEQ ID NO: 769689 - RNA, 19 nt, Homo sapiens
ggaaguuugagaagaauaa

SEQ ID NO: 769690 - RNA, 19 nt, Homo sapiens
caaugaaucagaugaagaa

SEQ ID NO: 769691 - RNA, 19 nt, Homo sapiens
ccaagggacuucgugaaug

SEQ ID NO: 769692 - RNA, 19 nt, Homo sapiens
gaagacaacacccucaucu

SEQ ID NO: 769693 - RNA, 19 nt, Homo sapiens
ccagaaagggugccaguug

SEQ ID NO: 769694 - RNA, 19 nt, Homo sapiens
gcgcagggaccgauacuug

SEQ ID NO: 769695 - RNA, 19 nt, Homo sapiens
acaacacccucaucuccua

SEQ ID NO: 769696 - RNA, 19 nt, Homo sapiens
agaaguugcugggaagaaa

SEQ ID NO: 769697 - RNA, 19 nt, Homo sapiens
ucaaggucauccucucuga

SEQ ID NO: 769698 - RNA, 19 nt, Homo sapiens
agcaggagaucauccagua

SEQ ID NO: 769699 - RNA, 19 nt, Homo sapiens
ggauggugcuguggaacaa

SEQ ID NO: 769700 - RNA, 19 nt, Homo sapiens
acacaggcauccguaagaa

SEQ ID NO: 769701 - RNA, 19 nt, Homo sapiens
ggagcugacccgagacuug

SEQ ID NO: 769702 - RNA, 19 nt, Homo sapiens
gaagaggagcgaugguauc

SEQ ID NO: 769703 - RNA, 19 nt, Homo sapiens
ucaucgaacugaauaccaa

SEQ ID NO: 769704 - RNA, 19 nt, Homo sapiens
gacaaugaaucagaugaag

SEQ ID NO: 769705 - RNA, 19 nt, Homo sapiens
acuggaaguuugagaagaa

SEQ ID NO: 769706 - RNA, 19 nt, Homo sapiens
gugcauuccucauugucaa

SEQ ID NO: 769707 - RNA, 19 nt, Homo sapiens
accuuugucuggauucuua

SEQ ID NO: 769708 - RNA, 19 nt, Homo sapiens
ggaccgauacuugucauca

SEQ ID NO: 769709 - RNA, 19 nt, Homo sapiens
gaacuuggagcaggagauc

SEQ ID NO: 769710 - RNA, 19 nt, Homo sapiens
ggacugcuccuaggcuaug

SEQ ID NO: 769711 - RNA, 19 nt, Homo sapiens
ugacaaugaaucagaugaa

SEQ ID NO: 769712 - RNA, 19 nt, Homo sapiens
ccagugcauuccucauugu

SEQ ID NO: 769713 - RNA, 19 nt, Homo sapiens
cggccaccauguuugaauu

SEQ ID NO: 769714 - RNA, 19 nt, Homo sapiens
ucuggccuguugauguuua

SEQ ID NO: 769715 - RNA, 19 nt, Homo sapiens
gugcucaagucggccagua

SEQ ID NO: 769716 - RNA, 19 nt, Homo sapiens
cugcggagcucguguacca

SEQ ID NO: 769717 - RNA, 19 nt, Homo sapiens
ggaagacaacacccucauc

SEQ ID NO: 769718 - RNA, 19 nt, Homo sapiens
ugcagggucugacaaugaa

SEQ ID NO: 769719 - RNA, 19 nt, Homo sapiens
caacacaggcauccguaag

SEQ ID NO: 769720 - RNA, 19 nt, Homo sapiens
aaacuuccuucuucgacau

SEQ ID NO: 769721 - RNA, 19 nt, Homo sapiens
cgaacugaauaccaacaca

SEQ ID NO: 769722 - RNA, 19 nt, Homo sapiens
agaggauggugcuguggaa

SEQ ID NO: 769723 - RNA, 19 nt, Homo sapiens
gaagaaguugcugggaaga

SEQ ID NO: 769724 - RNA, 19 nt, Homo sapiens
ccugcgcucucgucgguuu

SEQ ID NO: 769725 - RNA, 19 nt, Homo sapiens
gcgaagggccaucucugau

SEQ ID NO: 769726 - RNA, 19 nt, Homo sapiens
ucccugggcuccucacugu

SEQ ID NO: 769727 - RNA, 19 nt, Homo sapiens
cgagggacaguucuauuca

SEQ ID NO: 769728 - RNA, 19 nt, Homo sapiens
gccaccauguuugaauuug

SEQ ID NO: 769729 - RNA, 19 nt, Homo sapiens
caagacguuuauccugaag

SEQ ID NO: 769730 - RNA, 19 nt, Homo sapiens
ugaagaggagcgaugguau

SEQ ID NO: 769731 - RNA, 19 nt, Homo sapiens
uccagugcauuccucauug

SEQ ID NO: 769732 - RNA, 19 nt, Homo sapiens
uggaucaucgaacugaaua

SEQ ID NO: 769733 - RNA, 19 nt, Homo sapiens
ggccaccauguuugaauuu

SEQ ID NO: 769734 - RNA, 19 nt, Homo sapiens
gaucgccaccucacacagu

SEQ ID NO: 769735 - RNA, 19 nt, Homo sapiens
gcagggaccgauacuuguc

SEQ ID NO: 769736 - RNA, 19 nt, Homo sapiens
gagaucauccaguacaacu

SEQ ID NO: 769737 - RNA, 19 nt, Homo sapiens
gaagcgaagggccaucucu

SEQ ID NO: 769738 - RNA, 19 nt, Homo sapiens
gaccgauacuugucaucag

SEQ ID NO: 769739 - RNA, 19 nt, Homo sapiens
agaccugguuccuugacuu

SEQ ID NO: 769740 - RNA, 19 nt, Homo sapiens
guccagugcauuccucauu

SEQ ID NO: 769741 - RNA, 19 nt, Homo sapiens
acaaugaaucagaugaaga

SEQ ID NO: 769742 - RNA, 19 nt, Homo sapiens
ccaacacaggcauccguaa

SEQ ID NO: 769743 - RNA, 19 nt, Homo sapiens
caucuccuaugacgugucu

SEQ ID NO: 769744 - RNA, 19 nt, Homo sapiens
ccgagggacaguucuauuc

SEQ ID NO: 769745 - RNA, 19 nt, Homo sapiens
caggagaucauccaguaca

SEQ ID NO: 769746 - RNA, 19 nt, Homo sapiens
gugggcugcuggccaugaa

SEQ ID NO: 769747 - RNA, 19 nt, Homo sapiens
ccacuuccagagccagaaa

SEQ ID NO: 769748 - RNA, 19 nt, Homo sapiens
cauguuugaauuugccuuu

SEQ ID NO: 769749 - RNA, 19 nt, Homo sapiens
caccauugaaguucccuuu

SEQ ID NO: 769750 - RNA, 19 nt, Homo sapiens
uugcagggucugacaauga

SEQ ID NO: 769751 - RNA, 19 nt, Homo sapiens
ugucuggauucuuaauaca

SEQ ID NO: 769752 - RNA, 19 nt, Homo sapiens
gcaccuuugucuggauucu

SEQ ID NO: 769753 - RNA, 19 nt, Homo sapiens
cauccaguacaacuuuaaa

SEQ ID NO: 769754 - RNA, 19 nt, Homo sapiens
gagggacaguucuauucac

SEQ ID NO: 769755 - RNA, 19 nt, Homo sapiens
caacacccucaucuccuau

SEQ ID NO: 769756 - RNA, 19 nt, Homo sapiens
cguguacaccauugaaguu

SEQ ID NO: 769757 - RNA, 19 nt, Homo sapiens
ccacgcagugccuggaguu

SEQ ID NO: 769758 - RNA, 19 nt, Homo sapiens
ccaccauguuugaauuugc

SEQ ID NO: 769759 - RNA, 19 nt, Homo sapiens
uuucacggcaagacguuua

SEQ ID NO: 769760 - RNA, 19 nt, Homo sapiens
cugaagaggagcgauggua

SEQ ID NO: 769761 - RNA, 19 nt, Homo sapiens
gaccugguuccuugacuuc

SEQ ID NO: 769762 - RNA, 19 nt, Homo sapiens
ggaagcauauguacacaaa

SEQ ID NO: 769763 - RNA, 19 nt, Homo sapiens
ggagugaacuugcugauuc

SEQ ID NO: 769764 - RNA, 19 nt, Homo sapiens
uaaccuggcuacagcguuu

SEQ ID NO: 769765 - RNA, 19 nt, Homo sapiens
ugaacuugcugauucugua

SEQ ID NO: 769766 - RNA, 19 nt, Homo sapiens
ccugaaauuuggaagcaua

SEQ ID NO: 769767 - RNA, 19 nt, Homo sapiens
gagcacuucucgcaguuug

SEQ ID NO: 769768 - RNA, 19 nt, Homo sapiens
gcaguaauaguggaccuua

SEQ ID NO: 769769 - RNA, 19 nt, Homo sapiens
gcaacacuguggagcugaa

SEQ ID NO: 769770 - RNA, 19 nt, Homo sapiens
gaaauuuggaagcauaugu

SEQ ID NO: 769771 - RNA, 19 nt, Homo sapiens
aagcauauguacacaaauc

SEQ ID NO: 769772 - RNA, 19 nt, Homo sapiens
agaauucucaguuguguaa

SEQ ID NO: 769773 - RNA, 19 nt, Homo sapiens
ggauucggcuucguguauu

SEQ ID NO: 769774 - RNA, 19 nt, Homo sapiens
gaaaaggccgagauuauug

SEQ ID NO: 769775 - RNA, 19 nt, Homo sapiens
gauucggcuucguguauuu

SEQ ID NO: 769776 - RNA, 19 nt, Homo sapiens
ccuuggagauggagaauuc

SEQ ID NO: 769777 - RNA, 19 nt, Homo sapiens
ucuaugaaaucuacuugga

SEQ ID NO: 769778 - RNA, 19 nt, Homo sapiens
cagcaucaguccuccuaug

SEQ ID NO: 769779 - RNA, 19 nt, Homo sapiens
ggaaaaggccgagauuauu

SEQ ID NO: 769780 - RNA, 19 nt, Homo sapiens
gguaguuuacuuuguugua

SEQ ID NO: 769781 - RNA, 19 nt, Homo sapiens
gaucccaugccugaaauuu

SEQ ID NO: 769782 - RNA, 19 nt, Homo sapiens
gacaagcaguccggcaaga

SEQ ID NO: 769783 - RNA, 19 nt, Homo sapiens
ggagggagggagugaacuu

SEQ ID NO: 769784 - RNA, 19 nt, Homo sapiens
ucaaugugcagacgaguga

SEQ ID NO: 769785 - RNA, 19 nt, Homo sapiens
caaguggggucaacuccua

SEQ ID NO: 769786 - RNA, 19 nt, Homo sapiens
cuccucggcucgcccuuua

SEQ ID NO: 769787 - RNA, 19 nt, Homo sapiens
gagugaacuugcugauucu

SEQ ID NO: 769788 - RNA, 19 nt, Homo sapiens
cacaccgccuucccuguuu

SEQ ID NO: 769789 - RNA, 19 nt, Homo sapiens
ggguagcucuuuccaacag

SEQ ID NO: 769790 - RNA, 19 nt, Homo sapiens
gaacuugcugauucuguag

SEQ ID NO: 769791 - RNA, 19 nt, Homo sapiens
caacagcuacggugguuac

SEQ ID NO: 769792 - RNA, 19 nt, Homo sapiens
uacaacagcuacggugguu

SEQ ID NO: 769793 - RNA, 19 nt, Homo sapiens
ccaaggaggauaucuacuc

SEQ ID NO: 769794 - RNA, 19 nt, Homo sapiens
ggucaaguuccauccgauu

SEQ ID NO: 769795 - RNA, 19 nt, Homo sapiens
ucauugauggacucuauuu

SEQ ID NO: 769796 - RNA, 19 nt, Homo sapiens
gcguggaggugaagaaagc

SEQ ID NO: 769797 - RNA, 19 nt, Homo sapiens
ucccaugccugaaauuugg

SEQ ID NO: 769798 - RNA, 19 nt, Homo sapiens
gcuacagcguuuucuauga

SEQ ID NO: 769799 - RNA, 19 nt, Homo sapiens
uguaaggacuugauaaccu

SEQ ID NO: 769800 - RNA, 19 nt, Homo sapiens
cuacagcguuuucuaugaa

SEQ ID NO: 769801 - RNA, 19 nt, Homo sapiens
cuagcaaaaugucuuguuu

SEQ ID NO: 769802 - RNA, 19 nt, Homo sapiens
acacaccgccuucccuguu

SEQ ID NO: 769803 - RNA, 19 nt, Homo sapiens
gcagcuacagccagcauca

SEQ ID NO: 769804 - RNA, 19 nt, Homo sapiens
cuucguguauuuccagaau

SEQ ID NO: 769805 - RNA, 19 nt, Homo sapiens
gcuuuggcuucgugaccua

SEQ ID NO: 769806 - RNA, 19 nt, Homo sapiens
guguagaggccuuaaccaa

SEQ ID NO: 769807 - RNA, 19 nt, Homo sapiens
gggagugaacuugcugauu

SEQ ID NO: 769808 - RNA, 19 nt, Homo sapiens
gcaguuuggcaccguggaa

SEQ ID NO: 769809 - RNA, 19 nt, Homo sapiens
gaccagaacggccuuucca

SEQ ID NO: 769810 - RNA, 19 nt, Homo sapiens
ucguguauuuccagaauca

SEQ ID NO: 769811 - RNA, 19 nt, Homo sapiens
cgagauuauugccgacaag

SEQ ID NO: 769812 - RNA, 19 nt, Homo sapiens
gccagcaucaguccuccua

SEQ ID NO: 769813 - RNA, 19 nt, Homo sapiens
uggauucggcuucguguau

SEQ ID NO: 769814 - RNA, 19 nt, Homo sapiens
gcauauguacacaaaucau

SEQ ID NO: 769815 - RNA, 19 nt, Homo sapiens
uaauaguggaccuuacaga

SEQ ID NO: 769816 - RNA, 19 nt, Homo sapiens
ucacgacgcggcagacaag

SEQ ID NO: 769817 - RNA, 19 nt, Homo sapiens
caagcaguccggcaagaag

SEQ ID NO: 769818 - RNA, 19 nt, Homo sapiens
gcgguggccuugguugucu

SEQ ID NO: 769819 - RNA, 19 nt, Homo sapiens
gggagggagugaacuugcu

SEQ ID NO: 769820 - RNA, 19 nt, Homo sapiens
gagggagggagugaacuug

SEQ ID NO: 769821 - RNA, 19 nt, Homo sapiens
ggcggucgcaguaauagug

SEQ ID NO: 769822 - RNA, 19 nt, Homo sapiens
ucaaguuccauccgauuca

SEQ ID NO: 769823 - RNA, 19 nt, Homo sapiens
cuuccucucuuccuuccuu

SEQ ID NO: 769824 - RNA, 19 nt, Homo sapiens
ucaguuguguaagcuguuc

SEQ ID NO: 769825 - RNA, 19 nt, Homo sapiens
ccgagauuauugccgacaa

SEQ ID NO: 769826 - RNA, 19 nt, Homo sapiens
gaauaaaccuuacuacaca

SEQ ID NO: 769827 - RNA, 19 nt, Homo sapiens
gauuaauccucacauguua

SEQ ID NO: 769828 - RNA, 19 nt, Homo sapiens
gaaaucauguaguugcaaa

SEQ ID NO: 769829 - RNA, 19 nt, Homo sapiens
gaaauugacccuaauacuu

SEQ ID NO: 769830 - RNA, 19 nt, Homo sapiens
gagcguauguaaguuauuu

SEQ ID NO: 769831 - RNA, 19 nt, Homo sapiens
gcugagaaauugacccuaa

SEQ ID NO: 769832 - RNA, 19 nt, Homo sapiens
gaugagaucuccaggaaag

SEQ ID NO: 769833 - RNA, 19 nt, Homo sapiens
ggccaaaccaucaaacuua

SEQ ID NO: 769834 - RNA, 19 nt, Homo sapiens
gaagaaacaaguaaggaaa

SEQ ID NO: 769835 - RNA, 19 nt, Homo sapiens
ucacaaggcuaguucgaaa

SEQ ID NO: 769836 - RNA, 19 nt, Homo sapiens
guaaggaaauggaagugaa

SEQ ID NO: 769837 - RNA, 19 nt, Homo sapiens
gaaaacagcugcaucuugu

SEQ ID NO: 769838 - RNA, 19 nt, Homo sapiens
gagguuugcugagaaauug

SEQ ID NO: 769839 - RNA, 19 nt, Homo sapiens
gcaccucacuaacuucguu

SEQ ID NO: 769840 - RNA, 19 nt, Homo sapiens
gaaaggacaggccuacaga

SEQ ID NO: 769841 - RNA, 19 nt, Homo sapiens
gaaguuagaugggccaaac

SEQ ID NO: 769842 - RNA, 19 nt, Homo sapiens
uaaaccauaucgcccaauu

SEQ ID NO: 769843 - RNA, 19 nt, Homo sapiens
ggaauggccaucagaauca

SEQ ID NO: 769844 - RNA, 19 nt, Homo sapiens
uaccagauuucagaacuua

SEQ ID NO: 769845 - RNA, 19 nt, Homo sapiens
gccaaaccaucaaacuuau

SEQ ID NO: 769846 - RNA, 19 nt, Homo sapiens
agaauugugugaaaucaug

SEQ ID NO: 769847 - RNA, 19 nt, Homo sapiens
ccagauuucagaacuuaua

SEQ ID NO: 769848 - RNA, 19 nt, Homo sapiens
gaccugggcuugccaaagg

SEQ ID NO: 769849 - RNA, 19 nt, Homo sapiens
ugaaauugcugccguuguc

SEQ ID NO: 769850 - RNA, 19 nt, Homo sapiens
ugagagguuugcugagaaa

SEQ ID NO: 769851 - RNA, 19 nt, Homo sapiens
gagaucuccaggaaaguua

SEQ ID NO: 769852 - RNA, 19 nt, Homo sapiens
ugugugaaaucauguaguu

SEQ ID NO: 769853 - RNA, 19 nt, Homo sapiens
gaggugugcugucgguaug

SEQ ID NO: 769854 - RNA, 19 nt, Homo sapiens
guugagagguuugcugaga

SEQ ID NO: 769855 - RNA, 19 nt, Homo sapiens
uagcaccuuugagaauuua

SEQ ID NO: 769856 - RNA, 19 nt, Homo sapiens
guaccagauuucagaacuu

SEQ ID NO: 769857 - RNA, 19 nt, Homo sapiens
gauuuguucuagcaccuuu

SEQ ID NO: 769858 - RNA, 19 nt, Homo sapiens
aggaugagaucuccaggaa

SEQ ID NO: 769859 - RNA, 19 nt, Homo sapiens
ugagaaauugacccuaaua

SEQ ID NO: 769860 - RNA, 19 nt, Homo sapiens
gguagaauaaaccuuacua

SEQ ID NO: 769861 - RNA, 19 nt, Homo sapiens
gagaguugauccugauguc

SEQ ID NO: 769862 - RNA, 19 nt, Homo sapiens
aaauugacccuaauacuuc

SEQ ID NO: 769863 - RNA, 19 nt, Homo sapiens
cuagcaccuuugagaauuu

SEQ ID NO: 769864 - RNA, 19 nt, Homo sapiens
cuguagaaguggacgauuu

SEQ ID NO: 769865 - RNA, 19 nt, Homo sapiens
gggaauggccaucagaauc

SEQ ID NO: 769866 - RNA, 19 nt, Homo sapiens
agaaacaaguaaggaaaug

SEQ ID NO: 769867 - RNA, 19 nt, Homo sapiens
ugaagaaacaaguaaggaa

SEQ ID NO: 769868 - RNA, 19 nt, Homo sapiens
ucacuauccuccuccuguu

SEQ ID NO: 769869 - RNA, 19 nt, Homo sapiens
cagaugaagaaacaaguaa

SEQ ID NO: 769870 - RNA, 19 nt, Homo sapiens
ucuagcaccuuugagaauu

SEQ ID NO: 769871 - RNA, 19 nt, Homo sapiens
uaaggaaauggaagugaaa

SEQ ID NO: 769872 - RNA, 19 nt, Homo sapiens
aaacagcugcaucuuguau

SEQ ID NO: 769873 - RNA, 19 nt, Homo sapiens
ucagaugaagaaacaagua

SEQ ID NO: 769874 - RNA, 19 nt, Homo sapiens
aagaugagaacaaggauga

SEQ ID NO: 769875 - RNA, 19 nt, Homo sapiens
agaaguggacgauuuguuc

SEQ ID NO: 769876 - RNA, 19 nt, Homo sapiens
caaguccuguguaccagau

SEQ ID NO: 769877 - RNA, 19 nt, Homo sapiens
ucgaaaacaugauaaguug

SEQ ID NO: 769878 - RNA, 19 nt, Homo sapiens
gggccaaaccaucaaacuu

SEQ ID NO: 769879 - RNA, 19 nt, Homo sapiens
gagggaauggccaucagaa

SEQ ID NO: 769880 - RNA, 19 nt, Homo sapiens
aaacaaguaaggaaaugga

SEQ ID NO: 769881 - RNA, 19 nt, Homo sapiens
gauccucuucuucagauga

SEQ ID NO: 769882 - RNA, 19 nt, Homo sapiens
gaugagaacaaggaugaga

SEQ ID NO: 769883 - RNA, 19 nt, Homo sapiens
aagaggcaguugagagguu

SEQ ID NO: 769884 - RNA, 19 nt, Homo sapiens
caaguaaggaaauggaagu

SEQ ID NO: 769885 - RNA, 19 nt, Homo sapiens
uuaccagggcccuugauaa

SEQ ID NO: 769886 - RNA, 19 nt, Homo sapiens
auaaagaugagaacaagga

SEQ ID NO: 769887 - RNA, 19 nt, Homo sapiens
agagaauugugugaaauca

SEQ ID NO: 769888 - RNA, 19 nt, Homo sapiens
gagaaauugacccuaauac

SEQ ID NO: 769889 - RNA, 19 nt, Homo sapiens
acagcugcaucuuguauag

SEQ ID NO: 769890 - RNA, 19 nt, Homo sapiens
ccaaaccaucaaacuuauu

SEQ ID NO: 769891 - RNA, 19 nt, Homo sapiens
agaauaaaccuuacuacac

SEQ ID NO: 769892 - RNA, 19 nt, Homo sapiens
gaaacaaguaaggaaaugg

SEQ ID NO: 769893 - RNA, 19 nt, Homo sapiens
ccaaaggagcucacucucu

SEQ ID NO: 769894 - RNA, 19 nt, Homo sapiens
gugaaaucauguaguugca

SEQ ID NO: 769895 - RNA, 19 nt, Homo sapiens
gaaguggacgauuuguucu

SEQ ID NO: 769896 - RNA, 19 nt, Homo sapiens
gaugaagaaacaaguaagg

SEQ ID NO: 769897 - RNA, 19 nt, Homo sapiens
guugccagcuuugaaaaua

SEQ ID NO: 769898 - RNA, 19 nt, Homo sapiens
gaauguaucgagggaaugg

SEQ ID NO: 769899 - RNA, 19 nt, Homo sapiens
guuaccagggcccuugaua

SEQ ID NO: 769900 - RNA, 19 nt, Homo sapiens
agaggcaguugagagguuu

SEQ ID NO: 769901 - RNA, 19 nt, Homo sapiens
cagauguauucgugucaau

SEQ ID NO: 769902 - RNA, 19 nt, Homo sapiens
gacccuaauacuucaagaa

SEQ ID NO: 769903 - RNA, 19 nt, Homo sapiens
gguaccuccuccuggaaug

SEQ ID NO: 769904 - RNA, 19 nt, Homo sapiens
aggaauguaucgagggaau

SEQ ID NO: 769905 - RNA, 19 nt, Homo sapiens
ugagaucuccaggaaaguu

SEQ ID NO: 769906 - RNA, 19 nt, Homo sapiens
ggaugagaucuccaggaaa

SEQ ID NO: 769907 - RNA, 19 nt, Homo sapiens
uuauggagcguauguaagu

SEQ ID NO: 769908 - RNA, 19 nt, Homo sapiens
cuccuggaaugcauuguga

SEQ ID NO: 769909 - RNA, 19 nt, Homo sapiens
gcugcaucuuguauaguga

SEQ ID NO: 769910 - RNA, 19 nt, Homo sapiens
ugucguuguuuaagagaau

SEQ ID NO: 769911 - RNA, 19 nt, Homo sapiens
uauugugcaucaacucugu

SEQ ID NO: 769912 - RNA, 19 nt, Homo sapiens
uugagagguuugcugagaa

SEQ ID NO: 769913 - RNA, 19 nt, Homo sapiens
cgaaaggacaggccuacag

SEQ ID NO: 769914 - RNA, 19 nt, Homo sapiens
uaccagggcccuugauaag

SEQ ID NO: 769915 - RNA, 19 nt, Homo sapiens
uggagcguauguaaguuau

SEQ ID NO: 769916 - RNA, 19 nt, Homo sapiens
uguagaaguggacgauuug

SEQ ID NO: 769917 - RNA, 19 nt, Homo sapiens
cugagaaauugacccuaau

SEQ ID NO: 769918 - RNA, 19 nt, Homo sapiens
gaaacccaguucggugacu

SEQ ID NO: 769919 - RNA, 19 nt, Homo sapiens
auucauuguugccagcuuu

SEQ ID NO: 769920 - RNA, 19 nt, Homo sapiens
ugauuguguuggugucaug

SEQ ID NO: 769921 - RNA, 19 nt, Homo sapiens
agagguuugcugagaaauu

SEQ ID NO: 769922 - RNA, 19 nt, Homo sapiens
guccugaaagccugugaaa

SEQ ID NO: 769923 - RNA, 19 nt, Homo sapiens
acccuaauacuucaagaaa

SEQ ID NO: 769924 - RNA, 19 nt, Homo sapiens
acagauguauucgugucaa

SEQ ID NO: 769925 - RNA, 19 nt, Homo sapiens
cauucaggauccucuucuu

SEQ ID NO: 769926 - RNA, 19 nt, Homo sapiens
ggacuaagccuguucauaa

SEQ ID NO: 769927 - RNA, 19 nt, Homo sapiens
gaacagacaacuaaugauu

SEQ ID NO: 769928 - RNA, 19 nt, Homo sapiens
ggacaaaacuugcagaauu

SEQ ID NO: 769929 - RNA, 19 nt, Homo sapiens
gaacuaacgcuccugagua

SEQ ID NO: 769930 - RNA, 19 nt, Homo sapiens
gcgcaaagcugauucugau

SEQ ID NO: 769931 - RNA, 19 nt, Homo sapiens
gaaaagaacagacaacuaa

SEQ ID NO: 769932 - RNA, 19 nt, Homo sapiens
gagaagauguccuuugaag

SEQ ID NO: 769933 - RNA, 19 nt, Homo sapiens
ggaagggauucucagauga

SEQ ID NO: 769934 - RNA, 19 nt, Homo sapiens
ggaguaacgucgagugaau

SEQ ID NO: 769935 - RNA, 19 nt, Homo sapiens
ggcuauuacugguguauua

SEQ ID NO: 769936 - RNA, 19 nt, Homo sapiens
ggaaggaguucuacuuguc

SEQ ID NO: 769937 - RNA, 19 nt, Homo sapiens
guuucaagcuguauaguuu

SEQ ID NO: 769938 - RNA, 19 nt, Homo sapiens
gaauugauccaagaguuua

SEQ ID NO: 769939 - RNA, 19 nt, Homo sapiens
guucauaaguuaccaaagu

SEQ ID NO: 769940 - RNA, 19 nt, Homo sapiens
caaagaagaagaaagaaga

SEQ ID NO: 769941 - RNA, 19 nt, Homo sapiens
gaagauguccuuugaagag

SEQ ID NO: 769942 - RNA, 19 nt, Homo sapiens
ccauagagguggcuugaga

SEQ ID NO: 769943 - RNA, 19 nt, Homo sapiens
gaagaaagaagagucagaa

SEQ ID NO: 769944 - RNA, 19 nt, Homo sapiens
gaggagagcaaaccaaaga

SEQ ID NO: 769945 - RNA, 19 nt, Homo sapiens
caagcagcgucacccuuua

SEQ ID NO: 769946 - RNA, 19 nt, Homo sapiens
ggagaagauuaaacuuuca

SEQ ID NO: 769947 - RNA, 19 nt, Homo sapiens
acagacaacuaaugauuug

SEQ ID NO: 769948 - RNA, 19 nt, Homo sapiens
gagggaaggucuuuuauug

SEQ ID NO: 769949 - RNA, 19 nt, Homo sapiens
gggaaauggugaagcaaug

SEQ ID NO: 769950 - RNA, 19 nt, Homo sapiens
ucacugaauugauccaaga

SEQ ID NO: 769951 - RNA, 19 nt, Homo sapiens
ucaaagagcaucuccacaa

SEQ ID NO: 769952 - RNA, 19 nt, Homo sapiens
gaagaagaaagaagaguca

SEQ ID NO: 769953 - RNA, 19 nt, Homo sapiens
gcaaaccaaagaagaagaa

SEQ ID NO: 769954 - RNA, 19 nt, Homo sapiens
gagaggagagcaaaccaaa

SEQ ID NO: 769955 - RNA, 19 nt, Homo sapiens
gcaaagcugauucugauuc

SEQ ID NO: 769956 - RNA, 19 nt, Homo sapiens
gucauuggcaccauaaaua

SEQ ID NO: 769957 - RNA, 19 nt, Homo sapiens
uuaggcauguguuagauuu

SEQ ID NO: 769958 - RNA, 19 nt, Homo sapiens
uugagaagauguccuuuga

SEQ ID NO: 769959 - RNA, 19 nt, Homo sapiens
cagaagagaaccuggauug

SEQ ID NO: 769960 - RNA, 19 nt, Homo sapiens
ugaagagccaguauaguuu

SEQ ID NO: 769961 - RNA, 19 nt, Homo sapiens
agagguggcuugagaagau

SEQ ID NO: 769962 - RNA, 19 nt, Homo sapiens
gggaaggaguucuacuugu

SEQ ID NO: 769963 - RNA, 19 nt, Homo sapiens
caggagaagauuaaacuuu

SEQ ID NO: 769964 - RNA, 19 nt, Homo sapiens
uaagccuguucauaaguua

SEQ ID NO: 769965 - RNA, 19 nt, Homo sapiens
gacaaaacuugcagaauug

SEQ ID NO: 769966 - RNA, 19 nt, Homo sapiens
gcccacagguugucauauc

SEQ ID NO: 769967 - RNA, 19 nt, Homo sapiens
gcaggacuacggaggagua

SEQ ID NO: 769968 - RNA, 19 nt, Homo sapiens
uagaggagguaagacagua

SEQ ID NO: 769969 - RNA, 19 nt, Homo sapiens
cuaaugauuugcuucuaug

SEQ ID NO: 769970 - RNA, 19 nt, Homo sapiens
gaagagccaguauaguuuc

SEQ ID NO: 769971 - RNA, 19 nt, Homo sapiens
gaaaggcugacguggcauu

SEQ ID NO: 769972 - RNA, 19 nt, Homo sapiens
uggaagggauucucagaug

SEQ ID NO: 769973 - RNA, 19 nt, Homo sapiens
ggaggaagaggaauaugug

SEQ ID NO: 769974 - RNA, 19 nt, Homo sapiens
uccaagaguuuagugauuu

SEQ ID NO: 769975 - RNA, 19 nt, Homo sapiens
cuaagccuguucauaaguu

SEQ ID NO: 769976 - RNA, 19 nt, Homo sapiens
caaagagcaucuccacaac

SEQ ID NO: 769977 - RNA, 19 nt, Homo sapiens
caaggaagccaaugucaag

SEQ ID NO: 769978 - RNA, 19 nt, Homo sapiens
aggagaagauuaaacuuuc

SEQ ID NO: 769979 - RNA, 19 nt, Homo sapiens
guaagacaguagggaaaga

SEQ ID NO: 769980 - RNA, 19 nt, Homo sapiens
ggaaaggggauaaguguuu

SEQ ID NO: 769981 - RNA, 19 nt, Homo sapiens
gagagcaaaccaaagaaga

SEQ ID NO: 769982 - RNA, 19 nt, Homo sapiens
aaacagcacaugagacaga

SEQ ID NO: 769983 - RNA, 19 nt, Homo sapiens
gcacaugagacagauaaau

SEQ ID NO: 769984 - RNA, 19 nt, Homo sapiens
gacuaagccuguucauaag

SEQ ID NO: 769985 - RNA, 19 nt, Homo sapiens
ggacugugagagacuguuu

SEQ ID NO: 769986 - RNA, 19 nt, Homo sapiens
aagaacagacaacuaauga

SEQ ID NO: 769987 - RNA, 19 nt, Homo sapiens
caaagcugauucugauucu

SEQ ID NO: 769988 - RNA, 19 nt, Homo sapiens
gaaaacagcacaugagaca

SEQ ID NO: 769989 - RNA, 19 nt, Homo sapiens
gagcuacguuguaaaauuc

SEQ ID NO: 769990 - RNA, 19 nt, Homo sapiens
ugaauugauccaagaguuu

SEQ ID NO: 769991 - RNA, 19 nt, Homo sapiens
gaaagaagagucagaaaag

SEQ ID NO: 769992 - RNA, 19 nt, Homo sapiens
cagcacaugagacagauaa

SEQ ID NO: 769993 - RNA, 19 nt, Homo sapiens
ccaagaguuuagugauuuc

SEQ ID NO: 769994 - RNA, 19 nt, Homo sapiens
ccauaaauaaggacuguga

SEQ ID NO: 769995 - RNA, 19 nt, Homo sapiens
cagcguagcauguguguag

SEQ ID NO: 769996 - RNA, 19 nt, Homo sapiens
ccacagccuucuucccaau

SEQ ID NO: 769997 - RNA, 19 nt, Homo sapiens
gggaagggaaggaguucua

SEQ ID NO: 769998 - RNA, 19 nt, Homo sapiens
ucauuggcaccauaaauaa

SEQ ID NO: 769999 - RNA, 19 nt, Homo sapiens
gagccaguauaguuucugu

SEQ ID NO: 770000 - RNA, 19 nt, Homo sapiens
uugaagagccaguauaguu

SEQ ID NO: 770001 - RNA, 19 nt, Homo sapiens
uuugaacacugaaaccauu

SEQ ID NO: 770002 - RNA, 19 nt, Homo sapiens
gacaagggcccaugcucuu

SEQ ID NO: 770003 - RNA, 19 nt, Homo sapiens
gguguucccugccuaaacu

SEQ ID NO: 770004 - RNA, 19 nt, Homo sapiens
cguagcauguguguaguuu

SEQ ID NO: 770005 - RNA, 19 nt, Homo sapiens
acaagcagcgucacccuuu

SEQ ID NO: 770006 - RNA, 19 nt, Homo sapiens
gggaaggucuuuuauugga

SEQ ID NO: 770007 - RNA, 19 nt, Homo sapiens
gacaacuaaugauuugcuu

SEQ ID NO: 770008 - RNA, 19 nt, Homo sapiens
gagccggagcggauuauug

SEQ ID NO: 770009 - RNA, 19 nt, Homo sapiens
cugaauugauccaagaguu

SEQ ID NO: 770010 - RNA, 19 nt, Homo sapiens
aaauaaggacugugagaga

SEQ ID NO: 770011 - RNA, 19 nt, Homo sapiens
aaagaacagacaacuaaug

SEQ ID NO: 770012 - RNA, 19 nt, Homo sapiens
gaaauggugaagcaaugga

SEQ ID NO: 770013 - RNA, 19 nt, Homo sapiens
agaggaaccuggcuuugca

SEQ ID NO: 770014 - RNA, 19 nt, Homo sapiens
aaccaaagaagaagaaaga

SEQ ID NO: 770015 - RNA, 19 nt, Homo sapiens
cagaugaggacaacacaug

SEQ ID NO: 770016 - RNA, 19 nt, Homo sapiens
caugggagccagaagagaa

SEQ ID NO: 770017 - RNA, 19 nt, Homo sapiens
acacacacauacacacaca

SEQ ID NO: 770018 - RNA, 19 nt, Homo sapiens
uaacgucgagugaauugga

SEQ ID NO: 770019 - RNA, 19 nt, Homo sapiens
gaagaggaagaggguggua

SEQ ID NO: 770020 - RNA, 19 nt, Homo sapiens
caacuaaugauuugcuucu

SEQ ID NO: 770021 - RNA, 19 nt, Homo sapiens
ggaaaagaacagacaacua

SEQ ID NO: 770022 - RNA, 19 nt, Homo sapiens
guggagagcucauguuccu

SEQ ID NO: 770023 - RNA, 19 nt, Homo sapiens
gauucugauucugaagaua

SEQ ID NO: 770024 - RNA, 19 nt, Homo sapiens
gaggaguaacgucgaguga

SEQ ID NO: 770025 - RNA, 19 nt, Homo sapiens
acacacauacacacacaaa

SEQ ID NO: 770026 - RNA, 19 nt, Homo sapiens
gcucaaaguuggcccuguu

SEQ ID NO: 770027 - RNA, 19 nt, Homo sapiens
gcaaguacacucguucgua

SEQ ID NO: 770028 - RNA, 19 nt, Homo sapiens
guucguagauucaguuaca

SEQ ID NO: 770029 - RNA, 19 nt, Homo sapiens
gguuaugagucuucuguuc

SEQ ID NO: 770030 - RNA, 19 nt, Homo sapiens
guacacucguucguagauu

SEQ ID NO: 770031 - RNA, 19 nt, Homo sapiens
gugacuaucuguucaugag

SEQ ID NO: 770032 - RNA, 19 nt, Homo sapiens
ucugucaucugaagaagga

SEQ ID NO: 770033 - RNA, 19 nt, Homo sapiens
guuccaguauugguuauga

SEQ ID NO: 770034 - RNA, 19 nt, Homo sapiens
acauccaucugucaucuga

SEQ ID NO: 770035 - RNA, 19 nt, Homo sapiens
ucuguaagcuugcuguuuu

SEQ ID NO: 770036 - RNA, 19 nt, Homo sapiens
ucaccugggcucaaaguug

SEQ ID NO: 770037 - RNA, 19 nt, Homo sapiens
ccacccucaucuccaauau

SEQ ID NO: 770038 - RNA, 19 nt, Homo sapiens
uagauucaguuacauccau

SEQ ID NO: 770039 - RNA, 19 nt, Homo sapiens
guuaugagucuucuguuca

SEQ ID NO: 770040 - RNA, 19 nt, Homo sapiens
agauucaccugggcucaaa

SEQ ID NO: 770041 - RNA, 19 nt, Homo sapiens
caguauugguuaugagucu

SEQ ID NO: 770042 - RNA, 19 nt, Homo sapiens
uaucuguucaugagagaaa

SEQ ID NO: 770043 - RNA, 19 nt, Homo sapiens
uuacauccaucugucaucu

SEQ ID NO: 770044 - RNA, 19 nt, Homo sapiens
aguuggcccuguuccagua

SEQ ID NO: 770045 - RNA, 19 nt, Homo sapiens
ccuguuccaguauugguua

SEQ ID NO: 770046 - RNA, 19 nt, Homo sapiens
uacacucguucguagauuc

SEQ ID NO: 770047 - RNA, 19 nt, Homo sapiens
ccaucugucaucugaagaa

SEQ ID NO: 770048 - RNA, 19 nt, Homo sapiens
gccacccucaucuccaaua

SEQ ID NO: 770049 - RNA, 19 nt, Homo sapiens
ccacuguccggcagaggaa

SEQ ID NO: 770050 - RNA, 19 nt, Homo sapiens
gcaaugagcuuguaaagaa

SEQ ID NO: 770051 - RNA, 19 nt, Homo sapiens
gaaagccucuuguguagua

SEQ ID NO: 770052 - RNA, 19 nt, Homo sapiens
gaaagaacgugaaggcauu

SEQ ID NO: 770053 - RNA, 19 nt, Homo sapiens
caccuaagcuguuuaaaga

SEQ ID NO: 770054 - RNA, 19 nt, Homo sapiens
caagugggcugcagacuga

SEQ ID NO: 770055 - RNA, 19 nt, Homo sapiens
agaaagcuauugagaagua

SEQ ID NO: 770056 - RNA, 19 nt, Homo sapiens
uguuuaagcuguugcauua

SEQ ID NO: 770057 - RNA, 19 nt, Homo sapiens
uaagaaagcuauugagaag

SEQ ID NO: 770058 - RNA, 19 nt, Homo sapiens
gaagggaaaccauaagaaa

SEQ ID NO: 770059 - RNA, 19 nt, Homo sapiens
gcagagcccugacccuuga

SEQ ID NO: 770060 - RNA, 19 nt, Homo sapiens
caucaaagauugcacuuca

SEQ ID NO: 770061 - RNA, 19 nt, Homo sapiens
acaaagcacucaaggacua

SEQ ID NO: 770062 - RNA, 19 nt, Homo sapiens
guaagaggcuuugcuuguu

SEQ ID NO: 770063 - RNA, 19 nt, Homo sapiens
guaaagaagggaaaccaua

SEQ ID NO: 770064 - RNA, 19 nt, Homo sapiens
cuggaacucuguaguaaua

SEQ ID NO: 770065 - RNA, 19 nt, Homo sapiens
gcagauugaugauaaugug

SEQ ID NO: 770066 - RNA, 19 nt, Homo sapiens
uaaacucaguguagucaaa

SEQ ID NO: 770067 - RNA, 19 nt, Homo sapiens
uaaagaagggaaaccauaa

SEQ ID NO: 770068 - RNA, 19 nt, Homo sapiens
caaauuaaacucaguguag

SEQ ID NO: 770069 - RNA, 19 nt, Homo sapiens
ggaaugguccugcacagaa

SEQ ID NO: 770070 - RNA, 19 nt, Homo sapiens
gaaggcaucaacagaauga

SEQ ID NO: 770071 - RNA, 19 nt, Homo sapiens
gagacugcaucaaagauug

SEQ ID NO: 770072 - RNA, 19 nt, Homo sapiens
gaagcagaaccuacacuaa

SEQ ID NO: 770073 - RNA, 19 nt, Homo sapiens
gugaaagccucuuguguag

SEQ ID NO: 770074 - RNA, 19 nt, Homo sapiens
agacugugcugcagauuga

SEQ ID NO: 770075 - RNA, 19 nt, Homo sapiens
gacuauaaauccagcuuug

SEQ ID NO: 770076 - RNA, 19 nt, Homo sapiens
uggccuauguugacuauaa

SEQ ID NO: 770077 - RNA, 19 nt, Homo sapiens
guagaaggcaucaacagaa

SEQ ID NO: 770078 - RNA, 19 nt, Homo sapiens
ggaacucuguaguaauaau

SEQ ID NO: 770079 - RNA, 19 nt, Homo sapiens
gaaguacccuauggccuau

SEQ ID NO: 770080 - RNA, 19 nt, Homo sapiens
ggaagaaggcaaugagcuu

SEQ ID NO: 770081 - RNA, 19 nt, Homo sapiens
uuaaagagcccagugauug

SEQ ID NO: 770082 - RNA, 19 nt, Homo sapiens
gaaaccacagcuacaaaga

SEQ ID NO: 770083 - RNA, 19 nt, Homo sapiens
uaucugcugugcuuucauu

SEQ ID NO: 770084 - RNA, 19 nt, Homo sapiens
gcaccuaagcuguuuaaag

SEQ ID NO: 770085 - RNA, 19 nt, Homo sapiens
uaagaggcuuugcuuguuc

SEQ ID NO: 770086 - RNA, 19 nt, Homo sapiens
ggcaggaagugaagcagaa

SEQ ID NO: 770087 - RNA, 19 nt, Homo sapiens
uugguucccuucagcauua

SEQ ID NO: 770088 - RNA, 19 nt, Homo sapiens
aagcagaaccuacacuaaa

SEQ ID NO: 770089 - RNA, 19 nt, Homo sapiens
gcucagaagagguggaauu

SEQ ID NO: 770090 - RNA, 19 nt, Homo sapiens
uagaaggcaucaacagaau

SEQ ID NO: 770091 - RNA, 19 nt, Homo sapiens
gugaaggacugcacagaag

SEQ ID NO: 770092 - RNA, 19 nt, Homo sapiens
gaaugguccugcacagaag

SEQ ID NO: 770093 - RNA, 19 nt, Homo sapiens
gcaaccuccuacagauuga

SEQ ID NO: 770094 - RNA, 19 nt, Homo sapiens
cauaagaaagcuauugaga

SEQ ID NO: 770095 - RNA, 19 nt, Homo sapiens
gaaaccauaagaaagcuau

SEQ ID NO: 770096 - RNA, 19 nt, Homo sapiens
cugaagcucugucccuauu

SEQ ID NO: 770097 - RNA, 19 nt, Homo sapiens
gcacagaagcccucaagcu

SEQ ID NO: 770098 - RNA, 19 nt, Homo sapiens
gaaggaagaaggcaaugag

SEQ ID NO: 770099 - RNA, 19 nt, Homo sapiens
ggacuauaaauccagcuuu

SEQ ID NO: 770100 - RNA, 19 nt, Homo sapiens
caaagaaaccacagcuaca

SEQ ID NO: 770101 - RNA, 19 nt, Homo sapiens
cugcugugcuuucauuuau

SEQ ID NO: 770102 - RNA, 19 nt, Homo sapiens
gagaggcaccuaagcuguu

SEQ ID NO: 770103 - RNA, 19 nt, Homo sapiens
cuaaggcccugauccaaag

SEQ ID NO: 770104 - RNA, 19 nt, Homo sapiens
agugaaagccucuugugua

SEQ ID NO: 770105 - RNA, 19 nt, Homo sapiens
aaaguguucucuacuccaa

SEQ ID NO: 770106 - RNA, 19 nt, Homo sapiens
ucagcaaccuccuacagau

SEQ ID NO: 770107 - RNA, 19 nt, Homo sapiens
gcacucaaggacuauaaau

SEQ ID NO: 770108 - RNA, 19 nt, Homo sapiens
gaacgugaaggcauucuac

SEQ ID NO: 770109 - RNA, 19 nt, Homo sapiens
augaggcucuggagaagua

SEQ ID NO: 770110 - RNA, 19 nt, Homo sapiens
gcuauuugguccugaagca

SEQ ID NO: 770111 - RNA, 19 nt, Homo sapiens
gaaggcaaugagcuuguaa

SEQ ID NO: 770112 - RNA, 19 nt, Homo sapiens
agaaggcaaugagcuugua

SEQ ID NO: 770113 - RNA, 19 nt, Homo sapiens
acaaagagauggcuaaaag

SEQ ID NO: 770114 - RNA, 19 nt, Homo sapiens
ggagaaccacaaagagaug

SEQ ID NO: 770115 - RNA, 19 nt, Homo sapiens
gcuuucuucuacaucaaua

SEQ ID NO: 770116 - RNA, 19 nt, Homo sapiens
aaagcuuucuucuacauca

SEQ ID NO: 770117 - RNA, 19 nt, Homo sapiens
acugagugcugcccuugua

SEQ ID NO: 770118 - RNA, 19 nt, Homo sapiens
guacacagaagcagugaag

SEQ ID NO: 770119 - RNA, 19 nt, Homo sapiens
ucuccgggcuucauaguuc

SEQ ID NO: 770120 - RNA, 19 nt, Homo sapiens
uaaagagcccagugauugu

SEQ ID NO: 770121 - RNA, 19 nt, Homo sapiens
caagcuggauggaaagaac

SEQ ID NO: 770122 - RNA, 19 nt, Homo sapiens
ugaagcagaaccuacacua

SEQ ID NO: 770123 - RNA, 19 nt, Homo sapiens
gcuucauaguucuuuguaa

SEQ ID NO: 770124 - RNA, 19 nt, Homo sapiens
gcagagaggcaccuaagcu

SEQ ID NO: 770125 - RNA, 19 nt, Homo sapiens
cacagucuccuaugucuga

SEQ ID NO: 770126 - RNA, 19 nt, Homo sapiens
gauccaaagcagccuguug

SEQ ID NO: 770127 - RNA, 19 nt, Homo sapiens
ccuaaggcccugauccaaa

SEQ ID NO: 770128 - RNA, 19 nt, Homo sapiens
ccagaaagguccccacuag

SEQ ID NO: 770129 - RNA, 19 nt, Homo sapiens
aaagaaaccacagcuacaa

SEQ ID NO: 770130 - RNA, 19 nt, Homo sapiens
uuguugaacuguguguuua

SEQ ID NO: 770131 - RNA, 19 nt, Homo sapiens
agaggcaccuaagcuguuu

SEQ ID NO: 770132 - RNA, 19 nt, Homo sapiens
aaaccacagcuacaaagaa

SEQ ID NO: 770133 - RNA, 19 nt, Homo sapiens
ccacaaagagauggcuaaa

SEQ ID NO: 770134 - RNA, 19 nt, Homo sapiens
caccuggaacucuguagua

SEQ ID NO: 770135 - RNA, 19 nt, Homo sapiens
ggaagugaagcagaaccua

SEQ ID NO: 770136 - RNA, 19 nt, Homo sapiens
guacagugaaagccucuug

SEQ ID NO: 770137 - RNA, 19 nt, Homo sapiens
ugcagucucuccaggugua

SEQ ID NO: 770138 - RNA, 19 nt, Homo sapiens
ccucaucagcaaagcauuu

SEQ ID NO: 770139 - RNA, 19 nt, Homo sapiens
acacagaagcagugaagga

SEQ ID NO: 770140 - RNA, 19 nt, Homo sapiens
caaugagcuuguaaagaag

SEQ ID NO: 770141 - RNA, 19 nt, Homo sapiens
aucaauaucugcugugcuu

SEQ ID NO: 770142 - RNA, 19 nt, Homo sapiens
gaagcucugucccuauucc

SEQ ID NO: 770143 - RNA, 19 nt, Homo sapiens
ugcugcagauugaugauaa

SEQ ID NO: 770144 - RNA, 19 nt, Homo sapiens
uguaagaggcuuugcuugu

SEQ ID NO: 770145 - RNA, 19 nt, Homo sapiens
cagcaaccuccuacagauu

SEQ ID NO: 770146 - RNA, 19 nt, Homo sapiens
cuauugagaaguacaguga

SEQ ID NO: 770147 - RNA, 19 nt, Homo sapiens
ggaaaccauaagaaagcua

SEQ ID NO: 770148 - RNA, 19 nt, Homo sapiens
caauaucugcugugcuuuc

SEQ ID NO: 770149 - RNA, 19 nt, Homo sapiens
cgugaaggcauucuacaga

SEQ ID NO: 770150 - RNA, 19 nt, Homo sapiens
gcaagaagaugaaaguuga

SEQ ID NO: 770151 - RNA, 19 nt, Homo sapiens
uaaccgagcugugacauuu

SEQ ID NO: 770152 - RNA, 19 nt, Homo sapiens
gaaggaagaguuauaauuc

SEQ ID NO: 770153 - RNA, 19 nt, Homo sapiens
gggagacccugaagaagaa

SEQ ID NO: 770154 - RNA, 19 nt, Homo sapiens
ggaagauccuggagccaaa

SEQ ID NO: 770155 - RNA, 19 nt, Homo sapiens
gaauauaaccgagcuguga

SEQ ID NO: 770156 - RNA, 19 nt, Homo sapiens
ggagggagaccaugaaaga

SEQ ID NO: 770157 - RNA, 19 nt, Homo sapiens
gcugaugccuucaaagaug

SEQ ID NO: 770158 - RNA, 19 nt, Homo sapiens
gaaaggacgguucuuguuc

SEQ ID NO: 770159 - RNA, 19 nt, Homo sapiens
gaaggucauuccgcacuuu

SEQ ID NO: 770160 - RNA, 19 nt, Homo sapiens
ugaagacuuugaccaguuu

SEQ ID NO: 770161 - RNA, 19 nt, Homo sapiens
gcacagaauugggauuuac

SEQ ID NO: 770162 - RNA, 19 nt, Homo sapiens
gggagaccaugaaagacua

SEQ ID NO: 770163 - RNA, 19 nt, Homo sapiens
auaauguacuggugcuuua

SEQ ID NO: 770164 - RNA, 19 nt, Homo sapiens
aaagaugaccgaaagauug

SEQ ID NO: 770165 - RNA, 19 nt, Homo sapiens
aaacacaccuuggucaugu

SEQ ID NO: 770166 - RNA, 19 nt, Homo sapiens
caaagaugaccgaaagauu

SEQ ID NO: 770167 - RNA, 19 nt, Homo sapiens
caacaaggcccuggcagaa

SEQ ID NO: 770168 - RNA, 19 nt, Homo sapiens
aaaugaagccggaguuuga

SEQ ID NO: 770169 - RNA, 19 nt, Homo sapiens
uauaauuccugccucagaa

SEQ ID NO: 770170 - RNA, 19 nt, Homo sapiens
ucucagaguuuccuacguu

SEQ ID NO: 770171 - RNA, 19 nt, Homo sapiens
cuacuccucugaauuugaa

SEQ ID NO: 770172 - RNA, 19 nt, Homo sapiens
ccugaccgaugaagacuuu

SEQ ID NO: 770173 - RNA, 19 nt, Homo sapiens
gauggugcauuucauacug

SEQ ID NO: 770174 - RNA, 19 nt, Homo sapiens
ugucuacuccucugaauuu

SEQ ID NO: 770175 - RNA, 19 nt, Homo sapiens
caaagauguuguccaccuu

SEQ ID NO: 770176 - RNA, 19 nt, Homo sapiens
cuucaaagaugaccgaaag

SEQ ID NO: 770177 - RNA, 19 nt, Homo sapiens
gaaacacaccuuggucaug

SEQ ID NO: 770178 - RNA, 19 nt, Homo sapiens
gggaagagcagcagacaag

SEQ ID NO: 770179 - RNA, 19 nt, Homo sapiens
ucaaagacaagaaccaaga

SEQ ID NO: 770180 - RNA, 19 nt, Homo sapiens
gcucagaacccggaauaau

SEQ ID NO: 770181 - RNA, 19 nt, Homo sapiens
gagaagccgcuccugauca

SEQ ID NO: 770182 - RNA, 19 nt, Homo sapiens
ugacagcgaccgcacagaa

SEQ ID NO: 770183 - RNA, 19 nt, Homo sapiens
gaaguucgcagaaaaguau

SEQ ID NO: 770184 - RNA, 19 nt, Homo sapiens
uuuaucaccugaccgauga

SEQ ID NO: 770185 - RNA, 19 nt, Homo sapiens
ugaaaaucaucucagguua

SEQ ID NO: 770186 - RNA, 19 nt, Homo sapiens
guuccaguaugacaacuau

SEQ ID NO: 770187 - RNA, 19 nt, Homo sapiens
aaugauaccuguuuuguug

SEQ ID NO: 770188 - RNA, 19 nt, Homo sapiens
gagacucccugggcagaug

SEQ ID NO: 770189 - RNA, 19 nt, Homo sapiens
ucagaacccggaauaaugu

SEQ ID NO: 770190 - RNA, 19 nt, Homo sapiens
gaaugucuacuccucugaa

SEQ ID NO: 770191 - RNA, 19 nt, Homo sapiens
caggauggugcauuucaua

SEQ ID NO: 770192 - RNA, 19 nt, Homo sapiens
uuccuacguugaaguauuu

SEQ ID NO: 770193 - RNA, 19 nt, Homo sapiens
acaaggcccuggcagaaag

SEQ ID NO: 770194 - RNA, 19 nt, Homo sapiens
uaugggaaguucgcagaaa

SEQ ID NO: 770195 - RNA, 19 nt, Homo sapiens
acaccuuggucauguucua

SEQ ID NO: 770196 - RNA, 19 nt, Homo sapiens
gauuccacaucucagaguu

SEQ ID NO: 770197 - RNA, 19 nt, Homo sapiens
cgggagacccugaagaaga

SEQ ID NO: 770198 - RNA, 19 nt, Homo sapiens
ccucuguccucgucauguu

SEQ ID NO: 770199 - RNA, 19 nt, Homo sapiens
gacgguucuuguuccagua

SEQ ID NO: 770200 - RNA, 19 nt, Homo sapiens
guagaaaauugugcaagaa

SEQ ID NO: 770201 - RNA, 19 nt, Homo sapiens
gaaaaugaagccggaguuu

SEQ ID NO: 770202 - RNA, 19 nt, Homo sapiens
caucugcuauuuugagaaa

SEQ ID NO: 770203 - RNA, 19 nt, Homo sapiens
agaagccgcuccugaucau

SEQ ID NO: 770204 - RNA, 19 nt, Homo sapiens
accgagcugugacauuuaa

SEQ ID NO: 770205 - RNA, 19 nt, Homo sapiens
cgcacagaauugggauuua

SEQ ID NO: 770206 - RNA, 19 nt, Homo sapiens
gguucuuguuccaguauga

SEQ ID NO: 770207 - RNA, 19 nt, Homo sapiens
gugcuuuacuccaaaucug

SEQ ID NO: 770208 - RNA, 19 nt, Homo sapiens
gauccuggagccaaagaug

SEQ ID NO: 770209 - RNA, 19 nt, Homo sapiens
cugaugccuucaaagauga

SEQ ID NO: 770210 - RNA, 19 nt, Homo sapiens
cagaguuuccuacguugaa

SEQ ID NO: 770211 - RNA, 19 nt, Homo sapiens
augaagacuuugaccaguu

SEQ ID NO: 770212 - RNA, 19 nt, Homo sapiens
uggaguggcugaagaaucc

SEQ ID NO: 770213 - RNA, 19 nt, Homo sapiens
ccacagcugaggacauugu

SEQ ID NO: 770214 - RNA, 19 nt, Homo sapiens
uuuccuacguugaaguauu

SEQ ID NO: 770215 - RNA, 19 nt, Homo sapiens
aaaggucuccucgcucauu

SEQ ID NO: 770216 - RNA, 19 nt, Homo sapiens
ucaaagaugaccgaaagau

SEQ ID NO: 770217 - RNA, 19 nt, Homo sapiens
gcagcagacaagcguguug

SEQ ID NO: 770218 - RNA, 19 nt, Homo sapiens
aaucaucucagguuacugu

SEQ ID NO: 770219 - RNA, 19 nt, Homo sapiens
ccaggauggugcauuucau

SEQ ID NO: 770220 - RNA, 19 nt, Homo sapiens
ccgcacagaauugggauuu

SEQ ID NO: 770221 - RNA, 19 nt, Homo sapiens
cgaugccacugucaacaag

SEQ ID NO: 770222 - RNA, 19 nt, Homo sapiens
gacuuugaccaguuuguga

SEQ ID NO: 770223 - RNA, 19 nt, Homo sapiens
gggugguccugccaucaug

SEQ ID NO: 770224 - RNA, 19 nt, Homo sapiens
cugcugaugccuucaaaga

SEQ ID NO: 770225 - RNA, 19 nt, Homo sapiens
ucaggacaaagaagaaguu

SEQ ID NO: 770226 - RNA, 19 nt, Homo sapiens
aagauguuguccaccuuga

SEQ ID NO: 770227 - RNA, 19 nt, Homo sapiens
gagcugugacauuuaaguc

SEQ ID NO: 770228 - RNA, 19 nt, Homo sapiens
cucagaacccggaauaaug

SEQ ID NO: 770229 - RNA, 19 nt, Homo sapiens
gcagagaguagaaaauugu

SEQ ID NO: 770230 - RNA, 19 nt, Homo sapiens
ccaugaaagacuagggaaa

SEQ ID NO: 770231 - RNA, 19 nt, Homo sapiens
cagcgaccgcacagaauug

SEQ ID NO: 770232 - RNA, 19 nt, Homo sapiens
agaaggucauuccgcacuu

SEQ ID NO: 770233 - RNA, 19 nt, Homo sapiens
gguggacuguggugaugca

SEQ ID NO: 770234 - RNA, 19 nt, Homo sapiens
gugcucaggacaaagaaga

SEQ ID NO: 770235 - RNA, 19 nt, Homo sapiens
aauaauguacuggugcuuu

SEQ ID NO: 770236 - RNA, 19 nt, Homo sapiens
aagagaagccgcuccugau

SEQ ID NO: 770237 - RNA, 19 nt, Homo sapiens
ugcaagaagaugaaaguug

SEQ ID NO: 770238 - RNA, 19 nt, Homo sapiens
gacagcgaccgcacagaau

SEQ ID NO: 770239 - RNA, 19 nt, Homo sapiens
ggugaugcagagaguagaa

SEQ ID NO: 770240 - RNA, 19 nt, Homo sapiens
agaagaagaaacacaccuu

SEQ ID NO: 770241 - RNA, 19 nt, Homo sapiens
gaaaauugugcaagaagau

SEQ ID NO: 770242 - RNA, 19 nt, Homo sapiens
acagcgaccgcacagaauu

SEQ ID NO: 770243 - RNA, 19 nt, Homo sapiens
auuccgcacuuuacugcua

SEQ ID NO: 770244 - RNA, 19 nt, Homo sapiens
agaagaaacacaccuuggu

SEQ ID NO: 770245 - RNA, 19 nt, Homo sapiens
cugcucagaacccggaaua

SEQ ID NO: 770246 - RNA, 19 nt, Homo sapiens
caugguguggccacuguaa

SEQ ID NO: 770247 - RNA, 19 nt, Homo sapiens
ucauggcuguccucugcaa

SEQ ID NO: 770248 - RNA, 19 nt, Homo sapiens
ugaagccggaguuugagaa

SEQ ID NO: 770249 - RNA, 19 nt, Homo sapiens
ugaccgaugaagacuuuga

SEQ ID NO: 770250 - RNA, 19 nt, Homo sapiens
gaaaagagauggaaacuua

SEQ ID NO: 770251 - RNA, 19 nt, Homo sapiens
gaagaagauuccuggauuu

SEQ ID NO: 770252 - RNA, 19 nt, Homo sapiens
ccagauggcugcacagaaa

SEQ ID NO: 770253 - RNA, 19 nt, Homo sapiens
gaaacuuacuugaagaaga

SEQ ID NO: 770254 - RNA, 19 nt, Homo sapiens
ugaagaagauuccuggauu

SEQ ID NO: 770255 - RNA, 19 nt, Homo sapiens
ggucagccauguccaauga

SEQ ID NO: 770256 - RNA, 19 nt, Homo sapiens
gauggaaacuuacuugaag

SEQ ID NO: 770257 - RNA, 19 nt, Homo sapiens
guauuaaccugauccuuug

SEQ ID NO: 770258 - RNA, 19 nt, Homo sapiens
gugaugugcugguugguua

SEQ ID NO: 770259 - RNA, 19 nt, Homo sapiens
guacagcccugaugcaaag

SEQ ID NO: 770260 - RNA, 19 nt, Homo sapiens
ccaugaggcugauauaaau

SEQ ID NO: 770261 - RNA, 19 nt, Homo sapiens
gaaaacaaguucuucauca

SEQ ID NO: 770262 - RNA, 19 nt, Homo sapiens
cguuguggcuucuauuaua

SEQ ID NO: 770263 - RNA, 19 nt, Homo sapiens
gggcugcucuauacauauu

SEQ ID NO: 770264 - RNA, 19 nt, Homo sapiens
gagauugaauaaugcuuga

SEQ ID NO: 770265 - RNA, 19 nt, Homo sapiens
caaaauugcugcccuuauu

SEQ ID NO: 770266 - RNA, 19 nt, Homo sapiens
gcacugucguauccuauau

SEQ ID NO: 770267 - RNA, 19 nt, Homo sapiens
ggccaugcuuaauauauuu

SEQ ID NO: 770268 - RNA, 19 nt, Homo sapiens
gugaaugcuuugcaaguuu

SEQ ID NO: 770269 - RNA, 19 nt, Homo sapiens
aaggugagauugaauaaug

SEQ ID NO: 770270 - RNA, 19 nt, Homo sapiens
ggucuuuacuggauucaga

SEQ ID NO: 770271 - RNA, 19 nt, Homo sapiens
guugugguaugcugcuuua

SEQ ID NO: 770272 - RNA, 19 nt, Homo sapiens
agauaaagauugugaugug

SEQ ID NO: 770273 - RNA, 19 nt, Homo sapiens
aacaaguucuucaucagua

SEQ ID NO: 770274 - RNA, 19 nt, Homo sapiens
gaaucaugguuggcucuuu

SEQ ID NO: 770275 - RNA, 19 nt, Homo sapiens
gcagauaaagauugugaug

SEQ ID NO: 770276 - RNA, 19 nt, Homo sapiens
gaagauuccuggauuuugu

SEQ ID NO: 770277 - RNA, 19 nt, Homo sapiens
cagaaggugagauugaaua

SEQ ID NO: 770278 - RNA, 19 nt, Homo sapiens
gaaagagggagugcaguau

SEQ ID NO: 770279 - RNA, 19 nt, Homo sapiens
ccucauuuaugcuuucauu

SEQ ID NO: 770280 - RNA, 19 nt, Homo sapiens
gggucugccuccugcuuua

SEQ ID NO: 770281 - RNA, 19 nt, Homo sapiens
gagcuuuauuacacgcaua

SEQ ID NO: 770282 - RNA, 19 nt, Homo sapiens
cugcucauguucaaaguaa

SEQ ID NO: 770283 - RNA, 19 nt, Homo sapiens
ugaaugcuuugcaaguuug

SEQ ID NO: 770284 - RNA, 19 nt, Homo sapiens
aaagagggagugcaguaua

SEQ ID NO: 770285 - RNA, 19 nt, Homo sapiens
uauaaagccuguagguucu

SEQ ID NO: 770286 - RNA, 19 nt, Homo sapiens
agaaagagggagugcagua

SEQ ID NO: 770287 - RNA, 19 nt, Homo sapiens
gagugggucuuuacuggau

SEQ ID NO: 770288 - RNA, 19 nt, Homo sapiens
aaccugaugagcuuuauua

SEQ ID NO: 770289 - RNA, 19 nt, Homo sapiens
uuauaucgauccacccaaa

SEQ ID NO: 770290 - RNA, 19 nt, Homo sapiens
uaucagaaggugagauuga

SEQ ID NO: 770291 - RNA, 19 nt, Homo sapiens
guauagcuacuccuuauuc

SEQ ID NO: 770292 - RNA, 19 nt, Homo sapiens
guuguggcuucuauuauau

SEQ ID NO: 770293 - RNA, 19 nt, Homo sapiens
aguauuaaccugauccuuu

SEQ ID NO: 770294 - RNA, 19 nt, Homo sapiens
aauaaugcuugaugcagaa

SEQ ID NO: 770295 - RNA, 19 nt, Homo sapiens
gagcggcaguacacaaugg

SEQ ID NO: 770296 - RNA, 19 nt, Homo sapiens
cauguuugcuguguaguug

SEQ ID NO: 770297 - RNA, 19 nt, Homo sapiens
cuaaggauauagcacaaag

SEQ ID NO: 770298 - RNA, 19 nt, Homo sapiens
uuaagugaaugcuuugcaa

SEQ ID NO: 770299 - RNA, 19 nt, Homo sapiens
gcagcggugccucauguuu

SEQ ID NO: 770300 - RNA, 19 nt, Homo sapiens
gcaaaguuucagagcauga

SEQ ID NO: 770301 - RNA, 19 nt, Homo sapiens
uguaguugcuguccuaaca

SEQ ID NO: 770302 - RNA, 19 nt, Homo sapiens
gaagaaggaaacccaaggu

SEQ ID NO: 770303 - RNA, 19 nt, Homo sapiens
gagauggaaacuuacuuga

SEQ ID NO: 770304 - RNA, 19 nt, Homo sapiens
ugacucgccucauuuaugc

SEQ ID NO: 770305 - RNA, 19 nt, Homo sapiens
gaggccaugcuuaauauau

SEQ ID NO: 770306 - RNA, 19 nt, Homo sapiens
uagcacaaagggaacauuu

SEQ ID NO: 770307 - RNA, 19 nt, Homo sapiens
cacggugacucgccucauu

SEQ ID NO: 770308 - RNA, 19 nt, Homo sapiens
cugaugagcuuuauuacac

SEQ ID NO: 770309 - RNA, 19 nt, Homo sapiens
aaucauggguaaaucgaau

SEQ ID NO: 770310 - RNA, 19 nt, Homo sapiens
gguuggcucuuucuacauc

SEQ ID NO: 770311 - RNA, 19 nt, Homo sapiens
ccuauaucaugcagagaaa

SEQ ID NO: 770312 - RNA, 19 nt, Homo sapiens
ugucguauccuauaucaug

SEQ ID NO: 770313 - RNA, 19 nt, Homo sapiens
ucaucacccucuacacuau

SEQ ID NO: 770314 - RNA, 19 nt, Homo sapiens
ucgggcugcucuauacaua

SEQ ID NO: 770315 - RNA, 19 nt, Homo sapiens
aggccaugcuuaauauauu

SEQ ID NO: 770316 - RNA, 19 nt, Homo sapiens
aaucaugguuggcucuuuc

SEQ ID NO: 770317 - RNA, 19 nt, Homo sapiens
gcugauauaaaugcagaua

SEQ ID NO: 770318 - RNA, 19 nt, Homo sapiens
cagcccugaugcaaaguuu

SEQ ID NO: 770319 - RNA, 19 nt, Homo sapiens
aagagggagugcaguauag

SEQ ID NO: 770320 - RNA, 19 nt, Homo sapiens
ccacuaauagccaaguaga

SEQ ID NO: 770321 - RNA, 19 nt, Homo sapiens
cauccgcacuuccacuaau

SEQ ID NO: 770322 - RNA, 19 nt, Homo sapiens
uugaggccaugcuuaauau

SEQ ID NO: 770323 - RNA, 19 nt, Homo sapiens
uauaucagaaggugagauu

SEQ ID NO: 770324 - RNA, 19 nt, Homo sapiens
ugagcacugucguauccua

SEQ ID NO: 770325 - RNA, 19 nt, Homo sapiens
gcuuuacugucuuucacaa

SEQ ID NO: 770326 - RNA, 19 nt, Homo sapiens
gugguaugcugcuuuacug

SEQ ID NO: 770327 - RNA, 19 nt, Homo sapiens
guuuguuguuggcaugaua

SEQ ID NO: 770328 - RNA, 19 nt, Homo sapiens
uauuugaggccaugcuuaa

SEQ ID NO: 770329 - RNA, 19 nt, Homo sapiens
gauugaauaaugcuugaug

SEQ ID NO: 770330 - RNA, 19 nt, Homo sapiens
cugcuuggcuuccuuguac

SEQ ID NO: 770331 - RNA, 19 nt, Homo sapiens
acaaguucuucaucaguau

SEQ ID NO: 770332 - RNA, 19 nt, Homo sapiens
ggcaguuaccaccguguua

SEQ ID NO: 770333 - RNA, 19 nt, Homo sapiens
ccucauguuugcuguguag

SEQ ID NO: 770334 - RNA, 19 nt, Homo sapiens
gauaggaaaauguuggaua

SEQ ID NO: 770335 - RNA, 19 nt, Homo sapiens
gaaggugagauugaauaau

SEQ ID NO: 770336 - RNA, 19 nt, Homo sapiens
guaugcagguuuauaucag

SEQ ID NO: 770337 - RNA, 19 nt, Homo sapiens
uugacuguaugcagguuua

SEQ ID NO: 770338 - RNA, 19 nt, Homo sapiens
gguacagcccugaugcaaa

SEQ ID NO: 770339 - RNA, 19 nt, Homo sapiens
uccaugaggcugauauaaa

SEQ ID NO: 770340 - RNA, 19 nt, Homo sapiens
uuugaggccaugcuuaaua

SEQ ID NO: 770341 - RNA, 19 nt, Homo sapiens
gcugugcugugaagagagu

SEQ ID NO: 770342 - RNA, 19 nt, Homo sapiens
agaaggugagauugaauaa

SEQ ID NO: 770343 - RNA, 19 nt, Homo sapiens
cugcagcggugccucaugu

SEQ ID NO: 770344 - RNA, 19 nt, Homo sapiens
gugacucgccucauuuaug

SEQ ID NO: 770345 - RNA, 19 nt, Homo sapiens
uaugcagguuuauaucaga

SEQ ID NO: 770346 - RNA, 19 nt, Homo sapiens
agugaaugcuuugcaaguu

SEQ ID NO: 770347 - RNA, 19 nt, Homo sapiens
guaugcugcuuuacugucu

SEQ ID NO: 770348 - RNA, 19 nt, Homo sapiens
guaaaucgaauggaagaag

SEQ ID NO: 770349 - RNA, 19 nt, Homo sapiens
ggguaaaucgaauggaaga

SEQ ID NO: 770350 - RNA, 19 nt, Homo sapiens
ggacauaugaauucuguua

SEQ ID NO: 770351 - RNA, 19 nt, Homo sapiens
ggaaacaccugcuuaccaa

SEQ ID NO: 770352 - RNA, 19 nt, Homo sapiens
ggacgaauuugacuucuga

SEQ ID NO: 770353 - RNA, 19 nt, Homo sapiens
aaggagaucuucuucaaua

SEQ ID NO: 770354 - RNA, 19 nt, Homo sapiens
agaaagagcuggagagcaa

SEQ ID NO: 770355 - RNA, 19 nt, Homo sapiens
ggauuugauucgauucaua

SEQ ID NO: 770356 - RNA, 19 nt, Homo sapiens
ucaaggagaucuucuucaa

SEQ ID NO: 770357 - RNA, 19 nt, Homo sapiens
cgagaaaccucaaggagau

SEQ ID NO: 770358 - RNA, 19 nt, Homo sapiens
agagagagauggaagaaga

SEQ ID NO: 770359 - RNA, 19 nt, Homo sapiens
cagaugggcugaagaagga

SEQ ID NO: 770360 - RNA, 19 nt, Homo sapiens
cgacugggaugaugaaaca

SEQ ID NO: 770361 - RNA, 19 nt, Homo sapiens
ucuggaagaugcuuaauga

SEQ ID NO: 770362 - RNA, 19 nt, Homo sapiens
ggaugaagaugaggaugaa

SEQ ID NO: 770363 - RNA, 19 nt, Homo sapiens
uagaggagcugcaagaucu

SEQ ID NO: 770364 - RNA, 19 nt, Homo sapiens
auaaacaacuggaccauca

SEQ ID NO: 770365 - RNA, 19 nt, Homo sapiens
ggaaaggggugauccagaa

SEQ ID NO: 770366 - RNA, 19 nt, Homo sapiens
ucaaagcaguauggagaua

SEQ ID NO: 770367 - RNA, 19 nt, Homo sapiens
gauauuugcucuccugaac

SEQ ID NO: 770368 - RNA, 19 nt, Homo sapiens
caagcagcaucgucuuaaa

SEQ ID NO: 770369 - RNA, 19 nt, Homo sapiens
cacguuggcugacugauga

SEQ ID NO: 770370 - RNA, 19 nt, Homo sapiens
gaacaacgugcaggucaaa

SEQ ID NO: 770371 - RNA, 19 nt, Homo sapiens
cauggaagauucagagauc

SEQ ID NO: 770372 - RNA, 19 nt, Homo sapiens
gcugaaagguggaacaaaa

SEQ ID NO: 770373 - RNA, 19 nt, Homo sapiens
gugauugucuccucuaagu

SEQ ID NO: 770374 - RNA, 19 nt, Homo sapiens
acucacagcugcagggaaa

SEQ ID NO: 770375 - RNA, 19 nt, Homo sapiens
ucaaaagacuggaggaaaa

SEQ ID NO: 770376 - RNA, 19 nt, Homo sapiens
ggaugaugcugcagaaguc

SEQ ID NO: 770377 - RNA, 19 nt, Homo sapiens
gaccaaggaugacaguaag

SEQ ID NO: 770378 - RNA, 19 nt, Homo sapiens
cgaccaaggaugacaguaa

SEQ ID NO: 770379 - RNA, 19 nt, Homo sapiens
gcucucacauccacucuca

SEQ ID NO: 770380 - RNA, 19 nt, Homo sapiens
ugacuguccucgagaugaa

SEQ ID NO: 770381 - RNA, 19 nt, Homo sapiens
ggaugaggaugaggaugaa

SEQ ID NO: 770382 - RNA, 19 nt, Homo sapiens
aaagcaguauggagauaaa

SEQ ID NO: 770383 - RNA, 19 nt, Homo sapiens
cacauccacucucaacaaa

SEQ ID NO: 770384 - RNA, 19 nt, Homo sapiens
gaaacgcugcuguccaguu

SEQ ID NO: 770385 - RNA, 19 nt, Homo sapiens
gacgccacauccagcaaua

SEQ ID NO: 770386 - RNA, 19 nt, Homo sapiens
gcagagagagauggaagaa

SEQ ID NO: 770387 - RNA, 19 nt, Homo sapiens
gcucuuaugugcugaccau

SEQ ID NO: 770388 - RNA, 19 nt, Homo sapiens
cgucuccucugcauaagaa

SEQ ID NO: 770389 - RNA, 19 nt, Homo sapiens
ggaugaggaugaagaugag

SEQ ID NO: 770390 - RNA, 19 nt, Homo sapiens
acaguaaggacucagauuu

SEQ ID NO: 770391 - RNA, 19 nt, Homo sapiens
guggacauaugaauucugu

SEQ ID NO: 770392 - RNA, 19 nt, Homo sapiens
acaaaggacugguggacau

SEQ ID NO: 770393 - RNA, 19 nt, Homo sapiens
gggagaauuugagaaggaa

SEQ ID NO: 770394 - RNA, 19 nt, Homo sapiens
gaguggagguggguagaga

SEQ ID NO: 770395 - RNA, 19 nt, Homo sapiens
gcacguuggcugacugaug

SEQ ID NO: 770396 - RNA, 19 nt, Homo sapiens
ggaggauccugagcacaga

SEQ ID NO: 770397 - RNA, 19 nt, Homo sapiens
ggccugggaucccugaguu

SEQ ID NO: 770398 - RNA, 19 nt, Homo sapiens
ugagugagaugcguuaugg

SEQ ID NO: 770399 - RNA, 19 nt, Homo sapiens
ccugaacucucacucaauc

SEQ ID NO: 770400 - RNA, 19 nt, Homo sapiens
acccacagcugaaacaaau

SEQ ID NO: 770401 - RNA, 19 nt, Homo sapiens
caaagcaguauggagauaa

SEQ ID NO: 770402 - RNA, 19 nt, Homo sapiens
guacauggccuacguucag

SEQ ID NO: 770403 - RNA, 19 nt, Homo sapiens
gagaccaacacuacacuug

SEQ ID NO: 770404 - RNA, 19 nt, Homo sapiens
ggagaucuucuucaauauc

SEQ ID NO: 770405 - RNA, 19 nt, Homo sapiens
ucacauccacucucaacaa

SEQ ID NO: 770406 - RNA, 19 nt, Homo sapiens
gcugcuguccaguuuguua

SEQ ID NO: 770407 - RNA, 19 nt, Homo sapiens
ccaagcagcaucgucuuaa

SEQ ID NO: 770408 - RNA, 19 nt, Homo sapiens
ggaagauucagagaucaaa

SEQ ID NO: 770409 - RNA, 19 nt, Homo sapiens
caaaggacugguggacaua

SEQ ID NO: 770410 - RNA, 19 nt, Homo sapiens
cugaggaaaugguagaaug

SEQ ID NO: 770411 - RNA, 19 nt, Homo sapiens
gaucuucuucaauaucuug

SEQ ID NO: 770412 - RNA, 19 nt, Homo sapiens
aagagcagccuguggauga

SEQ ID NO: 770413 - RNA, 19 nt, Homo sapiens
caaaggugaaguccucuau

SEQ ID NO: 770414 - RNA, 19 nt, Homo sapiens
gagcugaagaggcccagaa

SEQ ID NO: 770415 - RNA, 19 nt, Homo sapiens
gaggcaagccgacucaaag

SEQ ID NO: 770416 - RNA, 19 nt, Homo sapiens
ugacgagggugcagguauc

SEQ ID NO: 770417 - RNA, 19 nt, Homo sapiens
cauccacucucaacaaacu

SEQ ID NO: 770418 - RNA, 19 nt, Homo sapiens
gaccaacacuacacuugac

SEQ ID NO: 770419 - RNA, 19 nt, Homo sapiens
ggagagggagggacucaca

SEQ ID NO: 770420 - RNA, 19 nt, Homo sapiens
ggugaagaagcacaagaaa

SEQ ID NO: 770421 - RNA, 19 nt, Homo sapiens
ggauccugcuuccgucaga

SEQ ID NO: 770422 - RNA, 19 nt, Homo sapiens
ugggagaauuugagaagga

SEQ ID NO: 770423 - RNA, 19 nt, Homo sapiens
ucgaagcccugcggauuug

SEQ ID NO: 770424 - RNA, 19 nt, Homo sapiens
ccaaugauuuucagaacaa

SEQ ID NO: 770425 - RNA, 19 nt, Homo sapiens
gcucccugcuugcugaaga

SEQ ID NO: 770426 - RNA, 19 nt, Homo sapiens
ggaggaaacaccugcuuac

SEQ ID NO: 770427 - RNA, 19 nt, Homo sapiens
ucaacaaacucaucaaaag

SEQ ID NO: 770428 - RNA, 19 nt, Homo sapiens
ccugcuugcugaagacaaa

SEQ ID NO: 770429 - RNA, 19 nt, Homo sapiens
ugaagaggcccagaaggaa

SEQ ID NO: 770430 - RNA, 19 nt, Homo sapiens
uggaggagcugagugagau

SEQ ID NO: 770431 - RNA, 19 nt, Homo sapiens
ggacugguggacauaugaa

SEQ ID NO: 770432 - RNA, 19 nt, Homo sapiens
guacaaacagcgcuaugag

SEQ ID NO: 770433 - RNA, 19 nt, Homo sapiens
cugccuaccuggagauuca

SEQ ID NO: 770434 - RNA, 19 nt, Homo sapiens
gacaguaaggacucagauu

SEQ ID NO: 770435 - RNA, 19 nt, Homo sapiens
aagaggaggaugaggauga

SEQ ID NO: 770436 - RNA, 19 nt, Homo sapiens
uaucucggcuacuaccaau

SEQ ID NO: 770437 - RNA, 19 nt, Homo sapiens
aaggugaaguccucuaucu

SEQ ID NO: 770438 - RNA, 19 nt, Homo sapiens
gcacucucccacacccuuu

SEQ ID NO: 770439 - RNA, 19 nt, Homo sapiens
ugggaucccugaguuguug

SEQ ID NO: 770440 - RNA, 19 nt, Homo sapiens
caaacagcgcuaugagugu

SEQ ID NO: 770441 - RNA, 19 nt, Homo sapiens
gaacgccagcggcagaaag

SEQ ID NO: 770442 - RNA, 19 nt, Homo sapiens
gggcugaagggacugaaga

SEQ ID NO: 770443 - RNA, 19 nt, Homo sapiens
ccagaacggcagagagaga

SEQ ID NO: 770444 - RNA, 19 nt, Homo sapiens
gauuugauucgauucauag

SEQ ID NO: 770445 - RNA, 19 nt, Homo sapiens
cugcggauuugauucgauu

SEQ ID NO: 770446 - RNA, 19 nt, Homo sapiens
ucauagaggagcugcaaga

SEQ ID NO: 770447 - RNA, 19 nt, Homo sapiens
cugaagaggcccagaagga

SEQ ID NO: 770448 - RNA, 19 nt, Homo sapiens
caaggagaucuucuucaau

SEQ ID NO: 770449 - RNA, 19 nt, Homo sapiens
caacaaacucaucaaaaga

SEQ ID NO: 770450 - RNA, 19 nt, Homo sapiens
ggaaagagguuuuaaaauc

SEQ ID NO: 770451 - RNA, 19 nt, Homo sapiens
gcacauggaagaccgauuu

SEQ ID NO: 770452 - RNA, 19 nt, Homo sapiens
agaaacagcugucaaaucu

SEQ ID NO: 770453 - RNA, 19 nt, Homo sapiens
ggagauggcccgugucuga

SEQ ID NO: 770454 - RNA, 19 nt, Homo sapiens
gcugauggcaguacacuua

SEQ ID NO: 770455 - RNA, 19 nt, Homo sapiens
gugaagaucuaaaugugaa

SEQ ID NO: 770456 - RNA, 19 nt, Homo sapiens
aaacagcugucaaaucuca

SEQ ID NO: 770457 - RNA, 19 nt, Homo sapiens
ccauaucccuggacucuug

SEQ ID NO: 770458 - RNA, 19 nt, Homo sapiens
ugucaaaucucaaggugaa

SEQ ID NO: 770459 - RNA, 19 nt, Homo sapiens
gaaaauugguacagaaaug

SEQ ID NO: 770460 - RNA, 19 nt, Homo sapiens
cuaaugcacuacugaaguu

SEQ ID NO: 770461 - RNA, 19 nt, Homo sapiens
ucaagaaacagcugucaaa

SEQ ID NO: 770462 - RNA, 19 nt, Homo sapiens
guacuugacuacucuagag

SEQ ID NO: 770463 - RNA, 19 nt, Homo sapiens
gauuucagauuucaguaug

SEQ ID NO: 770464 - RNA, 19 nt, Homo sapiens
gcacaagguacugagauuu

SEQ ID NO: 770465 - RNA, 19 nt, Homo sapiens
gcaggauucuguuucaucu

SEQ ID NO: 770466 - RNA, 19 nt, Homo sapiens
ugaaauuacugaacaacuc

SEQ ID NO: 770467 - RNA, 19 nt, Homo sapiens
cuacugaaguuuaaaucug

SEQ ID NO: 770468 - RNA, 19 nt, Homo sapiens
auauauccauuccagcuua

SEQ ID NO: 770469 - RNA, 19 nt, Homo sapiens
cgaagaagcggcgaaagaa

SEQ ID NO: 770470 - RNA, 19 nt, Homo sapiens
ggagauugcaauugagcua

SEQ ID NO: 770471 - RNA, 19 nt, Homo sapiens
aaguggagauugcaauuga

SEQ ID NO: 770472 - RNA, 19 nt, Homo sapiens
ggguuuguuucucuaaauu

SEQ ID NO: 770473 - RNA, 19 nt, Homo sapiens
gggaagcacuguugaaaau

SEQ ID NO: 770474 - RNA, 19 nt, Homo sapiens
gugaacaguuuacuaaugc

SEQ ID NO: 770475 - RNA, 19 nt, Homo sapiens
ugugaacaguuuacuaaug

SEQ ID NO: 770476 - RNA, 19 nt, Homo sapiens
gaagugagccaaaaggaaa

SEQ ID NO: 770477 - RNA, 19 nt, Homo sapiens
gaaguggagauugcaauug

SEQ ID NO: 770478 - RNA, 19 nt, Homo sapiens
gacuguuucucauguuuga

SEQ ID NO: 770479 - RNA, 19 nt, Homo sapiens
gcacuacugaaguuuaaau

SEQ ID NO: 770480 - RNA, 19 nt, Homo sapiens
gaucuaaaugugaacaguu

SEQ ID NO: 770481 - RNA, 19 nt, Homo sapiens
gaagcacuguugaaaauuc

SEQ ID NO: 770482 - RNA, 19 nt, Homo sapiens
ccaaagauaaacagacaga

SEQ ID NO: 770483 - RNA, 19 nt, Homo sapiens
uaugagcaaccaaagauaa

SEQ ID NO: 770484 - RNA, 19 nt, Homo sapiens
gugacuguuucucauguuu

SEQ ID NO: 770485 - RNA, 19 nt, Homo sapiens
caacuccuauucccauuuu

SEQ ID NO: 770486 - RNA, 19 nt, Homo sapiens
gcagguguuuuguauauau

SEQ ID NO: 770487 - RNA, 19 nt, Homo sapiens
aaccaaagauaaacagaca

SEQ ID NO: 770488 - RNA, 19 nt, Homo sapiens
ggugaagaucuaaauguga

SEQ ID NO: 770489 - RNA, 19 nt, Homo sapiens
ucccuggacucuugagaaa

SEQ ID NO: 770490 - RNA, 19 nt, Homo sapiens
gauccaccuucuccuagug

SEQ ID NO: 770491 - RNA, 19 nt, Homo sapiens
cagcauuucuaacugaagu

SEQ ID NO: 770492 - RNA, 19 nt, Homo sapiens
aggauucuguuucaucuga

SEQ ID NO: 770493 - RNA, 19 nt, Homo sapiens
ccagcuuguucaugguaua

SEQ ID NO: 770494 - RNA, 19 nt, Homo sapiens
gaagaagcggcgaaagaag

SEQ ID NO: 770495 - RNA, 19 nt, Homo sapiens
gagaugauuuugugugguu

SEQ ID NO: 770496 - RNA, 19 nt, Homo sapiens
cagcuuaaugccucuaauu

SEQ ID NO: 770497 - RNA, 19 nt, Homo sapiens
gauuucaguauguguguaa

SEQ ID NO: 770498 - RNA, 19 nt, Homo sapiens
ccgaagaagcggcgaaaga

SEQ ID NO: 770499 - RNA, 19 nt, Homo sapiens
acaguuuacuaaugcacua

SEQ ID NO: 770500 - RNA, 19 nt, Homo sapiens
gaagaccgauuuuauuugc

SEQ ID NO: 770501 - RNA, 19 nt, Homo sapiens
guaugagcaaccaaagaua

SEQ ID NO: 770502 - RNA, 19 nt, Homo sapiens
uauauccauuccagcuuaa

SEQ ID NO: 770503 - RNA, 19 nt, Homo sapiens
uugcuaaacucaauuucug

SEQ ID NO: 770504 - RNA, 19 nt, Homo sapiens
uaacugaagugagccaaaa

SEQ ID NO: 770505 - RNA, 19 nt, Homo sapiens
caagaucaccucugcaaaa

SEQ ID NO: 770506 - RNA, 19 nt, Homo sapiens
caagaaacagcugucaaau

SEQ ID NO: 770507 - RNA, 19 nt, Homo sapiens
gagcaaccaaagauaaaca

SEQ ID NO: 770508 - RNA, 19 nt, Homo sapiens
gaugggaagcacuguugaa

SEQ ID NO: 770509 - RNA, 19 nt, Homo sapiens
augcacuacugaaguuuaa

SEQ ID NO: 770510 - RNA, 19 nt, Homo sapiens
ugauggcaguacacuuaaa

SEQ ID NO: 770511 - RNA, 19 nt, Homo sapiens
aagaagcggcgaaagaaga

SEQ ID NO: 770512 - RNA, 19 nt, Homo sapiens
cuuccucccucauuuccua

SEQ ID NO: 770513 - RNA, 19 nt, Homo sapiens
caaauauaacuugccacua

SEQ ID NO: 770514 - RNA, 19 nt, Homo sapiens
gagaaguggagauugcaau

SEQ ID NO: 770515 - RNA, 19 nt, Homo sapiens
caaggugaagaucuaaaug

SEQ ID NO: 770516 - RNA, 19 nt, Homo sapiens
gcaaccaaagauaaacaga

SEQ ID NO: 770517 - RNA, 19 nt, Homo sapiens
ugagaaaauugguacagaa

SEQ ID NO: 770518 - RNA, 19 nt, Homo sapiens
caggaaagagguuuuaaaa

SEQ ID NO: 770519 - RNA, 19 nt, Homo sapiens
ggagcagcauugagguuuu

SEQ ID NO: 770520 - RNA, 19 nt, Homo sapiens
uuacugaacaacuccuauu

SEQ ID NO: 770521 - RNA, 19 nt, Homo sapiens
ucaaggugaagaucuaaau

SEQ ID NO: 770522 - RNA, 19 nt, Homo sapiens
ugcacaagguacugagauu

SEQ ID NO: 770523 - RNA, 19 nt, Homo sapiens
gagaaaauugguacagaaa

SEQ ID NO: 770524 - RNA, 19 nt, Homo sapiens
gggaaaaucggagaaaauu

SEQ ID NO: 770525 - RNA, 19 nt, Homo sapiens
ccugagaaguggagauugc

SEQ ID NO: 770526 - RNA, 19 nt, Homo sapiens
gcacaaucaauguaagcau

SEQ ID NO: 770527 - RNA, 19 nt, Homo sapiens
gaagaucuaaaugugaaca

SEQ ID NO: 770528 - RNA, 19 nt, Homo sapiens
uuccaaagccuccuaguca

SEQ ID NO: 770529 - RNA, 19 nt, Homo sapiens
agaaguggagauugcaauu

SEQ ID NO: 770530 - RNA, 19 nt, Homo sapiens
gaaaaucggagaaaauugc

SEQ ID NO: 770531 - RNA, 19 nt, Homo sapiens
aagaaacagcugucaaauc

SEQ ID NO: 770532 - RNA, 19 nt, Homo sapiens
gaaugugugacuaggagau

SEQ ID NO: 770533 - RNA, 19 nt, Homo sapiens
guucaaacuuagauuucag

SEQ ID NO: 770534 - RNA, 19 nt, Homo sapiens
ccaagaucaccucugcaaa

SEQ ID NO: 770535 - RNA, 19 nt, Homo sapiens
caagcuuccuagcgcuaug

SEQ ID NO: 770536 - RNA, 19 nt, Homo sapiens
aggugaagaucuaaaugug

SEQ ID NO: 770537 - RNA, 19 nt, Homo sapiens
ggaagaccgauuuuauuug

SEQ ID NO: 770538 - RNA, 19 nt, Homo sapiens
uguaugagcaaccaaagau

SEQ ID NO: 770539 - RNA, 19 nt, Homo sapiens
gaaaauuccaaccaaaaca

SEQ ID NO: 770540 - RNA, 19 nt, Homo sapiens
gcauuucuaacugaaguga

SEQ ID NO: 770541 - RNA, 19 nt, Homo sapiens
gaauucagaagcaggaaaa

SEQ ID NO: 770542 - RNA, 19 nt, Homo sapiens
gauugcaauugagcuagga

SEQ ID NO: 770543 - RNA, 19 nt, Homo sapiens
gugugacuguuucucaugu

SEQ ID NO: 770544 - RNA, 19 nt, Homo sapiens
aaucaaagaugggaaaauc

SEQ ID NO: 770545 - RNA, 19 nt, Homo sapiens
ggaugggaagcacuguuga

SEQ ID NO: 770546 - RNA, 19 nt, Homo sapiens
gcuuaaugccucuaauuuu

SEQ ID NO: 770547 - RNA, 19 nt, Homo sapiens
agaagcggcgaaagaagaa

SEQ ID NO: 770548 - RNA, 19 nt, Homo sapiens
ucaaaucucaaggugaaga

SEQ ID NO: 770549 - RNA, 19 nt, Homo sapiens
ggccagcuuguucauggua

SEQ ID NO: 770550 - RNA, 19 nt, Homo sapiens
gcacaaagccugauaguac

SEQ ID NO: 770551 - RNA, 19 nt, Homo sapiens
gguuaaagcuucuuggauu

SEQ ID NO: 770552 - RNA, 19 nt, Homo sapiens
guaugaaucuugacgguuu

SEQ ID NO: 770553 - RNA, 19 nt, Homo sapiens
gacaagauauggaaacaga

SEQ ID NO: 770554 - RNA, 19 nt, Homo sapiens
caaaggaauuuacaaagga

SEQ ID NO: 770555 - RNA, 19 nt, Homo sapiens
ggauggaacauacaaauuu

SEQ ID NO: 770556 - RNA, 19 nt, Homo sapiens
caacuuauguuucuuugag

SEQ ID NO: 770557 - RNA, 19 nt, Homo sapiens
ucagucaucuccacuuaaa

SEQ ID NO: 770558 - RNA, 19 nt, Homo sapiens
gucauuaguuucuccauuu

SEQ ID NO: 770559 - RNA, 19 nt, Homo sapiens
gagauuacaggaccagaua

SEQ ID NO: 770560 - RNA, 19 nt, Homo sapiens
gagaacacuugcaacaguu

SEQ ID NO: 770561 - RNA, 19 nt, Homo sapiens
guuaaagcuucuuggauuu

SEQ ID NO: 770562 - RNA, 19 nt, Homo sapiens
gaacaagcuagaagaaaug

SEQ ID NO: 770563 - RNA, 19 nt, Homo sapiens
gcacaugugaaucuuguuu

SEQ ID NO: 770564 - RNA, 19 nt, Homo sapiens
ggcauaauuucuuguuuga

SEQ ID NO: 770565 - RNA, 19 nt, Homo sapiens
acucagaauucacuguuua

SEQ ID NO: 770566 - RNA, 19 nt, Homo sapiens
gaacacuugcaacaguuua

SEQ ID NO: 770567 - RNA, 19 nt, Homo sapiens
gaccaucagugucagcauu

SEQ ID NO: 770568 - RNA, 19 nt, Homo sapiens
ucacauggauggaacauac

SEQ ID NO: 770569 - RNA, 19 nt, Homo sapiens
agaacaagcuagaagaaau

SEQ ID NO: 770570 - RNA, 19 nt, Homo sapiens
ggacaucgacguggagauu

SEQ ID NO: 770571 - RNA, 19 nt, Homo sapiens
ucaagucacuaaagauuca

SEQ ID NO: 770572 - RNA, 19 nt, Homo sapiens
agaauucacuguuuaccaa

SEQ ID NO: 770573 - RNA, 19 nt, Homo sapiens
uaagugaaauaugggagua

SEQ ID NO: 770574 - RNA, 19 nt, Homo sapiens
ugacacaagcagcuaauaa

SEQ ID NO: 770575 - RNA, 19 nt, Homo sapiens
guugaguccuuaugagaaa

SEQ ID NO: 770576 - RNA, 19 nt, Homo sapiens
gaaauaugggaguauaguu

SEQ ID NO: 770577 - RNA, 19 nt, Homo sapiens
ucuacuaccugaagagauu

SEQ ID NO: 770578 - RNA, 19 nt, Homo sapiens
gcacgaacaggaauacaug

SEQ ID NO: 770579 - RNA, 19 nt, Homo sapiens
aaacagaagcucaccagaa

SEQ ID NO: 770580 - RNA, 19 nt, Homo sapiens
gagaauccagugggaaaua

SEQ ID NO: 770581 - RNA, 19 nt, Homo sapiens
ugagaacacuugcaacagu

SEQ ID NO: 770582 - RNA, 19 nt, Homo sapiens
ccagauaacaaaggaauuu

SEQ ID NO: 770583 - RNA, 19 nt, Homo sapiens
gaacucaaacacuguaagu

SEQ ID NO: 770584 - RNA, 19 nt, Homo sapiens
ugauauacagccacuauuu

SEQ ID NO: 770585 - RNA, 19 nt, Homo sapiens
acaaaggaauuuacaaagg

SEQ ID NO: 770586 - RNA, 19 nt, Homo sapiens
aggauuauguugugacuga

SEQ ID NO: 770587 - RNA, 19 nt, Homo sapiens
uggcauaauuucuuguuug

SEQ ID NO: 770588 - RNA, 19 nt, Homo sapiens
gaucccaacucagaauuca

SEQ ID NO: 770589 - RNA, 19 nt, Homo sapiens
gauguucaccauugauauu

SEQ ID NO: 770590 - RNA, 19 nt, Homo sapiens
acucagucaucuccacuua

SEQ ID NO: 770591 - RNA, 19 nt, Homo sapiens
guucaagucacuaaagauu

SEQ ID NO: 770592 - RNA, 19 nt, Homo sapiens
cuuugaagcucuuguucua

SEQ ID NO: 770593 - RNA, 19 nt, Homo sapiens
acaguugauuggcauaauu

SEQ ID NO: 770594 - RNA, 19 nt, Homo sapiens
gcuggguacuuucauacuu

SEQ ID NO: 770595 - RNA, 19 nt, Homo sapiens
ugacugcauucuuuggauu

SEQ ID NO: 770596 - RNA, 19 nt, Homo sapiens
caaacaccuuggucauaau

SEQ ID NO: 770597 - RNA, 19 nt, Homo sapiens
caucuccacuuaaauugau

SEQ ID NO: 770598 - RNA, 19 nt, Homo sapiens
gcauacauuuucccacaua

SEQ ID NO: 770599 - RNA, 19 nt, Homo sapiens
aaacaccuuggucauaaua

SEQ ID NO: 770600 - RNA, 19 nt, Homo sapiens
gcauuaggguuuugguuuu

SEQ ID NO: 770601 - RNA, 19 nt, Homo sapiens
uuacaaaggagacagagaa

SEQ ID NO: 770602 - RNA, 19 nt, Homo sapiens
caggcuggguacuuucaua

SEQ ID NO: 770603 - RNA, 19 nt, Homo sapiens
caacucagaauucacuguu

SEQ ID NO: 770604 - RNA, 19 nt, Homo sapiens
ggaaguccgggagagaaua

SEQ ID NO: 770605 - RNA, 19 nt, Homo sapiens
cacauuugcugcucacaug

SEQ ID NO: 770606 - RNA, 19 nt, Homo sapiens
cuucuuggauuucauuuca

SEQ ID NO: 770607 - RNA, 19 nt, Homo sapiens
acaagcagcuaauaaccau

SEQ ID NO: 770608 - RNA, 19 nt, Homo sapiens
gaaacagcaguaugaaucu

SEQ ID NO: 770609 - RNA, 19 nt, Homo sapiens
agaaacagcaguaugaauc

SEQ ID NO: 770610 - RNA, 19 nt, Homo sapiens
gagaaacagcaguaugaau

SEQ ID NO: 770611 - RNA, 19 nt, Homo sapiens
uaaagcacgaacaggaaua

SEQ ID NO: 770612 - RNA, 19 nt, Homo sapiens
cagguucgguaaauaaaca

SEQ ID NO: 770613 - RNA, 19 nt, Homo sapiens
gauuauguugugacugaua

SEQ ID NO: 770614 - RNA, 19 nt, Homo sapiens
acuguacauucacaacuua

SEQ ID NO: 770615 - RNA, 19 nt, Homo sapiens
gaaguccggagaguuguuu

SEQ ID NO: 770616 - RNA, 19 nt, Homo sapiens
agugaaauaugggaguaua

SEQ ID NO: 770617 - RNA, 19 nt, Homo sapiens
guucucugaugauggguuu

SEQ ID NO: 770618 - RNA, 19 nt, Homo sapiens
uaaagcuucuuggauuuca

SEQ ID NO: 770619 - RNA, 19 nt, Homo sapiens
cuggguacuuucauacuuu

SEQ ID NO: 770620 - RNA, 19 nt, Homo sapiens
gcaguuuguucaggaaauc

SEQ ID NO: 770621 - RNA, 19 nt, Homo sapiens
cagagaauccagugggaaa

SEQ ID NO: 770622 - RNA, 19 nt, Homo sapiens
ccagaacaagcuagaagaa

SEQ ID NO: 770623 - RNA, 19 nt, Homo sapiens
ggugagaacacuugcaaca

SEQ ID NO: 770624 - RNA, 19 nt, Homo sapiens
ccaaaggguuaaagcuucu

SEQ ID NO: 770625 - RNA, 19 nt, Homo sapiens
aaccggauguccaccauga

SEQ ID NO: 770626 - RNA, 19 nt, Homo sapiens
gaccagauaacaaaggaau

SEQ ID NO: 770627 - RNA, 19 nt, Homo sapiens
cauuguaccuuaggacuca

SEQ ID NO: 770628 - RNA, 19 nt, Homo sapiens
cuacgacucagcauacauu

SEQ ID NO: 770629 - RNA, 19 nt, Homo sapiens
ugauuggcauaauuucuug

SEQ ID NO: 770630 - RNA, 19 nt, Homo sapiens
gaacuguacauucacaacu

SEQ ID NO: 770631 - RNA, 19 nt, Homo sapiens
gccaugacauugggacaga

SEQ ID NO: 770632 - RNA, 19 nt, Homo sapiens
acagagccaucaacgacaa

SEQ ID NO: 770633 - RNA, 19 nt, Homo sapiens
cagaagcucaccagaacaa

SEQ ID NO: 770634 - RNA, 19 nt, Homo sapiens
uguugugacugauacauau

SEQ ID NO: 770635 - RNA, 19 nt, Homo sapiens
agucaucuccacuuaaauu

SEQ ID NO: 770636 - RNA, 19 nt, Homo sapiens
aaacagcaguaugaaucuu

SEQ ID NO: 770637 - RNA, 19 nt, Homo sapiens
gcaccaagaugggccucau

SEQ ID NO: 770638 - RNA, 19 nt, Homo sapiens
ugucauuaguuucuccauu

SEQ ID NO: 770639 - RNA, 19 nt, Homo sapiens
caagcuagaagaaaugauc

SEQ ID NO: 770640 - RNA, 19 nt, Homo sapiens
aacagaagcucaccagaac

SEQ ID NO: 770641 - RNA, 19 nt, Homo sapiens
aagcagcuaauaaccauuu

SEQ ID NO: 770642 - RNA, 19 nt, Homo sapiens
caaaggagacagagaaucc

SEQ ID NO: 770643 - RNA, 19 nt, Homo sapiens
gacaucgacguggagauua

SEQ ID NO: 770644 - RNA, 19 nt, Homo sapiens
uacaggaccagauaacaaa

SEQ ID NO: 770645 - RNA, 19 nt, Homo sapiens
gacaguugauuggcauaau

SEQ ID NO: 770646 - RNA, 19 nt, Homo sapiens
gaauucacuguuuaccaaa

SEQ ID NO: 770647 - RNA, 19 nt, Homo sapiens
gaagcucuuguucuaguug

SEQ ID NO: 770648 - RNA, 19 nt, Homo sapiens
guaaagcacgaacaggaau

SEQ ID NO: 770649 - RNA, 19 nt, Homo sapiens
caucgacgcccaugcugaa

SEQ ID NO: 770650 - RNA, 19 nt, Homo sapiens
gaacaagcgcuucuacuga

SEQ ID NO: 770651 - RNA, 19 nt, Homo sapiens
acaacaagaugaccuuauu

SEQ ID NO: 770652 - RNA, 19 nt, Homo sapiens
acaccucucuuucuucuuu

SEQ ID NO: 770653 - RNA, 19 nt, Homo sapiens
gaacaacaagaugaccuua

SEQ ID NO: 770654 - RNA, 19 nt, Homo sapiens
gaccuuauuucuuaacugu

SEQ ID NO: 770655 - RNA, 19 nt, Homo sapiens
ggaaaugcacguccacuuc

SEQ ID NO: 770656 - RNA, 19 nt, Homo sapiens
uggaagaacugcauugaca

SEQ ID NO: 770657 - RNA, 19 nt, Homo sapiens
gaaaugcacguccacuuca

SEQ ID NO: 770658 - RNA, 19 nt, Homo sapiens
caacaagaugaccuuauuu

SEQ ID NO: 770659 - RNA, 19 nt, Homo sapiens
ggaacaagcgcuucuacug

SEQ ID NO: 770660 - RNA, 19 nt, Homo sapiens
gaagaagaaccuccaugga

SEQ ID NO: 770661 - RNA, 19 nt, Homo sapiens
ugaccgaccuggaggacaa

SEQ ID NO: 770662 - RNA, 19 nt, Homo sapiens
gaagaacugcauugacauc

SEQ ID NO: 770663 - RNA, 19 nt, Homo sapiens
ccaaugaugagaccacuga

SEQ ID NO: 770664 - RNA, 19 nt, Homo sapiens
ucaagucgcccaaagacaa

SEQ ID NO: 770665 - RNA, 19 nt, Homo sapiens
gacaagaacgaguggaaga

SEQ ID NO: 770666 - RNA, 19 nt, Homo sapiens
ugacugcggauauaacuga

SEQ ID NO: 770667 - RNA, 19 nt, Homo sapiens
cuacaccucucuuucuucu

SEQ ID NO: 770668 - RNA, 19 nt, Homo sapiens
ccucaaagacugggaaaug

SEQ ID NO: 770669 - RNA, 19 nt, Homo sapiens
ccacuacaccucucuuucu

SEQ ID NO: 770670 - RNA, 19 nt, Homo sapiens
gagacggcaucgccuugug

SEQ ID NO: 770671 - RNA, 19 nt, Homo sapiens
caacagugaacaucucaag

SEQ ID NO: 770672 - RNA, 19 nt, Homo sapiens
gggccgugguguuccagaa

SEQ ID NO: 770673 - RNA, 19 nt, Homo sapiens
cacuacaccucucuuucuu

SEQ ID NO: 770674 - RNA, 19 nt, Homo sapiens
ggaagaacugcauugacau

SEQ ID NO: 770675 - RNA, 19 nt, Homo sapiens
gcacagggaagaagaaccu

SEQ ID NO: 770676 - RNA, 19 nt, Homo sapiens
ggucugugacugcggauau

SEQ ID NO: 770677 - RNA, 19 nt, Homo sapiens
gggaaaugcacguccacuu

SEQ ID NO: 770678 - RNA, 19 nt, Homo sapiens
aaaugcacguccacuucaa

SEQ ID NO: 770679 - RNA, 19 nt, Homo sapiens
ucucggugauggugaacaa

SEQ ID NO: 770680 - RNA, 19 nt, Homo sapiens
ccaucuuccuggacaccua

SEQ ID NO: 770681 - RNA, 19 nt, Homo sapiens
cagccgugcuuccucaaag

SEQ ID NO: 770682 - RNA, 19 nt, Homo sapiens
ggaaccaccagccgugcuu

SEQ ID NO: 770683 - RNA, 19 nt, Homo sapiens
gucugugacugcggauaua

SEQ ID NO: 770684 - RNA, 19 nt, Homo sapiens
gagcgcguguucccguaca

SEQ ID NO: 770685 - RNA, 19 nt, Homo sapiens
agauaacuuccacggcuua

SEQ ID NO: 770686 - RNA, 19 nt, Homo sapiens
gagcaggggucugugucua

SEQ ID NO: 770687 - RNA, 19 nt, Homo sapiens
uuaccgggauuauaaaaga

SEQ ID NO: 770688 - RNA, 19 nt, Homo sapiens
ggcaucgccuugugguaca

SEQ ID NO: 770689 - RNA, 19 nt, Homo sapiens
cggcaacagugaacaucuc

SEQ ID NO: 770690 - RNA, 19 nt, Homo sapiens
gcccaccggcuacuacuuc

SEQ ID NO: 770691 - RNA, 19 nt, Homo sapiens
gaguggaagaacugcauug

SEQ ID NO: 770692 - RNA, 19 nt, Homo sapiens
aacaagaugaccuuauuuc

SEQ ID NO: 770693 - RNA, 19 nt, Homo sapiens
acaagaacgaguggaagaa

SEQ ID NO: 770694 - RNA, 19 nt, Homo sapiens
ugaccuuauuucuuaacug

SEQ ID NO: 770695 - RNA, 19 nt, Homo sapiens
gcccaggagccaaugugaa

SEQ ID NO: 770696 - RNA, 19 nt, Homo sapiens
ggagacggcaucgccuugu

SEQ ID NO: 770697 - RNA, 19 nt, Homo sapiens
gauaaccucucaaguguga

SEQ ID NO: 770698 - RNA, 19 nt, Homo sapiens
ggacauugaugcuaacaug

SEQ ID NO: 770699 - RNA, 19 nt, Homo sapiens
gugagucccuuguggaaua

SEQ ID NO: 770700 - RNA, 19 nt, Homo sapiens
gaguaugccuggacauuga

SEQ ID NO: 770701 - RNA, 19 nt, Homo sapiens
caagauaaccucucaagug

SEQ ID NO: 770702 - RNA, 19 nt, Homo sapiens
aauacaagcuggacaaaga

SEQ ID NO: 770703 - RNA, 19 nt, Homo sapiens
ugaaggagacucagaagaa

SEQ ID NO: 770704 - RNA, 19 nt, Homo sapiens
aaagagagcuacccagucu

SEQ ID NO: 770705 - RNA, 19 nt, Homo sapiens
gaaggagacucagaagaag

SEQ ID NO: 770706 - RNA, 19 nt, Homo sapiens
aagauaaccucucaagugu

SEQ ID NO: 770707 - RNA, 19 nt, Homo sapiens
gugacaagcugaacaugga

SEQ ID NO: 770708 - RNA, 19 nt, Homo sapiens
gagcaauaccugaagauca

SEQ ID NO: 770709 - RNA, 19 nt, Homo sapiens
gaaauacaagcuggacaaa

SEQ ID NO: 770710 - RNA, 19 nt, Homo sapiens
cgagaaagaggagcuguaa

SEQ ID NO: 770711 - RNA, 19 nt, Homo sapiens
gaagugggccgagcaauac

SEQ ID NO: 770712 - RNA, 19 nt, Homo sapiens
agaagugggccgagcaaua

SEQ ID NO: 770713 - RNA, 19 nt, Homo sapiens
uggauacggucacuuucua

SEQ ID NO: 770714 - RNA, 19 nt, Homo sapiens
gaagcaggaugaguucaag

SEQ ID NO: 770715 - RNA, 19 nt, Homo sapiens
gugagaagcaggaugaguu

SEQ ID NO: 770716 - RNA, 19 nt, Homo sapiens
gccuggacauugaugcuaa

SEQ ID NO: 770717 - RNA, 19 nt, Homo sapiens
ccaggcugauugagaagaa

SEQ ID NO: 770718 - RNA, 19 nt, Homo sapiens
acauggagcugagugagaa

SEQ ID NO: 770719 - RNA, 19 nt, Homo sapiens
gaagaagugggccgagcaa

SEQ ID NO: 770720 - RNA, 19 nt, Homo sapiens
agaagaacaagaugaguga

SEQ ID NO: 770721 - RNA, 19 nt, Homo sapiens
ucgccaggcugauugagaa

SEQ ID NO: 770722 - RNA, 19 nt, Homo sapiens
gaaguucgacacccaguac

SEQ ID NO: 770723 - RNA, 19 nt, Homo sapiens
gccaggcccucuugaagca

SEQ ID NO: 770724 - RNA, 19 nt, Homo sapiens
cugguugccugccuguaua

SEQ ID NO: 770725 - RNA, 19 nt, Homo sapiens
gagaaagaggagcuguaaa

SEQ ID NO: 770726 - RNA, 19 nt, Homo sapiens
ggagcugagugagaaauac

SEQ ID NO: 770727 - RNA, 19 nt, Homo sapiens
uuccagcgaugaucucuug

SEQ ID NO: 770728 - RNA, 19 nt, Homo sapiens
ccagaagagcuuaaacauc

SEQ ID NO: 770729 - RNA, 19 nt, Homo sapiens
gcaagauaaccucucaagu

SEQ ID NO: 770730 - RNA, 19 nt, Homo sapiens
agaaauacaagcuggacaa

SEQ ID NO: 770731 - RNA, 19 nt, Homo sapiens
gguagugggaacaguggua

SEQ ID NO: 770732 - RNA, 19 nt, Homo sapiens
agcaauaccugaagaucau

SEQ ID NO: 770733 - RNA, 19 nt, Homo sapiens
agaaagaggagcuguaaaa

SEQ ID NO: 770734 - RNA, 19 nt, Homo sapiens
gccgagcaauaccugaaga

SEQ ID NO: 770735 - RNA, 19 nt, Homo sapiens
gagcuacccagucuucuac

SEQ ID NO: 770736 - RNA, 19 nt, Homo sapiens
gacauugaugcuaacauga

SEQ ID NO: 770737 - RNA, 19 nt, Homo sapiens
ggaggacuucccagcauca

SEQ ID NO: 770738 - RNA, 19 nt, Homo sapiens
gaacccagucccauacacu

SEQ ID NO: 770739 - RNA, 19 nt, Homo sapiens
gagcugagugagaaauaca

SEQ ID NO: 770740 - RNA, 19 nt, Homo sapiens
cuacaaggucauucccaaa

SEQ ID NO: 770741 - RNA, 19 nt, Homo sapiens
ugauugagaagaacaagau

SEQ ID NO: 770742 - RNA, 19 nt, Homo sapiens
aaaaggcugucugugauuu

SEQ ID NO: 770743 - RNA, 19 nt, Homo sapiens
gagcuuaaacauccugacu

SEQ ID NO: 770744 - RNA, 19 nt, Homo sapiens
gaugagugacggcaagaag

SEQ ID NO: 770745 - RNA, 19 nt, Homo sapiens
uacggucacuuucuacaag

SEQ ID NO: 770746 - RNA, 19 nt, Homo sapiens
cauugaugcuaacaugaca

SEQ ID NO: 770747 - RNA, 19 nt, Homo sapiens
caagugugaaggagacuca

SEQ ID NO: 770748 - RNA, 19 nt, Homo sapiens
ugaguaugccuggacauug

SEQ ID NO: 770749 - RNA, 19 nt, Homo sapiens
gggccgagcaauaccugaa

SEQ ID NO: 770750 - RNA, 19 nt, Homo sapiens
gugaaggagacucagaaga

SEQ ID NO: 770751 - RNA, 19 nt, Homo sapiens
ggcaagauaaccucucaag

SEQ ID NO: 770752 - RNA, 19 nt, Homo sapiens
uugagaacccagucccaua

SEQ ID NO: 770753 - RNA, 19 nt, Homo sapiens
ugagaagcaggaugaguuc

SEQ ID NO: 770754 - RNA, 19 nt, Homo sapiens
ugagugacggcaagaagga

SEQ ID NO: 770755 - RNA, 19 nt, Homo sapiens
gauacggucacuuucuaca

SEQ ID NO: 770756 - RNA, 19 nt, Homo sapiens
ccgagaaagaggagcugua

SEQ ID NO: 770757 - RNA, 19 nt, Homo sapiens
agagagcuacccagucuuc

SEQ ID NO: 770758 - RNA, 19 nt, Homo sapiens
ugagucccuuguggaauau

SEQ ID NO: 770759 - RNA, 19 nt, Homo sapiens
agaagcaggaugaguucaa

SEQ ID NO: 770760 - RNA, 19 nt, Homo sapiens
ugaaguucgacacccagua

SEQ ID NO: 770761 - RNA, 19 nt, Homo sapiens
gagaacccagucccauaca

SEQ ID NO: 770762 - RNA, 19 nt, Homo sapiens
agagcuacccagucuucua

SEQ ID NO: 770763 - RNA, 19 nt, Homo sapiens
gaagagaucgggaauaaua

SEQ ID NO: 770764 - RNA, 19 nt, Homo sapiens
uaacaugcauuccuacuau

SEQ ID NO: 770765 - RNA, 19 nt, Homo sapiens
ccuuaaaccuuccuaauuu

SEQ ID NO: 770766 - RNA, 19 nt, Homo sapiens
guaaaugguucaagcaaug

SEQ ID NO: 770767 - RNA, 19 nt, Homo sapiens
gaaaucaggaggguaguua

SEQ ID NO: 770768 - RNA, 19 nt, Homo sapiens
ucacagggauuccuccuuu

SEQ ID NO: 770769 - RNA, 19 nt, Homo sapiens
gaacuggacuugcucuaag

SEQ ID NO: 770770 - RNA, 19 nt, Homo sapiens
caacuuugcuccuaacugu

SEQ ID NO: 770771 - RNA, 19 nt, Homo sapiens
uggaagagaucgggaauaa

SEQ ID NO: 770772 - RNA, 19 nt, Homo sapiens
gccaguaauugauugauaa

SEQ ID NO: 770773 - RNA, 19 nt, Homo sapiens
gaggguaguuagagguaua

SEQ ID NO: 770774 - RNA, 19 nt, Homo sapiens
acccugaaaugaacaauua

SEQ ID NO: 770775 - RNA, 19 nt, Homo sapiens
gcacaguucuucagcuaca

SEQ ID NO: 770776 - RNA, 19 nt, Homo sapiens
gggcacaguucuucagcua

SEQ ID NO: 770777 - RNA, 19 nt, Homo sapiens
gaguugaguucuauguauu

SEQ ID NO: 770778 - RNA, 19 nt, Homo sapiens
gugauggccuccuugagua

SEQ ID NO: 770779 - RNA, 19 nt, Homo sapiens
gcccucaagucacaaagua

SEQ ID NO: 770780 - RNA, 19 nt, Homo sapiens
guacagcaccuucaacuuc

SEQ ID NO: 770781 - RNA, 19 nt, Homo sapiens
cuaaaaggcuaaagugaua

SEQ ID NO: 770782 - RNA, 19 nt, Homo sapiens
ggaacacgccaguaauuga

SEQ ID NO: 770783 - RNA, 19 nt, Homo sapiens
cuacucacuuuacaacuuu

SEQ ID NO: 770784 - RNA, 19 nt, Homo sapiens
gcauuugcaauacguaaua

SEQ ID NO: 770785 - RNA, 19 nt, Homo sapiens
uaauagcgcagaccaauga

SEQ ID NO: 770786 - RNA, 19 nt, Homo sapiens
cggcauaaguccuauuuua

SEQ ID NO: 770787 - RNA, 19 nt, Homo sapiens
caguacaguuccuuucuuu

SEQ ID NO: 770788 - RNA, 19 nt, Homo sapiens
agacuucucucucccauca

SEQ ID NO: 770789 - RNA, 19 nt, Homo sapiens
cuucacaccuacucacuuu

SEQ ID NO: 770790 - RNA, 19 nt, Homo sapiens
gaacacgccaguaauugau

SEQ ID NO: 770791 - RNA, 19 nt, Homo sapiens
gcucuaaggccaagacuuc

SEQ ID NO: 770792 - RNA, 19 nt, Homo sapiens
agccuuaccuccugcauuu

SEQ ID NO: 770793 - RNA, 19 nt, Homo sapiens
cuucagagauuccuuaaac

SEQ ID NO: 770794 - RNA, 19 nt, Homo sapiens
gcuccuaacuguggguuga

SEQ ID NO: 770795 - RNA, 19 nt, Homo sapiens
caacagcuuuguauuucuc

SEQ ID NO: 770796 - RNA, 19 nt, Homo sapiens
gcuaccauuuacucguuua

SEQ ID NO: 770797 - RNA, 19 nt, Homo sapiens
aauuugagguuaucugcua

SEQ ID NO: 770798 - RNA, 19 nt, Homo sapiens
agaguugaguucuauguau

SEQ ID NO: 770799 - RNA, 19 nt, Homo sapiens
cgccaguaauugauugaua

SEQ ID NO: 770800 - RNA, 19 nt, Homo sapiens
ucuggaaccuaucauuuga

SEQ ID NO: 770801 - RNA, 19 nt, Homo sapiens
ggaggaaauauuauggaaa

SEQ ID NO: 770802 - RNA, 19 nt, Homo sapiens
gugauaagucucuugcuuu

SEQ ID NO: 770803 - RNA, 19 nt, Homo sapiens
gugcuaccauuuacucguu

SEQ ID NO: 770804 - RNA, 19 nt, Homo sapiens
ccagggcaguaaacacaaa

SEQ ID NO: 770805 - RNA, 19 nt, Homo sapiens
caaaagcccucaagucaca

SEQ ID NO: 770806 - RNA, 19 nt, Homo sapiens
ugauuugugcuaccauuua

SEQ ID NO: 770807 - RNA, 19 nt, Homo sapiens
ggugauuugugcuaccauu

SEQ ID NO: 770808 - RNA, 19 nt, Homo sapiens
ugaaaacucuagcuaaaga

SEQ ID NO: 770809 - RNA, 19 nt, Homo sapiens
ccuacucacuuuacaacuu

SEQ ID NO: 770810 - RNA, 19 nt, Homo sapiens
cccaacagcuuuguauuuc

SEQ ID NO: 770811 - RNA, 19 nt, Homo sapiens
ccaguacaguuccuuucuu

SEQ ID NO: 770812 - RNA, 19 nt, Homo sapiens
gugaguagccaguacaguu

SEQ ID NO: 770813 - RNA, 19 nt, Homo sapiens
guugaaaacucuagcuaaa

SEQ ID NO: 770814 - RNA, 19 nt, Homo sapiens
ccaaugagccuagggagau

SEQ ID NO: 770815 - RNA, 19 nt, Homo sapiens
cagcuucagagauuccuua

SEQ ID NO: 770816 - RNA, 19 nt, Homo sapiens
cuacuccauuucucucaaa

SEQ ID NO: 770817 - RNA, 19 nt, Homo sapiens
ggcaguaaacacaaauauu

SEQ ID NO: 770818 - RNA, 19 nt, Homo sapiens
ggugauggccuccuugagu

SEQ ID NO: 770819 - RNA, 19 nt, Homo sapiens
ggcacucccuccaucuuug

SEQ ID NO: 770820 - RNA, 19 nt, Homo sapiens
gaaaaggagugagaagaca

SEQ ID NO: 770821 - RNA, 19 nt, Homo sapiens
ccaaauauuaacuccagaa

SEQ ID NO: 770822 - RNA, 19 nt, Homo sapiens
gagccuagggagaugcuuu

SEQ ID NO: 770823 - RNA, 19 nt, Homo sapiens
cuaucugucuacuccauuu

SEQ ID NO: 770824 - RNA, 19 nt, Homo sapiens
gauuugugcuaccauuuac

SEQ ID NO: 770825 - RNA, 19 nt, Homo sapiens
acaugcauuccuacuauua

SEQ ID NO: 770826 - RNA, 19 nt, Homo sapiens
gggcaguaaacacaaauau

SEQ ID NO: 770827 - RNA, 19 nt, Homo sapiens
cgaacuggacuugcucuaa

SEQ ID NO: 770828 - RNA, 19 nt, Homo sapiens
gaauaauagcgcagaccaa

SEQ ID NO: 770829 - RNA, 19 nt, Homo sapiens
aggaggaaauauuauggaa

SEQ ID NO: 770830 - RNA, 19 nt, Homo sapiens
ugauaagucucuugcuuuu

SEQ ID NO: 770831 - RNA, 19 nt, Homo sapiens
ccucaagucacaaaguaaa

SEQ ID NO: 770832 - RNA, 19 nt, Homo sapiens
gacauucaaucccagaaaa

SEQ ID NO: 770833 - RNA, 19 nt, Homo sapiens
gaacggcauaaguccuauu

SEQ ID NO: 770834 - RNA, 19 nt, Homo sapiens
ggaggguaguuagagguau

SEQ ID NO: 770835 - RNA, 19 nt, Homo sapiens
agugauaagucucuugcuu

SEQ ID NO: 770836 - RNA, 19 nt, Homo sapiens
uggaaccuaucauuugaau

SEQ ID NO: 770837 - RNA, 19 nt, Homo sapiens
cuuaaaccuuccuaauuuc

SEQ ID NO: 770838 - RNA, 19 nt, Homo sapiens
ugagaguaguauaguagug

SEQ ID NO: 770839 - RNA, 19 nt, Homo sapiens
ccacuccuuucccauuuua

SEQ ID NO: 770840 - RNA, 19 nt, Homo sapiens
cagcauccacuccuucgaa

SEQ ID NO: 770841 - RNA, 19 nt, Homo sapiens
acacgccaguaauugauug

SEQ ID NO: 770842 - RNA, 19 nt, Homo sapiens
gcaauacguaauacugauc

SEQ ID NO: 770843 - RNA, 19 nt, Homo sapiens
cagaguugaguucuaugua

SEQ ID NO: 770844 - RNA, 19 nt, Homo sapiens
ugccagaguugaguucuau

SEQ ID NO: 770845 - RNA, 19 nt, Homo sapiens
caaugagccuagggagaug

SEQ ID NO: 770846 - RNA, 19 nt, Homo sapiens
ccucggaaguuuuaauuug

SEQ ID NO: 770847 - RNA, 19 nt, Homo sapiens
ccaacagcuuuguauuucu

SEQ ID NO: 770848 - RNA, 19 nt, Homo sapiens
ggacaccugagaguaguau

SEQ ID NO: 770849 - RNA, 19 nt, Homo sapiens
ucacaaaguaaaugguuca

SEQ ID NO: 770850 - RNA, 19 nt, Homo sapiens
agacagcagcguuggcaaa

SEQ ID NO: 770851 - RNA, 19 nt, Homo sapiens
aggcuaaagugauaagucu

SEQ ID NO: 770852 - RNA, 19 nt, Homo sapiens
aguaaaugguucaagcaau

SEQ ID NO: 770853 - RNA, 19 nt, Homo sapiens
aaaggagugagaagacaaa

SEQ ID NO: 770854 - RNA, 19 nt, Homo sapiens
uuuacaacuuugcuccuaa

SEQ ID NO: 770855 - RNA, 19 nt, Homo sapiens
gaagacaaagccgucaaag

SEQ ID NO: 770856 - RNA, 19 nt, Homo sapiens
gaugaaaaccucggaaguu

SEQ ID NO: 770857 - RNA, 19 nt, Homo sapiens
guacugggucacagggauu

SEQ ID NO: 770858 - RNA, 19 nt, Homo sapiens
gagaagacaaagccgucaa

SEQ ID NO: 770859 - RNA, 19 nt, Homo sapiens
gagcucccauugccagcau

SEQ ID NO: 770860 - RNA, 19 nt, Homo sapiens
uuaacaugcauuccuacua

SEQ ID NO: 770861 - RNA, 19 nt, Homo sapiens
gcuaaagugauaagucucu

SEQ ID NO: 770862 - RNA, 19 nt, Homo sapiens
uauaaucagcuucagagau

SEQ ID NO: 770863 - RNA, 19 nt, Homo sapiens
gcaaauaacccucaacuga

SEQ ID NO: 770864 - RNA, 19 nt, Homo sapiens
gaaagaggguuuacagaau

SEQ ID NO: 770865 - RNA, 19 nt, Homo sapiens
ccucaucucucuauauuua

SEQ ID NO: 770866 - RNA, 19 nt, Homo sapiens
gcaauucggugaugacuug

SEQ ID NO: 770867 - RNA, 19 nt, Homo sapiens
ucaaugagcugaaggagaa

SEQ ID NO: 770868 - RNA, 19 nt, Homo sapiens
caacaugccuaaucuguau

SEQ ID NO: 770869 - RNA, 19 nt, Homo sapiens
cgaaagaugccaaauuaua

SEQ ID NO: 770870 - RNA, 19 nt, Homo sapiens
cccgaaagaugccaaauua

SEQ ID NO: 770871 - RNA, 19 nt, Homo sapiens
aaagaggguuuacagaaua

SEQ ID NO: 770872 - RNA, 19 nt, Homo sapiens
gaacaaaggcaacgagugu

SEQ ID NO: 770873 - RNA, 19 nt, Homo sapiens
ugacuuacauuaccaauca

SEQ ID NO: 770874 - RNA, 19 nt, Homo sapiens
gcaagacugucgaccuaaa

SEQ ID NO: 770875 - RNA, 19 nt, Homo sapiens
acacagccuugaagcauua

SEQ ID NO: 770876 - RNA, 19 nt, Homo sapiens
gaaaggagacuaccagaag

SEQ ID NO: 770877 - RNA, 19 nt, Homo sapiens
ccaaagccauggaugugua

SEQ ID NO: 770878 - RNA, 19 nt, Homo sapiens
aaauaacccucaacugaaa

SEQ ID NO: 770879 - RNA, 19 nt, Homo sapiens
caaauaacccucaacugaa

SEQ ID NO: 770880 - RNA, 19 nt, Homo sapiens
ccagaaggcuuaugaggau

SEQ ID NO: 770881 - RNA, 19 nt, Homo sapiens
gaaagaugccaaauuauac

SEQ ID NO: 770882 - RNA, 19 nt, Homo sapiens
cagaugugcucaagaaaug

SEQ ID NO: 770883 - RNA, 19 nt, Homo sapiens
ggccucaucucucuauauu

SEQ ID NO: 770884 - RNA, 19 nt, Homo sapiens
gagacuaccagaaggcuua

SEQ ID NO: 770885 - RNA, 19 nt, Homo sapiens
gcacucagcgaacacuuaa

SEQ ID NO: 770886 - RNA, 19 nt, Homo sapiens
ccacuaacaugacuuacau

SEQ ID NO: 770887 - RNA, 19 nt, Homo sapiens
gaaaauucaugaacccuuu

SEQ ID NO: 770888 - RNA, 19 nt, Homo sapiens
gaaaagggcgacuacaaua

SEQ ID NO: 770889 - RNA, 19 nt, Homo sapiens
ggaacgaugccuacaagaa

SEQ ID NO: 770890 - RNA, 19 nt, Homo sapiens
ggcaagggcuauucacgaa

SEQ ID NO: 770891 - RNA, 19 nt, Homo sapiens
cgagaagacuaucgacaga

SEQ ID NO: 770892 - RNA, 19 nt, Homo sapiens
ucaagcagcgguauacuuu

SEQ ID NO: 770893 - RNA, 19 nt, Homo sapiens
gaacgaugccuacaagaag

SEQ ID NO: 770894 - RNA, 19 nt, Homo sapiens
caugaagcauuauacagaa

SEQ ID NO: 770895 - RNA, 19 nt, Homo sapiens
ugaaagaggguuuacagaa

SEQ ID NO: 770896 - RNA, 19 nt, Homo sapiens
gaugaaggacuacaccaaa

SEQ ID NO: 770897 - RNA, 19 nt, Homo sapiens
agaagacuaucgacagauu

SEQ ID NO: 770898 - RNA, 19 nt, Homo sapiens
gaagacacagagacucgua

SEQ ID NO: 770899 - RNA, 19 nt, Homo sapiens
gcagcgguauacuuugaaa

SEQ ID NO: 770900 - RNA, 19 nt, Homo sapiens
uggaagcgaugaaggacua

SEQ ID NO: 770901 - RNA, 19 nt, Homo sapiens
uaacaugacuuacauuacc

SEQ ID NO: 770902 - RNA, 19 nt, Homo sapiens
gacacagccuugaagcauu

SEQ ID NO: 770903 - RNA, 19 nt, Homo sapiens
aaagaauccuguaauagca

SEQ ID NO: 770904 - RNA, 19 nt, Homo sapiens
gcuguaugauggcgcagua

SEQ ID NO: 770905 - RNA, 19 nt, Homo sapiens
aagcagcgguauacuuuga

SEQ ID NO: 770906 - RNA, 19 nt, Homo sapiens
cggcugcucucccauaguu

SEQ ID NO: 770907 - RNA, 19 nt, Homo sapiens
uggaacagaugcagaagga

SEQ ID NO: 770908 - RNA, 19 nt, Homo sapiens
ccauggauguguaccagaa

SEQ ID NO: 770909 - RNA, 19 nt, Homo sapiens
cccaggccaugaagcauua

SEQ ID NO: 770910 - RNA, 19 nt, Homo sapiens
caacuccuacuucaaagaa

SEQ ID NO: 770911 - RNA, 19 nt, Homo sapiens
gaaggccucaucucucuau

SEQ ID NO: 770912 - RNA, 19 nt, Homo sapiens
ccaugaagcauuauacaga

SEQ ID NO: 770913 - RNA, 19 nt, Homo sapiens
cagcagcucuagaguucuu

SEQ ID NO: 770914 - RNA, 19 nt, Homo sapiens
caaccguucugcugccuau

SEQ ID NO: 770915 - RNA, 19 nt, Homo sapiens
gagcguggguaacaucgau

SEQ ID NO: 770916 - RNA, 19 nt, Homo sapiens
cugcaagacugucgaccua

SEQ ID NO: 770917 - RNA, 19 nt, Homo sapiens
gccgggagcuuugugagaa

SEQ ID NO: 770918 - RNA, 19 nt, Homo sapiens
gaagcaggcacugaaagaa

SEQ ID NO: 770919 - RNA, 19 nt, Homo sapiens
ccagcugucucacguuguu

SEQ ID NO: 770920 - RNA, 19 nt, Homo sapiens
caaggacugugaggaaugu

SEQ ID NO: 770921 - RNA, 19 nt, Homo sapiens
ugauagagcagcuacgaaa

SEQ ID NO: 770922 - RNA, 19 nt, Homo sapiens
uaaagaauccuguaauagc

SEQ ID NO: 770923 - RNA, 19 nt, Homo sapiens
ugucucacguuguuuauuc

SEQ ID NO: 770924 - RNA, 19 nt, Homo sapiens
cuauggagcaggucaauga

SEQ ID NO: 770925 - RNA, 19 nt, Homo sapiens
acucguaccugcgcuguuu

SEQ ID NO: 770926 - RNA, 19 nt, Homo sapiens
gagcggcuggccuacauaa

SEQ ID NO: 770927 - RNA, 19 nt, Homo sapiens
cgaguuccaugucucuuuc

SEQ ID NO: 770928 - RNA, 19 nt, Homo sapiens
caaauuauacagcaaucga

SEQ ID NO: 770929 - RNA, 19 nt, Homo sapiens
uggcaacuccuacuucaaa

SEQ ID NO: 770930 - RNA, 19 nt, Homo sapiens
ggaugaggaggaagagauu

SEQ ID NO: 770931 - RNA, 19 nt, Homo sapiens
gcaaucgagcugccugcua

SEQ ID NO: 770932 - RNA, 19 nt, Homo sapiens
ugagaaggccauugaagug

SEQ ID NO: 770933 - RNA, 19 nt, Homo sapiens
uaagaagcaggcacugaaa

SEQ ID NO: 770934 - RNA, 19 nt, Homo sapiens
cagcgaacacuuaaagaau

SEQ ID NO: 770935 - RNA, 19 nt, Homo sapiens
acaaaggcaacgaguguuu

SEQ ID NO: 770936 - RNA, 19 nt, Homo sapiens
gaagacuaucgacagauug

SEQ ID NO: 770937 - RNA, 19 nt, Homo sapiens
guucuuaaaccgcuuugaa

SEQ ID NO: 770938 - RNA, 19 nt, Homo sapiens
ugcagcagaucaugaguga

SEQ ID NO: 770939 - RNA, 19 nt, Homo sapiens
caaggguuauacacggaaa

SEQ ID NO: 770940 - RNA, 19 nt, Homo sapiens
uagagcagcuacgaaacaa

SEQ ID NO: 770941 - RNA, 19 nt, Homo sapiens
ucaacaugccuaaucugua

SEQ ID NO: 770942 - RNA, 19 nt, Homo sapiens
uuaaaccgcuuugaagaag

SEQ ID NO: 770943 - RNA, 19 nt, Homo sapiens
ccaguugggcgugguuaua

SEQ ID NO: 770944 - RNA, 19 nt, Homo sapiens
ucagcgaacacuuaaagaa

SEQ ID NO: 770945 - RNA, 19 nt, Homo sapiens
ccaaucaagcagcgguaua

SEQ ID NO: 770946 - RNA, 19 nt, Homo sapiens
cagagccaauggaagaaga

SEQ ID NO: 770947 - RNA, 19 nt, Homo sapiens
ggaggaagagauugcaaca

SEQ ID NO: 770948 - RNA, 19 nt, Homo sapiens
gcaggucaaugagcugaag

SEQ ID NO: 770949 - RNA, 19 nt, Homo sapiens
cacagaagauccagaagcu

SEQ ID NO: 770950 - RNA, 19 nt, Homo sapiens
ccagaugugcucaagaaau

SEQ ID NO: 770951 - RNA, 19 nt, Homo sapiens
gcagagagaaaauucauga

SEQ ID NO: 770952 - RNA, 19 nt, Homo sapiens
uaaaacacgaggcaaauaa

SEQ ID NO: 770953 - RNA, 19 nt, Homo sapiens
caagggcuauucacgaaaa

SEQ ID NO: 770954 - RNA, 19 nt, Homo sapiens
ggcacucagcgaacacuua

SEQ ID NO: 770955 - RNA, 19 nt, Homo sapiens
gaauuggcaacuccuacuu

SEQ ID NO: 770956 - RNA, 19 nt, Homo sapiens
gcaagggcuauucacgaaa

SEQ ID NO: 770957 - RNA, 19 nt, Homo sapiens
gcaacuccuacuucaaaga

SEQ ID NO: 770958 - RNA, 19 nt, Homo sapiens
gacagauugccaaagcaua

SEQ ID NO: 770959 - RNA, 19 nt, Homo sapiens
gacccagccaugcgccuua

SEQ ID NO: 770960 - RNA, 19 nt, Homo sapiens
gugcuacuccgaagcuauu

SEQ ID NO: 770961 - RNA, 19 nt, Homo sapiens
gaaggagaaaggcaacaag

SEQ ID NO: 770962 - RNA, 19 nt, Homo sapiens
uagcacagaagauccagaa

SEQ ID NO: 770963 - RNA, 19 nt, Homo sapiens
gaagcaaguucacaaagaa

SEQ ID NO: 770964 - RNA, 19 nt, Homo sapiens
gagauaaguugccuugauu

SEQ ID NO: 770965 - RNA, 19 nt, Homo sapiens
ccagacagauaucaguuua

SEQ ID NO: 770966 - RNA, 19 nt, Homo sapiens
ccacugaaauagaaacuuu

SEQ ID NO: 770967 - RNA, 19 nt, Homo sapiens
cgucagggauguacuauaa

SEQ ID NO: 770968 - RNA, 19 nt, Homo sapiens
uaaguugccuugauucuga

SEQ ID NO: 770969 - RNA, 19 nt, Homo sapiens
ggucaugaauguccauaaa

SEQ ID NO: 770970 - RNA, 19 nt, Homo sapiens
ugaggaaacuggugcaauu

SEQ ID NO: 770971 - RNA, 19 nt, Homo sapiens
ugacaccacugaaauagaa

SEQ ID NO: 770972 - RNA, 19 nt, Homo sapiens
ggagguagcauugaagaua

SEQ ID NO: 770973 - RNA, 19 nt, Homo sapiens
ccacagaucucuuaagaac

SEQ ID NO: 770974 - RNA, 19 nt, Homo sapiens
caacaagauugacauggaa

SEQ ID NO: 770975 - RNA, 19 nt, Homo sapiens
caacuggugugucguuuau

SEQ ID NO: 770976 - RNA, 19 nt, Homo sapiens
ggaagccacagaucucuua

SEQ ID NO: 770977 - RNA, 19 nt, Homo sapiens
gaagugacaacaagauuga

SEQ ID NO: 770978 - RNA, 19 nt, Homo sapiens
gagaagcggugggcuaaga

SEQ ID NO: 770979 - RNA, 19 nt, Homo sapiens
guagaucuaugacuucuca

SEQ ID NO: 770980 - RNA, 19 nt, Homo sapiens
uuaaacagauugugaguuc

SEQ ID NO: 770981 - RNA, 19 nt, Homo sapiens
uuacuaaaguggaugauug

SEQ ID NO: 770982 - RNA, 19 nt, Homo sapiens
ucacagagcuuagcacagu

SEQ ID NO: 770983 - RNA, 19 nt, Homo sapiens
gagguagcauugaagauau

SEQ ID NO: 770984 - RNA, 19 nt, Homo sapiens
acagaucucuuaagaacuu

SEQ ID NO: 770985 - RNA, 19 nt, Homo sapiens
gaacaguuaauccucaauu

SEQ ID NO: 770986 - RNA, 19 nt, Homo sapiens
gaacagucauaucucaagu

SEQ ID NO: 770987 - RNA, 19 nt, Homo sapiens
guauuaaacugugguauag

SEQ ID NO: 770988 - RNA, 19 nt, Homo sapiens
ucaauucagucaagucuau

SEQ ID NO: 770989 - RNA, 19 nt, Homo sapiens
auagacaucugcuucuuaa

SEQ ID NO: 770990 - RNA, 19 nt, Homo sapiens
guaaugagcaagcauacuu

SEQ ID NO: 770991 - RNA, 19 nt, Homo sapiens
cuacagagccaaaugauuc

SEQ ID NO: 770992 - RNA, 19 nt, Homo sapiens
agucauaucucaaguucaa

SEQ ID NO: 770993 - RNA, 19 nt, Homo sapiens
cuguguggcuuaugucuua

SEQ ID NO: 770994 - RNA, 19 nt, Homo sapiens
uauguggccuugcuuacua

SEQ ID NO: 770995 - RNA, 19 nt, Homo sapiens
gaauuaaggauaaccuaga

SEQ ID NO: 770996 - RNA, 19 nt, Homo sapiens
guacuggugugccgcaaug

SEQ ID NO: 770997 - RNA, 19 nt, Homo sapiens
ugagauaaguugccuugau

SEQ ID NO: 770998 - RNA, 19 nt, Homo sapiens
aaccguggcugcucgauaa

SEQ ID NO: 770999 - RNA, 19 nt, Homo sapiens
uugacaaucucuacucuaa

SEQ ID NO: 771000 - RNA, 19 nt, Homo sapiens
caccugagcauucuacuuu

SEQ ID NO: 771001 - RNA, 19 nt, Homo sapiens
gagcaggacugugcaugga

SEQ ID NO: 771002 - RNA, 19 nt, Homo sapiens
gcaacugcuuggaaauguu

SEQ ID NO: 771003 - RNA, 19 nt, Homo sapiens
ggaagugacaacaagauug

SEQ ID NO: 771004 - RNA, 19 nt, Homo sapiens
gacaucugcuucuuaaaca

SEQ ID NO: 771005 - RNA, 19 nt, Homo sapiens
gcaaguucacaaagaagua

SEQ ID NO: 771006 - RNA, 19 nt, Homo sapiens
gcagacaucagagacuaua

SEQ ID NO: 771007 - RNA, 19 nt, Homo sapiens
ccuuuaugcuuggaaauua

SEQ ID NO: 771008 - RNA, 19 nt, Homo sapiens
gauuguagccuuuaugcuu

SEQ ID NO: 771009 - RNA, 19 nt, Homo sapiens
gaagauaugguugaaagau

SEQ ID NO: 771010 - RNA, 19 nt, Homo sapiens
gcauauguggccuugcuua

SEQ ID NO: 771011 - RNA, 19 nt, Homo sapiens
gacaaucucuacucuaaaa

SEQ ID NO: 771012 - RNA, 19 nt, Homo sapiens
caaaugauucccuaugguu

SEQ ID NO: 771013 - RNA, 19 nt, Homo sapiens
acaacaagauugacaugga

SEQ ID NO: 771014 - RNA, 19 nt, Homo sapiens
aaacaugaguagaucuaug

SEQ ID NO: 771015 - RNA, 19 nt, Homo sapiens
gcaacuggugugucguuua

SEQ ID NO: 771016 - RNA, 19 nt, Homo sapiens
gauugugaguucuuugaga

SEQ ID NO: 771017 - RNA, 19 nt, Homo sapiens
cauauuuccguaccauuua

SEQ ID NO: 771018 - RNA, 19 nt, Homo sapiens
aaacugugguauagcauau

SEQ ID NO: 771019 - RNA, 19 nt, Homo sapiens
uagcagacaucagagacua

SEQ ID NO: 771020 - RNA, 19 nt, Homo sapiens
uggcuuacauugauuacaa

SEQ ID NO: 771021 - RNA, 19 nt, Homo sapiens
ggaaacuggugcaauugag

SEQ ID NO: 771022 - RNA, 19 nt, Homo sapiens
uaaccuagacgacauaaag

SEQ ID NO: 771023 - RNA, 19 nt, Homo sapiens
cuuugagucuucucuauaa

SEQ ID NO: 771024 - RNA, 19 nt, Homo sapiens
caauggaagugacaacaag

SEQ ID NO: 771025 - RNA, 19 nt, Homo sapiens
ugagaaacagcguggauuu

SEQ ID NO: 771026 - RNA, 19 nt, Homo sapiens
gaagcggugggcuaagaua

SEQ ID NO: 771027 - RNA, 19 nt, Homo sapiens
gggauguacuauaacaaug

SEQ ID NO: 771028 - RNA, 19 nt, Homo sapiens
caguuucugugacaucuuu

SEQ ID NO: 771029 - RNA, 19 nt, Homo sapiens
ccuagaaacagauauagaa

SEQ ID NO: 771030 - RNA, 19 nt, Homo sapiens
ccagagagcacagaaauag

SEQ ID NO: 771031 - RNA, 19 nt, Homo sapiens
gucaguauuuggaauguga

SEQ ID NO: 771032 - RNA, 19 nt, Homo sapiens
aaaugacaccacugaaaua

SEQ ID NO: 771033 - RNA, 19 nt, Homo sapiens
caacugcuuggaaauguuu

SEQ ID NO: 771034 - RNA, 19 nt, Homo sapiens
gaaacuggugcaauugaga

SEQ ID NO: 771035 - RNA, 19 nt, Homo sapiens
ggaaauuaugcuucagauu

SEQ ID NO: 771036 - RNA, 19 nt, Homo sapiens
ccauuuauguugugugaca

SEQ ID NO: 771037 - RNA, 19 nt, Homo sapiens
uaaaucagacagaacaguu

SEQ ID NO: 771038 - RNA, 19 nt, Homo sapiens
guacuauaacaauggcuua

SEQ ID NO: 771039 - RNA, 19 nt, Homo sapiens
caauuuaagccugaucuaa

SEQ ID NO: 771040 - RNA, 19 nt, Homo sapiens
ccauauuuccguaccauuu

SEQ ID NO: 771041 - RNA, 19 nt, Homo sapiens
gccaaaugauucccuaugg

SEQ ID NO: 771042 - RNA, 19 nt, Homo sapiens
ucagggauguacuauaaca

SEQ ID NO: 771043 - RNA, 19 nt, Homo sapiens
uauagacaucugcuucuua

SEQ ID NO: 771044 - RNA, 19 nt, Homo sapiens
guauagacaucugcuucuu

SEQ ID NO: 771045 - RNA, 19 nt, Homo sapiens
caauucaguuucugugaca

SEQ ID NO: 771046 - RNA, 19 nt, Homo sapiens
cgacauaaagaggauaauu

SEQ ID NO: 771047 - RNA, 19 nt, Homo sapiens
ggauaaccuagacgacaua

SEQ ID NO: 771048 - RNA, 19 nt, Homo sapiens
gguuggaaauuaugcuuca

SEQ ID NO: 771049 - RNA, 19 nt, Homo sapiens
guugaaggaauuaaggaua

SEQ ID NO: 771050 - RNA, 19 nt, Homo sapiens
ucauggagguagcauugaa

SEQ ID NO: 771051 - RNA, 19 nt, Homo sapiens
agccacagaucucuuaaga

SEQ ID NO: 771052 - RNA, 19 nt, Homo sapiens
gcauugaagauaugguuga

SEQ ID NO: 771053 - RNA, 19 nt, Homo sapiens
agagcuaugugaguacuaa

SEQ ID NO: 771054 - RNA, 19 nt, Homo sapiens
acagucauaucucaaguuc

SEQ ID NO: 771055 - RNA, 19 nt, Homo sapiens
ucucaaagccgggucauga

SEQ ID NO: 771056 - RNA, 19 nt, Homo sapiens
gaaguauuaaacuguggua

SEQ ID NO: 771057 - RNA, 19 nt, Homo sapiens
caauuacaccugagcauuc

SEQ ID NO: 771058 - RNA, 19 nt, Homo sapiens
ucugauaccaccagcauaa

SEQ ID NO: 771059 - RNA, 19 nt, Homo sapiens
agauugacauggaaugaug

SEQ ID NO: 771060 - RNA, 19 nt, Homo sapiens
ccaaaugauucccuauggu

SEQ ID NO: 771061 - RNA, 19 nt, Homo sapiens
uuacagcccugcauuugag

SEQ ID NO: 771062 - RNA, 19 nt, Homo sapiens
uaaacugugguauagcaua

SEQ ID NO: 771063 - RNA, 19 nt, Homo sapiens
ggaaacaucugccacauuu

SEQ ID NO: 771064 - RNA, 19 nt, Homo sapiens
ggaaacaacuccagacuuu

SEQ ID NO: 771065 - RNA, 19 nt, Homo sapiens
ggaaggaccugaccagaag

SEQ ID NO: 771066 - RNA, 19 nt, Homo sapiens
caacagaaaucgcaucaag

SEQ ID NO: 771067 - RNA, 19 nt, Homo sapiens
gaggguagcuuuccaacau

SEQ ID NO: 771068 - RNA, 19 nt, Homo sapiens
gcaucaaggugaccaaaga

SEQ ID NO: 771069 - RNA, 19 nt, Homo sapiens
gagguggccugcuggagua

SEQ ID NO: 771070 - RNA, 19 nt, Homo sapiens
gaccaaagauggcuaugca

SEQ ID NO: 771071 - RNA, 19 nt, Homo sapiens
agagugaguucuaugcuaa

SEQ ID NO: 771072 - RNA, 19 nt, Homo sapiens
gaggaugucuaacaagcuu

SEQ ID NO: 771073 - RNA, 19 nt, Homo sapiens
caauggagccugaagaguu

SEQ ID NO: 771074 - RNA, 19 nt, Homo sapiens
agacagcucugcccuagug

SEQ ID NO: 771075 - RNA, 19 nt, Homo sapiens
gcuaaucucuccuggaaac

SEQ ID NO: 771076 - RNA, 19 nt, Homo sapiens
caacauaaaguggagguuu

SEQ ID NO: 771077 - RNA, 19 nt, Homo sapiens
gcucagucaucccgaggua

SEQ ID NO: 771078 - RNA, 19 nt, Homo sapiens
agacagggcacuauauuga

SEQ ID NO: 771079 - RNA, 19 nt, Homo sapiens
gcagguuggucagaucauu

SEQ ID NO: 771080 - RNA, 19 nt, Homo sapiens
ucagguggaugcuuggaaa

SEQ ID NO: 771081 - RNA, 19 nt, Homo sapiens
ggguagcuuuccaacauaa

SEQ ID NO: 771082 - RNA, 19 nt, Homo sapiens
gaaacaucugccacauuua

SEQ ID NO: 771083 - RNA, 19 nt, Homo sapiens
gaguugggcugcuuggaau

SEQ ID NO: 771084 - RNA, 19 nt, Homo sapiens
gguaaaagguccaggaguu

SEQ ID NO: 771085 - RNA, 19 nt, Homo sapiens
guguguauguguauucauu

SEQ ID NO: 771086 - RNA, 19 nt, Homo sapiens
uaagcaaguuccagugugu

SEQ ID NO: 771087 - RNA, 19 nt, Homo sapiens
ggaguugggcugcuuggaa

SEQ ID NO: 771088 - RNA, 19 nt, Homo sapiens
ccgagaggaugucuaacaa

SEQ ID NO: 771089 - RNA, 19 nt, Homo sapiens
ccagagacagggcacuaua

SEQ ID NO: 771090 - RNA, 19 nt, Homo sapiens
aagaagccaugaacuacuu

SEQ ID NO: 771091 - RNA, 19 nt, Homo sapiens
uugcuaaucucuccuggaa

SEQ ID NO: 771092 - RNA, 19 nt, Homo sapiens
caacggcucuguggccaau

SEQ ID NO: 771093 - RNA, 19 nt, Homo sapiens
caacacaggagacuuuaag

SEQ ID NO: 771094 - RNA, 19 nt, Homo sapiens
gagacagggcacuauauug

SEQ ID NO: 771095 - RNA, 19 nt, Homo sapiens
guuccagugugucuauauu

SEQ ID NO: 771096 - RNA, 19 nt, Homo sapiens
aagagugaguucuaugcua

SEQ ID NO: 771097 - RNA, 19 nt, Homo sapiens
aaacaucugccacauuuag

SEQ ID NO: 771098 - RNA, 19 nt, Homo sapiens
aaagauggcuaugcagaca

SEQ ID NO: 771099 - RNA, 19 nt, Homo sapiens
ugaacuacuugcucaguca

SEQ ID NO: 771100 - RNA, 19 nt, Homo sapiens
gguggaugcuuggaaacaa

SEQ ID NO: 771101 - RNA, 19 nt, Homo sapiens
gaagaagccaugaacuacu

SEQ ID NO: 771102 - RNA, 19 nt, Homo sapiens
uaaaguggagguuucaaca

SEQ ID NO: 771103 - RNA, 19 nt, Homo sapiens
ucauguggccucucuguug

SEQ ID NO: 771104 - RNA, 19 nt, Homo sapiens
gaucauguggccucucugu

SEQ ID NO: 771105 - RNA, 19 nt, Homo sapiens
ggugagcucugccuuucca

SEQ ID NO: 771106 - RNA, 19 nt, Homo sapiens
cagguuggucagaucauua

SEQ ID NO: 771107 - RNA, 19 nt, Homo sapiens
aauggagccugaagaguuc

SEQ ID NO: 771108 - RNA, 19 nt, Homo sapiens
caaguuccagugugucuau

SEQ ID NO: 771109 - RNA, 19 nt, Homo sapiens
uauugagccuccuuacuuc

SEQ ID NO: 771110 - RNA, 19 nt, Homo sapiens
gccuuuccauggccucuuu

SEQ ID NO: 771111 - RNA, 19 nt, Homo sapiens
uugaagaagccaugaacua

SEQ ID NO: 771112 - RNA, 19 nt, Homo sapiens
ggacgaaccggugcgaauc

SEQ ID NO: 771113 - RNA, 19 nt, Homo sapiens
aaacaacuccagacuuucu

SEQ ID NO: 771114 - RNA, 19 nt, Homo sapiens
ggugggcaguccuauuauc

SEQ ID NO: 771115 - RNA, 19 nt, Homo sapiens
uuggugggcaguccuauua

SEQ ID NO: 771116 - RNA, 19 nt, Homo sapiens
gaccugaccagaagagcuu

SEQ ID NO: 771117 - RNA, 19 nt, Homo sapiens
agauggcuaugcagacauu

SEQ ID NO: 771118 - RNA, 19 nt, Homo sapiens
uuuaguguguguaugugua

SEQ ID NO: 771119 - RNA, 19 nt, Homo sapiens
cacaggagacuuuaagcaa

SEQ ID NO: 771120 - RNA, 19 nt, Homo sapiens
agagacagggcacuauauu

SEQ ID NO: 771121 - RNA, 19 nt, Homo sapiens
uccagugugucuauauuug

SEQ ID NO: 771122 - RNA, 19 nt, Homo sapiens
ggaagagugaguucuaugc

SEQ ID NO: 771123 - RNA, 19 nt, Homo sapiens
ucagucaucccgagguaaa

SEQ ID NO: 771124 - RNA, 19 nt, Homo sapiens
ugucauggcucagguggau

SEQ ID NO: 771125 - RNA, 19 nt, Homo sapiens
aacauaaaguggagguuuc

SEQ ID NO: 771126 - RNA, 19 nt, Homo sapiens
agagagcaccuuccuguuc

SEQ ID NO: 771127 - RNA, 19 nt, Homo sapiens
ggagaaagccccagaucau

SEQ ID NO: 771128 - RNA, 19 nt, Homo sapiens
gaagaguucggcgcaguuc

SEQ ID NO: 771129 - RNA, 19 nt, Homo sapiens
uuucaacacaggagacuuu

SEQ ID NO: 771130 - RNA, 19 nt, Homo sapiens
auauugagccuccuuacuu

SEQ ID NO: 771131 - RNA, 19 nt, Homo sapiens
ugaguucuaugcuaaugag

SEQ ID NO: 771132 - RNA, 19 nt, Homo sapiens
acagaaaucgcaucaaggu

SEQ ID NO: 771133 - RNA, 19 nt, Homo sapiens
gaggcagguuggucagauc

SEQ ID NO: 771134 - RNA, 19 nt, Homo sapiens
uggaaggaccugaccagaa

SEQ ID NO: 771135 - RNA, 19 nt, Homo sapiens
aaguggagguuucaacaca

SEQ ID NO: 771136 - RNA, 19 nt, Homo sapiens
cgucccggcuguaccaaug

SEQ ID NO: 771137 - RNA, 19 nt, Homo sapiens
ugaagaagccaugaacuac

SEQ ID NO: 771138 - RNA, 19 nt, Homo sapiens
caucuggaguacuuugaag

SEQ ID NO: 771139 - RNA, 19 nt, Homo sapiens
cagagacagggcacuauau

SEQ ID NO: 771140 - RNA, 19 nt, Homo sapiens
aggguagcuuuccaacaua

SEQ ID NO: 771141 - RNA, 19 nt, Homo sapiens
agacuuucuuccacaaaca

SEQ ID NO: 771142 - RNA, 19 nt, Homo sapiens
gaagagugaguucuaugcu

SEQ ID NO: 771143 - RNA, 19 nt, Homo sapiens
cauggccucuuuccugaag

SEQ ID NO: 771144 - RNA, 19 nt, Homo sapiens
gggacgaaccggugcgaau

SEQ ID NO: 771145 - RNA, 19 nt, Homo sapiens
gaugaccacaacuggaaga

SEQ ID NO: 771146 - RNA, 19 nt, Homo sapiens
cggcugcugucgucaucaa

SEQ ID NO: 771147 - RNA, 19 nt, Homo sapiens
gcaaguuccagugugucua

SEQ ID NO: 771148 - RNA, 19 nt, Homo sapiens
gcuaaugaggccuguaaac

SEQ ID NO: 771149 - RNA, 19 nt, Homo sapiens
gaaggaccugaccagaaga

SEQ ID NO: 771150 - RNA, 19 nt, Homo sapiens
ggccuuggagcccgagaaa

SEQ ID NO: 771151 - RNA, 19 nt, Homo sapiens
ugaggcagguuggucagau

SEQ ID NO: 771152 - RNA, 19 nt, Homo sapiens
gaacuacuugcucagucau

SEQ ID NO: 771153 - RNA, 19 nt, Homo sapiens
gggaaggguuuugcuguga

SEQ ID NO: 771154 - RNA, 19 nt, Homo sapiens
ucaacacaggagacuuuaa

SEQ ID NO: 771155 - RNA, 19 nt, Homo sapiens
uggccucucuguugcuaau

SEQ ID NO: 771156 - RNA, 19 nt, Homo sapiens
cagacuuucuuccacaaac

SEQ ID NO: 771157 - RNA, 19 nt, Homo sapiens
uggaaacaucugccacauu

SEQ ID NO: 771158 - RNA, 19 nt, Homo sapiens
cauuguggauguccugaac

SEQ ID NO: 771159 - RNA, 19 nt, Homo sapiens
guugggcugcuuggaauuu

SEQ ID NO: 771160 - RNA, 19 nt, Homo sapiens
gaaggguuuugcugugaug

SEQ ID NO: 771161 - RNA, 19 nt, Homo sapiens
gaagagcuguuucaguaaa

SEQ ID NO: 771162 - RNA, 19 nt, Homo sapiens
ccaaagauaccucuaguua

SEQ ID NO: 771163 - RNA, 19 nt, Homo sapiens
aaagauaccucuaguuaug

SEQ ID NO: 771164 - RNA, 19 nt, Homo sapiens
aggaagagcuguuucagua

SEQ ID NO: 771165 - RNA, 19 nt, Homo sapiens
gaacacagccagcacaguu

SEQ ID NO: 771166 - RNA, 19 nt, Homo sapiens
gauauuggagugauuagua

SEQ ID NO: 771167 - RNA, 19 nt, Homo sapiens
agaaacagcugcaaaauuu

SEQ ID NO: 771168 - RNA, 19 nt, Homo sapiens
uaagaacggugauauugga

SEQ ID NO: 771169 - RNA, 19 nt, Homo sapiens
ggaaggcacugaaagaaac

SEQ ID NO: 771170 - RNA, 19 nt, Homo sapiens
guacucugcucgacucuug

SEQ ID NO: 771171 - RNA, 19 nt, Homo sapiens
gaaugcugcuugcgaaugu

SEQ ID NO: 771172 - RNA, 19 nt, Homo sapiens
gaagccaccucaaguccuu

SEQ ID NO: 771173 - RNA, 19 nt, Homo sapiens
ucacggagcuggccaggau

SEQ ID NO: 771174 - RNA, 19 nt, Homo sapiens
gcaugaagcucuuguuuuc

SEQ ID NO: 771175 - RNA, 19 nt, Homo sapiens
ggauuaaggagaucgauga

SEQ ID NO: 771176 - RNA, 19 nt, Homo sapiens
ggaagaaaaugccaaagau

SEQ ID NO: 771177 - RNA, 19 nt, Homo sapiens
ggaagagcuguuucaguaa

SEQ ID NO: 771178 - RNA, 19 nt, Homo sapiens
caaagauaccucuaguuau

SEQ ID NO: 771179 - RNA, 19 nt, Homo sapiens
gaagaaaaugccaaagaua

SEQ ID NO: 771180 - RNA, 19 nt, Homo sapiens
gagguuaugugcaacugau

SEQ ID NO: 771181 - RNA, 19 nt, Homo sapiens
uaaggaaggcacugaaaga

SEQ ID NO: 771182 - RNA, 19 nt, Homo sapiens
gggaagauuuuguaccaua

SEQ ID NO: 771183 - RNA, 19 nt, Homo sapiens
gaaagaaacacggcggaau

SEQ ID NO: 771184 - RNA, 19 nt, Homo sapiens
auaaaacgcugcagaugua

SEQ ID NO: 771185 - RNA, 19 nt, Homo sapiens
caauggaauuugagaagca

SEQ ID NO: 771186 - RNA, 19 nt, Homo sapiens
gaaacacggcggaaucucu

SEQ ID NO: 771187 - RNA, 19 nt, Homo sapiens
ggugauauuggagugauua

SEQ ID NO: 771188 - RNA, 19 nt, Homo sapiens
cggcauugaucgauggauu

SEQ ID NO: 771189 - RNA, 19 nt, Homo sapiens
gcagcgggauaauuuagag

SEQ ID NO: 771190 - RNA, 19 nt, Homo sapiens
ggucagcccucugugcaau

SEQ ID NO: 771191 - RNA, 19 nt, Homo sapiens
gcauugaucgauggauuaa

SEQ ID NO: 771192 - RNA, 19 nt, Homo sapiens
ggcauugaucgauggauua

SEQ ID NO: 771193 - RNA, 19 nt, Homo sapiens
ggucaaggaagagcuguuu

SEQ ID NO: 771194 - RNA, 19 nt, Homo sapiens
gcgaaccgcuggucuuuug

SEQ ID NO: 771195 - RNA, 19 nt, Homo sapiens
gauccuggucuaugacauu

SEQ ID NO: 771196 - RNA, 19 nt, Homo sapiens
aauggcagcgggauaauuu

SEQ ID NO: 771197 - RNA, 19 nt, Homo sapiens
cuacguggaugugcaugaa

SEQ ID NO: 771198 - RNA, 19 nt, Homo sapiens
gaucuguccaguuugugua

SEQ ID NO: 771199 - RNA, 19 nt, Homo sapiens
gcucgacucuugguaacau

SEQ ID NO: 771200 - RNA, 19 nt, Homo sapiens
gugcaugaagcucuuguuu

SEQ ID NO: 771201 - RNA, 19 nt, Homo sapiens
ggaugugcaugaagcucuu

SEQ ID NO: 771202 - RNA, 19 nt, Homo sapiens
uguaagaacggugauauug

SEQ ID NO: 771203 - RNA, 19 nt, Homo sapiens
ggacuucgaauuucuacgu

SEQ ID NO: 771204 - RNA, 19 nt, Homo sapiens
gcaauuucaacaucacaga

SEQ ID NO: 771205 - RNA, 19 nt, Homo sapiens
gauaauuuagagucacuga

SEQ ID NO: 771206 - RNA, 19 nt, Homo sapiens
ucagcccucugugcaauuu

SEQ ID NO: 771207 - RNA, 19 nt, Homo sapiens
gugugauccuggucuauga

SEQ ID NO: 771208 - RNA, 19 nt, Homo sapiens
guaagaacggugauauugg

SEQ ID NO: 771209 - RNA, 19 nt, Homo sapiens
gcgggauaauuuagaguca

SEQ ID NO: 771210 - RNA, 19 nt, Homo sapiens
caggagaagcucggcguua

SEQ ID NO: 771211 - RNA, 19 nt, Homo sapiens
aaagaaacacggcggaauc

SEQ ID NO: 771212 - RNA, 19 nt, Homo sapiens
cugcagauguagagguuau

SEQ ID NO: 771213 - RNA, 19 nt, Homo sapiens
uuaugaagcuaagggaaga

SEQ ID NO: 771214 - RNA, 19 nt, Homo sapiens
cuacaaguuaugaagcuaa

SEQ ID NO: 771215 - RNA, 19 nt, Homo sapiens
uaagaagccaccucaaguc

SEQ ID NO: 771216 - RNA, 19 nt, Homo sapiens
ucaaggaagagcuguuuca

SEQ ID NO: 771217 - RNA, 19 nt, Homo sapiens
agauaccucuaguuauguu

SEQ ID NO: 771218 - RNA, 19 nt, Homo sapiens
ggaagauuuuguaccauau

SEQ ID NO: 771219 - RNA, 19 nt, Homo sapiens
gagcagccuccgcaaagug

SEQ ID NO: 771220 - RNA, 19 nt, Homo sapiens
uuaagaagccaccucaagu

SEQ ID NO: 771221 - RNA, 19 nt, Homo sapiens
gggauaauuuagagucacu

SEQ ID NO: 771222 - RNA, 19 nt, Homo sapiens
caguaaagaaugaagugaa

SEQ ID NO: 771223 - RNA, 19 nt, Homo sapiens
guacaagauauucuacaag

SEQ ID NO: 771224 - RNA, 19 nt, Homo sapiens
uagagucacugauauuacg

SEQ ID NO: 771225 - RNA, 19 nt, Homo sapiens
cugcagcucugggauacuu

SEQ ID NO: 771226 - RNA, 19 nt, Homo sapiens
caccagcuccacccacaaa

SEQ ID NO: 771227 - RNA, 19 nt, Homo sapiens
gcagauguagagguuaugu

SEQ ID NO: 771228 - RNA, 19 nt, Homo sapiens
guaaaccuccuuuucaaug

SEQ ID NO: 771229 - RNA, 19 nt, Homo sapiens
gguaacaugaaauucugaa

SEQ ID NO: 771230 - RNA, 19 nt, Homo sapiens
cgucggacuucgaauuucu

SEQ ID NO: 771231 - RNA, 19 nt, Homo sapiens
gaaggcacugaaagaaaca

SEQ ID NO: 771232 - RNA, 19 nt, Homo sapiens
caccagaaacagcugcaaa

SEQ ID NO: 771233 - RNA, 19 nt, Homo sapiens
caauggcagcgggauaauu

SEQ ID NO: 771234 - RNA, 19 nt, Homo sapiens
gagcuguuucaguaaagaa

SEQ ID NO: 771235 - RNA, 19 nt, Homo sapiens
ugccaaagauaccucuagu

SEQ ID NO: 771236 - RNA, 19 nt, Homo sapiens
gaauuucuacguggaugug

SEQ ID NO: 771237 - RNA, 19 nt, Homo sapiens
aggaaggcacugaaagaaa

SEQ ID NO: 771238 - RNA, 19 nt, Homo sapiens
gccaaagauaccucuaguu

SEQ ID NO: 771239 - RNA, 19 nt, Homo sapiens
ggugugauccuggucuaug

SEQ ID NO: 771240 - RNA, 19 nt, Homo sapiens
gggaagaaaaugccaaaga

SEQ ID NO: 771241 - RNA, 19 nt, Homo sapiens
guuuguguaugaaauggau

SEQ ID NO: 771242 - RNA, 19 nt, Homo sapiens
auguagagguuaugugcaa

SEQ ID NO: 771243 - RNA, 19 nt, Homo sapiens
gacucuugguaacaugaaa

SEQ ID NO: 771244 - RNA, 19 nt, Homo sapiens
cagaaacagcugcaaaauu

SEQ ID NO: 771245 - RNA, 19 nt, Homo sapiens
cuguuucaguaaagaauga

SEQ ID NO: 771246 - RNA, 19 nt, Homo sapiens
gaagcuaagggaagaaaau

SEQ ID NO: 771247 - RNA, 19 nt, Homo sapiens
gggcgugaccuucuuugag

SEQ ID NO: 771248 - RNA, 19 nt, Homo sapiens
gcaauggcagcgggauaau

SEQ ID NO: 771249 - RNA, 19 nt, Homo sapiens
ucugugcaauuucaacauc

SEQ ID NO: 771250 - RNA, 19 nt, Homo sapiens
ccaguuuguguaugaaaug

SEQ ID NO: 771251 - RNA, 19 nt, Homo sapiens
ugcgacgccuuccguguga

SEQ ID NO: 771252 - RNA, 19 nt, Homo sapiens
aaggaaggcacugaaagaa

SEQ ID NO: 771253 - RNA, 19 nt, Homo sapiens
uucgacaggucaaggaaga

SEQ ID NO: 771254 - RNA, 19 nt, Homo sapiens
ucuacaaguuaugaagcua

SEQ ID NO: 771255 - RNA, 19 nt, Homo sapiens
gccugcaccuggcguucaa

SEQ ID NO: 771256 - RNA, 19 nt, Homo sapiens
cgaaugcugcuugcgaaug

SEQ ID NO: 771257 - RNA, 19 nt, Homo sapiens
gacagaagcugcagacuaa

SEQ ID NO: 771258 - RNA, 19 nt, Homo sapiens
ggagagcuaugaugaugua

SEQ ID NO: 771259 - RNA, 19 nt, Homo sapiens
ggagaaagcccauaugaug

SEQ ID NO: 771260 - RNA, 19 nt, Homo sapiens
gcaagaaagggucaaauaa

SEQ ID NO: 771261 - RNA, 19 nt, Homo sapiens
caagaggccuggcaagaaa

SEQ ID NO: 771262 - RNA, 19 nt, Homo sapiens
gaaugaagacucgcaauuu

SEQ ID NO: 771263 - RNA, 19 nt, Homo sapiens
caagagagaagaugaagaa

SEQ ID NO: 771264 - RNA, 19 nt, Homo sapiens
gagagaagaugaagaacag

SEQ ID NO: 771265 - RNA, 19 nt, Homo sapiens
aagaaagggucaaauaaga

SEQ ID NO: 771266 - RNA, 19 nt, Homo sapiens
gaacaagagagaagaugaa

SEQ ID NO: 771267 - RNA, 19 nt, Homo sapiens
ccagaaagcuguugaucca

SEQ ID NO: 771268 - RNA, 19 nt, Homo sapiens
gaaaggcuucucugauaaa

SEQ ID NO: 771269 - RNA, 19 nt, Homo sapiens
ggaaugaagacucgcaauu

SEQ ID NO: 771270 - RNA, 19 nt, Homo sapiens
gagaaagcccauaugauga

SEQ ID NO: 771271 - RNA, 19 nt, Homo sapiens
gaaagcuguugauccagaa

SEQ ID NO: 771272 - RNA, 19 nt, Homo sapiens
gaagcaauguuuggcagaa

SEQ ID NO: 771273 - RNA, 19 nt, Homo sapiens
ggcaagaaagggucaaaua

SEQ ID NO: 771274 - RNA, 19 nt, Homo sapiens
ugaauggccugaagcaaug

SEQ ID NO: 771275 - RNA, 19 nt, Homo sapiens
gaaagggucaaauaagaga

SEQ ID NO: 771276 - RNA, 19 nt, Homo sapiens
gaaagaagaaaggcucaaa

SEQ ID NO: 771277 - RNA, 19 nt, Homo sapiens
cgaagcgacccacugauua

SEQ ID NO: 771278 - RNA, 19 nt, Homo sapiens
gagcuaugaugauguaucu

SEQ ID NO: 771279 - RNA, 19 nt, Homo sapiens
gaucuggaauggguugaaa

SEQ ID NO: 771280 - RNA, 19 nt, Homo sapiens
cgacagaagcugcagacua

SEQ ID NO: 771281 - RNA, 19 nt, Homo sapiens
ggaaauggccaaaucugau

SEQ ID NO: 771282 - RNA, 19 nt, Homo sapiens
gaagcgacccacugauuau

SEQ ID NO: 771283 - RNA, 19 nt, Homo sapiens
caagaaggcaggagccaaa

SEQ ID NO: 771284 - RNA, 19 nt, Homo sapiens
caaauaagagaccuggaaa

SEQ ID NO: 771285 - RNA, 19 nt, Homo sapiens
ggaaauacgggaagaaggu

SEQ ID NO: 771286 - RNA, 19 nt, Homo sapiens
gcagaagauucgacagaag

SEQ ID NO: 771287 - RNA, 19 nt, Homo sapiens
caagaaagggucaaauaag

SEQ ID NO: 771288 - RNA, 19 nt, Homo sapiens
aaugaagacucgcaauuuc

SEQ ID NO: 771289 - RNA, 19 nt, Homo sapiens
ccgcuugggucucgggaua

SEQ ID NO: 771290 - RNA, 19 nt, Homo sapiens
gaauacaaagaaccaagaa

SEQ ID NO: 771291 - RNA, 19 nt, Homo sapiens
gagaagaugaagaacagaa

SEQ ID NO: 771292 - RNA, 19 nt, Homo sapiens
gaaauggccaaaucugauc

SEQ ID NO: 771293 - RNA, 19 nt, Homo sapiens
gaaagcccauaugaugaau

SEQ ID NO: 771294 - RNA, 19 nt, Homo sapiens
ucaaauaagagaccuggaa

SEQ ID NO: 771295 - RNA, 19 nt, Homo sapiens
uaagagaccuggaaaacga

SEQ ID NO: 771296 - RNA, 19 nt, Homo sapiens
uaaacuggauuuccuugag

SEQ ID NO: 771297 - RNA, 19 nt, Homo sapiens
gccaaaggccagcagauga

SEQ ID NO: 771298 - RNA, 19 nt, Homo sapiens
ugcgagcacuuaggaaaua

SEQ ID NO: 771299 - RNA, 19 nt, Homo sapiens
caacugcgagcacuuagga

SEQ ID NO: 771300 - RNA, 19 nt, Homo sapiens
cgaagaaggccgugaacga

SEQ ID NO: 771301 - RNA, 19 nt, Homo sapiens
gaacaaggaccagaaagcu

SEQ ID NO: 771302 - RNA, 19 nt, Homo sapiens
ggaacacucgggagagcua

SEQ ID NO: 771303 - RNA, 19 nt, Homo sapiens
caggagaaagcccauauga

SEQ ID NO: 771304 - RNA, 19 nt, Homo sapiens
gaagaggcagcaggagaaa

SEQ ID NO: 771305 - RNA, 19 nt, Homo sapiens
cgggagagcuaugaugaug

SEQ ID NO: 771306 - RNA, 19 nt, Homo sapiens
gugaauggccugaagcaau

SEQ ID NO: 771307 - RNA, 19 nt, Homo sapiens
acacuuugaucccuucugu

SEQ ID NO: 771308 - RNA, 19 nt, Homo sapiens
cgacgugaauggccugaag

SEQ ID NO: 771309 - RNA, 19 nt, Homo sapiens
ucaagaggccuggcaagaa

SEQ ID NO: 771310 - RNA, 19 nt, Homo sapiens
gcuaaacgacgguauaaaa

SEQ ID NO: 771311 - RNA, 19 nt, Homo sapiens
gcccauaugaugaaugcua

SEQ ID NO: 771312 - RNA, 19 nt, Homo sapiens
agaaagcccauaugaugaa

SEQ ID NO: 771313 - RNA, 19 nt, Homo sapiens
cuacgaagcgacccacuga

SEQ ID NO: 771314 - RNA, 19 nt, Homo sapiens
cgcagugcuugcagucuua

SEQ ID NO: 771315 - RNA, 19 nt, Homo sapiens
caauuucacgacacacuuu

SEQ ID NO: 771316 - RNA, 19 nt, Homo sapiens
cgaacaagagagaagauga

SEQ ID NO: 771317 - RNA, 19 nt, Homo sapiens
gcuaugaugauguaucuag

SEQ ID NO: 771318 - RNA, 19 nt, Homo sapiens
augaaucccuugucacaga

SEQ ID NO: 771319 - RNA, 19 nt, Homo sapiens
gcaauuucacgacacacuu

SEQ ID NO: 771320 - RNA, 19 nt, Homo sapiens
guugaaaggcucgauguga

SEQ ID NO: 771321 - RNA, 19 nt, Homo sapiens
gugcuaaacgacgguauaa

SEQ ID NO: 771322 - RNA, 19 nt, Homo sapiens
ggaaaacgaacaagagaga

SEQ ID NO: 771323 - RNA, 19 nt, Homo sapiens
cuaaacaggcugccaugga

SEQ ID NO: 771324 - RNA, 19 nt, Homo sapiens
ccgcagugcuugcagucuu

SEQ ID NO: 771325 - RNA, 19 nt, Homo sapiens
agaagaggcagcaggagaa

SEQ ID NO: 771326 - RNA, 19 nt, Homo sapiens
gugcagaagauucgacaga

SEQ ID NO: 771327 - RNA, 19 nt, Homo sapiens
uuccauugcuaucuauuga

SEQ ID NO: 771328 - RNA, 19 nt, Homo sapiens
gcaauguuuggcagaauuc

SEQ ID NO: 771329 - RNA, 19 nt, Homo sapiens
caagcgggaucuggaaugg

SEQ ID NO: 771330 - RNA, 19 nt, Homo sapiens
aggcuucucugauaaacug

SEQ ID NO: 771331 - RNA, 19 nt, Homo sapiens
cgaugaaucccuugucaca

SEQ ID NO: 771332 - RNA, 19 nt, Homo sapiens
aagcaacugcgagcacuua

SEQ ID NO: 771333 - RNA, 19 nt, Homo sapiens
cggaaauggccaaaucuga

SEQ ID NO: 771334 - RNA, 19 nt, Homo sapiens
ucagaacaaggaccagaaa

SEQ ID NO: 771335 - RNA, 19 nt, Homo sapiens
gaguucaaauugccuucau

SEQ ID NO: 771336 - RNA, 19 nt, Homo sapiens
ugaauacaaagaaccaaga

SEQ ID NO: 771337 - RNA, 19 nt, Homo sapiens
gaagccaggccucaauguc

SEQ ID NO: 771338 - RNA, 19 nt, Homo sapiens
gcaggagaaagcccauaug

SEQ ID NO: 771339 - RNA, 19 nt, Homo sapiens
ugcagaagauucgacagaa

SEQ ID NO: 771340 - RNA, 19 nt, Homo sapiens
agaagaaaggcucaaagug

SEQ ID NO: 771341 - RNA, 19 nt, Homo sapiens
uugcggaaauggccaaauc

SEQ ID NO: 771342 - RNA, 19 nt, Homo sapiens
gcgacccacugauuauuuu

SEQ ID NO: 771343 - RNA, 19 nt, Homo sapiens
cccauaugaugaaugcuau

SEQ ID NO: 771344 - RNA, 19 nt, Homo sapiens
caaacggagguucuucaga

SEQ ID NO: 771345 - RNA, 19 nt, Homo sapiens
ggaaagaagaaaggcucaa

SEQ ID NO: 771346 - RNA, 19 nt, Homo sapiens
cgagagaugaguuucuauc

SEQ ID NO: 771347 - RNA, 19 nt, Homo sapiens
agcaauguuuggcagaauu

SEQ ID NO: 771348 - RNA, 19 nt, Homo sapiens
aaacgaacaagagagaaga

SEQ ID NO: 771349 - RNA, 19 nt, Homo sapiens
aagaagaaaggcucaaagu

SEQ ID NO: 771350 - RNA, 19 nt, Homo sapiens
acgaagcgacccacugauu

SEQ ID NO: 771351 - RNA, 19 nt, Homo sapiens
agcgagagaugaguuucua

SEQ ID NO: 771352 - RNA, 19 nt, Homo sapiens
ucucugauaaacuggauuu

SEQ ID NO: 771353 - RNA, 19 nt, Homo sapiens
cagcaccucagaacaagga

SEQ ID NO: 771354 - RNA, 19 nt, Homo sapiens
ccaaaggccagcagaugag

SEQ ID NO: 771355 - RNA, 19 nt, Homo sapiens
gcaaacggagguucuucag

SEQ ID NO: 771356 - RNA, 19 nt, Homo sapiens
gccagcaccucagaacaag

SEQ ID NO: 771357 - RNA, 19 nt, Homo sapiens
ggaaugaucuggauagguu

SEQ ID NO: 771358 - RNA, 19 nt, Homo sapiens
gauaaaggcuuaaauugag

SEQ ID NO: 771359 - RNA, 19 nt, Homo sapiens
ggacagacuuucuucucua

SEQ ID NO: 771360 - RNA, 19 nt, Homo sapiens
ugacggagcucaccaaauc

SEQ ID NO: 771361 - RNA, 19 nt, Homo sapiens
gaacaagcaggauuugaaa

SEQ ID NO: 771362 - RNA, 19 nt, Homo sapiens
gcuggcagauuucaaguaa

SEQ ID NO: 771363 - RNA, 19 nt, Homo sapiens
gagaagcucccaacauaaa

SEQ ID NO: 771364 - RNA, 19 nt, Homo sapiens
uugagaagcucccaacaua

SEQ ID NO: 771365 - RNA, 19 nt, Homo sapiens
aggcuuaaauugaggauua

SEQ ID NO: 771366 - RNA, 19 nt, Homo sapiens
ggaacaagcaggauuugaa

SEQ ID NO: 771367 - RNA, 19 nt, Homo sapiens
ucaaugacaugaaggcaaa

SEQ ID NO: 771368 - RNA, 19 nt, Homo sapiens
ggaaucagccaaggguuua

SEQ ID NO: 771369 - RNA, 19 nt, Homo sapiens
ggagaucaaugacaugaag

SEQ ID NO: 771370 - RNA, 19 nt, Homo sapiens
gcagggcgcucaacuuucu

SEQ ID NO: 771371 - RNA, 19 nt, Homo sapiens
ucacuugucuuccacuuug

SEQ ID NO: 771372 - RNA, 19 nt, Homo sapiens
uagaugaccugaggaauga

SEQ ID NO: 771373 - RNA, 19 nt, Homo sapiens
gagcuguauuguucuuuaa

SEQ ID NO: 771374 - RNA, 19 nt, Homo sapiens
gcaaggagcgugcauacug

SEQ ID NO: 771375 - RNA, 19 nt, Homo sapiens
ccaaauccaucaacgacaa

SEQ ID NO: 771376 - RNA, 19 nt, Homo sapiens
ugcagaaacuccagaauga

SEQ ID NO: 771377 - RNA, 19 nt, Homo sapiens
cuaguugucuuuaaggaaa

SEQ ID NO: 771378 - RNA, 19 nt, Homo sapiens
ugagcuguauuguucuuua

SEQ ID NO: 771379 - RNA, 19 nt, Homo sapiens
cuggauagguuguuuguga

SEQ ID NO: 771380 - RNA, 19 nt, Homo sapiens
ucacagaaguccagaagag

SEQ ID NO: 771381 - RNA, 19 nt, Homo sapiens
guucucugcuucugcauuu

SEQ ID NO: 771382 - RNA, 19 nt, Homo sapiens
gaacaccaaggcauuguau

SEQ ID NO: 771383 - RNA, 19 nt, Homo sapiens
agagaaagcugugaagcaa

SEQ ID NO: 771384 - RNA, 19 nt, Homo sapiens
aacaagaccucacagagaa

SEQ ID NO: 771385 - RNA, 19 nt, Homo sapiens
gagcgugcauacugcguuu

SEQ ID NO: 771386 - RNA, 19 nt, Homo sapiens
caacaucgccaucuucaca

SEQ ID NO: 771387 - RNA, 19 nt, Homo sapiens
aaacaagaccucacagaga

SEQ ID NO: 771388 - RNA, 19 nt, Homo sapiens
guaauuguuugcuguaucu

SEQ ID NO: 771389 - RNA, 19 nt, Homo sapiens
ugacgcaucugugauauca

SEQ ID NO: 771390 - RNA, 19 nt, Homo sapiens
auacugcguuuguguaauu

SEQ ID NO: 771391 - RNA, 19 nt, Homo sapiens
ggacauggaggcccugaga

SEQ ID NO: 771392 - RNA, 19 nt, Homo sapiens
gcgaagugcugcagaaacu

SEQ ID NO: 771393 - RNA, 19 nt, Homo sapiens
gccaaguccuuuuauuuua

SEQ ID NO: 771394 - RNA, 19 nt, Homo sapiens
gcacagguuucgacuacca

SEQ ID NO: 771395 - RNA, 19 nt, Homo sapiens
uaaaggaagcugugaagga

SEQ ID NO: 771396 - RNA, 19 nt, Homo sapiens
guccuuggguucuuucaaa

SEQ ID NO: 771397 - RNA, 19 nt, Homo sapiens
gccaaggguuuacuagaug

SEQ ID NO: 771398 - RNA, 19 nt, Homo sapiens
agaaggagaucaaugacau

SEQ ID NO: 771399 - RNA, 19 nt, Homo sapiens
aaaguccaauuucucauga

SEQ ID NO: 771400 - RNA, 19 nt, Homo sapiens
cgagaacaaucuggaauca

SEQ ID NO: 771401 - RNA, 19 nt, Homo sapiens
gcauacugcguuuguguaa

SEQ ID NO: 771402 - RNA, 19 nt, Homo sapiens
cggaugacguggcgaagaa

SEQ ID NO: 771403 - RNA, 19 nt, Homo sapiens
gcuguauuguucuuuaaug

SEQ ID NO: 771404 - RNA, 19 nt, Homo sapiens
acaccaaggcauuguauuu

SEQ ID NO: 771405 - RNA, 19 nt, Homo sapiens
ccaaggguuuacuagauga

SEQ ID NO: 771406 - RNA, 19 nt, Homo sapiens
gccagaaggagaucaauga

SEQ ID NO: 771407 - RNA, 19 nt, Homo sapiens
uaucagagguaacuaugca

SEQ ID NO: 771408 - RNA, 19 nt, Homo sapiens
agcagaaggugcagucuuu

SEQ ID NO: 771409 - RNA, 19 nt, Homo sapiens
aaaggaauccgcugcuuga

SEQ ID NO: 771410 - RNA, 19 nt, Homo sapiens
gaagcagauuaaccucaga

SEQ ID NO: 771411 - RNA, 19 nt, Homo sapiens
gauuaacagaagcagauua

SEQ ID NO: 771412 - RNA, 19 nt, Homo sapiens
gcgcucaacuuucucuucu

SEQ ID NO: 771413 - RNA, 19 nt, Homo sapiens
gcucaacuuucucuucuac

SEQ ID NO: 771414 - RNA, 19 nt, Homo sapiens
ggauuuaaaguccaauuuc

SEQ ID NO: 771415 - RNA, 19 nt, Homo sapiens
agacccagcuggugcucua

SEQ ID NO: 771416 - RNA, 19 nt, Homo sapiens
gaaacuccagaaugagauu

SEQ ID NO: 771417 - RNA, 19 nt, Homo sapiens
ucauggaugucucuaguca

SEQ ID NO: 771418 - RNA, 19 nt, Homo sapiens
cggcagggcgcucaacuuu

SEQ ID NO: 771419 - RNA, 19 nt, Homo sapiens
gauaucagagguaacuaug

SEQ ID NO: 771420 - RNA, 19 nt, Homo sapiens
gcagauuaaccucagaaau

SEQ ID NO: 771421 - RNA, 19 nt, Homo sapiens
aaauagaaaccaacgagaa

SEQ ID NO: 771422 - RNA, 19 nt, Homo sapiens
gacagacuuucuucucuag

SEQ ID NO: 771423 - RNA, 19 nt, Homo sapiens
gaaugcaggccaaguccuu

SEQ ID NO: 771424 - RNA, 19 nt, Homo sapiens
ggauccauguggugaagga

SEQ ID NO: 771425 - RNA, 19 nt, Homo sapiens
gggaguccuuggguucuuu

SEQ ID NO: 771426 - RNA, 19 nt, Homo sapiens
cagaaacuccagaaugaga

SEQ ID NO: 771427 - RNA, 19 nt, Homo sapiens
caacgagaacaaucuggaa

SEQ ID NO: 771428 - RNA, 19 nt, Homo sapiens
gaaaccaacgagaacaauc

SEQ ID NO: 771429 - RNA, 19 nt, Homo sapiens
agauaucucucacuugucu

SEQ ID NO: 771430 - RNA, 19 nt, Homo sapiens
ugagaagcucccaacauaa

SEQ ID NO: 771431 - RNA, 19 nt, Homo sapiens
uaaaguccaauuucucaug

SEQ ID NO: 771432 - RNA, 19 nt, Homo sapiens
gcgcggauuuaaaguccaa

SEQ ID NO: 771433 - RNA, 19 nt, Homo sapiens
ggauagguuguuugugaaa

SEQ ID NO: 771434 - RNA, 19 nt, Homo sapiens
gacggaggcuucagacacu

SEQ ID NO: 771435 - RNA, 19 nt, Homo sapiens
ccaaggaaugcacagguuu

SEQ ID NO: 771436 - RNA, 19 nt, Homo sapiens
gcgcagccccugugaauaa

SEQ ID NO: 771437 - RNA, 19 nt, Homo sapiens
gcaguugucaccaccugaa

SEQ ID NO: 771438 - RNA, 19 nt, Homo sapiens
cuagaugaccugaggaaug

SEQ ID NO: 771439 - RNA, 19 nt, Homo sapiens
auacagaccucagccaagu

SEQ ID NO: 771440 - RNA, 19 nt, Homo sapiens
ugaaaggaauccgcugcuu

SEQ ID NO: 771441 - RNA, 19 nt, Homo sapiens
ggaggacggaggcuucaga

SEQ ID NO: 771442 - RNA, 19 nt, Homo sapiens
gaaggagaucaaugacaug

SEQ ID NO: 771443 - RNA, 19 nt, Homo sapiens
gaagcucccaacauaaaca

SEQ ID NO: 771444 - RNA, 19 nt, Homo sapiens
uauggagucugacaucuac

SEQ ID NO: 771445 - RNA, 19 nt, Homo sapiens
gagcagaaggugcagucuu

SEQ ID NO: 771446 - RNA, 19 nt, Homo sapiens
gacaacaucgccaucuuca

SEQ ID NO: 771447 - RNA, 19 nt, Homo sapiens
caagccacauuuggaacuu

SEQ ID NO: 771448 - RNA, 19 nt, Homo sapiens
uggagaagauucacgaaaa

SEQ ID NO: 771449 - RNA, 19 nt, Homo sapiens
ugacaugaaggcaaagguu

SEQ ID NO: 771450 - RNA, 19 nt, Homo sapiens
cgacaacaucgccaucuuc

SEQ ID NO: 771451 - RNA, 19 nt, Homo sapiens
gagcucaccaaauccauca

SEQ ID NO: 771452 - RNA, 19 nt, Homo sapiens
uggcagauuucaaguaaaa

SEQ ID NO: 771453 - RNA, 19 nt, Homo sapiens
gcguuuguguaauuguuug

SEQ ID NO: 771454 - RNA, 19 nt, Homo sapiens
ggccaaguccuuuuauuuu

SEQ ID NO: 771455 - RNA, 19 nt, Homo sapiens
acgaaaaggucuaaaugaa

SEQ ID NO: 771456 - RNA, 19 nt, Homo sapiens
ggagaagauucacgaaaag

SEQ ID NO: 771457 - RNA, 19 nt, Homo sapiens
ugaaauggcuccuguauca

SEQ ID NO: 771458 - RNA, 19 nt, Homo sapiens
gauaucugguuaaguguua

SEQ ID NO: 771459 - RNA, 19 nt, Homo sapiens
ggaaucaacuguuuauagu

SEQ ID NO: 771460 - RNA, 19 nt, Homo sapiens
uaaguaaucugaaccaguu

SEQ ID NO: 771461 - RNA, 19 nt, Homo sapiens
caagaggcauuugauauaa

SEQ ID NO: 771462 - RNA, 19 nt, Homo sapiens
gcauguugcugccagaaua

SEQ ID NO: 771463 - RNA, 19 nt, Homo sapiens
gguauucacuuuacuaugu

SEQ ID NO: 771464 - RNA, 19 nt, Homo sapiens
caacuaauccagagaguaa

SEQ ID NO: 771465 - RNA, 19 nt, Homo sapiens
agacugagcugauccagaa

SEQ ID NO: 771466 - RNA, 19 nt, Homo sapiens
gcaaagaaacccauucaug

SEQ ID NO: 771467 - RNA, 19 nt, Homo sapiens
ccaaggagcuuaccaagag

SEQ ID NO: 771468 - RNA, 19 nt, Homo sapiens
ggaauaaaguggacauuuu

SEQ ID NO: 771469 - RNA, 19 nt, Homo sapiens
ccacuuggauuuccuauag

SEQ ID NO: 771470 - RNA, 19 nt, Homo sapiens
ccaagaggcauuugauaua

SEQ ID NO: 771471 - RNA, 19 nt, Homo sapiens
caaagaaacccauucaugu

SEQ ID NO: 771472 - RNA, 19 nt, Homo sapiens
ggaccacuauuguguguug

SEQ ID NO: 771473 - RNA, 19 nt, Homo sapiens
guacacaaguccaagucua

SEQ ID NO: 771474 - RNA, 19 nt, Homo sapiens
gagacaaccuaacacuuug

SEQ ID NO: 771475 - RNA, 19 nt, Homo sapiens
aaugauaucugguuaagug

SEQ ID NO: 771476 - RNA, 19 nt, Homo sapiens
gauauaagcaagaaagaga

SEQ ID NO: 771477 - RNA, 19 nt, Homo sapiens
caggugaauuuacuacuuu

SEQ ID NO: 771478 - RNA, 19 nt, Homo sapiens
gugagaggguguccaguuu

SEQ ID NO: 771479 - RNA, 19 nt, Homo sapiens
uaacagcagaguaacauaa

SEQ ID NO: 771480 - RNA, 19 nt, Homo sapiens
gcaacagggaguuuccuua

SEQ ID NO: 771481 - RNA, 19 nt, Homo sapiens
ccacggugcuggaauuguu

SEQ ID NO: 771482 - RNA, 19 nt, Homo sapiens
gaaacccauucauguguau

SEQ ID NO: 771483 - RNA, 19 nt, Homo sapiens
ccucagauguaaaugauau

SEQ ID NO: 771484 - RNA, 19 nt, Homo sapiens
ggagaagacugagcugauc

SEQ ID NO: 771485 - RNA, 19 nt, Homo sapiens
aguaaggucuucuaucuga

SEQ ID NO: 771486 - RNA, 19 nt, Homo sapiens
guaggaauccggaaguauu

SEQ ID NO: 771487 - RNA, 19 nt, Homo sapiens
uuacacaucuccauuccuu

SEQ ID NO: 771488 - RNA, 19 nt, Homo sapiens
gcucuuaacuuuucuguau

SEQ ID NO: 771489 - RNA, 19 nt, Homo sapiens
gauagauaauucccaagga

SEQ ID NO: 771490 - RNA, 19 nt, Homo sapiens
gugcuggaauuguuggaua

SEQ ID NO: 771491 - RNA, 19 nt, Homo sapiens
ggacugcauuucuuagagu

SEQ ID NO: 771492 - RNA, 19 nt, Homo sapiens
uuagagaguuggaccacua

SEQ ID NO: 771493 - RNA, 19 nt, Homo sapiens
caaauuaaagugcauguca

SEQ ID NO: 771494 - RNA, 19 nt, Homo sapiens
gagaggguguccaguuugu

SEQ ID NO: 771495 - RNA, 19 nt, Homo sapiens
acagggaguuuccuuauuc

SEQ ID NO: 771496 - RNA, 19 nt, Homo sapiens
gcugaaaacuaaauccaua

SEQ ID NO: 771497 - RNA, 19 nt, Homo sapiens
agagacaaccuaacacuuu

SEQ ID NO: 771498 - RNA, 19 nt, Homo sapiens
gaaguugcguguggugaug

SEQ ID NO: 771499 - RNA, 19 nt, Homo sapiens
agaguaaggucuucuaucu

SEQ ID NO: 771500 - RNA, 19 nt, Homo sapiens
gguuaaguguuauauggaa

SEQ ID NO: 771501 - RNA, 19 nt, Homo sapiens
uaaagugcaugucauuucu

SEQ ID NO: 771502 - RNA, 19 nt, Homo sapiens
caacagggaguuuccuuau

SEQ ID NO: 771503 - RNA, 19 nt, Homo sapiens
ggaaguauuagauugaaug

SEQ ID NO: 771504 - RNA, 19 nt, Homo sapiens
acacuuauguagaggacua

SEQ ID NO: 771505 - RNA, 19 nt, Homo sapiens
uguauggaaucaacuguuu

SEQ ID NO: 771506 - RNA, 19 nt, Homo sapiens
gcagauuugugcacaugug

SEQ ID NO: 771507 - RNA, 19 nt, Homo sapiens
ugauagaaguagcauguug

SEQ ID NO: 771508 - RNA, 19 nt, Homo sapiens
guagugauaccuauauuuc

SEQ ID NO: 771509 - RNA, 19 nt, Homo sapiens
agaaacccauucaugugua

SEQ ID NO: 771510 - RNA, 19 nt, Homo sapiens
agaaggggcugaaaacuaa

SEQ ID NO: 771511 - RNA, 19 nt, Homo sapiens
gcaugucauuucuuaauac

SEQ ID NO: 771512 - RNA, 19 nt, Homo sapiens
aagugcaugucauuucuua

SEQ ID NO: 771513 - RNA, 19 nt, Homo sapiens
gaacuugauacacugaaug

SEQ ID NO: 771514 - RNA, 19 nt, Homo sapiens
ggccauugcugaacuugau

SEQ ID NO: 771515 - RNA, 19 nt, Homo sapiens
uaagggacaggugaauuua

SEQ ID NO: 771516 - RNA, 19 nt, Homo sapiens
acaauugcauacccauauu

SEQ ID NO: 771517 - RNA, 19 nt, Homo sapiens
cauuuacuauggcuuugua

SEQ ID NO: 771518 - RNA, 19 nt, Homo sapiens
gaaaagcacuugccaucuc

SEQ ID NO: 771519 - RNA, 19 nt, Homo sapiens
uaggaauccggaaguauua

SEQ ID NO: 771520 - RNA, 19 nt, Homo sapiens
uuaagggacaggugaauuu

SEQ ID NO: 771521 - RNA, 19 nt, Homo sapiens
uaaggacuaucgggagaaa

SEQ ID NO: 771522 - RNA, 19 nt, Homo sapiens
gaagacucauacaaagaca

SEQ ID NO: 771523 - RNA, 19 nt, Homo sapiens
uaacaauugcauacccaua

SEQ ID NO: 771524 - RNA, 19 nt, Homo sapiens
gagcuuaccaagaggcauu

SEQ ID NO: 771525 - RNA, 19 nt, Homo sapiens
acaggugaauuuacuacuu

SEQ ID NO: 771526 - RNA, 19 nt, Homo sapiens
gagaguuggaccacuauug

SEQ ID NO: 771527 - RNA, 19 nt, Homo sapiens
gcucuuaauguauuccuuu

SEQ ID NO: 771528 - RNA, 19 nt, Homo sapiens
gcaacuaauccagagagua

SEQ ID NO: 771529 - RNA, 19 nt, Homo sapiens
guaguagugauaccuauau

SEQ ID NO: 771530 - RNA, 19 nt, Homo sapiens
uaauagccaaugcaacuaa

SEQ ID NO: 771531 - RNA, 19 nt, Homo sapiens
aaagaaacccauucaugug

SEQ ID NO: 771532 - RNA, 19 nt, Homo sapiens
aaagacagcacccucauca

SEQ ID NO: 771533 - RNA, 19 nt, Homo sapiens
agaaguugcagcugauuaa

SEQ ID NO: 771534 - RNA, 19 nt, Homo sapiens
gcuaaucauugacuguagu

SEQ ID NO: 771535 - RNA, 19 nt, Homo sapiens
gugacuguguuuuguauua

SEQ ID NO: 771536 - RNA, 19 nt, Homo sapiens
uugauacacugaaugaaga

SEQ ID NO: 771537 - RNA, 19 nt, Homo sapiens
cuauguaacagcagaguaa

SEQ ID NO: 771538 - RNA, 19 nt, Homo sapiens
uccaugcucuuaauguauu

SEQ ID NO: 771539 - RNA, 19 nt, Homo sapiens
cccaaacacuuauguagag

SEQ ID NO: 771540 - RNA, 19 nt, Homo sapiens
guauggaaucaacuguuua

SEQ ID NO: 771541 - RNA, 19 nt, Homo sapiens
agacagcacccucaucaug

SEQ ID NO: 771542 - RNA, 19 nt, Homo sapiens
aauguuaugcccuauguaa

SEQ ID NO: 771543 - RNA, 19 nt, Homo sapiens
acaagaaguugcagcugau

SEQ ID NO: 771544 - RNA, 19 nt, Homo sapiens
gcacuugccaucucugucu

SEQ ID NO: 771545 - RNA, 19 nt, Homo sapiens
gauuuccuauagcaaagaa

SEQ ID NO: 771546 - RNA, 19 nt, Homo sapiens
guaaggucuucuaucugaa

SEQ ID NO: 771547 - RNA, 19 nt, Homo sapiens
cauacagggugucauccuu

SEQ ID NO: 771548 - RNA, 19 nt, Homo sapiens
agacagugcaggagaagaa

SEQ ID NO: 771549 - RNA, 19 nt, Homo sapiens
agggaugccuggaagugua

SEQ ID NO: 771550 - RNA, 19 nt, Homo sapiens
uaaggucuucuaucugaaa

SEQ ID NO: 771551 - RNA, 19 nt, Homo sapiens
caauugcauacccauauuu

SEQ ID NO: 771552 - RNA, 19 nt, Homo sapiens
ccacuauuguguguugcua

SEQ ID NO: 771553 - RNA, 19 nt, Homo sapiens
gugcaugucauuucuuaau

SEQ ID NO: 771554 - RNA, 19 nt, Homo sapiens
guucugguauucacuuuac

SEQ ID NO: 771555 - RNA, 19 nt, Homo sapiens
uuuccaugcucuuaaugua

SEQ ID NO: 771556 - RNA, 19 nt, Homo sapiens
gcaagugacuguguuuugu

SEQ ID NO: 771557 - RNA, 19 nt, Homo sapiens
ccaagaaauugauugagua

SEQ ID NO: 771558 - RNA, 19 nt, Homo sapiens
gaacuguagauaacucuua

SEQ ID NO: 771559 - RNA, 19 nt, Homo sapiens
gaagaggagaugcgugaua

SEQ ID NO: 771560 - RNA, 19 nt, Homo sapiens
gcucaaaccauuagaggua

SEQ ID NO: 771561 - RNA, 19 nt, Homo sapiens
uagaagaccuuucagaauc

SEQ ID NO: 771562 - RNA, 19 nt, Homo sapiens
ugccagaacugaucucuuu

SEQ ID NO: 771563 - RNA, 19 nt, Homo sapiens
uuacauagcuucuggugau

SEQ ID NO: 771564 - RNA, 19 nt, Homo sapiens
acccuuagcugaaauguuu

SEQ ID NO: 771565 - RNA, 19 nt, Homo sapiens
gccaagaaauugauugagu

SEQ ID NO: 771566 - RNA, 19 nt, Homo sapiens
gaagagagaagaggagaug

SEQ ID NO: 771567 - RNA, 19 nt, Homo sapiens
gaagaccuuucagaaucua

SEQ ID NO: 771568 - RNA, 19 nt, Homo sapiens
gcggauaccugaccaacuc

SEQ ID NO: 771569 - RNA, 19 nt, Homo sapiens
ugacauguuugaagugugu

SEQ ID NO: 771570 - RNA, 19 nt, Homo sapiens
cauguugacuucauuugga

SEQ ID NO: 771571 - RNA, 19 nt, Homo sapiens
ccaaagaggaugcaaccaa

SEQ ID NO: 771572 - RNA, 19 nt, Homo sapiens
caaacacucggguccuaua

SEQ ID NO: 771573 - RNA, 19 nt, Homo sapiens
uuaccuagauaaugccaaa

SEQ ID NO: 771574 - RNA, 19 nt, Homo sapiens
caaggcacguuggagcuuu

SEQ ID NO: 771575 - RNA, 19 nt, Homo sapiens
ggaugugacaccucauaaa

SEQ ID NO: 771576 - RNA, 19 nt, Homo sapiens
gcuuugaacuguagauaac

SEQ ID NO: 771577 - RNA, 19 nt, Homo sapiens
gcacguuggagcuuucuug

SEQ ID NO: 771578 - RNA, 19 nt, Homo sapiens
uuauuagagucaccuauga

SEQ ID NO: 771579 - RNA, 19 nt, Homo sapiens
cacugaagauuaugacaug

SEQ ID NO: 771580 - RNA, 19 nt, Homo sapiens
cauauucucuacuccaaag

SEQ ID NO: 771581 - RNA, 19 nt, Homo sapiens
ccuagaagaccuuucagaa

SEQ ID NO: 771582 - RNA, 19 nt, Homo sapiens
acacucggguccuauacuu

SEQ ID NO: 771583 - RNA, 19 nt, Homo sapiens
gagaagcucaaaccauuag

SEQ ID NO: 771584 - RNA, 19 nt, Homo sapiens
cacaaggaccugcuaguga

SEQ ID NO: 771585 - RNA, 19 nt, Homo sapiens
caagggaacagggcggaua

SEQ ID NO: 771586 - RNA, 19 nt, Homo sapiens
gagcuuugaacuguagaua

SEQ ID NO: 771587 - RNA, 19 nt, Homo sapiens
ugaccauguugacuucauu

SEQ ID NO: 771588 - RNA, 19 nt, Homo sapiens
cccauuaacucucgcaagu

SEQ ID NO: 771589 - RNA, 19 nt, Homo sapiens
cuagaagaccuuucagaau

SEQ ID NO: 771590 - RNA, 19 nt, Homo sapiens
gccauauucucuacuccaa

SEQ ID NO: 771591 - RNA, 19 nt, Homo sapiens
gaguaaugaaugaggcaua

SEQ ID NO: 771592 - RNA, 19 nt, Homo sapiens
ggccuucgguggugaacga

SEQ ID NO: 771593 - RNA, 19 nt, Homo sapiens
gaagagauugcaaaaguug

SEQ ID NO: 771594 - RNA, 19 nt, Homo sapiens
cauuuggauugcccucuuu

SEQ ID NO: 771595 - RNA, 19 nt, Homo sapiens
gggcuuccauucuaguucu

SEQ ID NO: 771596 - RNA, 19 nt, Homo sapiens
ccuuccaucugcccauuaa

SEQ ID NO: 771597 - RNA, 19 nt, Homo sapiens
agaagaccuuucagaaucu

SEQ ID NO: 771598 - RNA, 19 nt, Homo sapiens
gaugugacaccucauaaaa

SEQ ID NO: 771599 - RNA, 19 nt, Homo sapiens
gauuaugacauguuugaag

SEQ ID NO: 771600 - RNA, 19 nt, Homo sapiens
gaccauguugacuucauuu

SEQ ID NO: 771601 - RNA, 19 nt, Homo sapiens
aacaaacacucggguccua

SEQ ID NO: 771602 - RNA, 19 nt, Homo sapiens
gagcugcgacgccuagaag

SEQ ID NO: 771603 - RNA, 19 nt, Homo sapiens
aaauauuugugcucaacug

SEQ ID NO: 771604 - RNA, 19 nt, Homo sapiens
cauauucuccucccaccuu

SEQ ID NO: 771605 - RNA, 19 nt, Homo sapiens
aguaaugaaugaggcauau

SEQ ID NO: 771606 - RNA, 19 nt, Homo sapiens
uaugacauguuugaagugu

SEQ ID NO: 771607 - RNA, 19 nt, Homo sapiens
ccuuuaccacugaagauua

SEQ ID NO: 771608 - RNA, 19 nt, Homo sapiens
agauucugcuggccauauu

SEQ ID NO: 771609 - RNA, 19 nt, Homo sapiens
cauagcuucuggugauauc

SEQ ID NO: 771610 - RNA, 19 nt, Homo sapiens
ucacaaggaccugcuagug

SEQ ID NO: 771611 - RNA, 19 nt, Homo sapiens
gaagauuaugacauguuug

SEQ ID NO: 771612 - RNA, 19 nt, Homo sapiens
uacauagcuucuggugaua

SEQ ID NO: 771613 - RNA, 19 nt, Homo sapiens
ucauuuggauugcccucuu

SEQ ID NO: 771614 - RNA, 19 nt, Homo sapiens
gucaaugagggacuucuuu

SEQ ID NO: 771615 - RNA, 19 nt, Homo sapiens
ggacaugggguaccaccua

SEQ ID NO: 771616 - RNA, 19 nt, Homo sapiens
cgaagagauugcaaaaguu

SEQ ID NO: 771617 - RNA, 19 nt, Homo sapiens
cuuuaccacugaagauuau

SEQ ID NO: 771618 - RNA, 19 nt, Homo sapiens
uauuugugcucaacugcuu

SEQ ID NO: 771619 - RNA, 19 nt, Homo sapiens
cuucaaggccaagaaauug

SEQ ID NO: 771620 - RNA, 19 nt, Homo sapiens
gauaccaacgagucaacaa

SEQ ID NO: 771621 - RNA, 19 nt, Homo sapiens
aagaggagaugcgugauac

SEQ ID NO: 771622 - RNA, 19 nt, Homo sapiens
ucaaaccauuagagguaga

SEQ ID NO: 771623 - RNA, 19 nt, Homo sapiens
gcagccaccucaagaucac

SEQ ID NO: 771624 - RNA, 19 nt, Homo sapiens
gguaggauuuugacugguu

SEQ ID NO: 771625 - RNA, 19 nt, Homo sapiens
ccacugaagauuaugacau

SEQ ID NO: 771626 - RNA, 19 nt, Homo sapiens
gcgcagccaccucaagauc

SEQ ID NO: 771627 - RNA, 19 nt, Homo sapiens
gaagcucaaaccauuagag

SEQ ID NO: 771628 - RNA, 19 nt, Homo sapiens
ggacuauguuuucuuuucu

SEQ ID NO: 771629 - RNA, 19 nt, Homo sapiens
gugugaccauguugacuuc

SEQ ID NO: 771630 - RNA, 19 nt, Homo sapiens
cuagauaaugccaaaguca

SEQ ID NO: 771631 - RNA, 19 nt, Homo sapiens
ccaccuacacccaacaagu

SEQ ID NO: 771632 - RNA, 19 nt, Homo sapiens
uaaggcauccuaccaacag

SEQ ID NO: 771633 - RNA, 19 nt, Homo sapiens
guaaugaaugaggcauauu

SEQ ID NO: 771634 - RNA, 19 nt, Homo sapiens
ccguuagcguugcugcuuu

SEQ ID NO: 771635 - RNA, 19 nt, Homo sapiens
acgaagagauugcaaaagu

SEQ ID NO: 771636 - RNA, 19 nt, Homo sapiens
ucuuuacccuuagcugaaa

SEQ ID NO: 771637 - RNA, 19 nt, Homo sapiens
guccuggguucccuugugu

SEQ ID NO: 771638 - RNA, 19 nt, Homo sapiens
acacccaacaagucaauga

SEQ ID NO: 771639 - RNA, 19 nt, Homo sapiens
ccuagauaaugccaaaguc

SEQ ID NO: 771640 - RNA, 19 nt, Homo sapiens
guccuauacuucagcaucu

SEQ ID NO: 771641 - RNA, 19 nt, Homo sapiens
caaggccaagaaauugauu

SEQ ID NO: 771642 - RNA, 19 nt, Homo sapiens
caacgagucaacaaacacu

SEQ ID NO: 771643 - RNA, 19 nt, Homo sapiens
gaccuuucagaaucuauug

SEQ ID NO: 771644 - RNA, 19 nt, Homo sapiens
aauuugccuuuaccacuga

SEQ ID NO: 771645 - RNA, 19 nt, Homo sapiens
gcuugggcuuccauucuag

SEQ ID NO: 771646 - RNA, 19 nt, Homo sapiens
agcuugggcuuccauucua

SEQ ID NO: 771647 - RNA, 19 nt, Homo sapiens
cagcuugggcuuccauucu

SEQ ID NO: 771648 - RNA, 19 nt, Homo sapiens
gaggagaugcgugauacca

SEQ ID NO: 771649 - RNA, 19 nt, Homo sapiens
guacaaaggucgagaaaua

SEQ ID NO: 771650 - RNA, 19 nt, Homo sapiens
ggaguuagauaccuuauua

SEQ ID NO: 771651 - RNA, 19 nt, Homo sapiens
ggacagaaauuuaguugaa

SEQ ID NO: 771652 - RNA, 19 nt, Homo sapiens
gaagguauaucuacacauu

SEQ ID NO: 771653 - RNA, 19 nt, Homo sapiens
gaacaucauugcaacagua

SEQ ID NO: 771654 - RNA, 19 nt, Homo sapiens
ccagagagcugugcaguua

SEQ ID NO: 771655 - RNA, 19 nt, Homo sapiens
gaacugcuuucaauucuaa

SEQ ID NO: 771656 - RNA, 19 nt, Homo sapiens
ucacaaggcuuaucagauu

SEQ ID NO: 771657 - RNA, 19 nt, Homo sapiens
caaauaagaugcagcaguu

SEQ ID NO: 771658 - RNA, 19 nt, Homo sapiens
gaacuuuccuacuguauug

SEQ ID NO: 771659 - RNA, 19 nt, Homo sapiens
gaggagaaauggacaguuu

SEQ ID NO: 771660 - RNA, 19 nt, Homo sapiens
gcagagagaugcagacguu

SEQ ID NO: 771661 - RNA, 19 nt, Homo sapiens
caaacgagaugacaacaaa

SEQ ID NO: 771662 - RNA, 19 nt, Homo sapiens
cagcugaaaugacagauua

SEQ ID NO: 771663 - RNA, 19 nt, Homo sapiens
gcauugaaccucuaacuua

SEQ ID NO: 771664 - RNA, 19 nt, Homo sapiens
caacauuacuguccucgua

SEQ ID NO: 771665 - RNA, 19 nt, Homo sapiens
gaugagagcaaauccauua

SEQ ID NO: 771666 - RNA, 19 nt, Homo sapiens
gaucuaaacuucaugaaca

SEQ ID NO: 771667 - RNA, 19 nt, Homo sapiens
gcagugaaguggauaaguu

SEQ ID NO: 771668 - RNA, 19 nt, Homo sapiens
gaacagcuaugucucuaau

SEQ ID NO: 771669 - RNA, 19 nt, Homo sapiens
gacaguggcugcaguauug

SEQ ID NO: 771670 - RNA, 19 nt, Homo sapiens
ccagagaccuugcugauug

SEQ ID NO: 771671 - RNA, 19 nt, Homo sapiens
gggauuaaaugugcaaaua

SEQ ID NO: 771672 - RNA, 19 nt, Homo sapiens
agagagaacuuauugcuuu

SEQ ID NO: 771673 - RNA, 19 nt, Homo sapiens
cuccaaagcugaagaauuu

SEQ ID NO: 771674 - RNA, 19 nt, Homo sapiens
gaucuuugcuguacuuuau

SEQ ID NO: 771675 - RNA, 19 nt, Homo sapiens
ugacugaccuggcauuaaa

SEQ ID NO: 771676 - RNA, 19 nt, Homo sapiens
ggaaagaggcccuguucua

SEQ ID NO: 771677 - RNA, 19 nt, Homo sapiens
agacaaagcucagaugauu

SEQ ID NO: 771678 - RNA, 19 nt, Homo sapiens
gagaacaguuggucauuga

SEQ ID NO: 771679 - RNA, 19 nt, Homo sapiens
gaaacaauaucgacgugaa

SEQ ID NO: 771680 - RNA, 19 nt, Homo sapiens
ccacuuaaaugcagagauu

SEQ ID NO: 771681 - RNA, 19 nt, Homo sapiens
gagcaaauccauuagcaua

SEQ ID NO: 771682 - RNA, 19 nt, Homo sapiens
gaagauagaggaccaguau

SEQ ID NO: 771683 - RNA, 19 nt, Homo sapiens
ggacuuaugugcuuugauc

SEQ ID NO: 771684 - RNA, 19 nt, Homo sapiens
gaacauggcgauaggguuu

SEQ ID NO: 771685 - RNA, 19 nt, Homo sapiens
gcagaagaauauacagauu

SEQ ID NO: 771686 - RNA, 19 nt, Homo sapiens
gaggaaagaugaaauaggu

SEQ ID NO: 771687 - RNA, 19 nt, Homo sapiens
ggaaugaagagacucaaua

SEQ ID NO: 771688 - RNA, 19 nt, Homo sapiens
caagaugcauuggauuaua

SEQ ID NO: 771689 - RNA, 19 nt, Homo sapiens
ggagaaccuugguggauuu

SEQ ID NO: 771690 - RNA, 19 nt, Homo sapiens
gaagaucuuugcuguacuu

SEQ ID NO: 771691 - RNA, 19 nt, Homo sapiens
ggaaagaccauguauuuag

SEQ ID NO: 771692 - RNA, 19 nt, Homo sapiens
gaacaagccugcauuucag

SEQ ID NO: 771693 - RNA, 19 nt, Homo sapiens
gaagaacugcuuucaauuc

SEQ ID NO: 771694 - RNA, 19 nt, Homo sapiens
aggcaaagcuguaauucua

SEQ ID NO: 771695 - RNA, 19 nt, Homo sapiens
uagaagauccuacaaauga

SEQ ID NO: 771696 - RNA, 19 nt, Homo sapiens
uaaccuaaaugcagagauu

SEQ ID NO: 771697 - RNA, 19 nt, Homo sapiens
gauaugaucacauguagaa

SEQ ID NO: 771698 - RNA, 19 nt, Homo sapiens
ucaccaagcaagauaauua

SEQ ID NO: 771699 - RNA, 19 nt, Homo sapiens
gcaaauccauuagcauaug

SEQ ID NO: 771700 - RNA, 19 nt, Homo sapiens
caacgaaacccaauugaga

SEQ ID NO: 771701 - RNA, 19 nt, Homo sapiens
ggagaagauuuagaaguuu

SEQ ID NO: 771702 - RNA, 19 nt, Homo sapiens
acaaauacccuacuucaaa

SEQ ID NO: 771703 - RNA, 19 nt, Homo sapiens
gagagaauaacaagcuuua

SEQ ID NO: 771704 - RNA, 19 nt, Homo sapiens
guaccuaaauucaacuuug

SEQ ID NO: 771705 - RNA, 19 nt, Homo sapiens
ggaacuauuuguaaacugu

SEQ ID NO: 771706 - RNA, 19 nt, Homo sapiens
gcaagucacuauucucauc

SEQ ID NO: 771707 - RNA, 19 nt, Homo sapiens
gaaauagaggaguuagaua

SEQ ID NO: 771708 - RNA, 19 nt, Homo sapiens
gaacaggcacuucugaaug

SEQ ID NO: 771709 - RNA, 19 nt, Homo sapiens
ugaaaggaguggcuaagaa

SEQ ID NO: 771710 - RNA, 19 nt, Homo sapiens
caacaaauggaucaaauug

SEQ ID NO: 771711 - RNA, 19 nt, Homo sapiens
uggaaagccuugcagauaa

SEQ ID NO: 771712 - RNA, 19 nt, Homo sapiens
gaaggaauccaaagagaga

SEQ ID NO: 771713 - RNA, 19 nt, Homo sapiens
ugacagcccucacaccaaa

SEQ ID NO: 771714 - RNA, 19 nt, Homo sapiens
agaagucccugauugaauu

SEQ ID NO: 771715 - RNA, 19 nt, Homo sapiens
ugaaagacaugaggaaaga

SEQ ID NO: 771716 - RNA, 19 nt, Homo sapiens
aaacaaaggcuaucaaaca

SEQ ID NO: 771717 - RNA, 19 nt, Homo sapiens
aaagagagauggagaacau

SEQ ID NO: 771718 - RNA, 19 nt, Homo sapiens
ccaaagcagugguuaaaca

SEQ ID NO: 771719 - RNA, 19 nt, Homo sapiens
aaacucgucuuacugcuuu

SEQ ID NO: 771720 - RNA, 19 nt, Homo sapiens
gacaguuucucccuuauau

SEQ ID NO: 771721 - RNA, 19 nt, Homo sapiens
ugaagagacucaauagaau

SEQ ID NO: 771722 - RNA, 19 nt, Homo sapiens
uggagaagauuuagaaguu

SEQ ID NO: 771723 - RNA, 19 nt, Homo sapiens
ggaaacaaaggcuaucaaa

SEQ ID NO: 771724 - RNA, 19 nt, Homo sapiens
ggagcuaucaaucaaauuu

SEQ ID NO: 771725 - RNA, 19 nt, Homo sapiens
gacaacaaauggaucaaau

SEQ ID NO: 771726 - RNA, 19 nt, Homo sapiens
guagaggaacuauuuguaa

SEQ ID NO: 771727 - RNA, 19 nt, Homo sapiens
uaaagaagcccaacuacug

SEQ ID NO: 771728 - RNA, 19 nt, Homo sapiens
ggucagagaagaggaaaua

SEQ ID NO: 771729 - RNA, 19 nt, Homo sapiens
aacagaaggugauaucuuu

SEQ ID NO: 771730 - RNA, 19 nt, Homo sapiens
gacuugaacuuauugagaa

SEQ ID NO: 771731 - RNA, 19 nt, Homo sapiens
ugaaggacuugaacuuauu

SEQ ID NO: 771732 - RNA, 19 nt, Homo sapiens
gauaugcuugcuucuauua

SEQ ID NO: 771733 - RNA, 19 nt, Homo sapiens
caaaucgaauuacuugaug

SEQ ID NO: 771734 - RNA, 19 nt, Homo sapiens
ugacaucuaucucaacguu

SEQ ID NO: 771735 - RNA, 19 nt, Homo sapiens
uuaaaggacucuucucuuc

SEQ ID NO: 771736 - RNA, 19 nt, Homo sapiens
ggaugugacuccugauaug

SEQ ID NO: 771737 - RNA, 19 nt, Homo sapiens
gugaaagaauggaugauug

SEQ ID NO: 771738 - RNA, 19 nt, Homo sapiens
gauaaauguuggcauaagu

SEQ ID NO: 771739 - RNA, 19 nt, Homo sapiens
uggacuaucuacugcauua

SEQ ID NO: 771740 - RNA, 19 nt, Homo sapiens
gaacugccagccauuacua

SEQ ID NO: 771741 - RNA, 19 nt, Homo sapiens
gagaagauuuagaaguuuc

SEQ ID NO: 771742 - RNA, 19 nt, Homo sapiens
gcuaagaauucucucuguu

SEQ ID NO: 771743 - RNA, 19 nt, Homo sapiens
gaaaggaguggcuaagaau

SEQ ID NO: 771744 - RNA, 19 nt, Homo sapiens
caaauugcaugcugaccaa

SEQ ID NO: 771745 - RNA, 19 nt, Homo sapiens
gaaagaccauguauuuagc

SEQ ID NO: 771746 - RNA, 19 nt, Homo sapiens
ggacguggcugcaaaucag

SEQ ID NO: 771747 - RNA, 19 nt, Homo sapiens
caaauacccuacuucaaag

SEQ ID NO: 771748 - RNA, 19 nt, Homo sapiens
caacaaauacccuacuuca

SEQ ID NO: 771749 - RNA, 19 nt, Homo sapiens
cuugacgacuccacagaua

SEQ ID NO: 771750 - RNA, 19 nt, Homo sapiens
gccaagaccacccaggaaa

SEQ ID NO: 771751 - RNA, 19 nt, Homo sapiens
ccgaagccauggcaagcaa

SEQ ID NO: 771752 - RNA, 19 nt, Homo sapiens
gggucggccuccugaaaug

SEQ ID NO: 771753 - RNA, 19 nt, Homo sapiens
ccaggaaaccaucgacaag

SEQ ID NO: 771754 - RNA, 19 nt, Homo sapiens
caggaaaccaucgacaaga

SEQ ID NO: 771755 - RNA, 19 nt, Homo sapiens
ggccaagaccacccaggaa

SEQ ID NO: 771756 - RNA, 19 nt, Homo sapiens
ucacguucccacccugaaa

SEQ ID NO: 771757 - RNA, 19 nt, Homo sapiens
cugcuaaccaggccucuga

SEQ ID NO: 771758 - RNA, 19 nt, Homo sapiens
ggaaaccaucgacaagacu

SEQ ID NO: 771759 - RNA, 19 nt, Homo sapiens
gaaaacagcuuggauauuu

SEQ ID NO: 771760 - RNA, 19 nt, Homo sapiens
gacagaaacugccuauuug

SEQ ID NO: 771761 - RNA, 19 nt, Homo sapiens
ugaaauggcucauaaguag

SEQ ID NO: 771762 - RNA, 19 nt, Homo sapiens
ugacagaaacugccuauuu

SEQ ID NO: 771763 - RNA, 19 nt, Homo sapiens
gcauuaaaccucacugaaa

SEQ ID NO: 771764 - RNA, 19 nt, Homo sapiens
uuacaucaauggcaaguuu

SEQ ID NO: 771765 - RNA, 19 nt, Homo sapiens
guacuaaccugggcaacaa

SEQ ID NO: 771766 - RNA, 19 nt, Homo sapiens
caacgaacauucacucucu

SEQ ID NO: 771767 - RNA, 19 nt, Homo sapiens
ggaagaauaucagaauugg

SEQ ID NO: 771768 - RNA, 19 nt, Homo sapiens
gcaaguuuaagaaggauaa

SEQ ID NO: 771769 - RNA, 19 nt, Homo sapiens
gggaagaauaucagaauug

SEQ ID NO: 771770 - RNA, 19 nt, Homo sapiens
gaacauucacucucucaca

SEQ ID NO: 771771 - RNA, 19 nt, Homo sapiens
gaagggaagaauaucagaa

SEQ ID NO: 771772 - RNA, 19 nt, Homo sapiens
gguagacauuucaaacugu

SEQ ID NO: 771773 - RNA, 19 nt, Homo sapiens
ggaaggagcaagccacagu

SEQ ID NO: 771774 - RNA, 19 nt, Homo sapiens
ccuacaaucccaacacuuu

SEQ ID NO: 771775 - RNA, 19 nt, Homo sapiens
cagaauugguagacauuuc

SEQ ID NO: 771776 - RNA, 19 nt, Homo sapiens
cucaugagguugcaguuaa

SEQ ID NO: 771777 - RNA, 19 nt, Homo sapiens
aguaguaucugcagugugu

SEQ ID NO: 771778 - RNA, 19 nt, Homo sapiens
agaaacugccuauuugaaa

SEQ ID NO: 771779 - RNA, 19 nt, Homo sapiens
cauuaaaccucacugaaac

SEQ ID NO: 771780 - RNA, 19 nt, Homo sapiens
aaccaggaguucaguacua

SEQ ID NO: 771781 - RNA, 19 nt, Homo sapiens
ccagaauguugcaagucua

SEQ ID NO: 771782 - RNA, 19 nt, Homo sapiens
ccuuucagcuccagaaugu

SEQ ID NO: 771783 - RNA, 19 nt, Homo sapiens
aaauggcucauaaguagua

SEQ ID NO: 771784 - RNA, 19 nt, Homo sapiens
cagaaacugccuauuugaa

SEQ ID NO: 771785 - RNA, 19 nt, Homo sapiens
uaucagaauugguagacau

SEQ ID NO: 771786 - RNA, 19 nt, Homo sapiens
cuggguaccuuacaucaau

SEQ ID NO: 771787 - RNA, 19 nt, Homo sapiens
ccaaggccacuucgucuga

SEQ ID NO: 771788 - RNA, 19 nt, Homo sapiens
uaaguaguaucugcagugu

SEQ ID NO: 771789 - RNA, 19 nt, Homo sapiens
gcugguggcuugguuacug

SEQ ID NO: 771790 - RNA, 19 nt, Homo sapiens
accgggagcuggucaagaa

SEQ ID NO: 771791 - RNA, 19 nt, Homo sapiens
cuaggagaguguuccaaug

SEQ ID NO: 771792 - RNA, 19 nt, Homo sapiens
ucaauggcaaguuuaagaa

SEQ ID NO: 771793 - RNA, 19 nt, Homo sapiens
cacaaacccuucacagacu

SEQ ID NO: 771794 - RNA, 19 nt, Homo sapiens
gaauguugcaagucuagga

SEQ ID NO: 771795 - RNA, 19 nt, Homo sapiens
gaauaucagaauugguaga

SEQ ID NO: 771796 - RNA, 19 nt, Homo sapiens
uuaaagcaacgaacauuca

SEQ ID NO: 771797 - RNA, 19 nt, Homo sapiens
ggacuggguaccuuacauc

SEQ ID NO: 771798 - RNA, 19 nt, Homo sapiens
gcuccagaauguugcaagu

SEQ ID NO: 771799 - RNA, 19 nt, Homo sapiens
gcccaagccucaggaugga

SEQ ID NO: 771800 - RNA, 19 nt, Homo sapiens
uugaaauggcucauaagua

SEQ ID NO: 771801 - RNA, 19 nt, Homo sapiens
uccaauggcugacagaaac

SEQ ID NO: 771802 - RNA, 19 nt, Homo sapiens
ggaaggggcaucacuugaa

SEQ ID NO: 771803 - RNA, 19 nt, Homo sapiens
ugguagacauuucaaacug

SEQ ID NO: 771804 - RNA, 19 nt, Homo sapiens
agggaagaauaucagaauu

SEQ ID NO: 771805 - RNA, 19 nt, Homo sapiens
gagccacccugagaagucu

SEQ ID NO: 771806 - RNA, 19 nt, Homo sapiens
ucuaugagccacccugaga

SEQ ID NO: 771807 - RNA, 19 nt, Homo sapiens
gaaauggcucauaaguagu

SEQ ID NO: 771808 - RNA, 19 nt, Homo sapiens
acagaaacugccuauuuga

SEQ ID NO: 771809 - RNA, 19 nt, Homo sapiens
cagcuuggauauuuuaaug

SEQ ID NO: 771810 - RNA, 19 nt, Homo sapiens
gaaugagguucuguguuuu

SEQ ID NO: 771811 - RNA, 19 nt, Homo sapiens
accaggaguucaguacuaa

SEQ ID NO: 771812 - RNA, 19 nt, Homo sapiens
guugcugccuuaacaaguc

SEQ ID NO: 771813 - RNA, 19 nt, Homo sapiens
gggagcuggucaagaacug

SEQ ID NO: 771814 - RNA, 19 nt, Homo sapiens
cuacaaucccaacacuuug

SEQ ID NO: 771815 - RNA, 19 nt, Homo sapiens
gaauugguagacauuucaa

SEQ ID NO: 771816 - RNA, 19 nt, Homo sapiens
ggauuugggagugauguau

SEQ ID NO: 771817 - RNA, 19 nt, Homo sapiens
uacacaaacccuucacaga

SEQ ID NO: 771818 - RNA, 19 nt, Homo sapiens
agucucacgugaucacuuc

SEQ ID NO: 771819 - RNA, 19 nt, Homo sapiens
ucucaugagguugcaguua

SEQ ID NO: 771820 - RNA, 19 nt, Homo sapiens
cauuucaaacugucacauu

SEQ ID NO: 771821 - RNA, 19 nt, Homo sapiens
ucaugagguugcaguuaag

SEQ ID NO: 771822 - RNA, 19 nt, Homo sapiens
gggauuugggagugaugua

SEQ ID NO: 771823 - RNA, 19 nt, Homo sapiens
gcaagucuaggagaguguu

SEQ ID NO: 771824 - RNA, 19 nt, Homo sapiens
agaauugguagacauuuca

SEQ ID NO: 771825 - RNA, 19 nt, Homo sapiens
gagggaggagaaugagguu

SEQ ID NO: 771826 - RNA, 19 nt, Homo sapiens
uccagaauguugcaagucu

SEQ ID NO: 771827 - RNA, 19 nt, Homo sapiens
gaaggggcaucacuugaac

SEQ ID NO: 771828 - RNA, 19 nt, Homo sapiens
gaagaauaucagaauuggu

SEQ ID NO: 771829 - RNA, 19 nt, Homo sapiens
aagggaagaauaucagaau

SEQ ID NO: 771830 - RNA, 19 nt, Homo sapiens
uaucugcaguguguucauc

SEQ ID NO: 771831 - RNA, 19 nt, Homo sapiens
gcugacagaaacugccuau

SEQ ID NO: 771832 - RNA, 19 nt, Homo sapiens
ugacccaggcguccuuuca

SEQ ID NO: 771833 - RNA, 19 nt, Homo sapiens
acaucaauggcaaguuuaa

SEQ ID NO: 771834 - RNA, 19 nt, Homo sapiens
caucagccaaggccacuuc

SEQ ID NO: 771835 - RNA, 19 nt, Homo sapiens
uuucagcuccagaauguug

SEQ ID NO: 771836 - RNA, 19 nt, Homo sapiens
gcacuaacaucaagcuuua

SEQ ID NO: 771837 - RNA, 19 nt, Homo sapiens
gcacagagcugacccgaaa

SEQ ID NO: 771838 - RNA, 19 nt, Homo sapiens
gcacugagguggcuuaugu

SEQ ID NO: 771839 - RNA, 19 nt, Homo sapiens
gggaggaccuucugaguuu

SEQ ID NO: 771840 - RNA, 19 nt, Homo sapiens
gagaagaggcuaaugauga

SEQ ID NO: 771841 - RNA, 19 nt, Homo sapiens
aaacagaacuucgcuuuga

SEQ ID NO: 771842 - RNA, 19 nt, Homo sapiens
gcagauguguucaaccaaa

SEQ ID NO: 771843 - RNA, 19 nt, Homo sapiens
gaacuuccuucucaucaug

SEQ ID NO: 771844 - RNA, 19 nt, Homo sapiens
gugaguggcugugucauua

SEQ ID NO: 771845 - RNA, 19 nt, Homo sapiens
cuaagacccuggagaauug

SEQ ID NO: 771846 - RNA, 19 nt, Homo sapiens
gaagccaaccacuaaauuu

SEQ ID NO: 771847 - RNA, 19 nt, Homo sapiens
gacuguaauugguuucuua

SEQ ID NO: 771848 - RNA, 19 nt, Homo sapiens
gcagaugggcugagauaaa

SEQ ID NO: 771849 - RNA, 19 nt, Homo sapiens
gagggacuccuuccaauaa

SEQ ID NO: 771850 - RNA, 19 nt, Homo sapiens
uaaccugacucuucuaauc

SEQ ID NO: 771851 - RNA, 19 nt, Homo sapiens
aagaacgacuguacaauga

SEQ ID NO: 771852 - RNA, 19 nt, Homo sapiens
gagcugacccgaaacaaga

SEQ ID NO: 771853 - RNA, 19 nt, Homo sapiens
acaagaagccaaccacuaa

SEQ ID NO: 771854 - RNA, 19 nt, Homo sapiens
gauuacaucucguuuagca

SEQ ID NO: 771855 - RNA, 19 nt, Homo sapiens
acaagaaauucaccuuuga

SEQ ID NO: 771856 - RNA, 19 nt, Homo sapiens
ccacuaaauuugaacuaga

SEQ ID NO: 771857 - RNA, 19 nt, Homo sapiens
cagaagagaugggagaaga

SEQ ID NO: 771858 - RNA, 19 nt, Homo sapiens
gggcaugucucaagaggau

SEQ ID NO: 771859 - RNA, 19 nt, Homo sapiens
cuucuaaucuugaaccaaa

SEQ ID NO: 771860 - RNA, 19 nt, Homo sapiens
gcacagcagcuacacagaa

SEQ ID NO: 771861 - RNA, 19 nt, Homo sapiens
caucagguguuuacuguuc

SEQ ID NO: 771862 - RNA, 19 nt, Homo sapiens
caagaacgacuguacaaug

SEQ ID NO: 771863 - RNA, 19 nt, Homo sapiens
ggaggcaucucagucaguu

SEQ ID NO: 771864 - RNA, 19 nt, Homo sapiens
ggaggaccuucugaguuua

SEQ ID NO: 771865 - RNA, 19 nt, Homo sapiens
aguaaacuguggacuagua

SEQ ID NO: 771866 - RNA, 19 nt, Homo sapiens
gggcaagucuacagugugu

SEQ ID NO: 771867 - RNA, 19 nt, Homo sapiens
acacuccuauguugcuuua

SEQ ID NO: 771868 - RNA, 19 nt, Homo sapiens
uaagaugccacuuugaauu

SEQ ID NO: 771869 - RNA, 19 nt, Homo sapiens
caccuaagaugccacuuug

SEQ ID NO: 771870 - RNA, 19 nt, Homo sapiens
guucauauucuaccucuaa

SEQ ID NO: 771871 - RNA, 19 nt, Homo sapiens
gaacgacuguacaaugaac

SEQ ID NO: 771872 - RNA, 19 nt, Homo sapiens
aaguguagcuggcuucauu

SEQ ID NO: 771873 - RNA, 19 nt, Homo sapiens
gacaagaagccaaccacua

SEQ ID NO: 771874 - RNA, 19 nt, Homo sapiens
aagaaccgcuuguaguuug

SEQ ID NO: 771875 - RNA, 19 nt, Homo sapiens
gaugaaagugugaauuaga

SEQ ID NO: 771876 - RNA, 19 nt, Homo sapiens
uggaugaaagugugaauua

SEQ ID NO: 771877 - RNA, 19 nt, Homo sapiens
gaaacagaacuucgcuuug

SEQ ID NO: 771878 - RNA, 19 nt, Homo sapiens
gaaacaagaaauucaccuu

SEQ ID NO: 771879 - RNA, 19 nt, Homo sapiens
ggaugaaagugugaauuag

SEQ ID NO: 771880 - RNA, 19 nt, Homo sapiens
gaaauucaccuuugaugcu

SEQ ID NO: 771881 - RNA, 19 nt, Homo sapiens
gaugacagcuuggugaaac

SEQ ID NO: 771882 - RNA, 19 nt, Homo sapiens
aacaagaaauucaccuuug

SEQ ID NO: 771883 - RNA, 19 nt, Homo sapiens
ugccuucaaugucaaauuu

SEQ ID NO: 771884 - RNA, 19 nt, Homo sapiens
ugagguggaugucguuguu

SEQ ID NO: 771885 - RNA, 19 nt, Homo sapiens
gagcguauccgugaguauu

SEQ ID NO: 771886 - RNA, 19 nt, Homo sapiens
gccaaccacuaaauuugaa

SEQ ID NO: 771887 - RNA, 19 nt, Homo sapiens
gugaaaaucuacaaaguug

SEQ ID NO: 771888 - RNA, 19 nt, Homo sapiens
cuucugaguuuaccuguug

SEQ ID NO: 771889 - RNA, 19 nt, Homo sapiens
gcuuguaguuugguuuaaa

SEQ ID NO: 771890 - RNA, 19 nt, Homo sapiens
ucauggaucugaaguagag

SEQ ID NO: 771891 - RNA, 19 nt, Homo sapiens
uagcagauguguucaacca

SEQ ID NO: 771892 - RNA, 19 nt, Homo sapiens
ggaccuagaccgagacagu

SEQ ID NO: 771893 - RNA, 19 nt, Homo sapiens
agaaacagaacuucgcuuu

SEQ ID NO: 771894 - RNA, 19 nt, Homo sapiens
gugcggaacugcguuuguu

SEQ ID NO: 771895 - RNA, 19 nt, Homo sapiens
gacagugagucucucuuuc

SEQ ID NO: 771896 - RNA, 19 nt, Homo sapiens
gcauggcuguucugugcaa

SEQ ID NO: 771897 - RNA, 19 nt, Homo sapiens
ggagaagaggcuaaugaug

SEQ ID NO: 771898 - RNA, 19 nt, Homo sapiens
gcaaacuacacaucccaaa

SEQ ID NO: 771899 - RNA, 19 nt, Homo sapiens
gcaugucucaagaggauaa

SEQ ID NO: 771900 - RNA, 19 nt, Homo sapiens
caucccagacuccuguuua

SEQ ID NO: 771901 - RNA, 19 nt, Homo sapiens
gaauugcauuucuuucacu

SEQ ID NO: 771902 - RNA, 19 nt, Homo sapiens
ggaaaaccaugagacugua

SEQ ID NO: 771903 - RNA, 19 nt, Homo sapiens
uggcuuaugucuccaagga

SEQ ID NO: 771904 - RNA, 19 nt, Homo sapiens
ccaccuaagaugccacuuu

SEQ ID NO: 771905 - RNA, 19 nt, Homo sapiens
uagagggacuccuuccaau

SEQ ID NO: 771906 - RNA, 19 nt, Homo sapiens
ccuaagaugccacuuugaa

SEQ ID NO: 771907 - RNA, 19 nt, Homo sapiens
gguaaccugacucuucuaa

SEQ ID NO: 771908 - RNA, 19 nt, Homo sapiens
gaaaguucauauucuaccu

SEQ ID NO: 771909 - RNA, 19 nt, Homo sapiens
caagaagccaaccacuaaa

SEQ ID NO: 771910 - RNA, 19 nt, Homo sapiens
caccaccuacugaguguua

SEQ ID NO: 771911 - RNA, 19 nt, Homo sapiens
ggaugucguuguuguucug

SEQ ID NO: 771912 - RNA, 19 nt, Homo sapiens
gcacgaauaaugacaacag

SEQ ID NO: 771913 - RNA, 19 nt, Homo sapiens
acuuguagcuggaagaaau

SEQ ID NO: 771914 - RNA, 19 nt, Homo sapiens
cagaugggcugagauaaaa

SEQ ID NO: 771915 - RNA, 19 nt, Homo sapiens
guguggaccuggagcauca

SEQ ID NO: 771916 - RNA, 19 nt, Homo sapiens
ccagacuccuguuuaccuu

SEQ ID NO: 771917 - RNA, 19 nt, Homo sapiens
gaucaagaacgacuguaca

SEQ ID NO: 771918 - RNA, 19 nt, Homo sapiens
aaacaauccuuugacuaca

SEQ ID NO: 771919 - RNA, 19 nt, Homo sapiens
gagaugacagcuuggugaa

SEQ ID NO: 771920 - RNA, 19 nt, Homo sapiens
ugaauuagagggacuccuu

SEQ ID NO: 771921 - RNA, 19 nt, Homo sapiens
ugacucuucuaaucuugaa

SEQ ID NO: 771922 - RNA, 19 nt, Homo sapiens
ggacacuccuauguugcuu

SEQ ID NO: 771923 - RNA, 19 nt, Homo sapiens
ucuaagacccuggagaauu

SEQ ID NO: 771924 - RNA, 19 nt, Homo sapiens
gugguaaccugacucuucu

SEQ ID NO: 771925 - RNA, 19 nt, Homo sapiens
agacuccuguuuaccuuug

SEQ ID NO: 771926 - RNA, 19 nt, Homo sapiens
ggcacuaacaucaagcuuu

SEQ ID NO: 771927 - RNA, 19 nt, Homo sapiens
ugacuggcauggcagagau

SEQ ID NO: 771928 - RNA, 19 nt, Homo sapiens
ccaugagacuguaauuggu

SEQ ID NO: 771929 - RNA, 19 nt, Homo sapiens
gguguuuacuguucugucu

SEQ ID NO: 771930 - RNA, 19 nt, Homo sapiens
gagcaucagguguuuacug

SEQ ID NO: 771931 - RNA, 19 nt, Homo sapiens
agagggacuccuuccaaua

SEQ ID NO: 771932 - RNA, 19 nt, Homo sapiens
cacuuugaauucucuaaga

SEQ ID NO: 771933 - RNA, 19 nt, Homo sapiens
caagaaauucaccuuugau

SEQ ID NO: 771934 - RNA, 19 nt, Homo sapiens
gggagaagaggcuaaugau

SEQ ID NO: 771935 - RNA, 19 nt, Homo sapiens
aaacuguggacuaguagaa

SEQ ID NO: 771936 - RNA, 19 nt, Homo sapiens
gcacuacacuuccuugaga

SEQ ID NO: 771937 - RNA, 19 nt, Homo sapiens
gaagagaagauuaucauug

SEQ ID NO: 771938 - RNA, 19 nt, Homo sapiens
ggagguggaugcagcagua

SEQ ID NO: 771939 - RNA, 19 nt, Homo sapiens
aaaccgcugucauuaauaa

SEQ ID NO: 771940 - RNA, 19 nt, Homo sapiens
gagagaaaccgcugucauu

SEQ ID NO: 771941 - RNA, 19 nt, Homo sapiens
gagaaaccgcugucauuaa

SEQ ID NO: 771942 - RNA, 19 nt, Homo sapiens
ucaaggagcuggaguuucu

SEQ ID NO: 771943 - RNA, 19 nt, Homo sapiens
agaaaccgcugucauuaau

SEQ ID NO: 771944 - RNA, 19 nt, Homo sapiens
ccaaggaggagcaguuuaa

SEQ ID NO: 771945 - RNA, 19 nt, Homo sapiens
ccacguagcccgaaugaca

SEQ ID NO: 771946 - RNA, 19 nt, Homo sapiens
gaaaccgcugucauuaaua

SEQ ID NO: 771947 - RNA, 19 nt, Homo sapiens
gauuaucauugacaaggaa

SEQ ID NO: 771948 - RNA, 19 nt, Homo sapiens
agagaaaccgcugucauua

SEQ ID NO: 771949 - RNA, 19 nt, Homo sapiens
cagacaaguucaagacaga

SEQ ID NO: 771950 - RNA, 19 nt, Homo sapiens
caaguucaauguccucuac

SEQ ID NO: 771951 - RNA, 19 nt, Homo sapiens
ggaagagaagauuaucauu

SEQ ID NO: 771952 - RNA, 19 nt, Homo sapiens
ggagugacugggaguguuu

SEQ ID NO: 771953 - RNA, 19 nt, Homo sapiens
gaaauaucgaggugaugaa

SEQ ID NO: 771954 - RNA, 19 nt, Homo sapiens
cgaaauaucgaggugauga

SEQ ID NO: 771955 - RNA, 19 nt, Homo sapiens
gcacagacaaguucaagac

SEQ ID NO: 771956 - RNA, 19 nt, Homo sapiens
ggaggccuaugcucugugu

SEQ ID NO: 771957 - RNA, 19 nt, Homo sapiens
gagaagauuaucauugaca

SEQ ID NO: 771958 - RNA, 19 nt, Homo sapiens
cagcacagcgccaucaaga

SEQ ID NO: 771959 - RNA, 19 nt, Homo sapiens
gcucagcacagacaaguuc

SEQ ID NO: 771960 - RNA, 19 nt, Homo sapiens
gcaggugugugagaucauc

SEQ ID NO: 771961 - RNA, 19 nt, Homo sapiens
gcaggagggccgaaauauc

SEQ ID NO: 771962 - RNA, 19 nt, Homo sapiens
gcacagcacagcgccauca

SEQ ID NO: 771963 - RNA, 19 nt, Homo sapiens
gugauggccugcggaguga

SEQ ID NO: 771964 - RNA, 19 nt, Homo sapiens
gccgaaauaucgaggugau

SEQ ID NO: 771965 - RNA, 19 nt, Homo sapiens
caaggcaucggcaggagaa

SEQ ID NO: 771966 - RNA, 19 nt, Homo sapiens
agaggaagcggaacgcauu

SEQ ID NO: 771967 - RNA, 19 nt, Homo sapiens
caauggagaggccacaaug

SEQ ID NO: 771968 - RNA, 19 nt, Homo sapiens
gcaacaggcaguggagaga

SEQ ID NO: 771969 - RNA, 19 nt, Homo sapiens
aagcaggagggccgaaaua

SEQ ID NO: 771970 - RNA, 19 nt, Homo sapiens
caaggaggagcaguuuaaa

SEQ ID NO: 771971 - RNA, 19 nt, Homo sapiens
ucaggcaacuaucccaaag

SEQ ID NO: 771972 - RNA, 19 nt, Homo sapiens
gacaaguucaagacagauu

SEQ ID NO: 771973 - RNA, 19 nt, Homo sapiens
ggaacgcauugguguagac

SEQ ID NO: 771974 - RNA, 19 nt, Homo sapiens
uugagucugucauugauau

SEQ ID NO: 771975 - RNA, 19 nt, Homo sapiens
gaucuuccugucagcguuu

SEQ ID NO: 771976 - RNA, 19 nt, Homo sapiens
uacacuuccuugagagaaa

SEQ ID NO: 771977 - RNA, 19 nt, Homo sapiens
gagucugucauugauauaa

SEQ ID NO: 771978 - RNA, 19 nt, Homo sapiens
uccauaagcagguguguga

SEQ ID NO: 771979 - RNA, 19 nt, Homo sapiens
guucaaggagcuggaguuu

SEQ ID NO: 771980 - RNA, 19 nt, Homo sapiens
gaccacguagcccgaauga

SEQ ID NO: 771981 - RNA, 19 nt, Homo sapiens
gcaagcaggagggccgaaa

SEQ ID NO: 771982 - RNA, 19 nt, Homo sapiens
ggagagguccccuuuaauc

SEQ ID NO: 771983 - RNA, 19 nt, Homo sapiens
caacaggcaguggagagaa

SEQ ID NO: 771984 - RNA, 19 nt, Homo sapiens
ugaccaagcacacagaucu

SEQ ID NO: 771985 - RNA, 19 nt, Homo sapiens
gaguuucuggguugguaua

SEQ ID NO: 771986 - RNA, 19 nt, Homo sapiens
caggagggccgaaauaucg

SEQ ID NO: 771987 - RNA, 19 nt, Homo sapiens
cauaagcaggugugugaga

SEQ ID NO: 771988 - RNA, 19 nt, Homo sapiens
aggaggagcaguuuaaaca

SEQ ID NO: 771989 - RNA, 19 nt, Homo sapiens
gaagauuaucauugacaag

SEQ ID NO: 771990 - RNA, 19 nt, Homo sapiens
uggaguuucuggguuggua

SEQ ID NO: 771991 - RNA, 19 nt, Homo sapiens
aagcaggugugugagauca

SEQ ID NO: 771992 - RNA, 19 nt, Homo sapiens
ggagggcacuacacuuccu

SEQ ID NO: 771993 - RNA, 19 nt, Homo sapiens
acaaguucaagacagauuu

SEQ ID NO: 771994 - RNA, 19 nt, Homo sapiens
gaggaagcggaacgcauug

SEQ ID NO: 771995 - RNA, 19 nt, Homo sapiens
gaggugaugaacuccuuug

SEQ ID NO: 771996 - RNA, 19 nt, Homo sapiens
gagguccccuuuaaucaug

SEQ ID NO: 771997 - RNA, 19 nt, Homo sapiens
guacgucaaggccucugaa

SEQ ID NO: 771998 - RNA, 19 nt, Homo sapiens
uugcugagcugaccuacac

SEQ ID NO: 771999 - RNA, 19 nt, Homo sapiens
agauuaucauugacaagga

SEQ ID NO: 772000 - RNA, 19 nt, Homo sapiens
cggagugacugggaguguu

SEQ ID NO: 772001 - RNA, 19 nt, Homo sapiens
gcggaacgcauugguguag

SEQ ID NO: 772002 - RNA, 19 nt, Homo sapiens
gagaggccacaaugcuguu

SEQ ID NO: 772003 - RNA, 19 nt, Homo sapiens
gaccaagcacacagaucuu

SEQ ID NO: 772004 - RNA, 19 nt, Homo sapiens
caccaaggaggagcaguuu

SEQ ID NO: 772005 - RNA, 19 nt, Homo sapiens
ucgaggugaugaacuccuu

SEQ ID NO: 772006 - RNA, 19 nt, Homo sapiens
ugaacccuaugaccaagca

SEQ ID NO: 772007 - RNA, 19 nt, Homo sapiens
uggaagagaagauuaucau

SEQ ID NO: 772008 - RNA, 19 nt, Homo sapiens
acaccaaggaggagcaguu

SEQ ID NO: 772009 - RNA, 19 nt, Homo sapiens
gggcacuacacuuccuuga

SEQ ID NO: 772010 - RNA, 19 nt, Homo sapiens
auaagcaggugugugagau

SEQ ID NO: 772011 - RNA, 19 nt, Homo sapiens
aaagugaucuggauaguaa

SEQ ID NO: 772012 - RNA, 19 nt, Homo sapiens
caccaaagcuuuccuaaug

SEQ ID NO: 772013 - RNA, 19 nt, Homo sapiens
gguuacagaugucauguua

SEQ ID NO: 772014 - RNA, 19 nt, Homo sapiens
gagaauggguuacagaugu

SEQ ID NO: 772015 - RNA, 19 nt, Homo sapiens
ucaagaaguuccacauuug

SEQ ID NO: 772016 - RNA, 19 nt, Homo sapiens
ugaagaaguuccugagaau

SEQ ID NO: 772017 - RNA, 19 nt, Homo sapiens
ccaaagcuuuccuaaugaa

SEQ ID NO: 772018 - RNA, 19 nt, Homo sapiens
caacaugacccgaguauac

SEQ ID NO: 772019 - RNA, 19 nt, Homo sapiens
gcuaguggcucuguaacuu

SEQ ID NO: 772020 - RNA, 19 nt, Homo sapiens
gauaguaaaguucaucuuc

SEQ ID NO: 772021 - RNA, 19 nt, Homo sapiens
caauuaggcuuuugucauu

SEQ ID NO: 772022 - RNA, 19 nt, Homo sapiens
ugaaaccucugcaaaggau

SEQ ID NO: 772023 - RNA, 19 nt, Homo sapiens
ggagcgauuuggcaacaug

SEQ ID NO: 772024 - RNA, 19 nt, Homo sapiens
ugucauuguugccaucaua

SEQ ID NO: 772025 - RNA, 19 nt, Homo sapiens
cuuaacagaugacaauuag

SEQ ID NO: 772026 - RNA, 19 nt, Homo sapiens
cgccugcacuuauuugaaa

SEQ ID NO: 772027 - RNA, 19 nt, Homo sapiens
cugaagaaguuccugagaa

SEQ ID NO: 772028 - RNA, 19 nt, Homo sapiens
guaaaguucaucuuccaaa

SEQ ID NO: 772029 - RNA, 19 nt, Homo sapiens
caagaaguuccacauuuga

SEQ ID NO: 772030 - RNA, 19 nt, Homo sapiens
ugguaaggcuuccaaguug

SEQ ID NO: 772031 - RNA, 19 nt, Homo sapiens
aaauggaacuuugggagaa

SEQ ID NO: 772032 - RNA, 19 nt, Homo sapiens
guaaggcuuccaaguugua

SEQ ID NO: 772033 - RNA, 19 nt, Homo sapiens
uaguggcucuguaacuuaa

SEQ ID NO: 772034 - RNA, 19 nt, Homo sapiens
aucaagaaguuccacauuu

SEQ ID NO: 772035 - RNA, 19 nt, Homo sapiens
gguaaggcuuccaaguugu

SEQ ID NO: 772036 - RNA, 19 nt, Homo sapiens
gacaguagccagaguccuu

SEQ ID NO: 772037 - RNA, 19 nt, Homo sapiens
cagaugacaauuaggcuuu

SEQ ID NO: 772038 - RNA, 19 nt, Homo sapiens
cugcaaaggauaacauaaa

SEQ ID NO: 772039 - RNA, 19 nt, Homo sapiens
cauguuagcugggagucuu

SEQ ID NO: 772040 - RNA, 19 nt, Homo sapiens
gaagaaguuccugagaaug

SEQ ID NO: 772041 - RNA, 19 nt, Homo sapiens
ggcaagaccagcaucauca

SEQ ID NO: 772042 - RNA, 19 nt, Homo sapiens
gcaaaggauaacauaaaca

SEQ ID NO: 772043 - RNA, 19 nt, Homo sapiens
gaccagaacaaggacagua

SEQ ID NO: 772044 - RNA, 19 nt, Homo sapiens
uuacagaugucauguuagc

SEQ ID NO: 772045 - RNA, 19 nt, Homo sapiens
aagcuuuccuaaugaagaa

SEQ ID NO: 772046 - RNA, 19 nt, Homo sapiens
gcaagaccagcaucaucaa

SEQ ID NO: 772047 - RNA, 19 nt, Homo sapiens
cuaguggcucuguaacuua

SEQ ID NO: 772048 - RNA, 19 nt, Homo sapiens
caguguugcugauauaugg

SEQ ID NO: 772049 - RNA, 19 nt, Homo sapiens
ucccaguguugcugauaua

SEQ ID NO: 772050 - RNA, 19 nt, Homo sapiens
guaaaccaccaaagcuuuc

SEQ ID NO: 772051 - RNA, 19 nt, Homo sapiens
gcuuccaaguuguagcuuu

SEQ ID NO: 772052 - RNA, 19 nt, Homo sapiens
gcaacaugacccgaguaua

SEQ ID NO: 772053 - RNA, 19 nt, Homo sapiens
ugaucuggauaguaaaguu

SEQ ID NO: 772054 - RNA, 19 nt, Homo sapiens
gaaaagugaucuggauagu

SEQ ID NO: 772055 - RNA, 19 nt, Homo sapiens
uaucaagaaguuccacauu

SEQ ID NO: 772056 - RNA, 19 nt, Homo sapiens
accaaagcuuuccuaauga

SEQ ID NO: 772057 - RNA, 19 nt, Homo sapiens
uguaaaccaccaaagcuuu

SEQ ID NO: 772058 - RNA, 19 nt, Homo sapiens
caaggacaguagccagagu

SEQ ID NO: 772059 - RNA, 19 nt, Homo sapiens
cacauuugaggcagucuua

SEQ ID NO: 772060 - RNA, 19 nt, Homo sapiens
ccgaguauacuacaaggaa

SEQ ID NO: 772061 - RNA, 19 nt, Homo sapiens
aaaacgauguggacaaaau

SEQ ID NO: 772062 - RNA, 19 nt, Homo sapiens
aaaccucugcaaaggauaa

SEQ ID NO: 772063 - RNA, 19 nt, Homo sapiens
agaaguaucccugcuagug

SEQ ID NO: 772064 - RNA, 19 nt, Homo sapiens
ggacaaaauuaagcuagau

SEQ ID NO: 772065 - RNA, 19 nt, Homo sapiens
cugcuguccucuuggcuaa

SEQ ID NO: 772066 - RNA, 19 nt, Homo sapiens
uaucccugcuguccucuug

SEQ ID NO: 772067 - RNA, 19 nt, Homo sapiens
ccaaauggcagcccuaucc

SEQ ID NO: 772068 - RNA, 19 nt, Homo sapiens
gggcaagaccagcaucauc

SEQ ID NO: 772069 - RNA, 19 nt, Homo sapiens
caggagcgauuuggcaaca

SEQ ID NO: 772070 - RNA, 19 nt, Homo sapiens
aaaguucaucuuccaaaug

SEQ ID NO: 772071 - RNA, 19 nt, Homo sapiens
gaucuggauaguaaaguuc

SEQ ID NO: 772072 - RNA, 19 nt, Homo sapiens
cauuugaggcagucuuaaa

SEQ ID NO: 772073 - RNA, 19 nt, Homo sapiens
auauauggcuucugcuucu

SEQ ID NO: 772074 - RNA, 19 nt, Homo sapiens
agaaaacgauguggacaaa

SEQ ID NO: 772075 - RNA, 19 nt, Homo sapiens
ccaccaaagcuuuccuaau

SEQ ID NO: 772076 - RNA, 19 nt, Homo sapiens
cuucccagguggaccaauu

SEQ ID NO: 772077 - RNA, 19 nt, Homo sapiens
aaguucaucuuccaaaugg

SEQ ID NO: 772078 - RNA, 19 nt, Homo sapiens
caucauauggaagauaaug

SEQ ID NO: 772079 - RNA, 19 nt, Homo sapiens
gugcuggggugguaauaaa

SEQ ID NO: 772080 - RNA, 19 nt, Homo sapiens
gcuguccucuuggcuaaca

SEQ ID NO: 772081 - RNA, 19 nt, Homo sapiens
ugcaaaggauaacauaaac

SEQ ID NO: 772082 - RNA, 19 nt, Homo sapiens
uaguaaaguucaucuucca

SEQ ID NO: 772083 - RNA, 19 nt, Homo sapiens
cuugagagcagagaacaaa

SEQ ID NO: 772084 - RNA, 19 nt, Homo sapiens
gaaaccucugcaaaggaua

SEQ ID NO: 772085 - RNA, 19 nt, Homo sapiens
gcgccugcacuuauuugaa

SEQ ID NO: 772086 - RNA, 19 nt, Homo sapiens
uggcuuugccggaugguuu

SEQ ID NO: 772087 - RNA, 19 nt, Homo sapiens
ggcaacaugacccgaguau

SEQ ID NO: 772088 - RNA, 19 nt, Homo sapiens
ugagagcagagaacaaauc

SEQ ID NO: 772089 - RNA, 19 nt, Homo sapiens
aaagcuuuccuaaugaaga

SEQ ID NO: 772090 - RNA, 19 nt, Homo sapiens
agaauggguuacagauguc

SEQ ID NO: 772091 - RNA, 19 nt, Homo sapiens
ugagaauggguuacagaug

SEQ ID NO: 772092 - RNA, 19 nt, Homo sapiens
ugacccgaguauacuacaa

SEQ ID NO: 772093 - RNA, 19 nt, Homo sapiens
guggaccaauucugcaaag

SEQ ID NO: 772094 - RNA, 19 nt, Homo sapiens
ggauaguaaaguucaucuu

SEQ ID NO: 772095 - RNA, 19 nt, Homo sapiens
gagcgauuuggcaacauga

SEQ ID NO: 772096 - RNA, 19 nt, Homo sapiens
gaggcagucuuaaaaugga

SEQ ID NO: 772097 - RNA, 19 nt, Homo sapiens
aagaaguuccugagaaugg

SEQ ID NO: 772098 - RNA, 19 nt, Homo sapiens
ugauauauggcuucugcuu

SEQ ID NO: 772099 - RNA, 19 nt, Homo sapiens
ggaaaagugaucuggauag

SEQ ID NO: 772100 - RNA, 19 nt, Homo sapiens
aguuguagcuuuuagugua

SEQ ID NO: 772101 - RNA, 19 nt, Homo sapiens
gaacaaagggaaacagaua

SEQ ID NO: 772102 - RNA, 19 nt, Homo sapiens
ggaaacagauacuugauau

SEQ ID NO: 772103 - RNA, 19 nt, Homo sapiens
cccaauaucuucuagaaua

SEQ ID NO: 772104 - RNA, 19 nt, Homo sapiens
gugaagaccuuauuaauag

SEQ ID NO: 772105 - RNA, 19 nt, Homo sapiens
aagcaaagcuggaacauga

SEQ ID NO: 772106 - RNA, 19 nt, Homo sapiens
gaacagguacauucauuaa

SEQ ID NO: 772107 - RNA, 19 nt, Homo sapiens
gaagugaagaccuuauuaa

SEQ ID NO: 772108 - RNA, 19 nt, Homo sapiens
gaauggcggucaaugugua

SEQ ID NO: 772109 - RNA, 19 nt, Homo sapiens
gaacguugauaagguaauu

SEQ ID NO: 772110 - RNA, 19 nt, Homo sapiens
ccauggcaauucauaaaua

SEQ ID NO: 772111 - RNA, 19 nt, Homo sapiens
gcuggaacaugaauauauu

SEQ ID NO: 772112 - RNA, 19 nt, Homo sapiens
cacaguauguuguuaguuu

SEQ ID NO: 772113 - RNA, 19 nt, Homo sapiens
gaaugaacguugauaaggu

SEQ ID NO: 772114 - RNA, 19 nt, Homo sapiens
gugaaacaaugguaauuug

SEQ ID NO: 772115 - RNA, 19 nt, Homo sapiens
gauaauaacgggaccauca

SEQ ID NO: 772116 - RNA, 19 nt, Homo sapiens
gaaauucuaugaugcuaac

SEQ ID NO: 772117 - RNA, 19 nt, Homo sapiens
gaacaacaacgacaucauc

SEQ ID NO: 772118 - RNA, 19 nt, Homo sapiens
gagauugguucugcucuuu

SEQ ID NO: 772119 - RNA, 19 nt, Homo sapiens
ccacuuggcugcuugagau

SEQ ID NO: 772120 - RNA, 19 nt, Homo sapiens
gcuaaaccauggcaauuca

SEQ ID NO: 772121 - RNA, 19 nt, Homo sapiens
gaaaccaguuguucccaau

SEQ ID NO: 772122 - RNA, 19 nt, Homo sapiens
gguuuacuuucacuuguua

SEQ ID NO: 772123 - RNA, 19 nt, Homo sapiens
gcucuucccuggcugcauu

SEQ ID NO: 772124 - RNA, 19 nt, Homo sapiens
ucacaauacuaaagggaaa

SEQ ID NO: 772125 - RNA, 19 nt, Homo sapiens
gggaaacagauacuugaua

SEQ ID NO: 772126 - RNA, 19 nt, Homo sapiens
caccuugguuucuaacuuu

SEQ ID NO: 772127 - RNA, 19 nt, Homo sapiens
ucuaaccucugaacauaaa

SEQ ID NO: 772128 - RNA, 19 nt, Homo sapiens
agucuaaccucugaacaua

SEQ ID NO: 772129 - RNA, 19 nt, Homo sapiens
aaugaacguugauaaggua

SEQ ID NO: 772130 - RNA, 19 nt, Homo sapiens
gagcuacucugccaagaac

SEQ ID NO: 772131 - RNA, 19 nt, Homo sapiens
uuagacaacuacacaguau

SEQ ID NO: 772132 - RNA, 19 nt, Homo sapiens
gaucguagggucacauuca

SEQ ID NO: 772133 - RNA, 19 nt, Homo sapiens
ggaguaugauccuguagag

SEQ ID NO: 772134 - RNA, 19 nt, Homo sapiens
gcauuaguuugaagaaagu

SEQ ID NO: 772135 - RNA, 19 nt, Homo sapiens
uaaugacggugacuugugu

SEQ ID NO: 772136 - RNA, 19 nt, Homo sapiens
aagaggguaugguuaggua

SEQ ID NO: 772137 - RNA, 19 nt, Homo sapiens
uaaaccauggcaauucaua

SEQ ID NO: 772138 - RNA, 19 nt, Homo sapiens
uguagacacuggaauaaca

SEQ ID NO: 772139 - RNA, 19 nt, Homo sapiens
ccaaagaggguaugguuag

SEQ ID NO: 772140 - RNA, 19 nt, Homo sapiens
caagaacacgggcaggaaa

SEQ ID NO: 772141 - RNA, 19 nt, Homo sapiens
cuuccuggaucauucauuu

SEQ ID NO: 772142 - RNA, 19 nt, Homo sapiens
uggaauaacagcacagaaa

SEQ ID NO: 772143 - RNA, 19 nt, Homo sapiens
agaagugaagaccuuauua

SEQ ID NO: 772144 - RNA, 19 nt, Homo sapiens
gaaaacaccaucucaacuu

SEQ ID NO: 772145 - RNA, 19 nt, Homo sapiens
gacauucacucaaggaaaa

SEQ ID NO: 772146 - RNA, 19 nt, Homo sapiens
ggauucaaagcuaggauuu

SEQ ID NO: 772147 - RNA, 19 nt, Homo sapiens
cauccaacuucaccacuug

SEQ ID NO: 772148 - RNA, 19 nt, Homo sapiens
ugacuuagcaggugcaaca

SEQ ID NO: 772149 - RNA, 19 nt, Homo sapiens
ucacauucauccaacuuca

SEQ ID NO: 772150 - RNA, 19 nt, Homo sapiens
gcucuugacacuuccauug

SEQ ID NO: 772151 - RNA, 19 nt, Homo sapiens
cggcugcucuugacacuuc

SEQ ID NO: 772152 - RNA, 19 nt, Homo sapiens
aaaccaggauccacaccuu

SEQ ID NO: 772153 - RNA, 19 nt, Homo sapiens
gaagaccuuauuaauagga

SEQ ID NO: 772154 - RNA, 19 nt, Homo sapiens
ccacacacuugcuguaagg

SEQ ID NO: 772155 - RNA, 19 nt, Homo sapiens
aaacugucauucacucuag

SEQ ID NO: 772156 - RNA, 19 nt, Homo sapiens
uaauggacauccuguaugc

SEQ ID NO: 772157 - RNA, 19 nt, Homo sapiens
ugagagagaucgagcuacu

SEQ ID NO: 772158 - RNA, 19 nt, Homo sapiens
cacagcaggugcagcuaaa

SEQ ID NO: 772159 - RNA, 19 nt, Homo sapiens
ucaccuugguuucuaacuu

SEQ ID NO: 772160 - RNA, 19 nt, Homo sapiens
cauggcaauucauaaauag

SEQ ID NO: 772161 - RNA, 19 nt, Homo sapiens
gcaccaugccacacacuug

SEQ ID NO: 772162 - RNA, 19 nt, Homo sapiens
ccucuacucacaauacuaa

SEQ ID NO: 772163 - RNA, 19 nt, Homo sapiens
gggaauggcggucaaugug

SEQ ID NO: 772164 - RNA, 19 nt, Homo sapiens
uggagaagcuagugaaagg

SEQ ID NO: 772165 - RNA, 19 nt, Homo sapiens
gcaaagcuggaacaugaau

SEQ ID NO: 772166 - RNA, 19 nt, Homo sapiens
guuagacaacuacacagua

SEQ ID NO: 772167 - RNA, 19 nt, Homo sapiens
gaaacagauacuugauaug

SEQ ID NO: 772168 - RNA, 19 nt, Homo sapiens
uugcaagucuaaccucuga

SEQ ID NO: 772169 - RNA, 19 nt, Homo sapiens
cauccuguaugcuucagaa

SEQ ID NO: 772170 - RNA, 19 nt, Homo sapiens
ccaaauggcgagaacaaca

SEQ ID NO: 772171 - RNA, 19 nt, Homo sapiens
gcuguaaggcuagaaguga

SEQ ID NO: 772172 - RNA, 19 nt, Homo sapiens
caaauggcgagaacaacaa

SEQ ID NO: 772173 - RNA, 19 nt, Homo sapiens
ccacagcaggugcagcuaa

SEQ ID NO: 772174 - RNA, 19 nt, Homo sapiens
cagcaguguuccuccauca

SEQ ID NO: 772175 - RNA, 19 nt, Homo sapiens
ggucaaauaauuggaacaa

SEQ ID NO: 772176 - RNA, 19 nt, Homo sapiens
ggagcaagcccacgaacag

SEQ ID NO: 772177 - RNA, 19 nt, Homo sapiens
ggaauggcggucaaugugu

SEQ ID NO: 772178 - RNA, 19 nt, Homo sapiens
gcacgacaagggcaagaug

SEQ ID NO: 772179 - RNA, 19 nt, Homo sapiens
guucaggagcggccuauug

SEQ ID NO: 772180 - RNA, 19 nt, Homo sapiens
ggaauaacagcacagaaaa

SEQ ID NO: 772181 - RNA, 19 nt, Homo sapiens
aaagggaaacagauacuug

SEQ ID NO: 772182 - RNA, 19 nt, Homo sapiens
ggaacaaagggaaacagau

SEQ ID NO: 772183 - RNA, 19 nt, Homo sapiens
caaauaauuggaacaaagg

SEQ ID NO: 772184 - RNA, 19 nt, Homo sapiens
gccccaagcucaacagaaa

SEQ ID NO: 772185 - RNA, 19 nt, Homo sapiens
ccacuuuccgcuuaacuga

SEQ ID NO: 772186 - RNA, 19 nt, Homo sapiens
ggcuagaagugaagaccuu

SEQ ID NO: 772187 - RNA, 19 nt, Homo sapiens
gacaucauugcauggguua

SEQ ID NO: 772188 - RNA, 19 nt, Homo sapiens
caaagcuggaacaugaaua

SEQ ID NO: 772189 - RNA, 19 nt, Homo sapiens
ucauuccucuuccucuuug

SEQ ID NO: 772190 - RNA, 19 nt, Homo sapiens
cuaccucgauaacccaaga

SEQ ID NO: 772191 - RNA, 19 nt, Homo sapiens
auucaaagcuaggauuuca

SEQ ID NO: 772192 - RNA, 19 nt, Homo sapiens
ugagauugguucugcucuu

SEQ ID NO: 772193 - RNA, 19 nt, Homo sapiens
ggacauccuguaugcuuca

SEQ ID NO: 772194 - RNA, 19 nt, Homo sapiens
caaccuggauuuuauucaa

SEQ ID NO: 772195 - RNA, 19 nt, Homo sapiens
uuaagcgaaugaacguuga

SEQ ID NO: 772196 - RNA, 19 nt, Homo sapiens
cauuucaccuugguuucua

SEQ ID NO: 772197 - RNA, 19 nt, Homo sapiens
cuuagucucuuuccaaguc

SEQ ID NO: 772198 - RNA, 19 nt, Homo sapiens
ugcauggguuaaugacaua

SEQ ID NO: 772199 - RNA, 19 nt, Homo sapiens
cauuaaaacuugcccuuga

SEQ ID NO: 772200 - RNA, 19 nt, Homo sapiens
acgcaggucauacagcuua

SEQ ID NO: 772201 - RNA, 19 nt, Homo sapiens
ccagagagaugaaguaauu

SEQ ID NO: 772202 - RNA, 19 nt, Homo sapiens
caaaggauaucaugaaguu

SEQ ID NO: 772203 - RNA, 19 nt, Homo sapiens
ucaaacggcucuauaauga

SEQ ID NO: 772204 - RNA, 19 nt, Homo sapiens
gagauugucuuuccuguug

SEQ ID NO: 772205 - RNA, 19 nt, Homo sapiens
gcaaccaacuucugcaauu

SEQ ID NO: 772206 - RNA, 19 nt, Homo sapiens
gcaagcagaccucuacuaa

SEQ ID NO: 772207 - RNA, 19 nt, Homo sapiens
gaaucaaacggcucuauaa

SEQ ID NO: 772208 - RNA, 19 nt, Homo sapiens
gaagauaaugucucagaaa

SEQ ID NO: 772209 - RNA, 19 nt, Homo sapiens
gaaagugaaugugcggaaa

SEQ ID NO: 772210 - RNA, 19 nt, Homo sapiens
gagcccaucucaacauuug

SEQ ID NO: 772211 - RNA, 19 nt, Homo sapiens
ugagagaauuccaguacua

SEQ ID NO: 772212 - RNA, 19 nt, Homo sapiens
ggaaucaaacggcucuaua

SEQ ID NO: 772213 - RNA, 19 nt, Homo sapiens
gaauugggaucuucacaca

SEQ ID NO: 772214 - RNA, 19 nt, Homo sapiens
gagaaacucauuccugauu

SEQ ID NO: 772215 - RNA, 19 nt, Homo sapiens
caacaagugcuaccuuuga

SEQ ID NO: 772216 - RNA, 19 nt, Homo sapiens
caaaguagaggaaauggaa

SEQ ID NO: 772217 - RNA, 19 nt, Homo sapiens
gcaacuacuucacuguaug

SEQ ID NO: 772218 - RNA, 19 nt, Homo sapiens
ugaggaagaugagagaauu

SEQ ID NO: 772219 - RNA, 19 nt, Homo sapiens
gcacaucaccuuucuacuc

SEQ ID NO: 772220 - RNA, 19 nt, Homo sapiens
ccaagacuguugaggaaga

SEQ ID NO: 772221 - RNA, 19 nt, Homo sapiens
guggaugacuucuaugaug

SEQ ID NO: 772222 - RNA, 19 nt, Homo sapiens
ugaauuccguuuaugucua

SEQ ID NO: 772223 - RNA, 19 nt, Homo sapiens
gagaauggagagaauuauu

SEQ ID NO: 772224 - RNA, 19 nt, Homo sapiens
aagcagaccucuacuaaac

SEQ ID NO: 772225 - RNA, 19 nt, Homo sapiens
gaaacucauuccugauugg

SEQ ID NO: 772226 - RNA, 19 nt, Homo sapiens
gaagugccagucagaggua

SEQ ID NO: 772227 - RNA, 19 nt, Homo sapiens
ucacacagccacaccauug

SEQ ID NO: 772228 - RNA, 19 nt, Homo sapiens
ccaaaauacuugaguugua

SEQ ID NO: 772229 - RNA, 19 nt, Homo sapiens
gauaaugucucagaaaaug

SEQ ID NO: 772230 - RNA, 19 nt, Homo sapiens
gugcuaccuuugaguguaa

SEQ ID NO: 772231 - RNA, 19 nt, Homo sapiens
caaccaacuucugcaauuc

SEQ ID NO: 772232 - RNA, 19 nt, Homo sapiens
gaaaaugccuucaaaucag

SEQ ID NO: 772233 - RNA, 19 nt, Homo sapiens
ggcuuucucuuacaauuga

SEQ ID NO: 772234 - RNA, 19 nt, Homo sapiens
gagagaauuccaguacuaa

SEQ ID NO: 772235 - RNA, 19 nt, Homo sapiens
ggaaaaugccuucaaauca

SEQ ID NO: 772236 - RNA, 19 nt, Homo sapiens
aaacggcucuauaaugaag

SEQ ID NO: 772237 - RNA, 19 nt, Homo sapiens
ugacuucuaugauggaauc

SEQ ID NO: 772238 - RNA, 19 nt, Homo sapiens
aaacucaaguaccaauuca

SEQ ID NO: 772239 - RNA, 19 nt, Homo sapiens
ugaagauaaugucucagaa

SEQ ID NO: 772240 - RNA, 19 nt, Homo sapiens
ggaagaggaggagaaggua

SEQ ID NO: 772241 - RNA, 19 nt, Homo sapiens
gcccagacuucuccaagga

SEQ ID NO: 772242 - RNA, 19 nt, Homo sapiens
gaauuccguuuaugucuac

SEQ ID NO: 772243 - RNA, 19 nt, Homo sapiens
gcucccaguugauccauug

SEQ ID NO: 772244 - RNA, 19 nt, Homo sapiens
guauugcaaucagcuguuu

SEQ ID NO: 772245 - RNA, 19 nt, Homo sapiens
cguaaaggcucauccaaaa

SEQ ID NO: 772246 - RNA, 19 nt, Homo sapiens
ggaaugagaacaugcaaaa

SEQ ID NO: 772247 - RNA, 19 nt, Homo sapiens
auggauagcucccaguuga

SEQ ID NO: 772248 - RNA, 19 nt, Homo sapiens
gaugagagaauuccaguac

SEQ ID NO: 772249 - RNA, 19 nt, Homo sapiens
ccugauuggcuuucucuua

SEQ ID NO: 772250 - RNA, 19 nt, Homo sapiens
ggucaucauggaacuaauu

SEQ ID NO: 772251 - RNA, 19 nt, Homo sapiens
uaaagguauuggcaagaga

SEQ ID NO: 772252 - RNA, 19 nt, Homo sapiens
agaaacucauuccugauug

SEQ ID NO: 772253 - RNA, 19 nt, Homo sapiens
gagaauuccaguacuaaag

SEQ ID NO: 772254 - RNA, 19 nt, Homo sapiens
uaaaggcucauccaaaaua

SEQ ID NO: 772255 - RNA, 19 nt, Homo sapiens
uaccuuaacaggcugauuu

SEQ ID NO: 772256 - RNA, 19 nt, Homo sapiens
caagcagaccucuacuaaa

SEQ ID NO: 772257 - RNA, 19 nt, Homo sapiens
ggugaccugugacaaagga

SEQ ID NO: 772258 - RNA, 19 nt, Homo sapiens
ugccaagacuguugaggaa

SEQ ID NO: 772259 - RNA, 19 nt, Homo sapiens
ucauguaguuucaacaagu

SEQ ID NO: 772260 - RNA, 19 nt, Homo sapiens
gauuacaucccuccucugu

SEQ ID NO: 772261 - RNA, 19 nt, Homo sapiens
gauuggcuuucucuuacaa

SEQ ID NO: 772262 - RNA, 19 nt, Homo sapiens
caacauuuggcaguccuua

SEQ ID NO: 772263 - RNA, 19 nt, Homo sapiens
cagaaagcacagauggaua

SEQ ID NO: 772264 - RNA, 19 nt, Homo sapiens
ggccaugguuagucuggaa

SEQ ID NO: 772265 - RNA, 19 nt, Homo sapiens
caaacucaaguaccaauuc

SEQ ID NO: 772266 - RNA, 19 nt, Homo sapiens
ggcuguagaaggaaauaua

SEQ ID NO: 772267 - RNA, 19 nt, Homo sapiens
cacaucaccuuucuacucu

SEQ ID NO: 772268 - RNA, 19 nt, Homo sapiens
gaauuccaguacuaaaggu

SEQ ID NO: 772269 - RNA, 19 nt, Homo sapiens
uagacuacuuugggaauga

SEQ ID NO: 772270 - RNA, 19 nt, Homo sapiens
gcaaaguagaggaaaugga

SEQ ID NO: 772271 - RNA, 19 nt, Homo sapiens
gagaagguagcuacagcaa

SEQ ID NO: 772272 - RNA, 19 nt, Homo sapiens
uaaguugaauugggaucuu

SEQ ID NO: 772273 - RNA, 19 nt, Homo sapiens
cauguaguuucaacaagug

SEQ ID NO: 772274 - RNA, 19 nt, Homo sapiens
ccauugcagugucaacuag

SEQ ID NO: 772275 - RNA, 19 nt, Homo sapiens
gaguguaaacuaagguaga

SEQ ID NO: 772276 - RNA, 19 nt, Homo sapiens
gaccucuacuaaacgcaaa

SEQ ID NO: 772277 - RNA, 19 nt, Homo sapiens
uuucuacucugcagucuuc

SEQ ID NO: 772278 - RNA, 19 nt, Homo sapiens
agaaagcacagauggauag

SEQ ID NO: 772279 - RNA, 19 nt, Homo sapiens
gaugacuucuaugauggaa

SEQ ID NO: 772280 - RNA, 19 nt, Homo sapiens
cugauuggcuuucucuuac

SEQ ID NO: 772281 - RNA, 19 nt, Homo sapiens
caaacggcucuauaaugaa

SEQ ID NO: 772282 - RNA, 19 nt, Homo sapiens
aagcaacuacuucacugua

SEQ ID NO: 772283 - RNA, 19 nt, Homo sapiens
uugagaauggagagaauua

SEQ ID NO: 772284 - RNA, 19 nt, Homo sapiens
cuaaagguauuggcaagag

SEQ ID NO: 772285 - RNA, 19 nt, Homo sapiens
aguaccaauucaaccuuua

SEQ ID NO: 772286 - RNA, 19 nt, Homo sapiens
uuaagcacauaaagaccaa

SEQ ID NO: 772287 - RNA, 19 nt, Homo sapiens
uucaacaagugcuaccuuu

SEQ ID NO: 772288 - RNA, 19 nt, Homo sapiens
gguagcaggcagauccaaa

SEQ ID NO: 772289 - RNA, 19 nt, Homo sapiens
cagccacaccauuggauuu

SEQ ID NO: 772290 - RNA, 19 nt, Homo sapiens
gauugucuuuccuguugga

SEQ ID NO: 772291 - RNA, 19 nt, Homo sapiens
gauuuggagugagccagaa

SEQ ID NO: 772292 - RNA, 19 nt, Homo sapiens
ucagaaagcacagauggau

SEQ ID NO: 772293 - RNA, 19 nt, Homo sapiens
cuucaaaucagaauguuuc

SEQ ID NO: 772294 - RNA, 19 nt, Homo sapiens
ggauagcucccaguugauc

SEQ ID NO: 772295 - RNA, 19 nt, Homo sapiens
ggagaaacucauuccugau

SEQ ID NO: 772296 - RNA, 19 nt, Homo sapiens
ccguaaaggcucauccaaa

SEQ ID NO: 772297 - RNA, 19 nt, Homo sapiens
aaguaccaauucaaccuuu

SEQ ID NO: 772298 - RNA, 19 nt, Homo sapiens
gcagccuguuucugucaug

SEQ ID NO: 772299 - RNA, 19 nt, Homo sapiens
aaucaaacggcucuauaau

SEQ ID NO: 772300 - RNA, 19 nt, Homo sapiens
aaggauaucaugaaguuuc

SEQ ID NO: 772301 - RNA, 19 nt, Homo sapiens
ggacuaaggaucaccauua

SEQ ID NO: 772302 - RNA, 19 nt, Homo sapiens
gcaaucgggugguaucaua

SEQ ID NO: 772303 - RNA, 19 nt, Homo sapiens
ggauugaugucucagguua

SEQ ID NO: 772304 - RNA, 19 nt, Homo sapiens
auacauggcugcauacaua

SEQ ID NO: 772305 - RNA, 19 nt, Homo sapiens
cuacaaaccuccugaugaa

SEQ ID NO: 772306 - RNA, 19 nt, Homo sapiens
guacucagaugcucaauca

SEQ ID NO: 772307 - RNA, 19 nt, Homo sapiens
ggugaaaccaugaucauua

SEQ ID NO: 772308 - RNA, 19 nt, Homo sapiens
gcucugaaguguccuaaau

SEQ ID NO: 772309 - RNA, 19 nt, Homo sapiens
gagaaguacuuuaccugaa

SEQ ID NO: 772310 - RNA, 19 nt, Homo sapiens
ccuuagaagucucauauuu

SEQ ID NO: 772311 - RNA, 19 nt, Homo sapiens
gcaggaagcucagaguauc

SEQ ID NO: 772312 - RNA, 19 nt, Homo sapiens
ggaguuucauguuggguuu

SEQ ID NO: 772313 - RNA, 19 nt, Homo sapiens
gugaaaccaugaucauuau

SEQ ID NO: 772314 - RNA, 19 nt, Homo sapiens
agaaguacuuuaccugaaa

SEQ ID NO: 772315 - RNA, 19 nt, Homo sapiens
cuacaaauacgacaagaaa

SEQ ID NO: 772316 - RNA, 19 nt, Homo sapiens
gugaauacguugaguucuu

SEQ ID NO: 772317 - RNA, 19 nt, Homo sapiens
ggucaggucuuugauuugu

SEQ ID NO: 772318 - RNA, 19 nt, Homo sapiens
gagcuguuguggaauaaau

SEQ ID NO: 772319 - RNA, 19 nt, Homo sapiens
ugaaagacaguaugagaaa

SEQ ID NO: 772320 - RNA, 19 nt, Homo sapiens
gaguaucgaugaaaucuac

SEQ ID NO: 772321 - RNA, 19 nt, Homo sapiens
gguguacacugcaaacaau

SEQ ID NO: 772322 - RNA, 19 nt, Homo sapiens
gaugaaaucuacaaauacg

SEQ ID NO: 772323 - RNA, 19 nt, Homo sapiens
ggugauugauccaacaaga

SEQ ID NO: 772324 - RNA, 19 nt, Homo sapiens
ggauugauguuaguacuca

SEQ ID NO: 772325 - RNA, 19 nt, Homo sapiens
ggcuauggcugcuggcuuu

SEQ ID NO: 772326 - RNA, 19 nt, Homo sapiens
gcuacaaaccuccugauga

SEQ ID NO: 772327 - RNA, 19 nt, Homo sapiens
gcagggaaagugaaucuug

SEQ ID NO: 772328 - RNA, 19 nt, Homo sapiens
gaauaaauacugggugaau

SEQ ID NO: 772329 - RNA, 19 nt, Homo sapiens
caaauugcuugagcuguug

SEQ ID NO: 772330 - RNA, 19 nt, Homo sapiens
gauccaacaagaacaauau

SEQ ID NO: 772331 - RNA, 19 nt, Homo sapiens
ucugaaguguccuaaauau

SEQ ID NO: 772332 - RNA, 19 nt, Homo sapiens
agagacagcuguaaaacua

SEQ ID NO: 772333 - RNA, 19 nt, Homo sapiens
ucuucuagcuugcuuacua

SEQ ID NO: 772334 - RNA, 19 nt, Homo sapiens
ggaacuggccaacaacaug

SEQ ID NO: 772335 - RNA, 19 nt, Homo sapiens
augaauacauggcugcaua

SEQ ID NO: 772336 - RNA, 19 nt, Homo sapiens
gcacugaaacccgaguaaa

SEQ ID NO: 772337 - RNA, 19 nt, Homo sapiens
ugucucagguuauuaagga

SEQ ID NO: 772338 - RNA, 19 nt, Homo sapiens
cuugagcuguuguggaaua

SEQ ID NO: 772339 - RNA, 19 nt, Homo sapiens
guaccagacuauuccacuu

SEQ ID NO: 772340 - RNA, 19 nt, Homo sapiens
ggacgagggaguuucaugu

SEQ ID NO: 772341 - RNA, 19 nt, Homo sapiens
ccugggaacuggccaacaa

SEQ ID NO: 772342 - RNA, 19 nt, Homo sapiens
agaaacagcagcaagaaau

SEQ ID NO: 772343 - RNA, 19 nt, Homo sapiens
cuggucaggucuuugauuu

SEQ ID NO: 772344 - RNA, 19 nt, Homo sapiens
gaaacagcagcaagaaauc

SEQ ID NO: 772345 - RNA, 19 nt, Homo sapiens
uagaaacgcaugaccgaaa

SEQ ID NO: 772346 - RNA, 19 nt, Homo sapiens
ccacuggucaggucuuuga

SEQ ID NO: 772347 - RNA, 19 nt, Homo sapiens
cuaaggaucaccauuacuu

SEQ ID NO: 772348 - RNA, 19 nt, Homo sapiens
caagaaacagcagcaagaa

SEQ ID NO: 772349 - RNA, 19 nt, Homo sapiens
guacacugcaaacaauauu

SEQ ID NO: 772350 - RNA, 19 nt, Homo sapiens
gacuaaggaucaccauuac

SEQ ID NO: 772351 - RNA, 19 nt, Homo sapiens
uaaaaccaguuacccaaaa

SEQ ID NO: 772352 - RNA, 19 nt, Homo sapiens
gaaagacaguaugagaaaa

SEQ ID NO: 772353 - RNA, 19 nt, Homo sapiens
ugaauacguugaguucuuc

SEQ ID NO: 772354 - RNA, 19 nt, Homo sapiens
aaggaucaccauuacuuua

SEQ ID NO: 772355 - RNA, 19 nt, Homo sapiens
acaagaaacagcagcaaga

SEQ ID NO: 772356 - RNA, 19 nt, Homo sapiens
uaccagacuauuccacuua

SEQ ID NO: 772357 - RNA, 19 nt, Homo sapiens
uaaggaucaccauuacuuu

SEQ ID NO: 772358 - RNA, 19 nt, Homo sapiens
acaaauacgacaagaaaca

SEQ ID NO: 772359 - RNA, 19 nt, Homo sapiens
gaagacaaacuugccaaag

SEQ ID NO: 772360 - RNA, 19 nt, Homo sapiens
gcucagaguaucgaugaaa

SEQ ID NO: 772361 - RNA, 19 nt, Homo sapiens
ucaggcugcugcauaugaa

SEQ ID NO: 772362 - RNA, 19 nt, Homo sapiens
gcccacacccggaaaccua

SEQ ID NO: 772363 - RNA, 19 nt, Homo sapiens
cuucuagcuugcuuacuaa

SEQ ID NO: 772364 - RNA, 19 nt, Homo sapiens
aauacugggugaauacguu

SEQ ID NO: 772365 - RNA, 19 nt, Homo sapiens
ggaucaccauuacuuuaag

SEQ ID NO: 772366 - RNA, 19 nt, Homo sapiens
aguauaaggugcucugaag

SEQ ID NO: 772367 - RNA, 19 nt, Homo sapiens
aacaauauccgcagggaaa

SEQ ID NO: 772368 - RNA, 19 nt, Homo sapiens
ugaugucucagguuauuaa

SEQ ID NO: 772369 - RNA, 19 nt, Homo sapiens
agacaaacuugccaaagcu

SEQ ID NO: 772370 - RNA, 19 nt, Homo sapiens
ggucuuugauuugucugaa

SEQ ID NO: 772371 - RNA, 19 nt, Homo sapiens
ggaaagguggauggugaaa

SEQ ID NO: 772372 - RNA, 19 nt, Homo sapiens
ugcuugagcuguuguggaa

SEQ ID NO: 772373 - RNA, 19 nt, Homo sapiens
ccaggaaccauuuguagca

SEQ ID NO: 772374 - RNA, 19 nt, Homo sapiens
ccugaaagacaguaugaga

SEQ ID NO: 772375 - RNA, 19 nt, Homo sapiens
acgagggaguuucauguug

SEQ ID NO: 772376 - RNA, 19 nt, Homo sapiens
gacgagggaguuucauguu

SEQ ID NO: 772377 - RNA, 19 nt, Homo sapiens
ggaagugaugggucugaug

SEQ ID NO: 772378 - RNA, 19 nt, Homo sapiens
uauaaggugcucugaagug

SEQ ID NO: 772379 - RNA, 19 nt, Homo sapiens
gagucuagguaagaguuug

SEQ ID NO: 772380 - RNA, 19 nt, Homo sapiens
ugaucauuauggacaguuu

SEQ ID NO: 772381 - RNA, 19 nt, Homo sapiens
aggaucaccauuacuuuaa

SEQ ID NO: 772382 - RNA, 19 nt, Homo sapiens
gacaaacuugccaaagcua

SEQ ID NO: 772383 - RNA, 19 nt, Homo sapiens
aagacaaacuugccaaagc

SEQ ID NO: 772384 - RNA, 19 nt, Homo sapiens
gcuuacuaaugcagacuau

SEQ ID NO: 772385 - RNA, 19 nt, Homo sapiens
ggaauaaauacugggugaa

SEQ ID NO: 772386 - RNA, 19 nt, Homo sapiens
gaaguauaaggugcucuga

SEQ ID NO: 772387 - RNA, 19 nt, Homo sapiens
aaaguuagagcagucagaa

SEQ ID NO: 772388 - RNA, 19 nt, Homo sapiens
cuagcuugcuuacuaaugc

SEQ ID NO: 772389 - RNA, 19 nt, Homo sapiens
accagacuauuccacuuaa

SEQ ID NO: 772390 - RNA, 19 nt, Homo sapiens
aaucuuggcgccuuuagga

SEQ ID NO: 772391 - RNA, 19 nt, Homo sapiens
gugauugauccaacaagaa

SEQ ID NO: 772392 - RNA, 19 nt, Homo sapiens
auaaggugcucugaagugu

SEQ ID NO: 772393 - RNA, 19 nt, Homo sapiens
ucucuuaaacagucucuga

SEQ ID NO: 772394 - RNA, 19 nt, Homo sapiens
ucaggucuuugauuugucu

SEQ ID NO: 772395 - RNA, 19 nt, Homo sapiens
aagcucagaguaucgauga

SEQ ID NO: 772396 - RNA, 19 nt, Homo sapiens
aaagguggauggugaaacc

SEQ ID NO: 772397 - RNA, 19 nt, Homo sapiens
gggugaauacguugaguuc

SEQ ID NO: 772398 - RNA, 19 nt, Homo sapiens
cuuagaagucucauauuuc

SEQ ID NO: 772399 - RNA, 19 nt, Homo sapiens
ccagacuauuccacuuaau

SEQ ID NO: 772400 - RNA, 19 nt, Homo sapiens
cugaaagacaguaugagaa

SEQ ID NO: 772401 - RNA, 19 nt, Homo sapiens
gaagacauaucaagugaaa

SEQ ID NO: 772402 - RNA, 19 nt, Homo sapiens
gaagagauuuggaaugauu

SEQ ID NO: 772403 - RNA, 19 nt, Homo sapiens
cagaggagaugacuauuaa

SEQ ID NO: 772404 - RNA, 19 nt, Homo sapiens
ggagaugacuauuaaacuu

SEQ ID NO: 772405 - RNA, 19 nt, Homo sapiens
gaucagcauuggaagauaa

SEQ ID NO: 772406 - RNA, 19 nt, Homo sapiens
gcagaggagaugacuauua

SEQ ID NO: 772407 - RNA, 19 nt, Homo sapiens
ggaaagaucagcauuggaa

SEQ ID NO: 772408 - RNA, 19 nt, Homo sapiens
gugaagagauuuggaauga

SEQ ID NO: 772409 - RNA, 19 nt, Homo sapiens
gggaagacauaucaaguga

SEQ ID NO: 772410 - RNA, 19 nt, Homo sapiens
gaaaagguguuguucauga

SEQ ID NO: 772411 - RNA, 19 nt, Homo sapiens
ggaauaaagugugcuggaa

SEQ ID NO: 772412 - RNA, 19 nt, Homo sapiens
gaaagaagaagaagagcaa

SEQ ID NO: 772413 - RNA, 19 nt, Homo sapiens
ggcaaaccgucuaauguaa

SEQ ID NO: 772414 - RNA, 19 nt, Homo sapiens
gaauuaauuugccacaugu

SEQ ID NO: 772415 - RNA, 19 nt, Homo sapiens
agaaagagaugaagaugau

SEQ ID NO: 772416 - RNA, 19 nt, Homo sapiens
caaaccgucuaauguaauu

SEQ ID NO: 772417 - RNA, 19 nt, Homo sapiens
ccaauaaggcuuccaagaa

SEQ ID NO: 772418 - RNA, 19 nt, Homo sapiens
ggagaaguauaugcaauug

SEQ ID NO: 772419 - RNA, 19 nt, Homo sapiens
ggaggaaggagaaguauau

SEQ ID NO: 772420 - RNA, 19 nt, Homo sapiens
aaaccaauccguaaucuaa

SEQ ID NO: 772421 - RNA, 19 nt, Homo sapiens
ucccaaauaugauacguua

SEQ ID NO: 772422 - RNA, 19 nt, Homo sapiens
uaugugaccuguauccuaa

SEQ ID NO: 772423 - RNA, 19 nt, Homo sapiens
caacaguauuacaguauga

SEQ ID NO: 772424 - RNA, 19 nt, Homo sapiens
gaucauauacagcgcaauu

SEQ ID NO: 772425 - RNA, 19 nt, Homo sapiens
cauauaagugguaggauua

SEQ ID NO: 772426 - RNA, 19 nt, Homo sapiens
acacaacaguauuacagua

SEQ ID NO: 772427 - RNA, 19 nt, Homo sapiens
gaagauaaagaaagagaug

SEQ ID NO: 772428 - RNA, 19 nt, Homo sapiens
aggaaugacuuauacguuu

SEQ ID NO: 772429 - RNA, 19 nt, Homo sapiens
caauaaggcuuccaagaac

SEQ ID NO: 772430 - RNA, 19 nt, Homo sapiens
gcaauugaaaccuuuggua

SEQ ID NO: 772431 - RNA, 19 nt, Homo sapiens
ugaaauagaugggaagaca

SEQ ID NO: 772432 - RNA, 19 nt, Homo sapiens
gaagcacaucgacaaguua

SEQ ID NO: 772433 - RNA, 19 nt, Homo sapiens
caagacaguuggaaagauc

SEQ ID NO: 772434 - RNA, 19 nt, Homo sapiens
ggaugacaaugauagaaau

SEQ ID NO: 772435 - RNA, 19 nt, Homo sapiens
ggaguccuaugaaguugaa

SEQ ID NO: 772436 - RNA, 19 nt, Homo sapiens
aauaaagugugcuggaauu

SEQ ID NO: 772437 - RNA, 19 nt, Homo sapiens
gcaagacaguuggaaagau

SEQ ID NO: 772438 - RNA, 19 nt, Homo sapiens
ugaagaaucugugugacuu

SEQ ID NO: 772439 - RNA, 19 nt, Homo sapiens
gaucaagccugggaugaca

SEQ ID NO: 772440 - RNA, 19 nt, Homo sapiens
gcacaucgacaaguuagaa

SEQ ID NO: 772441 - RNA, 19 nt, Homo sapiens
ugaaugcuuugaaugacua

SEQ ID NO: 772442 - RNA, 19 nt, Homo sapiens
acaguggacccauguaaua

SEQ ID NO: 772443 - RNA, 19 nt, Homo sapiens
agaauuaauuugccacaug

SEQ ID NO: 772444 - RNA, 19 nt, Homo sapiens
acauauaagugguaggauu

SEQ ID NO: 772445 - RNA, 19 nt, Homo sapiens
agaagcacaucgacaaguu

SEQ ID NO: 772446 - RNA, 19 nt, Homo sapiens
uaacaguggacccauguaa

SEQ ID NO: 772447 - RNA, 19 nt, Homo sapiens
ugaaguagcaagacaguug

SEQ ID NO: 772448 - RNA, 19 nt, Homo sapiens
ggagauggagcaacuggaa

SEQ ID NO: 772449 - RNA, 19 nt, Homo sapiens
ggaaggagaaguauaugca

SEQ ID NO: 772450 - RNA, 19 nt, Homo sapiens
gaaaccaauccguaaucua

SEQ ID NO: 772451 - RNA, 19 nt, Homo sapiens
aaauagaugggaagacaua

SEQ ID NO: 772452 - RNA, 19 nt, Homo sapiens
ucgagaagcugcagaagca

SEQ ID NO: 772453 - RNA, 19 nt, Homo sapiens
ucaggcaagugaagagauu

SEQ ID NO: 772454 - RNA, 19 nt, Homo sapiens
gagaugaagaugaugaaga

SEQ ID NO: 772455 - RNA, 19 nt, Homo sapiens
ugaggaagcagccaagaaa

SEQ ID NO: 772456 - RNA, 19 nt, Homo sapiens
gcuauaaagcucaaauuag

SEQ ID NO: 772457 - RNA, 19 nt, Homo sapiens
gaagagaggaccaaaaguu

SEQ ID NO: 772458 - RNA, 19 nt, Homo sapiens
caacuggaaagaagaagaa

SEQ ID NO: 772459 - RNA, 19 nt, Homo sapiens
agaugaagaugaugaagau

SEQ ID NO: 772460 - RNA, 19 nt, Homo sapiens
cagcagaggagaugacuau

SEQ ID NO: 772461 - RNA, 19 nt, Homo sapiens
gaauaaagugugcuggaau

SEQ ID NO: 772462 - RNA, 19 nt, Homo sapiens
gcuacuaacacuggaauaa

SEQ ID NO: 772463 - RNA, 19 nt, Homo sapiens
gggaugacaaugauagaaa

SEQ ID NO: 772464 - RNA, 19 nt, Homo sapiens
uccaauaugugaccuguau

SEQ ID NO: 772465 - RNA, 19 nt, Homo sapiens
aaacagacccucccucagu

SEQ ID NO: 772466 - RNA, 19 nt, Homo sapiens
ggaaugacuuauacguuuu

SEQ ID NO: 772467 - RNA, 19 nt, Homo sapiens
auugaaaccuuugguagua

SEQ ID NO: 772468 - RNA, 19 nt, Homo sapiens
gaagacuguucacgcaagu

SEQ ID NO: 772469 - RNA, 19 nt, Homo sapiens
aaagugugcuggaauugau

SEQ ID NO: 772470 - RNA, 19 nt, Homo sapiens
gaccaaaaguucaaacaga

SEQ ID NO: 772471 - RNA, 19 nt, Homo sapiens
ugaagaugaugaagaugga

SEQ ID NO: 772472 - RNA, 19 nt, Homo sapiens
gcaaaccgucuaauguaau

SEQ ID NO: 772473 - RNA, 19 nt, Homo sapiens
ugccacauguugucuguuu

SEQ ID NO: 772474 - RNA, 19 nt, Homo sapiens
agauccauauccaccauua

SEQ ID NO: 772475 - RNA, 19 nt, Homo sapiens
cauaucaagugaaaccaau

SEQ ID NO: 772476 - RNA, 19 nt, Homo sapiens
caagugaagagauuuggaa

SEQ ID NO: 772477 - RNA, 19 nt, Homo sapiens
caccucaacaccuuuauuu

SEQ ID NO: 772478 - RNA, 19 nt, Homo sapiens
gaaggagaaguauaugcaa

SEQ ID NO: 772479 - RNA, 19 nt, Homo sapiens
uuucugagcuuuguuggaa

SEQ ID NO: 772480 - RNA, 19 nt, Homo sapiens
uagaauacaugcuggaaaa

SEQ ID NO: 772481 - RNA, 19 nt, Homo sapiens
gacuuuggaacacauauaa

SEQ ID NO: 772482 - RNA, 19 nt, Homo sapiens
gaaaagaaagcauuagauc

SEQ ID NO: 772483 - RNA, 19 nt, Homo sapiens
gagcaacuggaaagaagaa

SEQ ID NO: 772484 - RNA, 19 nt, Homo sapiens
gaagaaucugugugacuug

SEQ ID NO: 772485 - RNA, 19 nt, Homo sapiens
gaagaaggagcugccucua

SEQ ID NO: 772486 - RNA, 19 nt, Homo sapiens
ggaacacauauaaguggua

SEQ ID NO: 772487 - RNA, 19 nt, Homo sapiens
agacuguucacgcaaguua

SEQ ID NO: 772488 - RNA, 19 nt, Homo sapiens
aggcaaaccgucuaaugua

SEQ ID NO: 772489 - RNA, 19 nt, Homo sapiens
aaagagaugaagaugauga

SEQ ID NO: 772490 - RNA, 19 nt, Homo sapiens
cauauacagcgcaauuuga

SEQ ID NO: 772491 - RNA, 19 nt, Homo sapiens
gaaguuauggaguccuaug

SEQ ID NO: 772492 - RNA, 19 nt, Homo sapiens
cauuagaucaggcaaguga

SEQ ID NO: 772493 - RNA, 19 nt, Homo sapiens
ccuauacccucugguguug

SEQ ID NO: 772494 - RNA, 19 nt, Homo sapiens
ugauggcucugaagaaucu

SEQ ID NO: 772495 - RNA, 19 nt, Homo sapiens
aagaaguuauggaguccua

SEQ ID NO: 772496 - RNA, 19 nt, Homo sapiens
ugacaaugauagaaaucug

SEQ ID NO: 772497 - RNA, 19 nt, Homo sapiens
gcgaauacccacccacaca

SEQ ID NO: 772498 - RNA, 19 nt, Homo sapiens
gacaaaggcaaaccgucua

SEQ ID NO: 772499 - RNA, 19 nt, Homo sapiens
gaggagaugacuauuaaac

SEQ ID NO: 772500 - RNA, 19 nt, Homo sapiens
uaagugguaggauuauuga

SEQ ID NO: 772501 - RNA, 19 nt, Homo sapiens
gaaacucucugaacaagaa

SEQ ID NO: 772502 - RNA, 19 nt, Homo sapiens
gaucugaacucccucauug

SEQ ID NO: 772503 - RNA, 19 nt, Homo sapiens
gaaaugagcagguuuacaa

SEQ ID NO: 772504 - RNA, 19 nt, Homo sapiens
caacuuuacucuggauaua

SEQ ID NO: 772505 - RNA, 19 nt, Homo sapiens
caacuguucugauaaugaa

SEQ ID NO: 772506 - RNA, 19 nt, Homo sapiens
caaaggaaaucagcaguga

SEQ ID NO: 772507 - RNA, 19 nt, Homo sapiens
ggaagcacgccuccacuua

SEQ ID NO: 772508 - RNA, 19 nt, Homo sapiens
gaacaggacagaaagauag

SEQ ID NO: 772509 - RNA, 19 nt, Homo sapiens
gacaagcucucuacugaug

SEQ ID NO: 772510 - RNA, 19 nt, Homo sapiens
gcagaaaggcaguagauga

SEQ ID NO: 772511 - RNA, 19 nt, Homo sapiens
caaguacuguucuaaaugu

SEQ ID NO: 772512 - RNA, 19 nt, Homo sapiens
ggagcuagcagcaaaguuu

SEQ ID NO: 772513 - RNA, 19 nt, Homo sapiens
gaacagaaggccaccgaaa

SEQ ID NO: 772514 - RNA, 19 nt, Homo sapiens
aaagccaacuguucugaua

SEQ ID NO: 772515 - RNA, 19 nt, Homo sapiens
gcauuaaaguacagcauga

SEQ ID NO: 772516 - RNA, 19 nt, Homo sapiens
ggauauaaauacugccuau

SEQ ID NO: 772517 - RNA, 19 nt, Homo sapiens
gccaagagcuuagaagaug

SEQ ID NO: 772518 - RNA, 19 nt, Homo sapiens
gaaugacccuagaaacgaa

SEQ ID NO: 772519 - RNA, 19 nt, Homo sapiens
gaagcacgccuccacuuaa

SEQ ID NO: 772520 - RNA, 19 nt, Homo sapiens
cgaaacagauaguggaaau

SEQ ID NO: 772521 - RNA, 19 nt, Homo sapiens
ggacagaaagauagaagaa

SEQ ID NO: 772522 - RNA, 19 nt, Homo sapiens
ugaauucacccaagcuuua

SEQ ID NO: 772523 - RNA, 19 nt, Homo sapiens
agaagcggcucaaauuauu

SEQ ID NO: 772524 - RNA, 19 nt, Homo sapiens
gcucugcccugaggauaua

SEQ ID NO: 772525 - RNA, 19 nt, Homo sapiens
gaacagagagcuggcagaa

SEQ ID NO: 772526 - RNA, 19 nt, Homo sapiens
acagagagcuggcagaaca

SEQ ID NO: 772527 - RNA, 19 nt, Homo sapiens
ggagcaaacugaauaaagc

SEQ ID NO: 772528 - RNA, 19 nt, Homo sapiens
gaccucaucugcagaaaca

SEQ ID NO: 772529 - RNA, 19 nt, Homo sapiens
gaaugaguguuucagacuu

SEQ ID NO: 772530 - RNA, 19 nt, Homo sapiens
ggacuugucuagaaaugag

SEQ ID NO: 772531 - RNA, 19 nt, Homo sapiens
agagugagguuuaggaaga

SEQ ID NO: 772532 - RNA, 19 nt, Homo sapiens
gagaagaaaucugcucagu

SEQ ID NO: 772533 - RNA, 19 nt, Homo sapiens
gcgaccaccugaagaaguu

SEQ ID NO: 772534 - RNA, 19 nt, Homo sapiens
aacgagagcuggacaguau

SEQ ID NO: 772535 - RNA, 19 nt, Homo sapiens
caaagccaaagaagaguua

SEQ ID NO: 772536 - RNA, 19 nt, Homo sapiens
cugacaagcucucuacuga

SEQ ID NO: 772537 - RNA, 19 nt, Homo sapiens
aaugaguguuucagacuua

SEQ ID NO: 772538 - RNA, 19 nt, Homo sapiens
uaguugaucuggauaaugu

SEQ ID NO: 772539 - RNA, 19 nt, Homo sapiens
gaagaccucaucugcagaa

SEQ ID NO: 772540 - RNA, 19 nt, Homo sapiens
agucagagaugccauggaa

SEQ ID NO: 772541 - RNA, 19 nt, Homo sapiens
gcacaucgucguauugauc

SEQ ID NO: 772542 - RNA, 19 nt, Homo sapiens
ccaaagaagaguuagagaa

SEQ ID NO: 772543 - RNA, 19 nt, Homo sapiens
uggaaauccugacagcaua

SEQ ID NO: 772544 - RNA, 19 nt, Homo sapiens
gaaccugucugagaaacuc

SEQ ID NO: 772545 - RNA, 19 nt, Homo sapiens
aaagauagaagaagucaga

SEQ ID NO: 772546 - RNA, 19 nt, Homo sapiens
caugauaguugaucuggau

SEQ ID NO: 772547 - RNA, 19 nt, Homo sapiens
caaagaagaguuagagaag

SEQ ID NO: 772548 - RNA, 19 nt, Homo sapiens
gaagaugcucugaggcaaa

SEQ ID NO: 772549 - RNA, 19 nt, Homo sapiens
acagaaagauagaagaagu

SEQ ID NO: 772550 - RNA, 19 nt, Homo sapiens
cuagaaaugagcagguuua

SEQ ID NO: 772551 - RNA, 19 nt, Homo sapiens
cauggacaauucugagauu

SEQ ID NO: 772552 - RNA, 19 nt, Homo sapiens
cagacaaacucuucgagau

SEQ ID NO: 772553 - RNA, 19 nt, Homo sapiens
gcagccagagugagguuua

SEQ ID NO: 772554 - RNA, 19 nt, Homo sapiens
ugucauaugcuuccuauug

SEQ ID NO: 772555 - RNA, 19 nt, Homo sapiens
cgagagcuggacaguauua

SEQ ID NO: 772556 - RNA, 19 nt, Homo sapiens
ggccaagccucauauaacu

SEQ ID NO: 772557 - RNA, 19 nt, Homo sapiens
cagaaaggcaguagaugaa

SEQ ID NO: 772558 - RNA, 19 nt, Homo sapiens
cagaagcggcucaaauuau

SEQ ID NO: 772559 - RNA, 19 nt, Homo sapiens
acagaagcggcucaaauua

SEQ ID NO: 772560 - RNA, 19 nt, Homo sapiens
gaauucacccaagcuuuaa

SEQ ID NO: 772561 - RNA, 19 nt, Homo sapiens
gagaugccauggaaaauga

SEQ ID NO: 772562 - RNA, 19 nt, Homo sapiens
gauagaagaagucagagau

SEQ ID NO: 772563 - RNA, 19 nt, Homo sapiens
gauaguugaucuggauaau

SEQ ID NO: 772564 - RNA, 19 nt, Homo sapiens
caccugcacuuucagaaga

SEQ ID NO: 772565 - RNA, 19 nt, Homo sapiens
ccucggagcaaacugaaua

SEQ ID NO: 772566 - RNA, 19 nt, Homo sapiens
gcauuugacucugcaguag

SEQ ID NO: 772567 - RNA, 19 nt, Homo sapiens
aacaaaagcuggaagaaaa

SEQ ID NO: 772568 - RNA, 19 nt, Homo sapiens
ggguaaacuucacaacaug

SEQ ID NO: 772569 - RNA, 19 nt, Homo sapiens
aaagaagaguuagagaaga

SEQ ID NO: 772570 - RNA, 19 nt, Homo sapiens
caaugcacacuccaacaua

SEQ ID NO: 772571 - RNA, 19 nt, Homo sapiens
ggagcgaccaccugaagaa

SEQ ID NO: 772572 - RNA, 19 nt, Homo sapiens
gcauccucaucuucuauaa

SEQ ID NO: 772573 - RNA, 19 nt, Homo sapiens
uacagaagcggcucaaauu

SEQ ID NO: 772574 - RNA, 19 nt, Homo sapiens
ccgggaaaguguagagaaa

SEQ ID NO: 772575 - RNA, 19 nt, Homo sapiens
cgccaggagugcuuucuuu

SEQ ID NO: 772576 - RNA, 19 nt, Homo sapiens
augagcagguuuacaagua

SEQ ID NO: 772577 - RNA, 19 nt, Homo sapiens
aagaagaguuagagaagau

SEQ ID NO: 772578 - RNA, 19 nt, Homo sapiens
aaacugaucacccugaaau

SEQ ID NO: 772579 - RNA, 19 nt, Homo sapiens
caaacugaauaaagcaaca

SEQ ID NO: 772580 - RNA, 19 nt, Homo sapiens
ccuagaaacgaaacagaua

SEQ ID NO: 772581 - RNA, 19 nt, Homo sapiens
cauauuucaugucaaagga

SEQ ID NO: 772582 - RNA, 19 nt, Homo sapiens
uugaucagcugaacagaga

SEQ ID NO: 772583 - RNA, 19 nt, Homo sapiens
gaagaguuagagaagauga

SEQ ID NO: 772584 - RNA, 19 nt, Homo sapiens
cagaaguaaugaaagaauc

SEQ ID NO: 772585 - RNA, 19 nt, Homo sapiens
gcagaaacaccuacuaucc

SEQ ID NO: 772586 - RNA, 19 nt, Homo sapiens
cugaggauauaaacacauu

SEQ ID NO: 772587 - RNA, 19 nt, Homo sapiens
ugaacaggacagaaagaua

SEQ ID NO: 772588 - RNA, 19 nt, Homo sapiens
ucaggcagcucuggguuga

SEQ ID NO: 772589 - RNA, 19 nt, Homo sapiens
uauccuauaugccaaaugg

SEQ ID NO: 772590 - RNA, 19 nt, Homo sapiens
gguccaggcugucaaugca

SEQ ID NO: 772591 - RNA, 19 nt, Homo sapiens
ugccagcgccguaggaaua

SEQ ID NO: 772592 - RNA, 19 nt, Homo sapiens
gccaugcaguugcugaaga

SEQ ID NO: 772593 - RNA, 19 nt, Homo sapiens
guucagagccaugcaguug

SEQ ID NO: 772594 - RNA, 19 nt, Homo sapiens
gcucaugcacaucgucgua

SEQ ID NO: 772595 - RNA, 19 nt, Homo sapiens
gcacacuccaacauauuga

SEQ ID NO: 772596 - RNA, 19 nt, Homo sapiens
ugaaauuggugaaggaaaa

SEQ ID NO: 772597 - RNA, 19 nt, Homo sapiens
cuacagaagcggcucaaau

SEQ ID NO: 772598 - RNA, 19 nt, Homo sapiens
ucuaguguaucagaaguaa

SEQ ID NO: 772599 - RNA, 19 nt, Homo sapiens
ugaauaaagcaacaagaug

SEQ ID NO: 772600 - RNA, 19 nt, Homo sapiens
caggagugcuuucuuugca

SEQ ID NO: 772601 - RNA, 19 nt, Homo sapiens
ccacagacuucucaauaaa

SEQ ID NO: 772602 - RNA, 19 nt, Homo sapiens
ggacggacuucucacguuu

SEQ ID NO: 772603 - RNA, 19 nt, Homo sapiens
ggacaucggcccauuucua

SEQ ID NO: 772604 - RNA, 19 nt, Homo sapiens
ugacuaauauccuugcauu

SEQ ID NO: 772605 - RNA, 19 nt, Homo sapiens
gccacagacuucucaauaa

SEQ ID NO: 772606 - RNA, 19 nt, Homo sapiens
gaaaugaagccacagacuu

SEQ ID NO: 772607 - RNA, 19 nt, Homo sapiens
caaaguaccagucuuauag

SEQ ID NO: 772608 - RNA, 19 nt, Homo sapiens
ucagauagacacuuucuuu

SEQ ID NO: 772609 - RNA, 19 nt, Homo sapiens
gcucugaugucggcuauga

SEQ ID NO: 772610 - RNA, 19 nt, Homo sapiens
ggcaucagauagacacuuu

SEQ ID NO: 772611 - RNA, 19 nt, Homo sapiens
ggacuucucacguuuguuc

SEQ ID NO: 772612 - RNA, 19 nt, Homo sapiens
ggacccagaucucauacuc

SEQ ID NO: 772613 - RNA, 19 nt, Homo sapiens
guucagaugcuauuacuau

SEQ ID NO: 772614 - RNA, 19 nt, Homo sapiens
ucaaaguaccagucuuaua

SEQ ID NO: 772615 - RNA, 19 nt, Homo sapiens
gaucccagccucucaccua

SEQ ID NO: 772616 - RNA, 19 nt, Homo sapiens
gaucucauacucaacagaa

SEQ ID NO: 772617 - RNA, 19 nt, Homo sapiens
gaggaguaccgucuggaua

SEQ ID NO: 772618 - RNA, 19 nt, Homo sapiens
gaacgugacccugcugugu

SEQ ID NO: 772619 - RNA, 19 nt, Homo sapiens
caacagaaggagacucaga

SEQ ID NO: 772620 - RNA, 19 nt, Homo sapiens
ggacugaucccugacauac

SEQ ID NO: 772621 - RNA, 19 nt, Homo sapiens
ugagccagccucugugaua

SEQ ID NO: 772622 - RNA, 19 nt, Homo sapiens
cgauaccgcugcuacuaug

SEQ ID NO: 772623 - RNA, 19 nt, Homo sapiens
agucaaaguaccagucuua

SEQ ID NO: 772624 - RNA, 19 nt, Homo sapiens
cagaugcuauuacuauuac

SEQ ID NO: 772625 - RNA, 19 nt, Homo sapiens
ucacguuuguucuuguuga

SEQ ID NO: 772626 - RNA, 19 nt, Homo sapiens
ggaggaaauucucaaugcu

SEQ ID NO: 772627 - RNA, 19 nt, Homo sapiens
acagacuucucaauaaauc

SEQ ID NO: 772628 - RNA, 19 nt, Homo sapiens
gagccagccucugugauag

SEQ ID NO: 772629 - RNA, 19 nt, Homo sapiens
gcagguggagguucagaug

SEQ ID NO: 772630 - RNA, 19 nt, Homo sapiens
acuagauucugcagucaaa

SEQ ID NO: 772631 - RNA, 19 nt, Homo sapiens
aagggaaccuccagcugaa

SEQ ID NO: 772632 - RNA, 19 nt, Homo sapiens
caggcugaauucuccauga

SEQ ID NO: 772633 - RNA, 19 nt, Homo sapiens
gcuauuacuauuacaggaa

SEQ ID NO: 772634 - RNA, 19 nt, Homo sapiens
ggaacucugggacucacua

SEQ ID NO: 772635 - RNA, 19 nt, Homo sapiens
ggaguaccgucuggauaag

SEQ ID NO: 772636 - RNA, 19 nt, Homo sapiens
ugacauauucguucuguac

SEQ ID NO: 772637 - RNA, 19 nt, Homo sapiens
ccagaucucauacucaaca

SEQ ID NO: 772638 - RNA, 19 nt, Homo sapiens
acccagaucucauacucaa

SEQ ID NO: 772639 - RNA, 19 nt, Homo sapiens
ucucaaugcugccgugaag

SEQ ID NO: 772640 - RNA, 19 nt, Homo sapiens
ucagucauggcaucagaua

SEQ ID NO: 772641 - RNA, 19 nt, Homo sapiens
gcgauaccgcugcuacuau

SEQ ID NO: 772642 - RNA, 19 nt, Homo sapiens
agccacagacuucucaaua

SEQ ID NO: 772643 - RNA, 19 nt, Homo sapiens
aggaguaccgucuggauaa

SEQ ID NO: 772644 - RNA, 19 nt, Homo sapiens
ggagguucagaugcuauua

SEQ ID NO: 772645 - RNA, 19 nt, Homo sapiens
gguggagguucagaugcua

SEQ ID NO: 772646 - RNA, 19 nt, Homo sapiens
ugacauccaggaggaaauu

SEQ ID NO: 772647 - RNA, 19 nt, Homo sapiens
acauauucguucuguacaa

SEQ ID NO: 772648 - RNA, 19 nt, Homo sapiens
ucaaagaugacuaauaucc

SEQ ID NO: 772649 - RNA, 19 nt, Homo sapiens
gacaucggcccauuucuac

SEQ ID NO: 772650 - RNA, 19 nt, Homo sapiens
uggacggacuucucacguu

SEQ ID NO: 772651 - RNA, 19 nt, Homo sapiens
auucugcagucaaagauga

SEQ ID NO: 772652 - RNA, 19 nt, Homo sapiens
ucacuagauucugcaguca

SEQ ID NO: 772653 - RNA, 19 nt, Homo sapiens
ucaaugcugccgugaagga

SEQ ID NO: 772654 - RNA, 19 nt, Homo sapiens
aggaggaaauucucaaugc

SEQ ID NO: 772655 - RNA, 19 nt, Homo sapiens
agucauggcaucagauaga

SEQ ID NO: 772656 - RNA, 19 nt, Homo sapiens
ugucagucauggcaucaga

SEQ ID NO: 772657 - RNA, 19 nt, Homo sapiens
cauauucguucuguacaag

SEQ ID NO: 772658 - RNA, 19 nt, Homo sapiens
acaaagaccaccaggacau

SEQ ID NO: 772659 - RNA, 19 nt, Homo sapiens
ggcgauaccgcugcuacua

SEQ ID NO: 772660 - RNA, 19 nt, Homo sapiens
gaagcccucccuccugauc

SEQ ID NO: 772661 - RNA, 19 nt, Homo sapiens
cacaggacaucggcccauu

SEQ ID NO: 772662 - RNA, 19 nt, Homo sapiens
caaggccaaguuccacauu

SEQ ID NO: 772663 - RNA, 19 nt, Homo sapiens
aaaguaccagucuuauaga

SEQ ID NO: 772664 - RNA, 19 nt, Homo sapiens
ucucacguuuguucuuguu

SEQ ID NO: 772665 - RNA, 19 nt, Homo sapiens
agaaggagacucagagacu

SEQ ID NO: 772666 - RNA, 19 nt, Homo sapiens
gacaucggcaucagagcaa

SEQ ID NO: 772667 - RNA, 19 nt, Homo sapiens
gguggaaccuaccgaugcu

SEQ ID NO: 772668 - RNA, 19 nt, Homo sapiens
auagacaccaggcugaauu

SEQ ID NO: 772669 - RNA, 19 nt, Homo sapiens
ucccaggcgugucuaggaa

SEQ ID NO: 772670 - RNA, 19 nt, Homo sapiens
gacuaauauccuugcauuu

SEQ ID NO: 772671 - RNA, 19 nt, Homo sapiens
uagauucugcagucaaaga

SEQ ID NO: 772672 - RNA, 19 nt, Homo sapiens
gaacucugggacucacuag

SEQ ID NO: 772673 - RNA, 19 nt, Homo sapiens
gagccaaggccaaguucca

SEQ ID NO: 772674 - RNA, 19 nt, Homo sapiens
caggacaucggcccauuuc

SEQ ID NO: 772675 - RNA, 19 nt, Homo sapiens
cuucucacguuuguucuug

SEQ ID NO: 772676 - RNA, 19 nt, Homo sapiens
acacuggacggacuucuca

SEQ ID NO: 772677 - RNA, 19 nt, Homo sapiens
aaaugugacccuccagugu

SEQ ID NO: 772678 - RNA, 19 nt, Homo sapiens
caaagaccaccaggacauc

SEQ ID NO: 772679 - RNA, 19 nt, Homo sapiens
caggaggaaauucucaaug

SEQ ID NO: 772680 - RNA, 19 nt, Homo sapiens
cgcugugucuaaagucaaa

SEQ ID NO: 772681 - RNA, 19 nt, Homo sapiens
gaugacuaauauccuugca

SEQ ID NO: 772682 - RNA, 19 nt, Homo sapiens
gcagaacccacucuuuuag

SEQ ID NO: 772683 - RNA, 19 nt, Homo sapiens
caucagauagacacuuucu

SEQ ID NO: 772684 - RNA, 19 nt, Homo sapiens
cacagaagcuccccaaagg

SEQ ID NO: 772685 - RNA, 19 nt, Homo sapiens
ggcaagagcuuccuacaga

SEQ ID NO: 772686 - RNA, 19 nt, Homo sapiens
ggguagggcugucgccuua

SEQ ID NO: 772687 - RNA, 19 nt, Homo sapiens
gcaagagcuuccuacagaa

SEQ ID NO: 772688 - RNA, 19 nt, Homo sapiens
gagaaagacgcgauuaaca

SEQ ID NO: 772689 - RNA, 19 nt, Homo sapiens
caucuucccugccaucuuc

SEQ ID NO: 772690 - RNA, 19 nt, Homo sapiens
ggucaucggugccacaucu

SEQ ID NO: 772691 - RNA, 19 nt, Homo sapiens
uccagcggcuucucucuua

SEQ ID NO: 772692 - RNA, 19 nt, Homo sapiens
gauuaacacuguggcauuc

SEQ ID NO: 772693 - RNA, 19 nt, Homo sapiens
caacauccugggcaucuuu

SEQ ID NO: 772694 - RNA, 19 nt, Homo sapiens
ggagaaggagccugcaaga

SEQ ID NO: 772695 - RNA, 19 nt, Homo sapiens
agaagaagaugcagcacau

SEQ ID NO: 772696 - RNA, 19 nt, Homo sapiens
uaauugcagucaucuacaa

SEQ ID NO: 772697 - RNA, 19 nt, Homo sapiens
guccaucgcugucauguac

SEQ ID NO: 772698 - RNA, 19 nt, Homo sapiens
guagggcugucgccuuaga

SEQ ID NO: 772699 - RNA, 19 nt, Homo sapiens
gaaagacgcgauuaacacu

SEQ ID NO: 772700 - RNA, 19 nt, Homo sapiens
caagagcuuccuacagaaa

SEQ ID NO: 772701 - RNA, 19 nt, Homo sapiens
gaggagaaagacgcgauua

SEQ ID NO: 772702 - RNA, 19 nt, Homo sapiens
agaaggagccugcaagauc

SEQ ID NO: 772703 - RNA, 19 nt, Homo sapiens
uggcagcccucuuuuauaa

SEQ ID NO: 772704 - RNA, 19 nt, Homo sapiens
ggccacagcucacauucca

SEQ ID NO: 772705 - RNA, 19 nt, Homo sapiens
ccucagcaaugccaucaug

SEQ ID NO: 772706 - RNA, 19 nt, Homo sapiens
caacaccacaggcaacuuc

SEQ ID NO: 772707 - RNA, 19 nt, Homo sapiens
agucugagcugccacuugu

SEQ ID NO: 772708 - RNA, 19 nt, Homo sapiens
guagaggcuuccugaacug

SEQ ID NO: 772709 - RNA, 19 nt, Homo sapiens
gcaagguggacccguuuga

SEQ ID NO: 772710 - RNA, 19 nt, Homo sapiens
gaggugcugcccaucuaua

SEQ ID NO: 772711 - RNA, 19 nt, Homo sapiens
ccagcuaccuguacaucau

SEQ ID NO: 772712 - RNA, 19 nt, Homo sapiens
ccgaggugcugcccaucua

SEQ ID NO: 772713 - RNA, 19 nt, Homo sapiens
gagccacacuucacugacu

SEQ ID NO: 772714 - RNA, 19 nt, Homo sapiens
ggagaaagacgcgauuaac

SEQ ID NO: 772715 - RNA, 19 nt, Homo sapiens
gaaucaugcccacggagaa

SEQ ID NO: 772716 - RNA, 19 nt, Homo sapiens
ucaacucacagacagcaua

SEQ ID NO: 772717 - RNA, 19 nt, Homo sapiens
gcaaggagccacacuucac

SEQ ID NO: 772718 - RNA, 19 nt, Homo sapiens
ucggcuaccucaccuucua

SEQ ID NO: 772719 - RNA, 19 nt, Homo sapiens
ccaucacgcuccagaacau

SEQ ID NO: 772720 - RNA, 19 nt, Homo sapiens
ggaggcgccuuugcagaca

SEQ ID NO: 772721 - RNA, 19 nt, Homo sapiens
gcaugguguucuuccuaau

SEQ ID NO: 772722 - RNA, 19 nt, Homo sapiens
gcagcccucuuuuauaaau

SEQ ID NO: 772723 - RNA, 19 nt, Homo sapiens
uguagaggcuuccugaacu

SEQ ID NO: 772724 - RNA, 19 nt, Homo sapiens
cgauuaacacuguggcauu

SEQ ID NO: 772725 - RNA, 19 nt, Homo sapiens
aagacgcgauuaacacugu

SEQ ID NO: 772726 - RNA, 19 nt, Homo sapiens
ggaggagaaagacgcgauu

SEQ ID NO: 772727 - RNA, 19 nt, Homo sapiens
ugagcuucaucaucauuga

SEQ ID NO: 772728 - RNA, 19 nt, Homo sapiens
ugcaugguguucuuccuaa

SEQ ID NO: 772729 - RNA, 19 nt, Homo sapiens
caaccugcuggucaucuuu

SEQ ID NO: 772730 - RNA, 19 nt, Homo sapiens
cggagcugcugcacaccua

SEQ ID NO: 772731 - RNA, 19 nt, Homo sapiens
ugagcugccacuugucaua

SEQ ID NO: 772732 - RNA, 19 nt, Homo sapiens
ccuaugccauggccaauac

SEQ ID NO: 772733 - RNA, 19 nt, Homo sapiens
cagcaaggagccacacuuc

SEQ ID NO: 772734 - RNA, 19 nt, Homo sapiens
ggaugacacccucccauac

SEQ ID NO: 772735 - RNA, 19 nt, Homo sapiens
gagaaggagccugcaagau

SEQ ID NO: 772736 - RNA, 19 nt, Homo sapiens
ucaaccugcuggucaucuu

SEQ ID NO: 772737 - RNA, 19 nt, Homo sapiens
guaucaaccugcuggucau

SEQ ID NO: 772738 - RNA, 19 nt, Homo sapiens
ccguuggccugcucacuug

SEQ ID NO: 772739 - RNA, 19 nt, Homo sapiens
ucggagccauguccagcua

SEQ ID NO: 772740 - RNA, 19 nt, Homo sapiens
gcauggaggaaaccacuag

SEQ ID NO: 772741 - RNA, 19 nt, Homo sapiens
ggccugcucacuuguauca

SEQ ID NO: 772742 - RNA, 19 nt, Homo sapiens
gcucacagugcccaucguu

SEQ ID NO: 772743 - RNA, 19 nt, Homo sapiens
cagcaagguggacccguuu

SEQ ID NO: 772744 - RNA, 19 nt, Homo sapiens
cuuccuggcugcccucuuc

SEQ ID NO: 772745 - RNA, 19 nt, Homo sapiens
cuacuucacgcucaacuca

SEQ ID NO: 772746 - RNA, 19 nt, Homo sapiens
caugguguucuuccuaauu

SEQ ID NO: 772747 - RNA, 19 nt, Homo sapiens
aauacgggcauuauccuuu

SEQ ID NO: 772748 - RNA, 19 nt, Homo sapiens
ucgccuugcucuccagcua

SEQ ID NO: 772749 - RNA, 19 nt, Homo sapiens
ggaugucaguguucaaccu

SEQ ID NO: 772750 - RNA, 19 nt, Homo sapiens
ccaucucccuucacaggau

SEQ ID NO: 772751 - RNA, 19 nt, Homo sapiens
ucauacagaccuuccugaa

SEQ ID NO: 772752 - RNA, 19 nt, Homo sapiens
ucaaggaccccuccaagaa

SEQ ID NO: 772753 - RNA, 19 nt, Homo sapiens
guacaugaacgggaacuac

SEQ ID NO: 772754 - RNA, 19 nt, Homo sapiens
aggaugacacccucccaua

SEQ ID NO: 772755 - RNA, 19 nt, Homo sapiens
ggagggcaagagcuuccua

SEQ ID NO: 772756 - RNA, 19 nt, Homo sapiens
ucacagugcccaucguucu

SEQ ID NO: 772757 - RNA, 19 nt, Homo sapiens
caucuauacugagcucaag

SEQ ID NO: 772758 - RNA, 19 nt, Homo sapiens
guauggagggcaagagcuu

SEQ ID NO: 772759 - RNA, 19 nt, Homo sapiens
acguggagaucgugaagga

SEQ ID NO: 772760 - RNA, 19 nt, Homo sapiens
augguguucuuccuaauug

SEQ ID NO: 772761 - RNA, 19 nt, Homo sapiens
gcugggcuaccgugccuuu

SEQ ID NO: 772762 - RNA, 19 nt, Homo sapiens
aggagaaagacgcgauuaa

SEQ ID NO: 772763 - RNA, 19 nt, Homo sapiens
caucuucuacuuccgaauc

SEQ ID NO: 772764 - RNA, 19 nt, Homo sapiens
gcugcggcaugugcuuauu

SEQ ID NO: 772765 - RNA, 19 nt, Homo sapiens
ccagcuacuucacgcucaa

SEQ ID NO: 772766 - RNA, 19 nt, Homo sapiens
uguacaucaucaagucuga

SEQ ID NO: 772767 - RNA, 19 nt, Homo sapiens
ccauccaccugcuacucaa

SEQ ID NO: 772768 - RNA, 19 nt, Homo sapiens
ucucccaucucccuucaca

SEQ ID NO: 772769 - RNA, 19 nt, Homo sapiens
agaaagacgcgauuaacac

SEQ ID NO: 772770 - RNA, 19 nt, Homo sapiens
cugaugaccaugagcuuga

SEQ ID NO: 772771 - RNA, 19 nt, Homo sapiens
gcauuauccuuuuccuguu

SEQ ID NO: 772772 - RNA, 19 nt, Homo sapiens
caauacgggcauuauccuu

SEQ ID NO: 772773 - RNA, 19 nt, Homo sapiens
ucccugccaucuucuacuu

SEQ ID NO: 772774 - RNA, 19 nt, Homo sapiens
ccaacauccugggcaucuu

SEQ ID NO: 772775 - RNA, 19 nt, Homo sapiens
gccguuggccugcucacuu

SEQ ID NO: 772776 - RNA, 19 nt, Homo sapiens
cauucgggaugucaguguu

SEQ ID NO: 772777 - RNA, 19 nt, Homo sapiens
uggagaucgugaaggagaa

SEQ ID NO: 772778 - RNA, 19 nt, Homo sapiens
ugguaauccuugucucugu

SEQ ID NO: 772779 - RNA, 19 nt, Homo sapiens
caaauagguugcccaagug

SEQ ID NO: 772780 - RNA, 19 nt, Homo sapiens
acaaauagguugcccaagu

SEQ ID NO: 772781 - RNA, 19 nt, Homo sapiens
gacaagugcccacaaguaa

SEQ ID NO: 772782 - RNA, 19 nt, Homo sapiens
cagcugggcaugacaaaua

SEQ ID NO: 772783 - RNA, 19 nt, Homo sapiens
ccaaggcccuagcgaagaa

SEQ ID NO: 772784 - RNA, 19 nt, Homo sapiens
gcucagacccaucaccuuu

SEQ ID NO: 772785 - RNA, 19 nt, Homo sapiens
ugacaagugcccacaagua

SEQ ID NO: 772786 - RNA, 19 nt, Homo sapiens
gcaaggcugugcacauuuu

SEQ ID NO: 772787 - RNA, 19 nt, Homo sapiens
aagcaaggcugugcacauu

SEQ ID NO: 772788 - RNA, 19 nt, Homo sapiens
gaacagcugggcaugacaa

SEQ ID NO: 772789 - RNA, 19 nt, Homo sapiens
caccugcucucaccauuga

SEQ ID NO: 772790 - RNA, 19 nt, Homo sapiens
acaaguaacacaccaggua

SEQ ID NO: 772791 - RNA, 19 nt, Homo sapiens
gguggugggugaguuauug

SEQ ID NO: 772792 - RNA, 19 nt, Homo sapiens
caagguggugggugaguua

SEQ ID NO: 772793 - RNA, 19 nt, Homo sapiens
ggaaugaugucuggagaac

SEQ ID NO: 772794 - RNA, 19 nt, Homo sapiens
ccagcgaggcuaugaauug

SEQ ID NO: 772795 - RNA, 19 nt, Homo sapiens
gcaagguggugggugaguu

SEQ ID NO: 772796 - RNA, 19 nt, Homo sapiens
agaaguucguggaugauga

SEQ ID NO: 772797 - RNA, 19 nt, Homo sapiens
gcaccagcgucuaccucaa

SEQ ID NO: 772798 - RNA, 19 nt, Homo sapiens
guucguggaugaugagaag

SEQ ID NO: 772799 - RNA, 19 nt, Homo sapiens
uugagaaguucguggauga

SEQ ID NO: 772800 - RNA, 19 nt, Homo sapiens
ccaacuugcuggcgugaca

SEQ ID NO: 772801 - RNA, 19 nt, Homo sapiens
caagugcccacaaguaaca

SEQ ID NO: 772802 - RNA, 19 nt, Homo sapiens
gcgucuaccucaagaugga

SEQ ID NO: 772803 - RNA, 19 nt, Homo sapiens
gcuaugaauuggaccuuuu

SEQ ID NO: 772804 - RNA, 19 nt, Homo sapiens
gggugcagguuaacuucuu

SEQ ID NO: 772805 - RNA, 19 nt, Homo sapiens
gcauugggcacuucugcaa

SEQ ID NO: 772806 - RNA, 19 nt, Homo sapiens
cagcauggcccuguccaaa

SEQ ID NO: 772807 - RNA, 19 nt, Homo sapiens
ucaucgccauggagacuuu

SEQ ID NO: 772808 - RNA, 19 nt, Homo sapiens
ugggugaguuauuggauga

SEQ ID NO: 772809 - RNA, 19 nt, Homo sapiens
cccaagaucaccaguguug

SEQ ID NO: 772810 - RNA, 19 nt, Homo sapiens
gcauggcccuguccaaaau

SEQ ID NO: 772811 - RNA, 19 nt, Homo sapiens
ggugcagguuaacuucuug

SEQ ID NO: 772812 - RNA, 19 nt, Homo sapiens
acgcuuccaucgugaaaga

SEQ ID NO: 772813 - RNA, 19 nt, Homo sapiens
ugggcuaucuacucaguug

SEQ ID NO: 772814 - RNA, 19 nt, Homo sapiens
ggcuaugaauuggaccuuu

SEQ ID NO: 772815 - RNA, 19 nt, Homo sapiens
cagcgaggcuaugaauugg

SEQ ID NO: 772816 - RNA, 19 nt, Homo sapiens
gagaaccccugcacgugaa

SEQ ID NO: 772817 - RNA, 19 nt, Homo sapiens
gcccauccuuagccaacuu

SEQ ID NO: 772818 - RNA, 19 nt, Homo sapiens
gagcugaaggagacacugu

SEQ ID NO: 772819 - RNA, 19 nt, Homo sapiens
gaaguucguggaugaugag

SEQ ID NO: 772820 - RNA, 19 nt, Homo sapiens
gagaaguucguggaugaug

SEQ ID NO: 772821 - RNA, 19 nt, Homo sapiens
gcaagaggugggccaagca

SEQ ID NO: 772822 - RNA, 19 nt, Homo sapiens
gcucugugcccauccuuag

SEQ ID NO: 772823 - RNA, 19 nt, Homo sapiens
guuaucaggagcccacuau

SEQ ID NO: 772824 - RNA, 19 nt, Homo sapiens
gggaaugaugucuggagaa

SEQ ID NO: 772825 - RNA, 19 nt, Homo sapiens
agaaugaaggugccacaug

SEQ ID NO: 772826 - RNA, 19 nt, Homo sapiens
caagcaaggcugugcacau

SEQ ID NO: 772827 - RNA, 19 nt, Homo sapiens
aaggagacacugugggaaa

SEQ ID NO: 772828 - RNA, 19 nt, Homo sapiens
caagaggugggccaagcaa

SEQ ID NO: 772829 - RNA, 19 nt, Homo sapiens
gcuaucuacucaguugauc

SEQ ID NO: 772830 - RNA, 19 nt, Homo sapiens
cagcgucuaccucaagaug

SEQ ID NO: 772831 - RNA, 19 nt, Homo sapiens
ugcccaagaucaccagugu

SEQ ID NO: 772832 - RNA, 19 nt, Homo sapiens
aggcauggcggcugcauau

SEQ ID NO: 772833 - RNA, 19 nt, Homo sapiens
cgugacaagugcccacaag

SEQ ID NO: 772834 - RNA, 19 nt, Homo sapiens
gccaaggcccuagcgaaga

SEQ ID NO: 772835 - RNA, 19 nt, Homo sapiens
cacaccugcucucaccauu

SEQ ID NO: 772836 - RNA, 19 nt, Homo sapiens
ccacuaugcagaggccaaa

SEQ ID NO: 772837 - RNA, 19 nt, Homo sapiens
uggaggggcuggaguuuau

SEQ ID NO: 772838 - RNA, 19 nt, Homo sapiens
ggugaguuauuggaugaag

SEQ ID NO: 772839 - RNA, 19 nt, Homo sapiens
gggaagagauguugcucaa

SEQ ID NO: 772840 - RNA, 19 nt, Homo sapiens
gcuacagccucaucgaauu

SEQ ID NO: 772841 - RNA, 19 nt, Homo sapiens
gggaguuggugcaggauuu

SEQ ID NO: 772842 - RNA, 19 nt, Homo sapiens
ccugguauuuagagaauua

SEQ ID NO: 772843 - RNA, 19 nt, Homo sapiens
ggacccaacugugccguuu

SEQ ID NO: 772844 - RNA, 19 nt, Homo sapiens
gaugcuggcuggacacaga

SEQ ID NO: 772845 - RNA, 19 nt, Homo sapiens
cgaguggucuccugguauu

SEQ ID NO: 772846 - RNA, 19 nt, Homo sapiens
ggugaagaaugcucagaug

SEQ ID NO: 772847 - RNA, 19 nt, Homo sapiens
gcaagaucaucaucgucaa

SEQ ID NO: 772848 - RNA, 19 nt, Homo sapiens
gcagcaagaucaucaucgu

SEQ ID NO: 772849 - RNA, 19 nt, Homo sapiens
gcugguggccugugagaaa

SEQ ID NO: 772850 - RNA, 19 nt, Homo sapiens
ugacugcggugaagaaugc

SEQ ID NO: 772851 - RNA, 19 nt, Homo sapiens
gguuuggagucucaucauu

SEQ ID NO: 772852 - RNA, 19 nt, Homo sapiens
gcucaacucagacaucuuc

SEQ ID NO: 772853 - RNA, 19 nt, Homo sapiens
caaguacucagucucagaa

SEQ ID NO: 772854 - RNA, 19 nt, Homo sapiens
gacacaagaucccagugau

SEQ ID NO: 772855 - RNA, 19 nt, Homo sapiens
guggagaccuuggguguuc

SEQ ID NO: 772856 - RNA, 19 nt, Homo sapiens
ggugugcgguucaucuuca

SEQ ID NO: 772857 - RNA, 19 nt, Homo sapiens
gccgaguggucuccuggua

SEQ ID NO: 772858 - RNA, 19 nt, Homo sapiens
gaggaaacgcuaccugaca

SEQ ID NO: 772859 - RNA, 19 nt, Homo sapiens
agaauuaccuggccaaccu

SEQ ID NO: 772860 - RNA, 19 nt, Homo sapiens
cuacagccucaucgaauuu

SEQ ID NO: 772861 - RNA, 19 nt, Homo sapiens
aggaaacgcuaccugacaa

SEQ ID NO: 772862 - RNA, 19 nt, Homo sapiens
gcuggucggugggcacauu

SEQ ID NO: 772863 - RNA, 19 nt, Homo sapiens
uagcaggaacuguguguga

SEQ ID NO: 772864 - RNA, 19 nt, Homo sapiens
gcccauguaggcccaagua

SEQ ID NO: 772865 - RNA, 19 nt, Homo sapiens
gaggucuggugccuguuug

SEQ ID NO: 772866 - RNA, 19 nt, Homo sapiens
cagcugguuuggagucuca

SEQ ID NO: 772867 - RNA, 19 nt, Homo sapiens
gccauauccuggaggugaa

SEQ ID NO: 772868 - RNA, 19 nt, Homo sapiens
gcuccaggcuguugaucag

SEQ ID NO: 772869 - RNA, 19 nt, Homo sapiens
uuaccuggccaaccucuuu

SEQ ID NO: 772870 - RNA, 19 nt, Homo sapiens
ugaggucacggccgucuuu

SEQ ID NO: 772871 - RNA, 19 nt, Homo sapiens
agacacaagaucccaguga

SEQ ID NO: 772872 - RNA, 19 nt, Homo sapiens
ggagggugcgggacauugu

SEQ ID NO: 772873 - RNA, 19 nt, Homo sapiens
guugaucagcugucccuuu

SEQ ID NO: 772874 - RNA, 19 nt, Homo sapiens
ccaaguacucagucucaga

SEQ ID NO: 772875 - RNA, 19 nt, Homo sapiens
gugugugacuuccgccuau

SEQ ID NO: 772876 - RNA, 19 nt, Homo sapiens
gcccaaguacucagucuca

SEQ ID NO: 772877 - RNA, 19 nt, Homo sapiens
caagaucaucaucgucaau

SEQ ID NO: 772878 - RNA, 19 nt, Homo sapiens
ugacuuccgccuauccuau

SEQ ID NO: 772879 - RNA, 19 nt, Homo sapiens
uuguggagcugcccguuga

SEQ ID NO: 772880 - RNA, 19 nt, Homo sapiens
guuuggagucucaucauug

SEQ ID NO: 772881 - RNA, 19 nt, Homo sapiens
ggaguuggugcaggauuug

SEQ ID NO: 772882 - RNA, 19 nt, Homo sapiens
aacgcuaccugacaacuca

SEQ ID NO: 772883 - RNA, 19 nt, Homo sapiens
caggaacugugugugacuu

SEQ ID NO: 772884 - RNA, 19 nt, Homo sapiens
guggucaacauccucauug

SEQ ID NO: 772885 - RNA, 19 nt, Homo sapiens
ccucaucgaauuugauaca

SEQ ID NO: 772886 - RNA, 19 nt, Homo sapiens
ugaggucuggugccuguuu

SEQ ID NO: 772887 - RNA, 19 nt, Homo sapiens
aaccaccucuggcccaugu

SEQ ID NO: 772888 - RNA, 19 nt, Homo sapiens
gcucuuggacccuccucuu

SEQ ID NO: 772889 - RNA, 19 nt, Homo sapiens
acacaagaucccagugaug

SEQ ID NO: 772890 - RNA, 19 nt, Homo sapiens
guaaucgggaagagauguu

SEQ ID NO: 772891 - RNA, 19 nt, Homo sapiens
ucaucaucgucaaucguaa

SEQ ID NO: 772892 - RNA, 19 nt, Homo sapiens
cauguaggcccaaguacuc

SEQ ID NO: 772893 - RNA, 19 nt, Homo sapiens
uauggagacugaauaaacc

SEQ ID NO: 772894 - RNA, 19 nt, Homo sapiens
gcagaccuuucgggagaag

SEQ ID NO: 772895 - RNA, 19 nt, Homo sapiens
aggaucagguggucaaggu

SEQ ID NO: 772896 - RNA, 19 nt, Homo sapiens
aguggucuccugguauuua

SEQ ID NO: 772897 - RNA, 19 nt, Homo sapiens
caucaucgucaaucguaau

SEQ ID NO: 772898 - RNA, 19 nt, Homo sapiens
gaucaucaucgucaaucgu

SEQ ID NO: 772899 - RNA, 19 nt, Homo sapiens
caacgucugccgacaagcu

SEQ ID NO: 772900 - RNA, 19 nt, Homo sapiens
gcaagaugcuguccuuauc

SEQ ID NO: 772901 - RNA, 19 nt, Homo sapiens
aaacucagauguguucaaa

SEQ ID NO: 772902 - RNA, 19 nt, Homo sapiens
ccagaggaccggacacaua

SEQ ID NO: 772903 - RNA, 19 nt, Homo sapiens
gcaacagguuaacguguau

SEQ ID NO: 772904 - RNA, 19 nt, Homo sapiens
agaauaaacucagaugugu

SEQ ID NO: 772905 - RNA, 19 nt, Homo sapiens
cagcagcgcuucgguccua

SEQ ID NO: 772906 - RNA, 19 nt, Homo sapiens
gaacauccgcugcuucuac

SEQ ID NO: 772907 - RNA, 19 nt, Homo sapiens
gcagccgccugacaccuuu

SEQ ID NO: 772908 - RNA, 19 nt, Homo sapiens
gcccugcccucuucaucua

SEQ ID NO: 772909 - RNA, 19 nt, Homo sapiens
cagcauggcgugacaguga

SEQ ID NO: 772910 - RNA, 19 nt, Homo sapiens
cagcugaugaugugguuua

SEQ ID NO: 772911 - RNA, 19 nt, Homo sapiens
ccuuugagcuggugcaguu

SEQ ID NO: 772912 - RNA, 19 nt, Homo sapiens
ugcaacagguuaacgugua

SEQ ID NO: 772913 - RNA, 19 nt, Homo sapiens
caacaugggcuuagucaac

SEQ ID NO: 772914 - RNA, 19 nt, Homo sapiens
gggagagccuggaggagau

SEQ ID NO: 772915 - RNA, 19 nt, Homo sapiens
cagaauaaacucagaugug

SEQ ID NO: 772916 - RNA, 19 nt, Homo sapiens
gcagguggacuucuugcaa

SEQ ID NO: 772917 - RNA, 19 nt, Homo sapiens
ggcaaucgggcgacguuua

SEQ ID NO: 772918 - RNA, 19 nt, Homo sapiens
gagcggguacugcagauga

SEQ ID NO: 772919 - RNA, 19 nt, Homo sapiens
gaauaaacucagauguguu

SEQ ID NO: 772920 - RNA, 19 nt, Homo sapiens
gguugacccucuguuugua

SEQ ID NO: 772921 - RNA, 19 nt, Homo sapiens
acacgguccugccucugua

SEQ ID NO: 772922 - RNA, 19 nt, Homo sapiens
ggagaagcccugcccucuu

SEQ ID NO: 772923 - RNA, 19 nt, Homo sapiens
cggcugaugugaucuucuu

SEQ ID NO: 772924 - RNA, 19 nt, Homo sapiens
gaaccuggaggcucugauc

SEQ ID NO: 772925 - RNA, 19 nt, Homo sapiens
gaaguuguaccagcacguu

SEQ ID NO: 772926 - RNA, 19 nt, Homo sapiens
cagccauccucacgcauga

SEQ ID NO: 772927 - RNA, 19 nt, Homo sapiens
gcugggaucacauggagaa

SEQ ID NO: 772928 - RNA, 19 nt, Homo sapiens
caaccucagugggcuggaa

SEQ ID NO: 772929 - RNA, 19 nt, Homo sapiens
ggacuucuugcaacagguu

SEQ ID NO: 772930 - RNA, 19 nt, Homo sapiens
ccugacaccuuuguagaug

SEQ ID NO: 772931 - RNA, 19 nt, Homo sapiens
gcagaauaaacucagaugu

SEQ ID NO: 772932 - RNA, 19 nt, Homo sapiens
cuguagcaguggcagaaua

SEQ ID NO: 772933 - RNA, 19 nt, Homo sapiens
ucagugggcuggaaaugac

SEQ ID NO: 772934 - RNA, 19 nt, Homo sapiens
gcaaucgggcgacguuuac

SEQ ID NO: 772935 - RNA, 19 nt, Homo sapiens
gauccucggcugcuuagau

SEQ ID NO: 772936 - RNA, 19 nt, Homo sapiens
aauaaacucagauguguuc

SEQ ID NO: 772937 - RNA, 19 nt, Homo sapiens
gggcgacguuuacuacaac

SEQ ID NO: 772938 - RNA, 19 nt, Homo sapiens
guacugcagaugagcaaga

SEQ ID NO: 772939 - RNA, 19 nt, Homo sapiens
gaaauguaccaggcugugu

SEQ ID NO: 772940 - RNA, 19 nt, Homo sapiens
ggcaaugggcaauggacua

SEQ ID NO: 772941 - RNA, 19 nt, Homo sapiens
ccugcccucuucaucuaua

SEQ ID NO: 772942 - RNA, 19 nt, Homo sapiens
gcagguacgguccggaauc

SEQ ID NO: 772943 - RNA, 19 nt, Homo sapiens
ucccacauguugcgugcua

SEQ ID NO: 772944 - RNA, 19 nt, Homo sapiens
ggacuacgggcugaugugu

SEQ ID NO: 772945 - RNA, 19 nt, Homo sapiens
caccugggccugaagauca

SEQ ID NO: 772946 - RNA, 19 nt, Homo sapiens
gcugccggcugaugugauc

SEQ ID NO: 772947 - RNA, 19 nt, Homo sapiens
ugucgcagguggacuucuu

SEQ ID NO: 772948 - RNA, 19 nt, Homo sapiens
gcugcaggcugagaacauc

SEQ ID NO: 772949 - RNA, 19 nt, Homo sapiens
uguagcaguggcagaauaa

SEQ ID NO: 772950 - RNA, 19 nt, Homo sapiens
gggacguacuggccaugga

SEQ ID NO: 772951 - RNA, 19 nt, Homo sapiens
cgggcgacguuuacuacaa

SEQ ID NO: 772952 - RNA, 19 nt, Homo sapiens
uacuugggcuggccauguu

SEQ ID NO: 772953 - RNA, 19 nt, Homo sapiens
gaaggcaacaugggcuuag

SEQ ID NO: 772954 - RNA, 19 nt, Homo sapiens
ugagcugccuccuccgaau

SEQ ID NO: 772955 - RNA, 19 nt, Homo sapiens
gcaaugggcaauggacuac

SEQ ID NO: 772956 - RNA, 19 nt, Homo sapiens
gagcugccuccuccgaaug

SEQ ID NO: 772957 - RNA, 19 nt, Homo sapiens
cagaggaccggacacauac

SEQ ID NO: 772958 - RNA, 19 nt, Homo sapiens
cugcgguacuuguguaaca

SEQ ID NO: 772959 - RNA, 19 nt, Homo sapiens
guuccagcccuguguaugu

SEQ ID NO: 772960 - RNA, 19 nt, Homo sapiens
gugguugacccucuguuug

SEQ ID NO: 772961 - RNA, 19 nt, Homo sapiens
accagcacguucaaacuga

SEQ ID NO: 772962 - RNA, 19 nt, Homo sapiens
gaggucaccagcacguuca

SEQ ID NO: 772963 - RNA, 19 nt, Homo sapiens
gauggaagggcgagaacgu

SEQ ID NO: 772964 - RNA, 19 nt, Homo sapiens
gggcuucugcaucccugua

SEQ ID NO: 772965 - RNA, 19 nt, Homo sapiens
uaaacucagauguguucaa

SEQ ID NO: 772966 - RNA, 19 nt, Homo sapiens
ccagcacguucaaacugau

SEQ ID NO: 772967 - RNA, 19 nt, Homo sapiens
ccaagcugcaggcugagaa

SEQ ID NO: 772968 - RNA, 19 nt, Homo sapiens
ggcaacaugggcuuaguca

SEQ ID NO: 772969 - RNA, 19 nt, Homo sapiens
gacaagggcuucacagaua

SEQ ID NO: 772970 - RNA, 19 nt, Homo sapiens
ccaagcaccuucccaguug

SEQ ID NO: 772971 - RNA, 19 nt, Homo sapiens
acaagaagauugccaagga

SEQ ID NO: 772972 - RNA, 19 nt, Homo sapiens
gauaaacuguucuacaucu

SEQ ID NO: 772973 - RNA, 19 nt, Homo sapiens
cagauaaacuguucuacau

SEQ ID NO: 772974 - RNA, 19 nt, Homo sapiens
agacagagcuacggaagga

SEQ ID NO: 772975 - RNA, 19 nt, Homo sapiens
gugaagacccgcuguucua

SEQ ID NO: 772976 - RNA, 19 nt, Homo sapiens
aaacaggaaccuacaaguu

SEQ ID NO: 772977 - RNA, 19 nt, Homo sapiens
acaagggcuucacagauaa

SEQ ID NO: 772978 - RNA, 19 nt, Homo sapiens
gcgcuuugcucaggucuug

SEQ ID NO: 772979 - RNA, 19 nt, Homo sapiens
caagaagauugccaaggau

SEQ ID NO: 772980 - RNA, 19 nt, Homo sapiens
caucaggcgcgauaucuuu

SEQ ID NO: 772981 - RNA, 19 nt, Homo sapiens
gaccaggccuaccuuacug

SEQ ID NO: 772982 - RNA, 19 nt, Homo sapiens
caggaaacaucgugggaau

SEQ ID NO: 772983 - RNA, 19 nt, Homo sapiens
uggcugcccugguguacua

SEQ ID NO: 772984 - RNA, 19 nt, Homo sapiens
aaguacaacugcacgauug

SEQ ID NO: 772985 - RNA, 19 nt, Homo sapiens
ucuccaagcuggugcugaa

SEQ ID NO: 772986 - RNA, 19 nt, Homo sapiens
ggacgauuguaucaaguac

SEQ ID NO: 772987 - RNA, 19 nt, Homo sapiens
gugaugugcuggugaugga

SEQ ID NO: 772988 - RNA, 19 nt, Homo sapiens
gggccagagugcaacugua

SEQ ID NO: 772989 - RNA, 19 nt, Homo sapiens
caaguacaacugcacgauu

SEQ ID NO: 772990 - RNA, 19 nt, Homo sapiens
gagcugggcuaccuguacu

SEQ ID NO: 772991 - RNA, 19 nt, Homo sapiens
ccagguggcugaguucuac

SEQ ID NO: 772992 - RNA, 19 nt, Homo sapiens
ccacucagcaggaaacauc

SEQ ID NO: 772993 - RNA, 19 nt, Homo sapiens
gggacgauuguaucaagua

SEQ ID NO: 772994 - RNA, 19 nt, Homo sapiens
gcaugacgguggugauucg

SEQ ID NO: 772995 - RNA, 19 nt, Homo sapiens
ugacaagggcuucacagau

SEQ ID NO: 772996 - RNA, 19 nt, Homo sapiens
ggacagugcccauuuuguu

SEQ ID NO: 772997 - RNA, 19 nt, Homo sapiens
uggcugacguggccgugua

SEQ ID NO: 772998 - RNA, 19 nt, Homo sapiens
ggaccaggccuaccuuacu

SEQ ID NO: 772999 - RNA, 19 nt, Homo sapiens
gcuguucuaucuacaucga

SEQ ID NO: 773000 - RNA, 19 nt, Homo sapiens
caagcaguguagccaacuu

SEQ ID NO: 773001 - RNA, 19 nt, Homo sapiens
agacggcccugaucuucga

SEQ ID NO: 773002 - RNA, 19 nt, Homo sapiens
gccaacaacaagaagauug

SEQ ID NO: 773003 - RNA, 19 nt, Homo sapiens
ggaaacaucgugggaaucg

SEQ ID NO: 773004 - RNA, 19 nt, Homo sapiens
aaacuguucuacaucuaca

SEQ ID NO: 773005 - RNA, 19 nt, Homo sapiens
gaagacccgcuguucuauc

SEQ ID NO: 773006 - RNA, 19 nt, Homo sapiens
cgacaagacggcccugauc

SEQ ID NO: 773007 - RNA, 19 nt, Homo sapiens
uugcucaggucuuggagaa

SEQ ID NO: 773008 - RNA, 19 nt, Homo sapiens
gaagauugccaaggauguc

SEQ ID NO: 773009 - RNA, 19 nt, Homo sapiens
gcauggcugcccuggugua

SEQ ID NO: 773010 - RNA, 19 nt, Homo sapiens
gggcuucacagauaaacug

SEQ ID NO: 773011 - RNA, 19 nt, Homo sapiens
gacccgcuguucuaucuac

SEQ ID NO: 773012 - RNA, 19 nt, Homo sapiens
ugccaaggaugucuucaag

SEQ ID NO: 773013 - RNA, 19 nt, Homo sapiens
ccuggacccucugcugaaa

SEQ ID NO: 773014 - RNA, 19 nt, Homo sapiens
uccgccagcuggaugagua

SEQ ID NO: 773015 - RNA, 19 nt, Homo sapiens
aagacccgcuguucuaucu

SEQ ID NO: 773016 - RNA, 19 nt, Homo sapiens
ccaagcuggugcugaaacu

SEQ ID NO: 773017 - RNA, 19 nt, Homo sapiens
cuaccuuacuggugaugug

SEQ ID NO: 773018 - RNA, 19 nt, Homo sapiens
caagggcuucacagauaaa

SEQ ID NO: 773019 - RNA, 19 nt, Homo sapiens
ugacccggcuauugugaag

SEQ ID NO: 773020 - RNA, 19 nt, Homo sapiens
uggacccucugcugaaaga

SEQ ID NO: 773021 - RNA, 19 nt, Homo sapiens
cggcggacagugcccauuu

SEQ ID NO: 773022 - RNA, 19 nt, Homo sapiens
ggccagagugcaacuguag

SEQ ID NO: 773023 - RNA, 19 nt, Homo sapiens
uggagaaccgcaaugaguu

SEQ ID NO: 773024 - RNA, 19 nt, Homo sapiens
caagcaccuucccaguugu

SEQ ID NO: 773025 - RNA, 19 nt, Homo sapiens
gacaagacggcccugaucu

SEQ ID NO: 773026 - RNA, 19 nt, Homo sapiens
uccugaaggugaaggcaaa

SEQ ID NO: 773027 - RNA, 19 nt, Homo sapiens
ugaagacccgcuguucuau

SEQ ID NO: 773028 - RNA, 19 nt, Homo sapiens
gccgcuaccuccugaacca

SEQ ID NO: 773029 - RNA, 19 nt, Homo sapiens
cccaagcaccuucccaguu

SEQ ID NO: 773030 - RNA, 19 nt, Homo sapiens
ccuacaaguuccagaagac

SEQ ID NO: 773031 - RNA, 19 nt, Homo sapiens
gcgccaacaacaagaagau

SEQ ID NO: 773032 - RNA, 19 nt, Homo sapiens
ucaacgaggacaccaugga

SEQ ID NO: 773033 - RNA, 19 nt, Homo sapiens
gggugcugcuguucuccaa

SEQ ID NO: 773034 - RNA, 19 nt, Homo sapiens
cuaucuacaucgagaaagg

SEQ ID NO: 773035 - RNA, 19 nt, Homo sapiens
ccgcuguucuaucuacauc

SEQ ID NO: 773036 - RNA, 19 nt, Homo sapiens
gcccugguguacuauggau

SEQ ID NO: 773037 - RNA, 19 nt, Homo sapiens
gaacugcggucacuauuuu

SEQ ID NO: 773038 - RNA, 19 nt, Homo sapiens
ggaaguugcuaaaggaugu

SEQ ID NO: 773039 - RNA, 19 nt, Homo sapiens
gcgcacaccuuucucauuc

SEQ ID NO: 773040 - RNA, 19 nt, Homo sapiens
ggagacauauggacugaca

SEQ ID NO: 773041 - RNA, 19 nt, Homo sapiens
ccacagagaccuucaaaca

SEQ ID NO: 773042 - RNA, 19 nt, Homo sapiens
gaacgucuauggagucacu

SEQ ID NO: 773043 - RNA, 19 nt, Homo sapiens
gcaggaaaccuucgaaucu

SEQ ID NO: 773044 - RNA, 19 nt, Homo sapiens
ccacgugucugagaacuug

SEQ ID NO: 773045 - RNA, 19 nt, Homo sapiens
ggucaguucugggaagauu

SEQ ID NO: 773046 - RNA, 19 nt, Homo sapiens
gggugacgguguuccagua

SEQ ID NO: 773047 - RNA, 19 nt, Homo sapiens
gcgauuugcuggcugaagu

SEQ ID NO: 773048 - RNA, 19 nt, Homo sapiens
cugagaacuugccaccuua

SEQ ID NO: 773049 - RNA, 19 nt, Homo sapiens
gccgauaccuugucaacca

SEQ ID NO: 773050 - RNA, 19 nt, Homo sapiens
guucucggcuggucaguuc

SEQ ID NO: 773051 - RNA, 19 nt, Homo sapiens
acacgugccuguacaucuu

SEQ ID NO: 773052 - RNA, 19 nt, Homo sapiens
ucugagaacuugccaccuu

SEQ ID NO: 773053 - RNA, 19 nt, Homo sapiens
gaacccacccugcuggaau

SEQ ID NO: 773054 - RNA, 19 nt, Homo sapiens
gcaaugccagggcuucuau

SEQ ID NO: 773055 - RNA, 19 nt, Homo sapiens
gaaccagacggugccgaua

SEQ ID NO: 773056 - RNA, 19 nt, Homo sapiens
ugcaggugcuggagacaua

SEQ ID NO: 773057 - RNA, 19 nt, Homo sapiens
gggcgugcuuccuggcuuu

SEQ ID NO: 773058 - RNA, 19 nt, Homo sapiens
gggaggaucagggauguuu

SEQ ID NO: 773059 - RNA, 19 nt, Homo sapiens
caggaaaccuucgaaucug

SEQ ID NO: 773060 - RNA, 19 nt, Homo sapiens
ggaauggcagcccuaguuc

SEQ ID NO: 773061 - RNA, 19 nt, Homo sapiens
ugaaguguccgcugaagug

SEQ ID NO: 773062 - RNA, 19 nt, Homo sapiens
ccagaacugcggucacuau

SEQ ID NO: 773063 - RNA, 19 nt, Homo sapiens
cuucgaaucugagaacuuc

SEQ ID NO: 773064 - RNA, 19 nt, Homo sapiens
aaauguggcuggagcugau

SEQ ID NO: 773065 - RNA, 19 nt, Homo sapiens
ggcagaacguggccauaag

SEQ ID NO: 773066 - RNA, 19 nt, Homo sapiens
gugcugaaauccaaguucu

SEQ ID NO: 773067 - RNA, 19 nt, Homo sapiens
aggaaaccuucgaaucuga

SEQ ID NO: 773068 - RNA, 19 nt, Homo sapiens
ggaggugaacgucuaugga

SEQ ID NO: 773069 - RNA, 19 nt, Homo sapiens
ucagggaucuuuucuauac

SEQ ID NO: 773070 - RNA, 19 nt, Homo sapiens
uggaauggcagcccuaguu

SEQ ID NO: 773071 - RNA, 19 nt, Homo sapiens
gggcuucuaucagcugugu

SEQ ID NO: 773072 - RNA, 19 nt, Homo sapiens
aggcggagcgcgagaguaa

SEQ ID NO: 773073 - RNA, 19 nt, Homo sapiens
caacguggccaccaucaac

SEQ ID NO: 773074 - RNA, 19 nt, Homo sapiens
aaguucggauggcaaauga

SEQ ID NO: 773075 - RNA, 19 nt, Homo sapiens
caguggugcugaaauccaa

SEQ ID NO: 773076 - RNA, 19 nt, Homo sapiens
cugcuggaauuagcgauuu

SEQ ID NO: 773077 - RNA, 19 nt, Homo sapiens
gcacaccuuucucauucac

SEQ ID NO: 773078 - RNA, 19 nt, Homo sapiens
agaacugcggucacuauuu

SEQ ID NO: 773079 - RNA, 19 nt, Homo sapiens
agacauauggacugacaga

SEQ ID NO: 773080 - RNA, 19 nt, Homo sapiens
gcagaacguggccauaagg

SEQ ID NO: 773081 - RNA, 19 nt, Homo sapiens
ugucagggaucuuuucuau

SEQ ID NO: 773082 - RNA, 19 nt, Homo sapiens
agaaaguucggauggcaaa

SEQ ID NO: 773083 - RNA, 19 nt, Homo sapiens
gagaacuugccaccuuaug

SEQ ID NO: 773084 - RNA, 19 nt, Homo sapiens
gaaggcagggcuggaaugg

SEQ ID NO: 773085 - RNA, 19 nt, Homo sapiens
aacccacccugcuggaauu

SEQ ID NO: 773086 - RNA, 19 nt, Homo sapiens
gugaacgucuauggaguca

SEQ ID NO: 773087 - RNA, 19 nt, Homo sapiens
gcaacguggccaccaucaa

SEQ ID NO: 773088 - RNA, 19 nt, Homo sapiens
ugacgguguuccaguacau

SEQ ID NO: 773089 - RNA, 19 nt, Homo sapiens
gaaaccuucgaaucugaga

SEQ ID NO: 773090 - RNA, 19 nt, Homo sapiens
gcggagcgcgagaguaaca

SEQ ID NO: 773091 - RNA, 19 nt, Homo sapiens
ggucuucgaggcccuagau

SEQ ID NO: 773092 - RNA, 19 nt, Homo sapiens
cagaacugcggucacuauu

SEQ ID NO: 773093 - RNA, 19 nt, Homo sapiens
ggcaggaaaccuucgaauc

SEQ ID NO: 773094 - RNA, 19 nt, Homo sapiens
aggcagaacguggccauaa

SEQ ID NO: 773095 - RNA, 19 nt, Homo sapiens
caaggcugcucggaucagu

SEQ ID NO: 773096 - RNA, 19 nt, Homo sapiens
caccacagagaccuucaaa

SEQ ID NO: 773097 - RNA, 19 nt, Homo sapiens
uuucuccgcuuccaugauc

SEQ ID NO: 773098 - RNA, 19 nt, Homo sapiens
gcugaaguguccgcugaag

SEQ ID NO: 773099 - RNA, 19 nt, Homo sapiens
uaccagaacugcggucacu

SEQ ID NO: 773100 - RNA, 19 nt, Homo sapiens
uugauucgcuaugauguca

SEQ ID NO: 773101 - RNA, 19 nt, Homo sapiens
ucuccuugauucgcuauga

SEQ ID NO: 773102 - RNA, 19 nt, Homo sapiens
cuggagacauauggacuga

SEQ ID NO: 773103 - RNA, 19 nt, Homo sapiens
ggaacccacccugcuggaa

SEQ ID NO: 773104 - RNA, 19 nt, Homo sapiens
ggagcugugccgauaccuu

SEQ ID NO: 773105 - RNA, 19 nt, Homo sapiens
ggaggaucagggauguuug

SEQ ID NO: 773106 - RNA, 19 nt, Homo sapiens
gaauggcagcccuaguucu

SEQ ID NO: 773107 - RNA, 19 nt, Homo sapiens
ggcacuguauggccacauc

SEQ ID NO: 773108 - RNA, 19 nt, Homo sapiens
gcacauugcugauuaccua

SEQ ID NO: 773109 - RNA, 19 nt, Homo sapiens
gaggauaacucaacauuuc

SEQ ID NO: 773110 - RNA, 19 nt, Homo sapiens
ggacaucuauaaugccaua

SEQ ID NO: 773111 - RNA, 19 nt, Homo sapiens
ggacauaggcuacuucuug

SEQ ID NO: 773112 - RNA, 19 nt, Homo sapiens
caaaguggaugaaguauca

SEQ ID NO: 773113 - RNA, 19 nt, Homo sapiens
ggacaaaguggaugaagua

SEQ ID NO: 773114 - RNA, 19 nt, Homo sapiens
ucaaagaugccuuguauuu

SEQ ID NO: 773115 - RNA, 19 nt, Homo sapiens
ucacacaacuuacaccauu

SEQ ID NO: 773116 - RNA, 19 nt, Homo sapiens
cagaugggauugacucuuu

SEQ ID NO: 773117 - RNA, 19 nt, Homo sapiens
gauugaagauugugaggaa

SEQ ID NO: 773118 - RNA, 19 nt, Homo sapiens
ggacagccacuugauauaa

SEQ ID NO: 773119 - RNA, 19 nt, Homo sapiens
cugauuaccuaccuaguua

SEQ ID NO: 773120 - RNA, 19 nt, Homo sapiens
caacaguggagaucucuua

SEQ ID NO: 773121 - RNA, 19 nt, Homo sapiens
ggagauguguggagacaau

SEQ ID NO: 773122 - RNA, 19 nt, Homo sapiens
ugacugaggacaucuauaa

SEQ ID NO: 773123 - RNA, 19 nt, Homo sapiens
cgacagaguuggagauaca

SEQ ID NO: 773124 - RNA, 19 nt, Homo sapiens
gacauaggcuacuucuuga

SEQ ID NO: 773125 - RNA, 19 nt, Homo sapiens
ugaaguugcugauacaguu

SEQ ID NO: 773126 - RNA, 19 nt, Homo sapiens
ugaaggcaauauuggauuu

SEQ ID NO: 773127 - RNA, 19 nt, Homo sapiens
gcaccuacuguuuguauuu

SEQ ID NO: 773128 - RNA, 19 nt, Homo sapiens
gaauacaggacaccauuga

SEQ ID NO: 773129 - RNA, 19 nt, Homo sapiens
gagauacugccaagccuua

SEQ ID NO: 773130 - RNA, 19 nt, Homo sapiens
aauaugauguggagaaaga

SEQ ID NO: 773131 - RNA, 19 nt, Homo sapiens
gaacugcuucgguauuuau

SEQ ID NO: 773132 - RNA, 19 nt, Homo sapiens
aaagaugccuuguauuucu

SEQ ID NO: 773133 - RNA, 19 nt, Homo sapiens
ggagaccucuauuucaaca

SEQ ID NO: 773134 - RNA, 19 nt, Homo sapiens
uaagaaaggagaccucuau

SEQ ID NO: 773135 - RNA, 19 nt, Homo sapiens
ccacugaaguugcugauac

SEQ ID NO: 773136 - RNA, 19 nt, Homo sapiens
caguggagaucucuuaaug

SEQ ID NO: 773137 - RNA, 19 nt, Homo sapiens
gugaacugcuucgguauuu

SEQ ID NO: 773138 - RNA, 19 nt, Homo sapiens
gaacuggccucacuuuugu

SEQ ID NO: 773139 - RNA, 19 nt, Homo sapiens
uaacccugcugucaucaaa

SEQ ID NO: 773140 - RNA, 19 nt, Homo sapiens
gaaaccaaaugaccgugau

SEQ ID NO: 773141 - RNA, 19 nt, Homo sapiens
guauaucggugaacugcuu

SEQ ID NO: 773142 - RNA, 19 nt, Homo sapiens
gacagccacuugauauaau

SEQ ID NO: 773143 - RNA, 19 nt, Homo sapiens
aaggagaccucuauuucaa

SEQ ID NO: 773144 - RNA, 19 nt, Homo sapiens
agaguaaacuaccuacaga

SEQ ID NO: 773145 - RNA, 19 nt, Homo sapiens
gaaggcaauauuggauuua

SEQ ID NO: 773146 - RNA, 19 nt, Homo sapiens
ggaggauaacucaacauuu

SEQ ID NO: 773147 - RNA, 19 nt, Homo sapiens
caacgucacugucauucag

SEQ ID NO: 773148 - RNA, 19 nt, Homo sapiens
uaacucaacauuuccagaa

SEQ ID NO: 773149 - RNA, 19 nt, Homo sapiens
aaauggauauugcgucaga

SEQ ID NO: 773150 - RNA, 19 nt, Homo sapiens
gaugaaguaucaacugaac

SEQ ID NO: 773151 - RNA, 19 nt, Homo sapiens
acaagcagcugucgaagag

SEQ ID NO: 773152 - RNA, 19 nt, Homo sapiens
guggagaucucuuaauggu

SEQ ID NO: 773153 - RNA, 19 nt, Homo sapiens
agaaaggagaccucuauuu

SEQ ID NO: 773154 - RNA, 19 nt, Homo sapiens
caaaggcucagacagagaa

SEQ ID NO: 773155 - RNA, 19 nt, Homo sapiens
ggcaauauuggauuuauga

SEQ ID NO: 773156 - RNA, 19 nt, Homo sapiens
gaucaugagggucgcauug

SEQ ID NO: 773157 - RNA, 19 nt, Homo sapiens
acacaacuuacaccauuua

SEQ ID NO: 773158 - RNA, 19 nt, Homo sapiens
gaggagauguguggagaca

SEQ ID NO: 773159 - RNA, 19 nt, Homo sapiens
aaacugagagaugucuuua

SEQ ID NO: 773160 - RNA, 19 nt, Homo sapiens
gagaaaaguuggugcuguu

SEQ ID NO: 773161 - RNA, 19 nt, Homo sapiens
ugaacugcuucgguauuua

SEQ ID NO: 773162 - RNA, 19 nt, Homo sapiens
acuccugccuuauacauuu

SEQ ID NO: 773163 - RNA, 19 nt, Homo sapiens
uggaugaaguaucaacuga

SEQ ID NO: 773164 - RNA, 19 nt, Homo sapiens
gaagauugugaggaaauuu

SEQ ID NO: 773165 - RNA, 19 nt, Homo sapiens
ugaagauugugaggaaauu

SEQ ID NO: 773166 - RNA, 19 nt, Homo sapiens
caaagaugccuuguauuuc

SEQ ID NO: 773167 - RNA, 19 nt, Homo sapiens
guucuaugcugccacugaa

SEQ ID NO: 773168 - RNA, 19 nt, Homo sapiens
gaucacucaucagcgcaua

SEQ ID NO: 773169 - RNA, 19 nt, Homo sapiens
uauaaugccauaagugcua

SEQ ID NO: 773170 - RNA, 19 nt, Homo sapiens
cgucagaguucccaaaggu

SEQ ID NO: 773171 - RNA, 19 nt, Homo sapiens
gaaccacaggucuuccaaa

SEQ ID NO: 773172 - RNA, 19 nt, Homo sapiens
gccauggcgugccucaauu

SEQ ID NO: 773173 - RNA, 19 nt, Homo sapiens
gaggaaauuuuguaggaaa

SEQ ID NO: 773174 - RNA, 19 nt, Homo sapiens
ugagaucacuggaacuuuu

SEQ ID NO: 773175 - RNA, 19 nt, Homo sapiens
gcugauuaccuaccuaguu

SEQ ID NO: 773176 - RNA, 19 nt, Homo sapiens
ggauauugcgucagaguuc

SEQ ID NO: 773177 - RNA, 19 nt, Homo sapiens
gaaaauacaacgucacugu

SEQ ID NO: 773178 - RNA, 19 nt, Homo sapiens
cuauaucacucugcccuuu

SEQ ID NO: 773179 - RNA, 19 nt, Homo sapiens
uggcgugccucaauuacaa

SEQ ID NO: 773180 - RNA, 19 nt, Homo sapiens
guugagucuuugcaaguaa

SEQ ID NO: 773181 - RNA, 19 nt, Homo sapiens
caagagauuuggggacaua

SEQ ID NO: 773182 - RNA, 19 nt, Homo sapiens
guauggaacuggccucacu

SEQ ID NO: 773183 - RNA, 19 nt, Homo sapiens
ggcauucacggauguauug

SEQ ID NO: 773184 - RNA, 19 nt, Homo sapiens
aagcagccaugaucacuca

SEQ ID NO: 773185 - RNA, 19 nt, Homo sapiens
ccaggaggauaacucaaca

SEQ ID NO: 773186 - RNA, 19 nt, Homo sapiens
gaauauucccaggaggaua

SEQ ID NO: 773187 - RNA, 19 nt, Homo sapiens
caucuauaaugccauaagu

SEQ ID NO: 773188 - RNA, 19 nt, Homo sapiens
gagugcaugugccagauca

SEQ ID NO: 773189 - RNA, 19 nt, Homo sapiens
aaaggagaccucuauuuca

SEQ ID NO: 773190 - RNA, 19 nt, Homo sapiens
acugagagaugucuuuaag

SEQ ID NO: 773191 - RNA, 19 nt, Homo sapiens
gcaaaggcucagacagaga

SEQ ID NO: 773192 - RNA, 19 nt, Homo sapiens
ugaccgugaucauaaagug

SEQ ID NO: 773193 - RNA, 19 nt, Homo sapiens
uaacacagaugggauugac

SEQ ID NO: 773194 - RNA, 19 nt, Homo sapiens
ccauggcgugccucaauua

SEQ ID NO: 773195 - RNA, 19 nt, Homo sapiens
ccagaaagaaacugaaugg

SEQ ID NO: 773196 - RNA, 19 nt, Homo sapiens
acucuugccuugcggacua

SEQ ID NO: 773197 - RNA, 19 nt, Homo sapiens
aauaacaguugagucuuug

SEQ ID NO: 773198 - RNA, 19 nt, Homo sapiens
aauauucccaggaggauaa

SEQ ID NO: 773199 - RNA, 19 nt, Homo sapiens
cacacaacuuacaccauuu

SEQ ID NO: 773200 - RNA, 19 nt, Homo sapiens
ccuuguauuucuuggauga

SEQ ID NO: 773201 - RNA, 19 nt, Homo sapiens
guccaagaaguaaauguuu

SEQ ID NO: 773202 - RNA, 19 nt, Homo sapiens
gaaguugcugauacaguug

SEQ ID NO: 773203 - RNA, 19 nt, Homo sapiens
uuaugcaacucaccacaga

SEQ ID NO: 773204 - RNA, 19 nt, Homo sapiens
ggaacuggccucacuuuug

SEQ ID NO: 773205 - RNA, 19 nt, Homo sapiens
ucauggaggucugaaguca

SEQ ID NO: 773206 - RNA, 19 nt, Homo sapiens
ggaugaaguaucaacugaa

SEQ ID NO: 773207 - RNA, 19 nt, Homo sapiens
caccuacuguuuguauuug

SEQ ID NO: 773208 - RNA, 19 nt, Homo sapiens
gaagagagcucaggaguau

SEQ ID NO: 773209 - RNA, 19 nt, Homo sapiens
ggaaggagcucuuaguuac

SEQ ID NO: 773210 - RNA, 19 nt, Homo sapiens
gaauuugcccgaaugauua

SEQ ID NO: 773211 - RNA, 19 nt, Homo sapiens
gaaaucaugucuugugaag

SEQ ID NO: 773212 - RNA, 19 nt, Homo sapiens
caaaguaucuggagaacca

SEQ ID NO: 773213 - RNA, 19 nt, Homo sapiens
cugaaugucuuguacuuua

SEQ ID NO: 773214 - RNA, 19 nt, Homo sapiens
ggagagagacggagccuuu

SEQ ID NO: 773215 - RNA, 19 nt, Homo sapiens
aaauugagguuucuuggua

SEQ ID NO: 773216 - RNA, 19 nt, Homo sapiens
ggaaacgcccacugaauaa

SEQ ID NO: 773217 - RNA, 19 nt, Homo sapiens
ggaaguggcaagacacaua

SEQ ID NO: 773218 - RNA, 19 nt, Homo sapiens
ugagaccucuuucuacuuu

SEQ ID NO: 773219 - RNA, 19 nt, Homo sapiens
ggcauaagcuccugugaau

SEQ ID NO: 773220 - RNA, 19 nt, Homo sapiens
gagaaugcauggcaaguuc

SEQ ID NO: 773221 - RNA, 19 nt, Homo sapiens
ugaaacagcuucgaaugaa

SEQ ID NO: 773222 - RNA, 19 nt, Homo sapiens
ggaauuugcccgaaugauu

SEQ ID NO: 773223 - RNA, 19 nt, Homo sapiens
gaaguugucuacagguuca

SEQ ID NO: 773224 - RNA, 19 nt, Homo sapiens
ucagggagcuggaggagaa

SEQ ID NO: 773225 - RNA, 19 nt, Homo sapiens
gaugugauuuccauuccua

SEQ ID NO: 773226 - RNA, 19 nt, Homo sapiens
cauaagcuccugugaauau

SEQ ID NO: 773227 - RNA, 19 nt, Homo sapiens
gcgcagaaaucaacaagag

SEQ ID NO: 773228 - RNA, 19 nt, Homo sapiens
ggaauguucucagcauaga

SEQ ID NO: 773229 - RNA, 19 nt, Homo sapiens
uggaagagcucaaggagau

SEQ ID NO: 773230 - RNA, 19 nt, Homo sapiens
caaauuauucuucgagcua

SEQ ID NO: 773231 - RNA, 19 nt, Homo sapiens
aaucaugucuugugaagga

SEQ ID NO: 773232 - RNA, 19 nt, Homo sapiens
guaacaauccagaaacaaa

SEQ ID NO: 773233 - RNA, 19 nt, Homo sapiens
uagaggaucccuacuguuu

SEQ ID NO: 773234 - RNA, 19 nt, Homo sapiens
uaacaaaguaucuggagaa

SEQ ID NO: 773235 - RNA, 19 nt, Homo sapiens
aauaaacccagaacucuua

SEQ ID NO: 773236 - RNA, 19 nt, Homo sapiens
ucccagauguccagcuuua

SEQ ID NO: 773237 - RNA, 19 nt, Homo sapiens
cacgcgugcuuccaaauua

SEQ ID NO: 773238 - RNA, 19 nt, Homo sapiens
ccaacgcaguaaugguuua

SEQ ID NO: 773239 - RNA, 19 nt, Homo sapiens
caaauaagcagcaagaaac

SEQ ID NO: 773240 - RNA, 19 nt, Homo sapiens
caaguucucuuugguagau

SEQ ID NO: 773241 - RNA, 19 nt, Homo sapiens
gcaagaauuggccaagaaa

SEQ ID NO: 773242 - RNA, 19 nt, Homo sapiens
ugacugauccuaucgaaga

SEQ ID NO: 773243 - RNA, 19 nt, Homo sapiens
cggaggaaaucaugucuug

SEQ ID NO: 773244 - RNA, 19 nt, Homo sapiens
ggagaaggcuauggaagag

SEQ ID NO: 773245 - RNA, 19 nt, Homo sapiens
uaucgaagagcacagaaua

SEQ ID NO: 773246 - RNA, 19 nt, Homo sapiens
caaaauuccugcuccaaaa

SEQ ID NO: 773247 - RNA, 19 nt, Homo sapiens
caggcuagcagacaaauaa

SEQ ID NO: 773248 - RNA, 19 nt, Homo sapiens
guacaugaacccaaguuga

SEQ ID NO: 773249 - RNA, 19 nt, Homo sapiens
gcaguaaugguuuaauuca

SEQ ID NO: 773250 - RNA, 19 nt, Homo sapiens
cgaaugaaguugucuacag

SEQ ID NO: 773251 - RNA, 19 nt, Homo sapiens
gcuaucugcuggcucuaaa

SEQ ID NO: 773252 - RNA, 19 nt, Homo sapiens
aggaaacgcccacugaaua

SEQ ID NO: 773253 - RNA, 19 nt, Homo sapiens
gaauaugugucuguguuag

SEQ ID NO: 773254 - RNA, 19 nt, Homo sapiens
gaagaaggcccagaacucu

SEQ ID NO: 773255 - RNA, 19 nt, Homo sapiens
gcugauuccaggcaauuua

SEQ ID NO: 773256 - RNA, 19 nt, Homo sapiens
ggaaacagaagagauggaa

SEQ ID NO: 773257 - RNA, 19 nt, Homo sapiens
gacaggaaguggcaagaca

SEQ ID NO: 773258 - RNA, 19 nt, Homo sapiens
gcauauggccagacaggaa

SEQ ID NO: 773259 - RNA, 19 nt, Homo sapiens
gaggaaaucaugucuugug

SEQ ID NO: 773260 - RNA, 19 nt, Homo sapiens
gcaauaaacccagaacucu

SEQ ID NO: 773261 - RNA, 19 nt, Homo sapiens
gaggaaggagcucuuaguu

SEQ ID NO: 773262 - RNA, 19 nt, Homo sapiens
gcuuugacuuugcauuuga

SEQ ID NO: 773263 - RNA, 19 nt, Homo sapiens
gaaugucauccacuuacua

SEQ ID NO: 773264 - RNA, 19 nt, Homo sapiens
gaacaagcgagaagagaag

SEQ ID NO: 773265 - RNA, 19 nt, Homo sapiens
agaaggaggugccacaaag

SEQ ID NO: 773266 - RNA, 19 nt, Homo sapiens
uuggagaaauccuguguuu

SEQ ID NO: 773267 - RNA, 19 nt, Homo sapiens
acaaauaagcagcaagaaa

SEQ ID NO: 773268 - RNA, 19 nt, Homo sapiens
gcucaggaguaugacagua

SEQ ID NO: 773269 - RNA, 19 nt, Homo sapiens
gaugaaacagcuucgaaug

SEQ ID NO: 773270 - RNA, 19 nt, Homo sapiens
caagaaagaaauugaugug

SEQ ID NO: 773271 - RNA, 19 nt, Homo sapiens
gaauuggccaagaaagaaa

SEQ ID NO: 773272 - RNA, 19 nt, Homo sapiens
gcugagggacuccuucauu

SEQ ID NO: 773273 - RNA, 19 nt, Homo sapiens
gguuaacucugcugaugau

SEQ ID NO: 773274 - RNA, 19 nt, Homo sapiens
guacagacaaucuuugaag

SEQ ID NO: 773275 - RNA, 19 nt, Homo sapiens
uguaaggacugugaacuug

SEQ ID NO: 773276 - RNA, 19 nt, Homo sapiens
ccacaaagggcaaagagau

SEQ ID NO: 773277 - RNA, 19 nt, Homo sapiens
uaaggacugugaacuugga

SEQ ID NO: 773278 - RNA, 19 nt, Homo sapiens
gagagagacggagccuuua

SEQ ID NO: 773279 - RNA, 19 nt, Homo sapiens
ugacaugggacacuccuuu

SEQ ID NO: 773280 - RNA, 19 nt, Homo sapiens
ugacauucuucgagaucua

SEQ ID NO: 773281 - RNA, 19 nt, Homo sapiens
gcagacaaauaagcagcaa

SEQ ID NO: 773282 - RNA, 19 nt, Homo sapiens
uaacucugcugaugauguc

SEQ ID NO: 773283 - RNA, 19 nt, Homo sapiens
gagaccucuuucuacuuua

SEQ ID NO: 773284 - RNA, 19 nt, Homo sapiens
ggacagguucugguaaaug

SEQ ID NO: 773285 - RNA, 19 nt, Homo sapiens
uuaaacacccugagauaug

SEQ ID NO: 773286 - RNA, 19 nt, Homo sapiens
ggagaaugcauggcaaguu

SEQ ID NO: 773287 - RNA, 19 nt, Homo sapiens
gggcuacuuuggaauguca

SEQ ID NO: 773288 - RNA, 19 nt, Homo sapiens
ggaaaucaugucuugugaa

SEQ ID NO: 773289 - RNA, 19 nt, Homo sapiens
ucacggcucaggagaauga

SEQ ID NO: 773290 - RNA, 19 nt, Homo sapiens
caucacggcucaggagaau

SEQ ID NO: 773291 - RNA, 19 nt, Homo sapiens
ugauguggcugcaauaaac

SEQ ID NO: 773292 - RNA, 19 nt, Homo sapiens
gaugauguggcugcaauaa

SEQ ID NO: 773293 - RNA, 19 nt, Homo sapiens
ucugguaaaugccaaguau

SEQ ID NO: 773294 - RNA, 19 nt, Homo sapiens
guggagagcaguugauuca

SEQ ID NO: 773295 - RNA, 19 nt, Homo sapiens
ucuaggacuugcaugauug

SEQ ID NO: 773296 - RNA, 19 nt, Homo sapiens
cugagggacuccuucauug

SEQ ID NO: 773297 - RNA, 19 nt, Homo sapiens
ggaaugucauccacuuacu

SEQ ID NO: 773298 - RNA, 19 nt, Homo sapiens
gaagaacaagcgagaagag

SEQ ID NO: 773299 - RNA, 19 nt, Homo sapiens
acgcaguaaugguuuaauu

SEQ ID NO: 773300 - RNA, 19 nt, Homo sapiens
gcaggaaaauguaacaauc

SEQ ID NO: 773301 - RNA, 19 nt, Homo sapiens
ccuagaggaucccuacugu

SEQ ID NO: 773302 - RNA, 19 nt, Homo sapiens
gagcacugaaugucuugua

SEQ ID NO: 773303 - RNA, 19 nt, Homo sapiens
aggaaggagcucuuaguua

SEQ ID NO: 773304 - RNA, 19 nt, Homo sapiens
ugauucaaauggaaacaga

SEQ ID NO: 773305 - RNA, 19 nt, Homo sapiens
gcaagcaacaggugcaagu

SEQ ID NO: 773306 - RNA, 19 nt, Homo sapiens
ggacugugaacuuggagaa

SEQ ID NO: 773307 - RNA, 19 nt, Homo sapiens
ugaagagagcucaggagua

SEQ ID NO: 773308 - RNA, 19 nt, Homo sapiens
caacagagcugaauuguga

SEQ ID NO: 773309 - RNA, 19 nt, Homo sapiens
gaagagaaaucaaguagca

SEQ ID NO: 773310 - RNA, 19 nt, Homo sapiens
ggacgaaugugcugaguau

SEQ ID NO: 773311 - RNA, 19 nt, Homo sapiens
gugcagagcugucuuucua

SEQ ID NO: 773312 - RNA, 19 nt, Homo sapiens
gguaauaaguguacuaugu

SEQ ID NO: 773313 - RNA, 19 nt, Homo sapiens
gagcuugucuuauuugcua

SEQ ID NO: 773314 - RNA, 19 nt, Homo sapiens
ccaacugccuguucaauaa

SEQ ID NO: 773315 - RNA, 19 nt, Homo sapiens
ggauacaugugaugaguuu

SEQ ID NO: 773316 - RNA, 19 nt, Homo sapiens
caacaaaugugcccugugu

SEQ ID NO: 773317 - RNA, 19 nt, Homo sapiens
gaagauagccacaguguca

SEQ ID NO: 773318 - RNA, 19 nt, Homo sapiens
gaaugaagaucaggaaaug

SEQ ID NO: 773319 - RNA, 19 nt, Homo sapiens
gaacucaucugcccuagag

SEQ ID NO: 773320 - RNA, 19 nt, Homo sapiens
gcagagaaauggaaagcuu

SEQ ID NO: 773321 - RNA, 19 nt, Homo sapiens
guagcaagcccucaaauaa

SEQ ID NO: 773322 - RNA, 19 nt, Homo sapiens
gaagagggccaggcauuua

SEQ ID NO: 773323 - RNA, 19 nt, Homo sapiens
ggaaaguucuauacaaaca

SEQ ID NO: 773324 - RNA, 19 nt, Homo sapiens
ggagacaugcgaugaauuu

SEQ ID NO: 773325 - RNA, 19 nt, Homo sapiens
gauggaaaguucuauacaa

SEQ ID NO: 773326 - RNA, 19 nt, Homo sapiens
gaaggaaggcgaaucaaga

SEQ ID NO: 773327 - RNA, 19 nt, Homo sapiens
ggaaagagaagcagagaga

SEQ ID NO: 773328 - RNA, 19 nt, Homo sapiens
caaaggaaaucugcaguga

SEQ ID NO: 773329 - RNA, 19 nt, Homo sapiens
caauaaaugugcuaugugu

SEQ ID NO: 773330 - RNA, 19 nt, Homo sapiens
caacaagugugccaugugu

SEQ ID NO: 773331 - RNA, 19 nt, Homo sapiens
ggaagacgcauggcaauaa

SEQ ID NO: 773332 - RNA, 19 nt, Homo sapiens
gaagaaagagcaagagcaa

SEQ ID NO: 773333 - RNA, 19 nt, Homo sapiens
aagagaagcugcaaaggaa

SEQ ID NO: 773334 - RNA, 19 nt, Homo sapiens
gaaaaugcauggcaacuug

SEQ ID NO: 773335 - RNA, 19 nt, Homo sapiens
gaaaacauaugacaacaga

SEQ ID NO: 773336 - RNA, 19 nt, Homo sapiens
gcagugaauuucgaaacua

SEQ ID NO: 773337 - RNA, 19 nt, Homo sapiens
gcaagacacaugguaauaa

SEQ ID NO: 773338 - RNA, 19 nt, Homo sapiens
cuucggagcuugucuuauu

SEQ ID NO: 773339 - RNA, 19 nt, Homo sapiens
ggaucugugucgugaauuu

SEQ ID NO: 773340 - RNA, 19 nt, Homo sapiens
ucgagaagcuaaugaaaga

SEQ ID NO: 773341 - RNA, 19 nt, Homo sapiens
gagcaucuuugaucgagaa

SEQ ID NO: 773342 - RNA, 19 nt, Homo sapiens
gaugaagacaggagcaaua

SEQ ID NO: 773343 - RNA, 19 nt, Homo sapiens
caacuuguguuccaugugu

SEQ ID NO: 773344 - RNA, 19 nt, Homo sapiens
ggaaagaagaggaagauca

SEQ ID NO: 773345 - RNA, 19 nt, Homo sapiens
caaauaaugcaaaggauga

SEQ ID NO: 773346 - RNA, 19 nt, Homo sapiens
gcaaaucguacaacaauca

SEQ ID NO: 773347 - RNA, 19 nt, Homo sapiens
ggaaacaagugugccaugu

SEQ ID NO: 773348 - RNA, 19 nt, Homo sapiens
gaaggcgaaucaagaaaca

SEQ ID NO: 773349 - RNA, 19 nt, Homo sapiens
caaagacuaccgaguauug

SEQ ID NO: 773350 - RNA, 19 nt, Homo sapiens
gugcaaagacuaccgagua

SEQ ID NO: 773351 - RNA, 19 nt, Homo sapiens
gaaagaaaaugaggaaaga

SEQ ID NO: 773352 - RNA, 19 nt, Homo sapiens
guaaggcagucuuccagaa

SEQ ID NO: 773353 - RNA, 19 nt, Homo sapiens
gcagagcuuugcaaugaau

SEQ ID NO: 773354 - RNA, 19 nt, Homo sapiens
gagaaaugcugcaggacau

SEQ ID NO: 773355 - RNA, 19 nt, Homo sapiens
gugaaacucugcagucaau

SEQ ID NO: 773356 - RNA, 19 nt, Homo sapiens
gagcugaauugugaugauu

SEQ ID NO: 773357 - RNA, 19 nt, Homo sapiens
caagacacaugguaauaag

SEQ ID NO: 773358 - RNA, 19 nt, Homo sapiens
aaacaagugugccaugugu

SEQ ID NO: 773359 - RNA, 19 nt, Homo sapiens
caaugaauaucgaaagcuu

SEQ ID NO: 773360 - RNA, 19 nt, Homo sapiens
gaagacgcauggcaauaag

SEQ ID NO: 773361 - RNA, 19 nt, Homo sapiens
gagaagcuaaugaaagaaa

SEQ ID NO: 773362 - RNA, 19 nt, Homo sapiens
gaggaucugugucgugaau

SEQ ID NO: 773363 - RNA, 19 nt, Homo sapiens
gaaagaaagaggaaagaag

SEQ ID NO: 773364 - RNA, 19 nt, Homo sapiens
gaauaucgucauuauguga

SEQ ID NO: 773365 - RNA, 19 nt, Homo sapiens
caauaagugugcaaugugu

SEQ ID NO: 773366 - RNA, 19 nt, Homo sapiens
gaauuucaggcauuuauga

SEQ ID NO: 773367 - RNA, 19 nt, Homo sapiens
ccuagaaucugugaucuga

SEQ ID NO: 773368 - RNA, 19 nt, Homo sapiens
gagcaaaagucaaaagaga

SEQ ID NO: 773369 - RNA, 19 nt, Homo sapiens
gagagaaugauccuauuga

SEQ ID NO: 773370 - RNA, 19 nt, Homo sapiens
gugaauaucgucauuaugu

SEQ ID NO: 773371 - RNA, 19 nt, Homo sapiens
aaggaaaucugcagugaau

SEQ ID NO: 773372 - RNA, 19 nt, Homo sapiens
ggcaaagaauggaauacuu

SEQ ID NO: 773373 - RNA, 19 nt, Homo sapiens
ggccaaaccuacaacaauc

SEQ ID NO: 773374 - RNA, 19 nt, Homo sapiens
caggaaaugugccaugaau

SEQ ID NO: 773375 - RNA, 19 nt, Homo sapiens
gaaacucugcagucaauau

SEQ ID NO: 773376 - RNA, 19 nt, Homo sapiens
acaaacaagugcuacaugu

SEQ ID NO: 773377 - RNA, 19 nt, Homo sapiens
ggagaaaggagcaaugaca

SEQ ID NO: 773378 - RNA, 19 nt, Homo sapiens
gaguuuagaagccaaauga

SEQ ID NO: 773379 - RNA, 19 nt, Homo sapiens
gaguacagcuuccuuugag

SEQ ID NO: 773380 - RNA, 19 nt, Homo sapiens
gaauaucgaaagcuuguga

SEQ ID NO: 773381 - RNA, 19 nt, Homo sapiens
auaaagacauuuccaccaa

SEQ ID NO: 773382 - RNA, 19 nt, Homo sapiens
ccaaacaaauacacacauc

SEQ ID NO: 773383 - RNA, 19 nt, Homo sapiens
aaagaaagaggaaagaaga

SEQ ID NO: 773384 - RNA, 19 nt, Homo sapiens
ggcaacaccugcuccaugu

SEQ ID NO: 773385 - RNA, 19 nt, Homo sapiens
ggcaacaccugcuccaugu

SEQ ID NO: 773386 - RNA, 19 nt, Homo sapiens
ggcaacaccugcuccaugu

SEQ ID NO: 773387 - RNA, 19 nt, Homo sapiens
caggaugcauggcaacaaa

SEQ ID NO: 773388 - RNA, 19 nt, Homo sapiens
gcgagagggugaaacuaga

SEQ ID NO: 773389 - RNA, 19 nt, Homo sapiens
ggcaauaagugugcaaugu

SEQ ID NO: 773390 - RNA, 19 nt, Homo sapiens
gaaacacucaggacgaaug

SEQ ID NO: 773391 - RNA, 19 nt, Homo sapiens
gcagugaauaucgucauua

SEQ ID NO: 773392 - RNA, 19 nt, Homo sapiens
ggaguuguguagugaauac

SEQ ID NO: 773393 - RNA, 19 nt, Homo sapiens
gcacagaugggaaaacaua

SEQ ID NO: 773394 - RNA, 19 nt, Homo sapiens
gcaaaaugauacuggaaaa

SEQ ID NO: 773395 - RNA, 19 nt, Homo sapiens
ggaaagggaagcagcugaa

SEQ ID NO: 773396 - RNA, 19 nt, Homo sapiens
ggaaagaaagaggaaagaa

SEQ ID NO: 773397 - RNA, 19 nt, Homo sapiens
cagagagaaugauccuauu

SEQ ID NO: 773398 - RNA, 19 nt, Homo sapiens
acaggaagauuguugaaag

SEQ ID NO: 773399 - RNA, 19 nt, Homo sapiens
gaaaggagcaaugacaaag

SEQ ID NO: 773400 - RNA, 19 nt, Homo sapiens
gaaagaagaggaagaucag

SEQ ID NO: 773401 - RNA, 19 nt, Homo sapiens
gccaguguguucaaacuug

SEQ ID NO: 773402 - RNA, 19 nt, Homo sapiens
gaauggaacacuuauaugc

SEQ ID NO: 773403 - RNA, 19 nt, Homo sapiens
gcaauaagugugcaaugug

SEQ ID NO: 773404 - RNA, 19 nt, Homo sapiens
aaacauaugacaacagaug

SEQ ID NO: 773405 - RNA, 19 nt, Homo sapiens
gaugaagagaaaucaagua

SEQ ID NO: 773406 - RNA, 19 nt, Homo sapiens
cgacuugcaucgucuucaa

SEQ ID NO: 773407 - RNA, 19 nt, Homo sapiens
ugacaaagaggaucugugu

SEQ ID NO: 773408 - RNA, 19 nt, Homo sapiens
gaagaucucucacagaaau

SEQ ID NO: 773409 - RNA, 19 nt, Homo sapiens
uaagcuaccuucccauuua

SEQ ID NO: 773410 - RNA, 19 nt, Homo sapiens
gaggaucaauucaccauaa

SEQ ID NO: 773411 - RNA, 19 nt, Homo sapiens
guauacagcuugcaacuau

SEQ ID NO: 773412 - RNA, 19 nt, Homo sapiens
ggaacaaguugauaccaaa

SEQ ID NO: 773413 - RNA, 19 nt, Homo sapiens
ggacugcccucucuuguuc

SEQ ID NO: 773414 - RNA, 19 nt, Homo sapiens
uagaagaucucucacagaa

SEQ ID NO: 773415 - RNA, 19 nt, Homo sapiens
ggauaaggguucaauuuca

SEQ ID NO: 773416 - RNA, 19 nt, Homo sapiens
ugagauagaugaaauacga

SEQ ID NO: 773417 - RNA, 19 nt, Homo sapiens
cacaaugaguuaacugaua

SEQ ID NO: 773418 - RNA, 19 nt, Homo sapiens
agaaaugccuguucagcua

SEQ ID NO: 773419 - RNA, 19 nt, Homo sapiens
uagcagaccucucaauuca

SEQ ID NO: 773420 - RNA, 19 nt, Homo sapiens
gggaauuccuggacacaaa

SEQ ID NO: 773421 - RNA, 19 nt, Homo sapiens
gugaaacacuccagaccua

SEQ ID NO: 773422 - RNA, 19 nt, Homo sapiens
gagacaggcugauuuccaa

SEQ ID NO: 773423 - RNA, 19 nt, Homo sapiens
gcagaccucucaauucaca

SEQ ID NO: 773424 - RNA, 19 nt, Homo sapiens
gggauuccauagugugaua

SEQ ID NO: 773425 - RNA, 19 nt, Homo sapiens
gaaacuuuguugaggauca

SEQ ID NO: 773426 - RNA, 19 nt, Homo sapiens
gacaggagccuacaguaaa

SEQ ID NO: 773427 - RNA, 19 nt, Homo sapiens
cccauuaccuaguuauuaa

SEQ ID NO: 773428 - RNA, 19 nt, Homo sapiens
aaacagaagucagacaaug

SEQ ID NO: 773429 - RNA, 19 nt, Homo sapiens
uaaaguagcagaccucuca

SEQ ID NO: 773430 - RNA, 19 nt, Homo sapiens
ggagauaccgcuguuacua

SEQ ID NO: 773431 - RNA, 19 nt, Homo sapiens
gauaaggguucaauuucau

SEQ ID NO: 773432 - RNA, 19 nt, Homo sapiens
ccauuuguaugucuucuuu

SEQ ID NO: 773433 - RNA, 19 nt, Homo sapiens
gcagggagauaccgcuguu

SEQ ID NO: 773434 - RNA, 19 nt, Homo sapiens
cacacaaacuugcauaaau

SEQ ID NO: 773435 - RNA, 19 nt, Homo sapiens
gggaguaccgucuggauaa

SEQ ID NO: 773436 - RNA, 19 nt, Homo sapiens
aaaggaaacuacagaaugg

SEQ ID NO: 773437 - RNA, 19 nt, Homo sapiens
cagcaugcauuagcucuuu

SEQ ID NO: 773438 - RNA, 19 nt, Homo sapiens
gcaggcauccauuuccaua

SEQ ID NO: 773439 - RNA, 19 nt, Homo sapiens
cacuauaccuguuucuauu

SEQ ID NO: 773440 - RNA, 19 nt, Homo sapiens
ucauauagcugcugaccau

SEQ ID NO: 773441 - RNA, 19 nt, Homo sapiens
ggaguaccgucuggauaaa

SEQ ID NO: 773442 - RNA, 19 nt, Homo sapiens
cuaggaccauuuauucaaa

SEQ ID NO: 773443 - RNA, 19 nt, Homo sapiens
gaagucagacaauguuuua

SEQ ID NO: 773444 - RNA, 19 nt, Homo sapiens
ggagcccaauggacacuuu

SEQ ID NO: 773445 - RNA, 19 nt, Homo sapiens
ugacaggagccuacaguaa

SEQ ID NO: 773446 - RNA, 19 nt, Homo sapiens
gcccauguuucaaguaguu

SEQ ID NO: 773447 - RNA, 19 nt, Homo sapiens
ggaaagucauagaagaucu

SEQ ID NO: 773448 - RNA, 19 nt, Homo sapiens
uuacagaggugaaagaaaa

SEQ ID NO: 773449 - RNA, 19 nt, Homo sapiens
gaaaacgaccuuggaauuu

SEQ ID NO: 773450 - RNA, 19 nt, Homo sapiens
gcuguagcuuuguaggaua

SEQ ID NO: 773451 - RNA, 19 nt, Homo sapiens
cagcuuacccucaaacaga

SEQ ID NO: 773452 - RNA, 19 nt, Homo sapiens
ggaccaacgucuugaagcu

SEQ ID NO: 773453 - RNA, 19 nt, Homo sapiens
gaaacuacagaaugggaaa

SEQ ID NO: 773454 - RNA, 19 nt, Homo sapiens
gaagcugccuccaguagac

SEQ ID NO: 773455 - RNA, 19 nt, Homo sapiens
ggaaaacgaccuuggaauu

SEQ ID NO: 773456 - RNA, 19 nt, Homo sapiens
ccaguuccaugaugucuuc

SEQ ID NO: 773457 - RNA, 19 nt, Homo sapiens
guaaaugccacuucagcaa

SEQ ID NO: 773458 - RNA, 19 nt, Homo sapiens
gcagagcccacacgaugaa

SEQ ID NO: 773459 - RNA, 19 nt, Homo sapiens
gagauaccgcuguuacuau

SEQ ID NO: 773460 - RNA, 19 nt, Homo sapiens
gggauaaggguucaauuuc

SEQ ID NO: 773461 - RNA, 19 nt, Homo sapiens
uauagcugcugaccauuug

SEQ ID NO: 773462 - RNA, 19 nt, Homo sapiens
gaaugggaaagucauagaa

SEQ ID NO: 773463 - RNA, 19 nt, Homo sapiens
ugaguugucucuucauucu

SEQ ID NO: 773464 - RNA, 19 nt, Homo sapiens
gcaaggauagcuuaauuuu

SEQ ID NO: 773465 - RNA, 19 nt, Homo sapiens
ccaagaacaaggccagauu

SEQ ID NO: 773466 - RNA, 19 nt, Homo sapiens
agacucaguucuccuagga

SEQ ID NO: 773467 - RNA, 19 nt, Homo sapiens
ugcagaagcuguuuagaag

SEQ ID NO: 773468 - RNA, 19 nt, Homo sapiens
gcauauuaacccuuuauca

SEQ ID NO: 773469 - RNA, 19 nt, Homo sapiens
ggaacucugugaccaucug

SEQ ID NO: 773470 - RNA, 19 nt, Homo sapiens
gagcaggcauccauuucca

SEQ ID NO: 773471 - RNA, 19 nt, Homo sapiens
guaagauucaugucucuau

SEQ ID NO: 773472 - RNA, 19 nt, Homo sapiens
acacagaccacuagaagau

SEQ ID NO: 773473 - RNA, 19 nt, Homo sapiens
ggacauuggcccagagaca

SEQ ID NO: 773474 - RNA, 19 nt, Homo sapiens
cauguguucucauuguuau

SEQ ID NO: 773475 - RNA, 19 nt, Homo sapiens
uguagucccauucaaauuu

SEQ ID NO: 773476 - RNA, 19 nt, Homo sapiens
cuuaugcacucaugaaaca

SEQ ID NO: 773477 - RNA, 19 nt, Homo sapiens
uuacacaucaaaccaauga

SEQ ID NO: 773478 - RNA, 19 nt, Homo sapiens
uugcagaccaugaacauaa

SEQ ID NO: 773479 - RNA, 19 nt, Homo sapiens
cagcuuuguuacauaggua

SEQ ID NO: 773480 - RNA, 19 nt, Homo sapiens
gcauugagucugcagguau

SEQ ID NO: 773481 - RNA, 19 nt, Homo sapiens
ucacuauaccuguuucuau

SEQ ID NO: 773482 - RNA, 19 nt, Homo sapiens
uauguguguuuccuucuuu

SEQ ID NO: 773483 - RNA, 19 nt, Homo sapiens
cagcugagccgagugugua

SEQ ID NO: 773484 - RNA, 19 nt, Homo sapiens
aaagaaaacugucagcaau

SEQ ID NO: 773485 - RNA, 19 nt, Homo sapiens
aaugggagcuucuaaugag

SEQ ID NO: 773486 - RNA, 19 nt, Homo sapiens
gagaaggcacugggaggua

SEQ ID NO: 773487 - RNA, 19 nt, Homo sapiens
acacuuuccuucugaucaa

SEQ ID NO: 773488 - RNA, 19 nt, Homo sapiens
ccauguguucucauuguua

SEQ ID NO: 773489 - RNA, 19 nt, Homo sapiens
ucaacccauuaccuaguua

SEQ ID NO: 773490 - RNA, 19 nt, Homo sapiens
ccacaccuuuugucuauuu

SEQ ID NO: 773491 - RNA, 19 nt, Homo sapiens
caagguuuguuggugguuu

SEQ ID NO: 773492 - RNA, 19 nt, Homo sapiens
gaaagaaaacugucagcaa

SEQ ID NO: 773493 - RNA, 19 nt, Homo sapiens
aaagagcaggcauccauuu

SEQ ID NO: 773494 - RNA, 19 nt, Homo sapiens
guagcagaccucucaauuc

SEQ ID NO: 773495 - RNA, 19 nt, Homo sapiens
cacaagccauggagacuca

SEQ ID NO: 773496 - RNA, 19 nt, Homo sapiens
gcacugggagguacugauc

SEQ ID NO: 773497 - RNA, 19 nt, Homo sapiens
guccauguguucucauugu

SEQ ID NO: 773498 - RNA, 19 nt, Homo sapiens
guuaggaauugcauugagu

SEQ ID NO: 773499 - RNA, 19 nt, Homo sapiens
cugcacagcuuacccucaa

SEQ ID NO: 773500 - RNA, 19 nt, Homo sapiens
ugggauaaggguucaauuu

SEQ ID NO: 773501 - RNA, 19 nt, Homo sapiens
gcauaaauuuucccugaga

SEQ ID NO: 773502 - RNA, 19 nt, Homo sapiens
gacccuacacacagcuuua

SEQ ID NO: 773503 - RNA, 19 nt, Homo sapiens
cauaagcuaccuucccauu

SEQ ID NO: 773504 - RNA, 19 nt, Homo sapiens
caaaaggacugcccucucu

SEQ ID NO: 773505 - RNA, 19 nt, Homo sapiens
gcaacuauuuucucccauu

SEQ ID NO: 773506 - RNA, 19 nt, Homo sapiens
ggaagcugccuccaguaga

SEQ ID NO: 773507 - RNA, 19 nt, Homo sapiens
ccuaucaacccauuaccua

SEQ ID NO: 773508 - RNA, 19 nt, Homo sapiens
gggagaaccuagcgcuuaa

SEQ ID NO: 773509 - RNA, 19 nt, Homo sapiens
uaagaaauccugacaccaa

SEQ ID NO: 773510 - RNA, 19 nt, Homo sapiens
gaaauccugacaccaagaa

SEQ ID NO: 773511 - RNA, 19 nt, Homo sapiens
ggacuaagaaauccugaca

SEQ ID NO: 773512 - RNA, 19 nt, Homo sapiens
ccgcuggcauggacuaaga

SEQ ID NO: 773513 - RNA, 19 nt, Homo sapiens
cgggagaaccuagcgcuua

SEQ ID NO: 773514 - RNA, 19 nt, Homo sapiens
uggcauggacuaagaaauc

SEQ ID NO: 773515 - RNA, 19 nt, Homo sapiens
gggcaguccggaucaguug

SEQ ID NO: 773516 - RNA, 19 nt, Homo sapiens
gcuaggcaaggaagagcua

SEQ ID NO: 773517 - RNA, 19 nt, Homo sapiens
gcagauaguuacaaaguug

SEQ ID NO: 773518 - RNA, 19 nt, Homo sapiens
cagauacacuucucucuuu

SEQ ID NO: 773519 - RNA, 19 nt, Homo sapiens
acaauuagguguacuucua

SEQ ID NO: 773520 - RNA, 19 nt, Homo sapiens
gagaccaagugaaacguua

SEQ ID NO: 773521 - RNA, 19 nt, Homo sapiens
gcucaaguacccuaauuua

SEQ ID NO: 773522 - RNA, 19 nt, Homo sapiens
acaauagccuggaugguuu

SEQ ID NO: 773523 - RNA, 19 nt, Homo sapiens
gcaaucacacucucagaaa

SEQ ID NO: 773524 - RNA, 19 nt, Homo sapiens
ggccagcaauugccaguuu

SEQ ID NO: 773525 - RNA, 19 nt, Homo sapiens
ccaauaaugacaaguguuu

SEQ ID NO: 773526 - RNA, 19 nt, Homo sapiens
ucacacacagcaaauauuu

SEQ ID NO: 773527 - RNA, 19 nt, Homo sapiens
aaacugguaugacgaaauc

SEQ ID NO: 773528 - RNA, 19 nt, Homo sapiens
uagccuggaugguuucuuu

SEQ ID NO: 773529 - RNA, 19 nt, Homo sapiens
aaacguuacuacucuguug

SEQ ID NO: 773530 - RNA, 19 nt, Homo sapiens
ggagggaauuacccaacuu

SEQ ID NO: 773531 - RNA, 19 nt, Homo sapiens
gauaugcuauacaugacuu

SEQ ID NO: 773532 - RNA, 19 nt, Homo sapiens
ccagugauaugcuauacau

SEQ ID NO: 773533 - RNA, 19 nt, Homo sapiens
ugucacacuugcuacaaua

SEQ ID NO: 773534 - RNA, 19 nt, Homo sapiens
ccacuacacucagguuguu

SEQ ID NO: 773535 - RNA, 19 nt, Homo sapiens
ccaauaacaauuaggugua

SEQ ID NO: 773536 - RNA, 19 nt, Homo sapiens
aaaccaaccucauucacau

SEQ ID NO: 773537 - RNA, 19 nt, Homo sapiens
cagcucaaguacccuaauu

SEQ ID NO: 773538 - RNA, 19 nt, Homo sapiens
caacuuggccauauaagag

SEQ ID NO: 773539 - RNA, 19 nt, Homo sapiens
ucacuucacugggagagaa

SEQ ID NO: 773540 - RNA, 19 nt, Homo sapiens
gcacuagcccaaauugcaa

SEQ ID NO: 773541 - RNA, 19 nt, Homo sapiens
aaaguuggcugcgcaguuc

SEQ ID NO: 773542 - RNA, 19 nt, Homo sapiens
caaccucauucacauaugg

SEQ ID NO: 773543 - RNA, 19 nt, Homo sapiens
ccacguaacagauacacuu

SEQ ID NO: 773544 - RNA, 19 nt, Homo sapiens
ugacaaguguuuggacaau

SEQ ID NO: 773545 - RNA, 19 nt, Homo sapiens
cuaauacaauucaggaaag

SEQ ID NO: 773546 - RNA, 19 nt, Homo sapiens
aaaccaacagccagugaua

SEQ ID NO: 773547 - RNA, 19 nt, Homo sapiens
ggcagauaguuacaaaguu

SEQ ID NO: 773548 - RNA, 19 nt, Homo sapiens
gggcagauaguuacaaagu

SEQ ID NO: 773549 - RNA, 19 nt, Homo sapiens
cccacaagcugcacccaaa

SEQ ID NO: 773550 - RNA, 19 nt, Homo sapiens
uggcugcgcaguucaauuu

SEQ ID NO: 773551 - RNA, 19 nt, Homo sapiens
uggacaaucucuguguuaa

SEQ ID NO: 773552 - RNA, 19 nt, Homo sapiens
gcugaagucggcuagguuu

SEQ ID NO: 773553 - RNA, 19 nt, Homo sapiens
caucaaagacugcguucga

SEQ ID NO: 773554 - RNA, 19 nt, Homo sapiens
gaagauuucaucaaagacu

SEQ ID NO: 773555 - RNA, 19 nt, Homo sapiens
caauaacaauuagguguac

SEQ ID NO: 773556 - RNA, 19 nt, Homo sapiens
caaaguuggcugcgcaguu

SEQ ID NO: 773557 - RNA, 19 nt, Homo sapiens
gaagucggcuagguuugca

SEQ ID NO: 773558 - RNA, 19 nt, Homo sapiens
cgacagcgagaccaaguga

SEQ ID NO: 773559 - RNA, 19 nt, Homo sapiens
ccaggacuaugacuucaag

SEQ ID NO: 773560 - RNA, 19 nt, Homo sapiens
caaagacugcguucgaauc

SEQ ID NO: 773561 - RNA, 19 nt, Homo sapiens
gcccauauauccacguaac

SEQ ID NO: 773562 - RNA, 19 nt, Homo sapiens
gaaacguuacuacucuguu

SEQ ID NO: 773563 - RNA, 19 nt, Homo sapiens
uacaauagccuggaugguu

SEQ ID NO: 773564 - RNA, 19 nt, Homo sapiens
acacuucucucuuucucau

SEQ ID NO: 773565 - RNA, 19 nt, Homo sapiens
ggcaaucacacucucagaa

SEQ ID NO: 773566 - RNA, 19 nt, Homo sapiens
gaaaccaacagccagugau

SEQ ID NO: 773567 - RNA, 19 nt, Homo sapiens
ucgaauccauaacaaguuc

SEQ ID NO: 773568 - RNA, 19 nt, Homo sapiens
acaaguguuuggacaaucu

SEQ ID NO: 773569 - RNA, 19 nt, Homo sapiens
gcacccaaacuucacuuca

SEQ ID NO: 773570 - RNA, 19 nt, Homo sapiens
guuacuacucuguuguaua

SEQ ID NO: 773571 - RNA, 19 nt, Homo sapiens
gacaaucucuguguuaacc

SEQ ID NO: 773572 - RNA, 19 nt, Homo sapiens
gagggaauuacccaacuug

SEQ ID NO: 773573 - RNA, 19 nt, Homo sapiens
gagcacauuuuauaugcaa

SEQ ID NO: 773574 - RNA, 19 nt, Homo sapiens
ggacuaugacuucaagacu

SEQ ID NO: 773575 - RNA, 19 nt, Homo sapiens
caaucacacucucagaaac

SEQ ID NO: 773576 - RNA, 19 nt, Homo sapiens
agugauaugcuauacauga

SEQ ID NO: 773577 - RNA, 19 nt, Homo sapiens
cauaacaaguuccgaucag

SEQ ID NO: 773578 - RNA, 19 nt, Homo sapiens
acagcgagaccaagugaaa

SEQ ID NO: 773579 - RNA, 19 nt, Homo sapiens
cagguuguuugggcagaua

SEQ ID NO: 773580 - RNA, 19 nt, Homo sapiens
caauuagguguacuucuau

SEQ ID NO: 773581 - RNA, 19 nt, Homo sapiens
ucaagacucggauaugcaa

SEQ ID NO: 773582 - RNA, 19 nt, Homo sapiens
guucgaauccauaacaagu

SEQ ID NO: 773583 - RNA, 19 nt, Homo sapiens
agugaaacguuacuacucu

SEQ ID NO: 773584 - RNA, 19 nt, Homo sapiens
gacaaguguuuggacaauc

SEQ ID NO: 773585 - RNA, 19 nt, Homo sapiens
gcacucaggcaaucacacu

SEQ ID NO: 773586 - RNA, 19 nt, Homo sapiens
ugccagauaucgaaaauga

SEQ ID NO: 773587 - RNA, 19 nt, Homo sapiens
caaacugguaugacgaaau

SEQ ID NO: 773588 - RNA, 19 nt, Homo sapiens
gcguucgaauccauaacaa

SEQ ID NO: 773589 - RNA, 19 nt, Homo sapiens
cguaacagauacacuucuc

SEQ ID NO: 773590 - RNA, 19 nt, Homo sapiens
caagugaaacguuacuacu

SEQ ID NO: 773591 - RNA, 19 nt, Homo sapiens
caauuuugcccuaaaguuu

SEQ ID NO: 773592 - RNA, 19 nt, Homo sapiens
aagcaugggccagcaauug

SEQ ID NO: 773593 - RNA, 19 nt, Homo sapiens
ccaaccucauucacauaug

SEQ ID NO: 773594 - RNA, 19 nt, Homo sapiens
agacugcguucgaauccau

SEQ ID NO: 773595 - RNA, 19 nt, Homo sapiens
acagauacacuucucucuu

SEQ ID NO: 773596 - RNA, 19 nt, Homo sapiens
ugacuucaagacucggaua

SEQ ID NO: 773597 - RNA, 19 nt, Homo sapiens
ugaaaccaacagccaguga

SEQ ID NO: 773598 - RNA, 19 nt, Homo sapiens
auaacaaguuccgaucaga

SEQ ID NO: 773599 - RNA, 19 nt, Homo sapiens
ucaaagacugcguucgaau

SEQ ID NO: 773600 - RNA, 19 nt, Homo sapiens
cauauauccacguaacaga

SEQ ID NO: 773601 - RNA, 19 nt, Homo sapiens
ggacaaucucuguguuaac

SEQ ID NO: 773602 - RNA, 19 nt, Homo sapiens
uugggcagauaguuacaaa

SEQ ID NO: 773603 - RNA, 19 nt, Homo sapiens
caagcugcacccaaacuuc

SEQ ID NO: 773604 - RNA, 19 nt, Homo sapiens
agauacacuucucucuuuc

SEQ ID NO: 773605 - RNA, 19 nt, Homo sapiens
ugacgaaauccaggacuau

SEQ ID NO: 773606 - RNA, 19 nt, Homo sapiens
uggcccauauauccacgua

SEQ ID NO: 773607 - RNA, 19 nt, Homo sapiens
uuggacaaucucuguguua

SEQ ID NO: 773608 - RNA, 19 nt, Homo sapiens
cuacggaccaggagggaau

SEQ ID NO: 773609 - RNA, 19 nt, Homo sapiens
cuuugacgcucuuuccaau

SEQ ID NO: 773610 - RNA, 19 nt, Homo sapiens
cuucaagacucggauaugc

SEQ ID NO: 773611 - RNA, 19 nt, Homo sapiens
gacgaaauccaggacuaug

SEQ ID NO: 773612 - RNA, 19 nt, Homo sapiens
gugauaugcuauacaugac

SEQ ID NO: 773613 - RNA, 19 nt, Homo sapiens
uaacaauuagguguacuuc

SEQ ID NO: 773614 - RNA, 19 nt, Homo sapiens
acuucucucuuucucauug

SEQ ID NO: 773615 - RNA, 19 nt, Homo sapiens
ccaagugaaacguuacuac

SEQ ID NO: 773616 - RNA, 19 nt, Homo sapiens
uaaccgacagcgagaccaa

SEQ ID NO: 773617 - RNA, 19 nt, Homo sapiens
gaaaugaucuggacuucua

SEQ ID NO: 773618 - RNA, 19 nt, Homo sapiens
gcaagaaacuccuuauaga

SEQ ID NO: 773619 - RNA, 19 nt, Homo sapiens
caccaaagaucucaaauaa

SEQ ID NO: 773620 - RNA, 19 nt, Homo sapiens
ccaaagaucucaaauaaag

SEQ ID NO: 773621 - RNA, 19 nt, Homo sapiens
gaaauacaaggaacgauua

SEQ ID NO: 773622 - RNA, 19 nt, Homo sapiens
gaucaucccagaauaguua

SEQ ID NO: 773623 - RNA, 19 nt, Homo sapiens
gaagaaggagggaagaaua

SEQ ID NO: 773624 - RNA, 19 nt, Homo sapiens
cagcaucgauucucauuga

SEQ ID NO: 773625 - RNA, 19 nt, Homo sapiens
gaacauagcgaauccgaau

SEQ ID NO: 773626 - RNA, 19 nt, Homo sapiens
gaaagucagucucuacaag

SEQ ID NO: 773627 - RNA, 19 nt, Homo sapiens
ggacagaugguuaugcuuu

SEQ ID NO: 773628 - RNA, 19 nt, Homo sapiens
ggaaagaaccaccaaagau

SEQ ID NO: 773629 - RNA, 19 nt, Homo sapiens
uaaagugaaacccguauua

SEQ ID NO: 773630 - RNA, 19 nt, Homo sapiens
cagcagaaaugauggaaga

SEQ ID NO: 773631 - RNA, 19 nt, Homo sapiens
gaaagaaccaccaaagauc

SEQ ID NO: 773632 - RNA, 19 nt, Homo sapiens
gggaagaauagaugauuua

SEQ ID NO: 773633 - RNA, 19 nt, Homo sapiens
cagaaaugauggaagaauu

SEQ ID NO: 773634 - RNA, 19 nt, Homo sapiens
ugaagaauguggacuugaa

SEQ ID NO: 773635 - RNA, 19 nt, Homo sapiens
gcauggagcuaacaucaca

SEQ ID NO: 773636 - RNA, 19 nt, Homo sapiens
gggaagagauagaaagaca

SEQ ID NO: 773637 - RNA, 19 nt, Homo sapiens
caacaggaaaggauaaauu

SEQ ID NO: 773638 - RNA, 19 nt, Homo sapiens
gcagauugaugaacagcaa

SEQ ID NO: 773639 - RNA, 19 nt, Homo sapiens
ggacaaagaaugagguuag

SEQ ID NO: 773640 - RNA, 19 nt, Homo sapiens
gaugauagcuacaauucag

SEQ ID NO: 773641 - RNA, 19 nt, Homo sapiens
gagcaagaaacuccuuaua

SEQ ID NO: 773642 - RNA, 19 nt, Homo sapiens
ccaauaacaguucuucuaa

SEQ ID NO: 773643 - RNA, 19 nt, Homo sapiens
gaagauggcguguagagau

SEQ ID NO: 773644 - RNA, 19 nt, Homo sapiens
caagaaacuccuuauagaa

SEQ ID NO: 773645 - RNA, 19 nt, Homo sapiens
gaaaggauaaauucacaga

SEQ ID NO: 773646 - RNA, 19 nt, Homo sapiens
caagacauccuacaagaga

SEQ ID NO: 773647 - RNA, 19 nt, Homo sapiens
gaauggaucugaugaaacc

SEQ ID NO: 773648 - RNA, 19 nt, Homo sapiens
agaauaccaugaacaagaa

SEQ ID NO: 773649 - RNA, 19 nt, Homo sapiens
ccaaucagaugcagcuuuc

SEQ ID NO: 773650 - RNA, 19 nt, Homo sapiens
aauaaaaccucccaucaua

SEQ ID NO: 773651 - RNA, 19 nt, Homo sapiens
gaugaagaauguggacuug

SEQ ID NO: 773652 - RNA, 19 nt, Homo sapiens
ccaccaaagaucucaaaua

SEQ ID NO: 773653 - RNA, 19 nt, Homo sapiens
ccugaaacagcacaaauua

SEQ ID NO: 773654 - RNA, 19 nt, Homo sapiens
gagauaagagcaugcaaga

SEQ ID NO: 773655 - RNA, 19 nt, Homo sapiens
gaaacagcacaaauuaaug

SEQ ID NO: 773656 - RNA, 19 nt, Homo sapiens
guucaucuguccaugcaaa

SEQ ID NO: 773657 - RNA, 19 nt, Homo sapiens
uagguaacaucuccugaaa

SEQ ID NO: 773658 - RNA, 19 nt, Homo sapiens
caaaccagguaauauucuu

SEQ ID NO: 773659 - RNA, 19 nt, Homo sapiens
ccagaauaguuaagcugua

SEQ ID NO: 773660 - RNA, 19 nt, Homo sapiens
cagaauaccaugaacaaga

SEQ ID NO: 773661 - RNA, 19 nt, Homo sapiens
gaagaauguggacuugaaa

SEQ ID NO: 773662 - RNA, 19 nt, Homo sapiens
gcagcggguuuggaacaua

SEQ ID NO: 773663 - RNA, 19 nt, Homo sapiens
gaagcaaaggcguuuauuc

SEQ ID NO: 773664 - RNA, 19 nt, Homo sapiens
aagauggcguguagagaua

SEQ ID NO: 773665 - RNA, 19 nt, Homo sapiens
aagaaaagcugaaccauau

SEQ ID NO: 773666 - RNA, 19 nt, Homo sapiens
gcaaguacgaggcaauguu

SEQ ID NO: 773667 - RNA, 19 nt, Homo sapiens
gagcaugacagcaucgauu

SEQ ID NO: 773668 - RNA, 19 nt, Homo sapiens
gaauaguuaagcuguauga

SEQ ID NO: 773669 - RNA, 19 nt, Homo sapiens
cagaauaguuaagcuguau

SEQ ID NO: 773670 - RNA, 19 nt, Homo sapiens
cuacauaucagggaacuaa

SEQ ID NO: 773671 - RNA, 19 nt, Homo sapiens
caauggagcugaaaaugaa

SEQ ID NO: 773672 - RNA, 19 nt, Homo sapiens
gacaaagaaugagguuaga

SEQ ID NO: 773673 - RNA, 19 nt, Homo sapiens
ccgaauggaucugaugaaa

SEQ ID NO: 773674 - RNA, 19 nt, Homo sapiens
aaagauacguagcugugaa

SEQ ID NO: 773675 - RNA, 19 nt, Homo sapiens
caaggcauuugaucuaaca

SEQ ID NO: 773676 - RNA, 19 nt, Homo sapiens
gcaauugcuucccucaucu

SEQ ID NO: 773677 - RNA, 19 nt, Homo sapiens
gaaagagggaccgcauuga

SEQ ID NO: 773678 - RNA, 19 nt, Homo sapiens
acaaggugcugguacuuau

SEQ ID NO: 773679 - RNA, 19 nt, Homo sapiens
ccucaaaccagguaauauu

SEQ ID NO: 773680 - RNA, 19 nt, Homo sapiens
uuacaaggcauuugaucua

SEQ ID NO: 773681 - RNA, 19 nt, Homo sapiens
gaucauccaacgcuaaaug

SEQ ID NO: 773682 - RNA, 19 nt, Homo sapiens
gauagaaagacaacggaaa

SEQ ID NO: 773683 - RNA, 19 nt, Homo sapiens
gauuugagacggcagauug

SEQ ID NO: 773684 - RNA, 19 nt, Homo sapiens
gggaaagaaccaccaaaga

SEQ ID NO: 773685 - RNA, 19 nt, Homo sapiens
acaaauuaaugucggagaa

SEQ ID NO: 773686 - RNA, 19 nt, Homo sapiens
aagagaagauggcguguag

SEQ ID NO: 773687 - RNA, 19 nt, Homo sapiens
gguugucccuuuuaauuua

SEQ ID NO: 773688 - RNA, 19 nt, Homo sapiens
gauugugaaugcuuuaaag

SEQ ID NO: 773689 - RNA, 19 nt, Homo sapiens
gauacugacucguuuugua

SEQ ID NO: 773690 - RNA, 19 nt, Homo sapiens
caagaccaauggagcugaa

SEQ ID NO: 773691 - RNA, 19 nt, Homo sapiens
aguccagugucuauauuua

SEQ ID NO: 773692 - RNA, 19 nt, Homo sapiens
cgaaagagggaccgcauug

SEQ ID NO: 773693 - RNA, 19 nt, Homo sapiens
ucuuaaagcuacugaagug

SEQ ID NO: 773694 - RNA, 19 nt, Homo sapiens
caaggaacgauuaaauaga

SEQ ID NO: 773695 - RNA, 19 nt, Homo sapiens
uacaaggcauuugaucuaa

SEQ ID NO: 773696 - RNA, 19 nt, Homo sapiens
aaauagaugugugacaaug

SEQ ID NO: 773697 - RNA, 19 nt, Homo sapiens
gaaacuagccaagggaaag

SEQ ID NO: 773698 - RNA, 19 nt, Homo sapiens
cacacaaaguggacaaaug

SEQ ID NO: 773699 - RNA, 19 nt, Homo sapiens
gaaauaaaaccucccauca

SEQ ID NO: 773700 - RNA, 19 nt, Homo sapiens
gcagauugugaaugcuuua

SEQ ID NO: 773701 - RNA, 19 nt, Homo sapiens
uagaaaggguuagaaaucu

SEQ ID NO: 773702 - RNA, 19 nt, Homo sapiens
gagagacuagaaaggguua

SEQ ID NO: 773703 - RNA, 19 nt, Homo sapiens
aaacucagauuaggucauc

SEQ ID NO: 773704 - RNA, 19 nt, Homo sapiens
gagggaagagauagaaaga

SEQ ID NO: 773705 - RNA, 19 nt, Homo sapiens
gcugaaccauaugaaacua

SEQ ID NO: 773706 - RNA, 19 nt, Homo sapiens
cauguacugugaacuugaa

SEQ ID NO: 773707 - RNA, 19 nt, Homo sapiens
gagcugcuauugcaucaac

SEQ ID NO: 773708 - RNA, 19 nt, Homo sapiens
gggaaaugaucuggacuuc

SEQ ID NO: 773709 - RNA, 19 nt, Homo sapiens
gacggcagauugaugaaca

SEQ ID NO: 773710 - RNA, 19 nt, Homo sapiens
aguagagacucccgagaaa

SEQ ID NO: 773711 - RNA, 19 nt, Homo sapiens
caagcaacaggaaaggaua

SEQ ID NO: 773712 - RNA, 19 nt, Homo sapiens
caaagaaugagguuagaag

SEQ ID NO: 773713 - RNA, 19 nt, Homo sapiens
ggucuccuguuugcaauug

SEQ ID NO: 773714 - RNA, 19 nt, Homo sapiens
ggaugaugauagcuacaau

SEQ ID NO: 773715 - RNA, 19 nt, Homo sapiens
cuagaaaggguuagaaauc

SEQ ID NO: 773716 - RNA, 19 nt, Homo sapiens
gaacaguggacagaugguu

SEQ ID NO: 773717 - RNA, 19 nt, Homo sapiens
gagaugcugucacuuaaua

SEQ ID NO: 773718 - RNA, 19 nt, Homo sapiens
gcaaauauguggacuggau

SEQ ID NO: 773719 - RNA, 19 nt, Homo sapiens
caaauucugccuugaaaua

SEQ ID NO: 773720 - RNA, 19 nt, Homo sapiens
gagcucagccuacgucuuu

SEQ ID NO: 773721 - RNA, 19 nt, Homo sapiens
acacgaaagucugcaaaua

SEQ ID NO: 773722 - RNA, 19 nt, Homo sapiens
caacaaagaccaccgcaau

SEQ ID NO: 773723 - RNA, 19 nt, Homo sapiens
caggagaugcugucacuua

SEQ ID NO: 773724 - RNA, 19 nt, Homo sapiens
ggagagaccaggaucauca

SEQ ID NO: 773725 - RNA, 19 nt, Homo sapiens
ggccauauaucaagguuuc

SEQ ID NO: 773726 - RNA, 19 nt, Homo sapiens
agugagaccuggauucaaa

SEQ ID NO: 773727 - RNA, 19 nt, Homo sapiens
ccaagacccucuacgaaca

SEQ ID NO: 773728 - RNA, 19 nt, Homo sapiens
ccuguucacucuguuaaua

SEQ ID NO: 773729 - RNA, 19 nt, Homo sapiens
gacagcuccuggccauaua

SEQ ID NO: 773730 - RNA, 19 nt, Homo sapiens
ggaaugacaacaccugguu

SEQ ID NO: 773731 - RNA, 19 nt, Homo sapiens
agacgaugaagaacaauua

SEQ ID NO: 773732 - RNA, 19 nt, Homo sapiens
caugaggauucugcaguua

SEQ ID NO: 773733 - RNA, 19 nt, Homo sapiens
gaaagucugcaaauaugug

SEQ ID NO: 773734 - RNA, 19 nt, Homo sapiens
acgaaagucugcaaauaug

SEQ ID NO: 773735 - RNA, 19 nt, Homo sapiens
ccaugaggauucugcaguu

SEQ ID NO: 773736 - RNA, 19 nt, Homo sapiens
acaaagaccaccgcaauga

SEQ ID NO: 773737 - RNA, 19 nt, Homo sapiens
aggagaugcugucacuuaa

SEQ ID NO: 773738 - RNA, 19 nt, Homo sapiens
gaaugacaacaccugguuu

SEQ ID NO: 773739 - RNA, 19 nt, Homo sapiens
cacgaaagucugcaaauau

SEQ ID NO: 773740 - RNA, 19 nt, Homo sapiens
gagaagacgcggcuacucu

SEQ ID NO: 773741 - RNA, 19 nt, Homo sapiens
ccgaaagccuggugucuac

SEQ ID NO: 773742 - RNA, 19 nt, Homo sapiens
gccaacaucaccaucauug

SEQ ID NO: 773743 - RNA, 19 nt, Homo sapiens
ugaggauucugcaguuaau

SEQ ID NO: 773744 - RNA, 19 nt, Homo sapiens
caacaucaccaucauugag

SEQ ID NO: 773745 - RNA, 19 nt, Homo sapiens
aggcagcccuguucgagaa

SEQ ID NO: 773746 - RNA, 19 nt, Homo sapiens
aggagacgaugaagaacaa

SEQ ID NO: 773747 - RNA, 19 nt, Homo sapiens
gcucagccuacgucuuuaa

SEQ ID NO: 773748 - RNA, 19 nt, Homo sapiens
gcccaucacccuccauuuc

SEQ ID NO: 773749 - RNA, 19 nt, Homo sapiens
agaccuggauucaaauucu

SEQ ID NO: 773750 - RNA, 19 nt, Homo sapiens
gagacgaugaagaacaauu

SEQ ID NO: 773751 - RNA, 19 nt, Homo sapiens
cuugaaauauugugacucu

SEQ ID NO: 773752 - RNA, 19 nt, Homo sapiens
gguguuugguuccuguuca

SEQ ID NO: 773753 - RNA, 19 nt, Homo sapiens
cgugugcgaucacccgaaa

SEQ ID NO: 773754 - RNA, 19 nt, Homo sapiens
ggagaugcugucacuuaau

SEQ ID NO: 773755 - RNA, 19 nt, Homo sapiens
ucauugagcaccagaagug

SEQ ID NO: 773756 - RNA, 19 nt, Homo sapiens
gaagacgcggcuacucugu

SEQ ID NO: 773757 - RNA, 19 nt, Homo sapiens
aagaaacccuaagccaaga

SEQ ID NO: 773758 - RNA, 19 nt, Homo sapiens
gcgccaacaucaccaucau

SEQ ID NO: 773759 - RNA, 19 nt, Homo sapiens
gaccuggauucaaauucug

SEQ ID NO: 773760 - RNA, 19 nt, Homo sapiens
gaugcugucacuuaauaau

SEQ ID NO: 773761 - RNA, 19 nt, Homo sapiens
cacccuccauuuccacuug

SEQ ID NO: 773762 - RNA, 19 nt, Homo sapiens
agacagcuccuggccauau

SEQ ID NO: 773763 - RNA, 19 nt, Homo sapiens
gguuuguucucuguuguau

SEQ ID NO: 773764 - RNA, 19 nt, Homo sapiens
gcugucacuuaauaaucaa

SEQ ID NO: 773765 - RNA, 19 nt, Homo sapiens
ugcugucacuuaauaauca

SEQ ID NO: 773766 - RNA, 19 nt, Homo sapiens
uccaggagacgaugaagaa

SEQ ID NO: 773767 - RNA, 19 nt, Homo sapiens
gcuccuggccauauaucaa

SEQ ID NO: 773768 - RNA, 19 nt, Homo sapiens
auucugccuugaaauauug

SEQ ID NO: 773769 - RNA, 19 nt, Homo sapiens
gagagaccaggaucaucaa

SEQ ID NO: 773770 - RNA, 19 nt, Homo sapiens
cagccuacgucuuuaaucc

SEQ ID NO: 773771 - RNA, 19 nt, Homo sapiens
ccugguuuguucucuguug

SEQ ID NO: 773772 - RNA, 19 nt, Homo sapiens
ucagugagaccuggauuca

SEQ ID NO: 773773 - RNA, 19 nt, Homo sapiens
cgaaagucugcaaauaugu

SEQ ID NO: 773774 - RNA, 19 nt, Homo sapiens
ccaacaucaccaucauuga

SEQ ID NO: 773775 - RNA, 19 nt, Homo sapiens
aaagaccaccgcaaugaca

SEQ ID NO: 773776 - RNA, 19 nt, Homo sapiens
caccugguuuguucucugu

SEQ ID NO: 773777 - RNA, 19 nt, Homo sapiens
gcagcccuguucgagaaga

SEQ ID NO: 773778 - RNA, 19 nt, Homo sapiens
agcacaaccuccagaagga

SEQ ID NO: 773779 - RNA, 19 nt, Homo sapiens
ccucuacgaacauucuuug

SEQ ID NO: 773780 - RNA, 19 nt, Homo sapiens
gaugaagaacaauuagacu

SEQ ID NO: 773781 - RNA, 19 nt, Homo sapiens
uguaaccagucucuucaag

SEQ ID NO: 773782 - RNA, 19 nt, Homo sapiens
agaaggaggagggcuguga

SEQ ID NO: 773783 - RNA, 19 nt, Homo sapiens
acaucaugcuggugaagau

SEQ ID NO: 773784 - RNA, 19 nt, Homo sapiens
uauugugacucugggaaug

SEQ ID NO: 773785 - RNA, 19 nt, Homo sapiens
guuccuguucacucuguua

SEQ ID NO: 773786 - RNA, 19 nt, Homo sapiens
ccauuuccacuugguguuu

SEQ ID NO: 773787 - RNA, 19 nt, Homo sapiens
ggauccaggagacgaugaa

SEQ ID NO: 773788 - RNA, 19 nt, Homo sapiens
ugagaccuggauucaaauu

SEQ ID NO: 773789 - RNA, 19 nt, Homo sapiens
caggagacgaugaagaaca

SEQ ID NO: 773790 - RNA, 19 nt, Homo sapiens
gagaugcugucacuuaaua

SEQ ID NO: 773791 - RNA, 19 nt, Homo sapiens
gcaaauauguggacuggau

SEQ ID NO: 773792 - RNA, 19 nt, Homo sapiens
caaauucugccuugaaaua

SEQ ID NO: 773793 - RNA, 19 nt, Homo sapiens
ggaagggaccuaacugaaa

SEQ ID NO: 773794 - RNA, 19 nt, Homo sapiens
acacgaaagucugcaaaua

SEQ ID NO: 773795 - RNA, 19 nt, Homo sapiens
ggaccuaacugaaaacaaa

SEQ ID NO: 773796 - RNA, 19 nt, Homo sapiens
caacaaagaccaccgcaau

SEQ ID NO: 773797 - RNA, 19 nt, Homo sapiens
gaagggaccuaacugaaaa

SEQ ID NO: 773798 - RNA, 19 nt, Homo sapiens
caggagaugcugucacuua

SEQ ID NO: 773799 - RNA, 19 nt, Homo sapiens
ggagagaccaggaucauca

SEQ ID NO: 773800 - RNA, 19 nt, Homo sapiens
ggccauauaucaagguuuc

SEQ ID NO: 773801 - RNA, 19 nt, Homo sapiens
agugagaccuggauucaaa

SEQ ID NO: 773802 - RNA, 19 nt, Homo sapiens
ccaagacccucuacgaaca

SEQ ID NO: 773803 - RNA, 19 nt, Homo sapiens
ccuguucacucuguuaaua

SEQ ID NO: 773804 - RNA, 19 nt, Homo sapiens
gacagcuccuggccauaua

SEQ ID NO: 773805 - RNA, 19 nt, Homo sapiens
ggaaugacaacaccugguu

SEQ ID NO: 773806 - RNA, 19 nt, Homo sapiens
agacgaugaagaacaauua

SEQ ID NO: 773807 - RNA, 19 nt, Homo sapiens
caugaggauucugcaguua

SEQ ID NO: 773808 - RNA, 19 nt, Homo sapiens
gaaagucugcaaauaugug

SEQ ID NO: 773809 - RNA, 19 nt, Homo sapiens
acgaaagucugcaaauaug

SEQ ID NO: 773810 - RNA, 19 nt, Homo sapiens
ccaugaggauucugcaguu

SEQ ID NO: 773811 - RNA, 19 nt, Homo sapiens
acaaagaccaccgcaauga

SEQ ID NO: 773812 - RNA, 19 nt, Homo sapiens
aggagaugcugucacuuaa

SEQ ID NO: 773813 - RNA, 19 nt, Homo sapiens
gggaagggaccuaacugaa

SEQ ID NO: 773814 - RNA, 19 nt, Homo sapiens
gaaugacaacaccugguuu

SEQ ID NO: 773815 - RNA, 19 nt, Homo sapiens
cacgaaagucugcaaauau

SEQ ID NO: 773816 - RNA, 19 nt, Homo sapiens
gagaagacgcggcuacucu

SEQ ID NO: 773817 - RNA, 19 nt, Homo sapiens
ccgaaagccuggugucuac

SEQ ID NO: 773818 - RNA, 19 nt, Homo sapiens
gccaacaucaccaucauug

SEQ ID NO: 773819 - RNA, 19 nt, Homo sapiens
ugaggauucugcaguuaau

SEQ ID NO: 773820 - RNA, 19 nt, Homo sapiens
caacaucaccaucauugag

SEQ ID NO: 773821 - RNA, 19 nt, Homo sapiens
aggcagcccuguucgagaa

SEQ ID NO: 773822 - RNA, 19 nt, Homo sapiens
aggagacgaugaagaacaa

SEQ ID NO: 773823 - RNA, 19 nt, Homo sapiens
gcccaucacccuccauuuc

SEQ ID NO: 773824 - RNA, 19 nt, Homo sapiens
agaccuggauucaaauucu

SEQ ID NO: 773825 - RNA, 19 nt, Homo sapiens
gagacgaugaagaacaauu

SEQ ID NO: 773826 - RNA, 19 nt, Homo sapiens
cuugaaauauugugacucu

SEQ ID NO: 773827 - RNA, 19 nt, Homo sapiens
gguguuugguuccuguuca

SEQ ID NO: 773828 - RNA, 19 nt, Homo sapiens
cgugugcgaucacccgaaa

SEQ ID NO: 773829 - RNA, 19 nt, Homo sapiens
ggagaugcugucacuuaau

SEQ ID NO: 773830 - RNA, 19 nt, Homo sapiens
ucauugagcaccagaagug

SEQ ID NO: 773831 - RNA, 19 nt, Homo sapiens
gaagacgcggcuacucugu

SEQ ID NO: 773832 - RNA, 19 nt, Homo sapiens
aagaaacccuaagccaaga

SEQ ID NO: 773833 - RNA, 19 nt, Homo sapiens
gcgccaacaucaccaucau

SEQ ID NO: 773834 - RNA, 19 nt, Homo sapiens
gaccuggauucaaauucug

SEQ ID NO: 773835 - RNA, 19 nt, Homo sapiens
gaugcugucacuuaauaau

SEQ ID NO: 773836 - RNA, 19 nt, Homo sapiens
cacccuccauuuccacuug

SEQ ID NO: 773837 - RNA, 19 nt, Homo sapiens
agacagcuccuggccauau

SEQ ID NO: 773838 - RNA, 19 nt, Homo sapiens
gguuuguucucuguuguau

SEQ ID NO: 773839 - RNA, 19 nt, Homo sapiens
ucucacagcagccaaggaa

SEQ ID NO: 773840 - RNA, 19 nt, Homo sapiens
gcugucacuuaauaaucaa

SEQ ID NO: 773841 - RNA, 19 nt, Homo sapiens
ugcugucacuuaauaauca

SEQ ID NO: 773842 - RNA, 19 nt, Homo sapiens
uccaggagacgaugaagaa

SEQ ID NO: 773843 - RNA, 19 nt, Homo sapiens
gcuccuggccauauaucaa

SEQ ID NO: 773844 - RNA, 19 nt, Homo sapiens
gagagaccaggaucaucaa

SEQ ID NO: 773845 - RNA, 19 nt, Homo sapiens
auucugccuugaaauauug

SEQ ID NO: 773846 - RNA, 19 nt, Homo sapiens
ccugguuuguucucuguug

SEQ ID NO: 773847 - RNA, 19 nt, Homo sapiens
ucagugagaccuggauuca

SEQ ID NO: 773848 - RNA, 19 nt, Homo sapiens
cgaaagucugcaaauaugu

SEQ ID NO: 773849 - RNA, 19 nt, Homo sapiens
ccaacaucaccaucauuga

SEQ ID NO: 773850 - RNA, 19 nt, Homo sapiens
aaagaccaccgcaaugaca

SEQ ID NO: 773851 - RNA, 19 nt, Homo sapiens
caccugguuuguucucugu

SEQ ID NO: 773852 - RNA, 19 nt, Homo sapiens
gcagcccuguucgagaaga

SEQ ID NO: 773853 - RNA, 19 nt, Homo sapiens
agcacaaccuccagaagga

SEQ ID NO: 773854 - RNA, 19 nt, Homo sapiens
caagggaagggaccuaacu

SEQ ID NO: 773855 - RNA, 19 nt, Homo sapiens
gcugggagaagcaggaauc

SEQ ID NO: 773856 - RNA, 19 nt, Homo sapiens
ccucuacgaacauucuuug

SEQ ID NO: 773857 - RNA, 19 nt, Homo sapiens
gaugaagaacaauuagacu

SEQ ID NO: 773858 - RNA, 19 nt, Homo sapiens
ccgcagaugcagagguuga

SEQ ID NO: 773859 - RNA, 19 nt, Homo sapiens
uguaaccagucucuucaag

SEQ ID NO: 773860 - RNA, 19 nt, Homo sapiens
acaucaugcuggugaagau

SEQ ID NO: 773861 - RNA, 19 nt, Homo sapiens
agaaggaggagggcuguga

SEQ ID NO: 773862 - RNA, 19 nt, Homo sapiens
uauugugacucugggaaug

SEQ ID NO: 773863 - RNA, 19 nt, Homo sapiens
guuccuguucacucuguua

SEQ ID NO: 773864 - RNA, 19 nt, Homo sapiens
ccauuuccacuugguguuu

SEQ ID NO: 773865 - RNA, 19 nt, Homo sapiens
ggauccaggagacgaugaa

SEQ ID NO: 773866 - RNA, 19 nt, Homo sapiens
ugagaccuggauucaaauu

SEQ ID NO: 773867 - RNA, 19 nt, Homo sapiens
gccaagggaagggaccuaa

SEQ ID NO: 773868 - RNA, 19 nt, Homo sapiens
caggagacgaugaagaaca

SEQ ID NO: 773869 - RNA, 19 nt, Homo sapiens
ucacgagucuucaagcuuu

SEQ ID NO: 773870 - RNA, 19 nt, Homo sapiens
gagaaagaguguguucaaa

SEQ ID NO: 773871 - RNA, 19 nt, Homo sapiens
gguagccaauguuuccuua

SEQ ID NO: 773872 - RNA, 19 nt, Homo sapiens
gccaauguuuccuuaaauu

SEQ ID NO: 773873 - RNA, 19 nt, Homo sapiens
gugcuuccauugcuucaua

SEQ ID NO: 773874 - RNA, 19 nt, Homo sapiens
gauaucuucucaccuaugu

SEQ ID NO: 773875 - RNA, 19 nt, Homo sapiens
ucggauaucuucucaccua

SEQ ID NO: 773876 - RNA, 19 nt, Homo sapiens
gauggcagaugcugucaau

SEQ ID NO: 773877 - RNA, 19 nt, Homo sapiens
uagccaauguuuccuuaaa

SEQ ID NO: 773878 - RNA, 19 nt, Homo sapiens
uggcagaugcugucaauaa

SEQ ID NO: 773879 - RNA, 19 nt, Homo sapiens
uauguucccuggcuaagaa

SEQ ID NO: 773880 - RNA, 19 nt, Homo sapiens
ggcagaugcugucaauaau

SEQ ID NO: 773881 - RNA, 19 nt, Homo sapiens
aaaauacucuucccucaaa

SEQ ID NO: 773882 - RNA, 19 nt, Homo sapiens
ggucaaaacugaagaaaac

SEQ ID NO: 773883 - RNA, 19 nt, Homo sapiens
ugucggaaguggagaaguu

SEQ ID NO: 773884 - RNA, 19 nt, Homo sapiens
agucagagguagccaaugu

SEQ ID NO: 773885 - RNA, 19 nt, Homo sapiens
gaugaccuuuguguaugua

SEQ ID NO: 773886 - RNA, 19 nt, Homo sapiens
aacagcagauuucgacauu

SEQ ID NO: 773887 - RNA, 19 nt, Homo sapiens
gaagucagagguagccaau

SEQ ID NO: 773888 - RNA, 19 nt, Homo sapiens
ccauguguuuguagagauu

SEQ ID NO: 773889 - RNA, 19 nt, Homo sapiens
caccauugaugaccuuugu

SEQ ID NO: 773890 - RNA, 19 nt, Homo sapiens
uagucaagaugagugauaa

SEQ ID NO: 773891 - RNA, 19 nt, Homo sapiens
caggcuaucuucuagucaa

SEQ ID NO: 773892 - RNA, 19 nt, Homo sapiens
guucuugcauccuauacug

SEQ ID NO: 773893 - RNA, 19 nt, Homo sapiens
ucagagguagccaauguuu

SEQ ID NO: 773894 - RNA, 19 nt, Homo sapiens
gcagaugcugucaauaauc

SEQ ID NO: 773895 - RNA, 19 nt, Homo sapiens
ugucaauaaucucaccauu

SEQ ID NO: 773896 - RNA, 19 nt, Homo sapiens
aauaaucucaccauugaug

SEQ ID NO: 773897 - RNA, 19 nt, Homo sapiens
guaguucuugcauccuaua

SEQ ID NO: 773898 - RNA, 19 nt, Homo sapiens
cuagucaagaugagugaua

SEQ ID NO: 773899 - RNA, 19 nt, Homo sapiens
ugaugaccuuuguguaugu

SEQ ID NO: 773900 - RNA, 19 nt, Homo sapiens
gcuuucaggcuaucuucua

SEQ ID NO: 773901 - RNA, 19 nt, Homo sapiens
ccaauguuuccuuaaauuc

SEQ ID NO: 773902 - RNA, 19 nt, Homo sapiens
caacagcagauuucgacau

SEQ ID NO: 773903 - RNA, 19 nt, Homo sapiens
uuccauugcuucauaaucu

SEQ ID NO: 773904 - RNA, 19 nt, Homo sapiens
ggauaucuucucaccuaug

SEQ ID NO: 773905 - RNA, 19 nt, Homo sapiens
gugauaagccagacuuguc

SEQ ID NO: 773906 - RNA, 19 nt, Homo sapiens
uaucuucucaccuauguuc

SEQ ID NO: 773907 - RNA, 19 nt, Homo sapiens
gaaguggagaaguuugaca

SEQ ID NO: 773908 - RNA, 19 nt, Homo sapiens
uugaugaccuuuguguaug

SEQ ID NO: 773909 - RNA, 19 nt, Homo sapiens
cuucaagcuuucaggcuau

SEQ ID NO: 773910 - RNA, 19 nt, Homo sapiens
gaccuuuguguauguaguu

SEQ ID NO: 773911 - RNA, 19 nt, Homo sapiens
agaaagaguguguucaaac

SEQ ID NO: 773912 - RNA, 19 nt, Homo sapiens
agccaauguuuccuuaaau

SEQ ID NO: 773913 - RNA, 19 nt, Homo sapiens
cggaaguggagaaguuuga

SEQ ID NO: 773914 - RNA, 19 nt, Homo sapiens
guuuuaaccugcuaugaug

SEQ ID NO: 773915 - RNA, 19 nt, Homo sapiens
gaugcugucaauaaucuca

SEQ ID NO: 773916 - RNA, 19 nt, Homo sapiens
ccauugaugaccuuugugu

SEQ ID NO: 773917 - RNA, 19 nt, Homo sapiens
ggagcgagucugggucuca

SEQ ID NO: 773918 - RNA, 19 nt, Homo sapiens
aagaugagcuguauuuguu

SEQ ID NO: 773919 - RNA, 19 nt, Homo sapiens
gagacacuauguucaauug

SEQ ID NO: 773920 - RNA, 19 nt, Homo sapiens
aaacuugcauuccacuaua

SEQ ID NO: 773921 - RNA, 19 nt, Homo sapiens
gaaaagagccagaagguuu

SEQ ID NO: 773922 - RNA, 19 nt, Homo sapiens
gaagguuucuguuuaaugc

SEQ ID NO: 773923 - RNA, 19 nt, Homo sapiens
gcacuggucuucacaacuc

SEQ ID NO: 773924 - RNA, 19 nt, Homo sapiens
uaacacaucuaugaagguu

SEQ ID NO: 773925 - RNA, 19 nt, Homo sapiens
cuugacaguugauagauua

SEQ ID NO: 773926 - RNA, 19 nt, Homo sapiens
gaaauuguacuccuugaca

SEQ ID NO: 773927 - RNA, 19 nt, Homo sapiens
gaugagcuguauuuguuug

SEQ ID NO: 773928 - RNA, 19 nt, Homo sapiens
gagcuguauuuguuugaaa

SEQ ID NO: 773929 - RNA, 19 nt, Homo sapiens
acacaucuaugaagguuau

SEQ ID NO: 773930 - RNA, 19 nt, Homo sapiens
uuuaaugcaucuugccuua

SEQ ID NO: 773931 - RNA, 19 nt, Homo sapiens
gaucuggcgcuucuacuuu

SEQ ID NO: 773932 - RNA, 19 nt, Homo sapiens
ggaaagaagcucaguuugc

SEQ ID NO: 773933 - RNA, 19 nt, Homo sapiens
caaaagaugagcuguauuu

SEQ ID NO: 773934 - RNA, 19 nt, Homo sapiens
gaggaauaagugcaaauuu

SEQ ID NO: 773935 - RNA, 19 nt, Homo sapiens
gggcuucuuugaccucauu

SEQ ID NO: 773936 - RNA, 19 nt, Homo sapiens
uaaugcaucuugccuuauc

SEQ ID NO: 773937 - RNA, 19 nt, Homo sapiens
caaaaguacucaagggaaa

SEQ ID NO: 773938 - RNA, 19 nt, Homo sapiens
caaagaccaucaccagcau

SEQ ID NO: 773939 - RNA, 19 nt, Homo sapiens
cagcauaagugccaaagac

SEQ ID NO: 773940 - RNA, 19 nt, Homo sapiens
uaaauucaguguguagcuu

SEQ ID NO: 773941 - RNA, 19 nt, Homo sapiens
caaacuugcauuccacuau

SEQ ID NO: 773942 - RNA, 19 nt, Homo sapiens
ccacagcaaaggcauaaga

SEQ ID NO: 773943 - RNA, 19 nt, Homo sapiens
uaucgugcuuuguaucuug

SEQ ID NO: 773944 - RNA, 19 nt, Homo sapiens
cacgauuucucuccucuug

SEQ ID NO: 773945 - RNA, 19 nt, Homo sapiens
uaccugaucuaccugaaau

SEQ ID NO: 773946 - RNA, 19 nt, Homo sapiens
ccuauacugugacuucuuc

SEQ ID NO: 773947 - RNA, 19 nt, Homo sapiens
uuugaaaucugagacacua

SEQ ID NO: 773948 - RNA, 19 nt, Homo sapiens
gagauccucuggaccuucu

SEQ ID NO: 773949 - RNA, 19 nt, Homo sapiens
gaaaucugagacacuaugu

SEQ ID NO: 773950 - RNA, 19 nt, Homo sapiens
aaagaugagcuguauuugu

SEQ ID NO: 773951 - RNA, 19 nt, Homo sapiens
agucaucaguggcucugua

SEQ ID NO: 773952 - RNA, 19 nt, Homo sapiens
gggccucuaucgugcuuug

SEQ ID NO: 773953 - RNA, 19 nt, Homo sapiens
gaccaucaccagcaucugu

SEQ ID NO: 773954 - RNA, 19 nt, Homo sapiens
uaaggcaaccuacgaugga

SEQ ID NO: 773955 - RNA, 19 nt, Homo sapiens
gcuccuaugccacagugua

SEQ ID NO: 773956 - RNA, 19 nt, Homo sapiens
gggaaagaagcucaguuug

SEQ ID NO: 773957 - RNA, 19 nt, Homo sapiens
cuuugugucugcaaugaaa

SEQ ID NO: 773958 - RNA, 19 nt, Homo sapiens
agaccauccuauacuguga

SEQ ID NO: 773959 - RNA, 19 nt, Homo sapiens
ugugggaggccucucauuu

SEQ ID NO: 773960 - RNA, 19 nt, Homo sapiens
guauaacacaucuaugaag

SEQ ID NO: 773961 - RNA, 19 nt, Homo sapiens
ggcaaaagaugagcuguau

SEQ ID NO: 773962 - RNA, 19 nt, Homo sapiens
ccuugacaguugauagauu

SEQ ID NO: 773963 - RNA, 19 nt, Homo sapiens
agggaaagaagcucaguuu

SEQ ID NO: 773964 - RNA, 19 nt, Homo sapiens
ggaucuggcgcuucuacuu

SEQ ID NO: 773965 - RNA, 19 nt, Homo sapiens
ccucuaucgugcuuuguau

SEQ ID NO: 773966 - RNA, 19 nt, Homo sapiens
cgauuucucuccucuugag

SEQ ID NO: 773967 - RNA, 19 nt, Homo sapiens
guaccugaucuaccugaaa

SEQ ID NO: 773968 - RNA, 19 nt, Homo sapiens
acacaaagaaacuuaaugc

SEQ ID NO: 773969 - RNA, 19 nt, Homo sapiens
cuacuuugagggcuucuuu

SEQ ID NO: 773970 - RNA, 19 nt, Homo sapiens
uaccuugccugcuccuaug

SEQ ID NO: 773971 - RNA, 19 nt, Homo sapiens
ugaggaauaagugcaaauu

SEQ ID NO: 773972 - RNA, 19 nt, Homo sapiens
ucagggugcucggacagaa

SEQ ID NO: 773973 - RNA, 19 nt, Homo sapiens
cauccuauacugugacuuc

SEQ ID NO: 773974 - RNA, 19 nt, Homo sapiens
caaccuacgauggaaauca

SEQ ID NO: 773975 - RNA, 19 nt, Homo sapiens
ugaaauuuaaggcaaccua

SEQ ID NO: 773976 - RNA, 19 nt, Homo sapiens
ccugaucuaccugaaauuu

SEQ ID NO: 773977 - RNA, 19 nt, Homo sapiens
aaucugagacacuauguuc

SEQ ID NO: 773978 - RNA, 19 nt, Homo sapiens
cuuuguaucuugucaacug

SEQ ID NO: 773979 - RNA, 19 nt, Homo sapiens
cugaucuaccugaaauuua

SEQ ID NO: 773980 - RNA, 19 nt, Homo sapiens
ugaaaucugagacacuaug

SEQ ID NO: 773981 - RNA, 19 nt, Homo sapiens
gugaagauuuugugaggaa

SEQ ID NO: 773982 - RNA, 19 nt, Homo sapiens
ugagacacuauguucaauu

SEQ ID NO: 773983 - RNA, 19 nt, Homo sapiens
ccacaguguaccugaucua

SEQ ID NO: 773984 - RNA, 19 nt, Homo sapiens
gaaacucuuaagucuuugu

SEQ ID NO: 773985 - RNA, 19 nt, Homo sapiens
cuuugaaacucuuaagucu

SEQ ID NO: 773986 - RNA, 19 nt, Homo sapiens
gaagauuuugugaggaaua

SEQ ID NO: 773987 - RNA, 19 nt, Homo sapiens
gaauucuuaccacagcaaa

SEQ ID NO: 773988 - RNA, 19 nt, Homo sapiens
gcucaguuugccagcauaa

SEQ ID NO: 773989 - RNA, 19 nt, Homo sapiens
caucuaugaagguuaucua

SEQ ID NO: 773990 - RNA, 19 nt, Homo sapiens
gugacuucuucuacuugua

SEQ ID NO: 773991 - RNA, 19 nt, Homo sapiens
ugagcuguauuuguuugaa

SEQ ID NO: 773992 - RNA, 19 nt, Homo sapiens
uacgauggaaaucaugaua

SEQ ID NO: 773993 - RNA, 19 nt, Homo sapiens
cggaaaaucagaaacuuaa

SEQ ID NO: 773994 - RNA, 19 nt, Homo sapiens
gaccaucaccacccacuac

SEQ ID NO: 773995 - RNA, 19 nt, Homo sapiens
caguguaccugaucuaccu

SEQ ID NO: 773996 - RNA, 19 nt, Homo sapiens
acugugacuucuucuacuu

SEQ ID NO: 773997 - RNA, 19 nt, Homo sapiens
uaccacagcaaaggcauaa

SEQ ID NO: 773998 - RNA, 19 nt, Homo sapiens
ucugagacacuauguucaa

SEQ ID NO: 773999 - RNA, 19 nt, Homo sapiens
aaccuacgauggaaaucau

SEQ ID NO: 774000 - RNA, 19 nt, Homo sapiens
uagcuucaauugggauagu

SEQ ID NO: 774001 - RNA, 19 nt, Homo sapiens
ccagguagaugaccaaauu

SEQ ID NO: 774002 - RNA, 19 nt, Homo sapiens
aauaaaagcucacaccuua

SEQ ID NO: 774003 - RNA, 19 nt, Homo sapiens
gguacguucuugugaauuu

SEQ ID NO: 774004 - RNA, 19 nt, Homo sapiens
ccaaaguccuuaagggaaa

SEQ ID NO: 774005 - RNA, 19 nt, Homo sapiens
gaccauaacuacucacuac

SEQ ID NO: 774006 - RNA, 19 nt, Homo sapiens
gcugauaccugccuuguac

SEQ ID NO: 774007 - RNA, 19 nt, Homo sapiens
cagaagcaaaccaaauuua

SEQ ID NO: 774008 - RNA, 19 nt, Homo sapiens
guaaucagucaauccaaua

SEQ ID NO: 774009 - RNA, 19 nt, Homo sapiens
aaauuuagguggucaagau

SEQ ID NO: 774010 - RNA, 19 nt, Homo sapiens
caaugucccuccucuuaga

SEQ ID NO: 774011 - RNA, 19 nt, Homo sapiens
gcacaugaaggaaacuauu

SEQ ID NO: 774012 - RNA, 19 nt, Homo sapiens
caugauauaugggaaauuc

SEQ ID NO: 774013 - RNA, 19 nt, Homo sapiens
gguaccagacugagaauuu

SEQ ID NO: 774014 - RNA, 19 nt, Homo sapiens
gaagagccagauccuguuu

SEQ ID NO: 774015 - RNA, 19 nt, Homo sapiens
uccaaacccuuaccuacua

SEQ ID NO: 774016 - RNA, 19 nt, Homo sapiens
agucgugucuggaguagua

SEQ ID NO: 774017 - RNA, 19 nt, Homo sapiens
agauauauccaaacccuua

SEQ ID NO: 774018 - RNA, 19 nt, Homo sapiens
cuuaguaccuuaauaccaa

SEQ ID NO: 774019 - RNA, 19 nt, Homo sapiens
gccagaagcaaaccaaauu

SEQ ID NO: 774020 - RNA, 19 nt, Homo sapiens
aacaaugucccuccucuua

SEQ ID NO: 774021 - RNA, 19 nt, Homo sapiens
gaucaucccacccagaaga

SEQ ID NO: 774022 - RNA, 19 nt, Homo sapiens
guaccagacugagaauuuc

SEQ ID NO: 774023 - RNA, 19 nt, Homo sapiens
gagauccucuggacuuucu

SEQ ID NO: 774024 - RNA, 19 nt, Homo sapiens
ccuuaaagacccauuguaa

SEQ ID NO: 774025 - RNA, 19 nt, Homo sapiens
ccaauaaccuaaugguacu

SEQ ID NO: 774026 - RNA, 19 nt, Homo sapiens
caauagaucgcccuuaaag

SEQ ID NO: 774027 - RNA, 19 nt, Homo sapiens
uggagaggcugagaccaua

SEQ ID NO: 774028 - RNA, 19 nt, Homo sapiens
gugcgaaaguaaucaguca

SEQ ID NO: 774029 - RNA, 19 nt, Homo sapiens
ggaagagccagauccuguu

SEQ ID NO: 774030 - RNA, 19 nt, Homo sapiens
aucaauagaucgcccuuaa

SEQ ID NO: 774031 - RNA, 19 nt, Homo sapiens
gauaccugccuuguacuua

SEQ ID NO: 774032 - RNA, 19 nt, Homo sapiens
ccagaagcaaaccaaauuu

SEQ ID NO: 774033 - RNA, 19 nt, Homo sapiens
uuuagguggucaagauaua

SEQ ID NO: 774034 - RNA, 19 nt, Homo sapiens
gaacaaugucccuccucuu

SEQ ID NO: 774035 - RNA, 19 nt, Homo sapiens
aaaguuuccuagaaguuug

SEQ ID NO: 774036 - RNA, 19 nt, Homo sapiens
uagaaugucccaacuaaag

SEQ ID NO: 774037 - RNA, 19 nt, Homo sapiens
gugccucacugcaacaaga

SEQ ID NO: 774038 - RNA, 19 nt, Homo sapiens
guacaaaccaucuucuacu

SEQ ID NO: 774039 - RNA, 19 nt, Homo sapiens
guacaugauauaugggaaa

SEQ ID NO: 774040 - RNA, 19 nt, Homo sapiens
caguguacaugauauaugg

SEQ ID NO: 774041 - RNA, 19 nt, Homo sapiens
gcgaguaccauuugcacaa

SEQ ID NO: 774042 - RNA, 19 nt, Homo sapiens
ccaacuucaucuccaucua

SEQ ID NO: 774043 - RNA, 19 nt, Homo sapiens
cugacuggcuggaccauga

SEQ ID NO: 774044 - RNA, 19 nt, Homo sapiens
ccagaaaaguguuuagugu

SEQ ID NO: 774045 - RNA, 19 nt, Homo sapiens
uaacuacucacuaccuguu

SEQ ID NO: 774046 - RNA, 19 nt, Homo sapiens
gaaaguaaucagucaaucc

SEQ ID NO: 774047 - RNA, 19 nt, Homo sapiens
augagcagauacagauaua

SEQ ID NO: 774048 - RNA, 19 nt, Homo sapiens
uaggguacguucuugugaa

SEQ ID NO: 774049 - RNA, 19 nt, Homo sapiens
cgaaaguaaucagucaauc

SEQ ID NO: 774050 - RNA, 19 nt, Homo sapiens
ucaaaccaguggcugauac

SEQ ID NO: 774051 - RNA, 19 nt, Homo sapiens
uaguguggauuucagcaaa

SEQ ID NO: 774052 - RNA, 19 nt, Homo sapiens
cacaugaaggaaacuauuu

SEQ ID NO: 774053 - RNA, 19 nt, Homo sapiens
uuaacaagcacaugaagga

SEQ ID NO: 774054 - RNA, 19 nt, Homo sapiens
gaccuucucaucaauagau

SEQ ID NO: 774055 - RNA, 19 nt, Homo sapiens
uacaaaccaucuucuacug

SEQ ID NO: 774056 - RNA, 19 nt, Homo sapiens
ggagaggcugagaccauaa

SEQ ID NO: 774057 - RNA, 19 nt, Homo sapiens
gcgaaaguaaucagucaau

SEQ ID NO: 774058 - RNA, 19 nt, Homo sapiens
ccacuuuccagguagauga

SEQ ID NO: 774059 - RNA, 19 nt, Homo sapiens
ucuugugaauuuccacuuu

SEQ ID NO: 774060 - RNA, 19 nt, Homo sapiens
gcuggaccaugaacguguu

SEQ ID NO: 774061 - RNA, 19 nt, Homo sapiens
gcaacaagaaaccuuaagg

SEQ ID NO: 774062 - RNA, 19 nt, Homo sapiens
ccuguuugcucucgucuuc

SEQ ID NO: 774063 - RNA, 19 nt, Homo sapiens
ccucuggacuuucucuauc

SEQ ID NO: 774064 - RNA, 19 nt, Homo sapiens
uuaaagacccauuguaagg

SEQ ID NO: 774065 - RNA, 19 nt, Homo sapiens
aaaccaucuucuacuguga

SEQ ID NO: 774066 - RNA, 19 nt, Homo sapiens
cuaucuaucuggaaucagu

SEQ ID NO: 774067 - RNA, 19 nt, Homo sapiens
cacaaucacuguuuuacuu

SEQ ID NO: 774068 - RNA, 19 nt, Homo sapiens
cgaguaccauuugcacaau

SEQ ID NO: 774069 - RNA, 19 nt, Homo sapiens
gguagaugaccaaauuuag

SEQ ID NO: 774070 - RNA, 19 nt, Homo sapiens
aauuuccacuuuccaggua

SEQ ID NO: 774071 - RNA, 19 nt, Homo sapiens
ucaauagaucgcccuuaaa

SEQ ID NO: 774072 - RNA, 19 nt, Homo sapiens
ugacuucuucuacuuguau

SEQ ID NO: 774073 - RNA, 19 nt, Homo sapiens
aguaaucagucaauccaau

SEQ ID NO: 774074 - RNA, 19 nt, Homo sapiens
ccaaacccuuaccuacuag

SEQ ID NO: 774075 - RNA, 19 nt, Homo sapiens
cuacaacacaguaaugaag

SEQ ID NO: 774076 - RNA, 19 nt, Homo sapiens
ccaaauugcagucgugucu

SEQ ID NO: 774077 - RNA, 19 nt, Homo sapiens
gcugagaccauaacuacuc

SEQ ID NO: 774078 - RNA, 19 nt, Homo sapiens
guagaugaccaaauuuagg

SEQ ID NO: 774079 - RNA, 19 nt, Homo sapiens
ggacuuucucuaucuaucu

SEQ ID NO: 774080 - RNA, 19 nt, Homo sapiens
guacguucuugugaauuuc

SEQ ID NO: 774081 - RNA, 19 nt, Homo sapiens
gacagucuacgccuuaaca

SEQ ID NO: 774082 - RNA, 19 nt, Homo sapiens
cuucuacugugacuucuuc

SEQ ID NO: 774083 - RNA, 19 nt, Homo sapiens
caucuucuacugugacuuc

SEQ ID NO: 774084 - RNA, 19 nt, Homo sapiens
gcagucgugucuggaguag

SEQ ID NO: 774085 - RNA, 19 nt, Homo sapiens
agguagaugaccaaauuua

SEQ ID NO: 774086 - RNA, 19 nt, Homo sapiens
caucuacaacacaguaaug

SEQ ID NO: 774087 - RNA, 19 nt, Homo sapiens
caacuucaucuccaucuac

SEQ ID NO: 774088 - RNA, 19 nt, Homo sapiens
acaagcacaugaaggaaac

SEQ ID NO: 774089 - RNA, 19 nt, Homo sapiens
uaacaagcacaugaaggaa

SEQ ID NO: 774090 - RNA, 19 nt, Homo sapiens
uggagauccucuggacuuu

SEQ ID NO: 774091 - RNA, 19 nt, Homo sapiens
gaguaccauuugcacaauc

SEQ ID NO: 774092 - RNA, 19 nt, Homo sapiens
ggccagaagcaaaccaaau

SEQ ID NO: 774093 - RNA, 19 nt, Homo sapiens
ugucuuaccgacgaaauaa

SEQ ID NO: 774094 - RNA, 19 nt, Homo sapiens
gugacuucuucuacuugua

SEQ ID NO: 774095 - RNA, 19 nt, Homo sapiens
auaccugccuuguacuuag

SEQ ID NO: 774096 - RNA, 19 nt, Homo sapiens
gaagcaaaccaaauuuacc

SEQ ID NO: 774097 - RNA, 19 nt, Homo sapiens
aauauuaggguacguucuu

SEQ ID NO: 774098 - RNA, 19 nt, Homo sapiens
agaaugucccaacuaaaga

SEQ ID NO: 774099 - RNA, 19 nt, Homo sapiens
ucaccaacuucaucuccau

SEQ ID NO: 774100 - RNA, 19 nt, Homo sapiens
gacuuucucuaucuaucug

SEQ ID NO: 774101 - RNA, 19 nt, Homo sapiens
gaccauaacuacucacuac

SEQ ID NO: 774102 - RNA, 19 nt, Homo sapiens
caugauauaugggaaauuc

SEQ ID NO: 774103 - RNA, 19 nt, Homo sapiens
auacagaugugaacaguca

SEQ ID NO: 774104 - RNA, 19 nt, Homo sapiens
gguaccagacugagaauuu

SEQ ID NO: 774105 - RNA, 19 nt, Homo sapiens
gaagagccagauccuguuu

SEQ ID NO: 774106 - RNA, 19 nt, Homo sapiens
acacuggccuaaggaguua

SEQ ID NO: 774107 - RNA, 19 nt, Homo sapiens
agucgugucuggaguagua

SEQ ID NO: 774108 - RNA, 19 nt, Homo sapiens
guaccagacugagaauuuc

SEQ ID NO: 774109 - RNA, 19 nt, Homo sapiens
gagauccucuggacuuucu

SEQ ID NO: 774110 - RNA, 19 nt, Homo sapiens
uggagaggcugagaccaua

SEQ ID NO: 774111 - RNA, 19 nt, Homo sapiens
ggaagagccagauccuguu

SEQ ID NO: 774112 - RNA, 19 nt, Homo sapiens
guacaaaccaucuucuacu

SEQ ID NO: 774113 - RNA, 19 nt, Homo sapiens
aaaguuuccuagaaguuug

SEQ ID NO: 774114 - RNA, 19 nt, Homo sapiens
guacaugauauaugggaaa

SEQ ID NO: 774115 - RNA, 19 nt, Homo sapiens
caguguacaugauauaugg

SEQ ID NO: 774116 - RNA, 19 nt, Homo sapiens
ccaacuucaucuccaucua

SEQ ID NO: 774117 - RNA, 19 nt, Homo sapiens
cugacuggcuggaccauga

SEQ ID NO: 774118 - RNA, 19 nt, Homo sapiens
gacacuggccuaaggaguu

SEQ ID NO: 774119 - RNA, 19 nt, Homo sapiens
uaacuacucacuaccuguu

SEQ ID NO: 774120 - RNA, 19 nt, Homo sapiens
gaugugaacagucaagucu

SEQ ID NO: 774121 - RNA, 19 nt, Homo sapiens
caaugcuuguguucuaaug

SEQ ID NO: 774122 - RNA, 19 nt, Homo sapiens
uacaaaccaucuucuacug

SEQ ID NO: 774123 - RNA, 19 nt, Homo sapiens
ggagaggcugagaccauaa

SEQ ID NO: 774124 - RNA, 19 nt, Homo sapiens
gcuggaccaugaacguguu

SEQ ID NO: 774125 - RNA, 19 nt, Homo sapiens
ccucuggacuuucucuauc

SEQ ID NO: 774126 - RNA, 19 nt, Homo sapiens
ccuguuugcucucgucuuc

SEQ ID NO: 774127 - RNA, 19 nt, Homo sapiens
aaaccaucuucuacuguga

SEQ ID NO: 774128 - RNA, 19 nt, Homo sapiens
cuaucuaucuggaaucagu

SEQ ID NO: 774129 - RNA, 19 nt, Homo sapiens
ugacuucuucuacuuguau

SEQ ID NO: 774130 - RNA, 19 nt, Homo sapiens
cagcagauacagaugugaa

SEQ ID NO: 774131 - RNA, 19 nt, Homo sapiens
ccaaauugcagucgugucu

SEQ ID NO: 774132 - RNA, 19 nt, Homo sapiens
gcugagaccauaacuacuc

SEQ ID NO: 774133 - RNA, 19 nt, Homo sapiens
cuacaacacaguaaugaag

SEQ ID NO: 774134 - RNA, 19 nt, Homo sapiens
ggacuuucucuaucuaucu

SEQ ID NO: 774135 - RNA, 19 nt, Homo sapiens
cuucuacugugacuucuuc

SEQ ID NO: 774136 - RNA, 19 nt, Homo sapiens
caucuucuacugugacuuc

SEQ ID NO: 774137 - RNA, 19 nt, Homo sapiens
gcagucgugucuggaguag

SEQ ID NO: 774138 - RNA, 19 nt, Homo sapiens
uggagauccucuggacuuu

SEQ ID NO: 774139 - RNA, 19 nt, Homo sapiens
caucuacaacacaguaaug

SEQ ID NO: 774140 - RNA, 19 nt, Homo sapiens
caacuucaucuccaucuac

SEQ ID NO: 774141 - RNA, 19 nt, Homo sapiens
guccugggaugacagcaau

SEQ ID NO: 774142 - RNA, 19 nt, Homo sapiens
ucuaaugcaagaagacaaa

SEQ ID NO: 774143 - RNA, 19 nt, Homo sapiens
gugacuucuucuacuugua

SEQ ID NO: 774144 - RNA, 19 nt, Homo sapiens
auaaguauuccagcagaua

SEQ ID NO: 774145 - RNA, 19 nt, Homo sapiens
gacuuucucuaucuaucug

SEQ ID NO: 774146 - RNA, 19 nt, Homo sapiens
ucaccaacuucaucuccau

SEQ ID NO: 774147 - RNA, 19 nt, Homo sapiens
gcagauacagaugugaaca

SEQ ID NO: 774148 - RNA, 19 nt, Homo sapiens
ggaguaguacaaaccaucu

SEQ ID NO: 774149 - RNA, 19 nt, Homo sapiens
gaggcugagaccauaacua

SEQ ID NO: 774150 - RNA, 19 nt, Homo sapiens
agauacagaugugaacagu

SEQ ID NO: 774151 - RNA, 19 nt, Homo sapiens
gguagguccugggaugaca

SEQ ID NO: 774152 - RNA, 19 nt, Homo sapiens
acugugacuucuucuacuu

SEQ ID NO: 774153 - RNA, 19 nt, Homo sapiens
ggcgguaccagacugagaa

SEQ ID NO: 774154 - RNA, 19 nt, Homo sapiens
ucuggacuuucucuaucua

SEQ ID NO: 774155 - RNA, 19 nt, Homo sapiens
ugugaacagucaagucucu

SEQ ID NO: 774156 - RNA, 19 nt, Homo sapiens
uaguacaaaccaucuucua

SEQ ID NO: 774157 - RNA, 19 nt, Homo sapiens
aagggcaucucugggaaga

SEQ ID NO: 774158 - RNA, 19 nt, Homo sapiens
acacauuccgccuggaguu

SEQ ID NO: 774159 - RNA, 19 nt, Homo sapiens
ucuccucugugccuauguu

SEQ ID NO: 774160 - RNA, 19 nt, Homo sapiens
ggaccuguucaccaacuuc

SEQ ID NO: 774161 - RNA, 19 nt, Homo sapiens
ucccauagcugcuuauuua

SEQ ID NO: 774162 - RNA, 19 nt, Homo sapiens
gaacaugaauucaagaaag

SEQ ID NO: 774163 - RNA, 19 nt, Homo sapiens
gagaugacauugaaauuug

SEQ ID NO: 774164 - RNA, 19 nt, Homo sapiens
gcaaugagguggcccaguu

SEQ ID NO: 774165 - RNA, 19 nt, Homo sapiens
ggacagagauuuacaaacg

SEQ ID NO: 774166 - RNA, 19 nt, Homo sapiens
caagaaagcugcagaugag

SEQ ID NO: 774167 - RNA, 19 nt, Homo sapiens
gaaagaaacccucaagagu

SEQ ID NO: 774168 - RNA, 19 nt, Homo sapiens
ggacucaggucucccauag

SEQ ID NO: 774169 - RNA, 19 nt, Homo sapiens
ugaacuagcuagcuccuuu

SEQ ID NO: 774170 - RNA, 19 nt, Homo sapiens
ccaacuagauuccugaaga

SEQ ID NO: 774171 - RNA, 19 nt, Homo sapiens
gaacugagcaugccgauac

SEQ ID NO: 774172 - RNA, 19 nt, Homo sapiens
caacuagauuccugaagaa

SEQ ID NO: 774173 - RNA, 19 nt, Homo sapiens
gcuccucucugcuauauga

SEQ ID NO: 774174 - RNA, 19 nt, Homo sapiens
gagcagagccagauucuca

SEQ ID NO: 774175 - RNA, 19 nt, Homo sapiens
caaagcauauugucaucuu

SEQ ID NO: 774176 - RNA, 19 nt, Homo sapiens
ggaauuguguguugugagu

SEQ ID NO: 774177 - RNA, 19 nt, Homo sapiens
ggauuaaucgauuccuuua

SEQ ID NO: 774178 - RNA, 19 nt, Homo sapiens
gaagaaggccgaagaacuc

SEQ ID NO: 774179 - RNA, 19 nt, Homo sapiens
gaacaaaguauuucaaagc

SEQ ID NO: 774180 - RNA, 19 nt, Homo sapiens
ggaacaaaguauuucaaag

SEQ ID NO: 774181 - RNA, 19 nt, Homo sapiens
caccaagucuccucaauca

SEQ ID NO: 774182 - RNA, 19 nt, Homo sapiens
aaagauugcuugguaguga

SEQ ID NO: 774183 - RNA, 19 nt, Homo sapiens
aaagaaacccucaagaguu

SEQ ID NO: 774184 - RNA, 19 nt, Homo sapiens
acucaaggcuauuuagaaa

SEQ ID NO: 774185 - RNA, 19 nt, Homo sapiens
ggcuagauuugaugacaua

SEQ ID NO: 774186 - RNA, 19 nt, Homo sapiens
uaacaguaguggcuccauu

SEQ ID NO: 774187 - RNA, 19 nt, Homo sapiens
aagaaacccucaagaguuc

SEQ ID NO: 774188 - RNA, 19 nt, Homo sapiens
gaucaaacgccuacuccaa

SEQ ID NO: 774189 - RNA, 19 nt, Homo sapiens
guaugaaguagcaguauuu

SEQ ID NO: 774190 - RNA, 19 nt, Homo sapiens
gagggaggcuagauuugau

SEQ ID NO: 774191 - RNA, 19 nt, Homo sapiens
ggacagauauggggcuuuu

SEQ ID NO: 774192 - RNA, 19 nt, Homo sapiens
ucaagaaagcugcagauga

SEQ ID NO: 774193 - RNA, 19 nt, Homo sapiens
agacaggaacaaaguauuu

SEQ ID NO: 774194 - RNA, 19 nt, Homo sapiens
aggaggagcuggagacaga

SEQ ID NO: 774195 - RNA, 19 nt, Homo sapiens
gggauuaaucgauuccuuu

SEQ ID NO: 774196 - RNA, 19 nt, Homo sapiens
gcagacaggaacaaaguau

SEQ ID NO: 774197 - RNA, 19 nt, Homo sapiens
ggucucccauagcugcuua

SEQ ID NO: 774198 - RNA, 19 nt, Homo sapiens
gauagagggaggcuagauu

SEQ ID NO: 774199 - RNA, 19 nt, Homo sapiens
caagucuccucaaucaaug

SEQ ID NO: 774200 - RNA, 19 nt, Homo sapiens
cugcuucucucucuucauu

SEQ ID NO: 774201 - RNA, 19 nt, Homo sapiens
ccaagucuccucaaucaau

SEQ ID NO: 774202 - RNA, 19 nt, Homo sapiens
caaccucugucaucacaca

SEQ ID NO: 774203 - RNA, 19 nt, Homo sapiens
cuauuuggguaccucauuu

SEQ ID NO: 774204 - RNA, 19 nt, Homo sapiens
uacggagaauguaagguua

SEQ ID NO: 774205 - RNA, 19 nt, Homo sapiens
ccaccucgguccucacuca

SEQ ID NO: 774206 - RNA, 19 nt, Homo sapiens
ccaccuggcaguucauaaa

SEQ ID NO: 774207 - RNA, 19 nt, Homo sapiens
gguuaccuuugauguauga

SEQ ID NO: 774208 - RNA, 19 nt, Homo sapiens
gaggcuagauuugaugaca

SEQ ID NO: 774209 - RNA, 19 nt, Homo sapiens
gcacguguaucugucucuu

SEQ ID NO: 774210 - RNA, 19 nt, Homo sapiens
cagaugguccgaacaauca

SEQ ID NO: 774211 - RNA, 19 nt, Homo sapiens
caauggugguuguggaaug

SEQ ID NO: 774212 - RNA, 19 nt, Homo sapiens
gacagagauuuacaaacga

SEQ ID NO: 774213 - RNA, 19 nt, Homo sapiens
ugugaguaauggacagaua

SEQ ID NO: 774214 - RNA, 19 nt, Homo sapiens
ucaugcaucuugcuaaugg

SEQ ID NO: 774215 - RNA, 19 nt, Homo sapiens
gaacuagcuagcuccuuug

SEQ ID NO: 774216 - RNA, 19 nt, Homo sapiens
ccuggaggcugucauguag

SEQ ID NO: 774217 - RNA, 19 nt, Homo sapiens
aacauucacuuacggagaa

SEQ ID NO: 774218 - RNA, 19 nt, Homo sapiens
gaagccaagaugagacuga

SEQ ID NO: 774219 - RNA, 19 nt, Homo sapiens
cuagcuagcuccuuugaac

SEQ ID NO: 774220 - RNA, 19 nt, Homo sapiens
gaggugggacucuucaaug

SEQ ID NO: 774221 - RNA, 19 nt, Homo sapiens
cuagauuccugaagaacug

SEQ ID NO: 774222 - RNA, 19 nt, Homo sapiens
agcaugagaugacauugaa

SEQ ID NO: 774223 - RNA, 19 nt, Homo sapiens
ccucaagaguucuaauucu

SEQ ID NO: 774224 - RNA, 19 nt, Homo sapiens
uguaugaaguagcaguauu

SEQ ID NO: 774225 - RNA, 19 nt, Homo sapiens
gauguaugaaguagcagua

SEQ ID NO: 774226 - RNA, 19 nt, Homo sapiens
gaaagcugcagaugaggau

SEQ ID NO: 774227 - RNA, 19 nt, Homo sapiens
gaaacccucaagaguucua

SEQ ID NO: 774228 - RNA, 19 nt, Homo sapiens
uuauuuacccguuuccuuu

SEQ ID NO: 774229 - RNA, 19 nt, Homo sapiens
ccuuggcacuucuagguuu

SEQ ID NO: 774230 - RNA, 19 nt, Homo sapiens
aauuguguguugugaguaa

SEQ ID NO: 774231 - RNA, 19 nt, Homo sapiens
ucaaggcuauuuagaaagc

SEQ ID NO: 774232 - RNA, 19 nt, Homo sapiens
ggagacgacagaccguuug

SEQ ID NO: 774233 - RNA, 19 nt, Homo sapiens
gccaaagcauauugucauc

SEQ ID NO: 774234 - RNA, 19 nt, Homo sapiens
uccaucaaguuagggauua

SEQ ID NO: 774235 - RNA, 19 nt, Homo sapiens
gggcagacaggaacaaagu

SEQ ID NO: 774236 - RNA, 19 nt, Homo sapiens
cagcacagcucagcaacag

SEQ ID NO: 774237 - RNA, 19 nt, Homo sapiens
cacccuaacucaccaaguc

SEQ ID NO: 774238 - RNA, 19 nt, Homo sapiens
ugaaagccacccuaacuca

SEQ ID NO: 774239 - RNA, 19 nt, Homo sapiens
cccaaagccuguucugauc

SEQ ID NO: 774240 - RNA, 19 nt, Homo sapiens
ggaggugggacucuucaau

SEQ ID NO: 774241 - RNA, 19 nt, Homo sapiens
gacucaaggcuauuuagaa

SEQ ID NO: 774242 - RNA, 19 nt, Homo sapiens
acuguuagcucauaaagac

SEQ ID NO: 774243 - RNA, 19 nt, Homo sapiens
gcugaguaaugaagucaca

SEQ ID NO: 774244 - RNA, 19 nt, Homo sapiens
cacaguagaugaagaucca

SEQ ID NO: 774245 - RNA, 19 nt, Homo sapiens
gacgacagaccguuugugu

SEQ ID NO: 774246 - RNA, 19 nt, Homo sapiens
agaaagaaacccucaagag

SEQ ID NO: 774247 - RNA, 19 nt, Homo sapiens
uagaugaagauccagauga

SEQ ID NO: 774248 - RNA, 19 nt, Homo sapiens
gcccaccaguuaacaguag

SEQ ID NO: 774249 - RNA, 19 nt, Homo sapiens
cauaaacacaagcaugaga

SEQ ID NO: 774250 - RNA, 19 nt, Homo sapiens
gggagacgacagaccguuu

SEQ ID NO: 774251 - RNA, 19 nt, Homo sapiens
agacugaaagccacccuaa

SEQ ID NO: 774252 - RNA, 19 nt, Homo sapiens
ugucaugcaucuugcuaau

SEQ ID NO: 774253 - RNA, 19 nt, Homo sapiens
uguaacuacuucagacuca

SEQ ID NO: 774254 - RNA, 19 nt, Homo sapiens
aguuagggauuaaucgauu

SEQ ID NO: 774255 - RNA, 19 nt, Homo sapiens
ccaucaaguuagggauuaa

SEQ ID NO: 774256 - RNA, 19 nt, Homo sapiens
caugagaugacauugaaau

SEQ ID NO: 774257 - RNA, 19 nt, Homo sapiens
aaagacucaaggcuauuua

SEQ ID NO: 774258 - RNA, 19 nt, Homo sapiens
caaagccuguucugaucuc

SEQ ID NO: 774259 - RNA, 19 nt, Homo sapiens
agaaggagguuaccccaaa

SEQ ID NO: 774260 - RNA, 19 nt, Homo sapiens
ggccaaagcauauugucau

SEQ ID NO: 774261 - RNA, 19 nt, Homo sapiens
caacagaccuuuggauuuc

SEQ ID NO: 774262 - RNA, 19 nt, Homo sapiens
gaagguggauggcucugua

SEQ ID NO: 774263 - RNA, 19 nt, Homo sapiens
ggaaguaaguuuauccaau

SEQ ID NO: 774264 - RNA, 19 nt, Homo sapiens
gaauugaaguguugaagga

SEQ ID NO: 774265 - RNA, 19 nt, Homo sapiens
gaauauguaugcaguucuu

SEQ ID NO: 774266 - RNA, 19 nt, Homo sapiens
cuacuugguuguaucauaa

SEQ ID NO: 774267 - RNA, 19 nt, Homo sapiens
guaugcaguucuuucuuua

SEQ ID NO: 774268 - RNA, 19 nt, Homo sapiens
gagaguggauuuuguauuu

SEQ ID NO: 774269 - RNA, 19 nt, Homo sapiens
uaacuuaccuugccucaac

SEQ ID NO: 774270 - RNA, 19 nt, Homo sapiens
ccauaaaugucucucagaa

SEQ ID NO: 774271 - RNA, 19 nt, Homo sapiens
gcaaagaacggcagauuac

SEQ ID NO: 774272 - RNA, 19 nt, Homo sapiens
auaaaugucucucagaaga

SEQ ID NO: 774273 - RNA, 19 nt, Homo sapiens
caugagaauugaaguguug

SEQ ID NO: 774274 - RNA, 19 nt, Homo sapiens
ggcaguacaugaaucgaaa

SEQ ID NO: 774275 - RNA, 19 nt, Homo sapiens
gaaaugaugaaguuaaugg

SEQ ID NO: 774276 - RNA, 19 nt, Homo sapiens
caaaacagaggaagaaaua

SEQ ID NO: 774277 - RNA, 19 nt, Homo sapiens
guggauggcucuguaaaug

SEQ ID NO: 774278 - RNA, 19 nt, Homo sapiens
gaaagaagagaugaggaaa

SEQ ID NO: 774279 - RNA, 19 nt, Homo sapiens
uguaugcaguucuuucuuu

SEQ ID NO: 774280 - RNA, 19 nt, Homo sapiens
ggaagaaauagaaaugaug

SEQ ID NO: 774281 - RNA, 19 nt, Homo sapiens
gcaugagaauugaaguguu

SEQ ID NO: 774282 - RNA, 19 nt, Homo sapiens
gagcaaagaacggcagauu

SEQ ID NO: 774283 - RNA, 19 nt, Homo sapiens
gaucucaguucuccuuucu

SEQ ID NO: 774284 - RNA, 19 nt, Homo sapiens
ucaacagaccuuuggauuu

SEQ ID NO: 774285 - RNA, 19 nt, Homo sapiens
ucaguucuccuuucuugua

SEQ ID NO: 774286 - RNA, 19 nt, Homo sapiens
aaacagaggaagaaauaga

SEQ ID NO: 774287 - RNA, 19 nt, Homo sapiens
cccaugacuugccauuaua

SEQ ID NO: 774288 - RNA, 19 nt, Homo sapiens
ccuaugagaucagaauaug

SEQ ID NO: 774289 - RNA, 19 nt, Homo sapiens
ggguugaucccaccuauga

SEQ ID NO: 774290 - RNA, 19 nt, Homo sapiens
ucucaguucuccuuucuug

SEQ ID NO: 774291 - RNA, 19 nt, Homo sapiens
cagaauauguaugcaguuc

SEQ ID NO: 774292 - RNA, 19 nt, Homo sapiens
uaucuacucccagaaauaa

SEQ ID NO: 774293 - RNA, 19 nt, Homo sapiens
cgaagacgcucccgaucuc

SEQ ID NO: 774294 - RNA, 19 nt, Homo sapiens
ucccaugacuugccauuau

SEQ ID NO: 774295 - RNA, 19 nt, Homo sapiens
caacagaagaaagguuaaa

SEQ ID NO: 774296 - RNA, 19 nt, Homo sapiens
ggauuugccuccuuugacu

SEQ ID NO: 774297 - RNA, 19 nt, Homo sapiens
gaagagaugaggaaaagaa

SEQ ID NO: 774298 - RNA, 19 nt, Homo sapiens
guaacuacuugguuguauc

SEQ ID NO: 774299 - RNA, 19 nt, Homo sapiens
uaaagaaucuccccagaca

SEQ ID NO: 774300 - RNA, 19 nt, Homo sapiens
ggaagcgggacuccaaaug

SEQ ID NO: 774301 - RNA, 19 nt, Homo sapiens
gaagcgggacuccaaaugg

SEQ ID NO: 774302 - RNA, 19 nt, Homo sapiens
gaggaagaaauagaaauga

SEQ ID NO: 774303 - RNA, 19 nt, Homo sapiens
gauuacugaggaagacuua

SEQ ID NO: 774304 - RNA, 19 nt, Homo sapiens
ccacaucccgggagagaga

SEQ ID NO: 774305 - RNA, 19 nt, Homo sapiens
ugaugaaguuaaugggauu

SEQ ID NO: 774306 - RNA, 19 nt, Homo sapiens
gaaagaaagaagagaugag

SEQ ID NO: 774307 - RNA, 19 nt, Homo sapiens
agaaagaagagaugaggaa

SEQ ID NO: 774308 - RNA, 19 nt, Homo sapiens
gaaacaaagagcaaagaac

SEQ ID NO: 774309 - RNA, 19 nt, Homo sapiens
gcagauuacugaggaagac

SEQ ID NO: 774310 - RNA, 19 nt, Homo sapiens
acuacuugguuguaucaua

SEQ ID NO: 774311 - RNA, 19 nt, Homo sapiens
gagaucagaauauguaugc

SEQ ID NO: 774312 - RNA, 19 nt, Homo sapiens
guucuuucuuuaacccuuu

SEQ ID NO: 774313 - RNA, 19 nt, Homo sapiens
caguucuccuuucuuguaa

SEQ ID NO: 774314 - RNA, 19 nt, Homo sapiens
ggaucucaguucuccuuuc

SEQ ID NO: 774315 - RNA, 19 nt, Homo sapiens
aaugggauuugccuccuuu

SEQ ID NO: 774316 - RNA, 19 nt, Homo sapiens
uaacuacuugguuguauca

SEQ ID NO: 774317 - RNA, 19 nt, Homo sapiens
uaaaagcguuacaugcaaa

SEQ ID NO: 774318 - RNA, 19 nt, Homo sapiens
guaucuugauuguuaguag

SEQ ID NO: 774319 - RNA, 19 nt, Homo sapiens
guggaagcaguauauguuu

SEQ ID NO: 774320 - RNA, 19 nt, Homo sapiens
guacaugaaucgaaaaggu

SEQ ID NO: 774321 - RNA, 19 nt, Homo sapiens
aagaacggcagauuacuga

SEQ ID NO: 774322 - RNA, 19 nt, Homo sapiens
guuaucuacucccagaaau

SEQ ID NO: 774323 - RNA, 19 nt, Homo sapiens
ugaaagaaagaagagauga

SEQ ID NO: 774324 - RNA, 19 nt, Homo sapiens
gagagagaucggagaagga

SEQ ID NO: 774325 - RNA, 19 nt, Homo sapiens
agcaaagaacggcagauua

SEQ ID NO: 774326 - RNA, 19 nt, Homo sapiens
agaggaagaaauagaaaug

SEQ ID NO: 774327 - RNA, 19 nt, Homo sapiens
uguggaagcaguauauguu

SEQ ID NO: 774328 - RNA, 19 nt, Homo sapiens
cucaacagaagaaagguua

SEQ ID NO: 774329 - RNA, 19 nt, Homo sapiens
uaccuugccucaacagaag

SEQ ID NO: 774330 - RNA, 19 nt, Homo sapiens
uugaaguguugaaggauga

SEQ ID NO: 774331 - RNA, 19 nt, Homo sapiens
agaaacaaagagcaaagaa

SEQ ID NO: 774332 - RNA, 19 nt, Homo sapiens
gaguggauuuuguauuuug

SEQ ID NO: 774333 - RNA, 19 nt, Homo sapiens
ccaugacuugccauuauaa

SEQ ID NO: 774334 - RNA, 19 nt, Homo sapiens
ccaccuaugagaucagaau

SEQ ID NO: 774335 - RNA, 19 nt, Homo sapiens
guucucuccgcaaguauaa

SEQ ID NO: 774336 - RNA, 19 nt, Homo sapiens
gguucucuccgcaaguaua

SEQ ID NO: 774337 - RNA, 19 nt, Homo sapiens
aaagaacggcagauuacug

SEQ ID NO: 774338 - RNA, 19 nt, Homo sapiens
ggaaacuuagcuuuuagua

SEQ ID NO: 774339 - RNA, 19 nt, Homo sapiens
guugaucccaccuaugaga

SEQ ID NO: 774340 - RNA, 19 nt, Homo sapiens
caaaagaaacaaagagcaa

SEQ ID NO: 774341 - RNA, 19 nt, Homo sapiens
ggauucaacagaccuuugg

SEQ ID NO: 774342 - RNA, 19 nt, Homo sapiens
uaaugggauuugccuccuu

SEQ ID NO: 774343 - RNA, 19 nt, Homo sapiens
gagaugaggaaaagaaaga

SEQ ID NO: 774344 - RNA, 19 nt, Homo sapiens
uuacugaggaagacuuaga

SEQ ID NO: 774345 - RNA, 19 nt, Homo sapiens
gcucauuaggacuucuuaa

SEQ ID NO: 774346 - RNA, 19 nt, Homo sapiens
gguggauggcucuguaaau

SEQ ID NO: 774347 - RNA, 19 nt, Homo sapiens
uuucuccuauguacuguga

SEQ ID NO: 774348 - RNA, 19 nt, Homo sapiens
uuaucuacucccagaaaua

SEQ ID NO: 774349 - RNA, 19 nt, Homo sapiens
gcaaaacagaggaagaaau

SEQ ID NO: 774350 - RNA, 19 nt, Homo sapiens
cucauuaggacuucuuaaa

SEQ ID NO: 774351 - RNA, 19 nt, Homo sapiens
cgucaaccccauuuuauuu

SEQ ID NO: 774352 - RNA, 19 nt, Homo sapiens
gggaagcgggacuccaaau

SEQ ID NO: 774353 - RNA, 19 nt, Homo sapiens
cagaggaagaaauagaaau

SEQ ID NO: 774354 - RNA, 19 nt, Homo sapiens
aaagaaacaaagagcaaag

SEQ ID NO: 774355 - RNA, 19 nt, Homo sapiens
acagaggaagaaauagaaa

SEQ ID NO: 774356 - RNA, 19 nt, Homo sapiens
cgacugaaagaaagaagag

SEQ ID NO: 774357 - RNA, 19 nt, Homo sapiens
gaugaaguuaaugggauuu

SEQ ID NO: 774358 - RNA, 19 nt, Homo sapiens
ggaagacuuagagggcaaa

SEQ ID NO: 774359 - RNA, 19 nt, Homo sapiens
ccaggcuucuuuggguuga

SEQ ID NO: 774360 - RNA, 19 nt, Homo sapiens
uuaccuugccucaacagaa

SEQ ID NO: 774361 - RNA, 19 nt, Homo sapiens
gaacaccucuggcuuguag

SEQ ID NO: 774362 - RNA, 19 nt, Homo sapiens
gcagaagccuccuauaaca

SEQ ID NO: 774363 - RNA, 19 nt, Homo sapiens
gaacgugagccucggauuu

SEQ ID NO: 774364 - RNA, 19 nt, Homo sapiens
gggcagggcuagcgcuuaa

SEQ ID NO: 774365 - RNA, 19 nt, Homo sapiens
gaggagaugcuggauguua

SEQ ID NO: 774366 - RNA, 19 nt, Homo sapiens
gaaggaagaacgggacaaa

SEQ ID NO: 774367 - RNA, 19 nt, Homo sapiens
gggcagggccuaacaagga

SEQ ID NO: 774368 - RNA, 19 nt, Homo sapiens
ggaggaagcaguguuucua

SEQ ID NO: 774369 - RNA, 19 nt, Homo sapiens
gcagcagggugugugcaua

SEQ ID NO: 774370 - RNA, 19 nt, Homo sapiens
ggaagaacgggacaaagga

SEQ ID NO: 774371 - RNA, 19 nt, Homo sapiens
ucuuugaacugaucuuuga

SEQ ID NO: 774372 - RNA, 19 nt, Homo sapiens
ccgaggagaugcuggaugu

SEQ ID NO: 774373 - RNA, 19 nt, Homo sapiens
cagaagccacugccaauga

SEQ ID NO: 774374 - RNA, 19 nt, Homo sapiens
ggagaugcuggauguuaaa

SEQ ID NO: 774375 - RNA, 19 nt, Homo sapiens
gguaacagaaugccaggaa

SEQ ID NO: 774376 - RNA, 19 nt, Homo sapiens
aggagaugcuggauguuaa

SEQ ID NO: 774377 - RNA, 19 nt, Homo sapiens
gggaacaccucuggcuugu

SEQ ID NO: 774378 - RNA, 19 nt, Homo sapiens
ggcagggccuaacaaggaa

SEQ ID NO: 774379 - RNA, 19 nt, Homo sapiens
agaagccuccuauaacaaa

SEQ ID NO: 774380 - RNA, 19 nt, Homo sapiens
gaagcugguguucuuugaa

SEQ ID NO: 774381 - RNA, 19 nt, Homo sapiens
gcagggugugugcauauga

SEQ ID NO: 774382 - RNA, 19 nt, Homo sapiens
gaugcuggauguuaaaaug

SEQ ID NO: 774383 - RNA, 19 nt, Homo sapiens
gaagccuccuauaacaaag

SEQ ID NO: 774384 - RNA, 19 nt, Homo sapiens
ggcagaagccuccuauaac

SEQ ID NO: 774385 - RNA, 19 nt, Homo sapiens
aaacgggagugugcaguca

SEQ ID NO: 774386 - RNA, 19 nt, Homo sapiens
ugaguucacguuccuguug

SEQ ID NO: 774387 - RNA, 19 nt, Homo sapiens
cagaagccuccuauaacaa

SEQ ID NO: 774388 - RNA, 19 nt, Homo sapiens
cuacuguaaaugugccuua

SEQ ID NO: 774389 - RNA, 19 nt, Homo sapiens
ggaagcaguguuucuacca

SEQ ID NO: 774390 - RNA, 19 nt, Homo sapiens
cgacgguccuggaaaucuc

SEQ ID NO: 774391 - RNA, 19 nt, Homo sapiens
aaauggaggacaucaagga

SEQ ID NO: 774392 - RNA, 19 nt, Homo sapiens
ggaaaccugggcccuccaa

SEQ ID NO: 774393 - RNA, 19 nt, Homo sapiens
cagcagggugugugcauau

SEQ ID NO: 774394 - RNA, 19 nt, Homo sapiens
uuacggacaacauacagaa

SEQ ID NO: 774395 - RNA, 19 nt, Homo sapiens
ggacuggacguggacuuca

SEQ ID NO: 774396 - RNA, 19 nt, Homo sapiens
ggccaaagucuaggcagaa

SEQ ID NO: 774397 - RNA, 19 nt, Homo sapiens
agccucccauccuguguua

SEQ ID NO: 774398 - RNA, 19 nt, Homo sapiens
ggaacaccucuggcuugua

SEQ ID NO: 774399 - RNA, 19 nt, Homo sapiens
gcagggcuagcgcuuaaag

SEQ ID NO: 774400 - RNA, 19 nt, Homo sapiens
ugacgaggaggucgaagga

SEQ ID NO: 774401 - RNA, 19 nt, Homo sapiens
uugacagccuccaggauga

SEQ ID NO: 774402 - RNA, 19 nt, Homo sapiens
gccaaagucuaggcagaag

SEQ ID NO: 774403 - RNA, 19 nt, Homo sapiens
ggaacgugagccucggauu

SEQ ID NO: 774404 - RNA, 19 nt, Homo sapiens
agaagccacugccaaugag

SEQ ID NO: 774405 - RNA, 19 nt, Homo sapiens
gaggaagcaguguuucuac

SEQ ID NO: 774406 - RNA, 19 nt, Homo sapiens
caaugagcuccgccgagua

SEQ ID NO: 774407 - RNA, 19 nt, Homo sapiens
gacaucaaggaguccauug

SEQ ID NO: 774408 - RNA, 19 nt, Homo sapiens
uacagaagccacugccaau

SEQ ID NO: 774409 - RNA, 19 nt, Homo sapiens
ggaaggaagaacgggacaa

SEQ ID NO: 774410 - RNA, 19 nt, Homo sapiens
cggaaaugcuggauaaauu

SEQ ID NO: 774411 - RNA, 19 nt, Homo sapiens
agaauuaccucugcucuuu

SEQ ID NO: 774412 - RNA, 19 nt, Homo sapiens
ggagagucccaaugucuua

SEQ ID NO: 774413 - RNA, 19 nt, Homo sapiens
ggaaaugcuggauaaauug

SEQ ID NO: 774414 - RNA, 19 nt, Homo sapiens
ucuaugaugugaccaauga

SEQ ID NO: 774415 - RNA, 19 nt, Homo sapiens
gaauggauuugguggugaa

SEQ ID NO: 774416 - RNA, 19 nt, Homo sapiens
caacaggaauggauuuggu

SEQ ID NO: 774417 - RNA, 19 nt, Homo sapiens
aaacauccgugaaagagau

SEQ ID NO: 774418 - RNA, 19 nt, Homo sapiens
ugaaagagauggaaaacuu

SEQ ID NO: 774419 - RNA, 19 nt, Homo sapiens
ucuuaugucucgucuauga

SEQ ID NO: 774420 - RNA, 19 nt, Homo sapiens
ugucuuaugucucgucuau

SEQ ID NO: 774421 - RNA, 19 nt, Homo sapiens
gaaaugcuggauaaauugu

SEQ ID NO: 774422 - RNA, 19 nt, Homo sapiens
gggagaagguggagguuuu

SEQ ID NO: 774423 - RNA, 19 nt, Homo sapiens
gaaacauccgugaaagaga

SEQ ID NO: 774424 - RNA, 19 nt, Homo sapiens
ccucugcucuuuuaauaua

SEQ ID NO: 774425 - RNA, 19 nt, Homo sapiens
ccacugacccuugagauca

SEQ ID NO: 774426 - RNA, 19 nt, Homo sapiens
ugacaacaggaauggauuu

SEQ ID NO: 774427 - RNA, 19 nt, Homo sapiens
gagacaguguggaacucuu

SEQ ID NO: 774428 - RNA, 19 nt, Homo sapiens
guguggaacucuucauuuu

SEQ ID NO: 774429 - RNA, 19 nt, Homo sapiens
ggagaagacagaauuaccu

SEQ ID NO: 774430 - RNA, 19 nt, Homo sapiens
aagaauccuucaacaacug

SEQ ID NO: 774431 - RNA, 19 nt, Homo sapiens
gugaagacagugccaguuc

SEQ ID NO: 774432 - RNA, 19 nt, Homo sapiens
uaccucugcucuuuuaaua

SEQ ID NO: 774433 - RNA, 19 nt, Homo sapiens
gagucccaaugucuuaugu

SEQ ID NO: 774434 - RNA, 19 nt, Homo sapiens
ugaaacauccgugaaagag

SEQ ID NO: 774435 - RNA, 19 nt, Homo sapiens
aauuaccucugcucuuuua

SEQ ID NO: 774436 - RNA, 19 nt, Homo sapiens
ugaugugaccaaugaagaa

SEQ ID NO: 774437 - RNA, 19 nt, Homo sapiens
gacaacaggaauggauuug

SEQ ID NO: 774438 - RNA, 19 nt, Homo sapiens
agaccgcccuggcacagau

SEQ ID NO: 774439 - RNA, 19 nt, Homo sapiens
uccgcucgcuugcaccuuu

SEQ ID NO: 774440 - RNA, 19 nt, Homo sapiens
gaugugaccaaugaagaau

SEQ ID NO: 774441 - RNA, 19 nt, Homo sapiens
aaccggagaagacagaauu

SEQ ID NO: 774442 - RNA, 19 nt, Homo sapiens
ggccuggaauguuuugaaa

SEQ ID NO: 774443 - RNA, 19 nt, Homo sapiens
gucccaaugucuuaugucu

SEQ ID NO: 774444 - RNA, 19 nt, Homo sapiens
gaucuuccgcagugaugga

SEQ ID NO: 774445 - RNA, 19 nt, Homo sapiens
uucaacaacugcagcaagu

SEQ ID NO: 774446 - RNA, 19 nt, Homo sapiens
ggaucguccuuccuugaac

SEQ ID NO: 774447 - RNA, 19 nt, Homo sapiens
augacgagcuggagcagau

SEQ ID NO: 774448 - RNA, 19 nt, Homo sapiens
gaaaagcuacacccugaca

SEQ ID NO: 774449 - RNA, 19 nt, Homo sapiens
gguucaagcugccaaauuu

SEQ ID NO: 774450 - RNA, 19 nt, Homo sapiens
ggacaggccuucacuuugg

SEQ ID NO: 774451 - RNA, 19 nt, Homo sapiens
gaugaugugugccgaauau

SEQ ID NO: 774452 - RNA, 19 nt, Homo sapiens
ccacuuguguccacuguuu

SEQ ID NO: 774453 - RNA, 19 nt, Homo sapiens
ggaagaugccuacaaauuc

SEQ ID NO: 774454 - RNA, 19 nt, Homo sapiens
gacggaagaugccuacaaa

SEQ ID NO: 774455 - RNA, 19 nt, Homo sapiens
ugaaauuccugucaaacaa

SEQ ID NO: 774456 - RNA, 19 nt, Homo sapiens
gaagaacaguaaacgaaag

SEQ ID NO: 774457 - RNA, 19 nt, Homo sapiens
gaagaugccuacaaauucg

SEQ ID NO: 774458 - RNA, 19 nt, Homo sapiens
gaagccaaaucaagugaau

SEQ ID NO: 774459 - RNA, 19 nt, Homo sapiens
gaaagaaacgcugcugcua

SEQ ID NO: 774460 - RNA, 19 nt, Homo sapiens
gaacaguaaacgaaagaaa

SEQ ID NO: 774461 - RNA, 19 nt, Homo sapiens
gaaauuccugucaaacaaa

SEQ ID NO: 774462 - RNA, 19 nt, Homo sapiens
aaagaauucucuccauguu

SEQ ID NO: 774463 - RNA, 19 nt, Homo sapiens
gaugugaaauuccugucaa

SEQ ID NO: 774464 - RNA, 19 nt, Homo sapiens
ggauguguuuccuuagauu

SEQ ID NO: 774465 - RNA, 19 nt, Homo sapiens
gcaaauucaagcaauaaga

SEQ ID NO: 774466 - RNA, 19 nt, Homo sapiens
ggacuacgaccaccucuuc

SEQ ID NO: 774467 - RNA, 19 nt, Homo sapiens
aaagguagcaagaggauuu

SEQ ID NO: 774468 - RNA, 19 nt, Homo sapiens
uggaagagauguucaacug

SEQ ID NO: 774469 - RNA, 19 nt, Homo sapiens
aagaaacgcugcugcuaau

SEQ ID NO: 774470 - RNA, 19 nt, Homo sapiens
aaagaaacgcugcugcuaa

SEQ ID NO: 774471 - RNA, 19 nt, Homo sapiens
uaguggaccugaugugaaa

SEQ ID NO: 774472 - RNA, 19 nt, Homo sapiens
cggaagaugccuacaaauu

SEQ ID NO: 774473 - RNA, 19 nt, Homo sapiens
gcagcuacaucaccacgau

SEQ ID NO: 774474 - RNA, 19 nt, Homo sapiens
ccagaacugugaugaugug

SEQ ID NO: 774475 - RNA, 19 nt, Homo sapiens
gcgagggugugcuugcaaa

SEQ ID NO: 774476 - RNA, 19 nt, Homo sapiens
acaaucacaucacagauca

SEQ ID NO: 774477 - RNA, 19 nt, Homo sapiens
ugaugugugccgaauauua

SEQ ID NO: 774478 - RNA, 19 nt, Homo sapiens
caacagguuucaguuccaa

SEQ ID NO: 774479 - RNA, 19 nt, Homo sapiens
cgaagaacaguaaacgaaa

SEQ ID NO: 774480 - RNA, 19 nt, Homo sapiens
cuaggaguauuucuguauu

SEQ ID NO: 774481 - RNA, 19 nt, Homo sapiens
cacugcaguuuccauguua

SEQ ID NO: 774482 - RNA, 19 nt, Homo sapiens
acacugcaguuuccauguu

SEQ ID NO: 774483 - RNA, 19 nt, Homo sapiens
agccaaaucaagugaauua

SEQ ID NO: 774484 - RNA, 19 nt, Homo sapiens
uaaagaauucucuccaugu

SEQ ID NO: 774485 - RNA, 19 nt, Homo sapiens
gcuaggaguauuucuguau

SEQ ID NO: 774486 - RNA, 19 nt, Homo sapiens
gaaacgcugcugcuaaugg

SEQ ID NO: 774487 - RNA, 19 nt, Homo sapiens
caagugaccugggaagaac

SEQ ID NO: 774488 - RNA, 19 nt, Homo sapiens
gaacaaccagggucaucug

SEQ ID NO: 774489 - RNA, 19 nt, Homo sapiens
cauaguguauauugcucua

SEQ ID NO: 774490 - RNA, 19 nt, Homo sapiens
gccguuauuuaaagaauuc

SEQ ID NO: 774491 - RNA, 19 nt, Homo sapiens
gaugugugccgaauauuag

SEQ ID NO: 774492 - RNA, 19 nt, Homo sapiens
aaccagaacugugaugaug

SEQ ID NO: 774493 - RNA, 19 nt, Homo sapiens
uaggaguauuucuguauug

SEQ ID NO: 774494 - RNA, 19 nt, Homo sapiens
cggaguggauuucaagauc

SEQ ID NO: 774495 - RNA, 19 nt, Homo sapiens
ccuuagauuuccuuuccua

SEQ ID NO: 774496 - RNA, 19 nt, Homo sapiens
ucaagaaaaugaagccaaa

SEQ ID NO: 774497 - RNA, 19 nt, Homo sapiens
gguuucaguuccaacagaa

SEQ ID NO: 774498 - RNA, 19 nt, Homo sapiens
agaauucucuccauguuuu

SEQ ID NO: 774499 - RNA, 19 nt, Homo sapiens
gggacaggccuucacuuug

SEQ ID NO: 774500 - RNA, 19 nt, Homo sapiens
gccaaaagcuggugauucu

SEQ ID NO: 774501 - RNA, 19 nt, Homo sapiens
gacaaucacaucacagauc

SEQ ID NO: 774502 - RNA, 19 nt, Homo sapiens
gagcugguccuccgagcaa

SEQ ID NO: 774503 - RNA, 19 nt, Homo sapiens
ucacuguccuaaccuuugu

SEQ ID NO: 774504 - RNA, 19 nt, Homo sapiens
guagguucgugcagagaug

SEQ ID NO: 774505 - RNA, 19 nt, Homo sapiens
ucaguuucgugccguuauu

SEQ ID NO: 774506 - RNA, 19 nt, Homo sapiens
agaaagacaaccuggcaaa

SEQ ID NO: 774507 - RNA, 19 nt, Homo sapiens
caaauucaagcaauaagag

SEQ ID NO: 774508 - RNA, 19 nt, Homo sapiens
ggcuaugggaggauuauuu

SEQ ID NO: 774509 - RNA, 19 nt, Homo sapiens
ggagacagcggcacguucu

SEQ ID NO: 774510 - RNA, 19 nt, Homo sapiens
gauguguuuccuuagauuu

SEQ ID NO: 774511 - RNA, 19 nt, Homo sapiens
gcaccaucaccuccacgua

SEQ ID NO: 774512 - RNA, 19 nt, Homo sapiens
gugaaauuccugucaaaca

SEQ ID NO: 774513 - RNA, 19 nt, Homo sapiens
ucaagugaccugggaagaa

SEQ ID NO: 774514 - RNA, 19 nt, Homo sapiens
gaucggaguggauuucaag

SEQ ID NO: 774515 - RNA, 19 nt, Homo sapiens
gacaggccuucacuuugga

SEQ ID NO: 774516 - RNA, 19 nt, Homo sapiens
aaaugaagccaaaucaagu

SEQ ID NO: 774517 - RNA, 19 nt, Homo sapiens
acgaagaacaguaaacgaa

SEQ ID NO: 774518 - RNA, 19 nt, Homo sapiens
ggaguauuucuguauugaa

SEQ ID NO: 774519 - RNA, 19 nt, Homo sapiens
gagggugugcuugcaaauu

SEQ ID NO: 774520 - RNA, 19 nt, Homo sapiens
gaaaaugaagccaaaucaa

SEQ ID NO: 774521 - RNA, 19 nt, Homo sapiens
gaccugaugugaaauuccu

SEQ ID NO: 774522 - RNA, 19 nt, Homo sapiens
agggugugcuugcaaauuc

SEQ ID NO: 774523 - RNA, 19 nt, Homo sapiens
ugggacaggccuucacuuu

SEQ ID NO: 774524 - RNA, 19 nt, Homo sapiens
ggacaaucacaucacagau

SEQ ID NO: 774525 - RNA, 19 nt, Homo sapiens
ggaggauuauuuuaacaga

SEQ ID NO: 774526 - RNA, 19 nt, Homo sapiens
caacguggaagagauguuc

SEQ ID NO: 774527 - RNA, 19 nt, Homo sapiens
ggagaaugucaacguggaa

SEQ ID NO: 774528 - RNA, 19 nt, Homo sapiens
cgaaaucaaccagaacugu

SEQ ID NO: 774529 - RNA, 19 nt, Homo sapiens
ccaucaccuccacguauua

SEQ ID NO: 774530 - RNA, 19 nt, Homo sapiens
caccaucaccuccacguau

SEQ ID NO: 774531 - RNA, 19 nt, Homo sapiens
ccaaggagaaugucaacgu

SEQ ID NO: 774532 - RNA, 19 nt, Homo sapiens
aaaucaaccagaacuguga

SEQ ID NO: 774533 - RNA, 19 nt, Homo sapiens
gcuggacucuugggcuuuc

SEQ ID NO: 774534 - RNA, 19 nt, Homo sapiens
gcgguggcuucacgaaauc

SEQ ID NO: 774535 - RNA, 19 nt, Homo sapiens
aggaguauuucuguauuga

SEQ ID NO: 774536 - RNA, 19 nt, Homo sapiens
acagaucacacugcaguuu

SEQ ID NO: 774537 - RNA, 19 nt, Homo sapiens
ucauuuacaccaacagguu

SEQ ID NO: 774538 - RNA, 19 nt, Homo sapiens
acagaacgauguggugaag

SEQ ID NO: 774539 - RNA, 19 nt, Homo sapiens
gugaugaugugugccgaau

SEQ ID NO: 774540 - RNA, 19 nt, Homo sapiens
gagaacaaccagggucauc

SEQ ID NO: 774541 - RNA, 19 nt, Homo sapiens
ggucacuguccuaaccuuu

SEQ ID NO: 774542 - RNA, 19 nt, Homo sapiens
gcaacaacagaacgaugug

SEQ ID NO: 774543 - RNA, 19 nt, Homo sapiens
gagcaaagaaagacaaccu

SEQ ID NO: 774544 - RNA, 19 nt, Homo sapiens
caaccagaacugugaugau

SEQ ID NO: 774545 - RNA, 19 nt, Homo sapiens
ggacucuugggcuuucuug

SEQ ID NO: 774546 - RNA, 19 nt, Homo sapiens
caaaacagcagcagcaaca

SEQ ID NO: 774547 - RNA, 19 nt, Homo sapiens
gaaagacaaccuggcaaaa

SEQ ID NO: 774548 - RNA, 19 nt, Homo sapiens
gaccagcgccaaggagaau

SEQ ID NO: 774549 - RNA, 19 nt, Homo sapiens
ggccaaagaucuacuuaua

SEQ ID NO: 774550 - RNA, 19 nt, Homo sapiens
ggauauaagucaaagagua

SEQ ID NO: 774551 - RNA, 19 nt, Homo sapiens
gaagggacauuacuacuau

SEQ ID NO: 774552 - RNA, 19 nt, Homo sapiens
ggaagaaacuugauauugg

SEQ ID NO: 774553 - RNA, 19 nt, Homo sapiens
gcaaggagccaauauuaaa

SEQ ID NO: 774554 - RNA, 19 nt, Homo sapiens
ccaaagaucuacuuauaug

SEQ ID NO: 774555 - RNA, 19 nt, Homo sapiens
uggauaagcuugucaauga

SEQ ID NO: 774556 - RNA, 19 nt, Homo sapiens
gagaagagcggcugacauu

SEQ ID NO: 774557 - RNA, 19 nt, Homo sapiens
gaugacagcuuucagaagu

SEQ ID NO: 774558 - RNA, 19 nt, Homo sapiens
gaacggacuucuuggacaa

SEQ ID NO: 774559 - RNA, 19 nt, Homo sapiens
gagguucccugauauaaau

SEQ ID NO: 774560 - RNA, 19 nt, Homo sapiens
gaagagcggcugacauuug

SEQ ID NO: 774561 - RNA, 19 nt, Homo sapiens
uagggaaccuuuacucuuu

SEQ ID NO: 774562 - RNA, 19 nt, Homo sapiens
ccuugaagaugacuacuua

SEQ ID NO: 774563 - RNA, 19 nt, Homo sapiens
gcaaacagccaaucagugu

SEQ ID NO: 774564 - RNA, 19 nt, Homo sapiens
caccucaacugaaauauau

SEQ ID NO: 774565 - RNA, 19 nt, Homo sapiens
ggacauggccacagaaaca

SEQ ID NO: 774566 - RNA, 19 nt, Homo sapiens
gccaagaucucuagcuaug

SEQ ID NO: 774567 - RNA, 19 nt, Homo sapiens
gaagagaagacaugacaga

SEQ ID NO: 774568 - RNA, 19 nt, Homo sapiens
gcaccucaacugaaauaua

SEQ ID NO: 774569 - RNA, 19 nt, Homo sapiens
cgacauggcugugguagug

SEQ ID NO: 774570 - RNA, 19 nt, Homo sapiens
ggacauuacuacuaucaag

SEQ ID NO: 774571 - RNA, 19 nt, Homo sapiens
uauagcaccucaacugaaa

SEQ ID NO: 774572 - RNA, 19 nt, Homo sapiens
ggaagaugacauugagaua

SEQ ID NO: 774573 - RNA, 19 nt, Homo sapiens
caacuuggccaaagaucua

SEQ ID NO: 774574 - RNA, 19 nt, Homo sapiens
ggauggagaccgaaggaua

SEQ ID NO: 774575 - RNA, 19 nt, Homo sapiens
uaaggcaucuggagccaaa

SEQ ID NO: 774576 - RNA, 19 nt, Homo sapiens
agacugggaucucaacuug

SEQ ID NO: 774577 - RNA, 19 nt, Homo sapiens
ggagaaaccuagugaugac

SEQ ID NO: 774578 - RNA, 19 nt, Homo sapiens
gaugagcgagugcugcuua

SEQ ID NO: 774579 - RNA, 19 nt, Homo sapiens
cggcaaggagccaauauua

SEQ ID NO: 774580 - RNA, 19 nt, Homo sapiens
ugaaggacauggccacaga

SEQ ID NO: 774581 - RNA, 19 nt, Homo sapiens
gggaagaaacuugauauug

SEQ ID NO: 774582 - RNA, 19 nt, Homo sapiens
gaacuuggaccucuauuuu

SEQ ID NO: 774583 - RNA, 19 nt, Homo sapiens
cuuuagagguucccugaua

SEQ ID NO: 774584 - RNA, 19 nt, Homo sapiens
gcaaugggaagaaacuuga

SEQ ID NO: 774585 - RNA, 19 nt, Homo sapiens
acaauucguucuaucugua

SEQ ID NO: 774586 - RNA, 19 nt, Homo sapiens
gaugauaaccuugaagaug

SEQ ID NO: 774587 - RNA, 19 nt, Homo sapiens
gagaagagaagacaugaca

SEQ ID NO: 774588 - RNA, 19 nt, Homo sapiens
acacaaaggauacgcaauu

SEQ ID NO: 774589 - RNA, 19 nt, Homo sapiens
caagaucucuagcuauguc

SEQ ID NO: 774590 - RNA, 19 nt, Homo sapiens
gagaugcccauguuugaaa

SEQ ID NO: 774591 - RNA, 19 nt, Homo sapiens
gcaguuuguuacuauguau

SEQ ID NO: 774592 - RNA, 19 nt, Homo sapiens
agacuugacugugcaugua

SEQ ID NO: 774593 - RNA, 19 nt, Homo sapiens
uuaaacagcugcggaaaca

SEQ ID NO: 774594 - RNA, 19 nt, Homo sapiens
augauaaccuugaagauga

SEQ ID NO: 774595 - RNA, 19 nt, Homo sapiens
ggaacuuggaccucuauuu

SEQ ID NO: 774596 - RNA, 19 nt, Homo sapiens
aagaugacauugagauaga

SEQ ID NO: 774597 - RNA, 19 nt, Homo sapiens
gaagaugacauugagauag

SEQ ID NO: 774598 - RNA, 19 nt, Homo sapiens
cuacaaaugguuccuggua

SEQ ID NO: 774599 - RNA, 19 nt, Homo sapiens
cauuguagcagcaccuuua

SEQ ID NO: 774600 - RNA, 19 nt, Homo sapiens
gacaauucguucuaucugu

SEQ ID NO: 774601 - RNA, 19 nt, Homo sapiens
gggagaaaccuagugauga

SEQ ID NO: 774602 - RNA, 19 nt, Homo sapiens
caaaggaggaggcgacaug

SEQ ID NO: 774603 - RNA, 19 nt, Homo sapiens
acagacaggugcucggauu

SEQ ID NO: 774604 - RNA, 19 nt, Homo sapiens
ugauauugggcuagaauua

SEQ ID NO: 774605 - RNA, 19 nt, Homo sapiens
gaucucaacuuggccaaag

SEQ ID NO: 774606 - RNA, 19 nt, Homo sapiens
gauggagaccgaaggauau

SEQ ID NO: 774607 - RNA, 19 nt, Homo sapiens
ggcaaggagccaauauuaa

SEQ ID NO: 774608 - RNA, 19 nt, Homo sapiens
agaauagugugccugaaga

SEQ ID NO: 774609 - RNA, 19 nt, Homo sapiens
cuacugaacggacuucuug

SEQ ID NO: 774610 - RNA, 19 nt, Homo sapiens
gcugugaaacucaucauug

SEQ ID NO: 774611 - RNA, 19 nt, Homo sapiens
cacaaaggauacgcaauug

SEQ ID NO: 774612 - RNA, 19 nt, Homo sapiens
gcaauuggauaagcuuguc

SEQ ID NO: 774613 - RNA, 19 nt, Homo sapiens
gcgagacaauucguucuau

SEQ ID NO: 774614 - RNA, 19 nt, Homo sapiens
gaccgaaggauauaaguca

SEQ ID NO: 774615 - RNA, 19 nt, Homo sapiens
uugauagacucacucauug

SEQ ID NO: 774616 - RNA, 19 nt, Homo sapiens
gcagcaccuuuaccuacaa

SEQ ID NO: 774617 - RNA, 19 nt, Homo sapiens
ccagagaugcccauguuug

SEQ ID NO: 774618 - RNA, 19 nt, Homo sapiens
ucccagagaugcccauguu

SEQ ID NO: 774619 - RNA, 19 nt, Homo sapiens
gagcgagugcugcuuauca

SEQ ID NO: 774620 - RNA, 19 nt, Homo sapiens
guagggaaccuuuacucuu

SEQ ID NO: 774621 - RNA, 19 nt, Homo sapiens
caucugcuuugcuguaugu

SEQ ID NO: 774622 - RNA, 19 nt, Homo sapiens
gagaugacccagcacuaug

SEQ ID NO: 774623 - RNA, 19 nt, Homo sapiens
ucugauggguucuuuguca

SEQ ID NO: 774624 - RNA, 19 nt, Homo sapiens
gcuagaauuaguacacaaa

SEQ ID NO: 774625 - RNA, 19 nt, Homo sapiens
ggaagaggaagcuuuggau

SEQ ID NO: 774626 - RNA, 19 nt, Homo sapiens
gagaauagugugccugaag

SEQ ID NO: 774627 - RNA, 19 nt, Homo sapiens
cagagaugcccauguuuga

SEQ ID NO: 774628 - RNA, 19 nt, Homo sapiens
aaacagccaaucaguguga

SEQ ID NO: 774629 - RNA, 19 nt, Homo sapiens
agaagggacauuacuacua

SEQ ID NO: 774630 - RNA, 19 nt, Homo sapiens
gagccaaaauuaccuguga

SEQ ID NO: 774631 - RNA, 19 nt, Homo sapiens
gauggguucuuugucauuc

SEQ ID NO: 774632 - RNA, 19 nt, Homo sapiens
caaaggauacgcaauugag

SEQ ID NO: 774633 - RNA, 19 nt, Homo sapiens
gccaaagaucuacuuauau

SEQ ID NO: 774634 - RNA, 19 nt, Homo sapiens
gagauugcccacugaagga

SEQ ID NO: 774635 - RNA, 19 nt, Homo sapiens
aaacagcugcggaaacaga

SEQ ID NO: 774636 - RNA, 19 nt, Homo sapiens
gauauaagucaaagaguac

SEQ ID NO: 774637 - RNA, 19 nt, Homo sapiens
ucccagacauguugaagga

SEQ ID NO: 774638 - RNA, 19 nt, Homo sapiens
gauagacucacucauugug

SEQ ID NO: 774639 - RNA, 19 nt, Homo sapiens
ucagggcucucaggaguga

SEQ ID NO: 774640 - RNA, 19 nt, Homo sapiens
acaaaugguuccugguauc

SEQ ID NO: 774641 - RNA, 19 nt, Homo sapiens
gauaagcuugucaaugaga

SEQ ID NO: 774642 - RNA, 19 nt, Homo sapiens
agaaucagaagggacauua

SEQ ID NO: 774643 - RNA, 19 nt, Homo sapiens
uagcaccucaacugaaaua

SEQ ID NO: 774644 - RNA, 19 nt, Homo sapiens
agggaaccuuuacucuuua

SEQ ID NO: 774645 - RNA, 19 nt, Homo sapiens
gauauugggcuagaauuag

SEQ ID NO: 774646 - RNA, 19 nt, Homo sapiens
gcaccuuuaccuacaaaug

SEQ ID NO: 774647 - RNA, 19 nt, Homo sapiens
uagugugccugaagacuug

SEQ ID NO: 774648 - RNA, 19 nt, Homo sapiens
aagagcggcugacauuugu

SEQ ID NO: 774649 - RNA, 19 nt, Homo sapiens
gacaggagccuacaucaaa

SEQ ID NO: 774650 - RNA, 19 nt, Homo sapiens
gaaggaccauuaacaugug

SEQ ID NO: 774651 - RNA, 19 nt, Homo sapiens
gauguuaucuggacugucu

SEQ ID NO: 774652 - RNA, 19 nt, Homo sapiens
ucagaucaauacacgaaua

SEQ ID NO: 774653 - RNA, 19 nt, Homo sapiens
gaacgugacccuccauugu

SEQ ID NO: 774654 - RNA, 19 nt, Homo sapiens
gcagcuucauucuguguaa

SEQ ID NO: 774655 - RNA, 19 nt, Homo sapiens
gggaacagaucugaugaug

SEQ ID NO: 774656 - RNA, 19 nt, Homo sapiens
gcagccagguccuauagug

SEQ ID NO: 774657 - RNA, 19 nt, Homo sapiens
caauuuagggcugauguua

SEQ ID NO: 774658 - RNA, 19 nt, Homo sapiens
gauuuguucuguauaagga

SEQ ID NO: 774659 - RNA, 19 nt, Homo sapiens
uaccuuuccucucuauuaa

SEQ ID NO: 774660 - RNA, 19 nt, Homo sapiens
acacgaauauccuaaguac

SEQ ID NO: 774661 - RNA, 19 nt, Homo sapiens
gaagaugaacacccacaau

SEQ ID NO: 774662 - RNA, 19 nt, Homo sapiens
gaaaacagcacccuggauu

SEQ ID NO: 774663 - RNA, 19 nt, Homo sapiens
ggaguaccgucuguauaga

SEQ ID NO: 774664 - RNA, 19 nt, Homo sapiens
gaacgugacccugcugugu

SEQ ID NO: 774665 - RNA, 19 nt, Homo sapiens
ggagggagaacgugacuuc

SEQ ID NO: 774666 - RNA, 19 nt, Homo sapiens
guacaggugcuaugcuuau

SEQ ID NO: 774667 - RNA, 19 nt, Homo sapiens
gauccaugaaggaccauua

SEQ ID NO: 774668 - RNA, 19 nt, Homo sapiens
cuaaguaccaggcugaauu

SEQ ID NO: 774669 - RNA, 19 nt, Homo sapiens
cacaaugccugaacucaca

SEQ ID NO: 774670 - RNA, 19 nt, Homo sapiens
uaaggaaggagaagaugaa

SEQ ID NO: 774671 - RNA, 19 nt, Homo sapiens
ugaaggaccauuaacaugu

SEQ ID NO: 774672 - RNA, 19 nt, Homo sapiens
gguccuagguguuucuaag

SEQ ID NO: 774673 - RNA, 19 nt, Homo sapiens
gcauuuggcagcuucauuc

SEQ ID NO: 774674 - RNA, 19 nt, Homo sapiens
ggaccauuaacaugugaua

SEQ ID NO: 774675 - RNA, 19 nt, Homo sapiens
gaacagcagagagaagaau

SEQ ID NO: 774676 - RNA, 19 nt, Homo sapiens
gaggugaacagcagagaga

SEQ ID NO: 774677 - RNA, 19 nt, Homo sapiens
guaaggaaggagaagauga

SEQ ID NO: 774678 - RNA, 19 nt, Homo sapiens
ugugauaccuuuccucucu

SEQ ID NO: 774679 - RNA, 19 nt, Homo sapiens
caggcugaauucccuauga

SEQ ID NO: 774680 - RNA, 19 nt, Homo sapiens
uaagaagccaucacucuca

SEQ ID NO: 774681 - RNA, 19 nt, Homo sapiens
caucaaacccacccucuca

SEQ ID NO: 774682 - RNA, 19 nt, Homo sapiens
auaccuuuccucucuauua

SEQ ID NO: 774683 - RNA, 19 nt, Homo sapiens
ggaacgugacccuccauug

SEQ ID NO: 774684 - RNA, 19 nt, Homo sapiens
gaacacacagggcgguauc

SEQ ID NO: 774685 - RNA, 19 nt, Homo sapiens
gcucagcacagccagagaa

SEQ ID NO: 774686 - RNA, 19 nt, Homo sapiens
acacuuuccuucugaccaa

SEQ ID NO: 774687 - RNA, 19 nt, Homo sapiens
gagggaggaaucaguguug

SEQ ID NO: 774688 - RNA, 19 nt, Homo sapiens
ggaaggagaagaugaacac

SEQ ID NO: 774689 - RNA, 19 nt, Homo sapiens
gacccuccauugugucuca

SEQ ID NO: 774690 - RNA, 19 nt, Homo sapiens
ugacuucccuugguuggau

SEQ ID NO: 774691 - RNA, 19 nt, Homo sapiens
ucaauacacgaauauccua

SEQ ID NO: 774692 - RNA, 19 nt, Homo sapiens
caggaguaccgucuguaua

SEQ ID NO: 774693 - RNA, 19 nt, Homo sapiens
cagcagagagaagaaugua

SEQ ID NO: 774694 - RNA, 19 nt, Homo sapiens
ucucacagguggcauuugg

SEQ ID NO: 774695 - RNA, 19 nt, Homo sapiens
ccucgggauucugcuauuu

SEQ ID NO: 774696 - RNA, 19 nt, Homo sapiens
ccuuuccucucuauuaaug

SEQ ID NO: 774697 - RNA, 19 nt, Homo sapiens
gugauaccuuuccucucua

SEQ ID NO: 774698 - RNA, 19 nt, Homo sapiens
caauacacgaauauccuaa

SEQ ID NO: 774699 - RNA, 19 nt, Homo sapiens
ggaggaaucaguguuggau

SEQ ID NO: 774700 - RNA, 19 nt, Homo sapiens
ucgggauucugcuauuuga

SEQ ID NO: 774701 - RNA, 19 nt, Homo sapiens
uuuggcagcuucauucugu

SEQ ID NO: 774702 - RNA, 19 nt, Homo sapiens
uaccgucuguauagagaaa

SEQ ID NO: 774703 - RNA, 19 nt, Homo sapiens
caugaaggaccauuaacau

SEQ ID NO: 774704 - RNA, 19 nt, Homo sapiens
uaaguaccaggcugaauuc

SEQ ID NO: 774705 - RNA, 19 nt, Homo sapiens
gagccugacccuccagugu

SEQ ID NO: 774706 - RNA, 19 nt, Homo sapiens
ugacaggagccuacaucaa

SEQ ID NO: 774707 - RNA, 19 nt, Homo sapiens
ccaugaaggaccauuaaca

SEQ ID NO: 774708 - RNA, 19 nt, Homo sapiens
gacugucugccaaucauuu

SEQ ID NO: 774709 - RNA, 19 nt, Homo sapiens
ccaggaguaccgucuguau

SEQ ID NO: 774710 - RNA, 19 nt, Homo sapiens
ugauaccuuuccucucuau

SEQ ID NO: 774711 - RNA, 19 nt, Homo sapiens
ggacugucugccaaucauu

SEQ ID NO: 774712 - RNA, 19 nt, Homo sapiens
gugaacagcagagagaaga

SEQ ID NO: 774713 - RNA, 19 nt, Homo sapiens
ucucagaucaauacacgaa

SEQ ID NO: 774714 - RNA, 19 nt, Homo sapiens
guuccacacuuuccuucug

SEQ ID NO: 774715 - RNA, 19 nt, Homo sapiens
uguggucucuacccaguga

SEQ ID NO: 774716 - RNA, 19 nt, Homo sapiens
aagaugaacacccacaaug

SEQ ID NO: 774717 - RNA, 19 nt, Homo sapiens
cagcuacgacagauuuguu

SEQ ID NO: 774718 - RNA, 19 nt, Homo sapiens
gaucaauacacgaauaucc

SEQ ID NO: 774719 - RNA, 19 nt, Homo sapiens
cagaucaauacacgaauau

SEQ ID NO: 774720 - RNA, 19 nt, Homo sapiens
gcaccgagggcucauccau

SEQ ID NO: 774721 - RNA, 19 nt, Homo sapiens
aaacagcacccuggauuac

SEQ ID NO: 774722 - RNA, 19 nt, Homo sapiens
acgaauauccuaaguacca

SEQ ID NO: 774723 - RNA, 19 nt, Homo sapiens
ggagguuccgggagacaau

SEQ ID NO: 774724 - RNA, 19 nt, Homo sapiens
auacacgaauauccuaagu

SEQ ID NO: 774725 - RNA, 19 nt, Homo sapiens
gccugacccuccagugugu

SEQ ID NO: 774726 - RNA, 19 nt, Homo sapiens
gagaagccucugagaugca

SEQ ID NO: 774727 - RNA, 19 nt, Homo sapiens
ucguacaggugcuaugcuu

SEQ ID NO: 774728 - RNA, 19 nt, Homo sapiens
aauguugacuucccuuggu

SEQ ID NO: 774729 - RNA, 19 nt, Homo sapiens
auuuagggcugauguuauc

SEQ ID NO: 774730 - RNA, 19 nt, Homo sapiens
ccaguguguuucugauguc

SEQ ID NO: 774731 - RNA, 19 nt, Homo sapiens
aggaguaccgucuguauag

SEQ ID NO: 774732 - RNA, 19 nt, Homo sapiens
ggauuacacaguggagaau

SEQ ID NO: 774733 - RNA, 19 nt, Homo sapiens
uccaguguguuucugaugu

SEQ ID NO: 774734 - RNA, 19 nt, Homo sapiens
ucuaagaagccaucacucu

SEQ ID NO: 774735 - RNA, 19 nt, Homo sapiens
ggaacacacagggcgguau

SEQ ID NO: 774736 - RNA, 19 nt, Homo sapiens
ggugacaggagccuacauc

SEQ ID NO: 774737 - RNA, 19 nt, Homo sapiens
aguaccgucuguauagaga

SEQ ID NO: 774738 - RNA, 19 nt, Homo sapiens
gacaauuuagggcugaugu

SEQ ID NO: 774739 - RNA, 19 nt, Homo sapiens
acccucagcccaucacaaa

SEQ ID NO: 774740 - RNA, 19 nt, Homo sapiens
ccacaaaacaaguccgauu

SEQ ID NO: 774741 - RNA, 19 nt, Homo sapiens
uuccacacuuuccuucuga

SEQ ID NO: 774742 - RNA, 19 nt, Homo sapiens
gugcagccagguccuauag

SEQ ID NO: 774743 - RNA, 19 nt, Homo sapiens
gcuaugcuuaugacucgaa

SEQ ID NO: 774744 - RNA, 19 nt, Homo sapiens
caacagacuucucaacaau

SEQ ID NO: 774745 - RNA, 19 nt, Homo sapiens
gcaacagacuucucaacaa

SEQ ID NO: 774746 - RNA, 19 nt, Homo sapiens
ggacucaccugacucaaag

SEQ ID NO: 774747 - RNA, 19 nt, Homo sapiens
gggaauuccuggacacaaa

SEQ ID NO: 774748 - RNA, 19 nt, Homo sapiens
ugacuaauaucgucccauu

SEQ ID NO: 774749 - RNA, 19 nt, Homo sapiens
gugaaacacuccaguccua

SEQ ID NO: 774750 - RNA, 19 nt, Homo sapiens
gaaauaaagcaacagacuu

SEQ ID NO: 774751 - RNA, 19 nt, Homo sapiens
ucaccugacucaaagauga

SEQ ID NO: 774752 - RNA, 19 nt, Homo sapiens
gcaaacacaggacaucuga

SEQ ID NO: 774753 - RNA, 19 nt, Homo sapiens
gaauaugacccuccgaugu

SEQ ID NO: 774754 - RNA, 19 nt, Homo sapiens
ggguggagcuggacaguca

SEQ ID NO: 774755 - RNA, 19 nt, Homo sapiens
gauuuguucuguauaagga

SEQ ID NO: 774756 - RNA, 19 nt, Homo sapiens
ggaaauaaagcaacagacu

SEQ ID NO: 774757 - RNA, 19 nt, Homo sapiens
gaccagagaaagacugauu

SEQ ID NO: 774758 - RNA, 19 nt, Homo sapiens
ggagauaccgcugccacua

SEQ ID NO: 774759 - RNA, 19 nt, Homo sapiens
ccagagcccuuggacagaa

SEQ ID NO: 774760 - RNA, 19 nt, Homo sapiens
caccuggucugggaagaua

SEQ ID NO: 774761 - RNA, 19 nt, Homo sapiens
gguggagguucacaugcua

SEQ ID NO: 774762 - RNA, 19 nt, Homo sapiens
uaaagcaacagacuucuca

SEQ ID NO: 774763 - RNA, 19 nt, Homo sapiens
ccaagaacaaggccagauu

SEQ ID NO: 774764 - RNA, 19 nt, Homo sapiens
acagacuucucaacaauca

SEQ ID NO: 774765 - RNA, 19 nt, Homo sapiens
guucacaugcuauuacuau

SEQ ID NO: 774766 - RNA, 19 nt, Homo sapiens
aaauaaagcaacagacuuc

SEQ ID NO: 774767 - RNA, 19 nt, Homo sapiens
agauaccgcugccacuauu

SEQ ID NO: 774768 - RNA, 19 nt, Homo sapiens
gagauaccgcugccacuau

SEQ ID NO: 774769 - RNA, 19 nt, Homo sapiens
ccucaggcgugucuaggaa

SEQ ID NO: 774770 - RNA, 19 nt, Homo sapiens
ggagguucacaugcuauua

SEQ ID NO: 774771 - RNA, 19 nt, Homo sapiens
gggacucaccugacucaaa

SEQ ID NO: 774772 - RNA, 19 nt, Homo sapiens
acacuuuccuucugaccaa

SEQ ID NO: 774773 - RNA, 19 nt, Homo sapiens
ugaaggacacacagucuga

SEQ ID NO: 774774 - RNA, 19 nt, Homo sapiens
gacucaaagaugacuaaua

SEQ ID NO: 774775 - RNA, 19 nt, Homo sapiens
auaaguaccaggcugaauu

SEQ ID NO: 774776 - RNA, 19 nt, Homo sapiens
gcucugaugucggcuacga

SEQ ID NO: 774777 - RNA, 19 nt, Homo sapiens
caagaacaaggccagauuc

SEQ ID NO: 774778 - RNA, 19 nt, Homo sapiens
ucaaagaugacuaauaucg

SEQ ID NO: 774779 - RNA, 19 nt, Homo sapiens
caauguacggagcucauaa

SEQ ID NO: 774780 - RNA, 19 nt, Homo sapiens
gauaccgcugccacuauua

SEQ ID NO: 774781 - RNA, 19 nt, Homo sapiens
caggaguaccgacuggaua

SEQ ID NO: 774782 - RNA, 19 nt, Homo sapiens
aggagacgcugggaacuug

SEQ ID NO: 774783 - RNA, 19 nt, Homo sapiens
cugcugacguccaggaaga

SEQ ID NO: 774784 - RNA, 19 nt, Homo sapiens
gaggagacgcugggaacuu

SEQ ID NO: 774785 - RNA, 19 nt, Homo sapiens
uaaguaccaggcugaauuc

SEQ ID NO: 774786 - RNA, 19 nt, Homo sapiens
cagagcccuuggacagaaa

SEQ ID NO: 774787 - RNA, 19 nt, Homo sapiens
gagccugacccuccagugu

SEQ ID NO: 774788 - RNA, 19 nt, Homo sapiens
ugaggcugcugcaucugaa

SEQ ID NO: 774789 - RNA, 19 nt, Homo sapiens
ucagagcccacacgaugaa

SEQ ID NO: 774790 - RNA, 19 nt, Homo sapiens
aauaugacccuccgaugug

SEQ ID NO: 774791 - RNA, 19 nt, Homo sapiens
gagguucacaugcuauuac

SEQ ID NO: 774792 - RNA, 19 nt, Homo sapiens
ggaguaccgacuggauaaa

SEQ ID NO: 774793 - RNA, 19 nt, Homo sapiens
caaagaugacuaauaucgu

SEQ ID NO: 774794 - RNA, 19 nt, Homo sapiens
ucaauguacggagcucaua

SEQ ID NO: 774795 - RNA, 19 nt, Homo sapiens
ccacugcgucugagaucaa

SEQ ID NO: 774796 - RNA, 19 nt, Homo sapiens
acaguggccucaggagaga

SEQ ID NO: 774797 - RNA, 19 nt, Homo sapiens
cagaaauaacccacuggaa

SEQ ID NO: 774798 - RNA, 19 nt, Homo sapiens
aguaccgacuggauaaaga

SEQ ID NO: 774799 - RNA, 19 nt, Homo sapiens
ccacuggaacccaagaaca

SEQ ID NO: 774800 - RNA, 19 nt, Homo sapiens
ggaauuccuggacacaaag

SEQ ID NO: 774801 - RNA, 19 nt, Homo sapiens
uuugacacuuuccuucuga

SEQ ID NO: 774802 - RNA, 19 nt, Homo sapiens
guuugacacuuuccuucug

SEQ ID NO: 774803 - RNA, 19 nt, Homo sapiens
aggaguaccgacuggauaa

SEQ ID NO: 774804 - RNA, 19 nt, Homo sapiens
ucuccucccuccucacugu

SEQ ID NO: 774805 - RNA, 19 nt, Homo sapiens
ccacucuggccauccacua

SEQ ID NO: 774806 - RNA, 19 nt, Homo sapiens
uguacggagcucauaagua

SEQ ID NO: 774807 - RNA, 19 nt, Homo sapiens
agacuucucaacaaucaau

SEQ ID NO: 774808 - RNA, 19 nt, Homo sapiens
aaacacuccaguccuagga

SEQ ID NO: 774809 - RNA, 19 nt, Homo sapiens
cacuggaacccaagaacaa

SEQ ID NO: 774810 - RNA, 19 nt, Homo sapiens
gacuaauaucgucccauuu

SEQ ID NO: 774811 - RNA, 19 nt, Homo sapiens
cacugaggcugcugcaucu

SEQ ID NO: 774812 - RNA, 19 nt, Homo sapiens
guggacauuugaagaauua

SEQ ID NO: 774813 - RNA, 19 nt, Homo sapiens
ucaaagcgccaaucucaua

SEQ ID NO: 774814 - RNA, 19 nt, Homo sapiens
caacaccuuuaacaaugua

SEQ ID NO: 774815 - RNA, 19 nt, Homo sapiens
gacaggagccuacagcaaa

SEQ ID NO: 774816 - RNA, 19 nt, Homo sapiens
gcagggcgguauugcugua

SEQ ID NO: 774817 - RNA, 19 nt, Homo sapiens
ggagaugcuugccgugaug

SEQ ID NO: 774818 - RNA, 19 nt, Homo sapiens
gaacaugcagggcgguauu

SEQ ID NO: 774819 - RNA, 19 nt, Homo sapiens
gcaggaguaccaucuauau

SEQ ID NO: 774820 - RNA, 19 nt, Homo sapiens
gcgccaaucucauaaguac

SEQ ID NO: 774821 - RNA, 19 nt, Homo sapiens
gaaaacagcacucuggauu

SEQ ID NO: 774822 - RNA, 19 nt, Homo sapiens
gaagaugaacacccacaau

SEQ ID NO: 774823 - RNA, 19 nt, Homo sapiens
ggcauuugauggcuucauu

SEQ ID NO: 774824 - RNA, 19 nt, Homo sapiens
acucacagguggcauuuga

SEQ ID NO: 774825 - RNA, 19 nt, Homo sapiens
gguggacauuugaagaauu

SEQ ID NO: 774826 - RNA, 19 nt, Homo sapiens
gaacgugacccugcugugu

SEQ ID NO: 774827 - RNA, 19 nt, Homo sapiens
guacaggugcuaugguuau

SEQ ID NO: 774828 - RNA, 19 nt, Homo sapiens
aaacagcacucuggauuac

SEQ ID NO: 774829 - RNA, 19 nt, Homo sapiens
cuccaaggcuggugaguga

SEQ ID NO: 774830 - RNA, 19 nt, Homo sapiens
aaucaaagcgccaaucuca

SEQ ID NO: 774831 - RNA, 19 nt, Homo sapiens
uaaggaaggagaagaugaa

SEQ ID NO: 774832 - RNA, 19 nt, Homo sapiens
caaagcgccaaucucauaa

SEQ ID NO: 774833 - RNA, 19 nt, Homo sapiens
agggagggaugcacacuuu

SEQ ID NO: 774834 - RNA, 19 nt, Homo sapiens
guaaggaaggagaagauga

SEQ ID NO: 774835 - RNA, 19 nt, Homo sapiens
gggaugcacacuuuccuuu

SEQ ID NO: 774836 - RNA, 19 nt, Homo sapiens
uuugauggcuucauucugu

SEQ ID NO: 774837 - RNA, 19 nt, Homo sapiens
ucaacaccuuuaacaaugu

SEQ ID NO: 774838 - RNA, 19 nt, Homo sapiens
uaagaagccaucacucuca

SEQ ID NO: 774839 - RNA, 19 nt, Homo sapiens
caauguauaugugaaguac

SEQ ID NO: 774840 - RNA, 19 nt, Homo sapiens
gaaugugaccauccagugu

SEQ ID NO: 774841 - RNA, 19 nt, Homo sapiens
cagcaaacccacccucuca

SEQ ID NO: 774842 - RNA, 19 nt, Homo sapiens
uucaacaccuuuaacaaug

SEQ ID NO: 774843 - RNA, 19 nt, Homo sapiens
ggaaggagaagaugaacac

SEQ ID NO: 774844 - RNA, 19 nt, Homo sapiens
caggaguaccaucuauaua

SEQ ID NO: 774845 - RNA, 19 nt, Homo sapiens
gagggaaugugaccaucca

SEQ ID NO: 774846 - RNA, 19 nt, Homo sapiens
auaaguaccaggcugaauu

SEQ ID NO: 774847 - RNA, 19 nt, Homo sapiens
ucacgguccugaucugucu

SEQ ID NO: 774848 - RNA, 19 nt, Homo sapiens
gaugcacacuuuccuuuug

SEQ ID NO: 774849 - RNA, 19 nt, Homo sapiens
ugaugacgcugggcacaga

SEQ ID NO: 774850 - RNA, 19 nt, Homo sapiens
ggucccagguguuucuaag

SEQ ID NO: 774851 - RNA, 19 nt, Homo sapiens
cgguauugcuguaucuaug

SEQ ID NO: 774852 - RNA, 19 nt, Homo sapiens
uaaguaccaggcugaauuc

SEQ ID NO: 774853 - RNA, 19 nt, Homo sapiens
ggguggacauuugaagaau

SEQ ID NO: 774854 - RNA, 19 nt, Homo sapiens
ucguacaggugcuaugguu

SEQ ID NO: 774855 - RNA, 19 nt, Homo sapiens
ucacagguggcauuugaug

SEQ ID NO: 774856 - RNA, 19 nt, Homo sapiens
gggcucauccauccacaga

SEQ ID NO: 774857 - RNA, 19 nt, Homo sapiens
uguggucucuacccaguga

SEQ ID NO: 774858 - RNA, 19 nt, Homo sapiens
aagaugaacacccacaaug

SEQ ID NO: 774859 - RNA, 19 nt, Homo sapiens
ugacaggagccuacagcaa

SEQ ID NO: 774860 - RNA, 19 nt, Homo sapiens
gaccauccagugugacuca

SEQ ID NO: 774861 - RNA, 19 nt, Homo sapiens
gagacgccaugaccuccau

SEQ ID NO: 774862 - RNA, 19 nt, Homo sapiens
gcaccgagggcucauccau

SEQ ID NO: 774863 - RNA, 19 nt, Homo sapiens
aggaguaccaucuauauag

SEQ ID NO: 774864 - RNA, 19 nt, Homo sapiens
acaguggccucaggagaga

SEQ ID NO: 774865 - RNA, 19 nt, Homo sapiens
acgcaggaguaccaucuau

SEQ ID NO: 774866 - RNA, 19 nt, Homo sapiens
gcuggugagugaggagaug

SEQ ID NO: 774867 - RNA, 19 nt, Homo sapiens
ccacacugcaggccucuca

SEQ ID NO: 774868 - RNA, 19 nt, Homo sapiens
gggcgguauugcuguaucu

SEQ ID NO: 774869 - RNA, 19 nt, Homo sapiens
aaaacagcacucuggauua

SEQ ID NO: 774870 - RNA, 19 nt, Homo sapiens
gccaaucucauaaguacca

SEQ ID NO: 774871 - RNA, 19 nt, Homo sapiens
aagcgccaaucucauaagu

SEQ ID NO: 774872 - RNA, 19 nt, Homo sapiens
ucuaagaagccaucacucu

SEQ ID NO: 774873 - RNA, 19 nt, Homo sapiens
gauggcuucauucugugua

SEQ ID NO: 774874 - RNA, 19 nt, Homo sapiens
ugacucacagguggcauuu

SEQ ID NO: 774875 - RNA, 19 nt, Homo sapiens
gcgguauugcuguaucuau

SEQ ID NO: 774876 - RNA, 19 nt, Homo sapiens
cgcaggaguaccaucuaua

SEQ ID NO: 774877 - RNA, 19 nt, Homo sapiens
gcauuugauggcuucauuc

SEQ ID NO: 774878 - RNA, 19 nt, Homo sapiens
agacagcaaucaauauuug

SEQ ID NO: 774879 - RNA, 19 nt, Homo sapiens
gaacgugacccuccagugu

SEQ ID NO: 774880 - RNA, 19 nt, Homo sapiens
gacaggagccuacagcaaa

SEQ ID NO: 774881 - RNA, 19 nt, Homo sapiens
cagagaagccuacaagaug

SEQ ID NO: 774882 - RNA, 19 nt, Homo sapiens
ucacaggacaguucuauga

SEQ ID NO: 774883 - RNA, 19 nt, Homo sapiens
ucucacagguggcauuuga

SEQ ID NO: 774884 - RNA, 19 nt, Homo sapiens
gcaccaagcucagcagaac

SEQ ID NO: 774885 - RNA, 19 nt, Homo sapiens
ccuagaagaucauuaaacu

SEQ ID NO: 774886 - RNA, 19 nt, Homo sapiens
gaggaguaccaucuauaua

SEQ ID NO: 774887 - RNA, 19 nt, Homo sapiens
gauuuguucuguauaagga

SEQ ID NO: 774888 - RNA, 19 nt, Homo sapiens
gagacagcaaucaauauuu

SEQ ID NO: 774889 - RNA, 19 nt, Homo sapiens
cuagagacagcaaucaaua

SEQ ID NO: 774890 - RNA, 19 nt, Homo sapiens
ggaguaccaucuauauagg

SEQ ID NO: 774891 - RNA, 19 nt, Homo sapiens
gaacgugacccugcugugu

SEQ ID NO: 774892 - RNA, 19 nt, Homo sapiens
ggagggagaacgugacuuc

SEQ ID NO: 774893 - RNA, 19 nt, Homo sapiens
guacaggugcuaugcuuau

SEQ ID NO: 774894 - RNA, 19 nt, Homo sapiens
gcagaaccaggcugaauuc

SEQ ID NO: 774895 - RNA, 19 nt, Homo sapiens
uaaggaaggagaagaugaa

SEQ ID NO: 774896 - RNA, 19 nt, Homo sapiens
gcugaggaguaccaucuau

SEQ ID NO: 774897 - RNA, 19 nt, Homo sapiens
guaaggaaggagaagauga

SEQ ID NO: 774898 - RNA, 19 nt, Homo sapiens
aaaucagcauccuggguua

SEQ ID NO: 774899 - RNA, 19 nt, Homo sapiens
ccagagaagccuacaagau

SEQ ID NO: 774900 - RNA, 19 nt, Homo sapiens
gaaacugucuggggugauu

SEQ ID NO: 774901 - RNA, 19 nt, Homo sapiens
gaucacaggacaguucuau

SEQ ID NO: 774902 - RNA, 19 nt, Homo sapiens
uaagaagccaucacucuca

SEQ ID NO: 774903 - RNA, 19 nt, Homo sapiens
gaacagcagagaggacaau

SEQ ID NO: 774904 - RNA, 19 nt, Homo sapiens
uacaagagccugggaagaa

SEQ ID NO: 774905 - RNA, 19 nt, Homo sapiens
agagacagcaaucaauauu

SEQ ID NO: 774906 - RNA, 19 nt, Homo sapiens
gcucagcacagccagagaa

SEQ ID NO: 774907 - RNA, 19 nt, Homo sapiens
acacuuuccuucugaccaa

SEQ ID NO: 774908 - RNA, 19 nt, Homo sapiens
cagcaaacccacccucuca

SEQ ID NO: 774909 - RNA, 19 nt, Homo sapiens
ggaaggagaagaugaacac

SEQ ID NO: 774910 - RNA, 19 nt, Homo sapiens
uaccaucuauauagggaaa

SEQ ID NO: 774911 - RNA, 19 nt, Homo sapiens
ugaggaguaccaucuauau

SEQ ID NO: 774912 - RNA, 19 nt, Homo sapiens
gcauuugacggcuucauuc

SEQ ID NO: 774913 - RNA, 19 nt, Homo sapiens
ucauuaaacugugguacau

SEQ ID NO: 774914 - RNA, 19 nt, Homo sapiens
acaagagccugggaagaau

SEQ ID NO: 774915 - RNA, 19 nt, Homo sapiens
cagccacaaucacucauca

SEQ ID NO: 774916 - RNA, 19 nt, Homo sapiens
ccucgggauucugcuauuu

SEQ ID NO: 774917 - RNA, 19 nt, Homo sapiens
gacucgaacucucccuaug

SEQ ID NO: 774918 - RNA, 19 nt, Homo sapiens
ucacgguccugaucugucu

SEQ ID NO: 774919 - RNA, 19 nt, Homo sapiens
gaagaugaacacccacaac

SEQ ID NO: 774920 - RNA, 19 nt, Homo sapiens
ucgggauucugcuauuuga

SEQ ID NO: 774921 - RNA, 19 nt, Homo sapiens
ggucccagguguuucuaag

SEQ ID NO: 774922 - RNA, 19 nt, Homo sapiens
gagccugacccuccagugu

SEQ ID NO: 774923 - RNA, 19 nt, Homo sapiens
acaggacaguucuaugaca

SEQ ID NO: 774924 - RNA, 19 nt, Homo sapiens
uuugacggcuucauucugu

SEQ ID NO: 774925 - RNA, 19 nt, Homo sapiens
guaugcuggucauuucuag

SEQ ID NO: 774926 - RNA, 19 nt, Homo sapiens
guuccacacuuuccuucug

SEQ ID NO: 774927 - RNA, 19 nt, Homo sapiens
uguggucucuacccaguga

SEQ ID NO: 774928 - RNA, 19 nt, Homo sapiens
ugacaggagccuacagcaa

SEQ ID NO: 774929 - RNA, 19 nt, Homo sapiens
uagagacagcaaucaauau

SEQ ID NO: 774930 - RNA, 19 nt, Homo sapiens
cagcagagaggacaaugca

SEQ ID NO: 774931 - RNA, 19 nt, Homo sapiens
ugggaagaauggccaguuc

SEQ ID NO: 774932 - RNA, 19 nt, Homo sapiens
acuguaugcuggucauuuc

SEQ ID NO: 774933 - RNA, 19 nt, Homo sapiens
aggaguaccaucuauauag

SEQ ID NO: 774934 - RNA, 19 nt, Homo sapiens
cagcaucccuaggccaaca

SEQ ID NO: 774935 - RNA, 19 nt, Homo sapiens
ggaacacgcagggcgguau

SEQ ID NO: 774936 - RNA, 19 nt, Homo sapiens
gaacacgcagggcgguauc

SEQ ID NO: 774937 - RNA, 19 nt, Homo sapiens
gcaguuccacacuuuccuu

SEQ ID NO: 774938 - RNA, 19 nt, Homo sapiens
gccaggcucugugaucauc

SEQ ID NO: 774939 - RNA, 19 nt, Homo sapiens
ggcauuugacggcuucauu

SEQ ID NO: 774940 - RNA, 19 nt, Homo sapiens
gccacaaucacucaucaga

SEQ ID NO: 774941 - RNA, 19 nt, Homo sapiens
gacuguaugcuggucauuu

SEQ ID NO: 774942 - RNA, 19 nt, Homo sapiens
caagagccugggaagaaug

SEQ ID NO: 774943 - RNA, 19 nt, Homo sapiens
aggaggcucuggaggacaa

SEQ ID NO: 774944 - RNA, 19 nt, Homo sapiens
gccugacccuccagugugu

SEQ ID NO: 774945 - RNA, 19 nt, Homo sapiens
ucguacaggugcuaugcuu

SEQ ID NO: 774946 - RNA, 19 nt, Homo sapiens
cuacagccacaaucacuca

SEQ ID NO: 774947 - RNA, 19 nt, Homo sapiens
cugaggaguaccaucuaua

SEQ ID NO: 774948 - RNA, 19 nt, Homo sapiens
ggauuacacaguggagaau

SEQ ID NO: 774949 - RNA, 19 nt, Homo sapiens
gagaucagagcaccaagcu

SEQ ID NO: 774950 - RNA, 19 nt, Homo sapiens
ucuaagaagccaucacucu

SEQ ID NO: 774951 - RNA, 19 nt, Homo sapiens
ggguuagacggauacaaga

SEQ ID NO: 774952 - RNA, 19 nt, Homo sapiens
uuccacacuuuccuucuga

SEQ ID NO: 774953 - RNA, 19 nt, Homo sapiens
gcuaugcuuaugacucgaa

SEQ ID NO: 774954 - RNA, 19 nt, Homo sapiens
acacgaagauggccaagaa

SEQ ID NO: 774955 - RNA, 19 nt, Homo sapiens
uaugaggguucucuuauaa

SEQ ID NO: 774956 - RNA, 19 nt, Homo sapiens
ggaaggaccgggaagauga

SEQ ID NO: 774957 - RNA, 19 nt, Homo sapiens
gaagauggccaagaacaaa

SEQ ID NO: 774958 - RNA, 19 nt, Homo sapiens
ggagcaugcuggcuugaaa

SEQ ID NO: 774959 - RNA, 19 nt, Homo sapiens
ggaaguacggcuaauagaa

SEQ ID NO: 774960 - RNA, 19 nt, Homo sapiens
ccgcuucgauccugaaauu

SEQ ID NO: 774961 - RNA, 19 nt, Homo sapiens
caauugcccuccuuuggaa

SEQ ID NO: 774962 - RNA, 19 nt, Homo sapiens
cuaugaggguucucuuaua

SEQ ID NO: 774963 - RNA, 19 nt, Homo sapiens
gaauaagauccgaauaaga

SEQ ID NO: 774964 - RNA, 19 nt, Homo sapiens
ggaguuagcgccugcucua

SEQ ID NO: 774965 - RNA, 19 nt, Homo sapiens
cgaauaagauccgaauaag

SEQ ID NO: 774966 - RNA, 19 nt, Homo sapiens
gaacaauugcccuccuuug

SEQ ID NO: 774967 - RNA, 19 nt, Homo sapiens
gauggcggcugcaaucugu

SEQ ID NO: 774968 - RNA, 19 nt, Homo sapiens
ccgaauaagauccgaauaa

SEQ ID NO: 774969 - RNA, 19 nt, Homo sapiens
gaaguacggcuaauagaag

SEQ ID NO: 774970 - RNA, 19 nt, Homo sapiens
gcuaauagaagcccuagau

SEQ ID NO: 774971 - RNA, 19 nt, Homo sapiens
cuagaaggacgaacaauug

SEQ ID NO: 774972 - RNA, 19 nt, Homo sapiens
gcaaagccgagaaggagaa

SEQ ID NO: 774973 - RNA, 19 nt, Homo sapiens
caaucugucuuguggguau

SEQ ID NO: 774974 - RNA, 19 nt, Homo sapiens
gcuaugaggguucucuuau

SEQ ID NO: 774975 - RNA, 19 nt, Homo sapiens
gaaauuccgcaaacacuac

SEQ ID NO: 774976 - RNA, 19 nt, Homo sapiens
cgggagcucuaucugcuuu

SEQ ID NO: 774977 - RNA, 19 nt, Homo sapiens
ugaggguucucuuauaaag

SEQ ID NO: 774978 - RNA, 19 nt, Homo sapiens
gaaggaccgggaagaugaa

SEQ ID NO: 774979 - RNA, 19 nt, Homo sapiens
cuacuguucucuagcuguu

SEQ ID NO: 774980 - RNA, 19 nt, Homo sapiens
acuauacccuucagcaaug

SEQ ID NO: 774981 - RNA, 19 nt, Homo sapiens
ugaaauuccgcaaacacua

SEQ ID NO: 774982 - RNA, 19 nt, Homo sapiens
ggaccgggaagaugaacaa

SEQ ID NO: 774983 - RNA, 19 nt, Homo sapiens
ggguauuaaugcaaucuuc

SEQ ID NO: 774984 - RNA, 19 nt, Homo sapiens
gcaauggcuacuagaagga

SEQ ID NO: 774985 - RNA, 19 nt, Homo sapiens
caguucugcugaauacuau

SEQ ID NO: 774986 - RNA, 19 nt, Homo sapiens
ggaagucccgucaguucug

SEQ ID NO: 774987 - RNA, 19 nt, Homo sapiens
gaggcaggcggaucacuug

SEQ ID NO: 774988 - RNA, 19 nt, Homo sapiens
cgaagauggccaagaacaa

SEQ ID NO: 774989 - RNA, 19 nt, Homo sapiens
gaccagcccagccaacaug

SEQ ID NO: 774990 - RNA, 19 nt, Homo sapiens
ggccaagaacaaacucgua

SEQ ID NO: 774991 - RNA, 19 nt, Homo sapiens
ugucacagccucuaucaca

SEQ ID NO: 774992 - RNA, 19 nt, Homo sapiens
cuucagcaauggcuacuag

SEQ ID NO: 774993 - RNA, 19 nt, Homo sapiens
cgacuagaguuugcuaagg

SEQ ID NO: 774994 - RNA, 19 nt, Homo sapiens
gcaaacacuacgacuagag

SEQ ID NO: 774995 - RNA, 19 nt, Homo sapiens
gaagcccuagauccgaaua

SEQ ID NO: 774996 - RNA, 19 nt, Homo sapiens
guacuccucugcccaacac

SEQ ID NO: 774997 - RNA, 19 nt, Homo sapiens
ccgcaaacacuacgacuag

SEQ ID NO: 774998 - RNA, 19 nt, Homo sapiens
cuuauaaagcucacaucua

SEQ ID NO: 774999 - RNA, 19 nt, Homo sapiens
ggcuaugaggguucucuua

SEQ ID NO: 775000 - RNA, 19 nt, Homo sapiens
guccggacccuauuuguca

SEQ ID NO: 775001 - RNA, 19 nt, Homo sapiens
acaauugcccuccuuugga

SEQ ID NO: 775002 - RNA, 19 nt, Homo sapiens
uggaucccuucaagacuuu

SEQ ID NO: 775003 - RNA, 19 nt, Homo sapiens
gguggcuacuguucucuag

SEQ ID NO: 775004 - RNA, 19 nt, Homo sapiens
gguauuaaugcaaucuuca

SEQ ID NO: 775005 - RNA, 19 nt, Homo sapiens
acuagaaggacgaacaauu

SEQ ID NO: 775006 - RNA, 19 nt, Homo sapiens
caaacacuacgacuagagu

SEQ ID NO: 775007 - RNA, 19 nt, Homo sapiens
uuggaucccuucaagacuu

SEQ ID NO: 775008 - RNA, 19 nt, Homo sapiens
caguuuggaucccuucaag

SEQ ID NO: 775009 - RNA, 19 nt, Homo sapiens
gaggaaggaccgggaagau

SEQ ID NO: 775010 - RNA, 19 nt, Homo sapiens
cgaacaauugcccuccuuu

SEQ ID NO: 775011 - RNA, 19 nt, Homo sapiens
gauccugaaauuccgcaaa

SEQ ID NO: 775012 - RNA, 19 nt, Homo sapiens
gauccgaauaagaauaugu

SEQ ID NO: 775013 - RNA, 19 nt, Homo sapiens
gcuacuagaaggacgaaca

SEQ ID NO: 775014 - RNA, 19 nt, Homo sapiens
ucaaaccucgggagcucua

SEQ ID NO: 775015 - RNA, 19 nt, Homo sapiens
cagccucuaucacacaucu

SEQ ID NO: 775016 - RNA, 19 nt, Homo sapiens
ucagcaauggcuacuagaa

SEQ ID NO: 775017 - RNA, 19 nt, Homo sapiens
gcuaaggcaaacacgaaga

SEQ ID NO: 775018 - RNA, 19 nt, Homo sapiens
cauggucccagguguguga

SEQ ID NO: 775019 - RNA, 19 nt, Homo sapiens
gcccuagauccgaauaaga

SEQ ID NO: 775020 - RNA, 19 nt, Homo sapiens
cagcaauggcuacuagaag

SEQ ID NO: 775021 - RNA, 19 nt, Homo sapiens
acacuacgacuagaguuug

SEQ ID NO: 775022 - RNA, 19 nt, Homo sapiens
gaccauuuaagggcuauga

SEQ ID NO: 775023 - RNA, 19 nt, Homo sapiens
ucacagccucuaucacaca

SEQ ID NO: 775024 - RNA, 19 nt, Homo sapiens
gagaccagcccagccaaca

SEQ ID NO: 775025 - RNA, 19 nt, Homo sapiens
cuugaugacagaaguguga

SEQ ID NO: 775026 - RNA, 19 nt, Homo sapiens
cgagcgaggccaaccuuca

SEQ ID NO: 775027 - RNA, 19 nt, Homo sapiens
cuacuagaaggacgaacaa

SEQ ID NO: 775028 - RNA, 19 nt, Homo sapiens
auaaagcucacaucuaaac

SEQ ID NO: 775029 - RNA, 19 nt, Homo sapiens
gaauggcauccgcuucgau

SEQ ID NO: 775030 - RNA, 19 nt, Homo sapiens
ggaauacgcugaauccaua

SEQ ID NO: 775031 - RNA, 19 nt, Homo sapiens
gaaagaacaugguccagaa

SEQ ID NO: 775032 - RNA, 19 nt, Homo sapiens
ggacacugcuggucaggaa

SEQ ID NO: 775033 - RNA, 19 nt, Homo sapiens
ugaaggaugcuaaggaaua

SEQ ID NO: 775034 - RNA, 19 nt, Homo sapiens
ggaacgguuucauucauug

SEQ ID NO: 775035 - RNA, 19 nt, Homo sapiens
ggccaucgcuggaaacaag

SEQ ID NO: 775036 - RNA, 19 nt, Homo sapiens
caacaucagcccuacuauu

SEQ ID NO: 775037 - RNA, 19 nt, Homo sapiens
ggaaacaauggaacaauca

SEQ ID NO: 775038 - RNA, 19 nt, Homo sapiens
gaaggaugcuaaggaauac

SEQ ID NO: 775039 - RNA, 19 nt, Homo sapiens
caaaauggccuuuagugua

SEQ ID NO: 775040 - RNA, 19 nt, Homo sapiens
cagcuguuaucguguauga

SEQ ID NO: 775041 - RNA, 19 nt, Homo sapiens
gauauuaccaagcaggauu

SEQ ID NO: 775042 - RNA, 19 nt, Homo sapiens
gaaaucaagcaucgugugu

SEQ ID NO: 775043 - RNA, 19 nt, Homo sapiens
ccugaaggaugcuaaggaa

SEQ ID NO: 775044 - RNA, 19 nt, Homo sapiens
ggucaggaacgguuucauu

SEQ ID NO: 775045 - RNA, 19 nt, Homo sapiens
aaaauggccuuuaguguau

SEQ ID NO: 775046 - RNA, 19 nt, Homo sapiens
caauggaacaaucaaaguu

SEQ ID NO: 775047 - RNA, 19 nt, Homo sapiens
gaaacaauggaacaaucaa

SEQ ID NO: 775048 - RNA, 19 nt, Homo sapiens
uuaccaagcaggauucauu

SEQ ID NO: 775049 - RNA, 19 nt, Homo sapiens
uguaugauauuaccaagca

SEQ ID NO: 775050 - RNA, 19 nt, Homo sapiens
uguaugaaaugcacaugga

SEQ ID NO: 775051 - RNA, 19 nt, Homo sapiens
ugcgaccucucagauauua

SEQ ID NO: 775052 - RNA, 19 nt, Homo sapiens
gguccacgguacuugaaga

SEQ ID NO: 775053 - RNA, 19 nt, Homo sapiens
uaauggccaucgcuggaaa

SEQ ID NO: 775054 - RNA, 19 nt, Homo sapiens
caggaacgguuucauucau

SEQ ID NO: 775055 - RNA, 19 nt, Homo sapiens
aacaucagcccuacuauug

SEQ ID NO: 775056 - RNA, 19 nt, Homo sapiens
aaacaagugcgaccucuca

SEQ ID NO: 775057 - RNA, 19 nt, Homo sapiens
cugcagcuguuaucgugua

SEQ ID NO: 775058 - RNA, 19 nt, Homo sapiens
uggaaacaauggaacaauc

SEQ ID NO: 775059 - RNA, 19 nt, Homo sapiens
gaaaauggaaacaauggaa

SEQ ID NO: 775060 - RNA, 19 nt, Homo sapiens
cacaacaucagcccuacua

SEQ ID NO: 775061 - RNA, 19 nt, Homo sapiens
gaaauguaccugaaaagga

SEQ ID NO: 775062 - RNA, 19 nt, Homo sapiens
ccugugcacugcugaagga

SEQ ID NO: 775063 - RNA, 19 nt, Homo sapiens
gcuaaggaauacgcugaau

SEQ ID NO: 775064 - RNA, 19 nt, Homo sapiens
caagcaggauucauuuuau

SEQ ID NO: 775065 - RNA, 19 nt, Homo sapiens
ccaagcaggauucauuuua

SEQ ID NO: 775066 - RNA, 19 nt, Homo sapiens
aggaacgguuucauucauu

SEQ ID NO: 775067 - RNA, 19 nt, Homo sapiens
ggccuuuaguguaugaaau

SEQ ID NO: 775068 - RNA, 19 nt, Homo sapiens
caagugcgaccucucagau

SEQ ID NO: 775069 - RNA, 19 nt, Homo sapiens
agugcgaccucucagauau

SEQ ID NO: 775070 - RNA, 19 nt, Homo sapiens
gauacgggagcucaaagug

SEQ ID NO: 775071 - RNA, 19 nt, Homo sapiens
cauuggcucccauguacua

SEQ ID NO: 775072 - RNA, 19 nt, Homo sapiens
aaacugugccuuguggaaa

SEQ ID NO: 775073 - RNA, 19 nt, Homo sapiens
uaggugccaucgugguuga

SEQ ID NO: 775074 - RNA, 19 nt, Homo sapiens
uaccaagcaggauucauuu

SEQ ID NO: 775075 - RNA, 19 nt, Homo sapiens
aaagaacaugguccagaaa

SEQ ID NO: 775076 - RNA, 19 nt, Homo sapiens
guaauggccaucgcuggaa

SEQ ID NO: 775077 - RNA, 19 nt, Homo sapiens
gucaggaacgguuucauuc

SEQ ID NO: 775078 - RNA, 19 nt, Homo sapiens
cuucacaaguuccucaucu

SEQ ID NO: 775079 - RNA, 19 nt, Homo sapiens
gaccaaaacugugccuugu

SEQ ID NO: 775080 - RNA, 19 nt, Homo sapiens
gaacaugguccagaaaaca

SEQ ID NO: 775081 - RNA, 19 nt, Homo sapiens
ucaggaacgguuucauuca

SEQ ID NO: 775082 - RNA, 19 nt, Homo sapiens
ugagcacacuggcuuugca

SEQ ID NO: 775083 - RNA, 19 nt, Homo sapiens
uaaggaauacgcugaaucc

SEQ ID NO: 775084 - RNA, 19 nt, Homo sapiens
gaggggauguaguugcauu

SEQ ID NO: 775085 - RNA, 19 nt, Homo sapiens
aaauguaccugaaaaggau

SEQ ID NO: 775086 - RNA, 19 nt, Homo sapiens
aauggaacaaucaaaguug

SEQ ID NO: 775087 - RNA, 19 nt, Homo sapiens
ucacuuugaccacaacauc

SEQ ID NO: 775088 - RNA, 19 nt, Homo sapiens
caucgugguugagacaagu

SEQ ID NO: 775089 - RNA, 19 nt, Homo sapiens
cauaggugccaucgugguu

SEQ ID NO: 775090 - RNA, 19 nt, Homo sapiens
gaacgguuucauucauugg

SEQ ID NO: 775091 - RNA, 19 nt, Homo sapiens
gccuuuaguguaugaaaug

SEQ ID NO: 775092 - RNA, 19 nt, Homo sapiens
uggccuggcaccucacuuu

SEQ ID NO: 775093 - RNA, 19 nt, Homo sapiens
uucauuggcucccauguac

SEQ ID NO: 775094 - RNA, 19 nt, Homo sapiens
gcucaaagugugccuucuc

SEQ ID NO: 775095 - RNA, 19 nt, Homo sapiens
gaggcgcacuucaagcaua

SEQ ID NO: 775096 - RNA, 19 nt, Homo sapiens
ggaaguuugugcugacaga

SEQ ID NO: 775097 - RNA, 19 nt, Homo sapiens
ugccaaagcucuccaggaa

SEQ ID NO: 775098 - RNA, 19 nt, Homo sapiens
gaagaucgagcaccugaau

SEQ ID NO: 775099 - RNA, 19 nt, Homo sapiens
gcccagccguguauuuauu

SEQ ID NO: 775100 - RNA, 19 nt, Homo sapiens
caaaguacccuccuucuac

SEQ ID NO: 775101 - RNA, 19 nt, Homo sapiens
caacagcacccguaacauc

SEQ ID NO: 775102 - RNA, 19 nt, Homo sapiens
ucaccuaccugaaggacaa

SEQ ID NO: 775103 - RNA, 19 nt, Homo sapiens
ccaaagcucuccaggaacu

SEQ ID NO: 775104 - RNA, 19 nt, Homo sapiens
acgcagaucuggugccaaa

SEQ ID NO: 775105 - RNA, 19 nt, Homo sapiens
gaccgcaaguuucuguuug

SEQ ID NO: 775106 - RNA, 19 nt, Homo sapiens
ccaccuccacgacuauuua

SEQ ID NO: 775107 - RNA, 19 nt, Homo sapiens
agggugcucugaaguauuu

SEQ ID NO: 775108 - RNA, 19 nt, Homo sapiens
ccaaggccgugaugaagau

SEQ ID NO: 775109 - RNA, 19 nt, Homo sapiens
ccaaaguacccuccuucua

SEQ ID NO: 775110 - RNA, 19 nt, Homo sapiens
gacaacagcacccguaaca

SEQ ID NO: 775111 - RNA, 19 nt, Homo sapiens
gagcgccuguuguguguca

SEQ ID NO: 775112 - RNA, 19 nt, Homo sapiens
gagccagguuugaguccaa

SEQ ID NO: 775113 - RNA, 19 nt, Homo sapiens
cccguaacaucuucaucua

SEQ ID NO: 775114 - RNA, 19 nt, Homo sapiens
cgugucgcauccuggaaua

SEQ ID NO: 775115 - RNA, 19 nt, Homo sapiens
ccuccacgacuauuuauug

SEQ ID NO: 775116 - RNA, 19 nt, Homo sapiens
gcaggcucauguacuucaa

SEQ ID NO: 775117 - RNA, 19 nt, Homo sapiens
caggguaccgugaggguuu

SEQ ID NO: 775118 - RNA, 19 nt, Homo sapiens
cgaccgcaaguuucuguuu

SEQ ID NO: 775119 - RNA, 19 nt, Homo sapiens
cagcacccguaacaucuuc

SEQ ID NO: 775120 - RNA, 19 nt, Homo sapiens
ggaauccaccggaauaucc

SEQ ID NO: 775121 - RNA, 19 nt, Homo sapiens
aggcgcacuucaagcauaa

SEQ ID NO: 775122 - RNA, 19 nt, Homo sapiens
cuccacgacuauuuauuga

SEQ ID NO: 775123 - RNA, 19 nt, Homo sapiens
ucgggaauccaccggaaua

SEQ ID NO: 775124 - RNA, 19 nt, Homo sapiens
cccugggccugaucucuaa

SEQ ID NO: 775125 - RNA, 19 nt, Homo sapiens
acagaaaugaugccaagga

SEQ ID NO: 775126 - RNA, 19 nt, Homo sapiens
cgacugggccuccuacacu

SEQ ID NO: 775127 - RNA, 19 nt, Homo sapiens
gcucauguacuucaaagac

SEQ ID NO: 775128 - RNA, 19 nt, Homo sapiens
acuucaagcauaaaccuua

SEQ ID NO: 775129 - RNA, 19 nt, Homo sapiens
ugaaggaaggcuacaugga

SEQ ID NO: 775130 - RNA, 19 nt, Homo sapiens
ggaggaccacggacauugg

SEQ ID NO: 775131 - RNA, 19 nt, Homo sapiens
gagggugcucugaaguauu

SEQ ID NO: 775132 - RNA, 19 nt, Homo sapiens
gaggaccacggacauugga

SEQ ID NO: 775133 - RNA, 19 nt, Homo sapiens
gaaguuugugcugacagaa

SEQ ID NO: 775134 - RNA, 19 nt, Homo sapiens
cuucaagcauaaaccuuag

SEQ ID NO: 775135 - RNA, 19 nt, Homo sapiens
gcacuucaagcauaaaccu

SEQ ID NO: 775136 - RNA, 19 nt, Homo sapiens
gcagaucuggugccaaagc

SEQ ID NO: 775137 - RNA, 19 nt, Homo sapiens
gcgagagccagguuugagu

SEQ ID NO: 775138 - RNA, 19 nt, Homo sapiens
guaacaucuucaucuacca

SEQ ID NO: 775139 - RNA, 19 nt, Homo sapiens
ggacaacagcacccguaac

SEQ ID NO: 775140 - RNA, 19 nt, Homo sapiens
gcaaguagcugaugaagua

SEQ ID NO: 775141 - RNA, 19 nt, Homo sapiens
gcaaacagcccuaaauaaa

SEQ ID NO: 775142 - RNA, 19 nt, Homo sapiens
aaaguuagguggauccuua

SEQ ID NO: 775143 - RNA, 19 nt, Homo sapiens
ggacaccugugguaucuuu

SEQ ID NO: 775144 - RNA, 19 nt, Homo sapiens
gaugaaguaugucgcauuu

SEQ ID NO: 775145 - RNA, 19 nt, Homo sapiens
ggaaauugcucauaaucug

SEQ ID NO: 775146 - RNA, 19 nt, Homo sapiens
uaauggagauugccucaaa

SEQ ID NO: 775147 - RNA, 19 nt, Homo sapiens
ccagugagcucgccauuca

SEQ ID NO: 775148 - RNA, 19 nt, Homo sapiens
aaacagcccuaaauaaauc

SEQ ID NO: 775149 - RNA, 19 nt, Homo sapiens
guuauccucuugcuauaua

SEQ ID NO: 775150 - RNA, 19 nt, Homo sapiens
gaaagaaggcugucauuuu

SEQ ID NO: 775151 - RNA, 19 nt, Homo sapiens
auugaaagcuuccauguuu

SEQ ID NO: 775152 - RNA, 19 nt, Homo sapiens
gaugcaagcuuugaaacaa

SEQ ID NO: 775153 - RNA, 19 nt, Homo sapiens
gagcuaagcagaauaaugg

SEQ ID NO: 775154 - RNA, 19 nt, Homo sapiens
cuuaggaaauugcucauaa

SEQ ID NO: 775155 - RNA, 19 nt, Homo sapiens
guaaucugcuuuguuaaug

SEQ ID NO: 775156 - RNA, 19 nt, Homo sapiens
caaauuagggcuacauugu

SEQ ID NO: 775157 - RNA, 19 nt, Homo sapiens
gcuuccauguuuaauguua

SEQ ID NO: 775158 - RNA, 19 nt, Homo sapiens
uuagguggauccuuaauug

SEQ ID NO: 775159 - RNA, 19 nt, Homo sapiens
gguuggagauguuggugua

SEQ ID NO: 775160 - RNA, 19 nt, Homo sapiens
caaacagcccuaaauaaau

SEQ ID NO: 775161 - RNA, 19 nt, Homo sapiens
uaacugauccuuucaagca

SEQ ID NO: 775162 - RNA, 19 nt, Homo sapiens
gcacaucauuggaauacag

SEQ ID NO: 775163 - RNA, 19 nt, Homo sapiens
gagcugucuugucaucuuu

SEQ ID NO: 775164 - RNA, 19 nt, Homo sapiens
ggagcugucuugucaucuu

SEQ ID NO: 775165 - RNA, 19 nt, Homo sapiens
gugcaucauuguagaagaa

SEQ ID NO: 775166 - RNA, 19 nt, Homo sapiens
ucaagcaaauggaccagaa

SEQ ID NO: 775167 - RNA, 19 nt, Homo sapiens
caugaaaguucguaaaugc

SEQ ID NO: 775168 - RNA, 19 nt, Homo sapiens
ugaaagcuuccauguuuaa

SEQ ID NO: 775169 - RNA, 19 nt, Homo sapiens
aaccauaacugauccuuuc

SEQ ID NO: 775170 - RNA, 19 nt, Homo sapiens
gcaaauuagggcuacauug

SEQ ID NO: 775171 - RNA, 19 nt, Homo sapiens
ccaaauguguaauggagau

SEQ ID NO: 775172 - RNA, 19 nt, Homo sapiens
gcuccaaggaugcaauuaa

SEQ ID NO: 775173 - RNA, 19 nt, Homo sapiens
ccugugguaucuuuaauug

SEQ ID NO: 775174 - RNA, 19 nt, Homo sapiens
gaaaucauugugugucuuc

SEQ ID NO: 775175 - RNA, 19 nt, Homo sapiens
ggaaaucauugugugucuu

SEQ ID NO: 775176 - RNA, 19 nt, Homo sapiens
gcagucuucuaccaaaugu

SEQ ID NO: 775177 - RNA, 19 nt, Homo sapiens
uaaguuaggcagucuucua

SEQ ID NO: 775178 - RNA, 19 nt, Homo sapiens
gcaaauggaccagaagauc

SEQ ID NO: 775179 - RNA, 19 nt, Homo sapiens
gaaugugcagugucuugua

SEQ ID NO: 775180 - RNA, 19 nt, Homo sapiens
gagaaugugcagugucuug

SEQ ID NO: 775181 - RNA, 19 nt, Homo sapiens
uaaaggccaugugaagaga

SEQ ID NO: 775182 - RNA, 19 nt, Homo sapiens
aauuguaucuccuucagaa

SEQ ID NO: 775183 - RNA, 19 nt, Homo sapiens
ggagauugccucaaaauug

SEQ ID NO: 775184 - RNA, 19 nt, Homo sapiens
ggccaugugaagagaauua

SEQ ID NO: 775185 - RNA, 19 nt, Homo sapiens
cuccaaggaugcaauuaaa

SEQ ID NO: 775186 - RNA, 19 nt, Homo sapiens
aaugugcagugucuuguaa

SEQ ID NO: 775187 - RNA, 19 nt, Homo sapiens
aagcuuccauguuuaaugu

SEQ ID NO: 775188 - RNA, 19 nt, Homo sapiens
uugaaagcuuccauguuua

SEQ ID NO: 775189 - RNA, 19 nt, Homo sapiens
gacaugaaaguucguaaau

SEQ ID NO: 775190 - RNA, 19 nt, Homo sapiens
agaacuagcaccucugaaa

SEQ ID NO: 775191 - RNA, 19 nt, Homo sapiens
gagauugccucaaaauugu

SEQ ID NO: 775192 - RNA, 19 nt, Homo sapiens
gguggauccuuaauuguag

SEQ ID NO: 775193 - RNA, 19 nt, Homo sapiens
uaaaugcuccacaccagaa

SEQ ID NO: 775194 - RNA, 19 nt, Homo sapiens
ccucagcauuuacuuuguu

SEQ ID NO: 775195 - RNA, 19 nt, Homo sapiens
guaaaggccaugugaagag

SEQ ID NO: 775196 - RNA, 19 nt, Homo sapiens
gagugcaaguagcugauga

SEQ ID NO: 775197 - RNA, 19 nt, Homo sapiens
gguccaaauucuuuauucu

SEQ ID NO: 775198 - RNA, 19 nt, Homo sapiens
uaaccucagcauuuacuuu

SEQ ID NO: 775199 - RNA, 19 nt, Homo sapiens
gaacuagcaccucugaaaa

SEQ ID NO: 775200 - RNA, 19 nt, Homo sapiens
cagaagaaaucaagaaaag

SEQ ID NO: 775201 - RNA, 19 nt, Homo sapiens
acacaguucacaaacagua

SEQ ID NO: 775202 - RNA, 19 nt, Homo sapiens
agaaagaaggcugucauuu

SEQ ID NO: 775203 - RNA, 19 nt, Homo sapiens
gcucgccauucacugauug

SEQ ID NO: 775204 - RNA, 19 nt, Homo sapiens
gaagaaggcaaagagaucu

SEQ ID NO: 775205 - RNA, 19 nt, Homo sapiens
ugacaugaaaguucguaaa

SEQ ID NO: 775206 - RNA, 19 nt, Homo sapiens
gaugcccuguguagauuau

SEQ ID NO: 775207 - RNA, 19 nt, Homo sapiens
uagcaccucugaaaaguaa

SEQ ID NO: 775208 - RNA, 19 nt, Homo sapiens
gauugucgcuaugcuuugu

SEQ ID NO: 775209 - RNA, 19 nt, Homo sapiens
guagaagaaggcaaagaga

SEQ ID NO: 775210 - RNA, 19 nt, Homo sapiens
gaaggaugcccuguguaga

SEQ ID NO: 775211 - RNA, 19 nt, Homo sapiens
caaauggaccagaagaucu

SEQ ID NO: 775212 - RNA, 19 nt, Homo sapiens
cauaacugauccuuucaag

SEQ ID NO: 775213 - RNA, 19 nt, Homo sapiens
uaggcagucuucuaccaaa

SEQ ID NO: 775214 - RNA, 19 nt, Homo sapiens
ugcaaacagcccuaaauaa

SEQ ID NO: 775215 - RNA, 19 nt, Homo sapiens
acaugaaaguucguaaaug

SEQ ID NO: 775216 - RNA, 19 nt, Homo sapiens
acagaauauugacaagcua

SEQ ID NO: 775217 - RNA, 19 nt, Homo sapiens
uuacacaguucacaaacag

SEQ ID NO: 775218 - RNA, 19 nt, Homo sapiens
ucaggcacaucauuggaau

SEQ ID NO: 775219 - RNA, 19 nt, Homo sapiens
gguguaaccauaacugauc

SEQ ID NO: 775220 - RNA, 19 nt, Homo sapiens
augcaaacagcccuaaaua

SEQ ID NO: 775221 - RNA, 19 nt, Homo sapiens
ugaaggaugcccuguguag

SEQ ID NO: 775222 - RNA, 19 nt, Homo sapiens
aauguuauccucuugcuau

SEQ ID NO: 775223 - RNA, 19 nt, Homo sapiens
gggcuuguauugcugaaaa

SEQ ID NO: 775224 - RNA, 19 nt, Homo sapiens
guuugcuucuuaugguaua

SEQ ID NO: 775225 - RNA, 19 nt, Homo sapiens
uaaccauaacugauccuuu

SEQ ID NO: 775226 - RNA, 19 nt, Homo sapiens
ccuggcaucuuggaaauca

SEQ ID NO: 775227 - RNA, 19 nt, Homo sapiens
ggaggacggucugcauacu

SEQ ID NO: 775228 - RNA, 19 nt, Homo sapiens
ggaugcccuguguagauua

SEQ ID NO: 775229 - RNA, 19 nt, Homo sapiens
uaggacaccugugguaucu

SEQ ID NO: 775230 - RNA, 19 nt, Homo sapiens
gaauauugacaagcuagga

SEQ ID NO: 775231 - RNA, 19 nt, Homo sapiens
cauaauccacgcucaucuu

SEQ ID NO: 775232 - RNA, 19 nt, Homo sapiens
gcuaagcagaauaauggaa

SEQ ID NO: 775233 - RNA, 19 nt, Homo sapiens
aagauugucgcuaugcuuu

SEQ ID NO: 775234 - RNA, 19 nt, Homo sapiens
caccagaagaaaucaagaa

SEQ ID NO: 775235 - RNA, 19 nt, Homo sapiens
gaaagcuuccauguuuaau

SEQ ID NO: 775236 - RNA, 19 nt, Homo sapiens
agaagaaggcaaagagauc

SEQ ID NO: 775237 - RNA, 19 nt, Homo sapiens
guuagguggauccuuaauu

SEQ ID NO: 775238 - RNA, 19 nt, Homo sapiens
gaucucaaucgggcuugua

SEQ ID NO: 775239 - RNA, 19 nt, Homo sapiens
gaccagaagaucucaaucg

SEQ ID NO: 775240 - RNA, 19 nt, Homo sapiens
ccagagaccucaacuuuca

SEQ ID NO: 775241 - RNA, 19 nt, Homo sapiens
gacaacaacuacuugacua

SEQ ID NO: 775242 - RNA, 19 nt, Homo sapiens
gcaagaaggcccuaaagau

SEQ ID NO: 775243 - RNA, 19 nt, Homo sapiens
ccacaggguugguauaauc

SEQ ID NO: 775244 - RNA, 19 nt, Homo sapiens
gagcagcaauaggagauuu

SEQ ID NO: 775245 - RNA, 19 nt, Homo sapiens
ugacuaaauucauggagaa

SEQ ID NO: 775246 - RNA, 19 nt, Homo sapiens
caagaaggcccuaaagauc

SEQ ID NO: 775247 - RNA, 19 nt, Homo sapiens
ggagccaaauccaguaaca

SEQ ID NO: 775248 - RNA, 19 nt, Homo sapiens
caacugccuugcccacaug

SEQ ID NO: 775249 - RNA, 19 nt, Homo sapiens
caggguugguauaaucaua

SEQ ID NO: 775250 - RNA, 19 nt, Homo sapiens
ggagacaacaacuacuuga

SEQ ID NO: 775251 - RNA, 19 nt, Homo sapiens
gaccgcucguuaacauaua

SEQ ID NO: 775252 - RNA, 19 nt, Homo sapiens
aaccagcacucucguaaug

SEQ ID NO: 775253 - RNA, 19 nt, Homo sapiens
gcugcugucuccacgguaa

SEQ ID NO: 775254 - RNA, 19 nt, Homo sapiens
ccagugacgucuacagcuu

SEQ ID NO: 775255 - RNA, 19 nt, Homo sapiens
gaacuguuuguuaacguaa

SEQ ID NO: 775256 - RNA, 19 nt, Homo sapiens
gaaauggauggcuuuagga

SEQ ID NO: 775257 - RNA, 19 nt, Homo sapiens
ggacagcaggcacaucuuc

SEQ ID NO: 775258 - RNA, 19 nt, Homo sapiens
agaaauggauggcuuuagg

SEQ ID NO: 775259 - RNA, 19 nt, Homo sapiens
gccugagacucccggcuua

SEQ ID NO: 775260 - RNA, 19 nt, Homo sapiens
gcagaaccggccuucauug

SEQ ID NO: 775261 - RNA, 19 nt, Homo sapiens
agaacuguuuguuaacgua

SEQ ID NO: 775262 - RNA, 19 nt, Homo sapiens
uggcaagucuggauaacga

SEQ ID NO: 775263 - RNA, 19 nt, Homo sapiens
ccaaggagggacagaaaug

SEQ ID NO: 775264 - RNA, 19 nt, Homo sapiens
ucccagcucuguuccuaaa

SEQ ID NO: 775265 - RNA, 19 nt, Homo sapiens
cuaaacaaacugaaucuag

SEQ ID NO: 775266 - RNA, 19 nt, Homo sapiens
uggaagagaaguugaguug

SEQ ID NO: 775267 - RNA, 19 nt, Homo sapiens
acgucaagcuggcagauuu

SEQ ID NO: 775268 - RNA, 19 nt, Homo sapiens
caacaacuacuugacuaug

SEQ ID NO: 775269 - RNA, 19 nt, Homo sapiens
cuccagagaccucaacuuu

SEQ ID NO: 775270 - RNA, 19 nt, Homo sapiens
ccagcacucucguaaugau

SEQ ID NO: 775271 - RNA, 19 nt, Homo sapiens
auggauggcuuuaggagaa

SEQ ID NO: 775272 - RNA, 19 nt, Homo sapiens
ggcagaaccggccuucauu

SEQ ID NO: 775273 - RNA, 19 nt, Homo sapiens
ccccagaacuguuuguuaa

SEQ ID NO: 775274 - RNA, 19 nt, Homo sapiens
cggcucuggugacuaaauu

SEQ ID NO: 775275 - RNA, 19 nt, Homo sapiens
ggccacaggguugguauaa

SEQ ID NO: 775276 - RNA, 19 nt, Homo sapiens
ggcgaccgcucguuaacau

SEQ ID NO: 775277 - RNA, 19 nt, Homo sapiens
ucuccacgguaaaggauuu

SEQ ID NO: 775278 - RNA, 19 nt, Homo sapiens
guauaaucauagcgggaaa

SEQ ID NO: 775279 - RNA, 19 nt, Homo sapiens
ccaguagguucgcaagaag

SEQ ID NO: 775280 - RNA, 19 nt, Homo sapiens
gcccgagccuuaccaagag

SEQ ID NO: 775281 - RNA, 19 nt, Homo sapiens
gacagaaauggauggcuuu

SEQ ID NO: 775282 - RNA, 19 nt, Homo sapiens
ucgaggaacuggagaacca

SEQ ID NO: 775283 - RNA, 19 nt, Homo sapiens
ucaaggccauggcaagucu

SEQ ID NO: 775284 - RNA, 19 nt, Homo sapiens
acagggcgaccgcucguua

SEQ ID NO: 775285 - RNA, 19 nt, Homo sapiens
gcugagagacaaggcauga

SEQ ID NO: 775286 - RNA, 19 nt, Homo sapiens
ggccaaggagggacagaaa

SEQ ID NO: 775287 - RNA, 19 nt, Homo sapiens
gcuacgauguggcggucaa

SEQ ID NO: 775288 - RNA, 19 nt, Homo sapiens
ucaagaucguaaacucgaa

SEQ ID NO: 775289 - RNA, 19 nt, Homo sapiens
ucagggaggcucacaguca

SEQ ID NO: 775290 - RNA, 19 nt, Homo sapiens
acccagagcugcacgucaa

SEQ ID NO: 775291 - RNA, 19 nt, Homo sapiens
agccggcucuggugacuaa

SEQ ID NO: 775292 - RNA, 19 nt, Homo sapiens
cgaccgcucguuaacauau

SEQ ID NO: 775293 - RNA, 19 nt, Homo sapiens
ccucccagcucuguuccua

SEQ ID NO: 775294 - RNA, 19 nt, Homo sapiens
gaaguggugcuugggaugu

SEQ ID NO: 775295 - RNA, 19 nt, Homo sapiens
gcuaaacaaacugaaucua

SEQ ID NO: 775296 - RNA, 19 nt, Homo sapiens
guggagaacaauaugaaug

SEQ ID NO: 775297 - RNA, 19 nt, Homo sapiens
ggacugaaggagcuaaugc

SEQ ID NO: 775298 - RNA, 19 nt, Homo sapiens
ucuggugacuaaauucaug

SEQ ID NO: 775299 - RNA, 19 nt, Homo sapiens
uagaagggguuaucgagaa

SEQ ID NO: 775300 - RNA, 19 nt, Homo sapiens
gaaaaccagcacucucgua

SEQ ID NO: 775301 - RNA, 19 nt, Homo sapiens
cagaugguggagaacaaua

SEQ ID NO: 775302 - RNA, 19 nt, Homo sapiens
ggcagugcuugcuggaaga

SEQ ID NO: 775303 - RNA, 19 nt, Homo sapiens
gaaggugaacugggaccaa

SEQ ID NO: 775304 - RNA, 19 nt, Homo sapiens
cucaagagcagcaauagga

SEQ ID NO: 775305 - RNA, 19 nt, Homo sapiens
ccacagccagugacgucua

SEQ ID NO: 775306 - RNA, 19 nt, Homo sapiens
accaguagguucgcaagaa

SEQ ID NO: 775307 - RNA, 19 nt, Homo sapiens
cugaguggcuaaacaaacu

SEQ ID NO: 775308 - RNA, 19 nt, Homo sapiens
uuuaggagaaccauagaaa

SEQ ID NO: 775309 - RNA, 19 nt, Homo sapiens
ggagaacaauaugaaugcu

SEQ ID NO: 775310 - RNA, 19 nt, Homo sapiens
gaugguggagaacaauaug

SEQ ID NO: 775311 - RNA, 19 nt, Homo sapiens
gaaggacugaaggagcuaa

SEQ ID NO: 775312 - RNA, 19 nt, Homo sapiens
gcaagucuggauaacgaau

SEQ ID NO: 775313 - RNA, 19 nt, Homo sapiens
caagucuggauaacgaauu

SEQ ID NO: 775314 - RNA, 19 nt, Homo sapiens
ccagaacuguuuguuaacg

SEQ ID NO: 775315 - RNA, 19 nt, Homo sapiens
gcucuggugacuaaauuca

SEQ ID NO: 775316 - RNA, 19 nt, Homo sapiens
acaacuacuugacuaugca

SEQ ID NO: 775317 - RNA, 19 nt, Homo sapiens
ccauggcaagucuggauaa

SEQ ID NO: 775318 - RNA, 19 nt, Homo sapiens
gcacucucguaaugauguc

SEQ ID NO: 775319 - RNA, 19 nt, Homo sapiens
acagaaauggauggcuuua

SEQ ID NO: 775320 - RNA, 19 nt, Homo sapiens
gcaggccacaggguuggua

SEQ ID NO: 775321 - RNA, 19 nt, Homo sapiens
acaacugccuugcccacau

SEQ ID NO: 775322 - RNA, 19 nt, Homo sapiens
agcccuaccucaacuggaa

SEQ ID NO: 775323 - RNA, 19 nt, Homo sapiens
gcccagcccuaccucaacu

SEQ ID NO: 775324 - RNA, 19 nt, Homo sapiens
gcuucgggauccuaaugug

SEQ ID NO: 775325 - RNA, 19 nt, Homo sapiens
auaaucauagcgggaaaua

SEQ ID NO: 775326 - RNA, 19 nt, Homo sapiens
gccacaggguugguauaau

SEQ ID NO: 775327 - RNA, 19 nt, Homo sapiens
uaaacucgaaggcgauauc

SEQ ID NO: 775328 - RNA, 19 nt, Homo sapiens
cgcaagaaggcccuaaaga

SEQ ID NO: 775329 - RNA, 19 nt, Homo sapiens
gccauggcaagucuggaua

SEQ ID NO: 775330 - RNA, 19 nt, Homo sapiens
cagcaggcacaucuucaga

SEQ ID NO: 775331 - RNA, 19 nt, Homo sapiens
ugagacucccggcuuagaa

SEQ ID NO: 775332 - RNA, 19 nt, Homo sapiens
gcugaaagaaguggugcuu

SEQ ID NO: 775333 - RNA, 19 nt, Homo sapiens
ggucaaggccauggcaagu

SEQ ID NO: 775334 - RNA, 19 nt, Homo sapiens
aaacaaacugaaucuagag

SEQ ID NO: 775335 - RNA, 19 nt, Homo sapiens
cagcuucgggauccuaaug

SEQ ID NO: 775336 - RNA, 19 nt, Homo sapiens
cagaacuguuuguuaacgu

SEQ ID NO: 775337 - RNA, 19 nt, Homo sapiens
gacagcaggcacaucuuca

SEQ ID NO: 775338 - RNA, 19 nt, Homo sapiens
gaagguaccugaagaagaa

SEQ ID NO: 775339 - RNA, 19 nt, Homo sapiens
gaacaucaguuggauuaua

SEQ ID NO: 775340 - RNA, 19 nt, Homo sapiens
gaagaggacccuuuaaauu

SEQ ID NO: 775341 - RNA, 19 nt, Homo sapiens
guaaagcaaccaagaaaua

SEQ ID NO: 775342 - RNA, 19 nt, Homo sapiens
gaaagaugguguuaugugu

SEQ ID NO: 775343 - RNA, 19 nt, Homo sapiens
agaagaagcugacaguauu

SEQ ID NO: 775344 - RNA, 19 nt, Homo sapiens
ggaaaguucucacuauauc

SEQ ID NO: 775345 - RNA, 19 nt, Homo sapiens
ccacaggucucucaaacaa

SEQ ID NO: 775346 - RNA, 19 nt, Homo sapiens
caggaaaguucucacuaua

SEQ ID NO: 775347 - RNA, 19 nt, Homo sapiens
ucaacagcaucauuaguua

SEQ ID NO: 775348 - RNA, 19 nt, Homo sapiens
gaagaaauaggaaguacaa

SEQ ID NO: 775349 - RNA, 19 nt, Homo sapiens
gcaaguauuucaacagcuu

SEQ ID NO: 775350 - RNA, 19 nt, Homo sapiens
gauuuaagcauucggguua

SEQ ID NO: 775351 - RNA, 19 nt, Homo sapiens
gaaucuauuugcugaagaa

SEQ ID NO: 775352 - RNA, 19 nt, Homo sapiens
ggugauacaucuuccaaug

SEQ ID NO: 775353 - RNA, 19 nt, Homo sapiens
aaacuaguguuccacaauu

SEQ ID NO: 775354 - RNA, 19 nt, Homo sapiens
ugaagaagguauagaggaa

SEQ ID NO: 775355 - RNA, 19 nt, Homo sapiens
gugaacaucaguuggauua

SEQ ID NO: 775356 - RNA, 19 nt, Homo sapiens
uaaugaagacccucaagua

SEQ ID NO: 775357 - RNA, 19 nt, Homo sapiens
guauggaugugauucugua

SEQ ID NO: 775358 - RNA, 19 nt, Homo sapiens
gagacuauguauuugcaaa

SEQ ID NO: 775359 - RNA, 19 nt, Homo sapiens
gaaugaauuucuagggaau

SEQ ID NO: 775360 - RNA, 19 nt, Homo sapiens
ccgcacagcuugcaccaaa

SEQ ID NO: 775361 - RNA, 19 nt, Homo sapiens
gcauucggguuacugauga

SEQ ID NO: 775362 - RNA, 19 nt, Homo sapiens
ucaggaaaguucucacuau

SEQ ID NO: 775363 - RNA, 19 nt, Homo sapiens
gaaaaugccaccagugaua

SEQ ID NO: 775364 - RNA, 19 nt, Homo sapiens
aaacuccagugcaaacuuu

SEQ ID NO: 775365 - RNA, 19 nt, Homo sapiens
gaagcaagaacaaauggaa

SEQ ID NO: 775366 - RNA, 19 nt, Homo sapiens
ugauacaucuuccaaugaa

SEQ ID NO: 775367 - RNA, 19 nt, Homo sapiens
gagcucaguacaucuauuu

SEQ ID NO: 775368 - RNA, 19 nt, Homo sapiens
gaagaagcugacaguauuu

SEQ ID NO: 775369 - RNA, 19 nt, Homo sapiens
gauaggaaacacuuagaaa

SEQ ID NO: 775370 - RNA, 19 nt, Homo sapiens
gaacugggcacuucaaacu

SEQ ID NO: 775371 - RNA, 19 nt, Homo sapiens
gaauuucuagggaauauug

SEQ ID NO: 775372 - RNA, 19 nt, Homo sapiens
gaaauaggaaguacaagag

SEQ ID NO: 775373 - RNA, 19 nt, Homo sapiens
ucagguggauuuaagcauu

SEQ ID NO: 775374 - RNA, 19 nt, Homo sapiens
aagaugguguuauguguuu

SEQ ID NO: 775375 - RNA, 19 nt, Homo sapiens
uggccagccuucaguaaua

SEQ ID NO: 775376 - RNA, 19 nt, Homo sapiens
cagcagaacugggcacuuc

SEQ ID NO: 775377 - RNA, 19 nt, Homo sapiens
ccacaaacaguagugauaa

SEQ ID NO: 775378 - RNA, 19 nt, Homo sapiens
gagagacuauguauuugca

SEQ ID NO: 775379 - RNA, 19 nt, Homo sapiens
guuauugucugucaguaug

SEQ ID NO: 775380 - RNA, 19 nt, Homo sapiens
ugaagacccucaaguaaac

SEQ ID NO: 775381 - RNA, 19 nt, Homo sapiens
gaagaagaagcugacagua

SEQ ID NO: 775382 - RNA, 19 nt, Homo sapiens
ucagaugcagauacaauua

SEQ ID NO: 775383 - RNA, 19 nt, Homo sapiens
guacaagagaugcagauga

SEQ ID NO: 775384 - RNA, 19 nt, Homo sapiens
uaucuggucaccuuuauaa

SEQ ID NO: 775385 - RNA, 19 nt, Homo sapiens
ugaaggaguucggaaucua

SEQ ID NO: 775386 - RNA, 19 nt, Homo sapiens
gaauauaguccagcacaga

SEQ ID NO: 775387 - RNA, 19 nt, Homo sapiens
agggagagacuauguauuu

SEQ ID NO: 775388 - RNA, 19 nt, Homo sapiens
gcaagaacaaauggaaauu

SEQ ID NO: 775389 - RNA, 19 nt, Homo sapiens
uagaagaggacccuuuaaa

SEQ ID NO: 775390 - RNA, 19 nt, Homo sapiens
caaacaguagugauaauga

SEQ ID NO: 775391 - RNA, 19 nt, Homo sapiens
gagaugcagaugagaauga

SEQ ID NO: 775392 - RNA, 19 nt, Homo sapiens
gggagagacuauguauuug

SEQ ID NO: 775393 - RNA, 19 nt, Homo sapiens
gaaggaguucggaaucuau

SEQ ID NO: 775394 - RNA, 19 nt, Homo sapiens
caagagaugcagaugagaa

SEQ ID NO: 775395 - RNA, 19 nt, Homo sapiens
uaauucagaugcagauaca

SEQ ID NO: 775396 - RNA, 19 nt, Homo sapiens
gcagagugguaaaccuugu

SEQ ID NO: 775397 - RNA, 19 nt, Homo sapiens
ggagggagagacuauguau

SEQ ID NO: 775398 - RNA, 19 nt, Homo sapiens
acaggucucucaaacaaau

SEQ ID NO: 775399 - RNA, 19 nt, Homo sapiens
uuugaaagaugguguuaug

SEQ ID NO: 775400 - RNA, 19 nt, Homo sapiens
aagaggacccuuuaaauuc

SEQ ID NO: 775401 - RNA, 19 nt, Homo sapiens
ggaaucuauuugcugaaga

SEQ ID NO: 775402 - RNA, 19 nt, Homo sapiens
cuaauucucagguggauuu

SEQ ID NO: 775403 - RNA, 19 nt, Homo sapiens
caccagugauauacuugua

SEQ ID NO: 775404 - RNA, 19 nt, Homo sapiens
gacuguaucuggucaccuu

SEQ ID NO: 775405 - RNA, 19 nt, Homo sapiens
ggaugugccagaccuguuu

SEQ ID NO: 775406 - RNA, 19 nt, Homo sapiens
gccacaaacaguagugaua

SEQ ID NO: 775407 - RNA, 19 nt, Homo sapiens
aaugaagacccucaaguaa

SEQ ID NO: 775408 - RNA, 19 nt, Homo sapiens
gaagcuuuguugugucauc

SEQ ID NO: 775409 - RNA, 19 nt, Homo sapiens
cauccaaucaccucuguuu

SEQ ID NO: 775410 - RNA, 19 nt, Homo sapiens
ucaguuggauuauauugca

SEQ ID NO: 775411 - RNA, 19 nt, Homo sapiens
guagauggaagcggugaua

SEQ ID NO: 775412 - RNA, 19 nt, Homo sapiens
gguuacugaugaugauauu

SEQ ID NO: 775413 - RNA, 19 nt, Homo sapiens
agaggaacccagcaacaua

SEQ ID NO: 775414 - RNA, 19 nt, Homo sapiens
aaucgugccugaagcuuug

SEQ ID NO: 775415 - RNA, 19 nt, Homo sapiens
gucaacagcaucauuaguu

SEQ ID NO: 775416 - RNA, 19 nt, Homo sapiens
uguagaagaggacccuuua

SEQ ID NO: 775417 - RNA, 19 nt, Homo sapiens
gaagcugacaguauuucaa

SEQ ID NO: 775418 - RNA, 19 nt, Homo sapiens
ggaguucggaaucuauuug

SEQ ID NO: 775419 - RNA, 19 nt, Homo sapiens
gaaaguucucacuauauca

SEQ ID NO: 775420 - RNA, 19 nt, Homo sapiens
ccaauuauggugacagaga

SEQ ID NO: 775421 - RNA, 19 nt, Homo sapiens
uacaagagaugcagaugag

SEQ ID NO: 775422 - RNA, 19 nt, Homo sapiens
agaaauaggaaguacaaga

SEQ ID NO: 775423 - RNA, 19 nt, Homo sapiens
caccagcacgugacugaua

SEQ ID NO: 775424 - RNA, 19 nt, Homo sapiens
ucaccucuguuuacucuuc

SEQ ID NO: 775425 - RNA, 19 nt, Homo sapiens
agaagaggacccuuuaaau

SEQ ID NO: 775426 - RNA, 19 nt, Homo sapiens
aagaagaagcugacaguau

SEQ ID NO: 775427 - RNA, 19 nt, Homo sapiens
guaauacaaacuaguguuc

SEQ ID NO: 775428 - RNA, 19 nt, Homo sapiens
uuaguucacuguauggaau

SEQ ID NO: 775429 - RNA, 19 nt, Homo sapiens
caucgaagcaagaacaaau

SEQ ID NO: 775430 - RNA, 19 nt, Homo sapiens
gaauugaaaccgugcuaca

SEQ ID NO: 775431 - RNA, 19 nt, Homo sapiens
gcauccaauucagcaagua

SEQ ID NO: 775432 - RNA, 19 nt, Homo sapiens
ugaaagaugguguuaugug

SEQ ID NO: 775433 - RNA, 19 nt, Homo sapiens
gauaagauucaucgaagca

SEQ ID NO: 775434 - RNA, 19 nt, Homo sapiens
agaggacccuuuaaauucu

SEQ ID NO: 775435 - RNA, 19 nt, Homo sapiens
guagaagaggacccuuuaa

SEQ ID NO: 775436 - RNA, 19 nt, Homo sapiens
caaacuaguguuccacaau

SEQ ID NO: 775437 - RNA, 19 nt, Homo sapiens
ccagugcaaacuuuacuuu

SEQ ID NO: 775438 - RNA, 19 nt, Homo sapiens
gaagguaccugaagaagaa

SEQ ID NO: 775439 - RNA, 19 nt, Homo sapiens
gaagaggacccuuuaaauu

SEQ ID NO: 775440 - RNA, 19 nt, Homo sapiens
ggacaucguuuaacaccua

SEQ ID NO: 775441 - RNA, 19 nt, Homo sapiens
guaaagcaaccaagaaaua

SEQ ID NO: 775442 - RNA, 19 nt, Homo sapiens
gauaaggcauucccaagaa

SEQ ID NO: 775443 - RNA, 19 nt, Homo sapiens
agaagaagcugacaguauu

SEQ ID NO: 775444 - RNA, 19 nt, Homo sapiens
ggaaaguucucacuauauc

SEQ ID NO: 775445 - RNA, 19 nt, Homo sapiens
ucgcuuggcuuccugauua

SEQ ID NO: 775446 - RNA, 19 nt, Homo sapiens
ccacaggucucucaaacaa

SEQ ID NO: 775447 - RNA, 19 nt, Homo sapiens
caggaaaguucucacuaua

SEQ ID NO: 775448 - RNA, 19 nt, Homo sapiens
ucaacagcaucauuaguua

SEQ ID NO: 775449 - RNA, 19 nt, Homo sapiens
gaagaaauaggaaguacaa

SEQ ID NO: 775450 - RNA, 19 nt, Homo sapiens
gcaaguauuucaacagcuu

SEQ ID NO: 775451 - RNA, 19 nt, Homo sapiens
gauuuaagcauucggguua

SEQ ID NO: 775452 - RNA, 19 nt, Homo sapiens
gaaucuauuugcugaagaa

SEQ ID NO: 775453 - RNA, 19 nt, Homo sapiens
ccaagaaggacaucguuua

SEQ ID NO: 775454 - RNA, 19 nt, Homo sapiens
ggugauacaucuuccaaug

SEQ ID NO: 775455 - RNA, 19 nt, Homo sapiens
aaacuaguguuccacaauu

SEQ ID NO: 775456 - RNA, 19 nt, Homo sapiens
ugaagaagguauagaggaa

SEQ ID NO: 775457 - RNA, 19 nt, Homo sapiens
caagaaggacaucguuuaa

SEQ ID NO: 775458 - RNA, 19 nt, Homo sapiens
uaaugaagacccucaagua

SEQ ID NO: 775459 - RNA, 19 nt, Homo sapiens
guauggaugugauucugua

SEQ ID NO: 775460 - RNA, 19 nt, Homo sapiens
gaaugaauuucuagggaau

SEQ ID NO: 775461 - RNA, 19 nt, Homo sapiens
ccgcacagcuugcaccaaa

SEQ ID NO: 775462 - RNA, 19 nt, Homo sapiens
gcauucggguuacugauga

SEQ ID NO: 775463 - RNA, 19 nt, Homo sapiens
ucaggaaaguucucacuau

SEQ ID NO: 775464 - RNA, 19 nt, Homo sapiens
gaaaaugccaccagugaua

SEQ ID NO: 775465 - RNA, 19 nt, Homo sapiens
aaacuccagugcaaacuuu

SEQ ID NO: 775466 - RNA, 19 nt, Homo sapiens
ugauacaucuuccaaugaa

SEQ ID NO: 775467 - RNA, 19 nt, Homo sapiens
gaagaagcugacaguauuu

SEQ ID NO: 775468 - RNA, 19 nt, Homo sapiens
gauaggaaacacuuagaaa

SEQ ID NO: 775469 - RNA, 19 nt, Homo sapiens
gaacugggcacuucaaacu

SEQ ID NO: 775470 - RNA, 19 nt, Homo sapiens
agaaggacaucguuuaaca

SEQ ID NO: 775471 - RNA, 19 nt, Homo sapiens
gaauuucuagggaauauug

SEQ ID NO: 775472 - RNA, 19 nt, Homo sapiens
gaaauaggaaguacaagag

SEQ ID NO: 775473 - RNA, 19 nt, Homo sapiens
ucagguggauuuaagcauu

SEQ ID NO: 775474 - RNA, 19 nt, Homo sapiens
uggccagccuucaguaaua

SEQ ID NO: 775475 - RNA, 19 nt, Homo sapiens
cagcagaacugggcacuuc

SEQ ID NO: 775476 - RNA, 19 nt, Homo sapiens
ccacaaacaguagugauaa

SEQ ID NO: 775477 - RNA, 19 nt, Homo sapiens
guuauugucugucaguaug

SEQ ID NO: 775478 - RNA, 19 nt, Homo sapiens
ugaagacccucaaguaaac

SEQ ID NO: 775479 - RNA, 19 nt, Homo sapiens
gaagaagaagcugacagua

SEQ ID NO: 775480 - RNA, 19 nt, Homo sapiens
guacaagagaugcagauga

SEQ ID NO: 775481 - RNA, 19 nt, Homo sapiens
ugaaggaguucggaaucua

SEQ ID NO: 775482 - RNA, 19 nt, Homo sapiens
uaucuggucaccuuuauaa

SEQ ID NO: 775483 - RNA, 19 nt, Homo sapiens
uagaagaggacccuuuaaa

SEQ ID NO: 775484 - RNA, 19 nt, Homo sapiens
caaacaguagugauaauga

SEQ ID NO: 775485 - RNA, 19 nt, Homo sapiens
gagaugcagaugagaauga

SEQ ID NO: 775486 - RNA, 19 nt, Homo sapiens
uaacaaaggauccgagaag

SEQ ID NO: 775487 - RNA, 19 nt, Homo sapiens
caagagaugcagaugagaa

SEQ ID NO: 775488 - RNA, 19 nt, Homo sapiens
gaaggaguucggaaucuau

SEQ ID NO: 775489 - RNA, 19 nt, Homo sapiens
acaggucucucaaacaaau

SEQ ID NO: 775490 - RNA, 19 nt, Homo sapiens
aagaggacccuuuaaauuc

SEQ ID NO: 775491 - RNA, 19 nt, Homo sapiens
ggaaucuauuugcugaaga

SEQ ID NO: 775492 - RNA, 19 nt, Homo sapiens
cuaauucucagguggauuu

SEQ ID NO: 775493 - RNA, 19 nt, Homo sapiens
caccagugauauacuugua

SEQ ID NO: 775494 - RNA, 19 nt, Homo sapiens
gacuguaucuggucaccuu

SEQ ID NO: 775495 - RNA, 19 nt, Homo sapiens
ggaugugccagaccuguuu

SEQ ID NO: 775496 - RNA, 19 nt, Homo sapiens
gccacaaacaguagugaua

SEQ ID NO: 775497 - RNA, 19 nt, Homo sapiens
aaugaagacccucaaguaa

SEQ ID NO: 775498 - RNA, 19 nt, Homo sapiens
gaagcuuuguugugucauc

SEQ ID NO: 775499 - RNA, 19 nt, Homo sapiens
cauccaaucaccucuguuu

SEQ ID NO: 775500 - RNA, 19 nt, Homo sapiens
guagauggaagcggugaua

SEQ ID NO: 775501 - RNA, 19 nt, Homo sapiens
gguuacugaugaugauauu

SEQ ID NO: 775502 - RNA, 19 nt, Homo sapiens
agaggaacccagcaacaua

SEQ ID NO: 775503 - RNA, 19 nt, Homo sapiens
aaucgugccugaagcuuug

SEQ ID NO: 775504 - RNA, 19 nt, Homo sapiens
gucaacagcaucauuaguu

SEQ ID NO: 775505 - RNA, 19 nt, Homo sapiens
aaagcuguauuccacugua

SEQ ID NO: 775506 - RNA, 19 nt, Homo sapiens
uggcauauuugcuuccuau

SEQ ID NO: 775507 - RNA, 19 nt, Homo sapiens
uguagaagaggacccuuua

SEQ ID NO: 775508 - RNA, 19 nt, Homo sapiens
gaagcugacaguauuucaa

SEQ ID NO: 775509 - RNA, 19 nt, Homo sapiens
gaaaguucucacuauauca

SEQ ID NO: 775510 - RNA, 19 nt, Homo sapiens
ggaguucggaaucuauuug

SEQ ID NO: 775511 - RNA, 19 nt, Homo sapiens
ccaauuauggugacagaga

SEQ ID NO: 775512 - RNA, 19 nt, Homo sapiens
gcacugccaaaccaauaaa

SEQ ID NO: 775513 - RNA, 19 nt, Homo sapiens
uacaagagaugcagaugag

SEQ ID NO: 775514 - RNA, 19 nt, Homo sapiens
agaaauaggaaguacaaga

SEQ ID NO: 775515 - RNA, 19 nt, Homo sapiens
caccagcacgugacugaua

SEQ ID NO: 775516 - RNA, 19 nt, Homo sapiens
ucaccucuguuuacucuuc

SEQ ID NO: 775517 - RNA, 19 nt, Homo sapiens
agaagaggacccuuuaaau

SEQ ID NO: 775518 - RNA, 19 nt, Homo sapiens
aagaagaagcugacaguau

SEQ ID NO: 775519 - RNA, 19 nt, Homo sapiens
guaauacaaacuaguguuc

SEQ ID NO: 775520 - RNA, 19 nt, Homo sapiens
cagaagagaaagcuguauu

SEQ ID NO: 775521 - RNA, 19 nt, Homo sapiens
gaauugaaaccgugcuaca

SEQ ID NO: 775522 - RNA, 19 nt, Homo sapiens
gcauccaauucagcaagua

SEQ ID NO: 775523 - RNA, 19 nt, Homo sapiens
agaggacccuuuaaauucu

SEQ ID NO: 775524 - RNA, 19 nt, Homo sapiens
guagaagaggacccuuuaa

SEQ ID NO: 775525 - RNA, 19 nt, Homo sapiens
caaacuaguguuccacaau

SEQ ID NO: 775526 - RNA, 19 nt, Homo sapiens
ccagugcaaacuuuacuuu

SEQ ID NO: 775527 - RNA, 19 nt, Homo sapiens
caacagcaucauuaguuau

SEQ ID NO: 775528 - RNA, 19 nt, Homo sapiens
cacaaacaguagugauaau

SEQ ID NO: 775529 - RNA, 19 nt, Homo sapiens
gccugaagcuuuguugugu

SEQ ID NO: 775530 - RNA, 19 nt, Homo sapiens
ugccuaaacucuacagauc

SEQ ID NO: 775531 - RNA, 19 nt, Homo sapiens
gcacagcuugcaccaaaca

SEQ ID NO: 775532 - RNA, 19 nt, Homo sapiens
cugccaaaccaauaaauuu

SEQ ID NO: 775533 - RNA, 19 nt, Homo sapiens
ucuuccagguguuguauuu

SEQ ID NO: 775534 - RNA, 19 nt, Homo sapiens
guagauaggaaacacuuag

SEQ ID NO: 775535 - RNA, 19 nt, Homo sapiens
cuauauuucuucuggaauc

SEQ ID NO: 775536 - RNA, 19 nt, Homo sapiens
ggacagugugggaagaaau

SEQ ID NO: 775537 - RNA, 19 nt, Homo sapiens
gacaucguuuaacaccuaa

SEQ ID NO: 775538 - RNA, 19 nt, Homo sapiens
ggaaaugacuucugaauag

SEQ ID NO: 775539 - RNA, 19 nt, Homo sapiens
gaaguuagguggguuaauu

SEQ ID NO: 775540 - RNA, 19 nt, Homo sapiens
ccaaguaacucuccucuuu

SEQ ID NO: 775541 - RNA, 19 nt, Homo sapiens
gcaaaggguucacuuaguu

SEQ ID NO: 775542 - RNA, 19 nt, Homo sapiens
gaagcgagaugaauccuau

SEQ ID NO: 775543 - RNA, 19 nt, Homo sapiens
ccaaggaguugaccaguuu

SEQ ID NO: 775544 - RNA, 19 nt, Homo sapiens
ggauugauauucuugacua

SEQ ID NO: 775545 - RNA, 19 nt, Homo sapiens
caaaguaggucuuccagau

SEQ ID NO: 775546 - RNA, 19 nt, Homo sapiens
gauguuaguucccuucauu

SEQ ID NO: 775547 - RNA, 19 nt, Homo sapiens
gaacugcccuugccggaau

SEQ ID NO: 775548 - RNA, 19 nt, Homo sapiens
uuauuuaccuguccucuua

SEQ ID NO: 775549 - RNA, 19 nt, Homo sapiens
gggcaaaucugugugugua

SEQ ID NO: 775550 - RNA, 19 nt, Homo sapiens
cuacagaguuuauuucaug

SEQ ID NO: 775551 - RNA, 19 nt, Homo sapiens
gguuugagcugaugcguuu

SEQ ID NO: 775552 - RNA, 19 nt, Homo sapiens
gaaccaagacucacuuaga

SEQ ID NO: 775553 - RNA, 19 nt, Homo sapiens
acaaggagaugccuauuga

SEQ ID NO: 775554 - RNA, 19 nt, Homo sapiens
ccaaagacuucccagguuu

SEQ ID NO: 775555 - RNA, 19 nt, Homo sapiens
caaauggacugaagcugaa

SEQ ID NO: 775556 - RNA, 19 nt, Homo sapiens
cuacagaacucuaggugaa

SEQ ID NO: 775557 - RNA, 19 nt, Homo sapiens
gagcauacguggaacuuca

SEQ ID NO: 775558 - RNA, 19 nt, Homo sapiens
gaaaaugccucuuccuuug

SEQ ID NO: 775559 - RNA, 19 nt, Homo sapiens
agauacagcuugauccaua

SEQ ID NO: 775560 - RNA, 19 nt, Homo sapiens
ucagguaggguucaaauua

SEQ ID NO: 775561 - RNA, 19 nt, Homo sapiens
ucaauagcauuagcaguua

SEQ ID NO: 775562 - RNA, 19 nt, Homo sapiens
agaagucucugaaagcuaa

SEQ ID NO: 775563 - RNA, 19 nt, Homo sapiens
gcgcagaggucauccuaug

SEQ ID NO: 775564 - RNA, 19 nt, Homo sapiens
gaaucaaggugucuguaga

SEQ ID NO: 775565 - RNA, 19 nt, Homo sapiens
gugcagaucugaauuuaag

SEQ ID NO: 775566 - RNA, 19 nt, Homo sapiens
cagguaggguucaaauuaa

SEQ ID NO: 775567 - RNA, 19 nt, Homo sapiens
gagaugaauccuauuauga

SEQ ID NO: 775568 - RNA, 19 nt, Homo sapiens
ggagaugccuauugaccaa

SEQ ID NO: 775569 - RNA, 19 nt, Homo sapiens
agacagaaguaguucauga

SEQ ID NO: 775570 - RNA, 19 nt, Homo sapiens
uuaaagagauacagcuuga

SEQ ID NO: 775571 - RNA, 19 nt, Homo sapiens
uuacugugcugugaauuua

SEQ ID NO: 775572 - RNA, 19 nt, Homo sapiens
cacaagaguuuauccacua

SEQ ID NO: 775573 - RNA, 19 nt, Homo sapiens
cuucacagguugacuagua

SEQ ID NO: 775574 - RNA, 19 nt, Homo sapiens
gaggcucacuguugaugua

SEQ ID NO: 775575 - RNA, 19 nt, Homo sapiens
aaauguagaucuggaagua

SEQ ID NO: 775576 - RNA, 19 nt, Homo sapiens
gaguggaaaugacuucuga

SEQ ID NO: 775577 - RNA, 19 nt, Homo sapiens
uagcaagaguuuaugauga

SEQ ID NO: 775578 - RNA, 19 nt, Homo sapiens
gagcuaugcuugugauaca

SEQ ID NO: 775579 - RNA, 19 nt, Homo sapiens
caaaugagcagacuuccaa

SEQ ID NO: 775580 - RNA, 19 nt, Homo sapiens
gaaaggaauuguuauugcu

SEQ ID NO: 775581 - RNA, 19 nt, Homo sapiens
guugagaacuucaguguag

SEQ ID NO: 775582 - RNA, 19 nt, Homo sapiens
gugagaagcuugaacaucu

SEQ ID NO: 775583 - RNA, 19 nt, Homo sapiens
gauucagucuugacaauau

SEQ ID NO: 775584 - RNA, 19 nt, Homo sapiens
gaaauucccucugauuggu

SEQ ID NO: 775585 - RNA, 19 nt, Homo sapiens
gagcaaucaagaaucauua

SEQ ID NO: 775586 - RNA, 19 nt, Homo sapiens
gcaaaucuguguguguaug

SEQ ID NO: 775587 - RNA, 19 nt, Homo sapiens
ccaaaguucugggauuaaa

SEQ ID NO: 775588 - RNA, 19 nt, Homo sapiens
uuagagaaguuuagaccua

SEQ ID NO: 775589 - RNA, 19 nt, Homo sapiens
caaauuagagcuuggauca

SEQ ID NO: 775590 - RNA, 19 nt, Homo sapiens
cgagaugaauccuauuaug

SEQ ID NO: 775591 - RNA, 19 nt, Homo sapiens
aggaggagcugaugaaguu

SEQ ID NO: 775592 - RNA, 19 nt, Homo sapiens
uuugaugccuugcuuauaa

SEQ ID NO: 775593 - RNA, 19 nt, Homo sapiens
gcagcgagcuugcuacaac

SEQ ID NO: 775594 - RNA, 19 nt, Homo sapiens
gcagugguauggaagauag

SEQ ID NO: 775595 - RNA, 19 nt, Homo sapiens
gaugaauccuauuaugaga

SEQ ID NO: 775596 - RNA, 19 nt, Homo sapiens
gcagauguauuaugaacag

SEQ ID NO: 775597 - RNA, 19 nt, Homo sapiens
gaaacaaggagaugccuau

SEQ ID NO: 775598 - RNA, 19 nt, Homo sapiens
aggaugaacuuaaugacua

SEQ ID NO: 775599 - RNA, 19 nt, Homo sapiens
gcuguucaaucuucucaaa

SEQ ID NO: 775600 - RNA, 19 nt, Homo sapiens
caagaaauucccucugauu

SEQ ID NO: 775601 - RNA, 19 nt, Homo sapiens
aaucaugacucacaaagau

SEQ ID NO: 775602 - RNA, 19 nt, Homo sapiens
ggaaguaucugugcuuuug

SEQ ID NO: 775603 - RNA, 19 nt, Homo sapiens
guggcuagguguagaauga

SEQ ID NO: 775604 - RNA, 19 nt, Homo sapiens
agacaguucuaggauguua

SEQ ID NO: 775605 - RNA, 19 nt, Homo sapiens
ggacuaaagcccaaaugga

SEQ ID NO: 775606 - RNA, 19 nt, Homo sapiens
ggaugaacuuaaugacuau

SEQ ID NO: 775607 - RNA, 19 nt, Homo sapiens
caucucuucuugcugcuua

SEQ ID NO: 775608 - RNA, 19 nt, Homo sapiens
gcugugaauuuauaucuuc

SEQ ID NO: 775609 - RNA, 19 nt, Homo sapiens
gcaggguguuacagcauaa

SEQ ID NO: 775610 - RNA, 19 nt, Homo sapiens
gcugugauaacucaaauuu

SEQ ID NO: 775611 - RNA, 19 nt, Homo sapiens
aaccaagacucacuuagaa

SEQ ID NO: 775612 - RNA, 19 nt, Homo sapiens
ugcagaagcugauagcauu

SEQ ID NO: 775613 - RNA, 19 nt, Homo sapiens
gaugguugguugaaaggaa

SEQ ID NO: 775614 - RNA, 19 nt, Homo sapiens
caaaggagacauaaaccaa

SEQ ID NO: 775615 - RNA, 19 nt, Homo sapiens
uuacugaggugccgucuuc

SEQ ID NO: 775616 - RNA, 19 nt, Homo sapiens
aaacucaaaggcacuguua

SEQ ID NO: 775617 - RNA, 19 nt, Homo sapiens
gaaccugucauucaaguca

SEQ ID NO: 775618 - RNA, 19 nt, Homo sapiens
gaacuacgaggagcaagaa

SEQ ID NO: 775619 - RNA, 19 nt, Homo sapiens
ugaagcggguggaucauga

SEQ ID NO: 775620 - RNA, 19 nt, Homo sapiens
ggaguugaccaguuuguga

SEQ ID NO: 775621 - RNA, 19 nt, Homo sapiens
gaaugagggaggaaauauu

SEQ ID NO: 775622 - RNA, 19 nt, Homo sapiens
ggcagaaggucagauguga

SEQ ID NO: 775623 - RNA, 19 nt, Homo sapiens
ccaacuagcugggauuaca

SEQ ID NO: 775624 - RNA, 19 nt, Homo sapiens
gauuuaguguucuuccaaa

SEQ ID NO: 775625 - RNA, 19 nt, Homo sapiens
gggaaucaaaggagacaua

SEQ ID NO: 775626 - RNA, 19 nt, Homo sapiens
gagcugaugcguuucaaga

SEQ ID NO: 775627 - RNA, 19 nt, Homo sapiens
guacaagaauuugagcaau

SEQ ID NO: 775628 - RNA, 19 nt, Homo sapiens
gcagaagcugauagcauua

SEQ ID NO: 775629 - RNA, 19 nt, Homo sapiens
ccacuugucaaauauguaa

SEQ ID NO: 775630 - RNA, 19 nt, Homo sapiens
acagcccacuugucaaaua

SEQ ID NO: 775631 - RNA, 19 nt, Homo sapiens
uaaaauuggugacugcaua

SEQ ID NO: 775632 - RNA, 19 nt, Homo sapiens
gaaguugccagcuguuuca

SEQ ID NO: 775633 - RNA, 19 nt, Homo sapiens
gaagaagaauaugaugucu

SEQ ID NO: 775634 - RNA, 19 nt, Homo sapiens
ggacucaugugcuuuaucc

SEQ ID NO: 775635 - RNA, 19 nt, Homo sapiens
ggaaugagggaggaaauau

SEQ ID NO: 775636 - RNA, 19 nt, Homo sapiens
ggguucaaauuaaguagaa

SEQ ID NO: 775637 - RNA, 19 nt, Homo sapiens
gaacucacagucugauuag

SEQ ID NO: 775638 - RNA, 19 nt, Homo sapiens
gaaauaaggcuugcuguuu

SEQ ID NO: 775639 - RNA, 19 nt, Homo sapiens
gaagaaccuuaauuccaua

SEQ ID NO: 775640 - RNA, 19 nt, Homo sapiens
gugccaaacucauugauuu

SEQ ID NO: 775641 - RNA, 19 nt, Homo sapiens
gguaagggauugaggauca

SEQ ID NO: 775642 - RNA, 19 nt, Homo sapiens
aaauaaggcuugcuguuug

SEQ ID NO: 775643 - RNA, 19 nt, Homo sapiens
cccaguagcuuuuauuuua

SEQ ID NO: 775644 - RNA, 19 nt, Homo sapiens
caggaucucuuugacuaua

SEQ ID NO: 775645 - RNA, 19 nt, Homo sapiens
ggaaauaaggcuugcuguu

SEQ ID NO: 775646 - RNA, 19 nt, Homo sapiens
agaagaaccuuaauuccau

SEQ ID NO: 775647 - RNA, 19 nt, Homo sapiens
gagaagaaccuuaauucca

SEQ ID NO: 775648 - RNA, 19 nt, Homo sapiens
gaacuucuugcuucucauu

SEQ ID NO: 775649 - RNA, 19 nt, Homo sapiens
ggacaccgccucacagauc

SEQ ID NO: 775650 - RNA, 19 nt, Homo sapiens
ggacauuuguugacuuggu

SEQ ID NO: 775651 - RNA, 19 nt, Homo sapiens
agggauagauggacauuug

SEQ ID NO: 775652 - RNA, 19 nt, Homo sapiens
cccaggaucucuuugacua

SEQ ID NO: 775653 - RNA, 19 nt, Homo sapiens
ggacaccaccagacaauag

SEQ ID NO: 775654 - RNA, 19 nt, Homo sapiens
ggucauuaccagucauuaa

SEQ ID NO: 775655 - RNA, 19 nt, Homo sapiens
gggaacuucuugcuucuca

SEQ ID NO: 775656 - RNA, 19 nt, Homo sapiens
gaacauccugauagaccua

SEQ ID NO: 775657 - RNA, 19 nt, Homo sapiens
uuuccugccuggauuauuu

SEQ ID NO: 775658 - RNA, 19 nt, Homo sapiens
uagaagacauaaaccaagu

SEQ ID NO: 775659 - RNA, 19 nt, Homo sapiens
gcaaacaccagccgaggau

SEQ ID NO: 775660 - RNA, 19 nt, Homo sapiens
gugagaagaaccuuaauuc

SEQ ID NO: 775661 - RNA, 19 nt, Homo sapiens
gaaccuguggucccugauu

SEQ ID NO: 775662 - RNA, 19 nt, Homo sapiens
gacauuuguugacuugguu

SEQ ID NO: 775663 - RNA, 19 nt, Homo sapiens
ccaccaguuucucugcuuu

SEQ ID NO: 775664 - RNA, 19 nt, Homo sapiens
ggugagaagaaccuuaauu

SEQ ID NO: 775665 - RNA, 19 nt, Homo sapiens
gagguaaugcccuguuguu

SEQ ID NO: 775666 - RNA, 19 nt, Homo sapiens
gauggacauuuguugacuu

SEQ ID NO: 775667 - RNA, 19 nt, Homo sapiens
gauagauggacauuuguug

SEQ ID NO: 775668 - RNA, 19 nt, Homo sapiens
gaugaacccuacacugacu

SEQ ID NO: 775669 - RNA, 19 nt, Homo sapiens
gggagguaaugcccuguug

SEQ ID NO: 775670 - RNA, 19 nt, Homo sapiens
ccagacugcugugcccuaa

SEQ ID NO: 775671 - RNA, 19 nt, Homo sapiens
aggaugggauggaugguuu

SEQ ID NO: 775672 - RNA, 19 nt, Homo sapiens
uaucccaagugcucuuauu

SEQ ID NO: 775673 - RNA, 19 nt, Homo sapiens
gucauuaccagucauuaaa

SEQ ID NO: 775674 - RNA, 19 nt, Homo sapiens
ggaaggaauggaagaugga

SEQ ID NO: 775675 - RNA, 19 nt, Homo sapiens
ggauagauggacauuuguu

SEQ ID NO: 775676 - RNA, 19 nt, Homo sapiens
gacccucacuggaagagau

SEQ ID NO: 775677 - RNA, 19 nt, Homo sapiens
agacugcugugcccuaauc

SEQ ID NO: 775678 - RNA, 19 nt, Homo sapiens
cugcuugacugguuugaga

SEQ ID NO: 775679 - RNA, 19 nt, Homo sapiens
ccaccuccauguugaccaa

SEQ ID NO: 775680 - RNA, 19 nt, Homo sapiens
guuagaagacauaaaccaa

SEQ ID NO: 775681 - RNA, 19 nt, Homo sapiens
cugcuucuuuggccaagua

SEQ ID NO: 775682 - RNA, 19 nt, Homo sapiens
aauaaggcuugcuguuugu

SEQ ID NO: 775683 - RNA, 19 nt, Homo sapiens
agccuagggucccauauug

SEQ ID NO: 775684 - RNA, 19 nt, Homo sapiens
ccaguucccuucccaaucc

SEQ ID NO: 775685 - RNA, 19 nt, Homo sapiens
cuaccaccacacaaacuua

SEQ ID NO: 775686 - RNA, 19 nt, Homo sapiens
ggugaaguuguucccauuu

SEQ ID NO: 775687 - RNA, 19 nt, Homo sapiens
aaccuguggucccugauuu

SEQ ID NO: 775688 - RNA, 19 nt, Homo sapiens
gaagucgcacugcuaugga

SEQ ID NO: 775689 - RNA, 19 nt, Homo sapiens
ccagguggccaucaaagug

SEQ ID NO: 775690 - RNA, 19 nt, Homo sapiens
ggaaguuuauuuuggugaa

SEQ ID NO: 775691 - RNA, 19 nt, Homo sapiens
cuggugcccugcuucauga

SEQ ID NO: 775692 - RNA, 19 nt, Homo sapiens
ggaucucuuugacuauauc

SEQ ID NO: 775693 - RNA, 19 nt, Homo sapiens
acaauaggaugggauggau

SEQ ID NO: 775694 - RNA, 19 nt, Homo sapiens
cauuaccagucauuaaagu

SEQ ID NO: 775695 - RNA, 19 nt, Homo sapiens
gacaauaggaugggaugga

SEQ ID NO: 775696 - RNA, 19 nt, Homo sapiens
cccaagugcucuuauucug

SEQ ID NO: 775697 - RNA, 19 nt, Homo sapiens
augagaacauccugauaga

SEQ ID NO: 775698 - RNA, 19 nt, Homo sapiens
uugacuauaucacagagaa

SEQ ID NO: 775699 - RNA, 19 nt, Homo sapiens
ccuacuaccaccacacaaa

SEQ ID NO: 775700 - RNA, 19 nt, Homo sapiens
ugagagggaccaggagauu

SEQ ID NO: 775701 - RNA, 19 nt, Homo sapiens
guucauaugcuuuuacuug

SEQ ID NO: 775702 - RNA, 19 nt, Homo sapiens
augaugaacccuacacuga

SEQ ID NO: 775703 - RNA, 19 nt, Homo sapiens
uggaaacccacuauuuaau

SEQ ID NO: 775704 - RNA, 19 nt, Homo sapiens
uagccuagggucccauauu

SEQ ID NO: 775705 - RNA, 19 nt, Homo sapiens
gaaguuguucccauuuuga

SEQ ID NO: 775706 - RNA, 19 nt, Homo sapiens
gugaaguuguucccauuuu

SEQ ID NO: 775707 - RNA, 19 nt, Homo sapiens
uggugaaguuguucccauu

SEQ ID NO: 775708 - RNA, 19 nt, Homo sapiens
gaucagggguuagaagaca

SEQ ID NO: 775709 - RNA, 19 nt, Homo sapiens
gauugaggaucagggguua

SEQ ID NO: 775710 - RNA, 19 nt, Homo sapiens
cagcgccaccuccauguug

SEQ ID NO: 775711 - RNA, 19 nt, Homo sapiens
cagguggccaucaaaguga

SEQ ID NO: 775712 - RNA, 19 nt, Homo sapiens
ucacaugcccacucgaagu

SEQ ID NO: 775713 - RNA, 19 nt, Homo sapiens
cgaagucgcacugcuaugg

SEQ ID NO: 775714 - RNA, 19 nt, Homo sapiens
ggaucucucgacaccagua

SEQ ID NO: 775715 - RNA, 19 nt, Homo sapiens
ggaggggaguuccaagugu

SEQ ID NO: 775716 - RNA, 19 nt, Homo sapiens
ggagguaaugcccuguugu

SEQ ID NO: 775717 - RNA, 19 nt, Homo sapiens
cuaaggaaguuuauuuugg

SEQ ID NO: 775718 - RNA, 19 nt, Homo sapiens
gcagcgccaccuccauguu

SEQ ID NO: 775719 - RNA, 19 nt, Homo sapiens
aaacaccagccgaggaugu

SEQ ID NO: 775720 - RNA, 19 nt, Homo sapiens
gccaccaguuucucugcuu

SEQ ID NO: 775721 - RNA, 19 nt, Homo sapiens
gucauuaaaguccaguauu

SEQ ID NO: 775722 - RNA, 19 nt, Homo sapiens
gagagggaccaggagauuc

SEQ ID NO: 775723 - RNA, 19 nt, Homo sapiens
ugggcauccuccucuauga

SEQ ID NO: 775724 - RNA, 19 nt, Homo sapiens
aaccaaguuugcccaguuc

SEQ ID NO: 775725 - RNA, 19 nt, Homo sapiens
caggacaccgccucacaga

SEQ ID NO: 775726 - RNA, 19 nt, Homo sapiens
auagauggacauuuguuga

SEQ ID NO: 775727 - RNA, 19 nt, Homo sapiens
cauaauuugggaaggaaug

SEQ ID NO: 775728 - RNA, 19 nt, Homo sapiens
ccgccugcuugacugguuu

SEQ ID NO: 775729 - RNA, 19 nt, Homo sapiens
cuggugagaagaaccuuaa

SEQ ID NO: 775730 - RNA, 19 nt, Homo sapiens
gaaaucagaugaaggcaua

SEQ ID NO: 775731 - RNA, 19 nt, Homo sapiens
gaacgaagguuucuugguu

SEQ ID NO: 775732 - RNA, 19 nt, Homo sapiens
gaagguuucuugguucaua

SEQ ID NO: 775733 - RNA, 19 nt, Homo sapiens
ccaauaaccugcugaggaa

SEQ ID NO: 775734 - RNA, 19 nt, Homo sapiens
gagcuaagaagucugaaua

SEQ ID NO: 775735 - RNA, 19 nt, Homo sapiens
cagaugagaugcuauaugu

SEQ ID NO: 775736 - RNA, 19 nt, Homo sapiens
ggaaagaaaucagaugaag

SEQ ID NO: 775737 - RNA, 19 nt, Homo sapiens
gaaaugucgcuccacuuua

SEQ ID NO: 775738 - RNA, 19 nt, Homo sapiens
gaugagaugcuauauguga

SEQ ID NO: 775739 - RNA, 19 nt, Homo sapiens
guaaauaaaugcguguuca

SEQ ID NO: 775740 - RNA, 19 nt, Homo sapiens
gauccuauaucgccaguuc

SEQ ID NO: 775741 - RNA, 19 nt, Homo sapiens
gaacagaagccuaaaauuc

SEQ ID NO: 775742 - RNA, 19 nt, Homo sapiens
acaauaagauccuauaucg

SEQ ID NO: 775743 - RNA, 19 nt, Homo sapiens
ggaggucuuugacaagcua

SEQ ID NO: 775744 - RNA, 19 nt, Homo sapiens
cgaugacaauguguaaaua

SEQ ID NO: 775745 - RNA, 19 nt, Homo sapiens
caaagaagcguugaaguuc

SEQ ID NO: 775746 - RNA, 19 nt, Homo sapiens
agagguagcugugguguug

SEQ ID NO: 775747 - RNA, 19 nt, Homo sapiens
ggagaggccugcgggaaau

SEQ ID NO: 775748 - RNA, 19 nt, Homo sapiens
gccaggaggucuuugacaa

SEQ ID NO: 775749 - RNA, 19 nt, Homo sapiens
gugcugggaucgauuccua

SEQ ID NO: 775750 - RNA, 19 nt, Homo sapiens
agaaaugucgcuccacuuu

SEQ ID NO: 775751 - RNA, 19 nt, Homo sapiens
ccugagaucugucccuuca

SEQ ID NO: 775752 - RNA, 19 nt, Homo sapiens
gcacaauaagauccuauau

SEQ ID NO: 775753 - RNA, 19 nt, Homo sapiens
gguggugccugccuucgaa

SEQ ID NO: 775754 - RNA, 19 nt, Homo sapiens
ggauggagcuaagaagucu

SEQ ID NO: 775755 - RNA, 19 nt, Homo sapiens
gaaacacuggacuuggaua

SEQ ID NO: 775756 - RNA, 19 nt, Homo sapiens
ggaucgauuccuagcuuua

SEQ ID NO: 775757 - RNA, 19 nt, Homo sapiens
aaaugucgcuccacuuuac

SEQ ID NO: 775758 - RNA, 19 nt, Homo sapiens
auuccuagcuuuaccacua

SEQ ID NO: 775759 - RNA, 19 nt, Homo sapiens
ggaggagcaagaccaauau

SEQ ID NO: 775760 - RNA, 19 nt, Homo sapiens
gaaaaucagcacaauaaga

SEQ ID NO: 775761 - RNA, 19 nt, Homo sapiens
gcuaagaagucugaauacu

SEQ ID NO: 775762 - RNA, 19 nt, Homo sapiens
ucauaagggcuucaaagaa

SEQ ID NO: 775763 - RNA, 19 nt, Homo sapiens
ugaaugggauggagcuaag

SEQ ID NO: 775764 - RNA, 19 nt, Homo sapiens
gggaucgauuccuagcuuu

SEQ ID NO: 775765 - RNA, 19 nt, Homo sapiens
ggagcaagaccaauauuuu

SEQ ID NO: 775766 - RNA, 19 nt, Homo sapiens
ucuuagcucuugaacagaa

SEQ ID NO: 775767 - RNA, 19 nt, Homo sapiens
uguguggccuugaguaaau

SEQ ID NO: 775768 - RNA, 19 nt, Homo sapiens
uaaaucccguuaccucucu

SEQ ID NO: 775769 - RNA, 19 nt, Homo sapiens
gggucaaccugccggaaga

SEQ ID NO: 775770 - RNA, 19 nt, Homo sapiens
acacuggacuuggauaugg

SEQ ID NO: 775771 - RNA, 19 nt, Homo sapiens
gaaguuccauccccaaaag

SEQ ID NO: 775772 - RNA, 19 nt, Homo sapiens
uugaaacacuggacuugga

SEQ ID NO: 775773 - RNA, 19 nt, Homo sapiens
gccaggcacccaccaacua

SEQ ID NO: 775774 - RNA, 19 nt, Homo sapiens
cgagagccaugcagauguc

SEQ ID NO: 775775 - RNA, 19 nt, Homo sapiens
gcuccacuuuacagaggua

SEQ ID NO: 775776 - RNA, 19 nt, Homo sapiens
ggugacagccugagaucug

SEQ ID NO: 775777 - RNA, 19 nt, Homo sapiens
gcuguguggccuugaguaa

SEQ ID NO: 775778 - RNA, 19 nt, Homo sapiens
aggaggagcaagaccaaua

SEQ ID NO: 775779 - RNA, 19 nt, Homo sapiens
ugggaucgauuccuagcuu

SEQ ID NO: 775780 - RNA, 19 nt, Homo sapiens
gagcaagaccaauauuuug

SEQ ID NO: 775781 - RNA, 19 nt, Homo sapiens
gcaggaggagcaagaccaa

SEQ ID NO: 775782 - RNA, 19 nt, Homo sapiens
ugagaucugucccuucaac

SEQ ID NO: 775783 - RNA, 19 nt, Homo sapiens
gagccaugcagauguccua

SEQ ID NO: 775784 - RNA, 19 nt, Homo sapiens
aaaaggaggcugaaaauca

SEQ ID NO: 775785 - RNA, 19 nt, Homo sapiens
gaggagcaagaccaauauu

SEQ ID NO: 775786 - RNA, 19 nt, Homo sapiens
ucucagggcuucgccuuca

SEQ ID NO: 775787 - RNA, 19 nt, Homo sapiens
guaagcuucguacaaaugu

SEQ ID NO: 775788 - RNA, 19 nt, Homo sapiens
gaaaacauucuguaagcuu

SEQ ID NO: 775789 - RNA, 19 nt, Homo sapiens
caacuaugcccuggugauc

SEQ ID NO: 775790 - RNA, 19 nt, Homo sapiens
ccgaugacaauguguaaau

SEQ ID NO: 775791 - RNA, 19 nt, Homo sapiens
ugagaugcuauaugugaaa

SEQ ID NO: 775792 - RNA, 19 nt, Homo sapiens
uaucgcaguauuauuguug

SEQ ID NO: 775793 - RNA, 19 nt, Homo sapiens
aaacacuggacuuggauau

SEQ ID NO: 775794 - RNA, 19 nt, Homo sapiens
cuccucaggccaccauuua

SEQ ID NO: 775795 - RNA, 19 nt, Homo sapiens
cacaauaagauccuauauc

SEQ ID NO: 775796 - RNA, 19 nt, Homo sapiens
aagguuucuugguucauaa

SEQ ID NO: 775797 - RNA, 19 nt, Homo sapiens
ccaggcacccaccaacuau

SEQ ID NO: 775798 - RNA, 19 nt, Homo sapiens
ucagaugagaugcuauaug

SEQ ID NO: 775799 - RNA, 19 nt, Homo sapiens
guucauaagggcuucaaag

SEQ ID NO: 775800 - RNA, 19 nt, Homo sapiens
ccugaacgaagguuucuug

SEQ ID NO: 775801 - RNA, 19 nt, Homo sapiens
aaucuuggguggguaguag

SEQ ID NO: 775802 - RNA, 19 nt, Homo sapiens
cuaccgaugacaaugugua

SEQ ID NO: 775803 - RNA, 19 nt, Homo sapiens
ggagcuaagaagucugaau

SEQ ID NO: 775804 - RNA, 19 nt, Homo sapiens
gggauggagcuaagaaguc

SEQ ID NO: 775805 - RNA, 19 nt, Homo sapiens
gcgcugggcaccaaugucu

SEQ ID NO: 775806 - RNA, 19 nt, Homo sapiens
auaccuaccucacggaacu

SEQ ID NO: 775807 - RNA, 19 nt, Homo sapiens
gcgauuaccgcgucuacag

SEQ ID NO: 775808 - RNA, 19 nt, Homo sapiens
uggagaggccugcgggaaa

SEQ ID NO: 775809 - RNA, 19 nt, Homo sapiens
gagaugcuauaugugaaaa

SEQ ID NO: 775810 - RNA, 19 nt, Homo sapiens
cuaccucacggaacuguug

SEQ ID NO: 775811 - RNA, 19 nt, Homo sapiens
gcuccucaggccaccauuu

SEQ ID NO: 775812 - RNA, 19 nt, Homo sapiens
ggaguugaaggccaaguac

SEQ ID NO: 775813 - RNA, 19 nt, Homo sapiens
gccuaccgaugacaaugug

SEQ ID NO: 775814 - RNA, 19 nt, Homo sapiens
agaccaauauuuugaguuc

SEQ ID NO: 775815 - RNA, 19 nt, Homo sapiens
aggagcaagaccaauauuu

SEQ ID NO: 775816 - RNA, 19 nt, Homo sapiens
aagaagcguugaaguucca

SEQ ID NO: 775817 - RNA, 19 nt, Homo sapiens
uuccuagcuuuaccacuaa

SEQ ID NO: 775818 - RNA, 19 nt, Homo sapiens
ccaaaaggaggcugaaaau

SEQ ID NO: 775819 - RNA, 19 nt, Homo sapiens
cagaugaaggcauaaaauu

SEQ ID NO: 775820 - RNA, 19 nt, Homo sapiens
uggaaagaaaucagaugaa

SEQ ID NO: 775821 - RNA, 19 nt, Homo sapiens
acuaugcccuggugaucga

SEQ ID NO: 775822 - RNA, 19 nt, Homo sapiens
cgcaguauuauuguuguua

SEQ ID NO: 775823 - RNA, 19 nt, Homo sapiens
gaugaaagcucucuaaaga

SEQ ID NO: 775824 - RNA, 19 nt, Homo sapiens
gaacaaaucccuaaugauc

SEQ ID NO: 775825 - RNA, 19 nt, Homo sapiens
ggaagaaugugacgaguug

SEQ ID NO: 775826 - RNA, 19 nt, Homo sapiens
guagacagcuggaugauug

SEQ ID NO: 775827 - RNA, 19 nt, Homo sapiens
caaaucagcuccaaagaau

SEQ ID NO: 775828 - RNA, 19 nt, Homo sapiens
gagcauauccugaaagaaa

SEQ ID NO: 775829 - RNA, 19 nt, Homo sapiens
ucaaauggccaaacuaaua

SEQ ID NO: 775830 - RNA, 19 nt, Homo sapiens
gaugugaccuucauucuuc

SEQ ID NO: 775831 - RNA, 19 nt, Homo sapiens
ccacgaggccuguauaauu

SEQ ID NO: 775832 - RNA, 19 nt, Homo sapiens
gaacauguacuguguaucu

SEQ ID NO: 775833 - RNA, 19 nt, Homo sapiens
agacaaagguuaugaaacu

SEQ ID NO: 775834 - RNA, 19 nt, Homo sapiens
acaacaauaugcugucuuu

SEQ ID NO: 775835 - RNA, 19 nt, Homo sapiens
ugaaagcucucuaaagaag

SEQ ID NO: 775836 - RNA, 19 nt, Homo sapiens
acaauaugcugucuuucua

SEQ ID NO: 775837 - RNA, 19 nt, Homo sapiens
caggcuaacuucaucagua

SEQ ID NO: 775838 - RNA, 19 nt, Homo sapiens
gaaaaccugucauuaaguu

SEQ ID NO: 775839 - RNA, 19 nt, Homo sapiens
acaaacagccaacccuuua

SEQ ID NO: 775840 - RNA, 19 nt, Homo sapiens
caaccaagcugagcauauc

SEQ ID NO: 775841 - RNA, 19 nt, Homo sapiens
gcaaaugaucgcugucaaa

SEQ ID NO: 775842 - RNA, 19 nt, Homo sapiens
gaucucggaugaugaguuc

SEQ ID NO: 775843 - RNA, 19 nt, Homo sapiens
uggaacaaaucccuaauga

SEQ ID NO: 775844 - RNA, 19 nt, Homo sapiens
gcaagaaugccuccucaug

SEQ ID NO: 775845 - RNA, 19 nt, Homo sapiens
ggucauggguuccucaaca

SEQ ID NO: 775846 - RNA, 19 nt, Homo sapiens
uggaaacacuggagucuga

SEQ ID NO: 775847 - RNA, 19 nt, Homo sapiens
gaaauguaaggaagcagua

SEQ ID NO: 775848 - RNA, 19 nt, Homo sapiens
gagcuucaguacaccauau

SEQ ID NO: 775849 - RNA, 19 nt, Homo sapiens
caacaguccucaucaacca

SEQ ID NO: 775850 - RNA, 19 nt, Homo sapiens
uugaagaucuccaaugaug

SEQ ID NO: 775851 - RNA, 19 nt, Homo sapiens
caauugaucugugccuuau

SEQ ID NO: 775852 - RNA, 19 nt, Homo sapiens
cagccaacccuuuaaauug

SEQ ID NO: 775853 - RNA, 19 nt, Homo sapiens
ccagagauaaggaaaugua

SEQ ID NO: 775854 - RNA, 19 nt, Homo sapiens
ggucaacaguccucaucaa

SEQ ID NO: 775855 - RNA, 19 nt, Homo sapiens
gaucugugccuuaugcaaa

SEQ ID NO: 775856 - RNA, 19 nt, Homo sapiens
gauugcagauggagaagga

SEQ ID NO: 775857 - RNA, 19 nt, Homo sapiens
cacgaggccuguauaauuc

SEQ ID NO: 775858 - RNA, 19 nt, Homo sapiens
ggaggacuauuuucacuaa

SEQ ID NO: 775859 - RNA, 19 nt, Homo sapiens
caagcaaacucuggagaug

SEQ ID NO: 775860 - RNA, 19 nt, Homo sapiens
gcaggaaauauauucauug

SEQ ID NO: 775861 - RNA, 19 nt, Homo sapiens
ggccagagauaaggaaaug

SEQ ID NO: 775862 - RNA, 19 nt, Homo sapiens
ucaaagagacaaagguuau

SEQ ID NO: 775863 - RNA, 19 nt, Homo sapiens
ucaccugccuggaccauga

SEQ ID NO: 775864 - RNA, 19 nt, Homo sapiens
ggucuucucucgcugcaau

SEQ ID NO: 775865 - RNA, 19 nt, Homo sapiens
gauaaggaaauguaaggaa

SEQ ID NO: 775866 - RNA, 19 nt, Homo sapiens
gcaacugcaucuucucaag

SEQ ID NO: 775867 - RNA, 19 nt, Homo sapiens
cgcuacaucuucaucguua

SEQ ID NO: 775868 - RNA, 19 nt, Homo sapiens
ggaaugugacucugcagaa

SEQ ID NO: 775869 - RNA, 19 nt, Homo sapiens
caaaaugacucacaagaag

SEQ ID NO: 775870 - RNA, 19 nt, Homo sapiens
cagcagaggaagcaaauga

SEQ ID NO: 775871 - RNA, 19 nt, Homo sapiens
ccaauugaucugugccuua

SEQ ID NO: 775872 - RNA, 19 nt, Homo sapiens
gugaacauguacuguguau

SEQ ID NO: 775873 - RNA, 19 nt, Homo sapiens
cacaagaaguugaagaucu

SEQ ID NO: 775874 - RNA, 19 nt, Homo sapiens
guaagcugcucaagauugg

SEQ ID NO: 775875 - RNA, 19 nt, Homo sapiens
gcucacagccucugcuuca

SEQ ID NO: 775876 - RNA, 19 nt, Homo sapiens
gccuagaguuguuugaaga

SEQ ID NO: 775877 - RNA, 19 nt, Homo sapiens
aaucaaauggccaaacuaa

SEQ ID NO: 775878 - RNA, 19 nt, Homo sapiens
auaauucacuggcucucua

SEQ ID NO: 775879 - RNA, 19 nt, Homo sapiens
ucaggagaguauauaauuc

SEQ ID NO: 775880 - RNA, 19 nt, Homo sapiens
ccaguuuguccaacauuua

SEQ ID NO: 775881 - RNA, 19 nt, Homo sapiens
aguugaagaucuccaauga

SEQ ID NO: 775882 - RNA, 19 nt, Homo sapiens
aggcuaacuucaucaguaa

SEQ ID NO: 775883 - RNA, 19 nt, Homo sapiens
gcgcaacagcgaacuagaa

SEQ ID NO: 775884 - RNA, 19 nt, Homo sapiens
gaccuucauucuuccaguu

SEQ ID NO: 775885 - RNA, 19 nt, Homo sapiens
acaaaucagcuccaaagaa

SEQ ID NO: 775886 - RNA, 19 nt, Homo sapiens
ccuaugagcuucaguacac

SEQ ID NO: 775887 - RNA, 19 nt, Homo sapiens
ugaauacugcuaugcauga

SEQ ID NO: 775888 - RNA, 19 nt, Homo sapiens
uggguguccuccuggauua

SEQ ID NO: 775889 - RNA, 19 nt, Homo sapiens
aaucagcuccaaagaauga

SEQ ID NO: 775890 - RNA, 19 nt, Homo sapiens
ggaugaaagcucucuaaag

SEQ ID NO: 775891 - RNA, 19 nt, Homo sapiens
aaacagccaacccuuuaaa

SEQ ID NO: 775892 - RNA, 19 nt, Homo sapiens
caaacagccaacccuuuaa

SEQ ID NO: 775893 - RNA, 19 nt, Homo sapiens
ugaaugaucgauuugagaa

SEQ ID NO: 775894 - RNA, 19 nt, Homo sapiens
augagaaagugaacaugua

SEQ ID NO: 775895 - RNA, 19 nt, Homo sapiens
gccaagggaugcaguaaaa

SEQ ID NO: 775896 - RNA, 19 nt, Homo sapiens
ugaauggauuggcaagaau

SEQ ID NO: 775897 - RNA, 19 nt, Homo sapiens
cuucaucguuaaagccaua

SEQ ID NO: 775898 - RNA, 19 nt, Homo sapiens
gggacucgcuacaucuuca

SEQ ID NO: 775899 - RNA, 19 nt, Homo sapiens
caacugcaggccucaagaa

SEQ ID NO: 775900 - RNA, 19 nt, Homo sapiens
caacauuuacaaucuggaa

SEQ ID NO: 775901 - RNA, 19 nt, Homo sapiens
cuaacucucuccaucuuca

SEQ ID NO: 775902 - RNA, 19 nt, Homo sapiens
ccaaagaaugaauggauug

SEQ ID NO: 775903 - RNA, 19 nt, Homo sapiens
gaaugugacucugcagaac

SEQ ID NO: 775904 - RNA, 19 nt, Homo sapiens
ccccagauuuuauugauua

SEQ ID NO: 775905 - RNA, 19 nt, Homo sapiens
cagccuccgugguucuuaa

SEQ ID NO: 775906 - RNA, 19 nt, Homo sapiens
cagugaaccuacccgacua

SEQ ID NO: 775907 - RNA, 19 nt, Homo sapiens
gccagcagguugaggugaa

SEQ ID NO: 775908 - RNA, 19 nt, Homo sapiens
caaucugccuagaguuguu

SEQ ID NO: 775909 - RNA, 19 nt, Homo sapiens
cuacaaaucagcuccaaag

SEQ ID NO: 775910 - RNA, 19 nt, Homo sapiens
caaauggccaaacuaauac

SEQ ID NO: 775911 - RNA, 19 nt, Homo sapiens
acacuggagucugaauuga

SEQ ID NO: 775912 - RNA, 19 nt, Homo sapiens
gaaagugaacauguacugu

SEQ ID NO: 775913 - RNA, 19 nt, Homo sapiens
ggaacaaaucccuaaugau

SEQ ID NO: 775914 - RNA, 19 nt, Homo sapiens
aggaaaugcugguggaugu

SEQ ID NO: 775915 - RNA, 19 nt, Homo sapiens
gaauggauuggcaagaaug

SEQ ID NO: 775916 - RNA, 19 nt, Homo sapiens
acaagaaguugaagaucuc

SEQ ID NO: 775917 - RNA, 19 nt, Homo sapiens
gguauguuaucucgcugaa

SEQ ID NO: 775918 - RNA, 19 nt, Homo sapiens
gagauaaggaaauguaagg

SEQ ID NO: 775919 - RNA, 19 nt, Homo sapiens
guuaugaaacugagaaagu

SEQ ID NO: 775920 - RNA, 19 nt, Homo sapiens
ggugaauacugcuaugcau

SEQ ID NO: 775921 - RNA, 19 nt, Homo sapiens
caacaugguaugcaauugg

SEQ ID NO: 775922 - RNA, 19 nt, Homo sapiens
cugagcauauccugaaaga

SEQ ID NO: 775923 - RNA, 19 nt, Homo sapiens
gaugaaagcucucuaaaga

SEQ ID NO: 775924 - RNA, 19 nt, Homo sapiens
gaacaaaucccuaaugauc

SEQ ID NO: 775925 - RNA, 19 nt, Homo sapiens
ggaagaaugugacgaguug

SEQ ID NO: 775926 - RNA, 19 nt, Homo sapiens
guagacagcuggaugauug

SEQ ID NO: 775927 - RNA, 19 nt, Homo sapiens
caaaucagcuccaaagaau

SEQ ID NO: 775928 - RNA, 19 nt, Homo sapiens
gagcauauccugaaagaaa

SEQ ID NO: 775929 - RNA, 19 nt, Homo sapiens
ucaaauggccaaacuaaua

SEQ ID NO: 775930 - RNA, 19 nt, Homo sapiens
gaugugaccuucauucuuc

SEQ ID NO: 775931 - RNA, 19 nt, Homo sapiens
gaacauguacuguguaucu

SEQ ID NO: 775932 - RNA, 19 nt, Homo sapiens
agacaaagguuaugaaacu

SEQ ID NO: 775933 - RNA, 19 nt, Homo sapiens
acaacaauaugcugucuuu

SEQ ID NO: 775934 - RNA, 19 nt, Homo sapiens
ugaaagcucucuaaagaag

SEQ ID NO: 775935 - RNA, 19 nt, Homo sapiens
acaauaugcugucuuucua

SEQ ID NO: 775936 - RNA, 19 nt, Homo sapiens
gaaaaccugucauuaaguu

SEQ ID NO: 775937 - RNA, 19 nt, Homo sapiens
acaaacagccaacccuuua

SEQ ID NO: 775938 - RNA, 19 nt, Homo sapiens
caaccaagcugagcauauc

SEQ ID NO: 775939 - RNA, 19 nt, Homo sapiens
gcaaaugaucgcugucaaa

SEQ ID NO: 775940 - RNA, 19 nt, Homo sapiens
gaucucggaugaugaguuc

SEQ ID NO: 775941 - RNA, 19 nt, Homo sapiens
uggaacaaaucccuaauga

SEQ ID NO: 775942 - RNA, 19 nt, Homo sapiens
gcaagaaugccuccucaug

SEQ ID NO: 775943 - RNA, 19 nt, Homo sapiens
ggucauggguuccucaaca

SEQ ID NO: 775944 - RNA, 19 nt, Homo sapiens
uggaaacacuggagucuga

SEQ ID NO: 775945 - RNA, 19 nt, Homo sapiens
gagcuucaguacaccauau

SEQ ID NO: 775946 - RNA, 19 nt, Homo sapiens
caacaguccucaucaacca

SEQ ID NO: 775947 - RNA, 19 nt, Homo sapiens
uugaagaucuccaaugaug

SEQ ID NO: 775948 - RNA, 19 nt, Homo sapiens
caauugaucugugccuuau

SEQ ID NO: 775949 - RNA, 19 nt, Homo sapiens
cagccaacccuuuaaauug

SEQ ID NO: 775950 - RNA, 19 nt, Homo sapiens
ggucaacaguccucaucaa

SEQ ID NO: 775951 - RNA, 19 nt, Homo sapiens
gaucugugccuuaugcaaa

SEQ ID NO: 775952 - RNA, 19 nt, Homo sapiens
ggaggacuauuuucacuaa

SEQ ID NO: 775953 - RNA, 19 nt, Homo sapiens
gauugcagauggagaagga

SEQ ID NO: 775954 - RNA, 19 nt, Homo sapiens
caagcaaacucuggagaug

SEQ ID NO: 775955 - RNA, 19 nt, Homo sapiens
gcaggaaauauauucauug

SEQ ID NO: 775956 - RNA, 19 nt, Homo sapiens
ucaaagagacaaagguuau

SEQ ID NO: 775957 - RNA, 19 nt, Homo sapiens
ucaccugccuggaccauga

SEQ ID NO: 775958 - RNA, 19 nt, Homo sapiens
ggucuucucucgcugcaau

SEQ ID NO: 775959 - RNA, 19 nt, Homo sapiens
gcaacugcaucuucucaag

SEQ ID NO: 775960 - RNA, 19 nt, Homo sapiens
cgcuacaucuucaucguua

SEQ ID NO: 775961 - RNA, 19 nt, Homo sapiens
ggaaugugacucugcagaa

SEQ ID NO: 775962 - RNA, 19 nt, Homo sapiens
caaaaugacucacaagaag

SEQ ID NO: 775963 - RNA, 19 nt, Homo sapiens
cagcagaggaagcaaauga

SEQ ID NO: 775964 - RNA, 19 nt, Homo sapiens
ccaauugaucugugccuua

SEQ ID NO: 775965 - RNA, 19 nt, Homo sapiens
gugaacauguacuguguau

SEQ ID NO: 775966 - RNA, 19 nt, Homo sapiens
cacaagaaguugaagaucu

SEQ ID NO: 775967 - RNA, 19 nt, Homo sapiens
gcucacagccucugcuuca

SEQ ID NO: 775968 - RNA, 19 nt, Homo sapiens
aaucaaauggccaaacuaa

SEQ ID NO: 775969 - RNA, 19 nt, Homo sapiens
gccuagaguuguuugaaga

SEQ ID NO: 775970 - RNA, 19 nt, Homo sapiens
auaauucacuggcucucua

SEQ ID NO: 775971 - RNA, 19 nt, Homo sapiens
ucaggagaguauauaauuc

SEQ ID NO: 775972 - RNA, 19 nt, Homo sapiens
ccaguuuguccaacauuua

SEQ ID NO: 775973 - RNA, 19 nt, Homo sapiens
aguugaagaucuccaauga

SEQ ID NO: 775974 - RNA, 19 nt, Homo sapiens
gcgcaacagcgaacuagaa

SEQ ID NO: 775975 - RNA, 19 nt, Homo sapiens
gaccuucauucuuccaguu

SEQ ID NO: 775976 - RNA, 19 nt, Homo sapiens
acaaaucagcuccaaagaa

SEQ ID NO: 775977 - RNA, 19 nt, Homo sapiens
ucaucagccuguauaauuc

SEQ ID NO: 775978 - RNA, 19 nt, Homo sapiens
ccuaugagcuucaguacac

SEQ ID NO: 775979 - RNA, 19 nt, Homo sapiens
ugaauacugcuaugcauga

SEQ ID NO: 775980 - RNA, 19 nt, Homo sapiens
uggguguccuccuggauua

SEQ ID NO: 775981 - RNA, 19 nt, Homo sapiens
aaucagcuccaaagaauga

SEQ ID NO: 775982 - RNA, 19 nt, Homo sapiens
ggaugaaagcucucuaaag

SEQ ID NO: 775983 - RNA, 19 nt, Homo sapiens
aaacagccaacccuuuaaa

SEQ ID NO: 775984 - RNA, 19 nt, Homo sapiens
caaacagccaacccuuuaa

SEQ ID NO: 775985 - RNA, 19 nt, Homo sapiens
cagccuguauaauucagua

SEQ ID NO: 775986 - RNA, 19 nt, Homo sapiens
ugaaugaucgauuugagaa

SEQ ID NO: 775987 - RNA, 19 nt, Homo sapiens
augagaaagugaacaugua

SEQ ID NO: 775988 - RNA, 19 nt, Homo sapiens
gccaagggaugcaguaaaa

SEQ ID NO: 775989 - RNA, 19 nt, Homo sapiens
ugaauggauuggcaagaau

SEQ ID NO: 775990 - RNA, 19 nt, Homo sapiens
cuucaucguuaaagccaua

SEQ ID NO: 775991 - RNA, 19 nt, Homo sapiens
gggacucgcuacaucuuca

SEQ ID NO: 775992 - RNA, 19 nt, Homo sapiens
caacugcaggccucaagaa

SEQ ID NO: 775993 - RNA, 19 nt, Homo sapiens
caacauuuacaaucuggaa

SEQ ID NO: 775994 - RNA, 19 nt, Homo sapiens
cuaacucucuccaucuuca

SEQ ID NO: 775995 - RNA, 19 nt, Homo sapiens
ccaaagaaugaauggauug

SEQ ID NO: 775996 - RNA, 19 nt, Homo sapiens
gaaugugacucugcagaac

SEQ ID NO: 775997 - RNA, 19 nt, Homo sapiens
ccccagauuuuauugauua

SEQ ID NO: 775998 - RNA, 19 nt, Homo sapiens
cagccuccgugguucuuaa

SEQ ID NO: 775999 - RNA, 19 nt, Homo sapiens
cagugaaccuacccgacua

SEQ ID NO: 776000 - RNA, 19 nt, Homo sapiens
gccagcagguugaggugaa

SEQ ID NO: 776001 - RNA, 19 nt, Homo sapiens
cuacaaaucagcuccaaag

SEQ ID NO: 776002 - RNA, 19 nt, Homo sapiens
acacuggagucugaauuga

SEQ ID NO: 776003 - RNA, 19 nt, Homo sapiens
caaauggccaaacuaauac

SEQ ID NO: 776004 - RNA, 19 nt, Homo sapiens
caaucugccuagaguuguu

SEQ ID NO: 776005 - RNA, 19 nt, Homo sapiens
gaaagugaacauguacugu

SEQ ID NO: 776006 - RNA, 19 nt, Homo sapiens
ggaacaaaucccuaaugau

SEQ ID NO: 776007 - RNA, 19 nt, Homo sapiens
gguauguuaucucgcugaa

SEQ ID NO: 776008 - RNA, 19 nt, Homo sapiens
aggaaaugcugguggaugu

SEQ ID NO: 776009 - RNA, 19 nt, Homo sapiens
gaauggauuggcaagaaug

SEQ ID NO: 776010 - RNA, 19 nt, Homo sapiens
acaagaaguugaagaucuc

SEQ ID NO: 776011 - RNA, 19 nt, Homo sapiens
guuaugaaacugagaaagu

SEQ ID NO: 776012 - RNA, 19 nt, Homo sapiens
ggugaauacugcuaugcau

SEQ ID NO: 776013 - RNA, 19 nt, Homo sapiens
caacaugguaugcaauugg

SEQ ID NO: 776014 - RNA, 19 nt, Homo sapiens
cugagcauauccugaaaga

SEQ ID NO: 776015 - RNA, 19 nt, Homo sapiens
gcagaggaagcaaaugauc

SEQ ID NO: 776016 - RNA, 19 nt, Homo sapiens
agcaaacucuggagaugaa

SEQ ID NO: 776017 - RNA, 19 nt, Homo sapiens
gaaugaucgauuugagaaa

SEQ ID NO: 776018 - RNA, 19 nt, Homo sapiens
uguaucugaugaccaauug

SEQ ID NO: 776019 - RNA, 19 nt, Homo sapiens
ugaauccauugaacccauu

SEQ ID NO: 776020 - RNA, 19 nt, Homo sapiens
gaaagcucucuaaagaaga

SEQ ID NO: 776021 - RNA, 19 nt, Homo sapiens
ggacuauuuucacuaaaga

SEQ ID NO: 776022 - RNA, 19 nt, Homo sapiens
ccugugaggucuccuacug

SEQ ID NO: 776023 - RNA, 19 nt, Homo sapiens
gagaaggguugucacauua

SEQ ID NO: 776024 - RNA, 19 nt, Homo sapiens
guacuaaucucuacgcauu

SEQ ID NO: 776025 - RNA, 19 nt, Homo sapiens
ggaagaaucaucaaaguaa

SEQ ID NO: 776026 - RNA, 19 nt, Homo sapiens
uaauaaagcucacagauca

SEQ ID NO: 776027 - RNA, 19 nt, Homo sapiens
gaaaggaauucuguugauu

SEQ ID NO: 776028 - RNA, 19 nt, Homo sapiens
gaaggguugucacauuaua

SEQ ID NO: 776029 - RNA, 19 nt, Homo sapiens
gcacaacgcccaguguuua

SEQ ID NO: 776030 - RNA, 19 nt, Homo sapiens
gcucaucugugaagccuua

SEQ ID NO: 776031 - RNA, 19 nt, Homo sapiens
gaucgaaacuguggugaaa

SEQ ID NO: 776032 - RNA, 19 nt, Homo sapiens
gaagagagguggugaaacg

SEQ ID NO: 776033 - RNA, 19 nt, Homo sapiens
ggagugacguugauucaga

SEQ ID NO: 776034 - RNA, 19 nt, Homo sapiens
cagacaagcugguguagaa

SEQ ID NO: 776035 - RNA, 19 nt, Homo sapiens
ggagguggaucaaagagaa

SEQ ID NO: 776036 - RNA, 19 nt, Homo sapiens
gcccucaucuguaucauaa

SEQ ID NO: 776037 - RNA, 19 nt, Homo sapiens
ccacagaguuuuaauguuu

SEQ ID NO: 776038 - RNA, 19 nt, Homo sapiens
gccauuagcuuucuacagu

SEQ ID NO: 776039 - RNA, 19 nt, Homo sapiens
gguauacuaugcaagugua

SEQ ID NO: 776040 - RNA, 19 nt, Homo sapiens
cagcggaguucaucaagaa

SEQ ID NO: 776041 - RNA, 19 nt, Homo sapiens
ggucuggucuugcuaaaca

SEQ ID NO: 776042 - RNA, 19 nt, Homo sapiens
ugaggaaucuguagcguau

SEQ ID NO: 776043 - RNA, 19 nt, Homo sapiens
uaaacaagcuuagguccuu

SEQ ID NO: 776044 - RNA, 19 nt, Homo sapiens
cggaguucaucaagaauua

SEQ ID NO: 776045 - RNA, 19 nt, Homo sapiens
agagaaggguugucacauu

SEQ ID NO: 776046 - RNA, 19 nt, Homo sapiens
ggccagcgcuugacuuugu

SEQ ID NO: 776047 - RNA, 19 nt, Homo sapiens
acaacaauauggaagcuaa

SEQ ID NO: 776048 - RNA, 19 nt, Homo sapiens
ugacauagccugugaugau

SEQ ID NO: 776049 - RNA, 19 nt, Homo sapiens
gaacacugaucaugacaac

SEQ ID NO: 776050 - RNA, 19 nt, Homo sapiens
agacugaagugaaaguuga

SEQ ID NO: 776051 - RNA, 19 nt, Homo sapiens
gagcaaaucuaggagaagu

SEQ ID NO: 776052 - RNA, 19 nt, Homo sapiens
ucaagugccagaaguauaa

SEQ ID NO: 776053 - RNA, 19 nt, Homo sapiens
gaacaugcgcuugcgguuu

SEQ ID NO: 776054 - RNA, 19 nt, Homo sapiens
ccaaagaggagaucaugaa

SEQ ID NO: 776055 - RNA, 19 nt, Homo sapiens
acagauauuuggcagcuuu

SEQ ID NO: 776056 - RNA, 19 nt, Homo sapiens
gugaaccuauugauaaaga

SEQ ID NO: 776057 - RNA, 19 nt, Homo sapiens
ugaaacggaucgaaacugu

SEQ ID NO: 776058 - RNA, 19 nt, Homo sapiens
gaagaagcagcuaugagaa

SEQ ID NO: 776059 - RNA, 19 nt, Homo sapiens
ggaccgugguacccaguuu

SEQ ID NO: 776060 - RNA, 19 nt, Homo sapiens
aaacagagacgccgaaagu

SEQ ID NO: 776061 - RNA, 19 nt, Homo sapiens
ugaagaagcagcuaugaga

SEQ ID NO: 776062 - RNA, 19 nt, Homo sapiens
gagaagagagguggugaaa

SEQ ID NO: 776063 - RNA, 19 nt, Homo sapiens
cagguaccauguuccauuu

SEQ ID NO: 776064 - RNA, 19 nt, Homo sapiens
gggaguugguugcaucuug

SEQ ID NO: 776065 - RNA, 19 nt, Homo sapiens
ggacaacaaauccagcauu

SEQ ID NO: 776066 - RNA, 19 nt, Homo sapiens
agaaggaggugccuauauc

SEQ ID NO: 776067 - RNA, 19 nt, Homo sapiens
ggaguugguugcaucuugu

SEQ ID NO: 776068 - RNA, 19 nt, Homo sapiens
caucaagaauuacaugaag

SEQ ID NO: 776069 - RNA, 19 nt, Homo sapiens
gaaggaacugcgucuuuga

SEQ ID NO: 776070 - RNA, 19 nt, Homo sapiens
gcgaauagccacaugcaau

SEQ ID NO: 776071 - RNA, 19 nt, Homo sapiens
gaagaaucaucaaaguaac

SEQ ID NO: 776072 - RNA, 19 nt, Homo sapiens
caaagaaggaggugccuau

SEQ ID NO: 776073 - RNA, 19 nt, Homo sapiens
gaauagaguagcacacugu

SEQ ID NO: 776074 - RNA, 19 nt, Homo sapiens
caucugugaagccuuauua

SEQ ID NO: 776075 - RNA, 19 nt, Homo sapiens
gcucagccaugccguguca

SEQ ID NO: 776076 - RNA, 19 nt, Homo sapiens
aauauucauugcugccuua

SEQ ID NO: 776077 - RNA, 19 nt, Homo sapiens
gcagcggaguucaucaaga

SEQ ID NO: 776078 - RNA, 19 nt, Homo sapiens
agacacagguaccauguuc

SEQ ID NO: 776079 - RNA, 19 nt, Homo sapiens
agaaggaacugcgucuuug

SEQ ID NO: 776080 - RNA, 19 nt, Homo sapiens
aaucagaccagguuuacua

SEQ ID NO: 776081 - RNA, 19 nt, Homo sapiens
gcuacgguaccaauaauaa

SEQ ID NO: 776082 - RNA, 19 nt, Homo sapiens
guuaagagcaaaucuagga

SEQ ID NO: 776083 - RNA, 19 nt, Homo sapiens
gcugaucacucugcauguu

SEQ ID NO: 776084 - RNA, 19 nt, Homo sapiens
ucgaaacuguggugaaaga

SEQ ID NO: 776085 - RNA, 19 nt, Homo sapiens
caaagaggagaucaugaaa

SEQ ID NO: 776086 - RNA, 19 nt, Homo sapiens
gugccuauaucgccaaaga

SEQ ID NO: 776087 - RNA, 19 nt, Homo sapiens
gacauagccugugaugaug

SEQ ID NO: 776088 - RNA, 19 nt, Homo sapiens
uaacucaggaggugauuga

SEQ ID NO: 776089 - RNA, 19 nt, Homo sapiens
gacggcugauguacagaua

SEQ ID NO: 776090 - RNA, 19 nt, Homo sapiens
acaguugcauccaagaauu

SEQ ID NO: 776091 - RNA, 19 nt, Homo sapiens
ucucuacgcauuagcaaua

SEQ ID NO: 776092 - RNA, 19 nt, Homo sapiens
ccagcaaggacaagcuuua

SEQ ID NO: 776093 - RNA, 19 nt, Homo sapiens
cggcugauguacagauauu

SEQ ID NO: 776094 - RNA, 19 nt, Homo sapiens
agagggaccugaaugaagu

SEQ ID NO: 776095 - RNA, 19 nt, Homo sapiens
gcugagccguguuccauca

SEQ ID NO: 776096 - RNA, 19 nt, Homo sapiens
cagguagguuggucuuuga

SEQ ID NO: 776097 - RNA, 19 nt, Homo sapiens
gaauguggagaaaggaauu

SEQ ID NO: 776098 - RNA, 19 nt, Homo sapiens
ugaugggucuggugacuau

SEQ ID NO: 776099 - RNA, 19 nt, Homo sapiens
caagaucaaagagcgaaua

SEQ ID NO: 776100 - RNA, 19 nt, Homo sapiens
gaaaaccgguauuagaauc

SEQ ID NO: 776101 - RNA, 19 nt, Homo sapiens
gaagugaaaguugacauca

SEQ ID NO: 776102 - RNA, 19 nt, Homo sapiens
gacaagauacuuauuacca

SEQ ID NO: 776103 - RNA, 19 nt, Homo sapiens
guaugcauucguucuguua

SEQ ID NO: 776104 - RNA, 19 nt, Homo sapiens
ugucuuuccuccauggaua

SEQ ID NO: 776105 - RNA, 19 nt, Homo sapiens
gaaagccguccaccacaug

SEQ ID NO: 776106 - RNA, 19 nt, Homo sapiens
uagaaggaacugcgucuuu

SEQ ID NO: 776107 - RNA, 19 nt, Homo sapiens
cagaccagguuuacuauac

SEQ ID NO: 776108 - RNA, 19 nt, Homo sapiens
gaucaugacaaccaacaau

SEQ ID NO: 776109 - RNA, 19 nt, Homo sapiens
uaggaagaaucaucaaagu

SEQ ID NO: 776110 - RNA, 19 nt, Homo sapiens
cagguggaauuagcucaua

SEQ ID NO: 776111 - RNA, 19 nt, Homo sapiens
gcagagggaccugaaugaa

SEQ ID NO: 776112 - RNA, 19 nt, Homo sapiens
ugacaucagcuuuaacaug

SEQ ID NO: 776113 - RNA, 19 nt, Homo sapiens
gacuguaaacccacauuaa

SEQ ID NO: 776114 - RNA, 19 nt, Homo sapiens
ggagagaaggguugucaca

SEQ ID NO: 776115 - RNA, 19 nt, Homo sapiens
agaagcagcuaugagaaga

SEQ ID NO: 776116 - RNA, 19 nt, Homo sapiens
ccagaacacugaucaugac

SEQ ID NO: 776117 - RNA, 19 nt, Homo sapiens
gguauuagaaucaaagaag

SEQ ID NO: 776118 - RNA, 19 nt, Homo sapiens
gcaaggacaagcuuuaaaa

SEQ ID NO: 776119 - RNA, 19 nt, Homo sapiens
guagguuggucuuugaagu

SEQ ID NO: 776120 - RNA, 19 nt, Homo sapiens
cacaacaaccacugucuuu

SEQ ID NO: 776121 - RNA, 19 nt, Homo sapiens
ggaaaacgcuucggucagu

SEQ ID NO: 776122 - RNA, 19 nt, Homo sapiens
ggucuggugacuauuauug

SEQ ID NO: 776123 - RNA, 19 nt, Homo sapiens
gaagggaucuccaguugug

SEQ ID NO: 776124 - RNA, 19 nt, Homo sapiens
gcacauggacuaccuguuc

SEQ ID NO: 776125 - RNA, 19 nt, Homo sapiens
acagauaccucucuuguag

SEQ ID NO: 776126 - RNA, 19 nt, Homo sapiens
caagggaccucuccaugau

SEQ ID NO: 776127 - RNA, 19 nt, Homo sapiens
gggcuaagcauauacuaga

SEQ ID NO: 776128 - RNA, 19 nt, Homo sapiens
ugauagccauguauuucua

SEQ ID NO: 776129 - RNA, 19 nt, Homo sapiens
gcuaagcauauacuagaua

SEQ ID NO: 776130 - RNA, 19 nt, Homo sapiens
gcacggggcuaagcauaua

SEQ ID NO: 776131 - RNA, 19 nt, Homo sapiens
gcaggcaucgccauucuug

SEQ ID NO: 776132 - RNA, 19 nt, Homo sapiens
gcugaaccguuugugauug

SEQ ID NO: 776133 - RNA, 19 nt, Homo sapiens
ucaagggaccucuccauga

SEQ ID NO: 776134 - RNA, 19 nt, Homo sapiens
guugugggcaauaucauua

SEQ ID NO: 776135 - RNA, 19 nt, Homo sapiens
gguccaugguccucacgua

SEQ ID NO: 776136 - RNA, 19 nt, Homo sapiens
caccucccauucacagaua

SEQ ID NO: 776137 - RNA, 19 nt, Homo sapiens
ucacguaccuggugcucau

SEQ ID NO: 776138 - RNA, 19 nt, Homo sapiens
caacgucccuagcccuuac

SEQ ID NO: 776139 - RNA, 19 nt, Homo sapiens
gcugauagccauguauuuc

SEQ ID NO: 776140 - RNA, 19 nt, Homo sapiens
gcucaucgucuacaucuuc

SEQ ID NO: 776141 - RNA, 19 nt, Homo sapiens
cuaagcauauacuagauag

SEQ ID NO: 776142 - RNA, 19 nt, Homo sapiens
ucucugaccuccuccuuca

SEQ ID NO: 776143 - RNA, 19 nt, Homo sapiens
ucacagauaccucucuugu

SEQ ID NO: 776144 - RNA, 19 nt, Homo sapiens
gcacaucuggucccaugga

SEQ ID NO: 776145 - RNA, 19 nt, Homo sapiens
aggcaaggaugacgucuuc

SEQ ID NO: 776146 - RNA, 19 nt, Homo sapiens
gcucuggaagccucuauug

SEQ ID NO: 776147 - RNA, 19 nt, Homo sapiens
cauucuugcugaaccguuu

SEQ ID NO: 776148 - RNA, 19 nt, Homo sapiens
uggacuaccuguucaccaa

SEQ ID NO: 776149 - RNA, 19 nt, Homo sapiens
gugacuacaugguguccaa

SEQ ID NO: 776150 - RNA, 19 nt, Homo sapiens
ccuguuugcugagaccaua

SEQ ID NO: 776151 - RNA, 19 nt, Homo sapiens
ggugacagccgaccaguac

SEQ ID NO: 776152 - RNA, 19 nt, Homo sapiens
gggaccgcgucaugauuga

SEQ ID NO: 776153 - RNA, 19 nt, Homo sapiens
gagugcgccuccugcauca

SEQ ID NO: 776154 - RNA, 19 nt, Homo sapiens
guggugggccugcuaguug

SEQ ID NO: 776155 - RNA, 19 nt, Homo sapiens
cgucaugauugagcaagaa

SEQ ID NO: 776156 - RNA, 19 nt, Homo sapiens
gugccuggauugccaucuu

SEQ ID NO: 776157 - RNA, 19 nt, Homo sapiens
cacagauaccucucuugua

SEQ ID NO: 776158 - RNA, 19 nt, Homo sapiens
caccaagggcugcuucgaa

SEQ ID NO: 776159 - RNA, 19 nt, Homo sapiens
cacauggacuaccuguuca

SEQ ID NO: 776160 - RNA, 19 nt, Homo sapiens
guuugugauugccauuuga

SEQ ID NO: 776161 - RNA, 19 nt, Homo sapiens
gccacgccaucgacagcua

SEQ ID NO: 776162 - RNA, 19 nt, Homo sapiens
uaccguguauacccacuga

SEQ ID NO: 776163 - RNA, 19 nt, Homo sapiens
cggcuucuccuucuucaug

SEQ ID NO: 776164 - RNA, 19 nt, Homo sapiens
cguuugugauugccauuug

SEQ ID NO: 776165 - RNA, 19 nt, Homo sapiens
caugaucccaccucccauu

SEQ ID NO: 776166 - RNA, 19 nt, Homo sapiens
ccuccugcaucacguccua

SEQ ID NO: 776167 - RNA, 19 nt, Homo sapiens
ggcuaagcauauacuagau

SEQ ID NO: 776168 - RNA, 19 nt, Homo sapiens
gaucccaccucccauucac

SEQ ID NO: 776169 - RNA, 19 nt, Homo sapiens
acccaucccugaucaccaa

SEQ ID NO: 776170 - RNA, 19 nt, Homo sapiens
guucugucacggucacuuu

SEQ ID NO: 776171 - RNA, 19 nt, Homo sapiens
ccaacgucccuagcccuua

SEQ ID NO: 776172 - RNA, 19 nt, Homo sapiens
gcgucaugauugagcaaga

SEQ ID NO: 776173 - RNA, 19 nt, Homo sapiens
caucgccauucuugcugaa

SEQ ID NO: 776174 - RNA, 19 nt, Homo sapiens
ccugagcccuacugugucu

SEQ ID NO: 776175 - RNA, 19 nt, Homo sapiens
uaucauuauucugcuguca

SEQ ID NO: 776176 - RNA, 19 nt, Homo sapiens
gggagucucaggcaaggau

SEQ ID NO: 776177 - RNA, 19 nt, Homo sapiens
cgaccaguaccguguauac

SEQ ID NO: 776178 - RNA, 19 nt, Homo sapiens
cacccaccgugacuacaug

SEQ ID NO: 776179 - RNA, 19 nt, Homo sapiens
gccgaccaguaccguguau

SEQ ID NO: 776180 - RNA, 19 nt, Homo sapiens
ggaaagggcugguguacau

SEQ ID NO: 776181 - RNA, 19 nt, Homo sapiens
gaagacgacuugaucaucu

SEQ ID NO: 776182 - RNA, 19 nt, Homo sapiens
ccaaagccaugcagaacaa

SEQ ID NO: 776183 - RNA, 19 nt, Homo sapiens
gaacguggaagacgacuug

SEQ ID NO: 776184 - RNA, 19 nt, Homo sapiens
gagcauugccggaaaguca

SEQ ID NO: 776185 - RNA, 19 nt, Homo sapiens
gccggaaagucaacgagua

SEQ ID NO: 776186 - RNA, 19 nt, Homo sapiens
caucuucccugacgacugu

SEQ ID NO: 776187 - RNA, 19 nt, Homo sapiens
ggacaugagccuggacuga

SEQ ID NO: 776188 - RNA, 19 nt, Homo sapiens
ggacgaagaggaggacaug

SEQ ID NO: 776189 - RNA, 19 nt, Homo sapiens
agaaagagggcgacacgaa

SEQ ID NO: 776190 - RNA, 19 nt, Homo sapiens
ggaagacgacuugaucauc

SEQ ID NO: 776191 - RNA, 19 nt, Homo sapiens
ggacaagaaggacgaagag

SEQ ID NO: 776192 - RNA, 19 nt, Homo sapiens
ugaggagcauugccggaaa

SEQ ID NO: 776193 - RNA, 19 nt, Homo sapiens
gcagaccgcggaugagauc

SEQ ID NO: 776194 - RNA, 19 nt, Homo sapiens
gggucuacgugcugaaguu

SEQ ID NO: 776195 - RNA, 19 nt, Homo sapiens
caacgaguaucugaacaac

SEQ ID NO: 776196 - RNA, 19 nt, Homo sapiens
ggaaagucaacgaguaucu

SEQ ID NO: 776197 - RNA, 19 nt, Homo sapiens
gaggagcauugccggaaag

SEQ ID NO: 776198 - RNA, 19 nt, Homo sapiens
cccacccacugauuauuaa

SEQ ID NO: 776199 - RNA, 19 nt, Homo sapiens
acacgaaggacaagaagga

SEQ ID NO: 776200 - RNA, 19 nt, Homo sapiens
gaaagggcugguguacauu

SEQ ID NO: 776201 - RNA, 19 nt, Homo sapiens
gaaagucaacgaguaucug

SEQ ID NO: 776202 - RNA, 19 nt, Homo sapiens
ucccacccacugauuauua

SEQ ID NO: 776203 - RNA, 19 nt, Homo sapiens
ccaagacagaccaggauga

SEQ ID NO: 776204 - RNA, 19 nt, Homo sapiens
gcgccugcuucccuacuug

SEQ ID NO: 776205 - RNA, 19 nt, Homo sapiens
ccaccgugacuccggauaa

SEQ ID NO: 776206 - RNA, 19 nt, Homo sapiens
acgacucgcuuauucacuu

SEQ ID NO: 776207 - RNA, 19 nt, Homo sapiens
aaagucaacgaguaucuga

SEQ ID NO: 776208 - RNA, 19 nt, Homo sapiens
acggacgacucgcuuauuc

SEQ ID NO: 776209 - RNA, 19 nt, Homo sapiens
ugagcgaccuccagagcau

SEQ ID NO: 776210 - RNA, 19 nt, Homo sapiens
gcgacacgaaggacaagaa

SEQ ID NO: 776211 - RNA, 19 nt, Homo sapiens
gugcugacgccggagauaa

SEQ ID NO: 776212 - RNA, 19 nt, Homo sapiens
aaguggaccuggccagugu

SEQ ID NO: 776213 - RNA, 19 nt, Homo sapiens
ucaacgaguaucugaacaa

SEQ ID NO: 776214 - RNA, 19 nt, Homo sapiens
cgacucgcuuauucacuuc

SEQ ID NO: 776215 - RNA, 19 nt, Homo sapiens
ugacgacugugaguucaag

SEQ ID NO: 776216 - RNA, 19 nt, Homo sapiens
gccaaagccaugcagaaca

SEQ ID NO: 776217 - RNA, 19 nt, Homo sapiens
ccggaaagucaacgaguau

SEQ ID NO: 776218 - RNA, 19 nt, Homo sapiens
cagacggacgacucgcuua

SEQ ID NO: 776219 - RNA, 19 nt, Homo sapiens
ggacgacucgcuuauucac

SEQ ID NO: 776220 - RNA, 19 nt, Homo sapiens
gaaggacaagaaggacgaa

SEQ ID NO: 776221 - RNA, 19 nt, Homo sapiens
gacggacgacucgcuuauu

SEQ ID NO: 776222 - RNA, 19 nt, Homo sapiens
cgucauccaccaccucuuc

SEQ ID NO: 776223 - RNA, 19 nt, Homo sapiens
ugcaggaacccaagacaga

SEQ ID NO: 776224 - RNA, 19 nt, Homo sapiens
caagacagaccaggaugag

SEQ ID NO: 776225 - RNA, 19 nt, Homo sapiens
cguggaagacgacuugauc

SEQ ID NO: 776226 - RNA, 19 nt, Homo sapiens
ggaaagggcugguguacau

SEQ ID NO: 776227 - RNA, 19 nt, Homo sapiens
gaagacgacuugaucaucu

SEQ ID NO: 776228 - RNA, 19 nt, Homo sapiens
ccaaagccaugcagaacaa

SEQ ID NO: 776229 - RNA, 19 nt, Homo sapiens
gaacguggaagacgacuug

SEQ ID NO: 776230 - RNA, 19 nt, Homo sapiens
gagcauugccggaaaguca

SEQ ID NO: 776231 - RNA, 19 nt, Homo sapiens
gccggaaagucaacgagua

SEQ ID NO: 776232 - RNA, 19 nt, Homo sapiens
caucuucccugacgacugu

SEQ ID NO: 776233 - RNA, 19 nt, Homo sapiens
ggacaugagccuggacuga

SEQ ID NO: 776234 - RNA, 19 nt, Homo sapiens
ggacgaagaggaggacaug

SEQ ID NO: 776235 - RNA, 19 nt, Homo sapiens
agaaagagggcgacacgaa

SEQ ID NO: 776236 - RNA, 19 nt, Homo sapiens
ggaagacgacuugaucauc

SEQ ID NO: 776237 - RNA, 19 nt, Homo sapiens
ggacaagaaggacgaagag

SEQ ID NO: 776238 - RNA, 19 nt, Homo sapiens
ugaggagcauugccggaaa

SEQ ID NO: 776239 - RNA, 19 nt, Homo sapiens
gcagaccgcggaugagauc

SEQ ID NO: 776240 - RNA, 19 nt, Homo sapiens
gggucuacgugcugaaguu

SEQ ID NO: 776241 - RNA, 19 nt, Homo sapiens
caacgaguaucugaacaac

SEQ ID NO: 776242 - RNA, 19 nt, Homo sapiens
ggaaagucaacgaguaucu

SEQ ID NO: 776243 - RNA, 19 nt, Homo sapiens
gaggagcauugccggaaag

SEQ ID NO: 776244 - RNA, 19 nt, Homo sapiens
cccacccacugauuauuaa

SEQ ID NO: 776245 - RNA, 19 nt, Homo sapiens
acacgaaggacaagaagga

SEQ ID NO: 776246 - RNA, 19 nt, Homo sapiens
gaaagggcugguguacauu

SEQ ID NO: 776247 - RNA, 19 nt, Homo sapiens
gaaagucaacgaguaucug

SEQ ID NO: 776248 - RNA, 19 nt, Homo sapiens
ucccacccacugauuauua

SEQ ID NO: 776249 - RNA, 19 nt, Homo sapiens
ccaagacagaccaggauga

SEQ ID NO: 776250 - RNA, 19 nt, Homo sapiens
gcgccugcuucccuacuug

SEQ ID NO: 776251 - RNA, 19 nt, Homo sapiens
ccaccgugacuccggauaa

SEQ ID NO: 776252 - RNA, 19 nt, Homo sapiens
acgacucgcuuauucacuu

SEQ ID NO: 776253 - RNA, 19 nt, Homo sapiens
aaagucaacgaguaucuga

SEQ ID NO: 776254 - RNA, 19 nt, Homo sapiens
acggacgacucgcuuauuc

SEQ ID NO: 776255 - RNA, 19 nt, Homo sapiens
ugagcgaccuccagagcau

SEQ ID NO: 776256 - RNA, 19 nt, Homo sapiens
gcgacacgaaggacaagaa

SEQ ID NO: 776257 - RNA, 19 nt, Homo sapiens
gugcugacgccggagauaa

SEQ ID NO: 776258 - RNA, 19 nt, Homo sapiens
aaguggaccuggccagugu

SEQ ID NO: 776259 - RNA, 19 nt, Homo sapiens
ucaacgaguaucugaacaa

SEQ ID NO: 776260 - RNA, 19 nt, Homo sapiens
cgacucgcuuauucacuuc

SEQ ID NO: 776261 - RNA, 19 nt, Homo sapiens
ugacgacugugaguucaag

SEQ ID NO: 776262 - RNA, 19 nt, Homo sapiens
gccaaagccaugcagaaca

SEQ ID NO: 776263 - RNA, 19 nt, Homo sapiens
ccggaaagucaacgaguau

SEQ ID NO: 776264 - RNA, 19 nt, Homo sapiens
cagacggacgacucgcuua

SEQ ID NO: 776265 - RNA, 19 nt, Homo sapiens
ggacgacucgcuuauucac

SEQ ID NO: 776266 - RNA, 19 nt, Homo sapiens
gaaggacaagaaggacgaa

SEQ ID NO: 776267 - RNA, 19 nt, Homo sapiens
gacggacgacucgcuuauu

SEQ ID NO: 776268 - RNA, 19 nt, Homo sapiens
cgucauccaccaccucuuc

SEQ ID NO: 776269 - RNA, 19 nt, Homo sapiens
ugcaggaacccaagacaga

SEQ ID NO: 776270 - RNA, 19 nt, Homo sapiens
caagacagaccaggaugag

SEQ ID NO: 776271 - RNA, 19 nt, Homo sapiens
cguggaagacgacuugauc

SEQ ID NO: 776272 - RNA, 19 nt, Homo sapiens
caaagaccguguagauaua

SEQ ID NO: 776273 - RNA, 19 nt, Homo sapiens
guacauaguucuaaugcau

SEQ ID NO: 776274 - RNA, 19 nt, Homo sapiens
gaugaggacuugcuuucuu

SEQ ID NO: 776275 - RNA, 19 nt, Homo sapiens
guauagagaugugaaaugu

SEQ ID NO: 776276 - RNA, 19 nt, Homo sapiens
uuugggagcugcacaguua

SEQ ID NO: 776277 - RNA, 19 nt, Homo sapiens
uagacaacguuaaccaaua

SEQ ID NO: 776278 - RNA, 19 nt, Homo sapiens
guagauuguuugugaauuc

SEQ ID NO: 776279 - RNA, 19 nt, Homo sapiens
ccacugcugugcaaguuaa

SEQ ID NO: 776280 - RNA, 19 nt, Homo sapiens
gauggaugcugcaaguuga

SEQ ID NO: 776281 - RNA, 19 nt, Homo sapiens
aaugguagauuguuuguga

SEQ ID NO: 776282 - RNA, 19 nt, Homo sapiens
ucaaagaccguguagauau

SEQ ID NO: 776283 - RNA, 19 nt, Homo sapiens
agacaacguuaaccaauau

SEQ ID NO: 776284 - RNA, 19 nt, Homo sapiens
caccaguacuucuauaaug

SEQ ID NO: 776285 - RNA, 19 nt, Homo sapiens
auaggcagaugaacaaauu

SEQ ID NO: 776286 - RNA, 19 nt, Homo sapiens
gaacacaacaggccaacuc

SEQ ID NO: 776287 - RNA, 19 nt, Homo sapiens
gaccaccaguacuucuaua

SEQ ID NO: 776288 - RNA, 19 nt, Homo sapiens
ugacguuccuaauguggua

SEQ ID NO: 776289 - RNA, 19 nt, Homo sapiens
ggacagcagaggaggguuu

SEQ ID NO: 776290 - RNA, 19 nt, Homo sapiens
cacaacaggccaacucaua

SEQ ID NO: 776291 - RNA, 19 nt, Homo sapiens
ggccaacucauacucauuu

SEQ ID NO: 776292 - RNA, 19 nt, Homo sapiens
ggauggaugcugcaaguug

SEQ ID NO: 776293 - RNA, 19 nt, Homo sapiens
guuugugaauucagacuuu

SEQ ID NO: 776294 - RNA, 19 nt, Homo sapiens
guucuaaugcauuguauug

SEQ ID NO: 776295 - RNA, 19 nt, Homo sapiens
caacucauacucauuugga

SEQ ID NO: 776296 - RNA, 19 nt, Homo sapiens
ucuguggacugcugaugua

SEQ ID NO: 776297 - RNA, 19 nt, Homo sapiens
aaucaaagaccguguagau

SEQ ID NO: 776298 - RNA, 19 nt, Homo sapiens
acugaugacuguauagaga

SEQ ID NO: 776299 - RNA, 19 nt, Homo sapiens
caagugucuuuguaauaug

SEQ ID NO: 776300 - RNA, 19 nt, Homo sapiens
gguagauuguuugugaauu

SEQ ID NO: 776301 - RNA, 19 nt, Homo sapiens
gucauuaacaguuucguaa

SEQ ID NO: 776302 - RNA, 19 nt, Homo sapiens
gauuguuugugaauucaga

SEQ ID NO: 776303 - RNA, 19 nt, Homo sapiens
auauguugcuguguuguua

SEQ ID NO: 776304 - RNA, 19 nt, Homo sapiens
aaacugugcguuguacaua

SEQ ID NO: 776305 - RNA, 19 nt, Homo sapiens
gcauugugccagaaacauu

SEQ ID NO: 776306 - RNA, 19 nt, Homo sapiens
ccguguagauauacuuuau

SEQ ID NO: 776307 - RNA, 19 nt, Homo sapiens
uguuguugcuguuaaacua

SEQ ID NO: 776308 - RNA, 19 nt, Homo sapiens
gcuguguuguuauuagguu

SEQ ID NO: 776309 - RNA, 19 nt, Homo sapiens
ucaaaucaaagaccgugua

SEQ ID NO: 776310 - RNA, 19 nt, Homo sapiens
ggacuugcuuucuuuaccu

SEQ ID NO: 776311 - RNA, 19 nt, Homo sapiens
gaacaauuagaacacaaca

SEQ ID NO: 776312 - RNA, 19 nt, Homo sapiens
acauaguucuaaugcauug

SEQ ID NO: 776313 - RNA, 19 nt, Homo sapiens
guauugaccaccaguacuu

SEQ ID NO: 776314 - RNA, 19 nt, Homo sapiens
gcugaacaauuagaacaca

SEQ ID NO: 776315 - RNA, 19 nt, Homo sapiens
ugcuauggaucaaaucaaa

SEQ ID NO: 776316 - RNA, 19 nt, Homo sapiens
uuaguuggaugucccugaa

SEQ ID NO: 776317 - RNA, 19 nt, Homo sapiens
caguacuucuauaauggua

SEQ ID NO: 776318 - RNA, 19 nt, Homo sapiens
auacuaaacugugcguugu

SEQ ID NO: 776319 - RNA, 19 nt, Homo sapiens
aauggugucuuaagugcuu

SEQ ID NO: 776320 - RNA, 19 nt, Homo sapiens
cacaaagaauggacucucu

SEQ ID NO: 776321 - RNA, 19 nt, Homo sapiens
augaggacuugcuuucuuu

SEQ ID NO: 776322 - RNA, 19 nt, Homo sapiens
gggaugaggacuugcuuuc

SEQ ID NO: 776323 - RNA, 19 nt, Homo sapiens
cuuacucccuucuggauau

SEQ ID NO: 776324 - RNA, 19 nt, Homo sapiens
caacguuaaccaauauauc

SEQ ID NO: 776325 - RNA, 19 nt, Homo sapiens
cuuaguguuugaugucauu

SEQ ID NO: 776326 - RNA, 19 nt, Homo sapiens
gaccguguagauauacuuu

SEQ ID NO: 776327 - RNA, 19 nt, Homo sapiens
gcugauguacagugccuuu

SEQ ID NO: 776328 - RNA, 19 nt, Homo sapiens
ucaaagagagaacuuacuc

SEQ ID NO: 776329 - RNA, 19 nt, Homo sapiens
uacagugccuuugcugcua

SEQ ID NO: 776330 - RNA, 19 nt, Homo sapiens
ccaccaguacuucuauaau

SEQ ID NO: 776331 - RNA, 19 nt, Homo sapiens
ggaaauuuggcugaacaau

SEQ ID NO: 776332 - RNA, 19 nt, Homo sapiens
gccaacucauacucauuug

SEQ ID NO: 776333 - RNA, 19 nt, Homo sapiens
ugaggacuugcuuucuuua

SEQ ID NO: 776334 - RNA, 19 nt, Homo sapiens
agaggaggguuugcagaga

SEQ ID NO: 776335 - RNA, 19 nt, Homo sapiens
cugugcaaguuaagucuuu

SEQ ID NO: 776336 - RNA, 19 nt, Homo sapiens
caaaucaaagaccguguag

SEQ ID NO: 776337 - RNA, 19 nt, Homo sapiens
gauguacagugccuuugcu

SEQ ID NO: 776338 - RNA, 19 nt, Homo sapiens
ugccacauuucuuugcaaa

SEQ ID NO: 776339 - RNA, 19 nt, Homo sapiens
ggcagaugaacaaauuaaa

SEQ ID NO: 776340 - RNA, 19 nt, Homo sapiens
aggcagaugaacaaauuaa

SEQ ID NO: 776341 - RNA, 19 nt, Homo sapiens
gacaacguuaaccaauaua

SEQ ID NO: 776342 - RNA, 19 nt, Homo sapiens
ugaugacuguauagagaug

SEQ ID NO: 776343 - RNA, 19 nt, Homo sapiens
cuauggaucaaaucaaaga

SEQ ID NO: 776344 - RNA, 19 nt, Homo sapiens
guugcuguguuguuauuag

SEQ ID NO: 776345 - RNA, 19 nt, Homo sapiens
caacaggccaacucauacu

SEQ ID NO: 776346 - RNA, 19 nt, Homo sapiens
cauacucauuuggaucuau

SEQ ID NO: 776347 - RNA, 19 nt, Homo sapiens
ucuaaugcauuguauugac

SEQ ID NO: 776348 - RNA, 19 nt, Homo sapiens
gaugcugcaaguugaaaug

SEQ ID NO: 776349 - RNA, 19 nt, Homo sapiens
uaaacugugcguuguacau

SEQ ID NO: 776350 - RNA, 19 nt, Homo sapiens
acagugccuuugcugcuau

SEQ ID NO: 776351 - RNA, 19 nt, Homo sapiens
uguauuauaggcagaugaa

SEQ ID NO: 776352 - RNA, 19 nt, Homo sapiens
gaauucagacuuuuaagca

SEQ ID NO: 776353 - RNA, 19 nt, Homo sapiens
aauuacacauggaagcaau

SEQ ID NO: 776354 - RNA, 19 nt, Homo sapiens
uugcugcuauggaucaaau

SEQ ID NO: 776355 - RNA, 19 nt, Homo sapiens
uuagacaacguuaaccaau

SEQ ID NO: 776356 - RNA, 19 nt, Homo sapiens
cauugugccagaaacauug

SEQ ID NO: 776357 - RNA, 19 nt, Homo sapiens
guggacugcugauguacag

SEQ ID NO: 776358 - RNA, 19 nt, Homo sapiens
uauuauaggcagaugaaca

SEQ ID NO: 776359 - RNA, 19 nt, Homo sapiens
gcugugcauugugccagaa

SEQ ID NO: 776360 - RNA, 19 nt, Homo sapiens
gggaacaacuuucuucaaa

SEQ ID NO: 776361 - RNA, 19 nt, Homo sapiens
gaacaacuuucuucaaacu

SEQ ID NO: 776362 - RNA, 19 nt, Homo sapiens
gagcacagcuauauacagu

SEQ ID NO: 776363 - RNA, 19 nt, Homo sapiens
gcacagcuauauacagugu

SEQ ID NO: 776364 - RNA, 19 nt, Homo sapiens
caaacuaccugguggugaa

SEQ ID NO: 776365 - RNA, 19 nt, Homo sapiens
gagggaagaauuugauaaa

SEQ ID NO: 776366 - RNA, 19 nt, Homo sapiens
uguacccucuuaccaauua

SEQ ID NO: 776367 - RNA, 19 nt, Homo sapiens
gaacuuaacccaggagaag

SEQ ID NO: 776368 - RNA, 19 nt, Homo sapiens
ggaaugaggaggacuguag

SEQ ID NO: 776369 - RNA, 19 nt, Homo sapiens
uuacaaagccuaaggaaca

SEQ ID NO: 776370 - RNA, 19 nt, Homo sapiens
cuaaggaacauaagaaguu

SEQ ID NO: 776371 - RNA, 19 nt, Homo sapiens
gcgcaugagggaagaauuu

SEQ ID NO: 776372 - RNA, 19 nt, Homo sapiens
ggacuaaaacgcuuaauga

SEQ ID NO: 776373 - RNA, 19 nt, Homo sapiens
caccauuguuugaauugua

SEQ ID NO: 776374 - RNA, 19 nt, Homo sapiens
uaaggaacauaagaaguug

SEQ ID NO: 776375 - RNA, 19 nt, Homo sapiens
ggaacaacuuucuucaaac

SEQ ID NO: 776376 - RNA, 19 nt, Homo sapiens
aggagaagaugaaguugaa

SEQ ID NO: 776377 - RNA, 19 nt, Homo sapiens
gauacugggucgucaggau

SEQ ID NO: 776378 - RNA, 19 nt, Homo sapiens
caaagccuaaggaacauaa

SEQ ID NO: 776379 - RNA, 19 nt, Homo sapiens
agaugaaguugaaggacua

SEQ ID NO: 776380 - RNA, 19 nt, Homo sapiens
ugacaaugcaccaggauau

SEQ ID NO: 776381 - RNA, 19 nt, Homo sapiens
ggacccaucauuucuaguc

SEQ ID NO: 776382 - RNA, 19 nt, Homo sapiens
gcaccauuguuugaauugu

SEQ ID NO: 776383 - RNA, 19 nt, Homo sapiens
ccauauauuccugcacaua

SEQ ID NO: 776384 - RNA, 19 nt, Homo sapiens
ccuccucaguauccauaua

SEQ ID NO: 776385 - RNA, 19 nt, Homo sapiens
gaaugaggaggacuguaga

SEQ ID NO: 776386 - RNA, 19 nt, Homo sapiens
gguagcugcaccauuguuu

SEQ ID NO: 776387 - RNA, 19 nt, Homo sapiens
ugagggaagaauuugauaa

SEQ ID NO: 776388 - RNA, 19 nt, Homo sapiens
ucacucaguucggcaacaa

SEQ ID NO: 776389 - RNA, 19 nt, Homo sapiens
gcugcaccauuguuugaau

SEQ ID NO: 776390 - RNA, 19 nt, Homo sapiens
gcaugagggaagaauuuga

SEQ ID NO: 776391 - RNA, 19 nt, Homo sapiens
ggguucugauuguacauga

SEQ ID NO: 776392 - RNA, 19 nt, Homo sapiens
uugcaagacugggucauug

SEQ ID NO: 776393 - RNA, 19 nt, Homo sapiens
caggagaagaugaaguuga

SEQ ID NO: 776394 - RNA, 19 nt, Homo sapiens
ccugcgcaguggagaagua

SEQ ID NO: 776395 - RNA, 19 nt, Homo sapiens
uagcugcaccauuguuuga

SEQ ID NO: 776396 - RNA, 19 nt, Homo sapiens
uaacccaggagaagaugaa

SEQ ID NO: 776397 - RNA, 19 nt, Homo sapiens
acaacuuucuucaaacuac

SEQ ID NO: 776398 - RNA, 19 nt, Homo sapiens
ccuguacccucuuaccaau

SEQ ID NO: 776399 - RNA, 19 nt, Homo sapiens
ccucuuaccaauuauacuu

SEQ ID NO: 776400 - RNA, 19 nt, Homo sapiens
cugcaccauuguuugaauu

SEQ ID NO: 776401 - RNA, 19 nt, Homo sapiens
gcugggaacaacuuucuuc

SEQ ID NO: 776402 - RNA, 19 nt, Homo sapiens
gaaguuguuucugguucag

SEQ ID NO: 776403 - RNA, 19 nt, Homo sapiens
gacaaugcaccaggauaug

SEQ ID NO: 776404 - RNA, 19 nt, Homo sapiens
cccaggagaagaugaaguu

SEQ ID NO: 776405 - RNA, 19 nt, Homo sapiens
caaugcaccaggauaugga

SEQ ID NO: 776406 - RNA, 19 nt, Homo sapiens
guagcugcaccauuguuug

SEQ ID NO: 776407 - RNA, 19 nt, Homo sapiens
cauugacgauugcauuggu

SEQ ID NO: 776408 - RNA, 19 nt, Homo sapiens
caugagggaagaauuugau

SEQ ID NO: 776409 - RNA, 19 nt, Homo sapiens
gaugaaguugaaggacuaa

SEQ ID NO: 776410 - RNA, 19 nt, Homo sapiens
gacccaucauuucuagucu

SEQ ID NO: 776411 - RNA, 19 nt, Homo sapiens
gacaacagaugaagacuua

SEQ ID NO: 776412 - RNA, 19 nt, Homo sapiens
gcaaaguucuuauuaguuc

SEQ ID NO: 776413 - RNA, 19 nt, Homo sapiens
ggacaaugcuuaaaguguu

SEQ ID NO: 776414 - RNA, 19 nt, Homo sapiens
cuaguuagcuugugacuuu

SEQ ID NO: 776415 - RNA, 19 nt, Homo sapiens
caacacagauguaccgaaa

SEQ ID NO: 776416 - RNA, 19 nt, Homo sapiens
gaaggaaaccugugugauu

SEQ ID NO: 776417 - RNA, 19 nt, Homo sapiens
gaauagaucugaauaaagc

SEQ ID NO: 776418 - RNA, 19 nt, Homo sapiens
gaauugaguccaagucuua

SEQ ID NO: 776419 - RNA, 19 nt, Homo sapiens
ggaaauggauacugcaaga

SEQ ID NO: 776420 - RNA, 19 nt, Homo sapiens
caaaguaucugcugaugau

SEQ ID NO: 776421 - RNA, 19 nt, Homo sapiens
gagugaagcugaauuugaa

SEQ ID NO: 776422 - RNA, 19 nt, Homo sapiens
cauaguagaucacgagaaa

SEQ ID NO: 776423 - RNA, 19 nt, Homo sapiens
aagcaaaucugcauaaaug

SEQ ID NO: 776424 - RNA, 19 nt, Homo sapiens
gaacaggaauagaucugaa

SEQ ID NO: 776425 - RNA, 19 nt, Homo sapiens
uaauggaucuguuaccuaa

SEQ ID NO: 776426 - RNA, 19 nt, Homo sapiens
uagaaacccuccagaaauu

SEQ ID NO: 776427 - RNA, 19 nt, Homo sapiens
gcaacuuuauuacugguua

SEQ ID NO: 776428 - RNA, 19 nt, Homo sapiens
guuagaagcugaaggaaga

SEQ ID NO: 776429 - RNA, 19 nt, Homo sapiens
gcgaauaucgucaucguua

SEQ ID NO: 776430 - RNA, 19 nt, Homo sapiens
cgucauaaaucccguagua

SEQ ID NO: 776431 - RNA, 19 nt, Homo sapiens
uagaauaggugauuacaug

SEQ ID NO: 776432 - RNA, 19 nt, Homo sapiens
ugagagaucuucuguuaau

SEQ ID NO: 776433 - RNA, 19 nt, Homo sapiens
guaaagagagccuuauauu

SEQ ID NO: 776434 - RNA, 19 nt, Homo sapiens
guguaaagcuguucaaguu

SEQ ID NO: 776435 - RNA, 19 nt, Homo sapiens
ggaaaccugugugauuuaa

SEQ ID NO: 776436 - RNA, 19 nt, Homo sapiens
gaacugaaccuguaaggau

SEQ ID NO: 776437 - RNA, 19 nt, Homo sapiens
gacaaugcuuaaaguguua

SEQ ID NO: 776438 - RNA, 19 nt, Homo sapiens
guaaagcuguucaaguuau

SEQ ID NO: 776439 - RNA, 19 nt, Homo sapiens
caauagauguaguguugua

SEQ ID NO: 776440 - RNA, 19 nt, Homo sapiens
guaaacagcaucacuuuga

SEQ ID NO: 776441 - RNA, 19 nt, Homo sapiens
uuugagagaucuucuguua

SEQ ID NO: 776442 - RNA, 19 nt, Homo sapiens
ucaaaccacuucugacaaa

SEQ ID NO: 776443 - RNA, 19 nt, Homo sapiens
ccgaaacacuuaauuguga

SEQ ID NO: 776444 - RNA, 19 nt, Homo sapiens
caucuugucugcuaucaaa

SEQ ID NO: 776445 - RNA, 19 nt, Homo sapiens
gaaaagagucgacgucaua

SEQ ID NO: 776446 - RNA, 19 nt, Homo sapiens
gaugaagacuuaacugaag

SEQ ID NO: 776447 - RNA, 19 nt, Homo sapiens
ggauaugccucaaucuaau

SEQ ID NO: 776448 - RNA, 19 nt, Homo sapiens
ggaaagagaauugcauuau

SEQ ID NO: 776449 - RNA, 19 nt, Homo sapiens
guucuucacuuucaucuug

SEQ ID NO: 776450 - RNA, 19 nt, Homo sapiens
ugacagacauagcaaucua

SEQ ID NO: 776451 - RNA, 19 nt, Homo sapiens
gcagguaaaugugaguaaa

SEQ ID NO: 776452 - RNA, 19 nt, Homo sapiens
ugaaugguauguaaacuug

SEQ ID NO: 776453 - RNA, 19 nt, Homo sapiens
gagauuacauggauacucu

SEQ ID NO: 776454 - RNA, 19 nt, Homo sapiens
acacauugguuguuaaaga

SEQ ID NO: 776455 - RNA, 19 nt, Homo sapiens
gaugaucguugcaaaguuc

SEQ ID NO: 776456 - RNA, 19 nt, Homo sapiens
gaagcugaauuugaagaaa

SEQ ID NO: 776457 - RNA, 19 nt, Homo sapiens
caagaacgccauugaguga

SEQ ID NO: 776458 - RNA, 19 nt, Homo sapiens
gaucuucuguuaauacaca

SEQ ID NO: 776459 - RNA, 19 nt, Homo sapiens
ugauugaacugaaccugua

SEQ ID NO: 776460 - RNA, 19 nt, Homo sapiens
guagaaacccuccagaaau

SEQ ID NO: 776461 - RNA, 19 nt, Homo sapiens
guuaaagaguacccaaauu

SEQ ID NO: 776462 - RNA, 19 nt, Homo sapiens
aaaccugccuuacauauag

SEQ ID NO: 776463 - RNA, 19 nt, Homo sapiens
ccaggaagcugaauauggu

SEQ ID NO: 776464 - RNA, 19 nt, Homo sapiens
uagcauguguucuugauug

SEQ ID NO: 776465 - RNA, 19 nt, Homo sapiens
ugacuuugcugaaugguau

SEQ ID NO: 776466 - RNA, 19 nt, Homo sapiens
ggaauugaguccaagucuu

SEQ ID NO: 776467 - RNA, 19 nt, Homo sapiens
cauauaggcccacuuuaaa

SEQ ID NO: 776468 - RNA, 19 nt, Homo sapiens
gcaaucuagucaaugugua

SEQ ID NO: 776469 - RNA, 19 nt, Homo sapiens
aaggaaaccugugugauuu

SEQ ID NO: 776470 - RNA, 19 nt, Homo sapiens
gaaaugcaguccaggaaaa

SEQ ID NO: 776471 - RNA, 19 nt, Homo sapiens
gagcaaauggccagucaaa

SEQ ID NO: 776472 - RNA, 19 nt, Homo sapiens
uacccuagauacuguguua

SEQ ID NO: 776473 - RNA, 19 nt, Homo sapiens
gagagaucuucuguuaaua

SEQ ID NO: 776474 - RNA, 19 nt, Homo sapiens
gaaaucacuacuucagaaa

SEQ ID NO: 776475 - RNA, 19 nt, Homo sapiens
cugcacaguuuaaggaaua

SEQ ID NO: 776476 - RNA, 19 nt, Homo sapiens
uaaaggagcagcaccaaau

SEQ ID NO: 776477 - RNA, 19 nt, Homo sapiens
gcaguuugcuucuugugau

SEQ ID NO: 776478 - RNA, 19 nt, Homo sapiens
caagauugccuucauggaa

SEQ ID NO: 776479 - RNA, 19 nt, Homo sapiens
gcaaauggccagucaaagg

SEQ ID NO: 776480 - RNA, 19 nt, Homo sapiens
gcaccugacuagcaugugu

SEQ ID NO: 776481 - RNA, 19 nt, Homo sapiens
guucagcaauaucuaaaga

SEQ ID NO: 776482 - RNA, 19 nt, Homo sapiens
gaacccagcuuucuuuccu

SEQ ID NO: 776483 - RNA, 19 nt, Homo sapiens
caccaaauguugucuauac

SEQ ID NO: 776484 - RNA, 19 nt, Homo sapiens
ggcaugaucagauagauuu

SEQ ID NO: 776485 - RNA, 19 nt, Homo sapiens
caaaccugccuuacauaua

SEQ ID NO: 776486 - RNA, 19 nt, Homo sapiens
gaguaaagagagccuuaua

SEQ ID NO: 776487 - RNA, 19 nt, Homo sapiens
ggccgaggcugaaggaaga

SEQ ID NO: 776488 - RNA, 19 nt, Homo sapiens
gauguguaaugcagguuaa

SEQ ID NO: 776489 - RNA, 19 nt, Homo sapiens
caaaucugcauaaauggua

SEQ ID NO: 776490 - RNA, 19 nt, Homo sapiens
gaauagaaauagggcaauc

SEQ ID NO: 776491 - RNA, 19 nt, Homo sapiens
gaggcagggugucaacuug

SEQ ID NO: 776492 - RNA, 19 nt, Homo sapiens
gugaaccgcuaacauugaa

SEQ ID NO: 776493 - RNA, 19 nt, Homo sapiens
gaauaaagcaaaucugcau

SEQ ID NO: 776494 - RNA, 19 nt, Homo sapiens
uguaaggauucauggauaa

SEQ ID NO: 776495 - RNA, 19 nt, Homo sapiens
acauauaggcccacuuuaa

SEQ ID NO: 776496 - RNA, 19 nt, Homo sapiens
acacagauguaccgaaaca

SEQ ID NO: 776497 - RNA, 19 nt, Homo sapiens
gaaauagggcaaucucaag

SEQ ID NO: 776498 - RNA, 19 nt, Homo sapiens
gauacuguguuaugugcaa

SEQ ID NO: 776499 - RNA, 19 nt, Homo sapiens
guaguaguuuguucuuguu

SEQ ID NO: 776500 - RNA, 19 nt, Homo sapiens
gagaucuucuguuaauaca

SEQ ID NO: 776501 - RNA, 19 nt, Homo sapiens
guaaaugugaguaaagaga

SEQ ID NO: 776502 - RNA, 19 nt, Homo sapiens
ccgcuaacauugaagaaau

SEQ ID NO: 776503 - RNA, 19 nt, Homo sapiens
guaccgaaacacuuaauug

SEQ ID NO: 776504 - RNA, 19 nt, Homo sapiens
ucaugacgauuauuacaga

SEQ ID NO: 776505 - RNA, 19 nt, Homo sapiens
caagagagagggaccauag

SEQ ID NO: 776506 - RNA, 19 nt, Homo sapiens
ccacugcuguucuucacuu

SEQ ID NO: 776507 - RNA, 19 nt, Homo sapiens
gcagguuaauuacaacaca

SEQ ID NO: 776508 - RNA, 19 nt, Homo sapiens
uuacauauaggcccacuuu

SEQ ID NO: 776509 - RNA, 19 nt, Homo sapiens
cguauugauucaugcuaua

SEQ ID NO: 776510 - RNA, 19 nt, Homo sapiens
cgaaacacuuaauugugaa

SEQ ID NO: 776511 - RNA, 19 nt, Homo sapiens
gcgaaaugcugaacugaua

SEQ ID NO: 776512 - RNA, 19 nt, Homo sapiens
gcagaacaauuaccucaaa

SEQ ID NO: 776513 - RNA, 19 nt, Homo sapiens
caaauaacauccacaggaa

SEQ ID NO: 776514 - RNA, 19 nt, Homo sapiens
gccauuaucuucaguuauu

SEQ ID NO: 776515 - RNA, 19 nt, Homo sapiens
aaaccgcacugcacaaaua

SEQ ID NO: 776516 - RNA, 19 nt, Homo sapiens
gaaugaauguccagcaaca

SEQ ID NO: 776517 - RNA, 19 nt, Homo sapiens
cauguuuccucgaauauaa

SEQ ID NO: 776518 - RNA, 19 nt, Homo sapiens
ggaagaaauuguuaaacgu

SEQ ID NO: 776519 - RNA, 19 nt, Homo sapiens
gaccauaacugugaaccuu

SEQ ID NO: 776520 - RNA, 19 nt, Homo sapiens
gaguaugaguggaauuuau

SEQ ID NO: 776521 - RNA, 19 nt, Homo sapiens
ugaaugccaucgcguuaaa

SEQ ID NO: 776522 - RNA, 19 nt, Homo sapiens
ugaagguacucuccaaaug

SEQ ID NO: 776523 - RNA, 19 nt, Homo sapiens
auacauguuuccucgaaua

SEQ ID NO: 776524 - RNA, 19 nt, Homo sapiens
guucacagcucgauaucau

SEQ ID NO: 776525 - RNA, 19 nt, Homo sapiens
gguaugggccuaaaggaaa

SEQ ID NO: 776526 - RNA, 19 nt, Homo sapiens
guuaaacgucuucaacuaa

SEQ ID NO: 776527 - RNA, 19 nt, Homo sapiens
gagaguaugaguggaauuu

SEQ ID NO: 776528 - RNA, 19 nt, Homo sapiens
gaagguacucuccaaaugg

SEQ ID NO: 776529 - RNA, 19 nt, Homo sapiens
uguuaaacgucuucaacua

SEQ ID NO: 776530 - RNA, 19 nt, Homo sapiens
gaguggaauuuauacaugu

SEQ ID NO: 776531 - RNA, 19 nt, Homo sapiens
ugaguggaauuuauacaug

SEQ ID NO: 776532 - RNA, 19 nt, Homo sapiens
cagacgugcagaacaauua

SEQ ID NO: 776533 - RNA, 19 nt, Homo sapiens
aaagaguccacacguguua

SEQ ID NO: 776534 - RNA, 19 nt, Homo sapiens
gaaaugcugaacugauaga

SEQ ID NO: 776535 - RNA, 19 nt, Homo sapiens
cugcagcccuggaucauau

SEQ ID NO: 776536 - RNA, 19 nt, Homo sapiens
uggcagacgugcagaacaa

SEQ ID NO: 776537 - RNA, 19 nt, Homo sapiens
gcaauagcagccuggugua

SEQ ID NO: 776538 - RNA, 19 nt, Homo sapiens
auagugggaucaacaaguu

SEQ ID NO: 776539 - RNA, 19 nt, Homo sapiens
aagccauuaucuucaguua

SEQ ID NO: 776540 - RNA, 19 nt, Homo sapiens
gaggagaguaugaguggaa

SEQ ID NO: 776541 - RNA, 19 nt, Homo sapiens
uuucaucucuagacacuga

SEQ ID NO: 776542 - RNA, 19 nt, Homo sapiens
auauaaaccuacuguggaa

SEQ ID NO: 776543 - RNA, 19 nt, Homo sapiens
uaacugugaaccuuacaaa

SEQ ID NO: 776544 - RNA, 19 nt, Homo sapiens
ccaaugguaugggccuaaa

SEQ ID NO: 776545 - RNA, 19 nt, Homo sapiens
caaacugcuucuugaccuu

SEQ ID NO: 776546 - RNA, 19 nt, Homo sapiens
gaaauuguuaaacgucuuc

SEQ ID NO: 776547 - RNA, 19 nt, Homo sapiens
gauagacccaucauuccaa

SEQ ID NO: 776548 - RNA, 19 nt, Homo sapiens
cagaacaauuaccucaaau

SEQ ID NO: 776549 - RNA, 19 nt, Homo sapiens
gcacugcacaaauaacauc

SEQ ID NO: 776550 - RNA, 19 nt, Homo sapiens
ucaguuauucagugguuua

SEQ ID NO: 776551 - RNA, 19 nt, Homo sapiens
cgggugcccucaucaguug

SEQ ID NO: 776552 - RNA, 19 nt, Homo sapiens
gagcugguuugcaaaauga

SEQ ID NO: 776553 - RNA, 19 nt, Homo sapiens
uggaagaaauuguuaaacg

SEQ ID NO: 776554 - RNA, 19 nt, Homo sapiens
gcagacgugcagaacaauu

SEQ ID NO: 776555 - RNA, 19 nt, Homo sapiens
uuauacauguuuccucgaa

SEQ ID NO: 776556 - RNA, 19 nt, Homo sapiens
gaaaauagugggaucaaca

SEQ ID NO: 776557 - RNA, 19 nt, Homo sapiens
caugugaaauuuccuuacu

SEQ ID NO: 776558 - RNA, 19 nt, Homo sapiens
ccacaggaagccuuguauu

SEQ ID NO: 776559 - RNA, 19 nt, Homo sapiens
gguacucuccaaaugguuu

SEQ ID NO: 776560 - RNA, 19 nt, Homo sapiens
uaaaccuacuguggaagaa

SEQ ID NO: 776561 - RNA, 19 nt, Homo sapiens
ucaacaaguuuuccaguga

SEQ ID NO: 776562 - RNA, 19 nt, Homo sapiens
gagccucauuauuauuauc

SEQ ID NO: 776563 - RNA, 19 nt, Homo sapiens
caacaaguuuuccagugaa

SEQ ID NO: 776564 - RNA, 19 nt, Homo sapiens
cacaggaagccuuguauuc

SEQ ID NO: 776565 - RNA, 19 nt, Homo sapiens
ccauaacugugaaccuuac

SEQ ID NO: 776566 - RNA, 19 nt, Homo sapiens
ccugcaauagcauuuauaa

SEQ ID NO: 776567 - RNA, 19 nt, Homo sapiens
gaaaaccgcacugcacaaa

SEQ ID NO: 776568 - RNA, 19 nt, Homo sapiens
agugaaagcguaugucaug

SEQ ID NO: 776569 - RNA, 19 nt, Homo sapiens
uauugaagguacucuccaa

SEQ ID NO: 776570 - RNA, 19 nt, Homo sapiens
ucaguucacagcucgauau

SEQ ID NO: 776571 - RNA, 19 nt, Homo sapiens
ccagugaaagcguauguca

SEQ ID NO: 776572 - RNA, 19 nt, Homo sapiens
cuucaguuauucagugguu

SEQ ID NO: 776573 - RNA, 19 nt, Homo sapiens
caagcgauguacagaccau

SEQ ID NO: 776574 - RNA, 19 nt, Homo sapiens
caggauauggaaugaaugu

SEQ ID NO: 776575 - RNA, 19 nt, Homo sapiens
ucugaaugccaucgcguua

SEQ ID NO: 776576 - RNA, 19 nt, Homo sapiens
gcgggugcccucaucaguu

SEQ ID NO: 776577 - RNA, 19 nt, Homo sapiens
gccgccauccuccucuuua

SEQ ID NO: 776578 - RNA, 19 nt, Homo sapiens
ucaguuucaucucuagaca

SEQ ID NO: 776579 - RNA, 19 nt, Homo sapiens
uucuugaccuuucauguga

SEQ ID NO: 776580 - RNA, 19 nt, Homo sapiens
uggaauucauugccuucaa

SEQ ID NO: 776581 - RNA, 19 nt, Homo sapiens
gcagcccuggaucauauaa

SEQ ID NO: 776582 - RNA, 19 nt, Homo sapiens
uguccugagugcuguguga

SEQ ID NO: 776583 - RNA, 19 nt, Homo sapiens
ccgccauccuccucuuuau

SEQ ID NO: 776584 - RNA, 19 nt, Homo sapiens
aaaggacccaagcgaugua

SEQ ID NO: 776585 - RNA, 19 nt, Homo sapiens
ucgcugcuuuccaggauau

SEQ ID NO: 776586 - RNA, 19 nt, Homo sapiens
ccucaucaguuggacacuu

SEQ ID NO: 776587 - RNA, 19 nt, Homo sapiens
cguaugucaugcuccauca

SEQ ID NO: 776588 - RNA, 19 nt, Homo sapiens
uaugucaugcuccaucaaa

SEQ ID NO: 776589 - RNA, 19 nt, Homo sapiens
aaccuacuguggaagaaau

SEQ ID NO: 776590 - RNA, 19 nt, Homo sapiens
caauagcagccugguguau

SEQ ID NO: 776591 - RNA, 19 nt, Homo sapiens
cucaucaguuggacacuug

SEQ ID NO: 776592 - RNA, 19 nt, Homo sapiens
agaguaugaguggaauuua

SEQ ID NO: 776593 - RNA, 19 nt, Homo sapiens
guaugggccuaaaggaaaa

SEQ ID NO: 776594 - RNA, 19 nt, Homo sapiens
aagguacucuccaaauggu

SEQ ID NO: 776595 - RNA, 19 nt, Homo sapiens
aaacugcuucuugaccuuu

SEQ ID NO: 776596 - RNA, 19 nt, Homo sapiens
ggagaguaugaguggaauu

SEQ ID NO: 776597 - RNA, 19 nt, Homo sapiens
aaucgcugcuuuccaggau

SEQ ID NO: 776598 - RNA, 19 nt, Homo sapiens
uuggauuaaucgcugcuuu

SEQ ID NO: 776599 - RNA, 19 nt, Homo sapiens
gauguacagaccauaacug

SEQ ID NO: 776600 - RNA, 19 nt, Homo sapiens
guuggacacuugguucgau

SEQ ID NO: 776601 - RNA, 19 nt, Homo sapiens
gaagagagccuaacugaaa

SEQ ID NO: 776602 - RNA, 19 nt, Homo sapiens
gaaaccugcugcucucuua

SEQ ID NO: 776603 - RNA, 19 nt, Homo sapiens
gaaacaacccgcaaauaaa

SEQ ID NO: 776604 - RNA, 19 nt, Homo sapiens
gacgaugacuucagaaauu

SEQ ID NO: 776605 - RNA, 19 nt, Homo sapiens
agaagaaggugcuacuaua

SEQ ID NO: 776606 - RNA, 19 nt, Homo sapiens
gaaggaaggugugaugaau

SEQ ID NO: 776607 - RNA, 19 nt, Homo sapiens
ugaaacaacccgcaaauaa

SEQ ID NO: 776608 - RNA, 19 nt, Homo sapiens
gaaaucaacuacaaguaca

SEQ ID NO: 776609 - RNA, 19 nt, Homo sapiens
caagaaauuuggaccuaaa

SEQ ID NO: 776610 - RNA, 19 nt, Homo sapiens
ggugauaaaugauccuaaa

SEQ ID NO: 776611 - RNA, 19 nt, Homo sapiens
ugaaagggcuaaagaacuu

SEQ ID NO: 776612 - RNA, 19 nt, Homo sapiens
cagauaaacuguugaagau

SEQ ID NO: 776613 - RNA, 19 nt, Homo sapiens
agaaauugcuucccaagaa

SEQ ID NO: 776614 - RNA, 19 nt, Homo sapiens
gaaagggagagcauuagua

SEQ ID NO: 776615 - RNA, 19 nt, Homo sapiens
gaacaguggugcaacucaa

SEQ ID NO: 776616 - RNA, 19 nt, Homo sapiens
ggaaauaugacuuugauuc

SEQ ID NO: 776617 - RNA, 19 nt, Homo sapiens
gagagauacuucuuauaga

SEQ ID NO: 776618 - RNA, 19 nt, Homo sapiens
acacaauccuccugccuua

SEQ ID NO: 776619 - RNA, 19 nt, Homo sapiens
cgaaucagauaaacuguug

SEQ ID NO: 776620 - RNA, 19 nt, Homo sapiens
ccagagagauacuucuuau

SEQ ID NO: 776621 - RNA, 19 nt, Homo sapiens
uaagaagcguugcuaaugu

SEQ ID NO: 776622 - RNA, 19 nt, Homo sapiens
caagagggauugauuuuaa

SEQ ID NO: 776623 - RNA, 19 nt, Homo sapiens
ucaagucaguuucaauuug

SEQ ID NO: 776624 - RNA, 19 nt, Homo sapiens
gaacacaacaacagagaga

SEQ ID NO: 776625 - RNA, 19 nt, Homo sapiens
uaaacuaacuuccggaaag

SEQ ID NO: 776626 - RNA, 19 nt, Homo sapiens
ggaccuaaaucaucuaaaa

SEQ ID NO: 776627 - RNA, 19 nt, Homo sapiens
aagcaaagauugaagacaa

SEQ ID NO: 776628 - RNA, 19 nt, Homo sapiens
ccaaaucgacuaaucuauu

SEQ ID NO: 776629 - RNA, 19 nt, Homo sapiens
ggacguccacgaucucuuu

SEQ ID NO: 776630 - RNA, 19 nt, Homo sapiens
caagucaguuucaauuugu

SEQ ID NO: 776631 - RNA, 19 nt, Homo sapiens
ggugaacucuuaaggacuu

SEQ ID NO: 776632 - RNA, 19 nt, Homo sapiens
ggaacaggauucaggauac

SEQ ID NO: 776633 - RNA, 19 nt, Homo sapiens
gaacagcaagaagaaagua

SEQ ID NO: 776634 - RNA, 19 nt, Homo sapiens
gaaucgaccuagcaagugu

SEQ ID NO: 776635 - RNA, 19 nt, Homo sapiens
gaacuugccagccagauuc

SEQ ID NO: 776636 - RNA, 19 nt, Homo sapiens
gaacaggauucaggauaca

SEQ ID NO: 776637 - RNA, 19 nt, Homo sapiens
ggaaauaacauucauugac

SEQ ID NO: 776638 - RNA, 19 nt, Homo sapiens
gagagaaaguaaacuaacu

SEQ ID NO: 776639 - RNA, 19 nt, Homo sapiens
guaggugacuuuuaaauga

SEQ ID NO: 776640 - RNA, 19 nt, Homo sapiens
aagcguugcuaauguuaua

SEQ ID NO: 776641 - RNA, 19 nt, Homo sapiens
gcagcucgauuccagauag

SEQ ID NO: 776642 - RNA, 19 nt, Homo sapiens
ugacauuucugugguuuga

SEQ ID NO: 776643 - RNA, 19 nt, Homo sapiens
ggucagaacagcaagaaga

SEQ ID NO: 776644 - RNA, 19 nt, Homo sapiens
aguagaaacuguagaacaa

SEQ ID NO: 776645 - RNA, 19 nt, Homo sapiens
gcaaggaauucugcaguag

SEQ ID NO: 776646 - RNA, 19 nt, Homo sapiens
gagccuauguucagugcaa

SEQ ID NO: 776647 - RNA, 19 nt, Homo sapiens
auaaacuucuugcggaaua

SEQ ID NO: 776648 - RNA, 19 nt, Homo sapiens
caacuugaccaggaauaua

SEQ ID NO: 776649 - RNA, 19 nt, Homo sapiens
gaucaacuaugacuuucca

SEQ ID NO: 776650 - RNA, 19 nt, Homo sapiens
ggugaucaacuaugacuuu

SEQ ID NO: 776651 - RNA, 19 nt, Homo sapiens
gggaacaggauucaggaua

SEQ ID NO: 776652 - RNA, 19 nt, Homo sapiens
gucauaauguuguacaaga

SEQ ID NO: 776653 - RNA, 19 nt, Homo sapiens
guacaugggacuggugaua

SEQ ID NO: 776654 - RNA, 19 nt, Homo sapiens
ccaacuagcucaguggaau

SEQ ID NO: 776655 - RNA, 19 nt, Homo sapiens
ugaacuuggugaucaacua

SEQ ID NO: 776656 - RNA, 19 nt, Homo sapiens
uaaguauccuuguauugga

SEQ ID NO: 776657 - RNA, 19 nt, Homo sapiens
aaaauguggugaacucuua

SEQ ID NO: 776658 - RNA, 19 nt, Homo sapiens
gagcagggaauaagggaaa

SEQ ID NO: 776659 - RNA, 19 nt, Homo sapiens
gaacuuggugaucaacuau

SEQ ID NO: 776660 - RNA, 19 nt, Homo sapiens
ggugugaacuuggugauca

SEQ ID NO: 776661 - RNA, 19 nt, Homo sapiens
gagcuucucuuuguuggau

SEQ ID NO: 776662 - RNA, 19 nt, Homo sapiens
gaagaaggugcuacuauac

SEQ ID NO: 776663 - RNA, 19 nt, Homo sapiens
ucagauaaacuguugaaga

SEQ ID NO: 776664 - RNA, 19 nt, Homo sapiens
caauccaccuguucuuguu

SEQ ID NO: 776665 - RNA, 19 nt, Homo sapiens
guaguagacgaaucagaua

SEQ ID NO: 776666 - RNA, 19 nt, Homo sapiens
ugacccaauugcuacauuu

SEQ ID NO: 776667 - RNA, 19 nt, Homo sapiens
ucagagagaaaguaaacua

SEQ ID NO: 776668 - RNA, 19 nt, Homo sapiens
gagaccagcuggcuuccau

SEQ ID NO: 776669 - RNA, 19 nt, Homo sapiens
aaucaauucucgacuacuu

SEQ ID NO: 776670 - RNA, 19 nt, Homo sapiens
uuggauacguaauaccuua

SEQ ID NO: 776671 - RNA, 19 nt, Homo sapiens
caugagcugucuaccaaga

SEQ ID NO: 776672 - RNA, 19 nt, Homo sapiens
gccuuagccuccugaguaa

SEQ ID NO: 776673 - RNA, 19 nt, Homo sapiens
uagaaacuguagaacaaga

SEQ ID NO: 776674 - RNA, 19 nt, Homo sapiens
agagagauacuucuuauag

SEQ ID NO: 776675 - RNA, 19 nt, Homo sapiens
aagaagcguugcuaauguu

SEQ ID NO: 776676 - RNA, 19 nt, Homo sapiens
caacuagcucaguggaaua

SEQ ID NO: 776677 - RNA, 19 nt, Homo sapiens
gagagaacacaacaacaga

SEQ ID NO: 776678 - RNA, 19 nt, Homo sapiens
gguauuaauguggauguua

SEQ ID NO: 776679 - RNA, 19 nt, Homo sapiens
gcuucucccuuucuucauu

SEQ ID NO: 776680 - RNA, 19 nt, Homo sapiens
ccuuagugcugucauaaug

SEQ ID NO: 776681 - RNA, 19 nt, Homo sapiens
acaugggacuggugauaaa

SEQ ID NO: 776682 - RNA, 19 nt, Homo sapiens
gggaaaagcaauuacauuu

SEQ ID NO: 776683 - RNA, 19 nt, Homo sapiens
gauaacacaguccacaguu

SEQ ID NO: 776684 - RNA, 19 nt, Homo sapiens
acacaacaacagagagaua

SEQ ID NO: 776685 - RNA, 19 nt, Homo sapiens
gagaacacaacaacagaga

SEQ ID NO: 776686 - RNA, 19 nt, Homo sapiens
gcagagagaacacaacaac

SEQ ID NO: 776687 - RNA, 19 nt, Homo sapiens
ggauucaggauacacauga

SEQ ID NO: 776688 - RNA, 19 nt, Homo sapiens
ccagccagauucacagaga

SEQ ID NO: 776689 - RNA, 19 nt, Homo sapiens
aaacaacccgcaaauaaag

SEQ ID NO: 776690 - RNA, 19 nt, Homo sapiens
augaucagcuucucccuuu

SEQ ID NO: 776691 - RNA, 19 nt, Homo sapiens
ugaggaugauaagccauua

SEQ ID NO: 776692 - RNA, 19 nt, Homo sapiens
aagaagagagccuaacuga

SEQ ID NO: 776693 - RNA, 19 nt, Homo sapiens
gagcaucacaaacacauca

SEQ ID NO: 776694 - RNA, 19 nt, Homo sapiens
uccugucucuuuccauuua

SEQ ID NO: 776695 - RNA, 19 nt, Homo sapiens
aacuaugacuuuccaacua

SEQ ID NO: 776696 - RNA, 19 nt, Homo sapiens
agaugcagguuuccaaaug

SEQ ID NO: 776697 - RNA, 19 nt, Homo sapiens
ccuaaacuaucaagucagu

SEQ ID NO: 776698 - RNA, 19 nt, Homo sapiens
guacaacuccaaaauguuu

SEQ ID NO: 776699 - RNA, 19 nt, Homo sapiens
gguguccuguaccagaaua

SEQ ID NO: 776700 - RNA, 19 nt, Homo sapiens
cuagcucaguggaauauau

SEQ ID NO: 776701 - RNA, 19 nt, Homo sapiens
gaagagagccuaacugaaa

SEQ ID NO: 776702 - RNA, 19 nt, Homo sapiens
gauggugccucauuuaaua

SEQ ID NO: 776703 - RNA, 19 nt, Homo sapiens
gaaaccugcugcucucuua

SEQ ID NO: 776704 - RNA, 19 nt, Homo sapiens
gaacaguggugcaaacuca

SEQ ID NO: 776705 - RNA, 19 nt, Homo sapiens
gaaacaacccgcaaauaaa

SEQ ID NO: 776706 - RNA, 19 nt, Homo sapiens
agaagaaggugcuacuaua

SEQ ID NO: 776707 - RNA, 19 nt, Homo sapiens
gaaggaaggugugaugaau

SEQ ID NO: 776708 - RNA, 19 nt, Homo sapiens
ugaaacaacccgcaaauaa

SEQ ID NO: 776709 - RNA, 19 nt, Homo sapiens
gaaaucaacuacaaguaca

SEQ ID NO: 776710 - RNA, 19 nt, Homo sapiens
caagaaauuuggaccuaaa

SEQ ID NO: 776711 - RNA, 19 nt, Homo sapiens
ggugauaaaugauccuaaa

SEQ ID NO: 776712 - RNA, 19 nt, Homo sapiens
ugaaagggcuaaagaacuu

SEQ ID NO: 776713 - RNA, 19 nt, Homo sapiens
agaaauugcuucccaagaa

SEQ ID NO: 776714 - RNA, 19 nt, Homo sapiens
gaaagggagagcauuagua

SEQ ID NO: 776715 - RNA, 19 nt, Homo sapiens
gaucccagcaugaauguua

SEQ ID NO: 776716 - RNA, 19 nt, Homo sapiens
ggaaauaugacuuugauuc

SEQ ID NO: 776717 - RNA, 19 nt, Homo sapiens
gaauacacaugauccacaa

SEQ ID NO: 776718 - RNA, 19 nt, Homo sapiens
acacaauccuccugccuua

SEQ ID NO: 776719 - RNA, 19 nt, Homo sapiens
uaagaagcguugcuaaugu

SEQ ID NO: 776720 - RNA, 19 nt, Homo sapiens
caagagggauugauuuuaa

SEQ ID NO: 776721 - RNA, 19 nt, Homo sapiens
ucaagucaguuucaauuug

SEQ ID NO: 776722 - RNA, 19 nt, Homo sapiens
gaacacaacaacagagaga

SEQ ID NO: 776723 - RNA, 19 nt, Homo sapiens
uaaacuaacuuccggaaag

SEQ ID NO: 776724 - RNA, 19 nt, Homo sapiens
ggaccuaaaucaucuaaaa

SEQ ID NO: 776725 - RNA, 19 nt, Homo sapiens
aagcaaagauugaagacaa

SEQ ID NO: 776726 - RNA, 19 nt, Homo sapiens
ggacguccacgaucucuuu

SEQ ID NO: 776727 - RNA, 19 nt, Homo sapiens
ccaaaucgacuaaucuauu

SEQ ID NO: 776728 - RNA, 19 nt, Homo sapiens
gcuaaaggauuaugaucau

SEQ ID NO: 776729 - RNA, 19 nt, Homo sapiens
caagucaguuucaauuugu

SEQ ID NO: 776730 - RNA, 19 nt, Homo sapiens
ggugaacucuuaaggacuu

SEQ ID NO: 776731 - RNA, 19 nt, Homo sapiens
gaucucuacuuaagcuaaa

SEQ ID NO: 776732 - RNA, 19 nt, Homo sapiens
gaacagcaagaagaaagua

SEQ ID NO: 776733 - RNA, 19 nt, Homo sapiens
gaaucgaccuagcaagugu

SEQ ID NO: 776734 - RNA, 19 nt, Homo sapiens
gaacuugccagccagauuc

SEQ ID NO: 776735 - RNA, 19 nt, Homo sapiens
gggagauacuucuuauaga

SEQ ID NO: 776736 - RNA, 19 nt, Homo sapiens
ggaaauaacauucauugac

SEQ ID NO: 776737 - RNA, 19 nt, Homo sapiens
gagagaaaguaaacuaacu

SEQ ID NO: 776738 - RNA, 19 nt, Homo sapiens
uggagacuauuagcuauua

SEQ ID NO: 776739 - RNA, 19 nt, Homo sapiens
ccagggagauacuucuuau

SEQ ID NO: 776740 - RNA, 19 nt, Homo sapiens
guaggugacuuuuaaauga

SEQ ID NO: 776741 - RNA, 19 nt, Homo sapiens
gcagcucgauuccagauag

SEQ ID NO: 776742 - RNA, 19 nt, Homo sapiens
aagcguugcuaauguuaua

SEQ ID NO: 776743 - RNA, 19 nt, Homo sapiens
ugacauuucugugguuuga

SEQ ID NO: 776744 - RNA, 19 nt, Homo sapiens
ggucagaacagcaagaaga

SEQ ID NO: 776745 - RNA, 19 nt, Homo sapiens
aguagaaacuguagaacaa

SEQ ID NO: 776746 - RNA, 19 nt, Homo sapiens
gcaaggaauucugcaguag

SEQ ID NO: 776747 - RNA, 19 nt, Homo sapiens
auaaacuucuugcggaaua

SEQ ID NO: 776748 - RNA, 19 nt, Homo sapiens
uaagacuggugccuaagaa

SEQ ID NO: 776749 - RNA, 19 nt, Homo sapiens
caacuugaccaggaauaua

SEQ ID NO: 776750 - RNA, 19 nt, Homo sapiens
gacgaugacuucagagaca

SEQ ID NO: 776751 - RNA, 19 nt, Homo sapiens
cagcuuaucuuuccuuagg

SEQ ID NO: 776752 - RNA, 19 nt, Homo sapiens
gaucaacuaugacuuucca

SEQ ID NO: 776753 - RNA, 19 nt, Homo sapiens
ggugaucaacuaugacuuu

SEQ ID NO: 776754 - RNA, 19 nt, Homo sapiens
guacaugggacuggugaua

SEQ ID NO: 776755 - RNA, 19 nt, Homo sapiens
ccaacuagcucaguggaau

SEQ ID NO: 776756 - RNA, 19 nt, Homo sapiens
ugaacuuggugaucaacua

SEQ ID NO: 776757 - RNA, 19 nt, Homo sapiens
uaaguauccuuguauugga

SEQ ID NO: 776758 - RNA, 19 nt, Homo sapiens
aaaauguggugaacucuua

SEQ ID NO: 776759 - RNA, 19 nt, Homo sapiens
gagcagggaauaagggaaa

SEQ ID NO: 776760 - RNA, 19 nt, Homo sapiens
gaacuuggugaucaacuau

SEQ ID NO: 776761 - RNA, 19 nt, Homo sapiens
ggugugaacuuggugauca

SEQ ID NO: 776762 - RNA, 19 nt, Homo sapiens
gagcuucucuuuguuggau

SEQ ID NO: 776763 - RNA, 19 nt, Homo sapiens
gaagaaggugcuacuauac

SEQ ID NO: 776764 - RNA, 19 nt, Homo sapiens
gaauguucuuguuacuuga

SEQ ID NO: 776765 - RNA, 19 nt, Homo sapiens
gaugcaggcuuccaaaugc

SEQ ID NO: 776766 - RNA, 19 nt, Homo sapiens
gugccucauuuaauaagua

SEQ ID NO: 776767 - RNA, 19 nt, Homo sapiens
gucauaauguugcacaaga

SEQ ID NO: 776768 - RNA, 19 nt, Homo sapiens
caauccaccuguucuuguu

SEQ ID NO: 776769 - RNA, 19 nt, Homo sapiens
guaguagacgaaucagaua

SEQ ID NO: 776770 - RNA, 19 nt, Homo sapiens
ugacccaauugcuacauuu

SEQ ID NO: 776771 - RNA, 19 nt, Homo sapiens
ucagagagaaaguaaacua

SEQ ID NO: 776772 - RNA, 19 nt, Homo sapiens
ccaaagugcugggauuaca

SEQ ID NO: 776773 - RNA, 19 nt, Homo sapiens
ugacuugaauguuaucagu

SEQ ID NO: 776774 - RNA, 19 nt, Homo sapiens
agacaggguuucaccaugu

SEQ ID NO: 776775 - RNA, 19 nt, Homo sapiens
uucauucucuuacagcuua

SEQ ID NO: 776776 - RNA, 19 nt, Homo sapiens
gagaccagcuggcuuccau

SEQ ID NO: 776777 - RNA, 19 nt, Homo sapiens
aaucaauucucgacuacuu

SEQ ID NO: 776778 - RNA, 19 nt, Homo sapiens
gugcugggauuacagaugu

SEQ ID NO: 776779 - RNA, 19 nt, Homo sapiens
guacuaccacagaacuaua

SEQ ID NO: 776780 - RNA, 19 nt, Homo sapiens
uuggauacguaauaccuua

SEQ ID NO: 776781 - RNA, 19 nt, Homo sapiens
caugagcugucuaccaaga

SEQ ID NO: 776782 - RNA, 19 nt, Homo sapiens
gccuuagccuccugaguaa

SEQ ID NO: 776783 - RNA, 19 nt, Homo sapiens
uagaaacuguagaacaaga

SEQ ID NO: 776784 - RNA, 19 nt, Homo sapiens
aagaagcguugcuaauguu

SEQ ID NO: 776785 - RNA, 19 nt, Homo sapiens
caacuagcucaguggaaua

SEQ ID NO: 776786 - RNA, 19 nt, Homo sapiens
gagagaacacaacaacaga

SEQ ID NO: 776787 - RNA, 19 nt, Homo sapiens
gguauuaauguggauguua

SEQ ID NO: 776788 - RNA, 19 nt, Homo sapiens
cuacuuaagcuaaaggauu

SEQ ID NO: 776789 - RNA, 19 nt, Homo sapiens
gguugauggugccucauuu

SEQ ID NO: 776790 - RNA, 19 nt, Homo sapiens
gcuucucccuuucuucauu

SEQ ID NO: 776791 - RNA, 19 nt, Homo sapiens
ccuuagugcugucauaaug

SEQ ID NO: 776792 - RNA, 19 nt, Homo sapiens
acaugggacuggugauaaa

SEQ ID NO: 776793 - RNA, 19 nt, Homo sapiens
gggaaaagcaauuacauuu

SEQ ID NO: 776794 - RNA, 19 nt, Homo sapiens
gauaacacaguccacaguu

SEQ ID NO: 776795 - RNA, 19 nt, Homo sapiens
acacaacaacagagagaua

SEQ ID NO: 776796 - RNA, 19 nt, Homo sapiens
gagaacacaacaacagaga

SEQ ID NO: 776797 - RNA, 19 nt, Homo sapiens
gcagagagaacacaacaac

SEQ ID NO: 776798 - RNA, 19 nt, Homo sapiens
ccagccagauucacagaga

SEQ ID NO: 776799 - RNA, 19 nt, Homo sapiens
aaacaacccgcaaauaaag

SEQ ID NO: 776800 - RNA, 19 nt, Homo sapiens
aagaagagagccuaacuga

SEQ ID NO: 776801 - RNA, 19 nt, Homo sapiens
guacaacucuucaaggaaa

SEQ ID NO: 776802 - RNA, 19 nt, Homo sapiens
ggauuuagcugguagcauu

SEQ ID NO: 776803 - RNA, 19 nt, Homo sapiens
gcacaccugucucggagua

SEQ ID NO: 776804 - RNA, 19 nt, Homo sapiens
ccacacagcugaaagagau

SEQ ID NO: 776805 - RNA, 19 nt, Homo sapiens
gagagaacgucauguuugu

SEQ ID NO: 776806 - RNA, 19 nt, Homo sapiens
ggaauacuaugaggaagaa

SEQ ID NO: 776807 - RNA, 19 nt, Homo sapiens
gaaggaauacuaugaggaa

SEQ ID NO: 776808 - RNA, 19 nt, Homo sapiens
ggaagaauaaguaacauug

SEQ ID NO: 776809 - RNA, 19 nt, Homo sapiens
acaucuaguuucccuauua

SEQ ID NO: 776810 - RNA, 19 nt, Homo sapiens
gcagugggaagaauaagua

SEQ ID NO: 776811 - RNA, 19 nt, Homo sapiens
caggaaaccuucaugcaau

SEQ ID NO: 776812 - RNA, 19 nt, Homo sapiens
caucuaguuucccuauuaa

SEQ ID NO: 776813 - RNA, 19 nt, Homo sapiens
ucaaucacacgcagaaaua

SEQ ID NO: 776814 - RNA, 19 nt, Homo sapiens
cagcagcccuccucuggaa

SEQ ID NO: 776815 - RNA, 19 nt, Homo sapiens
gaaagucuucuaaccauuc

SEQ ID NO: 776816 - RNA, 19 nt, Homo sapiens
gagaugauaucaccauggu

SEQ ID NO: 776817 - RNA, 19 nt, Homo sapiens
auaacucccugaaggaaua

SEQ ID NO: 776818 - RNA, 19 nt, Homo sapiens
guaacauugugugcaaaua

SEQ ID NO: 776819 - RNA, 19 nt, Homo sapiens
gcacugagggcccaggaaa

SEQ ID NO: 776820 - RNA, 19 nt, Homo sapiens
gguagcauuugucuccuaa

SEQ ID NO: 776821 - RNA, 19 nt, Homo sapiens
gagcaccuguagucaauca

SEQ ID NO: 776822 - RNA, 19 nt, Homo sapiens
ggugacaagugacagaguu

SEQ ID NO: 776823 - RNA, 19 nt, Homo sapiens
gagauccuguuucuacuca

SEQ ID NO: 776824 - RNA, 19 nt, Homo sapiens
gcucccagguggcagaauu

SEQ ID NO: 776825 - RNA, 19 nt, Homo sapiens
uacuacaucugaagcauuu

SEQ ID NO: 776826 - RNA, 19 nt, Homo sapiens
gaaacgagagaacgucaug

SEQ ID NO: 776827 - RNA, 19 nt, Homo sapiens
ggaaguuucacggcuauaa

SEQ ID NO: 776828 - RNA, 19 nt, Homo sapiens
gagcugagcaccuguaguc

SEQ ID NO: 776829 - RNA, 19 nt, Homo sapiens
ugacauggauggauaagcu

SEQ ID NO: 776830 - RNA, 19 nt, Homo sapiens
cgagagaacgucauguuug

SEQ ID NO: 776831 - RNA, 19 nt, Homo sapiens
caccggaaguucaucacua

SEQ ID NO: 776832 - RNA, 19 nt, Homo sapiens
guucuguccucuucauuug

SEQ ID NO: 776833 - RNA, 19 nt, Homo sapiens
ugaagcauuuagaacagua

SEQ ID NO: 776834 - RNA, 19 nt, Homo sapiens
gaggaaguuucacggcuau

SEQ ID NO: 776835 - RNA, 19 nt, Homo sapiens
ggaguacgccaacgccauu

SEQ ID NO: 776836 - RNA, 19 nt, Homo sapiens
cagccugggugguaacauu

SEQ ID NO: 776837 - RNA, 19 nt, Homo sapiens
gcacuguguuggagaugau

SEQ ID NO: 776838 - RNA, 19 nt, Homo sapiens
ggaaguucaucacuauguc

SEQ ID NO: 776839 - RNA, 19 nt, Homo sapiens
ccuaagacuuggucacaga

SEQ ID NO: 776840 - RNA, 19 nt, Homo sapiens
uagcauuugucuccuaaga

SEQ ID NO: 776841 - RNA, 19 nt, Homo sapiens
ugaggucgccacauccuua

SEQ ID NO: 776842 - RNA, 19 nt, Homo sapiens
ccacgcauguucaccuaug

SEQ ID NO: 776843 - RNA, 19 nt, Homo sapiens
ugaaagucuucuaaccauu

SEQ ID NO: 776844 - RNA, 19 nt, Homo sapiens
ggauuuauguuccucucau

SEQ ID NO: 776845 - RNA, 19 nt, Homo sapiens
ggucaucugcccuggaauu

SEQ ID NO: 776846 - RNA, 19 nt, Homo sapiens
guacaucuaguuucccuau

SEQ ID NO: 776847 - RNA, 19 nt, Homo sapiens
uggagaccauguuaagaaa

SEQ ID NO: 776848 - RNA, 19 nt, Homo sapiens
ccaggaaaccuucaugcaa

SEQ ID NO: 776849 - RNA, 19 nt, Homo sapiens
gcauggaguuacuacaucu

SEQ ID NO: 776850 - RNA, 19 nt, Homo sapiens
ccaaguacaucuaguuucc

SEQ ID NO: 776851 - RNA, 19 nt, Homo sapiens
gugcaugaaagucuucuaa

SEQ ID NO: 776852 - RNA, 19 nt, Homo sapiens
gugguaacauugugugcaa

SEQ ID NO: 776853 - RNA, 19 nt, Homo sapiens
gcaugaaagucuucuaacc

SEQ ID NO: 776854 - RNA, 19 nt, Homo sapiens
ugaugcagauugaugacaa

SEQ ID NO: 776855 - RNA, 19 nt, Homo sapiens
gcugacaacaugaagaaga

SEQ ID NO: 776856 - RNA, 19 nt, Homo sapiens
cuucaggccuucugcucua

SEQ ID NO: 776857 - RNA, 19 nt, Homo sapiens
ucacacgcagaaauaauaa

SEQ ID NO: 776858 - RNA, 19 nt, Homo sapiens
gggaagaauaaguaacauu

SEQ ID NO: 776859 - RNA, 19 nt, Homo sapiens
acaaugugaugaggaaguu

SEQ ID NO: 776860 - RNA, 19 nt, Homo sapiens
ugaacuacaucaagaagac

SEQ ID NO: 776861 - RNA, 19 nt, Homo sapiens
gagccacacagcugaaaga

SEQ ID NO: 776862 - RNA, 19 nt, Homo sapiens
aaugggagcguaacaaguu

SEQ ID NO: 776863 - RNA, 19 nt, Homo sapiens
gauuuauguuccucucaug

SEQ ID NO: 776864 - RNA, 19 nt, Homo sapiens
gagccauggugaacuacau

SEQ ID NO: 776865 - RNA, 19 nt, Homo sapiens
gcccuuggcugagcacugu

SEQ ID NO: 776866 - RNA, 19 nt, Homo sapiens
gauccuguuucuacucaca

SEQ ID NO: 776867 - RNA, 19 nt, Homo sapiens
gcuauaacucccugaagga

SEQ ID NO: 776868 - RNA, 19 nt, Homo sapiens
gcaauacauccgcacuuuc

SEQ ID NO: 776869 - RNA, 19 nt, Homo sapiens
gcucaaguccuguccucuu

SEQ ID NO: 776870 - RNA, 19 nt, Homo sapiens
cgaacucccagccguguuu

SEQ ID NO: 776871 - RNA, 19 nt, Homo sapiens
agcaauacauccgcacuuu

SEQ ID NO: 776872 - RNA, 19 nt, Homo sapiens
uuucuccauugcauuguua

SEQ ID NO: 776873 - RNA, 19 nt, Homo sapiens
gaagugcauggaguuacua

SEQ ID NO: 776874 - RNA, 19 nt, Homo sapiens
cugagcaccuguagucaau

SEQ ID NO: 776875 - RNA, 19 nt, Homo sapiens
cuacuuaugccagugaauu

SEQ ID NO: 776876 - RNA, 19 nt, Homo sapiens
guuccucucaugcugguua

SEQ ID NO: 776877 - RNA, 19 nt, Homo sapiens
gguucuguccucuucauuu

SEQ ID NO: 776878 - RNA, 19 nt, Homo sapiens
ugagaagugcauggaguua

SEQ ID NO: 776879 - RNA, 19 nt, Homo sapiens
uaucuggauuuagcuggua

SEQ ID NO: 776880 - RNA, 19 nt, Homo sapiens
ugagggcucugugcuguuc

SEQ ID NO: 776881 - RNA, 19 nt, Homo sapiens
caaucacacgcagaaauaa

SEQ ID NO: 776882 - RNA, 19 nt, Homo sapiens
uggagccacuucuacauuc

SEQ ID NO: 776883 - RNA, 19 nt, Homo sapiens
caccugaccucuacuucca

SEQ ID NO: 776884 - RNA, 19 nt, Homo sapiens
cuguacaacucuucaagga

SEQ ID NO: 776885 - RNA, 19 nt, Homo sapiens
uaacauugugugcaaauac

SEQ ID NO: 776886 - RNA, 19 nt, Homo sapiens
auaagcuggugguggagua

SEQ ID NO: 776887 - RNA, 19 nt, Homo sapiens
uuggagccauggugaacua

SEQ ID NO: 776888 - RNA, 19 nt, Homo sapiens
uacuuaugccagugaauua

SEQ ID NO: 776889 - RNA, 19 nt, Homo sapiens
cugacaacaugaagaagau

SEQ ID NO: 776890 - RNA, 19 nt, Homo sapiens
ggaguuacuacaucugaag

SEQ ID NO: 776891 - RNA, 19 nt, Homo sapiens
gcugagcaccuguagucaa

SEQ ID NO: 776892 - RNA, 19 nt, Homo sapiens
acacgcagaaauaauaaug

SEQ ID NO: 776893 - RNA, 19 nt, Homo sapiens
caaguccuguccucuucug

SEQ ID NO: 776894 - RNA, 19 nt, Homo sapiens
gugggaagaauaaguaaca

SEQ ID NO: 776895 - RNA, 19 nt, Homo sapiens
caugaaagucuucuaacca

SEQ ID NO: 776896 - RNA, 19 nt, Homo sapiens
gagaccauguuaagaaacc

SEQ ID NO: 776897 - RNA, 19 nt, Homo sapiens
gugaucguccgguguuuga

SEQ ID NO: 776898 - RNA, 19 nt, Homo sapiens
aggaaaccuucaugcaaug

SEQ ID NO: 776899 - RNA, 19 nt, Homo sapiens
gguaacauugugugcaaau

SEQ ID NO: 776900 - RNA, 19 nt, Homo sapiens
caauacauccgcacuuucg

SEQ ID NO: 776901 - RNA, 19 nt, Homo sapiens
guacaacucuucaaggaaa

SEQ ID NO: 776902 - RNA, 19 nt, Homo sapiens
gcacaccugucucggagua

SEQ ID NO: 776903 - RNA, 19 nt, Homo sapiens
gagagaacgucauguuugu

SEQ ID NO: 776904 - RNA, 19 nt, Homo sapiens
ggaauacuaugaggaagaa

SEQ ID NO: 776905 - RNA, 19 nt, Homo sapiens
gaaggaauacuaugaggaa

SEQ ID NO: 776906 - RNA, 19 nt, Homo sapiens
ggaagaauaaguaacauug

SEQ ID NO: 776907 - RNA, 19 nt, Homo sapiens
acaucuaguuucccuauua

SEQ ID NO: 776908 - RNA, 19 nt, Homo sapiens
gcagugggaagaauaagua

SEQ ID NO: 776909 - RNA, 19 nt, Homo sapiens
caggaaaccuucaugcaau

SEQ ID NO: 776910 - RNA, 19 nt, Homo sapiens
caucuaguuucccuauuaa

SEQ ID NO: 776911 - RNA, 19 nt, Homo sapiens
cagcagcccuccucuggaa

SEQ ID NO: 776912 - RNA, 19 nt, Homo sapiens
gaaagucuucuaaccauuc

SEQ ID NO: 776913 - RNA, 19 nt, Homo sapiens
gagaugauaucaccauggu

SEQ ID NO: 776914 - RNA, 19 nt, Homo sapiens
auaacucccugaaggaaua

SEQ ID NO: 776915 - RNA, 19 nt, Homo sapiens
guaacauugugugcaaaua

SEQ ID NO: 776916 - RNA, 19 nt, Homo sapiens
gcacugagggcccaggaaa

SEQ ID NO: 776917 - RNA, 19 nt, Homo sapiens
gagcaccuguagucaauca

SEQ ID NO: 776918 - RNA, 19 nt, Homo sapiens
ggugacaagugacagaguu

SEQ ID NO: 776919 - RNA, 19 nt, Homo sapiens
gaaacgagagaacgucaug

SEQ ID NO: 776920 - RNA, 19 nt, Homo sapiens
ggaaguuucacggcuauaa

SEQ ID NO: 776921 - RNA, 19 nt, Homo sapiens
ugacauggauggauaagcu

SEQ ID NO: 776922 - RNA, 19 nt, Homo sapiens
cgagagaacgucauguuug

SEQ ID NO: 776923 - RNA, 19 nt, Homo sapiens
gagcugagcaccuguaguc

SEQ ID NO: 776924 - RNA, 19 nt, Homo sapiens
caccggaaguucaucacua

SEQ ID NO: 776925 - RNA, 19 nt, Homo sapiens
gaggaaguuucacggcuau

SEQ ID NO: 776926 - RNA, 19 nt, Homo sapiens
ggaguacgccaacgccauu

SEQ ID NO: 776927 - RNA, 19 nt, Homo sapiens
cagccugggugguaacauu

SEQ ID NO: 776928 - RNA, 19 nt, Homo sapiens
gcacuguguuggagaugau

SEQ ID NO: 776929 - RNA, 19 nt, Homo sapiens
ggaaguucaucacuauguc

SEQ ID NO: 776930 - RNA, 19 nt, Homo sapiens
ugaggucgccacauccuua

SEQ ID NO: 776931 - RNA, 19 nt, Homo sapiens
ccacgcauguucaccuaug

SEQ ID NO: 776932 - RNA, 19 nt, Homo sapiens
ugaaagucuucuaaccauu

SEQ ID NO: 776933 - RNA, 19 nt, Homo sapiens
ggauuuauguuccucucau

SEQ ID NO: 776934 - RNA, 19 nt, Homo sapiens
ggucaucugcccuggaauu

SEQ ID NO: 776935 - RNA, 19 nt, Homo sapiens
guacaucuaguuucccuau

SEQ ID NO: 776936 - RNA, 19 nt, Homo sapiens
uggagaccauguuaagaaa

SEQ ID NO: 776937 - RNA, 19 nt, Homo sapiens
ccaggaaaccuucaugcaa

SEQ ID NO: 776938 - RNA, 19 nt, Homo sapiens
ccaaguacaucuaguuucc

SEQ ID NO: 776939 - RNA, 19 nt, Homo sapiens
acacgcagcuuuuagguuu

SEQ ID NO: 776940 - RNA, 19 nt, Homo sapiens
gugcaugaaagucuucuaa

SEQ ID NO: 776941 - RNA, 19 nt, Homo sapiens
gugguaacauugugugcaa

SEQ ID NO: 776942 - RNA, 19 nt, Homo sapiens
gcaugaaagucuucuaacc

SEQ ID NO: 776943 - RNA, 19 nt, Homo sapiens
ugaugcagauugaugacaa

SEQ ID NO: 776944 - RNA, 19 nt, Homo sapiens
gcugacaacaugaagaaga

SEQ ID NO: 776945 - RNA, 19 nt, Homo sapiens
gggaagaauaaguaacauu

SEQ ID NO: 776946 - RNA, 19 nt, Homo sapiens
acaaugugaugaggaaguu

SEQ ID NO: 776947 - RNA, 19 nt, Homo sapiens
ugaacuacaucaagaagac

SEQ ID NO: 776948 - RNA, 19 nt, Homo sapiens
aaugggagcguaacaaguu

SEQ ID NO: 776949 - RNA, 19 nt, Homo sapiens
gauuuauguuccucucaug

SEQ ID NO: 776950 - RNA, 19 nt, Homo sapiens
gagccauggugaacuacau

SEQ ID NO: 776951 - RNA, 19 nt, Homo sapiens
gcccuuggcugagcacugu

SEQ ID NO: 776952 - RNA, 19 nt, Homo sapiens
gcuauaacucccugaagga

SEQ ID NO: 776953 - RNA, 19 nt, Homo sapiens
gcaauacauccgcacuuuc

SEQ ID NO: 776954 - RNA, 19 nt, Homo sapiens
gcucaaguccuguccucuu

SEQ ID NO: 776955 - RNA, 19 nt, Homo sapiens
cgaacucccagccguguuu

SEQ ID NO: 776956 - RNA, 19 nt, Homo sapiens
agcaauacauccgcacuuu

SEQ ID NO: 776957 - RNA, 19 nt, Homo sapiens
uuucuccauugcauuguua

SEQ ID NO: 776958 - RNA, 19 nt, Homo sapiens
cugagcaccuguagucaau

SEQ ID NO: 776959 - RNA, 19 nt, Homo sapiens
guuccucucaugcugguua

SEQ ID NO: 776960 - RNA, 19 nt, Homo sapiens
ugagggcucugugcuguuc

SEQ ID NO: 776961 - RNA, 19 nt, Homo sapiens
cuguacaacucuucaagga

SEQ ID NO: 776962 - RNA, 19 nt, Homo sapiens
uggagccacuucuacauuc

SEQ ID NO: 776963 - RNA, 19 nt, Homo sapiens
caccugaccucuacuucca

SEQ ID NO: 776964 - RNA, 19 nt, Homo sapiens
uaacauugugugcaaauac

SEQ ID NO: 776965 - RNA, 19 nt, Homo sapiens
auaagcuggugguggagua

SEQ ID NO: 776966 - RNA, 19 nt, Homo sapiens
gucaaucacacgcagcuuu

SEQ ID NO: 776967 - RNA, 19 nt, Homo sapiens
uuggagccauggugaacua

SEQ ID NO: 776968 - RNA, 19 nt, Homo sapiens
cugacaacaugaagaagau

SEQ ID NO: 776969 - RNA, 19 nt, Homo sapiens
gcugagcaccuguagucaa

SEQ ID NO: 776970 - RNA, 19 nt, Homo sapiens
caaguccuguccucuucug

SEQ ID NO: 776971 - RNA, 19 nt, Homo sapiens
gugggaagaauaaguaaca

SEQ ID NO: 776972 - RNA, 19 nt, Homo sapiens
caugaaagucuucuaacca

SEQ ID NO: 776973 - RNA, 19 nt, Homo sapiens
gagaccauguuaagaaacc

SEQ ID NO: 776974 - RNA, 19 nt, Homo sapiens
gugaucguccgguguuuga

SEQ ID NO: 776975 - RNA, 19 nt, Homo sapiens
gcccaacuguacaacucuu

SEQ ID NO: 776976 - RNA, 19 nt, Homo sapiens
guaacauugaucaagauga

SEQ ID NO: 776977 - RNA, 19 nt, Homo sapiens
aggaaaccuucaugcaaug

SEQ ID NO: 776978 - RNA, 19 nt, Homo sapiens
gguaacauugugugcaaau

SEQ ID NO: 776979 - RNA, 19 nt, Homo sapiens
caauacauccgcacuuucg

SEQ ID NO: 776980 - RNA, 19 nt, Homo sapiens
gaaguucaucacuaugucu

SEQ ID NO: 776981 - RNA, 19 nt, Homo sapiens
uaggcauggugacaaguga

SEQ ID NO: 776982 - RNA, 19 nt, Homo sapiens
gcaccuguagucaaucaca

SEQ ID NO: 776983 - RNA, 19 nt, Homo sapiens
ccacuugggcuucuuugag

SEQ ID NO: 776984 - RNA, 19 nt, Homo sapiens
uuggagaccauguuaagaa

SEQ ID NO: 776985 - RNA, 19 nt, Homo sapiens
gacaacaugaagaagauca

SEQ ID NO: 776986 - RNA, 19 nt, Homo sapiens
guucuacaacuuccucaug

SEQ ID NO: 776987 - RNA, 19 nt, Homo sapiens
ccaaugggagcguaacaag

SEQ ID NO: 776988 - RNA, 19 nt, Homo sapiens
augaaagucuucuaaccau

SEQ ID NO: 776989 - RNA, 19 nt, Homo sapiens
gaaguuucacggcuauaac

SEQ ID NO: 776990 - RNA, 19 nt, Homo sapiens
gaacuacaucaagaagaca

SEQ ID NO: 776991 - RNA, 19 nt, Homo sapiens
gauggagccacuucuacau

SEQ ID NO: 776992 - RNA, 19 nt, Homo sapiens
gugcuuaguuacugguuuu

SEQ ID NO: 776993 - RNA, 19 nt, Homo sapiens
gacaaugugaugaggaagu

SEQ ID NO: 776994 - RNA, 19 nt, Homo sapiens
agacucaggcaaaccaaga

SEQ ID NO: 776995 - RNA, 19 nt, Homo sapiens
gcuucagccugggugguaa

SEQ ID NO: 776996 - RNA, 19 nt, Homo sapiens
caacuguacaacucuucaa

SEQ ID NO: 776997 - RNA, 19 nt, Homo sapiens
auggugaacuacaucaaga

SEQ ID NO: 776998 - RNA, 19 nt, Homo sapiens
cgccacgcauguucaccua

SEQ ID NO: 776999 - RNA, 19 nt, Homo sapiens
guuggugcaugaaagucuu

SEQ ID NO: 777000 - RNA, 19 nt, Homo sapiens
uggcugacaacaugaagaa

SEQ ID NO: 777001 - RNA, 19 nt, Homo sapiens
gaaugaauguggcuucuua

SEQ ID NO: 777002 - RNA, 19 nt, Homo sapiens
gcacagauaguguauauaa

SEQ ID NO: 777003 - RNA, 19 nt, Homo sapiens
gaagucaucuguaacuaaa

SEQ ID NO: 777004 - RNA, 19 nt, Homo sapiens
gaggagcucuugcauuuaa

SEQ ID NO: 777005 - RNA, 19 nt, Homo sapiens
gaacagcaauauauacaga

SEQ ID NO: 777006 - RNA, 19 nt, Homo sapiens
gcagauaaauccagcauca

SEQ ID NO: 777007 - RNA, 19 nt, Homo sapiens
gcagagaaauacuguuuau

SEQ ID NO: 777008 - RNA, 19 nt, Homo sapiens
gaccaaagcuuuccuugau

SEQ ID NO: 777009 - RNA, 19 nt, Homo sapiens
ugacagccauucauucaua

SEQ ID NO: 777010 - RNA, 19 nt, Homo sapiens
gauaguggcucuaguuuua

SEQ ID NO: 777011 - RNA, 19 nt, Homo sapiens
gggcuuaggccaaaucuua

SEQ ID NO: 777012 - RNA, 19 nt, Homo sapiens
gaauguggcuuagaaaugu

SEQ ID NO: 777013 - RNA, 19 nt, Homo sapiens
uggaggagcucuugcauuu

SEQ ID NO: 777014 - RNA, 19 nt, Homo sapiens
gaacaacaacauucaaaga

SEQ ID NO: 777015 - RNA, 19 nt, Homo sapiens
ggugaugccuuacaugaaa

SEQ ID NO: 777016 - RNA, 19 nt, Homo sapiens
ccaaguguauuaaacauga

SEQ ID NO: 777017 - RNA, 19 nt, Homo sapiens
ugaaaugacugaccaggaa

SEQ ID NO: 777018 - RNA, 19 nt, Homo sapiens
gaauguggcuucuuauuuu

SEQ ID NO: 777019 - RNA, 19 nt, Homo sapiens
ugaagaauguggcuuagaa

SEQ ID NO: 777020 - RNA, 19 nt, Homo sapiens
gagaagaaggacuugauua

SEQ ID NO: 777021 - RNA, 19 nt, Homo sapiens
gaaguaagaaugcgacuau

SEQ ID NO: 777022 - RNA, 19 nt, Homo sapiens
gaucauaacacaagaacaa

SEQ ID NO: 777023 - RNA, 19 nt, Homo sapiens
uccaagaacucaaggcuua

SEQ ID NO: 777024 - RNA, 19 nt, Homo sapiens
gaagacaggugcuugaacu

SEQ ID NO: 777025 - RNA, 19 nt, Homo sapiens
gcagaugcuuuauuaggaa

SEQ ID NO: 777026 - RNA, 19 nt, Homo sapiens
uuauagagcuccaagugua

SEQ ID NO: 777027 - RNA, 19 nt, Homo sapiens
gaaagagacagacaaugaa

SEQ ID NO: 777028 - RNA, 19 nt, Homo sapiens
cauggaaaguuuaucgaua

SEQ ID NO: 777029 - RNA, 19 nt, Homo sapiens
gaucauaacaccagaacaa

SEQ ID NO: 777030 - RNA, 19 nt, Homo sapiens
ggagaaucauccucauuug

SEQ ID NO: 777031 - RNA, 19 nt, Homo sapiens
cagcucaucuccaaccaua

SEQ ID NO: 777032 - RNA, 19 nt, Homo sapiens
ugaaagagacagacaauga

SEQ ID NO: 777033 - RNA, 19 nt, Homo sapiens
cuauucggcuucaauguua

SEQ ID NO: 777034 - RNA, 19 nt, Homo sapiens
ggaaaauggugaugccuua

SEQ ID NO: 777035 - RNA, 19 nt, Homo sapiens
caagaagccauacauguuu

SEQ ID NO: 777036 - RNA, 19 nt, Homo sapiens
ccaauauucuggugacuga

SEQ ID NO: 777037 - RNA, 19 nt, Homo sapiens
gcagauuggcagagaaaua

SEQ ID NO: 777038 - RNA, 19 nt, Homo sapiens
gguggaagcuugcucacuu

SEQ ID NO: 777039 - RNA, 19 nt, Homo sapiens
gaaaaugccuugucuccaa

SEQ ID NO: 777040 - RNA, 19 nt, Homo sapiens
gacagacaaugaaguaaga

SEQ ID NO: 777041 - RNA, 19 nt, Homo sapiens
gagaaauacuguuuaucga

SEQ ID NO: 777042 - RNA, 19 nt, Homo sapiens
gguguaagguacuuuguug

SEQ ID NO: 777043 - RNA, 19 nt, Homo sapiens
gcacgaauggaauagauaa

SEQ ID NO: 777044 - RNA, 19 nt, Homo sapiens
ggaagucaucuguaacuaa

SEQ ID NO: 777045 - RNA, 19 nt, Homo sapiens
gcaaaacaguucauccuuu

SEQ ID NO: 777046 - RNA, 19 nt, Homo sapiens
aggaggcgcuuauauguaa

SEQ ID NO: 777047 - RNA, 19 nt, Homo sapiens
ggagaacaaagaugaauau

SEQ ID NO: 777048 - RNA, 19 nt, Homo sapiens
caacuauugucugcagaua

SEQ ID NO: 777049 - RNA, 19 nt, Homo sapiens
gaagaaggacuugauuaug

SEQ ID NO: 777050 - RNA, 19 nt, Homo sapiens
guccacaaauugcuuauga

SEQ ID NO: 777051 - RNA, 19 nt, Homo sapiens
ccaaauugcacuaguacua

SEQ ID NO: 777052 - RNA, 19 nt, Homo sapiens
cgaauggaauagauaauca

SEQ ID NO: 777053 - RNA, 19 nt, Homo sapiens
gaaaagcaacgauagauuu

SEQ ID NO: 777054 - RNA, 19 nt, Homo sapiens
guucuucucucccuuaugu

SEQ ID NO: 777055 - RNA, 19 nt, Homo sapiens
ucauaaagaucuggauuug

SEQ ID NO: 777056 - RNA, 19 nt, Homo sapiens
ccaagaagccauacauguu

SEQ ID NO: 777057 - RNA, 19 nt, Homo sapiens
ggucugauacuaguaauaa

SEQ ID NO: 777058 - RNA, 19 nt, Homo sapiens
uugcauggcuguucagaaa

SEQ ID NO: 777059 - RNA, 19 nt, Homo sapiens
uaagguacuuuguugauca

SEQ ID NO: 777060 - RNA, 19 nt, Homo sapiens
cauggaaucuguccgaaau

SEQ ID NO: 777061 - RNA, 19 nt, Homo sapiens
ggaaagagugaaagaacaa

SEQ ID NO: 777062 - RNA, 19 nt, Homo sapiens
gauuugcuuuaccuuguua

SEQ ID NO: 777063 - RNA, 19 nt, Homo sapiens
gcuuggaucuaccaccaua

SEQ ID NO: 777064 - RNA, 19 nt, Homo sapiens
caacagacaggguuuacuu

SEQ ID NO: 777065 - RNA, 19 nt, Homo sapiens
gaagcuagaaguauauuag

SEQ ID NO: 777066 - RNA, 19 nt, Homo sapiens
gaauuggaaucugaagcua

SEQ ID NO: 777067 - RNA, 19 nt, Homo sapiens
ucaccaaggucugauacua

SEQ ID NO: 777068 - RNA, 19 nt, Homo sapiens
aaacaagaauggcauagca

SEQ ID NO: 777069 - RNA, 19 nt, Homo sapiens
gagguugacuuggcagauu

SEQ ID NO: 777070 - RNA, 19 nt, Homo sapiens
uggaaucuauugauacuga

SEQ ID NO: 777071 - RNA, 19 nt, Homo sapiens
cgauacugguuucucuuua

SEQ ID NO: 777072 - RNA, 19 nt, Homo sapiens
ggacauggccacugcuuca

SEQ ID NO: 777073 - RNA, 19 nt, Homo sapiens
acucaaggcuuacagaaug

SEQ ID NO: 777074 - RNA, 19 nt, Homo sapiens
gaacucaaggcuuacagaa

SEQ ID NO: 777075 - RNA, 19 nt, Homo sapiens
gaaagaagaguugaugauc

SEQ ID NO: 777076 - RNA, 19 nt, Homo sapiens
ggaaagaagaguugaugau

SEQ ID NO: 777077 - RNA, 19 nt, Homo sapiens
ugaauguggcuucuuauuu

SEQ ID NO: 777078 - RNA, 19 nt, Homo sapiens
gaucuaccaccauauaaga

SEQ ID NO: 777079 - RNA, 19 nt, Homo sapiens
gaaugcgacuauugcaguu

SEQ ID NO: 777080 - RNA, 19 nt, Homo sapiens
aagaaggacuugauuaugg

SEQ ID NO: 777081 - RNA, 19 nt, Homo sapiens
aaugggaagucaucuguaa

SEQ ID NO: 777082 - RNA, 19 nt, Homo sapiens
ccugacaccucuaauucua

SEQ ID NO: 777083 - RNA, 19 nt, Homo sapiens
gguacuuuguugaucauaa

SEQ ID NO: 777084 - RNA, 19 nt, Homo sapiens
ggagcuaugcaacaguuua

SEQ ID NO: 777085 - RNA, 19 nt, Homo sapiens
uauaagcuguucauucugu

SEQ ID NO: 777086 - RNA, 19 nt, Homo sapiens
gaagaauguggcuuagaaa

SEQ ID NO: 777087 - RNA, 19 nt, Homo sapiens
gagauaacaacauugaaga

SEQ ID NO: 777088 - RNA, 19 nt, Homo sapiens
agaaguaguuguagaugga

SEQ ID NO: 777089 - RNA, 19 nt, Homo sapiens
aauccagcaucaaccauua

SEQ ID NO: 777090 - RNA, 19 nt, Homo sapiens
ggagaagaaggacuugauu

SEQ ID NO: 777091 - RNA, 19 nt, Homo sapiens
caacagauuauggcauuaa

SEQ ID NO: 777092 - RNA, 19 nt, Homo sapiens
gcucguauguaguuaaugg

SEQ ID NO: 777093 - RNA, 19 nt, Homo sapiens
gacagccauucauucauaa

SEQ ID NO: 777094 - RNA, 19 nt, Homo sapiens
ggaaguaaugggccucaaa

SEQ ID NO: 777095 - RNA, 19 nt, Homo sapiens
cagaccaucuuucauacuu

SEQ ID NO: 777096 - RNA, 19 nt, Homo sapiens
gaggaggcgcuuauaugua

SEQ ID NO: 777097 - RNA, 19 nt, Homo sapiens
gaucguagaagaguuuauu

SEQ ID NO: 777098 - RNA, 19 nt, Homo sapiens
gaugaucguagaagaguuu

SEQ ID NO: 777099 - RNA, 19 nt, Homo sapiens
uuccgaaccucucaaagua

SEQ ID NO: 777100 - RNA, 19 nt, Homo sapiens
agaauuagagguuauguug

SEQ ID NO: 777101 - RNA, 19 nt, Homo sapiens
gaaaguugguuguuguuug

SEQ ID NO: 777102 - RNA, 19 nt, Homo sapiens
ggacgugucuauuauguug

SEQ ID NO: 777103 - RNA, 19 nt, Homo sapiens
caacggacgugucuauuau

SEQ ID NO: 777104 - RNA, 19 nt, Homo sapiens
caaacucccuccagacuuu

SEQ ID NO: 777105 - RNA, 19 nt, Homo sapiens
gagagaagcugcuguaugc

SEQ ID NO: 777106 - RNA, 19 nt, Homo sapiens
gcaagcagauccagugguu

SEQ ID NO: 777107 - RNA, 19 nt, Homo sapiens
gcacagagucauuuagauu

SEQ ID NO: 777108 - RNA, 19 nt, Homo sapiens
ugacaaaguuggcaaggaa

SEQ ID NO: 777109 - RNA, 19 nt, Homo sapiens
acaagcggaugcucaauaa

SEQ ID NO: 777110 - RNA, 19 nt, Homo sapiens
uguauuacgugaaccauaa

SEQ ID NO: 777111 - RNA, 19 nt, Homo sapiens
ugaaggagauggacaacga

SEQ ID NO: 777112 - RNA, 19 nt, Homo sapiens
acaauggacggguguauua

SEQ ID NO: 777113 - RNA, 19 nt, Homo sapiens
ccaacggacgugucuauua

SEQ ID NO: 777114 - RNA, 19 nt, Homo sapiens
ggauggcagucuggaauaa

SEQ ID NO: 777115 - RNA, 19 nt, Homo sapiens
ugccauaccuugagaaaug

SEQ ID NO: 777116 - RNA, 19 nt, Homo sapiens
gaccaaagccuuccuggau

SEQ ID NO: 777117 - RNA, 19 nt, Homo sapiens
gaacaaccuggaagaaugu

SEQ ID NO: 777118 - RNA, 19 nt, Homo sapiens
agaacaaccuggaagaaug

SEQ ID NO: 777119 - RNA, 19 nt, Homo sapiens
caacggaccacagaaguuu

SEQ ID NO: 777120 - RNA, 19 nt, Homo sapiens
ugaaagugguguccgcaaa

SEQ ID NO: 777121 - RNA, 19 nt, Homo sapiens
ccacagaaguuuugcauug

SEQ ID NO: 777122 - RNA, 19 nt, Homo sapiens
gaaacagaaaggcuaaaga

SEQ ID NO: 777123 - RNA, 19 nt, Homo sapiens
gagccucucugaugaugga

SEQ ID NO: 777124 - RNA, 19 nt, Homo sapiens
uaauugagccucucugaug

SEQ ID NO: 777125 - RNA, 19 nt, Homo sapiens
caggaugggagaugaaaua

SEQ ID NO: 777126 - RNA, 19 nt, Homo sapiens
gcacuucagccaaagauuc

SEQ ID NO: 777127 - RNA, 19 nt, Homo sapiens
gcgcuacuuugacgagaaa

SEQ ID NO: 777128 - RNA, 19 nt, Homo sapiens
caaggaagaguacaucaug

SEQ ID NO: 777129 - RNA, 19 nt, Homo sapiens
ucaacccuauguauuguuu

SEQ ID NO: 777130 - RNA, 19 nt, Homo sapiens
gaugggagaugaaauacac

SEQ ID NO: 777131 - RNA, 19 nt, Homo sapiens
gaacaaggaagaguacauc

SEQ ID NO: 777132 - RNA, 19 nt, Homo sapiens
uaagagaccaacccugaaa

SEQ ID NO: 777133 - RNA, 19 nt, Homo sapiens
aaucgucaaccucgaauua

SEQ ID NO: 777134 - RNA, 19 nt, Homo sapiens
caccuacuuucgcuuuaua

SEQ ID NO: 777135 - RNA, 19 nt, Homo sapiens
aaagauuccuauaccaguu

SEQ ID NO: 777136 - RNA, 19 nt, Homo sapiens
gagcugccauaccuugaga

SEQ ID NO: 777137 - RNA, 19 nt, Homo sapiens
aaaguugguuguuguuugu

SEQ ID NO: 777138 - RNA, 19 nt, Homo sapiens
agucucagcucacuuugaa

SEQ ID NO: 777139 - RNA, 19 nt, Homo sapiens
gaauaugccggaaagaaca

SEQ ID NO: 777140 - RNA, 19 nt, Homo sapiens
gaugaaacagaaaggcuaa

SEQ ID NO: 777141 - RNA, 19 nt, Homo sapiens
gcugcacccuugaguguga

SEQ ID NO: 777142 - RNA, 19 nt, Homo sapiens
gcucaacccuauguauugu

SEQ ID NO: 777143 - RNA, 19 nt, Homo sapiens
cuugagaaaugaacugcua

SEQ ID NO: 777144 - RNA, 19 nt, Homo sapiens
gcaacggaccacagaaguu

SEQ ID NO: 777145 - RNA, 19 nt, Homo sapiens
gagaacaaccuggaagaau

SEQ ID NO: 777146 - RNA, 19 nt, Homo sapiens
gcaaagcccaaggugcaua

SEQ ID NO: 777147 - RNA, 19 nt, Homo sapiens
aaacugcuuugguggaaga

SEQ ID NO: 777148 - RNA, 19 nt, Homo sapiens
gcuguaccauggaaaguuc

SEQ ID NO: 777149 - RNA, 19 nt, Homo sapiens
ugagagagaagcugcugua

SEQ ID NO: 777150 - RNA, 19 nt, Homo sapiens
ucuauuauguugaccacaa

SEQ ID NO: 777151 - RNA, 19 nt, Homo sapiens
ugauggagaugaagugaag

SEQ ID NO: 777152 - RNA, 19 nt, Homo sapiens
gagaccuccuggacuaguu

SEQ ID NO: 777153 - RNA, 19 nt, Homo sapiens
ccauugacccugaguucua

SEQ ID NO: 777154 - RNA, 19 nt, Homo sapiens
gagaggaacccagcacuuc

SEQ ID NO: 777155 - RNA, 19 nt, Homo sapiens
guggaaguaucaccaguuc

SEQ ID NO: 777156 - RNA, 19 nt, Homo sapiens
guuguuguuuguuagguuu

SEQ ID NO: 777157 - RNA, 19 nt, Homo sapiens
guuaauucauucucagcaa

SEQ ID NO: 777158 - RNA, 19 nt, Homo sapiens
ccaauggcacagugaauga

SEQ ID NO: 777159 - RNA, 19 nt, Homo sapiens
caaaggcagcguugucuca

SEQ ID NO: 777160 - RNA, 19 nt, Homo sapiens
cacagagucauuuagauuu

SEQ ID NO: 777161 - RNA, 19 nt, Homo sapiens
gggcugacccucucugcaa

SEQ ID NO: 777162 - RNA, 19 nt, Homo sapiens
acgaacagcugagagagaa

SEQ ID NO: 777163 - RNA, 19 nt, Homo sapiens
caaagcccaaggugcauaa

SEQ ID NO: 777164 - RNA, 19 nt, Homo sapiens
caaccucuccaacgucuug

SEQ ID NO: 777165 - RNA, 19 nt, Homo sapiens
gcaaacucccuccagacuu

SEQ ID NO: 777166 - RNA, 19 nt, Homo sapiens
caaagagaacaaccuggaa

SEQ ID NO: 777167 - RNA, 19 nt, Homo sapiens
gaaagugguguccgcaaag

SEQ ID NO: 777168 - RNA, 19 nt, Homo sapiens
ggagaggaacccagcacuu

SEQ ID NO: 777169 - RNA, 19 nt, Homo sapiens
cacggcagaugaaacagaa

SEQ ID NO: 777170 - RNA, 19 nt, Homo sapiens
ggagauggacaacgagaag

SEQ ID NO: 777171 - RNA, 19 nt, Homo sapiens
aaacagaaaggcuaaagag

SEQ ID NO: 777172 - RNA, 19 nt, Homo sapiens
ucacggaggagaacaagga

SEQ ID NO: 777173 - RNA, 19 nt, Homo sapiens
uacaagcggaugcucaaua

SEQ ID NO: 777174 - RNA, 19 nt, Homo sapiens
gaacaugaaacccuaugac

SEQ ID NO: 777175 - RNA, 19 nt, Homo sapiens
cggaguacgugcgcaacua

SEQ ID NO: 777176 - RNA, 19 nt, Homo sapiens
ugggaaaugugccuaaugg

SEQ ID NO: 777177 - RNA, 19 nt, Homo sapiens
agacuuuguccauguuaua

SEQ ID NO: 777178 - RNA, 19 nt, Homo sapiens
aauugagccucucugauga

SEQ ID NO: 777179 - RNA, 19 nt, Homo sapiens
aauguggccuggagcugua

SEQ ID NO: 777180 - RNA, 19 nt, Homo sapiens
gaaaagacaggacaaugga

SEQ ID NO: 777181 - RNA, 19 nt, Homo sapiens
gugcuucgacugaccauga

SEQ ID NO: 777182 - RNA, 19 nt, Homo sapiens
gccauaccuugagaaauga

SEQ ID NO: 777183 - RNA, 19 nt, Homo sapiens
gccaguuaauucauucuca

SEQ ID NO: 777184 - RNA, 19 nt, Homo sapiens
caaggugcauaaucgucaa

SEQ ID NO: 777185 - RNA, 19 nt, Homo sapiens
gcuucacccucccuuucua

SEQ ID NO: 777186 - RNA, 19 nt, Homo sapiens
gugcucaacccuauguauu

SEQ ID NO: 777187 - RNA, 19 nt, Homo sapiens
ggaguacgugcgcaacuau

SEQ ID NO: 777188 - RNA, 19 nt, Homo sapiens
acaugcagcugacccugaa

SEQ ID NO: 777189 - RNA, 19 nt, Homo sapiens
ggcagaagagcaccaucua

SEQ ID NO: 777190 - RNA, 19 nt, Homo sapiens
gcuacgaacagcugagaga

SEQ ID NO: 777191 - RNA, 19 nt, Homo sapiens
ggaguggcugcgcuacuuu

SEQ ID NO: 777192 - RNA, 19 nt, Homo sapiens
ggagaacaaggaagaguac

SEQ ID NO: 777193 - RNA, 19 nt, Homo sapiens
gccuggagcuguacuucau

SEQ ID NO: 777194 - RNA, 19 nt, Homo sapiens
aagcggaugcucaauaaga

SEQ ID NO: 777195 - RNA, 19 nt, Homo sapiens
ucaccuacuuucgcuuuau

SEQ ID NO: 777196 - RNA, 19 nt, Homo sapiens
gacaauggacggguguauu

SEQ ID NO: 777197 - RNA, 19 nt, Homo sapiens
ggacaauggacggguguau

SEQ ID NO: 777198 - RNA, 19 nt, Homo sapiens
augcagcacuucagccaaa

SEQ ID NO: 777199 - RNA, 19 nt, Homo sapiens
caagaacucaggccacagu

SEQ ID NO: 777200 - RNA, 19 nt, Homo sapiens
cuugaaaguugguuguugu

SEQ ID NO: 777201 - RNA, 19 nt, Homo sapiens
ggagagaagugcuacauua

SEQ ID NO: 777202 - RNA, 19 nt, Homo sapiens
gaagagaagugguaagaaa

SEQ ID NO: 777203 - RNA, 19 nt, Homo sapiens
gaaggaaucuguuguauag

SEQ ID NO: 777204 - RNA, 19 nt, Homo sapiens
gacaacagcuucuugaguu

SEQ ID NO: 777205 - RNA, 19 nt, Homo sapiens
caagaugggucaauggaaa

SEQ ID NO: 777206 - RNA, 19 nt, Homo sapiens
ggaaagaagagaaguggua

SEQ ID NO: 777207 - RNA, 19 nt, Homo sapiens
gagaagugcuacauuaaag

SEQ ID NO: 777208 - RNA, 19 nt, Homo sapiens
gaucaugccagucaaauau

SEQ ID NO: 777209 - RNA, 19 nt, Homo sapiens
gaagaagcaauugcaguua

SEQ ID NO: 777210 - RNA, 19 nt, Homo sapiens
gagagaagugcuacauuaa

SEQ ID NO: 777211 - RNA, 19 nt, Homo sapiens
aauaagaacuagcugaaga

SEQ ID NO: 777212 - RNA, 19 nt, Homo sapiens
gaaagaagagaagugguaa

SEQ ID NO: 777213 - RNA, 19 nt, Homo sapiens
acccauggccuuauaauua

SEQ ID NO: 777214 - RNA, 19 nt, Homo sapiens
gcaauugcaguuaaugauu

SEQ ID NO: 777215 - RNA, 19 nt, Homo sapiens
ggagcgacagucacauuua

SEQ ID NO: 777216 - RNA, 19 nt, Homo sapiens
agaacuagcugaagagaca

SEQ ID NO: 777217 - RNA, 19 nt, Homo sapiens
cuggaagacugaauaauga

SEQ ID NO: 777218 - RNA, 19 nt, Homo sapiens
aagaagcaauugcaguuaa

SEQ ID NO: 777219 - RNA, 19 nt, Homo sapiens
gcauugauuugccauaagu

SEQ ID NO: 777220 - RNA, 19 nt, Homo sapiens
gaaaccagacccaguguuc

SEQ ID NO: 777221 - RNA, 19 nt, Homo sapiens
aaggguaguucaagucuaa

SEQ ID NO: 777222 - RNA, 19 nt, Homo sapiens
ggaacaacuuggagaccuu

SEQ ID NO: 777223 - RNA, 19 nt, Homo sapiens
gaagagacaaccaaagaag

SEQ ID NO: 777224 - RNA, 19 nt, Homo sapiens
ggaaucuguuguauagaau

SEQ ID NO: 777225 - RNA, 19 nt, Homo sapiens
cgaaggaaucuguuguaua

SEQ ID NO: 777226 - RNA, 19 nt, Homo sapiens
gcuggaagacugaauaaug

SEQ ID NO: 777227 - RNA, 19 nt, Homo sapiens
gaguaucaaugggaaacua

SEQ ID NO: 777228 - RNA, 19 nt, Homo sapiens
gacaaccaaagaagcauua

SEQ ID NO: 777229 - RNA, 19 nt, Homo sapiens
gagcaucuccuccaaacug

SEQ ID NO: 777230 - RNA, 19 nt, Homo sapiens
aaagaaauccagagggaaa

SEQ ID NO: 777231 - RNA, 19 nt, Homo sapiens
ggacaacagcuucuugagu

SEQ ID NO: 777232 - RNA, 19 nt, Homo sapiens
guuaaugauuuccagaaug

SEQ ID NO: 777233 - RNA, 19 nt, Homo sapiens
gagcgacagucacauuuac

SEQ ID NO: 777234 - RNA, 19 nt, Homo sapiens
gcuauuacccauggccuua

SEQ ID NO: 777235 - RNA, 19 nt, Homo sapiens
aggaaucuguuguauagaa

SEQ ID NO: 777236 - RNA, 19 nt, Homo sapiens
ggaagacugaauaaugaaa

SEQ ID NO: 777237 - RNA, 19 nt, Homo sapiens
uuccaaagcuauuucgaaa

SEQ ID NO: 777238 - RNA, 19 nt, Homo sapiens
ccugagcgguuauucuuga

SEQ ID NO: 777239 - RNA, 19 nt, Homo sapiens
gggaaagcaugacauucga

SEQ ID NO: 777240 - RNA, 19 nt, Homo sapiens
gcggugaccuuccuauuuu

SEQ ID NO: 777241 - RNA, 19 nt, Homo sapiens
caacuuggagaccuuuaaa

SEQ ID NO: 777242 - RNA, 19 nt, Homo sapiens
cccauggccuuauaauuau

SEQ ID NO: 777243 - RNA, 19 nt, Homo sapiens
cagaauggcaucacaggaa

SEQ ID NO: 777244 - RNA, 19 nt, Homo sapiens
ugaagaagcaauugcaguu

SEQ ID NO: 777245 - RNA, 19 nt, Homo sapiens
gaacaacuuggagaccuuu

SEQ ID NO: 777246 - RNA, 19 nt, Homo sapiens
gcaagaucaugccagucaa

SEQ ID NO: 777247 - RNA, 19 nt, Homo sapiens
caagugaaggcucguauuc

SEQ ID NO: 777248 - RNA, 19 nt, Homo sapiens
uuaaugauuuccagaaugg

SEQ ID NO: 777249 - RNA, 19 nt, Homo sapiens
gaaaggguaguucaagucu

SEQ ID NO: 777250 - RNA, 19 nt, Homo sapiens
gcaagugaaggcucguauu

SEQ ID NO: 777251 - RNA, 19 nt, Homo sapiens
gagccgugguccucauuuc

SEQ ID NO: 777252 - RNA, 19 nt, Homo sapiens
uauuacccauggccuuaua

SEQ ID NO: 777253 - RNA, 19 nt, Homo sapiens
uagaucagccugugaagga

SEQ ID NO: 777254 - RNA, 19 nt, Homo sapiens
gaaauagacgcugggaaca

SEQ ID NO: 777255 - RNA, 19 nt, Homo sapiens
acagagaacuccgacaaag

SEQ ID NO: 777256 - RNA, 19 nt, Homo sapiens
ccagucaaauaugaagaaa

SEQ ID NO: 777257 - RNA, 19 nt, Homo sapiens
uagacuggaucacgaagga

SEQ ID NO: 777258 - RNA, 19 nt, Homo sapiens
ggacucacaagccuucaau

SEQ ID NO: 777259 - RNA, 19 nt, Homo sapiens
gaccugaugacguggaauu

SEQ ID NO: 777260 - RNA, 19 nt, Homo sapiens
agagaagugcuacauuaaa

SEQ ID NO: 777261 - RNA, 19 nt, Homo sapiens
gacagagaacuccgacaaa

SEQ ID NO: 777262 - RNA, 19 nt, Homo sapiens
ucaauccugauaauccuua

SEQ ID NO: 777263 - RNA, 19 nt, Homo sapiens
caagaucaugccagucaaa

SEQ ID NO: 777264 - RNA, 19 nt, Homo sapiens
agaagcaauugcaguuaau

SEQ ID NO: 777265 - RNA, 19 nt, Homo sapiens
gaaauccagagggaaagaa

SEQ ID NO: 777266 - RNA, 19 nt, Homo sapiens
cagagcaucuccuccaaac

SEQ ID NO: 777267 - RNA, 19 nt, Homo sapiens
aaguggagcugaagaagca

SEQ ID NO: 777268 - RNA, 19 nt, Homo sapiens
gcgcuggaagacugaauaa

SEQ ID NO: 777269 - RNA, 19 nt, Homo sapiens
agaauggcaucacaggaau

SEQ ID NO: 777270 - RNA, 19 nt, Homo sapiens
gggagcgacagucacauuu

SEQ ID NO: 777271 - RNA, 19 nt, Homo sapiens
ugaagagacaaccaaagaa

SEQ ID NO: 777272 - RNA, 19 nt, Homo sapiens
cugaagagacaaccaaaga

SEQ ID NO: 777273 - RNA, 19 nt, Homo sapiens
uugcauugauuugccauaa

SEQ ID NO: 777274 - RNA, 19 nt, Homo sapiens
aaaggguaguucaagucua

SEQ ID NO: 777275 - RNA, 19 nt, Homo sapiens
gggaaguggagcugaagaa

SEQ ID NO: 777276 - RNA, 19 nt, Homo sapiens
ccagaacuuuaguauaugc

SEQ ID NO: 777277 - RNA, 19 nt, Homo sapiens
acgcuacgcugacggugaa

SEQ ID NO: 777278 - RNA, 19 nt, Homo sapiens
guggguggcccguaucuug

SEQ ID NO: 777279 - RNA, 19 nt, Homo sapiens
gaagcaauugcaguuaaug

SEQ ID NO: 777280 - RNA, 19 nt, Homo sapiens
cuugaguucuaagguguua

SEQ ID NO: 777281 - RNA, 19 nt, Homo sapiens
cauuaaagcgcaagugaag

SEQ ID NO: 777282 - RNA, 19 nt, Homo sapiens
gaauggcaucacaggaauu

SEQ ID NO: 777283 - RNA, 19 nt, Homo sapiens
ccauaagucuucccuugcu

SEQ ID NO: 777284 - RNA, 19 nt, Homo sapiens
ugacacucuuaacagaauu

SEQ ID NO: 777285 - RNA, 19 nt, Homo sapiens
ucuugacacucuuaacaga

SEQ ID NO: 777286 - RNA, 19 nt, Homo sapiens
aagaagagaagugguaaga

SEQ ID NO: 777287 - RNA, 19 nt, Homo sapiens
cacgaaggaaucuguugua

SEQ ID NO: 777288 - RNA, 19 nt, Homo sapiens
gaagacugaauaaugaaac

SEQ ID NO: 777289 - RNA, 19 nt, Homo sapiens
cauuacaccaugaguauca

SEQ ID NO: 777290 - RNA, 19 nt, Homo sapiens
cauaagucuucccuugcuu

SEQ ID NO: 777291 - RNA, 19 nt, Homo sapiens
guuauucuugacacucuua

SEQ ID NO: 777292 - RNA, 19 nt, Homo sapiens
gcauuaaggcagguugaug

SEQ ID NO: 777293 - RNA, 19 nt, Homo sapiens
aaugggaaguggagcugaa

SEQ ID NO: 777294 - RNA, 19 nt, Homo sapiens
gcgacagucacauuuacaa

SEQ ID NO: 777295 - RNA, 19 nt, Homo sapiens
acgaaggaaucuguuguau

SEQ ID NO: 777296 - RNA, 19 nt, Homo sapiens
gaucacgaaggaaucuguu

SEQ ID NO: 777297 - RNA, 19 nt, Homo sapiens
ccagagggaaagaagagaa

SEQ ID NO: 777298 - RNA, 19 nt, Homo sapiens
gccagucaaauaugaagaa

SEQ ID NO: 777299 - RNA, 19 nt, Homo sapiens
caaacuggaaggcaagauc

SEQ ID NO: 777300 - RNA, 19 nt, Homo sapiens
ucaaugggaaacuacaaga

SEQ ID NO: 777301 - RNA, 19 nt, Homo sapiens
gcacucagaacuuauauua

SEQ ID NO: 777302 - RNA, 19 nt, Homo sapiens
ugacuagacuucccaaaua

SEQ ID NO: 777303 - RNA, 19 nt, Homo sapiens
gaauugcacucagaacuua

SEQ ID NO: 777304 - RNA, 19 nt, Homo sapiens
gaaaauguguggcggauua

SEQ ID NO: 777305 - RNA, 19 nt, Homo sapiens
gcacuaugauuccauuaaa

SEQ ID NO: 777306 - RNA, 19 nt, Homo sapiens
gaauagaauugcacucaga

SEQ ID NO: 777307 - RNA, 19 nt, Homo sapiens
aggcaaacauugacaaaua

SEQ ID NO: 777308 - RNA, 19 nt, Homo sapiens
ggucacaucucaacuaaca

SEQ ID NO: 777309 - RNA, 19 nt, Homo sapiens
gaaacuguauaggaacaua

SEQ ID NO: 777310 - RNA, 19 nt, Homo sapiens
accaguagcucucaaauuu

SEQ ID NO: 777311 - RNA, 19 nt, Homo sapiens
uggaagaacugcugaagaa

SEQ ID NO: 777312 - RNA, 19 nt, Homo sapiens
gacuagacuucccaaauaa

SEQ ID NO: 777313 - RNA, 19 nt, Homo sapiens
caacaggaguuucauggau

SEQ ID NO: 777314 - RNA, 19 nt, Homo sapiens
ggagacaucagaagcuuaa

SEQ ID NO: 777315 - RNA, 19 nt, Homo sapiens
caacauccauccaaaauga

SEQ ID NO: 777316 - RNA, 19 nt, Homo sapiens
gaacaaauaccaacaucca

SEQ ID NO: 777317 - RNA, 19 nt, Homo sapiens
gacaaauacugcucugaau

SEQ ID NO: 777318 - RNA, 19 nt, Homo sapiens
gcaucagauuugaaacaua

SEQ ID NO: 777319 - RNA, 19 nt, Homo sapiens
ccagaaauacacaguuuaa

SEQ ID NO: 777320 - RNA, 19 nt, Homo sapiens
ggucauauuuuguaccuua

SEQ ID NO: 777321 - RNA, 19 nt, Homo sapiens
guaagagcaucagauuuga

SEQ ID NO: 777322 - RNA, 19 nt, Homo sapiens
gccaugguuuggaguguua

SEQ ID NO: 777323 - RNA, 19 nt, Homo sapiens
gcacugcaagaauuaagua

SEQ ID NO: 777324 - RNA, 19 nt, Homo sapiens
uggaguagacccagaaaua

SEQ ID NO: 777325 - RNA, 19 nt, Homo sapiens
ucucagccguugauuguaa

SEQ ID NO: 777326 - RNA, 19 nt, Homo sapiens
acaggaguuucauggauua

SEQ ID NO: 777327 - RNA, 19 nt, Homo sapiens
caucucaacuaacaguauu

SEQ ID NO: 777328 - RNA, 19 nt, Homo sapiens
gaauccuguucuauagaua

SEQ ID NO: 777329 - RNA, 19 nt, Homo sapiens
ugacauugcucuugaacuc

SEQ ID NO: 777330 - RNA, 19 nt, Homo sapiens
caaggugauugcccauuga

SEQ ID NO: 777331 - RNA, 19 nt, Homo sapiens
gcacaucagcaaucauaga

SEQ ID NO: 777332 - RNA, 19 nt, Homo sapiens
gaagaacugcugaagaaag

SEQ ID NO: 777333 - RNA, 19 nt, Homo sapiens
aguaagaaaucaaguggaa

SEQ ID NO: 777334 - RNA, 19 nt, Homo sapiens
uguaagagcaucagauuug

SEQ ID NO: 777335 - RNA, 19 nt, Homo sapiens
ucaaggugauugcccauug

SEQ ID NO: 777336 - RNA, 19 nt, Homo sapiens
caauaugucaggaaagaaa

SEQ ID NO: 777337 - RNA, 19 nt, Homo sapiens
caucagaagcuuaaaggaa

SEQ ID NO: 777338 - RNA, 19 nt, Homo sapiens
aagaacugcugaagaaaga

SEQ ID NO: 777339 - RNA, 19 nt, Homo sapiens
cguauagucuguccuuaug

SEQ ID NO: 777340 - RNA, 19 nt, Homo sapiens
gcccauugauuguucaguu

SEQ ID NO: 777341 - RNA, 19 nt, Homo sapiens
gaagagugacugcaugcaa

SEQ ID NO: 777342 - RNA, 19 nt, Homo sapiens
gccguugauuguaacuuua

SEQ ID NO: 777343 - RNA, 19 nt, Homo sapiens
caguagcucucaaauuuua

SEQ ID NO: 777344 - RNA, 19 nt, Homo sapiens
ggugauugcccauugauug

SEQ ID NO: 777345 - RNA, 19 nt, Homo sapiens
ugacaaauacugcucugaa

SEQ ID NO: 777346 - RNA, 19 nt, Homo sapiens
guucaaacauccugaucau

SEQ ID NO: 777347 - RNA, 19 nt, Homo sapiens
aagagugacugcaugcaaa

SEQ ID NO: 777348 - RNA, 19 nt, Homo sapiens
uuacauguguuuccaucaa

SEQ ID NO: 777349 - RNA, 19 nt, Homo sapiens
gguucgauauucaaaguug

SEQ ID NO: 777350 - RNA, 19 nt, Homo sapiens
gcaaucuaccauaucuuaa

SEQ ID NO: 777351 - RNA, 19 nt, Homo sapiens
uccaaagauugaaagcuua

SEQ ID NO: 777352 - RNA, 19 nt, Homo sapiens
aagcacaucagcaaucaua

SEQ ID NO: 777353 - RNA, 19 nt, Homo sapiens
guauaccuguaauugcuaa

SEQ ID NO: 777354 - RNA, 19 nt, Homo sapiens
uuaggacacuaguaagaaa

SEQ ID NO: 777355 - RNA, 19 nt, Homo sapiens
gcuguaagagcaucagauu

SEQ ID NO: 777356 - RNA, 19 nt, Homo sapiens
gguauuuaaugcucuguca

SEQ ID NO: 777357 - RNA, 19 nt, Homo sapiens
ggguugacauugcucuuga

SEQ ID NO: 777358 - RNA, 19 nt, Homo sapiens
guauauuguugccacagaa

SEQ ID NO: 777359 - RNA, 19 nt, Homo sapiens
ggccauguuugcuggauau

SEQ ID NO: 777360 - RNA, 19 nt, Homo sapiens
gagcaucagauuugaaaca

SEQ ID NO: 777361 - RNA, 19 nt, Homo sapiens
ccaaagauugaaagcuuaa

SEQ ID NO: 777362 - RNA, 19 nt, Homo sapiens
ugaauccuguucuauagau

SEQ ID NO: 777363 - RNA, 19 nt, Homo sapiens
ggcaaacauugacaaauac

SEQ ID NO: 777364 - RNA, 19 nt, Homo sapiens
gaacuguagaucuuuguca

SEQ ID NO: 777365 - RNA, 19 nt, Homo sapiens
gggcaauggcagaagguua

SEQ ID NO: 777366 - RNA, 19 nt, Homo sapiens
uauaggaaauuugguguca

SEQ ID NO: 777367 - RNA, 19 nt, Homo sapiens
ugcaaucuaccauaucuua

SEQ ID NO: 777368 - RNA, 19 nt, Homo sapiens
cuccaaagauugaaagcuu

SEQ ID NO: 777369 - RNA, 19 nt, Homo sapiens
ucaagcacaucagcaauca

SEQ ID NO: 777370 - RNA, 19 nt, Homo sapiens
gacaucagccagugcacua

SEQ ID NO: 777371 - RNA, 19 nt, Homo sapiens
cagaaacuguauaggaaca

SEQ ID NO: 777372 - RNA, 19 nt, Homo sapiens
gcaagaauuaaguaucuca

SEQ ID NO: 777373 - RNA, 19 nt, Homo sapiens
acccagaaauacacaguuu

SEQ ID NO: 777374 - RNA, 19 nt, Homo sapiens
ggacuggguugacauugcu

SEQ ID NO: 777375 - RNA, 19 nt, Homo sapiens
ggacagauggugugauggu

SEQ ID NO: 777376 - RNA, 19 nt, Homo sapiens
ucaaaaggcugaagcaaca

SEQ ID NO: 777377 - RNA, 19 nt, Homo sapiens
ucaguuugcugcuaacgau

SEQ ID NO: 777378 - RNA, 19 nt, Homo sapiens
accuggagaugauuauaua

SEQ ID NO: 777379 - RNA, 19 nt, Homo sapiens
ggaagaacugcugaagaaa

SEQ ID NO: 777380 - RNA, 19 nt, Homo sapiens
ggacuccuuacauguguuu

SEQ ID NO: 777381 - RNA, 19 nt, Homo sapiens
ggugaaacaaguaagaaau

SEQ ID NO: 777382 - RNA, 19 nt, Homo sapiens
gggcuugcuuaauaaacaa

SEQ ID NO: 777383 - RNA, 19 nt, Homo sapiens
gguuuggaguguuauuaau

SEQ ID NO: 777384 - RNA, 19 nt, Homo sapiens
auaccaacauccauccaaa

SEQ ID NO: 777385 - RNA, 19 nt, Homo sapiens
ucugaauccuguucuauag

SEQ ID NO: 777386 - RNA, 19 nt, Homo sapiens
aacaggaguuucauggauu

SEQ ID NO: 777387 - RNA, 19 nt, Homo sapiens
uuauggggcuugcuuaaua

SEQ ID NO: 777388 - RNA, 19 nt, Homo sapiens
ggcaauggcagaagguuau

SEQ ID NO: 777389 - RNA, 19 nt, Homo sapiens
acagcgaauuuaccacaaa

SEQ ID NO: 777390 - RNA, 19 nt, Homo sapiens
cugcaagaauuaaguaucu

SEQ ID NO: 777391 - RNA, 19 nt, Homo sapiens
gaaaccacagaaggucaua

SEQ ID NO: 777392 - RNA, 19 nt, Homo sapiens
gaacucgggacuccuuaca

SEQ ID NO: 777393 - RNA, 19 nt, Homo sapiens
gcaagacuuuuaucugaug

SEQ ID NO: 777394 - RNA, 19 nt, Homo sapiens
cccauugauuguucaguuu

SEQ ID NO: 777395 - RNA, 19 nt, Homo sapiens
gacagcgaauuuaccacaa

SEQ ID NO: 777396 - RNA, 19 nt, Homo sapiens
gaguagacccagaaauaca

SEQ ID NO: 777397 - RNA, 19 nt, Homo sapiens
ggaguagacccagaaauac

SEQ ID NO: 777398 - RNA, 19 nt, Homo sapiens
cacagaaggucauauuuug

SEQ ID NO: 777399 - RNA, 19 nt, Homo sapiens
ugggacagauggugugaug

SEQ ID NO: 777400 - RNA, 19 nt, Homo sapiens
gcuaauggagacaucagaa

SEQ ID NO: 777401 - RNA, 19 nt, Homo sapiens
gcucagggauuuauaauuu

SEQ ID NO: 777402 - RNA, 19 nt, Homo sapiens
ggacuugguugcuaaauuu

SEQ ID NO: 777403 - RNA, 19 nt, Homo sapiens
ggaaauaaaucuagcauag

SEQ ID NO: 777404 - RNA, 19 nt, Homo sapiens
gaauggaacuucuuacuau

SEQ ID NO: 777405 - RNA, 19 nt, Homo sapiens
gaacaaacuuagugaagaa

SEQ ID NO: 777406 - RNA, 19 nt, Homo sapiens
cagaaugccuuaguuauua

SEQ ID NO: 777407 - RNA, 19 nt, Homo sapiens
gcaaggcucuuaaccgaaa

SEQ ID NO: 777408 - RNA, 19 nt, Homo sapiens
ggacagaaauggucaugug

SEQ ID NO: 777409 - RNA, 19 nt, Homo sapiens
cuacaacaguuuauccuua

SEQ ID NO: 777410 - RNA, 19 nt, Homo sapiens
ggaacaaacuuagugaaga

SEQ ID NO: 777411 - RNA, 19 nt, Homo sapiens
gaacaugaauggaacuucu

SEQ ID NO: 777412 - RNA, 19 nt, Homo sapiens
uaagagaacuccacaagag

SEQ ID NO: 777413 - RNA, 19 nt, Homo sapiens
gacaacggcuguaagagaa

SEQ ID NO: 777414 - RNA, 19 nt, Homo sapiens
gaaauuugcaucaacaugu

SEQ ID NO: 777415 - RNA, 19 nt, Homo sapiens
gaaacccuauuacgaugaa

SEQ ID NO: 777416 - RNA, 19 nt, Homo sapiens
gaaacuagagucuggaugu

SEQ ID NO: 777417 - RNA, 19 nt, Homo sapiens
ugacaccagugccuacuaa

SEQ ID NO: 777418 - RNA, 19 nt, Homo sapiens
cgaaaacgauucccucuaa

SEQ ID NO: 777419 - RNA, 19 nt, Homo sapiens
ccagaaugccuuaguuauu

SEQ ID NO: 777420 - RNA, 19 nt, Homo sapiens
cagaauaucaucucuacaa

SEQ ID NO: 777421 - RNA, 19 nt, Homo sapiens
uggcauacaucguucuuug

SEQ ID NO: 777422 - RNA, 19 nt, Homo sapiens
gcugaaauuugcaucaaca

SEQ ID NO: 777423 - RNA, 19 nt, Homo sapiens
gagucuggauguuucauug

SEQ ID NO: 777424 - RNA, 19 nt, Homo sapiens
aaagaaacccuauuacgau

SEQ ID NO: 777425 - RNA, 19 nt, Homo sapiens
cggaggaggucaugagaga

SEQ ID NO: 777426 - RNA, 19 nt, Homo sapiens
caaauccuacaacaguuua

SEQ ID NO: 777427 - RNA, 19 nt, Homo sapiens
cuacaaauccuacaacagu

SEQ ID NO: 777428 - RNA, 19 nt, Homo sapiens
caaacuuagugaagaacaa

SEQ ID NO: 777429 - RNA, 19 nt, Homo sapiens
gaacgaaaaugugcaacaa

SEQ ID NO: 777430 - RNA, 19 nt, Homo sapiens
gcauacaucguucuuuguu

SEQ ID NO: 777431 - RNA, 19 nt, Homo sapiens
ccgagaaggugugaucaaa

SEQ ID NO: 777432 - RNA, 19 nt, Homo sapiens
ugaauggaacuucuuacua

SEQ ID NO: 777433 - RNA, 19 nt, Homo sapiens
gaggguaucuuuucaacuu

SEQ ID NO: 777434 - RNA, 19 nt, Homo sapiens
caagagagucagaacgaaa

SEQ ID NO: 777435 - RNA, 19 nt, Homo sapiens
gaccuuaggaucccuuuga

SEQ ID NO: 777436 - RNA, 19 nt, Homo sapiens
cgaguucaaugccagaaug

SEQ ID NO: 777437 - RNA, 19 nt, Homo sapiens
cuaaguguuuccaauguau

SEQ ID NO: 777438 - RNA, 19 nt, Homo sapiens
caacaaugcagaaaucagu

SEQ ID NO: 777439 - RNA, 19 nt, Homo sapiens
agaaaucaguguccagcuu

SEQ ID NO: 777440 - RNA, 19 nt, Homo sapiens
ucuaaguguuuccaaugua

SEQ ID NO: 777441 - RNA, 19 nt, Homo sapiens
gaaaguauuuugacaacuc

SEQ ID NO: 777442 - RNA, 19 nt, Homo sapiens
cgacagugaugaggaggaa

SEQ ID NO: 777443 - RNA, 19 nt, Homo sapiens
caucacucauccaguugua

SEQ ID NO: 777444 - RNA, 19 nt, Homo sapiens
aaagacaacggcuguaaga

SEQ ID NO: 777445 - RNA, 19 nt, Homo sapiens
guaagagaacuccacaaga

SEQ ID NO: 777446 - RNA, 19 nt, Homo sapiens
ucaagugaaugcacacaca

SEQ ID NO: 777447 - RNA, 19 nt, Homo sapiens
guaauucccagccuacaga

SEQ ID NO: 777448 - RNA, 19 nt, Homo sapiens
caugaacgcauuuaugguu

SEQ ID NO: 777449 - RNA, 19 nt, Homo sapiens
cagaaauggucaugugaag

SEQ ID NO: 777450 - RNA, 19 nt, Homo sapiens
aaacuagagucuggauguu

SEQ ID NO: 777451 - RNA, 19 nt, Homo sapiens
cgacaucaacuccuucuag

SEQ ID NO: 777452 - RNA, 19 nt, Homo sapiens
gaaugcacacacagugaaa

SEQ ID NO: 777453 - RNA, 19 nt, Homo sapiens
cacagaauaucaucucuac

SEQ ID NO: 777454 - RNA, 19 nt, Homo sapiens
agacaacggcuguaagaga

SEQ ID NO: 777455 - RNA, 19 nt, Homo sapiens
gggaaauaaaucuagcaua

SEQ ID NO: 777456 - RNA, 19 nt, Homo sapiens
gccuagaauucuuuguuga

SEQ ID NO: 777457 - RNA, 19 nt, Homo sapiens
gcacaaaagauuaaggaaa

SEQ ID NO: 777458 - RNA, 19 nt, Homo sapiens
gacaacuccuagugaacuu

SEQ ID NO: 777459 - RNA, 19 nt, Homo sapiens
uuuaauggcugaaauuugc

SEQ ID NO: 777460 - RNA, 19 nt, Homo sapiens
gauguuucauuguaggaau

SEQ ID NO: 777461 - RNA, 19 nt, Homo sapiens
gucuggauguuucauugua

SEQ ID NO: 777462 - RNA, 19 nt, Homo sapiens
ucccaucacucauccaguu

SEQ ID NO: 777463 - RNA, 19 nt, Homo sapiens
cuacuggagccuucuguaa

SEQ ID NO: 777464 - RNA, 19 nt, Homo sapiens
ucagggagcuccgccuuca

SEQ ID NO: 777465 - RNA, 19 nt, Homo sapiens
auacaucguucuuuguugu

SEQ ID NO: 777466 - RNA, 19 nt, Homo sapiens
gaacgcauuuaugguuugg

SEQ ID NO: 777467 - RNA, 19 nt, Homo sapiens
gucgugauuugaggaguua

SEQ ID NO: 777468 - RNA, 19 nt, Homo sapiens
ggaguugugagaacaugaa

SEQ ID NO: 777469 - RNA, 19 nt, Homo sapiens
cuaaagacaacggcuguaa

SEQ ID NO: 777470 - RNA, 19 nt, Homo sapiens
cauacaucguucuuuguug

SEQ ID NO: 777471 - RNA, 19 nt, Homo sapiens
gggugauucuucagcuaaa

SEQ ID NO: 777472 - RNA, 19 nt, Homo sapiens
ggagggaugacuaaagaca

SEQ ID NO: 777473 - RNA, 19 nt, Homo sapiens
ggaacuucuuacuauaaca

SEQ ID NO: 777474 - RNA, 19 nt, Homo sapiens
gaagacagguacccaaaac

SEQ ID NO: 777475 - RNA, 19 nt, Homo sapiens
gaacaaaagaaacccuauu

SEQ ID NO: 777476 - RNA, 19 nt, Homo sapiens
gaccagcacuagccaaagc

SEQ ID NO: 777477 - RNA, 19 nt, Homo sapiens
ccuccaggguggucaaguu

SEQ ID NO: 777478 - RNA, 19 nt, Homo sapiens
uggacuugguugcuaaauu

SEQ ID NO: 777479 - RNA, 19 nt, Homo sapiens
uaacagucauagccacagu

SEQ ID NO: 777480 - RNA, 19 nt, Homo sapiens
uacguacucugugguaauu

SEQ ID NO: 777481 - RNA, 19 nt, Homo sapiens
acaaauccuacaacaguuu

SEQ ID NO: 777482 - RNA, 19 nt, Homo sapiens
cuauuacgaugaagcacaa

SEQ ID NO: 777483 - RNA, 19 nt, Homo sapiens
ggaaaacccgccugugauu

SEQ ID NO: 777484 - RNA, 19 nt, Homo sapiens
acaaacggcugagcucaca

SEQ ID NO: 777485 - RNA, 19 nt, Homo sapiens
ugaacgcauuuaugguuug

SEQ ID NO: 777486 - RNA, 19 nt, Homo sapiens
gacagaaauggucauguga

SEQ ID NO: 777487 - RNA, 19 nt, Homo sapiens
uacaaauccuacaacaguu

SEQ ID NO: 777488 - RNA, 19 nt, Homo sapiens
gaauuuccugguuggguuu

SEQ ID NO: 777489 - RNA, 19 nt, Homo sapiens
gaugaagcacaaaagauua

SEQ ID NO: 777490 - RNA, 19 nt, Homo sapiens
uaacccagcagccaacaau

SEQ ID NO: 777491 - RNA, 19 nt, Homo sapiens
gugaugaggaggaagaaga

SEQ ID NO: 777492 - RNA, 19 nt, Homo sapiens
gaacuucuuacuauaacag

SEQ ID NO: 777493 - RNA, 19 nt, Homo sapiens
agagacuacucaagugaau

SEQ ID NO: 777494 - RNA, 19 nt, Homo sapiens
guuauuaugaagacaggua

SEQ ID NO: 777495 - RNA, 19 nt, Homo sapiens
aaacgauucccucuaagug

SEQ ID NO: 777496 - RNA, 19 nt, Homo sapiens
ccauuuggcauacaucguu

SEQ ID NO: 777497 - RNA, 19 nt, Homo sapiens
acaagagagucagaacgaa

SEQ ID NO: 777498 - RNA, 19 nt, Homo sapiens
gccagaaugccuuaguuau

SEQ ID NO: 777499 - RNA, 19 nt, Homo sapiens
ucaaugccagaaugccuua

SEQ ID NO: 777500 - RNA, 19 nt, Homo sapiens
uacagaaucccaucacuca

SEQ ID NO: 777501 - RNA, 19 nt, Homo sapiens
gagaacagcugcauacaaa

SEQ ID NO: 777502 - RNA, 19 nt, Homo sapiens
gaacugagauucugaaacu

SEQ ID NO: 777503 - RNA, 19 nt, Homo sapiens
gaaauugagugcauugaga

SEQ ID NO: 777504 - RNA, 19 nt, Homo sapiens
aaagagaaccuuccauuua

SEQ ID NO: 777505 - RNA, 19 nt, Homo sapiens
caagcaagcagaaguauua

SEQ ID NO: 777506 - RNA, 19 nt, Homo sapiens
gaagaacugcaucauaaua

SEQ ID NO: 777507 - RNA, 19 nt, Homo sapiens
uuaaggcccucuuuauuua

SEQ ID NO: 777508 - RNA, 19 nt, Homo sapiens
gaaaucaggugagcuguug

SEQ ID NO: 777509 - RNA, 19 nt, Homo sapiens
uggaagaacugcaucauaa

SEQ ID NO: 777510 - RNA, 19 nt, Homo sapiens
gaaagagaaccuuccauuu

SEQ ID NO: 777511 - RNA, 19 nt, Homo sapiens
ggaacuagcuaauguccaa

SEQ ID NO: 777512 - RNA, 19 nt, Homo sapiens
gaaaggagaacuaaauguu

SEQ ID NO: 777513 - RNA, 19 nt, Homo sapiens
ggaauuaacagaccagaaa

SEQ ID NO: 777514 - RNA, 19 nt, Homo sapiens
caagagaaguuuauugcaa

SEQ ID NO: 777515 - RNA, 19 nt, Homo sapiens
gaggagagguggugugaga

SEQ ID NO: 777516 - RNA, 19 nt, Homo sapiens
gcaagcagaaguauuaauu

SEQ ID NO: 777517 - RNA, 19 nt, Homo sapiens
ccaaaggguaucugaauua

SEQ ID NO: 777518 - RNA, 19 nt, Homo sapiens
gaaaggagagcucaggaaa

SEQ ID NO: 777519 - RNA, 19 nt, Homo sapiens
ggagacaaguagaugcuuu

SEQ ID NO: 777520 - RNA, 19 nt, Homo sapiens
acacggagcucaagaaaca

SEQ ID NO: 777521 - RNA, 19 nt, Homo sapiens
gcaaugaggacacuuaaau

SEQ ID NO: 777522 - RNA, 19 nt, Homo sapiens
ugaaggagcucaaccagau

SEQ ID NO: 777523 - RNA, 19 nt, Homo sapiens
gaaggaagcacuuaagauc

SEQ ID NO: 777524 - RNA, 19 nt, Homo sapiens
gagaagugcaaucacauua

SEQ ID NO: 777525 - RNA, 19 nt, Homo sapiens
ugacugaacuagaaauaga

SEQ ID NO: 777526 - RNA, 19 nt, Homo sapiens
gaaacuacagaaagacaua

SEQ ID NO: 777527 - RNA, 19 nt, Homo sapiens
gcagacagagggcacuuua

SEQ ID NO: 777528 - RNA, 19 nt, Homo sapiens
ggaaauggcaacaauugaa

SEQ ID NO: 777529 - RNA, 19 nt, Homo sapiens
gaaagaggcagauucuaug

SEQ ID NO: 777530 - RNA, 19 nt, Homo sapiens
acauagaacuguccagaaa

SEQ ID NO: 777531 - RNA, 19 nt, Homo sapiens
cuaccucacugacuucaua

SEQ ID NO: 777532 - RNA, 19 nt, Homo sapiens
ggugaaggaugaaaucaga

SEQ ID NO: 777533 - RNA, 19 nt, Homo sapiens
ugaggacacuuaaaucuga

SEQ ID NO: 777534 - RNA, 19 nt, Homo sapiens
cagcagaucuagaagcuau

SEQ ID NO: 777535 - RNA, 19 nt, Homo sapiens
ucaaccagaugcaguauga

SEQ ID NO: 777536 - RNA, 19 nt, Homo sapiens
gaaagaaagcugagaagca

SEQ ID NO: 777537 - RNA, 19 nt, Homo sapiens
gaacuagaccaacuaaaca

SEQ ID NO: 777538 - RNA, 19 nt, Homo sapiens
guacauaugggaauaguug

SEQ ID NO: 777539 - RNA, 19 nt, Homo sapiens
gaaaucagaaccagcuuga

SEQ ID NO: 777540 - RNA, 19 nt, Homo sapiens
ggacuucauugauggaaau

SEQ ID NO: 777541 - RNA, 19 nt, Homo sapiens
guacuuaaggcccucuuua

SEQ ID NO: 777542 - RNA, 19 nt, Homo sapiens
aaucugaggugaaggauga

SEQ ID NO: 777543 - RNA, 19 nt, Homo sapiens
uaaagaaucugaggugcuu

SEQ ID NO: 777544 - RNA, 19 nt, Homo sapiens
ggaaauguugagagucuua

SEQ ID NO: 777545 - RNA, 19 nt, Homo sapiens
gaacugcaucauaauauug

SEQ ID NO: 777546 - RNA, 19 nt, Homo sapiens
uaaggcagaugucuaaaca

SEQ ID NO: 777547 - RNA, 19 nt, Homo sapiens
gaagacaaauggaaaucag

SEQ ID NO: 777548 - RNA, 19 nt, Homo sapiens
caacagcagcuccaagaaa

SEQ ID NO: 777549 - RNA, 19 nt, Homo sapiens
ccagaaacgucaacagcaa

SEQ ID NO: 777550 - RNA, 19 nt, Homo sapiens
gaaagcaaauuagaaacca

SEQ ID NO: 777551 - RNA, 19 nt, Homo sapiens
ggauaaacgagaaauagaa

SEQ ID NO: 777552 - RNA, 19 nt, Homo sapiens
caaaaggacuucauugaug

SEQ ID NO: 777553 - RNA, 19 nt, Homo sapiens
gagagaagacaaauggaaa

SEQ ID NO: 777554 - RNA, 19 nt, Homo sapiens
caaacuaguccaacaagaa

SEQ ID NO: 777555 - RNA, 19 nt, Homo sapiens
guuugaagcuacaacauga

SEQ ID NO: 777556 - RNA, 19 nt, Homo sapiens
ggccauugauaccacuuua

SEQ ID NO: 777557 - RNA, 19 nt, Homo sapiens
uuggaaagcuugaaagaga

SEQ ID NO: 777558 - RNA, 19 nt, Homo sapiens
gaaccagcuugaagaaucu

SEQ ID NO: 777559 - RNA, 19 nt, Homo sapiens
ggagagaagacaaauggaa

SEQ ID NO: 777560 - RNA, 19 nt, Homo sapiens
gagagaaagugaagaaagc

SEQ ID NO: 777561 - RNA, 19 nt, Homo sapiens
ggaauugaaugucagaaaa

SEQ ID NO: 777562 - RNA, 19 nt, Homo sapiens
gaagugcaaucacauuagg

SEQ ID NO: 777563 - RNA, 19 nt, Homo sapiens
caaagaagcgggaagaaag

SEQ ID NO: 777564 - RNA, 19 nt, Homo sapiens
gagacaaguagaugcuuua

SEQ ID NO: 777565 - RNA, 19 nt, Homo sapiens
ggcaacaauugaacuggua

SEQ ID NO: 777566 - RNA, 19 nt, Homo sapiens
gaagcaugguccaggcaaa

SEQ ID NO: 777567 - RNA, 19 nt, Homo sapiens
caaacuaaacggcagcuuu

SEQ ID NO: 777568 - RNA, 19 nt, Homo sapiens
aaaggaagaucuccaagag

SEQ ID NO: 777569 - RNA, 19 nt, Homo sapiens
gcuacaagguuugaagcua

SEQ ID NO: 777570 - RNA, 19 nt, Homo sapiens
gaauuuaaaccaacaugug

SEQ ID NO: 777571 - RNA, 19 nt, Homo sapiens
ugaaagagaaccuuccauu

SEQ ID NO: 777572 - RNA, 19 nt, Homo sapiens
caacaugaccaaaggguau

SEQ ID NO: 777573 - RNA, 19 nt, Homo sapiens
ggaacuagaccaacuaaac

SEQ ID NO: 777574 - RNA, 19 nt, Homo sapiens
acucagacuuccaauguuu

SEQ ID NO: 777575 - RNA, 19 nt, Homo sapiens
cuuaaggcccucuuuauuu

SEQ ID NO: 777576 - RNA, 19 nt, Homo sapiens
uacuuugccuguaccauua

SEQ ID NO: 777577 - RNA, 19 nt, Homo sapiens
gaugcaaugaggacacuua

SEQ ID NO: 777578 - RNA, 19 nt, Homo sapiens
ggagaacagcugcauacaa

SEQ ID NO: 777579 - RNA, 19 nt, Homo sapiens
gcaaauuagaaaccaguaa

SEQ ID NO: 777580 - RNA, 19 nt, Homo sapiens
aaucguguguugaguguuu

SEQ ID NO: 777581 - RNA, 19 nt, Homo sapiens
ugagagggauaaacgagaa

SEQ ID NO: 777582 - RNA, 19 nt, Homo sapiens
caaaggguaucugaauuag

SEQ ID NO: 777583 - RNA, 19 nt, Homo sapiens
gcaaauguuucucagucau

SEQ ID NO: 777584 - RNA, 19 nt, Homo sapiens
gaaagaaauggaagaacug

SEQ ID NO: 777585 - RNA, 19 nt, Homo sapiens
aaaccuagaaggagaauug

SEQ ID NO: 777586 - RNA, 19 nt, Homo sapiens
gaaagagagagaaagugaa

SEQ ID NO: 777587 - RNA, 19 nt, Homo sapiens
ucagaaaggagaacuaaau

SEQ ID NO: 777588 - RNA, 19 nt, Homo sapiens
gggagagacugaaguaacu

SEQ ID NO: 777589 - RNA, 19 nt, Homo sapiens
agaaagaaauggaagaacu

SEQ ID NO: 777590 - RNA, 19 nt, Homo sapiens
ggagaaagaaauggaagaa

SEQ ID NO: 777591 - RNA, 19 nt, Homo sapiens
cagcaccucugcagauuca

SEQ ID NO: 777592 - RNA, 19 nt, Homo sapiens
ggaaagaaacgaaaaccua

SEQ ID NO: 777593 - RNA, 19 nt, Homo sapiens
caaauguuucucagucaua

SEQ ID NO: 777594 - RNA, 19 nt, Homo sapiens
gaccaaaggguaucugaau

SEQ ID NO: 777595 - RNA, 19 nt, Homo sapiens
gcaaucacauuagggaagu

SEQ ID NO: 777596 - RNA, 19 nt, Homo sapiens
agacugaaguaacugagaa

SEQ ID NO: 777597 - RNA, 19 nt, Homo sapiens
uuucauccgugacauuuaa

SEQ ID NO: 777598 - RNA, 19 nt, Homo sapiens
ccuacaaacugguaaaucu

SEQ ID NO: 777599 - RNA, 19 nt, Homo sapiens
aagagaaccuuccauuuac

SEQ ID NO: 777600 - RNA, 19 nt, Homo sapiens
agaaccagcuugaagaauc

SEQ ID NO: 777601 - RNA, 19 nt, Homo sapiens
guugagcccuuguauauua

SEQ ID NO: 777602 - RNA, 19 nt, Homo sapiens
gguauaagcucucgcuaga

SEQ ID NO: 777603 - RNA, 19 nt, Homo sapiens
gcaagaaaccuacucaaag

SEQ ID NO: 777604 - RNA, 19 nt, Homo sapiens
ggagaacccaacauugaua

SEQ ID NO: 777605 - RNA, 19 nt, Homo sapiens
guauaggacucuuuaucuu

SEQ ID NO: 777606 - RNA, 19 nt, Homo sapiens
caagaaaccuacucaaagc

SEQ ID NO: 777607 - RNA, 19 nt, Homo sapiens
uggagcagcuggaacagua

SEQ ID NO: 777608 - RNA, 19 nt, Homo sapiens
ggucugcccuguaugaugu

SEQ ID NO: 777609 - RNA, 19 nt, Homo sapiens
aaaguggucugcccuguau

SEQ ID NO: 777610 - RNA, 19 nt, Homo sapiens
uaaauuaagccucgguuga

SEQ ID NO: 777611 - RNA, 19 nt, Homo sapiens
uaggagaacccaacauuga

SEQ ID NO: 777612 - RNA, 19 nt, Homo sapiens
agaaguaccugcaagaaac

SEQ ID NO: 777613 - RNA, 19 nt, Homo sapiens
ccacagcuuuuaagaagua

SEQ ID NO: 777614 - RNA, 19 nt, Homo sapiens
auaggacucuuuaucuuga

SEQ ID NO: 777615 - RNA, 19 nt, Homo sapiens
gagcagcuggaacaguaua

SEQ ID NO: 777616 - RNA, 19 nt, Homo sapiens
cgguugagcccuuguauau

SEQ ID NO: 777617 - RNA, 19 nt, Homo sapiens
ggaccauucugcucuccau

SEQ ID NO: 777618 - RNA, 19 nt, Homo sapiens
cagacaaccuuuucaaaug

SEQ ID NO: 777619 - RNA, 19 nt, Homo sapiens
uaacauaugccuggacauc

SEQ ID NO: 777620 - RNA, 19 nt, Homo sapiens
uauaggacucuuuaucuug

SEQ ID NO: 777621 - RNA, 19 nt, Homo sapiens
uaagaaguaccugcaagaa

SEQ ID NO: 777622 - RNA, 19 nt, Homo sapiens
acaaugcgcccacagugaa

SEQ ID NO: 777623 - RNA, 19 nt, Homo sapiens
aagaaguaccugcaagaaa

SEQ ID NO: 777624 - RNA, 19 nt, Homo sapiens
gaacccaacauugauaguc

SEQ ID NO: 777625 - RNA, 19 nt, Homo sapiens
cagcuggaacaguauauga

SEQ ID NO: 777626 - RNA, 19 nt, Homo sapiens
ugcaagaaaccuacucaaa

SEQ ID NO: 777627 - RNA, 19 nt, Homo sapiens
gagaacccaacauugauag

SEQ ID NO: 777628 - RNA, 19 nt, Homo sapiens
ucuaggagaacccaacauu

SEQ ID NO: 777629 - RNA, 19 nt, Homo sapiens
gagcccuuguauauuaaau

SEQ ID NO: 777630 - RNA, 19 nt, Homo sapiens
cgagcgaguuccugucucu

SEQ ID NO: 777631 - RNA, 19 nt, Homo sapiens
aucuugagcugugguauuu

SEQ ID NO: 777632 - RNA, 19 nt, Homo sapiens
uuaagaaguaccugcaaga

SEQ ID NO: 777633 - RNA, 19 nt, Homo sapiens
ccauggagcagcuggaaca

SEQ ID NO: 777634 - RNA, 19 nt, Homo sapiens
uaucuugagcugugguauu

SEQ ID NO: 777635 - RNA, 19 nt, Homo sapiens
cuaggagaacccaacauug

SEQ ID NO: 777636 - RNA, 19 nt, Homo sapiens
uaugaugucaggaccauuc

SEQ ID NO: 777637 - RNA, 19 nt, Homo sapiens
uguauaggacucuuuaucu

SEQ ID NO: 777638 - RNA, 19 nt, Homo sapiens
cuggaacaguauaugaaga

SEQ ID NO: 777639 - RNA, 19 nt, Homo sapiens
uugagcccuuguauauuaa

SEQ ID NO: 777640 - RNA, 19 nt, Homo sapiens
uacaaugcgcccacaguga

SEQ ID NO: 777641 - RNA, 19 nt, Homo sapiens
cccaguggcuacccuuaca

SEQ ID NO: 777642 - RNA, 19 nt, Homo sapiens
gguugagcccuuguauauu

SEQ ID NO: 777643 - RNA, 19 nt, Homo sapiens
gcuggaacaguauaugaag

SEQ ID NO: 777644 - RNA, 19 nt, Homo sapiens
cuuagauggucuguccuuu

SEQ ID NO: 777645 - RNA, 19 nt, Homo sapiens
gaacagagcuucuaaucaa

SEQ ID NO: 777646 - RNA, 19 nt, Homo sapiens
gaacacaccucucauugaa

SEQ ID NO: 777647 - RNA, 19 nt, Homo sapiens
gaagauaacugccauuucu

SEQ ID NO: 777648 - RNA, 19 nt, Homo sapiens
ggagaaauaucgacaguau

SEQ ID NO: 777649 - RNA, 19 nt, Homo sapiens
gaaacgggcucuaacaaug

SEQ ID NO: 777650 - RNA, 19 nt, Homo sapiens
gaaccugaccacauuauua

SEQ ID NO: 777651 - RNA, 19 nt, Homo sapiens
gcuaaucuaucacacauuu

SEQ ID NO: 777652 - RNA, 19 nt, Homo sapiens
cauaccagaugacaauuua

SEQ ID NO: 777653 - RNA, 19 nt, Homo sapiens
gcucaaaccuaaugauguu

SEQ ID NO: 777654 - RNA, 19 nt, Homo sapiens
cauuauggcuguuuaugua

SEQ ID NO: 777655 - RNA, 19 nt, Homo sapiens
guacggcaauuaaauguga

SEQ ID NO: 777656 - RNA, 19 nt, Homo sapiens
uuacgacgcucaccauuaa

SEQ ID NO: 777657 - RNA, 19 nt, Homo sapiens
gcaagaggaugacguaucu

SEQ ID NO: 777658 - RNA, 19 nt, Homo sapiens
gaugagaugugcuacaaau

SEQ ID NO: 777659 - RNA, 19 nt, Homo sapiens
gaaguucuaugcggaguuu

SEQ ID NO: 777660 - RNA, 19 nt, Homo sapiens
uaacugccauuucuuaaga

SEQ ID NO: 777661 - RNA, 19 nt, Homo sapiens
ggacuggucuguaauuucu

SEQ ID NO: 777662 - RNA, 19 nt, Homo sapiens
gcaagagaaggaauuauuu

SEQ ID NO: 777663 - RNA, 19 nt, Homo sapiens
gaugagcuccaaagauuua

SEQ ID NO: 777664 - RNA, 19 nt, Homo sapiens
uaaagaacaugaccaagau

SEQ ID NO: 777665 - RNA, 19 nt, Homo sapiens
gcgaagauguggauauaau

SEQ ID NO: 777666 - RNA, 19 nt, Homo sapiens
cauaagaauuccacuaaga

SEQ ID NO: 777667 - RNA, 19 nt, Homo sapiens
gagaaggaauuauuugaca

SEQ ID NO: 777668 - RNA, 19 nt, Homo sapiens
cagcgaagauguggauaua

SEQ ID NO: 777669 - RNA, 19 nt, Homo sapiens
gaagagcacaauaugcaua

SEQ ID NO: 777670 - RNA, 19 nt, Homo sapiens
gagggacuguguuguuuaa

SEQ ID NO: 777671 - RNA, 19 nt, Homo sapiens
gaggagcuucuucauauua

SEQ ID NO: 777672 - RNA, 19 nt, Homo sapiens
uagauacugugccaaauaa

SEQ ID NO: 777673 - RNA, 19 nt, Homo sapiens
caagcaaguucaagaaguu

SEQ ID NO: 777674 - RNA, 19 nt, Homo sapiens
aauagaaccugaccacauu

SEQ ID NO: 777675 - RNA, 19 nt, Homo sapiens
cugaugagcuccaaagauu

SEQ ID NO: 777676 - RNA, 19 nt, Homo sapiens
gauuaugcccucaacaaua

SEQ ID NO: 777677 - RNA, 19 nt, Homo sapiens
gggagaaacugccaagcaa

SEQ ID NO: 777678 - RNA, 19 nt, Homo sapiens
gcaauucgauucacugacu

SEQ ID NO: 777679 - RNA, 19 nt, Homo sapiens
gaagaguuugguagaaaua

SEQ ID NO: 777680 - RNA, 19 nt, Homo sapiens
cugaggagauuuaaugaaa

SEQ ID NO: 777681 - RNA, 19 nt, Homo sapiens
gagcuaaucuaucacacau

SEQ ID NO: 777682 - RNA, 19 nt, Homo sapiens
ugaggcaacuuuaaaugaa

SEQ ID NO: 777683 - RNA, 19 nt, Homo sapiens
ucacagaugucacacagau

SEQ ID NO: 777684 - RNA, 19 nt, Homo sapiens
gcaagcguguucagcuauu

SEQ ID NO: 777685 - RNA, 19 nt, Homo sapiens
caaguuagcacuagugaau

SEQ ID NO: 777686 - RNA, 19 nt, Homo sapiens
guuagcagguguucucauu

SEQ ID NO: 777687 - RNA, 19 nt, Homo sapiens
cagauuugcuuaugugguu

SEQ ID NO: 777688 - RNA, 19 nt, Homo sapiens
ccaaaucuccuucaucaga

SEQ ID NO: 777689 - RNA, 19 nt, Homo sapiens
gugaagaguuugguagaaa

SEQ ID NO: 777690 - RNA, 19 nt, Homo sapiens
uugcugaaguguugaauaa

SEQ ID NO: 777691 - RNA, 19 nt, Homo sapiens
cugaugaaguucuguuuaa

SEQ ID NO: 777692 - RNA, 19 nt, Homo sapiens
ggagaagauugucaagcaa

SEQ ID NO: 777693 - RNA, 19 nt, Homo sapiens
ucgagcaccucacaugaua

SEQ ID NO: 777694 - RNA, 19 nt, Homo sapiens
acuaagaaaugccaagauu

SEQ ID NO: 777695 - RNA, 19 nt, Homo sapiens
gggaugagaugugcuacaa

SEQ ID NO: 777696 - RNA, 19 nt, Homo sapiens
uggcuacccuguuucauuu

SEQ ID NO: 777697 - RNA, 19 nt, Homo sapiens
ggaguuauguacggcaauu

SEQ ID NO: 777698 - RNA, 19 nt, Homo sapiens
cuaaagacauacagacaau

SEQ ID NO: 777699 - RNA, 19 nt, Homo sapiens
gaauagaaccugaccacau

SEQ ID NO: 777700 - RNA, 19 nt, Homo sapiens
gaauaaggcccacgugaag

SEQ ID NO: 777701 - RNA, 19 nt, Homo sapiens
gaugaugcccggaugauug

SEQ ID NO: 777702 - RNA, 19 nt, Homo sapiens
gaggacuggucuguaauuu

SEQ ID NO: 777703 - RNA, 19 nt, Homo sapiens
acagaugucacacagauua

SEQ ID NO: 777704 - RNA, 19 nt, Homo sapiens
uaagauagcagcccacugu

SEQ ID NO: 777705 - RNA, 19 nt, Homo sapiens
ucaagcaaaucucagaaga

SEQ ID NO: 777706 - RNA, 19 nt, Homo sapiens
gaugauugcugcccucaag

SEQ ID NO: 777707 - RNA, 19 nt, Homo sapiens
gagaagauaacugccauuu

SEQ ID NO: 777708 - RNA, 19 nt, Homo sapiens
ccagaacagugagauacua

SEQ ID NO: 777709 - RNA, 19 nt, Homo sapiens
cagcaagcguguucagcua

SEQ ID NO: 777710 - RNA, 19 nt, Homo sapiens
acagugggcugccauguau

SEQ ID NO: 777711 - RNA, 19 nt, Homo sapiens
ggaaacgggcucuaacaau

SEQ ID NO: 777712 - RNA, 19 nt, Homo sapiens
cagagaacuuuaucacaga

SEQ ID NO: 777713 - RNA, 19 nt, Homo sapiens
caucagauuugcuuaugug

SEQ ID NO: 777714 - RNA, 19 nt, Homo sapiens
ucacugagaucugccuuug

SEQ ID NO: 777715 - RNA, 19 nt, Homo sapiens
gauaacugccauuucuuaa

SEQ ID NO: 777716 - RNA, 19 nt, Homo sapiens
ggagggacuguguuguuua

SEQ ID NO: 777717 - RNA, 19 nt, Homo sapiens
gauacugugccaaauaauu

SEQ ID NO: 777718 - RNA, 19 nt, Homo sapiens
gaaggaauuauuugacaug

SEQ ID NO: 777719 - RNA, 19 nt, Homo sapiens
gcuggaaccuccucucauc

SEQ ID NO: 777720 - RNA, 19 nt, Homo sapiens
caagcguguucagcuauua

SEQ ID NO: 777721 - RNA, 19 nt, Homo sapiens
ggaaaagggaauaacauua

SEQ ID NO: 777722 - RNA, 19 nt, Homo sapiens
caagagaaggaauuauuug

SEQ ID NO: 777723 - RNA, 19 nt, Homo sapiens
ccacagcaaacuuggauuu

SEQ ID NO: 777724 - RNA, 19 nt, Homo sapiens
gcagggucuuuggauguua

SEQ ID NO: 777725 - RNA, 19 nt, Homo sapiens
uaaauuugccagcguuaaa

SEQ ID NO: 777726 - RNA, 19 nt, Homo sapiens
ugaggaaucuauagaaguc

SEQ ID NO: 777727 - RNA, 19 nt, Homo sapiens
gggaagguguugaggaauc

SEQ ID NO: 777728 - RNA, 19 nt, Homo sapiens
ugggauagauuuggauaaa

SEQ ID NO: 777729 - RNA, 19 nt, Homo sapiens
gaacugaugagcuccaaag

SEQ ID NO: 777730 - RNA, 19 nt, Homo sapiens
ggcaaguccuguuagaaga

SEQ ID NO: 777731 - RNA, 19 nt, Homo sapiens
gagaagauugucaagcaaa

SEQ ID NO: 777732 - RNA, 19 nt, Homo sapiens
ggaacagagcuucuaauca

SEQ ID NO: 777733 - RNA, 19 nt, Homo sapiens
caaaggagggacuguguug

SEQ ID NO: 777734 - RNA, 19 nt, Homo sapiens
uggaugaccuagagauuau

SEQ ID NO: 777735 - RNA, 19 nt, Homo sapiens
aauaccaccuaaagacaua

SEQ ID NO: 777736 - RNA, 19 nt, Homo sapiens
ccaagcaaguucaagaagu

SEQ ID NO: 777737 - RNA, 19 nt, Homo sapiens
uuaaagaacaugaccaaga

SEQ ID NO: 777738 - RNA, 19 nt, Homo sapiens
gaguagacaaggaggauuu

SEQ ID NO: 777739 - RNA, 19 nt, Homo sapiens
ccugguacauuauucuaaa

SEQ ID NO: 777740 - RNA, 19 nt, Homo sapiens
uaauagauacugugccaaa

SEQ ID NO: 777741 - RNA, 19 nt, Homo sapiens
ggaggacuggucuguaauu

SEQ ID NO: 777742 - RNA, 19 nt, Homo sapiens
uaaaugugauugacaacca

SEQ ID NO: 777743 - RNA, 19 nt, Homo sapiens
acugagaucugccuuuguu

SEQ ID NO: 777744 - RNA, 19 nt, Homo sapiens
gcauaccagaugacaauuu

SEQ ID NO: 777745 - RNA, 19 nt, Homo sapiens
ggacauggcugaccacuuu

SEQ ID NO: 777746 - RNA, 19 nt, Homo sapiens
guaaagauaugccagaaga

SEQ ID NO: 777747 - RNA, 19 nt, Homo sapiens
caauaaagcaguucucuga

SEQ ID NO: 777748 - RNA, 19 nt, Homo sapiens
gaaggcaacuggcccugaa

SEQ ID NO: 777749 - RNA, 19 nt, Homo sapiens
cagcauggaugaugaugaa

SEQ ID NO: 777750 - RNA, 19 nt, Homo sapiens
caucugagguaagaaugua

SEQ ID NO: 777751 - RNA, 19 nt, Homo sapiens
ggguauaucuucgcuucua

SEQ ID NO: 777752 - RNA, 19 nt, Homo sapiens
cuacauggcuuccuucaac

SEQ ID NO: 777753 - RNA, 19 nt, Homo sapiens
ggaagcggauccuuuacca

SEQ ID NO: 777754 - RNA, 19 nt, Homo sapiens
gagguaagaauguacauca

SEQ ID NO: 777755 - RNA, 19 nt, Homo sapiens
ucaccuacauggcuuccuu

SEQ ID NO: 777756 - RNA, 19 nt, Homo sapiens
ucgccuaccuccucaccua

SEQ ID NO: 777757 - RNA, 19 nt, Homo sapiens
gcauggaugaugaugaaga

SEQ ID NO: 777758 - RNA, 19 nt, Homo sapiens
ucaaugagcggcugaagag

SEQ ID NO: 777759 - RNA, 19 nt, Homo sapiens
gcucuccaguuggguauau

SEQ ID NO: 777760 - RNA, 19 nt, Homo sapiens
caggcucgcaguaucaaua

SEQ ID NO: 777761 - RNA, 19 nt, Homo sapiens
caguaucaauaaagcaguu

SEQ ID NO: 777762 - RNA, 19 nt, Homo sapiens
ccagaauccagucuaauca

SEQ ID NO: 777763 - RNA, 19 nt, Homo sapiens
ggcccagcauggaugauga

SEQ ID NO: 777764 - RNA, 19 nt, Homo sapiens
ccucuuuccucccaacuuc

SEQ ID NO: 777765 - RNA, 19 nt, Homo sapiens
caaccuggucuaccuguuc

SEQ ID NO: 777766 - RNA, 19 nt, Homo sapiens
uggcugaccacuuugcuuu

SEQ ID NO: 777767 - RNA, 19 nt, Homo sapiens
gagccaaggcaaggauuug

SEQ ID NO: 777768 - RNA, 19 nt, Homo sapiens
caacuccagacaaccacua

SEQ ID NO: 777769 - RNA, 19 nt, Homo sapiens
acacuacccaggacucuug

SEQ ID NO: 777770 - RNA, 19 nt, Homo sapiens
gccacuuucuucccugaga

SEQ ID NO: 777771 - RNA, 19 nt, Homo sapiens
caggugcgcgucaguguga

SEQ ID NO: 777772 - RNA, 19 nt, Homo sapiens
gagcugaccaggcuugacu

SEQ ID NO: 777773 - RNA, 19 nt, Homo sapiens
ugacucggguacagaacga

SEQ ID NO: 777774 - RNA, 19 nt, Homo sapiens
cauggaugaugaugaagag

SEQ ID NO: 777775 - RNA, 19 nt, Homo sapiens
agaaagacuguuccuguca

SEQ ID NO: 777776 - RNA, 19 nt, Homo sapiens
ggacucuugcuaccugguu

SEQ ID NO: 777777 - RNA, 19 nt, Homo sapiens
uggugaagguaaagauaug

SEQ ID NO: 777778 - RNA, 19 nt, Homo sapiens
uggguuugcuggcgaacuu

SEQ ID NO: 777779 - RNA, 19 nt, Homo sapiens
ccauggccuucugcuguuu

SEQ ID NO: 777780 - RNA, 19 nt, Homo sapiens
gccauaggccagugacuag

SEQ ID NO: 777781 - RNA, 19 nt, Homo sapiens
ccacuuucuucccugagau

SEQ ID NO: 777782 - RNA, 19 nt, Homo sapiens
gguauaucuucgcuucuac

SEQ ID NO: 777783 - RNA, 19 nt, Homo sapiens
gcucgcaguaucaauaaag

SEQ ID NO: 777784 - RNA, 19 nt, Homo sapiens
gaagggccucgcaguggau

SEQ ID NO: 777785 - RNA, 19 nt, Homo sapiens
ccuguucacuguccguauc

SEQ ID NO: 777786 - RNA, 19 nt, Homo sapiens
ccucccaacuucuggaucu

SEQ ID NO: 777787 - RNA, 19 nt, Homo sapiens
cuugacauccucucagcua

SEQ ID NO: 777788 - RNA, 19 nt, Homo sapiens
aauccagucuaaucaccuu

SEQ ID NO: 777789 - RNA, 19 nt, Homo sapiens
ccuggugaagguaaagaua

SEQ ID NO: 777790 - RNA, 19 nt, Homo sapiens
uccauggccuucugcuguu

SEQ ID NO: 777791 - RNA, 19 nt, Homo sapiens
cggcgguacuauuccucua

SEQ ID NO: 777792 - RNA, 19 nt, Homo sapiens
gacauccucucagcuacuc

SEQ ID NO: 777793 - RNA, 19 nt, Homo sapiens
ggugaagcgcuacgaugug

SEQ ID NO: 777794 - RNA, 19 nt, Homo sapiens
uggucuaccuguucacugu

SEQ ID NO: 777795 - RNA, 19 nt, Homo sapiens
uaacuccagaccaccuuga

SEQ ID NO: 777796 - RNA, 19 nt, Homo sapiens
gcccugaaggcacucaaug

SEQ ID NO: 777797 - RNA, 19 nt, Homo sapiens
caagacgccgagcggagaa

SEQ ID NO: 777798 - RNA, 19 nt, Homo sapiens
ccauugagaucccuaauuu

SEQ ID NO: 777799 - RNA, 19 nt, Homo sapiens
ggaauaguguuuauggaaa

SEQ ID NO: 777800 - RNA, 19 nt, Homo sapiens
caaaucaccuccucucuau

SEQ ID NO: 777801 - RNA, 19 nt, Homo sapiens
ggaggcaacugauagacua

SEQ ID NO: 777802 - RNA, 19 nt, Homo sapiens
ggcaucaccugcauuguua

SEQ ID NO: 777803 - RNA, 19 nt, Homo sapiens
gaagaaggagacucuaauu

SEQ ID NO: 777804 - RNA, 19 nt, Homo sapiens
ucgcguaccugaugaaauu

SEQ ID NO: 777805 - RNA, 19 nt, Homo sapiens
gaaggagacucuaauuuug

SEQ ID NO: 777806 - RNA, 19 nt, Homo sapiens
gauaccagcuucagucucu

SEQ ID NO: 777807 - RNA, 19 nt, Homo sapiens
ccauuggacuguacuuuga

SEQ ID NO: 777808 - RNA, 19 nt, Homo sapiens
uggauuagcccuacucuuu

SEQ ID NO: 777809 - RNA, 19 nt, Homo sapiens
acacuggacucuugaggaa

SEQ ID NO: 777810 - RNA, 19 nt, Homo sapiens
ggaagaaggagacucuaau

SEQ ID NO: 777811 - RNA, 19 nt, Homo sapiens
auacauugcuagucacauu

SEQ ID NO: 777812 - RNA, 19 nt, Homo sapiens
caaaaucucucuuggaauc

SEQ ID NO: 777813 - RNA, 19 nt, Homo sapiens
guucugcucucuucugaau

SEQ ID NO: 777814 - RNA, 19 nt, Homo sapiens
gacauaaagggaaugcaua

SEQ ID NO: 777815 - RNA, 19 nt, Homo sapiens
cccgacaccugaugccuua

SEQ ID NO: 777816 - RNA, 19 nt, Homo sapiens
gcgccgauuugauuuguau

SEQ ID NO: 777817 - RNA, 19 nt, Homo sapiens
gguucucccucaaguguuu

SEQ ID NO: 777818 - RNA, 19 nt, Homo sapiens
uuugggaagucgacaguua

SEQ ID NO: 777819 - RNA, 19 nt, Homo sapiens
ucaaaucaccuccucucua

SEQ ID NO: 777820 - RNA, 19 nt, Homo sapiens
ggacauaaagggaaugcau

SEQ ID NO: 777821 - RNA, 19 nt, Homo sapiens
gcauacaacugggugaaag

SEQ ID NO: 777822 - RNA, 19 nt, Homo sapiens
gaaaucugcugcaaaaucu

SEQ ID NO: 777823 - RNA, 19 nt, Homo sapiens
cacuggguguucaaauuua

SEQ ID NO: 777824 - RNA, 19 nt, Homo sapiens
cauuaacccuuuagagaca

SEQ ID NO: 777825 - RNA, 19 nt, Homo sapiens
uuuagugacucuguaagua

SEQ ID NO: 777826 - RNA, 19 nt, Homo sapiens
caccguggcugacaagauc

SEQ ID NO: 777827 - RNA, 19 nt, Homo sapiens
ucuccacucucuucucaaa

SEQ ID NO: 777828 - RNA, 19 nt, Homo sapiens
aagaaggagacucuaauuu

SEQ ID NO: 777829 - RNA, 19 nt, Homo sapiens
gggccucauuaacccuuua

SEQ ID NO: 777830 - RNA, 19 nt, Homo sapiens
ggucacagcacgcuaccaa

SEQ ID NO: 777831 - RNA, 19 nt, Homo sapiens
aaugaaaucugcugcaaaa

SEQ ID NO: 777832 - RNA, 19 nt, Homo sapiens
aggaggagcucagugcaaa

SEQ ID NO: 777833 - RNA, 19 nt, Homo sapiens
ugagaucccuaauuucaac

SEQ ID NO: 777834 - RNA, 19 nt, Homo sapiens
ggauuagcccuacucuuuc

SEQ ID NO: 777835 - RNA, 19 nt, Homo sapiens
uaggaggcauugcucaaau

SEQ ID NO: 777836 - RNA, 19 nt, Homo sapiens
augcauacauugcuaguca

SEQ ID NO: 777837 - RNA, 19 nt, Homo sapiens
ugauuuguauccacuguca

SEQ ID NO: 777838 - RNA, 19 nt, Homo sapiens
ccaggauuauauuagcauu

SEQ ID NO: 777839 - RNA, 19 nt, Homo sapiens
uuagugacucuguaaguaa

SEQ ID NO: 777840 - RNA, 19 nt, Homo sapiens
ccucuccacucucuucuca

SEQ ID NO: 777841 - RNA, 19 nt, Homo sapiens
gcauaguucccgacgucua

SEQ ID NO: 777842 - RNA, 19 nt, Homo sapiens
agaaggagacucuaauuuu

SEQ ID NO: 777843 - RNA, 19 nt, Homo sapiens
ggagacauaggaggcauug

SEQ ID NO: 777844 - RNA, 19 nt, Homo sapiens
caugugcccaggauuauau

SEQ ID NO: 777845 - RNA, 19 nt, Homo sapiens
cugacaagauccacagugu

SEQ ID NO: 777846 - RNA, 19 nt, Homo sapiens
uggaauaguguuuauggaa

SEQ ID NO: 777847 - RNA, 19 nt, Homo sapiens
aaucaccuccucucuauuc

SEQ ID NO: 777848 - RNA, 19 nt, Homo sapiens
ggaggcauugcucaaauca

SEQ ID NO: 777849 - RNA, 19 nt, Homo sapiens
gauuuccgagggagacaua

SEQ ID NO: 777850 - RNA, 19 nt, Homo sapiens
uaaugaaaucugcugcaaa

SEQ ID NO: 777851 - RNA, 19 nt, Homo sapiens
auaaugaaaucugcugcaa

SEQ ID NO: 777852 - RNA, 19 nt, Homo sapiens
ggaccagacagaugcuuag

SEQ ID NO: 777853 - RNA, 19 nt, Homo sapiens
uccacucucuucucaaaug

SEQ ID NO: 777854 - RNA, 19 nt, Homo sapiens
uggcaucaccugcauuguu

SEQ ID NO: 777855 - RNA, 19 nt, Homo sapiens
ggaagucgacaguuaaaau

SEQ ID NO: 777856 - RNA, 19 nt, Homo sapiens
uagcccuacucuuuccuuu

SEQ ID NO: 777857 - RNA, 19 nt, Homo sapiens
aaaugguacagacaccuua

SEQ ID NO: 777858 - RNA, 19 nt, Homo sapiens
gcccaggauuauauuagca

SEQ ID NO: 777859 - RNA, 19 nt, Homo sapiens
ugcaaaaucucucuuggaa

SEQ ID NO: 777860 - RNA, 19 nt, Homo sapiens
gauuagcccuacucuuucc

SEQ ID NO: 777861 - RNA, 19 nt, Homo sapiens
cucauuaacccuuuagaga

SEQ ID NO: 777862 - RNA, 19 nt, Homo sapiens
uucugaaucucaugccuuu

SEQ ID NO: 777863 - RNA, 19 nt, Homo sapiens
gaagucgacaguuaaaaug

SEQ ID NO: 777864 - RNA, 19 nt, Homo sapiens
gcccuacucuuuccuuucc

SEQ ID NO: 777865 - RNA, 19 nt, Homo sapiens
ggaagguugauaccagcuu

SEQ ID NO: 777866 - RNA, 19 nt, Homo sapiens
uaaacugguucugcucucu

SEQ ID NO: 777867 - RNA, 19 nt, Homo sapiens
aggaagaaggagacucuaa

SEQ ID NO: 777868 - RNA, 19 nt, Homo sapiens
ugugacugcuggcgucuuc

SEQ ID NO: 777869 - RNA, 19 nt, Homo sapiens
cggaccagacagaugcuua

SEQ ID NO: 777870 - RNA, 19 nt, Homo sapiens
cuucucaaauggcugacuu

SEQ ID NO: 777871 - RNA, 19 nt, Homo sapiens
auugagaucccuaauuuca

SEQ ID NO: 777872 - RNA, 19 nt, Homo sapiens
cauaggaggcauugcucaa

SEQ ID NO: 777873 - RNA, 19 nt, Homo sapiens
ccaugugcccaggauuaua

SEQ ID NO: 777874 - RNA, 19 nt, Homo sapiens
ugacucuguaaguaaguua

SEQ ID NO: 777875 - RNA, 19 nt, Homo sapiens
ccacucucuucucaaaugg

SEQ ID NO: 777876 - RNA, 19 nt, Homo sapiens
ggcaacugauagacuacga

SEQ ID NO: 777877 - RNA, 19 nt, Homo sapiens
guguaucgcguaccugaug

SEQ ID NO: 777878 - RNA, 19 nt, Homo sapiens
uagugacucuguaaguaag

SEQ ID NO: 777879 - RNA, 19 nt, Homo sapiens
gcucucuucugaaucucau

SEQ ID NO: 777880 - RNA, 19 nt, Homo sapiens
ucugcucucuucugaaucu

SEQ ID NO: 777881 - RNA, 19 nt, Homo sapiens
ugaugaaauuccacaacgu

SEQ ID NO: 777882 - RNA, 19 nt, Homo sapiens
gugacucuguaaguaaguu

SEQ ID NO: 777883 - RNA, 19 nt, Homo sapiens
auaaaacacucuggucuug

SEQ ID NO: 777884 - RNA, 19 nt, Homo sapiens
gcauacauugcuagucaca

SEQ ID NO: 777885 - RNA, 19 nt, Homo sapiens
ugaggaagaaggagacucu

SEQ ID NO: 777886 - RNA, 19 nt, Homo sapiens
ugucaucaggcccaacgua

SEQ ID NO: 777887 - RNA, 19 nt, Homo sapiens
acugcucacuuaggacuuu

SEQ ID NO: 777888 - RNA, 19 nt, Homo sapiens
gcaguguggccuccaaucg

SEQ ID NO: 777889 - RNA, 19 nt, Homo sapiens
gcgcacacuggacucuuga

SEQ ID NO: 777890 - RNA, 19 nt, Homo sapiens
gcaaauagcucucgaaaug

SEQ ID NO: 777891 - RNA, 19 nt, Homo sapiens
gggaagaaguucauaaaua

SEQ ID NO: 777892 - RNA, 19 nt, Homo sapiens
guaaauaucugaagcugua

SEQ ID NO: 777893 - RNA, 19 nt, Homo sapiens
gaagaggcauugaagauaa

SEQ ID NO: 777894 - RNA, 19 nt, Homo sapiens
cagaauacauugcugauua

SEQ ID NO: 777895 - RNA, 19 nt, Homo sapiens
gcagaacuguugcggauua

SEQ ID NO: 777896 - RNA, 19 nt, Homo sapiens
guacaaaucuccaugaugu

SEQ ID NO: 777897 - RNA, 19 nt, Homo sapiens
ggaaucaccuccucaugua

SEQ ID NO: 777898 - RNA, 19 nt, Homo sapiens
gagcaaguguucaagaaua

SEQ ID NO: 777899 - RNA, 19 nt, Homo sapiens
ucaagcaccugaagauuua

SEQ ID NO: 777900 - RNA, 19 nt, Homo sapiens
ggagacucaugaagaauua

SEQ ID NO: 777901 - RNA, 19 nt, Homo sapiens
acaaauacauggcugguua

SEQ ID NO: 777902 - RNA, 19 nt, Homo sapiens
gcaaagaaguggaauuuac

SEQ ID NO: 777903 - RNA, 19 nt, Homo sapiens
gcagaaagcuagauaaacu

SEQ ID NO: 777904 - RNA, 19 nt, Homo sapiens
ggauauaucuuugcgguuu

SEQ ID NO: 777905 - RNA, 19 nt, Homo sapiens
guaaacaucuuccugaauc

SEQ ID NO: 777906 - RNA, 19 nt, Homo sapiens
gcagaggacuucccuuuca

SEQ ID NO: 777907 - RNA, 19 nt, Homo sapiens
guacucaucuuauacugaa

SEQ ID NO: 777908 - RNA, 19 nt, Homo sapiens
caaaagaguuuccuuguuu

SEQ ID NO: 777909 - RNA, 19 nt, Homo sapiens
gaucugcucucucaauaug

SEQ ID NO: 777910 - RNA, 19 nt, Homo sapiens
gauaaacugagaagacuua

SEQ ID NO: 777911 - RNA, 19 nt, Homo sapiens
guaauucacuuaacagcaa

SEQ ID NO: 777912 - RNA, 19 nt, Homo sapiens
gcacacgccugcaaacuca

SEQ ID NO: 777913 - RNA, 19 nt, Homo sapiens
guucagaaauguccagaaa

SEQ ID NO: 777914 - RNA, 19 nt, Homo sapiens
uaacaucgcaaacaucaua

SEQ ID NO: 777915 - RNA, 19 nt, Homo sapiens
caaagacuaugcccaauuc

SEQ ID NO: 777916 - RNA, 19 nt, Homo sapiens
ggaagaagacuaugaaugg

SEQ ID NO: 777917 - RNA, 19 nt, Homo sapiens
gaaagaggaguacacauug

SEQ ID NO: 777918 - RNA, 19 nt, Homo sapiens
ucagaaauguccagaaaug

SEQ ID NO: 777919 - RNA, 19 nt, Homo sapiens
gauuucaaguguccuauuu

SEQ ID NO: 777920 - RNA, 19 nt, Homo sapiens
caaauccaaugcaaagaaa

SEQ ID NO: 777921 - RNA, 19 nt, Homo sapiens
auacauggcugguuacuug

SEQ ID NO: 777922 - RNA, 19 nt, Homo sapiens
gcugagcccuugaaugauu

SEQ ID NO: 777923 - RNA, 19 nt, Homo sapiens
acacagaccuuagagauga

SEQ ID NO: 777924 - RNA, 19 nt, Homo sapiens
gaagcagagugaacuaaau

SEQ ID NO: 777925 - RNA, 19 nt, Homo sapiens
ccacaggccucauguagug

SEQ ID NO: 777926 - RNA, 19 nt, Homo sapiens
gaacuggaaacucccauaa

SEQ ID NO: 777927 - RNA, 19 nt, Homo sapiens
ccugauguuucuacaauua

SEQ ID NO: 777928 - RNA, 19 nt, Homo sapiens
gaagaacgaaguuuggaaa

SEQ ID NO: 777929 - RNA, 19 nt, Homo sapiens
gguaauggauuuugcuuua

SEQ ID NO: 777930 - RNA, 19 nt, Homo sapiens
aagcuuggcugcagaauug

SEQ ID NO: 777931 - RNA, 19 nt, Homo sapiens
gaauuuaccugccguuacu

SEQ ID NO: 777932 - RNA, 19 nt, Homo sapiens
gauguaaccauaucuugua

SEQ ID NO: 777933 - RNA, 19 nt, Homo sapiens
gcaaauccaaugcaaagaa

SEQ ID NO: 777934 - RNA, 19 nt, Homo sapiens
ccagcuaaaugaagaugua

SEQ ID NO: 777935 - RNA, 19 nt, Homo sapiens
ggagaagucacaagagaaa

SEQ ID NO: 777936 - RNA, 19 nt, Homo sapiens
acacuaaucgggaguauaa

SEQ ID NO: 777937 - RNA, 19 nt, Homo sapiens
guccagaaaugacaaagaa

SEQ ID NO: 777938 - RNA, 19 nt, Homo sapiens
gacagaaccuagaccagaa

SEQ ID NO: 777939 - RNA, 19 nt, Homo sapiens
aaauacaacuccucagcua

SEQ ID NO: 777940 - RNA, 19 nt, Homo sapiens
gggacuggauuaucacaaa

SEQ ID NO: 777941 - RNA, 19 nt, Homo sapiens
gacaauauggccaccaaua

SEQ ID NO: 777942 - RNA, 19 nt, Homo sapiens
gaagaaaccuauuuugcuu

SEQ ID NO: 777943 - RNA, 19 nt, Homo sapiens
gaacguguacugcuugaga

SEQ ID NO: 777944 - RNA, 19 nt, Homo sapiens
guagugguauguguuagua

SEQ ID NO: 777945 - RNA, 19 nt, Homo sapiens
gcaaagacuaugcccaauu

SEQ ID NO: 777946 - RNA, 19 nt, Homo sapiens
gagauggaauguacacugu

SEQ ID NO: 777947 - RNA, 19 nt, Homo sapiens
gagccgaacauccaguuua

SEQ ID NO: 777948 - RNA, 19 nt, Homo sapiens
gaaugugacugugauagau

SEQ ID NO: 777949 - RNA, 19 nt, Homo sapiens
gccaggcccuuuaaugauu

SEQ ID NO: 777950 - RNA, 19 nt, Homo sapiens
ccacaguaguugaggcuaa

SEQ ID NO: 777951 - RNA, 19 nt, Homo sapiens
ugagcaagcugaugaagau

SEQ ID NO: 777952 - RNA, 19 nt, Homo sapiens
guuauaugcuuucugaaga

SEQ ID NO: 777953 - RNA, 19 nt, Homo sapiens
ucagaugucagcaauauuu

SEQ ID NO: 777954 - RNA, 19 nt, Homo sapiens
gccaagagauggaauguac

SEQ ID NO: 777955 - RNA, 19 nt, Homo sapiens
cauggaagauuucaagugu

SEQ ID NO: 777956 - RNA, 19 nt, Homo sapiens
gaagaucugcucucucaau

SEQ ID NO: 777957 - RNA, 19 nt, Homo sapiens
gcuagaguguuucaguaaa

SEQ ID NO: 777958 - RNA, 19 nt, Homo sapiens
gagaagacuuauuaacagu

SEQ ID NO: 777959 - RNA, 19 nt, Homo sapiens
cagcaauauuuccaacaua

SEQ ID NO: 777960 - RNA, 19 nt, Homo sapiens
guaaccauaucuuguacaa

SEQ ID NO: 777961 - RNA, 19 nt, Homo sapiens
uugaacaccugaaauugua

SEQ ID NO: 777962 - RNA, 19 nt, Homo sapiens
gaugacccuucuugaguuu

SEQ ID NO: 777963 - RNA, 19 nt, Homo sapiens
gaaucucuuuauccacaua

SEQ ID NO: 777964 - RNA, 19 nt, Homo sapiens
ggaaagagagcagacgaaa

SEQ ID NO: 777965 - RNA, 19 nt, Homo sapiens
aaccauauauccaugcuaa

SEQ ID NO: 777966 - RNA, 19 nt, Homo sapiens
accagaagcuauuucauuu

SEQ ID NO: 777967 - RNA, 19 nt, Homo sapiens
caacgaagacuagcacuug

SEQ ID NO: 777968 - RNA, 19 nt, Homo sapiens
gcaggaagaagacuaugaa

SEQ ID NO: 777969 - RNA, 19 nt, Homo sapiens
gagagaacuuucagaagca

SEQ ID NO: 777970 - RNA, 19 nt, Homo sapiens
gaaagaaugacucuaaagg

SEQ ID NO: 777971 - RNA, 19 nt, Homo sapiens
gaucgcagccucucuagga

SEQ ID NO: 777972 - RNA, 19 nt, Homo sapiens
uaaagaagaacgaaguuug

SEQ ID NO: 777973 - RNA, 19 nt, Homo sapiens
caguaaagguuauaugcuu

SEQ ID NO: 777974 - RNA, 19 nt, Homo sapiens
caugauguuugccaaguuu

SEQ ID NO: 777975 - RNA, 19 nt, Homo sapiens
gaagaagaggcauugaaga

SEQ ID NO: 777976 - RNA, 19 nt, Homo sapiens
agaggagacucaugaagaa

SEQ ID NO: 777977 - RNA, 19 nt, Homo sapiens
uugcguaagugaaucaaua

SEQ ID NO: 777978 - RNA, 19 nt, Homo sapiens
acagagaccuuaauguauc

SEQ ID NO: 777979 - RNA, 19 nt, Homo sapiens
uaaaaugucugccuuacaa

SEQ ID NO: 777980 - RNA, 19 nt, Homo sapiens
aaacauacgugugacugaa

SEQ ID NO: 777981 - RNA, 19 nt, Homo sapiens
ugaaagaggcccagucaga

SEQ ID NO: 777982 - RNA, 19 nt, Homo sapiens
ccaaacacccaaucucuga

SEQ ID NO: 777983 - RNA, 19 nt, Homo sapiens
agaaagaggaguacacauu

SEQ ID NO: 777984 - RNA, 19 nt, Homo sapiens
ugacucauuucaucuauca

SEQ ID NO: 777985 - RNA, 19 nt, Homo sapiens
gaacgugguggcucuaaau

SEQ ID NO: 777986 - RNA, 19 nt, Homo sapiens
gaagccaggcccuuuaaug

SEQ ID NO: 777987 - RNA, 19 nt, Homo sapiens
aagaucugcucucucaaua

SEQ ID NO: 777988 - RNA, 19 nt, Homo sapiens
ccgaacauccaguuuauaa

SEQ ID NO: 777989 - RNA, 19 nt, Homo sapiens
gaugaguaccugaagaauu

SEQ ID NO: 777990 - RNA, 19 nt, Homo sapiens
gaagagaguuggagaagga

SEQ ID NO: 777991 - RNA, 19 nt, Homo sapiens
ggagacacuucuaacuuua

SEQ ID NO: 777992 - RNA, 19 nt, Homo sapiens
cgaagaagcugcccagaau

SEQ ID NO: 777993 - RNA, 19 nt, Homo sapiens
ggagaagaauuuccugcua

SEQ ID NO: 777994 - RNA, 19 nt, Homo sapiens
gugcagaagugaagaguuu

SEQ ID NO: 777995 - RNA, 19 nt, Homo sapiens
gaccacgguucuugacuua

SEQ ID NO: 777996 - RNA, 19 nt, Homo sapiens
gagaagaauuuccugcuau

SEQ ID NO: 777997 - RNA, 19 nt, Homo sapiens
gaccacaaaucccauaaug

SEQ ID NO: 777998 - RNA, 19 nt, Homo sapiens
gccaagagguagcaagaaa

SEQ ID NO: 777999 - RNA, 19 nt, Homo sapiens
caaaggauccucacagaau

SEQ ID NO: 778000 - RNA, 19 nt, Homo sapiens
gaacaaacugcaagaggaa

SEQ ID NO: 778001 - RNA, 19 nt, Homo sapiens
cagcaagggaaauuaauua

SEQ ID NO: 778002 - RNA, 19 nt, Homo sapiens
uggagacacuucuaacuuu

SEQ ID NO: 778003 - RNA, 19 nt, Homo sapiens
gaagagacgcaaucagguu

SEQ ID NO: 778004 - RNA, 19 nt, Homo sapiens
uagaggaggagaagaauuu

SEQ ID NO: 778005 - RNA, 19 nt, Homo sapiens
aagaagcugcccagaauua

SEQ ID NO: 778006 - RNA, 19 nt, Homo sapiens
ccacaaaucccauaauguc

SEQ ID NO: 778007 - RNA, 19 nt, Homo sapiens
aaaggauccucacagaauu

SEQ ID NO: 778008 - RNA, 19 nt, Homo sapiens
gaaggagacaguacaagug

SEQ ID NO: 778009 - RNA, 19 nt, Homo sapiens
gaacaugagaagcaaagga

SEQ ID NO: 778010 - RNA, 19 nt, Homo sapiens
ucaaaugcaucacucagau

SEQ ID NO: 778011 - RNA, 19 nt, Homo sapiens
ugagauuucuggucaagga

SEQ ID NO: 778012 - RNA, 19 nt, Homo sapiens
gcaaaggauccucacagaa

SEQ ID NO: 778013 - RNA, 19 nt, Homo sapiens
ugagguuccuucaagcuaa

SEQ ID NO: 778014 - RNA, 19 nt, Homo sapiens
gaagaagcugcccagaauu

SEQ ID NO: 778015 - RNA, 19 nt, Homo sapiens
gcacaauuucugccucaaa

SEQ ID NO: 778016 - RNA, 19 nt, Homo sapiens
uuaauaaacugcgacugaa

SEQ ID NO: 778017 - RNA, 19 nt, Homo sapiens
aaagucgucuugugcagaa

SEQ ID NO: 778018 - RNA, 19 nt, Homo sapiens
gaggauccgccaagaggua

SEQ ID NO: 778019 - RNA, 19 nt, Homo sapiens
gaagugaucugccccaucu

SEQ ID NO: 778020 - RNA, 19 nt, Homo sapiens
uggcacagcuuccuacagu

SEQ ID NO: 778021 - RNA, 19 nt, Homo sapiens
gguagaacaugagaagcaa

SEQ ID NO: 778022 - RNA, 19 nt, Homo sapiens
gagacacuucuaacuuuaa

SEQ ID NO: 778023 - RNA, 19 nt, Homo sapiens
cgaccacgguucuugacuu

SEQ ID NO: 778024 - RNA, 19 nt, Homo sapiens
ccacgguucuugacuuagu

SEQ ID NO: 778025 - RNA, 19 nt, Homo sapiens
uaugucuccuggccucuua

SEQ ID NO: 778026 - RNA, 19 nt, Homo sapiens
ugaacgaucucaagaagcu

SEQ ID NO: 778027 - RNA, 19 nt, Homo sapiens
gaagagcuggggcuuguua

SEQ ID NO: 778028 - RNA, 19 nt, Homo sapiens
ggauaucaaagucgucuug

SEQ ID NO: 778029 - RNA, 19 nt, Homo sapiens
ggagaaggagacaguacaa

SEQ ID NO: 778030 - RNA, 19 nt, Homo sapiens
uaucagcaagggaaauuaa

SEQ ID NO: 778031 - RNA, 19 nt, Homo sapiens
gaugagauuucuggucaag

SEQ ID NO: 778032 - RNA, 19 nt, Homo sapiens
aauuugaacuccugcauca

SEQ ID NO: 778033 - RNA, 19 nt, Homo sapiens
gauccucacagaauuugaa

SEQ ID NO: 778034 - RNA, 19 nt, Homo sapiens
ggacuucggagcauagagu

SEQ ID NO: 778035 - RNA, 19 nt, Homo sapiens
gagguagcaagaaacagua

SEQ ID NO: 778036 - RNA, 19 nt, Homo sapiens
cuugacuucuuaucacuuu

SEQ ID NO: 778037 - RNA, 19 nt, Homo sapiens
acacggacuucggagcaua

SEQ ID NO: 778038 - RNA, 19 nt, Homo sapiens
caagagguagcaagaaaca

SEQ ID NO: 778039 - RNA, 19 nt, Homo sapiens
caaaugcaucacucagauu

SEQ ID NO: 778040 - RNA, 19 nt, Homo sapiens
uaagccagcucagagaaca

SEQ ID NO: 778041 - RNA, 19 nt, Homo sapiens
caccaaaucaccacucuuc

SEQ ID NO: 778042 - RNA, 19 nt, Homo sapiens
gcuggaggauaucaaaguc

SEQ ID NO: 778043 - RNA, 19 nt, Homo sapiens
gcucguugauucccugaag

SEQ ID NO: 778044 - RNA, 19 nt, Homo sapiens
gcacagcuuccuacagucu

SEQ ID NO: 778045 - RNA, 19 nt, Homo sapiens
ggccucgucugcugggaaa

SEQ ID NO: 778046 - RNA, 19 nt, Homo sapiens
gaagaauuuccugcuauca

SEQ ID NO: 778047 - RNA, 19 nt, Homo sapiens
agaagaauuuccugcuauc

SEQ ID NO: 778048 - RNA, 19 nt, Homo sapiens
guaagaagagacgcaauca

SEQ ID NO: 778049 - RNA, 19 nt, Homo sapiens
cugcaaaacuuccguaaga

SEQ ID NO: 778050 - RNA, 19 nt, Homo sapiens
guucuugacuuaguggaau

SEQ ID NO: 778051 - RNA, 19 nt, Homo sapiens
gaagcugcccagaauuauc

SEQ ID NO: 778052 - RNA, 19 nt, Homo sapiens
gaaaauccaagcucuacaa

SEQ ID NO: 778053 - RNA, 19 nt, Homo sapiens
ucagcaagggaaauuaauu

SEQ ID NO: 778054 - RNA, 19 nt, Homo sapiens
gaagaguuucaguuucuca

SEQ ID NO: 778055 - RNA, 19 nt, Homo sapiens
ucgaaggaguggagaaugg

SEQ ID NO: 778056 - RNA, 19 nt, Homo sapiens
agcaaaggauccucacaga

SEQ ID NO: 778057 - RNA, 19 nt, Homo sapiens
ggagacaguacaagugaag

SEQ ID NO: 778058 - RNA, 19 nt, Homo sapiens
ggaaucugguggagaaaau

SEQ ID NO: 778059 - RNA, 19 nt, Homo sapiens
cauaucagcaagggaaauu

SEQ ID NO: 778060 - RNA, 19 nt, Homo sapiens
gcuaagccagcucagagaa

SEQ ID NO: 778061 - RNA, 19 nt, Homo sapiens
cggaccagguagaacauga

SEQ ID NO: 778062 - RNA, 19 nt, Homo sapiens
ugcggaaucugguggagaa

SEQ ID NO: 778063 - RNA, 19 nt, Homo sapiens
ccagugggcaguuugugaa

SEQ ID NO: 778064 - RNA, 19 nt, Homo sapiens
ucacggaccagguagaaca

SEQ ID NO: 778065 - RNA, 19 nt, Homo sapiens
ggaccacaaaucccauaau

SEQ ID NO: 778066 - RNA, 19 nt, Homo sapiens
ccacucucgcucuuccuua

SEQ ID NO: 778067 - RNA, 19 nt, Homo sapiens
gagaguuggagaaggaaug

SEQ ID NO: 778068 - RNA, 19 nt, Homo sapiens
ggccucuuaugaugagauu

SEQ ID NO: 778069 - RNA, 19 nt, Homo sapiens
gagacgcaaucagguucaa

SEQ ID NO: 778070 - RNA, 19 nt, Homo sapiens
aaaugcaucacucagauug

SEQ ID NO: 778071 - RNA, 19 nt, Homo sapiens
ccagguagaacaugagaag

SEQ ID NO: 778072 - RNA, 19 nt, Homo sapiens
acacagggucgaugucuuc

SEQ ID NO: 778073 - RNA, 19 nt, Homo sapiens
gcccuguuguucugucaug

SEQ ID NO: 778074 - RNA, 19 nt, Homo sapiens
gcaggcggcagaacuacau

SEQ ID NO: 778075 - RNA, 19 nt, Homo sapiens
gaagaccaagcagaacaug

SEQ ID NO: 778076 - RNA, 19 nt, Homo sapiens
uugauucccugaagaccaa

SEQ ID NO: 778077 - RNA, 19 nt, Homo sapiens
ucgaagaagcugcccagaa

SEQ ID NO: 778078 - RNA, 19 nt, Homo sapiens
cgaggaugaugggaaguuc

SEQ ID NO: 778079 - RNA, 19 nt, Homo sapiens
aaaggaaagaggcuacaug

SEQ ID NO: 778080 - RNA, 19 nt, Homo sapiens
gagguuccuucaagcuaag

SEQ ID NO: 778081 - RNA, 19 nt, Homo sapiens
caggauacgaagacauuug

SEQ ID NO: 778082 - RNA, 19 nt, Homo sapiens
aaaacucagugaagcaaaa

SEQ ID NO: 778083 - RNA, 19 nt, Homo sapiens
aaggagacaguacaaguga

SEQ ID NO: 778084 - RNA, 19 nt, Homo sapiens
aagaaacaguauccacagu

SEQ ID NO: 778085 - RNA, 19 nt, Homo sapiens
gauggagacacuucuaacu

SEQ ID NO: 778086 - RNA, 19 nt, Homo sapiens
ggugaagagaguuggagaa

SEQ ID NO: 778087 - RNA, 19 nt, Homo sapiens
gugagguuccuucaagcua

SEQ ID NO: 778088 - RNA, 19 nt, Homo sapiens
uuccugcuaucacggauuu

SEQ ID NO: 778089 - RNA, 19 nt, Homo sapiens
gaagcaaaggauccucaca

SEQ ID NO: 778090 - RNA, 19 nt, Homo sapiens
gaagagaguuggagaagga

SEQ ID NO: 778091 - RNA, 19 nt, Homo sapiens
ggagacacuucuaacuuua

SEQ ID NO: 778092 - RNA, 19 nt, Homo sapiens
cgaagaagcugcccagaau

SEQ ID NO: 778093 - RNA, 19 nt, Homo sapiens
ggagaagaauuuccugcua

SEQ ID NO: 778094 - RNA, 19 nt, Homo sapiens
gaccacgguucuugacuua

SEQ ID NO: 778095 - RNA, 19 nt, Homo sapiens
gagaagaauuuccugcuau

SEQ ID NO: 778096 - RNA, 19 nt, Homo sapiens
gaccacaaaucccauaaug

SEQ ID NO: 778097 - RNA, 19 nt, Homo sapiens
gccaagagguagcaagaaa

SEQ ID NO: 778098 - RNA, 19 nt, Homo sapiens
caaaggauccucacagaau

SEQ ID NO: 778099 - RNA, 19 nt, Homo sapiens
gaacaaacugcaagaggaa

SEQ ID NO: 778100 - RNA, 19 nt, Homo sapiens
cagcaagggaaauuaauua

SEQ ID NO: 778101 - RNA, 19 nt, Homo sapiens
uggagacacuucuaacuuu

SEQ ID NO: 778102 - RNA, 19 nt, Homo sapiens
gaagagacgcaaucagguu

SEQ ID NO: 778103 - RNA, 19 nt, Homo sapiens
uagaggaggagaagaauuu

SEQ ID NO: 778104 - RNA, 19 nt, Homo sapiens
aagaagcugcccagaauua

SEQ ID NO: 778105 - RNA, 19 nt, Homo sapiens
ccacaaaucccauaauguc

SEQ ID NO: 778106 - RNA, 19 nt, Homo sapiens
aaaggauccucacagaauu

SEQ ID NO: 778107 - RNA, 19 nt, Homo sapiens
gaaggagacaguacaagug

SEQ ID NO: 778108 - RNA, 19 nt, Homo sapiens
gaacaugagaagcaaagga

SEQ ID NO: 778109 - RNA, 19 nt, Homo sapiens
ucaaaugcaucacucagau

SEQ ID NO: 778110 - RNA, 19 nt, Homo sapiens
ugagauuucuggucaagga

SEQ ID NO: 778111 - RNA, 19 nt, Homo sapiens
gcaaaggauccucacagaa

SEQ ID NO: 778112 - RNA, 19 nt, Homo sapiens
ugagguuccuucaagcuaa

SEQ ID NO: 778113 - RNA, 19 nt, Homo sapiens
gaagaagcugcccagaauu

SEQ ID NO: 778114 - RNA, 19 nt, Homo sapiens
gcacaauuucugccucaaa

SEQ ID NO: 778115 - RNA, 19 nt, Homo sapiens
uuaauaaacugcgacugaa

SEQ ID NO: 778116 - RNA, 19 nt, Homo sapiens
gaggauccgccaagaggua

SEQ ID NO: 778117 - RNA, 19 nt, Homo sapiens
gaagugaucugccccaucu

SEQ ID NO: 778118 - RNA, 19 nt, Homo sapiens
uggcacagcuuccuacagu

SEQ ID NO: 778119 - RNA, 19 nt, Homo sapiens
gguagaacaugagaagcaa

SEQ ID NO: 778120 - RNA, 19 nt, Homo sapiens
gagacacuucuaacuuuaa

SEQ ID NO: 778121 - RNA, 19 nt, Homo sapiens
cgaccacgguucuugacuu

SEQ ID NO: 778122 - RNA, 19 nt, Homo sapiens
ccacgguucuugacuuagu

SEQ ID NO: 778123 - RNA, 19 nt, Homo sapiens
uaugucuccuggccucuua

SEQ ID NO: 778124 - RNA, 19 nt, Homo sapiens
ugaacgaucucaagaagcu

SEQ ID NO: 778125 - RNA, 19 nt, Homo sapiens
gaagagcuggggcuuguua

SEQ ID NO: 778126 - RNA, 19 nt, Homo sapiens
ggagaaggagacaguacaa

SEQ ID NO: 778127 - RNA, 19 nt, Homo sapiens
uaucagcaagggaaauuaa

SEQ ID NO: 778128 - RNA, 19 nt, Homo sapiens
gaugagauuucuggucaag

SEQ ID NO: 778129 - RNA, 19 nt, Homo sapiens
aauuugaacuccugcauca

SEQ ID NO: 778130 - RNA, 19 nt, Homo sapiens
gauccucacagaauuugaa

SEQ ID NO: 778131 - RNA, 19 nt, Homo sapiens
gagguagcaagaaacagua

SEQ ID NO: 778132 - RNA, 19 nt, Homo sapiens
ggacuucggagcauagagu

SEQ ID NO: 778133 - RNA, 19 nt, Homo sapiens
cuugacuucuuaucacuuu

SEQ ID NO: 778134 - RNA, 19 nt, Homo sapiens
acacggacuucggagcaua

SEQ ID NO: 778135 - RNA, 19 nt, Homo sapiens
caagagguagcaagaaaca

SEQ ID NO: 778136 - RNA, 19 nt, Homo sapiens
caaaugcaucacucagauu

SEQ ID NO: 778137 - RNA, 19 nt, Homo sapiens
uaagccagcucagagaaca

SEQ ID NO: 778138 - RNA, 19 nt, Homo sapiens
caccaaaucaccacucuuc

SEQ ID NO: 778139 - RNA, 19 nt, Homo sapiens
gcucguugauucccugaag

SEQ ID NO: 778140 - RNA, 19 nt, Homo sapiens
ggccucgucugcugggaaa

SEQ ID NO: 778141 - RNA, 19 nt, Homo sapiens
gaagaauuuccugcuauca

SEQ ID NO: 778142 - RNA, 19 nt, Homo sapiens
agaagaauuuccugcuauc

SEQ ID NO: 778143 - RNA, 19 nt, Homo sapiens
gcacagcuuccuacagucu

SEQ ID NO: 778144 - RNA, 19 nt, Homo sapiens
guaagaagagacgcaauca

SEQ ID NO: 778145 - RNA, 19 nt, Homo sapiens
cugcaaaacuuccguaaga

SEQ ID NO: 778146 - RNA, 19 nt, Homo sapiens
guucuugacuuaguggaau

SEQ ID NO: 778147 - RNA, 19 nt, Homo sapiens
gaagcugcccagaauuauc

SEQ ID NO: 778148 - RNA, 19 nt, Homo sapiens
gaaaauccaagcucuacaa

SEQ ID NO: 778149 - RNA, 19 nt, Homo sapiens
ucagcaagggaaauuaauu

SEQ ID NO: 778150 - RNA, 19 nt, Homo sapiens
ucgaaggaguggagaaugg

SEQ ID NO: 778151 - RNA, 19 nt, Homo sapiens
agcaaaggauccucacaga

SEQ ID NO: 778152 - RNA, 19 nt, Homo sapiens
ggagacaguacaagugaag

SEQ ID NO: 778153 - RNA, 19 nt, Homo sapiens
ggaaucugguggagaaaau

SEQ ID NO: 778154 - RNA, 19 nt, Homo sapiens
cauaucagcaagggaaauu

SEQ ID NO: 778155 - RNA, 19 nt, Homo sapiens
gcuaagccagcucagagaa

SEQ ID NO: 778156 - RNA, 19 nt, Homo sapiens
cggaccagguagaacauga

SEQ ID NO: 778157 - RNA, 19 nt, Homo sapiens
ugcggaaucugguggagaa

SEQ ID NO: 778158 - RNA, 19 nt, Homo sapiens
ccagugggcaguuugugaa

SEQ ID NO: 778159 - RNA, 19 nt, Homo sapiens
ucacggaccagguagaaca

SEQ ID NO: 778160 - RNA, 19 nt, Homo sapiens
ggaccacaaaucccauaau

SEQ ID NO: 778161 - RNA, 19 nt, Homo sapiens
ccacucucgcucuuccuua

SEQ ID NO: 778162 - RNA, 19 nt, Homo sapiens
gagaguuggagaaggaaug

SEQ ID NO: 778163 - RNA, 19 nt, Homo sapiens
ggccucuuaugaugagauu

SEQ ID NO: 778164 - RNA, 19 nt, Homo sapiens
gagacgcaaucagguucaa

SEQ ID NO: 778165 - RNA, 19 nt, Homo sapiens
ccagguagaacaugagaag

SEQ ID NO: 778166 - RNA, 19 nt, Homo sapiens
aaaugcaucacucagauug

SEQ ID NO: 778167 - RNA, 19 nt, Homo sapiens
acacagggucgaugucuuc

SEQ ID NO: 778168 - RNA, 19 nt, Homo sapiens
gcaggcggcagaacuacau

SEQ ID NO: 778169 - RNA, 19 nt, Homo sapiens
gaagaccaagcagaacaug

SEQ ID NO: 778170 - RNA, 19 nt, Homo sapiens
uugauucccugaagaccaa

SEQ ID NO: 778171 - RNA, 19 nt, Homo sapiens
gcccuguuguucugucaug

SEQ ID NO: 778172 - RNA, 19 nt, Homo sapiens
ucgaagaagcugcccagaa

SEQ ID NO: 778173 - RNA, 19 nt, Homo sapiens
cgaggaugaugggaaguuc

SEQ ID NO: 778174 - RNA, 19 nt, Homo sapiens
aaaggaaagaggcuacaug

SEQ ID NO: 778175 - RNA, 19 nt, Homo sapiens
gagguuccuucaagcuaag

SEQ ID NO: 778176 - RNA, 19 nt, Homo sapiens
caggauacgaagacauuug

SEQ ID NO: 778177 - RNA, 19 nt, Homo sapiens
aaaacucagugaagcaaaa

SEQ ID NO: 778178 - RNA, 19 nt, Homo sapiens
aaggagacaguacaaguga

SEQ ID NO: 778179 - RNA, 19 nt, Homo sapiens
aagaaacaguauccacagu

SEQ ID NO: 778180 - RNA, 19 nt, Homo sapiens
gauggagacacuucuaacu

SEQ ID NO: 778181 - RNA, 19 nt, Homo sapiens
ggugaagagaguuggagaa

SEQ ID NO: 778182 - RNA, 19 nt, Homo sapiens
gugagguuccuucaagcua

SEQ ID NO: 778183 - RNA, 19 nt, Homo sapiens
uuccugcuaucacggauuu

SEQ ID NO: 778184 - RNA, 19 nt, Homo sapiens
gaagcaaaggauccucaca

SEQ ID NO: 778185 - RNA, 19 nt, Homo sapiens
agaaggagacaguacaagu

SEQ ID NO: 778186 - RNA, 19 nt, Homo sapiens
ccucuuaugaugagauuuc

SEQ ID NO: 778187 - RNA, 19 nt, Homo sapiens
cuccuggccucuuaugaug

SEQ ID NO: 778188 - RNA, 19 nt, Homo sapiens
gccagugggcaguuuguga

SEQ ID NO: 778189 - RNA, 19 nt, Homo sapiens
uuugugagguuccuucaag

SEQ ID NO: 778190 - RNA, 19 nt, Homo sapiens
uauaauggaucaugcgaua

SEQ ID NO: 778191 - RNA, 19 nt, Homo sapiens
gcaauggccuacaaggaaa

SEQ ID NO: 778192 - RNA, 19 nt, Homo sapiens
gaacaaggaacuccagguu

SEQ ID NO: 778193 - RNA, 19 nt, Homo sapiens
acaaggaacuccagguuga

SEQ ID NO: 778194 - RNA, 19 nt, Homo sapiens
aaacagcaauggccuacaa

SEQ ID NO: 778195 - RNA, 19 nt, Homo sapiens
caacaucuauacuuacgau

SEQ ID NO: 778196 - RNA, 19 nt, Homo sapiens
ugaaacaauuggcagagaa

SEQ ID NO: 778197 - RNA, 19 nt, Homo sapiens
gaacuuuagcuucuccaaa

SEQ ID NO: 778198 - RNA, 19 nt, Homo sapiens
gaagugaagcaaaucaaca

SEQ ID NO: 778199 - RNA, 19 nt, Homo sapiens
ugaaggagcuguccaugcu

SEQ ID NO: 778200 - RNA, 19 nt, Homo sapiens
aacaacaacuucagcaaga

SEQ ID NO: 778201 - RNA, 19 nt, Homo sapiens
ucacugaucugcucuugcu

SEQ ID NO: 778202 - RNA, 19 nt, Homo sapiens
gaaccucgcaacaucaaca

SEQ ID NO: 778203 - RNA, 19 nt, Homo sapiens
gaaaagcugauccugaaaa

SEQ ID NO: 778204 - RNA, 19 nt, Homo sapiens
cccaggugcugaaacaauu

SEQ ID NO: 778205 - RNA, 19 nt, Homo sapiens
gauauggaagugaagcaaa

SEQ ID NO: 778206 - RNA, 19 nt, Homo sapiens
gccaccaucuccuaucuca

SEQ ID NO: 778207 - RNA, 19 nt, Homo sapiens
gaggagaacaacaacuuca

SEQ ID NO: 778208 - RNA, 19 nt, Homo sapiens
caacaacuucagcaagaug

SEQ ID NO: 778209 - RNA, 19 nt, Homo sapiens
caccaucuccuaucucaga

SEQ ID NO: 778210 - RNA, 19 nt, Homo sapiens
gaaacaauuggcagagaag

SEQ ID NO: 778211 - RNA, 19 nt, Homo sapiens
gaggagauccagaagaaac

SEQ ID NO: 778212 - RNA, 19 nt, Homo sapiens
ugaagcaaaucaacaaacg

SEQ ID NO: 778213 - RNA, 19 nt, Homo sapiens
agaaggcuuuggaggagaa

SEQ ID NO: 778214 - RNA, 19 nt, Homo sapiens
acgaugauauggaagugaa

SEQ ID NO: 778215 - RNA, 19 nt, Homo sapiens
ggaggagaacaacaacuuc

SEQ ID NO: 778216 - RNA, 19 nt, Homo sapiens
gaucugcucuugcuuuuac

SEQ ID NO: 778217 - RNA, 19 nt, Homo sapiens
ggucugcacaucccuacaa

SEQ ID NO: 778218 - RNA, 19 nt, Homo sapiens
caacaucaacaucuauacu

SEQ ID NO: 778219 - RNA, 19 nt, Homo sapiens
uaauggaucaugcgauauc

SEQ ID NO: 778220 - RNA, 19 nt, Homo sapiens
ggaacacgagcgagaaguc

SEQ ID NO: 778221 - RNA, 19 nt, Homo sapiens
cagcaauggccuacaagga

SEQ ID NO: 778222 - RNA, 19 nt, Homo sapiens
ggaagugaagcaaaucaac

SEQ ID NO: 778223 - RNA, 19 nt, Homo sapiens
uacuuacgaugauauggaa

SEQ ID NO: 778224 - RNA, 19 nt, Homo sapiens
auauggaagugaagcaaau

SEQ ID NO: 778225 - RNA, 19 nt, Homo sapiens
ggaggagauccagaagaaa

SEQ ID NO: 778226 - RNA, 19 nt, Homo sapiens
gaagccaccaucuccuauc

SEQ ID NO: 778227 - RNA, 19 nt, Homo sapiens
gggaaagaagaaagucuca

SEQ ID NO: 778228 - RNA, 19 nt, Homo sapiens
gcacgccccaccaauagua

SEQ ID NO: 778229 - RNA, 19 nt, Homo sapiens
gaacuccagguugaacugu

SEQ ID NO: 778230 - RNA, 19 nt, Homo sapiens
gagggaacacgagcgagaa

SEQ ID NO: 778231 - RNA, 19 nt, Homo sapiens
cugaaacaauuggcagaga

SEQ ID NO: 778232 - RNA, 19 nt, Homo sapiens
gcccaggugcugaaacaau

SEQ ID NO: 778233 - RNA, 19 nt, Homo sapiens
agcaauggccuacaaggaa

SEQ ID NO: 778234 - RNA, 19 nt, Homo sapiens
cgcaacaucaacaucuaua

SEQ ID NO: 778235 - RNA, 19 nt, Homo sapiens
cccggaaccucgcaacauc

SEQ ID NO: 778236 - RNA, 19 nt, Homo sapiens
ggaacuccagguugaacug

SEQ ID NO: 778237 - RNA, 19 nt, Homo sapiens
caaggaacuccagguugaa

SEQ ID NO: 778238 - RNA, 19 nt, Homo sapiens
ggaaaaccgugaggcuaau

SEQ ID NO: 778239 - RNA, 19 nt, Homo sapiens
uggaggagaacaacaacuu

SEQ ID NO: 778240 - RNA, 19 nt, Homo sapiens
gcaagauggcggaggaaaa

SEQ ID NO: 778241 - RNA, 19 nt, Homo sapiens
gcaacaucaacaucuauac

SEQ ID NO: 778242 - RNA, 19 nt, Homo sapiens
guugaacugucuggcugaa

SEQ ID NO: 778243 - RNA, 19 nt, Homo sapiens
acaacaacuucagcaagau

SEQ ID NO: 778244 - RNA, 19 nt, Homo sapiens
ccacgaacuuuagcuucuc

SEQ ID NO: 778245 - RNA, 19 nt, Homo sapiens
gaucuugaagccaccaucu

SEQ ID NO: 778246 - RNA, 19 nt, Homo sapiens
gaagcaaaucaacaaacgu

SEQ ID NO: 778247 - RNA, 19 nt, Homo sapiens
uauugaacgucugcaggaa

SEQ ID NO: 778248 - RNA, 19 nt, Homo sapiens
cugcacaucccuacaaugg

SEQ ID NO: 778249 - RNA, 19 nt, Homo sapiens
gauggggaauugaugacaa

SEQ ID NO: 778250 - RNA, 19 nt, Homo sapiens
gaacugucuggcugaagca

SEQ ID NO: 778251 - RNA, 19 nt, Homo sapiens
cccacgaacuuuagcuucu

SEQ ID NO: 778252 - RNA, 19 nt, Homo sapiens
ccagagugcuuauuuauuu

SEQ ID NO: 778253 - RNA, 19 nt, Homo sapiens
ccaaagcccuuguguugaa

SEQ ID NO: 778254 - RNA, 19 nt, Homo sapiens
gaacuaacgugcggaaaca

SEQ ID NO: 778255 - RNA, 19 nt, Homo sapiens
gaaguucagugccuggaaa

SEQ ID NO: 778256 - RNA, 19 nt, Homo sapiens
gaaauaaagagcaaggaaa

SEQ ID NO: 778257 - RNA, 19 nt, Homo sapiens
caaagugucucgcggauca

SEQ ID NO: 778258 - RNA, 19 nt, Homo sapiens
ggucgaagcugugcaagga

SEQ ID NO: 778259 - RNA, 19 nt, Homo sapiens
uggaggagcucgccaagaa

SEQ ID NO: 778260 - RNA, 19 nt, Homo sapiens
ggaaucacccgaucacaga

SEQ ID NO: 778261 - RNA, 19 nt, Homo sapiens
ggaaucacccgaucacaga

SEQ ID NO: 778262 - RNA, 19 nt, Homo sapiens
ggaaucacccgaucacaga

SEQ ID NO: 778263 - RNA, 19 nt, Homo sapiens
ggaaucacccgaucacaga

SEQ ID NO: 778264 - RNA, 19 nt, Homo sapiens
gcagguguguguucucuuc

SEQ ID NO: 778265 - RNA, 19 nt, Homo sapiens
ggaaauaaagagcaaggaa

SEQ ID NO: 778266 - RNA, 19 nt, Homo sapiens
ccaagaagcgauucaaaga

SEQ ID NO: 778267 - RNA, 19 nt, Homo sapiens
ggacucacccgaucacaga

SEQ ID NO: 778268 - RNA, 19 nt, Homo sapiens
ggacucacccgaucacaga

SEQ ID NO: 778269 - RNA, 19 nt, Homo sapiens
ggacucacccgaucacaga

SEQ ID NO: 778270 - RNA, 19 nt, Homo sapiens
gagcgggucugggaagauu

SEQ ID NO: 778271 - RNA, 19 nt, Homo sapiens
gaguugggcuggcaucaug

SEQ ID NO: 778272 - RNA, 19 nt, Homo sapiens
cuaauauccuguccaaguu

SEQ ID NO: 778273 - RNA, 19 nt, Homo sapiens
gggcgcagaugguggaguu

SEQ ID NO: 778274 - RNA, 19 nt, Homo sapiens
gauaacagcccaucacaac

SEQ ID NO: 778275 - RNA, 19 nt, Homo sapiens
gaaaacaacucugaaugug

SEQ ID NO: 778276 - RNA, 19 nt, Homo sapiens
ggagagcgcugagaagacu

SEQ ID NO: 778277 - RNA, 19 nt, Homo sapiens
ccaccggaaucacccgaua

SEQ ID NO: 778278 - RNA, 19 nt, Homo sapiens
caagcaacauggcugacaa

SEQ ID NO: 778279 - RNA, 19 nt, Homo sapiens
gacgagcggucaccagaau

SEQ ID NO: 778280 - RNA, 19 nt, Homo sapiens
gacaagcagucaucggaau

SEQ ID NO: 778281 - RNA, 19 nt, Homo sapiens
ggacugugaggguagagua

SEQ ID NO: 778282 - RNA, 19 nt, Homo sapiens
ccaaccagcaggcaacuaa

SEQ ID NO: 778283 - RNA, 19 nt, Homo sapiens
guucagugccuggaaauaa

SEQ ID NO: 778284 - RNA, 19 nt, Homo sapiens
ccaagcaccuucuucaacu

SEQ ID NO: 778285 - RNA, 19 nt, Homo sapiens
aagaagcgauucaaagaca

SEQ ID NO: 778286 - RNA, 19 nt, Homo sapiens
uaacagacccgugcaucuu

SEQ ID NO: 778287 - RNA, 19 nt, Homo sapiens
ccacucggcucccaucucu

SEQ ID NO: 778288 - RNA, 19 nt, Homo sapiens
gagcacccuucuccacuca

SEQ ID NO: 778289 - RNA, 19 nt, Homo sapiens
ucacggacaccaccaaguu

SEQ ID NO: 778290 - RNA, 19 nt, Homo sapiens
caacuugucuguggaaucc

SEQ ID NO: 778291 - RNA, 19 nt, Homo sapiens
gguuggugcccacgaguua

SEQ ID NO: 778292 - RNA, 19 nt, Homo sapiens
ccacgcagaacgaacauga

SEQ ID NO: 778293 - RNA, 19 nt, Homo sapiens
ccucagccauuuccaaagu

SEQ ID NO: 778294 - RNA, 19 nt, Homo sapiens
acgccagagugcuuauuua

SEQ ID NO: 778295 - RNA, 19 nt, Homo sapiens
caaagcccuuguguugaaa

SEQ ID NO: 778296 - RNA, 19 nt, Homo sapiens
gaucacagacgagcaguca

SEQ ID NO: 778297 - RNA, 19 nt, Homo sapiens
gaucacagacgagcaguca

SEQ ID NO: 778298 - RNA, 19 nt, Homo sapiens
gaucacagacgagcaguca

SEQ ID NO: 778299 - RNA, 19 nt, Homo sapiens
gaucacagacgagcaguca

SEQ ID NO: 778300 - RNA, 19 nt, Homo sapiens
ggaaucgcccaaucacaga

SEQ ID NO: 778301 - RNA, 19 nt, Homo sapiens
gcucgcagaccucccauug

SEQ ID NO: 778302 - RNA, 19 nt, Homo sapiens
ggacgagucaggcuaugug

SEQ ID NO: 778303 - RNA, 19 nt, Homo sapiens
cuccaaagcccuuguguug

SEQ ID NO: 778304 - RNA, 19 nt, Homo sapiens
ucgcuuugcuuuccugaga

SEQ ID NO: 778305 - RNA, 19 nt, Homo sapiens
caaccuagguaaaacgaaa

SEQ ID NO: 778306 - RNA, 19 nt, Homo sapiens
ggacgugggaggugucugu

SEQ ID NO: 778307 - RNA, 19 nt, Homo sapiens
gggccaggcucacaguaca

SEQ ID NO: 778308 - RNA, 19 nt, Homo sapiens
gaggagacagggacagguu

SEQ ID NO: 778309 - RNA, 19 nt, Homo sapiens
gacgagcagucaucggaau

SEQ ID NO: 778310 - RNA, 19 nt, Homo sapiens
gacgagcagucaucggaau

SEQ ID NO: 778311 - RNA, 19 nt, Homo sapiens
gccaagggcaaccuaggua

SEQ ID NO: 778312 - RNA, 19 nt, Homo sapiens
ccucgcacuucauuacauu

SEQ ID NO: 778313 - RNA, 19 nt, Homo sapiens
ucuaauauccuguccaagu

SEQ ID NO: 778314 - RNA, 19 nt, Homo sapiens
cuucuaauauccuguccaa

SEQ ID NO: 778315 - RNA, 19 nt, Homo sapiens
caagcacggccucgagaaa

SEQ ID NO: 778316 - RNA, 19 nt, Homo sapiens
gacacgaagugccgagaca

SEQ ID NO: 778317 - RNA, 19 nt, Homo sapiens
caagggcaaccuagguaaa

SEQ ID NO: 778318 - RNA, 19 nt, Homo sapiens
gauaagcaaccagguagug

SEQ ID NO: 778319 - RNA, 19 nt, Homo sapiens
gccggaccaucaccuuuga

SEQ ID NO: 778320 - RNA, 19 nt, Homo sapiens
gccagagugcuuauuuauu

SEQ ID NO: 778321 - RNA, 19 nt, Homo sapiens
ggagucuaccugcggauga

SEQ ID NO: 778322 - RNA, 19 nt, Homo sapiens
uaggauaagcaaccaggua

SEQ ID NO: 778323 - RNA, 19 nt, Homo sapiens
agggacagguucuaucaug

SEQ ID NO: 778324 - RNA, 19 nt, Homo sapiens
uguguucucuucugcaugu

SEQ ID NO: 778325 - RNA, 19 nt, Homo sapiens
uaacagcccaucacaacuc

SEQ ID NO: 778326 - RNA, 19 nt, Homo sapiens
ggccaagccugccaaagcu

SEQ ID NO: 778327 - RNA, 19 nt, Homo sapiens
gccacccgcugucacaaug

SEQ ID NO: 778328 - RNA, 19 nt, Homo sapiens
uaauauccuguccaaguuu

SEQ ID NO: 778329 - RNA, 19 nt, Homo sapiens
gcgcugagaagacuguuca

SEQ ID NO: 778330 - RNA, 19 nt, Homo sapiens
ggaggacagugcugaucgu

SEQ ID NO: 778331 - RNA, 19 nt, Homo sapiens
uuuaugcacugccaauuag

SEQ ID NO: 778332 - RNA, 19 nt, Homo sapiens
uucagugccuggaaauaaa

SEQ ID NO: 778333 - RNA, 19 nt, Homo sapiens
ccaagggcaaccuagguaa

SEQ ID NO: 778334 - RNA, 19 nt, Homo sapiens
acaauuagcguuaccaaaa

SEQ ID NO: 778335 - RNA, 19 nt, Homo sapiens
caggagagagggacagguu

SEQ ID NO: 778336 - RNA, 19 nt, Homo sapiens
caggagagagggacagguu

SEQ ID NO: 778337 - RNA, 19 nt, Homo sapiens
caggagagagggacagguu

SEQ ID NO: 778338 - RNA, 19 nt, Homo sapiens
caggagagagggacagguu

SEQ ID NO: 778339 - RNA, 19 nt, Homo sapiens
caggcugcguuucuccuuu

SEQ ID NO: 778340 - RNA, 19 nt, Homo sapiens
ggucacaggcugcguuucu

SEQ ID NO: 778341 - RNA, 19 nt, Homo sapiens
gacgagcggucaccagacu

SEQ ID NO: 778342 - RNA, 19 nt, Homo sapiens
ucacagacaagcagucauc

SEQ ID NO: 778343 - RNA, 19 nt, Homo sapiens
ggaaacauuugaaaacaac

SEQ ID NO: 778344 - RNA, 19 nt, Homo sapiens
cuaacgugcggaaacauuu

SEQ ID NO: 778345 - RNA, 19 nt, Homo sapiens
gccaagaagcgauucaaag

SEQ ID NO: 778346 - RNA, 19 nt, Homo sapiens
ucacugacguggacaucgu

SEQ ID NO: 778347 - RNA, 19 nt, Homo sapiens
gaucgugucucagcaucag

SEQ ID NO: 778348 - RNA, 19 nt, Homo sapiens
ggacacaggaauagguucu

SEQ ID NO: 778349 - RNA, 19 nt, Homo sapiens
gcgugggcaucaccuccua

SEQ ID NO: 778350 - RNA, 19 nt, Homo sapiens
acaccaggacacaggaaua

SEQ ID NO: 778351 - RNA, 19 nt, Homo sapiens
ccaccggaaucgcccaauc

SEQ ID NO: 778352 - RNA, 19 nt, Homo sapiens
gcaaauacgggacuucuua

SEQ ID NO: 778353 - RNA, 19 nt, Homo sapiens
ccagaucccucauuugaua

SEQ ID NO: 778354 - RNA, 19 nt, Homo sapiens
ggaaagagcaagaauuaga

SEQ ID NO: 778355 - RNA, 19 nt, Homo sapiens
caacugaagugaugcaaau

SEQ ID NO: 778356 - RNA, 19 nt, Homo sapiens
ggucgugaauucuugguua

SEQ ID NO: 778357 - RNA, 19 nt, Homo sapiens
gcuuguaggugguugguua

SEQ ID NO: 778358 - RNA, 19 nt, Homo sapiens
gagauaaagcuuugaaguu

SEQ ID NO: 778359 - RNA, 19 nt, Homo sapiens
gaacuaaagaggaauuugu

SEQ ID NO: 778360 - RNA, 19 nt, Homo sapiens
gcaauucauucucucucua

SEQ ID NO: 778361 - RNA, 19 nt, Homo sapiens
gcagaggugugccuucaug

SEQ ID NO: 778362 - RNA, 19 nt, Homo sapiens
ggaauugucacgaauguug

SEQ ID NO: 778363 - RNA, 19 nt, Homo sapiens
gaugaaagucaguuuguuu

SEQ ID NO: 778364 - RNA, 19 nt, Homo sapiens
aaggaaagagcaagaauua

SEQ ID NO: 778365 - RNA, 19 nt, Homo sapiens
gcugacaacugaagugaug

SEQ ID NO: 778366 - RNA, 19 nt, Homo sapiens
caaaggagaggccaugaaa

SEQ ID NO: 778367 - RNA, 19 nt, Homo sapiens
gacuagagauggacaugaa

SEQ ID NO: 778368 - RNA, 19 nt, Homo sapiens
cagcaucacuggucaaaca

SEQ ID NO: 778369 - RNA, 19 nt, Homo sapiens
gcagaguauuguacagaaa

SEQ ID NO: 778370 - RNA, 19 nt, Homo sapiens
gaaccuguccuucuggaaa

SEQ ID NO: 778371 - RNA, 19 nt, Homo sapiens
gggaggagauaaagcuuug

SEQ ID NO: 778372 - RNA, 19 nt, Homo sapiens
ggagagcuuccagaaauua

SEQ ID NO: 778373 - RNA, 19 nt, Homo sapiens
agauggacaugaauugaua

SEQ ID NO: 778374 - RNA, 19 nt, Homo sapiens
gaagugagagugcuuguag

SEQ ID NO: 778375 - RNA, 19 nt, Homo sapiens
ucacgaauguugcugcuau

SEQ ID NO: 778376 - RNA, 19 nt, Homo sapiens
ggaauuuguuaaagucaga

SEQ ID NO: 778377 - RNA, 19 nt, Homo sapiens
cgagaauacugcgcaaauu

SEQ ID NO: 778378 - RNA, 19 nt, Homo sapiens
uaagagagaagaaggagaa

SEQ ID NO: 778379 - RNA, 19 nt, Homo sapiens
gaaaagcaauucauucucu

SEQ ID NO: 778380 - RNA, 19 nt, Homo sapiens
ggaugaaagucaguuuguu

SEQ ID NO: 778381 - RNA, 19 nt, Homo sapiens
cgacagcaguugaaugaag

SEQ ID NO: 778382 - RNA, 19 nt, Homo sapiens
gaaaggaaagagcaagaau

SEQ ID NO: 778383 - RNA, 19 nt, Homo sapiens
uggaacggcugacaacuga

SEQ ID NO: 778384 - RNA, 19 nt, Homo sapiens
caugggaacuaaagaggaa

SEQ ID NO: 778385 - RNA, 19 nt, Homo sapiens
cauucucucucuaguaauu

SEQ ID NO: 778386 - RNA, 19 nt, Homo sapiens
ggagauaaagcuuugaagu

SEQ ID NO: 778387 - RNA, 19 nt, Homo sapiens
cagcagaccaugaccugua

SEQ ID NO: 778388 - RNA, 19 nt, Homo sapiens
uugaaaggcuugaaauaca

SEQ ID NO: 778389 - RNA, 19 nt, Homo sapiens
cggaugacauugggcauuu

SEQ ID NO: 778390 - RNA, 19 nt, Homo sapiens
ccaaaaccaucaccaugua

SEQ ID NO: 778391 - RNA, 19 nt, Homo sapiens
ggcagaguauuguacagaa

SEQ ID NO: 778392 - RNA, 19 nt, Homo sapiens
gaaagagcaagaauuagag

SEQ ID NO: 778393 - RNA, 19 nt, Homo sapiens
ggaaaggaaagagcaagaa

SEQ ID NO: 778394 - RNA, 19 nt, Homo sapiens
ugaaaggcuugaaauacau

SEQ ID NO: 778395 - RNA, 19 nt, Homo sapiens
gcucuuggacaccauauug

SEQ ID NO: 778396 - RNA, 19 nt, Homo sapiens
ggaaauugaauaaccaucu

SEQ ID NO: 778397 - RNA, 19 nt, Homo sapiens
gagcuggauucggaugaaa

SEQ ID NO: 778398 - RNA, 19 nt, Homo sapiens
ggagcuggauucggaugaa

SEQ ID NO: 778399 - RNA, 19 nt, Homo sapiens
gggaggugcuggagagcuu

SEQ ID NO: 778400 - RNA, 19 nt, Homo sapiens
uucauucucucucuaguaa

SEQ ID NO: 778401 - RNA, 19 nt, Homo sapiens
ggcgagauaacaaguuuaa

SEQ ID NO: 778402 - RNA, 19 nt, Homo sapiens
gcugaugucccuauacaau

SEQ ID NO: 778403 - RNA, 19 nt, Homo sapiens
ucaaagugcuaaugcugau

SEQ ID NO: 778404 - RNA, 19 nt, Homo sapiens
caucacuggucaaacaaug

SEQ ID NO: 778405 - RNA, 19 nt, Homo sapiens
caacgcauccuggcaaugu

SEQ ID NO: 778406 - RNA, 19 nt, Homo sapiens
caauguaagcaucaauuug

SEQ ID NO: 778407 - RNA, 19 nt, Homo sapiens
uaaugcugaugucccuaua

SEQ ID NO: 778408 - RNA, 19 nt, Homo sapiens
gagagaagaaggagaaacu

SEQ ID NO: 778409 - RNA, 19 nt, Homo sapiens
ggcaaaaugugauugacua

SEQ ID NO: 778410 - RNA, 19 nt, Homo sapiens
caagucggccucugaguuc

SEQ ID NO: 778411 - RNA, 19 nt, Homo sapiens
ugaugucccuauacaaugu

SEQ ID NO: 778412 - RNA, 19 nt, Homo sapiens
aaggagaggccaugaaaga

SEQ ID NO: 778413 - RNA, 19 nt, Homo sapiens
gugauugacuagagaugga

SEQ ID NO: 778414 - RNA, 19 nt, Homo sapiens
ccaagucggccucugaguu

SEQ ID NO: 778415 - RNA, 19 nt, Homo sapiens
cagcgagaguccaggauuc

SEQ ID NO: 778416 - RNA, 19 nt, Homo sapiens
gcacaugggaacuaaagag

SEQ ID NO: 778417 - RNA, 19 nt, Homo sapiens
aaaggaaagagcaagaauu

SEQ ID NO: 778418 - RNA, 19 nt, Homo sapiens
gagagcuuccagaaauuaa

SEQ ID NO: 778419 - RNA, 19 nt, Homo sapiens
ggaagugagagugcuugua

SEQ ID NO: 778420 - RNA, 19 nt, Homo sapiens
gagauggacaugaauugau

SEQ ID NO: 778421 - RNA, 19 nt, Homo sapiens
gaggagauaaagcuuugaa

SEQ ID NO: 778422 - RNA, 19 nt, Homo sapiens
gaaaaucagaagaguugua

SEQ ID NO: 778423 - RNA, 19 nt, Homo sapiens
agaggaauuuguuaaaguc

SEQ ID NO: 778424 - RNA, 19 nt, Homo sapiens
ggacaguguaccaaacuca

SEQ ID NO: 778425 - RNA, 19 nt, Homo sapiens
gaacggcugacaacugaag

SEQ ID NO: 778426 - RNA, 19 nt, Homo sapiens
gucgugaauucuugguuaa

SEQ ID NO: 778427 - RNA, 19 nt, Homo sapiens
cacauaacuuugucuugga

SEQ ID NO: 778428 - RNA, 19 nt, Homo sapiens
cacgaauguugcugcuaua

SEQ ID NO: 778429 - RNA, 19 nt, Homo sapiens
gcaggccgacaacauaaga

SEQ ID NO: 778430 - RNA, 19 nt, Homo sapiens
uauagcauguggucgugaa

SEQ ID NO: 778431 - RNA, 19 nt, Homo sapiens
caacauaagagagaagaag

SEQ ID NO: 778432 - RNA, 19 nt, Homo sapiens
ggcuguagacggcgagaua

SEQ ID NO: 778433 - RNA, 19 nt, Homo sapiens
gguuaagcuugccaaagga

SEQ ID NO: 778434 - RNA, 19 nt, Homo sapiens
gugcaggccgacaacauaa

SEQ ID NO: 778435 - RNA, 19 nt, Homo sapiens
ggauugugagcacuuuaaa

SEQ ID NO: 778436 - RNA, 19 nt, Homo sapiens
aaccugcuauuucggauga

SEQ ID NO: 778437 - RNA, 19 nt, Homo sapiens
ggagaggccaugaaagaac

SEQ ID NO: 778438 - RNA, 19 nt, Homo sapiens
acauaacuuugucuuggaa

SEQ ID NO: 778439 - RNA, 19 nt, Homo sapiens
aaaugugauugacuagaga

SEQ ID NO: 778440 - RNA, 19 nt, Homo sapiens
gaaauacaucagcgagagu

SEQ ID NO: 778441 - RNA, 19 nt, Homo sapiens
caauuugaaaggcuugaaa

SEQ ID NO: 778442 - RNA, 19 nt, Homo sapiens
gaaugaagcgaagcagcaa

SEQ ID NO: 778443 - RNA, 19 nt, Homo sapiens
agaauuagagcagcugaaa

SEQ ID NO: 778444 - RNA, 19 nt, Homo sapiens
caugaaagaaccuguccuu

SEQ ID NO: 778445 - RNA, 19 nt, Homo sapiens
ccaaaggagaggccaugaa

SEQ ID NO: 778446 - RNA, 19 nt, Homo sapiens
ugguuaagcuugccaaagg

SEQ ID NO: 778447 - RNA, 19 nt, Homo sapiens
guaggugguugguuaagcu

SEQ ID NO: 778448 - RNA, 19 nt, Homo sapiens
gcacucuggagcauaaugu

SEQ ID NO: 778449 - RNA, 19 nt, Homo sapiens
gaucuggaacggcugacaa

SEQ ID NO: 778450 - RNA, 19 nt, Homo sapiens
guagacggcgagauaacaa

SEQ ID NO: 778451 - RNA, 19 nt, Homo sapiens
gaagucgucaaggccauuu

SEQ ID NO: 778452 - RNA, 19 nt, Homo sapiens
gcacggaugucacugagua

SEQ ID NO: 778453 - RNA, 19 nt, Homo sapiens
gaagaaggccuaccaggaa

SEQ ID NO: 778454 - RNA, 19 nt, Homo sapiens
gaaaguaccaggacgucua

SEQ ID NO: 778455 - RNA, 19 nt, Homo sapiens
gaacuccaguaccuaaaga

SEQ ID NO: 778456 - RNA, 19 nt, Homo sapiens
gugaggagaucgagaagaa

SEQ ID NO: 778457 - RNA, 19 nt, Homo sapiens
gagcugagccacaucaaga

SEQ ID NO: 778458 - RNA, 19 nt, Homo sapiens
cccugaaccucuuaacuua

SEQ ID NO: 778459 - RNA, 19 nt, Homo sapiens
ggaagcagcaccagucaga

SEQ ID NO: 778460 - RNA, 19 nt, Homo sapiens
gggacgagcuccagaugau

SEQ ID NO: 778461 - RNA, 19 nt, Homo sapiens
caccaaggaugcugucuau

SEQ ID NO: 778462 - RNA, 19 nt, Homo sapiens
gagcaguacucgcagaagu

SEQ ID NO: 778463 - RNA, 19 nt, Homo sapiens
gaucgaggcucugagaaag

SEQ ID NO: 778464 - RNA, 19 nt, Homo sapiens
cagauucaagucucaaaua

SEQ ID NO: 778465 - RNA, 19 nt, Homo sapiens
gaccguacguccaacuuca

SEQ ID NO: 778466 - RNA, 19 nt, Homo sapiens
gcuagcagcuggccuccau

SEQ ID NO: 778467 - RNA, 19 nt, Homo sapiens
ggaucgaggcucugagaaa

SEQ ID NO: 778468 - RNA, 19 nt, Homo sapiens
ccaaggaugcugucuauac

SEQ ID NO: 778469 - RNA, 19 nt, Homo sapiens
gguuugugcugacagauuc

SEQ ID NO: 778470 - RNA, 19 nt, Homo sapiens
ggaggcagaugagcuggau

SEQ ID NO: 778471 - RNA, 19 nt, Homo sapiens
agaagugccuggagauugg

SEQ ID NO: 778472 - RNA, 19 nt, Homo sapiens
gcagaagugccuggagauu

SEQ ID NO: 778473 - RNA, 19 nt, Homo sapiens
gaaggagguucaggcucuu

SEQ ID NO: 778474 - RNA, 19 nt, Homo sapiens
ccauugaagccaugaagaa

SEQ ID NO: 778475 - RNA, 19 nt, Homo sapiens
ucacugcccugcucaacca

SEQ ID NO: 778476 - RNA, 19 nt, Homo sapiens
agaaagaccguacguccaa

SEQ ID NO: 778477 - RNA, 19 nt, Homo sapiens
gaucugcucaacuucaaga

SEQ ID NO: 778478 - RNA, 19 nt, Homo sapiens
ccuccuggauggaaguaaa

SEQ ID NO: 778479 - RNA, 19 nt, Homo sapiens
gaugcugucuauaccuugu

SEQ ID NO: 778480 - RNA, 19 nt, Homo sapiens
acacauguacacacggaua

SEQ ID NO: 778481 - RNA, 19 nt, Homo sapiens
uccaguaccuaaagaagga

SEQ ID NO: 778482 - RNA, 19 nt, Homo sapiens
gaggugcugcuucgcguaa

SEQ ID NO: 778483 - RNA, 19 nt, Homo sapiens
gaggagaucgagaagaagu

SEQ ID NO: 778484 - RNA, 19 nt, Homo sapiens
caacuauggcuuccagauc

SEQ ID NO: 778485 - RNA, 19 nt, Homo sapiens
acagacacacagacacaua

SEQ ID NO: 778486 - RNA, 19 nt, Homo sapiens
ggucugagcgggagaucga

SEQ ID NO: 778487 - RNA, 19 nt, Homo sapiens
gcaacuauggcuuccagau

SEQ ID NO: 778488 - RNA, 19 nt, Homo sapiens
cagaagugccuggagauug

SEQ ID NO: 778489 - RNA, 19 nt, Homo sapiens
acacacggauacacacaca

SEQ ID NO: 778490 - RNA, 19 nt, Homo sapiens
cgcccgaucugcucaacuu

SEQ ID NO: 778491 - RNA, 19 nt, Homo sapiens
acgaggcacuggagaagga

SEQ ID NO: 778492 - RNA, 19 nt, Homo sapiens
caaggaugcugucuauacc

SEQ ID NO: 778493 - RNA, 19 nt, Homo sapiens
guaccaggacgucuaugug

SEQ ID NO: 778494 - RNA, 19 nt, Homo sapiens
ugagcuggauggugagauc

SEQ ID NO: 778495 - RNA, 19 nt, Homo sapiens
caaaagguguuucucuucu

SEQ ID NO: 778496 - RNA, 19 nt, Homo sapiens
acacacacacugcauaucu

SEQ ID NO: 778497 - RNA, 19 nt, Homo sapiens
ccgaucugcucaacuucaa

SEQ ID NO: 778498 - RNA, 19 nt, Homo sapiens
acacacacacacugcauau

SEQ ID NO: 778499 - RNA, 19 nt, Homo sapiens
gcggaguuccugcgagcua

SEQ ID NO: 778500 - RNA, 19 nt, Homo sapiens
acacacacugcauaucuga

SEQ ID NO: 778501 - RNA, 19 nt, Homo sapiens
aaggagcaccugcgucuug

SEQ ID NO: 778502 - RNA, 19 nt, Homo sapiens
aaacgaacuccaguaccua

SEQ ID NO: 778503 - RNA, 19 nt, Homo sapiens
agggauggaugucgaucuu

SEQ ID NO: 778504 - RNA, 19 nt, Homo sapiens
ucccugaaccucuuaacuu

SEQ ID NO: 778505 - RNA, 19 nt, Homo sapiens
gacagauucaagucucaaa

SEQ ID NO: 778506 - RNA, 19 nt, Homo sapiens
uuagugaggagaucgagaa

SEQ ID NO: 778507 - RNA, 19 nt, Homo sapiens
gcuuccagauccacaccaa

SEQ ID NO: 778508 - RNA, 19 nt, Homo sapiens
ggauacacacacacacaca

SEQ ID NO: 778509 - RNA, 19 nt, Homo sapiens
acacagacacacagacaca

SEQ ID NO: 778510 - RNA, 19 nt, Homo sapiens
ccacacacacacacacaca

SEQ ID NO: 778511 - RNA, 19 nt, Homo sapiens
gagccgagagcugagcaaa

SEQ ID NO: 778512 - RNA, 19 nt, Homo sapiens
cacacacacugcauaucug

SEQ ID NO: 778513 - RNA, 19 nt, Homo sapiens
guacacacggauacacaca

SEQ ID NO: 778514 - RNA, 19 nt, Homo sapiens
acacacagacacacagaca

SEQ ID NO: 778515 - RNA, 19 nt, Homo sapiens
acacacacacacacacaga

SEQ ID NO: 778516 - RNA, 19 nt, Homo sapiens
ggagaucgagcagcugaag

SEQ ID NO: 778517 - RNA, 19 nt, Homo sapiens
ggacgagcuccagaugaug

SEQ ID NO: 778518 - RNA, 19 nt, Homo sapiens
cagcaaaaccggcuuagug

SEQ ID NO: 778519 - RNA, 19 nt, Homo sapiens
acacacgugcacacaugua

SEQ ID NO: 778520 - RNA, 19 nt, Homo sapiens
aaaguaccaggacgucuau

SEQ ID NO: 778521 - RNA, 19 nt, Homo sapiens
aggaugcugucuauaccuu

SEQ ID NO: 778522 - RNA, 19 nt, Homo sapiens
acaccaaggaugcugucua

SEQ ID NO: 778523 - RNA, 19 nt, Homo sapiens
cacacacacacacugcaua

SEQ ID NO: 778524 - RNA, 19 nt, Homo sapiens
aagcagcaccagucagaug

SEQ ID NO: 778525 - RNA, 19 nt, Homo sapiens
gcucucggacucuaacaag

SEQ ID NO: 778526 - RNA, 19 nt, Homo sapiens
caaacuaacucucuagaaa

SEQ ID NO: 778527 - RNA, 19 nt, Homo sapiens
gcacggaugucacugagua

SEQ ID NO: 778528 - RNA, 19 nt, Homo sapiens
gugaggagaucgagaagaa

SEQ ID NO: 778529 - RNA, 19 nt, Homo sapiens
caccaaggaugcugucuau

SEQ ID NO: 778530 - RNA, 19 nt, Homo sapiens
aaacaaugcuuaguacaca

SEQ ID NO: 778531 - RNA, 19 nt, Homo sapiens
gaucgaggcucugagaaag

SEQ ID NO: 778532 - RNA, 19 nt, Homo sapiens
cagauucaagucucaaaua

SEQ ID NO: 778533 - RNA, 19 nt, Homo sapiens
gaccguacguccaacuuca

SEQ ID NO: 778534 - RNA, 19 nt, Homo sapiens
cugcagagccuguguguga

SEQ ID NO: 778535 - RNA, 19 nt, Homo sapiens
ggaucgaggcucugagaaa

SEQ ID NO: 778536 - RNA, 19 nt, Homo sapiens
ucacaacuaggacaaacua

SEQ ID NO: 778537 - RNA, 19 nt, Homo sapiens
caaggccacugagcucuga

SEQ ID NO: 778538 - RNA, 19 nt, Homo sapiens
ccaaggaugcugucuauac

SEQ ID NO: 778539 - RNA, 19 nt, Homo sapiens
gguuugugcugacagauuc

SEQ ID NO: 778540 - RNA, 19 nt, Homo sapiens
ggacaaacuaacucucuag

SEQ ID NO: 778541 - RNA, 19 nt, Homo sapiens
ggaggcagaugagcuggau

SEQ ID NO: 778542 - RNA, 19 nt, Homo sapiens
gaaggagguucaggcucuu

SEQ ID NO: 778543 - RNA, 19 nt, Homo sapiens
ucacugcccugcucaacca

SEQ ID NO: 778544 - RNA, 19 nt, Homo sapiens
agaaagaccguacguccaa

SEQ ID NO: 778545 - RNA, 19 nt, Homo sapiens
gaucugcucaacuucaaga

SEQ ID NO: 778546 - RNA, 19 nt, Homo sapiens
caacuaggacaaacuaacu

SEQ ID NO: 778547 - RNA, 19 nt, Homo sapiens
gaugcugucuauaccuugu

SEQ ID NO: 778548 - RNA, 19 nt, Homo sapiens
uuacagacaaggccacuga

SEQ ID NO: 778549 - RNA, 19 nt, Homo sapiens
gaggagaucgagaagaagu

SEQ ID NO: 778550 - RNA, 19 nt, Homo sapiens
caacuauggcuuccagauc

SEQ ID NO: 778551 - RNA, 19 nt, Homo sapiens
gggaauacuucugguuguc

SEQ ID NO: 778552 - RNA, 19 nt, Homo sapiens
gugacacucugcacuugga

SEQ ID NO: 778553 - RNA, 19 nt, Homo sapiens
ucugagagguuaugugacu

SEQ ID NO: 778554 - RNA, 19 nt, Homo sapiens
gcaacuauggcuuccagau

SEQ ID NO: 778555 - RNA, 19 nt, Homo sapiens
ccaguagcccucagagaau

SEQ ID NO: 778556 - RNA, 19 nt, Homo sapiens
cgcccgaucugcucaacuu

SEQ ID NO: 778557 - RNA, 19 nt, Homo sapiens
gacaaacuaacucucuaga

SEQ ID NO: 778558 - RNA, 19 nt, Homo sapiens
ggaauacuucugguuguca

SEQ ID NO: 778559 - RNA, 19 nt, Homo sapiens
acgaggcacuggagaagga

SEQ ID NO: 778560 - RNA, 19 nt, Homo sapiens
caaggaugcugucuauacc

SEQ ID NO: 778561 - RNA, 19 nt, Homo sapiens
caguagcccucagagaaug

SEQ ID NO: 778562 - RNA, 19 nt, Homo sapiens
uccaguagcccucagagaa

SEQ ID NO: 778563 - RNA, 19 nt, Homo sapiens
ugagcuggauggugagauc

SEQ ID NO: 778564 - RNA, 19 nt, Homo sapiens
aggacaaacuaacucucua

SEQ ID NO: 778565 - RNA, 19 nt, Homo sapiens
ccgaucugcucaacuucaa

SEQ ID NO: 778566 - RNA, 19 nt, Homo sapiens
acaaacuaacucucuagaa

SEQ ID NO: 778567 - RNA, 19 nt, Homo sapiens
agggauggaugucgaucuu

SEQ ID NO: 778568 - RNA, 19 nt, Homo sapiens
ggucucaaaggugggauuu

SEQ ID NO: 778569 - RNA, 19 nt, Homo sapiens
uuagugaggagaucgagaa

SEQ ID NO: 778570 - RNA, 19 nt, Homo sapiens
gacagauucaagucucaaa

SEQ ID NO: 778571 - RNA, 19 nt, Homo sapiens
gcuuccagauccacaccaa

SEQ ID NO: 778572 - RNA, 19 nt, Homo sapiens
ugggaauacuucugguugu

SEQ ID NO: 778573 - RNA, 19 nt, Homo sapiens
cagcaaaaccggcuuagug

SEQ ID NO: 778574 - RNA, 19 nt, Homo sapiens
ugagagguuaugugacuug

SEQ ID NO: 778575 - RNA, 19 nt, Homo sapiens
aggaugcugucuauaccuu

SEQ ID NO: 778576 - RNA, 19 nt, Homo sapiens
acaccaaggaugcugucua

SEQ ID NO: 778577 - RNA, 19 nt, Homo sapiens
gcucucggacucuaacaag

SEQ ID NO: 778578 - RNA, 19 nt, Homo sapiens
gagcuucaaugauuuguaa

SEQ ID NO: 778579 - RNA, 19 nt, Homo sapiens
uaaaggugauugucaagua

SEQ ID NO: 778580 - RNA, 19 nt, Homo sapiens
ucaagcacaugauuaagua

SEQ ID NO: 778581 - RNA, 19 nt, Homo sapiens
agaagaaacuggcgcuuaa

SEQ ID NO: 778582 - RNA, 19 nt, Homo sapiens
uaacuaccaugauugcuuu

SEQ ID NO: 778583 - RNA, 19 nt, Homo sapiens
cgaaagaacuuaacguuuu

SEQ ID NO: 778584 - RNA, 19 nt, Homo sapiens
gggaugaucuagccugauu

SEQ ID NO: 778585 - RNA, 19 nt, Homo sapiens
ucagugacguuaaguguuu

SEQ ID NO: 778586 - RNA, 19 nt, Homo sapiens
guucuuaacuaccaugauu

SEQ ID NO: 778587 - RNA, 19 nt, Homo sapiens
aaaaggagcuucaaugauu

SEQ ID NO: 778588 - RNA, 19 nt, Homo sapiens
gaucuaccaucuaaaucuu

SEQ ID NO: 778589 - RNA, 19 nt, Homo sapiens
aaaggugauugucaaguaa

SEQ ID NO: 778590 - RNA, 19 nt, Homo sapiens
gcaaggccuucgccagcua

SEQ ID NO: 778591 - RNA, 19 nt, Homo sapiens
gaaauaucagguucuagaa

SEQ ID NO: 778592 - RNA, 19 nt, Homo sapiens
aaaggagcuucaaugauuu

SEQ ID NO: 778593 - RNA, 19 nt, Homo sapiens
gcuauggucuguacuuucu

SEQ ID NO: 778594 - RNA, 19 nt, Homo sapiens
ccaaacagaacgaggaauu

SEQ ID NO: 778595 - RNA, 19 nt, Homo sapiens
ugaaauaucagguucuaga

SEQ ID NO: 778596 - RNA, 19 nt, Homo sapiens
aauaucagguucuagaaga

SEQ ID NO: 778597 - RNA, 19 nt, Homo sapiens
aaaguuggccucuauccua

SEQ ID NO: 778598 - RNA, 19 nt, Homo sapiens
guuuaaaguuggccucuau

SEQ ID NO: 778599 - RNA, 19 nt, Homo sapiens
guugguacauugugaccua

SEQ ID NO: 778600 - RNA, 19 nt, Homo sapiens
aaacuugguucuuaacuac

SEQ ID NO: 778601 - RNA, 19 nt, Homo sapiens
cuggagauguuuaaaguug

SEQ ID NO: 778602 - RNA, 19 nt, Homo sapiens
uaaugccaguuuccuaauu

SEQ ID NO: 778603 - RNA, 19 nt, Homo sapiens
gcucccagaguuuaaauuu

SEQ ID NO: 778604 - RNA, 19 nt, Homo sapiens
ggccgauucuggugaugua

SEQ ID NO: 778605 - RNA, 19 nt, Homo sapiens
guacuuucuucgacgcuuu

SEQ ID NO: 778606 - RNA, 19 nt, Homo sapiens
gaagaaacuggcgcuuaaa

SEQ ID NO: 778607 - RNA, 19 nt, Homo sapiens
cgaaggcucccagaguuua

SEQ ID NO: 778608 - RNA, 19 nt, Homo sapiens
gaaacuggcgcuuaaacca

SEQ ID NO: 778609 - RNA, 19 nt, Homo sapiens
uagaagaaacuggcgcuua

SEQ ID NO: 778610 - RNA, 19 nt, Homo sapiens
ucucacggauggaauucua

SEQ ID NO: 778611 - RNA, 19 nt, Homo sapiens
uuacgagggagucaaauuu

SEQ ID NO: 778612 - RNA, 19 nt, Homo sapiens
gaaggcucccagaguuuaa

SEQ ID NO: 778613 - RNA, 19 nt, Homo sapiens
acucaaaacuugguucuua

SEQ ID NO: 778614 - RNA, 19 nt, Homo sapiens
uaaaccaaaucgcauggau

SEQ ID NO: 778615 - RNA, 19 nt, Homo sapiens
ggaaaccuucgguggugua

SEQ ID NO: 778616 - RNA, 19 nt, Homo sapiens
gagcuuugucuacaugauu

SEQ ID NO: 778617 - RNA, 19 nt, Homo sapiens
guagcggagcugcgaguua

SEQ ID NO: 778618 - RNA, 19 nt, Homo sapiens
ggccugagcuuugucuaca

SEQ ID NO: 778619 - RNA, 19 nt, Homo sapiens
ccuaaugacucaaaacuug

SEQ ID NO: 778620 - RNA, 19 nt, Homo sapiens
ccgaaagaacuuaacguuu

SEQ ID NO: 778621 - RNA, 19 nt, Homo sapiens
gaaggcaugcggcuaccaa

SEQ ID NO: 778622 - RNA, 19 nt, Homo sapiens
cacuggagauguuuaaagu

SEQ ID NO: 778623 - RNA, 19 nt, Homo sapiens
gagcugcgaguuacagaau

SEQ ID NO: 778624 - RNA, 19 nt, Homo sapiens
cugcaggguugguacauug

SEQ ID NO: 778625 - RNA, 19 nt, Homo sapiens
cuacaugauucgaguuuac

SEQ ID NO: 778626 - RNA, 19 nt, Homo sapiens
gcugcgaguuacagaaugu

SEQ ID NO: 778627 - RNA, 19 nt, Homo sapiens
ucaucaugcucuucuguau

SEQ ID NO: 778628 - RNA, 19 nt, Homo sapiens
acacugggccugagcuuug

SEQ ID NO: 778629 - RNA, 19 nt, Homo sapiens
uaucaguccuggcuagaca

SEQ ID NO: 778630 - RNA, 19 nt, Homo sapiens
aaguuggccucuauccuaa

SEQ ID NO: 778631 - RNA, 19 nt, Homo sapiens
guucacacaugggaagaga

SEQ ID NO: 778632 - RNA, 19 nt, Homo sapiens
ucuaaugccaguuuccuaa

SEQ ID NO: 778633 - RNA, 19 nt, Homo sapiens
ggaucuaccaucuaaaucu

SEQ ID NO: 778634 - RNA, 19 nt, Homo sapiens
guacaucccguucacacau

SEQ ID NO: 778635 - RNA, 19 nt, Homo sapiens
uaauggaagacucagauga

SEQ ID NO: 778636 - RNA, 19 nt, Homo sapiens
caggguugguacauuguga

SEQ ID NO: 778637 - RNA, 19 nt, Homo sapiens
gaacaguuuugagccauug

SEQ ID NO: 778638 - RNA, 19 nt, Homo sapiens
uagcggagcugcgaguuac

SEQ ID NO: 778639 - RNA, 19 nt, Homo sapiens
guuggccucuauccuaaug

SEQ ID NO: 778640 - RNA, 19 nt, Homo sapiens
guacagaggcaaggaggau

SEQ ID NO: 778641 - RNA, 19 nt, Homo sapiens
cuucggugguguacagauu

SEQ ID NO: 778642 - RNA, 19 nt, Homo sapiens
uggcuauggucuguacuuu

SEQ ID NO: 778643 - RNA, 19 nt, Homo sapiens
caaacagaacgaggaauuc

SEQ ID NO: 778644 - RNA, 19 nt, Homo sapiens
guccuucgcuacccaccaa

SEQ ID NO: 778645 - RNA, 19 nt, Homo sapiens
ucuacaugauucgaguuua

SEQ ID NO: 778646 - RNA, 19 nt, Homo sapiens
guggauccuuccuuaaugg

SEQ ID NO: 778647 - RNA, 19 nt, Homo sapiens
ccucuauccuaaugacuca

SEQ ID NO: 778648 - RNA, 19 nt, Homo sapiens
aacuggcgcuuaaaccaaa

SEQ ID NO: 778649 - RNA, 19 nt, Homo sapiens
aaacuggcgcuuaaaccaa

SEQ ID NO: 778650 - RNA, 19 nt, Homo sapiens
ggagcuucaaugauuugua

SEQ ID NO: 778651 - RNA, 19 nt, Homo sapiens
ccugagcuuugucuacaug

SEQ ID NO: 778652 - RNA, 19 nt, Homo sapiens
gaagguacagaggcaagga

SEQ ID NO: 778653 - RNA, 19 nt, Homo sapiens
aaugccaguuuccuaauuc

SEQ ID NO: 778654 - RNA, 19 nt, Homo sapiens
gacuuggacagauuuauca

SEQ ID NO: 778655 - RNA, 19 nt, Homo sapiens
aggcaaaucaagcacauga

SEQ ID NO: 778656 - RNA, 19 nt, Homo sapiens
gaugaagaggcaaaucaag

SEQ ID NO: 778657 - RNA, 19 nt, Homo sapiens
cgauucuggugauguacuu

SEQ ID NO: 778658 - RNA, 19 nt, Homo sapiens
uauggucuguacuuucuuc

SEQ ID NO: 778659 - RNA, 19 nt, Homo sapiens
uucgaaggcucccagaguu

SEQ ID NO: 778660 - RNA, 19 nt, Homo sapiens
ugaagaggcaaaucaagca

SEQ ID NO: 778661 - RNA, 19 nt, Homo sapiens
cgaugaagaggcaaaucaa

SEQ ID NO: 778662 - RNA, 19 nt, Homo sapiens
aucaugcucuucuguauca

SEQ ID NO: 778663 - RNA, 19 nt, Homo sapiens
gggcauccuuguggcuaug

SEQ ID NO: 778664 - RNA, 19 nt, Homo sapiens
aguggauccuuccuuaaug

SEQ ID NO: 778665 - RNA, 19 nt, Homo sapiens
ucccagaguuuaaauuuug

SEQ ID NO: 778666 - RNA, 19 nt, Homo sapiens
uuaacuaccaugauugcuu

SEQ ID NO: 778667 - RNA, 19 nt, Homo sapiens
ucacuggagauguuuaaag

SEQ ID NO: 778668 - RNA, 19 nt, Homo sapiens
ggagcugcgaguuacagaa

SEQ ID NO: 778669 - RNA, 19 nt, Homo sapiens
ugauuacgagggagucaaa

SEQ ID NO: 778670 - RNA, 19 nt, Homo sapiens
agacuuggacagauuuauc

SEQ ID NO: 778671 - RNA, 19 nt, Homo sapiens
gguacauugugaccuaugc

SEQ ID NO: 778672 - RNA, 19 nt, Homo sapiens
agaggcaaaucaagcacau

SEQ ID NO: 778673 - RNA, 19 nt, Homo sapiens
ucgaaggcucccagaguuu

SEQ ID NO: 778674 - RNA, 19 nt, Homo sapiens
cuucaaugauuuguaacug

SEQ ID NO: 778675 - RNA, 19 nt, Homo sapiens
ucacacaugggaagagaag

SEQ ID NO: 778676 - RNA, 19 nt, Homo sapiens
ccgguguucuggccgauuc

SEQ ID NO: 778677 - RNA, 19 nt, Homo sapiens
ggaaugaggagaagaauua

SEQ ID NO: 778678 - RNA, 19 nt, Homo sapiens
ggagaagaauuauuggaua

SEQ ID NO: 778679 - RNA, 19 nt, Homo sapiens
gaagagauauauagugguu

SEQ ID NO: 778680 - RNA, 19 nt, Homo sapiens
gaaaugcuguuacuuggaa

SEQ ID NO: 778681 - RNA, 19 nt, Homo sapiens
gaacuuagaguaucacuug

SEQ ID NO: 778682 - RNA, 19 nt, Homo sapiens
uaaaucaccuucugaaaug

SEQ ID NO: 778683 - RNA, 19 nt, Homo sapiens
gugcuagacuauccaauua

SEQ ID NO: 778684 - RNA, 19 nt, Homo sapiens
gaugaaacaccaaauagua

SEQ ID NO: 778685 - RNA, 19 nt, Homo sapiens
cgcagaagcuuaugaagua

SEQ ID NO: 778686 - RNA, 19 nt, Homo sapiens
gcagaucuuucuucauaaa

SEQ ID NO: 778687 - RNA, 19 nt, Homo sapiens
aggcagaucuuucuucaua

SEQ ID NO: 778688 - RNA, 19 nt, Homo sapiens
gcuguagcauuucuuaaua

SEQ ID NO: 778689 - RNA, 19 nt, Homo sapiens
caaacaagauccuccaguu

SEQ ID NO: 778690 - RNA, 19 nt, Homo sapiens
ggagaugaaacaccaaaua

SEQ ID NO: 778691 - RNA, 19 nt, Homo sapiens
ccaagucaguuauuagauu

SEQ ID NO: 778692 - RNA, 19 nt, Homo sapiens
ccaaagaaguacuuaggaa

SEQ ID NO: 778693 - RNA, 19 nt, Homo sapiens
caaagggaaaucuaaguua

SEQ ID NO: 778694 - RNA, 19 nt, Homo sapiens
ggaaauagauggugauccu

SEQ ID NO: 778695 - RNA, 19 nt, Homo sapiens
aaacccaagucaguuauua

SEQ ID NO: 778696 - RNA, 19 nt, Homo sapiens
gagguguccuucccagaua

SEQ ID NO: 778697 - RNA, 19 nt, Homo sapiens
uuacagaucugaggacaaa

SEQ ID NO: 778698 - RNA, 19 nt, Homo sapiens
cuaaugaagugcuagacua

SEQ ID NO: 778699 - RNA, 19 nt, Homo sapiens
ccaaacggaugaagauuuc

SEQ ID NO: 778700 - RNA, 19 nt, Homo sapiens
agggauggaucaaauauaa

SEQ ID NO: 778701 - RNA, 19 nt, Homo sapiens
gaggaaaugcuguuacuug

SEQ ID NO: 778702 - RNA, 19 nt, Homo sapiens
uagcugaauugcugauuaa

SEQ ID NO: 778703 - RNA, 19 nt, Homo sapiens
gaagaacuuuguuacacau

SEQ ID NO: 778704 - RNA, 19 nt, Homo sapiens
caauuucucuccuguggaa

SEQ ID NO: 778705 - RNA, 19 nt, Homo sapiens
ggagucaguggauauauuu

SEQ ID NO: 778706 - RNA, 19 nt, Homo sapiens
aaacaagauccuccaguua

SEQ ID NO: 778707 - RNA, 19 nt, Homo sapiens
gaagaaauggaaauagaug

SEQ ID NO: 778708 - RNA, 19 nt, Homo sapiens
gaagaauuauuggauaugg

SEQ ID NO: 778709 - RNA, 19 nt, Homo sapiens
ggacaaaauucuuaccauu

SEQ ID NO: 778710 - RNA, 19 nt, Homo sapiens
gaguaucacuugaagagau

SEQ ID NO: 778711 - RNA, 19 nt, Homo sapiens
cuagcugaauugcugauua

SEQ ID NO: 778712 - RNA, 19 nt, Homo sapiens
gaaagaaggcaccaaaauu

SEQ ID NO: 778713 - RNA, 19 nt, Homo sapiens
ggaaggaguuacagaucug

SEQ ID NO: 778714 - RNA, 19 nt, Homo sapiens
gaacuaccacuacacuaug

SEQ ID NO: 778715 - RNA, 19 nt, Homo sapiens
ggaaaucccaauugcuuga

SEQ ID NO: 778716 - RNA, 19 nt, Homo sapiens
uaaggcagaucuuucuuca

SEQ ID NO: 778717 - RNA, 19 nt, Homo sapiens
guaguuuacugauguagau

SEQ ID NO: 778718 - RNA, 19 nt, Homo sapiens
caaagaaguacuuaggaaa

SEQ ID NO: 778719 - RNA, 19 nt, Homo sapiens
agacaaagaucauccaaaa

SEQ ID NO: 778720 - RNA, 19 nt, Homo sapiens
aaacaagcccucaaauuuc

SEQ ID NO: 778721 - RNA, 19 nt, Homo sapiens
gaaaacaagcccucaaauu

SEQ ID NO: 778722 - RNA, 19 nt, Homo sapiens
uaacugcugcuuauggaua

SEQ ID NO: 778723 - RNA, 19 nt, Homo sapiens
uuguguggcugcucaauua

SEQ ID NO: 778724 - RNA, 19 nt, Homo sapiens
gaauagagacgggucaaau

SEQ ID NO: 778725 - RNA, 19 nt, Homo sapiens
cugaagaaauggaaauaga

SEQ ID NO: 778726 - RNA, 19 nt, Homo sapiens
cuucugaaaugcugcuaua

SEQ ID NO: 778727 - RNA, 19 nt, Homo sapiens
acaagauccuccaguuauu

SEQ ID NO: 778728 - RNA, 19 nt, Homo sapiens
gggaaagacuauuauugca

SEQ ID NO: 778729 - RNA, 19 nt, Homo sapiens
gcaaguugacuauauaucu

SEQ ID NO: 778730 - RNA, 19 nt, Homo sapiens
cuauagggcugguaucugu

SEQ ID NO: 778731 - RNA, 19 nt, Homo sapiens
aaagaaggcaccaaaauua

SEQ ID NO: 778732 - RNA, 19 nt, Homo sapiens
gcaacuacuuguuaugcau

SEQ ID NO: 778733 - RNA, 19 nt, Homo sapiens
gagacgggucaaauaaaua

SEQ ID NO: 778734 - RNA, 19 nt, Homo sapiens
ugaagaacuuuguuacaca

SEQ ID NO: 778735 - RNA, 19 nt, Homo sapiens
gagaugaaacaccaaauag

SEQ ID NO: 778736 - RNA, 19 nt, Homo sapiens
cugaauugcugauuaacuu

SEQ ID NO: 778737 - RNA, 19 nt, Homo sapiens
gagaaaggagcuucagaug

SEQ ID NO: 778738 - RNA, 19 nt, Homo sapiens
gcuguuacuuggaauuaau

SEQ ID NO: 778739 - RNA, 19 nt, Homo sapiens
agagacgggucaaauaaau

SEQ ID NO: 778740 - RNA, 19 nt, Homo sapiens
aaaacaagcccucaaauuu

SEQ ID NO: 778741 - RNA, 19 nt, Homo sapiens
uuuguucucugcuaguuua

SEQ ID NO: 778742 - RNA, 19 nt, Homo sapiens
gcugguaucuguaaaagaa

SEQ ID NO: 778743 - RNA, 19 nt, Homo sapiens
uaaaagggauggaucaaau

SEQ ID NO: 778744 - RNA, 19 nt, Homo sapiens
caacuacuuguuaugcaua

SEQ ID NO: 778745 - RNA, 19 nt, Homo sapiens
guacuuaggaaacaucuuc

SEQ ID NO: 778746 - RNA, 19 nt, Homo sapiens
gcagaagcuuaugaaguau

SEQ ID NO: 778747 - RNA, 19 nt, Homo sapiens
gaaaaccauucacuguauu

SEQ ID NO: 778748 - RNA, 19 nt, Homo sapiens
aauagagacgggucaaaua

SEQ ID NO: 778749 - RNA, 19 nt, Homo sapiens
aacaagcccucaaauuuca

SEQ ID NO: 778750 - RNA, 19 nt, Homo sapiens
agaaugaacuaccacuaca

SEQ ID NO: 778751 - RNA, 19 nt, Homo sapiens
ggaaagacuauuauugcau

SEQ ID NO: 778752 - RNA, 19 nt, Homo sapiens
gaaugaagaacuuuguuac

SEQ ID NO: 778753 - RNA, 19 nt, Homo sapiens
gucaguaaaugauauugug

SEQ ID NO: 778754 - RNA, 19 nt, Homo sapiens
gauggaagaaacauaccua

SEQ ID NO: 778755 - RNA, 19 nt, Homo sapiens
cuuaugaaguauugaguga

SEQ ID NO: 778756 - RNA, 19 nt, Homo sapiens
gucaguggauauauuucua

SEQ ID NO: 778757 - RNA, 19 nt, Homo sapiens
ggucaaauaaauaggcaaa

SEQ ID NO: 778758 - RNA, 19 nt, Homo sapiens
agaaaggagcuucagauga

SEQ ID NO: 778759 - RNA, 19 nt, Homo sapiens
ccaacguggugaccuucua

SEQ ID NO: 778760 - RNA, 19 nt, Homo sapiens
guaccaaacggaugaagau

SEQ ID NO: 778761 - RNA, 19 nt, Homo sapiens
agaagcuuaugaaguauug

SEQ ID NO: 778762 - RNA, 19 nt, Homo sapiens
aaacacuaacugcugcuua

SEQ ID NO: 778763 - RNA, 19 nt, Homo sapiens
aaaggaaaguaauggcaau

SEQ ID NO: 778764 - RNA, 19 nt, Homo sapiens
ggcagaucuuucuucauaa

SEQ ID NO: 778765 - RNA, 19 nt, Homo sapiens
uggagucaguggauauauu

SEQ ID NO: 778766 - RNA, 19 nt, Homo sapiens
gagaaaaccauucacugua

SEQ ID NO: 778767 - RNA, 19 nt, Homo sapiens
agagauauauagugguugu

SEQ ID NO: 778768 - RNA, 19 nt, Homo sapiens
gauaauguugcaacuacuu

SEQ ID NO: 778769 - RNA, 19 nt, Homo sapiens
ugaacuaccacuacacuau

SEQ ID NO: 778770 - RNA, 19 nt, Homo sapiens
auagagacgggucaaauaa

SEQ ID NO: 778771 - RNA, 19 nt, Homo sapiens
uuacugauguagaugugaa

SEQ ID NO: 778772 - RNA, 19 nt, Homo sapiens
caacguggugaccuucuaa

SEQ ID NO: 778773 - RNA, 19 nt, Homo sapiens
uaugaaguauugagugauc

SEQ ID NO: 778774 - RNA, 19 nt, Homo sapiens
ggaaaugcuguuacuugga

SEQ ID NO: 778775 - RNA, 19 nt, Homo sapiens
guggaaaucccaauugcuu

SEQ ID NO: 778776 - RNA, 19 nt, Homo sapiens
aaauagauggugauccuuu

SEQ ID NO: 778777 - RNA, 19 nt, Homo sapiens
gaauaugccuccaagauua

SEQ ID NO: 778778 - RNA, 19 nt, Homo sapiens
gaaauaagguguccagaau

SEQ ID NO: 778779 - RNA, 19 nt, Homo sapiens
gcacuaagauuccgugguu

SEQ ID NO: 778780 - RNA, 19 nt, Homo sapiens
gaaauuagcaagcuucauu

SEQ ID NO: 778781 - RNA, 19 nt, Homo sapiens
gaaugucucuguaauaugu

SEQ ID NO: 778782 - RNA, 19 nt, Homo sapiens
ggauggaaaugaaaucaaa

SEQ ID NO: 778783 - RNA, 19 nt, Homo sapiens
gagacuaaaucacaacaaa

SEQ ID NO: 778784 - RNA, 19 nt, Homo sapiens
aaauagaggucucaaagaa

SEQ ID NO: 778785 - RNA, 19 nt, Homo sapiens
gaucaaagguguucauggu

SEQ ID NO: 778786 - RNA, 19 nt, Homo sapiens
gaacgagauuccuucaguu

SEQ ID NO: 778787 - RNA, 19 nt, Homo sapiens
caaagaaauuccugcuauu

SEQ ID NO: 778788 - RNA, 19 nt, Homo sapiens
ucaaagaaauuccugcuau

SEQ ID NO: 778789 - RNA, 19 nt, Homo sapiens
gaaaucaaaccaccaauuc

SEQ ID NO: 778790 - RNA, 19 nt, Homo sapiens
gagaauggguauggaauga

SEQ ID NO: 778791 - RNA, 19 nt, Homo sapiens
cagcuaagauggauaaauc

SEQ ID NO: 778792 - RNA, 19 nt, Homo sapiens
ggaauaugccuccaagauu

SEQ ID NO: 778793 - RNA, 19 nt, Homo sapiens
acaacaaacugucagauga

SEQ ID NO: 778794 - RNA, 19 nt, Homo sapiens
uaagccagcugaagaaguu

SEQ ID NO: 778795 - RNA, 19 nt, Homo sapiens
gccaagaaguuuagaacaa

SEQ ID NO: 778796 - RNA, 19 nt, Homo sapiens
ccacuuaaacugcaaauug

SEQ ID NO: 778797 - RNA, 19 nt, Homo sapiens
ggaagaagaagauccaaga

SEQ ID NO: 778798 - RNA, 19 nt, Homo sapiens
gugaaugucucuguaauau

SEQ ID NO: 778799 - RNA, 19 nt, Homo sapiens
cgaguagguuucacuguuu

SEQ ID NO: 778800 - RNA, 19 nt, Homo sapiens
gaauggguauggaaugaau

SEQ ID NO: 778801 - RNA, 19 nt, Homo sapiens
uaaauaaggucuggauauc

SEQ ID NO: 778802 - RNA, 19 nt, Homo sapiens
gagguaagcagucuucuga

SEQ ID NO: 778803 - RNA, 19 nt, Homo sapiens
guaaauaaggucuggauau

SEQ ID NO: 778804 - RNA, 19 nt, Homo sapiens
cuaaugaauugaacuguga

SEQ ID NO: 778805 - RNA, 19 nt, Homo sapiens
uaggagacuugacagcuua

SEQ ID NO: 778806 - RNA, 19 nt, Homo sapiens
guacaagcagugaccaaua

SEQ ID NO: 778807 - RNA, 19 nt, Homo sapiens
ucucuuccauagcuuauua

SEQ ID NO: 778808 - RNA, 19 nt, Homo sapiens
uuaaaggacucaagaaucu

SEQ ID NO: 778809 - RNA, 19 nt, Homo sapiens
guacaugauucagaugauu

SEQ ID NO: 778810 - RNA, 19 nt, Homo sapiens
aaacagcagucacuucuag

SEQ ID NO: 778811 - RNA, 19 nt, Homo sapiens
gguauggaaugaaucaaau

SEQ ID NO: 778812 - RNA, 19 nt, Homo sapiens
caaagaaauuagcaagcuu

SEQ ID NO: 778813 - RNA, 19 nt, Homo sapiens
cgagauuccuucaguuaug

SEQ ID NO: 778814 - RNA, 19 nt, Homo sapiens
ccaagaaguuuagaacaau

SEQ ID NO: 778815 - RNA, 19 nt, Homo sapiens
gagaaugccacccagcuaa

SEQ ID NO: 778816 - RNA, 19 nt, Homo sapiens
gagccugggucaauccauu

SEQ ID NO: 778817 - RNA, 19 nt, Homo sapiens
gaaugaaaauugccuagaa

SEQ ID NO: 778818 - RNA, 19 nt, Homo sapiens
ggcacaaucuguuucauca

SEQ ID NO: 778819 - RNA, 19 nt, Homo sapiens
cuugacagcuuaaaguaaa

SEQ ID NO: 778820 - RNA, 19 nt, Homo sapiens
gucaauccauuaccaugua

SEQ ID NO: 778821 - RNA, 19 nt, Homo sapiens
uuagcaagcuucauuaaag

SEQ ID NO: 778822 - RNA, 19 nt, Homo sapiens
auaguccacugcauucuua

SEQ ID NO: 778823 - RNA, 19 nt, Homo sapiens
gcaggucuaugaaguacau

SEQ ID NO: 778824 - RNA, 19 nt, Homo sapiens
gaagaagaagauccaagaa

SEQ ID NO: 778825 - RNA, 19 nt, Homo sapiens
uagcaagcuucauuaaaga

SEQ ID NO: 778826 - RNA, 19 nt, Homo sapiens
gaacugugaauuaggaaug

SEQ ID NO: 778827 - RNA, 19 nt, Homo sapiens
caucacagccugcauuaau

SEQ ID NO: 778828 - RNA, 19 nt, Homo sapiens
aagaaugcccugaggaaua

SEQ ID NO: 778829 - RNA, 19 nt, Homo sapiens
aauaagguguccagaauuc

SEQ ID NO: 778830 - RNA, 19 nt, Homo sapiens
ggaaugaaucaaauacuuc

SEQ ID NO: 778831 - RNA, 19 nt, Homo sapiens
acacagaguuaagauaguu

SEQ ID NO: 778832 - RNA, 19 nt, Homo sapiens
ucaccuugaucauaacaaa

SEQ ID NO: 778833 - RNA, 19 nt, Homo sapiens
agaaugcccugaggaauau

SEQ ID NO: 778834 - RNA, 19 nt, Homo sapiens
ucagaugauuggacuauuc

SEQ ID NO: 778835 - RNA, 19 nt, Homo sapiens
gaucuacuagugcauauau

SEQ ID NO: 778836 - RNA, 19 nt, Homo sapiens
ggauaucaguacaugacaa

SEQ ID NO: 778837 - RNA, 19 nt, Homo sapiens
cuucaucacuaaagaauuc

SEQ ID NO: 778838 - RNA, 19 nt, Homo sapiens
uaaggcaggucuaugaagu

SEQ ID NO: 778839 - RNA, 19 nt, Homo sapiens
aaauuuggaucuacuagug

SEQ ID NO: 778840 - RNA, 19 nt, Homo sapiens
auauuuagcuugagaaugg

SEQ ID NO: 778841 - RNA, 19 nt, Homo sapiens
aauugcagauugcuaagua

SEQ ID NO: 778842 - RNA, 19 nt, Homo sapiens
ugcaggcugucauuauuua

SEQ ID NO: 778843 - RNA, 19 nt, Homo sapiens
acaaucaacucacaaaggu

SEQ ID NO: 778844 - RNA, 19 nt, Homo sapiens
caaaacaaccugauagaaa

SEQ ID NO: 778845 - RNA, 19 nt, Homo sapiens
cacaaucuguuucaucaug

SEQ ID NO: 778846 - RNA, 19 nt, Homo sapiens
ggaaggcaaggugcuauaa

SEQ ID NO: 778847 - RNA, 19 nt, Homo sapiens
caagaaggcugagguaagc

SEQ ID NO: 778848 - RNA, 19 nt, Homo sapiens
ccacugcauucuuauaagu

SEQ ID NO: 778849 - RNA, 19 nt, Homo sapiens
uuaaacacauucucaccaa

SEQ ID NO: 778850 - RNA, 19 nt, Homo sapiens
gaaacagcagucacuucua

SEQ ID NO: 778851 - RNA, 19 nt, Homo sapiens
uaaacacauucucaccaaa

SEQ ID NO: 778852 - RNA, 19 nt, Homo sapiens
auagaggucucaaagaaau

SEQ ID NO: 778853 - RNA, 19 nt, Homo sapiens
ugucaaaguggaaacaaua

SEQ ID NO: 778854 - RNA, 19 nt, Homo sapiens
ggauaacgaccugaagaaa

SEQ ID NO: 778855 - RNA, 19 nt, Homo sapiens
caagaggauuugauguauc

SEQ ID NO: 778856 - RNA, 19 nt, Homo sapiens
gauauaguccacugcauuc

SEQ ID NO: 778857 - RNA, 19 nt, Homo sapiens
gaggauaacgaccugaaga

SEQ ID NO: 778858 - RNA, 19 nt, Homo sapiens
ucacagccugcauuaauuu

SEQ ID NO: 778859 - RNA, 19 nt, Homo sapiens
agucacuucuaguucauua

SEQ ID NO: 778860 - RNA, 19 nt, Homo sapiens
uaaucaaacaggaggauaa

SEQ ID NO: 778861 - RNA, 19 nt, Homo sapiens
augcagauaccguaauuua

SEQ ID NO: 778862 - RNA, 19 nt, Homo sapiens
agaacgagauuccuucagu

SEQ ID NO: 778863 - RNA, 19 nt, Homo sapiens
ccaagaaugcccugaggaa

SEQ ID NO: 778864 - RNA, 19 nt, Homo sapiens
gaaaauagaggucucaaag

SEQ ID NO: 778865 - RNA, 19 nt, Homo sapiens
cacuuaaacugcaaauugu

SEQ ID NO: 778866 - RNA, 19 nt, Homo sapiens
ugaaaucaaaccaccaauu

SEQ ID NO: 778867 - RNA, 19 nt, Homo sapiens
caucaauucuagaucuuca

SEQ ID NO: 778868 - RNA, 19 nt, Homo sapiens
ucaaagaaauuagcaagcu

SEQ ID NO: 778869 - RNA, 19 nt, Homo sapiens
cuacugcuuuauauuguga

SEQ ID NO: 778870 - RNA, 19 nt, Homo sapiens
aaggcaaggugcuauaaug

SEQ ID NO: 778871 - RNA, 19 nt, Homo sapiens
cugaagcccugucaaagug

SEQ ID NO: 778872 - RNA, 19 nt, Homo sapiens
uacaagcagugaccaauag

SEQ ID NO: 778873 - RNA, 19 nt, Homo sapiens
caagucauauucccauugc

SEQ ID NO: 778874 - RNA, 19 nt, Homo sapiens
ucuggaagauaaugagcua

SEQ ID NO: 778875 - RNA, 19 nt, Homo sapiens
gaaauuccugcuauuccuu

SEQ ID NO: 778876 - RNA, 19 nt, Homo sapiens
gaaggcaaggugcuauaau

SEQ ID NO: 778877 - RNA, 19 nt, Homo sapiens
ggaaauaucucagaaguau

SEQ ID NO: 778878 - RNA, 19 nt, Homo sapiens
gauauggaaugaagacuua

SEQ ID NO: 778879 - RNA, 19 nt, Homo sapiens
gagaagaaguugugaaaga

SEQ ID NO: 778880 - RNA, 19 nt, Homo sapiens
ggaaggccuuugaauguaa

SEQ ID NO: 778881 - RNA, 19 nt, Homo sapiens
ggaauuaggaguauauuug

SEQ ID NO: 778882 - RNA, 19 nt, Homo sapiens
caacagagggaccuuauuu

SEQ ID NO: 778883 - RNA, 19 nt, Homo sapiens
ggacugcccucaacacugu

SEQ ID NO: 778884 - RNA, 19 nt, Homo sapiens
gaacugagagcaauuucaa

SEQ ID NO: 778885 - RNA, 19 nt, Homo sapiens
ggagacaggucaaccaaag

SEQ ID NO: 778886 - RNA, 19 nt, Homo sapiens
ccauaugacugaacacuug

SEQ ID NO: 778887 - RNA, 19 nt, Homo sapiens
gcuguuagguuuuguuuua

SEQ ID NO: 778888 - RNA, 19 nt, Homo sapiens
ucaaacaucugaggcauga

SEQ ID NO: 778889 - RNA, 19 nt, Homo sapiens
gagagaagaaguugugaaa

SEQ ID NO: 778890 - RNA, 19 nt, Homo sapiens
ugcauaagcuguuagguuu

SEQ ID NO: 778891 - RNA, 19 nt, Homo sapiens
ggagauggcaauauuguga

SEQ ID NO: 778892 - RNA, 19 nt, Homo sapiens
caacacacagccaacauuu

SEQ ID NO: 778893 - RNA, 19 nt, Homo sapiens
ucaaaaggcugcugaugua

SEQ ID NO: 778894 - RNA, 19 nt, Homo sapiens
ucugaggcaugauaaauuu

SEQ ID NO: 778895 - RNA, 19 nt, Homo sapiens
ugauguaguucccggguua

SEQ ID NO: 778896 - RNA, 19 nt, Homo sapiens
guuugaagcuuauggaaau

SEQ ID NO: 778897 - RNA, 19 nt, Homo sapiens
gaaugcauguagauuuguu

SEQ ID NO: 778898 - RNA, 19 nt, Homo sapiens
gaaggccuuugaauguaaa

SEQ ID NO: 778899 - RNA, 19 nt, Homo sapiens
cacauacacuuccauaaau

SEQ ID NO: 778900 - RNA, 19 nt, Homo sapiens
acacauacacuuccauaaa

SEQ ID NO: 778901 - RNA, 19 nt, Homo sapiens
aaacagcuuugaacugaga

SEQ ID NO: 778902 - RNA, 19 nt, Homo sapiens
ugaaggaaguaagauguuu

SEQ ID NO: 778903 - RNA, 19 nt, Homo sapiens
guaaugaggaaaugguuaa

SEQ ID NO: 778904 - RNA, 19 nt, Homo sapiens
cagaaaacaugucaacuuu

SEQ ID NO: 778905 - RNA, 19 nt, Homo sapiens
aaacauaagugcugugacu

SEQ ID NO: 778906 - RNA, 19 nt, Homo sapiens
gcagugagucaaauuaguu

SEQ ID NO: 778907 - RNA, 19 nt, Homo sapiens
caucuucccuacccauauu

SEQ ID NO: 778908 - RNA, 19 nt, Homo sapiens
aaacaucugaggcaugaua

SEQ ID NO: 778909 - RNA, 19 nt, Homo sapiens
gaggaaagaaaucuaguau

SEQ ID NO: 778910 - RNA, 19 nt, Homo sapiens
aaauauagguggaauuagg

SEQ ID NO: 778911 - RNA, 19 nt, Homo sapiens
acagagggaccuuauuuaa

SEQ ID NO: 778912 - RNA, 19 nt, Homo sapiens
ggaggcagcugggaaacau

SEQ ID NO: 778913 - RNA, 19 nt, Homo sapiens
gcaauauugugagagaaga

SEQ ID NO: 778914 - RNA, 19 nt, Homo sapiens
agagggaccuuauuuaaac

SEQ ID NO: 778915 - RNA, 19 nt, Homo sapiens
ucgaaugcauguagauuug

SEQ ID NO: 778916 - RNA, 19 nt, Homo sapiens
ugacugaacacuuguaugu

SEQ ID NO: 778917 - RNA, 19 nt, Homo sapiens
cagagggaccuuauuuaaa

SEQ ID NO: 778918 - RNA, 19 nt, Homo sapiens
aaacacauacacuuccaua

SEQ ID NO: 778919 - RNA, 19 nt, Homo sapiens
aaaggcugcugauguaguu

SEQ ID NO: 778920 - RNA, 19 nt, Homo sapiens
gaagaaguugugaaagaga

SEQ ID NO: 778921 - RNA, 19 nt, Homo sapiens
uggaaggccuuugaaugua

SEQ ID NO: 778922 - RNA, 19 nt, Homo sapiens
ggacuguuguacuagaugu

SEQ ID NO: 778923 - RNA, 19 nt, Homo sapiens
uaacguaugccaccucaga

SEQ ID NO: 778924 - RNA, 19 nt, Homo sapiens
ggaaguaagauguuugaag

SEQ ID NO: 778925 - RNA, 19 nt, Homo sapiens
gaaggaaguaagauguuug

SEQ ID NO: 778926 - RNA, 19 nt, Homo sapiens
uaggaaauaucucagaagu

SEQ ID NO: 778927 - RNA, 19 nt, Homo sapiens
gaaaaccccugaaggaagu

SEQ ID NO: 778928 - RNA, 19 nt, Homo sapiens
gggaccuuauuuaaacaua

SEQ ID NO: 778929 - RNA, 19 nt, Homo sapiens
gaagauccaaauugugaug

SEQ ID NO: 778930 - RNA, 19 nt, Homo sapiens
guggaaggccuuugaaugu

SEQ ID NO: 778931 - RNA, 19 nt, Homo sapiens
gauauagcauaaguacaug

SEQ ID NO: 778932 - RNA, 19 nt, Homo sapiens
aaccaagucuuccaacaga

SEQ ID NO: 778933 - RNA, 19 nt, Homo sapiens
cggguuaccuguaucugaa

SEQ ID NO: 778934 - RNA, 19 nt, Homo sapiens
guaaccaagucuuccaaca

SEQ ID NO: 778935 - RNA, 19 nt, Homo sapiens
cuaugacucuauaagguuu

SEQ ID NO: 778936 - RNA, 19 nt, Homo sapiens
ugacagcagugagugcaaa

SEQ ID NO: 778937 - RNA, 19 nt, Homo sapiens
uaacauccauaugacugaa

SEQ ID NO: 778938 - RNA, 19 nt, Homo sapiens
gagcaacagagggaccuua

SEQ ID NO: 778939 - RNA, 19 nt, Homo sapiens
ugaagcuuauggaaauuug

SEQ ID NO: 778940 - RNA, 19 nt, Homo sapiens
gggauggauugcagagaga

SEQ ID NO: 778941 - RNA, 19 nt, Homo sapiens
guaugccaccucagagaua

SEQ ID NO: 778942 - RNA, 19 nt, Homo sapiens
ggauauggaaugaagacuu

SEQ ID NO: 778943 - RNA, 19 nt, Homo sapiens
acacacagccaacauuuua

SEQ ID NO: 778944 - RNA, 19 nt, Homo sapiens
ccgccuggagcaauaauua

SEQ ID NO: 778945 - RNA, 19 nt, Homo sapiens
ggugucagccuucuaaugg

SEQ ID NO: 778946 - RNA, 19 nt, Homo sapiens
uacuagauguucuuaggaa

SEQ ID NO: 778947 - RNA, 19 nt, Homo sapiens
gcagaaaacaugucaacuu

SEQ ID NO: 778948 - RNA, 19 nt, Homo sapiens
gcaacagagggaccuuauu

SEQ ID NO: 778949 - RNA, 19 nt, Homo sapiens
ugaggaaagaaaucuagua

SEQ ID NO: 778950 - RNA, 19 nt, Homo sapiens
guucuuugacuuugaugua

SEQ ID NO: 778951 - RNA, 19 nt, Homo sapiens
aagaaguugugaaagagaa

SEQ ID NO: 778952 - RNA, 19 nt, Homo sapiens
gcugugacuucggugaauu

SEQ ID NO: 778953 - RNA, 19 nt, Homo sapiens
gagggaccuuauuuaaaca

SEQ ID NO: 778954 - RNA, 19 nt, Homo sapiens
ugaggugucagccuucuaa

SEQ ID NO: 778955 - RNA, 19 nt, Homo sapiens
gggugggagugggaaauaa

SEQ ID NO: 778956 - RNA, 19 nt, Homo sapiens
gaaauuccccuucuuccaa

SEQ ID NO: 778957 - RNA, 19 nt, Homo sapiens
cuuaggaaauaucucagaa

SEQ ID NO: 778958 - RNA, 19 nt, Homo sapiens
guugggauauggaaugaag

SEQ ID NO: 778959 - RNA, 19 nt, Homo sapiens
uugaagauccaaauuguga

SEQ ID NO: 778960 - RNA, 19 nt, Homo sapiens
gcugaucccggcugugauu

SEQ ID NO: 778961 - RNA, 19 nt, Homo sapiens
ccaagucuuccaacagauu

SEQ ID NO: 778962 - RNA, 19 nt, Homo sapiens
ggugaagaguuugguaucu

SEQ ID NO: 778963 - RNA, 19 nt, Homo sapiens
cuuaagagcaggagaagau

SEQ ID NO: 778964 - RNA, 19 nt, Homo sapiens
uaugccaccucagagauaa

SEQ ID NO: 778965 - RNA, 19 nt, Homo sapiens
acacuuccauaaauagcuu

SEQ ID NO: 778966 - RNA, 19 nt, Homo sapiens
gcuuugaacugagagcaau

SEQ ID NO: 778967 - RNA, 19 nt, Homo sapiens
gugaagaguuugguaucug

SEQ ID NO: 778968 - RNA, 19 nt, Homo sapiens
agaagaaguugugaaagag

SEQ ID NO: 778969 - RNA, 19 nt, Homo sapiens
caagucuuccaacagauuu

SEQ ID NO: 778970 - RNA, 19 nt, Homo sapiens
uaaauguguuagugcaagu

SEQ ID NO: 778971 - RNA, 19 nt, Homo sapiens
gcuuauggaaauuugagua

SEQ ID NO: 778972 - RNA, 19 nt, Homo sapiens
ggugggagugggaaauaaa

SEQ ID NO: 778973 - RNA, 19 nt, Homo sapiens
aaagagggagcuaggcaaa

SEQ ID NO: 778974 - RNA, 19 nt, Homo sapiens
gguggaauuaggaguauau

SEQ ID NO: 778975 - RNA, 19 nt, Homo sapiens
aacagagggaccuuauuua

SEQ ID NO: 778976 - RNA, 19 nt, Homo sapiens
cguaaugaggaaaugguua

SEQ ID NO: 778977 - RNA, 19 nt, Homo sapiens
gggaacagccucuagauaa

SEQ ID NO: 778978 - RNA, 19 nt, Homo sapiens
ggaacagccucuagauaau

SEQ ID NO: 778979 - RNA, 19 nt, Homo sapiens
guaaagaacagaagccaaa

SEQ ID NO: 778980 - RNA, 19 nt, Homo sapiens
gaccgaagccugaauguga

SEQ ID NO: 778981 - RNA, 19 nt, Homo sapiens
gcaaugaggaggcaccuaa

SEQ ID NO: 778982 - RNA, 19 nt, Homo sapiens
ccucgucucuugaauguuu

SEQ ID NO: 778983 - RNA, 19 nt, Homo sapiens
gaacaggagcccacugaga

SEQ ID NO: 778984 - RNA, 19 nt, Homo sapiens
cgaccagccucuucugaaa

SEQ ID NO: 778985 - RNA, 19 nt, Homo sapiens
gcgagccgaugaccaauga

SEQ ID NO: 778986 - RNA, 19 nt, Homo sapiens
ugagaaagcugcaaaucca

SEQ ID NO: 778987 - RNA, 19 nt, Homo sapiens
caacaacagguuuaugauu

SEQ ID NO: 778988 - RNA, 19 nt, Homo sapiens
gagcagguauggacgacaa

SEQ ID NO: 778989 - RNA, 19 nt, Homo sapiens
cgccgucacuguuguauaa

SEQ ID NO: 778990 - RNA, 19 nt, Homo sapiens
gaaaauacgaagccuguua

SEQ ID NO: 778991 - RNA, 19 nt, Homo sapiens
guguuaagcugaucacaga

SEQ ID NO: 778992 - RNA, 19 nt, Homo sapiens
gcgauggccugaccuugaa

SEQ ID NO: 778993 - RNA, 19 nt, Homo sapiens
gauaaaggguagaauugag

SEQ ID NO: 778994 - RNA, 19 nt, Homo sapiens
caagagaccagcuccagaa

SEQ ID NO: 778995 - RNA, 19 nt, Homo sapiens
gaugacaccuccgauagug

SEQ ID NO: 778996 - RNA, 19 nt, Homo sapiens
gcaagaagaaacucaagau

SEQ ID NO: 778997 - RNA, 19 nt, Homo sapiens
ugaggagccuggagacuug

SEQ ID NO: 778998 - RNA, 19 nt, Homo sapiens
gagcaguuccugaccauug

SEQ ID NO: 778999 - RNA, 19 nt, Homo sapiens
gggcgagcgaucacaauua

SEQ ID NO: 779000 - RNA, 19 nt, Homo sapiens
ggauaaaggguagaauuga

SEQ ID NO: 779001 - RNA, 19 nt, Homo sapiens
gggauaaaggguagaauug

SEQ ID NO: 779002 - RNA, 19 nt, Homo sapiens
gacuauaucugcccaaacu

SEQ ID NO: 779003 - RNA, 19 nt, Homo sapiens
gaguugcagcuuuguguua

SEQ ID NO: 779004 - RNA, 19 nt, Homo sapiens
gaucuuccagccugugaua

SEQ ID NO: 779005 - RNA, 19 nt, Homo sapiens
gugggaaucuuugcaaguu

SEQ ID NO: 779006 - RNA, 19 nt, Homo sapiens
uagcgaagaccaagggaua

SEQ ID NO: 779007 - RNA, 19 nt, Homo sapiens
cagcaaagaguucaggaaa

SEQ ID NO: 779008 - RNA, 19 nt, Homo sapiens
gauaaucugaguuguugaa

SEQ ID NO: 779009 - RNA, 19 nt, Homo sapiens
aaacagaucuuugaaaccu

SEQ ID NO: 779010 - RNA, 19 nt, Homo sapiens
gaacuucgaaggccacaca

SEQ ID NO: 779011 - RNA, 19 nt, Homo sapiens
gaauugagaaagcugcaaa

SEQ ID NO: 779012 - RNA, 19 nt, Homo sapiens
guacaaguauaggaacaau

SEQ ID NO: 779013 - RNA, 19 nt, Homo sapiens
agaguaaguuggagggaaa

SEQ ID NO: 779014 - RNA, 19 nt, Homo sapiens
ugacagagagaguaaguug

SEQ ID NO: 779015 - RNA, 19 nt, Homo sapiens
ggacuuccugucacuguuu

SEQ ID NO: 779016 - RNA, 19 nt, Homo sapiens
acaacagguuuaugauuug

SEQ ID NO: 779017 - RNA, 19 nt, Homo sapiens
gcacaugaaagcaucacuu

SEQ ID NO: 779018 - RNA, 19 nt, Homo sapiens
cacaacaacagguuuauga

SEQ ID NO: 779019 - RNA, 19 nt, Homo sapiens
caucaaacccaccagcaaa

SEQ ID NO: 779020 - RNA, 19 nt, Homo sapiens
uguccaagcuuucaguguu

SEQ ID NO: 779021 - RNA, 19 nt, Homo sapiens
gaacagccucuagauaauc

SEQ ID NO: 779022 - RNA, 19 nt, Homo sapiens
ggacuugguauucuacaug

SEQ ID NO: 779023 - RNA, 19 nt, Homo sapiens
caugaaagcaucacuucuu

SEQ ID NO: 779024 - RNA, 19 nt, Homo sapiens
cagaucagcaggaagcuaa

SEQ ID NO: 779025 - RNA, 19 nt, Homo sapiens
gaaaggcggcucaggacau

SEQ ID NO: 779026 - RNA, 19 nt, Homo sapiens
gggaaucuuugcaaguuag

SEQ ID NO: 779027 - RNA, 19 nt, Homo sapiens
uaaugacuguauccucaaa

SEQ ID NO: 779028 - RNA, 19 nt, Homo sapiens
gaacaguggcugacaacag

SEQ ID NO: 779029 - RNA, 19 nt, Homo sapiens
gcccucgucucuugaaugu

SEQ ID NO: 779030 - RNA, 19 nt, Homo sapiens
gaagccaaagccuaaagaa

SEQ ID NO: 779031 - RNA, 19 nt, Homo sapiens
gaacguucaccuuaaugau

SEQ ID NO: 779032 - RNA, 19 nt, Homo sapiens
acaaugaaguuucuaagcu

SEQ ID NO: 779033 - RNA, 19 nt, Homo sapiens
gaacaauagagcagaaguc

SEQ ID NO: 779034 - RNA, 19 nt, Homo sapiens
guggaaagcgcuucugaga

SEQ ID NO: 779035 - RNA, 19 nt, Homo sapiens
gaucauauccugccccaaa

SEQ ID NO: 779036 - RNA, 19 nt, Homo sapiens
acacccacaugaacacauu

SEQ ID NO: 779037 - RNA, 19 nt, Homo sapiens
gugaagcacucgggaagga

SEQ ID NO: 779038 - RNA, 19 nt, Homo sapiens
gaagaugaagccagagaag

SEQ ID NO: 779039 - RNA, 19 nt, Homo sapiens
aaccucagcuuccguacuu

SEQ ID NO: 779040 - RNA, 19 nt, Homo sapiens
cacaugaguuguucugaca

SEQ ID NO: 779041 - RNA, 19 nt, Homo sapiens
gacaccggcugcaccauca

SEQ ID NO: 779042 - RNA, 19 nt, Homo sapiens
gcaccgauuguacaaguau

SEQ ID NO: 779043 - RNA, 19 nt, Homo sapiens
gggaacaggagcccacuga

SEQ ID NO: 779044 - RNA, 19 nt, Homo sapiens
ugggaaucuuugcaaguua

SEQ ID NO: 779045 - RNA, 19 nt, Homo sapiens
gaaagaugacagagagagu

SEQ ID NO: 779046 - RNA, 19 nt, Homo sapiens
ccacaugaacacauucgaa

SEQ ID NO: 779047 - RNA, 19 nt, Homo sapiens
guaaguauucguauucucu

SEQ ID NO: 779048 - RNA, 19 nt, Homo sapiens
gcucugguaaguauucgua

SEQ ID NO: 779049 - RNA, 19 nt, Homo sapiens
ccucacaacaacagguuua

SEQ ID NO: 779050 - RNA, 19 nt, Homo sapiens
cagagucgccugcggaaga

SEQ ID NO: 779051 - RNA, 19 nt, Homo sapiens
ggcgagcgaucacaauuac

SEQ ID NO: 779052 - RNA, 19 nt, Homo sapiens
uuucuaagcucagguaaag

SEQ ID NO: 779053 - RNA, 19 nt, Homo sapiens
gcaaauccaaguggcaaga

SEQ ID NO: 779054 - RNA, 19 nt, Homo sapiens
acaaguauaggaacaauag

SEQ ID NO: 779055 - RNA, 19 nt, Homo sapiens
gcugauggcaccgauugua

SEQ ID NO: 779056 - RNA, 19 nt, Homo sapiens
guccaagcuuucaguguug

SEQ ID NO: 779057 - RNA, 19 nt, Homo sapiens
acacacuccugcuucauag

SEQ ID NO: 779058 - RNA, 19 nt, Homo sapiens
guccaucccuagucuguca

SEQ ID NO: 779059 - RNA, 19 nt, Homo sapiens
gacugggaguugcagcuuu

SEQ ID NO: 779060 - RNA, 19 nt, Homo sapiens
ccaacgcccuguauugcau

SEQ ID NO: 779061 - RNA, 19 nt, Homo sapiens
aaagaugacagagagagua

SEQ ID NO: 779062 - RNA, 19 nt, Homo sapiens
gcaaagaguucaggaaaac

SEQ ID NO: 779063 - RNA, 19 nt, Homo sapiens
gacuugguauucuacaugu

SEQ ID NO: 779064 - RNA, 19 nt, Homo sapiens
ucaccuuaaugauugauuc

SEQ ID NO: 779065 - RNA, 19 nt, Homo sapiens
cgucacuguuguauaaaug

SEQ ID NO: 779066 - RNA, 19 nt, Homo sapiens
ucacaauuacaaugcagua

SEQ ID NO: 779067 - RNA, 19 nt, Homo sapiens
cagcgacaaugaaguuucu

SEQ ID NO: 779068 - RNA, 19 nt, Homo sapiens
gcgaagaccaagggauaaa

SEQ ID NO: 779069 - RNA, 19 nt, Homo sapiens
uaggaacaauagagcagaa

SEQ ID NO: 779070 - RNA, 19 nt, Homo sapiens
guaagcaggagcccgagaa

SEQ ID NO: 779071 - RNA, 19 nt, Homo sapiens
cacacacuccugcuucaua

SEQ ID NO: 779072 - RNA, 19 nt, Homo sapiens
aacagaagccaaagccuaa

SEQ ID NO: 779073 - RNA, 19 nt, Homo sapiens
ucuaagcucagguaaagaa

SEQ ID NO: 779074 - RNA, 19 nt, Homo sapiens
gcgacaaugaaguuucuaa

SEQ ID NO: 779075 - RNA, 19 nt, Homo sapiens
caagaagaaacucaagauc

SEQ ID NO: 779076 - RNA, 19 nt, Homo sapiens
gauuguacaaguauaggaa

SEQ ID NO: 779077 - RNA, 19 nt, Homo sapiens
gggaacagccucuagauaa

SEQ ID NO: 779078 - RNA, 19 nt, Homo sapiens
ggaacagccucuagauaau

SEQ ID NO: 779079 - RNA, 19 nt, Homo sapiens
guaaagaacagaagccaaa

SEQ ID NO: 779080 - RNA, 19 nt, Homo sapiens
gaccgaagccugaauguga

SEQ ID NO: 779081 - RNA, 19 nt, Homo sapiens
gcaaugaggaggcaccuaa

SEQ ID NO: 779082 - RNA, 19 nt, Homo sapiens
ccucgucucuugaauguuu

SEQ ID NO: 779083 - RNA, 19 nt, Homo sapiens
gaacaggagcccacugaga

SEQ ID NO: 779084 - RNA, 19 nt, Homo sapiens
cgaccagccucuucugaaa

SEQ ID NO: 779085 - RNA, 19 nt, Homo sapiens
ugagaaagcugcaaaucca

SEQ ID NO: 779086 - RNA, 19 nt, Homo sapiens
caacaacagguuuaugauu

SEQ ID NO: 779087 - RNA, 19 nt, Homo sapiens
gagcagguauggacgacaa

SEQ ID NO: 779088 - RNA, 19 nt, Homo sapiens
cgccgucacuguuguauaa

SEQ ID NO: 779089 - RNA, 19 nt, Homo sapiens
gaaaauacgaagccuguua

SEQ ID NO: 779090 - RNA, 19 nt, Homo sapiens
guguuaagcugaucacaga

SEQ ID NO: 779091 - RNA, 19 nt, Homo sapiens
gcgauggccugaccuugaa

SEQ ID NO: 779092 - RNA, 19 nt, Homo sapiens
gauaaaggguagaauugag

SEQ ID NO: 779093 - RNA, 19 nt, Homo sapiens
caagagaccagcuccagaa

SEQ ID NO: 779094 - RNA, 19 nt, Homo sapiens
gaugacaccuccgauagug

SEQ ID NO: 779095 - RNA, 19 nt, Homo sapiens
gcaagaagaaacucaagau

SEQ ID NO: 779096 - RNA, 19 nt, Homo sapiens
ugaggagccuggagacuug

SEQ ID NO: 779097 - RNA, 19 nt, Homo sapiens
gagcaguuccugaccauug

SEQ ID NO: 779098 - RNA, 19 nt, Homo sapiens
gggcgagcgaucacaauua

SEQ ID NO: 779099 - RNA, 19 nt, Homo sapiens
ggauaaaggguagaauuga

SEQ ID NO: 779100 - RNA, 19 nt, Homo sapiens
gggauaaaggguagaauug

SEQ ID NO: 779101 - RNA, 19 nt, Homo sapiens
gacuauaucugcccaaacu

SEQ ID NO: 779102 - RNA, 19 nt, Homo sapiens
gaguugcagcuuuguguua

SEQ ID NO: 779103 - RNA, 19 nt, Homo sapiens
gaucuuccagccugugaua

SEQ ID NO: 779104 - RNA, 19 nt, Homo sapiens
gugggaaucuuugcaaguu

SEQ ID NO: 779105 - RNA, 19 nt, Homo sapiens
gauaaucugaguuguugaa

SEQ ID NO: 779106 - RNA, 19 nt, Homo sapiens
uagcgaagaccaagggaua

SEQ ID NO: 779107 - RNA, 19 nt, Homo sapiens
cagcaaagaguucaggaaa

SEQ ID NO: 779108 - RNA, 19 nt, Homo sapiens
aaacagaucuuugaaaccu

SEQ ID NO: 779109 - RNA, 19 nt, Homo sapiens
gaacuucgaaggccacaca

SEQ ID NO: 779110 - RNA, 19 nt, Homo sapiens
gaauugagaaagcugcaaa

SEQ ID NO: 779111 - RNA, 19 nt, Homo sapiens
guacaaguauaggaacaau

SEQ ID NO: 779112 - RNA, 19 nt, Homo sapiens
agaguaaguuggagggaaa

SEQ ID NO: 779113 - RNA, 19 nt, Homo sapiens
ugacagagagaguaaguug

SEQ ID NO: 779114 - RNA, 19 nt, Homo sapiens
ggacuuccugucacuguuu

SEQ ID NO: 779115 - RNA, 19 nt, Homo sapiens
acaacagguuuaugauuug

SEQ ID NO: 779116 - RNA, 19 nt, Homo sapiens
gcacaugaaagcaucacuu

SEQ ID NO: 779117 - RNA, 19 nt, Homo sapiens
gaacagccucuagauaauc

SEQ ID NO: 779118 - RNA, 19 nt, Homo sapiens
cacaacaacagguuuauga

SEQ ID NO: 779119 - RNA, 19 nt, Homo sapiens
caucaaacccaccagcaaa

SEQ ID NO: 779120 - RNA, 19 nt, Homo sapiens
uguccaagcuuucaguguu

SEQ ID NO: 779121 - RNA, 19 nt, Homo sapiens
ggacuugguauucuacaug

SEQ ID NO: 779122 - RNA, 19 nt, Homo sapiens
caugaaagcaucacuucuu

SEQ ID NO: 779123 - RNA, 19 nt, Homo sapiens
cagaucagcaggaagcuaa

SEQ ID NO: 779124 - RNA, 19 nt, Homo sapiens
gaaaggcggcucaggacau

SEQ ID NO: 779125 - RNA, 19 nt, Homo sapiens
gggaaucuuugcaaguuag

SEQ ID NO: 779126 - RNA, 19 nt, Homo sapiens
uaaugacuguauccucaaa

SEQ ID NO: 779127 - RNA, 19 nt, Homo sapiens
gaacaguggcugacaacag

SEQ ID NO: 779128 - RNA, 19 nt, Homo sapiens
gcccucgucucuugaaugu

SEQ ID NO: 779129 - RNA, 19 nt, Homo sapiens
gaagccaaagccuaaagaa

SEQ ID NO: 779130 - RNA, 19 nt, Homo sapiens
gaacguucaccuuaaugau

SEQ ID NO: 779131 - RNA, 19 nt, Homo sapiens
acaaugaaguuucuaagcu

SEQ ID NO: 779132 - RNA, 19 nt, Homo sapiens
gaacaauagagcagaaguc

SEQ ID NO: 779133 - RNA, 19 nt, Homo sapiens
guggaaagcgcuucugaga

SEQ ID NO: 779134 - RNA, 19 nt, Homo sapiens
gaucauauccugccccaaa

SEQ ID NO: 779135 - RNA, 19 nt, Homo sapiens
acacccacaugaacacauu

SEQ ID NO: 779136 - RNA, 19 nt, Homo sapiens
gugaagcacucgggaagga

SEQ ID NO: 779137 - RNA, 19 nt, Homo sapiens
gaagaugaagccagagaag

SEQ ID NO: 779138 - RNA, 19 nt, Homo sapiens
cacaugaguuguucugaca

SEQ ID NO: 779139 - RNA, 19 nt, Homo sapiens
gacaccggcugcaccauca

SEQ ID NO: 779140 - RNA, 19 nt, Homo sapiens
gcaccgauuguacaaguau

SEQ ID NO: 779141 - RNA, 19 nt, Homo sapiens
gggaacaggagcccacuga

SEQ ID NO: 779142 - RNA, 19 nt, Homo sapiens
ugggaaucuuugcaaguua

SEQ ID NO: 779143 - RNA, 19 nt, Homo sapiens
gaaagaugacagagagagu

SEQ ID NO: 779144 - RNA, 19 nt, Homo sapiens
ccacaugaacacauucgaa

SEQ ID NO: 779145 - RNA, 19 nt, Homo sapiens
guaaguauucguauucucu

SEQ ID NO: 779146 - RNA, 19 nt, Homo sapiens
gcucugguaaguauucgua

SEQ ID NO: 779147 - RNA, 19 nt, Homo sapiens
ccucacaacaacagguuua

SEQ ID NO: 779148 - RNA, 19 nt, Homo sapiens
cagagucgccugcggaaga

SEQ ID NO: 779149 - RNA, 19 nt, Homo sapiens
guccaagcuuucaguguug

SEQ ID NO: 779150 - RNA, 19 nt, Homo sapiens
ggcgagcgaucacaauuac

SEQ ID NO: 779151 - RNA, 19 nt, Homo sapiens
uuucuaagcucagguaaag

SEQ ID NO: 779152 - RNA, 19 nt, Homo sapiens
gcaaauccaaguggcaaga

SEQ ID NO: 779153 - RNA, 19 nt, Homo sapiens
acaaguauaggaacaauag

SEQ ID NO: 779154 - RNA, 19 nt, Homo sapiens
gcugauggcaccgauugua

SEQ ID NO: 779155 - RNA, 19 nt, Homo sapiens
acacacuccugcuucauag

SEQ ID NO: 779156 - RNA, 19 nt, Homo sapiens
guccaucccuagucuguca

SEQ ID NO: 779157 - RNA, 19 nt, Homo sapiens
gacugggaguugcagcuuu

SEQ ID NO: 779158 - RNA, 19 nt, Homo sapiens
ccaacgcccuguauugcau

SEQ ID NO: 779159 - RNA, 19 nt, Homo sapiens
aaagaugacagagagagua

SEQ ID NO: 779160 - RNA, 19 nt, Homo sapiens
gcaaagaguucaggaaaac

SEQ ID NO: 779161 - RNA, 19 nt, Homo sapiens
gacuugguauucuacaugu

SEQ ID NO: 779162 - RNA, 19 nt, Homo sapiens
ucaccuuaaugauugauuc

SEQ ID NO: 779163 - RNA, 19 nt, Homo sapiens
cgucacuguuguauaaaug

SEQ ID NO: 779164 - RNA, 19 nt, Homo sapiens
ucacaauuacaaugcagua

SEQ ID NO: 779165 - RNA, 19 nt, Homo sapiens
cagcgacaaugaaguuucu

SEQ ID NO: 779166 - RNA, 19 nt, Homo sapiens
gcgaagaccaagggauaaa

SEQ ID NO: 779167 - RNA, 19 nt, Homo sapiens
uaggaacaauagagcagaa

SEQ ID NO: 779168 - RNA, 19 nt, Homo sapiens
guaagcaggagcccgagaa

SEQ ID NO: 779169 - RNA, 19 nt, Homo sapiens
cacacacuccugcuucaua

SEQ ID NO: 779170 - RNA, 19 nt, Homo sapiens
aacagaagccaaagccuaa

SEQ ID NO: 779171 - RNA, 19 nt, Homo sapiens
ucuaagcucagguaaagaa

SEQ ID NO: 779172 - RNA, 19 nt, Homo sapiens
gcgacaaugaaguuucuaa

SEQ ID NO: 779173 - RNA, 19 nt, Homo sapiens
caagaagaaacucaagauc

SEQ ID NO: 779174 - RNA, 19 nt, Homo sapiens
gauuguacaaguauaggaa

SEQ ID NO: 779175 - RNA, 19 nt, Homo sapiens
gcgauugugugggcauuuc

SEQ ID NO: 779176 - RNA, 19 nt, Homo sapiens
caugaacacauucgaacuu

SEQ ID NO: 779177 - RNA, 19 nt, Homo sapiens
uaaaugcucugguaaguau

SEQ ID NO: 779178 - RNA, 19 nt, Homo sapiens
gggaacagccucuagauaa

SEQ ID NO: 779179 - RNA, 19 nt, Homo sapiens
ggaacagccucuagauaau

SEQ ID NO: 779180 - RNA, 19 nt, Homo sapiens
guaaagaacagaagccaaa

SEQ ID NO: 779181 - RNA, 19 nt, Homo sapiens
gaccgaagccugaauguga

SEQ ID NO: 779182 - RNA, 19 nt, Homo sapiens
gcaaugaggaggcaccuaa

SEQ ID NO: 779183 - RNA, 19 nt, Homo sapiens
ccucgucucuugaauguuu

SEQ ID NO: 779184 - RNA, 19 nt, Homo sapiens
gaacaggagcccacugaga

SEQ ID NO: 779185 - RNA, 19 nt, Homo sapiens
cgaccagccucuucugaaa

SEQ ID NO: 779186 - RNA, 19 nt, Homo sapiens
ugagaaagcugcaaaucca

SEQ ID NO: 779187 - RNA, 19 nt, Homo sapiens
caacaacagguuuaugauu

SEQ ID NO: 779188 - RNA, 19 nt, Homo sapiens
gagcagguauggacgacaa

SEQ ID NO: 779189 - RNA, 19 nt, Homo sapiens
cgccgucacuguuguauaa

SEQ ID NO: 779190 - RNA, 19 nt, Homo sapiens
gaaaauacgaagccuguua

SEQ ID NO: 779191 - RNA, 19 nt, Homo sapiens
gcgauggccugaccuugaa

SEQ ID NO: 779192 - RNA, 19 nt, Homo sapiens
gauaaaggguagaauugag

SEQ ID NO: 779193 - RNA, 19 nt, Homo sapiens
caagagaccagcuccagaa

SEQ ID NO: 779194 - RNA, 19 nt, Homo sapiens
gaugacaccuccgauagug

SEQ ID NO: 779195 - RNA, 19 nt, Homo sapiens
gcaagaagaaacucaagau

SEQ ID NO: 779196 - RNA, 19 nt, Homo sapiens
ugaggagccuggagacuug

SEQ ID NO: 779197 - RNA, 19 nt, Homo sapiens
gagcaguuccugaccauug

SEQ ID NO: 779198 - RNA, 19 nt, Homo sapiens
gggcgagcgaucacaauua

SEQ ID NO: 779199 - RNA, 19 nt, Homo sapiens
ggauaaaggguagaauuga

SEQ ID NO: 779200 - RNA, 19 nt, Homo sapiens
gggauaaaggguagaauug

SEQ ID NO: 779201 - RNA, 19 nt, Homo sapiens
gacuauaucugcccaaacu

SEQ ID NO: 779202 - RNA, 19 nt, Homo sapiens
gaucuuccagccugugaua

SEQ ID NO: 779203 - RNA, 19 nt, Homo sapiens
gugggaaucuuugcaaguu

SEQ ID NO: 779204 - RNA, 19 nt, Homo sapiens
uagcgaagaccaagggaua

SEQ ID NO: 779205 - RNA, 19 nt, Homo sapiens
gauaaucugaguuguugaa

SEQ ID NO: 779206 - RNA, 19 nt, Homo sapiens
cagcaaagaguucaggaaa

SEQ ID NO: 779207 - RNA, 19 nt, Homo sapiens
aaacagaucuuugaaaccu

SEQ ID NO: 779208 - RNA, 19 nt, Homo sapiens
gaacuucgaaggccacaca

SEQ ID NO: 779209 - RNA, 19 nt, Homo sapiens
gaauugagaaagcugcaaa

SEQ ID NO: 779210 - RNA, 19 nt, Homo sapiens
guacaaguauaggaacaau

SEQ ID NO: 779211 - RNA, 19 nt, Homo sapiens
agaguaaguuggagggaaa

SEQ ID NO: 779212 - RNA, 19 nt, Homo sapiens
ugacagagagaguaaguug

SEQ ID NO: 779213 - RNA, 19 nt, Homo sapiens
acaacagguuuaugauuug

SEQ ID NO: 779214 - RNA, 19 nt, Homo sapiens
gcacaugaaagcaucacuu

SEQ ID NO: 779215 - RNA, 19 nt, Homo sapiens
gaacagccucuagauaauc

SEQ ID NO: 779216 - RNA, 19 nt, Homo sapiens
cacaacaacagguuuauga

SEQ ID NO: 779217 - RNA, 19 nt, Homo sapiens
caucaaacccaccagcaaa

SEQ ID NO: 779218 - RNA, 19 nt, Homo sapiens
uguccaagcuuucaguguu

SEQ ID NO: 779219 - RNA, 19 nt, Homo sapiens
ggacuugguauucuacaug

SEQ ID NO: 779220 - RNA, 19 nt, Homo sapiens
caugaaagcaucacuucuu

SEQ ID NO: 779221 - RNA, 19 nt, Homo sapiens
uauaaaugcucugguaagu

SEQ ID NO: 779222 - RNA, 19 nt, Homo sapiens
cagaucagcaggaagcuaa

SEQ ID NO: 779223 - RNA, 19 nt, Homo sapiens
gaaaggcggcucaggacau

SEQ ID NO: 779224 - RNA, 19 nt, Homo sapiens
gggaaucuuugcaaguuag

SEQ ID NO: 779225 - RNA, 19 nt, Homo sapiens
gaacaguggcugacaacag

SEQ ID NO: 779226 - RNA, 19 nt, Homo sapiens
uaaugacuguauccucaaa

SEQ ID NO: 779227 - RNA, 19 nt, Homo sapiens
gcccucgucucuugaaugu

SEQ ID NO: 779228 - RNA, 19 nt, Homo sapiens
gaagccaaagccuaaagaa

SEQ ID NO: 779229 - RNA, 19 nt, Homo sapiens
acaaugaaguuucuaagcu

SEQ ID NO: 779230 - RNA, 19 nt, Homo sapiens
gaacaauagagcagaaguc

SEQ ID NO: 779231 - RNA, 19 nt, Homo sapiens
guggaaagcgcuucugaga

SEQ ID NO: 779232 - RNA, 19 nt, Homo sapiens
gaucauauccugccccaaa

SEQ ID NO: 779233 - RNA, 19 nt, Homo sapiens
acacccacaugaacacauu

SEQ ID NO: 779234 - RNA, 19 nt, Homo sapiens
gugaagcacucgggaagga

SEQ ID NO: 779235 - RNA, 19 nt, Homo sapiens
gaagaugaagccagagaag

SEQ ID NO: 779236 - RNA, 19 nt, Homo sapiens
cacaugaguuguucugaca

SEQ ID NO: 779237 - RNA, 19 nt, Homo sapiens
gcaccgauuguacaaguau

SEQ ID NO: 779238 - RNA, 19 nt, Homo sapiens
gggaacaggagcccacuga

SEQ ID NO: 779239 - RNA, 19 nt, Homo sapiens
ugggaaucuuugcaaguua

SEQ ID NO: 779240 - RNA, 19 nt, Homo sapiens
uuguauaaaugcucuggua

SEQ ID NO: 779241 - RNA, 19 nt, Homo sapiens
gaaagaugacagagagagu

SEQ ID NO: 779242 - RNA, 19 nt, Homo sapiens
ccacaugaacacauucgaa

SEQ ID NO: 779243 - RNA, 19 nt, Homo sapiens
guaaguauucguauucucu

SEQ ID NO: 779244 - RNA, 19 nt, Homo sapiens
gcucugguaaguauucgua

SEQ ID NO: 779245 - RNA, 19 nt, Homo sapiens
ccucacaacaacagguuua

SEQ ID NO: 779246 - RNA, 19 nt, Homo sapiens
cagagucgccugcggaaga

SEQ ID NO: 779247 - RNA, 19 nt, Homo sapiens
ggcgagcgaucacaauuac

SEQ ID NO: 779248 - RNA, 19 nt, Homo sapiens
uuucuaagcucagguaaag

SEQ ID NO: 779249 - RNA, 19 nt, Homo sapiens
gcaaauccaaguggcaaga

SEQ ID NO: 779250 - RNA, 19 nt, Homo sapiens
acaaguauaggaacaauag

SEQ ID NO: 779251 - RNA, 19 nt, Homo sapiens
gcugauggcaccgauugua

SEQ ID NO: 779252 - RNA, 19 nt, Homo sapiens
guccaagcuuucaguguug

SEQ ID NO: 779253 - RNA, 19 nt, Homo sapiens
acacacuccugcuucauag

SEQ ID NO: 779254 - RNA, 19 nt, Homo sapiens
ccaacgcccuguauugcau

SEQ ID NO: 779255 - RNA, 19 nt, Homo sapiens
aaagaugacagagagagua

SEQ ID NO: 779256 - RNA, 19 nt, Homo sapiens
gcaaagaguucaggaaaac

SEQ ID NO: 779257 - RNA, 19 nt, Homo sapiens
gacuugguauucuacaugu

SEQ ID NO: 779258 - RNA, 19 nt, Homo sapiens
cgucacuguuguauaaaug

SEQ ID NO: 779259 - RNA, 19 nt, Homo sapiens
ucacaauuacaaugcagua

SEQ ID NO: 779260 - RNA, 19 nt, Homo sapiens
cagcgacaaugaaguuucu

SEQ ID NO: 779261 - RNA, 19 nt, Homo sapiens
gcgaagaccaagggauaaa

SEQ ID NO: 779262 - RNA, 19 nt, Homo sapiens
uaggaacaauagagcagaa

SEQ ID NO: 779263 - RNA, 19 nt, Homo sapiens
guaagcaggagcccgagaa

SEQ ID NO: 779264 - RNA, 19 nt, Homo sapiens
cacacacuccugcuucaua

SEQ ID NO: 779265 - RNA, 19 nt, Homo sapiens
aacagaagccaaagccuaa

SEQ ID NO: 779266 - RNA, 19 nt, Homo sapiens
ucuaagcucagguaaagaa

SEQ ID NO: 779267 - RNA, 19 nt, Homo sapiens
gcgacaaugaaguuucuaa

SEQ ID NO: 779268 - RNA, 19 nt, Homo sapiens
caagaagaaacucaagauc

SEQ ID NO: 779269 - RNA, 19 nt, Homo sapiens
gauuguacaaguauaggaa

SEQ ID NO: 779270 - RNA, 19 nt, Homo sapiens
gcgauugugugggcauuuc

SEQ ID NO: 779271 - RNA, 19 nt, Homo sapiens
caugaacacauucgaacuu

SEQ ID NO: 779272 - RNA, 19 nt, Homo sapiens
cgagcgaucacaauuacaa

SEQ ID NO: 779273 - RNA, 19 nt, Homo sapiens
aaagagaccacagugaaga

SEQ ID NO: 779274 - RNA, 19 nt, Homo sapiens
cgggaacagccucuagaua

SEQ ID NO: 779275 - RNA, 19 nt, Homo sapiens
gcuguauacgcuucaguuu

SEQ ID NO: 779276 - RNA, 19 nt, Homo sapiens
aacaguggcugacaacagu

SEQ ID NO: 779277 - RNA, 19 nt, Homo sapiens
gaacaauacugccaaugua

SEQ ID NO: 779278 - RNA, 19 nt, Homo sapiens
ggagcaacaugucuaaaua

SEQ ID NO: 779279 - RNA, 19 nt, Homo sapiens
ggacuuugcugucaugauu

SEQ ID NO: 779280 - RNA, 19 nt, Homo sapiens
gcgauucccucgucaauuu

SEQ ID NO: 779281 - RNA, 19 nt, Homo sapiens
uaagagauguggaaacaaa

SEQ ID NO: 779282 - RNA, 19 nt, Homo sapiens
gaacaacaaucuuucucaa

SEQ ID NO: 779283 - RNA, 19 nt, Homo sapiens
gagcauacgacuauaauuu

SEQ ID NO: 779284 - RNA, 19 nt, Homo sapiens
cuuaaaggcucuugaagua

SEQ ID NO: 779285 - RNA, 19 nt, Homo sapiens
ggaagaaucugaagcaaaa

SEQ ID NO: 779286 - RNA, 19 nt, Homo sapiens
caaaugacguuuauaagca

SEQ ID NO: 779287 - RNA, 19 nt, Homo sapiens
gaaucagguuuguggcuua

SEQ ID NO: 779288 - RNA, 19 nt, Homo sapiens
ggaagaaucuaaagcaaac

SEQ ID NO: 779289 - RNA, 19 nt, Homo sapiens
gcacuggguuuagcaauug

SEQ ID NO: 779290 - RNA, 19 nt, Homo sapiens
gaauugauccuacucuuug

SEQ ID NO: 779291 - RNA, 19 nt, Homo sapiens
caaagagugucaagaaaca

SEQ ID NO: 779292 - RNA, 19 nt, Homo sapiens
ggacuagguuaugugcuua

SEQ ID NO: 779293 - RNA, 19 nt, Homo sapiens
agaguuagcugaaguuuua

SEQ ID NO: 779294 - RNA, 19 nt, Homo sapiens
uaaaggcucuugaaguaug

SEQ ID NO: 779295 - RNA, 19 nt, Homo sapiens
ggacuuuccuggauccuau

SEQ ID NO: 779296 - RNA, 19 nt, Homo sapiens
cgacaaugcuccuuaaguc

SEQ ID NO: 779297 - RNA, 19 nt, Homo sapiens
gcucaguccugcaguuuga

SEQ ID NO: 779298 - RNA, 19 nt, Homo sapiens
gaaaguaaacgacccaaag

SEQ ID NO: 779299 - RNA, 19 nt, Homo sapiens
caaaguacuuggaauugau

SEQ ID NO: 779300 - RNA, 19 nt, Homo sapiens
gagcaacaugucuaaauaa

SEQ ID NO: 779301 - RNA, 19 nt, Homo sapiens
ggaauugauccuacucuuu

SEQ ID NO: 779302 - RNA, 19 nt, Homo sapiens
gcaaccaggugccaacugu

SEQ ID NO: 779303 - RNA, 19 nt, Homo sapiens
caaucuuucucaagucaua

SEQ ID NO: 779304 - RNA, 19 nt, Homo sapiens
cgagguguauuuaacauug

SEQ ID NO: 779305 - RNA, 19 nt, Homo sapiens
gggugcagauccagauaua

SEQ ID NO: 779306 - RNA, 19 nt, Homo sapiens
aaugugaccuugcagagua

SEQ ID NO: 779307 - RNA, 19 nt, Homo sapiens
gagaauaaggcgaggcuaa

SEQ ID NO: 779308 - RNA, 19 nt, Homo sapiens
ugccaaacauuaccaaauu

SEQ ID NO: 779309 - RNA, 19 nt, Homo sapiens
uaacauugaugccaaacau

SEQ ID NO: 779310 - RNA, 19 nt, Homo sapiens
ccaaaggacugcaacuaca

SEQ ID NO: 779311 - RNA, 19 nt, Homo sapiens
gcccaaaugacguuuauaa

SEQ ID NO: 779312 - RNA, 19 nt, Homo sapiens
guuaugugcuuaagagaug

SEQ ID NO: 779313 - RNA, 19 nt, Homo sapiens
agaagcacguccuccauuu

SEQ ID NO: 779314 - RNA, 19 nt, Homo sapiens
gaagucaccauuccugaga

SEQ ID NO: 779315 - RNA, 19 nt, Homo sapiens
guaaacgacccaaagcaaa

SEQ ID NO: 779316 - RNA, 19 nt, Homo sapiens
ucaaguuccugcccaaaug

SEQ ID NO: 779317 - RNA, 19 nt, Homo sapiens
ccuauaaacacccaaagua

SEQ ID NO: 779318 - RNA, 19 nt, Homo sapiens
aaagaucgguguugccaau

SEQ ID NO: 779319 - RNA, 19 nt, Homo sapiens
acaacaaucuuucucaagu

SEQ ID NO: 779320 - RNA, 19 nt, Homo sapiens
cgacuauaauuucuacuca

SEQ ID NO: 779321 - RNA, 19 nt, Homo sapiens
uuugguaacugugagauua

SEQ ID NO: 779322 - RNA, 19 nt, Homo sapiens
ggaggacaaugaggaaugu

SEQ ID NO: 779323 - RNA, 19 nt, Homo sapiens
gggaacugcuggaggauca

SEQ ID NO: 779324 - RNA, 19 nt, Homo sapiens
gggcacaggcuaucaucua

SEQ ID NO: 779325 - RNA, 19 nt, Homo sapiens
gagauuacaggaauucgaa

SEQ ID NO: 779326 - RNA, 19 nt, Homo sapiens
gccaaacauuaccaaauug

SEQ ID NO: 779327 - RNA, 19 nt, Homo sapiens
gaaucuaaagcaaacauug

SEQ ID NO: 779328 - RNA, 19 nt, Homo sapiens
gcaggaaggaaaugaaugu

SEQ ID NO: 779329 - RNA, 19 nt, Homo sapiens
ggugccaacuguagcauug

SEQ ID NO: 779330 - RNA, 19 nt, Homo sapiens
gcucuugcauggucguuug

SEQ ID NO: 779331 - RNA, 19 nt, Homo sapiens
gauuauggacaccuacuuu

SEQ ID NO: 779332 - RNA, 19 nt, Homo sapiens
caacaaucuuucucaaguc

SEQ ID NO: 779333 - RNA, 19 nt, Homo sapiens
gaucauccuuacauaccaa

SEQ ID NO: 779334 - RNA, 19 nt, Homo sapiens
gcauuggacuuugcuguca

SEQ ID NO: 779335 - RNA, 19 nt, Homo sapiens
ggaaaaguguguucucuag

SEQ ID NO: 779336 - RNA, 19 nt, Homo sapiens
ggacaccuacuuucaagau

SEQ ID NO: 779337 - RNA, 19 nt, Homo sapiens
acauugaugccaaacauua

SEQ ID NO: 779338 - RNA, 19 nt, Homo sapiens
ucucuggacucuaaagcua

SEQ ID NO: 779339 - RNA, 19 nt, Homo sapiens
gcaaagagugucaagaaac

SEQ ID NO: 779340 - RNA, 19 nt, Homo sapiens
gcauacgacuauaauuucu

SEQ ID NO: 779341 - RNA, 19 nt, Homo sapiens
cagauugggcacauuuaua

SEQ ID NO: 779342 - RNA, 19 nt, Homo sapiens
gagguguauuuaacauuga

SEQ ID NO: 779343 - RNA, 19 nt, Homo sapiens
uugaaaccaucccugauuu

SEQ ID NO: 779344 - RNA, 19 nt, Homo sapiens
gaugaacaauacugccaau

SEQ ID NO: 779345 - RNA, 19 nt, Homo sapiens
gaucaaaguagguauaggu

SEQ ID NO: 779346 - RNA, 19 nt, Homo sapiens
uggcuuaagugaugaugaa

SEQ ID NO: 779347 - RNA, 19 nt, Homo sapiens
guuuguggcuuaagugaug

SEQ ID NO: 779348 - RNA, 19 nt, Homo sapiens
cuacaugggcuccgugaaa

SEQ ID NO: 779349 - RNA, 19 nt, Homo sapiens
aagcaaagagugucaagaa

SEQ ID NO: 779350 - RNA, 19 nt, Homo sapiens
caggaagaaucuaaagcaa

SEQ ID NO: 779351 - RNA, 19 nt, Homo sapiens
ggcacaggcuaucaucuau

SEQ ID NO: 779352 - RNA, 19 nt, Homo sapiens
ucuagaauaugcuggauca

SEQ ID NO: 779353 - RNA, 19 nt, Homo sapiens
gcucgccugucaucagauu

SEQ ID NO: 779354 - RNA, 19 nt, Homo sapiens
cuaagggacuuuccuggau

SEQ ID NO: 779355 - RNA, 19 nt, Homo sapiens
ugaccuagguaugauaaau

SEQ ID NO: 779356 - RNA, 19 nt, Homo sapiens
gaagcacguccuccauuug

SEQ ID NO: 779357 - RNA, 19 nt, Homo sapiens
gaaagagcaguuugggaau

SEQ ID NO: 779358 - RNA, 19 nt, Homo sapiens
gauaggaaaccacuuaaaa

SEQ ID NO: 779359 - RNA, 19 nt, Homo sapiens
guugaaaccaucccugauu

SEQ ID NO: 779360 - RNA, 19 nt, Homo sapiens
ugagugcuaugaugcaguu

SEQ ID NO: 779361 - RNA, 19 nt, Homo sapiens
gugcagauccagauauaug

SEQ ID NO: 779362 - RNA, 19 nt, Homo sapiens
cuuaagagauguggaaaca

SEQ ID NO: 779363 - RNA, 19 nt, Homo sapiens
gaauaugcuggaucaguga

SEQ ID NO: 779364 - RNA, 19 nt, Homo sapiens
caucagauugggcacauuu

SEQ ID NO: 779365 - RNA, 19 nt, Homo sapiens
aaacugaacaggaagaauc

SEQ ID NO: 779366 - RNA, 19 nt, Homo sapiens
caauugcaguuauaucucu

SEQ ID NO: 779367 - RNA, 19 nt, Homo sapiens
ccaaacauuaccaaauuga

SEQ ID NO: 779368 - RNA, 19 nt, Homo sapiens
gaacaggaagaaucuaaaa

SEQ ID NO: 779369 - RNA, 19 nt, Homo sapiens
ccagagcauacgacuauaa

SEQ ID NO: 779370 - RNA, 19 nt, Homo sapiens
gaucgguguugccaaucaa

SEQ ID NO: 779371 - RNA, 19 nt, Homo sapiens
caaaauacgcguuggauau

SEQ ID NO: 779372 - RNA, 19 nt, Homo sapiens
ggacaggaagaaucuaaag

SEQ ID NO: 779373 - RNA, 19 nt, Homo sapiens
aucauaauguuucgccuua

SEQ ID NO: 779374 - RNA, 19 nt, Homo sapiens
caauuuggguuguguccau

SEQ ID NO: 779375 - RNA, 19 nt, Homo sapiens
gggagcaacaugucuaaau

SEQ ID NO: 779376 - RNA, 19 nt, Homo sapiens
ugagcugggucaugcugua

SEQ ID NO: 779377 - RNA, 19 nt, Homo sapiens
gaacaauacugccaaugua

SEQ ID NO: 779378 - RNA, 19 nt, Homo sapiens
ggagcaacaugucuaaaua

SEQ ID NO: 779379 - RNA, 19 nt, Homo sapiens
ggacuuugcugucaugauu

SEQ ID NO: 779380 - RNA, 19 nt, Homo sapiens
gcgauucccucgucaauuu

SEQ ID NO: 779381 - RNA, 19 nt, Homo sapiens
uaagagauguggaaacaaa

SEQ ID NO: 779382 - RNA, 19 nt, Homo sapiens
gaacaacaaucuuucucaa

SEQ ID NO: 779383 - RNA, 19 nt, Homo sapiens
gagcauacgacuauaauuu

SEQ ID NO: 779384 - RNA, 19 nt, Homo sapiens
cuuaaaggcucuugaagua

SEQ ID NO: 779385 - RNA, 19 nt, Homo sapiens
ggaagaaucugaagcaaaa

SEQ ID NO: 779386 - RNA, 19 nt, Homo sapiens
caaaugacguuuauaagca

SEQ ID NO: 779387 - RNA, 19 nt, Homo sapiens
gaaucagguuuguggcuua

SEQ ID NO: 779388 - RNA, 19 nt, Homo sapiens
ggaagaaucuaaagcaaac

SEQ ID NO: 779389 - RNA, 19 nt, Homo sapiens
gcacuggguuuagcaauug

SEQ ID NO: 779390 - RNA, 19 nt, Homo sapiens
gaauugauccuacucuuug

SEQ ID NO: 779391 - RNA, 19 nt, Homo sapiens
caaagagugucaagaaaca

SEQ ID NO: 779392 - RNA, 19 nt, Homo sapiens
ggaagaaucuaaagcaaaa

SEQ ID NO: 779393 - RNA, 19 nt, Homo sapiens
ggacuagguuaugugcuua

SEQ ID NO: 779394 - RNA, 19 nt, Homo sapiens
agaguuagcugaaguuuua

SEQ ID NO: 779395 - RNA, 19 nt, Homo sapiens
uaaaggcucuugaaguaug

SEQ ID NO: 779396 - RNA, 19 nt, Homo sapiens
ggacuuuccuggauccuau

SEQ ID NO: 779397 - RNA, 19 nt, Homo sapiens
cgacaaugcuccuuaaguc

SEQ ID NO: 779398 - RNA, 19 nt, Homo sapiens
gcucaguccugcaguuuga

SEQ ID NO: 779399 - RNA, 19 nt, Homo sapiens
gaaaguaaacgacccaaag

SEQ ID NO: 779400 - RNA, 19 nt, Homo sapiens
caaaguacuuggaauugau

SEQ ID NO: 779401 - RNA, 19 nt, Homo sapiens
gagcaacaugucuaaauaa

SEQ ID NO: 779402 - RNA, 19 nt, Homo sapiens
ggaauugauccuacucuuu

SEQ ID NO: 779403 - RNA, 19 nt, Homo sapiens
gcaaccaggugccaacugu

SEQ ID NO: 779404 - RNA, 19 nt, Homo sapiens
caaucuuucucaagucaua

SEQ ID NO: 779405 - RNA, 19 nt, Homo sapiens
cgagguguauuuaacauug

SEQ ID NO: 779406 - RNA, 19 nt, Homo sapiens
gggugcagauccagauaua

SEQ ID NO: 779407 - RNA, 19 nt, Homo sapiens
aaugugaccuugcagagua

SEQ ID NO: 779408 - RNA, 19 nt, Homo sapiens
gagaauaaggcgaggcuaa

SEQ ID NO: 779409 - RNA, 19 nt, Homo sapiens
ugccaaacauuaccaaauu

SEQ ID NO: 779410 - RNA, 19 nt, Homo sapiens
uaacauugaugccaaacau

SEQ ID NO: 779411 - RNA, 19 nt, Homo sapiens
ccaaaggacugcaacuaca

SEQ ID NO: 779412 - RNA, 19 nt, Homo sapiens
gcccaaaugacguuuauaa

SEQ ID NO: 779413 - RNA, 19 nt, Homo sapiens
guuaugugcuuaagagaug

SEQ ID NO: 779414 - RNA, 19 nt, Homo sapiens
agaagcacguccuccauuu

SEQ ID NO: 779415 - RNA, 19 nt, Homo sapiens
gaagucaccauuccugaga

SEQ ID NO: 779416 - RNA, 19 nt, Homo sapiens
guaaacgacccaaagcaaa

SEQ ID NO: 779417 - RNA, 19 nt, Homo sapiens
ucaaguuccugcccaaaug

SEQ ID NO: 779418 - RNA, 19 nt, Homo sapiens
ccuauaaacacccaaagua

SEQ ID NO: 779419 - RNA, 19 nt, Homo sapiens
aaagaucgguguugccaau

SEQ ID NO: 779420 - RNA, 19 nt, Homo sapiens
acaacaaucuuucucaagu

SEQ ID NO: 779421 - RNA, 19 nt, Homo sapiens
cgacuauaauuucuacuca

SEQ ID NO: 779422 - RNA, 19 nt, Homo sapiens
uuugguaacugugagauua

SEQ ID NO: 779423 - RNA, 19 nt, Homo sapiens
ggaggacaaugaggaaugu

SEQ ID NO: 779424 - RNA, 19 nt, Homo sapiens
gggaacugcuggaggauca

SEQ ID NO: 779425 - RNA, 19 nt, Homo sapiens
gggcacaggcuaucaucua

SEQ ID NO: 779426 - RNA, 19 nt, Homo sapiens
gagauuacaggaauucgaa

SEQ ID NO: 779427 - RNA, 19 nt, Homo sapiens
gccaaacauuaccaaauug

SEQ ID NO: 779428 - RNA, 19 nt, Homo sapiens
gaaucuaaagcaaacauug

SEQ ID NO: 779429 - RNA, 19 nt, Homo sapiens
gcaggaaggaaaugaaugu

SEQ ID NO: 779430 - RNA, 19 nt, Homo sapiens
ggugccaacuguagcauug

SEQ ID NO: 779431 - RNA, 19 nt, Homo sapiens
gcucuugcauggucguuug

SEQ ID NO: 779432 - RNA, 19 nt, Homo sapiens
gauuauggacaccuacuuu

SEQ ID NO: 779433 - RNA, 19 nt, Homo sapiens
caacaaucuuucucaaguc

SEQ ID NO: 779434 - RNA, 19 nt, Homo sapiens
gaucauccuuacauaccaa

SEQ ID NO: 779435 - RNA, 19 nt, Homo sapiens
gcauuggacuuugcuguca

SEQ ID NO: 779436 - RNA, 19 nt, Homo sapiens
ggaaaaguguguucucuag

SEQ ID NO: 779437 - RNA, 19 nt, Homo sapiens
ggacaccuacuuucaagau

SEQ ID NO: 779438 - RNA, 19 nt, Homo sapiens
acauugaugccaaacauua

SEQ ID NO: 779439 - RNA, 19 nt, Homo sapiens
ucucuggacucuaaagcua

SEQ ID NO: 779440 - RNA, 19 nt, Homo sapiens
gcaaagagugucaagaaac

SEQ ID NO: 779441 - RNA, 19 nt, Homo sapiens
gcauacgacuauaauuucu

SEQ ID NO: 779442 - RNA, 19 nt, Homo sapiens
cagauugggcacauuuaua

SEQ ID NO: 779443 - RNA, 19 nt, Homo sapiens
gagguguauuuaacauuga

SEQ ID NO: 779444 - RNA, 19 nt, Homo sapiens
uugaaaccaucccugauuu

SEQ ID NO: 779445 - RNA, 19 nt, Homo sapiens
gaugaacaauacugccaau

SEQ ID NO: 779446 - RNA, 19 nt, Homo sapiens
gaucaaaguagguauaggu

SEQ ID NO: 779447 - RNA, 19 nt, Homo sapiens
uggcuuaagugaugaugaa

SEQ ID NO: 779448 - RNA, 19 nt, Homo sapiens
guuuguggcuuaagugaug

SEQ ID NO: 779449 - RNA, 19 nt, Homo sapiens
cuacaugggcuccgugaaa

SEQ ID NO: 779450 - RNA, 19 nt, Homo sapiens
aagcaaagagugucaagaa

SEQ ID NO: 779451 - RNA, 19 nt, Homo sapiens
caggaagaaucuaaagcaa

SEQ ID NO: 779452 - RNA, 19 nt, Homo sapiens
caggaagaaucuaaagcaa

SEQ ID NO: 779453 - RNA, 19 nt, Homo sapiens
ggcacaggcuaucaucuau

SEQ ID NO: 779454 - RNA, 19 nt, Homo sapiens
ucuagaauaugcuggauca

SEQ ID NO: 779455 - RNA, 19 nt, Homo sapiens
gcucgccugucaucagauu

SEQ ID NO: 779456 - RNA, 19 nt, Homo sapiens
cuaagggacuuuccuggau

SEQ ID NO: 779457 - RNA, 19 nt, Homo sapiens
ugaccuagguaugauaaau

SEQ ID NO: 779458 - RNA, 19 nt, Homo sapiens
gaagcacguccuccauuug

SEQ ID NO: 779459 - RNA, 19 nt, Homo sapiens
gaaagagcaguuugggaau

SEQ ID NO: 779460 - RNA, 19 nt, Homo sapiens
gauaggaaaccacuuaaaa

SEQ ID NO: 779461 - RNA, 19 nt, Homo sapiens
guugaaaccaucccugauu

SEQ ID NO: 779462 - RNA, 19 nt, Homo sapiens
ugagugcuaugaugcaguu

SEQ ID NO: 779463 - RNA, 19 nt, Homo sapiens
gugcagauccagauauaug

SEQ ID NO: 779464 - RNA, 19 nt, Homo sapiens
cuuaagagauguggaaaca

SEQ ID NO: 779465 - RNA, 19 nt, Homo sapiens
gaauaugcuggaucaguga

SEQ ID NO: 779466 - RNA, 19 nt, Homo sapiens
caucagauugggcacauuu

SEQ ID NO: 779467 - RNA, 19 nt, Homo sapiens
aaacugaacaggaagaauc

SEQ ID NO: 779468 - RNA, 19 nt, Homo sapiens
caauugcaguuauaucucu

SEQ ID NO: 779469 - RNA, 19 nt, Homo sapiens
ccaaacauuaccaaauuga

SEQ ID NO: 779470 - RNA, 19 nt, Homo sapiens
gaacaggaagaaucuaaaa

SEQ ID NO: 779471 - RNA, 19 nt, Homo sapiens
ccagagcauacgacuauaa

SEQ ID NO: 779472 - RNA, 19 nt, Homo sapiens
gaucgguguugccaaucaa

SEQ ID NO: 779473 - RNA, 19 nt, Homo sapiens
caaaauacgcguuggauau

SEQ ID NO: 779474 - RNA, 19 nt, Homo sapiens
ggacaggaagaaucuaaag

SEQ ID NO: 779475 - RNA, 19 nt, Homo sapiens
ggacaggaagaaucuaaag

SEQ ID NO: 779476 - RNA, 19 nt, Homo sapiens
aucauaauguuucgccuua

SEQ ID NO: 779477 - RNA, 19 nt, Homo sapiens
gaaaggaggucaaugaaug

SEQ ID NO: 779478 - RNA, 19 nt, Homo sapiens
gaaauaacaugccgaaugg

SEQ ID NO: 779479 - RNA, 19 nt, Homo sapiens
ugacagaaauucccaauau

SEQ ID NO: 779480 - RNA, 19 nt, Homo sapiens
gaaggcaacccaccaauaa

SEQ ID NO: 779481 - RNA, 19 nt, Homo sapiens
ggaaaucugugcaccugua

SEQ ID NO: 779482 - RNA, 19 nt, Homo sapiens
gaaacacauuauccacaua

SEQ ID NO: 779483 - RNA, 19 nt, Homo sapiens
gaagggaccugauauuggu

SEQ ID NO: 779484 - RNA, 19 nt, Homo sapiens
ggaaugguguuguugaaga

SEQ ID NO: 779485 - RNA, 19 nt, Homo sapiens
gaaguucuguuaucugugu

SEQ ID NO: 779486 - RNA, 19 nt, Homo sapiens
gaggauacaugucguuguu

SEQ ID NO: 779487 - RNA, 19 nt, Homo sapiens
caugacaccucacaucuuu

SEQ ID NO: 779488 - RNA, 19 nt, Homo sapiens
gugcauaacuugucaauac

SEQ ID NO: 779489 - RNA, 19 nt, Homo sapiens
uuucacaacucuaggauua

SEQ ID NO: 779490 - RNA, 19 nt, Homo sapiens
gaagcaaaguucuuaugug

SEQ ID NO: 779491 - RNA, 19 nt, Homo sapiens
guagaaaggaggucaauga

SEQ ID NO: 779492 - RNA, 19 nt, Homo sapiens
gcgucgaccucaugaguua

SEQ ID NO: 779493 - RNA, 19 nt, Homo sapiens
gaagauggaauucccugua

SEQ ID NO: 779494 - RNA, 19 nt, Homo sapiens
gaacaucugguauacaaga

SEQ ID NO: 779495 - RNA, 19 nt, Homo sapiens
cagaauaacugcuacuauc

SEQ ID NO: 779496 - RNA, 19 nt, Homo sapiens
ugacuuugcuuaugaaauc

SEQ ID NO: 779497 - RNA, 19 nt, Homo sapiens
gaacaguguaggaggauuu

SEQ ID NO: 779498 - RNA, 19 nt, Homo sapiens
gauuagcacuacacacuga

SEQ ID NO: 779499 - RNA, 19 nt, Homo sapiens
gcagcaagauguucaaacu

SEQ ID NO: 779500 - RNA, 19 nt, Homo sapiens
gaaugguguuguugaagaa

SEQ ID NO: 779501 - RNA, 19 nt, Homo sapiens
gaaaggaacgacucaaagu

SEQ ID NO: 779502 - RNA, 19 nt, Homo sapiens
uauacaagauggacaguga

SEQ ID NO: 779503 - RNA, 19 nt, Homo sapiens
ccagaguggugcaauggua

SEQ ID NO: 779504 - RNA, 19 nt, Homo sapiens
gcgcaaauacugcaaguga

SEQ ID NO: 779505 - RNA, 19 nt, Homo sapiens
caaaguugcuggaggaucu

SEQ ID NO: 779506 - RNA, 19 nt, Homo sapiens
aaagaucccugcugucugu

SEQ ID NO: 779507 - RNA, 19 nt, Homo sapiens
gaggaucuauauguuauug

SEQ ID NO: 779508 - RNA, 19 nt, Homo sapiens
aaacaucacugccauugca

SEQ ID NO: 779509 - RNA, 19 nt, Homo sapiens
cgaauggaauuugaagaaa

SEQ ID NO: 779510 - RNA, 19 nt, Homo sapiens
ucacugccauugcaauuau

SEQ ID NO: 779511 - RNA, 19 nt, Homo sapiens
gacagaaauucccaauaug

SEQ ID NO: 779512 - RNA, 19 nt, Homo sapiens
gcaaauacugcaagugaga

SEQ ID NO: 779513 - RNA, 19 nt, Homo sapiens
ucaagaagcuuuuguuuuc

SEQ ID NO: 779514 - RNA, 19 nt, Homo sapiens
gaacagagugugggauaga

SEQ ID NO: 779515 - RNA, 19 nt, Homo sapiens
caaauugcacucugacuga

SEQ ID NO: 779516 - RNA, 19 nt, Homo sapiens
ggauacaugucguuguuca

SEQ ID NO: 779517 - RNA, 19 nt, Homo sapiens
guugugcaauuguuacuuu

SEQ ID NO: 779518 - RNA, 19 nt, Homo sapiens
gcuggaggaucuauauguu

SEQ ID NO: 779519 - RNA, 19 nt, Homo sapiens
ugaaauaacaugccgaaug

SEQ ID NO: 779520 - RNA, 19 nt, Homo sapiens
caaagaauugaacaccuua

SEQ ID NO: 779521 - RNA, 19 nt, Homo sapiens
ucaucuaggucauaauuug

SEQ ID NO: 779522 - RNA, 19 nt, Homo sapiens
ggaguacugauuaccauuu

SEQ ID NO: 779523 - RNA, 19 nt, Homo sapiens
gugagaaugugacagaaau

SEQ ID NO: 779524 - RNA, 19 nt, Homo sapiens
acaaagaauugaacaccuu

SEQ ID NO: 779525 - RNA, 19 nt, Homo sapiens
caggcuggcucuccuauau

SEQ ID NO: 779526 - RNA, 19 nt, Homo sapiens
guggaagaauucaguguga

SEQ ID NO: 779527 - RNA, 19 nt, Homo sapiens
aagauggaauucccuguaa

SEQ ID NO: 779528 - RNA, 19 nt, Homo sapiens
ugauauuggugaagugaaa

SEQ ID NO: 779529 - RNA, 19 nt, Homo sapiens
guacauucguuaugaaagg

SEQ ID NO: 779530 - RNA, 19 nt, Homo sapiens
gagucaaccuccugugaug

SEQ ID NO: 779531 - RNA, 19 nt, Homo sapiens
gagucaaccuccugugaug

SEQ ID NO: 779532 - RNA, 19 nt, Homo sapiens
ggugaugccuucucagagu

SEQ ID NO: 779533 - RNA, 19 nt, Homo sapiens
gagacuugcuacaaagaau

SEQ ID NO: 779534 - RNA, 19 nt, Homo sapiens
gggaaaguguguagaaagg

SEQ ID NO: 779535 - RNA, 19 nt, Homo sapiens
gcaauuguuacuuucauga

SEQ ID NO: 779536 - RNA, 19 nt, Homo sapiens
gaaauuguagucgucauug

SEQ ID NO: 779537 - RNA, 19 nt, Homo sapiens
uaacaugccgaauggaauu

SEQ ID NO: 779538 - RNA, 19 nt, Homo sapiens
ccucccaacugccugauaa

SEQ ID NO: 779539 - RNA, 19 nt, Homo sapiens
gaugaagggaccugauauu

SEQ ID NO: 779540 - RNA, 19 nt, Homo sapiens
gggaugaagggaccugaua

SEQ ID NO: 779541 - RNA, 19 nt, Homo sapiens
gaguacugauuaccauuug

SEQ ID NO: 779542 - RNA, 19 nt, Homo sapiens
gugaagcgcugugggaaug

SEQ ID NO: 779543 - RNA, 19 nt, Homo sapiens
gcaacccaccaauaacuaa

SEQ ID NO: 779544 - RNA, 19 nt, Homo sapiens
gcaaguggaagucggagaa

SEQ ID NO: 779545 - RNA, 19 nt, Homo sapiens
caugagauccggauuuaug

SEQ ID NO: 779546 - RNA, 19 nt, Homo sapiens
ggaggucaaugaaugugau

SEQ ID NO: 779547 - RNA, 19 nt, Homo sapiens
guauaaccaucagcaagaa

SEQ ID NO: 779548 - RNA, 19 nt, Homo sapiens
ccagagucauccucaguug

SEQ ID NO: 779549 - RNA, 19 nt, Homo sapiens
ccagagucauccucaguug

SEQ ID NO: 779550 - RNA, 19 nt, Homo sapiens
ggugaugccuucccagagu

SEQ ID NO: 779551 - RNA, 19 nt, Homo sapiens
gaaaacucauagugcauaa

SEQ ID NO: 779552 - RNA, 19 nt, Homo sapiens
acagaaauucccaauauga

SEQ ID NO: 779553 - RNA, 19 nt, Homo sapiens
caucaucuaggucauaauu

SEQ ID NO: 779554 - RNA, 19 nt, Homo sapiens
caacaugacaccucacauc

SEQ ID NO: 779555 - RNA, 19 nt, Homo sapiens
uugaacaucugguauacaa

SEQ ID NO: 779556 - RNA, 19 nt, Homo sapiens
ggaagaauucagugugaga

SEQ ID NO: 779557 - RNA, 19 nt, Homo sapiens
guagagaggacaaaguguu

SEQ ID NO: 779558 - RNA, 19 nt, Homo sapiens
ugaaggcaacccaccaaua

SEQ ID NO: 779559 - RNA, 19 nt, Homo sapiens
uggaggaucuauauguuau

SEQ ID NO: 779560 - RNA, 19 nt, Homo sapiens
cuguguauauuguugcuua

SEQ ID NO: 779561 - RNA, 19 nt, Homo sapiens
ggauagaucauauaugcau

SEQ ID NO: 779562 - RNA, 19 nt, Homo sapiens
ugggauagaucauauaugc

SEQ ID NO: 779563 - RNA, 19 nt, Homo sapiens
gaaccaugaugaggauaca

SEQ ID NO: 779564 - RNA, 19 nt, Homo sapiens
uguaguagaugauguaagg

SEQ ID NO: 779565 - RNA, 19 nt, Homo sapiens
accaugagauccggauuua

SEQ ID NO: 779566 - RNA, 19 nt, Homo sapiens
gauggacagugaggagaaa

SEQ ID NO: 779567 - RNA, 19 nt, Homo sapiens
caauugcaguggcucauca

SEQ ID NO: 779568 - RNA, 19 nt, Homo sapiens
caccguaguugugcaauug

SEQ ID NO: 779569 - RNA, 19 nt, Homo sapiens
aaccucaugugacaccuua

SEQ ID NO: 779570 - RNA, 19 nt, Homo sapiens
caggcacuguguccauaua

SEQ ID NO: 779571 - RNA, 19 nt, Homo sapiens
cagggaaaguguguagaaa

SEQ ID NO: 779572 - RNA, 19 nt, Homo sapiens
ccugcugucugucaaauug

SEQ ID NO: 779573 - RNA, 19 nt, Homo sapiens
ugcaguggcucaucaucua

SEQ ID NO: 779574 - RNA, 19 nt, Homo sapiens
ccauauaaccaucuugaau

SEQ ID NO: 779575 - RNA, 19 nt, Homo sapiens
ucgcuucaaugacauaaug

SEQ ID NO: 779576 - RNA, 19 nt, Homo sapiens
gaagaauucagugugagaa

SEQ ID NO: 779577 - RNA, 19 nt, Homo sapiens
gaaaggaggucaaugaaug

SEQ ID NO: 779578 - RNA, 19 nt, Homo sapiens
gaaauaacaugccgaaugg

SEQ ID NO: 779579 - RNA, 19 nt, Homo sapiens
ugacagaaauucccaauau

SEQ ID NO: 779580 - RNA, 19 nt, Homo sapiens
gaaggcaacccaccaauaa

SEQ ID NO: 779581 - RNA, 19 nt, Homo sapiens
ggaaaucugugcaccugua

SEQ ID NO: 779582 - RNA, 19 nt, Homo sapiens
gaaacacauuauccacaua

SEQ ID NO: 779583 - RNA, 19 nt, Homo sapiens
gaagggaccugauauuggu

SEQ ID NO: 779584 - RNA, 19 nt, Homo sapiens
ggaaugguguuguugaaga

SEQ ID NO: 779585 - RNA, 19 nt, Homo sapiens
gaaguucuguuaucugugu

SEQ ID NO: 779586 - RNA, 19 nt, Homo sapiens
gaggauacaugucguuguu

SEQ ID NO: 779587 - RNA, 19 nt, Homo sapiens
caugacaccucacaucuuu

SEQ ID NO: 779588 - RNA, 19 nt, Homo sapiens
uuucacaacucuaggauua

SEQ ID NO: 779589 - RNA, 19 nt, Homo sapiens
gaagcaaaguucuuaugug

SEQ ID NO: 779590 - RNA, 19 nt, Homo sapiens
guagaaaggaggucaauga

SEQ ID NO: 779591 - RNA, 19 nt, Homo sapiens
gcgucgaccucaugaguua

SEQ ID NO: 779592 - RNA, 19 nt, Homo sapiens
gaagauggaauucccugua

SEQ ID NO: 779593 - RNA, 19 nt, Homo sapiens
gaacaucugguauacaaga

SEQ ID NO: 779594 - RNA, 19 nt, Homo sapiens
cagaauaacugcuacuauc

SEQ ID NO: 779595 - RNA, 19 nt, Homo sapiens
ugacuuugcuuaugaaauc

SEQ ID NO: 779596 - RNA, 19 nt, Homo sapiens
gaacaguguaggaggauuu

SEQ ID NO: 779597 - RNA, 19 nt, Homo sapiens
gcagcaagauguucaaacu

SEQ ID NO: 779598 - RNA, 19 nt, Homo sapiens
gaaugguguuguugaagaa

SEQ ID NO: 779599 - RNA, 19 nt, Homo sapiens
gaaaggaacgacucaaagu

SEQ ID NO: 779600 - RNA, 19 nt, Homo sapiens
uauacaagauggacaguga

SEQ ID NO: 779601 - RNA, 19 nt, Homo sapiens
ccagaguggugcaauggua

SEQ ID NO: 779602 - RNA, 19 nt, Homo sapiens
gcgcaaauacugcaaguga

SEQ ID NO: 779603 - RNA, 19 nt, Homo sapiens
caaaguugcuggaggaucu

SEQ ID NO: 779604 - RNA, 19 nt, Homo sapiens
aaagaucccugcugucugu

SEQ ID NO: 779605 - RNA, 19 nt, Homo sapiens
gaggaucuauauguuauug

SEQ ID NO: 779606 - RNA, 19 nt, Homo sapiens
aaacaucacugccauugca

SEQ ID NO: 779607 - RNA, 19 nt, Homo sapiens
cgaauggaauuugaagaaa

SEQ ID NO: 779608 - RNA, 19 nt, Homo sapiens
ucacugccauugcaauuau

SEQ ID NO: 779609 - RNA, 19 nt, Homo sapiens
gacagaaauucccaauaug

SEQ ID NO: 779610 - RNA, 19 nt, Homo sapiens
gcaaauacugcaagugaga

SEQ ID NO: 779611 - RNA, 19 nt, Homo sapiens
ucaagaagcuuuuguuuuc

SEQ ID NO: 779612 - RNA, 19 nt, Homo sapiens
gaacagagugugggauaga

SEQ ID NO: 779613 - RNA, 19 nt, Homo sapiens
caaauugcacucugacuga

SEQ ID NO: 779614 - RNA, 19 nt, Homo sapiens
ggauacaugucguuguuca

SEQ ID NO: 779615 - RNA, 19 nt, Homo sapiens
guugugcaauuguuacuuu

SEQ ID NO: 779616 - RNA, 19 nt, Homo sapiens
gcuggaggaucuauauguu

SEQ ID NO: 779617 - RNA, 19 nt, Homo sapiens
ugaaauaacaugccgaaug

SEQ ID NO: 779618 - RNA, 19 nt, Homo sapiens
caaagaauugaacaccuua

SEQ ID NO: 779619 - RNA, 19 nt, Homo sapiens
ucaucuaggucauaauuug

SEQ ID NO: 779620 - RNA, 19 nt, Homo sapiens
ggaguacugauuaccauuu

SEQ ID NO: 779621 - RNA, 19 nt, Homo sapiens
gugagaaugugacagaaau

SEQ ID NO: 779622 - RNA, 19 nt, Homo sapiens
acaaagaauugaacaccuu

SEQ ID NO: 779623 - RNA, 19 nt, Homo sapiens
caggcuggcucuccuauau

SEQ ID NO: 779624 - RNA, 19 nt, Homo sapiens
guggaagaauucaguguga

SEQ ID NO: 779625 - RNA, 19 nt, Homo sapiens
aagauggaauucccuguaa

SEQ ID NO: 779626 - RNA, 19 nt, Homo sapiens
ugauauuggugaagugaaa

SEQ ID NO: 779627 - RNA, 19 nt, Homo sapiens
guacauucguuaugaaagg

SEQ ID NO: 779628 - RNA, 19 nt, Homo sapiens
gagacuugcuacaaagaau

SEQ ID NO: 779629 - RNA, 19 nt, Homo sapiens
gggaaaguguguagaaagg

SEQ ID NO: 779630 - RNA, 19 nt, Homo sapiens
gcaauuguuacuuucauga

SEQ ID NO: 779631 - RNA, 19 nt, Homo sapiens
gaaauuguagucgucauug

SEQ ID NO: 779632 - RNA, 19 nt, Homo sapiens
uaacaugccgaauggaauu

SEQ ID NO: 779633 - RNA, 19 nt, Homo sapiens
ccucccaacugccugauaa

SEQ ID NO: 779634 - RNA, 19 nt, Homo sapiens
gaugaagggaccugauauu

SEQ ID NO: 779635 - RNA, 19 nt, Homo sapiens
gggaugaagggaccugaua

SEQ ID NO: 779636 - RNA, 19 nt, Homo sapiens
gaguacugauuaccauuug

SEQ ID NO: 779637 - RNA, 19 nt, Homo sapiens
gugaagcgcugugggaaug

SEQ ID NO: 779638 - RNA, 19 nt, Homo sapiens
gcaacccaccaauaacuaa

SEQ ID NO: 779639 - RNA, 19 nt, Homo sapiens
gcaaguggaagucggagaa

SEQ ID NO: 779640 - RNA, 19 nt, Homo sapiens
caugagauccggauuuaug

SEQ ID NO: 779641 - RNA, 19 nt, Homo sapiens
ggaggucaaugaaugugau

SEQ ID NO: 779642 - RNA, 19 nt, Homo sapiens
ggugaugccuucccagagu

SEQ ID NO: 779643 - RNA, 19 nt, Homo sapiens
acagaaauucccaauauga

SEQ ID NO: 779644 - RNA, 19 nt, Homo sapiens
caucaucuaggucauaauu

SEQ ID NO: 779645 - RNA, 19 nt, Homo sapiens
caacaugacaccucacauc

SEQ ID NO: 779646 - RNA, 19 nt, Homo sapiens
uugaacaucugguauacaa

SEQ ID NO: 779647 - RNA, 19 nt, Homo sapiens
ggaagaauucagugugaga

SEQ ID NO: 779648 - RNA, 19 nt, Homo sapiens
guagagaggacaaaguguu

SEQ ID NO: 779649 - RNA, 19 nt, Homo sapiens
ugaaggcaacccaccaaua

SEQ ID NO: 779650 - RNA, 19 nt, Homo sapiens
uggaggaucuauauguuau

SEQ ID NO: 779651 - RNA, 19 nt, Homo sapiens
cuguguauauuguugcuua

SEQ ID NO: 779652 - RNA, 19 nt, Homo sapiens
ggauagaucauauaugcau

SEQ ID NO: 779653 - RNA, 19 nt, Homo sapiens
ugggauagaucauauaugc

SEQ ID NO: 779654 - RNA, 19 nt, Homo sapiens
gaaccaugaugaggauaca

SEQ ID NO: 779655 - RNA, 19 nt, Homo sapiens
uguaguagaugauguaagg

SEQ ID NO: 779656 - RNA, 19 nt, Homo sapiens
accaugagauccggauuua

SEQ ID NO: 779657 - RNA, 19 nt, Homo sapiens
gauggacagugaggagaaa

SEQ ID NO: 779658 - RNA, 19 nt, Homo sapiens
caauugcaguggcucauca

SEQ ID NO: 779659 - RNA, 19 nt, Homo sapiens
caccguaguugugcaauug

SEQ ID NO: 779660 - RNA, 19 nt, Homo sapiens
caggcacuguguccauaua

SEQ ID NO: 779661 - RNA, 19 nt, Homo sapiens
cagggaaaguguguagaaa

SEQ ID NO: 779662 - RNA, 19 nt, Homo sapiens
ccugcugucugucaaauug

SEQ ID NO: 779663 - RNA, 19 nt, Homo sapiens
ugcaguggcucaucaucua

SEQ ID NO: 779664 - RNA, 19 nt, Homo sapiens
ccauauaaccaucuugaau

SEQ ID NO: 779665 - RNA, 19 nt, Homo sapiens
ucgcuucaaugacauaaug

SEQ ID NO: 779666 - RNA, 19 nt, Homo sapiens
gaagaauucagugugagaa

SEQ ID NO: 779667 - RNA, 19 nt, Homo sapiens
agaaacacauuauccacau

SEQ ID NO: 779668 - RNA, 19 nt, Homo sapiens
ggagaucuggaccaauaaa

SEQ ID NO: 779669 - RNA, 19 nt, Homo sapiens
ugacugaugguucuacuug

SEQ ID NO: 779670 - RNA, 19 nt, Homo sapiens
gggcaucugcaacaauaaa

SEQ ID NO: 779671 - RNA, 19 nt, Homo sapiens
uaauugcucaccugcauuu

SEQ ID NO: 779672 - RNA, 19 nt, Homo sapiens
ggaacagagugugggauag

SEQ ID NO: 779673 - RNA, 19 nt, Homo sapiens
gaauaacugcuacuaucau

SEQ ID NO: 779674 - RNA, 19 nt, Homo sapiens
gugugacuguggaccuuua

SEQ ID NO: 779675 - RNA, 19 nt, Homo sapiens
ggaagucggagaacauuac

SEQ ID NO: 779676 - RNA, 19 nt, Homo sapiens
guugaugccuucccagagu

SEQ ID NO: 779677 - RNA, 19 nt, Homo sapiens
gaaaggaggucaaugaaug

SEQ ID NO: 779678 - RNA, 19 nt, Homo sapiens
gaaauaacaugccgaaugg

SEQ ID NO: 779679 - RNA, 19 nt, Homo sapiens
ugacagaaauucccaauau

SEQ ID NO: 779680 - RNA, 19 nt, Homo sapiens
gaaggcaacccaccaauaa

SEQ ID NO: 779681 - RNA, 19 nt, Homo sapiens
ggaaaucugugcaccugua

SEQ ID NO: 779682 - RNA, 19 nt, Homo sapiens
gaaacacauuauccacaua

SEQ ID NO: 779683 - RNA, 19 nt, Homo sapiens
gaagggaccugauauuggu

SEQ ID NO: 779684 - RNA, 19 nt, Homo sapiens
ggaaugguguuguugaaga

SEQ ID NO: 779685 - RNA, 19 nt, Homo sapiens
gaaguucuguuaucugugu

SEQ ID NO: 779686 - RNA, 19 nt, Homo sapiens
gaggauacaugucguuguu

SEQ ID NO: 779687 - RNA, 19 nt, Homo sapiens
caugacaccucacaucuuu

SEQ ID NO: 779688 - RNA, 19 nt, Homo sapiens
uuucacaacucuaggauua

SEQ ID NO: 779689 - RNA, 19 nt, Homo sapiens
gaagcaaaguucuuaugug

SEQ ID NO: 779690 - RNA, 19 nt, Homo sapiens
guagaaaggaggucaauga

SEQ ID NO: 779691 - RNA, 19 nt, Homo sapiens
gcgucgaccucaugaguua

SEQ ID NO: 779692 - RNA, 19 nt, Homo sapiens
gaagauggaauucccugua

SEQ ID NO: 779693 - RNA, 19 nt, Homo sapiens
gaacaucugguauacaaga

SEQ ID NO: 779694 - RNA, 19 nt, Homo sapiens
cagaauaacugcuacuauc

SEQ ID NO: 779695 - RNA, 19 nt, Homo sapiens
ugacuuugcuuaugaaauc

SEQ ID NO: 779696 - RNA, 19 nt, Homo sapiens
gaacaguguaggaggauuu

SEQ ID NO: 779697 - RNA, 19 nt, Homo sapiens
gcagcaagauguucaaacu

SEQ ID NO: 779698 - RNA, 19 nt, Homo sapiens
gaaugguguuguugaagaa

SEQ ID NO: 779699 - RNA, 19 nt, Homo sapiens
gaaaggaacgacucaaagu

SEQ ID NO: 779700 - RNA, 19 nt, Homo sapiens
uauacaagauggacaguga

SEQ ID NO: 779701 - RNA, 19 nt, Homo sapiens
ccagaguggugcaauggua

SEQ ID NO: 779702 - RNA, 19 nt, Homo sapiens
gcgcaaauacugcaaguga

SEQ ID NO: 779703 - RNA, 19 nt, Homo sapiens
caaaguugcuggaggaucu

SEQ ID NO: 779704 - RNA, 19 nt, Homo sapiens
aaagaucccugcugucugu

SEQ ID NO: 779705 - RNA, 19 nt, Homo sapiens
gaggaucuauauguuauug

SEQ ID NO: 779706 - RNA, 19 nt, Homo sapiens
aaacaucacugccauugca

SEQ ID NO: 779707 - RNA, 19 nt, Homo sapiens
cgaauggaauuugaagaaa

SEQ ID NO: 779708 - RNA, 19 nt, Homo sapiens
gugacugugugcuaaauuu

SEQ ID NO: 779709 - RNA, 19 nt, Homo sapiens
ucacugccauugcaauuau

SEQ ID NO: 779710 - RNA, 19 nt, Homo sapiens
gacagaaauucccaauaug

SEQ ID NO: 779711 - RNA, 19 nt, Homo sapiens
gcaaauacugcaagugaga

SEQ ID NO: 779712 - RNA, 19 nt, Homo sapiens
ucaagaagcuuuuguuuuc

SEQ ID NO: 779713 - RNA, 19 nt, Homo sapiens
gaacagagugugggauaga

SEQ ID NO: 779714 - RNA, 19 nt, Homo sapiens
caaauugcacucugacuga

SEQ ID NO: 779715 - RNA, 19 nt, Homo sapiens
ggauacaugucguuguuca

SEQ ID NO: 779716 - RNA, 19 nt, Homo sapiens
guugugcaauuguuacuuu

SEQ ID NO: 779717 - RNA, 19 nt, Homo sapiens
gcuggaggaucuauauguu

SEQ ID NO: 779718 - RNA, 19 nt, Homo sapiens
ugaaauaacaugccgaaug

SEQ ID NO: 779719 - RNA, 19 nt, Homo sapiens
caaagaauugaacaccuua

SEQ ID NO: 779720 - RNA, 19 nt, Homo sapiens
ucaucuaggucauaauuug

SEQ ID NO: 779721 - RNA, 19 nt, Homo sapiens
ggaguacugauuaccauuu

SEQ ID NO: 779722 - RNA, 19 nt, Homo sapiens
gugagaaugugacagaaau

SEQ ID NO: 779723 - RNA, 19 nt, Homo sapiens
acaaagaauugaacaccuu

SEQ ID NO: 779724 - RNA, 19 nt, Homo sapiens
caggcuggcucuccuauau

SEQ ID NO: 779725 - RNA, 19 nt, Homo sapiens
guggaagaauucaguguga

SEQ ID NO: 779726 - RNA, 19 nt, Homo sapiens
aagauggaauucccuguaa

SEQ ID NO: 779727 - RNA, 19 nt, Homo sapiens
ugauauuggugaagugaaa

SEQ ID NO: 779728 - RNA, 19 nt, Homo sapiens
guacauucguuaugaaagg

SEQ ID NO: 779729 - RNA, 19 nt, Homo sapiens
gagacuugcuacaaagaau

SEQ ID NO: 779730 - RNA, 19 nt, Homo sapiens
gggaaaguguguagaaagg

SEQ ID NO: 779731 - RNA, 19 nt, Homo sapiens
gcaauuguuacuuucauga

SEQ ID NO: 779732 - RNA, 19 nt, Homo sapiens
gaaauuguagucgucauug

SEQ ID NO: 779733 - RNA, 19 nt, Homo sapiens
uaacaugccgaauggaauu

SEQ ID NO: 779734 - RNA, 19 nt, Homo sapiens
ccucccaacugccugauaa

SEQ ID NO: 779735 - RNA, 19 nt, Homo sapiens
gaugaagggaccugauauu

SEQ ID NO: 779736 - RNA, 19 nt, Homo sapiens
gggaugaagggaccugaua

SEQ ID NO: 779737 - RNA, 19 nt, Homo sapiens
gaguacugauuaccauuug

SEQ ID NO: 779738 - RNA, 19 nt, Homo sapiens
gugaagcgcugugggaaug

SEQ ID NO: 779739 - RNA, 19 nt, Homo sapiens
gcaacccaccaauaacuaa

SEQ ID NO: 779740 - RNA, 19 nt, Homo sapiens
gcaaguggaagucggagaa

SEQ ID NO: 779741 - RNA, 19 nt, Homo sapiens
caugagauccggauuuaug

SEQ ID NO: 779742 - RNA, 19 nt, Homo sapiens
ggaggucaaugaaugugau

SEQ ID NO: 779743 - RNA, 19 nt, Homo sapiens
ggugaugccuucccagagu

SEQ ID NO: 779744 - RNA, 19 nt, Homo sapiens
ggugaugccuucccagagu

SEQ ID NO: 779745 - RNA, 19 nt, Homo sapiens
acagaaauucccaauauga

SEQ ID NO: 779746 - RNA, 19 nt, Homo sapiens
caucaucuaggucauaauu

SEQ ID NO: 779747 - RNA, 19 nt, Homo sapiens
caacaugacaccucacauc

SEQ ID NO: 779748 - RNA, 19 nt, Homo sapiens
uugaacaucugguauacaa

SEQ ID NO: 779749 - RNA, 19 nt, Homo sapiens
ggaagaauucagugugaga

SEQ ID NO: 779750 - RNA, 19 nt, Homo sapiens
guagagaggacaaaguguu

SEQ ID NO: 779751 - RNA, 19 nt, Homo sapiens
ugaaggcaacccaccaaua

SEQ ID NO: 779752 - RNA, 19 nt, Homo sapiens
uggaggaucuauauguuau

SEQ ID NO: 779753 - RNA, 19 nt, Homo sapiens
cuguguauauuguugcuua

SEQ ID NO: 779754 - RNA, 19 nt, Homo sapiens
ggauagaucauauaugcau

SEQ ID NO: 779755 - RNA, 19 nt, Homo sapiens
ugggauagaucauauaugc

SEQ ID NO: 779756 - RNA, 19 nt, Homo sapiens
gaaccaugaugaggauaca

SEQ ID NO: 779757 - RNA, 19 nt, Homo sapiens
uguaguagaugauguaagg

SEQ ID NO: 779758 - RNA, 19 nt, Homo sapiens
accaugagauccggauuua

SEQ ID NO: 779759 - RNA, 19 nt, Homo sapiens
gauggacagugaggagaaa

SEQ ID NO: 779760 - RNA, 19 nt, Homo sapiens
caauugcaguggcucauca

SEQ ID NO: 779761 - RNA, 19 nt, Homo sapiens
caccguaguugugcaauug

SEQ ID NO: 779762 - RNA, 19 nt, Homo sapiens
caggcacuguguccauaua

SEQ ID NO: 779763 - RNA, 19 nt, Homo sapiens
cagggaaaguguguagaaa

SEQ ID NO: 779764 - RNA, 19 nt, Homo sapiens
ccugcugucugucaaauug

SEQ ID NO: 779765 - RNA, 19 nt, Homo sapiens
ugcaguggcucaucaucua

SEQ ID NO: 779766 - RNA, 19 nt, Homo sapiens
ccauauaaccaucuugaau

SEQ ID NO: 779767 - RNA, 19 nt, Homo sapiens
ucgcuucaaugacauaaug

SEQ ID NO: 779768 - RNA, 19 nt, Homo sapiens
agaaacacauuauccacau

SEQ ID NO: 779769 - RNA, 19 nt, Homo sapiens
gaagaauucagugugagaa

SEQ ID NO: 779770 - RNA, 19 nt, Homo sapiens
ggagaucuggaccaauaaa

SEQ ID NO: 779771 - RNA, 19 nt, Homo sapiens
ugacugaugguucuacuug

SEQ ID NO: 779772 - RNA, 19 nt, Homo sapiens
gggcaucugcaacaauaaa

SEQ ID NO: 779773 - RNA, 19 nt, Homo sapiens
uaauugcucaccugcauuu

SEQ ID NO: 779774 - RNA, 19 nt, Homo sapiens
ggaacagagugugggauag

SEQ ID NO: 779775 - RNA, 19 nt, Homo sapiens
gugugacuguggaccuuua

SEQ ID NO: 779776 - RNA, 19 nt, Homo sapiens
gaauaacugcuacuaucau

SEQ ID NO: 779777 - RNA, 19 nt, Homo sapiens
gcacaugacucucccguuu

SEQ ID NO: 779778 - RNA, 19 nt, Homo sapiens
cgaaagagauuguacagaa

SEQ ID NO: 779779 - RNA, 19 nt, Homo sapiens
ggaagugccugaagacgua

SEQ ID NO: 779780 - RNA, 19 nt, Homo sapiens
gaaagagauuguacagaaa

SEQ ID NO: 779781 - RNA, 19 nt, Homo sapiens
gagaguggcuggcaaguuc

SEQ ID NO: 779782 - RNA, 19 nt, Homo sapiens
gauggauccuugauaguuu

SEQ ID NO: 779783 - RNA, 19 nt, Homo sapiens
ugacauuucuugccaauuc

SEQ ID NO: 779784 - RNA, 19 nt, Homo sapiens
gcaaguucaucugcugaua

SEQ ID NO: 779785 - RNA, 19 nt, Homo sapiens
ccacacagaugucgugauc

SEQ ID NO: 779786 - RNA, 19 nt, Homo sapiens
gacaaaaccuugaagauau

SEQ ID NO: 779787 - RNA, 19 nt, Homo sapiens
gaagggacacaguaauuau

SEQ ID NO: 779788 - RNA, 19 nt, Homo sapiens
gacgaaagcgugaggauau

SEQ ID NO: 779789 - RNA, 19 nt, Homo sapiens
gauucuaaccuucuuguuu

SEQ ID NO: 779790 - RNA, 19 nt, Homo sapiens
gaggauaugggaugugaaa

SEQ ID NO: 779791 - RNA, 19 nt, Homo sapiens
ugaagggacacaguaauua

SEQ ID NO: 779792 - RNA, 19 nt, Homo sapiens
gccaguagcuguuccuagu

SEQ ID NO: 779793 - RNA, 19 nt, Homo sapiens
gaaugagaaauacugcaua

SEQ ID NO: 779794 - RNA, 19 nt, Homo sapiens
gccacaagaaugagaaaua

SEQ ID NO: 779795 - RNA, 19 nt, Homo sapiens
guaaacguucuguaucuuu

SEQ ID NO: 779796 - RNA, 19 nt, Homo sapiens
ccacaagaaugagaaauac

SEQ ID NO: 779797 - RNA, 19 nt, Homo sapiens
ggauaaccuuguuuacauc

SEQ ID NO: 779798 - RNA, 19 nt, Homo sapiens
cagaggauaaccuuguuua

SEQ ID NO: 779799 - RNA, 19 nt, Homo sapiens
gaagaguuccuagucuauu

SEQ ID NO: 779800 - RNA, 19 nt, Homo sapiens
guggaagagugacugcuaa

SEQ ID NO: 779801 - RNA, 19 nt, Homo sapiens
gccaaacuaugcucuaaag

SEQ ID NO: 779802 - RNA, 19 nt, Homo sapiens
caauuaaacuguggaagag

SEQ ID NO: 779803 - RNA, 19 nt, Homo sapiens
ggugggaaguggauugugu

SEQ ID NO: 779804 - RNA, 19 nt, Homo sapiens
caaguucaucugcugauaa

SEQ ID NO: 779805 - RNA, 19 nt, Homo sapiens
caguaaacguucuguaucu

SEQ ID NO: 779806 - RNA, 19 nt, Homo sapiens
gaggauaaccuuguuuaca

SEQ ID NO: 779807 - RNA, 19 nt, Homo sapiens
gugaggauaugggauguga

SEQ ID NO: 779808 - RNA, 19 nt, Homo sapiens
acaauuaaacuguggaaga

SEQ ID NO: 779809 - RNA, 19 nt, Homo sapiens
aggauaaccuuguuuacau

SEQ ID NO: 779810 - RNA, 19 nt, Homo sapiens
cuacaccugugaagccaaa

SEQ ID NO: 779811 - RNA, 19 nt, Homo sapiens
cgugauggauccuugauag

SEQ ID NO: 779812 - RNA, 19 nt, Homo sapiens
gaaacuacaaggccacaca

SEQ ID NO: 779813 - RNA, 19 nt, Homo sapiens
acagggaagugccucaaga

SEQ ID NO: 779814 - RNA, 19 nt, Homo sapiens
gaagccaaacuaugcucua

SEQ ID NO: 779815 - RNA, 19 nt, Homo sapiens
gcucagaggauaaccuugu

SEQ ID NO: 779816 - RNA, 19 nt, Homo sapiens
aagaguuccuagucuauug

SEQ ID NO: 779817 - RNA, 19 nt, Homo sapiens
aaaaguugcuggugacauu

SEQ ID NO: 779818 - RNA, 19 nt, Homo sapiens
cuacaaggccacacagaug

SEQ ID NO: 779819 - RNA, 19 nt, Homo sapiens
cugcauauuugccaauuuc

SEQ ID NO: 779820 - RNA, 19 nt, Homo sapiens
gcaguguccuccgugaaau

SEQ ID NO: 779821 - RNA, 19 nt, Homo sapiens
ugacaaaaccuugaagaua

SEQ ID NO: 779822 - RNA, 19 nt, Homo sapiens
aaguucaucugcugauaaa

SEQ ID NO: 779823 - RNA, 19 nt, Homo sapiens
gcuagaaaaugacaaaaca

SEQ ID NO: 779824 - RNA, 19 nt, Homo sapiens
acacuggccacaagaauga

SEQ ID NO: 779825 - RNA, 19 nt, Homo sapiens
aagccaaacuaugcucuaa

SEQ ID NO: 779826 - RNA, 19 nt, Homo sapiens
gcaccgcagacuguaauaa

SEQ ID NO: 779827 - RNA, 19 nt, Homo sapiens
caauuuaacaugcguugug

SEQ ID NO: 779828 - RNA, 19 nt, Homo sapiens
gucgugaucucaacagcuu

SEQ ID NO: 779829 - RNA, 19 nt, Homo sapiens
gacguacacuggccacaag

SEQ ID NO: 779830 - RNA, 19 nt, Homo sapiens
guuugugucuugggaguuu

SEQ ID NO: 779831 - RNA, 19 nt, Homo sapiens
ccuagucuauuguguucaa

SEQ ID NO: 779832 - RNA, 19 nt, Homo sapiens
ggugacauuucuugccaau

SEQ ID NO: 779833 - RNA, 19 nt, Homo sapiens
ugacgaaagcgugaggaua

SEQ ID NO: 779834 - RNA, 19 nt, Homo sapiens
auucuaaccuucuuguuuc

SEQ ID NO: 779835 - RNA, 19 nt, Homo sapiens
ggucacaagcugggaauau

SEQ ID NO: 779836 - RNA, 19 nt, Homo sapiens
gacccggauuggcaagaaa

SEQ ID NO: 779837 - RNA, 19 nt, Homo sapiens
uagcuaugauggucucugu

SEQ ID NO: 779838 - RNA, 19 nt, Homo sapiens
caccgcagacuguaauaaa

SEQ ID NO: 779839 - RNA, 19 nt, Homo sapiens
ggcccugacuccuccauuc

SEQ ID NO: 779840 - RNA, 19 nt, Homo sapiens
ggagaguggcuggcaaguu

SEQ ID NO: 779841 - RNA, 19 nt, Homo sapiens
gaugggaaauuugagaaaa

SEQ ID NO: 779842 - RNA, 19 nt, Homo sapiens
gcuugucacccaacagaaa

SEQ ID NO: 779843 - RNA, 19 nt, Homo sapiens
cguaugaugggaaauuuga

SEQ ID NO: 779844 - RNA, 19 nt, Homo sapiens
caguagcuguuccuagugu

SEQ ID NO: 779845 - RNA, 19 nt, Homo sapiens
gagacugucgggaaguuga

SEQ ID NO: 779846 - RNA, 19 nt, Homo sapiens
gcgcguaugaugggaaauu

SEQ ID NO: 779847 - RNA, 19 nt, Homo sapiens
gcagcaccgcagacuguaa

SEQ ID NO: 779848 - RNA, 19 nt, Homo sapiens
acaugacucucccguuugu

SEQ ID NO: 779849 - RNA, 19 nt, Homo sapiens
uaaagagccguuugugucu

SEQ ID NO: 779850 - RNA, 19 nt, Homo sapiens
gccaauuucucuguuacug

SEQ ID NO: 779851 - RNA, 19 nt, Homo sapiens
guacacuggccacaagaau

SEQ ID NO: 779852 - RNA, 19 nt, Homo sapiens
guagccuggucgucagauu

SEQ ID NO: 779853 - RNA, 19 nt, Homo sapiens
ccaauucuaacacugucua

SEQ ID NO: 779854 - RNA, 19 nt, Homo sapiens
ugauggauccuugauaguu

SEQ ID NO: 779855 - RNA, 19 nt, Homo sapiens
gauaugggaugugaaaaca

SEQ ID NO: 779856 - RNA, 19 nt, Homo sapiens
ucaggauccuuugacgaaa

SEQ ID NO: 779857 - RNA, 19 nt, Homo sapiens
cugaagggacacaguaauu

SEQ ID NO: 779858 - RNA, 19 nt, Homo sapiens
gucacaagcugggaauauc

SEQ ID NO: 779859 - RNA, 19 nt, Homo sapiens
guucaaacagagucaacaa

SEQ ID NO: 779860 - RNA, 19 nt, Homo sapiens
ggaaccuucagacgaaaga

SEQ ID NO: 779861 - RNA, 19 nt, Homo sapiens
gucgucagauucuaaccuu

SEQ ID NO: 779862 - RNA, 19 nt, Homo sapiens
ccuccucucugaagaugau

SEQ ID NO: 779863 - RNA, 19 nt, Homo sapiens
ugacccggauuggcaagaa

SEQ ID NO: 779864 - RNA, 19 nt, Homo sapiens
gagauuguacagaaacuac

SEQ ID NO: 779865 - RNA, 19 nt, Homo sapiens
gcugggaauauccgaugua

SEQ ID NO: 779866 - RNA, 19 nt, Homo sapiens
ucaguaaacguucuguauc

SEQ ID NO: 779867 - RNA, 19 nt, Homo sapiens
agaaacagggugucuugga

SEQ ID NO: 779868 - RNA, 19 nt, Homo sapiens
cagcuugucacccaacaga

SEQ ID NO: 779869 - RNA, 19 nt, Homo sapiens
acaagaaugagaaauacug

SEQ ID NO: 779870 - RNA, 19 nt, Homo sapiens
cagcauugagugguuguuu

SEQ ID NO: 779871 - RNA, 19 nt, Homo sapiens
caaacagagucaacaaaag

SEQ ID NO: 779872 - RNA, 19 nt, Homo sapiens
uuugccaauuucucuguua

SEQ ID NO: 779873 - RNA, 19 nt, Homo sapiens
cgcguaugaugggaaauuu

SEQ ID NO: 779874 - RNA, 19 nt, Homo sapiens
ucaaacagagucaacaaaa

SEQ ID NO: 779875 - RNA, 19 nt, Homo sapiens
aagagacugucgggaaguu

SEQ ID NO: 779876 - RNA, 19 nt, Homo sapiens
ggaagagugacugcuaagu

SEQ ID NO: 779877 - RNA, 19 nt, Homo sapiens
cgaaagagauuguacagaa

SEQ ID NO: 779878 - RNA, 19 nt, Homo sapiens
ggaagugccugaagacgua

SEQ ID NO: 779879 - RNA, 19 nt, Homo sapiens
gaaagagauuguacagaaa

SEQ ID NO: 779880 - RNA, 19 nt, Homo sapiens
gagaguggcuggcaaguuc

SEQ ID NO: 779881 - RNA, 19 nt, Homo sapiens
gauggauccuugauaguuu

SEQ ID NO: 779882 - RNA, 19 nt, Homo sapiens
gcacauggauuuucccuuu

SEQ ID NO: 779883 - RNA, 19 nt, Homo sapiens
ugacauuucuugccaauuc

SEQ ID NO: 779884 - RNA, 19 nt, Homo sapiens
gcaaguucaucugcugaua

SEQ ID NO: 779885 - RNA, 19 nt, Homo sapiens
ggaaaguucuuaaaaguug

SEQ ID NO: 779886 - RNA, 19 nt, Homo sapiens
ccacacagaugucgugauc

SEQ ID NO: 779887 - RNA, 19 nt, Homo sapiens
gacaaaaccuugaagauau

SEQ ID NO: 779888 - RNA, 19 nt, Homo sapiens
gaagggacacaguaauuau

SEQ ID NO: 779889 - RNA, 19 nt, Homo sapiens
gacgaaagcgugaggauau

SEQ ID NO: 779890 - RNA, 19 nt, Homo sapiens
gauucuaaccuucuuguuu

SEQ ID NO: 779891 - RNA, 19 nt, Homo sapiens
gaggauaugggaugugaaa

SEQ ID NO: 779892 - RNA, 19 nt, Homo sapiens
ugaagggacacaguaauua

SEQ ID NO: 779893 - RNA, 19 nt, Homo sapiens
gccaguagcuguuccuagu

SEQ ID NO: 779894 - RNA, 19 nt, Homo sapiens
gaaugagaaauacugcaua

SEQ ID NO: 779895 - RNA, 19 nt, Homo sapiens
gccacaagaaugagaaaua

SEQ ID NO: 779896 - RNA, 19 nt, Homo sapiens
guaaacguucuguaucuuu

SEQ ID NO: 779897 - RNA, 19 nt, Homo sapiens
ccacaagaaugagaaauac

SEQ ID NO: 779898 - RNA, 19 nt, Homo sapiens
ggauaaccuuguuuacauc

SEQ ID NO: 779899 - RNA, 19 nt, Homo sapiens
cagaggauaaccuuguuua

SEQ ID NO: 779900 - RNA, 19 nt, Homo sapiens
gaagaguuccuagucuauu

SEQ ID NO: 779901 - RNA, 19 nt, Homo sapiens
gagagacugucgggaaguu

SEQ ID NO: 779902 - RNA, 19 nt, Homo sapiens
guggaagagugacugcuaa

SEQ ID NO: 779903 - RNA, 19 nt, Homo sapiens
gccaaacuaugcucuaaag

SEQ ID NO: 779904 - RNA, 19 nt, Homo sapiens
caauuaaacuguggaagag

SEQ ID NO: 779905 - RNA, 19 nt, Homo sapiens
ggugggaaguggauugugu

SEQ ID NO: 779906 - RNA, 19 nt, Homo sapiens
caaguucaucugcugauaa

SEQ ID NO: 779907 - RNA, 19 nt, Homo sapiens
caguaaacguucuguaucu

SEQ ID NO: 779908 - RNA, 19 nt, Homo sapiens
gaggauaaccuuguuuaca

SEQ ID NO: 779909 - RNA, 19 nt, Homo sapiens
gugaggauaugggauguga

SEQ ID NO: 779910 - RNA, 19 nt, Homo sapiens
cuacaccugugaagccaaa

SEQ ID NO: 779911 - RNA, 19 nt, Homo sapiens
acaauuaaacuguggaaga

SEQ ID NO: 779912 - RNA, 19 nt, Homo sapiens
aggauaaccuuguuuacau

SEQ ID NO: 779913 - RNA, 19 nt, Homo sapiens
cgugauggauccuugauag

SEQ ID NO: 779914 - RNA, 19 nt, Homo sapiens
gaaacuacaaggccacaca

SEQ ID NO: 779915 - RNA, 19 nt, Homo sapiens
acagggaagugccucaaga

SEQ ID NO: 779916 - RNA, 19 nt, Homo sapiens
gaagccaaacuaugcucua

SEQ ID NO: 779917 - RNA, 19 nt, Homo sapiens
gcucagaggauaaccuugu

SEQ ID NO: 779918 - RNA, 19 nt, Homo sapiens
gcaucucgcucaacagacu

SEQ ID NO: 779919 - RNA, 19 nt, Homo sapiens
aagaguuccuagucuauug

SEQ ID NO: 779920 - RNA, 19 nt, Homo sapiens
aaaaguugcuggugacauu

SEQ ID NO: 779921 - RNA, 19 nt, Homo sapiens
cuacaaggccacacagaug

SEQ ID NO: 779922 - RNA, 19 nt, Homo sapiens
gcaguguccuccgugaaau

SEQ ID NO: 779923 - RNA, 19 nt, Homo sapiens
cugcauauuugccaauuuc

SEQ ID NO: 779924 - RNA, 19 nt, Homo sapiens
ugacaaaaccuugaagaua

SEQ ID NO: 779925 - RNA, 19 nt, Homo sapiens
aaguucaucugcugauaaa

SEQ ID NO: 779926 - RNA, 19 nt, Homo sapiens
gcuagaaaaugacaaaaca

SEQ ID NO: 779927 - RNA, 19 nt, Homo sapiens
acacuggccacaagaauga

SEQ ID NO: 779928 - RNA, 19 nt, Homo sapiens
aagccaaacuaugcucuaa

SEQ ID NO: 779929 - RNA, 19 nt, Homo sapiens
caauuuaacaugcguugug

SEQ ID NO: 779930 - RNA, 19 nt, Homo sapiens
gucgugaucucaacagcuu

SEQ ID NO: 779931 - RNA, 19 nt, Homo sapiens
gacguacacuggccacaag

SEQ ID NO: 779932 - RNA, 19 nt, Homo sapiens
guuugugucuugggaguuu

SEQ ID NO: 779933 - RNA, 19 nt, Homo sapiens
ccuagucuauuguguucaa

SEQ ID NO: 779934 - RNA, 19 nt, Homo sapiens
ggugacauuucuugccaau

SEQ ID NO: 779935 - RNA, 19 nt, Homo sapiens
ugacgaaagcgugaggaua

SEQ ID NO: 779936 - RNA, 19 nt, Homo sapiens
auucuaaccuucuuguuuc

SEQ ID NO: 779937 - RNA, 19 nt, Homo sapiens
ggucacaagcugggaauau

SEQ ID NO: 779938 - RNA, 19 nt, Homo sapiens
gacccggauuggcaagaaa

SEQ ID NO: 779939 - RNA, 19 nt, Homo sapiens
uagcuaugauggucucugu

SEQ ID NO: 779940 - RNA, 19 nt, Homo sapiens
ggcccugacuccuccauuc

SEQ ID NO: 779941 - RNA, 19 nt, Homo sapiens
ggagaguggcuggcaaguu

SEQ ID NO: 779942 - RNA, 19 nt, Homo sapiens
gaugggaaauuugagaaaa

SEQ ID NO: 779943 - RNA, 19 nt, Homo sapiens
gcuugucacccaacagaaa

SEQ ID NO: 779944 - RNA, 19 nt, Homo sapiens
cguaugaugggaaauuuga

SEQ ID NO: 779945 - RNA, 19 nt, Homo sapiens
caguagcuguuccuagugu

SEQ ID NO: 779946 - RNA, 19 nt, Homo sapiens
gagacugucgggaaguuga

SEQ ID NO: 779947 - RNA, 19 nt, Homo sapiens
gcgcguaugaugggaaauu

SEQ ID NO: 779948 - RNA, 19 nt, Homo sapiens
gauuuucccuuuuguuuuc

SEQ ID NO: 779949 - RNA, 19 nt, Homo sapiens
uaaagagccguuugugucu

SEQ ID NO: 779950 - RNA, 19 nt, Homo sapiens
gccaauuucucuguuacug

SEQ ID NO: 779951 - RNA, 19 nt, Homo sapiens
guacacuggccacaagaau

SEQ ID NO: 779952 - RNA, 19 nt, Homo sapiens
guagccuggucgucagauu

SEQ ID NO: 779953 - RNA, 19 nt, Homo sapiens
ccaauucuaacacugucua

SEQ ID NO: 779954 - RNA, 19 nt, Homo sapiens
ugauggauccuugauaguu

SEQ ID NO: 779955 - RNA, 19 nt, Homo sapiens
gaccaccggaaaguucuua

SEQ ID NO: 779956 - RNA, 19 nt, Homo sapiens
gauaugggaugugaaaaca

SEQ ID NO: 779957 - RNA, 19 nt, Homo sapiens
ucaggauccuuugacgaaa

SEQ ID NO: 779958 - RNA, 19 nt, Homo sapiens
cugaagggacacaguaauu

SEQ ID NO: 779959 - RNA, 19 nt, Homo sapiens
gucacaagcugggaauauc

SEQ ID NO: 779960 - RNA, 19 nt, Homo sapiens
ucauucggcacauggauuu

SEQ ID NO: 779961 - RNA, 19 nt, Homo sapiens
guucaaacagagucaacaa

SEQ ID NO: 779962 - RNA, 19 nt, Homo sapiens
ggaaccuucagacgaaaga

SEQ ID NO: 779963 - RNA, 19 nt, Homo sapiens
gucgucagauucuaaccuu

SEQ ID NO: 779964 - RNA, 19 nt, Homo sapiens
ccuccucucugaagaugau

SEQ ID NO: 779965 - RNA, 19 nt, Homo sapiens
ugacccggauuggcaagaa

SEQ ID NO: 779966 - RNA, 19 nt, Homo sapiens
gagauuguacagaaacuac

SEQ ID NO: 779967 - RNA, 19 nt, Homo sapiens
gcugggaauauccgaugua

SEQ ID NO: 779968 - RNA, 19 nt, Homo sapiens
ucaguaaacguucuguauc

SEQ ID NO: 779969 - RNA, 19 nt, Homo sapiens
ccaccggaaaguucuuaaa

SEQ ID NO: 779970 - RNA, 19 nt, Homo sapiens
agaaacagggugucuugga

SEQ ID NO: 779971 - RNA, 19 nt, Homo sapiens
cagcuugucacccaacaga

SEQ ID NO: 779972 - RNA, 19 nt, Homo sapiens
acaagaaugagaaauacug

SEQ ID NO: 779973 - RNA, 19 nt, Homo sapiens
cagcauugagugguuguuu

SEQ ID NO: 779974 - RNA, 19 nt, Homo sapiens
caaacagagucaacaaaag

SEQ ID NO: 779975 - RNA, 19 nt, Homo sapiens
uuugccaauuucucuguua

SEQ ID NO: 779976 - RNA, 19 nt, Homo sapiens
ucaaacagagucaacaaaa

SEQ ID NO: 779977 - RNA, 19 nt, Homo sapiens
ggaaucagccaauauauua

SEQ ID NO: 779978 - RNA, 19 nt, Homo sapiens
gaacucagcguguuuauuu

SEQ ID NO: 779979 - RNA, 19 nt, Homo sapiens
gagcuuugcuguuuaauuu

SEQ ID NO: 779980 - RNA, 19 nt, Homo sapiens
gcggagagcuuugcuguuu

SEQ ID NO: 779981 - RNA, 19 nt, Homo sapiens
ggagagcuuugcuguuuaa

SEQ ID NO: 779982 - RNA, 19 nt, Homo sapiens
gggagacagucaagaauaa

SEQ ID NO: 779983 - RNA, 19 nt, Homo sapiens
caaacaggaugguguggua

SEQ ID NO: 779984 - RNA, 19 nt, Homo sapiens
ccaccuggcuaauuuauau

SEQ ID NO: 779985 - RNA, 19 nt, Homo sapiens
ggagggcacugaacuguca

SEQ ID NO: 779986 - RNA, 19 nt, Homo sapiens
ugaaugaggugaaagaauc

SEQ ID NO: 779987 - RNA, 19 nt, Homo sapiens
ucaccuagguccucuuuga

SEQ ID NO: 779988 - RNA, 19 nt, Homo sapiens
gaacucaguaguguguuua

SEQ ID NO: 779989 - RNA, 19 nt, Homo sapiens
caagggcgaugaccugguu

SEQ ID NO: 779990 - RNA, 19 nt, Homo sapiens
ccaagggaaucagccaaua

SEQ ID NO: 779991 - RNA, 19 nt, Homo sapiens
ccacagaggaagacaauga

SEQ ID NO: 779992 - RNA, 19 nt, Homo sapiens
ggauuccucuucuccugua

SEQ ID NO: 779993 - RNA, 19 nt, Homo sapiens
gacaaugaaugaggugaaa

SEQ ID NO: 779994 - RNA, 19 nt, Homo sapiens
ggugggaaauuguaacuca

SEQ ID NO: 779995 - RNA, 19 nt, Homo sapiens
guaaaugaccacagaggaa

SEQ ID NO: 779996 - RNA, 19 nt, Homo sapiens
gaggaaacccacuuacaga

SEQ ID NO: 779997 - RNA, 19 nt, Homo sapiens
caccucgccuggcuaauuu

SEQ ID NO: 779998 - RNA, 19 nt, Homo sapiens
gggaaucagccaauauauu

SEQ ID NO: 779999 - RNA, 19 nt, Homo sapiens
ggagaacgcccacgacaag

SEQ ID NO: 780000 - RNA, 19 nt, Homo sapiens
ggccagaacucaguagugu

SEQ ID NO: 780001 - RNA, 19 nt, Homo sapiens
cauccuagacuuaaugaaa

SEQ ID NO: 780002 - RNA, 19 nt, Homo sapiens
cugaguagcuggaauuaca

SEQ ID NO: 780003 - RNA, 19 nt, Homo sapiens
gagcuugcccaaaguaaug

SEQ ID NO: 780004 - RNA, 19 nt, Homo sapiens
ccaaagugcugggauuaca

SEQ ID NO: 780005 - RNA, 19 nt, Homo sapiens
ccaaagugcugggauuaca

SEQ ID NO: 780006 - RNA, 19 nt, Homo sapiens
gggaauaaacucaccuuuc

SEQ ID NO: 780007 - RNA, 19 nt, Homo sapiens
gcaaggcacacgcuguuug

SEQ ID NO: 780008 - RNA, 19 nt, Homo sapiens
agacagcguuucaccaugu

SEQ ID NO: 780009 - RNA, 19 nt, Homo sapiens
ucaguaguguguuuaguuc

SEQ ID NO: 780010 - RNA, 19 nt, Homo sapiens
ccucuucuccuguaaauga

SEQ ID NO: 780011 - RNA, 19 nt, Homo sapiens
ugaagaggaaacccacuua

SEQ ID NO: 780012 - RNA, 19 nt, Homo sapiens
caaaauacccucaugaugu

SEQ ID NO: 780013 - RNA, 19 nt, Homo sapiens
cggagagcuuugcuguuua

SEQ ID NO: 780014 - RNA, 19 nt, Homo sapiens
agaggaagacaaugaauga

SEQ ID NO: 780015 - RNA, 19 nt, Homo sapiens
gcaucgagcagaaguacaa

SEQ ID NO: 780016 - RNA, 19 nt, Homo sapiens
cuucugagcuugcccaaag

SEQ ID NO: 780017 - RNA, 19 nt, Homo sapiens
gaaguugcccaaacaggau

SEQ ID NO: 780018 - RNA, 19 nt, Homo sapiens
cuucuaacauuuccacuuc

SEQ ID NO: 780019 - RNA, 19 nt, Homo sapiens
aaaguauucuaccaccaaa

SEQ ID NO: 780020 - RNA, 19 nt, Homo sapiens
agaacucaguaguguguuu

SEQ ID NO: 780021 - RNA, 19 nt, Homo sapiens
uuacagaaguugcccaaac

SEQ ID NO: 780022 - RNA, 19 nt, Homo sapiens
ucuaacauuuccacuucua

SEQ ID NO: 780023 - RNA, 19 nt, Homo sapiens
agagcuacauggaacacua

SEQ ID NO: 780024 - RNA, 19 nt, Homo sapiens
caaugaaugaggugaaaga

SEQ ID NO: 780025 - RNA, 19 nt, Homo sapiens
cuccugaccucaugaucua

SEQ ID NO: 780026 - RNA, 19 nt, Homo sapiens
ggacccugccacuuacuaa

SEQ ID NO: 780027 - RNA, 19 nt, Homo sapiens
ugaaccaccucagcuguga

SEQ ID NO: 780028 - RNA, 19 nt, Homo sapiens
ggagacagucaagaauaaa

SEQ ID NO: 780029 - RNA, 19 nt, Homo sapiens
uacagaaguugcccaaaca

SEQ ID NO: 780030 - RNA, 19 nt, Homo sapiens
ggaaacccacuuacagaag

SEQ ID NO: 780031 - RNA, 19 nt, Homo sapiens
aagggaaucagccaauaua

SEQ ID NO: 780032 - RNA, 19 nt, Homo sapiens
caagggaaucagccaauau

SEQ ID NO: 780033 - RNA, 19 nt, Homo sapiens
ccaccucgccuggcuaauu

SEQ ID NO: 780034 - RNA, 19 nt, Homo sapiens
cuuagcuucuguauuauug

SEQ ID NO: 780035 - RNA, 19 nt, Homo sapiens
caccuuuccuucgccuuua

SEQ ID NO: 780036 - RNA, 19 nt, Homo sapiens
ccucuugcuuuaacuucua

SEQ ID NO: 780037 - RNA, 19 nt, Homo sapiens
ucaaucuccugaccucaug

SEQ ID NO: 780038 - RNA, 19 nt, Homo sapiens
gaacgcccacgacaagauc

SEQ ID NO: 780039 - RNA, 19 nt, Homo sapiens
cggcccaucuccagcauug

SEQ ID NO: 780040 - RNA, 19 nt, Homo sapiens
gaccacagaggaagacaau

SEQ ID NO: 780041 - RNA, 19 nt, Homo sapiens
uaagcagccucagagcaaa

SEQ ID NO: 780042 - RNA, 19 nt, Homo sapiens
uagccaaagcaacgacuua

SEQ ID NO: 780043 - RNA, 19 nt, Homo sapiens
caugacagaagccagaauu

SEQ ID NO: 780044 - RNA, 19 nt, Homo sapiens
ccagaacucaguagugugu

SEQ ID NO: 780045 - RNA, 19 nt, Homo sapiens
ggaacucagcguguuuauu

SEQ ID NO: 780046 - RNA, 19 nt, Homo sapiens
gcuccgugcugaugaagag

SEQ ID NO: 780047 - RNA, 19 nt, Homo sapiens
cuuccucucucucuucuug

SEQ ID NO: 780048 - RNA, 19 nt, Homo sapiens
cgacuuaagcagccucaga

SEQ ID NO: 780049 - RNA, 19 nt, Homo sapiens
ugaucaagcuggagaccau

SEQ ID NO: 780050 - RNA, 19 nt, Homo sapiens
gaagaggaaacccacuuac

SEQ ID NO: 780051 - RNA, 19 nt, Homo sapiens
uagccaggauggucucaau

SEQ ID NO: 780052 - RNA, 19 nt, Homo sapiens
agagggagaccaugacaga

SEQ ID NO: 780053 - RNA, 19 nt, Homo sapiens
ugccucagccucccaagua

SEQ ID NO: 780054 - RNA, 19 nt, Homo sapiens
guagacagcucacaaaagc

SEQ ID NO: 780055 - RNA, 19 nt, Homo sapiens
uuaagcagccucagagcaa

SEQ ID NO: 780056 - RNA, 19 nt, Homo sapiens
caaagcaacgacuuaagca

SEQ ID NO: 780057 - RNA, 19 nt, Homo sapiens
caaccucggcucacugcaa

SEQ ID NO: 780058 - RNA, 19 nt, Homo sapiens
gcaaaauacccucaugaug

SEQ ID NO: 780059 - RNA, 19 nt, Homo sapiens
cagaggaagacaaugaaug

SEQ ID NO: 780060 - RNA, 19 nt, Homo sapiens
gaacuccugaccucaacug

SEQ ID NO: 780061 - RNA, 19 nt, Homo sapiens
gacagcguuucaccauguu

SEQ ID NO: 780062 - RNA, 19 nt, Homo sapiens
gcuuugcuguuuaauuugg

SEQ ID NO: 780063 - RNA, 19 nt, Homo sapiens
aaaauacccucaugaugug

SEQ ID NO: 780064 - RNA, 19 nt, Homo sapiens
uuggacaggugcagagcua

SEQ ID NO: 780065 - RNA, 19 nt, Homo sapiens
gucccuggcuucugagcuu

SEQ ID NO: 780066 - RNA, 19 nt, Homo sapiens
ggagagggagaccaugaca

SEQ ID NO: 780067 - RNA, 19 nt, Homo sapiens
ggacaggugcagagcuaca

SEQ ID NO: 780068 - RNA, 19 nt, Homo sapiens
gggagaacgcccacgacaa

SEQ ID NO: 780069 - RNA, 19 nt, Homo sapiens
guggaacucagcguguuua

SEQ ID NO: 780070 - RNA, 19 nt, Homo sapiens
ccaaagcaacgacuuaagc

SEQ ID NO: 780071 - RNA, 19 nt, Homo sapiens
uaacauuuccacuucuaag

SEQ ID NO: 780072 - RNA, 19 nt, Homo sapiens
gcagcaucgagcagaagua

SEQ ID NO: 780073 - RNA, 19 nt, Homo sapiens
ggcggguucugcucauguu

SEQ ID NO: 780074 - RNA, 19 nt, Homo sapiens
ucaccuuuccuucgccuuu

SEQ ID NO: 780075 - RNA, 19 nt, Homo sapiens
aauaaacucaccuuuccuu

SEQ ID NO: 780076 - RNA, 19 nt, Homo sapiens
ugaucggccucccaaagug

SEQ ID NO: 780077 - RNA, 19 nt, Homo sapiens
gcaggaagcuguuggacau

SEQ ID NO: 780078 - RNA, 19 nt, Homo sapiens
gagcaggccugucccauuc

SEQ ID NO: 780079 - RNA, 19 nt, Homo sapiens
ggaggaagaugugcaggaa

SEQ ID NO: 780080 - RNA, 19 nt, Homo sapiens
ggacugggcugcagguuac

SEQ ID NO: 780081 - RNA, 19 nt, Homo sapiens
gaacugcaaccaucuuaga

SEQ ID NO: 780082 - RNA, 19 nt, Homo sapiens
ccacaggccucucuucaca

SEQ ID NO: 780083 - RNA, 19 nt, Homo sapiens
ggccgugucuucuuacuug

SEQ ID NO: 780084 - RNA, 19 nt, Homo sapiens
cacaggccgugucuucuua

SEQ ID NO: 780085 - RNA, 19 nt, Homo sapiens
ucucagugcuuuccaauuc

SEQ ID NO: 780086 - RNA, 19 nt, Homo sapiens
agaguugucuucaggcuuu

SEQ ID NO: 780087 - RNA, 19 nt, Homo sapiens
gcugccggcucuucauuaa

SEQ ID NO: 780088 - RNA, 19 nt, Homo sapiens
gagggucauugaacauuug

SEQ ID NO: 780089 - RNA, 19 nt, Homo sapiens
gaaggaaccugagggucau

SEQ ID NO: 780090 - RNA, 19 nt, Homo sapiens
gggagcaccuggauaugug

SEQ ID NO: 780091 - RNA, 19 nt, Homo sapiens
ugagggucauugaacauuu

SEQ ID NO: 780092 - RNA, 19 nt, Homo sapiens
ucaccuacuuccagccuaa

SEQ ID NO: 780093 - RNA, 19 nt, Homo sapiens
accuggagcugccucauua

SEQ ID NO: 780094 - RNA, 19 nt, Homo sapiens
ggaguugccugaugguaac

SEQ ID NO: 780095 - RNA, 19 nt, Homo sapiens
cagccgagguccuggcauu

SEQ ID NO: 780096 - RNA, 19 nt, Homo sapiens
gcagagcgagagaauaugu

SEQ ID NO: 780097 - RNA, 19 nt, Homo sapiens
ccucggguaccaauaaaua

SEQ ID NO: 780098 - RNA, 19 nt, Homo sapiens
gcagccuccugaagacauu

SEQ ID NO: 780099 - RNA, 19 nt, Homo sapiens
ucacauuucugacaguuac

SEQ ID NO: 780100 - RNA, 19 nt, Homo sapiens
acauuuggcugugauggua

SEQ ID NO: 780101 - RNA, 19 nt, Homo sapiens
gcaggacauuuggcuguga

SEQ ID NO: 780102 - RNA, 19 nt, Homo sapiens
gaccuggaguugccugaug

SEQ ID NO: 780103 - RNA, 19 nt, Homo sapiens
uggauggagugcucuguuu

SEQ ID NO: 780104 - RNA, 19 nt, Homo sapiens
augcugacauccagguuua

SEQ ID NO: 780105 - RNA, 19 nt, Homo sapiens
gugaagauggucauucuga

SEQ ID NO: 780106 - RNA, 19 nt, Homo sapiens
gaguaaacacugccuaauc

SEQ ID NO: 780107 - RNA, 19 nt, Homo sapiens
gaaccugagggucauugaa

SEQ ID NO: 780108 - RNA, 19 nt, Homo sapiens
cggcucaccuggaggaaga

SEQ ID NO: 780109 - RNA, 19 nt, Homo sapiens
ggacgauggugaggagauc

SEQ ID NO: 780110 - RNA, 19 nt, Homo sapiens
uggcagagcgagagaauau

SEQ ID NO: 780111 - RNA, 19 nt, Homo sapiens
ugagggugcuccaaauauc

SEQ ID NO: 780112 - RNA, 19 nt, Homo sapiens
caacaggaaccauugacau

SEQ ID NO: 780113 - RNA, 19 nt, Homo sapiens
caccauugcccaugagauu

SEQ ID NO: 780114 - RNA, 19 nt, Homo sapiens
ugccggcucuucauuaaug

SEQ ID NO: 780115 - RNA, 19 nt, Homo sapiens
gagccaacaggaaccauug

SEQ ID NO: 780116 - RNA, 19 nt, Homo sapiens
gagucaccauugcccauga

SEQ ID NO: 780117 - RNA, 19 nt, Homo sapiens
uuuagagucuucuccaaug

SEQ ID NO: 780118 - RNA, 19 nt, Homo sapiens
guccuggcauuccuuguga

SEQ ID NO: 780119 - RNA, 19 nt, Homo sapiens
gggcugcgcuggguaaacu

SEQ ID NO: 780120 - RNA, 19 nt, Homo sapiens
gacaucaccuucaccuacu

SEQ ID NO: 780121 - RNA, 19 nt, Homo sapiens
gauggacucccagcaggua

SEQ ID NO: 780122 - RNA, 19 nt, Homo sapiens
gaugggacccgguguaugc

SEQ ID NO: 780123 - RNA, 19 nt, Homo sapiens
aguaaacacugccuaaucg

SEQ ID NO: 780124 - RNA, 19 nt, Homo sapiens
ccugaccagugucuacauu

SEQ ID NO: 780125 - RNA, 19 nt, Homo sapiens
ggacaggugccaggugugu

SEQ ID NO: 780126 - RNA, 19 nt, Homo sapiens
gaccugggagucaccauug

SEQ ID NO: 780127 - RNA, 19 nt, Homo sapiens
ccacaggccgugucuucuu

SEQ ID NO: 780128 - RNA, 19 nt, Homo sapiens
gaguucaugucgcaacagu

SEQ ID NO: 780129 - RNA, 19 nt, Homo sapiens
ugcggaggauccuguauug

SEQ ID NO: 780130 - RNA, 19 nt, Homo sapiens
agacccagcuggaguucau

SEQ ID NO: 780131 - RNA, 19 nt, Homo sapiens
gcuaugugcucaccaaccu

SEQ ID NO: 780132 - RNA, 19 nt, Homo sapiens
ugucguggcugggaagaug

SEQ ID NO: 780133 - RNA, 19 nt, Homo sapiens
ccacggaagggcucuuuca

SEQ ID NO: 780134 - RNA, 19 nt, Homo sapiens
ccugagggugcuccaaaua

SEQ ID NO: 780135 - RNA, 19 nt, Homo sapiens
gcuuuccaauucgaacuuu

SEQ ID NO: 780136 - RNA, 19 nt, Homo sapiens
aaucauggguaccggagau

SEQ ID NO: 780137 - RNA, 19 nt, Homo sapiens
cugaaaccuucuacagaga

SEQ ID NO: 780138 - RNA, 19 nt, Homo sapiens
cggaggauccuguauugug

SEQ ID NO: 780139 - RNA, 19 nt, Homo sapiens
gaucggagggcgcuauguc

SEQ ID NO: 780140 - RNA, 19 nt, Homo sapiens
ccacuggggugcugcugua

SEQ ID NO: 780141 - RNA, 19 nt, Homo sapiens
caugggcgcuggucuagcu

SEQ ID NO: 780142 - RNA, 19 nt, Homo sapiens
gagggugcuccaaauauca

SEQ ID NO: 780143 - RNA, 19 nt, Homo sapiens
aaugccagcuacaucuuga

SEQ ID NO: 780144 - RNA, 19 nt, Homo sapiens
gcaccuaccgcuggcaugu

SEQ ID NO: 780145 - RNA, 19 nt, Homo sapiens
gugcggaggauccuguauu

SEQ ID NO: 780146 - RNA, 19 nt, Homo sapiens
gggacauguugcugcuuug

SEQ ID NO: 780147 - RNA, 19 nt, Homo sapiens
aagaguaaacacugccuaa

SEQ ID NO: 780148 - RNA, 19 nt, Homo sapiens
gugcaugggcgcuggucua

SEQ ID NO: 780149 - RNA, 19 nt, Homo sapiens
uggaguugccugaugguaa

SEQ ID NO: 780150 - RNA, 19 nt, Homo sapiens
aggaagcuguuggacauga

SEQ ID NO: 780151 - RNA, 19 nt, Homo sapiens
ggggacauguugcugcuuu

SEQ ID NO: 780152 - RNA, 19 nt, Homo sapiens
gcccagcucaugcacauca

SEQ ID NO: 780153 - RNA, 19 nt, Homo sapiens
gaauguggcguggagaagu

SEQ ID NO: 780154 - RNA, 19 nt, Homo sapiens
cagacccgcuggaccaaag

SEQ ID NO: 780155 - RNA, 19 nt, Homo sapiens
uuagagucuucuccaaugu

SEQ ID NO: 780156 - RNA, 19 nt, Homo sapiens
ucuuagguaucuacuuuag

SEQ ID NO: 780157 - RNA, 19 nt, Homo sapiens
ggauggagugcucuguuuc

SEQ ID NO: 780158 - RNA, 19 nt, Homo sapiens
ugagcaggccugucccauu

SEQ ID NO: 780159 - RNA, 19 nt, Homo sapiens
cagugucccuucuccagau

SEQ ID NO: 780160 - RNA, 19 nt, Homo sapiens
ggguggagccagaccauca

SEQ ID NO: 780161 - RNA, 19 nt, Homo sapiens
ggaaccugagggucauuga

SEQ ID NO: 780162 - RNA, 19 nt, Homo sapiens
ggauggucgugucgaguac

SEQ ID NO: 780163 - RNA, 19 nt, Homo sapiens
acaggccucucuucacaca

SEQ ID NO: 780164 - RNA, 19 nt, Homo sapiens
gggcagcugcaggacauuu

SEQ ID NO: 780165 - RNA, 19 nt, Homo sapiens
acucaggccugcgagaaga

SEQ ID NO: 780166 - RNA, 19 nt, Homo sapiens
cagaauguggcguggagaa

SEQ ID NO: 780167 - RNA, 19 nt, Homo sapiens
caaugccagcuacaucuug

SEQ ID NO: 780168 - RNA, 19 nt, Homo sapiens
gcccagacaucaccuucac

SEQ ID NO: 780169 - RNA, 19 nt, Homo sapiens
gccugagggugcuccaaau

SEQ ID NO: 780170 - RNA, 19 nt, Homo sapiens
gcccuggugcucccuuaaa

SEQ ID NO: 780171 - RNA, 19 nt, Homo sapiens
ggcugccggcucuucauua

SEQ ID NO: 780172 - RNA, 19 nt, Homo sapiens
gggcugccggcucuucauu

SEQ ID NO: 780173 - RNA, 19 nt, Homo sapiens
ugaguccagccacgaguaa

SEQ ID NO: 780174 - RNA, 19 nt, Homo sapiens
caaccugaccagugucuac

SEQ ID NO: 780175 - RNA, 19 nt, Homo sapiens
agaagacccagcuggaguu

SEQ ID NO: 780176 - RNA, 19 nt, Homo sapiens
ggaggacacagagcgcuau

SEQ ID NO: 780177 - RNA, 19 nt, Homo sapiens
gcaggaagcuguuggacau

SEQ ID NO: 780178 - RNA, 19 nt, Homo sapiens
gagcaggccugucccauuc

SEQ ID NO: 780179 - RNA, 19 nt, Homo sapiens
ggaggaagaugugcaggaa

SEQ ID NO: 780180 - RNA, 19 nt, Homo sapiens
ggacugggcugcagguuac

SEQ ID NO: 780181 - RNA, 19 nt, Homo sapiens
gaacugcaaccaucuuaga

SEQ ID NO: 780182 - RNA, 19 nt, Homo sapiens
ccacaggccucucuucaca

SEQ ID NO: 780183 - RNA, 19 nt, Homo sapiens
ggccgugucuucuuacuug

SEQ ID NO: 780184 - RNA, 19 nt, Homo sapiens
cacaggccgugucuucuua

SEQ ID NO: 780185 - RNA, 19 nt, Homo sapiens
ucucagugcuuuccaauuc

SEQ ID NO: 780186 - RNA, 19 nt, Homo sapiens
agaguugucuucaggcuuu

SEQ ID NO: 780187 - RNA, 19 nt, Homo sapiens
gcugccggcucuucauuaa

SEQ ID NO: 780188 - RNA, 19 nt, Homo sapiens
gagggucauugaacauuug

SEQ ID NO: 780189 - RNA, 19 nt, Homo sapiens
gaaggaaccugagggucau

SEQ ID NO: 780190 - RNA, 19 nt, Homo sapiens
gggagcaccuggauaugug

SEQ ID NO: 780191 - RNA, 19 nt, Homo sapiens
ugagggucauugaacauuu

SEQ ID NO: 780192 - RNA, 19 nt, Homo sapiens
ucaccuacuuccagccuaa

SEQ ID NO: 780193 - RNA, 19 nt, Homo sapiens
accuggagcugccucauua

SEQ ID NO: 780194 - RNA, 19 nt, Homo sapiens
ggaguugccugaugguaac

SEQ ID NO: 780195 - RNA, 19 nt, Homo sapiens
cagccgagguccuggcauu

SEQ ID NO: 780196 - RNA, 19 nt, Homo sapiens
gcagagcgagagaauaugu

SEQ ID NO: 780197 - RNA, 19 nt, Homo sapiens
ccucggguaccaauaaaua

SEQ ID NO: 780198 - RNA, 19 nt, Homo sapiens
gcagccuccugaagacauu

SEQ ID NO: 780199 - RNA, 19 nt, Homo sapiens
ucacauuucugacaguuac

SEQ ID NO: 780200 - RNA, 19 nt, Homo sapiens
acauuuggcugugauggua

SEQ ID NO: 780201 - RNA, 19 nt, Homo sapiens
gcaggacauuuggcuguga

SEQ ID NO: 780202 - RNA, 19 nt, Homo sapiens
gaccuggaguugccugaug

SEQ ID NO: 780203 - RNA, 19 nt, Homo sapiens
uggauggagugcucuguuu

SEQ ID NO: 780204 - RNA, 19 nt, Homo sapiens
augcugacauccagguuua

SEQ ID NO: 780205 - RNA, 19 nt, Homo sapiens
gugaagauggucauucuga

SEQ ID NO: 780206 - RNA, 19 nt, Homo sapiens
gaguaaacacugccuaauc

SEQ ID NO: 780207 - RNA, 19 nt, Homo sapiens
gaaccugagggucauugaa

SEQ ID NO: 780208 - RNA, 19 nt, Homo sapiens
cggcucaccuggaggaaga

SEQ ID NO: 780209 - RNA, 19 nt, Homo sapiens
ggacgauggugaggagauc

SEQ ID NO: 780210 - RNA, 19 nt, Homo sapiens
uggcagagcgagagaauau

SEQ ID NO: 780211 - RNA, 19 nt, Homo sapiens
caacaggaaccauugacau

SEQ ID NO: 780212 - RNA, 19 nt, Homo sapiens
caccauugcccaugagauu

SEQ ID NO: 780213 - RNA, 19 nt, Homo sapiens
ugccggcucuucauuaaug

SEQ ID NO: 780214 - RNA, 19 nt, Homo sapiens
gagccaacaggaaccauug

SEQ ID NO: 780215 - RNA, 19 nt, Homo sapiens
gagucaccauugcccauga

SEQ ID NO: 780216 - RNA, 19 nt, Homo sapiens
uuuagagucuucuccaaug

SEQ ID NO: 780217 - RNA, 19 nt, Homo sapiens
guccuggcauuccuuguga

SEQ ID NO: 780218 - RNA, 19 nt, Homo sapiens
gggcugcgcuggguaaacu

SEQ ID NO: 780219 - RNA, 19 nt, Homo sapiens
gacaucaccuucaccuacu

SEQ ID NO: 780220 - RNA, 19 nt, Homo sapiens
gauggacucccagcaggua

SEQ ID NO: 780221 - RNA, 19 nt, Homo sapiens
gaugggacccgguguaugc

SEQ ID NO: 780222 - RNA, 19 nt, Homo sapiens
aguaaacacugccuaaucg

SEQ ID NO: 780223 - RNA, 19 nt, Homo sapiens
ccugaccagugucuacauu

SEQ ID NO: 780224 - RNA, 19 nt, Homo sapiens
ggacaggugccaggugugu

SEQ ID NO: 780225 - RNA, 19 nt, Homo sapiens
gaccugggagucaccauug

SEQ ID NO: 780226 - RNA, 19 nt, Homo sapiens
ccacaggccgugucuucuu

SEQ ID NO: 780227 - RNA, 19 nt, Homo sapiens
gaguucaugucgcaacagu

SEQ ID NO: 780228 - RNA, 19 nt, Homo sapiens
ugcggaggauccuguauug

SEQ ID NO: 780229 - RNA, 19 nt, Homo sapiens
agacccagcuggaguucau

SEQ ID NO: 780230 - RNA, 19 nt, Homo sapiens
gcuaugugcucaccaaccu

SEQ ID NO: 780231 - RNA, 19 nt, Homo sapiens
ugucguggcugggaagaug

SEQ ID NO: 780232 - RNA, 19 nt, Homo sapiens
ccacggaagggcucuuuca

SEQ ID NO: 780233 - RNA, 19 nt, Homo sapiens
gcuuuccaauucgaacuuu

SEQ ID NO: 780234 - RNA, 19 nt, Homo sapiens
aaucauggguaccggagau

SEQ ID NO: 780235 - RNA, 19 nt, Homo sapiens
cugaaaccuucuacagaga

SEQ ID NO: 780236 - RNA, 19 nt, Homo sapiens
cggaggauccuguauugug

SEQ ID NO: 780237 - RNA, 19 nt, Homo sapiens
gaucggagggcgcuauguc

SEQ ID NO: 780238 - RNA, 19 nt, Homo sapiens
ccacuggggugcugcugua

SEQ ID NO: 780239 - RNA, 19 nt, Homo sapiens
caugggcgcuggucuagcu

SEQ ID NO: 780240 - RNA, 19 nt, Homo sapiens
aaugccagcuacaucuuga

SEQ ID NO: 780241 - RNA, 19 nt, Homo sapiens
gcaccuaccgcuggcaugu

SEQ ID NO: 780242 - RNA, 19 nt, Homo sapiens
gugcggaggauccuguauu

SEQ ID NO: 780243 - RNA, 19 nt, Homo sapiens
gggacauguugcugcuuug

SEQ ID NO: 780244 - RNA, 19 nt, Homo sapiens
aagaguaaacacugccuaa

SEQ ID NO: 780245 - RNA, 19 nt, Homo sapiens
gugcaugggcgcuggucua

SEQ ID NO: 780246 - RNA, 19 nt, Homo sapiens
uggaguugccugaugguaa

SEQ ID NO: 780247 - RNA, 19 nt, Homo sapiens
aggaagcuguuggacauga

SEQ ID NO: 780248 - RNA, 19 nt, Homo sapiens
ggggacauguugcugcuuu

SEQ ID NO: 780249 - RNA, 19 nt, Homo sapiens
gcccagcucaugcacauca

SEQ ID NO: 780250 - RNA, 19 nt, Homo sapiens
gaauguggcguggagaagu

SEQ ID NO: 780251 - RNA, 19 nt, Homo sapiens
cagacccgcuggaccaaag

SEQ ID NO: 780252 - RNA, 19 nt, Homo sapiens
uuagagucuucuccaaugu

SEQ ID NO: 780253 - RNA, 19 nt, Homo sapiens
ucuuagguaucuacuuuag

SEQ ID NO: 780254 - RNA, 19 nt, Homo sapiens
ggauggagugcucuguuuc

SEQ ID NO: 780255 - RNA, 19 nt, Homo sapiens
ugagcaggccugucccauu

SEQ ID NO: 780256 - RNA, 19 nt, Homo sapiens
cagugucccuucuccagau

SEQ ID NO: 780257 - RNA, 19 nt, Homo sapiens
ggguggagccagaccauca

SEQ ID NO: 780258 - RNA, 19 nt, Homo sapiens
ggaaccugagggucauuga

SEQ ID NO: 780259 - RNA, 19 nt, Homo sapiens
ggauggucgugucgaguac

SEQ ID NO: 780260 - RNA, 19 nt, Homo sapiens
acaggccucucuucacaca

SEQ ID NO: 780261 - RNA, 19 nt, Homo sapiens
gggcagcugcaggacauuu

SEQ ID NO: 780262 - RNA, 19 nt, Homo sapiens
acucaggccugcgagaaga

SEQ ID NO: 780263 - RNA, 19 nt, Homo sapiens
cagaauguggcguggagaa

SEQ ID NO: 780264 - RNA, 19 nt, Homo sapiens
caaugccagcuacaucuug

SEQ ID NO: 780265 - RNA, 19 nt, Homo sapiens
gcccagacaucaccuucac

SEQ ID NO: 780266 - RNA, 19 nt, Homo sapiens
gcccuggugcucccuuaaa

SEQ ID NO: 780267 - RNA, 19 nt, Homo sapiens
ggcugccggcucuucauua

SEQ ID NO: 780268 - RNA, 19 nt, Homo sapiens
gggcugccggcucuucauu

SEQ ID NO: 780269 - RNA, 19 nt, Homo sapiens
ugaguccagccacgaguaa

SEQ ID NO: 780270 - RNA, 19 nt, Homo sapiens
caaccugaccagugucuac

SEQ ID NO: 780271 - RNA, 19 nt, Homo sapiens
agaagacccagcuggaguu

SEQ ID NO: 780272 - RNA, 19 nt, Homo sapiens
ggaggacacagagcgcuau

SEQ ID NO: 780273 - RNA, 19 nt, Homo sapiens
ucagugcuuuccaauucga

SEQ ID NO: 780274 - RNA, 19 nt, Homo sapiens
gguccuggcauuccuugug

SEQ ID NO: 780275 - RNA, 19 nt, Homo sapiens
ggaagcuguuggacaugac

SEQ ID NO: 780276 - RNA, 19 nt, Homo sapiens
cugaacugcaaccaucuua

SEQ ID NO: 780277 - RNA, 19 nt, Homo sapiens
gcaggaagcuguuggacau

SEQ ID NO: 780278 - RNA, 19 nt, Homo sapiens
gagcaggccugucccauuc

SEQ ID NO: 780279 - RNA, 19 nt, Homo sapiens
ggaggaagaugugcaggaa

SEQ ID NO: 780280 - RNA, 19 nt, Homo sapiens
ggacugggcugcagguuac

SEQ ID NO: 780281 - RNA, 19 nt, Homo sapiens
gaacugcaaccaucuuaga

SEQ ID NO: 780282 - RNA, 19 nt, Homo sapiens
ccacaggccucucuucaca

SEQ ID NO: 780283 - RNA, 19 nt, Homo sapiens
ggccgugucuucuuacuug

SEQ ID NO: 780284 - RNA, 19 nt, Homo sapiens
cacaggccgugucuucuua

SEQ ID NO: 780285 - RNA, 19 nt, Homo sapiens
ucucagugcuuuccaauuc

SEQ ID NO: 780286 - RNA, 19 nt, Homo sapiens
agaguugucuucaggcuuu

SEQ ID NO: 780287 - RNA, 19 nt, Homo sapiens
gcugccggcucuucauuaa

SEQ ID NO: 780288 - RNA, 19 nt, Homo sapiens
gagggucauugaacauuug

SEQ ID NO: 780289 - RNA, 19 nt, Homo sapiens
gaaggaaccugagggucau

SEQ ID NO: 780290 - RNA, 19 nt, Homo sapiens
gggagcaccuggauaugug

SEQ ID NO: 780291 - RNA, 19 nt, Homo sapiens
ugagggucauugaacauuu

SEQ ID NO: 780292 - RNA, 19 nt, Homo sapiens
ucaccuacuuccagccuaa

SEQ ID NO: 780293 - RNA, 19 nt, Homo sapiens
accuggagcugccucauua

SEQ ID NO: 780294 - RNA, 19 nt, Homo sapiens
ggaguugccugaugguaac

SEQ ID NO: 780295 - RNA, 19 nt, Homo sapiens
cagccgagguccuggcauu

SEQ ID NO: 780296 - RNA, 19 nt, Homo sapiens
gcagagcgagagaauaugu

SEQ ID NO: 780297 - RNA, 19 nt, Homo sapiens
ccucggguaccaauaaaua

SEQ ID NO: 780298 - RNA, 19 nt, Homo sapiens
gcagccuccugaagacauu

SEQ ID NO: 780299 - RNA, 19 nt, Homo sapiens
ucacauuucugacaguuac

SEQ ID NO: 780300 - RNA, 19 nt, Homo sapiens
acauuuggcugugauggua

SEQ ID NO: 780301 - RNA, 19 nt, Homo sapiens
gcaggacauuuggcuguga

SEQ ID NO: 780302 - RNA, 19 nt, Homo sapiens
gaccuggaguugccugaug

SEQ ID NO: 780303 - RNA, 19 nt, Homo sapiens
uggauggagugcucuguuu

SEQ ID NO: 780304 - RNA, 19 nt, Homo sapiens
augcugacauccagguuua

SEQ ID NO: 780305 - RNA, 19 nt, Homo sapiens
gugaagauggucauucuga

SEQ ID NO: 780306 - RNA, 19 nt, Homo sapiens
gaguaaacacugccuaauc

SEQ ID NO: 780307 - RNA, 19 nt, Homo sapiens
gaaccugagggucauugaa

SEQ ID NO: 780308 - RNA, 19 nt, Homo sapiens
cggcucaccuggaggaaga

SEQ ID NO: 780309 - RNA, 19 nt, Homo sapiens
ggacgauggugaggagauc

SEQ ID NO: 780310 - RNA, 19 nt, Homo sapiens
uggcagagcgagagaauau

SEQ ID NO: 780311 - RNA, 19 nt, Homo sapiens
caacaggaaccauugacau

SEQ ID NO: 780312 - RNA, 19 nt, Homo sapiens
caccauugcccaugagauu

SEQ ID NO: 780313 - RNA, 19 nt, Homo sapiens
ugccggcucuucauuaaug

SEQ ID NO: 780314 - RNA, 19 nt, Homo sapiens
gagccaacaggaaccauug

SEQ ID NO: 780315 - RNA, 19 nt, Homo sapiens
gagucaccauugcccauga

SEQ ID NO: 780316 - RNA, 19 nt, Homo sapiens
uuuagagucuucuccaaug

SEQ ID NO: 780317 - RNA, 19 nt, Homo sapiens
guccuggcauuccuuguga

SEQ ID NO: 780318 - RNA, 19 nt, Homo sapiens
gggcugcgcuggguaaacu

SEQ ID NO: 780319 - RNA, 19 nt, Homo sapiens
gacaucaccuucaccuacu

SEQ ID NO: 780320 - RNA, 19 nt, Homo sapiens
gauggacucccagcaggua

SEQ ID NO: 780321 - RNA, 19 nt, Homo sapiens
gaugggacccgguguaugc

SEQ ID NO: 780322 - RNA, 19 nt, Homo sapiens
aguaaacacugccuaaucg

SEQ ID NO: 780323 - RNA, 19 nt, Homo sapiens
ccugaccagugucuacauu

SEQ ID NO: 780324 - RNA, 19 nt, Homo sapiens
ggacaggugccaggugugu

SEQ ID NO: 780325 - RNA, 19 nt, Homo sapiens
gaccugggagucaccauug

SEQ ID NO: 780326 - RNA, 19 nt, Homo sapiens
ccacaggccgugucuucuu

SEQ ID NO: 780327 - RNA, 19 nt, Homo sapiens
gaguucaugucgcaacagu

SEQ ID NO: 780328 - RNA, 19 nt, Homo sapiens
ugcggaggauccuguauug

SEQ ID NO: 780329 - RNA, 19 nt, Homo sapiens
agacccagcuggaguucau

SEQ ID NO: 780330 - RNA, 19 nt, Homo sapiens
gcuaugugcucaccaaccu

SEQ ID NO: 780331 - RNA, 19 nt, Homo sapiens
ugucguggcugggaagaug

SEQ ID NO: 780332 - RNA, 19 nt, Homo sapiens
ccacggaagggcucuuuca

SEQ ID NO: 780333 - RNA, 19 nt, Homo sapiens
gcuuuccaauucgaacuuu

SEQ ID NO: 780334 - RNA, 19 nt, Homo sapiens
aaucauggguaccggagau

SEQ ID NO: 780335 - RNA, 19 nt, Homo sapiens
cugaaaccuucuacagaga

SEQ ID NO: 780336 - RNA, 19 nt, Homo sapiens
cggaggauccuguauugug

SEQ ID NO: 780337 - RNA, 19 nt, Homo sapiens
gaucggagggcgcuauguc

SEQ ID NO: 780338 - RNA, 19 nt, Homo sapiens
ccacuggggugcugcugua

SEQ ID NO: 780339 - RNA, 19 nt, Homo sapiens
caugggcgcuggucuagcu

SEQ ID NO: 780340 - RNA, 19 nt, Homo sapiens
aaugccagcuacaucuuga

SEQ ID NO: 780341 - RNA, 19 nt, Homo sapiens
gcaccuaccgcuggcaugu

SEQ ID NO: 780342 - RNA, 19 nt, Homo sapiens
gugcggaggauccuguauu

SEQ ID NO: 780343 - RNA, 19 nt, Homo sapiens
gggacauguugcugcuuug

SEQ ID NO: 780344 - RNA, 19 nt, Homo sapiens
aagaguaaacacugccuaa

SEQ ID NO: 780345 - RNA, 19 nt, Homo sapiens
gugcaugggcgcuggucua

SEQ ID NO: 780346 - RNA, 19 nt, Homo sapiens
uggaguugccugaugguaa

SEQ ID NO: 780347 - RNA, 19 nt, Homo sapiens
aggaagcuguuggacauga

SEQ ID NO: 780348 - RNA, 19 nt, Homo sapiens
ggggacauguugcugcuuu

SEQ ID NO: 780349 - RNA, 19 nt, Homo sapiens
gcccagcucaugcacauca

SEQ ID NO: 780350 - RNA, 19 nt, Homo sapiens
gaauguggcguggagaagu

SEQ ID NO: 780351 - RNA, 19 nt, Homo sapiens
cagacccgcuggaccaaag

SEQ ID NO: 780352 - RNA, 19 nt, Homo sapiens
uuagagucuucuccaaugu

SEQ ID NO: 780353 - RNA, 19 nt, Homo sapiens
ucuuagguaucuacuuuag

SEQ ID NO: 780354 - RNA, 19 nt, Homo sapiens
ggauggagugcucuguuuc

SEQ ID NO: 780355 - RNA, 19 nt, Homo sapiens
ugagcaggccugucccauu

SEQ ID NO: 780356 - RNA, 19 nt, Homo sapiens
cagugucccuucuccagau

SEQ ID NO: 780357 - RNA, 19 nt, Homo sapiens
ggguggagccagaccauca

SEQ ID NO: 780358 - RNA, 19 nt, Homo sapiens
ggaaccugagggucauuga

SEQ ID NO: 780359 - RNA, 19 nt, Homo sapiens
ggauggucgugucgaguac

SEQ ID NO: 780360 - RNA, 19 nt, Homo sapiens
acaggccucucuucacaca

SEQ ID NO: 780361 - RNA, 19 nt, Homo sapiens
gggcagcugcaggacauuu

SEQ ID NO: 780362 - RNA, 19 nt, Homo sapiens
acucaggccugcgagaaga

SEQ ID NO: 780363 - RNA, 19 nt, Homo sapiens
cagaauguggcguggagaa

SEQ ID NO: 780364 - RNA, 19 nt, Homo sapiens
caaugccagcuacaucuug

SEQ ID NO: 780365 - RNA, 19 nt, Homo sapiens
gcccagacaucaccuucac

SEQ ID NO: 780366 - RNA, 19 nt, Homo sapiens
gcccuggugcucccuuaaa

SEQ ID NO: 780367 - RNA, 19 nt, Homo sapiens
ggcugccggcucuucauua

SEQ ID NO: 780368 - RNA, 19 nt, Homo sapiens
gggcugccggcucuucauu

SEQ ID NO: 780369 - RNA, 19 nt, Homo sapiens
ugaguccagccacgaguaa

SEQ ID NO: 780370 - RNA, 19 nt, Homo sapiens
caaccugaccagugucuac

SEQ ID NO: 780371 - RNA, 19 nt, Homo sapiens
agaagacccagcuggaguu

SEQ ID NO: 780372 - RNA, 19 nt, Homo sapiens
ggaggacacagagcgcuau

SEQ ID NO: 780373 - RNA, 19 nt, Homo sapiens
ucagugcuuuccaauucga

SEQ ID NO: 780374 - RNA, 19 nt, Homo sapiens
gguccuggcauuccuugug

SEQ ID NO: 780375 - RNA, 19 nt, Homo sapiens
ggaagcuguuggacaugac

SEQ ID NO: 780376 - RNA, 19 nt, Homo sapiens
cugaacugcaaccaucuua

SEQ ID NO: 780377 - RNA, 19 nt, Homo sapiens
gagcaggccugucccauuc

SEQ ID NO: 780378 - RNA, 19 nt, Homo sapiens
ggacugggcugcagguuac

SEQ ID NO: 780379 - RNA, 19 nt, Homo sapiens
gaacugcaaccaucuuaga

SEQ ID NO: 780380 - RNA, 19 nt, Homo sapiens
ccacaggccucucuucaca

SEQ ID NO: 780381 - RNA, 19 nt, Homo sapiens
ggccgugucuucuuacuug

SEQ ID NO: 780382 - RNA, 19 nt, Homo sapiens
cacaggccgugucuucuua

SEQ ID NO: 780383 - RNA, 19 nt, Homo sapiens
agaguugucuucaggcuuu

SEQ ID NO: 780384 - RNA, 19 nt, Homo sapiens
ggcaggagccuuagucuug

SEQ ID NO: 780385 - RNA, 19 nt, Homo sapiens
accuggagcugccucauua

SEQ ID NO: 780386 - RNA, 19 nt, Homo sapiens
aaacgugcauggauaugug

SEQ ID NO: 780387 - RNA, 19 nt, Homo sapiens
ggaguugccugaugguaac

SEQ ID NO: 780388 - RNA, 19 nt, Homo sapiens
gcagagcgagagaauaugu

SEQ ID NO: 780389 - RNA, 19 nt, Homo sapiens
cagccgagguccuggcauu

SEQ ID NO: 780390 - RNA, 19 nt, Homo sapiens
ucacauuucugacaguuac

SEQ ID NO: 780391 - RNA, 19 nt, Homo sapiens
acauuuggcugugauggua

SEQ ID NO: 780392 - RNA, 19 nt, Homo sapiens
gcaggacauuuggcuguga

SEQ ID NO: 780393 - RNA, 19 nt, Homo sapiens
gaccuggaguugccugaug

SEQ ID NO: 780394 - RNA, 19 nt, Homo sapiens
gugaagauggucauucuga

SEQ ID NO: 780395 - RNA, 19 nt, Homo sapiens
gaguaaacacugccuaauc

SEQ ID NO: 780396 - RNA, 19 nt, Homo sapiens
ggacgauggugaggagauc

SEQ ID NO: 780397 - RNA, 19 nt, Homo sapiens
uggcagagcgagagaauau

SEQ ID NO: 780398 - RNA, 19 nt, Homo sapiens
caccauugcccaugagauu

SEQ ID NO: 780399 - RNA, 19 nt, Homo sapiens
gagucaccauugcccauga

SEQ ID NO: 780400 - RNA, 19 nt, Homo sapiens
guccuggcauuccuuguga

SEQ ID NO: 780401 - RNA, 19 nt, Homo sapiens
ggccugggauuggcuguga

SEQ ID NO: 780402 - RNA, 19 nt, Homo sapiens
gauggacucccagcaggua

SEQ ID NO: 780403 - RNA, 19 nt, Homo sapiens
gaugggacccgguguaugc

SEQ ID NO: 780404 - RNA, 19 nt, Homo sapiens
aguaaacacugccuaaucg

SEQ ID NO: 780405 - RNA, 19 nt, Homo sapiens
ccugaccagugucuacauu

SEQ ID NO: 780406 - RNA, 19 nt, Homo sapiens
ggacaggugccaggugugu

SEQ ID NO: 780407 - RNA, 19 nt, Homo sapiens
gaccugggagucaccauug

SEQ ID NO: 780408 - RNA, 19 nt, Homo sapiens
ccacaggccgugucuucuu

SEQ ID NO: 780409 - RNA, 19 nt, Homo sapiens
ugcggaggauccuguauug

SEQ ID NO: 780410 - RNA, 19 nt, Homo sapiens
agacccagcuggaguucau

SEQ ID NO: 780411 - RNA, 19 nt, Homo sapiens
gcuaugugcucaccaaccu

SEQ ID NO: 780412 - RNA, 19 nt, Homo sapiens
ugucguggcugggaagaug

SEQ ID NO: 780413 - RNA, 19 nt, Homo sapiens
ccacggaagggcucuuuca

SEQ ID NO: 780414 - RNA, 19 nt, Homo sapiens
cggaggauccuguauugug

SEQ ID NO: 780415 - RNA, 19 nt, Homo sapiens
gaucggagggcgcuauguc

SEQ ID NO: 780416 - RNA, 19 nt, Homo sapiens
ccacuggggugcugcugua

SEQ ID NO: 780417 - RNA, 19 nt, Homo sapiens
caugggcgcuggucuagcu

SEQ ID NO: 780418 - RNA, 19 nt, Homo sapiens
gugcggaggauccuguauu

SEQ ID NO: 780419 - RNA, 19 nt, Homo sapiens
gugcaugggcgcuggucua

SEQ ID NO: 780420 - RNA, 19 nt, Homo sapiens
uggaguugccugaugguaa

SEQ ID NO: 780421 - RNA, 19 nt, Homo sapiens
aagaguaaacacugccuaa

SEQ ID NO: 780422 - RNA, 19 nt, Homo sapiens
gcccagcucaugcacauca

SEQ ID NO: 780423 - RNA, 19 nt, Homo sapiens
gaauguggcguggagaagu

SEQ ID NO: 780424 - RNA, 19 nt, Homo sapiens
cagacccgcuggaccaaag

SEQ ID NO: 780425 - RNA, 19 nt, Homo sapiens
cccaaaacgugcauggaua

SEQ ID NO: 780426 - RNA, 19 nt, Homo sapiens
cagugucccuucuccagau

SEQ ID NO: 780427 - RNA, 19 nt, Homo sapiens
ggguggagccagaccauca

SEQ ID NO: 780428 - RNA, 19 nt, Homo sapiens
ugagcaggccugucccauu

SEQ ID NO: 780429 - RNA, 19 nt, Homo sapiens
ggauggucgugucgaguac

SEQ ID NO: 780430 - RNA, 19 nt, Homo sapiens
acaggccucucuucacaca

SEQ ID NO: 780431 - RNA, 19 nt, Homo sapiens
gggcagcugcaggacauuu

SEQ ID NO: 780432 - RNA, 19 nt, Homo sapiens
acucaggccugcgagaaga

SEQ ID NO: 780433 - RNA, 19 nt, Homo sapiens
cagaauguggcguggagaa

SEQ ID NO: 780434 - RNA, 19 nt, Homo sapiens
gcccuggugcucccuuaaa

SEQ ID NO: 780435 - RNA, 19 nt, Homo sapiens
caaccugaccagugucuac

SEQ ID NO: 780436 - RNA, 19 nt, Homo sapiens
agaagacccagcuggaguu

SEQ ID NO: 780437 - RNA, 19 nt, Homo sapiens
ggaggacacagagcgcuau

SEQ ID NO: 780438 - RNA, 19 nt, Homo sapiens
cugaacugcaaccaucuua

SEQ ID NO: 780439 - RNA, 19 nt, Homo sapiens
uguguggccuggcaagcaa

SEQ ID NO: 780440 - RNA, 19 nt, Homo sapiens
ugaccagugucuacauugc

SEQ ID NO: 780441 - RNA, 19 nt, Homo sapiens
gaagacccagcuggaguuc

SEQ ID NO: 780442 - RNA, 19 nt, Homo sapiens
gcaggccugucccauucca

SEQ ID NO: 780443 - RNA, 19 nt, Homo sapiens
ggaggcggcagugcaacaa

SEQ ID NO: 780444 - RNA, 19 nt, Homo sapiens
aauguggcguggagaagug

SEQ ID NO: 780445 - RNA, 19 nt, Homo sapiens
gguccuggcauuccuugug

SEQ ID NO: 780446 - RNA, 19 nt, Homo sapiens
uggugaagauggucauucu

SEQ ID NO: 780447 - RNA, 19 nt, Homo sapiens
gcucaccaaccucaacauc

SEQ ID NO: 780448 - RNA, 19 nt, Homo sapiens
ccaggugggaggugucaga

SEQ ID NO: 780449 - RNA, 19 nt, Homo sapiens
caaccacaggccucucuuc

SEQ ID NO: 780450 - RNA, 19 nt, Homo sapiens
ccucguuccucuccuggau

SEQ ID NO: 780451 - RNA, 19 nt, Homo sapiens
cgaccugggagucaccauu

SEQ ID NO: 780452 - RNA, 19 nt, Homo sapiens
caggacauuuggcugugau

SEQ ID NO: 780453 - RNA, 19 nt, Homo sapiens
uggcacagccucucaucug

SEQ ID NO: 780454 - RNA, 19 nt, Homo sapiens
ucagggagcuucugccuuu

SEQ ID NO: 780455 - RNA, 19 nt, Homo sapiens
ggucugggcugcuggacuu

SEQ ID NO: 780456 - RNA, 19 nt, Homo sapiens
gcagaucucacaccacaga

SEQ ID NO: 780457 - RNA, 19 nt, Homo sapiens
caaacacaguggcggagaa

SEQ ID NO: 780458 - RNA, 19 nt, Homo sapiens
gggcaacgccaucgccuuu

SEQ ID NO: 780459 - RNA, 19 nt, Homo sapiens
gcgaugcgaucuccuaugc

SEQ ID NO: 780460 - RNA, 19 nt, Homo sapiens
gugugcgucuuaagcaaua

SEQ ID NO: 780461 - RNA, 19 nt, Homo sapiens
gcguguggaugaucaugaa

SEQ ID NO: 780462 - RNA, 19 nt, Homo sapiens
gcccuuuccuucuuguuug

SEQ ID NO: 780463 - RNA, 19 nt, Homo sapiens
guguguguguguauguaua

SEQ ID NO: 780464 - RNA, 19 nt, Homo sapiens
cuugcuaagugaacuguuu

SEQ ID NO: 780465 - RNA, 19 nt, Homo sapiens
caagugaggccuggacugu

SEQ ID NO: 780466 - RNA, 19 nt, Homo sapiens
gguacugggucuugcuaag

SEQ ID NO: 780467 - RNA, 19 nt, Homo sapiens
ccacagcccagccccauua

SEQ ID NO: 780468 - RNA, 19 nt, Homo sapiens
gcugccaguucaucgaguu

SEQ ID NO: 780469 - RNA, 19 nt, Homo sapiens
ucucuggccucuucaacug

SEQ ID NO: 780470 - RNA, 19 nt, Homo sapiens
ucccauguaugcagugaga

SEQ ID NO: 780471 - RNA, 19 nt, Homo sapiens
cgcgaucucuggccucuuc

SEQ ID NO: 780472 - RNA, 19 nt, Homo sapiens
guuccucuguguucugugu

SEQ ID NO: 780473 - RNA, 19 nt, Homo sapiens
gcaggcggaugaggagaag

SEQ ID NO: 780474 - RNA, 19 nt, Homo sapiens
gcgcagguacugggucuug

SEQ ID NO: 780475 - RNA, 19 nt, Homo sapiens
cugcuggccuuggugcuaa

SEQ ID NO: 780476 - RNA, 19 nt, Homo sapiens
agaggcagcaggcggauga

SEQ ID NO: 780477 - RNA, 19 nt, Homo sapiens
guacugcccuggggacuug

SEQ ID NO: 780478 - RNA, 19 nt, Homo sapiens
gggagcuucugccuuuuaa

SEQ ID NO: 780479 - RNA, 19 nt, Homo sapiens
ggcugggaguggcaucuga

SEQ ID NO: 780480 - RNA, 19 nt, Homo sapiens
guguguguauguauaugug

SEQ ID NO: 780481 - RNA, 19 nt, Homo sapiens
cauccacccucugaacauc

SEQ ID NO: 780482 - RNA, 19 nt, Homo sapiens
guguguguguguguaugua

SEQ ID NO: 780483 - RNA, 19 nt, Homo sapiens
guacugggucuugcuaagu

SEQ ID NO: 780484 - RNA, 19 nt, Homo sapiens
gaaugccuucaucuuguug

SEQ ID NO: 780485 - RNA, 19 nt, Homo sapiens
caaagggcugugugugugu

SEQ ID NO: 780486 - RNA, 19 nt, Homo sapiens
uacugggucuugcuaagug

SEQ ID NO: 780487 - RNA, 19 nt, Homo sapiens
gagcuucugccuuuuaaga

SEQ ID NO: 780488 - RNA, 19 nt, Homo sapiens
aaggaaggcugccccugua

SEQ ID NO: 780489 - RNA, 19 nt, Homo sapiens
gccagagacagcaggagaa

SEQ ID NO: 780490 - RNA, 19 nt, Homo sapiens
ucacugacagccagagaca

SEQ ID NO: 780491 - RNA, 19 nt, Homo sapiens
cugccuggcuugccugcuu

SEQ ID NO: 780492 - RNA, 19 nt, Homo sapiens
ucaucuuguugcuguguga

SEQ ID NO: 780493 - RNA, 19 nt, Homo sapiens
ggaaagaaguuguaguuga

SEQ ID NO: 780494 - RNA, 19 nt, Homo sapiens
gaaagaaguuguaguugac

SEQ ID NO: 780495 - RNA, 19 nt, Homo sapiens
ggaacuaccuggcgcugaa

SEQ ID NO: 780496 - RNA, 19 nt, Homo sapiens
ggaaggaaguauaaauaag

SEQ ID NO: 780497 - RNA, 19 nt, Homo sapiens
ggaaaggaaagaaguugua

SEQ ID NO: 780498 - RNA, 19 nt, Homo sapiens
guacugaggugcagacaag

SEQ ID NO: 780499 - RNA, 19 nt, Homo sapiens
ccacuaauauugacgugaa

SEQ ID NO: 780500 - RNA, 19 nt, Homo sapiens
gcagacaucgggaccauuu

SEQ ID NO: 780501 - RNA, 19 nt, Homo sapiens
gaaguauaaugccuacaau

SEQ ID NO: 780502 - RNA, 19 nt, Homo sapiens
gggaaggaaguauaaauaa

SEQ ID NO: 780503 - RNA, 19 nt, Homo sapiens
aaauacaccuucuuuguuc

SEQ ID NO: 780504 - RNA, 19 nt, Homo sapiens
ccaauuauggcuacaauga

SEQ ID NO: 780505 - RNA, 19 nt, Homo sapiens
ggagcgaguucaaaguguu

SEQ ID NO: 780506 - RNA, 19 nt, Homo sapiens
gcagaacgaugggaacuac

SEQ ID NO: 780507 - RNA, 19 nt, Homo sapiens
ccaagcgguuugugucuga

SEQ ID NO: 780508 - RNA, 19 nt, Homo sapiens
cgggaaggaaguauaaaua

SEQ ID NO: 780509 - RNA, 19 nt, Homo sapiens
guacugcacaaauuccuaa

SEQ ID NO: 780510 - RNA, 19 nt, Homo sapiens
gaugcauccuggacucuug

SEQ ID NO: 780511 - RNA, 19 nt, Homo sapiens
ucagggagcagcaguguga

SEQ ID NO: 780512 - RNA, 19 nt, Homo sapiens
gaaccacauccugacguua

SEQ ID NO: 780513 - RNA, 19 nt, Homo sapiens
aaacgggaauagugagaga

SEQ ID NO: 780514 - RNA, 19 nt, Homo sapiens
guccauggcugccuucuac

SEQ ID NO: 780515 - RNA, 19 nt, Homo sapiens
uaaaagugcugaucguaga

SEQ ID NO: 780516 - RNA, 19 nt, Homo sapiens
caucaagaauuccaucaac

SEQ ID NO: 780517 - RNA, 19 nt, Homo sapiens
gggucucgcugccugauug

SEQ ID NO: 780518 - RNA, 19 nt, Homo sapiens
ggaccuugcucggguucaa

SEQ ID NO: 780519 - RNA, 19 nt, Homo sapiens
cucggaagcuggacaaaug

SEQ ID NO: 780520 - RNA, 19 nt, Homo sapiens
gcagcagugugagaaguau

SEQ ID NO: 780521 - RNA, 19 nt, Homo sapiens
gagcagcagugugagaagu

SEQ ID NO: 780522 - RNA, 19 nt, Homo sapiens
gcuccgugaucgaggauga

SEQ ID NO: 780523 - RNA, 19 nt, Homo sapiens
ggaauagugagagaucaaa

SEQ ID NO: 780524 - RNA, 19 nt, Homo sapiens
gcuggugccacuaauauug

SEQ ID NO: 780525 - RNA, 19 nt, Homo sapiens
ggaaacgggaauagugaga

SEQ ID NO: 780526 - RNA, 19 nt, Homo sapiens
gaaaggaaagaaguuguag

SEQ ID NO: 780527 - RNA, 19 nt, Homo sapiens
gcagagcagcaaagagaga

SEQ ID NO: 780528 - RNA, 19 nt, Homo sapiens
ggaccauccugaaguacag

SEQ ID NO: 780529 - RNA, 19 nt, Homo sapiens
ccauagagcaggacaucuu

SEQ ID NO: 780530 - RNA, 19 nt, Homo sapiens
gaggagcgaguucaaagug

SEQ ID NO: 780531 - RNA, 19 nt, Homo sapiens
cuccaguacugcacaaauu

SEQ ID NO: 780532 - RNA, 19 nt, Homo sapiens
aaggaaagaaguuguaguu

SEQ ID NO: 780533 - RNA, 19 nt, Homo sapiens
cccagggacucuuucuaaa

SEQ ID NO: 780534 - RNA, 19 nt, Homo sapiens
cggcagacccuaucaucaa

SEQ ID NO: 780535 - RNA, 19 nt, Homo sapiens
gcaacuggcagcggcguuu

SEQ ID NO: 780536 - RNA, 19 nt, Homo sapiens
ccuaaugacguggacuuua

SEQ ID NO: 780537 - RNA, 19 nt, Homo sapiens
agucaaauacaccuucuuu

SEQ ID NO: 780538 - RNA, 19 nt, Homo sapiens
cagcuggugccacuaauau

SEQ ID NO: 780539 - RNA, 19 nt, Homo sapiens
uggaggaggaguacaguuu

SEQ ID NO: 780540 - RNA, 19 nt, Homo sapiens
gagggaaaggaaagaaguu

SEQ ID NO: 780541 - RNA, 19 nt, Homo sapiens
gcgaggaguucaccaucca

SEQ ID NO: 780542 - RNA, 19 nt, Homo sapiens
aauuauggcuacaaugaca

SEQ ID NO: 780543 - RNA, 19 nt, Homo sapiens
caccaauuauggcuacaau

SEQ ID NO: 780544 - RNA, 19 nt, Homo sapiens
acaauuacacugacaugga

SEQ ID NO: 780545 - RNA, 19 nt, Homo sapiens
agaaguauaaugccuacaa

SEQ ID NO: 780546 - RNA, 19 nt, Homo sapiens
gagagcaaccaccaacauc

SEQ ID NO: 780547 - RNA, 19 nt, Homo sapiens
gggcaagcaccacgugaug

SEQ ID NO: 780548 - RNA, 19 nt, Homo sapiens
gcaucaagaauuccaucaa

SEQ ID NO: 780549 - RNA, 19 nt, Homo sapiens
aaccacauccugacguuaa

SEQ ID NO: 780550 - RNA, 19 nt, Homo sapiens
agaaccacauccugacguu

SEQ ID NO: 780551 - RNA, 19 nt, Homo sapiens
gcaacaaggcucugaaacc

SEQ ID NO: 780552 - RNA, 19 nt, Homo sapiens
gagcaaccaccaacaucau

SEQ ID NO: 780553 - RNA, 19 nt, Homo sapiens
cagugcagcuccugacagu

SEQ ID NO: 780554 - RNA, 19 nt, Homo sapiens
gcagugcaggcagaucuuu

SEQ ID NO: 780555 - RNA, 19 nt, Homo sapiens
ccaagaagaggaggcagaa

SEQ ID NO: 780556 - RNA, 19 nt, Homo sapiens
ccagcuggugccacuaaua

SEQ ID NO: 780557 - RNA, 19 nt, Homo sapiens
cacccuggcccaugaacua

SEQ ID NO: 780558 - RNA, 19 nt, Homo sapiens
uggcagaggcgaacuguag

SEQ ID NO: 780559 - RNA, 19 nt, Homo sapiens
gggaggagcgaguucaaag

SEQ ID NO: 780560 - RNA, 19 nt, Homo sapiens
gagccaaguaccagucaug

SEQ ID NO: 780561 - RNA, 19 nt, Homo sapiens
gggaauagugagagaucaa

SEQ ID NO: 780562 - RNA, 19 nt, Homo sapiens
cgggaccgcugcaaguugu

SEQ ID NO: 780563 - RNA, 19 nt, Homo sapiens
cugcguaacuucugcaacu

SEQ ID NO: 780564 - RNA, 19 nt, Homo sapiens
ucaaccugauggugguaaa

SEQ ID NO: 780565 - RNA, 19 nt, Homo sapiens
ggaggagcgaguucaaagu

SEQ ID NO: 780566 - RNA, 19 nt, Homo sapiens
ucagaaggcagcugucuac

SEQ ID NO: 780567 - RNA, 19 nt, Homo sapiens
gcugaucguagaagaugaa

SEQ ID NO: 780568 - RNA, 19 nt, Homo sapiens
ggaggagagccaagaagag

SEQ ID NO: 780569 - RNA, 19 nt, Homo sapiens
uugcauuucaucccaauuu

SEQ ID NO: 780570 - RNA, 19 nt, Homo sapiens
guagagggaaaggaaagaa

SEQ ID NO: 780571 - RNA, 19 nt, Homo sapiens
acaccuucuuuguuccuaa

SEQ ID NO: 780572 - RNA, 19 nt, Homo sapiens
cauagagcaggacaucuug

SEQ ID NO: 780573 - RNA, 19 nt, Homo sapiens
gggagcagcagugugagaa

SEQ ID NO: 780574 - RNA, 19 nt, Homo sapiens
gggaagaggagaggguaug

SEQ ID NO: 780575 - RNA, 19 nt, Homo sapiens
augcagagcagcaaagaga

SEQ ID NO: 780576 - RNA, 19 nt, Homo sapiens
gcaugcagagcagcaaaga

SEQ ID NO: 780577 - RNA, 19 nt, Homo sapiens
gggaaaggaaagaaguugu

SEQ ID NO: 780578 - RNA, 19 nt, Homo sapiens
gaccuguggaggaggagua

SEQ ID NO: 780579 - RNA, 19 nt, Homo sapiens
ggcagacccuaucaucaac

SEQ ID NO: 780580 - RNA, 19 nt, Homo sapiens
ccugauugguuuugcauuu

SEQ ID NO: 780581 - RNA, 19 nt, Homo sapiens
uaaagggucaguccagcau

SEQ ID NO: 780582 - RNA, 19 nt, Homo sapiens
aaagucaaauacaccuucu

SEQ ID NO: 780583 - RNA, 19 nt, Homo sapiens
gagcgaguucaaaguguuc

SEQ ID NO: 780584 - RNA, 19 nt, Homo sapiens
gaguaggaccaagcgguuu

SEQ ID NO: 780585 - RNA, 19 nt, Homo sapiens
gagagagcaaccaccaaca

SEQ ID NO: 780586 - RNA, 19 nt, Homo sapiens
caccuucuuuguuccuaau

SEQ ID NO: 780587 - RNA, 19 nt, Homo sapiens
guucgaggccaaggugauu

SEQ ID NO: 780588 - RNA, 19 nt, Homo sapiens
gugcugaucguagaagaug

SEQ ID NO: 780589 - RNA, 19 nt, Homo sapiens
gcgaggaggagagccaaga

SEQ ID NO: 780590 - RNA, 19 nt, Homo sapiens
ggaggaggaguacaguuuu

SEQ ID NO: 780591 - RNA, 19 nt, Homo sapiens
cgaggaggagagccaagaa

SEQ ID NO: 780592 - RNA, 19 nt, Homo sapiens
gcggcagacccuaucauca

SEQ ID NO: 780593 - RNA, 19 nt, Homo sapiens
gcucaaagcugcaguauga

SEQ ID NO: 780594 - RNA, 19 nt, Homo sapiens
guaaauagaucucagugua

SEQ ID NO: 780595 - RNA, 19 nt, Homo sapiens
guacaaggcugauaaccua

SEQ ID NO: 780596 - RNA, 19 nt, Homo sapiens
gaaauggaguguucaauag

SEQ ID NO: 780597 - RNA, 19 nt, Homo sapiens
ucaaguaacucaaauguga

SEQ ID NO: 780598 - RNA, 19 nt, Homo sapiens
ucaccaaccucacaacuua

SEQ ID NO: 780599 - RNA, 19 nt, Homo sapiens
gaacagucaugaacuauag

SEQ ID NO: 780600 - RNA, 19 nt, Homo sapiens
ggaaagcacuugauuguac

SEQ ID NO: 780601 - RNA, 19 nt, Homo sapiens
uagauucacugccuauuua

SEQ ID NO: 780602 - RNA, 19 nt, Homo sapiens
aaagaucacuugguaguua

SEQ ID NO: 780603 - RNA, 19 nt, Homo sapiens
gaaggaaauucuaauagug

SEQ ID NO: 780604 - RNA, 19 nt, Homo sapiens
ccaaaggccuucugcguuu

SEQ ID NO: 780605 - RNA, 19 nt, Homo sapiens
agaaagagcuguggauauu

SEQ ID NO: 780606 - RNA, 19 nt, Homo sapiens
aaagauaacuggaggauuc

SEQ ID NO: 780607 - RNA, 19 nt, Homo sapiens
gauagaaugucuuuaaugg

SEQ ID NO: 780608 - RNA, 19 nt, Homo sapiens
ggagagagguuaauguuac

SEQ ID NO: 780609 - RNA, 19 nt, Homo sapiens
ucagguagcuagccaaauu

SEQ ID NO: 780610 - RNA, 19 nt, Homo sapiens
gaaagcaaaccuaguuaaa

SEQ ID NO: 780611 - RNA, 19 nt, Homo sapiens
ccaaaugugccuauuguua

SEQ ID NO: 780612 - RNA, 19 nt, Homo sapiens
gcacacaccuaaagauauc

SEQ ID NO: 780613 - RNA, 19 nt, Homo sapiens
cauuaaagaucacuuggua

SEQ ID NO: 780614 - RNA, 19 nt, Homo sapiens
guggugaccuugcaauaua

SEQ ID NO: 780615 - RNA, 19 nt, Homo sapiens
caacaggaguccaauuaug

SEQ ID NO: 780616 - RNA, 19 nt, Homo sapiens
caaaguaggucugcagcua

SEQ ID NO: 780617 - RNA, 19 nt, Homo sapiens
gcagaaagcaaaccuaguu

SEQ ID NO: 780618 - RNA, 19 nt, Homo sapiens
ucugauaucucacaaugua

SEQ ID NO: 780619 - RNA, 19 nt, Homo sapiens
guuggaaccuuuaauaaga

SEQ ID NO: 780620 - RNA, 19 nt, Homo sapiens
gcugauaaccuauauguga

SEQ ID NO: 780621 - RNA, 19 nt, Homo sapiens
caaaugugccuauuguuaa

SEQ ID NO: 780622 - RNA, 19 nt, Homo sapiens
guucaaggguucaguaaga

SEQ ID NO: 780623 - RNA, 19 nt, Homo sapiens
ucacagaauuccuggauga

SEQ ID NO: 780624 - RNA, 19 nt, Homo sapiens
gagaagugguuaucauugu

SEQ ID NO: 780625 - RNA, 19 nt, Homo sapiens
gaagugguuaucauuguua

SEQ ID NO: 780626 - RNA, 19 nt, Homo sapiens
gaacaucgaccaacucuac

SEQ ID NO: 780627 - RNA, 19 nt, Homo sapiens
caagggcacuggcuacuau

SEQ ID NO: 780628 - RNA, 19 nt, Homo sapiens
gauauggauuggaaacuga

SEQ ID NO: 780629 - RNA, 19 nt, Homo sapiens
aguaagaccuacaauguuu

SEQ ID NO: 780630 - RNA, 19 nt, Homo sapiens
guuaugaucuuaugcacaa

SEQ ID NO: 780631 - RNA, 19 nt, Homo sapiens
ccaaagaccagacuagauu

SEQ ID NO: 780632 - RNA, 19 nt, Homo sapiens
gagaagaugauauggauug

SEQ ID NO: 780633 - RNA, 19 nt, Homo sapiens
gaaacacugaugaauguaa

SEQ ID NO: 780634 - RNA, 19 nt, Homo sapiens
aagaaacacugaugaaugu

SEQ ID NO: 780635 - RNA, 19 nt, Homo sapiens
cgaaggaaauucuaauagu

SEQ ID NO: 780636 - RNA, 19 nt, Homo sapiens
gggcaaauguguggacaaa

SEQ ID NO: 780637 - RNA, 19 nt, Homo sapiens
gaagagaccuuugguucca

SEQ ID NO: 780638 - RNA, 19 nt, Homo sapiens
aaaguaaacucugucacua

SEQ ID NO: 780639 - RNA, 19 nt, Homo sapiens
gugaguaccuuaucaaugg

SEQ ID NO: 780640 - RNA, 19 nt, Homo sapiens
gcacuacgaugcagcuauc

SEQ ID NO: 780641 - RNA, 19 nt, Homo sapiens
ucagagaaauggaguguuc

SEQ ID NO: 780642 - RNA, 19 nt, Homo sapiens
gggaaccacuguuugaguu

SEQ ID NO: 780643 - RNA, 19 nt, Homo sapiens
caucugauaucucacaaug

SEQ ID NO: 780644 - RNA, 19 nt, Homo sapiens
gcaauaaagugggaucaca

SEQ ID NO: 780645 - RNA, 19 nt, Homo sapiens
gaaguccacuccaaaagua

SEQ ID NO: 780646 - RNA, 19 nt, Homo sapiens
caagaaacacugaugaaug

SEQ ID NO: 780647 - RNA, 19 nt, Homo sapiens
cgaugcagcuauccuguuu

SEQ ID NO: 780648 - RNA, 19 nt, Homo sapiens
gacaagagccuggaaguga

SEQ ID NO: 780649 - RNA, 19 nt, Homo sapiens
ggaacagucaugaacuaua

SEQ ID NO: 780650 - RNA, 19 nt, Homo sapiens
agaaauggaguguucaaua

SEQ ID NO: 780651 - RNA, 19 nt, Homo sapiens
gaagauggcagaacugucu

SEQ ID NO: 780652 - RNA, 19 nt, Homo sapiens
uaaauguaguugucuccua

SEQ ID NO: 780653 - RNA, 19 nt, Homo sapiens
guuaaagauuugcauguga

SEQ ID NO: 780654 - RNA, 19 nt, Homo sapiens
uaaguagguuguaaguuug

SEQ ID NO: 780655 - RNA, 19 nt, Homo sapiens
cagcaaguaucuucugaga

SEQ ID NO: 780656 - RNA, 19 nt, Homo sapiens
caaaggccuucugcguuua

SEQ ID NO: 780657 - RNA, 19 nt, Homo sapiens
caaagagaauuaggagaga

SEQ ID NO: 780658 - RNA, 19 nt, Homo sapiens
guaguuagccacauugaga

SEQ ID NO: 780659 - RNA, 19 nt, Homo sapiens
ucaccuaccucugauagaa

SEQ ID NO: 780660 - RNA, 19 nt, Homo sapiens
ccaugacgauuccaaauuc

SEQ ID NO: 780661 - RNA, 19 nt, Homo sapiens
ccaccacacucaagaacuu

SEQ ID NO: 780662 - RNA, 19 nt, Homo sapiens
gaaaugaggccuguacaag

SEQ ID NO: 780663 - RNA, 19 nt, Homo sapiens
uccauagccuguuuaagua

SEQ ID NO: 780664 - RNA, 19 nt, Homo sapiens
guagcuagccaaauuaaug

SEQ ID NO: 780665 - RNA, 19 nt, Homo sapiens
gaagaacucccaggacaga

SEQ ID NO: 780666 - RNA, 19 nt, Homo sapiens
cuaaauuccuggagaagau

SEQ ID NO: 780667 - RNA, 19 nt, Homo sapiens
gaaagagcuguggauauuu

SEQ ID NO: 780668 - RNA, 19 nt, Homo sapiens
cuugguaugucacuuuaua

SEQ ID NO: 780669 - RNA, 19 nt, Homo sapiens
gucaacaggaguccaauua

SEQ ID NO: 780670 - RNA, 19 nt, Homo sapiens
gaaagucaugcuucaguga

SEQ ID NO: 780671 - RNA, 19 nt, Homo sapiens
ggauggaaaccggaaguua

SEQ ID NO: 780672 - RNA, 19 nt, Homo sapiens
aagaugauauggauuggaa

SEQ ID NO: 780673 - RNA, 19 nt, Homo sapiens
gcaaggggcuggugcagaa

SEQ ID NO: 780674 - RNA, 19 nt, Homo sapiens
aaauagaugucuugcuguu

SEQ ID NO: 780675 - RNA, 19 nt, Homo sapiens
gaugacaugugaugauuuu

SEQ ID NO: 780676 - RNA, 19 nt, Homo sapiens
gacagcaaguaucuucuga

SEQ ID NO: 780677 - RNA, 19 nt, Homo sapiens
cacaguagcuucuucuuac

SEQ ID NO: 780678 - RNA, 19 nt, Homo sapiens
uaaacucugucacuaguca

SEQ ID NO: 780679 - RNA, 19 nt, Homo sapiens
gaacaaagggaaaauucua

SEQ ID NO: 780680 - RNA, 19 nt, Homo sapiens
guaaguguuugagugauga

SEQ ID NO: 780681 - RNA, 19 nt, Homo sapiens
gcuuucaucugauaucuca

SEQ ID NO: 780682 - RNA, 19 nt, Homo sapiens
gugguuauauucccaacaa

SEQ ID NO: 780683 - RNA, 19 nt, Homo sapiens
gugaugacaugugaugauu

SEQ ID NO: 780684 - RNA, 19 nt, Homo sapiens
ucaguaagaccuacaaugu

SEQ ID NO: 780685 - RNA, 19 nt, Homo sapiens
acacaguagcuucuucuua

SEQ ID NO: 780686 - RNA, 19 nt, Homo sapiens
gaagcugccugcgguggaa

SEQ ID NO: 780687 - RNA, 19 nt, Homo sapiens
cguacugucuuucaccuuu

SEQ ID NO: 780688 - RNA, 19 nt, Homo sapiens
gaccuuugguuccacagaa

SEQ ID NO: 780689 - RNA, 19 nt, Homo sapiens
gcaaguggcagcaccaaca

SEQ ID NO: 780690 - RNA, 19 nt, Homo sapiens
caaggcugauaaccuauau

SEQ ID NO: 780691 - RNA, 19 nt, Homo sapiens
ccaagaaguccacuccaaa

SEQ ID NO: 780692 - RNA, 19 nt, Homo sapiens
cuucagagacuaucauuga

SEQ ID NO: 780693 - RNA, 19 nt, Homo sapiens
uagaagaacuggaacaauu

SEQ ID NO: 780694 - RNA, 19 nt, Homo sapiens
gaaggaaggcuuuggauug

SEQ ID NO: 780695 - RNA, 19 nt, Homo sapiens
gcagaaagaugaaaagaaa

SEQ ID NO: 780696 - RNA, 19 nt, Homo sapiens
gagauaaacuaacaguaga

SEQ ID NO: 780697 - RNA, 19 nt, Homo sapiens
gaauacaacuagccagaga

SEQ ID NO: 780698 - RNA, 19 nt, Homo sapiens
uaaauucuguccaacguuu

SEQ ID NO: 780699 - RNA, 19 nt, Homo sapiens
gcaguucuguggcugguuu

SEQ ID NO: 780700 - RNA, 19 nt, Homo sapiens
gaauauaagcuuccaucaa

SEQ ID NO: 780701 - RNA, 19 nt, Homo sapiens
ggaaauagcagcauaucca

SEQ ID NO: 780702 - RNA, 19 nt, Homo sapiens
caggguaaaugaacugaaa

SEQ ID NO: 780703 - RNA, 19 nt, Homo sapiens
gcgagaagaugacgucaca

SEQ ID NO: 780704 - RNA, 19 nt, Homo sapiens
ggaggaacaggguaaauga

SEQ ID NO: 780705 - RNA, 19 nt, Homo sapiens
gaagaugacgucacaguag

SEQ ID NO: 780706 - RNA, 19 nt, Homo sapiens
cacaucggcugcaucauuu

SEQ ID NO: 780707 - RNA, 19 nt, Homo sapiens
uguaaaggauggaguaaau

SEQ ID NO: 780708 - RNA, 19 nt, Homo sapiens
gauaaugcucagaacuuua

SEQ ID NO: 780709 - RNA, 19 nt, Homo sapiens
gaacggugcagacugaaga

SEQ ID NO: 780710 - RNA, 19 nt, Homo sapiens
aauaacagcagcagugaua

SEQ ID NO: 780711 - RNA, 19 nt, Homo sapiens
gaacccauuugcuucacuu

SEQ ID NO: 780712 - RNA, 19 nt, Homo sapiens
gaacuggaacaauuucaau

SEQ ID NO: 780713 - RNA, 19 nt, Homo sapiens
ugauaaugcucagaacuuu

SEQ ID NO: 780714 - RNA, 19 nt, Homo sapiens
ccagagauauuccaauguc

SEQ ID NO: 780715 - RNA, 19 nt, Homo sapiens
agacguggauggaauacaa

SEQ ID NO: 780716 - RNA, 19 nt, Homo sapiens
uaaaagauauggagguuug

SEQ ID NO: 780717 - RNA, 19 nt, Homo sapiens
ggaaggaaggcuuuggauu

SEQ ID NO: 780718 - RNA, 19 nt, Homo sapiens
cagcagccuucagguaaua

SEQ ID NO: 780719 - RNA, 19 nt, Homo sapiens
ucacaucggcugcaucauu

SEQ ID NO: 780720 - RNA, 19 nt, Homo sapiens
guucagguaucucuacuuc

SEQ ID NO: 780721 - RNA, 19 nt, Homo sapiens
gcaccugcauuuggauuug

SEQ ID NO: 780722 - RNA, 19 nt, Homo sapiens
uaauagacguggauggaau

SEQ ID NO: 780723 - RNA, 19 nt, Homo sapiens
uaccauaacuucuuaacca

SEQ ID NO: 780724 - RNA, 19 nt, Homo sapiens
ucagguaucucuacuucug

SEQ ID NO: 780725 - RNA, 19 nt, Homo sapiens
gaaauuuacucugggaaaa

SEQ ID NO: 780726 - RNA, 19 nt, Homo sapiens
ggaaggcuuuggauugucu

SEQ ID NO: 780727 - RNA, 19 nt, Homo sapiens
gcagcagccuucagguaau

SEQ ID NO: 780728 - RNA, 19 nt, Homo sapiens
cauauccacuucucuguca

SEQ ID NO: 780729 - RNA, 19 nt, Homo sapiens
gcagugauaaugcucagaa

SEQ ID NO: 780730 - RNA, 19 nt, Homo sapiens
gcuuugcucucugauguaa

SEQ ID NO: 780731 - RNA, 19 nt, Homo sapiens
uaacaggaaggaaggcuuu

SEQ ID NO: 780732 - RNA, 19 nt, Homo sapiens
aagcuuccaucaauaguga

SEQ ID NO: 780733 - RNA, 19 nt, Homo sapiens
gaacaauuucaauccaaga

SEQ ID NO: 780734 - RNA, 19 nt, Homo sapiens
gaagaacuggaacaauuuc

SEQ ID NO: 780735 - RNA, 19 nt, Homo sapiens
uagcuuugcucucugaugu

SEQ ID NO: 780736 - RNA, 19 nt, Homo sapiens
ggaaggaauuguaaaagau

SEQ ID NO: 780737 - RNA, 19 nt, Homo sapiens
gagcuucaacuaacaggaa

SEQ ID NO: 780738 - RNA, 19 nt, Homo sapiens
agaagaacuggaacaauuu

SEQ ID NO: 780739 - RNA, 19 nt, Homo sapiens
gaacaggguaaaugaacug

SEQ ID NO: 780740 - RNA, 19 nt, Homo sapiens
acaacuagccagagauauu

SEQ ID NO: 780741 - RNA, 19 nt, Homo sapiens
uaaaggauggaguaaauca

SEQ ID NO: 780742 - RNA, 19 nt, Homo sapiens
ggaacaggguaaaugaacu

SEQ ID NO: 780743 - RNA, 19 nt, Homo sapiens
ggaauugaggcuugaauac

SEQ ID NO: 780744 - RNA, 19 nt, Homo sapiens
gcagcaucauugcaacaga

SEQ ID NO: 780745 - RNA, 19 nt, Homo sapiens
ggccauuugucaauucuuc

SEQ ID NO: 780746 - RNA, 19 nt, Homo sapiens
cagcagagaucaagaaaag

SEQ ID NO: 780747 - RNA, 19 nt, Homo sapiens
caacuagccagagauauuc

SEQ ID NO: 780748 - RNA, 19 nt, Homo sapiens
gcugcugccucuucuggaa

SEQ ID NO: 780749 - RNA, 19 nt, Homo sapiens
gagaagaugacgucacagu

SEQ ID NO: 780750 - RNA, 19 nt, Homo sapiens
ccuauuggcucaaguccau

SEQ ID NO: 780751 - RNA, 19 nt, Homo sapiens
auaaaucaauggaggaaca

SEQ ID NO: 780752 - RNA, 19 nt, Homo sapiens
gguccgcucuucucaaguc

SEQ ID NO: 780753 - RNA, 19 nt, Homo sapiens
agagauaaacuaacaguag

SEQ ID NO: 780754 - RNA, 19 nt, Homo sapiens
gcugcagccucuaccaguu

SEQ ID NO: 780755 - RNA, 19 nt, Homo sapiens
gcagucaagcagcaacauu

SEQ ID NO: 780756 - RNA, 19 nt, Homo sapiens
cugaugagcagaaagauga

SEQ ID NO: 780757 - RNA, 19 nt, Homo sapiens
cagcagcagccuucaggua

SEQ ID NO: 780758 - RNA, 19 nt, Homo sapiens
cagcaucauugcaacagau

SEQ ID NO: 780759 - RNA, 19 nt, Homo sapiens
ucaagcagcaucauugcaa

SEQ ID NO: 780760 - RNA, 19 nt, Homo sapiens
gugauaaugcucagaacuu

SEQ ID NO: 780761 - RNA, 19 nt, Homo sapiens
aaggaaggcuuuggauugu

SEQ ID NO: 780762 - RNA, 19 nt, Homo sapiens
acagagauguauauaugca

SEQ ID NO: 780763 - RNA, 19 nt, Homo sapiens
gaagucacaucggcugcau

SEQ ID NO: 780764 - RNA, 19 nt, Homo sapiens
uaacagcagcagugauaau

SEQ ID NO: 780765 - RNA, 19 nt, Homo sapiens
gaggaacaggguaaaugaa

SEQ ID NO: 780766 - RNA, 19 nt, Homo sapiens
gggcagcagagaucaagaa

SEQ ID NO: 780767 - RNA, 19 nt, Homo sapiens
acccagagauaaacuaaca

SEQ ID NO: 780768 - RNA, 19 nt, Homo sapiens
ucaagcagcaacauuuaug

SEQ ID NO: 780769 - RNA, 19 nt, Homo sapiens
cagucaagcagcaacauuu

SEQ ID NO: 780770 - RNA, 19 nt, Homo sapiens
auacaacuagccagagaua

SEQ ID NO: 780771 - RNA, 19 nt, Homo sapiens
agucaagcagcaacauuua

SEQ ID NO: 780772 - RNA, 19 nt, Homo sapiens
caauggaggaacaggguaa

SEQ ID NO: 780773 - RNA, 19 nt, Homo sapiens
ggcuuuggauugucugaga

SEQ ID NO: 780774 - RNA, 19 nt, Homo sapiens
agaagaugacgucacagua

SEQ ID NO: 780775 - RNA, 19 nt, Homo sapiens
agccagagauauuccaaug

SEQ ID NO: 780776 - RNA, 19 nt, Homo sapiens
ugucaauucuuccuucaag

SEQ ID NO: 780777 - RNA, 19 nt, Homo sapiens
ucgccaggcuuuccaguca

SEQ ID NO: 780778 - RNA, 19 nt, Homo sapiens
cagaggaauugaggcuuga

SEQ ID NO: 780779 - RNA, 19 nt, Homo sapiens
gccauccaguuucuccaaa

SEQ ID NO: 780780 - RNA, 19 nt, Homo sapiens
cuacuucugcuccagcuuu

SEQ ID NO: 780781 - RNA, 19 nt, Homo sapiens
gcucucugauguaaaggau

SEQ ID NO: 780782 - RNA, 19 nt, Homo sapiens
ucuggaacuucuaaauguu

SEQ ID NO: 780783 - RNA, 19 nt, Homo sapiens
uuucuaagccauccaguga

SEQ ID NO: 780784 - RNA, 19 nt, Homo sapiens
ggauuuggcagcagucaag

SEQ ID NO: 780785 - RNA, 19 nt, Homo sapiens
gauguaaaggauggaguaa

SEQ ID NO: 780786 - RNA, 19 nt, Homo sapiens
gcuugaauaccauaacuuc

SEQ ID NO: 780787 - RNA, 19 nt, Homo sapiens
agccauauuucaguucuuu

SEQ ID NO: 780788 - RNA, 19 nt, Homo sapiens
uauaagcuuccaucaauag

SEQ ID NO: 780789 - RNA, 19 nt, Homo sapiens
ucuaagccauccagugaca

SEQ ID NO: 780790 - RNA, 19 nt, Homo sapiens
gggcucacauucucacacu

SEQ ID NO: 780791 - RNA, 19 nt, Homo sapiens
gcccugcagcuuccaguuu

SEQ ID NO: 780792 - RNA, 19 nt, Homo sapiens
ugggaagccugaagucaca

SEQ ID NO: 780793 - RNA, 19 nt, Homo sapiens
gaacuccacugcccacuua

SEQ ID NO: 780794 - RNA, 19 nt, Homo sapiens
gaaggaagcggcagauuua

SEQ ID NO: 780795 - RNA, 19 nt, Homo sapiens
cagauuugcuauuggauua

SEQ ID NO: 780796 - RNA, 19 nt, Homo sapiens
gaauucacuucucugguua

SEQ ID NO: 780797 - RNA, 19 nt, Homo sapiens
cagaaucacuccucucaaa

SEQ ID NO: 780798 - RNA, 19 nt, Homo sapiens
caacguggcugucagaauc

SEQ ID NO: 780799 - RNA, 19 nt, Homo sapiens
gacagcagguucagcauuu

SEQ ID NO: 780800 - RNA, 19 nt, Homo sapiens
gcuauuggauuaaaggaaa

SEQ ID NO: 780801 - RNA, 19 nt, Homo sapiens
gaaucacuccucucaaaua

SEQ ID NO: 780802 - RNA, 19 nt, Homo sapiens
caacaucagugaaguuauc

SEQ ID NO: 780803 - RNA, 19 nt, Homo sapiens
caacuacccuuucucaaca

SEQ ID NO: 780804 - RNA, 19 nt, Homo sapiens
agcaauaucugucuuauga

SEQ ID NO: 780805 - RNA, 19 nt, Homo sapiens
cggcauggauuaugauuau

SEQ ID NO: 780806 - RNA, 19 nt, Homo sapiens
ucucaaauaugcccagauu

SEQ ID NO: 780807 - RNA, 19 nt, Homo sapiens
aaaggaaacuaccuggauu

SEQ ID NO: 780808 - RNA, 19 nt, Homo sapiens
gaaaggaacccagaagcuu

SEQ ID NO: 780809 - RNA, 19 nt, Homo sapiens
gaagccaaauuagaaguau

SEQ ID NO: 780810 - RNA, 19 nt, Homo sapiens
caagaugacuggcuuuacu

SEQ ID NO: 780811 - RNA, 19 nt, Homo sapiens
cgaaggaagcggcagauuu

SEQ ID NO: 780812 - RNA, 19 nt, Homo sapiens
ucaaagacgagaccuauga

SEQ ID NO: 780813 - RNA, 19 nt, Homo sapiens
gaaacgcucuaugccaaug

SEQ ID NO: 780814 - RNA, 19 nt, Homo sapiens
ugacuggcuuuacuauuug

SEQ ID NO: 780815 - RNA, 19 nt, Homo sapiens
augacuggcuuuacuauuu

SEQ ID NO: 780816 - RNA, 19 nt, Homo sapiens
ggaagagacagcagcagaa

SEQ ID NO: 780817 - RNA, 19 nt, Homo sapiens
ucaggaaagucucgaagga

SEQ ID NO: 780818 - RNA, 19 nt, Homo sapiens
acgaagaggccaagcaaua

SEQ ID NO: 780819 - RNA, 19 nt, Homo sapiens
ccaagcaauaucugucuua

SEQ ID NO: 780820 - RNA, 19 nt, Homo sapiens
ggaaacuaccuggauugua

SEQ ID NO: 780821 - RNA, 19 nt, Homo sapiens
aaucacuccucucaaauau

SEQ ID NO: 780822 - RNA, 19 nt, Homo sapiens
uaagcaguuugaaggcaua

SEQ ID NO: 780823 - RNA, 19 nt, Homo sapiens
ggaagcggcagauuuaugg

SEQ ID NO: 780824 - RNA, 19 nt, Homo sapiens
caagcaauaucugucuuau

SEQ ID NO: 780825 - RNA, 19 nt, Homo sapiens
gcccagauuugcuauugga

SEQ ID NO: 780826 - RNA, 19 nt, Homo sapiens
ccucuuccuucucuucuuu

SEQ ID NO: 780827 - RNA, 19 nt, Homo sapiens
uaaaggaaacuaccuggau

SEQ ID NO: 780828 - RNA, 19 nt, Homo sapiens
gaagaggccaagcaauauc

SEQ ID NO: 780829 - RNA, 19 nt, Homo sapiens
ccagucuacccucaauuua

SEQ ID NO: 780830 - RNA, 19 nt, Homo sapiens
ucacuccucucaaauaugc

SEQ ID NO: 780831 - RNA, 19 nt, Homo sapiens
ccaaugacaucggcaugga

SEQ ID NO: 780832 - RNA, 19 nt, Homo sapiens
agacgagaccuaugacuug

SEQ ID NO: 780833 - RNA, 19 nt, Homo sapiens
cgaagaggccaagcaauau

SEQ ID NO: 780834 - RNA, 19 nt, Homo sapiens
gagccgaagccaaauuaga

SEQ ID NO: 780835 - RNA, 19 nt, Homo sapiens
gcucaacuacccuuucuca

SEQ ID NO: 780836 - RNA, 19 nt, Homo sapiens
cgaagccaaauuagaagua

SEQ ID NO: 780837 - RNA, 19 nt, Homo sapiens
gggcaaugaggaauauuug

SEQ ID NO: 780838 - RNA, 19 nt, Homo sapiens
gaaggcauacuuuugcaua

SEQ ID NO: 780839 - RNA, 19 nt, Homo sapiens
ucacuucucugguuaugac

SEQ ID NO: 780840 - RNA, 19 nt, Homo sapiens
gcaagugagcccuuacagu

SEQ ID NO: 780841 - RNA, 19 nt, Homo sapiens
ucgcuucugugacgucaaa

SEQ ID NO: 780842 - RNA, 19 nt, Homo sapiens
ggugagcccuccugcuaag

SEQ ID NO: 780843 - RNA, 19 nt, Homo sapiens
gcagauuuauggcuaugac

SEQ ID NO: 780844 - RNA, 19 nt, Homo sapiens
gggcuccucuuccuucucu

SEQ ID NO: 780845 - RNA, 19 nt, Homo sapiens
gaagagacagcagcagaag

SEQ ID NO: 780846 - RNA, 19 nt, Homo sapiens
ugaccgaccaggcaauuug

SEQ ID NO: 780847 - RNA, 19 nt, Homo sapiens
agagaagcauguccucaca

SEQ ID NO: 780848 - RNA, 19 nt, Homo sapiens
agacgcaggugggcaucua

SEQ ID NO: 780849 - RNA, 19 nt, Homo sapiens
gcaaugaggaauauuugac

SEQ ID NO: 780850 - RNA, 19 nt, Homo sapiens
gcaguuugaaggcauacuu

SEQ ID NO: 780851 - RNA, 19 nt, Homo sapiens
gaugacuggcuuuacuauu

SEQ ID NO: 780852 - RNA, 19 nt, Homo sapiens
agagacagcagcagaagug

SEQ ID NO: 780853 - RNA, 19 nt, Homo sapiens
uggagccgaagccaaauua

SEQ ID NO: 780854 - RNA, 19 nt, Homo sapiens
acaucggcauggauuauga

SEQ ID NO: 780855 - RNA, 19 nt, Homo sapiens
gcaauaucugucuuaugaa

SEQ ID NO: 780856 - RNA, 19 nt, Homo sapiens
ccagauuugcuauuggauu

SEQ ID NO: 780857 - RNA, 19 nt, Homo sapiens
ugacagcagguucagcauu

SEQ ID NO: 780858 - RNA, 19 nt, Homo sapiens
gacucagggucuucaggaa

SEQ ID NO: 780859 - RNA, 19 nt, Homo sapiens
gcaggugggcaucuacauc

SEQ ID NO: 780860 - RNA, 19 nt, Homo sapiens
gccaagcaauaucugucuu

SEQ ID NO: 780861 - RNA, 19 nt, Homo sapiens
aagcccaaguuuaaagaug

SEQ ID NO: 780862 - RNA, 19 nt, Homo sapiens
ggaacuccacugcccacuu

SEQ ID NO: 780863 - RNA, 19 nt, Homo sapiens
caaugaggaauauuugaca

SEQ ID NO: 780864 - RNA, 19 nt, Homo sapiens
uuuaggagaggccaaauug

SEQ ID NO: 780865 - RNA, 19 nt, Homo sapiens
ugacaucggcauggauuau

SEQ ID NO: 780866 - RNA, 19 nt, Homo sapiens
cccagucuacccucaauuu

SEQ ID NO: 780867 - RNA, 19 nt, Homo sapiens
ggcaaugaggaauauuuga

SEQ ID NO: 780868 - RNA, 19 nt, Homo sapiens
gacuggcuuuacuauuuga

SEQ ID NO: 780869 - RNA, 19 nt, Homo sapiens
ggccaacgacuccacuuca

SEQ ID NO: 780870 - RNA, 19 nt, Homo sapiens
ucaacuacccuuucucaac

SEQ ID NO: 780871 - RNA, 19 nt, Homo sapiens
aauaugcccagauuugcua

SEQ ID NO: 780872 - RNA, 19 nt, Homo sapiens
uaugugaggauguggaaga

SEQ ID NO: 780873 - RNA, 19 nt, Homo sapiens
agccgaagccaaauuagaa

SEQ ID NO: 780874 - RNA, 19 nt, Homo sapiens
gggugagcccuccugcuaa

SEQ ID NO: 780875 - RNA, 19 nt, Homo sapiens
ugcccgagcagaugaaauu

SEQ ID NO: 780876 - RNA, 19 nt, Homo sapiens
uuacgaagaggccaagcaa

SEQ ID NO: 780877 - RNA, 19 nt, Homo sapiens
uuucugcucugugcuguug

SEQ ID NO: 780878 - RNA, 19 nt, Homo sapiens
gcaagaugacuggcuuuac

SEQ ID NO: 780879 - RNA, 19 nt, Homo sapiens
gucagaaucacuccucuca

SEQ ID NO: 780880 - RNA, 19 nt, Homo sapiens
ccuaugacuugcucuacca

SEQ ID NO: 780881 - RNA, 19 nt, Homo sapiens
cucaacaucagugaaguua

SEQ ID NO: 780882 - RNA, 19 nt, Homo sapiens
caggaaagucucgaaggaa

SEQ ID NO: 780883 - RNA, 19 nt, Homo sapiens
aagaugacuggcuuuacua

SEQ ID NO: 780884 - RNA, 19 nt, Homo sapiens
gcggcagauuuauggcuau

SEQ ID NO: 780885 - RNA, 19 nt, Homo sapiens
ccucagcaguaguggagau

SEQ ID NO: 780886 - RNA, 19 nt, Homo sapiens
gccaacgacuccacuucag

SEQ ID NO: 780887 - RNA, 19 nt, Homo sapiens
ggacuuccugcucaacuac

SEQ ID NO: 780888 - RNA, 19 nt, Homo sapiens
accaguggguggacaugaa

SEQ ID NO: 780889 - RNA, 19 nt, Homo sapiens
ugauuaugcccuccuggaa

SEQ ID NO: 780890 - RNA, 19 nt, Homo sapiens
aauggcagccgcacagaga

SEQ ID NO: 780891 - RNA, 19 nt, Homo sapiens
caguuugaaggcauacuuu

SEQ ID NO: 780892 - RNA, 19 nt, Homo sapiens
aaugacaucggcauggauu

SEQ ID NO: 780893 - RNA, 19 nt, Homo sapiens
gaagagagcuacccugcua

SEQ ID NO: 780894 - RNA, 19 nt, Homo sapiens
gaacauggcuguccagaag

SEQ ID NO: 780895 - RNA, 19 nt, Homo sapiens
cauuagagcuggcaaauaa

SEQ ID NO: 780896 - RNA, 19 nt, Homo sapiens
agaagcagcuggauaaaua

SEQ ID NO: 780897 - RNA, 19 nt, Homo sapiens
gcacaacacugucaccuau

SEQ ID NO: 780898 - RNA, 19 nt, Homo sapiens
cagaauaccugucaagauu

SEQ ID NO: 780899 - RNA, 19 nt, Homo sapiens
caucuaagcucccacaauu

SEQ ID NO: 780900 - RNA, 19 nt, Homo sapiens
ggauaaauaugcauuggaa

SEQ ID NO: 780901 - RNA, 19 nt, Homo sapiens
ggauccaacugcuuaauaa

SEQ ID NO: 780902 - RNA, 19 nt, Homo sapiens
gaacaacgauuagaacaag

SEQ ID NO: 780903 - RNA, 19 nt, Homo sapiens
gagaagagcuuuagguacu

SEQ ID NO: 780904 - RNA, 19 nt, Homo sapiens
gagcagcgcuggcgucaau

SEQ ID NO: 780905 - RNA, 19 nt, Homo sapiens
cagaagaccucaagggauu

SEQ ID NO: 780906 - RNA, 19 nt, Homo sapiens
gcaauucuggcaaucauua

SEQ ID NO: 780907 - RNA, 19 nt, Homo sapiens
ggagagcacuggccaggaa

SEQ ID NO: 780908 - RNA, 19 nt, Homo sapiens
ccacaggccugaagaugaa

SEQ ID NO: 780909 - RNA, 19 nt, Homo sapiens
uaaacuggcugcccuaaau

SEQ ID NO: 780910 - RNA, 19 nt, Homo sapiens
gagaauggauggcuaugga

SEQ ID NO: 780911 - RNA, 19 nt, Homo sapiens
ucagaaauuugccuuguuu

SEQ ID NO: 780912 - RNA, 19 nt, Homo sapiens
gaagagauccagucuguuc

SEQ ID NO: 780913 - RNA, 19 nt, Homo sapiens
aaacaacacugguuacauc

SEQ ID NO: 780914 - RNA, 19 nt, Homo sapiens
gcaccaacuccuuaaauaa

SEQ ID NO: 780915 - RNA, 19 nt, Homo sapiens
gagcgugucuugaagguau

SEQ ID NO: 780916 - RNA, 19 nt, Homo sapiens
ugaagaagcagcuggauaa

SEQ ID NO: 780917 - RNA, 19 nt, Homo sapiens
gaagguaucuuugugaaac

SEQ ID NO: 780918 - RNA, 19 nt, Homo sapiens
agaaaucgauuccaagaug

SEQ ID NO: 780919 - RNA, 19 nt, Homo sapiens
gaugaaagguguaaaauuc

SEQ ID NO: 780920 - RNA, 19 nt, Homo sapiens
agaaagaaaucgauuccaa

SEQ ID NO: 780921 - RNA, 19 nt, Homo sapiens
gaagugacauauccauugg

SEQ ID NO: 780922 - RNA, 19 nt, Homo sapiens
ggaagugacauauccauug

SEQ ID NO: 780923 - RNA, 19 nt, Homo sapiens
gaaaucgauuccaagaugu

SEQ ID NO: 780924 - RNA, 19 nt, Homo sapiens
gaaggcauccugugguauu

SEQ ID NO: 780925 - RNA, 19 nt, Homo sapiens
gaagaugccacugccauuu

SEQ ID NO: 780926 - RNA, 19 nt, Homo sapiens
guucgacgccauacaaaua

SEQ ID NO: 780927 - RNA, 19 nt, Homo sapiens
gagcuacccugcuaaggau

SEQ ID NO: 780928 - RNA, 19 nt, Homo sapiens
uauggaagguuuaagauca

SEQ ID NO: 780929 - RNA, 19 nt, Homo sapiens
cagggaccauuacagaaua

SEQ ID NO: 780930 - RNA, 19 nt, Homo sapiens
gggauuauauugccacaca

SEQ ID NO: 780931 - RNA, 19 nt, Homo sapiens
ccauuuggguugaaacuga

SEQ ID NO: 780932 - RNA, 19 nt, Homo sapiens
caucaacgcaucacauauu

SEQ ID NO: 780933 - RNA, 19 nt, Homo sapiens
uaaauggacucucccuauc

SEQ ID NO: 780934 - RNA, 19 nt, Homo sapiens
gagggacucucugaagaaa

SEQ ID NO: 780935 - RNA, 19 nt, Homo sapiens
gggagaagagcuuuaggua

SEQ ID NO: 780936 - RNA, 19 nt, Homo sapiens
caccgcaguugcacuauaa

SEQ ID NO: 780937 - RNA, 19 nt, Homo sapiens
gaggagaccauucaauuuc

SEQ ID NO: 780938 - RNA, 19 nt, Homo sapiens
guauuuagguggcaugaca

SEQ ID NO: 780939 - RNA, 19 nt, Homo sapiens
ccagucaugugaagcguuu

SEQ ID NO: 780940 - RNA, 19 nt, Homo sapiens
gaaggaaacgugcgaagca

SEQ ID NO: 780941 - RNA, 19 nt, Homo sapiens
gaagaagaacaucguggaa

SEQ ID NO: 780942 - RNA, 19 nt, Homo sapiens
caacaugucccacaacaag

SEQ ID NO: 780943 - RNA, 19 nt, Homo sapiens
ccaccgcaguugcacuaua

SEQ ID NO: 780944 - RNA, 19 nt, Homo sapiens
acaaauagcacaagugauc

SEQ ID NO: 780945 - RNA, 19 nt, Homo sapiens
gacauuauacagaaccaua

SEQ ID NO: 780946 - RNA, 19 nt, Homo sapiens
acacagcaccaacuccuua

SEQ ID NO: 780947 - RNA, 19 nt, Homo sapiens
ggagaccauucaauuucaa

SEQ ID NO: 780948 - RNA, 19 nt, Homo sapiens
ggacuggcguggugauuuu

SEQ ID NO: 780949 - RNA, 19 nt, Homo sapiens
ggaagggagaagagcuuua

SEQ ID NO: 780950 - RNA, 19 nt, Homo sapiens
gaauaccugucaagauuuu

SEQ ID NO: 780951 - RNA, 19 nt, Homo sapiens
aaaguggccuuacuacauc

SEQ ID NO: 780952 - RNA, 19 nt, Homo sapiens
ggaacaacgauuagaacaa

SEQ ID NO: 780953 - RNA, 19 nt, Homo sapiens
ggagggacucucugaagaa

SEQ ID NO: 780954 - RNA, 19 nt, Homo sapiens
gcucacagcuccugaugcu

SEQ ID NO: 780955 - RNA, 19 nt, Homo sapiens
aaguauuccuuguaccuua

SEQ ID NO: 780956 - RNA, 19 nt, Homo sapiens
aguauuaucugcaacugaa

SEQ ID NO: 780957 - RNA, 19 nt, Homo sapiens
ugggaaaggugcucaagga

SEQ ID NO: 780958 - RNA, 19 nt, Homo sapiens
uugaagagauccagucugu

SEQ ID NO: 780959 - RNA, 19 nt, Homo sapiens
gcccggauccaacugcuua

SEQ ID NO: 780960 - RNA, 19 nt, Homo sapiens
uggaaggcauccuguggua

SEQ ID NO: 780961 - RNA, 19 nt, Homo sapiens
ccaaggaagugacauaucc

SEQ ID NO: 780962 - RNA, 19 nt, Homo sapiens
gaagaagcagcuggauaaa

SEQ ID NO: 780963 - RNA, 19 nt, Homo sapiens
gagugccucugccugauga

SEQ ID NO: 780964 - RNA, 19 nt, Homo sapiens
ggaaacagcaaaauacauu

SEQ ID NO: 780965 - RNA, 19 nt, Homo sapiens
ccauucaauuucaaacuga

SEQ ID NO: 780966 - RNA, 19 nt, Homo sapiens
gcauuagagcuggcaaaua

SEQ ID NO: 780967 - RNA, 19 nt, Homo sapiens
guaugaaucccaggacuuu

SEQ ID NO: 780968 - RNA, 19 nt, Homo sapiens
acaaugaggugcuggacau

SEQ ID NO: 780969 - RNA, 19 nt, Homo sapiens
gaagaugaagcaccuccuu

SEQ ID NO: 780970 - RNA, 19 nt, Homo sapiens
caacacugguuacaucaac

SEQ ID NO: 780971 - RNA, 19 nt, Homo sapiens
aaagaaaucgauuccaaga

SEQ ID NO: 780972 - RNA, 19 nt, Homo sapiens
ccagagcaacgaaugauga

SEQ ID NO: 780973 - RNA, 19 nt, Homo sapiens
agcaccaacuccuuaaaua

SEQ ID NO: 780974 - RNA, 19 nt, Homo sapiens
aagaggagaccauucaauu

SEQ ID NO: 780975 - RNA, 19 nt, Homo sapiens
gaagcuaugcugggcaauu

SEQ ID NO: 780976 - RNA, 19 nt, Homo sapiens
gaagggagaagagcuuuag

SEQ ID NO: 780977 - RNA, 19 nt, Homo sapiens
cggagggacucucugaaga

SEQ ID NO: 780978 - RNA, 19 nt, Homo sapiens
gcaguacuugcacacauuu

SEQ ID NO: 780979 - RNA, 19 nt, Homo sapiens
ccucuuugcuccuccauuc

SEQ ID NO: 780980 - RNA, 19 nt, Homo sapiens
gagcaacgaaugaugaaag

SEQ ID NO: 780981 - RNA, 19 nt, Homo sapiens
cuaaauggacucucccuau

SEQ ID NO: 780982 - RNA, 19 nt, Homo sapiens
gggcaauucuggcaaucau

SEQ ID NO: 780983 - RNA, 19 nt, Homo sapiens
acagaguccucauccaguu

SEQ ID NO: 780984 - RNA, 19 nt, Homo sapiens
caugaucgccugccuggaa

SEQ ID NO: 780985 - RNA, 19 nt, Homo sapiens
acacagggaccauuacaga

SEQ ID NO: 780986 - RNA, 19 nt, Homo sapiens
caacgcaucacauauuaag

SEQ ID NO: 780987 - RNA, 19 nt, Homo sapiens
cagacaagcuuggauagag

SEQ ID NO: 780988 - RNA, 19 nt, Homo sapiens
agaggagaccauucaauuu

SEQ ID NO: 780989 - RNA, 19 nt, Homo sapiens
gaaccuaccgucuauuuug

SEQ ID NO: 780990 - RNA, 19 nt, Homo sapiens
gcgcuugccuaacucauac

SEQ ID NO: 780991 - RNA, 19 nt, Homo sapiens
aucaacgcaucacauauua

SEQ ID NO: 780992 - RNA, 19 nt, Homo sapiens
gcaguugcacuauaaugga

SEQ ID NO: 780993 - RNA, 19 nt, Homo sapiens
gaagaugacuuugaugaua

SEQ ID NO: 780994 - RNA, 19 nt, Homo sapiens
gcgcaaagcuauuguaauu

SEQ ID NO: 780995 - RNA, 19 nt, Homo sapiens
gggaagaaguccaccaaua

SEQ ID NO: 780996 - RNA, 19 nt, Homo sapiens
gaaagaggccuuaugaaga

SEQ ID NO: 780997 - RNA, 19 nt, Homo sapiens
gcaagaaacgcaacuauau

SEQ ID NO: 780998 - RNA, 19 nt, Homo sapiens
ggaaggaugucccagauca

SEQ ID NO: 780999 - RNA, 19 nt, Homo sapiens
gcaacuauauccuagauca

SEQ ID NO: 781000 - RNA, 19 nt, Homo sapiens
aaagaggccuuaugaagaa

SEQ ID NO: 781001 - RNA, 19 nt, Homo sapiens
gagcagagcccuacuguuc

SEQ ID NO: 781002 - RNA, 19 nt, Homo sapiens
gcgaagagccuuucuccua

SEQ ID NO: 781003 - RNA, 19 nt, Homo sapiens
gaagaucaaugaggaaauc

SEQ ID NO: 781004 - RNA, 19 nt, Homo sapiens
gcuauccgcucacaauuga

SEQ ID NO: 781005 - RNA, 19 nt, Homo sapiens
gagagugacuauugaacuu

SEQ ID NO: 781006 - RNA, 19 nt, Homo sapiens
ggaugaagaugacuuugau

SEQ ID NO: 781007 - RNA, 19 nt, Homo sapiens
gaaggaagcaggguugaaa

SEQ ID NO: 781008 - RNA, 19 nt, Homo sapiens
gagacaaguuugcagagaa

SEQ ID NO: 781009 - RNA, 19 nt, Homo sapiens
ggaagaaguccaccaauag

SEQ ID NO: 781010 - RNA, 19 nt, Homo sapiens
ggaggaagcggacaagcua

SEQ ID NO: 781011 - RNA, 19 nt, Homo sapiens
cgaagagccuuucuccuau

SEQ ID NO: 781012 - RNA, 19 nt, Homo sapiens
gaaauguguuugcccuguu

SEQ ID NO: 781013 - RNA, 19 nt, Homo sapiens
gaagagccuuucuccuaug

SEQ ID NO: 781014 - RNA, 19 nt, Homo sapiens
ggagaccacuggaaaugga

SEQ ID NO: 781015 - RNA, 19 nt, Homo sapiens
gaaaugaagacagagauga

SEQ ID NO: 781016 - RNA, 19 nt, Homo sapiens
gaaacgcaacuauauccua

SEQ ID NO: 781017 - RNA, 19 nt, Homo sapiens
gggcauugcuuuccgaauc

SEQ ID NO: 781018 - RNA, 19 nt, Homo sapiens
gagaggagaccacuggaaa

SEQ ID NO: 781019 - RNA, 19 nt, Homo sapiens
caacaacuccaacaacaga

SEQ ID NO: 781020 - RNA, 19 nt, Homo sapiens
ggagacaaguuugcagaga

SEQ ID NO: 781021 - RNA, 19 nt, Homo sapiens
gcaguugguuguaaauucu

SEQ ID NO: 781022 - RNA, 19 nt, Homo sapiens
gaugauacccuuguugcua

SEQ ID NO: 781023 - RNA, 19 nt, Homo sapiens
acagugauacccuuuauuu

SEQ ID NO: 781024 - RNA, 19 nt, Homo sapiens
gaaaguggaugggcauugc

SEQ ID NO: 781025 - RNA, 19 nt, Homo sapiens
cgaaagaggccuuaugaag

SEQ ID NO: 781026 - RNA, 19 nt, Homo sapiens
guccagaaaugaagacaga

SEQ ID NO: 781027 - RNA, 19 nt, Homo sapiens
gguaguuucuggugggauu

SEQ ID NO: 781028 - RNA, 19 nt, Homo sapiens
gaucaugcggucuuagaaa

SEQ ID NO: 781029 - RNA, 19 nt, Homo sapiens
caauugagggcuuugcaua

SEQ ID NO: 781030 - RNA, 19 nt, Homo sapiens
gccagcaccuacaauaaga

SEQ ID NO: 781031 - RNA, 19 nt, Homo sapiens
cuauugaacuugaaaccuu

SEQ ID NO: 781032 - RNA, 19 nt, Homo sapiens
gagugacuauugaacuuga

SEQ ID NO: 781033 - RNA, 19 nt, Homo sapiens
gcacccagcuaggcgaaga

SEQ ID NO: 781034 - RNA, 19 nt, Homo sapiens
cuacagugauacccuuuau

SEQ ID NO: 781035 - RNA, 19 nt, Homo sapiens
ugggugggcuguugauauu

SEQ ID NO: 781036 - RNA, 19 nt, Homo sapiens
cuuccuaccuucuuccuuu

SEQ ID NO: 781037 - RNA, 19 nt, Homo sapiens
gcagagaacgaugugauug

SEQ ID NO: 781038 - RNA, 19 nt, Homo sapiens
gcaggccuaucguccagaa

SEQ ID NO: 781039 - RNA, 19 nt, Homo sapiens
ggagagagugacuauugaa

SEQ ID NO: 781040 - RNA, 19 nt, Homo sapiens
gcauuucuuuccugaguuc

SEQ ID NO: 781041 - RNA, 19 nt, Homo sapiens
caaggcagaaugugagauu

SEQ ID NO: 781042 - RNA, 19 nt, Homo sapiens
ggaaaugacguggaacugu

SEQ ID NO: 781043 - RNA, 19 nt, Homo sapiens
gguaacaacaaccgggaua

SEQ ID NO: 781044 - RNA, 19 nt, Homo sapiens
caagucaucaaacaagaaa

SEQ ID NO: 781045 - RNA, 19 nt, Homo sapiens
aaaccaaaccacagaauca

SEQ ID NO: 781046 - RNA, 19 nt, Homo sapiens
ggugggcuguugauauuuc

SEQ ID NO: 781047 - RNA, 19 nt, Homo sapiens
gggaggaagcagugacuuu

SEQ ID NO: 781048 - RNA, 19 nt, Homo sapiens
ccaccucccuugaucauac

SEQ ID NO: 781049 - RNA, 19 nt, Homo sapiens
gcccagcuauaaccaguau

SEQ ID NO: 781050 - RNA, 19 nt, Homo sapiens
cuaaaagaccgaacaauaa

SEQ ID NO: 781051 - RNA, 19 nt, Homo sapiens
accaauagccgguuugaaa

SEQ ID NO: 781052 - RNA, 19 nt, Homo sapiens
uaacugcgaccuccacuuc

SEQ ID NO: 781053 - RNA, 19 nt, Homo sapiens
aaauguguuugcccuguuu

SEQ ID NO: 781054 - RNA, 19 nt, Homo sapiens
aagcuucuguguucaguug

SEQ ID NO: 781055 - RNA, 19 nt, Homo sapiens
gaggagaccacuggaaaug

SEQ ID NO: 781056 - RNA, 19 nt, Homo sapiens
caagaaacgcaacuauauc

SEQ ID NO: 781057 - RNA, 19 nt, Homo sapiens
uaaccaguaucagcaguau

SEQ ID NO: 781058 - RNA, 19 nt, Homo sapiens
caacagaggcagcuacaac

SEQ ID NO: 781059 - RNA, 19 nt, Homo sapiens
caugcggucuuagaaauga

SEQ ID NO: 781060 - RNA, 19 nt, Homo sapiens
aaugugagauucugaugau

SEQ ID NO: 781061 - RNA, 19 nt, Homo sapiens
uggagagagugacuauuga

SEQ ID NO: 781062 - RNA, 19 nt, Homo sapiens
gggccagcaccuacaauaa

SEQ ID NO: 781063 - RNA, 19 nt, Homo sapiens
aacaacaacuccaacaaca

SEQ ID NO: 781064 - RNA, 19 nt, Homo sapiens
gauaacaacaacuccaaca

SEQ ID NO: 781065 - RNA, 19 nt, Homo sapiens
cgcaagaaacgcaacuaua

SEQ ID NO: 781066 - RNA, 19 nt, Homo sapiens
gaagcggacaagcuaguga

SEQ ID NO: 781067 - RNA, 19 nt, Homo sapiens
gacauuaugccauggacaa

SEQ ID NO: 781068 - RNA, 19 nt, Homo sapiens
ccuaaaagaccgaacaaua

SEQ ID NO: 781069 - RNA, 19 nt, Homo sapiens
cuagaucagacaaauguuu

SEQ ID NO: 781070 - RNA, 19 nt, Homo sapiens
uauccuagaucagacaaau

SEQ ID NO: 781071 - RNA, 19 nt, Homo sapiens
aaccacagaaucaucuuua

SEQ ID NO: 781072 - RNA, 19 nt, Homo sapiens
acacaggguggcacaagua

SEQ ID NO: 781073 - RNA, 19 nt, Homo sapiens
ccaaagagcaaggcagaau

SEQ ID NO: 781074 - RNA, 19 nt, Homo sapiens
ggaaaguggaugggcauug

SEQ ID NO: 781075 - RNA, 19 nt, Homo sapiens
gucgaaagaggccuuauga

SEQ ID NO: 781076 - RNA, 19 nt, Homo sapiens
gccugaagcuucucaacuc

SEQ ID NO: 781077 - RNA, 19 nt, Homo sapiens
ucaugcaguugguuguaaa

SEQ ID NO: 781078 - RNA, 19 nt, Homo sapiens
ggaaccaguacuaucagaa

SEQ ID NO: 781079 - RNA, 19 nt, Homo sapiens
ccaccugccuacaacuaug

SEQ ID NO: 781080 - RNA, 19 nt, Homo sapiens
gaagaaguccaccaauagc

SEQ ID NO: 781081 - RNA, 19 nt, Homo sapiens
ugaagaggaugaagaugac

SEQ ID NO: 781082 - RNA, 19 nt, Homo sapiens
cugaagaggaugaagauga

SEQ ID NO: 781083 - RNA, 19 nt, Homo sapiens
guugaauuguaacugcuuu

SEQ ID NO: 781084 - RNA, 19 nt, Homo sapiens
uaacuuugcacacaagcuu

SEQ ID NO: 781085 - RNA, 19 nt, Homo sapiens
aagcauuucuuuccugagu

SEQ ID NO: 781086 - RNA, 19 nt, Homo sapiens
gaaccaguacuaucagaac

SEQ ID NO: 781087 - RNA, 19 nt, Homo sapiens
caaccgggauaacaacaac

SEQ ID NO: 781088 - RNA, 19 nt, Homo sapiens
cagcgcaaagcuauuguaa

SEQ ID NO: 781089 - RNA, 19 nt, Homo sapiens
caaagagcaaggcagaaug

SEQ ID NO: 781090 - RNA, 19 nt, Homo sapiens
gaauugcgcaguggaguuc

SEQ ID NO: 781091 - RNA, 19 nt, Homo sapiens
cgaugugauuggcugcuuu

SEQ ID NO: 781092 - RNA, 19 nt, Homo sapiens
ggaaggaagcaggguugaa

SEQ ID NO: 781093 - RNA, 19 nt, Homo sapiens
gaagaugacuuugaugaua

SEQ ID NO: 781094 - RNA, 19 nt, Homo sapiens
gcgcaaagcuauuguaauu

SEQ ID NO: 781095 - RNA, 19 nt, Homo sapiens
gggaagaaguccaccaaua

SEQ ID NO: 781096 - RNA, 19 nt, Homo sapiens
gaaagaggccuuaugaaga

SEQ ID NO: 781097 - RNA, 19 nt, Homo sapiens
gcaagaaacgcaacuauau

SEQ ID NO: 781098 - RNA, 19 nt, Homo sapiens
ggaaggaugucccagauca

SEQ ID NO: 781099 - RNA, 19 nt, Homo sapiens
gcaacuauauccuagauca

SEQ ID NO: 781100 - RNA, 19 nt, Homo sapiens
aaagaggccuuaugaagaa

SEQ ID NO: 781101 - RNA, 19 nt, Homo sapiens
gagcagagcccuacuguuc

SEQ ID NO: 781102 - RNA, 19 nt, Homo sapiens
gcgaagagccuuucuccua

SEQ ID NO: 781103 - RNA, 19 nt, Homo sapiens
gaagaucaaugaggaaauc

SEQ ID NO: 781104 - RNA, 19 nt, Homo sapiens
gcuauccgcucacaauuga

SEQ ID NO: 781105 - RNA, 19 nt, Homo sapiens
gagagugacuauugaacuu

SEQ ID NO: 781106 - RNA, 19 nt, Homo sapiens
ggaugaagaugacuuugau

SEQ ID NO: 781107 - RNA, 19 nt, Homo sapiens
gaaggaagcaggguugaaa

SEQ ID NO: 781108 - RNA, 19 nt, Homo sapiens
gagacaaguuugcagagaa

SEQ ID NO: 781109 - RNA, 19 nt, Homo sapiens
ggaagaaguccaccaauag

SEQ ID NO: 781110 - RNA, 19 nt, Homo sapiens
ggaggaagcggacaagcua

SEQ ID NO: 781111 - RNA, 19 nt, Homo sapiens
cgaagagccuuucuccuau

SEQ ID NO: 781112 - RNA, 19 nt, Homo sapiens
gaaauguguuugcccuguu

SEQ ID NO: 781113 - RNA, 19 nt, Homo sapiens
gaagagccuuucuccuaug

SEQ ID NO: 781114 - RNA, 19 nt, Homo sapiens
ggagaccacuggaaaugga

SEQ ID NO: 781115 - RNA, 19 nt, Homo sapiens
gaaaugaagacagagauga

SEQ ID NO: 781116 - RNA, 19 nt, Homo sapiens
gaaacgcaacuauauccua

SEQ ID NO: 781117 - RNA, 19 nt, Homo sapiens
gggcauugcuuuccgaauc

SEQ ID NO: 781118 - RNA, 19 nt, Homo sapiens
gagaggagaccacuggaaa

SEQ ID NO: 781119 - RNA, 19 nt, Homo sapiens
caacaacuccaacaacaga

SEQ ID NO: 781120 - RNA, 19 nt, Homo sapiens
ggagacaaguuugcagaga

SEQ ID NO: 781121 - RNA, 19 nt, Homo sapiens
gcaguugguuguaaauucu

SEQ ID NO: 781122 - RNA, 19 nt, Homo sapiens
gaugauacccuuguugcua

SEQ ID NO: 781123 - RNA, 19 nt, Homo sapiens
acagugauacccuuuauuu

SEQ ID NO: 781124 - RNA, 19 nt, Homo sapiens
gaaaguggaugggcauugc

SEQ ID NO: 781125 - RNA, 19 nt, Homo sapiens
cgaaagaggccuuaugaag

SEQ ID NO: 781126 - RNA, 19 nt, Homo sapiens
guccagaaaugaagacaga

SEQ ID NO: 781127 - RNA, 19 nt, Homo sapiens
gguaguuucuggugggauu

SEQ ID NO: 781128 - RNA, 19 nt, Homo sapiens
gaucaugcggucuuagaaa

SEQ ID NO: 781129 - RNA, 19 nt, Homo sapiens
caauugagggcuuugcaua

SEQ ID NO: 781130 - RNA, 19 nt, Homo sapiens
gccagcaccuacaauaaga

SEQ ID NO: 781131 - RNA, 19 nt, Homo sapiens
cuauugaacuugaaaccuu

SEQ ID NO: 781132 - RNA, 19 nt, Homo sapiens
gagugacuauugaacuuga

SEQ ID NO: 781133 - RNA, 19 nt, Homo sapiens
gcacccagcuaggcgaaga

SEQ ID NO: 781134 - RNA, 19 nt, Homo sapiens
cuacagugauacccuuuau

SEQ ID NO: 781135 - RNA, 19 nt, Homo sapiens
ugggugggcuguugauauu

SEQ ID NO: 781136 - RNA, 19 nt, Homo sapiens
cuuccuaccuucuuccuuu

SEQ ID NO: 781137 - RNA, 19 nt, Homo sapiens
gcagagaacgaugugauug

SEQ ID NO: 781138 - RNA, 19 nt, Homo sapiens
gcaggccuaucguccagaa

SEQ ID NO: 781139 - RNA, 19 nt, Homo sapiens
ggagagagugacuauugaa

SEQ ID NO: 781140 - RNA, 19 nt, Homo sapiens
gcauuucuuuccugaguuc

SEQ ID NO: 781141 - RNA, 19 nt, Homo sapiens
caaggcagaaugugagauu

SEQ ID NO: 781142 - RNA, 19 nt, Homo sapiens
ggaaaugacguggaacugu

SEQ ID NO: 781143 - RNA, 19 nt, Homo sapiens
gguaacaacaaccgggaua

SEQ ID NO: 781144 - RNA, 19 nt, Homo sapiens
caagucaucaaacaagaaa

SEQ ID NO: 781145 - RNA, 19 nt, Homo sapiens
aaaccaaaccacagaauca

SEQ ID NO: 781146 - RNA, 19 nt, Homo sapiens
ggugggcuguugauauuuc

SEQ ID NO: 781147 - RNA, 19 nt, Homo sapiens
gggaggaagcagugacuuu

SEQ ID NO: 781148 - RNA, 19 nt, Homo sapiens
ccaccucccuugaucauac

SEQ ID NO: 781149 - RNA, 19 nt, Homo sapiens
gcccagcuauaaccaguau

SEQ ID NO: 781150 - RNA, 19 nt, Homo sapiens
cuaaaagaccgaacaauaa

SEQ ID NO: 781151 - RNA, 19 nt, Homo sapiens
accaauagccgguuugaaa

SEQ ID NO: 781152 - RNA, 19 nt, Homo sapiens
uaacugcgaccuccacuuc

SEQ ID NO: 781153 - RNA, 19 nt, Homo sapiens
aaauguguuugcccuguuu

SEQ ID NO: 781154 - RNA, 19 nt, Homo sapiens
gaggagaccacuggaaaug

SEQ ID NO: 781155 - RNA, 19 nt, Homo sapiens
aagcuucuguguucaguug

SEQ ID NO: 781156 - RNA, 19 nt, Homo sapiens
caagaaacgcaacuauauc

SEQ ID NO: 781157 - RNA, 19 nt, Homo sapiens
uaaccaguaucagcaguau

SEQ ID NO: 781158 - RNA, 19 nt, Homo sapiens
caacagaggcagcuacaac

SEQ ID NO: 781159 - RNA, 19 nt, Homo sapiens
caugcggucuuagaaauga

SEQ ID NO: 781160 - RNA, 19 nt, Homo sapiens
aaugugagauucugaugau

SEQ ID NO: 781161 - RNA, 19 nt, Homo sapiens
uggagagagugacuauuga

SEQ ID NO: 781162 - RNA, 19 nt, Homo sapiens
gggccagcaccuacaauaa

SEQ ID NO: 781163 - RNA, 19 nt, Homo sapiens
aacaacaacuccaacaaca

SEQ ID NO: 781164 - RNA, 19 nt, Homo sapiens
gauaacaacaacuccaaca

SEQ ID NO: 781165 - RNA, 19 nt, Homo sapiens
cgcaagaaacgcaacuaua

SEQ ID NO: 781166 - RNA, 19 nt, Homo sapiens
gaagcggacaagcuaguga

SEQ ID NO: 781167 - RNA, 19 nt, Homo sapiens
ccuaaaagaccgaacaaua

SEQ ID NO: 781168 - RNA, 19 nt, Homo sapiens
cuagaucagacaaauguuu

SEQ ID NO: 781169 - RNA, 19 nt, Homo sapiens
uauccuagaucagacaaau

SEQ ID NO: 781170 - RNA, 19 nt, Homo sapiens
aaccacagaaucaucuuua

SEQ ID NO: 781171 - RNA, 19 nt, Homo sapiens
acacaggguggcacaagua

SEQ ID NO: 781172 - RNA, 19 nt, Homo sapiens
gccugaagcuucucaacuc

SEQ ID NO: 781173 - RNA, 19 nt, Homo sapiens
ccaaagagcaaggcagaau

SEQ ID NO: 781174 - RNA, 19 nt, Homo sapiens
ggaaaguggaugggcauug

SEQ ID NO: 781175 - RNA, 19 nt, Homo sapiens
gucgaaagaggccuuauga

SEQ ID NO: 781176 - RNA, 19 nt, Homo sapiens
ucaugcaguugguuguaaa

SEQ ID NO: 781177 - RNA, 19 nt, Homo sapiens
ggaaccaguacuaucagaa

SEQ ID NO: 781178 - RNA, 19 nt, Homo sapiens
ccaccugccuacaacuaug

SEQ ID NO: 781179 - RNA, 19 nt, Homo sapiens
gaagaaguccaccaauagc

SEQ ID NO: 781180 - RNA, 19 nt, Homo sapiens
ugaagaggaugaagaugac

SEQ ID NO: 781181 - RNA, 19 nt, Homo sapiens
cugaagaggaugaagauga

SEQ ID NO: 781182 - RNA, 19 nt, Homo sapiens
guugaauuguaacugcuuu

SEQ ID NO: 781183 - RNA, 19 nt, Homo sapiens
uaacuuugcacacaagcuu

SEQ ID NO: 781184 - RNA, 19 nt, Homo sapiens
aagcauuucuuuccugagu

SEQ ID NO: 781185 - RNA, 19 nt, Homo sapiens
gaaccaguacuaucagaac

SEQ ID NO: 781186 - RNA, 19 nt, Homo sapiens
caaccgggauaacaacaac

SEQ ID NO: 781187 - RNA, 19 nt, Homo sapiens
cagcgcaaagcuauuguaa

SEQ ID NO: 781188 - RNA, 19 nt, Homo sapiens
caaagagcaaggcagaaug

SEQ ID NO: 781189 - RNA, 19 nt, Homo sapiens
gaauugcgcaguggaguuc

SEQ ID NO: 781190 - RNA, 19 nt, Homo sapiens
cgaugugauuggcugcuuu

SEQ ID NO: 781191 - RNA, 19 nt, Homo sapiens
ggaaggaagcaggguugaa

SEQ ID NO: 781192 - RNA, 19 nt, Homo sapiens
uaacaacaacuccaacaac

SEQ ID NO: 781193 - RNA, 19 nt, Homo sapiens
gaagaugacuuugaugaua

SEQ ID NO: 781194 - RNA, 19 nt, Homo sapiens
gcgcaaagcuauuguaauu

SEQ ID NO: 781195 - RNA, 19 nt, Homo sapiens
gggaagaaguccaccaaua

SEQ ID NO: 781196 - RNA, 19 nt, Homo sapiens
gaaagaggccuuaugaaga

SEQ ID NO: 781197 - RNA, 19 nt, Homo sapiens
gcaagaaacgcaacuauau

SEQ ID NO: 781198 - RNA, 19 nt, Homo sapiens
ggaaggaugucccagauca

SEQ ID NO: 781199 - RNA, 19 nt, Homo sapiens
gcaacuauauccuagauca

SEQ ID NO: 781200 - RNA, 19 nt, Homo sapiens
aaagaggccuuaugaagaa

SEQ ID NO: 781201 - RNA, 19 nt, Homo sapiens
gagcagagcccuacuguuc

SEQ ID NO: 781202 - RNA, 19 nt, Homo sapiens
gcgaagagccuuucuccua

SEQ ID NO: 781203 - RNA, 19 nt, Homo sapiens
gaagaucaaugaggaaauc

SEQ ID NO: 781204 - RNA, 19 nt, Homo sapiens
gcuauccgcucacaauuga

SEQ ID NO: 781205 - RNA, 19 nt, Homo sapiens
gagagugacuauugaacuu

SEQ ID NO: 781206 - RNA, 19 nt, Homo sapiens
ggaugaagaugacuuugau

SEQ ID NO: 781207 - RNA, 19 nt, Homo sapiens
gaaggaagcaggguugaaa

SEQ ID NO: 781208 - RNA, 19 nt, Homo sapiens
gagacaaguuugcagagaa

SEQ ID NO: 781209 - RNA, 19 nt, Homo sapiens
ggaagaaguccaccaauag

SEQ ID NO: 781210 - RNA, 19 nt, Homo sapiens
ggaggaagcggacaagcua

SEQ ID NO: 781211 - RNA, 19 nt, Homo sapiens
cgaagagccuuucuccuau

SEQ ID NO: 781212 - RNA, 19 nt, Homo sapiens
gaaauguguuugcccuguu

SEQ ID NO: 781213 - RNA, 19 nt, Homo sapiens
gaagagccuuucuccuaug

SEQ ID NO: 781214 - RNA, 19 nt, Homo sapiens
ggagaccacuggaaaugga

SEQ ID NO: 781215 - RNA, 19 nt, Homo sapiens
gaaaugaagacagagauga

SEQ ID NO: 781216 - RNA, 19 nt, Homo sapiens
gaaacgcaacuauauccua

SEQ ID NO: 781217 - RNA, 19 nt, Homo sapiens
gggcauugcuuuccgaauc

SEQ ID NO: 781218 - RNA, 19 nt, Homo sapiens
gagaggagaccacuggaaa

SEQ ID NO: 781219 - RNA, 19 nt, Homo sapiens
caacaacuccaacaacaga

SEQ ID NO: 781220 - RNA, 19 nt, Homo sapiens
ggagacaaguuugcagaga

SEQ ID NO: 781221 - RNA, 19 nt, Homo sapiens
gcaguugguuguaaauucu

SEQ ID NO: 781222 - RNA, 19 nt, Homo sapiens
gaugauacccuuguugcua

SEQ ID NO: 781223 - RNA, 19 nt, Homo sapiens
acagugauacccuuuauuu

SEQ ID NO: 781224 - RNA, 19 nt, Homo sapiens
gaaaguggaugggcauugc

SEQ ID NO: 781225 - RNA, 19 nt, Homo sapiens
cgaaagaggccuuaugaag

SEQ ID NO: 781226 - RNA, 19 nt, Homo sapiens
guccagaaaugaagacaga

SEQ ID NO: 781227 - RNA, 19 nt, Homo sapiens
gguaguuucuggugggauu

SEQ ID NO: 781228 - RNA, 19 nt, Homo sapiens
gaucaugcggucuuagaaa

SEQ ID NO: 781229 - RNA, 19 nt, Homo sapiens
caauugagggcuuugcaua

SEQ ID NO: 781230 - RNA, 19 nt, Homo sapiens
gccagcaccuacaauaaga

SEQ ID NO: 781231 - RNA, 19 nt, Homo sapiens
cuauugaacuugaaaccuu

SEQ ID NO: 781232 - RNA, 19 nt, Homo sapiens
gagugacuauugaacuuga

SEQ ID NO: 781233 - RNA, 19 nt, Homo sapiens
gcacccagcuaggcgaaga

SEQ ID NO: 781234 - RNA, 19 nt, Homo sapiens
cuacagugauacccuuuau

SEQ ID NO: 781235 - RNA, 19 nt, Homo sapiens
ugggugggcuguugauauu

SEQ ID NO: 781236 - RNA, 19 nt, Homo sapiens
cuuccuaccuucuuccuuu

SEQ ID NO: 781237 - RNA, 19 nt, Homo sapiens
gcagagaacgaugugauug

SEQ ID NO: 781238 - RNA, 19 nt, Homo sapiens
gcaggccuaucguccagaa

SEQ ID NO: 781239 - RNA, 19 nt, Homo sapiens
ggagagagugacuauugaa

SEQ ID NO: 781240 - RNA, 19 nt, Homo sapiens
gcauuucuuuccugaguuc

SEQ ID NO: 781241 - RNA, 19 nt, Homo sapiens
caaggcagaaugugagauu

SEQ ID NO: 781242 - RNA, 19 nt, Homo sapiens
ggaaaugacguggaacugu

SEQ ID NO: 781243 - RNA, 19 nt, Homo sapiens
gguaacaacaaccgggaua

SEQ ID NO: 781244 - RNA, 19 nt, Homo sapiens
caagucaucaaacaagaaa

SEQ ID NO: 781245 - RNA, 19 nt, Homo sapiens
aaaccaaaccacagaauca

SEQ ID NO: 781246 - RNA, 19 nt, Homo sapiens
ggugggcuguugauauuuc

SEQ ID NO: 781247 - RNA, 19 nt, Homo sapiens
gggaggaagcagugacuuu

SEQ ID NO: 781248 - RNA, 19 nt, Homo sapiens
ccaccucccuugaucauac

SEQ ID NO: 781249 - RNA, 19 nt, Homo sapiens
gcccagcuauaaccaguau

SEQ ID NO: 781250 - RNA, 19 nt, Homo sapiens
cuaaaagaccgaacaauaa

SEQ ID NO: 781251 - RNA, 19 nt, Homo sapiens
accaauagccgguuugaaa

SEQ ID NO: 781252 - RNA, 19 nt, Homo sapiens
uaacugcgaccuccacuuc

SEQ ID NO: 781253 - RNA, 19 nt, Homo sapiens
aaauguguuugcccuguuu

SEQ ID NO: 781254 - RNA, 19 nt, Homo sapiens
aagcuucuguguucaguug

SEQ ID NO: 781255 - RNA, 19 nt, Homo sapiens
gaggagaccacuggaaaug

SEQ ID NO: 781256 - RNA, 19 nt, Homo sapiens
caagaaacgcaacuauauc

SEQ ID NO: 781257 - RNA, 19 nt, Homo sapiens
uaaccaguaucagcaguau

SEQ ID NO: 781258 - RNA, 19 nt, Homo sapiens
caacagaggcagcuacaac

SEQ ID NO: 781259 - RNA, 19 nt, Homo sapiens
caugcggucuuagaaauga

SEQ ID NO: 781260 - RNA, 19 nt, Homo sapiens
aaugugagauucugaugau

SEQ ID NO: 781261 - RNA, 19 nt, Homo sapiens
uggagagagugacuauuga

SEQ ID NO: 781262 - RNA, 19 nt, Homo sapiens
gggccagcaccuacaauaa

SEQ ID NO: 781263 - RNA, 19 nt, Homo sapiens
aacaacaacuccaacaaca

SEQ ID NO: 781264 - RNA, 19 nt, Homo sapiens
gauaacaacaacuccaaca

SEQ ID NO: 781265 - RNA, 19 nt, Homo sapiens
cgcaagaaacgcaacuaua

SEQ ID NO: 781266 - RNA, 19 nt, Homo sapiens
gaagcggacaagcuaguga

SEQ ID NO: 781267 - RNA, 19 nt, Homo sapiens
gacauuaugccauggacaa

SEQ ID NO: 781268 - RNA, 19 nt, Homo sapiens
ccuaaaagaccgaacaaua

SEQ ID NO: 781269 - RNA, 19 nt, Homo sapiens
cuagaucagacaaauguuu

SEQ ID NO: 781270 - RNA, 19 nt, Homo sapiens
uauccuagaucagacaaau

SEQ ID NO: 781271 - RNA, 19 nt, Homo sapiens
aaccacagaaucaucuuua

SEQ ID NO: 781272 - RNA, 19 nt, Homo sapiens
acacaggguggcacaagua

SEQ ID NO: 781273 - RNA, 19 nt, Homo sapiens
ccaaagagcaaggcagaau

SEQ ID NO: 781274 - RNA, 19 nt, Homo sapiens
ggaaaguggaugggcauug

SEQ ID NO: 781275 - RNA, 19 nt, Homo sapiens
gucgaaagaggccuuauga

SEQ ID NO: 781276 - RNA, 19 nt, Homo sapiens
gccugaagcuucucaacuc

SEQ ID NO: 781277 - RNA, 19 nt, Homo sapiens
ucaugcaguugguuguaaa

SEQ ID NO: 781278 - RNA, 19 nt, Homo sapiens
ggaaccaguacuaucagaa

SEQ ID NO: 781279 - RNA, 19 nt, Homo sapiens
gaagaaguccaccaauagc

SEQ ID NO: 781280 - RNA, 19 nt, Homo sapiens
ugaagaggaugaagaugac

SEQ ID NO: 781281 - RNA, 19 nt, Homo sapiens
cugaagaggaugaagauga

SEQ ID NO: 781282 - RNA, 19 nt, Homo sapiens
guugaauuguaacugcuuu

SEQ ID NO: 781283 - RNA, 19 nt, Homo sapiens
uaacuuugcacacaagcuu

SEQ ID NO: 781284 - RNA, 19 nt, Homo sapiens
aagcauuucuuuccugagu

SEQ ID NO: 781285 - RNA, 19 nt, Homo sapiens
gaaccaguacuaucagaac

SEQ ID NO: 781286 - RNA, 19 nt, Homo sapiens
caaccgggauaacaacaac

SEQ ID NO: 781287 - RNA, 19 nt, Homo sapiens
cagcgcaaagcuauuguaa

SEQ ID NO: 781288 - RNA, 19 nt, Homo sapiens
caaagagcaaggcagaaug

SEQ ID NO: 781289 - RNA, 19 nt, Homo sapiens
gaauugcgcaguggaguuc

SEQ ID NO: 781290 - RNA, 19 nt, Homo sapiens
cgaugugauuggcugcuuu

SEQ ID NO: 781291 - RNA, 19 nt, Homo sapiens
ggaaggaagcaggguugaa

SEQ ID NO: 781292 - RNA, 19 nt, Homo sapiens
uaacaacaacuccaacaac

SEQ ID NO: 781293 - RNA, 19 nt, Homo sapiens
gagagugacuauugaacuu

SEQ ID NO: 781294 - RNA, 19 nt, Homo sapiens
gaaggaagcaggguugaaa

SEQ ID NO: 781295 - RNA, 19 nt, Homo sapiens
caacgaggaggccgaguua

SEQ ID NO: 781296 - RNA, 19 nt, Homo sapiens
gaaauguguuugcccuguu

SEQ ID NO: 781297 - RNA, 19 nt, Homo sapiens
gcaguugguuguaaauucu

SEQ ID NO: 781298 - RNA, 19 nt, Homo sapiens
acagugauacccuuuauuu

SEQ ID NO: 781299 - RNA, 19 nt, Homo sapiens
gguaguuucuggugggauu

SEQ ID NO: 781300 - RNA, 19 nt, Homo sapiens
cuauugaacuugaaaccuu

SEQ ID NO: 781301 - RNA, 19 nt, Homo sapiens
gagugacuauugaacuuga

SEQ ID NO: 781302 - RNA, 19 nt, Homo sapiens
cuacagugauacccuuuau

SEQ ID NO: 781303 - RNA, 19 nt, Homo sapiens
ugggugggcuguugauauu

SEQ ID NO: 781304 - RNA, 19 nt, Homo sapiens
cuuccuaccuucuuccuuu

SEQ ID NO: 781305 - RNA, 19 nt, Homo sapiens
ggagagagugacuauugaa

SEQ ID NO: 781306 - RNA, 19 nt, Homo sapiens
gcauuucuuuccugaguuc

SEQ ID NO: 781307 - RNA, 19 nt, Homo sapiens
aaaccaaaccacagaauca

SEQ ID NO: 781308 - RNA, 19 nt, Homo sapiens
ggugggcuguugauauuuc

SEQ ID NO: 781309 - RNA, 19 nt, Homo sapiens
gggaggaagcagugacuuu

SEQ ID NO: 781310 - RNA, 19 nt, Homo sapiens
ccaccucccuugaucauac

SEQ ID NO: 781311 - RNA, 19 nt, Homo sapiens
gcccagcuauaaccaguau

SEQ ID NO: 781312 - RNA, 19 nt, Homo sapiens
aaauguguuugcccuguuu

SEQ ID NO: 781313 - RNA, 19 nt, Homo sapiens
aagcuucuguguucaguug

SEQ ID NO: 781314 - RNA, 19 nt, Homo sapiens
uaaccaguaucagcaguau

SEQ ID NO: 781315 - RNA, 19 nt, Homo sapiens
uggagagagugacuauuga

SEQ ID NO: 781316 - RNA, 19 nt, Homo sapiens
aaccacagaaucaucuuua

SEQ ID NO: 781317 - RNA, 19 nt, Homo sapiens
acacaggguggcacaagua

SEQ ID NO: 781318 - RNA, 19 nt, Homo sapiens
ucaugcaguugguuguaaa

SEQ ID NO: 781319 - RNA, 19 nt, Homo sapiens
ggaaccaguacuaucagaa

SEQ ID NO: 781320 - RNA, 19 nt, Homo sapiens
ccaccugccuacaacuaug

SEQ ID NO: 781321 - RNA, 19 nt, Homo sapiens
guugaauuguaacugcuuu

SEQ ID NO: 781322 - RNA, 19 nt, Homo sapiens
uaacuuugcacacaagcuu

SEQ ID NO: 781323 - RNA, 19 nt, Homo sapiens
aagcauuucuuuccugagu

SEQ ID NO: 781324 - RNA, 19 nt, Homo sapiens
gaaccaguacuaucagaac

SEQ ID NO: 781325 - RNA, 19 nt, Homo sapiens
ggaaggaagcaggguugaa

SEQ ID NO: 781326 - RNA, 19 nt, Homo sapiens
ggaagagccacaaaacaaa

SEQ ID NO: 781327 - RNA, 19 nt, Homo sapiens
gaagagccacaaaacaaaa

SEQ ID NO: 781328 - RNA, 19 nt, Homo sapiens
cccagacccucaugcaguu

SEQ ID NO: 781329 - RNA, 19 nt, Homo sapiens
gcaguggaaccaguacuau

SEQ ID NO: 781330 - RNA, 19 nt, Homo sapiens
aggcaacaaugaccuuuua

SEQ ID NO: 781331 - RNA, 19 nt, Homo sapiens
ccauaacuuugcacacaag

SEQ ID NO: 781332 - RNA, 19 nt, Homo sapiens
ugcaguugguuguaaauuc

SEQ ID NO: 781333 - RNA, 19 nt, Homo sapiens
uuggagagagugacuauug

SEQ ID NO: 781334 - RNA, 19 nt, Homo sapiens
ccaaaccacagaaucaucu

SEQ ID NO: 781335 - RNA, 19 nt, Homo sapiens
gagcuacggcgguuacaac

SEQ ID NO: 781336 - RNA, 19 nt, Homo sapiens
gauucaaacaggcaacaau

SEQ ID NO: 781337 - RNA, 19 nt, Homo sapiens
ccagcuauaaccaguauca

SEQ ID NO: 781338 - RNA, 19 nt, Homo sapiens
cuccuucccuucagaacuu

SEQ ID NO: 781339 - RNA, 19 nt, Homo sapiens
accacagaaucaucuuuaa

SEQ ID NO: 781340 - RNA, 19 nt, Homo sapiens
ggaggaagcagugacuuuu

SEQ ID NO: 781341 - RNA, 19 nt, Homo sapiens
gcaacaaugaccuuuuauu

SEQ ID NO: 781342 - RNA, 19 nt, Homo sapiens
cccauaacuuugcacacaa

SEQ ID NO: 781343 - RNA, 19 nt, Homo sapiens
uggcacaaguacacaguag

SEQ ID NO: 781344 - RNA, 19 nt, Homo sapiens
ccccuugacucauauguuu

SEQ ID NO: 781345 - RNA, 19 nt, Homo sapiens
aaaccacagaaucaucuuu

SEQ ID NO: 781346 - RNA, 19 nt, Homo sapiens
ugucuacuuuucaggauua

SEQ ID NO: 781347 - RNA, 19 nt, Homo sapiens
gagcuacuccgggaacaca

SEQ ID NO: 781348 - RNA, 19 nt, Homo sapiens
ccacagaaucaucuuuaac

SEQ ID NO: 781349 - RNA, 19 nt, Homo sapiens
ucaucaagauaagcauuuc

SEQ ID NO: 781350 - RNA, 19 nt, Homo sapiens
ucaacgaggaggccgaguu

SEQ ID NO: 781351 - RNA, 19 nt, Homo sapiens
gugggugggcuguugauau

SEQ ID NO: 781352 - RNA, 19 nt, Homo sapiens
uggaaccaguacuaucaga

SEQ ID NO: 781353 - RNA, 19 nt, Homo sapiens
caccaccugccuacaacua

SEQ ID NO: 781354 - RNA, 19 nt, Homo sapiens
ugacaggaaagguuuaagg

SEQ ID NO: 781355 - RNA, 19 nt, Homo sapiens
uugagccgcugccgccauu

SEQ ID NO: 781356 - RNA, 19 nt, Homo sapiens
ccuacagugauacccuuua

SEQ ID NO: 781357 - RNA, 19 nt, Homo sapiens
caccaccaccugccuacaa

SEQ ID NO: 781358 - RNA, 19 nt, Homo sapiens
cucaugcaguugguuguaa

SEQ ID NO: 781359 - RNA, 19 nt, Homo sapiens
gagaauccccuccuguuca

SEQ ID NO: 781360 - RNA, 19 nt, Homo sapiens
guacaaaccugucaugaau

SEQ ID NO: 781361 - RNA, 19 nt, Homo sapiens
agaagaaccucaggaauua

SEQ ID NO: 781362 - RNA, 19 nt, Homo sapiens
gaacccagcuggagaacuu

SEQ ID NO: 781363 - RNA, 19 nt, Homo sapiens
guauagaccuucugauuug

SEQ ID NO: 781364 - RNA, 19 nt, Homo sapiens
gauauacagugugaucuua

SEQ ID NO: 781365 - RNA, 19 nt, Homo sapiens
guacuacgauccugauuau

SEQ ID NO: 781366 - RNA, 19 nt, Homo sapiens
gugccgaccuuuacaauuu

SEQ ID NO: 781367 - RNA, 19 nt, Homo sapiens
ugaaauugcugccaaaugu

SEQ ID NO: 781368 - RNA, 19 nt, Homo sapiens
gaagguagaaaguucauuu

SEQ ID NO: 781369 - RNA, 19 nt, Homo sapiens
gaaugcaucacacaaguua

SEQ ID NO: 781370 - RNA, 19 nt, Homo sapiens
gaaagaagaaccucaggaa

SEQ ID NO: 781371 - RNA, 19 nt, Homo sapiens
guuaguaccugucuccuuu

SEQ ID NO: 781372 - RNA, 19 nt, Homo sapiens
gucccaagaugaaauauaa

SEQ ID NO: 781373 - RNA, 19 nt, Homo sapiens
caaaggaaauccggaaaga

SEQ ID NO: 781374 - RNA, 19 nt, Homo sapiens
gaagaagugaaucuaagua

SEQ ID NO: 781375 - RNA, 19 nt, Homo sapiens
caaaggaaguugugaggau

SEQ ID NO: 781376 - RNA, 19 nt, Homo sapiens
gaaaauaugucuucucaag

SEQ ID NO: 781377 - RNA, 19 nt, Homo sapiens
agacugaguucacaagauu

SEQ ID NO: 781378 - RNA, 19 nt, Homo sapiens
uaggaaaccuuaaguaugg

SEQ ID NO: 781379 - RNA, 19 nt, Homo sapiens
gaugauuugugccaggaua

SEQ ID NO: 781380 - RNA, 19 nt, Homo sapiens
gagaaugcaucacacaagu

SEQ ID NO: 781381 - RNA, 19 nt, Homo sapiens
agagagccaucaugccuua

SEQ ID NO: 781382 - RNA, 19 nt, Homo sapiens
gaccgaggauggcgaagaa

SEQ ID NO: 781383 - RNA, 19 nt, Homo sapiens
cuucucaacucagcuauua

SEQ ID NO: 781384 - RNA, 19 nt, Homo sapiens
caaagagaguuuagagagu

SEQ ID NO: 781385 - RNA, 19 nt, Homo sapiens
guacggaaccugaccgauu

SEQ ID NO: 781386 - RNA, 19 nt, Homo sapiens
ggaugcugcuguucagaaa

SEQ ID NO: 781387 - RNA, 19 nt, Homo sapiens
caucaugccuuacgguguu

SEQ ID NO: 781388 - RNA, 19 nt, Homo sapiens
cuaggcagcuucaugagaa

SEQ ID NO: 781389 - RNA, 19 nt, Homo sapiens
ggaauuacuucagucacaa

SEQ ID NO: 781390 - RNA, 19 nt, Homo sapiens
gcgaagaaguggaaaauau

SEQ ID NO: 781391 - RNA, 19 nt, Homo sapiens
ccaugacaguacaggauua

SEQ ID NO: 781392 - RNA, 19 nt, Homo sapiens
gcagguguuucacaagaga

SEQ ID NO: 781393 - RNA, 19 nt, Homo sapiens
caaguuagaggugagguua

SEQ ID NO: 781394 - RNA, 19 nt, Homo sapiens
cuggagaacuugaggguuu

SEQ ID NO: 781395 - RNA, 19 nt, Homo sapiens
gaaccgucacauucaguua

SEQ ID NO: 781396 - RNA, 19 nt, Homo sapiens
aagaagaaccucaggaauu

SEQ ID NO: 781397 - RNA, 19 nt, Homo sapiens
ugccaaauguuauguaguu

SEQ ID NO: 781398 - RNA, 19 nt, Homo sapiens
ugucaccacccacaaauua

SEQ ID NO: 781399 - RNA, 19 nt, Homo sapiens
gcuaggaaaccuuaaguau

SEQ ID NO: 781400 - RNA, 19 nt, Homo sapiens
uuacuucagucacaagauu

SEQ ID NO: 781401 - RNA, 19 nt, Homo sapiens
caauguaucugugagaauc

SEQ ID NO: 781402 - RNA, 19 nt, Homo sapiens
gaaauauaagggucaguau

SEQ ID NO: 781403 - RNA, 19 nt, Homo sapiens
caagauuccuuugcaguuc

SEQ ID NO: 781404 - RNA, 19 nt, Homo sapiens
gaaguugggcucuggugaa

SEQ ID NO: 781405 - RNA, 19 nt, Homo sapiens
ugaaauuucuggcuaaagg

SEQ ID NO: 781406 - RNA, 19 nt, Homo sapiens
acaaaccugucaugaauca

SEQ ID NO: 781407 - RNA, 19 nt, Homo sapiens
caagauaugcucaaauucu

SEQ ID NO: 781408 - RNA, 19 nt, Homo sapiens
gaaaauauguguacaaacc

SEQ ID NO: 781409 - RNA, 19 nt, Homo sapiens
gaagugaaucuaaguaacu

SEQ ID NO: 781410 - RNA, 19 nt, Homo sapiens
gauugcagguguuucacaa

SEQ ID NO: 781411 - RNA, 19 nt, Homo sapiens
gcagaacccagcuggagaa

SEQ ID NO: 781412 - RNA, 19 nt, Homo sapiens
gaaagaaaggaaaagguua

SEQ ID NO: 781413 - RNA, 19 nt, Homo sapiens
cacaauggaugaugcuguu

SEQ ID NO: 781414 - RNA, 19 nt, Homo sapiens
gaaauugcugccaaauguu

SEQ ID NO: 781415 - RNA, 19 nt, Homo sapiens
caguauagaccuucugauu

SEQ ID NO: 781416 - RNA, 19 nt, Homo sapiens
uauauggguuucuacauuc

SEQ ID NO: 781417 - RNA, 19 nt, Homo sapiens
aaggaaauccggaaagaaa

SEQ ID NO: 781418 - RNA, 19 nt, Homo sapiens
aaauugcugccaaauguua

SEQ ID NO: 781419 - RNA, 19 nt, Homo sapiens
caaacuguguaucaucugu

SEQ ID NO: 781420 - RNA, 19 nt, Homo sapiens
aaacugugcuguuacaacu

SEQ ID NO: 781421 - RNA, 19 nt, Homo sapiens
uacggaaccugaccgauug

SEQ ID NO: 781422 - RNA, 19 nt, Homo sapiens
gggugacuuugcauugaua

SEQ ID NO: 781423 - RNA, 19 nt, Homo sapiens
gcgggugacuuugcauuga

SEQ ID NO: 781424 - RNA, 19 nt, Homo sapiens
ugaaauauaagggucagua

SEQ ID NO: 781425 - RNA, 19 nt, Homo sapiens
ugauugacauccucccaaa

SEQ ID NO: 781426 - RNA, 19 nt, Homo sapiens
gucacaagauuucguagga

SEQ ID NO: 781427 - RNA, 19 nt, Homo sapiens
gaguucaagucgucuuuca

SEQ ID NO: 781428 - RNA, 19 nt, Homo sapiens
uguaucaucuguguauuug

SEQ ID NO: 781429 - RNA, 19 nt, Homo sapiens
gaagacugaguucacaaga

SEQ ID NO: 781430 - RNA, 19 nt, Homo sapiens
acaacucaguguucaaugu

SEQ ID NO: 781431 - RNA, 19 nt, Homo sapiens
caggauacauauucaguac

SEQ ID NO: 781432 - RNA, 19 nt, Homo sapiens
gcugugcccugagacauau

SEQ ID NO: 781433 - RNA, 19 nt, Homo sapiens
ccagcgucguggacuauuu

SEQ ID NO: 781434 - RNA, 19 nt, Homo sapiens
ggauauacagugugaucuu

SEQ ID NO: 781435 - RNA, 19 nt, Homo sapiens
ggcaauguaucugugagaa

SEQ ID NO: 781436 - RNA, 19 nt, Homo sapiens
ggauacauauucaguaccu

SEQ ID NO: 781437 - RNA, 19 nt, Homo sapiens
guguugugcugaugauuug

SEQ ID NO: 781438 - RNA, 19 nt, Homo sapiens
ugaggaggcugcuguucug

SEQ ID NO: 781439 - RNA, 19 nt, Homo sapiens
auaagaaacagcagaaaga

SEQ ID NO: 781440 - RNA, 19 nt, Homo sapiens
gauuugcugugcccugaga

SEQ ID NO: 781441 - RNA, 19 nt, Homo sapiens
uuacuaggcagcuucauga

SEQ ID NO: 781442 - RNA, 19 nt, Homo sapiens
caccaaaggcuaaauccaa

SEQ ID NO: 781443 - RNA, 19 nt, Homo sapiens
gcaaaggaaauccggaaag

SEQ ID NO: 781444 - RNA, 19 nt, Homo sapiens
ugacaucaaagagaguuua

SEQ ID NO: 781445 - RNA, 19 nt, Homo sapiens
aaaccugucaugaaucaaa

SEQ ID NO: 781446 - RNA, 19 nt, Homo sapiens
aaacauguuguccucagua

SEQ ID NO: 781447 - RNA, 19 nt, Homo sapiens
gcacauuccaugacaguac

SEQ ID NO: 781448 - RNA, 19 nt, Homo sapiens
cgucuacucugcacuacga

SEQ ID NO: 781449 - RNA, 19 nt, Homo sapiens
aguauagaccuucugauuu

SEQ ID NO: 781450 - RNA, 19 nt, Homo sapiens
gcacuacgagaaauugcuu

SEQ ID NO: 781451 - RNA, 19 nt, Homo sapiens
ugacaguacaggauuauca

SEQ ID NO: 781452 - RNA, 19 nt, Homo sapiens
ccucaggaauuacuucagu

SEQ ID NO: 781453 - RNA, 19 nt, Homo sapiens
gaggaugagcccauggauu

SEQ ID NO: 781454 - RNA, 19 nt, Homo sapiens
cuaggaaaccuuaaguaug

SEQ ID NO: 781455 - RNA, 19 nt, Homo sapiens
gagcggaugcugcuguuca

SEQ ID NO: 781456 - RNA, 19 nt, Homo sapiens
guacuggcuugacggaaag

SEQ ID NO: 781457 - RNA, 19 nt, Homo sapiens
ucacccaccaucuuuguuu

SEQ ID NO: 781458 - RNA, 19 nt, Homo sapiens
ggaaagaaaggaaaagguu

SEQ ID NO: 781459 - RNA, 19 nt, Homo sapiens
guugaaauuucuggcuaaa

SEQ ID NO: 781460 - RNA, 19 nt, Homo sapiens
gcaguggucuugucaaauu

SEQ ID NO: 781461 - RNA, 19 nt, Homo sapiens
gaagaggguuguucaaaug

SEQ ID NO: 781462 - RNA, 19 nt, Homo sapiens
gaaagucugccuagaauuu

SEQ ID NO: 781463 - RNA, 19 nt, Homo sapiens
ucaaacagcugcuuauuuc

SEQ ID NO: 781464 - RNA, 19 nt, Homo sapiens
ggaagaggguuguucaaau

SEQ ID NO: 781465 - RNA, 19 nt, Homo sapiens
gaacuaguauuggauugaa

SEQ ID NO: 781466 - RNA, 19 nt, Homo sapiens
ggagguugaugccgccuua

SEQ ID NO: 781467 - RNA, 19 nt, Homo sapiens
ccaaugcuguuguuaaaga

SEQ ID NO: 781468 - RNA, 19 nt, Homo sapiens
gaagauguucccacuaauu

SEQ ID NO: 781469 - RNA, 19 nt, Homo sapiens
gcagugucauguucuguaa

SEQ ID NO: 781470 - RNA, 19 nt, Homo sapiens
gcuaaaagcucuugaugaa

SEQ ID NO: 781471 - RNA, 19 nt, Homo sapiens
cagaagcccauguuaguua

SEQ ID NO: 781472 - RNA, 19 nt, Homo sapiens
caccaaugcuguuguuaaa

SEQ ID NO: 781473 - RNA, 19 nt, Homo sapiens
cugaagauguucccacuaa

SEQ ID NO: 781474 - RNA, 19 nt, Homo sapiens
guaaagacaccaggaguuu

SEQ ID NO: 781475 - RNA, 19 nt, Homo sapiens
uaucucagcucuccuagga

SEQ ID NO: 781476 - RNA, 19 nt, Homo sapiens
guagggaacuaguauugga

SEQ ID NO: 781477 - RNA, 19 nt, Homo sapiens
gggaauugcugcucuuuac

SEQ ID NO: 781478 - RNA, 19 nt, Homo sapiens
gaaggcuggguuaaaguua

SEQ ID NO: 781479 - RNA, 19 nt, Homo sapiens
ggagaccgcgcugaacuua

SEQ ID NO: 781480 - RNA, 19 nt, Homo sapiens
cauccacucucauauuuau

SEQ ID NO: 781481 - RNA, 19 nt, Homo sapiens
guuaauccuuugcauuuga

SEQ ID NO: 781482 - RNA, 19 nt, Homo sapiens
cugcagcacuuucagcaua

SEQ ID NO: 781483 - RNA, 19 nt, Homo sapiens
ucagccaucuugagaauau

SEQ ID NO: 781484 - RNA, 19 nt, Homo sapiens
gggagaagccaaacguaaa

SEQ ID NO: 781485 - RNA, 19 nt, Homo sapiens
gcuuccaaauccugaaaua

SEQ ID NO: 781486 - RNA, 19 nt, Homo sapiens
uagcaguggucuugucaaa

SEQ ID NO: 781487 - RNA, 19 nt, Homo sapiens
gaucaacggacuuaucuca

SEQ ID NO: 781488 - RNA, 19 nt, Homo sapiens
gauucagguuucuccauuu

SEQ ID NO: 781489 - RNA, 19 nt, Homo sapiens
ggaaggcuggguuaaaguu

SEQ ID NO: 781490 - RNA, 19 nt, Homo sapiens
agugucauguucuguaaua

SEQ ID NO: 781491 - RNA, 19 nt, Homo sapiens
gaucagcacuggaaaagau

SEQ ID NO: 781492 - RNA, 19 nt, Homo sapiens
ugagggugcugaagauguu

SEQ ID NO: 781493 - RNA, 19 nt, Homo sapiens
gcacgagggagaagccaaa

SEQ ID NO: 781494 - RNA, 19 nt, Homo sapiens
gcgguucauugcuauuauu

SEQ ID NO: 781495 - RNA, 19 nt, Homo sapiens
gaaugaagacuuugcaaaa

SEQ ID NO: 781496 - RNA, 19 nt, Homo sapiens
gccuagaauuucaagauug

SEQ ID NO: 781497 - RNA, 19 nt, Homo sapiens
caugaaagucugccuagaa

SEQ ID NO: 781498 - RNA, 19 nt, Homo sapiens
agacugauguggcuaccuu

SEQ ID NO: 781499 - RNA, 19 nt, Homo sapiens
gaaauuugagggugcugaa

SEQ ID NO: 781500 - RNA, 19 nt, Homo sapiens
gaagacugaagcaggcuaa

SEQ ID NO: 781501 - RNA, 19 nt, Homo sapiens
ugauucagguuucuccauu

SEQ ID NO: 781502 - RNA, 19 nt, Homo sapiens
ugccacauaugaaagagua

SEQ ID NO: 781503 - RNA, 19 nt, Homo sapiens
gaacuuaggagggccuuca

SEQ ID NO: 781504 - RNA, 19 nt, Homo sapiens
ugaauagucuuccauuuug

SEQ ID NO: 781505 - RNA, 19 nt, Homo sapiens
gcaggaagaggguuguuca

SEQ ID NO: 781506 - RNA, 19 nt, Homo sapiens
gauguuaauccuuugcauu

SEQ ID NO: 781507 - RNA, 19 nt, Homo sapiens
gcauaugcacaucaaaguu

SEQ ID NO: 781508 - RNA, 19 nt, Homo sapiens
cuucuugcauuaucuggua

SEQ ID NO: 781509 - RNA, 19 nt, Homo sapiens
ccuagaauuucaagauugu

SEQ ID NO: 781510 - RNA, 19 nt, Homo sapiens
uuaaagaugcaaccucaaa

SEQ ID NO: 781511 - RNA, 19 nt, Homo sapiens
guucauugcuauuauugca

SEQ ID NO: 781512 - RNA, 19 nt, Homo sapiens
gggccaggcuguguauuuc

SEQ ID NO: 781513 - RNA, 19 nt, Homo sapiens
cauaugcacaucaaaguug

SEQ ID NO: 781514 - RNA, 19 nt, Homo sapiens
guucauccacucucauauu

SEQ ID NO: 781515 - RNA, 19 nt, Homo sapiens
ggaacuaguauuggauuga

SEQ ID NO: 781516 - RNA, 19 nt, Homo sapiens
uaugcagacuugaguguau

SEQ ID NO: 781517 - RNA, 19 nt, Homo sapiens
aguuuggccuuaugcuuua

SEQ ID NO: 781518 - RNA, 19 nt, Homo sapiens
ugaaugaagacuuugcaaa

SEQ ID NO: 781519 - RNA, 19 nt, Homo sapiens
aagauguucccacuaauuu

SEQ ID NO: 781520 - RNA, 19 nt, Homo sapiens
aaacguucauccacucuca

SEQ ID NO: 781521 - RNA, 19 nt, Homo sapiens
ugauguggcuaccuucuca

SEQ ID NO: 781522 - RNA, 19 nt, Homo sapiens
ggagaagccaaacguaaag

SEQ ID NO: 781523 - RNA, 19 nt, Homo sapiens
uugaguguaugcaggauuu

SEQ ID NO: 781524 - RNA, 19 nt, Homo sapiens
cgaguaccacuacaugaaa

SEQ ID NO: 781525 - RNA, 19 nt, Homo sapiens
caguuuggccuuaugcuuu

SEQ ID NO: 781526 - RNA, 19 nt, Homo sapiens
uucauccacucucauauuu

SEQ ID NO: 781527 - RNA, 19 nt, Homo sapiens
gggaacuaguauuggauug

SEQ ID NO: 781528 - RNA, 19 nt, Homo sapiens
ucagguuucuccauuucuu

SEQ ID NO: 781529 - RNA, 19 nt, Homo sapiens
ugucagccaucuugagaau

SEQ ID NO: 781530 - RNA, 19 nt, Homo sapiens
gaccuugucagccaucuug

SEQ ID NO: 781531 - RNA, 19 nt, Homo sapiens
gaagccaaacguaaagaca

SEQ ID NO: 781532 - RNA, 19 nt, Homo sapiens
acaccaaugcuguuguuaa

SEQ ID NO: 781533 - RNA, 19 nt, Homo sapiens
cugcauguuugaagacuga

SEQ ID NO: 781534 - RNA, 19 nt, Homo sapiens
cgacgaagaguggguguga

SEQ ID NO: 781535 - RNA, 19 nt, Homo sapiens
ggugugaucagcacuggaa

SEQ ID NO: 781536 - RNA, 19 nt, Homo sapiens
ugccuagaauuucaagauu

SEQ ID NO: 781537 - RNA, 19 nt, Homo sapiens
gaguaccacuacaugaaag

SEQ ID NO: 781538 - RNA, 19 nt, Homo sapiens
gccaggcuguguauuucuu

SEQ ID NO: 781539 - RNA, 19 nt, Homo sapiens
augaaagucugccuagaau

SEQ ID NO: 781540 - RNA, 19 nt, Homo sapiens
ggacauccuaaccuaugaa

SEQ ID NO: 781541 - RNA, 19 nt, Homo sapiens
guaugcaggauuucauuau

SEQ ID NO: 781542 - RNA, 19 nt, Homo sapiens
gagggagaagccaaacgua

SEQ ID NO: 781543 - RNA, 19 nt, Homo sapiens
ggagcucuuugacccuguu

SEQ ID NO: 781544 - RNA, 19 nt, Homo sapiens
ucaagauuguggaguugga

SEQ ID NO: 781545 - RNA, 19 nt, Homo sapiens
uccaaauccugaaauagau

SEQ ID NO: 781546 - RNA, 19 nt, Homo sapiens
guuauggaaggcuggguua

SEQ ID NO: 781547 - RNA, 19 nt, Homo sapiens
gugccugcauguuugaaga

SEQ ID NO: 781548 - RNA, 19 nt, Homo sapiens
uccauuucuucuugcauua

SEQ ID NO: 781549 - RNA, 19 nt, Homo sapiens
aaugcccacuuuccaguuu

SEQ ID NO: 781550 - RNA, 19 nt, Homo sapiens
uccagaagcuuccaaaucc

SEQ ID NO: 781551 - RNA, 19 nt, Homo sapiens
ugaagauguucccacuaau

SEQ ID NO: 781552 - RNA, 19 nt, Homo sapiens
ccuguaauccuggcacuuu

SEQ ID NO: 781553 - RNA, 19 nt, Homo sapiens
uaugcaggauuucauuauc

SEQ ID NO: 781554 - RNA, 19 nt, Homo sapiens
aggagggccuucacacaga

SEQ ID NO: 781555 - RNA, 19 nt, Homo sapiens
ccgaguaccacuacaugaa

SEQ ID NO: 781556 - RNA, 19 nt, Homo sapiens
cauccuaaccuaugaagag

SEQ ID NO: 781557 - RNA, 19 nt, Homo sapiens
ccagaagcccauguuaguu

SEQ ID NO: 781558 - RNA, 19 nt, Homo sapiens
gaauugcugcucuuuacca

SEQ ID NO: 781559 - RNA, 19 nt, Homo sapiens
agaccgcgcugaacuuagg

SEQ ID NO: 781560 - RNA, 19 nt, Homo sapiens
ucacauagcucuuaaugaa

SEQ ID NO: 781561 - RNA, 19 nt, Homo sapiens
gaaguacaccuaauuguua

SEQ ID NO: 781562 - RNA, 19 nt, Homo sapiens
ucacugagcuuuauucaaa

SEQ ID NO: 781563 - RNA, 19 nt, Homo sapiens
gaaccaagaugaaucagaa

SEQ ID NO: 781564 - RNA, 19 nt, Homo sapiens
gaagucagaucgauaaaga

SEQ ID NO: 781565 - RNA, 19 nt, Homo sapiens
gcagaaagccuuaaaugaa

SEQ ID NO: 781566 - RNA, 19 nt, Homo sapiens
gaauuacgaucacaaaguu

SEQ ID NO: 781567 - RNA, 19 nt, Homo sapiens
gaaauaaauuccacaacug

SEQ ID NO: 781568 - RNA, 19 nt, Homo sapiens
ggaaagaaacaaagcauuu

SEQ ID NO: 781569 - RNA, 19 nt, Homo sapiens
gauguucccucucuaauga

SEQ ID NO: 781570 - RNA, 19 nt, Homo sapiens
uaaggaagcuucuacugaa

SEQ ID NO: 781571 - RNA, 19 nt, Homo sapiens
cagggaagcuuacuugaaa

SEQ ID NO: 781572 - RNA, 19 nt, Homo sapiens
gaaggcagcaugacuguuu

SEQ ID NO: 781573 - RNA, 19 nt, Homo sapiens
gcaguuauguccaugaaau

SEQ ID NO: 781574 - RNA, 19 nt, Homo sapiens
gagagaaguguaucuguua

SEQ ID NO: 781575 - RNA, 19 nt, Homo sapiens
cauuggaacucuuaacuaa

SEQ ID NO: 781576 - RNA, 19 nt, Homo sapiens
gaaagaguguuggccauug

SEQ ID NO: 781577 - RNA, 19 nt, Homo sapiens
caaaggaucuacauugaag

SEQ ID NO: 781578 - RNA, 19 nt, Homo sapiens
ucagaucgauaaagaauug

SEQ ID NO: 781579 - RNA, 19 nt, Homo sapiens
gaagaaauugcacuuaaga

SEQ ID NO: 781580 - RNA, 19 nt, Homo sapiens
caaggaguguuucauuuga

SEQ ID NO: 781581 - RNA, 19 nt, Homo sapiens
ccauugugauuauccauua

SEQ ID NO: 781582 - RNA, 19 nt, Homo sapiens
gaauucacauagcucuuaa

SEQ ID NO: 781583 - RNA, 19 nt, Homo sapiens
gagaaggaaucuguuaaau

SEQ ID NO: 781584 - RNA, 19 nt, Homo sapiens
gaacaggcaguacgaauuc

SEQ ID NO: 781585 - RNA, 19 nt, Homo sapiens
cauagaauauccucuuaga

SEQ ID NO: 781586 - RNA, 19 nt, Homo sapiens
guaguaaccugugaaacaa

SEQ ID NO: 781587 - RNA, 19 nt, Homo sapiens
gacuagaacuaucuccuuu

SEQ ID NO: 781588 - RNA, 19 nt, Homo sapiens
gaaggaauaccacgaagga

SEQ ID NO: 781589 - RNA, 19 nt, Homo sapiens
gcaaggaguguuucauuug

SEQ ID NO: 781590 - RNA, 19 nt, Homo sapiens
gaaggcauuggaacucuua

SEQ ID NO: 781591 - RNA, 19 nt, Homo sapiens
aaacgaagacaacggcuua

SEQ ID NO: 781592 - RNA, 19 nt, Homo sapiens
ggaauaccacgaaggaauu

SEQ ID NO: 781593 - RNA, 19 nt, Homo sapiens
cugaagaaauugcacuuaa

SEQ ID NO: 781594 - RNA, 19 nt, Homo sapiens
gcagaagccaucaguaaga

SEQ ID NO: 781595 - RNA, 19 nt, Homo sapiens
gauaaagaauuggcuagug

SEQ ID NO: 781596 - RNA, 19 nt, Homo sapiens
gcacugggaagaaauaaau

SEQ ID NO: 781597 - RNA, 19 nt, Homo sapiens
ugacugaauuaacuuggua

SEQ ID NO: 781598 - RNA, 19 nt, Homo sapiens
gaguaagaguauugcuaua

SEQ ID NO: 781599 - RNA, 19 nt, Homo sapiens
gagcaucccuggucuucau

SEQ ID NO: 781600 - RNA, 19 nt, Homo sapiens
ucaagagugugauguucua

SEQ ID NO: 781601 - RNA, 19 nt, Homo sapiens
auaaugcacugacagaauu

SEQ ID NO: 781602 - RNA, 19 nt, Homo sapiens
gauauacaacagaguagua

SEQ ID NO: 781603 - RNA, 19 nt, Homo sapiens
uggguuagguuacuuacua

SEQ ID NO: 781604 - RNA, 19 nt, Homo sapiens
cuacuggaguuacuaagaa

SEQ ID NO: 781605 - RNA, 19 nt, Homo sapiens
uuaguugccuuauuuguga

SEQ ID NO: 781606 - RNA, 19 nt, Homo sapiens
gaucuacauugaaggcauu

SEQ ID NO: 781607 - RNA, 19 nt, Homo sapiens
gaauauccucuuagacauu

SEQ ID NO: 781608 - RNA, 19 nt, Homo sapiens
gaagcuuacuugaaagagu

SEQ ID NO: 781609 - RNA, 19 nt, Homo sapiens
gagaagaaugauacuguuu

SEQ ID NO: 781610 - RNA, 19 nt, Homo sapiens
aaagaaagccauaugugaa

SEQ ID NO: 781611 - RNA, 19 nt, Homo sapiens
cccaaaggaucuacauuga

SEQ ID NO: 781612 - RNA, 19 nt, Homo sapiens
ugaaacauggguuagguua

SEQ ID NO: 781613 - RNA, 19 nt, Homo sapiens
gaagcugaaacauggguua

SEQ ID NO: 781614 - RNA, 19 nt, Homo sapiens
ccagauauuuagagucgaa

SEQ ID NO: 781615 - RNA, 19 nt, Homo sapiens
cagaaagccuuaaaugaac

SEQ ID NO: 781616 - RNA, 19 nt, Homo sapiens
ucagagcacugggaagaaa

SEQ ID NO: 781617 - RNA, 19 nt, Homo sapiens
gaagacaacggcuuauugg

SEQ ID NO: 781618 - RNA, 19 nt, Homo sapiens
guacaucugugaacuagcu

SEQ ID NO: 781619 - RNA, 19 nt, Homo sapiens
ugaaacaaauguacaucug

SEQ ID NO: 781620 - RNA, 19 nt, Homo sapiens
agagagaaguguaucuguu

SEQ ID NO: 781621 - RNA, 19 nt, Homo sapiens
gaaagccauaugugaauga

SEQ ID NO: 781622 - RNA, 19 nt, Homo sapiens
ggaggcagaugaaaagaaa

SEQ ID NO: 781623 - RNA, 19 nt, Homo sapiens
aauaaaggcuaaacaagca

SEQ ID NO: 781624 - RNA, 19 nt, Homo sapiens
gccauaauuugucugagaa

SEQ ID NO: 781625 - RNA, 19 nt, Homo sapiens
ugagaagaaugauacuguu

SEQ ID NO: 781626 - RNA, 19 nt, Homo sapiens
gaacugacugaauuaacuu

SEQ ID NO: 781627 - RNA, 19 nt, Homo sapiens
guaagaguauugcuauaac

SEQ ID NO: 781628 - RNA, 19 nt, Homo sapiens
uacuguaccuugcucauuu

SEQ ID NO: 781629 - RNA, 19 nt, Homo sapiens
ggagaaccaagaugaauca

SEQ ID NO: 781630 - RNA, 19 nt, Homo sapiens
guaaaacaguccugauuug

SEQ ID NO: 781631 - RNA, 19 nt, Homo sapiens
uagaauauccucuuagaca

SEQ ID NO: 781632 - RNA, 19 nt, Homo sapiens
gagaaagagagaaguguau

SEQ ID NO: 781633 - RNA, 19 nt, Homo sapiens
gcaauaaaggcuaaacaag

SEQ ID NO: 781634 - RNA, 19 nt, Homo sapiens
gaaggcaaaucagaagaag

SEQ ID NO: 781635 - RNA, 19 nt, Homo sapiens
agaauuggcuaguggugaa

SEQ ID NO: 781636 - RNA, 19 nt, Homo sapiens
gcauuggaacucuuaacua

SEQ ID NO: 781637 - RNA, 19 nt, Homo sapiens
cgaagacaacggcuuauug

SEQ ID NO: 781638 - RNA, 19 nt, Homo sapiens
gaaacaaauguacaucugu

SEQ ID NO: 781639 - RNA, 19 nt, Homo sapiens
caaaauacagggaagcuua

SEQ ID NO: 781640 - RNA, 19 nt, Homo sapiens
uuacgaccauugugauuau

SEQ ID NO: 781641 - RNA, 19 nt, Homo sapiens
uuugagauaucaggcauua

SEQ ID NO: 781642 - RNA, 19 nt, Homo sapiens
aagcagaagccaucaguaa

SEQ ID NO: 781643 - RNA, 19 nt, Homo sapiens
uaauaugcccagcacauuu

SEQ ID NO: 781644 - RNA, 19 nt, Homo sapiens
cauccagucuaguauauca

SEQ ID NO: 781645 - RNA, 19 nt, Homo sapiens
uuaacuugcuuuggcuuua

SEQ ID NO: 781646 - RNA, 19 nt, Homo sapiens
uagacacaguugagaguuu

SEQ ID NO: 781647 - RNA, 19 nt, Homo sapiens
gaaagugguauauaugucu

SEQ ID NO: 781648 - RNA, 19 nt, Homo sapiens
ugaagaaauugcacuuaag

SEQ ID NO: 781649 - RNA, 19 nt, Homo sapiens
gccuuuagccuucuggaua

SEQ ID NO: 781650 - RNA, 19 nt, Homo sapiens
aaauugcacuuaagaugga

SEQ ID NO: 781651 - RNA, 19 nt, Homo sapiens
cuaaggaagcuucuacuga

SEQ ID NO: 781652 - RNA, 19 nt, Homo sapiens
uaauuugucugagaaggaa

SEQ ID NO: 781653 - RNA, 19 nt, Homo sapiens
ugaacugacugaauuaacu

SEQ ID NO: 781654 - RNA, 19 nt, Homo sapiens
aaugaaggcuacuggaguu

SEQ ID NO: 781655 - RNA, 19 nt, Homo sapiens
ugucugaugcuauugguua

SEQ ID NO: 781656 - RNA, 19 nt, Homo sapiens
aagcauuuauuccaccuaa

SEQ ID NO: 781657 - RNA, 19 nt, Homo sapiens
ggcuaguggugaauacuuu

SEQ ID NO: 781658 - RNA, 19 nt, Homo sapiens
caggaagucagaucgauaa

SEQ ID NO: 781659 - RNA, 19 nt, Homo sapiens
ucacaaaguugggagagau

SEQ ID NO: 781660 - RNA, 19 nt, Homo sapiens
ggaagacgcuccuugcuaa

SEQ ID NO: 781661 - RNA, 19 nt, Homo sapiens
ggacagcacucccuugaaa

SEQ ID NO: 781662 - RNA, 19 nt, Homo sapiens
ggaauuggcugaugauguu

SEQ ID NO: 781663 - RNA, 19 nt, Homo sapiens
gaacaugagucuucuuaug

SEQ ID NO: 781664 - RNA, 19 nt, Homo sapiens
ggauauagaugaggcuuua

SEQ ID NO: 781665 - RNA, 19 nt, Homo sapiens
uaaggaagccguaguguua

SEQ ID NO: 781666 - RNA, 19 nt, Homo sapiens
ugauaucgcugauuuagua

SEQ ID NO: 781667 - RNA, 19 nt, Homo sapiens
gaggaaauccgaaaucuuu

SEQ ID NO: 781668 - RNA, 19 nt, Homo sapiens
gggaugauaucgcugauuu

SEQ ID NO: 781669 - RNA, 19 nt, Homo sapiens
gauaguaccggauaugaua

SEQ ID NO: 781670 - RNA, 19 nt, Homo sapiens
gcacaugccuacaacuaug

SEQ ID NO: 781671 - RNA, 19 nt, Homo sapiens
cuacaacuauggaggauuu

SEQ ID NO: 781672 - RNA, 19 nt, Homo sapiens
uaacagaaccagagacaaa

SEQ ID NO: 781673 - RNA, 19 nt, Homo sapiens
cugcagacauugaaagaua

SEQ ID NO: 781674 - RNA, 19 nt, Homo sapiens
gaaggcgcauugaagguuu

SEQ ID NO: 781675 - RNA, 19 nt, Homo sapiens
acucugcgauggucuauua

SEQ ID NO: 781676 - RNA, 19 nt, Homo sapiens
cacagaauguucacaauga

SEQ ID NO: 781677 - RNA, 19 nt, Homo sapiens
gaaaugcacaugccuacaa

SEQ ID NO: 781678 - RNA, 19 nt, Homo sapiens
gauaaagacuuaguagaag

SEQ ID NO: 781679 - RNA, 19 nt, Homo sapiens
gacccuaaaucacauggua

SEQ ID NO: 781680 - RNA, 19 nt, Homo sapiens
auacauaccuccagcagaa

SEQ ID NO: 781681 - RNA, 19 nt, Homo sapiens
gaacaugaagcaagcagaa

SEQ ID NO: 781682 - RNA, 19 nt, Homo sapiens
gauauaauuucccagaauc

SEQ ID NO: 781683 - RNA, 19 nt, Homo sapiens
caacagguuuggcaggaaa

SEQ ID NO: 781684 - RNA, 19 nt, Homo sapiens
gggaggagcuauuacgaau

SEQ ID NO: 781685 - RNA, 19 nt, Homo sapiens
gaauaagucuacgugaguu

SEQ ID NO: 781686 - RNA, 19 nt, Homo sapiens
gaaagaacagaauaaagga

SEQ ID NO: 781687 - RNA, 19 nt, Homo sapiens
ggaaauaaauguggaagcu

SEQ ID NO: 781688 - RNA, 19 nt, Homo sapiens
caauguggaugcccgaauu

SEQ ID NO: 781689 - RNA, 19 nt, Homo sapiens
aaaauuggcucgugaauau

SEQ ID NO: 781690 - RNA, 19 nt, Homo sapiens
gagauauaauuucccagaa

SEQ ID NO: 781691 - RNA, 19 nt, Homo sapiens
cagaaaacauggaagguua

SEQ ID NO: 781692 - RNA, 19 nt, Homo sapiens
cggauaugauaaagacuua

SEQ ID NO: 781693 - RNA, 19 nt, Homo sapiens
gaauaaaggaagagaggaa

SEQ ID NO: 781694 - RNA, 19 nt, Homo sapiens
gcacagaauguucacaaug

SEQ ID NO: 781695 - RNA, 19 nt, Homo sapiens
guacagugacccuaaauca

SEQ ID NO: 781696 - RNA, 19 nt, Homo sapiens
gcagaaauggcaacagguu

SEQ ID NO: 781697 - RNA, 19 nt, Homo sapiens
caaaugaacaaguaucugu

SEQ ID NO: 781698 - RNA, 19 nt, Homo sapiens
ucagauggaugguguugga

SEQ ID NO: 781699 - RNA, 19 nt, Homo sapiens
ggaaaggaguacugauggu

SEQ ID NO: 781700 - RNA, 19 nt, Homo sapiens
gaaccagagacaaauaaau

SEQ ID NO: 781701 - RNA, 19 nt, Homo sapiens
gcuguucguugucgugaaa

SEQ ID NO: 781702 - RNA, 19 nt, Homo sapiens
gaaauaaauguggaagcua

SEQ ID NO: 781703 - RNA, 19 nt, Homo sapiens
gauguugaccuugcaagua

SEQ ID NO: 781704 - RNA, 19 nt, Homo sapiens
gggaagacgcuccuugcua

SEQ ID NO: 781705 - RNA, 19 nt, Homo sapiens
aagcggagcugcugguuca

SEQ ID NO: 781706 - RNA, 19 nt, Homo sapiens
uguggaagcuaaacauguu

SEQ ID NO: 781707 - RNA, 19 nt, Homo sapiens
aaacauggaagguuauuca

SEQ ID NO: 781708 - RNA, 19 nt, Homo sapiens
cuaaagcaguagcuacaga

SEQ ID NO: 781709 - RNA, 19 nt, Homo sapiens
guggaugcccgaauucuuu

SEQ ID NO: 781710 - RNA, 19 nt, Homo sapiens
agggaaagcuguucguugu

SEQ ID NO: 781711 - RNA, 19 nt, Homo sapiens
gguaaucguccaaguacaa

SEQ ID NO: 781712 - RNA, 19 nt, Homo sapiens
gcaacagguuuggcaggaa

SEQ ID NO: 781713 - RNA, 19 nt, Homo sapiens
ucagggaguucuugaccaa

SEQ ID NO: 781714 - RNA, 19 nt, Homo sapiens
caaugucucuucaucaacu

SEQ ID NO: 781715 - RNA, 19 nt, Homo sapiens
ucaguacagugacccuaaa

SEQ ID NO: 781716 - RNA, 19 nt, Homo sapiens
uauggaggauuucgagaug

SEQ ID NO: 781717 - RNA, 19 nt, Homo sapiens
gaugauaucgcugauuuag

SEQ ID NO: 781718 - RNA, 19 nt, Homo sapiens
aauguucgaugggaugaua

SEQ ID NO: 781719 - RNA, 19 nt, Homo sapiens
agaaagaacagaauaaagg

SEQ ID NO: 781720 - RNA, 19 nt, Homo sapiens
ccaccauauuuauugauga

SEQ ID NO: 781721 - RNA, 19 nt, Homo sapiens
uaucgcugauuuaguagaa

SEQ ID NO: 781722 - RNA, 19 nt, Homo sapiens
ggaugauaucgcugauuua

SEQ ID NO: 781723 - RNA, 19 nt, Homo sapiens
cagaaccagagacaaauaa

SEQ ID NO: 781724 - RNA, 19 nt, Homo sapiens
uaaaucacaugguaaucgu

SEQ ID NO: 781725 - RNA, 19 nt, Homo sapiens
ugaaagcggcacagcauga

SEQ ID NO: 781726 - RNA, 19 nt, Homo sapiens
gaaagauacgagaaaugga

SEQ ID NO: 781727 - RNA, 19 nt, Homo sapiens
gaagacgcuccuugcuaaa

SEQ ID NO: 781728 - RNA, 19 nt, Homo sapiens
ugucagaguucaccguuca

SEQ ID NO: 781729 - RNA, 19 nt, Homo sapiens
guccaugccuguaccuguu

SEQ ID NO: 781730 - RNA, 19 nt, Homo sapiens
caugagucuucuuaugauu

SEQ ID NO: 781731 - RNA, 19 nt, Homo sapiens
cgaauaagucuacgugagu

SEQ ID NO: 781732 - RNA, 19 nt, Homo sapiens
gcuacagaaugcaagacaa

SEQ ID NO: 781733 - RNA, 19 nt, Homo sapiens
caugguaaucguccaagua

SEQ ID NO: 781734 - RNA, 19 nt, Homo sapiens
gauauuugaguuuggauca

SEQ ID NO: 781735 - RNA, 19 nt, Homo sapiens
cagaggaaauccgaaaucu

SEQ ID NO: 781736 - RNA, 19 nt, Homo sapiens
gccaccauauuuauugaug

SEQ ID NO: 781737 - RNA, 19 nt, Homo sapiens
cagccaccauauuuauuga

SEQ ID NO: 781738 - RNA, 19 nt, Homo sapiens
gcuuguucgucuucuguuu

SEQ ID NO: 781739 - RNA, 19 nt, Homo sapiens
gggaguucuugaccaaaug

SEQ ID NO: 781740 - RNA, 19 nt, Homo sapiens
gccguaguguuaccaaugu

SEQ ID NO: 781741 - RNA, 19 nt, Homo sapiens
ugaaagauacgagaaaugg

SEQ ID NO: 781742 - RNA, 19 nt, Homo sapiens
caaagaagaaaugcacaug

SEQ ID NO: 781743 - RNA, 19 nt, Homo sapiens
gcagggaugcguccuugau

SEQ ID NO: 781744 - RNA, 19 nt, Homo sapiens
cuugagaaacgaaucuaua

SEQ ID NO: 781745 - RNA, 19 nt, Homo sapiens
ccagccaccauauuuauug

SEQ ID NO: 781746 - RNA, 19 nt, Homo sapiens
gcaguaacagaaccagaga

SEQ ID NO: 781747 - RNA, 19 nt, Homo sapiens
aacaugagucuucuuauga

SEQ ID NO: 781748 - RNA, 19 nt, Homo sapiens
gccuguaccuguugaacga

SEQ ID NO: 781749 - RNA, 19 nt, Homo sapiens
uugaccaaaugaacaagua

SEQ ID NO: 781750 - RNA, 19 nt, Homo sapiens
caaauacagaggagaaucu

SEQ ID NO: 781751 - RNA, 19 nt, Homo sapiens
uaaagcaguagcuacagaa

SEQ ID NO: 781752 - RNA, 19 nt, Homo sapiens
gaagagaggaaaagaacaa

SEQ ID NO: 781753 - RNA, 19 nt, Homo sapiens
cagcaugaccuuccagcuu

SEQ ID NO: 781754 - RNA, 19 nt, Homo sapiens
ggaagcuaaacauguuaaa

SEQ ID NO: 781755 - RNA, 19 nt, Homo sapiens
agaaauggcaacagguuug

SEQ ID NO: 781756 - RNA, 19 nt, Homo sapiens
ugagucuucuuaugauuag

SEQ ID NO: 781757 - RNA, 19 nt, Homo sapiens
acagaaccagagacaaaua

SEQ ID NO: 781758 - RNA, 19 nt, Homo sapiens
gagaaucugagaagcuugu

SEQ ID NO: 781759 - RNA, 19 nt, Homo sapiens
ggaguucuugaccaaauga

SEQ ID NO: 781760 - RNA, 19 nt, Homo sapiens
gaacaugcauuacaacuuu

SEQ ID NO: 781761 - RNA, 19 nt, Homo sapiens
gaagagaaauguaggguuu

SEQ ID NO: 781762 - RNA, 19 nt, Homo sapiens
guaaagagaucggaaauaa

SEQ ID NO: 781763 - RNA, 19 nt, Homo sapiens
guaggaaucucaagaauug

SEQ ID NO: 781764 - RNA, 19 nt, Homo sapiens
gguccaaacucuugaauaa

SEQ ID NO: 781765 - RNA, 19 nt, Homo sapiens
caacugauguuaucuauag

SEQ ID NO: 781766 - RNA, 19 nt, Homo sapiens
gaaauugaauacucugaga

SEQ ID NO: 781767 - RNA, 19 nt, Homo sapiens
gggcaagguuucagugaua

SEQ ID NO: 781768 - RNA, 19 nt, Homo sapiens
gaauuaaaguacaggauug

SEQ ID NO: 781769 - RNA, 19 nt, Homo sapiens
gagaaagaaugauggaaga

SEQ ID NO: 781770 - RNA, 19 nt, Homo sapiens
gauccacgcugcuguaaug

SEQ ID NO: 781771 - RNA, 19 nt, Homo sapiens
gaccuaagccugguaguua

SEQ ID NO: 781772 - RNA, 19 nt, Homo sapiens
caaggaacaugcauuacaa

SEQ ID NO: 781773 - RNA, 19 nt, Homo sapiens
auaaaccgcuuccuucuuu

SEQ ID NO: 781774 - RNA, 19 nt, Homo sapiens
ggauauuccuggcuaauca

SEQ ID NO: 781775 - RNA, 19 nt, Homo sapiens
gaaagacauugugaaacuu

SEQ ID NO: 781776 - RNA, 19 nt, Homo sapiens
gaauugcgaaagucaaaua

SEQ ID NO: 781777 - RNA, 19 nt, Homo sapiens
gaacaggccagaaagugaa

SEQ ID NO: 781778 - RNA, 19 nt, Homo sapiens
aaagaaagguccaaacucu

SEQ ID NO: 781779 - RNA, 19 nt, Homo sapiens
gggagaaacugcuaugagu

SEQ ID NO: 781780 - RNA, 19 nt, Homo sapiens
gaguccaucugguuuaauu

SEQ ID NO: 781781 - RNA, 19 nt, Homo sapiens
guucaagucuccacaggaa

SEQ ID NO: 781782 - RNA, 19 nt, Homo sapiens
guaccucauucuucccuua

SEQ ID NO: 781783 - RNA, 19 nt, Homo sapiens
gaagaagaguccagaacag

SEQ ID NO: 781784 - RNA, 19 nt, Homo sapiens
uaucaaggaacaugcauua

SEQ ID NO: 781785 - RNA, 19 nt, Homo sapiens
gcucuuauaucaaggaaca

SEQ ID NO: 781786 - RNA, 19 nt, Homo sapiens
ccagaaagacauaaacuug

SEQ ID NO: 781787 - RNA, 19 nt, Homo sapiens
ggauaguucuguaaguguu

SEQ ID NO: 781788 - RNA, 19 nt, Homo sapiens
ugagguggcuucagcgaaa

SEQ ID NO: 781789 - RNA, 19 nt, Homo sapiens
uauagaaccugccgaguca

SEQ ID NO: 781790 - RNA, 19 nt, Homo sapiens
gagaaacugcuaugaguau

SEQ ID NO: 781791 - RNA, 19 nt, Homo sapiens
ggagaaacugcuaugagua

SEQ ID NO: 781792 - RNA, 19 nt, Homo sapiens
gaagucaguccuccucauu

SEQ ID NO: 781793 - RNA, 19 nt, Homo sapiens
aaagaaugauggaagaaga

SEQ ID NO: 781794 - RNA, 19 nt, Homo sapiens
agaaagacauugugaaacu

SEQ ID NO: 781795 - RNA, 19 nt, Homo sapiens
aaacaaauccgccacuuuc

SEQ ID NO: 781796 - RNA, 19 nt, Homo sapiens
gugaacugcuggucuggua

SEQ ID NO: 781797 - RNA, 19 nt, Homo sapiens
gaaccagaccugaaaccaa

SEQ ID NO: 781798 - RNA, 19 nt, Homo sapiens
ggaagaagaguccagaaca

SEQ ID NO: 781799 - RNA, 19 nt, Homo sapiens
gucaagagaucaaagaaag

SEQ ID NO: 781800 - RNA, 19 nt, Homo sapiens
agaaagacauaaacuugga

SEQ ID NO: 781801 - RNA, 19 nt, Homo sapiens
agugauaagucagauguua

SEQ ID NO: 781802 - RNA, 19 nt, Homo sapiens
gaacgaggcaucugaucug

SEQ ID NO: 781803 - RNA, 19 nt, Homo sapiens
gcacugauccccuccauuu

SEQ ID NO: 781804 - RNA, 19 nt, Homo sapiens
ugacuagaguugaggaaga

SEQ ID NO: 781805 - RNA, 19 nt, Homo sapiens
gacagacccucucauacug

SEQ ID NO: 781806 - RNA, 19 nt, Homo sapiens
ggaugaguauggccaggaa

SEQ ID NO: 781807 - RNA, 19 nt, Homo sapiens
cuaaggaaauugaauacuc

SEQ ID NO: 781808 - RNA, 19 nt, Homo sapiens
ccaucugguuuaauuauug

SEQ ID NO: 781809 - RNA, 19 nt, Homo sapiens
gcaggaaggaugaguaagu

SEQ ID NO: 781810 - RNA, 19 nt, Homo sapiens
agucagaccuccucaguca

SEQ ID NO: 781811 - RNA, 19 nt, Homo sapiens
acaggcagaucuucuauag

SEQ ID NO: 781812 - RNA, 19 nt, Homo sapiens
uaaacaaauccgccacuuu

SEQ ID NO: 781813 - RNA, 19 nt, Homo sapiens
gaagucagaccuccucagu

SEQ ID NO: 781814 - RNA, 19 nt, Homo sapiens
gaauaaaccgcuuccuucu

SEQ ID NO: 781815 - RNA, 19 nt, Homo sapiens
caaggaaccagacccgaaa

SEQ ID NO: 781816 - RNA, 19 nt, Homo sapiens
agugugaccucuucuaaug

SEQ ID NO: 781817 - RNA, 19 nt, Homo sapiens
gacuagaguugaggaagaa

SEQ ID NO: 781818 - RNA, 19 nt, Homo sapiens
gguaggaaucucaagaauu

SEQ ID NO: 781819 - RNA, 19 nt, Homo sapiens
gaacuucccaggaccaucu

SEQ ID NO: 781820 - RNA, 19 nt, Homo sapiens
gaugagguaugugaacugu

SEQ ID NO: 781821 - RNA, 19 nt, Homo sapiens
gaaacuucccggucuguuc

SEQ ID NO: 781822 - RNA, 19 nt, Homo sapiens
ccaaguguguaccucauuc

SEQ ID NO: 781823 - RNA, 19 nt, Homo sapiens
agucaaauauggagagugu

SEQ ID NO: 781824 - RNA, 19 nt, Homo sapiens
ggucaagagaucaaagaaa

SEQ ID NO: 781825 - RNA, 19 nt, Homo sapiens
aaccaaaggucaagagauc

SEQ ID NO: 781826 - RNA, 19 nt, Homo sapiens
ggaacaugcauuacaacuu

SEQ ID NO: 781827 - RNA, 19 nt, Homo sapiens
caaauccgccacuuucaug

SEQ ID NO: 781828 - RNA, 19 nt, Homo sapiens
ggcaagguuucagugauaa

SEQ ID NO: 781829 - RNA, 19 nt, Homo sapiens
ggaacacaggcaaauuauu

SEQ ID NO: 781830 - RNA, 19 nt, Homo sapiens
cgcaaucacuccucucaga

SEQ ID NO: 781831 - RNA, 19 nt, Homo sapiens
gcaacugauguuaucuaua

SEQ ID NO: 781832 - RNA, 19 nt, Homo sapiens
ccuagcaacugauguuauc

SEQ ID NO: 781833 - RNA, 19 nt, Homo sapiens
uuucaaggguguauuagga

SEQ ID NO: 781834 - RNA, 19 nt, Homo sapiens
ccucuccucugcugccaua

SEQ ID NO: 781835 - RNA, 19 nt, Homo sapiens
agucagauguuauuacaca

SEQ ID NO: 781836 - RNA, 19 nt, Homo sapiens
gaaagguccaaacucuuga

SEQ ID NO: 781837 - RNA, 19 nt, Homo sapiens
gagcggcaauauucugauc

SEQ ID NO: 781838 - RNA, 19 nt, Homo sapiens
gcaaucacuccucucagaa

SEQ ID NO: 781839 - RNA, 19 nt, Homo sapiens
ccaacuggaugagguaugu

SEQ ID NO: 781840 - RNA, 19 nt, Homo sapiens
gguaugugcccucugugua

SEQ ID NO: 781841 - RNA, 19 nt, Homo sapiens
caaacgugaucaccacaca

SEQ ID NO: 781842 - RNA, 19 nt, Homo sapiens
gaaagaaugauggaagaag

SEQ ID NO: 781843 - RNA, 19 nt, Homo sapiens
agaaagguccaaacucuug

SEQ ID NO: 781844 - RNA, 19 nt, Homo sapiens
gaucaaagaaagguccaaa

SEQ ID NO: 781845 - RNA, 19 nt, Homo sapiens
gugccacgcucuuucugaa

SEQ ID NO: 781846 - RNA, 19 nt, Homo sapiens
ccacgcugcuguaaugaca

SEQ ID NO: 781847 - RNA, 19 nt, Homo sapiens
gcagcaaguggaagaaaga

SEQ ID NO: 781848 - RNA, 19 nt, Homo sapiens
gcauguguguauauaugug

SEQ ID NO: 781849 - RNA, 19 nt, Homo sapiens
acucaaacguucaguucaa

SEQ ID NO: 781850 - RNA, 19 nt, Homo sapiens
ggguaggaaucucaagaau

SEQ ID NO: 781851 - RNA, 19 nt, Homo sapiens
gaacugcuggucugguaug

SEQ ID NO: 781852 - RNA, 19 nt, Homo sapiens
cugaagcucuuauaucaag

SEQ ID NO: 781853 - RNA, 19 nt, Homo sapiens
ggguuucaaggguguauua

SEQ ID NO: 781854 - RNA, 19 nt, Homo sapiens
ccagaagggccacagagaa

SEQ ID NO: 781855 - RNA, 19 nt, Homo sapiens
aaagagaucggaaauaacu

SEQ ID NO: 781856 - RNA, 19 nt, Homo sapiens
ucucaagaauugcgaaagu

SEQ ID NO: 781857 - RNA, 19 nt, Homo sapiens
agggaacacaggcaaauua

SEQ ID NO: 781858 - RNA, 19 nt, Homo sapiens
ggacauggcagagggagau

SEQ ID NO: 781859 - RNA, 19 nt, Homo sapiens
gaaacugcuaugaguaugu

SEQ ID NO: 781860 - RNA, 19 nt, Homo sapiens
gaaagaggcugaagagcaa

SEQ ID NO: 781861 - RNA, 19 nt, Homo sapiens
gagaaugccugaagacuug

SEQ ID NO: 781862 - RNA, 19 nt, Homo sapiens
gagcaaggaugcccugaaa

SEQ ID NO: 781863 - RNA, 19 nt, Homo sapiens
ggugugagcuauguaauaa

SEQ ID NO: 781864 - RNA, 19 nt, Homo sapiens
gaacauagaaagauucaug

SEQ ID NO: 781865 - RNA, 19 nt, Homo sapiens
cauaagaaguuuacaagga

SEQ ID NO: 781866 - RNA, 19 nt, Homo sapiens
gagaaaaucuguccauauu

SEQ ID NO: 781867 - RNA, 19 nt, Homo sapiens
cagaagggcuccuaauaug

SEQ ID NO: 781868 - RNA, 19 nt, Homo sapiens
gaagaacagcaaauuauga

SEQ ID NO: 781869 - RNA, 19 nt, Homo sapiens
caacuugugcucugucuua

SEQ ID NO: 781870 - RNA, 19 nt, Homo sapiens
gaaagacacaagaaguaua

SEQ ID NO: 781871 - RNA, 19 nt, Homo sapiens
gaggaaggauacauuaaau

SEQ ID NO: 781872 - RNA, 19 nt, Homo sapiens
ccacagaaauguuuacaag

SEQ ID NO: 781873 - RNA, 19 nt, Homo sapiens
agacaaaccuuacaaaugc

SEQ ID NO: 781874 - RNA, 19 nt, Homo sapiens
gaggaagaacagcaaauua

SEQ ID NO: 781875 - RNA, 19 nt, Homo sapiens
gaagggcuccuaauaugaa

SEQ ID NO: 781876 - RNA, 19 nt, Homo sapiens
ucacugcgaugcuaccuuu

SEQ ID NO: 781877 - RNA, 19 nt, Homo sapiens
ggagagaccguuccaaugu

SEQ ID NO: 781878 - RNA, 19 nt, Homo sapiens
gaagacaaaccuuacaaau

SEQ ID NO: 781879 - RNA, 19 nt, Homo sapiens
ucaagugggugcucacaaa

SEQ ID NO: 781880 - RNA, 19 nt, Homo sapiens
ccacagaggagaaagaauu

SEQ ID NO: 781881 - RNA, 19 nt, Homo sapiens
uaagaggaaggauacauua

SEQ ID NO: 781882 - RNA, 19 nt, Homo sapiens
gaaaaucuguccauauugu

SEQ ID NO: 781883 - RNA, 19 nt, Homo sapiens
gaauuuaagugcaagaacu

SEQ ID NO: 781884 - RNA, 19 nt, Homo sapiens
caagaacugugggaagaaa

SEQ ID NO: 781885 - RNA, 19 nt, Homo sapiens
acacggagcuucugauugg

SEQ ID NO: 781886 - RNA, 19 nt, Homo sapiens
ggccaucccucuguaauga

SEQ ID NO: 781887 - RNA, 19 nt, Homo sapiens
ggaagaacagcaaauuaug

SEQ ID NO: 781888 - RNA, 19 nt, Homo sapiens
guucuuauuugccuacauu

SEQ ID NO: 781889 - RNA, 19 nt, Homo sapiens
gggagaagccguacaagug

SEQ ID NO: 781890 - RNA, 19 nt, Homo sapiens
ugaagaauguaaagcuuug

SEQ ID NO: 781891 - RNA, 19 nt, Homo sapiens
cuugugcucugucuuauaa

SEQ ID NO: 781892 - RNA, 19 nt, Homo sapiens
gaagaaauucccaguuaag

SEQ ID NO: 781893 - RNA, 19 nt, Homo sapiens
uguaauaaggccuuuguua

SEQ ID NO: 781894 - RNA, 19 nt, Homo sapiens
ccaggugguucaugaaaga

SEQ ID NO: 781895 - RNA, 19 nt, Homo sapiens
ggaggaagaacagcaaauu

SEQ ID NO: 781896 - RNA, 19 nt, Homo sapiens
ggucucauaguucuuauuu

SEQ ID NO: 781897 - RNA, 19 nt, Homo sapiens
gaaaacacauacaggagaa

SEQ ID NO: 781898 - RNA, 19 nt, Homo sapiens
ggagaaguuuuguacauuu

SEQ ID NO: 781899 - RNA, 19 nt, Homo sapiens
caagaaaugguauaaaugg

SEQ ID NO: 781900 - RNA, 19 nt, Homo sapiens
ggacugaagaugcacauuc

SEQ ID NO: 781901 - RNA, 19 nt, Homo sapiens
gaagauauagaaacagaca

SEQ ID NO: 781902 - RNA, 19 nt, Homo sapiens
caacuggcuucgcuucguu

SEQ ID NO: 781903 - RNA, 19 nt, Homo sapiens
gugacuuacuggucucaua

SEQ ID NO: 781904 - RNA, 19 nt, Homo sapiens
ucagaagggcuccuaauau

SEQ ID NO: 781905 - RNA, 19 nt, Homo sapiens
guuccaaugugaagaaugu

SEQ ID NO: 781906 - RNA, 19 nt, Homo sapiens
gagagaccguuccaaugug

SEQ ID NO: 781907 - RNA, 19 nt, Homo sapiens
ccuuacaaaugcaaacuuu

SEQ ID NO: 781908 - RNA, 19 nt, Homo sapiens
acaggaacauagaaagauu

SEQ ID NO: 781909 - RNA, 19 nt, Homo sapiens
gagaagagaaugccugaag

SEQ ID NO: 781910 - RNA, 19 nt, Homo sapiens
gacaccugcuaauacauaa

SEQ ID NO: 781911 - RNA, 19 nt, Homo sapiens
ugucaagaauguaugaaga

SEQ ID NO: 781912 - RNA, 19 nt, Homo sapiens
aagcuuauauguucagugu

SEQ ID NO: 781913 - RNA, 19 nt, Homo sapiens
cagaggagaaagaauuuaa

SEQ ID NO: 781914 - RNA, 19 nt, Homo sapiens
agucauggcucucuuucuu

SEQ ID NO: 781915 - RNA, 19 nt, Homo sapiens
ucaauguccuuacugugaa

SEQ ID NO: 781916 - RNA, 19 nt, Homo sapiens
uaauaaggccuuuguuaca

SEQ ID NO: 781917 - RNA, 19 nt, Homo sapiens
agagacaccugcuaauaca

SEQ ID NO: 781918 - RNA, 19 nt, Homo sapiens
gaggagagaccguuccaau

SEQ ID NO: 781919 - RNA, 19 nt, Homo sapiens
caaugugaaucgaguuuua

SEQ ID NO: 781920 - RNA, 19 nt, Homo sapiens
cugauuggcuaccuggaua

SEQ ID NO: 781921 - RNA, 19 nt, Homo sapiens
agaagagaaugccugaaga

SEQ ID NO: 781922 - RNA, 19 nt, Homo sapiens
uuacagagacaccugcuaa

SEQ ID NO: 781923 - RNA, 19 nt, Homo sapiens
caucaagccuacaggaaca

SEQ ID NO: 781924 - RNA, 19 nt, Homo sapiens
aaaguguucuucagcauca

SEQ ID NO: 781925 - RNA, 19 nt, Homo sapiens
cacuggagauccuaagaaa

SEQ ID NO: 781926 - RNA, 19 nt, Homo sapiens
uagagucuguagaugcaua

SEQ ID NO: 781927 - RNA, 19 nt, Homo sapiens
ggacaauauccauggugua

SEQ ID NO: 781928 - RNA, 19 nt, Homo sapiens
acagagacaccugcuaaua

SEQ ID NO: 781929 - RNA, 19 nt, Homo sapiens
uauguucagugugcaauaa

SEQ ID NO: 781930 - RNA, 19 nt, Homo sapiens
gcaauucuuccuucaguuc

SEQ ID NO: 781931 - RNA, 19 nt, Homo sapiens
gaucagcauaacagaagua

SEQ ID NO: 781932 - RNA, 19 nt, Homo sapiens
gaaugacuaccucaaagug

SEQ ID NO: 781933 - RNA, 19 nt, Homo sapiens
gagcgucccuaucaauguc

SEQ ID NO: 781934 - RNA, 19 nt, Homo sapiens
agacaccugcuaauacaua

SEQ ID NO: 781935 - RNA, 19 nt, Homo sapiens
ccugaagacuuggaugaaa

SEQ ID NO: 781936 - RNA, 19 nt, Homo sapiens
aaagggauuugcccacaga

SEQ ID NO: 781937 - RNA, 19 nt, Homo sapiens
ucagugcucuguuugcaau

SEQ ID NO: 781938 - RNA, 19 nt, Homo sapiens
cugagcaucuccagacauu

SEQ ID NO: 781939 - RNA, 19 nt, Homo sapiens
ggaaugacuaccucaaagu

SEQ ID NO: 781940 - RNA, 19 nt, Homo sapiens
gcaaggccuucagccagaa

SEQ ID NO: 781941 - RNA, 19 nt, Homo sapiens
auaagaagacccacucuga

SEQ ID NO: 781942 - RNA, 19 nt, Homo sapiens
uaaagaggacuaugcuugu

SEQ ID NO: 781943 - RNA, 19 nt, Homo sapiens
cauaacagaaguagccaaa

SEQ ID NO: 781944 - RNA, 19 nt, Homo sapiens
agugggugcucacaaagua

SEQ ID NO: 781945 - RNA, 19 nt, Homo sapiens
gaaaagacaccaggaaaau

SEQ ID NO: 781946 - RNA, 19 nt, Homo sapiens
aaagaucgccuuggcugua

SEQ ID NO: 781947 - RNA, 19 nt, Homo sapiens
gcaguugaagauauagaaa

SEQ ID NO: 781948 - RNA, 19 nt, Homo sapiens
ucucauaguucuuauuugc

SEQ ID NO: 781949 - RNA, 19 nt, Homo sapiens
agaggaaggauacauuaaa

SEQ ID NO: 781950 - RNA, 19 nt, Homo sapiens
agagaccguuccaauguga

SEQ ID NO: 781951 - RNA, 19 nt, Homo sapiens
cgaagacaaaccuuacaaa

SEQ ID NO: 781952 - RNA, 19 nt, Homo sapiens
caauguccuuacugugaaa

SEQ ID NO: 781953 - RNA, 19 nt, Homo sapiens
caggugagcgucccuauca

SEQ ID NO: 781954 - RNA, 19 nt, Homo sapiens
gugaagaauguaaagcuuu

SEQ ID NO: 781955 - RNA, 19 nt, Homo sapiens
aagacaaaccuuacaaaug

SEQ ID NO: 781956 - RNA, 19 nt, Homo sapiens
gcuaaaacgucauaugauc

SEQ ID NO: 781957 - RNA, 19 nt, Homo sapiens
gcgaaagggugaaaaguuc

SEQ ID NO: 781958 - RNA, 19 nt, Homo sapiens
gaaguauaggugugagcua

SEQ ID NO: 781959 - RNA, 19 nt, Homo sapiens
gaggagaaagaauuuaagu

SEQ ID NO: 781960 - RNA, 19 nt, Homo sapiens
gaaauuagcuuugauggaa

SEQ ID NO: 781961 - RNA, 19 nt, Homo sapiens
caauggaaauguuggauua

SEQ ID NO: 781962 - RNA, 19 nt, Homo sapiens
aaagaaggcugaauaguga

SEQ ID NO: 781963 - RNA, 19 nt, Homo sapiens
ggagaucuuuguagguuua

SEQ ID NO: 781964 - RNA, 19 nt, Homo sapiens
gaauaaagcacuuacagaa

SEQ ID NO: 781965 - RNA, 19 nt, Homo sapiens
gcaaggagugcaauucuua

SEQ ID NO: 781966 - RNA, 19 nt, Homo sapiens
cuagaauucugcaucauua

SEQ ID NO: 781967 - RNA, 19 nt, Homo sapiens
caagauaucccuccugaaa

SEQ ID NO: 781968 - RNA, 19 nt, Homo sapiens
caccugggcugcuuuauuu

SEQ ID NO: 781969 - RNA, 19 nt, Homo sapiens
ggagagcaguuauuucaga

SEQ ID NO: 781970 - RNA, 19 nt, Homo sapiens
uaaagaagcaucucaauuc

SEQ ID NO: 781971 - RNA, 19 nt, Homo sapiens
gagaacaaaucacuuaaag

SEQ ID NO: 781972 - RNA, 19 nt, Homo sapiens
guaauuggaugauguuugu

SEQ ID NO: 781973 - RNA, 19 nt, Homo sapiens
ccaaauggcuccagaaguc

SEQ ID NO: 781974 - RNA, 19 nt, Homo sapiens
gcauuuaucugaaucaaag

SEQ ID NO: 781975 - RNA, 19 nt, Homo sapiens
caauaacccuucagcacua

SEQ ID NO: 781976 - RNA, 19 nt, Homo sapiens
ggacacagcagcauaagug

SEQ ID NO: 781977 - RNA, 19 nt, Homo sapiens
aggcuuaucuaaccaaaua

SEQ ID NO: 781978 - RNA, 19 nt, Homo sapiens
gaauguaauuggaugaugu

SEQ ID NO: 781979 - RNA, 19 nt, Homo sapiens
ccacaaugguguccuagaa

SEQ ID NO: 781980 - RNA, 19 nt, Homo sapiens
ggacagacaaggcaguuaa

SEQ ID NO: 781981 - RNA, 19 nt, Homo sapiens
cagaggagcuuacgaugga

SEQ ID NO: 781982 - RNA, 19 nt, Homo sapiens
ggaagaugccaaaggauuu

SEQ ID NO: 781983 - RNA, 19 nt, Homo sapiens
caagucaccugguuauugu

SEQ ID NO: 781984 - RNA, 19 nt, Homo sapiens
gaucaagugucccaagugu

SEQ ID NO: 781985 - RNA, 19 nt, Homo sapiens
gcaaagaaaggaaguggaa

SEQ ID NO: 781986 - RNA, 19 nt, Homo sapiens
aaauacacauacccaguua

SEQ ID NO: 781987 - RNA, 19 nt, Homo sapiens
gagcgcuccuucucugaua

SEQ ID NO: 781988 - RNA, 19 nt, Homo sapiens
uaaagaaggcugaauagug

SEQ ID NO: 781989 - RNA, 19 nt, Homo sapiens
ggaagggaauaaucuuuua

SEQ ID NO: 781990 - RNA, 19 nt, Homo sapiens
acagagagcccaaauaaug

SEQ ID NO: 781991 - RNA, 19 nt, Homo sapiens
aauaaugccugcuggauug

SEQ ID NO: 781992 - RNA, 19 nt, Homo sapiens
gcaagucaccugguuauug

SEQ ID NO: 781993 - RNA, 19 nt, Homo sapiens
ggaagaagaggaugacuca

SEQ ID NO: 781994 - RNA, 19 nt, Homo sapiens
auaaagcacuuacagaaga

SEQ ID NO: 781995 - RNA, 19 nt, Homo sapiens
ggacccaccucaagauaca

SEQ ID NO: 781996 - RNA, 19 nt, Homo sapiens
ugcagacucuugugacuua

SEQ ID NO: 781997 - RNA, 19 nt, Homo sapiens
ggacaggucauguagaugu

SEQ ID NO: 781998 - RNA, 19 nt, Homo sapiens
cacccuaacucuauaaaug

SEQ ID NO: 781999 - RNA, 19 nt, Homo sapiens
cauggaagaugccaaagga

SEQ ID NO: 782000 - RNA, 19 nt, Homo sapiens
auacagagagcccaaauaa

SEQ ID NO: 782001 - RNA, 19 nt, Homo sapiens
gugauaagcuguucuugag

SEQ ID NO: 782002 - RNA, 19 nt, Homo sapiens
ggagugcaauucuuacaca

SEQ ID NO: 782003 - RNA, 19 nt, Homo sapiens
gagcagaaguugguguaug

SEQ ID NO: 782004 - RNA, 19 nt, Homo sapiens
gagagcaguuauuucagaa

SEQ ID NO: 782005 - RNA, 19 nt, Homo sapiens
gaagcagacccacccuuaa

SEQ ID NO: 782006 - RNA, 19 nt, Homo sapiens
gaggcuuuauuacaugaua

SEQ ID NO: 782007 - RNA, 19 nt, Homo sapiens
agaagaggaugacucagaa

SEQ ID NO: 782008 - RNA, 19 nt, Homo sapiens
gaacauggaccagugacuu

SEQ ID NO: 782009 - RNA, 19 nt, Homo sapiens
acaaugguguccuagaauu

SEQ ID NO: 782010 - RNA, 19 nt, Homo sapiens
gaaccucugucuguggauu

SEQ ID NO: 782011 - RNA, 19 nt, Homo sapiens
ggacacagcaaucacuaug

SEQ ID NO: 782012 - RNA, 19 nt, Homo sapiens
cacaguacauccacccuaa

SEQ ID NO: 782013 - RNA, 19 nt, Homo sapiens
ucaaaucuguauuccucua

SEQ ID NO: 782014 - RNA, 19 nt, Homo sapiens
ggaaugaauaaagcacuua

SEQ ID NO: 782015 - RNA, 19 nt, Homo sapiens
guggagaucuuuguagguu

SEQ ID NO: 782016 - RNA, 19 nt, Homo sapiens
acacauacccaguuaucua

SEQ ID NO: 782017 - RNA, 19 nt, Homo sapiens
acaaggcaguuaaccauau

SEQ ID NO: 782018 - RNA, 19 nt, Homo sapiens
gacaggucauguagaugua

SEQ ID NO: 782019 - RNA, 19 nt, Homo sapiens
gaaggaagggaauaaucuu

SEQ ID NO: 782020 - RNA, 19 nt, Homo sapiens
ggaaggaagggaauaaucu

SEQ ID NO: 782021 - RNA, 19 nt, Homo sapiens
guaaacauccagccauuca

SEQ ID NO: 782022 - RNA, 19 nt, Homo sapiens
gauggaagccugagcaagu

SEQ ID NO: 782023 - RNA, 19 nt, Homo sapiens
ucacauucuuccauuauuc

SEQ ID NO: 782024 - RNA, 19 nt, Homo sapiens
ggacugggagggaagugua

SEQ ID NO: 782025 - RNA, 19 nt, Homo sapiens
gggaaugaauaaagcacuu

SEQ ID NO: 782026 - RNA, 19 nt, Homo sapiens
guacaaaggcuuaucuaac

SEQ ID NO: 782027 - RNA, 19 nt, Homo sapiens
cauccacccuaacucuaua

SEQ ID NO: 782028 - RNA, 19 nt, Homo sapiens
gauugucuccugaugagua

SEQ ID NO: 782029 - RNA, 19 nt, Homo sapiens
gauacagagagcccaaaua

SEQ ID NO: 782030 - RNA, 19 nt, Homo sapiens
caguaaacauccagccauu

SEQ ID NO: 782031 - RNA, 19 nt, Homo sapiens
gcaucucaauucucaugaa

SEQ ID NO: 782032 - RNA, 19 nt, Homo sapiens
ucaagugucccaaguguga

SEQ ID NO: 782033 - RNA, 19 nt, Homo sapiens
ccaagucacagcaaagaaa

SEQ ID NO: 782034 - RNA, 19 nt, Homo sapiens
ccacauccauaaccaucuu

SEQ ID NO: 782035 - RNA, 19 nt, Homo sapiens
agaagcagacccacccuua

SEQ ID NO: 782036 - RNA, 19 nt, Homo sapiens
gcacauccagcguuucuca

SEQ ID NO: 782037 - RNA, 19 nt, Homo sapiens
gagcaagucaccugguuau

SEQ ID NO: 782038 - RNA, 19 nt, Homo sapiens
agauuaugcucaacagauu

SEQ ID NO: 782039 - RNA, 19 nt, Homo sapiens
gagauuaugcucaacagau

SEQ ID NO: 782040 - RNA, 19 nt, Homo sapiens
acacagcaaucacuaugga

SEQ ID NO: 782041 - RNA, 19 nt, Homo sapiens
gaagggaaggaagggaaua

SEQ ID NO: 782042 - RNA, 19 nt, Homo sapiens
gagagcagagcaaggcuuu

SEQ ID NO: 782043 - RNA, 19 nt, Homo sapiens
caaccuugccucccuagaa

SEQ ID NO: 782044 - RNA, 19 nt, Homo sapiens
caagaaauuagcuuugaug

SEQ ID NO: 782045 - RNA, 19 nt, Homo sapiens
caaaucacuuaaagaagca

SEQ ID NO: 782046 - RNA, 19 nt, Homo sapiens
gggaagagcagaauuuggu

SEQ ID NO: 782047 - RNA, 19 nt, Homo sapiens
gacaaggcaguuaaccaua

SEQ ID NO: 782048 - RNA, 19 nt, Homo sapiens
gcagacccacccuuaaguu

SEQ ID NO: 782049 - RNA, 19 nt, Homo sapiens
uaacguggagaucuuugua

SEQ ID NO: 782050 - RNA, 19 nt, Homo sapiens
ccaagaaauuagcuuugau

SEQ ID NO: 782051 - RNA, 19 nt, Homo sapiens
cccaagaaauuagcuuuga

SEQ ID NO: 782052 - RNA, 19 nt, Homo sapiens
cuuggcagcuaguaaguuu

SEQ ID NO: 782053 - RNA, 19 nt, Homo sapiens
ucucaauucucaugaagga

SEQ ID NO: 782054 - RNA, 19 nt, Homo sapiens
caagaacgccagaucaagu

SEQ ID NO: 782055 - RNA, 19 nt, Homo sapiens
uggaagauauaccacaaug

SEQ ID NO: 782056 - RNA, 19 nt, Homo sapiens
ugauuacugugacaaguug

SEQ ID NO: 782057 - RNA, 19 nt, Homo sapiens
gaaguggaagugcucaaug

SEQ ID NO: 782058 - RNA, 19 nt, Homo sapiens
ugacaggauugauggaaca

SEQ ID NO: 782059 - RNA, 19 nt, Homo sapiens
uaacuucugaggcuuuauu

SEQ ID NO: 782060 - RNA, 19 nt, Homo sapiens
gaacaacacucauggcuaa

SEQ ID NO: 782061 - RNA, 19 nt, Homo sapiens
gaagaagggcucauuauua

SEQ ID NO: 782062 - RNA, 19 nt, Homo sapiens
aaacauggcuauccacuua

SEQ ID NO: 782063 - RNA, 19 nt, Homo sapiens
gcaaagggcuacucaaaga

SEQ ID NO: 782064 - RNA, 19 nt, Homo sapiens
gcaaagaucugcaacaaca

SEQ ID NO: 782065 - RNA, 19 nt, Homo sapiens
aagaagggcucauuauuaa

SEQ ID NO: 782066 - RNA, 19 nt, Homo sapiens
gaggagaccuucugagugu

SEQ ID NO: 782067 - RNA, 19 nt, Homo sapiens
ucaaugcaauagaagcuua

SEQ ID NO: 782068 - RNA, 19 nt, Homo sapiens
gcuguuagcuauuaguaug

SEQ ID NO: 782069 - RNA, 19 nt, Homo sapiens
gggaggaguugaagaugaa

SEQ ID NO: 782070 - RNA, 19 nt, Homo sapiens
gguuagggcuugacccaaa

SEQ ID NO: 782071 - RNA, 19 nt, Homo sapiens
gcacaagacucugcuacca

SEQ ID NO: 782072 - RNA, 19 nt, Homo sapiens
gagcaaaugggauucuaaa

SEQ ID NO: 782073 - RNA, 19 nt, Homo sapiens
cagcauggcagccuccuua

SEQ ID NO: 782074 - RNA, 19 nt, Homo sapiens
caaaagaauuggccaaaga

SEQ ID NO: 782075 - RNA, 19 nt, Homo sapiens
ccaaagaaguugagaaaau

SEQ ID NO: 782076 - RNA, 19 nt, Homo sapiens
ggacgguguuggucaagug

SEQ ID NO: 782077 - RNA, 19 nt, Homo sapiens
ggccaaagaaguugagaaa

SEQ ID NO: 782078 - RNA, 19 nt, Homo sapiens
ugaagaagggcucauuauu

SEQ ID NO: 782079 - RNA, 19 nt, Homo sapiens
caguaucaaugcaauagaa

SEQ ID NO: 782080 - RNA, 19 nt, Homo sapiens
gugaacagguaguaucuuc

SEQ ID NO: 782081 - RNA, 19 nt, Homo sapiens
uuagcucacuccacaagua

SEQ ID NO: 782082 - RNA, 19 nt, Homo sapiens
caacacucauggcuaagga

SEQ ID NO: 782083 - RNA, 19 nt, Homo sapiens
cggcaaagaucugcaacaa

SEQ ID NO: 782084 - RNA, 19 nt, Homo sapiens
ggaaccaaacucugucuug

SEQ ID NO: 782085 - RNA, 19 nt, Homo sapiens
gugcaaagggcuacucaaa

SEQ ID NO: 782086 - RNA, 19 nt, Homo sapiens
ggcguucccucggcuaaua

SEQ ID NO: 782087 - RNA, 19 nt, Homo sapiens
uguaggagcugcacgaucu

SEQ ID NO: 782088 - RNA, 19 nt, Homo sapiens
agaauuggccaaagaaguu

SEQ ID NO: 782089 - RNA, 19 nt, Homo sapiens
caaagaguuucaagaugca

SEQ ID NO: 782090 - RNA, 19 nt, Homo sapiens
gauuggaacugcugaagcu

SEQ ID NO: 782091 - RNA, 19 nt, Homo sapiens
gcuauuaguaugauuggaa

SEQ ID NO: 782092 - RNA, 19 nt, Homo sapiens
caaagaaguugagaaaaug

SEQ ID NO: 782093 - RNA, 19 nt, Homo sapiens
agaugcaggugaacaggua

SEQ ID NO: 782094 - RNA, 19 nt, Homo sapiens
gaacugcugaagcuaugaa

SEQ ID NO: 782095 - RNA, 19 nt, Homo sapiens
cuaggucaguggcuucaaa

SEQ ID NO: 782096 - RNA, 19 nt, Homo sapiens
ggagcaaaugggauucuaa

SEQ ID NO: 782097 - RNA, 19 nt, Homo sapiens
gaucugggauuggcacaag

SEQ ID NO: 782098 - RNA, 19 nt, Homo sapiens
gaaacauggcuauccacuu

SEQ ID NO: 782099 - RNA, 19 nt, Homo sapiens
gcugacagaauuauuacaa

SEQ ID NO: 782100 - RNA, 19 nt, Homo sapiens
caaaacuacuggcuaaaau

SEQ ID NO: 782101 - RNA, 19 nt, Homo sapiens
cugggaaccucacguuuau

SEQ ID NO: 782102 - RNA, 19 nt, Homo sapiens
ucugggaaccucacguuua

SEQ ID NO: 782103 - RNA, 19 nt, Homo sapiens
ggcuauccacuuauuauuu

SEQ ID NO: 782104 - RNA, 19 nt, Homo sapiens
uuaauagauuccagcacua

SEQ ID NO: 782105 - RNA, 19 nt, Homo sapiens
uaugauguguucccugaug

SEQ ID NO: 782106 - RNA, 19 nt, Homo sapiens
gaagcuaugaaucuuggaa

SEQ ID NO: 782107 - RNA, 19 nt, Homo sapiens
gcuccaacgugguguacug

SEQ ID NO: 782108 - RNA, 19 nt, Homo sapiens
ucucauccguguuccaguu

SEQ ID NO: 782109 - RNA, 19 nt, Homo sapiens
ugggaggaguugaagauga

SEQ ID NO: 782110 - RNA, 19 nt, Homo sapiens
gaucugggaaccucacguu

SEQ ID NO: 782111 - RNA, 19 nt, Homo sapiens
ccaccaguaucaaugcaau

SEQ ID NO: 782112 - RNA, 19 nt, Homo sapiens
gugaagaagggcucauuau

SEQ ID NO: 782113 - RNA, 19 nt, Homo sapiens
aaagggcuacucaaagaaa

SEQ ID NO: 782114 - RNA, 19 nt, Homo sapiens
caaagggcuacucaaagaa

SEQ ID NO: 782115 - RNA, 19 nt, Homo sapiens
gcagcgguguguucuaggu

SEQ ID NO: 782116 - RNA, 19 nt, Homo sapiens
uaacuaucaggguggauuu

SEQ ID NO: 782117 - RNA, 19 nt, Homo sapiens
ggauuuggaacaacacuca

SEQ ID NO: 782118 - RNA, 19 nt, Homo sapiens
ccugaugccugcaaagagu

SEQ ID NO: 782119 - RNA, 19 nt, Homo sapiens
acauggcuauccacuuauu

SEQ ID NO: 782120 - RNA, 19 nt, Homo sapiens
gcacaaagagcccaauccu

SEQ ID NO: 782121 - RNA, 19 nt, Homo sapiens
gguguacuguggagcuguu

SEQ ID NO: 782122 - RNA, 19 nt, Homo sapiens
ugcaaagaguuucaagaug

SEQ ID NO: 782123 - RNA, 19 nt, Homo sapiens
ucaggacgguguuggucaa

SEQ ID NO: 782124 - RNA, 19 nt, Homo sapiens
gaaucuuggaaucagguua

SEQ ID NO: 782125 - RNA, 19 nt, Homo sapiens
caggguggauuuggaacaa

SEQ ID NO: 782126 - RNA, 19 nt, Homo sapiens
gucaguggcuucaaagacu

SEQ ID NO: 782127 - RNA, 19 nt, Homo sapiens
gagaggaggagaccuucug

SEQ ID NO: 782128 - RNA, 19 nt, Homo sapiens
ggcuaaggaucugggauug

SEQ ID NO: 782129 - RNA, 19 nt, Homo sapiens
gcuaugaaucuuggaauca

SEQ ID NO: 782130 - RNA, 19 nt, Homo sapiens
acaaugcugcccaccagua

SEQ ID NO: 782131 - RNA, 19 nt, Homo sapiens
gggauuggcacaagacucu

SEQ ID NO: 782132 - RNA, 19 nt, Homo sapiens
uggaacugcugaagcuaug

SEQ ID NO: 782133 - RNA, 19 nt, Homo sapiens
gaauuggccaaagaaguug

SEQ ID NO: 782134 - RNA, 19 nt, Homo sapiens
gcacacgcucgcagucugu

SEQ ID NO: 782135 - RNA, 19 nt, Homo sapiens
ggugggaggaguugaagau

SEQ ID NO: 782136 - RNA, 19 nt, Homo sapiens
cugcaaagaguuucaagau

SEQ ID NO: 782137 - RNA, 19 nt, Homo sapiens
uagcucacuccacaaguaa

SEQ ID NO: 782138 - RNA, 19 nt, Homo sapiens
ggguggauuuggaacaaca

SEQ ID NO: 782139 - RNA, 19 nt, Homo sapiens
gaaucagguuagggcuuga

SEQ ID NO: 782140 - RNA, 19 nt, Homo sapiens
aaagaucugcaacaacaug

SEQ ID NO: 782141 - RNA, 19 nt, Homo sapiens
gggaaccucacguuuaugg

SEQ ID NO: 782142 - RNA, 19 nt, Homo sapiens
gcucacuccacaaguaaau

SEQ ID NO: 782143 - RNA, 19 nt, Homo sapiens
cccaucagaucuacaggau

SEQ ID NO: 782144 - RNA, 19 nt, Homo sapiens
caaagagcccaauccuucu

SEQ ID NO: 782145 - RNA, 19 nt, Homo sapiens
ucccucggcuaauaacuau

SEQ ID NO: 782146 - RNA, 19 nt, Homo sapiens
cggagcaaaugggauucua

SEQ ID NO: 782147 - RNA, 19 nt, Homo sapiens
agacuucucauccguguuc

SEQ ID NO: 782148 - RNA, 19 nt, Homo sapiens
gcugaagcuaugaaucuug

SEQ ID NO: 782149 - RNA, 19 nt, Homo sapiens
cacuauugauccugcaguu

SEQ ID NO: 782150 - RNA, 19 nt, Homo sapiens
caaugcugcccaccaguau

SEQ ID NO: 782151 - RNA, 19 nt, Homo sapiens
cuauugauccugcaguuuc

SEQ ID NO: 782152 - RNA, 19 nt, Homo sapiens
uagauuccagcacuauuga

SEQ ID NO: 782153 - RNA, 19 nt, Homo sapiens
agugaagaagggcucauua

SEQ ID NO: 782154 - RNA, 19 nt, Homo sapiens
uaucaggguggauuuggaa

SEQ ID NO: 782155 - RNA, 19 nt, Homo sapiens
ggaguugaagaugaauuug

SEQ ID NO: 782156 - RNA, 19 nt, Homo sapiens
gagaaaaugggagcaguuu

SEQ ID NO: 782157 - RNA, 19 nt, Homo sapiens
cauggcuauccacuuauua

SEQ ID NO: 782158 - RNA, 19 nt, Homo sapiens
uauugauccugcaguuuca

SEQ ID NO: 782159 - RNA, 19 nt, Homo sapiens
gacagaauuauuacaaugc

SEQ ID NO: 782160 - RNA, 19 nt, Homo sapiens
ggaaggagauucuuucuuu

SEQ ID NO: 782161 - RNA, 19 nt, Homo sapiens
gaauuuagcccgagauuua

SEQ ID NO: 782162 - RNA, 19 nt, Homo sapiens
gaugaaaggugucaauaaa

SEQ ID NO: 782163 - RNA, 19 nt, Homo sapiens
ucagugauguugcggauua

SEQ ID NO: 782164 - RNA, 19 nt, Homo sapiens
gcacagacaacaccaagua

SEQ ID NO: 782165 - RNA, 19 nt, Homo sapiens
ggacugaccgguuccauuu

SEQ ID NO: 782166 - RNA, 19 nt, Homo sapiens
gcagaaggcuggugacaag

SEQ ID NO: 782167 - RNA, 19 nt, Homo sapiens
caaagacggucguuuagug

SEQ ID NO: 782168 - RNA, 19 nt, Homo sapiens
gagauucuuucuuugauga

SEQ ID NO: 782169 - RNA, 19 nt, Homo sapiens
gaaggagauucuuucuuug

SEQ ID NO: 782170 - RNA, 19 nt, Homo sapiens
gugaagagauagaagaaga

SEQ ID NO: 782171 - RNA, 19 nt, Homo sapiens
gcccauguguggaagauuu

SEQ ID NO: 782172 - RNA, 19 nt, Homo sapiens
gaaggaaccuaggaagcaa

SEQ ID NO: 782173 - RNA, 19 nt, Homo sapiens
ggaaauugauuaucuacac

SEQ ID NO: 782174 - RNA, 19 nt, Homo sapiens
gagaagaugaugacuaugu

SEQ ID NO: 782175 - RNA, 19 nt, Homo sapiens
uggagaagaugaugacuau

SEQ ID NO: 782176 - RNA, 19 nt, Homo sapiens
gaaugucugcucucuauug

SEQ ID NO: 782177 - RNA, 19 nt, Homo sapiens
ucacucagcuggaaugucu

SEQ ID NO: 782178 - RNA, 19 nt, Homo sapiens
gacaaucacucagcuggaa

SEQ ID NO: 782179 - RNA, 19 nt, Homo sapiens
uaccaaagacggucguuua

SEQ ID NO: 782180 - RNA, 19 nt, Homo sapiens
uggaaugucugcucucuau

SEQ ID NO: 782181 - RNA, 19 nt, Homo sapiens
ggagauucuuucuuugaug

SEQ ID NO: 782182 - RNA, 19 nt, Homo sapiens
gacaacaccaaguaagaua

SEQ ID NO: 782183 - RNA, 19 nt, Homo sapiens
gguggacccuuauuauuag

SEQ ID NO: 782184 - RNA, 19 nt, Homo sapiens
ggaagauguugcauagaca

SEQ ID NO: 782185 - RNA, 19 nt, Homo sapiens
cacaagaucugacuguauc

SEQ ID NO: 782186 - RNA, 19 nt, Homo sapiens
gaugaugacuauguugaug

SEQ ID NO: 782187 - RNA, 19 nt, Homo sapiens
agaugaagaugauauggaa

SEQ ID NO: 782188 - RNA, 19 nt, Homo sapiens
acaagaaggccaaugauga

SEQ ID NO: 782189 - RNA, 19 nt, Homo sapiens
ggaaggugcacuugaucua

SEQ ID NO: 782190 - RNA, 19 nt, Homo sapiens
gcauagacacgaagaagga

SEQ ID NO: 782191 - RNA, 19 nt, Homo sapiens
ugagauaaguauuggugaa

SEQ ID NO: 782192 - RNA, 19 nt, Homo sapiens
gaacuggagaagaugauga

SEQ ID NO: 782193 - RNA, 19 nt, Homo sapiens
caaaagcagccuucacuua

SEQ ID NO: 782194 - RNA, 19 nt, Homo sapiens
guuaagagcaugaugaaag

SEQ ID NO: 782195 - RNA, 19 nt, Homo sapiens
agaagaugaugacuauguu

SEQ ID NO: 782196 - RNA, 19 nt, Homo sapiens
ggaaggaaccuaggaagca

SEQ ID NO: 782197 - RNA, 19 nt, Homo sapiens
gauguugcauagacacgaa

SEQ ID NO: 782198 - RNA, 19 nt, Homo sapiens
caaagucaccagagggaaa

SEQ ID NO: 782199 - RNA, 19 nt, Homo sapiens
ugaaaggugucaauaaagc

SEQ ID NO: 782200 - RNA, 19 nt, Homo sapiens
aaguauuggugaagagaua

SEQ ID NO: 782201 - RNA, 19 nt, Homo sapiens
gaagaugaugacuauguug

SEQ ID NO: 782202 - RNA, 19 nt, Homo sapiens
gcacuugaucuaucugaug

SEQ ID NO: 782203 - RNA, 19 nt, Homo sapiens
uugaugaccucacacaaga

SEQ ID NO: 782204 - RNA, 19 nt, Homo sapiens
gaaggcuggugacaagaag

SEQ ID NO: 782205 - RNA, 19 nt, Homo sapiens
ggacaagguaagaagaaga

SEQ ID NO: 782206 - RNA, 19 nt, Homo sapiens
gauuaucuacacucaguuu

SEQ ID NO: 782207 - RNA, 19 nt, Homo sapiens
gauaaguauuggugaagag

SEQ ID NO: 782208 - RNA, 19 nt, Homo sapiens
gaaggugcacuugaucuau

SEQ ID NO: 782209 - RNA, 19 nt, Homo sapiens
ugaugaaaggugucaauaa

SEQ ID NO: 782210 - RNA, 19 nt, Homo sapiens
caauaccagugauaagcuu

SEQ ID NO: 782211 - RNA, 19 nt, Homo sapiens
gcccgagauuuagguauaa

SEQ ID NO: 782212 - RNA, 19 nt, Homo sapiens
ucuggaagauguugcauag

SEQ ID NO: 782213 - RNA, 19 nt, Homo sapiens
gacaagaaggccaaugaug

SEQ ID NO: 782214 - RNA, 19 nt, Homo sapiens
gaaggucgagagaauuuag

SEQ ID NO: 782215 - RNA, 19 nt, Homo sapiens
ccagugauaagcuugauga

SEQ ID NO: 782216 - RNA, 19 nt, Homo sapiens
aauuggaucacuuggauua

SEQ ID NO: 782217 - RNA, 19 nt, Homo sapiens
gcacuagaggagcaagaaa

SEQ ID NO: 782218 - RNA, 19 nt, Homo sapiens
gauguacauucuccaccaa

SEQ ID NO: 782219 - RNA, 19 nt, Homo sapiens
ucacuuggauuaggaacug

SEQ ID NO: 782220 - RNA, 19 nt, Homo sapiens
gguauaaaggacaagguaa

SEQ ID NO: 782221 - RNA, 19 nt, Homo sapiens
ugaucuaucugauguacau

SEQ ID NO: 782222 - RNA, 19 nt, Homo sapiens
acacgaagaaggaaguauu

SEQ ID NO: 782223 - RNA, 19 nt, Homo sapiens
gacuuuacuuuggcuguuu

SEQ ID NO: 782224 - RNA, 19 nt, Homo sapiens
cgagauuuagguauaauug

SEQ ID NO: 782225 - RNA, 19 nt, Homo sapiens
gagaauuuagcccgagauu

SEQ ID NO: 782226 - RNA, 19 nt, Homo sapiens
cacacaagaucugacugua

SEQ ID NO: 782227 - RNA, 19 nt, Homo sapiens
gagaaaagugagauaagua

SEQ ID NO: 782228 - RNA, 19 nt, Homo sapiens
caagaaggccaaugaugag

SEQ ID NO: 782229 - RNA, 19 nt, Homo sapiens
ucuacacucaguuucauua

SEQ ID NO: 782230 - RNA, 19 nt, Homo sapiens
aaagugagauaaguauugg

SEQ ID NO: 782231 - RNA, 19 nt, Homo sapiens
auuaggaacuggagaagau

SEQ ID NO: 782232 - RNA, 19 nt, Homo sapiens
gggagccccuucuuuaaaa

SEQ ID NO: 782233 - RNA, 19 nt, Homo sapiens
gugacaagaaggccaauga

SEQ ID NO: 782234 - RNA, 19 nt, Homo sapiens
cagacaacaccaaguaaga

SEQ ID NO: 782235 - RNA, 19 nt, Homo sapiens
agcccgagauuuagguaua

SEQ ID NO: 782236 - RNA, 19 nt, Homo sapiens
uugaugaucccauuccuaa

SEQ ID NO: 782237 - RNA, 19 nt, Homo sapiens
ucuaagcaacagaacuuua

SEQ ID NO: 782238 - RNA, 19 nt, Homo sapiens
uggaagauguugcauagac

SEQ ID NO: 782239 - RNA, 19 nt, Homo sapiens
ugucagaacccaagagcaa

SEQ ID NO: 782240 - RNA, 19 nt, Homo sapiens
uaaaggacaagguaagaag

SEQ ID NO: 782241 - RNA, 19 nt, Homo sapiens
ggacccuuauuauuagaag

SEQ ID NO: 782242 - RNA, 19 nt, Homo sapiens
uuuaguggcuagucuuguu

SEQ ID NO: 782243 - RNA, 19 nt, Homo sapiens
uuaagagcaugaugaaagg

SEQ ID NO: 782244 - RNA, 19 nt, Homo sapiens
uaaccuugacuuuacuuug

SEQ ID NO: 782245 - RNA, 19 nt, Homo sapiens
agagauagaagaagaccuu

SEQ ID NO: 782246 - RNA, 19 nt, Homo sapiens
ugacuuuacuuuggcuguu

SEQ ID NO: 782247 - RNA, 19 nt, Homo sapiens
ggaaggaacccaugaaaac

SEQ ID NO: 782248 - RNA, 19 nt, Homo sapiens
acacucaguuucauuacag

SEQ ID NO: 782249 - RNA, 19 nt, Homo sapiens
uaucccagcucagugaugu

SEQ ID NO: 782250 - RNA, 19 nt, Homo sapiens
acacaagaucugacuguau

SEQ ID NO: 782251 - RNA, 19 nt, Homo sapiens
gaugauauggaaggagauu

SEQ ID NO: 782252 - RNA, 19 nt, Homo sapiens
cacuugaucuaucugaugu

SEQ ID NO: 782253 - RNA, 19 nt, Homo sapiens
uaagcuugaugaccucaca

SEQ ID NO: 782254 - RNA, 19 nt, Homo sapiens
ggaaauacaguuuugaaag

SEQ ID NO: 782255 - RNA, 19 nt, Homo sapiens
aaggagauucuuucuuuga

SEQ ID NO: 782256 - RNA, 19 nt, Homo sapiens
ccaaguaagauaccaaggu

SEQ ID NO: 782257 - RNA, 19 nt, Homo sapiens
uugauuaucuacacucagu

SEQ ID NO: 782258 - RNA, 19 nt, Homo sapiens
gagcccauguguggaagau

SEQ ID NO: 782259 - RNA, 19 nt, Homo sapiens
gaagacaagcgggcagaag

SEQ ID NO: 782260 - RNA, 19 nt, Homo sapiens
gaauaaagacacuugguuu

SEQ ID NO: 782261 - RNA, 19 nt, Homo sapiens
gcagggugcuggacaguga

SEQ ID NO: 782262 - RNA, 19 nt, Homo sapiens
ugagacagcugcagaguuc

SEQ ID NO: 782263 - RNA, 19 nt, Homo sapiens
acuaaacgaucgaggaaua

SEQ ID NO: 782264 - RNA, 19 nt, Homo sapiens
ccacagagcaugcuacaga

SEQ ID NO: 782265 - RNA, 19 nt, Homo sapiens
ggaauaaagacacuugguu

SEQ ID NO: 782266 - RNA, 19 nt, Homo sapiens
gauggaggcuauuaugauc

SEQ ID NO: 782267 - RNA, 19 nt, Homo sapiens
acagaguccugcucaauga

SEQ ID NO: 782268 - RNA, 19 nt, Homo sapiens
cugagggccuggagaauaa

SEQ ID NO: 782269 - RNA, 19 nt, Homo sapiens
gcucaaugauggaggcuau

SEQ ID NO: 782270 - RNA, 19 nt, Homo sapiens
ccaaggaccguaucauuuc

SEQ ID NO: 782271 - RNA, 19 nt, Homo sapiens
cguaucauuucugagauua

SEQ ID NO: 782272 - RNA, 19 nt, Homo sapiens
gaccguaucauuucugaga

SEQ ID NO: 782273 - RNA, 19 nt, Homo sapiens
gcgagggccuuuccagaca

SEQ ID NO: 782274 - RNA, 19 nt, Homo sapiens
ucaaugauggaggcuauua

SEQ ID NO: 782275 - RNA, 19 nt, Homo sapiens
aggauggaguggagacaua

SEQ ID NO: 782276 - RNA, 19 nt, Homo sapiens
ucaaugacucacugaauga

SEQ ID NO: 782277 - RNA, 19 nt, Homo sapiens
gacagaguccugcucaaug

SEQ ID NO: 782278 - RNA, 19 nt, Homo sapiens
ggacggcuucagcguguuu

SEQ ID NO: 782279 - RNA, 19 nt, Homo sapiens
cucaaugacucacugaaug

SEQ ID NO: 782280 - RNA, 19 nt, Homo sapiens
ggaggugcugucaggguua

SEQ ID NO: 782281 - RNA, 19 nt, Homo sapiens
caacaccaccagccagaug

SEQ ID NO: 782282 - RNA, 19 nt, Homo sapiens
ccugagggccuggagaaua

SEQ ID NO: 782283 - RNA, 19 nt, Homo sapiens
caaggaccguaucauuucu

SEQ ID NO: 782284 - RNA, 19 nt, Homo sapiens
ggagggauuacaagagguu

SEQ ID NO: 782285 - RNA, 19 nt, Homo sapiens
ggagcugggucaccucaac

SEQ ID NO: 782286 - RNA, 19 nt, Homo sapiens
guggugacccggacaguga

SEQ ID NO: 782287 - RNA, 19 nt, Homo sapiens
ggcgaugacugugcugaga

SEQ ID NO: 782288 - RNA, 19 nt, Homo sapiens
cgacagaguccugcucaau

SEQ ID NO: 782289 - RNA, 19 nt, Homo sapiens
gugaacgguuggacacugu

SEQ ID NO: 782290 - RNA, 19 nt, Homo sapiens
uaaacgaucgaggaauaaa

SEQ ID NO: 782291 - RNA, 19 nt, Homo sapiens
acacuacggcugaaucuca

SEQ ID NO: 782292 - RNA, 19 nt, Homo sapiens
gaggugcugucaggguuau

SEQ ID NO: 782293 - RNA, 19 nt, Homo sapiens
ccguaucauuucugagauu

SEQ ID NO: 782294 - RNA, 19 nt, Homo sapiens
accaaggaccguaucauuu

SEQ ID NO: 782295 - RNA, 19 nt, Homo sapiens
cgaggaauaaagacacuug

SEQ ID NO: 782296 - RNA, 19 nt, Homo sapiens
aaccaaggaccguaucauu

SEQ ID NO: 782297 - RNA, 19 nt, Homo sapiens
gagguuauucucagcuuca

SEQ ID NO: 782298 - RNA, 19 nt, Homo sapiens
ugcaugaaacccucaauga

SEQ ID NO: 782299 - RNA, 19 nt, Homo sapiens
gcaggaggccacagagcau

SEQ ID NO: 782300 - RNA, 19 nt, Homo sapiens
cuaaacgaucgaggaauaa

SEQ ID NO: 782301 - RNA, 19 nt, Homo sapiens
ccaccgccauacuaaacga

SEQ ID NO: 782302 - RNA, 19 nt, Homo sapiens
ugcagagccugaccaagga

SEQ ID NO: 782303 - RNA, 19 nt, Homo sapiens
gcuaccguguggccuacaa

SEQ ID NO: 782304 - RNA, 19 nt, Homo sapiens
ugauggaggcuauuaugau

SEQ ID NO: 782305 - RNA, 19 nt, Homo sapiens
acaagacagugaccgacau

SEQ ID NO: 782306 - RNA, 19 nt, Homo sapiens
gcaaccaaggaccguauca

SEQ ID NO: 782307 - RNA, 19 nt, Homo sapiens
aggccacgcuggagggauu

SEQ ID NO: 782308 - RNA, 19 nt, Homo sapiens
ggauggaguggagacauau

SEQ ID NO: 782309 - RNA, 19 nt, Homo sapiens
gggcugcuggccaauguga

SEQ ID NO: 782310 - RNA, 19 nt, Homo sapiens
cgaugacugugcugagagu

SEQ ID NO: 782311 - RNA, 19 nt, Homo sapiens
caagacagugaccgacaug

SEQ ID NO: 782312 - RNA, 19 nt, Homo sapiens
gggcaaccaaggaccguau

SEQ ID NO: 782313 - RNA, 19 nt, Homo sapiens
auacuaaacgaucgaggaa

SEQ ID NO: 782314 - RNA, 19 nt, Homo sapiens
caaugauggaggcuauuau

SEQ ID NO: 782315 - RNA, 19 nt, Homo sapiens
ccucaaugacucacugaau

SEQ ID NO: 782316 - RNA, 19 nt, Homo sapiens
cuauuaugauccagagaca

SEQ ID NO: 782317 - RNA, 19 nt, Homo sapiens
gcugcagaguucacacuac

SEQ ID NO: 782318 - RNA, 19 nt, Homo sapiens
gugcaugaaacccucaaug

SEQ ID NO: 782319 - RNA, 19 nt, Homo sapiens
uacgucggcugaagagaca

SEQ ID NO: 782320 - RNA, 19 nt, Homo sapiens
aaugauggaggcuauuaug

SEQ ID NO: 782321 - RNA, 19 nt, Homo sapiens
agacagugaccgacaugga

SEQ ID NO: 782322 - RNA, 19 nt, Homo sapiens
gaaauaagccuaagagaga

SEQ ID NO: 782323 - RNA, 19 nt, Homo sapiens
gauggugacuucuaugaaa

SEQ ID NO: 782324 - RNA, 19 nt, Homo sapiens
gcucaugccuguaauccua

SEQ ID NO: 782325 - RNA, 19 nt, Homo sapiens
gaacguguaugcagaugga

SEQ ID NO: 782326 - RNA, 19 nt, Homo sapiens
gcacuggguucuaaucuuc

SEQ ID NO: 782327 - RNA, 19 nt, Homo sapiens
ccagugagauagaaaguga

SEQ ID NO: 782328 - RNA, 19 nt, Homo sapiens
gaacaucccagcuguggaa

SEQ ID NO: 782329 - RNA, 19 nt, Homo sapiens
caacagagcgggaaauaag

SEQ ID NO: 782330 - RNA, 19 nt, Homo sapiens
gaggaaaugcuucagauga

SEQ ID NO: 782331 - RNA, 19 nt, Homo sapiens
gaaaugggauaugcugcaa

SEQ ID NO: 782332 - RNA, 19 nt, Homo sapiens
gcuccaccuuguuaaauaa

SEQ ID NO: 782333 - RNA, 19 nt, Homo sapiens
ccaagauggugacuucuau

SEQ ID NO: 782334 - RNA, 19 nt, Homo sapiens
ucaagaccauccuggcuaa

SEQ ID NO: 782335 - RNA, 19 nt, Homo sapiens
gaaaagacagccagcauuu

SEQ ID NO: 782336 - RNA, 19 nt, Homo sapiens
guaugcagauggaaaggaa

SEQ ID NO: 782337 - RNA, 19 nt, Homo sapiens
gagcaagagaugaaagaaa

SEQ ID NO: 782338 - RNA, 19 nt, Homo sapiens
ggagacaacagaaggaaau

SEQ ID NO: 782339 - RNA, 19 nt, Homo sapiens
ggcuccaccuuguuaaaua

SEQ ID NO: 782340 - RNA, 19 nt, Homo sapiens
gaaguagcagcaucuguga

SEQ ID NO: 782341 - RNA, 19 nt, Homo sapiens
ggagugggccuauaugaag

SEQ ID NO: 782342 - RNA, 19 nt, Homo sapiens
gauagaaagugagcaagag

SEQ ID NO: 782343 - RNA, 19 nt, Homo sapiens
ugaaagaaaugggauaugc

SEQ ID NO: 782344 - RNA, 19 nt, Homo sapiens
gaggguguauccugcauca

SEQ ID NO: 782345 - RNA, 19 nt, Homo sapiens
cagcagcucaugccuguaa

SEQ ID NO: 782346 - RNA, 19 nt, Homo sapiens
gaggagucuucguccgaua

SEQ ID NO: 782347 - RNA, 19 nt, Homo sapiens
gcaacagagcgggaaauaa

SEQ ID NO: 782348 - RNA, 19 nt, Homo sapiens
aggaggaacucaagaggaa

SEQ ID NO: 782349 - RNA, 19 nt, Homo sapiens
agcaagagaugaaagaaau

SEQ ID NO: 782350 - RNA, 19 nt, Homo sapiens
gaaagugagcaagagauga

SEQ ID NO: 782351 - RNA, 19 nt, Homo sapiens
ggaagcaccugugguugca

SEQ ID NO: 782352 - RNA, 19 nt, Homo sapiens
gcuaagccauaauagaaag

SEQ ID NO: 782353 - RNA, 19 nt, Homo sapiens
gugaggaaaugcuucagau

SEQ ID NO: 782354 - RNA, 19 nt, Homo sapiens
gggccuauaugaaguagca

SEQ ID NO: 782355 - RNA, 19 nt, Homo sapiens
cuucaagccuggugaggaa

SEQ ID NO: 782356 - RNA, 19 nt, Homo sapiens
caacagaaggaaauaacug

SEQ ID NO: 782357 - RNA, 19 nt, Homo sapiens
gcaggagaauggcaugaac

SEQ ID NO: 782358 - RNA, 19 nt, Homo sapiens
gaaaccccgucucuacuaa

SEQ ID NO: 782359 - RNA, 19 nt, Homo sapiens
gguguauccugcaucauca

SEQ ID NO: 782360 - RNA, 19 nt, Homo sapiens
gagcgggaaauaagccuaa

SEQ ID NO: 782361 - RNA, 19 nt, Homo sapiens
aaagugagcaagagaugaa

SEQ ID NO: 782362 - RNA, 19 nt, Homo sapiens
uggguaaguuccagccuaa

SEQ ID NO: 782363 - RNA, 19 nt, Homo sapiens
gaugaaagaaaugggauau

SEQ ID NO: 782364 - RNA, 19 nt, Homo sapiens
gagacaacagaaggaaaua

SEQ ID NO: 782365 - RNA, 19 nt, Homo sapiens
cagauggagugggccuaua

SEQ ID NO: 782366 - RNA, 19 nt, Homo sapiens
gaaggguuaugaggaugga

SEQ ID NO: 782367 - RNA, 19 nt, Homo sapiens
uugcagcacuggguucuaa

SEQ ID NO: 782368 - RNA, 19 nt, Homo sapiens
acgcugaucugcccuguca

SEQ ID NO: 782369 - RNA, 19 nt, Homo sapiens
ggcagguggugaacgugua

SEQ ID NO: 782370 - RNA, 19 nt, Homo sapiens
uaaggcagguggugaacgu

SEQ ID NO: 782371 - RNA, 19 nt, Homo sapiens
aaaauagacugcagaaaag

SEQ ID NO: 782372 - RNA, 19 nt, Homo sapiens
gcaagagaugaaagaaaug

SEQ ID NO: 782373 - RNA, 19 nt, Homo sapiens
gggcucugauucuccaaug

SEQ ID NO: 782374 - RNA, 19 nt, Homo sapiens
ugauugaccgucuuuauuc

SEQ ID NO: 782375 - RNA, 19 nt, Homo sapiens
gaacccaaagguaaagaca

SEQ ID NO: 782376 - RNA, 19 nt, Homo sapiens
cagcaucugugaucaugag

SEQ ID NO: 782377 - RNA, 19 nt, Homo sapiens
uggcagagcauagaugaaa

SEQ ID NO: 782378 - RNA, 19 nt, Homo sapiens
gauugaccgucuuuauucu

SEQ ID NO: 782379 - RNA, 19 nt, Homo sapiens
cgagggagaacuucgauuc

SEQ ID NO: 782380 - RNA, 19 nt, Homo sapiens
gaggagggcggaucacaag

SEQ ID NO: 782381 - RNA, 19 nt, Homo sapiens
gucaggagaucaagaccau

SEQ ID NO: 782382 - RNA, 19 nt, Homo sapiens
ccuguaauccuagcacuuu

SEQ ID NO: 782383 - RNA, 19 nt, Homo sapiens
gccugaugcucuaauggaa

SEQ ID NO: 782384 - RNA, 19 nt, Homo sapiens
gagugggccuauaugaagu

SEQ ID NO: 782385 - RNA, 19 nt, Homo sapiens
gaaagaaaugggauaugcu

SEQ ID NO: 782386 - RNA, 19 nt, Homo sapiens
ggagccaguuacuucuugu

SEQ ID NO: 782387 - RNA, 19 nt, Homo sapiens
gcaccuguagucccagcua

SEQ ID NO: 782388 - RNA, 19 nt, Homo sapiens
gaucacaaggucaggagau

SEQ ID NO: 782389 - RNA, 19 nt, Homo sapiens
agaugaggcuccaccuugu

SEQ ID NO: 782390 - RNA, 19 nt, Homo sapiens
cggagccaguuacuucuug

SEQ ID NO: 782391 - RNA, 19 nt, Homo sapiens
ggaaaagacagccagcauu

SEQ ID NO: 782392 - RNA, 19 nt, Homo sapiens
uuuccaagauggugacuuc

SEQ ID NO: 782393 - RNA, 19 nt, Homo sapiens
caaguucccuggcuuuccu

SEQ ID NO: 782394 - RNA, 19 nt, Homo sapiens
guggucgagugaagauuga

SEQ ID NO: 782395 - RNA, 19 nt, Homo sapiens
gaggcuccaccuuguuaaa

SEQ ID NO: 782396 - RNA, 19 nt, Homo sapiens
aaugggauaugcugcaaca

SEQ ID NO: 782397 - RNA, 19 nt, Homo sapiens
ugagauagaaagugagcaa

SEQ ID NO: 782398 - RNA, 19 nt, Homo sapiens
gcagauggagugggccuau

SEQ ID NO: 782399 - RNA, 19 nt, Homo sapiens
ggaaaggaaguggaagaca

SEQ ID NO: 782400 - RNA, 19 nt, Homo sapiens
gaugaggcuccaccuuguu

SEQ ID NO: 782401 - RNA, 19 nt, Homo sapiens
cugcucaacuuucaugucu

SEQ ID NO: 782402 - RNA, 19 nt, Homo sapiens
ccaaagguaaagacacuca

SEQ ID NO: 782403 - RNA, 19 nt, Homo sapiens
gacaacagaaggaaauaac

SEQ ID NO: 782404 - RNA, 19 nt, Homo sapiens
agacaacagaaggaaauaa

SEQ ID NO: 782405 - RNA, 19 nt, Homo sapiens
caucccagcuguggaagca

SEQ ID NO: 782406 - RNA, 19 nt, Homo sapiens
aggaaaugcuucagaugag

SEQ ID NO: 782407 - RNA, 19 nt, Homo sapiens
auacuggaacccaaaggua

SEQ ID NO: 782408 - RNA, 19 nt, Homo sapiens
ucaugucucccuccucuug

SEQ ID NO: 782409 - RNA, 19 nt, Homo sapiens
ggguguauccugcaucauc

SEQ ID NO: 782410 - RNA, 19 nt, Homo sapiens
guagcagcaucugugauca

SEQ ID NO: 782411 - RNA, 19 nt, Homo sapiens
agugaaggguuaugaggau

SEQ ID NO: 782412 - RNA, 19 nt, Homo sapiens
ggugaggaaaugcuucaga

SEQ ID NO: 782413 - RNA, 19 nt, Homo sapiens
gggaaauaagccuaagaga

SEQ ID NO: 782414 - RNA, 19 nt, Homo sapiens
uugauugaccgucuuuauu

SEQ ID NO: 782415 - RNA, 19 nt, Homo sapiens
gcagguggugaacguguau

SEQ ID NO: 782416 - RNA, 19 nt, Homo sapiens
ggagggcggaucacaaggu

SEQ ID NO: 782417 - RNA, 19 nt, Homo sapiens
ggucgagugaagauugaaa

SEQ ID NO: 782418 - RNA, 19 nt, Homo sapiens
caagagaugaaagaaaugg

SEQ ID NO: 782419 - RNA, 19 nt, Homo sapiens
acgucgaagugaaggguua

SEQ ID NO: 782420 - RNA, 19 nt, Homo sapiens
aagauggugacuucuauga

SEQ ID NO: 782421 - RNA, 19 nt, Homo sapiens
gugagcaagagaugaaaga

SEQ ID NO: 782422 - RNA, 19 nt, Homo sapiens
gaacucagauggagaagua

SEQ ID NO: 782423 - RNA, 19 nt, Homo sapiens
gaacaaagcacaagaguga

SEQ ID NO: 782424 - RNA, 19 nt, Homo sapiens
caacaaaugugauaaguga

SEQ ID NO: 782425 - RNA, 19 nt, Homo sapiens
gaagagaguuccuccaauu

SEQ ID NO: 782426 - RNA, 19 nt, Homo sapiens
caacacagcugggaucuaa

SEQ ID NO: 782427 - RNA, 19 nt, Homo sapiens
gaagggagcuagaagaaau

SEQ ID NO: 782428 - RNA, 19 nt, Homo sapiens
uuacauaacucaugcagua

SEQ ID NO: 782429 - RNA, 19 nt, Homo sapiens
gaucgcauauucauacuuu

SEQ ID NO: 782430 - RNA, 19 nt, Homo sapiens
guaagaaugugcagagaaa

SEQ ID NO: 782431 - RNA, 19 nt, Homo sapiens
agaaggagauuuaaccaua

SEQ ID NO: 782432 - RNA, 19 nt, Homo sapiens
gagcaagaguugagagaaa

SEQ ID NO: 782433 - RNA, 19 nt, Homo sapiens
caggauggcuccaggauaa

SEQ ID NO: 782434 - RNA, 19 nt, Homo sapiens
gauggugacuucuaugaaa

SEQ ID NO: 782435 - RNA, 19 nt, Homo sapiens
gaaauggcauggagcacaa

SEQ ID NO: 782436 - RNA, 19 nt, Homo sapiens
gaacguguaugcagaugga

SEQ ID NO: 782437 - RNA, 19 nt, Homo sapiens
cugaagcacuuuacugaua

SEQ ID NO: 782438 - RNA, 19 nt, Homo sapiens
gggcuuagcuaacgaaagu

SEQ ID NO: 782439 - RNA, 19 nt, Homo sapiens
gcucauugguggauguuaa

SEQ ID NO: 782440 - RNA, 19 nt, Homo sapiens
caaccaaucacaaccauaa

SEQ ID NO: 782441 - RNA, 19 nt, Homo sapiens
guucugaucuucacguuga

SEQ ID NO: 782442 - RNA, 19 nt, Homo sapiens
ggaauucuauagcuucuuc

SEQ ID NO: 782443 - RNA, 19 nt, Homo sapiens
ggaugucacuccuuuaauc

SEQ ID NO: 782444 - RNA, 19 nt, Homo sapiens
aaguagacaugacuaguua

SEQ ID NO: 782445 - RNA, 19 nt, Homo sapiens
uagaaagaauggagaacua

SEQ ID NO: 782446 - RNA, 19 nt, Homo sapiens
gaaggagauuuaaccauag

SEQ ID NO: 782447 - RNA, 19 nt, Homo sapiens
gagagaacaucccgacugu

SEQ ID NO: 782448 - RNA, 19 nt, Homo sapiens
agacaacccugagagauuu

SEQ ID NO: 782449 - RNA, 19 nt, Homo sapiens
gaugaggguucacuauguu

SEQ ID NO: 782450 - RNA, 19 nt, Homo sapiens
gaaugaaaauggcaaguuu

SEQ ID NO: 782451 - RNA, 19 nt, Homo sapiens
agacaugacuaguuaacaa

SEQ ID NO: 782452 - RNA, 19 nt, Homo sapiens
ggagaaguauccaguaugc

SEQ ID NO: 782453 - RNA, 19 nt, Homo sapiens
gaaagaauggagaacuauu

SEQ ID NO: 782454 - RNA, 19 nt, Homo sapiens
gaacaucccgacuguggaa

SEQ ID NO: 782455 - RNA, 19 nt, Homo sapiens
caaauacaguggagcaaca

SEQ ID NO: 782456 - RNA, 19 nt, Homo sapiens
ccaagauggugacuucuau

SEQ ID NO: 782457 - RNA, 19 nt, Homo sapiens
ugaguuugguaccaucuua

SEQ ID NO: 782458 - RNA, 19 nt, Homo sapiens
gaauaaguaucggacucua

SEQ ID NO: 782459 - RNA, 19 nt, Homo sapiens
aaacuacuccucauuauca

SEQ ID NO: 782460 - RNA, 19 nt, Homo sapiens
guggauggaucgcauauuc

SEQ ID NO: 782461 - RNA, 19 nt, Homo sapiens
uagaagaaauacagggauu

SEQ ID NO: 782462 - RNA, 19 nt, Homo sapiens
gaaaagacagccagcauuu

SEQ ID NO: 782463 - RNA, 19 nt, Homo sapiens
gagccagccuuccuucaau

SEQ ID NO: 782464 - RNA, 19 nt, Homo sapiens
ugacugaugggaauaagua

SEQ ID NO: 782465 - RNA, 19 nt, Homo sapiens
guaugcagauggaaaggaa

SEQ ID NO: 782466 - RNA, 19 nt, Homo sapiens
uagcaaguauggaaguuga

SEQ ID NO: 782467 - RNA, 19 nt, Homo sapiens
gugaauugacuacaaagua

SEQ ID NO: 782468 - RNA, 19 nt, Homo sapiens
ggagcacaaugaagcaaga

SEQ ID NO: 782469 - RNA, 19 nt, Homo sapiens
gcacuggguucugaucuuc

SEQ ID NO: 782470 - RNA, 19 nt, Homo sapiens
gagcaaauacccuagagau

SEQ ID NO: 782471 - RNA, 19 nt, Homo sapiens
ccacaugacacgugauuug

SEQ ID NO: 782472 - RNA, 19 nt, Homo sapiens
cauaacucaugcaguaauu

SEQ ID NO: 782473 - RNA, 19 nt, Homo sapiens
ccacggcccugaguauuug

SEQ ID NO: 782474 - RNA, 19 nt, Homo sapiens
agagagacauucagccuau

SEQ ID NO: 782475 - RNA, 19 nt, Homo sapiens
aaagagagagcaagaguug

SEQ ID NO: 782476 - RNA, 19 nt, Homo sapiens
gcacuuuacugauacucau

SEQ ID NO: 782477 - RNA, 19 nt, Homo sapiens
guuaugagcuuugguggau

SEQ ID NO: 782478 - RNA, 19 nt, Homo sapiens
gagagacauucagccuaua

SEQ ID NO: 782479 - RNA, 19 nt, Homo sapiens
ccaccacacccaacaaauu

SEQ ID NO: 782480 - RNA, 19 nt, Homo sapiens
caugacacgugauuuggaa

SEQ ID NO: 782481 - RNA, 19 nt, Homo sapiens
gaucuaaacagcaauaacu

SEQ ID NO: 782482 - RNA, 19 nt, Homo sapiens
ccaaagugcugggauuaca

SEQ ID NO: 782483 - RNA, 19 nt, Homo sapiens
gcuaagaggugauuuucaa

SEQ ID NO: 782484 - RNA, 19 nt, Homo sapiens
gaggcucuauauccuguuu

SEQ ID NO: 782485 - RNA, 19 nt, Homo sapiens
caccacacccaacaaauuu

SEQ ID NO: 782486 - RNA, 19 nt, Homo sapiens
uaugacaguuguuugaguu

SEQ ID NO: 782487 - RNA, 19 nt, Homo sapiens
gaauggagaacuauuaacu

SEQ ID NO: 782488 - RNA, 19 nt, Homo sapiens
uaacugagcccagaaccaa

SEQ ID NO: 782489 - RNA, 19 nt, Homo sapiens
gcccagaaccaaccugaaa

SEQ ID NO: 782490 - RNA, 19 nt, Homo sapiens
gcaagaacaaagcacaaga

SEQ ID NO: 782491 - RNA, 19 nt, Homo sapiens
ggaagcaccugugguugca

SEQ ID NO: 782492 - RNA, 19 nt, Homo sapiens
gguggauguuaaaccaaua

SEQ ID NO: 782493 - RNA, 19 nt, Homo sapiens
guugggagauguucagcuu

SEQ ID NO: 782494 - RNA, 19 nt, Homo sapiens
gagaguuccuccaauucug

SEQ ID NO: 782495 - RNA, 19 nt, Homo sapiens
cuagaggccacacuugaua

SEQ ID NO: 782496 - RNA, 19 nt, Homo sapiens
acuauuaacugccuuccuu

SEQ ID NO: 782497 - RNA, 19 nt, Homo sapiens
gcacugaagcacuuuacug

SEQ ID NO: 782498 - RNA, 19 nt, Homo sapiens
gcugaucauucccuagaga

SEQ ID NO: 782499 - RNA, 19 nt, Homo sapiens
ggaaagaguggcauauagg

SEQ ID NO: 782500 - RNA, 19 nt, Homo sapiens
gaggaacucagauggagaa

SEQ ID NO: 782501 - RNA, 19 nt, Homo sapiens
cagagugucuugguugaga

SEQ ID NO: 782502 - RNA, 19 nt, Homo sapiens
cagacaacccugagagauu

SEQ ID NO: 782503 - RNA, 19 nt, Homo sapiens
gaugaagggagcuagaaga

SEQ ID NO: 782504 - RNA, 19 nt, Homo sapiens
caggaaagaguggcauaua

SEQ ID NO: 782505 - RNA, 19 nt, Homo sapiens
gcacaaugaagcaagaaca

SEQ ID NO: 782506 - RNA, 19 nt, Homo sapiens
gguguauccuguaccauca

SEQ ID NO: 782507 - RNA, 19 nt, Homo sapiens
cuagagauuuucugugaua

SEQ ID NO: 782508 - RNA, 19 nt, Homo sapiens
gauuagcuuugcagagugu

SEQ ID NO: 782509 - RNA, 19 nt, Homo sapiens
guaggugguuguggaguug

SEQ ID NO: 782510 - RNA, 19 nt, Homo sapiens
ucugagugcuguguuauga

SEQ ID NO: 782511 - RNA, 19 nt, Homo sapiens
agacucaguucagaaagaa

SEQ ID NO: 782512 - RNA, 19 nt, Homo sapiens
guggaugucacuccuuuaa

SEQ ID NO: 782513 - RNA, 19 nt, Homo sapiens
aaaguagacaugacuaguu

SEQ ID NO: 782514 - RNA, 19 nt, Homo sapiens
acacugaaggacagaauuu

SEQ ID NO: 782515 - RNA, 19 nt, Homo sapiens
ggucaccauacuugaguua

SEQ ID NO: 782516 - RNA, 19 nt, Homo sapiens
cuacaaugcuguggaugga

SEQ ID NO: 782517 - RNA, 19 nt, Homo sapiens
uuauugcucuccacuguau

SEQ ID NO: 782518 - RNA, 19 nt, Homo sapiens
uauuauugcucuccacugu

SEQ ID NO: 782519 - RNA, 19 nt, Homo sapiens
agaugaggguucacuaugu

SEQ ID NO: 782520 - RNA, 19 nt, Homo sapiens
ugucuugguugagagaaua

SEQ ID NO: 782521 - RNA, 19 nt, Homo sapiens
uggauuagcuuugcagagu

SEQ ID NO: 782522 - RNA, 19 nt, Homo sapiens
uaaaggaacuggagaaaga

SEQ ID NO: 782523 - RNA, 19 nt, Homo sapiens
gaccagaucuaccucagua

SEQ ID NO: 782524 - RNA, 19 nt, Homo sapiens
gaauugcgauggagaagaa

SEQ ID NO: 782525 - RNA, 19 nt, Homo sapiens
ggaugaagaugaaugaaga

SEQ ID NO: 782526 - RNA, 19 nt, Homo sapiens
gagcuucgcuucagggaaa

SEQ ID NO: 782527 - RNA, 19 nt, Homo sapiens
gaagaugaaugaagaacau

SEQ ID NO: 782528 - RNA, 19 nt, Homo sapiens
gaagaaagaaagugucauu

SEQ ID NO: 782529 - RNA, 19 nt, Homo sapiens
gaagaaagugugagaaguu

SEQ ID NO: 782530 - RNA, 19 nt, Homo sapiens
ggacaccaguggcuucaaa

SEQ ID NO: 782531 - RNA, 19 nt, Homo sapiens
gaguguggcugaaauuuga

SEQ ID NO: 782532 - RNA, 19 nt, Homo sapiens
ggaagaaccaccuuuguga

SEQ ID NO: 782533 - RNA, 19 nt, Homo sapiens
gaucagagauagaggaagu

SEQ ID NO: 782534 - RNA, 19 nt, Homo sapiens
agaaauugcucuaaaggaa

SEQ ID NO: 782535 - RNA, 19 nt, Homo sapiens
gaacagaggagcagaugga

SEQ ID NO: 782536 - RNA, 19 nt, Homo sapiens
ugagacgccuuacaaauga

SEQ ID NO: 782537 - RNA, 19 nt, Homo sapiens
gcacguggauguaguuugg

SEQ ID NO: 782538 - RNA, 19 nt, Homo sapiens
gaacauguccugcucuauc

SEQ ID NO: 782539 - RNA, 19 nt, Homo sapiens
guaguuccuuugcuuguaa

SEQ ID NO: 782540 - RNA, 19 nt, Homo sapiens
cagaagauauggacuugga

SEQ ID NO: 782541 - RNA, 19 nt, Homo sapiens
gaucgcacaucuacacaug

SEQ ID NO: 782542 - RNA, 19 nt, Homo sapiens
caagaagaauugcgaugga

SEQ ID NO: 782543 - RNA, 19 nt, Homo sapiens
gaacgggaaacaagagaaa

SEQ ID NO: 782544 - RNA, 19 nt, Homo sapiens
gaccugggaugaagaugaa

SEQ ID NO: 782545 - RNA, 19 nt, Homo sapiens
agaaagggaagaacaauuu

SEQ ID NO: 782546 - RNA, 19 nt, Homo sapiens
gaggagagggaaccagaua

SEQ ID NO: 782547 - RNA, 19 nt, Homo sapiens
ccgcaguguuuguguauaa

SEQ ID NO: 782548 - RNA, 19 nt, Homo sapiens
gauaugcagaucagagaua

SEQ ID NO: 782549 - RNA, 19 nt, Homo sapiens
ggagaaagaacgugugcaa

SEQ ID NO: 782550 - RNA, 19 nt, Homo sapiens
gaaccaccuuugugagcaa

SEQ ID NO: 782551 - RNA, 19 nt, Homo sapiens
gauaggauucucccuuuga

SEQ ID NO: 782552 - RNA, 19 nt, Homo sapiens
caacaucacagcccaggaa

SEQ ID NO: 782553 - RNA, 19 nt, Homo sapiens
gagaaagggaagaacaauu

SEQ ID NO: 782554 - RNA, 19 nt, Homo sapiens
gagacaguguugagaggaa

SEQ ID NO: 782555 - RNA, 19 nt, Homo sapiens
gaagaauugcgauggagaa

SEQ ID NO: 782556 - RNA, 19 nt, Homo sapiens
ggguuaauauuuguuggua

SEQ ID NO: 782557 - RNA, 19 nt, Homo sapiens
ggaggauuccaaagaguuu

SEQ ID NO: 782558 - RNA, 19 nt, Homo sapiens
ggagagggaaccagauaug

SEQ ID NO: 782559 - RNA, 19 nt, Homo sapiens
gaagauauggacuuggaau

SEQ ID NO: 782560 - RNA, 19 nt, Homo sapiens
caccagagccuauagaauc

SEQ ID NO: 782561 - RNA, 19 nt, Homo sapiens
guaugcaucuauuggauca

SEQ ID NO: 782562 - RNA, 19 nt, Homo sapiens
ggaccugggaugaagauga

SEQ ID NO: 782563 - RNA, 19 nt, Homo sapiens
ucacagccauguagacaag

SEQ ID NO: 782564 - RNA, 19 nt, Homo sapiens
aagcaacguuuaauucuag

SEQ ID NO: 782565 - RNA, 19 nt, Homo sapiens
gaaagugugagaaguugau

SEQ ID NO: 782566 - RNA, 19 nt, Homo sapiens
cugauaggauucucccuuu

SEQ ID NO: 782567 - RNA, 19 nt, Homo sapiens
gagaaauugcucuaaagga

SEQ ID NO: 782568 - RNA, 19 nt, Homo sapiens
ggucucagcccaguuuauu

SEQ ID NO: 782569 - RNA, 19 nt, Homo sapiens
gauauggacuuggaaugag

SEQ ID NO: 782570 - RNA, 19 nt, Homo sapiens
gcauagggaacuaguuguu

SEQ ID NO: 782571 - RNA, 19 nt, Homo sapiens
ggaccuuggagaugcauaa

SEQ ID NO: 782572 - RNA, 19 nt, Homo sapiens
ggagggaccaagguuguaa

SEQ ID NO: 782573 - RNA, 19 nt, Homo sapiens
cauagggaacuaguuguua

SEQ ID NO: 782574 - RNA, 19 nt, Homo sapiens
gacaagcccuggucaucuc

SEQ ID NO: 782575 - RNA, 19 nt, Homo sapiens
caucugcccugcacucaca

SEQ ID NO: 782576 - RNA, 19 nt, Homo sapiens
cuaugaagcuggagauguc

SEQ ID NO: 782577 - RNA, 19 nt, Homo sapiens
aggagcagauggaggagua

SEQ ID NO: 782578 - RNA, 19 nt, Homo sapiens
caucagggugaccacauua

SEQ ID NO: 782579 - RNA, 19 nt, Homo sapiens
ccaagaagaaagugugaga

SEQ ID NO: 782580 - RNA, 19 nt, Homo sapiens
ggagaaucgucgagaacca

SEQ ID NO: 782581 - RNA, 19 nt, Homo sapiens
cagcguggcccuggucaua

SEQ ID NO: 782582 - RNA, 19 nt, Homo sapiens
uacaaaugauggaggauuc

SEQ ID NO: 782583 - RNA, 19 nt, Homo sapiens
ggaagguuugcgucuagua

SEQ ID NO: 782584 - RNA, 19 nt, Homo sapiens
cuacaggguucaccaggau

SEQ ID NO: 782585 - RNA, 19 nt, Homo sapiens
aagaaagugugagaaguug

SEQ ID NO: 782586 - RNA, 19 nt, Homo sapiens
gagaaagaacgugugcaaa

SEQ ID NO: 782587 - RNA, 19 nt, Homo sapiens
ccagaucuaccucaguauu

SEQ ID NO: 782588 - RNA, 19 nt, Homo sapiens
agagauagaggaaguggaa

SEQ ID NO: 782589 - RNA, 19 nt, Homo sapiens
ggaaccagauaugcagauc

SEQ ID NO: 782590 - RNA, 19 nt, Homo sapiens
ggaggaguaccgaggaaga

SEQ ID NO: 782591 - RNA, 19 nt, Homo sapiens
gcccacugaucccaucuug

SEQ ID NO: 782592 - RNA, 19 nt, Homo sapiens
uagcaugaauaagccaauu

SEQ ID NO: 782593 - RNA, 19 nt, Homo sapiens
ggagaaagggaagaacaau

SEQ ID NO: 782594 - RNA, 19 nt, Homo sapiens
gggagagcgugccugacaa

SEQ ID NO: 782595 - RNA, 19 nt, Homo sapiens
cggcuggagugcauaucua

SEQ ID NO: 782596 - RNA, 19 nt, Homo sapiens
gaggaagaaccaccuuugu

SEQ ID NO: 782597 - RNA, 19 nt, Homo sapiens
cuaccucaguauucaaguu

SEQ ID NO: 782598 - RNA, 19 nt, Homo sapiens
gaugucuccuucuacaaca

SEQ ID NO: 782599 - RNA, 19 nt, Homo sapiens
gaagguuugcgucuaguag

SEQ ID NO: 782600 - RNA, 19 nt, Homo sapiens
ucaacaaacuccaaaagga

SEQ ID NO: 782601 - RNA, 19 nt, Homo sapiens
uggcaggacuaggcucuaa

SEQ ID NO: 782602 - RNA, 19 nt, Homo sapiens
ggucauacacaacaucaca

SEQ ID NO: 782603 - RNA, 19 nt, Homo sapiens
uggcuaagucccaccauaa

SEQ ID NO: 782604 - RNA, 19 nt, Homo sapiens
cacauuaagcccaguauuc

SEQ ID NO: 782605 - RNA, 19 nt, Homo sapiens
gaaguugaugggcagcaaa

SEQ ID NO: 782606 - RNA, 19 nt, Homo sapiens
cagagagauucgacaguca

SEQ ID NO: 782607 - RNA, 19 nt, Homo sapiens
ucuauuggaucaacaaacu

SEQ ID NO: 782608 - RNA, 19 nt, Homo sapiens
cgaggaagaaccaccuuug

SEQ ID NO: 782609 - RNA, 19 nt, Homo sapiens
guauuuauggcauuugaga

SEQ ID NO: 782610 - RNA, 19 nt, Homo sapiens
accaguggcuucaaacuuc

SEQ ID NO: 782611 - RNA, 19 nt, Homo sapiens
agaagaaagugugagaagu

SEQ ID NO: 782612 - RNA, 19 nt, Homo sapiens
ucaauuccuuggucucaca

SEQ ID NO: 782613 - RNA, 19 nt, Homo sapiens
ucagaggaccggagaagug

SEQ ID NO: 782614 - RNA, 19 nt, Homo sapiens
gaaccagauaugcagauca

SEQ ID NO: 782615 - RNA, 19 nt, Homo sapiens
gggaacuaguuguuacaca

SEQ ID NO: 782616 - RNA, 19 nt, Homo sapiens
ggacccaccagagccuaua

SEQ ID NO: 782617 - RNA, 19 nt, Homo sapiens
gaggaccggagaaguguga

SEQ ID NO: 782618 - RNA, 19 nt, Homo sapiens
gguugcgccugcccugaaa

SEQ ID NO: 782619 - RNA, 19 nt, Homo sapiens
gagaacagaggagcagaug

SEQ ID NO: 782620 - RNA, 19 nt, Homo sapiens
guugguauuuauggcauuu

SEQ ID NO: 782621 - RNA, 19 nt, Homo sapiens
ggaugcacguggauguagu

SEQ ID NO: 782622 - RNA, 19 nt, Homo sapiens
uaaaggaacuggagaaaga

SEQ ID NO: 782623 - RNA, 19 nt, Homo sapiens
gaccagaucuaccucagua

SEQ ID NO: 782624 - RNA, 19 nt, Homo sapiens
gaauugcgauggagaagaa

SEQ ID NO: 782625 - RNA, 19 nt, Homo sapiens
ggaugaagaugaaugaaga

SEQ ID NO: 782626 - RNA, 19 nt, Homo sapiens
gagcuucgcuucagggaaa

SEQ ID NO: 782627 - RNA, 19 nt, Homo sapiens
gaagaugaaugaagaacau

SEQ ID NO: 782628 - RNA, 19 nt, Homo sapiens
gaagaaagaaagugucauu

SEQ ID NO: 782629 - RNA, 19 nt, Homo sapiens
gaagaaagugugagaaguu

SEQ ID NO: 782630 - RNA, 19 nt, Homo sapiens
ggacaccaguggcuucaaa

SEQ ID NO: 782631 - RNA, 19 nt, Homo sapiens
gaguguggcugaaauuuga

SEQ ID NO: 782632 - RNA, 19 nt, Homo sapiens
ggaagaaccaccuuuguga

SEQ ID NO: 782633 - RNA, 19 nt, Homo sapiens
gaucagagauagaggaagu

SEQ ID NO: 782634 - RNA, 19 nt, Homo sapiens
agaaauugcucuaaaggaa

SEQ ID NO: 782635 - RNA, 19 nt, Homo sapiens
gaacagaggagcagaugga

SEQ ID NO: 782636 - RNA, 19 nt, Homo sapiens
ugagacgccuuacaaauga

SEQ ID NO: 782637 - RNA, 19 nt, Homo sapiens
gcacguggauguaguuugg

SEQ ID NO: 782638 - RNA, 19 nt, Homo sapiens
gaacauguccugcucuauc

SEQ ID NO: 782639 - RNA, 19 nt, Homo sapiens
guaguuccuuugcuuguaa

SEQ ID NO: 782640 - RNA, 19 nt, Homo sapiens
cagaagauauggacuugga

SEQ ID NO: 782641 - RNA, 19 nt, Homo sapiens
gaucgcacaucuacacaug

SEQ ID NO: 782642 - RNA, 19 nt, Homo sapiens
ucagagagccuucauggaa

SEQ ID NO: 782643 - RNA, 19 nt, Homo sapiens
caagaagaauugcgaugga

SEQ ID NO: 782644 - RNA, 19 nt, Homo sapiens
gaacgggaaacaagagaaa

SEQ ID NO: 782645 - RNA, 19 nt, Homo sapiens
gaccugggaugaagaugaa

SEQ ID NO: 782646 - RNA, 19 nt, Homo sapiens
agaaagggaagaacaauuu

SEQ ID NO: 782647 - RNA, 19 nt, Homo sapiens
gaggagagggaaccagaua

SEQ ID NO: 782648 - RNA, 19 nt, Homo sapiens
ccgcaguguuuguguauaa

SEQ ID NO: 782649 - RNA, 19 nt, Homo sapiens
gauaugcagaucagagaua

SEQ ID NO: 782650 - RNA, 19 nt, Homo sapiens
ggagaaagaacgugugcaa

SEQ ID NO: 782651 - RNA, 19 nt, Homo sapiens
gaaccaccuuugugagcaa

SEQ ID NO: 782652 - RNA, 19 nt, Homo sapiens
gauaggauucucccuuuga

SEQ ID NO: 782653 - RNA, 19 nt, Homo sapiens
aagugcagcuucaguaauu

SEQ ID NO: 782654 - RNA, 19 nt, Homo sapiens
caacaucacagcccaggaa

SEQ ID NO: 782655 - RNA, 19 nt, Homo sapiens
gagaaagggaagaacaauu

SEQ ID NO: 782656 - RNA, 19 nt, Homo sapiens
gagacaguguugagaggaa

SEQ ID NO: 782657 - RNA, 19 nt, Homo sapiens
gaagaauugcgauggagaa

SEQ ID NO: 782658 - RNA, 19 nt, Homo sapiens
ggguuaauauuuguuggua

SEQ ID NO: 782659 - RNA, 19 nt, Homo sapiens
ggaggauuccaaagaguuu

SEQ ID NO: 782660 - RNA, 19 nt, Homo sapiens
ggagagggaaccagauaug

SEQ ID NO: 782661 - RNA, 19 nt, Homo sapiens
gaagauauggacuuggaau

SEQ ID NO: 782662 - RNA, 19 nt, Homo sapiens
caccagagccuauagaauc

SEQ ID NO: 782663 - RNA, 19 nt, Homo sapiens
ggggaucccuucagagaua

SEQ ID NO: 782664 - RNA, 19 nt, Homo sapiens
guaugcaucuauuggauca

SEQ ID NO: 782665 - RNA, 19 nt, Homo sapiens
ggaccugggaugaagauga

SEQ ID NO: 782666 - RNA, 19 nt, Homo sapiens
ucacagccauguagacaag

SEQ ID NO: 782667 - RNA, 19 nt, Homo sapiens
aagcaacguuuaauucuag

SEQ ID NO: 782668 - RNA, 19 nt, Homo sapiens
gaaagugugagaaguugau

SEQ ID NO: 782669 - RNA, 19 nt, Homo sapiens
cugauaggauucucccuuu

SEQ ID NO: 782670 - RNA, 19 nt, Homo sapiens
gagaaauugcucuaaagga

SEQ ID NO: 782671 - RNA, 19 nt, Homo sapiens
ggucucagcccaguuuauu

SEQ ID NO: 782672 - RNA, 19 nt, Homo sapiens
gauauggacuuggaaugag

SEQ ID NO: 782673 - RNA, 19 nt, Homo sapiens
gcauagggaacuaguuguu

SEQ ID NO: 782674 - RNA, 19 nt, Homo sapiens
ggaccuuggagaugcauaa

SEQ ID NO: 782675 - RNA, 19 nt, Homo sapiens
ggagggaccaagguuguaa

SEQ ID NO: 782676 - RNA, 19 nt, Homo sapiens
cauagggaacuaguuguua

SEQ ID NO: 782677 - RNA, 19 nt, Homo sapiens
gacaagcccuggucaucuc

SEQ ID NO: 782678 - RNA, 19 nt, Homo sapiens
caucugcccugcacucaca

SEQ ID NO: 782679 - RNA, 19 nt, Homo sapiens
cuaugaagcuggagauguc

SEQ ID NO: 782680 - RNA, 19 nt, Homo sapiens
gaucaggaaccacacaauc

SEQ ID NO: 782681 - RNA, 19 nt, Homo sapiens
ggccuaaaccugagacuuc

SEQ ID NO: 782682 - RNA, 19 nt, Homo sapiens
ccaauucuucucaaacuga

SEQ ID NO: 782683 - RNA, 19 nt, Homo sapiens
aggagcagauggaggagua

SEQ ID NO: 782684 - RNA, 19 nt, Homo sapiens
caucagggugaccacauua

SEQ ID NO: 782685 - RNA, 19 nt, Homo sapiens
ccaagaagaaagugugaga

SEQ ID NO: 782686 - RNA, 19 nt, Homo sapiens
ggagaaucgucgagaacca

SEQ ID NO: 782687 - RNA, 19 nt, Homo sapiens
gagcuccaauucuucucaa

SEQ ID NO: 782688 - RNA, 19 nt, Homo sapiens
cagcguggcccuggucaua

SEQ ID NO: 782689 - RNA, 19 nt, Homo sapiens
uacaaaugauggaggauuc

SEQ ID NO: 782690 - RNA, 19 nt, Homo sapiens
cuacaggguucaccaggau

SEQ ID NO: 782691 - RNA, 19 nt, Homo sapiens
aagaaagugugagaaguug

SEQ ID NO: 782692 - RNA, 19 nt, Homo sapiens
gagacuuccucugcaguug

SEQ ID NO: 782693 - RNA, 19 nt, Homo sapiens
ugugugagcugccuaggau

SEQ ID NO: 782694 - RNA, 19 nt, Homo sapiens
gagaaagaacgugugcaaa

SEQ ID NO: 782695 - RNA, 19 nt, Homo sapiens
ggaagguuugcgucuagua

SEQ ID NO: 782696 - RNA, 19 nt, Homo sapiens
ccagaucuaccucaguauu

SEQ ID NO: 782697 - RNA, 19 nt, Homo sapiens
gcccacugaucccaucuug

SEQ ID NO: 782698 - RNA, 19 nt, Homo sapiens
agagauagaggaaguggaa

SEQ ID NO: 782699 - RNA, 19 nt, Homo sapiens
ggaaccagauaugcagauc

SEQ ID NO: 782700 - RNA, 19 nt, Homo sapiens
augcugagcuccaauucuu

SEQ ID NO: 782701 - RNA, 19 nt, Homo sapiens
ggaggaguaccgaggaaga

SEQ ID NO: 782702 - RNA, 19 nt, Homo sapiens
uagcaugaauaagccaauu

SEQ ID NO: 782703 - RNA, 19 nt, Homo sapiens
ggagaaagggaagaacaau

SEQ ID NO: 782704 - RNA, 19 nt, Homo sapiens
gggagagcgugccugacaa

SEQ ID NO: 782705 - RNA, 19 nt, Homo sapiens
cggcuggagugcauaucua

SEQ ID NO: 782706 - RNA, 19 nt, Homo sapiens
gaggaagaaccaccuuugu

SEQ ID NO: 782707 - RNA, 19 nt, Homo sapiens
cuaccucaguauucaaguu

SEQ ID NO: 782708 - RNA, 19 nt, Homo sapiens
gaagguuugcgucuaguag

SEQ ID NO: 782709 - RNA, 19 nt, Homo sapiens
gaugucuccuucuacaaca

SEQ ID NO: 782710 - RNA, 19 nt, Homo sapiens
ucaacaaacuccaaaagga

SEQ ID NO: 782711 - RNA, 19 nt, Homo sapiens
uggcaggacuaggcucuaa

SEQ ID NO: 782712 - RNA, 19 nt, Homo sapiens
ggucauacacaacaucaca

SEQ ID NO: 782713 - RNA, 19 nt, Homo sapiens
cuccaaacauggcgaccua

SEQ ID NO: 782714 - RNA, 19 nt, Homo sapiens
uggcuaagucccaccauaa

SEQ ID NO: 782715 - RNA, 19 nt, Homo sapiens
cacauuaagcccaguauuc

SEQ ID NO: 782716 - RNA, 19 nt, Homo sapiens
gaaguugaugggcagcaaa

SEQ ID NO: 782717 - RNA, 19 nt, Homo sapiens
cagagagauucgacaguca

SEQ ID NO: 782718 - RNA, 19 nt, Homo sapiens
ucuauuggaucaacaaacu

SEQ ID NO: 782719 - RNA, 19 nt, Homo sapiens
cgaggaagaaccaccuuug

SEQ ID NO: 782720 - RNA, 19 nt, Homo sapiens
guauuuauggcauuugaga

SEQ ID NO: 782721 - RNA, 19 nt, Homo sapiens
accaguggcuucaaacuuc

SEQ ID NO: 782722 - RNA, 19 nt, Homo sapiens
ggacagagcucagucuuua

SEQ ID NO: 782723 - RNA, 19 nt, Homo sapiens
gcagauaacuccacaaaug

SEQ ID NO: 782724 - RNA, 19 nt, Homo sapiens
ggauaaagcucaaagcaaa

SEQ ID NO: 782725 - RNA, 19 nt, Homo sapiens
gaaggcaggugucucuuua

SEQ ID NO: 782726 - RNA, 19 nt, Homo sapiens
ggagagagcuacugacuug

SEQ ID NO: 782727 - RNA, 19 nt, Homo sapiens
gaaauccacucaugaaugu

SEQ ID NO: 782728 - RNA, 19 nt, Homo sapiens
caugugagcucauuaaauu

SEQ ID NO: 782729 - RNA, 19 nt, Homo sapiens
ggaugcagaugacuuauuu

SEQ ID NO: 782730 - RNA, 19 nt, Homo sapiens
gcaaacaacaguaagcuua

SEQ ID NO: 782731 - RNA, 19 nt, Homo sapiens
cuaaauagcuucaggaugu

SEQ ID NO: 782732 - RNA, 19 nt, Homo sapiens
gaaagccagucucaucuaa

SEQ ID NO: 782733 - RNA, 19 nt, Homo sapiens
gaagauggcuggcgugauc

SEQ ID NO: 782734 - RNA, 19 nt, Homo sapiens
gcgcagaauuucagauaua

SEQ ID NO: 782735 - RNA, 19 nt, Homo sapiens
ggaagugccucaaagcaaa

SEQ ID NO: 782736 - RNA, 19 nt, Homo sapiens
gaagaaaugcuuauuccua

SEQ ID NO: 782737 - RNA, 19 nt, Homo sapiens
gcaaguccaucuuauuuau

SEQ ID NO: 782738 - RNA, 19 nt, Homo sapiens
gcaaagggauccauaugug

SEQ ID NO: 782739 - RNA, 19 nt, Homo sapiens
ccacgcaccuuccuuagua

SEQ ID NO: 782740 - RNA, 19 nt, Homo sapiens
gcagaugacuuauuuagca

SEQ ID NO: 782741 - RNA, 19 nt, Homo sapiens
ugaaauagcuggcagauac

SEQ ID NO: 782742 - RNA, 19 nt, Homo sapiens
aaaggaagcuggccaagaa

SEQ ID NO: 782743 - RNA, 19 nt, Homo sapiens
gagggcagcugacauuauu

SEQ ID NO: 782744 - RNA, 19 nt, Homo sapiens
gagcugggaucauguuuga

SEQ ID NO: 782745 - RNA, 19 nt, Homo sapiens
caacugaaauccacucaug

SEQ ID NO: 782746 - RNA, 19 nt, Homo sapiens
ugacauagcuggagaaagg

SEQ ID NO: 782747 - RNA, 19 nt, Homo sapiens
gagagcuacugacuuguua

SEQ ID NO: 782748 - RNA, 19 nt, Homo sapiens
gaucauguuugaacucauu

SEQ ID NO: 782749 - RNA, 19 nt, Homo sapiens
ccaauggccugcacuugua

SEQ ID NO: 782750 - RNA, 19 nt, Homo sapiens
gagcaggacucuuggaugu

SEQ ID NO: 782751 - RNA, 19 nt, Homo sapiens
ggacucugauccuuaauug

SEQ ID NO: 782752 - RNA, 19 nt, Homo sapiens
gcucuuaccucauagaugu

SEQ ID NO: 782753 - RNA, 19 nt, Homo sapiens
caggagcucuuaccucaua

SEQ ID NO: 782754 - RNA, 19 nt, Homo sapiens
guacagacuuuguccuauu

SEQ ID NO: 782755 - RNA, 19 nt, Homo sapiens
gaagagacaaacaagauaa

SEQ ID NO: 782756 - RNA, 19 nt, Homo sapiens
gcauuccacuuucugauuu

SEQ ID NO: 782757 - RNA, 19 nt, Homo sapiens
ggagucacaugguugcuaa

SEQ ID NO: 782758 - RNA, 19 nt, Homo sapiens
ggagagcuauuuaacacaa

SEQ ID NO: 782759 - RNA, 19 nt, Homo sapiens
gaagggcugucacuuuaga

SEQ ID NO: 782760 - RNA, 19 nt, Homo sapiens
ggacaucauccacagaaua

SEQ ID NO: 782761 - RNA, 19 nt, Homo sapiens
ggaggcugguguucgauua

SEQ ID NO: 782762 - RNA, 19 nt, Homo sapiens
uugagucucuguacaauua

SEQ ID NO: 782763 - RNA, 19 nt, Homo sapiens
gaagagacaagcugagauu

SEQ ID NO: 782764 - RNA, 19 nt, Homo sapiens
ccagagacauugaaggaaa

SEQ ID NO: 782765 - RNA, 19 nt, Homo sapiens
aggaagggcugucacuuua

SEQ ID NO: 782766 - RNA, 19 nt, Homo sapiens
gggaaacucucgaccuuga

SEQ ID NO: 782767 - RNA, 19 nt, Homo sapiens
ccaacuacauugacggaua

SEQ ID NO: 782768 - RNA, 19 nt, Homo sapiens
cauggaagaugaauaaugu

SEQ ID NO: 782769 - RNA, 19 nt, Homo sapiens
gaaugaaccaggauuuaaa

SEQ ID NO: 782770 - RNA, 19 nt, Homo sapiens
ccauggagcuuuagagaga

SEQ ID NO: 782771 - RNA, 19 nt, Homo sapiens
ggugguagcuuucuuugga

SEQ ID NO: 782772 - RNA, 19 nt, Homo sapiens
gaaagggucauaggaagua

SEQ ID NO: 782773 - RNA, 19 nt, Homo sapiens
ggugagauguggacucuga

SEQ ID NO: 782774 - RNA, 19 nt, Homo sapiens
gcacagcagagauaucuaa

SEQ ID NO: 782775 - RNA, 19 nt, Homo sapiens
gaggguagguuagaagaaa

SEQ ID NO: 782776 - RNA, 19 nt, Homo sapiens
cuaggaagcuccaucuuga

SEQ ID NO: 782777 - RNA, 19 nt, Homo sapiens
ucacaaaccugguggaagu

SEQ ID NO: 782778 - RNA, 19 nt, Homo sapiens
acagugaaguguaaucuuu

SEQ ID NO: 782779 - RNA, 19 nt, Homo sapiens
gagcagacucuucuaguuu

SEQ ID NO: 782780 - RNA, 19 nt, Homo sapiens
gauuuagccuuguugguuu

SEQ ID NO: 782781 - RNA, 19 nt, Homo sapiens
aggaagaaauugaggcuua

SEQ ID NO: 782782 - RNA, 19 nt, Homo sapiens
gaaccaacauuugcuaagu

SEQ ID NO: 782783 - RNA, 19 nt, Homo sapiens
ggaagagacaaacaagaua

SEQ ID NO: 782784 - RNA, 19 nt, Homo sapiens
uaucuuagcugcacuccaa

SEQ ID NO: 782785 - RNA, 19 nt, Homo sapiens
gucauuccauguaaaguua

SEQ ID NO: 782786 - RNA, 19 nt, Homo sapiens
gaaccgaggaugcagauga

SEQ ID NO: 782787 - RNA, 19 nt, Homo sapiens
gaaggaacccauuaacuca

SEQ ID NO: 782788 - RNA, 19 nt, Homo sapiens
gcagagaauucaagaaggu

SEQ ID NO: 782789 - RNA, 19 nt, Homo sapiens
gggcugaccuguaggaugu

SEQ ID NO: 782790 - RNA, 19 nt, Homo sapiens
gcaggugucucuuuaaagg

SEQ ID NO: 782791 - RNA, 19 nt, Homo sapiens
ggagaaagggucauaggaa

SEQ ID NO: 782792 - RNA, 19 nt, Homo sapiens
gcauggcacugacuauaga

SEQ ID NO: 782793 - RNA, 19 nt, Homo sapiens
gcaaggaaguaaugagaag

SEQ ID NO: 782794 - RNA, 19 nt, Homo sapiens
gaucuagggucuuguccaa

SEQ ID NO: 782795 - RNA, 19 nt, Homo sapiens
gcaaauagagcaccagcuu

SEQ ID NO: 782796 - RNA, 19 nt, Homo sapiens
gcacguaugagaagagaaa

SEQ ID NO: 782797 - RNA, 19 nt, Homo sapiens
ugacuuggcuuccccauua

SEQ ID NO: 782798 - RNA, 19 nt, Homo sapiens
ggaaaguggugccuguugu

SEQ ID NO: 782799 - RNA, 19 nt, Homo sapiens
gcucugaccucacuguuca

SEQ ID NO: 782800 - RNA, 19 nt, Homo sapiens
gaaccauggugcaguagug

SEQ ID NO: 782801 - RNA, 19 nt, Homo sapiens
gcaccuuccuuaguaauga

SEQ ID NO: 782802 - RNA, 19 nt, Homo sapiens
guauguaccucuaagacaa

SEQ ID NO: 782803 - RNA, 19 nt, Homo sapiens
ccagguggcuguuccuuug

SEQ ID NO: 782804 - RNA, 19 nt, Homo sapiens
gaagaaaggcuaccaugag

SEQ ID NO: 782805 - RNA, 19 nt, Homo sapiens
guucaugguuccuuaguga

SEQ ID NO: 782806 - RNA, 19 nt, Homo sapiens
acaauuaauuccuggguaa

SEQ ID NO: 782807 - RNA, 19 nt, Homo sapiens
guuauaggcucaagaucaa

SEQ ID NO: 782808 - RNA, 19 nt, Homo sapiens
uaaaggaggguuugugauu

SEQ ID NO: 782809 - RNA, 19 nt, Homo sapiens
ucaagaagguacagcuuug

SEQ ID NO: 782810 - RNA, 19 nt, Homo sapiens
gagcagauaacuccacaaa

SEQ ID NO: 782811 - RNA, 19 nt, Homo sapiens
gaauauuccgcaucuguaa

SEQ ID NO: 782812 - RNA, 19 nt, Homo sapiens
aaugucaggucaaugaaua

SEQ ID NO: 782813 - RNA, 19 nt, Homo sapiens
cacauuaucuccagagguu

SEQ ID NO: 782814 - RNA, 19 nt, Homo sapiens
ucaaaucacagccaaguaa

SEQ ID NO: 782815 - RNA, 19 nt, Homo sapiens
cacacuagcucuugcugua

SEQ ID NO: 782816 - RNA, 19 nt, Homo sapiens
gaaaucacuugcccacagu

SEQ ID NO: 782817 - RNA, 19 nt, Homo sapiens
ggaagaaauugaggcuuau

SEQ ID NO: 782818 - RNA, 19 nt, Homo sapiens
gcacacaggaagaaauuga

SEQ ID NO: 782819 - RNA, 19 nt, Homo sapiens
cacaggaucuuucaugaug

SEQ ID NO: 782820 - RNA, 19 nt, Homo sapiens
gaagauggucccuuugguu

SEQ ID NO: 782821 - RNA, 19 nt, Homo sapiens
cuacuuugcugcugaguug

SEQ ID NO: 782822 - RNA, 19 nt, Homo sapiens
ggacagagcucagucuuua

SEQ ID NO: 782823 - RNA, 19 nt, Homo sapiens
gcagauaacuccacaaaug

SEQ ID NO: 782824 - RNA, 19 nt, Homo sapiens
ggauaaagcucaaagcaaa

SEQ ID NO: 782825 - RNA, 19 nt, Homo sapiens
gaaggcaggugucucuuua

SEQ ID NO: 782826 - RNA, 19 nt, Homo sapiens
ggagagagcuacugacuug

SEQ ID NO: 782827 - RNA, 19 nt, Homo sapiens
gaaauccacucaugaaugu

SEQ ID NO: 782828 - RNA, 19 nt, Homo sapiens
caugugagcucauuaaauu

SEQ ID NO: 782829 - RNA, 19 nt, Homo sapiens
ggaugcagaugacuuauuu

SEQ ID NO: 782830 - RNA, 19 nt, Homo sapiens
gcaaacaacaguaagcuua

SEQ ID NO: 782831 - RNA, 19 nt, Homo sapiens
cuaaauagcuucaggaugu

SEQ ID NO: 782832 - RNA, 19 nt, Homo sapiens
gaaagccagucucaucuaa

SEQ ID NO: 782833 - RNA, 19 nt, Homo sapiens
gaagauggcuggcgugauc

SEQ ID NO: 782834 - RNA, 19 nt, Homo sapiens
gcgcagaauuucagauaua

SEQ ID NO: 782835 - RNA, 19 nt, Homo sapiens
ggaagugccucaaagcaaa

SEQ ID NO: 782836 - RNA, 19 nt, Homo sapiens
gaagaaaugcuuauuccua

SEQ ID NO: 782837 - RNA, 19 nt, Homo sapiens
gcaaguccaucuuauuuau

SEQ ID NO: 782838 - RNA, 19 nt, Homo sapiens
gcaaagggauccauaugug

SEQ ID NO: 782839 - RNA, 19 nt, Homo sapiens
ccacgcaccuuccuuagua

SEQ ID NO: 782840 - RNA, 19 nt, Homo sapiens
gcagaugacuuauuuagca

SEQ ID NO: 782841 - RNA, 19 nt, Homo sapiens
ugaaauagcuggcagauac

SEQ ID NO: 782842 - RNA, 19 nt, Homo sapiens
aaaggaagcuggccaagaa

SEQ ID NO: 782843 - RNA, 19 nt, Homo sapiens
gagggcagcugacauuauu

SEQ ID NO: 782844 - RNA, 19 nt, Homo sapiens
gagcugggaucauguuuga

SEQ ID NO: 782845 - RNA, 19 nt, Homo sapiens
caacugaaauccacucaug

SEQ ID NO: 782846 - RNA, 19 nt, Homo sapiens
ugacauagcuggagaaagg

SEQ ID NO: 782847 - RNA, 19 nt, Homo sapiens
gagagcuacugacuuguua

SEQ ID NO: 782848 - RNA, 19 nt, Homo sapiens
gaucauguuugaacucauu

SEQ ID NO: 782849 - RNA, 19 nt, Homo sapiens
ccaauggccugcacuugua

SEQ ID NO: 782850 - RNA, 19 nt, Homo sapiens
gagcaggacucuuggaugu

SEQ ID NO: 782851 - RNA, 19 nt, Homo sapiens
ggacucugauccuuaauug

SEQ ID NO: 782852 - RNA, 19 nt, Homo sapiens
gcucuuaccucauagaugu

SEQ ID NO: 782853 - RNA, 19 nt, Homo sapiens
caggagcucuuaccucaua

SEQ ID NO: 782854 - RNA, 19 nt, Homo sapiens
guacagacuuuguccuauu

SEQ ID NO: 782855 - RNA, 19 nt, Homo sapiens
gaagagacaaacaagauaa

SEQ ID NO: 782856 - RNA, 19 nt, Homo sapiens
gcauuccacuuucugauuu

SEQ ID NO: 782857 - RNA, 19 nt, Homo sapiens
ggagucacaugguugcuaa

SEQ ID NO: 782858 - RNA, 19 nt, Homo sapiens
ggagagcuauuuaacacaa

SEQ ID NO: 782859 - RNA, 19 nt, Homo sapiens
gaagggcugucacuuuaga

SEQ ID NO: 782860 - RNA, 19 nt, Homo sapiens
ggacaucauccacagaaua

SEQ ID NO: 782861 - RNA, 19 nt, Homo sapiens
ggaggcugguguucgauua

SEQ ID NO: 782862 - RNA, 19 nt, Homo sapiens
uugagucucuguacaauua

SEQ ID NO: 782863 - RNA, 19 nt, Homo sapiens
gaagagacaagcugagauu

SEQ ID NO: 782864 - RNA, 19 nt, Homo sapiens
ccagagacauugaaggaaa

SEQ ID NO: 782865 - RNA, 19 nt, Homo sapiens
aggaagggcugucacuuua

SEQ ID NO: 782866 - RNA, 19 nt, Homo sapiens
gggaaacucucgaccuuga

SEQ ID NO: 782867 - RNA, 19 nt, Homo sapiens
ccaacuacauugacggaua

SEQ ID NO: 782868 - RNA, 19 nt, Homo sapiens
cauggaagaugaauaaugu

SEQ ID NO: 782869 - RNA, 19 nt, Homo sapiens
gaaugaaccaggauuuaaa

SEQ ID NO: 782870 - RNA, 19 nt, Homo sapiens
ccauggagcuuuagagaga

SEQ ID NO: 782871 - RNA, 19 nt, Homo sapiens
ggugguagcuuucuuugga

SEQ ID NO: 782872 - RNA, 19 nt, Homo sapiens
gaaagggucauaggaagua

SEQ ID NO: 782873 - RNA, 19 nt, Homo sapiens
ggugagauguggacucuga

SEQ ID NO: 782874 - RNA, 19 nt, Homo sapiens
gcacagcagagauaucuaa

SEQ ID NO: 782875 - RNA, 19 nt, Homo sapiens
gaggguagguuagaagaaa

SEQ ID NO: 782876 - RNA, 19 nt, Homo sapiens
cuaggaagcuccaucuuga

SEQ ID NO: 782877 - RNA, 19 nt, Homo sapiens
ucacaaaccugguggaagu

SEQ ID NO: 782878 - RNA, 19 nt, Homo sapiens
acagugaaguguaaucuuu

SEQ ID NO: 782879 - RNA, 19 nt, Homo sapiens
gagcagacucuucuaguuu

SEQ ID NO: 782880 - RNA, 19 nt, Homo sapiens
gauuuagccuuguugguuu

SEQ ID NO: 782881 - RNA, 19 nt, Homo sapiens
aggaagaaauugaggcuua

SEQ ID NO: 782882 - RNA, 19 nt, Homo sapiens
gaaccaacauuugcuaagu

SEQ ID NO: 782883 - RNA, 19 nt, Homo sapiens
ggaagagacaaacaagaua

SEQ ID NO: 782884 - RNA, 19 nt, Homo sapiens
uaucuuagcugcacuccaa

SEQ ID NO: 782885 - RNA, 19 nt, Homo sapiens
gucauuccauguaaaguua

SEQ ID NO: 782886 - RNA, 19 nt, Homo sapiens
gaaccgaggaugcagauga

SEQ ID NO: 782887 - RNA, 19 nt, Homo sapiens
gaaggaacccauuaacuca

SEQ ID NO: 782888 - RNA, 19 nt, Homo sapiens
gcagagaauucaagaaggu

SEQ ID NO: 782889 - RNA, 19 nt, Homo sapiens
gggcugaccuguaggaugu

SEQ ID NO: 782890 - RNA, 19 nt, Homo sapiens
gcaggugucucuuuaaagg

SEQ ID NO: 782891 - RNA, 19 nt, Homo sapiens
ggagaaagggucauaggaa

SEQ ID NO: 782892 - RNA, 19 nt, Homo sapiens
gcauggcacugacuauaga

SEQ ID NO: 782893 - RNA, 19 nt, Homo sapiens
gcaaggaaguaaugagaag

SEQ ID NO: 782894 - RNA, 19 nt, Homo sapiens
gaucuagggucuuguccaa

SEQ ID NO: 782895 - RNA, 19 nt, Homo sapiens
gcaaauagagcaccagcuu

SEQ ID NO: 782896 - RNA, 19 nt, Homo sapiens
gcacguaugagaagagaaa

SEQ ID NO: 782897 - RNA, 19 nt, Homo sapiens
ugacuuggcuuccccauua

SEQ ID NO: 782898 - RNA, 19 nt, Homo sapiens
ggaaaguggugccuguugu

SEQ ID NO: 782899 - RNA, 19 nt, Homo sapiens
gcucugaccucacuguuca

SEQ ID NO: 782900 - RNA, 19 nt, Homo sapiens
gaaccauggugcaguagug

SEQ ID NO: 782901 - RNA, 19 nt, Homo sapiens
gcaccuuccuuaguaauga

SEQ ID NO: 782902 - RNA, 19 nt, Homo sapiens
guauguaccucuaagacaa

SEQ ID NO: 782903 - RNA, 19 nt, Homo sapiens
ccagguggcuguuccuuug

SEQ ID NO: 782904 - RNA, 19 nt, Homo sapiens
gaagaaaggcuaccaugag

SEQ ID NO: 782905 - RNA, 19 nt, Homo sapiens
guucaugguuccuuaguga

SEQ ID NO: 782906 - RNA, 19 nt, Homo sapiens
acaauuaauuccuggguaa

SEQ ID NO: 782907 - RNA, 19 nt, Homo sapiens
guuauaggcucaagaucaa

SEQ ID NO: 782908 - RNA, 19 nt, Homo sapiens
uaaaggaggguuugugauu

SEQ ID NO: 782909 - RNA, 19 nt, Homo sapiens
ucaagaagguacagcuuug

SEQ ID NO: 782910 - RNA, 19 nt, Homo sapiens
gagcagauaacuccacaaa

SEQ ID NO: 782911 - RNA, 19 nt, Homo sapiens
gaauauuccgcaucuguaa

SEQ ID NO: 782912 - RNA, 19 nt, Homo sapiens
aaugucaggucaaugaaua

SEQ ID NO: 782913 - RNA, 19 nt, Homo sapiens
cacauuaucuccagagguu

SEQ ID NO: 782914 - RNA, 19 nt, Homo sapiens
ucaaaucacagccaaguaa

SEQ ID NO: 782915 - RNA, 19 nt, Homo sapiens
cacacuagcucuugcugua

SEQ ID NO: 782916 - RNA, 19 nt, Homo sapiens
gaaaucacuugcccacagu

SEQ ID NO: 782917 - RNA, 19 nt, Homo sapiens
ggaagaaauugaggcuuau

SEQ ID NO: 782918 - RNA, 19 nt, Homo sapiens
gcacacaggaagaaauuga

SEQ ID NO: 782919 - RNA, 19 nt, Homo sapiens
cacaggaucuuucaugaug

SEQ ID NO: 782920 - RNA, 19 nt, Homo sapiens
gaagauggucccuuugguu

SEQ ID NO: 782921 - RNA, 19 nt, Homo sapiens
cuacuuugcugcugaguug

SEQ ID NO: 782922 - RNA, 19 nt, Homo sapiens
gaauagaacuccacgaaac

SEQ ID NO: 782923 - RNA, 19 nt, Homo sapiens
gaagaugcgaugccuguua

SEQ ID NO: 782924 - RNA, 19 nt, Homo sapiens
uggaugagaugauggauuu

SEQ ID NO: 782925 - RNA, 19 nt, Homo sapiens
cgaugccuguuauaaauua

SEQ ID NO: 782926 - RNA, 19 nt, Homo sapiens
ggagagaaauaugaacuuc

SEQ ID NO: 782927 - RNA, 19 nt, Homo sapiens
gaagaugauuuggaugaga

SEQ ID NO: 782928 - RNA, 19 nt, Homo sapiens
gaugauggauuuaagugau

SEQ ID NO: 782929 - RNA, 19 nt, Homo sapiens
gauuuacucugugcuguuu

SEQ ID NO: 782930 - RNA, 19 nt, Homo sapiens
ggaaugauagccagucaga

SEQ ID NO: 782931 - RNA, 19 nt, Homo sapiens
gcagauguccggcgaagug

SEQ ID NO: 782932 - RNA, 19 nt, Homo sapiens
gcgaauagaacuccacgaa

SEQ ID NO: 782933 - RNA, 19 nt, Homo sapiens
gggacacuaugaaaucuug

SEQ ID NO: 782934 - RNA, 19 nt, Homo sapiens
gaaggaaagauuugaagca

SEQ ID NO: 782935 - RNA, 19 nt, Homo sapiens
gagcagaaggaaagauuug

SEQ ID NO: 782936 - RNA, 19 nt, Homo sapiens
gagagcagaaggaaagauu

SEQ ID NO: 782937 - RNA, 19 nt, Homo sapiens
gaugagaugauggauuuaa

SEQ ID NO: 782938 - RNA, 19 nt, Homo sapiens
guguagcacugaccaagaa

SEQ ID NO: 782939 - RNA, 19 nt, Homo sapiens
gaccaggagagaaauauga

SEQ ID NO: 782940 - RNA, 19 nt, Homo sapiens
ccacgaaacagacuucaau

SEQ ID NO: 782941 - RNA, 19 nt, Homo sapiens
gcagaaggaaagauuugaa

SEQ ID NO: 782942 - RNA, 19 nt, Homo sapiens
ucaaugggcagaagcuaaa

SEQ ID NO: 782943 - RNA, 19 nt, Homo sapiens
acuaugaaaucuuggaaug

SEQ ID NO: 782944 - RNA, 19 nt, Homo sapiens
aagugaaacugaagaggaa

SEQ ID NO: 782945 - RNA, 19 nt, Homo sapiens
gaugcgaugccuguuauaa

SEQ ID NO: 782946 - RNA, 19 nt, Homo sapiens
gaggaagaagagaugauuu

SEQ ID NO: 782947 - RNA, 19 nt, Homo sapiens
gcagcaagagcgcgaauag

SEQ ID NO: 782948 - RNA, 19 nt, Homo sapiens
ucugugcuguuuccaaauu

SEQ ID NO: 782949 - RNA, 19 nt, Homo sapiens
aagaugcgaugccuguuau

SEQ ID NO: 782950 - RNA, 19 nt, Homo sapiens
cgaauagaacuccacgaaa

SEQ ID NO: 782951 - RNA, 19 nt, Homo sapiens
aaacugaagaggaagaaga

SEQ ID NO: 782952 - RNA, 19 nt, Homo sapiens
ugcgaugccuguuauaaau

SEQ ID NO: 782953 - RNA, 19 nt, Homo sapiens
gcacgagagcagaaggaaa

SEQ ID NO: 782954 - RNA, 19 nt, Homo sapiens
gcugagggacacuaugaaa

SEQ ID NO: 782955 - RNA, 19 nt, Homo sapiens
gagaugauggauuuaagug

SEQ ID NO: 782956 - RNA, 19 nt, Homo sapiens
gaauaaauuucagcaaacc

SEQ ID NO: 782957 - RNA, 19 nt, Homo sapiens
gaagaggaagaagagauga

SEQ ID NO: 782958 - RNA, 19 nt, Homo sapiens
ccaagaagaggaagaagag

SEQ ID NO: 782959 - RNA, 19 nt, Homo sapiens
acucugugcuguuuccaaa

SEQ ID NO: 782960 - RNA, 19 nt, Homo sapiens
gagggacacuaugaaaucu

SEQ ID NO: 782961 - RNA, 19 nt, Homo sapiens
gaucugccuaccucacuuu

SEQ ID NO: 782962 - RNA, 19 nt, Homo sapiens
cgaccgcagcguugaauga

SEQ ID NO: 782963 - RNA, 19 nt, Homo sapiens
gcgaugccuguuauaaauu

SEQ ID NO: 782964 - RNA, 19 nt, Homo sapiens
ugagggacacuaugaaauc

SEQ ID NO: 782965 - RNA, 19 nt, Homo sapiens
gauagccagucagaucugu

SEQ ID NO: 782966 - RNA, 19 nt, Homo sapiens
agcaagagcgcgaauagaa

SEQ ID NO: 782967 - RNA, 19 nt, Homo sapiens
aagaugauuuggaugagau

SEQ ID NO: 782968 - RNA, 19 nt, Homo sapiens
ggaccaggagagaaauaug

SEQ ID NO: 782969 - RNA, 19 nt, Homo sapiens
gcaagagcgcgaauagaac

SEQ ID NO: 782970 - RNA, 19 nt, Homo sapiens
ugauuuggaugagaugaug

SEQ ID NO: 782971 - RNA, 19 nt, Homo sapiens
ucaugucugugaaagugaa

SEQ ID NO: 782972 - RNA, 19 nt, Homo sapiens
aaugauagccagucagauc

SEQ ID NO: 782973 - RNA, 19 nt, Homo sapiens
gguggaagcagagcgaaga

SEQ ID NO: 782974 - RNA, 19 nt, Homo sapiens
ucaagcaguuccucaucuc

SEQ ID NO: 782975 - RNA, 19 nt, Homo sapiens
gucaagcaguuccucaucu

SEQ ID NO: 782976 - RNA, 19 nt, Homo sapiens
caagagcgcgaauagaacu

SEQ ID NO: 782977 - RNA, 19 nt, Homo sapiens
ugaaaucuuggaaugauag

SEQ ID NO: 782978 - RNA, 19 nt, Homo sapiens
agaagaggaagaagagaug

SEQ ID NO: 782979 - RNA, 19 nt, Homo sapiens
ccagcguggugguucaugu

SEQ ID NO: 782980 - RNA, 19 nt, Homo sapiens
gaacuucacgcgggaacag

SEQ ID NO: 782981 - RNA, 19 nt, Homo sapiens
gcgaagugcgggacaaguc

SEQ ID NO: 782982 - RNA, 19 nt, Homo sapiens
augaugaccagguuacuuu

SEQ ID NO: 782983 - RNA, 19 nt, Homo sapiens
ugaccaagaagaggaagaa

SEQ ID NO: 782984 - RNA, 19 nt, Homo sapiens
gaagaggaagaagagacaa

SEQ ID NO: 782985 - RNA, 19 nt, Homo sapiens
ugaagaggaagaagagaca

SEQ ID NO: 782986 - RNA, 19 nt, Homo sapiens
cuuuagaagagucagaaua

SEQ ID NO: 782987 - RNA, 19 nt, Homo sapiens
gcacucuucaccaucuaug

SEQ ID NO: 782988 - RNA, 19 nt, Homo sapiens
cacgagagcagaaggaaag

SEQ ID NO: 782989 - RNA, 19 nt, Homo sapiens
agaggaagaagagaugauu

SEQ ID NO: 782990 - RNA, 19 nt, Homo sapiens
cguggugguucaugucugu

SEQ ID NO: 782991 - RNA, 19 nt, Homo sapiens
gaacuccacgaaacagacu

SEQ ID NO: 782992 - RNA, 19 nt, Homo sapiens
ggaugagaugauggauuua

SEQ ID NO: 782993 - RNA, 19 nt, Homo sapiens
cagaaggaaagauuugaag

SEQ ID NO: 782994 - RNA, 19 nt, Homo sapiens
ugaagaugauuuggaugag

SEQ ID NO: 782995 - RNA, 19 nt, Homo sapiens
augaagaugauuuggauga

SEQ ID NO: 782996 - RNA, 19 nt, Homo sapiens
ugaaugagccccagaccuu

SEQ ID NO: 782997 - RNA, 19 nt, Homo sapiens
ucugugaaagugaaacuga

SEQ ID NO: 782998 - RNA, 19 nt, Homo sapiens
ggaaagcgaucaucuaaug

SEQ ID NO: 782999 - RNA, 19 nt, Homo sapiens
gaagacaccuguacuguug

SEQ ID NO: 783000 - RNA, 19 nt, Homo sapiens
ggacccaaauaaaucauua

SEQ ID NO: 783001 - RNA, 19 nt, Homo sapiens
ggagaugccuuauuacaau

SEQ ID NO: 783002 - RNA, 19 nt, Homo sapiens
caagaggccuucuauguga

SEQ ID NO: 783003 - RNA, 19 nt, Homo sapiens
ugacgaagcuauuacauug

SEQ ID NO: 783004 - RNA, 19 nt, Homo sapiens
gagggaagcucacgagaga

SEQ ID NO: 783005 - RNA, 19 nt, Homo sapiens
guagaugaguuaaugauga

SEQ ID NO: 783006 - RNA, 19 nt, Homo sapiens
gaaagcuucuugcuaucua

SEQ ID NO: 783007 - RNA, 19 nt, Homo sapiens
ugaagaugcuacagaauuu

SEQ ID NO: 783008 - RNA, 19 nt, Homo sapiens
uaacucaacuggacccaaa

SEQ ID NO: 783009 - RNA, 19 nt, Homo sapiens
ggacgaggaugaacgugaa

SEQ ID NO: 783010 - RNA, 19 nt, Homo sapiens
ggagaugacuuugaagaug

SEQ ID NO: 783011 - RNA, 19 nt, Homo sapiens
gagcaagauuucucacuau

SEQ ID NO: 783012 - RNA, 19 nt, Homo sapiens
cugaauccauuguuucuua

SEQ ID NO: 783013 - RNA, 19 nt, Homo sapiens
cuaaugaaguguugaaugu

SEQ ID NO: 783014 - RNA, 19 nt, Homo sapiens
caacuggacccaaauaaau

SEQ ID NO: 783015 - RNA, 19 nt, Homo sapiens
caagauuucucacuaugug

SEQ ID NO: 783016 - RNA, 19 nt, Homo sapiens
gcagaacaguuucguuugg

SEQ ID NO: 783017 - RNA, 19 nt, Homo sapiens
cgauggagaugacuuugaa

SEQ ID NO: 783018 - RNA, 19 nt, Homo sapiens
ucagauaccuguguccaaa

SEQ ID NO: 783019 - RNA, 19 nt, Homo sapiens
agacagaaauguugaugug

SEQ ID NO: 783020 - RNA, 19 nt, Homo sapiens
gaacgugaagccagagaaa

SEQ ID NO: 783021 - RNA, 19 nt, Homo sapiens
gguggaugauggagaagua

SEQ ID NO: 783022 - RNA, 19 nt, Homo sapiens
guucauaugguuagugaua

SEQ ID NO: 783023 - RNA, 19 nt, Homo sapiens
gaucaucacccaccgagaa

SEQ ID NO: 783024 - RNA, 19 nt, Homo sapiens
cagaaauguugauguggua

SEQ ID NO: 783025 - RNA, 19 nt, Homo sapiens
gagaugccuuauuacaauu

SEQ ID NO: 783026 - RNA, 19 nt, Homo sapiens
gagaaaaugugaagagaga

SEQ ID NO: 783027 - RNA, 19 nt, Homo sapiens
gaacacaacaguagaugag

SEQ ID NO: 783028 - RNA, 19 nt, Homo sapiens
ugauugccauccuguauuu

SEQ ID NO: 783029 - RNA, 19 nt, Homo sapiens
agagagagauggcagaaca

SEQ ID NO: 783030 - RNA, 19 nt, Homo sapiens
gaagagagagcaagaugag

SEQ ID NO: 783031 - RNA, 19 nt, Homo sapiens
agagcaagauuucucacua

SEQ ID NO: 783032 - RNA, 19 nt, Homo sapiens
agaaauguguaugaccuua

SEQ ID NO: 783033 - RNA, 19 nt, Homo sapiens
aaacaacagucuuuauguc

SEQ ID NO: 783034 - RNA, 19 nt, Homo sapiens
caaagaacaagaagaggaa

SEQ ID NO: 783035 - RNA, 19 nt, Homo sapiens
caaugugucuugcugaauc

SEQ ID NO: 783036 - RNA, 19 nt, Homo sapiens
gaauacagagacagaaaug

SEQ ID NO: 783037 - RNA, 19 nt, Homo sapiens
cuuaagauuucccaucaaa

SEQ ID NO: 783038 - RNA, 19 nt, Homo sapiens
uaaaguuguucccucaaga

SEQ ID NO: 783039 - RNA, 19 nt, Homo sapiens
ggagagacguaacucaacu

SEQ ID NO: 783040 - RNA, 19 nt, Homo sapiens
ucaggaagcaguacuauuc

SEQ ID NO: 783041 - RNA, 19 nt, Homo sapiens
gcuauuacauugcuugaac

SEQ ID NO: 783042 - RNA, 19 nt, Homo sapiens
ucaauucaaugucacacuu

SEQ ID NO: 783043 - RNA, 19 nt, Homo sapiens
ggagcagauucgcaaagaa

SEQ ID NO: 783044 - RNA, 19 nt, Homo sapiens
agagauggcagaacaguuu

SEQ ID NO: 783045 - RNA, 19 nt, Homo sapiens
ccaacaacaggaagauaua

SEQ ID NO: 783046 - RNA, 19 nt, Homo sapiens
gaacuucagauaccugugu

SEQ ID NO: 783047 - RNA, 19 nt, Homo sapiens
caacaacaggaagauauaa

SEQ ID NO: 783048 - RNA, 19 nt, Homo sapiens
aaugaaguguugaauguga

SEQ ID NO: 783049 - RNA, 19 nt, Homo sapiens
gacaaaggacuccaacaga

SEQ ID NO: 783050 - RNA, 19 nt, Homo sapiens
caggagucauuaaaucaaa

SEQ ID NO: 783051 - RNA, 19 nt, Homo sapiens
caacagucuuuauguccuu

SEQ ID NO: 783052 - RNA, 19 nt, Homo sapiens
ccuaaaaucucuacacuug

SEQ ID NO: 783053 - RNA, 19 nt, Homo sapiens
uaacgccgcugaagguauc

SEQ ID NO: 783054 - RNA, 19 nt, Homo sapiens
guaaaguuguucccucaag

SEQ ID NO: 783055 - RNA, 19 nt, Homo sapiens
ggacccacauccagaccaa

SEQ ID NO: 783056 - RNA, 19 nt, Homo sapiens
gaagcaguacuauucaaga

SEQ ID NO: 783057 - RNA, 19 nt, Homo sapiens
gcacagacccgggaacagu

SEQ ID NO: 783058 - RNA, 19 nt, Homo sapiens
ggaagacaguacgguccua

SEQ ID NO: 783059 - RNA, 19 nt, Homo sapiens
gaagacgggagauguggaa

SEQ ID NO: 783060 - RNA, 19 nt, Homo sapiens
gagauuaaacagauucuag

SEQ ID NO: 783061 - RNA, 19 nt, Homo sapiens
uuacugagcaccuuuccua

SEQ ID NO: 783062 - RNA, 19 nt, Homo sapiens
acacaacaguagaugaguu

SEQ ID NO: 783063 - RNA, 19 nt, Homo sapiens
ggaugauggagaaguauuu

SEQ ID NO: 783064 - RNA, 19 nt, Homo sapiens
caaaucaccgauguucaua

SEQ ID NO: 783065 - RNA, 19 nt, Homo sapiens
ccaggcagauuguagaaag

SEQ ID NO: 783066 - RNA, 19 nt, Homo sapiens
cacaacaguagaugaguua

SEQ ID NO: 783067 - RNA, 19 nt, Homo sapiens
caagggaacacaacaguag

SEQ ID NO: 783068 - RNA, 19 nt, Homo sapiens
caacagagcaagauuucuc

SEQ ID NO: 783069 - RNA, 19 nt, Homo sapiens
gcuuugugcugaauccauu

SEQ ID NO: 783070 - RNA, 19 nt, Homo sapiens
cuaucuaccuccaccauga

SEQ ID NO: 783071 - RNA, 19 nt, Homo sapiens
aaacauugacgaagcuauu

SEQ ID NO: 783072 - RNA, 19 nt, Homo sapiens
aaucaccgauguucauaug

SEQ ID NO: 783073 - RNA, 19 nt, Homo sapiens
ggaacagucggaagaacaa

SEQ ID NO: 783074 - RNA, 19 nt, Homo sapiens
gcaggagucauuaaaucaa

SEQ ID NO: 783075 - RNA, 19 nt, Homo sapiens
gaagacaguacgguccuaa

SEQ ID NO: 783076 - RNA, 19 nt, Homo sapiens
gaucuucacagcccaacaa

SEQ ID NO: 783077 - RNA, 19 nt, Homo sapiens
aagaacaaaucaccgaugu

SEQ ID NO: 783078 - RNA, 19 nt, Homo sapiens
aacaguagaugaguuaaug

SEQ ID NO: 783079 - RNA, 19 nt, Homo sapiens
ggaacacaacaguagauga

SEQ ID NO: 783080 - RNA, 19 nt, Homo sapiens
uaugugcaauagacacuuu

SEQ ID NO: 783081 - RNA, 19 nt, Homo sapiens
ucaagaggccuucuaugug

SEQ ID NO: 783082 - RNA, 19 nt, Homo sapiens
uucaagagguaaagagaaa

SEQ ID NO: 783083 - RNA, 19 nt, Homo sapiens
uggcagaacaguuucguuu

SEQ ID NO: 783084 - RNA, 19 nt, Homo sapiens
ugugaaagcccgagauaga

SEQ ID NO: 783085 - RNA, 19 nt, Homo sapiens
caacauggaccgggagaug

SEQ ID NO: 783086 - RNA, 19 nt, Homo sapiens
aaucagggcucucuuaucc

SEQ ID NO: 783087 - RNA, 19 nt, Homo sapiens
ggcauguacuggcauugaa

SEQ ID NO: 783088 - RNA, 19 nt, Homo sapiens
ucaacuggacccaaauaaa

SEQ ID NO: 783089 - RNA, 19 nt, Homo sapiens
ugggaaagcgaucaucuaa

SEQ ID NO: 783090 - RNA, 19 nt, Homo sapiens
cuugggaucugacaaagga

SEQ ID NO: 783091 - RNA, 19 nt, Homo sapiens
ugaaagcccgagauagaaa

SEQ ID NO: 783092 - RNA, 19 nt, Homo sapiens
ggcgucaucugccuugaga

SEQ ID NO: 783093 - RNA, 19 nt, Homo sapiens
ugggagggcuggccaacuu

SEQ ID NO: 783094 - RNA, 19 nt, Homo sapiens
ccuaucgccuuucacuuga

SEQ ID NO: 783095 - RNA, 19 nt, Homo sapiens
gguguaauaccacaggaaa

SEQ ID NO: 783096 - RNA, 19 nt, Homo sapiens
gcaagauuucucacuaugu

SEQ ID NO: 783097 - RNA, 19 nt, Homo sapiens
gaagaugcuacagaauuug

SEQ ID NO: 783098 - RNA, 19 nt, Homo sapiens
ggaaagcgaucaucuaaug

SEQ ID NO: 783099 - RNA, 19 nt, Homo sapiens
gaagacaccuguacuguug

SEQ ID NO: 783100 - RNA, 19 nt, Homo sapiens
ggacccaaauaaaucauua

SEQ ID NO: 783101 - RNA, 19 nt, Homo sapiens
caagaggccuucuauguga

SEQ ID NO: 783102 - RNA, 19 nt, Homo sapiens
ugacgaagcuauuacauug

SEQ ID NO: 783103 - RNA, 19 nt, Homo sapiens
gagggaagcucacgagaga

SEQ ID NO: 783104 - RNA, 19 nt, Homo sapiens
guagaugaguuaaugauga

SEQ ID NO: 783105 - RNA, 19 nt, Homo sapiens
gaaagcuucuugcuaucua

SEQ ID NO: 783106 - RNA, 19 nt, Homo sapiens
uaacucaacuggacccaaa

SEQ ID NO: 783107 - RNA, 19 nt, Homo sapiens
ggacgaggaugaacgugaa

SEQ ID NO: 783108 - RNA, 19 nt, Homo sapiens
gagcaagauuucucacuau

SEQ ID NO: 783109 - RNA, 19 nt, Homo sapiens
cugaauccauuguuucuua

SEQ ID NO: 783110 - RNA, 19 nt, Homo sapiens
cuaaugaaguguugaaugu

SEQ ID NO: 783111 - RNA, 19 nt, Homo sapiens
caacuggacccaaauaaau

SEQ ID NO: 783112 - RNA, 19 nt, Homo sapiens
caagauuucucacuaugug

SEQ ID NO: 783113 - RNA, 19 nt, Homo sapiens
gcagaacaguuucguuugg

SEQ ID NO: 783114 - RNA, 19 nt, Homo sapiens
ucagauaccuguguccaaa

SEQ ID NO: 783115 - RNA, 19 nt, Homo sapiens
agacagaaauguugaugug

SEQ ID NO: 783116 - RNA, 19 nt, Homo sapiens
gaacgugaagccagagaaa

SEQ ID NO: 783117 - RNA, 19 nt, Homo sapiens
cagaaauguugauguggua

SEQ ID NO: 783118 - RNA, 19 nt, Homo sapiens
gagaaaaugugaagagaga

SEQ ID NO: 783119 - RNA, 19 nt, Homo sapiens
gaacacaacaguagaugag

SEQ ID NO: 783120 - RNA, 19 nt, Homo sapiens
ugauugccauccuguauuu

SEQ ID NO: 783121 - RNA, 19 nt, Homo sapiens
agagagagauggcagaaca

SEQ ID NO: 783122 - RNA, 19 nt, Homo sapiens
gaagagagagcaagaugag

SEQ ID NO: 783123 - RNA, 19 nt, Homo sapiens
agagcaagauuucucacua

SEQ ID NO: 783124 - RNA, 19 nt, Homo sapiens
aaacaacagucuuuauguc

SEQ ID NO: 783125 - RNA, 19 nt, Homo sapiens
caaagaacaagaagaggaa

SEQ ID NO: 783126 - RNA, 19 nt, Homo sapiens
gaauacagagacagaaaug

SEQ ID NO: 783127 - RNA, 19 nt, Homo sapiens
cuuaagauuucccaucaaa

SEQ ID NO: 783128 - RNA, 19 nt, Homo sapiens
uaaaguuguucccucaaga

SEQ ID NO: 783129 - RNA, 19 nt, Homo sapiens
ggagagacguaacucaacu

SEQ ID NO: 783130 - RNA, 19 nt, Homo sapiens
gcuauuacauugcuugaac

SEQ ID NO: 783131 - RNA, 19 nt, Homo sapiens
ucaauucaaugucacacuu

SEQ ID NO: 783132 - RNA, 19 nt, Homo sapiens
ggagcagauucgcaaagaa

SEQ ID NO: 783133 - RNA, 19 nt, Homo sapiens
agagauggcagaacaguuu

SEQ ID NO: 783134 - RNA, 19 nt, Homo sapiens
ccaacaacaggaagauaua

SEQ ID NO: 783135 - RNA, 19 nt, Homo sapiens
gaacuucagauaccugugu

SEQ ID NO: 783136 - RNA, 19 nt, Homo sapiens
uaacgccgcugaagguauc

SEQ ID NO: 783137 - RNA, 19 nt, Homo sapiens
caacaacaggaagauauaa

SEQ ID NO: 783138 - RNA, 19 nt, Homo sapiens
aaugaaguguugaauguga

SEQ ID NO: 783139 - RNA, 19 nt, Homo sapiens
gacaaaggacuccaacaga

SEQ ID NO: 783140 - RNA, 19 nt, Homo sapiens
caacagucuuuauguccuu

SEQ ID NO: 783141 - RNA, 19 nt, Homo sapiens
ccuaaaaucucuacacuug

SEQ ID NO: 783142 - RNA, 19 nt, Homo sapiens
guaaaguuguucccucaag

SEQ ID NO: 783143 - RNA, 19 nt, Homo sapiens
ggacccacauccagaccaa

SEQ ID NO: 783144 - RNA, 19 nt, Homo sapiens
ggaagacaguacgguccua

SEQ ID NO: 783145 - RNA, 19 nt, Homo sapiens
gaagacgggagauguggaa

SEQ ID NO: 783146 - RNA, 19 nt, Homo sapiens
gagauuaaacagauucuag

SEQ ID NO: 783147 - RNA, 19 nt, Homo sapiens
uuacugagcaccuuuccua

SEQ ID NO: 783148 - RNA, 19 nt, Homo sapiens
acacaacaguagaugaguu

SEQ ID NO: 783149 - RNA, 19 nt, Homo sapiens
ccaggcagauuguagaaag

SEQ ID NO: 783150 - RNA, 19 nt, Homo sapiens
cacaacaguagaugaguua

SEQ ID NO: 783151 - RNA, 19 nt, Homo sapiens
caagggaacacaacaguag

SEQ ID NO: 783152 - RNA, 19 nt, Homo sapiens
caacagagcaagauuucuc

SEQ ID NO: 783153 - RNA, 19 nt, Homo sapiens
gcuuugugcugaauccauu

SEQ ID NO: 783154 - RNA, 19 nt, Homo sapiens
cuaucuaccuccaccauga

SEQ ID NO: 783155 - RNA, 19 nt, Homo sapiens
gaagacaguacgguccuaa

SEQ ID NO: 783156 - RNA, 19 nt, Homo sapiens
aaacauugacgaagcuauu

SEQ ID NO: 783157 - RNA, 19 nt, Homo sapiens
gaucuucacagcccaacaa

SEQ ID NO: 783158 - RNA, 19 nt, Homo sapiens
aacaguagaugaguuaaug

SEQ ID NO: 783159 - RNA, 19 nt, Homo sapiens
ggaacacaacaguagauga

SEQ ID NO: 783160 - RNA, 19 nt, Homo sapiens
uaugugcaauagacacuuu

SEQ ID NO: 783161 - RNA, 19 nt, Homo sapiens
ucaagaggccuucuaugug

SEQ ID NO: 783162 - RNA, 19 nt, Homo sapiens
uggcagaacaguuucguuu

SEQ ID NO: 783163 - RNA, 19 nt, Homo sapiens
caacauggaccgggagaug

SEQ ID NO: 783164 - RNA, 19 nt, Homo sapiens
ugugaaagcccgagauaga

SEQ ID NO: 783165 - RNA, 19 nt, Homo sapiens
ggcauguacuggcauugaa

SEQ ID NO: 783166 - RNA, 19 nt, Homo sapiens
ucaacuggacccaaauaaa

SEQ ID NO: 783167 - RNA, 19 nt, Homo sapiens
ugggaaagcgaucaucuaa

SEQ ID NO: 783168 - RNA, 19 nt, Homo sapiens
cuugggaucugacaaagga

SEQ ID NO: 783169 - RNA, 19 nt, Homo sapiens
ugaaagcccgagauagaaa

SEQ ID NO: 783170 - RNA, 19 nt, Homo sapiens
ccuaucgccuuucacuuga

SEQ ID NO: 783171 - RNA, 19 nt, Homo sapiens
gcaagauuucucacuaugu

SEQ ID NO: 783172 - RNA, 19 nt, Homo sapiens
ccaccaccuucaucaucua

SEQ ID NO: 783173 - RNA, 19 nt, Homo sapiens
ggagagauuaaacagauuc

SEQ ID NO: 783174 - RNA, 19 nt, Homo sapiens
gguguaauaccacaggaaa

SEQ ID NO: 783175 - RNA, 19 nt, Homo sapiens
gggaagcucacgagagaga

SEQ ID NO: 783176 - RNA, 19 nt, Homo sapiens
uuuauuggcucauuagaag

SEQ ID NO: 783177 - RNA, 19 nt, Homo sapiens
gcagcuaucaaugguguaa

SEQ ID NO: 783178 - RNA, 19 nt, Homo sapiens
uacuuaagauuucccauca

SEQ ID NO: 783179 - RNA, 19 nt, Homo sapiens
uauuggagguaaaguuguu

SEQ ID NO: 783180 - RNA, 19 nt, Homo sapiens
gccuaucgccuuucacuug

SEQ ID NO: 783181 - RNA, 19 nt, Homo sapiens
gggcuugggaucugacaaa

SEQ ID NO: 783182 - RNA, 19 nt, Homo sapiens
ccaaaaugcuguuaaaagg

SEQ ID NO: 783183 - RNA, 19 nt, Homo sapiens
uuggagagauuaaacagau

SEQ ID NO: 783184 - RNA, 19 nt, Homo sapiens
auacagagacagaaauguu

SEQ ID NO: 783185 - RNA, 19 nt, Homo sapiens
ggacuuaguggcagcuauc

SEQ ID NO: 783186 - RNA, 19 nt, Homo sapiens
cagaacaguuucguuugga

SEQ ID NO: 783187 - RNA, 19 nt, Homo sapiens
gcauguacuggcauugaaa

SEQ ID NO: 783188 - RNA, 19 nt, Homo sapiens
agcuaucaaugguguaaua

SEQ ID NO: 783189 - RNA, 19 nt, Homo sapiens
ugaagacaccuguacuguu

SEQ ID NO: 783190 - RNA, 19 nt, Homo sapiens
cugagcaccuuuccuagga

SEQ ID NO: 783191 - RNA, 19 nt, Homo sapiens
caacaguagaugaguuaau

SEQ ID NO: 783192 - RNA, 19 nt, Homo sapiens
caaaccauucggacucaaa

SEQ ID NO: 783193 - RNA, 19 nt, Homo sapiens
gcuccuacuuccucuucuu

SEQ ID NO: 783194 - RNA, 19 nt, Homo sapiens
gaugaaaguguguuaacca

SEQ ID NO: 783195 - RNA, 19 nt, Homo sapiens
gugaaagcccgagauagaa

SEQ ID NO: 783196 - RNA, 19 nt, Homo sapiens
ggugauugccauccuguau

SEQ ID NO: 783197 - RNA, 19 nt, Homo sapiens
gcucgucucacucaauuca

SEQ ID NO: 783198 - RNA, 19 nt, Homo sapiens
gggaagagaugcuaaauau

SEQ ID NO: 783199 - RNA, 19 nt, Homo sapiens
ccaagaaucuguggaaaua

SEQ ID NO: 783200 - RNA, 19 nt, Homo sapiens
cgacuaaacuuaaucugua

SEQ ID NO: 783201 - RNA, 19 nt, Homo sapiens
gaucauaccucacuacauc

SEQ ID NO: 783202 - RNA, 19 nt, Homo sapiens
cagaacagcuuucaccaaa

SEQ ID NO: 783203 - RNA, 19 nt, Homo sapiens
gcaaaucaguguaauccuu

SEQ ID NO: 783204 - RNA, 19 nt, Homo sapiens
gaagagaugcuaaauauac

SEQ ID NO: 783205 - RNA, 19 nt, Homo sapiens
agacagaccucaacauuca

SEQ ID NO: 783206 - RNA, 19 nt, Homo sapiens
guaguauaguccucaaaua

SEQ ID NO: 783207 - RNA, 19 nt, Homo sapiens
gaacgcgacuaaacuuaau

SEQ ID NO: 783208 - RNA, 19 nt, Homo sapiens
gcagacagaccucaacauu

SEQ ID NO: 783209 - RNA, 19 nt, Homo sapiens
gaacaagaaagaagaacuu

SEQ ID NO: 783210 - RNA, 19 nt, Homo sapiens
gaagauuugugcagaccaa

SEQ ID NO: 783211 - RNA, 19 nt, Homo sapiens
ggaggaagaggaagauuug

SEQ ID NO: 783212 - RNA, 19 nt, Homo sapiens
ggaacgcgacuaaacuuaa

SEQ ID NO: 783213 - RNA, 19 nt, Homo sapiens
ggaagagaugcuaaauaua

SEQ ID NO: 783214 - RNA, 19 nt, Homo sapiens
caaaguggguaguauaguc

SEQ ID NO: 783215 - RNA, 19 nt, Homo sapiens
caguugauguucaccauaa

SEQ ID NO: 783216 - RNA, 19 nt, Homo sapiens
uaaaacagcugagacuuaa

SEQ ID NO: 783217 - RNA, 19 nt, Homo sapiens
gauagaugguguuggugaa

SEQ ID NO: 783218 - RNA, 19 nt, Homo sapiens
ccuaagcuccaguaaauaa

SEQ ID NO: 783219 - RNA, 19 nt, Homo sapiens
acagggaacuacacaguga

SEQ ID NO: 783220 - RNA, 19 nt, Homo sapiens
aaagauagguaggacagaa

SEQ ID NO: 783221 - RNA, 19 nt, Homo sapiens
gaugcuaaauauaccaaga

SEQ ID NO: 783222 - RNA, 19 nt, Homo sapiens
cuccuaagcuccaguaaau

SEQ ID NO: 783223 - RNA, 19 nt, Homo sapiens
uaaaacagcuacagcaaga

SEQ ID NO: 783224 - RNA, 19 nt, Homo sapiens
gugacgggauugaaacaaa

SEQ ID NO: 783225 - RNA, 19 nt, Homo sapiens
ggaaggaacgcgacuaaac

SEQ ID NO: 783226 - RNA, 19 nt, Homo sapiens
caaaggaaagagagagaaa

SEQ ID NO: 783227 - RNA, 19 nt, Homo sapiens
gaaacaaagacaacaccuu

SEQ ID NO: 783228 - RNA, 19 nt, Homo sapiens
guuaaccucuuuggucauu

SEQ ID NO: 783229 - RNA, 19 nt, Homo sapiens
gaaggaacgcgacuaaacu

SEQ ID NO: 783230 - RNA, 19 nt, Homo sapiens
gagaaaacaagcaaagaua

SEQ ID NO: 783231 - RNA, 19 nt, Homo sapiens
caccuugaguucagccaua

SEQ ID NO: 783232 - RNA, 19 nt, Homo sapiens
caacauuugcuucaaguuc

SEQ ID NO: 783233 - RNA, 19 nt, Homo sapiens
gaccucaacauucaacauu

SEQ ID NO: 783234 - RNA, 19 nt, Homo sapiens
gacaacaccuugaguucag

SEQ ID NO: 783235 - RNA, 19 nt, Homo sapiens
ccaccuaagucucuugagu

SEQ ID NO: 783236 - RNA, 19 nt, Homo sapiens
ugauugacuuggcaugaaa

SEQ ID NO: 783237 - RNA, 19 nt, Homo sapiens
gaaaaggucuggguaaugc

SEQ ID NO: 783238 - RNA, 19 nt, Homo sapiens
uaaccucuuuggucauuuc

SEQ ID NO: 783239 - RNA, 19 nt, Homo sapiens
guauaguccucaaauaucg

SEQ ID NO: 783240 - RNA, 19 nt, Homo sapiens
ucacagagacagggaacua

SEQ ID NO: 783241 - RNA, 19 nt, Homo sapiens
gagccaacauuugcuucaa

SEQ ID NO: 783242 - RNA, 19 nt, Homo sapiens
gacuacaacugcccagcuu

SEQ ID NO: 783243 - RNA, 19 nt, Homo sapiens
gugauugacuuggcaugaa

SEQ ID NO: 783244 - RNA, 19 nt, Homo sapiens
guucaggcuuccuacaaga

SEQ ID NO: 783245 - RNA, 19 nt, Homo sapiens
uuaaauaaaugcccauagc

SEQ ID NO: 783246 - RNA, 19 nt, Homo sapiens
ccucaacauucaacauuca

SEQ ID NO: 783247 - RNA, 19 nt, Homo sapiens
aaacaagcaaagauaggua

SEQ ID NO: 783248 - RNA, 19 nt, Homo sapiens
gcaaaggaaagagagagaa

SEQ ID NO: 783249 - RNA, 19 nt, Homo sapiens
caccuaagucucuugagua

SEQ ID NO: 783250 - RNA, 19 nt, Homo sapiens
ucaccaaaguggguaguau

SEQ ID NO: 783251 - RNA, 19 nt, Homo sapiens
acagccagauccagugauu

SEQ ID NO: 783252 - RNA, 19 nt, Homo sapiens
caccaaaguggguaguaua

SEQ ID NO: 783253 - RNA, 19 nt, Homo sapiens
ugacuuugcuccucaccau

SEQ ID NO: 783254 - RNA, 19 nt, Homo sapiens
aaagacaacaccuugaguu

SEQ ID NO: 783255 - RNA, 19 nt, Homo sapiens
cuaagucucuugaguagcu

SEQ ID NO: 783256 - RNA, 19 nt, Homo sapiens
gcccagcuucaucuaaaua

SEQ ID NO: 783257 - RNA, 19 nt, Homo sapiens
gaagccagaagucagguau

SEQ ID NO: 783258 - RNA, 19 nt, Homo sapiens
ccaagagcaccacagacua

SEQ ID NO: 783259 - RNA, 19 nt, Homo sapiens
gguaguauaguccucaaau

SEQ ID NO: 783260 - RNA, 19 nt, Homo sapiens
caggaaggaacgcgacuaa

SEQ ID NO: 783261 - RNA, 19 nt, Homo sapiens
cugcccagcuucaucuaaa

SEQ ID NO: 783262 - RNA, 19 nt, Homo sapiens
gaaaggaagacagccagau

SEQ ID NO: 783263 - RNA, 19 nt, Homo sapiens
ggaaagagagagaaaacaa

SEQ ID NO: 783264 - RNA, 19 nt, Homo sapiens
gcgacuaaacuuaaucugu

SEQ ID NO: 783265 - RNA, 19 nt, Homo sapiens
ugaagaucauaccucacua

SEQ ID NO: 783266 - RNA, 19 nt, Homo sapiens
gcagagccaacauuugcuu

SEQ ID NO: 783267 - RNA, 19 nt, Homo sapiens
cagcagagccaacauuugc

SEQ ID NO: 783268 - RNA, 19 nt, Homo sapiens
gccaacauuugcuucaagu

SEQ ID NO: 783269 - RNA, 19 nt, Homo sapiens
gaagaucauaccucacuac

SEQ ID NO: 783270 - RNA, 19 nt, Homo sapiens
gagacugaagccaaggaua

SEQ ID NO: 783271 - RNA, 19 nt, Homo sapiens
caauaggcacagagaagaa

SEQ ID NO: 783272 - RNA, 19 nt, Homo sapiens
gcaugaaaaugagaaaaug

SEQ ID NO: 783273 - RNA, 19 nt, Homo sapiens
caagagcaccacagacuac

SEQ ID NO: 783274 - RNA, 19 nt, Homo sapiens
caacauucaacauucaaca

SEQ ID NO: 783275 - RNA, 19 nt, Homo sapiens
aaacagcuacagcaagaug

SEQ ID NO: 783276 - RNA, 19 nt, Homo sapiens
ugacgggauugaaacaaag

SEQ ID NO: 783277 - RNA, 19 nt, Homo sapiens
ugggauagaugguguuggu

SEQ ID NO: 783278 - RNA, 19 nt, Homo sapiens
ucugguggaugcauuaaca

SEQ ID NO: 783279 - RNA, 19 nt, Homo sapiens
uaaauaaaugcccauagca

SEQ ID NO: 783280 - RNA, 19 nt, Homo sapiens
caacugcccagcuucaucu

SEQ ID NO: 783281 - RNA, 19 nt, Homo sapiens
cagauccagugauugacuu

SEQ ID NO: 783282 - RNA, 19 nt, Homo sapiens
ugacuuggcaugaaaauga

SEQ ID NO: 783283 - RNA, 19 nt, Homo sapiens
gacuaaacuuaaucuguac

SEQ ID NO: 783284 - RNA, 19 nt, Homo sapiens
uaccaagaaucuguggaaa

SEQ ID NO: 783285 - RNA, 19 nt, Homo sapiens
guaagccuguccaaaagaa

SEQ ID NO: 783286 - RNA, 19 nt, Homo sapiens
uuaaaacagcugagacuua

SEQ ID NO: 783287 - RNA, 19 nt, Homo sapiens
uggaggaagaggaagauuu

SEQ ID NO: 783288 - RNA, 19 nt, Homo sapiens
cauucaacauucaacaaca

SEQ ID NO: 783289 - RNA, 19 nt, Homo sapiens
caguguaauccuugacuuu

SEQ ID NO: 783290 - RNA, 19 nt, Homo sapiens
cauaaugaaggcacucuca

SEQ ID NO: 783291 - RNA, 19 nt, Homo sapiens
cagacagaccucaacauuc

SEQ ID NO: 783292 - RNA, 19 nt, Homo sapiens
ucaguguaauccuugacuu

SEQ ID NO: 783293 - RNA, 19 nt, Homo sapiens
ugagaacaagaaagaagaa

SEQ ID NO: 783294 - RNA, 19 nt, Homo sapiens
caagaaaaggucuggguaa

SEQ ID NO: 783295 - RNA, 19 nt, Homo sapiens
uugaguagcugggacuuca

SEQ ID NO: 783296 - RNA, 19 nt, Homo sapiens
aaugaaggcacucucaguu

SEQ ID NO: 783297 - RNA, 19 nt, Homo sapiens
caaagacaacaccuugagu

SEQ ID NO: 783298 - RNA, 19 nt, Homo sapiens
ugaagaaggugaagaaaua

SEQ ID NO: 783299 - RNA, 19 nt, Homo sapiens
aaacaaagcucgacaugga

SEQ ID NO: 783300 - RNA, 19 nt, Homo sapiens
gaaaagcacuugaaacaaa

SEQ ID NO: 783301 - RNA, 19 nt, Homo sapiens
caugccaucuuuacaauua

SEQ ID NO: 783302 - RNA, 19 nt, Homo sapiens
ccagaaagcugcgauaaug

SEQ ID NO: 783303 - RNA, 19 nt, Homo sapiens
uaucguaacucuaaacuga

SEQ ID NO: 783304 - RNA, 19 nt, Homo sapiens
acacaaagguuagcgguua

SEQ ID NO: 783305 - RNA, 19 nt, Homo sapiens
ggaaagaccaagaaguuaa

SEQ ID NO: 783306 - RNA, 19 nt, Homo sapiens
caacuaauaugaacgaaca

SEQ ID NO: 783307 - RNA, 19 nt, Homo sapiens
gaaauaacaugaggaagca

SEQ ID NO: 783308 - RNA, 19 nt, Homo sapiens
gcagagaacuugaggaaaa

SEQ ID NO: 783309 - RNA, 19 nt, Homo sapiens
gaacuaucacuguacauaa

SEQ ID NO: 783310 - RNA, 19 nt, Homo sapiens
ugaagaaucuaacauggaa

SEQ ID NO: 783311 - RNA, 19 nt, Homo sapiens
gcucacauauuuggucaua

SEQ ID NO: 783312 - RNA, 19 nt, Homo sapiens
gcugauggcugcaaaguca

SEQ ID NO: 783313 - RNA, 19 nt, Homo sapiens
gagaacauucggcaacuua

SEQ ID NO: 783314 - RNA, 19 nt, Homo sapiens
gaaagaccaagaaguuaaa

SEQ ID NO: 783315 - RNA, 19 nt, Homo sapiens
aaacaaggcuagagcugaa

SEQ ID NO: 783316 - RNA, 19 nt, Homo sapiens
cgacuucagaugcuuauua

SEQ ID NO: 783317 - RNA, 19 nt, Homo sapiens
ggccaaagcugaggaacaa

SEQ ID NO: 783318 - RNA, 19 nt, Homo sapiens
gaccugaugugggaguuua

SEQ ID NO: 783319 - RNA, 19 nt, Homo sapiens
ggaccuuucucacguguau

SEQ ID NO: 783320 - RNA, 19 nt, Homo sapiens
caauucauuugcucacaua

SEQ ID NO: 783321 - RNA, 19 nt, Homo sapiens
caagaccuauuauugauuc

SEQ ID NO: 783322 - RNA, 19 nt, Homo sapiens
ggaacuaucacuguacaua

SEQ ID NO: 783323 - RNA, 19 nt, Homo sapiens
caaugaaccuccaaagaca

SEQ ID NO: 783324 - RNA, 19 nt, Homo sapiens
gaacaucagagggaaauug

SEQ ID NO: 783325 - RNA, 19 nt, Homo sapiens
ccaagaaguuaaagaaagu

SEQ ID NO: 783326 - RNA, 19 nt, Homo sapiens
ggaagaugaugaugaagag

SEQ ID NO: 783327 - RNA, 19 nt, Homo sapiens
cagacaagaugauugaaau

SEQ ID NO: 783328 - RNA, 19 nt, Homo sapiens
uggagaagauggagagaaa

SEQ ID NO: 783329 - RNA, 19 nt, Homo sapiens
agaggaagaugaugaugaa

SEQ ID NO: 783330 - RNA, 19 nt, Homo sapiens
gaaacuaucaguacauuac

SEQ ID NO: 783331 - RNA, 19 nt, Homo sapiens
gccagcagauuacaauuau

SEQ ID NO: 783332 - RNA, 19 nt, Homo sapiens
caugaugugugcaaauauu

SEQ ID NO: 783333 - RNA, 19 nt, Homo sapiens
uuuaucagcuuauguggua

SEQ ID NO: 783334 - RNA, 19 nt, Homo sapiens
gaaccuccaaagacauuua

SEQ ID NO: 783335 - RNA, 19 nt, Homo sapiens
gaaaucaaugugcuacaaa

SEQ ID NO: 783336 - RNA, 19 nt, Homo sapiens
gaaugaagacauaggagaa

SEQ ID NO: 783337 - RNA, 19 nt, Homo sapiens
caagaugauugaaaugcaa

SEQ ID NO: 783338 - RNA, 19 nt, Homo sapiens
ggaagguguucgagcuauu

SEQ ID NO: 783339 - RNA, 19 nt, Homo sapiens
ggagggugauacaagguuu

SEQ ID NO: 783340 - RNA, 19 nt, Homo sapiens
gaaagaccacgaacuucaa

SEQ ID NO: 783341 - RNA, 19 nt, Homo sapiens
gggaaagaccaagaaguua

SEQ ID NO: 783342 - RNA, 19 nt, Homo sapiens
gcgauaaugugaagguugu

SEQ ID NO: 783343 - RNA, 19 nt, Homo sapiens
gaaaagaagguaauuguug

SEQ ID NO: 783344 - RNA, 19 nt, Homo sapiens
ggccagcagauuacaauua

SEQ ID NO: 783345 - RNA, 19 nt, Homo sapiens
uaaacugacucgucuucuu

SEQ ID NO: 783346 - RNA, 19 nt, Homo sapiens
cgacauggaagaagaagaa

SEQ ID NO: 783347 - RNA, 19 nt, Homo sapiens
ugaagaaguucgugaccuu

SEQ ID NO: 783348 - RNA, 19 nt, Homo sapiens
gaaagaaauagaagaacug

SEQ ID NO: 783349 - RNA, 19 nt, Homo sapiens
gcaaggaucagacacaaag

SEQ ID NO: 783350 - RNA, 19 nt, Homo sapiens
gacuucagaugcuuauuau

SEQ ID NO: 783351 - RNA, 19 nt, Homo sapiens
uggcugaucuccaacaaga

SEQ ID NO: 783352 - RNA, 19 nt, Homo sapiens
ggcuagagcugaauuagag

SEQ ID NO: 783353 - RNA, 19 nt, Homo sapiens
ccagaaagaaauagaagaa

SEQ ID NO: 783354 - RNA, 19 nt, Homo sapiens
aaagaaggauucaaauagg

SEQ ID NO: 783355 - RNA, 19 nt, Homo sapiens
gaaagcugcgauaauguga

SEQ ID NO: 783356 - RNA, 19 nt, Homo sapiens
ggaagaagaagaaagaaac

SEQ ID NO: 783357 - RNA, 19 nt, Homo sapiens
ugauugaaaugcaagcaaa

SEQ ID NO: 783358 - RNA, 19 nt, Homo sapiens
gcaaagccugaaacuguaa

SEQ ID NO: 783359 - RNA, 19 nt, Homo sapiens
ggucagaggaagaugauga

SEQ ID NO: 783360 - RNA, 19 nt, Homo sapiens
cagcagauuacaauuauga

SEQ ID NO: 783361 - RNA, 19 nt, Homo sapiens
ucacguguaucuugccuau

SEQ ID NO: 783362 - RNA, 19 nt, Homo sapiens
aaagaaaguuuggacuaug

SEQ ID NO: 783363 - RNA, 19 nt, Homo sapiens
caacuucgcagagaacuug

SEQ ID NO: 783364 - RNA, 19 nt, Homo sapiens
aaaauuaucugcccuggaa

SEQ ID NO: 783365 - RNA, 19 nt, Homo sapiens
gaagaagaagaaagaaaca

SEQ ID NO: 783366 - RNA, 19 nt, Homo sapiens
ugugggaguuuauaucaaa

SEQ ID NO: 783367 - RNA, 19 nt, Homo sapiens
ucgagugucuuauuuggaa

SEQ ID NO: 783368 - RNA, 19 nt, Homo sapiens
gcaagaccuauuauugauu

SEQ ID NO: 783369 - RNA, 19 nt, Homo sapiens
cuucagaugcuuauuauug

SEQ ID NO: 783370 - RNA, 19 nt, Homo sapiens
gaccaagaaguuaaagaaa

SEQ ID NO: 783371 - RNA, 19 nt, Homo sapiens
gcacagggaaagaccaaga

SEQ ID NO: 783372 - RNA, 19 nt, Homo sapiens
gagaguaaacaacuugaug

SEQ ID NO: 783373 - RNA, 19 nt, Homo sapiens
ugcaaagccugaaacugua

SEQ ID NO: 783374 - RNA, 19 nt, Homo sapiens
cuagaaagaccacgaacuu

SEQ ID NO: 783375 - RNA, 19 nt, Homo sapiens
ggagaacauucggcaacuu

SEQ ID NO: 783376 - RNA, 19 nt, Homo sapiens
gaaaagagcagagcaacuu

SEQ ID NO: 783377 - RNA, 19 nt, Homo sapiens
gguaaauaaugcugaugau

SEQ ID NO: 783378 - RNA, 19 nt, Homo sapiens
ggaucagacacaaagguua

SEQ ID NO: 783379 - RNA, 19 nt, Homo sapiens
gggcaaggaucagacacaa

SEQ ID NO: 783380 - RNA, 19 nt, Homo sapiens
gaagaaguucgugaccuuu

SEQ ID NO: 783381 - RNA, 19 nt, Homo sapiens
gcuaaaauguguugcuuau

SEQ ID NO: 783382 - RNA, 19 nt, Homo sapiens
agaaaucaaugugcuacaa

SEQ ID NO: 783383 - RNA, 19 nt, Homo sapiens
gaagaaggugaagaaauau

SEQ ID NO: 783384 - RNA, 19 nt, Homo sapiens
gaugugggaguuuauauca

SEQ ID NO: 783385 - RNA, 19 nt, Homo sapiens
agacugauucuuccaauga

SEQ ID NO: 783386 - RNA, 19 nt, Homo sapiens
uaacauggaacuggaagaa

SEQ ID NO: 783387 - RNA, 19 nt, Homo sapiens
gagaaaagcacuugaaaca

SEQ ID NO: 783388 - RNA, 19 nt, Homo sapiens
gguuagcgguuaaagaaag

SEQ ID NO: 783389 - RNA, 19 nt, Homo sapiens
gaccuauuauugauucugu

SEQ ID NO: 783390 - RNA, 19 nt, Homo sapiens
gaaagcaaggccaaagaca

SEQ ID NO: 783391 - RNA, 19 nt, Homo sapiens
gccaaucgugcuaagaaua

SEQ ID NO: 783392 - RNA, 19 nt, Homo sapiens
uguaauuucugccuugguu

SEQ ID NO: 783393 - RNA, 19 nt, Homo sapiens
cacaaagguuagcgguuaa

SEQ ID NO: 783394 - RNA, 19 nt, Homo sapiens
cugcaaagccugaaacugu

SEQ ID NO: 783395 - RNA, 19 nt, Homo sapiens
gaaguuaaagaaaguuugg

SEQ ID NO: 783396 - RNA, 19 nt, Homo sapiens
gagagaaaucaaugugcua

SEQ ID NO: 783397 - RNA, 19 nt, Homo sapiens
gaucagacacaaagguuag

SEQ ID NO: 783398 - RNA, 19 nt, Homo sapiens
gaaagcagaucuucagugu

SEQ ID NO: 783399 - RNA, 19 nt, Homo sapiens
ggaaaucucucaggaaaga

SEQ ID NO: 783400 - RNA, 19 nt, Homo sapiens
gaggaaaucucucaggaaa

SEQ ID NO: 783401 - RNA, 19 nt, Homo sapiens
caaauuuccuucagucuuu

SEQ ID NO: 783402 - RNA, 19 nt, Homo sapiens
aaacagccauugaacauaa

SEQ ID NO: 783403 - RNA, 19 nt, Homo sapiens
caccggaccuucagauuua

SEQ ID NO: 783404 - RNA, 19 nt, Homo sapiens
aaacuugaaucccuuagua

SEQ ID NO: 783405 - RNA, 19 nt, Homo sapiens
gaagaucucugugccaaug

SEQ ID NO: 783406 - RNA, 19 nt, Homo sapiens
gccaaugauuccuauguua

SEQ ID NO: 783407 - RNA, 19 nt, Homo sapiens
caaugaaacugacagaaau

SEQ ID NO: 783408 - RNA, 19 nt, Homo sapiens
ggaaagccgucugauuuga

SEQ ID NO: 783409 - RNA, 19 nt, Homo sapiens
ggagagauuuccgaguaua

SEQ ID NO: 783410 - RNA, 19 nt, Homo sapiens
aaacuuggcugacugucua

SEQ ID NO: 783411 - RNA, 19 nt, Homo sapiens
caagaaaugugaugaguac

SEQ ID NO: 783412 - RNA, 19 nt, Homo sapiens
gaaccaagggcaagcagua

SEQ ID NO: 783413 - RNA, 19 nt, Homo sapiens
caaguauggugacaucgua

SEQ ID NO: 783414 - RNA, 19 nt, Homo sapiens
gaaacugacagaaaucauu

SEQ ID NO: 783415 - RNA, 19 nt, Homo sapiens
gccaucagcacuccaauua

SEQ ID NO: 783416 - RNA, 19 nt, Homo sapiens
ccugaagacuuuccacuuu

SEQ ID NO: 783417 - RNA, 19 nt, Homo sapiens
cugcacaaauugagcauua

SEQ ID NO: 783418 - RNA, 19 nt, Homo sapiens
gaagucaccugaggagaug

SEQ ID NO: 783419 - RNA, 19 nt, Homo sapiens
gaaccgggcucuucaagcu

SEQ ID NO: 783420 - RNA, 19 nt, Homo sapiens
aagcagaucuucaguguca

SEQ ID NO: 783421 - RNA, 19 nt, Homo sapiens
cgacacggcuguaaagaca

SEQ ID NO: 783422 - RNA, 19 nt, Homo sapiens
gaagacggcugaccaucuc

SEQ ID NO: 783423 - RNA, 19 nt, Homo sapiens
cagcacagcuagacaagga

SEQ ID NO: 783424 - RNA, 19 nt, Homo sapiens
gaucuuugcucccaguaug

SEQ ID NO: 783425 - RNA, 19 nt, Homo sapiens
ugaaggagcugucugugau

SEQ ID NO: 783426 - RNA, 19 nt, Homo sapiens
caaggacacuuucuuugau

SEQ ID NO: 783427 - RNA, 19 nt, Homo sapiens
gagaaaagauggcucaaga

SEQ ID NO: 783428 - RNA, 19 nt, Homo sapiens
ugggagagauuuccgagua

SEQ ID NO: 783429 - RNA, 19 nt, Homo sapiens
gaugaaccuuuggaguuua

SEQ ID NO: 783430 - RNA, 19 nt, Homo sapiens
gaaacagccauugaacaua

SEQ ID NO: 783431 - RNA, 19 nt, Homo sapiens
gaacggauuaggcuucuga

SEQ ID NO: 783432 - RNA, 19 nt, Homo sapiens
caucagcacuccaauuauc

SEQ ID NO: 783433 - RNA, 19 nt, Homo sapiens
ccggaaagccgucugauuu

SEQ ID NO: 783434 - RNA, 19 nt, Homo sapiens
ccugaugacugcuuuauuc

SEQ ID NO: 783435 - RNA, 19 nt, Homo sapiens
gcacccagaugacccugaa

SEQ ID NO: 783436 - RNA, 19 nt, Homo sapiens
gaaauacaagaccaacaaa

SEQ ID NO: 783437 - RNA, 19 nt, Homo sapiens
gaaauacggaaaucgagaa

SEQ ID NO: 783438 - RNA, 19 nt, Homo sapiens
agacggauguggccaagaa

SEQ ID NO: 783439 - RNA, 19 nt, Homo sapiens
gaucugacaaugaaacuga

SEQ ID NO: 783440 - RNA, 19 nt, Homo sapiens
gagcugucauccacauuga

SEQ ID NO: 783441 - RNA, 19 nt, Homo sapiens
cagaguccaucaugaagaa

SEQ ID NO: 783442 - RNA, 19 nt, Homo sapiens
cgaaccaccuccaauaaca

SEQ ID NO: 783443 - RNA, 19 nt, Homo sapiens
ccacagaguccaucaugaa

SEQ ID NO: 783444 - RNA, 19 nt, Homo sapiens
gcagugugcccucuacauu

SEQ ID NO: 783445 - RNA, 19 nt, Homo sapiens
ugagaaggaucguccaugu

SEQ ID NO: 783446 - RNA, 19 nt, Homo sapiens
gaaggagagugugcugaug

SEQ ID NO: 783447 - RNA, 19 nt, Homo sapiens
gaaaggagaaguacaagcu

SEQ ID NO: 783448 - RNA, 19 nt, Homo sapiens
ggauuaggcuucugagacu

SEQ ID NO: 783449 - RNA, 19 nt, Homo sapiens
gaaagggagaauugagaaa

SEQ ID NO: 783450 - RNA, 19 nt, Homo sapiens
gcucaaguauggugacauc

SEQ ID NO: 783451 - RNA, 19 nt, Homo sapiens
gcagagacauacgcagaug

SEQ ID NO: 783452 - RNA, 19 nt, Homo sapiens
ugagguagcugugccaguu

SEQ ID NO: 783453 - RNA, 19 nt, Homo sapiens
gcaagagcuccauguacua

SEQ ID NO: 783454 - RNA, 19 nt, Homo sapiens
gaaggaucguccaugugaa

SEQ ID NO: 783455 - RNA, 19 nt, Homo sapiens
agaugacccugaagacuuu

SEQ ID NO: 783456 - RNA, 19 nt, Homo sapiens
gacuaaagcaaaucuugua

SEQ ID NO: 783457 - RNA, 19 nt, Homo sapiens
ugacuuugauggugaugaa

SEQ ID NO: 783458 - RNA, 19 nt, Homo sapiens
cucaagagcucaaguaugg

SEQ ID NO: 783459 - RNA, 19 nt, Homo sapiens
guacuucagagcagucaua

SEQ ID NO: 783460 - RNA, 19 nt, Homo sapiens
agaugaaccuuuggaguuu

SEQ ID NO: 783461 - RNA, 19 nt, Homo sapiens
gagauguggugcuguucaa

SEQ ID NO: 783462 - RNA, 19 nt, Homo sapiens
caacauggcacccaagaag

SEQ ID NO: 783463 - RNA, 19 nt, Homo sapiens
acaaugaaacugacagaaa

SEQ ID NO: 783464 - RNA, 19 nt, Homo sapiens
guaaacaaagcaaacauca

SEQ ID NO: 783465 - RNA, 19 nt, Homo sapiens
gaaugccggcuacaagaaa

SEQ ID NO: 783466 - RNA, 19 nt, Homo sapiens
ggacuaaagcaaaucuugu

SEQ ID NO: 783467 - RNA, 19 nt, Homo sapiens
ccaccggaccuucagauuu

SEQ ID NO: 783468 - RNA, 19 nt, Homo sapiens
gcacaaauugagcauuaug

SEQ ID NO: 783469 - RNA, 19 nt, Homo sapiens
cagggucgauuuagaggaa

SEQ ID NO: 783470 - RNA, 19 nt, Homo sapiens
ggaaaacagggucgauuua

SEQ ID NO: 783471 - RNA, 19 nt, Homo sapiens
gaucuucgacacaaaugaa

SEQ ID NO: 783472 - RNA, 19 nt, Homo sapiens
gggagagauuuccgaguau

SEQ ID NO: 783473 - RNA, 19 nt, Homo sapiens
caacaucaaagcagucuuc

SEQ ID NO: 783474 - RNA, 19 nt, Homo sapiens
ucaaacagaagaagcuaaa

SEQ ID NO: 783475 - RNA, 19 nt, Homo sapiens
gaaccuucaucuuccucaa

SEQ ID NO: 783476 - RNA, 19 nt, Homo sapiens
gaccagaggcuucguccaa

SEQ ID NO: 783477 - RNA, 19 nt, Homo sapiens
guacaagcuucugguggaa

SEQ ID NO: 783478 - RNA, 19 nt, Homo sapiens
gcacagauggagccagguu

SEQ ID NO: 783479 - RNA, 19 nt, Homo sapiens
uggaggagauggcuuagau

SEQ ID NO: 783480 - RNA, 19 nt, Homo sapiens
gcgaaggcuugucaaaucu

SEQ ID NO: 783481 - RNA, 19 nt, Homo sapiens
aaagccgucugauuugauu

SEQ ID NO: 783482 - RNA, 19 nt, Homo sapiens
ugucacaccuggccaagga

SEQ ID NO: 783483 - RNA, 19 nt, Homo sapiens
gcaaggaugagaaaauuaa

SEQ ID NO: 783484 - RNA, 19 nt, Homo sapiens
agaaggaucguccauguga

SEQ ID NO: 783485 - RNA, 19 nt, Homo sapiens
ugaggaaacugguucaaaa

SEQ ID NO: 783486 - RNA, 19 nt, Homo sapiens
aaucccagcugaagauguu

SEQ ID NO: 783487 - RNA, 19 nt, Homo sapiens
gcugagacagugagauauu

SEQ ID NO: 783488 - RNA, 19 nt, Homo sapiens
ccgaguauauugaagaagu

SEQ ID NO: 783489 - RNA, 19 nt, Homo sapiens
caggaaagagaguggauuu

SEQ ID NO: 783490 - RNA, 19 nt, Homo sapiens
agugugcccucuacauuaa

SEQ ID NO: 783491 - RNA, 19 nt, Homo sapiens
cagugugcccucuacauua

SEQ ID NO: 783492 - RNA, 19 nt, Homo sapiens
ccuuaguaguucugaauuu

SEQ ID NO: 783493 - RNA, 19 nt, Homo sapiens
gaagcaguuucuggacuau

SEQ ID NO: 783494 - RNA, 19 nt, Homo sapiens
ucuccgaccucaugaccua

SEQ ID NO: 783495 - RNA, 19 nt, Homo sapiens
cauccaagcuccgugugaa

SEQ ID NO: 783496 - RNA, 19 nt, Homo sapiens
gauauuccaucugcacauc

SEQ ID NO: 783497 - RNA, 19 nt, Homo sapiens
caaagcaaacaucaauuuc

SEQ ID NO: 783498 - RNA, 19 nt, Homo sapiens
gaauacagcucuucucgaa

SEQ ID NO: 783499 - RNA, 19 nt, Homo sapiens
agaagaagcuggcagagaa

SEQ ID NO: 783500 - RNA, 19 nt, Homo sapiens
gcugagagcccuguuaaua

SEQ ID NO: 783501 - RNA, 19 nt, Homo sapiens
caacaugauugaccgauuc

SEQ ID NO: 783502 - RNA, 19 nt, Homo sapiens
ggagagaguuucgggagaa

SEQ ID NO: 783503 - RNA, 19 nt, Homo sapiens
acaaacaggccacgacuua

SEQ ID NO: 783504 - RNA, 19 nt, Homo sapiens
gaucuacauugaugaguug

SEQ ID NO: 783505 - RNA, 19 nt, Homo sapiens
gagaagaucacguucauca

SEQ ID NO: 783506 - RNA, 19 nt, Homo sapiens
ggacguggaugaauugaac

SEQ ID NO: 783507 - RNA, 19 nt, Homo sapiens
ugagagcccuguuaauaug

SEQ ID NO: 783508 - RNA, 19 nt, Homo sapiens
uggcagaucucaacaaaca

SEQ ID NO: 783509 - RNA, 19 nt, Homo sapiens
gguggcagaucucaacaaa

SEQ ID NO: 783510 - RNA, 19 nt, Homo sapiens
uaagaaggcggcacaagaa

SEQ ID NO: 783511 - RNA, 19 nt, Homo sapiens
ggagacgggaguauuauga

SEQ ID NO: 783512 - RNA, 19 nt, Homo sapiens
uaccagaucuacauugaug

SEQ ID NO: 783513 - RNA, 19 nt, Homo sapiens
ucacguucaucaccaguuu

SEQ ID NO: 783514 - RNA, 19 nt, Homo sapiens
gcgaagaugagaagaagaa

SEQ ID NO: 783515 - RNA, 19 nt, Homo sapiens
gcaugauggucgacuacaa

SEQ ID NO: 783516 - RNA, 19 nt, Homo sapiens
acagaggccuggugcagaa

SEQ ID NO: 783517 - RNA, 19 nt, Homo sapiens
ggacaccaacaacaugauu

SEQ ID NO: 783518 - RNA, 19 nt, Homo sapiens
gcaacucggacgaagauga

SEQ ID NO: 783519 - RNA, 19 nt, Homo sapiens
gagcaacucggacgaagau

SEQ ID NO: 783520 - RNA, 19 nt, Homo sapiens
agacgggaguauuaugaaa

SEQ ID NO: 783521 - RNA, 19 nt, Homo sapiens
caggagaagcugaaacuga

SEQ ID NO: 783522 - RNA, 19 nt, Homo sapiens
gaaggacccagcccaguuc

SEQ ID NO: 783523 - RNA, 19 nt, Homo sapiens
gaucagcccacccagcuau

SEQ ID NO: 783524 - RNA, 19 nt, Homo sapiens
gguuuuaucucuagugaaa

SEQ ID NO: 783525 - RNA, 19 nt, Homo sapiens
gcaagauccgcaugaagga

SEQ ID NO: 783526 - RNA, 19 nt, Homo sapiens
gcgaggagaagaucacguu

SEQ ID NO: 783527 - RNA, 19 nt, Homo sapiens
aaacaggccacgacuuaug

SEQ ID NO: 783528 - RNA, 19 nt, Homo sapiens
cagcgaagaugagaagaag

SEQ ID NO: 783529 - RNA, 19 nt, Homo sapiens
gaggcaugauggucgacua

SEQ ID NO: 783530 - RNA, 19 nt, Homo sapiens
gcugugaugcugcugguuu

SEQ ID NO: 783531 - RNA, 19 nt, Homo sapiens
gagcggagacgggaguauu

SEQ ID NO: 783532 - RNA, 19 nt, Homo sapiens
uaacuacgagcgcuacaga

SEQ ID NO: 783533 - RNA, 19 nt, Homo sapiens
gagagaaggagagagaaga

SEQ ID NO: 783534 - RNA, 19 nt, Homo sapiens
ucaggaugcuccggaaaga

SEQ ID NO: 783535 - RNA, 19 nt, Homo sapiens
ccagagacccagcgaagau

SEQ ID NO: 783536 - RNA, 19 nt, Homo sapiens
cgacuuugccggcaucuca

SEQ ID NO: 783537 - RNA, 19 nt, Homo sapiens
gagacgggaguauuaugaa

SEQ ID NO: 783538 - RNA, 19 nt, Homo sapiens
acaacaugauugaccgauu

SEQ ID NO: 783539 - RNA, 19 nt, Homo sapiens
gaggagaagaucacguuca

SEQ ID NO: 783540 - RNA, 19 nt, Homo sapiens
ccgauacagucgagaauac

SEQ ID NO: 783541 - RNA, 19 nt, Homo sapiens
agaucuacauugaugaguu

SEQ ID NO: 783542 - RNA, 19 nt, Homo sapiens
guacauggccgagcuugca

SEQ ID NO: 783543 - RNA, 19 nt, Homo sapiens
auaagaaggcggcacaaga

SEQ ID NO: 783544 - RNA, 19 nt, Homo sapiens
guucaaggcggauaagaag

SEQ ID NO: 783545 - RNA, 19 nt, Homo sapiens
ggagguggacguggaugaa

SEQ ID NO: 783546 - RNA, 19 nt, Homo sapiens
ggagagcaacucggacgaa

SEQ ID NO: 783547 - RNA, 19 nt, Homo sapiens
guagagaaggcggcagaaa

SEQ ID NO: 783548 - RNA, 19 nt, Homo sapiens
gauggucgacuacaagaag

SEQ ID NO: 783549 - RNA, 19 nt, Homo sapiens
cggacgaacggaaguguaa

SEQ ID NO: 783550 - RNA, 19 nt, Homo sapiens
gcagcagcaucaggaguca

SEQ ID NO: 783551 - RNA, 19 nt, Homo sapiens
gcagguggcagaucucaac

SEQ ID NO: 783552 - RNA, 19 nt, Homo sapiens
gagagcccuguuaauauga

SEQ ID NO: 783553 - RNA, 19 nt, Homo sapiens
cagaggagcagugccugua

SEQ ID NO: 783554 - RNA, 19 nt, Homo sapiens
cugagagcccuguuaauau

SEQ ID NO: 783555 - RNA, 19 nt, Homo sapiens
ccgcugagagcccuguuaa

SEQ ID NO: 783556 - RNA, 19 nt, Homo sapiens
gaagaagcuggcagagaag

SEQ ID NO: 783557 - RNA, 19 nt, Homo sapiens
gccgagagaaggagagaga

SEQ ID NO: 783558 - RNA, 19 nt, Homo sapiens
gaaccugccgcugguaaag

SEQ ID NO: 783559 - RNA, 19 nt, Homo sapiens
aggagaagaucacguucau

SEQ ID NO: 783560 - RNA, 19 nt, Homo sapiens
agaaggacccagcccaguu

SEQ ID NO: 783561 - RNA, 19 nt, Homo sapiens
uuaccgacauuaggcagaa

SEQ ID NO: 783562 - RNA, 19 nt, Homo sapiens
acucgcagccgcagccaua

SEQ ID NO: 783563 - RNA, 19 nt, Homo sapiens
gguggacguggaugaauug

SEQ ID NO: 783564 - RNA, 19 nt, Homo sapiens
acaccaacaacaugauuga

SEQ ID NO: 783565 - RNA, 19 nt, Homo sapiens
caaacaggccacgacuuau

SEQ ID NO: 783566 - RNA, 19 nt, Homo sapiens
ccagcgaagaugagaagaa

SEQ ID NO: 783567 - RNA, 19 nt, Homo sapiens
ggcuuggccucaccacaau

SEQ ID NO: 783568 - RNA, 19 nt, Homo sapiens
ggaggcagaggccaucaag

SEQ ID NO: 783569 - RNA, 19 nt, Homo sapiens
gaagcuggcagagaagaag

SEQ ID NO: 783570 - RNA, 19 nt, Homo sapiens
gauaagaaggcggcacaag

SEQ ID NO: 783571 - RNA, 19 nt, Homo sapiens
gagagaguuucgggagaag

SEQ ID NO: 783572 - RNA, 19 nt, Homo sapiens
caacucggacgaagaugag

SEQ ID NO: 783573 - RNA, 19 nt, Homo sapiens
gacaccaacaacaugauug

SEQ ID NO: 783574 - RNA, 19 nt, Homo sapiens
aggaggagaaggccaugua

SEQ ID NO: 783575 - RNA, 19 nt, Homo sapiens
agguggacguggaugaauu

SEQ ID NO: 783576 - RNA, 19 nt, Homo sapiens
ggaguauuaugaaaagauc

SEQ ID NO: 783577 - RNA, 19 nt, Homo sapiens
ggaugcagaaggcgcugaa

SEQ ID NO: 783578 - RNA, 19 nt, Homo sapiens
agagacaggagcugccaaa

SEQ ID NO: 783579 - RNA, 19 nt, Homo sapiens
gagcccuguuaauaugaug

SEQ ID NO: 783580 - RNA, 19 nt, Homo sapiens
gcggagacgggaguauuau

SEQ ID NO: 783581 - RNA, 19 nt, Homo sapiens
augaaaagaucaagaagga

SEQ ID NO: 783582 - RNA, 19 nt, Homo sapiens
aagaaggcggcacaagaaa

SEQ ID NO: 783583 - RNA, 19 nt, Homo sapiens
ugaaacugaggaugcagaa

SEQ ID NO: 783584 - RNA, 19 nt, Homo sapiens
gagacagccccaccuauga

SEQ ID NO: 783585 - RNA, 19 nt, Homo sapiens
gagcagguggcagaucuca

SEQ ID NO: 783586 - RNA, 19 nt, Homo sapiens
cgccaucacccgcaagaga

SEQ ID NO: 783587 - RNA, 19 nt, Homo sapiens
ggaggagaaggccauguac

SEQ ID NO: 783588 - RNA, 19 nt, Homo sapiens
gggacaagcugcagaggua

SEQ ID NO: 783589 - RNA, 19 nt, Homo sapiens
gcaggaacaacuauuaaua

SEQ ID NO: 783590 - RNA, 19 nt, Homo sapiens
ucacguauuuggaucuuua

SEQ ID NO: 783591 - RNA, 19 nt, Homo sapiens
gguuucagauguucauuua

SEQ ID NO: 783592 - RNA, 19 nt, Homo sapiens
ucauugaccucuagugaua

SEQ ID NO: 783593 - RNA, 19 nt, Homo sapiens
ggagaaagauccuagaaaa

SEQ ID NO: 783594 - RNA, 19 nt, Homo sapiens
gaaccagaauuauaacagu

SEQ ID NO: 783595 - RNA, 19 nt, Homo sapiens
gcacguagaggccaucaaa

SEQ ID NO: 783596 - RNA, 19 nt, Homo sapiens
gcagacauggugaauuuaa

SEQ ID NO: 783597 - RNA, 19 nt, Homo sapiens
gguuauaugugggaagaua

SEQ ID NO: 783598 - RNA, 19 nt, Homo sapiens
gauguacagccuaguguua

SEQ ID NO: 783599 - RNA, 19 nt, Homo sapiens
cauccacuauuguauguuu

SEQ ID NO: 783600 - RNA, 19 nt, Homo sapiens
ggacucagcaggagcuuga

SEQ ID NO: 783601 - RNA, 19 nt, Homo sapiens
augcagacauggugaauuu

SEQ ID NO: 783602 - RNA, 19 nt, Homo sapiens
gaucacugguuucagaugu

SEQ ID NO: 783603 - RNA, 19 nt, Homo sapiens
gcggugaaccagaauuaua

SEQ ID NO: 783604 - RNA, 19 nt, Homo sapiens
ggaggaagcccagaggaaa

SEQ ID NO: 783605 - RNA, 19 nt, Homo sapiens
ccaagauccugguugaguu

SEQ ID NO: 783606 - RNA, 19 nt, Homo sapiens
agaaggcaauugcagcuaa

SEQ ID NO: 783607 - RNA, 19 nt, Homo sapiens
augaucaacucacguauuu

SEQ ID NO: 783608 - RNA, 19 nt, Homo sapiens
cagccaagauccugguuga

SEQ ID NO: 783609 - RNA, 19 nt, Homo sapiens
gaguucagcuugauuucug

SEQ ID NO: 783610 - RNA, 19 nt, Homo sapiens
cuucaaggcuguuggucua

SEQ ID NO: 783611 - RNA, 19 nt, Homo sapiens
gagcucaucugacuguuuu

SEQ ID NO: 783612 - RNA, 19 nt, Homo sapiens
gcagagcaguccagaacca

SEQ ID NO: 783613 - RNA, 19 nt, Homo sapiens
caaccaucauuacaggaaa

SEQ ID NO: 783614 - RNA, 19 nt, Homo sapiens
gguggacucucagaagaaa

SEQ ID NO: 783615 - RNA, 19 nt, Homo sapiens
agaaacaaauggccaugga

SEQ ID NO: 783616 - RNA, 19 nt, Homo sapiens
gaugaucaacucacguauu

SEQ ID NO: 783617 - RNA, 19 nt, Homo sapiens
gagauuggcuuuugucauc

SEQ ID NO: 783618 - RNA, 19 nt, Homo sapiens
acagugagcucaucugacu

SEQ ID NO: 783619 - RNA, 19 nt, Homo sapiens
uaacagugagcucaucuga

SEQ ID NO: 783620 - RNA, 19 nt, Homo sapiens
gaagacacgagccgacaga

SEQ ID NO: 783621 - RNA, 19 nt, Homo sapiens
gaucaacucacguauuugg

SEQ ID NO: 783622 - RNA, 19 nt, Homo sapiens
agugauaccuugaucuuuc

SEQ ID NO: 783623 - RNA, 19 nt, Homo sapiens
uaauacagauacucagaag

SEQ ID NO: 783624 - RNA, 19 nt, Homo sapiens
gaaggcaauugcagcuaag

SEQ ID NO: 783625 - RNA, 19 nt, Homo sapiens
caagauccugguugaguuu

SEQ ID NO: 783626 - RNA, 19 nt, Homo sapiens
cagaugaucaacucacgua

SEQ ID NO: 783627 - RNA, 19 nt, Homo sapiens
gugguggacucucagaaga

SEQ ID NO: 783628 - RNA, 19 nt, Homo sapiens
ucaaggaggaggagaaugu

SEQ ID NO: 783629 - RNA, 19 nt, Homo sapiens
guaaauuugccaugacuuc

SEQ ID NO: 783630 - RNA, 19 nt, Homo sapiens
agaagcaucugcagcaucu

SEQ ID NO: 783631 - RNA, 19 nt, Homo sapiens
uuaggcaggugguuauaug

SEQ ID NO: 783632 - RNA, 19 nt, Homo sapiens
acaaccugcuggagaugua

SEQ ID NO: 783633 - RNA, 19 nt, Homo sapiens
uagcggauuuccugcagaa

SEQ ID NO: 783634 - RNA, 19 nt, Homo sapiens
guguuaacauucuugguau

SEQ ID NO: 783635 - RNA, 19 nt, Homo sapiens
ggacagcagcauggagaaa

SEQ ID NO: 783636 - RNA, 19 nt, Homo sapiens
cggugaaccagaauuauaa

SEQ ID NO: 783637 - RNA, 19 nt, Homo sapiens
auucauggauccaaauguu

SEQ ID NO: 783638 - RNA, 19 nt, Homo sapiens
gauacucagaagccaauaa

SEQ ID NO: 783639 - RNA, 19 nt, Homo sapiens
cuaagguucuugcggugaa

SEQ ID NO: 783640 - RNA, 19 nt, Homo sapiens
agauguaaauuugccauga

SEQ ID NO: 783641 - RNA, 19 nt, Homo sapiens
acaaauggccauggagaaa

SEQ ID NO: 783642 - RNA, 19 nt, Homo sapiens
guugaguccuuucuuugug

SEQ ID NO: 783643 - RNA, 19 nt, Homo sapiens
cagacauggugaauuuaau

SEQ ID NO: 783644 - RNA, 19 nt, Homo sapiens
ggaucucucucaguugugu

SEQ ID NO: 783645 - RNA, 19 nt, Homo sapiens
ggagaagcaucugcagcau

SEQ ID NO: 783646 - RNA, 19 nt, Homo sapiens
ucagaagccaauaacauga

SEQ ID NO: 783647 - RNA, 19 nt, Homo sapiens
ucuggcaucuguggauuaa

SEQ ID NO: 783648 - RNA, 19 nt, Homo sapiens
gcucuggcaucuguggauu

SEQ ID NO: 783649 - RNA, 19 nt, Homo sapiens
gauguaaauuugccaugac

SEQ ID NO: 783650 - RNA, 19 nt, Homo sapiens
gaggugagggagcguaaga

SEQ ID NO: 783651 - RNA, 19 nt, Homo sapiens
ucucaguuguguauuuguu

SEQ ID NO: 783652 - RNA, 19 nt, Homo sapiens
ugagguggcaggcaucuug

SEQ ID NO: 783653 - RNA, 19 nt, Homo sapiens
uuuguugaguccuuucuuu

SEQ ID NO: 783654 - RNA, 19 nt, Homo sapiens
gugguuauaugugggaaga

SEQ ID NO: 783655 - RNA, 19 nt, Homo sapiens
gagcugggacugguuugaa

SEQ ID NO: 783656 - RNA, 19 nt, Homo sapiens
ugcuggagauguaaauuug

SEQ ID NO: 783657 - RNA, 19 nt, Homo sapiens
caaggcuguuggucuacaa

SEQ ID NO: 783658 - RNA, 19 nt, Homo sapiens
ccaaccaucauuacaggaa

SEQ ID NO: 783659 - RNA, 19 nt, Homo sapiens
uggagaagauguaccuuuu

SEQ ID NO: 783660 - RNA, 19 nt, Homo sapiens
gucauccacuauuguaugu

SEQ ID NO: 783661 - RNA, 19 nt, Homo sapiens
caggaacaacuauuaauac

SEQ ID NO: 783662 - RNA, 19 nt, Homo sapiens
ucaguuguguauuuguuca

SEQ ID NO: 783663 - RNA, 19 nt, Homo sapiens
caggaaagacugugaacuc

SEQ ID NO: 783664 - RNA, 19 nt, Homo sapiens
acagcagcauggagaaaga

SEQ ID NO: 783665 - RNA, 19 nt, Homo sapiens
ucuacaaccugcuggagau

SEQ ID NO: 783666 - RNA, 19 nt, Homo sapiens
ucaccaaggcccugacuca

SEQ ID NO: 783667 - RNA, 19 nt, Homo sapiens
ggcaauugcagcuaaggaa

SEQ ID NO: 783668 - RNA, 19 nt, Homo sapiens
gaucuuucccacuuucugu

SEQ ID NO: 783669 - RNA, 19 nt, Homo sapiens
ggaggaggagaauguuuua

SEQ ID NO: 783670 - RNA, 19 nt, Homo sapiens
cagcuaaggaacaauggaa

SEQ ID NO: 783671 - RNA, 19 nt, Homo sapiens
gauccugguugaguuugug

SEQ ID NO: 783672 - RNA, 19 nt, Homo sapiens
aguguuaacauucuuggua

SEQ ID NO: 783673 - RNA, 19 nt, Homo sapiens
cagcuugauuucugacuac

SEQ ID NO: 783674 - RNA, 19 nt, Homo sapiens
ugaagcagcaggcagaaca

SEQ ID NO: 783675 - RNA, 19 nt, Homo sapiens
ucacugguuucagauguuc

SEQ ID NO: 783676 - RNA, 19 nt, Homo sapiens
cucgaucacugguuucaga

SEQ ID NO: 783677 - RNA, 19 nt, Homo sapiens
ggauguacagccuaguguu

SEQ ID NO: 783678 - RNA, 19 nt, Homo sapiens
uggcaggaacaacuauuaa

SEQ ID NO: 783679 - RNA, 19 nt, Homo sapiens
ucucucaguuguguauuug

SEQ ID NO: 783680 - RNA, 19 nt, Homo sapiens
gcaggaggaggcagaacug

SEQ ID NO: 783681 - RNA, 19 nt, Homo sapiens
guagaggccaucaaaauug

SEQ ID NO: 783682 - RNA, 19 nt, Homo sapiens
cuggaucucucucaguugu

SEQ ID NO: 783683 - RNA, 19 nt, Homo sapiens
cccuggaucucucucaguu

SEQ ID NO: 783684 - RNA, 19 nt, Homo sapiens
uggcaucuguggauuaaaa

SEQ ID NO: 783685 - RNA, 19 nt, Homo sapiens
agcaagcucuggcaucugu

SEQ ID NO: 783686 - RNA, 19 nt, Homo sapiens
cuaaggaacaauggaaaga

SEQ ID NO: 783687 - RNA, 19 nt, Homo sapiens
ggcaggaacaacuauuaau

SEQ ID NO: 783688 - RNA, 19 nt, Homo sapiens
ggaaagagcuuauguuaca

SEQ ID NO: 783689 - RNA, 19 nt, Homo sapiens
gggacaagcugcagaggua

SEQ ID NO: 783690 - RNA, 19 nt, Homo sapiens
gcaggaacaacuauuaaua

SEQ ID NO: 783691 - RNA, 19 nt, Homo sapiens
ucacguauuuggaucuuua

SEQ ID NO: 783692 - RNA, 19 nt, Homo sapiens
gguuucagauguucauuua

SEQ ID NO: 783693 - RNA, 19 nt, Homo sapiens
ucauugaccucuagugaua

SEQ ID NO: 783694 - RNA, 19 nt, Homo sapiens
ggagaaagauccuagaaaa

SEQ ID NO: 783695 - RNA, 19 nt, Homo sapiens
gaaccagaauuauaacagu

SEQ ID NO: 783696 - RNA, 19 nt, Homo sapiens
caggaaagagcuuauguua

SEQ ID NO: 783697 - RNA, 19 nt, Homo sapiens
gcacguagaggccaucaaa

SEQ ID NO: 783698 - RNA, 19 nt, Homo sapiens
gcagacauggugaauuuaa

SEQ ID NO: 783699 - RNA, 19 nt, Homo sapiens
gguuauaugugggaagaua

SEQ ID NO: 783700 - RNA, 19 nt, Homo sapiens
gauguacagccuaguguua

SEQ ID NO: 783701 - RNA, 19 nt, Homo sapiens
ggagggaaagccugguuua

SEQ ID NO: 783702 - RNA, 19 nt, Homo sapiens
cauccacuauuguauguuu

SEQ ID NO: 783703 - RNA, 19 nt, Homo sapiens
ggacucagcaggagcuuga

SEQ ID NO: 783704 - RNA, 19 nt, Homo sapiens
augcagacauggugaauuu

SEQ ID NO: 783705 - RNA, 19 nt, Homo sapiens
gaucacugguuucagaugu

SEQ ID NO: 783706 - RNA, 19 nt, Homo sapiens
gcggugaaccagaauuaua

SEQ ID NO: 783707 - RNA, 19 nt, Homo sapiens
ggaggaagcccagaggaaa

SEQ ID NO: 783708 - RNA, 19 nt, Homo sapiens
ccaagauccugguugaguu

SEQ ID NO: 783709 - RNA, 19 nt, Homo sapiens
agaaggcaauugcagcuaa

SEQ ID NO: 783710 - RNA, 19 nt, Homo sapiens
augaucaacucacguauuu

SEQ ID NO: 783711 - RNA, 19 nt, Homo sapiens
cagccaagauccugguuga

SEQ ID NO: 783712 - RNA, 19 nt, Homo sapiens
gaguucagcuugauuucug

SEQ ID NO: 783713 - RNA, 19 nt, Homo sapiens
cuucaaggcuguuggucua

SEQ ID NO: 783714 - RNA, 19 nt, Homo sapiens
gagcucaucugacuguuuu

SEQ ID NO: 783715 - RNA, 19 nt, Homo sapiens
gcagagcaguccagaacca

SEQ ID NO: 783716 - RNA, 19 nt, Homo sapiens
caaccaucauuacaggaaa

SEQ ID NO: 783717 - RNA, 19 nt, Homo sapiens
gguggacucucagaagaaa

SEQ ID NO: 783718 - RNA, 19 nt, Homo sapiens
agaaacaaauggccaugga

SEQ ID NO: 783719 - RNA, 19 nt, Homo sapiens
gaugaucaacucacguauu

SEQ ID NO: 783720 - RNA, 19 nt, Homo sapiens
gagauuggcuuuugucauc

SEQ ID NO: 783721 - RNA, 19 nt, Homo sapiens
gaacaggaaagagcuuaug

SEQ ID NO: 783722 - RNA, 19 nt, Homo sapiens
acagugagcucaucugacu

SEQ ID NO: 783723 - RNA, 19 nt, Homo sapiens
uaacagugagcucaucuga

SEQ ID NO: 783724 - RNA, 19 nt, Homo sapiens
gaagacacgagccgacaga

SEQ ID NO: 783725 - RNA, 19 nt, Homo sapiens
gaucaacucacguauuugg

SEQ ID NO: 783726 - RNA, 19 nt, Homo sapiens
agugauaccuugaucuuuc

SEQ ID NO: 783727 - RNA, 19 nt, Homo sapiens
uaauacagauacucagaag

SEQ ID NO: 783728 - RNA, 19 nt, Homo sapiens
gaaggcaauugcagcuaag

SEQ ID NO: 783729 - RNA, 19 nt, Homo sapiens
caagauccugguugaguuu

SEQ ID NO: 783730 - RNA, 19 nt, Homo sapiens
cagaugaucaacucacgua

SEQ ID NO: 783731 - RNA, 19 nt, Homo sapiens
gugguggacucucagaaga

SEQ ID NO: 783732 - RNA, 19 nt, Homo sapiens
ucaaggaggaggagaaugu

SEQ ID NO: 783733 - RNA, 19 nt, Homo sapiens
gggaaagccugguuuaccu

SEQ ID NO: 783734 - RNA, 19 nt, Homo sapiens
guaaauuugccaugacuuc

SEQ ID NO: 783735 - RNA, 19 nt, Homo sapiens
agaagcaucugcagcaucu

SEQ ID NO: 783736 - RNA, 19 nt, Homo sapiens
uuaggcaggugguuauaug

SEQ ID NO: 783737 - RNA, 19 nt, Homo sapiens
acaaccugcuggagaugua

SEQ ID NO: 783738 - RNA, 19 nt, Homo sapiens
uagcggauuuccugcagaa

SEQ ID NO: 783739 - RNA, 19 nt, Homo sapiens
guguuaacauucuugguau

SEQ ID NO: 783740 - RNA, 19 nt, Homo sapiens
ggacagcagcauggagaaa

SEQ ID NO: 783741 - RNA, 19 nt, Homo sapiens
cggugaaccagaauuauaa

SEQ ID NO: 783742 - RNA, 19 nt, Homo sapiens
auucauggauccaaauguu

SEQ ID NO: 783743 - RNA, 19 nt, Homo sapiens
gauacucagaagccaauaa

SEQ ID NO: 783744 - RNA, 19 nt, Homo sapiens
cuaagguucuugcggugaa

SEQ ID NO: 783745 - RNA, 19 nt, Homo sapiens
agauguaaauuugccauga

SEQ ID NO: 783746 - RNA, 19 nt, Homo sapiens
acaaauggccauggagaaa

SEQ ID NO: 783747 - RNA, 19 nt, Homo sapiens
cagacauggugaauuuaau

SEQ ID NO: 783748 - RNA, 19 nt, Homo sapiens
ggaucucucucaguugugu

SEQ ID NO: 783749 - RNA, 19 nt, Homo sapiens
gagcucugcuacccaugga

SEQ ID NO: 783750 - RNA, 19 nt, Homo sapiens
ggagaagcaucugcagcau

SEQ ID NO: 783751 - RNA, 19 nt, Homo sapiens
ucagaagccaauaacauga

SEQ ID NO: 783752 - RNA, 19 nt, Homo sapiens
ucuggcaucuguggauuaa

SEQ ID NO: 783753 - RNA, 19 nt, Homo sapiens
gcucuggcaucuguggauu

SEQ ID NO: 783754 - RNA, 19 nt, Homo sapiens
gggaacaggaaagagcuua

SEQ ID NO: 783755 - RNA, 19 nt, Homo sapiens
gauguaaauuugccaugac

SEQ ID NO: 783756 - RNA, 19 nt, Homo sapiens
gaggugagggagcguaaga

SEQ ID NO: 783757 - RNA, 19 nt, Homo sapiens
ucucaguuguguauuuguu

SEQ ID NO: 783758 - RNA, 19 nt, Homo sapiens
ugagguggcaggcaucuug

SEQ ID NO: 783759 - RNA, 19 nt, Homo sapiens
gugguuauaugugggaaga

SEQ ID NO: 783760 - RNA, 19 nt, Homo sapiens
gagcugggacugguuugaa

SEQ ID NO: 783761 - RNA, 19 nt, Homo sapiens
gaaagauccuagaaaaggu

SEQ ID NO: 783762 - RNA, 19 nt, Homo sapiens
ugcuggagauguaaauuug

SEQ ID NO: 783763 - RNA, 19 nt, Homo sapiens
caaggcuguuggucuacaa

SEQ ID NO: 783764 - RNA, 19 nt, Homo sapiens
ccaaccaucauuacaggaa

SEQ ID NO: 783765 - RNA, 19 nt, Homo sapiens
uggagaagauguaccuuuu

SEQ ID NO: 783766 - RNA, 19 nt, Homo sapiens
gucauccacuauuguaugu

SEQ ID NO: 783767 - RNA, 19 nt, Homo sapiens
caggaacaacuauuaauac

SEQ ID NO: 783768 - RNA, 19 nt, Homo sapiens
ggcaauugcagcuaaggaa

SEQ ID NO: 783769 - RNA, 19 nt, Homo sapiens
ucaguuguguauuuguuca

SEQ ID NO: 783770 - RNA, 19 nt, Homo sapiens
caggaaagacugugaacuc

SEQ ID NO: 783771 - RNA, 19 nt, Homo sapiens
acagcagcauggagaaaga

SEQ ID NO: 783772 - RNA, 19 nt, Homo sapiens
ucuacaaccugcuggagau

SEQ ID NO: 783773 - RNA, 19 nt, Homo sapiens
ucaccaaggcccugacuca

SEQ ID NO: 783774 - RNA, 19 nt, Homo sapiens
gaucuuucccacuuucugu

SEQ ID NO: 783775 - RNA, 19 nt, Homo sapiens
ggaggaggagaauguuuua

SEQ ID NO: 783776 - RNA, 19 nt, Homo sapiens
ggaacaggaaagagcuuau

SEQ ID NO: 783777 - RNA, 19 nt, Homo sapiens
cagcuaaggaacaauggaa

SEQ ID NO: 783778 - RNA, 19 nt, Homo sapiens
aguguuaacauucuuggua

SEQ ID NO: 783779 - RNA, 19 nt, Homo sapiens
cagcuugauuucugacuac

SEQ ID NO: 783780 - RNA, 19 nt, Homo sapiens
gauccugguugaguuugug

SEQ ID NO: 783781 - RNA, 19 nt, Homo sapiens
ugaagcagcaggcagaaca

SEQ ID NO: 783782 - RNA, 19 nt, Homo sapiens
ucacugguuucagauguuc

SEQ ID NO: 783783 - RNA, 19 nt, Homo sapiens
cucgaucacugguuucaga

SEQ ID NO: 783784 - RNA, 19 nt, Homo sapiens
ggauguacagccuaguguu

SEQ ID NO: 783785 - RNA, 19 nt, Homo sapiens
gcaggaggaggcagaacug

SEQ ID NO: 783786 - RNA, 19 nt, Homo sapiens
uggcaggaacaacuauuaa

SEQ ID NO: 783787 - RNA, 19 nt, Homo sapiens
ucucucaguuguguauuug

SEQ ID NO: 783788 - RNA, 19 nt, Homo sapiens
ggacagagcuucaagaaaa

SEQ ID NO: 783789 - RNA, 19 nt, Homo sapiens
gcaucaagcugaacaacaa

SEQ ID NO: 783790 - RNA, 19 nt, Homo sapiens
ccaaggauaucauaaacaa

SEQ ID NO: 783791 - RNA, 19 nt, Homo sapiens
gaacaguggcugcagauga

SEQ ID NO: 783792 - RNA, 19 nt, Homo sapiens
acacagagaugcugacuuc

SEQ ID NO: 783793 - RNA, 19 nt, Homo sapiens
aaacaacccucuauucauc

SEQ ID NO: 783794 - RNA, 19 nt, Homo sapiens
ggaauuggaugaagucaac

SEQ ID NO: 783795 - RNA, 19 nt, Homo sapiens
ggagugcccugcuggagaa

SEQ ID NO: 783796 - RNA, 19 nt, Homo sapiens
ugaucaaccucauggauaa

SEQ ID NO: 783797 - RNA, 19 nt, Homo sapiens
cgacaacgcccagaacuuu

SEQ ID NO: 783798 - RNA, 19 nt, Homo sapiens
gagaugcgccugguuauug

SEQ ID NO: 783799 - RNA, 19 nt, Homo sapiens
ggaaugguggcucacauaa

SEQ ID NO: 783800 - RNA, 19 nt, Homo sapiens
ggauagaggcgcuguagga

SEQ ID NO: 783801 - RNA, 19 nt, Homo sapiens
gcgagcagccugucuaaga

SEQ ID NO: 783802 - RNA, 19 nt, Homo sapiens
ucagagaucuucaccaacu

SEQ ID NO: 783803 - RNA, 19 nt, Homo sapiens
ugacuggccuucaggaugu

SEQ ID NO: 783804 - RNA, 19 nt, Homo sapiens
ggacuuccuacauuuguuu

SEQ ID NO: 783805 - RNA, 19 nt, Homo sapiens
cgagcagccugucuaagaa

SEQ ID NO: 783806 - RNA, 19 nt, Homo sapiens
gcagagagccuggauggau

SEQ ID NO: 783807 - RNA, 19 nt, Homo sapiens
caaaagaguuucagaacau

SEQ ID NO: 783808 - RNA, 19 nt, Homo sapiens
gaggacagagcuucaagaa

SEQ ID NO: 783809 - RNA, 19 nt, Homo sapiens
uaugagaugcgccugguua

SEQ ID NO: 783810 - RNA, 19 nt, Homo sapiens
gaaugguggcucacauaaa

SEQ ID NO: 783811 - RNA, 19 nt, Homo sapiens
gggaaugguggcucacaua

SEQ ID NO: 783812 - RNA, 19 nt, Homo sapiens
gggaugacccagaggauga

SEQ ID NO: 783813 - RNA, 19 nt, Homo sapiens
cauaaacaacccucuauuc

SEQ ID NO: 783814 - RNA, 19 nt, Homo sapiens
gagcccagcugcagaccau

SEQ ID NO: 783815 - RNA, 19 nt, Homo sapiens
gcaccuugaacuccuauga

SEQ ID NO: 783816 - RNA, 19 nt, Homo sapiens
ugaacguggugguagauga

SEQ ID NO: 783817 - RNA, 19 nt, Homo sapiens
ggaauggagcuuggaguga

SEQ ID NO: 783818 - RNA, 19 nt, Homo sapiens
gcccucagcucuccagucu

SEQ ID NO: 783819 - RNA, 19 nt, Homo sapiens
gcccaaggauaucauaaac

SEQ ID NO: 783820 - RNA, 19 nt, Homo sapiens
ugagaaagcaggcaucaag

SEQ ID NO: 783821 - RNA, 19 nt, Homo sapiens
gcgccugguuauugagaaa

SEQ ID NO: 783822 - RNA, 19 nt, Homo sapiens
aagauuuccugaacaacuu

SEQ ID NO: 783823 - RNA, 19 nt, Homo sapiens
cuaccaagauuuccugaac

SEQ ID NO: 783824 - RNA, 19 nt, Homo sapiens
uaaacaacccucuauucau

SEQ ID NO: 783825 - RNA, 19 nt, Homo sapiens
gagcagccugucuaagaaa

SEQ ID NO: 783826 - RNA, 19 nt, Homo sapiens
ccucagcucuccagucucu

SEQ ID NO: 783827 - RNA, 19 nt, Homo sapiens
ccaagaauacuggccauau

SEQ ID NO: 783828 - RNA, 19 nt, Homo sapiens
ucauagacuuugacagcuu

SEQ ID NO: 783829 - RNA, 19 nt, Homo sapiens
ccacaaagaaugacaagcu

SEQ ID NO: 783830 - RNA, 19 nt, Homo sapiens
auaaacaacccucuauuca

SEQ ID NO: 783831 - RNA, 19 nt, Homo sapiens
ggacaucuucagagagugu

SEQ ID NO: 783832 - RNA, 19 nt, Homo sapiens
gcuugccgcugcaugauca

SEQ ID NO: 783833 - RNA, 19 nt, Homo sapiens
gagcaacuccaagaggaaa

SEQ ID NO: 783834 - RNA, 19 nt, Homo sapiens
ccagguaugcagaugauga

SEQ ID NO: 783835 - RNA, 19 nt, Homo sapiens
ggccagguaugcagaugau

SEQ ID NO: 783836 - RNA, 19 nt, Homo sapiens
gcaaggagauaggggugua

SEQ ID NO: 783837 - RNA, 19 nt, Homo sapiens
aaugguggcucacauaaac

SEQ ID NO: 783838 - RNA, 19 nt, Homo sapiens
gaugggauuucuccaacag

SEQ ID NO: 783839 - RNA, 19 nt, Homo sapiens
guaggagccuggucaucuc

SEQ ID NO: 783840 - RNA, 19 nt, Homo sapiens
gaaugacaagcugguguuu

SEQ ID NO: 783841 - RNA, 19 nt, Homo sapiens
ggaugggauuucuccaaca

SEQ ID NO: 783842 - RNA, 19 nt, Homo sapiens
aagcaggcaucaagcugaa

SEQ ID NO: 783843 - RNA, 19 nt, Homo sapiens
gcagaccauuggcuuuguc

SEQ ID NO: 783844 - RNA, 19 nt, Homo sapiens
uuucagauuuggcaguuug

SEQ ID NO: 783845 - RNA, 19 nt, Homo sapiens
uggaugaagucaacuaugc

SEQ ID NO: 783846 - RNA, 19 nt, Homo sapiens
cauucaggauguccacuug

SEQ ID NO: 783847 - RNA, 19 nt, Homo sapiens
gggcacgcuuacucuguga

SEQ ID NO: 783848 - RNA, 19 nt, Homo sapiens
uaucauaaacaacccucua

SEQ ID NO: 783849 - RNA, 19 nt, Homo sapiens
gaccugaucauagacuuug

SEQ ID NO: 783850 - RNA, 19 nt, Homo sapiens
agaugcgccugguuauuga

SEQ ID NO: 783851 - RNA, 19 nt, Homo sapiens
gggugaacguggugguaga

SEQ ID NO: 783852 - RNA, 19 nt, Homo sapiens
ggcccaaggauaucauaaa

SEQ ID NO: 783853 - RNA, 19 nt, Homo sapiens
agucucugcugaugaaaug

SEQ ID NO: 783854 - RNA, 19 nt, Homo sapiens
uccagucucugcugaugaa

SEQ ID NO: 783855 - RNA, 19 nt, Homo sapiens
gagcccacuuuuacugaua

SEQ ID NO: 783856 - RNA, 19 nt, Homo sapiens
caugggaauuggaugaagu

SEQ ID NO: 783857 - RNA, 19 nt, Homo sapiens
ccaaaagaguuucagaaca

SEQ ID NO: 783858 - RNA, 19 nt, Homo sapiens
ggauguccuaccaagauuu

SEQ ID NO: 783859 - RNA, 19 nt, Homo sapiens
caagcugaacaacaaggua

SEQ ID NO: 783860 - RNA, 19 nt, Homo sapiens
caagggcuuuggccuggau

SEQ ID NO: 783861 - RNA, 19 nt, Homo sapiens
caagauuuccugaacaacu

SEQ ID NO: 783862 - RNA, 19 nt, Homo sapiens
ggagggccuugaggacuuc

SEQ ID NO: 783863 - RNA, 19 nt, Homo sapiens
caaccgaacgcagugaguu

SEQ ID NO: 783864 - RNA, 19 nt, Homo sapiens
gcuguuuccugaggcuaaa

SEQ ID NO: 783865 - RNA, 19 nt, Homo sapiens
aagcugaacaacaagguaa

SEQ ID NO: 783866 - RNA, 19 nt, Homo sapiens
ucaaccucauggauaaaga

SEQ ID NO: 783867 - RNA, 19 nt, Homo sapiens
ggagagggcaaggagauag

SEQ ID NO: 783868 - RNA, 19 nt, Homo sapiens
ugacauggaccaggacuuc

SEQ ID NO: 783869 - RNA, 19 nt, Homo sapiens
ggaaccacccuggcacguu

SEQ ID NO: 783870 - RNA, 19 nt, Homo sapiens
accaagauuuccugaacaa

SEQ ID NO: 783871 - RNA, 19 nt, Homo sapiens
gaccggcugcccacaaaga

SEQ ID NO: 783872 - RNA, 19 nt, Homo sapiens
ucauaaacaacccucuauu

SEQ ID NO: 783873 - RNA, 19 nt, Homo sapiens
gaucaaccucauggauaaa

SEQ ID NO: 783874 - RNA, 19 nt, Homo sapiens
caggauguccacuugaaga

SEQ ID NO: 783875 - RNA, 19 nt, Homo sapiens
uggauguccuaccaagauu

SEQ ID NO: 783876 - RNA, 19 nt, Homo sapiens
uggagggccuugaggacuu

SEQ ID NO: 783877 - RNA, 19 nt, Homo sapiens
gcccagaacuuugguaacc

SEQ ID NO: 783878 - RNA, 19 nt, Homo sapiens
gccaucggcucccuuacca

SEQ ID NO: 783879 - RNA, 19 nt, Homo sapiens
ucacauucuuucuaaccau

SEQ ID NO: 783880 - RNA, 19 nt, Homo sapiens
gacaacgcccagaacuuug

SEQ ID NO: 783881 - RNA, 19 nt, Homo sapiens
auuauucccuccaccuuug

SEQ ID NO: 783882 - RNA, 19 nt, Homo sapiens
caaaauggaaacacugauu

SEQ ID NO: 783883 - RNA, 19 nt, Homo sapiens
gcugccaucggcucccuua

SEQ ID NO: 783884 - RNA, 19 nt, Homo sapiens
ugacgcagagggcaauguu

SEQ ID NO: 783885 - RNA, 19 nt, Homo sapiens
gcacgacaacgcccagaac

SEQ ID NO: 783886 - RNA, 19 nt, Homo sapiens
cauuauucccuccaccuuu

SEQ ID NO: 783887 - RNA, 19 nt, Homo sapiens
caugugcggagcccacuuu

SEQ ID NO: 783888 - RNA, 19 nt, Homo sapiens
cagcagaucuucuuuauaa

SEQ ID NO: 783889 - RNA, 19 nt, Homo sapiens
caugagcgcugaugauuug

SEQ ID NO: 783890 - RNA, 19 nt, Homo sapiens
ggcagcagaucuucuuuau

SEQ ID NO: 783891 - RNA, 19 nt, Homo sapiens
gggcagcagaucuucuuua

SEQ ID NO: 783892 - RNA, 19 nt, Homo sapiens
gcagcagaucuucuuuaua

SEQ ID NO: 783893 - RNA, 19 nt, Homo sapiens
ucccagagcuucccaggau

SEQ ID NO: 783894 - RNA, 19 nt, Homo sapiens
gggcugguccugagucuug

SEQ ID NO: 783895 - RNA, 19 nt, Homo sapiens
gacaggccauccauucaca

SEQ ID NO: 783896 - RNA, 19 nt, Homo sapiens
gcagaucuucuuuauaacu

SEQ ID NO: 783897 - RNA, 19 nt, Homo sapiens
gaccaucgcaaccaggauu

SEQ ID NO: 783898 - RNA, 19 nt, Homo sapiens
aaacaugagcgcugaugau

SEQ ID NO: 783899 - RNA, 19 nt, Homo sapiens
ccaagaggucuccgucaug

SEQ ID NO: 783900 - RNA, 19 nt, Homo sapiens
uaaacaugagcgcugauga

SEQ ID NO: 783901 - RNA, 19 nt, Homo sapiens
acaugagcgcugaugauuu

SEQ ID NO: 783902 - RNA, 19 nt, Homo sapiens
aacaugagcgcugaugauu

SEQ ID NO: 783903 - RNA, 19 nt, Homo sapiens
ggguagggcagcagaucuu

SEQ ID NO: 783904 - RNA, 19 nt, Homo sapiens
uccaagaggucuccgucau

SEQ ID NO: 783905 - RNA, 19 nt, Homo sapiens
cgaaucacuuuuaggaugu

SEQ ID NO: 783906 - RNA, 19 nt, Homo sapiens
cagcagaucuucuuuauaa

SEQ ID NO: 783907 - RNA, 19 nt, Homo sapiens
gcaggaacuuugccucaua

SEQ ID NO: 783908 - RNA, 19 nt, Homo sapiens
caugagcgcugaugauuug

SEQ ID NO: 783909 - RNA, 19 nt, Homo sapiens
ggaguuccaugccuucauu

SEQ ID NO: 783910 - RNA, 19 nt, Homo sapiens
ggcagcagaucuucuuuau

SEQ ID NO: 783911 - RNA, 19 nt, Homo sapiens
gggcagcagaucuucuuua

SEQ ID NO: 783912 - RNA, 19 nt, Homo sapiens
gcagcagaucuucuuuaua

SEQ ID NO: 783913 - RNA, 19 nt, Homo sapiens
cgagugagguguacauugc

SEQ ID NO: 783914 - RNA, 19 nt, Homo sapiens
gcagggagacucuguuucu

SEQ ID NO: 783915 - RNA, 19 nt, Homo sapiens
ucccagagcuucccaggau

SEQ ID NO: 783916 - RNA, 19 nt, Homo sapiens
gggcugguccugagucuug

SEQ ID NO: 783917 - RNA, 19 nt, Homo sapiens
ucagggcaguggccaagaa

SEQ ID NO: 783918 - RNA, 19 nt, Homo sapiens
gacaggccauccauucaca

SEQ ID NO: 783919 - RNA, 19 nt, Homo sapiens
gcagaucuucuuuauaacu

SEQ ID NO: 783920 - RNA, 19 nt, Homo sapiens
gaccaucgcaaccaggauu

SEQ ID NO: 783921 - RNA, 19 nt, Homo sapiens
gggaagggcaggugaagca

SEQ ID NO: 783922 - RNA, 19 nt, Homo sapiens
gaaggaccagugucugauc

SEQ ID NO: 783923 - RNA, 19 nt, Homo sapiens
aaacaugagcgcugaugau

SEQ ID NO: 783924 - RNA, 19 nt, Homo sapiens
ccagagggaggauguguuc

SEQ ID NO: 783925 - RNA, 19 nt, Homo sapiens
ccaagaggucuccgucaug

SEQ ID NO: 783926 - RNA, 19 nt, Homo sapiens
gcugggagcacaggacuug

SEQ ID NO: 783927 - RNA, 19 nt, Homo sapiens
cccaucggcuuccauaucu

SEQ ID NO: 783928 - RNA, 19 nt, Homo sapiens
uaaacaugagcgcugauga

SEQ ID NO: 783929 - RNA, 19 nt, Homo sapiens
gaaccugaagggcguagca

SEQ ID NO: 783930 - RNA, 19 nt, Homo sapiens
caggaacuuugccucauac

SEQ ID NO: 783931 - RNA, 19 nt, Homo sapiens
cagaaccgagugaggugua

SEQ ID NO: 783932 - RNA, 19 nt, Homo sapiens
uccuucaccugucgcauuu

SEQ ID NO: 783933 - RNA, 19 nt, Homo sapiens
ggcagcugcuccaccugaa

SEQ ID NO: 783934 - RNA, 19 nt, Homo sapiens
ggaggcugccggaacaaca

SEQ ID NO: 783935 - RNA, 19 nt, Homo sapiens
acaugagcgcugaugauuu

SEQ ID NO: 783936 - RNA, 19 nt, Homo sapiens
ugucgcauuuggcaguuug

SEQ ID NO: 783937 - RNA, 19 nt, Homo sapiens
aaggaccagugucugauca

SEQ ID NO: 783938 - RNA, 19 nt, Homo sapiens
cugaaggaccagugucuga

SEQ ID NO: 783939 - RNA, 19 nt, Homo sapiens
aacaugagcgcugaugauu

SEQ ID NO: 783940 - RNA, 19 nt, Homo sapiens
ggguagggcagcagaucuu

SEQ ID NO: 783941 - RNA, 19 nt, Homo sapiens
uccaagaggucuccgucau

SEQ ID NO: 783942 - RNA, 19 nt, Homo sapiens
ggaguuccucagggaguuu

SEQ ID NO: 783943 - RNA, 19 nt, Homo sapiens
cgaaucacuuuuaggaugu

SEQ ID NO: 783944 - RNA, 19 nt, Homo sapiens
uuccaugccuucauugucu

SEQ ID NO: 783945 - RNA, 19 nt, Homo sapiens
ggauugcugguuccugugu

SEQ ID NO: 783946 - RNA, 19 nt, Homo sapiens
cagcagaucuucuuuauaa

SEQ ID NO: 783947 - RNA, 19 nt, Homo sapiens
caugagcgcugaugauuug

SEQ ID NO: 783948 - RNA, 19 nt, Homo sapiens
ggaguuccaugccuucauu

SEQ ID NO: 783949 - RNA, 19 nt, Homo sapiens
ggcagcagaucuucuuuau

SEQ ID NO: 783950 - RNA, 19 nt, Homo sapiens
gggcagcagaucuucuuua

SEQ ID NO: 783951 - RNA, 19 nt, Homo sapiens
gcagcagaucuucuuuaua

SEQ ID NO: 783952 - RNA, 19 nt, Homo sapiens
cgagugagguguacauugc

SEQ ID NO: 783953 - RNA, 19 nt, Homo sapiens
gcagggagacucuguuucu

SEQ ID NO: 783954 - RNA, 19 nt, Homo sapiens
ucccagagcuucccaggau

SEQ ID NO: 783955 - RNA, 19 nt, Homo sapiens
gggcugguccugagucuug

SEQ ID NO: 783956 - RNA, 19 nt, Homo sapiens
gacaggccauccauucaca

SEQ ID NO: 783957 - RNA, 19 nt, Homo sapiens
gcagaucuucuuuauaacu

SEQ ID NO: 783958 - RNA, 19 nt, Homo sapiens
gaccaucgcaaccaggauu

SEQ ID NO: 783959 - RNA, 19 nt, Homo sapiens
gggaagggcaggugaagca

SEQ ID NO: 783960 - RNA, 19 nt, Homo sapiens
gaaggaccagugucugauc

SEQ ID NO: 783961 - RNA, 19 nt, Homo sapiens
aaacaugagcgcugaugau

SEQ ID NO: 783962 - RNA, 19 nt, Homo sapiens
ccagagggaggauguguuc

SEQ ID NO: 783963 - RNA, 19 nt, Homo sapiens
ccaagaggucuccgucaug

SEQ ID NO: 783964 - RNA, 19 nt, Homo sapiens
gcugggagcacaggacuug

SEQ ID NO: 783965 - RNA, 19 nt, Homo sapiens
cccaucggcuuccauaucu

SEQ ID NO: 783966 - RNA, 19 nt, Homo sapiens
uaaacaugagcgcugauga

SEQ ID NO: 783967 - RNA, 19 nt, Homo sapiens
gaaccugaagggcguagca

SEQ ID NO: 783968 - RNA, 19 nt, Homo sapiens
uccuucaccugucgcauuu

SEQ ID NO: 783969 - RNA, 19 nt, Homo sapiens
cagaaccgagugaggugua

SEQ ID NO: 783970 - RNA, 19 nt, Homo sapiens
ggcagcugcuccaccugaa

SEQ ID NO: 783971 - RNA, 19 nt, Homo sapiens
ggaggcugccggaacaaca

SEQ ID NO: 783972 - RNA, 19 nt, Homo sapiens
acaugagcgcugaugauuu

SEQ ID NO: 783973 - RNA, 19 nt, Homo sapiens
ugucgcauuuggcaguuug

SEQ ID NO: 783974 - RNA, 19 nt, Homo sapiens
aaggaccagugucugauca

SEQ ID NO: 783975 - RNA, 19 nt, Homo sapiens
cugaaggaccagugucuga

SEQ ID NO: 783976 - RNA, 19 nt, Homo sapiens
aacaugagcgcugaugauu

SEQ ID NO: 783977 - RNA, 19 nt, Homo sapiens
ggguagggcagcagaucuu

SEQ ID NO: 783978 - RNA, 19 nt, Homo sapiens
uccaagaggucuccgucau

SEQ ID NO: 783979 - RNA, 19 nt, Homo sapiens
ggaguuccucagggaguuu

SEQ ID NO: 783980 - RNA, 19 nt, Homo sapiens
cgaaucacuuuuaggaugu

SEQ ID NO: 783981 - RNA, 19 nt, Homo sapiens
uuccaugccuucauugucu

SEQ ID NO: 783982 - RNA, 19 nt, Homo sapiens
ggauugcugguuccugugu

SEQ ID NO: 783983 - RNA, 19 nt, Homo sapiens
cagcagaucuucuuuauaa

SEQ ID NO: 783984 - RNA, 19 nt, Homo sapiens
caugagcgcugaugauuug

SEQ ID NO: 783985 - RNA, 19 nt, Homo sapiens
ggaguuccaugccuucauu

SEQ ID NO: 783986 - RNA, 19 nt, Homo sapiens
ggcagcagaucuucuuuau

SEQ ID NO: 783987 - RNA, 19 nt, Homo sapiens
gggcagcagaucuucuuua

SEQ ID NO: 783988 - RNA, 19 nt, Homo sapiens
gcagcagaucuucuuuaua

SEQ ID NO: 783989 - RNA, 19 nt, Homo sapiens
cgagugagguguacauugc

SEQ ID NO: 783990 - RNA, 19 nt, Homo sapiens
gcagggagacucuguuucu

SEQ ID NO: 783991 - RNA, 19 nt, Homo sapiens
ucccagagcuucccaggau

SEQ ID NO: 783992 - RNA, 19 nt, Homo sapiens
gggcugguccugagucuug

SEQ ID NO: 783993 - RNA, 19 nt, Homo sapiens
gacaggccauccauucaca

SEQ ID NO: 783994 - RNA, 19 nt, Homo sapiens
gcagaucuucuuuauaacu

SEQ ID NO: 783995 - RNA, 19 nt, Homo sapiens
gaccaucgcaaccaggauu

SEQ ID NO: 783996 - RNA, 19 nt, Homo sapiens
gggaagggcaggugaagca

SEQ ID NO: 783997 - RNA, 19 nt, Homo sapiens
gaaggaccagugucugauc

SEQ ID NO: 783998 - RNA, 19 nt, Homo sapiens
aaacaugagcgcugaugau

SEQ ID NO: 783999 - RNA, 19 nt, Homo sapiens
ccagagggaggauguguuc

SEQ ID NO: 784000 - RNA, 19 nt, Homo sapiens
ccaagaggucuccgucaug

SEQ ID NO: 784001 - RNA, 19 nt, Homo sapiens
gcugggagcacaggacuug

SEQ ID NO: 784002 - RNA, 19 nt, Homo sapiens
uaaacaugagcgcugauga

SEQ ID NO: 784003 - RNA, 19 nt, Homo sapiens
gaaccugaagggcguagca

SEQ ID NO: 784004 - RNA, 19 nt, Homo sapiens
uccuucaccugucgcauuu

SEQ ID NO: 784005 - RNA, 19 nt, Homo sapiens
ggcagcugcuccaccugaa

SEQ ID NO: 784006 - RNA, 19 nt, Homo sapiens
ggaggcugccggaacaaca

SEQ ID NO: 784007 - RNA, 19 nt, Homo sapiens
acaugagcgcugaugauuu

SEQ ID NO: 784008 - RNA, 19 nt, Homo sapiens
aaggaccagugucugauca

SEQ ID NO: 784009 - RNA, 19 nt, Homo sapiens
ugucgcauuuggcaguuug

SEQ ID NO: 784010 - RNA, 19 nt, Homo sapiens
cugaaggaccagugucuga

SEQ ID NO: 784011 - RNA, 19 nt, Homo sapiens
aacaugagcgcugaugauu

SEQ ID NO: 784012 - RNA, 19 nt, Homo sapiens
ggguagggcagcagaucuu

SEQ ID NO: 784013 - RNA, 19 nt, Homo sapiens
uccaagaggucuccgucau

SEQ ID NO: 784014 - RNA, 19 nt, Homo sapiens
ggaguuccucagggaguuu

SEQ ID NO: 784015 - RNA, 19 nt, Homo sapiens
cgaaucacuuuuaggaugu

SEQ ID NO: 784016 - RNA, 19 nt, Homo sapiens
uuccaugccuucauugucu

SEQ ID NO: 784017 - RNA, 19 nt, Homo sapiens
ggauugcugguuccugugu

SEQ ID NO: 784018 - RNA, 19 nt, Homo sapiens
cagcagaucuucuuuauaa

SEQ ID NO: 784019 - RNA, 19 nt, Homo sapiens
caugagcgcugaugauuug

SEQ ID NO: 784020 - RNA, 19 nt, Homo sapiens
ggaguuccaugccuucauu

SEQ ID NO: 784021 - RNA, 19 nt, Homo sapiens
ggcagcagaucuucuuuau

SEQ ID NO: 784022 - RNA, 19 nt, Homo sapiens
gggcagcagaucuucuuua

SEQ ID NO: 784023 - RNA, 19 nt, Homo sapiens
gcagcagaucuucuuuaua

SEQ ID NO: 784024 - RNA, 19 nt, Homo sapiens
cgagugagguguacauugc

SEQ ID NO: 784025 - RNA, 19 nt, Homo sapiens
gcagggagacucuguuucu

SEQ ID NO: 784026 - RNA, 19 nt, Homo sapiens
gggcgagucucccuuaggu

SEQ ID NO: 784027 - RNA, 19 nt, Homo sapiens
ucccagagcuucccaggau

SEQ ID NO: 784028 - RNA, 19 nt, Homo sapiens
gggcugguccugagucuug

SEQ ID NO: 784029 - RNA, 19 nt, Homo sapiens
gacaggccauccauucaca

SEQ ID NO: 784030 - RNA, 19 nt, Homo sapiens
gcagaucuucuuuauaacu

SEQ ID NO: 784031 - RNA, 19 nt, Homo sapiens
gaccaucgcaaccaggauu

SEQ ID NO: 784032 - RNA, 19 nt, Homo sapiens
gggaagggcaggugaagca

SEQ ID NO: 784033 - RNA, 19 nt, Homo sapiens
gaaggaccagugucugauc

SEQ ID NO: 784034 - RNA, 19 nt, Homo sapiens
aaacaugagcgcugaugau

SEQ ID NO: 784035 - RNA, 19 nt, Homo sapiens
ccagagggaggauguguuc

SEQ ID NO: 784036 - RNA, 19 nt, Homo sapiens
ccaagaggucuccgucaug

SEQ ID NO: 784037 - RNA, 19 nt, Homo sapiens
gcugggagcacaggacuug

SEQ ID NO: 784038 - RNA, 19 nt, Homo sapiens
uaaacaugagcgcugauga

SEQ ID NO: 784039 - RNA, 19 nt, Homo sapiens
gaaccugaagggcguagca

SEQ ID NO: 784040 - RNA, 19 nt, Homo sapiens
uccuucaccugucgcauuu

SEQ ID NO: 784041 - RNA, 19 nt, Homo sapiens
cagaaccgagugaggugua

SEQ ID NO: 784042 - RNA, 19 nt, Homo sapiens
ggcagcugcuccaccugaa

SEQ ID NO: 784043 - RNA, 19 nt, Homo sapiens
ggaggcugccggaacaaca

SEQ ID NO: 784044 - RNA, 19 nt, Homo sapiens
acaugagcgcugaugauuu

SEQ ID NO: 784045 - RNA, 19 nt, Homo sapiens
ugucgcauuuggcaguuug

SEQ ID NO: 784046 - RNA, 19 nt, Homo sapiens
aaggaccagugucugauca

SEQ ID NO: 784047 - RNA, 19 nt, Homo sapiens
cugaaggaccagugucuga

SEQ ID NO: 784048 - RNA, 19 nt, Homo sapiens
aacaugagcgcugaugauu

SEQ ID NO: 784049 - RNA, 19 nt, Homo sapiens
ggguagggcagcagaucuu

SEQ ID NO: 784050 - RNA, 19 nt, Homo sapiens
uccaagaggucuccgucau

SEQ ID NO: 784051 - RNA, 19 nt, Homo sapiens
ggaguuccucagggaguuu

SEQ ID NO: 784052 - RNA, 19 nt, Homo sapiens
cgaaucacuuuuaggaugu

SEQ ID NO: 784053 - RNA, 19 nt, Homo sapiens
ggauugcugguuccugugu

SEQ ID NO: 784054 - RNA, 19 nt, Homo sapiens
uuccaugccuucauugucu

SEQ ID NO: 784055 - RNA, 19 nt, Homo sapiens
cagcagaucuucuuuauaa

SEQ ID NO: 784056 - RNA, 19 nt, Homo sapiens
caugagcgcugaugauuug

SEQ ID NO: 784057 - RNA, 19 nt, Homo sapiens
ggaguuccaugccuucauu

SEQ ID NO: 784058 - RNA, 19 nt, Homo sapiens
ggcagcagaucuucuuuau

SEQ ID NO: 784059 - RNA, 19 nt, Homo sapiens
gggcagcagaucuucuuua

SEQ ID NO: 784060 - RNA, 19 nt, Homo sapiens
gcagcagaucuucuuuaua

SEQ ID NO: 784061 - RNA, 19 nt, Homo sapiens
cgagugagguguacauugc

SEQ ID NO: 784062 - RNA, 19 nt, Homo sapiens
gcagggagacucuguuucu

SEQ ID NO: 784063 - RNA, 19 nt, Homo sapiens
ucccagagcuucccaggau

SEQ ID NO: 784064 - RNA, 19 nt, Homo sapiens
gggcugguccugagucuug

SEQ ID NO: 784065 - RNA, 19 nt, Homo sapiens
gacaggccauccauucaca

SEQ ID NO: 784066 - RNA, 19 nt, Homo sapiens
ugauguuccuuuccucuug

SEQ ID NO: 784067 - RNA, 19 nt, Homo sapiens
gcagaucuucuuuauaacu

SEQ ID NO: 784068 - RNA, 19 nt, Homo sapiens
gaccaucgcaaccaggauu

SEQ ID NO: 784069 - RNA, 19 nt, Homo sapiens
gggaagggcaggugaagca

SEQ ID NO: 784070 - RNA, 19 nt, Homo sapiens
gaaggaccagugucugauc

SEQ ID NO: 784071 - RNA, 19 nt, Homo sapiens
aaacaugagcgcugaugau

SEQ ID NO: 784072 - RNA, 19 nt, Homo sapiens
ccagagggaggauguguuc

SEQ ID NO: 784073 - RNA, 19 nt, Homo sapiens
ccaagaggucuccgucaug

SEQ ID NO: 784074 - RNA, 19 nt, Homo sapiens
gcugggagcacaggacuug

SEQ ID NO: 784075 - RNA, 19 nt, Homo sapiens
cccaucggcuuccauaucu

SEQ ID NO: 784076 - RNA, 19 nt, Homo sapiens
acacuuggcaccacacugu

SEQ ID NO: 784077 - RNA, 19 nt, Homo sapiens
uaaacaugagcgcugauga

SEQ ID NO: 784078 - RNA, 19 nt, Homo sapiens
gaaccugaagggcguagca

SEQ ID NO: 784079 - RNA, 19 nt, Homo sapiens
uccuucaccugucgcauuu

SEQ ID NO: 784080 - RNA, 19 nt, Homo sapiens
ggcagcugcuccaccugaa

SEQ ID NO: 784081 - RNA, 19 nt, Homo sapiens
ggaggcugccggaacaaca

SEQ ID NO: 784082 - RNA, 19 nt, Homo sapiens
acaugagcgcugaugauuu

SEQ ID NO: 784083 - RNA, 19 nt, Homo sapiens
aaggaccagugucugauca

SEQ ID NO: 784084 - RNA, 19 nt, Homo sapiens
cugaaggaccagugucuga

SEQ ID NO: 784085 - RNA, 19 nt, Homo sapiens
ugucgcauuuggcaguuug

SEQ ID NO: 784086 - RNA, 19 nt, Homo sapiens
aacaugagcgcugaugauu

SEQ ID NO: 784087 - RNA, 19 nt, Homo sapiens
ggguagggcagcagaucuu

SEQ ID NO: 784088 - RNA, 19 nt, Homo sapiens
uccaagaggucuccgucau

SEQ ID NO: 784089 - RNA, 19 nt, Homo sapiens
ggaguuccucagggaguuu

SEQ ID NO: 784090 - RNA, 19 nt, Homo sapiens
cgaaucacuuuuaggaugu

SEQ ID NO: 784091 - RNA, 19 nt, Homo sapiens
ggauugcugguuccugugu

SEQ ID NO: 784092 - RNA, 19 nt, Homo sapiens
uuccaugccuucauugucu

SEQ ID NO: 784093 - RNA, 19 nt, Homo sapiens
cagcagaucuucuuuauaa

SEQ ID NO: 784094 - RNA, 19 nt, Homo sapiens
gcaggaacuuugccucaua

SEQ ID NO: 784095 - RNA, 19 nt, Homo sapiens
caugagcgcugaugauuug

SEQ ID NO: 784096 - RNA, 19 nt, Homo sapiens
ggaguuccaugccuucauu

SEQ ID NO: 784097 - RNA, 19 nt, Homo sapiens
ggcagcagaucuucuuuau

SEQ ID NO: 784098 - RNA, 19 nt, Homo sapiens
gggcagcagaucuucuuua

SEQ ID NO: 784099 - RNA, 19 nt, Homo sapiens
gcagcagaucuucuuuaua

SEQ ID NO: 784100 - RNA, 19 nt, Homo sapiens
cgagugagguguacauugc

SEQ ID NO: 784101 - RNA, 19 nt, Homo sapiens
gcagggagacucuguuucu

SEQ ID NO: 784102 - RNA, 19 nt, Homo sapiens
ucccagagcuucccaggau

SEQ ID NO: 784103 - RNA, 19 nt, Homo sapiens
gggcugguccugagucuug

SEQ ID NO: 784104 - RNA, 19 nt, Homo sapiens
ucagggcaguggccaagaa

SEQ ID NO: 784105 - RNA, 19 nt, Homo sapiens
gacaggccauccauucaca

SEQ ID NO: 784106 - RNA, 19 nt, Homo sapiens
gcagaucuucuuuauaacu

SEQ ID NO: 784107 - RNA, 19 nt, Homo sapiens
gaccaucgcaaccaggauu

SEQ ID NO: 784108 - RNA, 19 nt, Homo sapiens
gggaagggcaggugaagca

SEQ ID NO: 784109 - RNA, 19 nt, Homo sapiens
gaaggaccagugucugauc

SEQ ID NO: 784110 - RNA, 19 nt, Homo sapiens
aaacaugagcgcugaugau

SEQ ID NO: 784111 - RNA, 19 nt, Homo sapiens
ccagagggaggauguguuc

SEQ ID NO: 784112 - RNA, 19 nt, Homo sapiens
ccaagaggucuccgucaug

SEQ ID NO: 784113 - RNA, 19 nt, Homo sapiens
gcugggagcacaggacuug

SEQ ID NO: 784114 - RNA, 19 nt, Homo sapiens
cccaucggcuuccauaucu

SEQ ID NO: 784115 - RNA, 19 nt, Homo sapiens
uaaacaugagcgcugauga

SEQ ID NO: 784116 - RNA, 19 nt, Homo sapiens
gaaccugaagggcguagca

SEQ ID NO: 784117 - RNA, 19 nt, Homo sapiens
caggaacuuugccucauac

SEQ ID NO: 784118 - RNA, 19 nt, Homo sapiens
cagaaccgagugaggugua

SEQ ID NO: 784119 - RNA, 19 nt, Homo sapiens
uccuucaccugucgcauuu

SEQ ID NO: 784120 - RNA, 19 nt, Homo sapiens
ggcagcugcuccaccugaa

SEQ ID NO: 784121 - RNA, 19 nt, Homo sapiens
ggaggcugccggaacaaca

SEQ ID NO: 784122 - RNA, 19 nt, Homo sapiens
acaugagcgcugaugauuu

SEQ ID NO: 784123 - RNA, 19 nt, Homo sapiens
ugucgcauuuggcaguuug

SEQ ID NO: 784124 - RNA, 19 nt, Homo sapiens
aaggaccagugucugauca

SEQ ID NO: 784125 - RNA, 19 nt, Homo sapiens
cugaaggaccagugucuga

SEQ ID NO: 784126 - RNA, 19 nt, Homo sapiens
aacaugagcgcugaugauu

SEQ ID NO: 784127 - RNA, 19 nt, Homo sapiens
ggguagggcagcagaucuu

SEQ ID NO: 784128 - RNA, 19 nt, Homo sapiens
uccaagaggucuccgucau

SEQ ID NO: 784129 - RNA, 19 nt, Homo sapiens
ggaguuccucagggaguuu

SEQ ID NO: 784130 - RNA, 19 nt, Homo sapiens
cgaaucacuuuuaggaugu

SEQ ID NO: 784131 - RNA, 19 nt, Homo sapiens
uuccaugccuucauugucu

SEQ ID NO: 784132 - RNA, 19 nt, Homo sapiens
ggauugcugguuccugugu

SEQ ID NO: 784133 - RNA, 19 nt, Homo sapiens
ggaagugaaucucaucuua

SEQ ID NO: 784134 - RNA, 19 nt, Homo sapiens
ggaagugaaucuccucgua

SEQ ID NO: 784135 - RNA, 19 nt, Homo sapiens
ggaagugaaucuccucgua

SEQ ID NO: 784136 - RNA, 19 nt, Homo sapiens
ugaaagaccugaaacucua

SEQ ID NO: 784137 - RNA, 19 nt, Homo sapiens
ugaaagaccugaaacucua

SEQ ID NO: 784138 - RNA, 19 nt, Homo sapiens
gcaaaguagugauauucua

SEQ ID NO: 784139 - RNA, 19 nt, Homo sapiens
ggcaaaugcuugauucuuu

SEQ ID NO: 784140 - RNA, 19 nt, Homo sapiens
caucaggguuugcaaagua

SEQ ID NO: 784141 - RNA, 19 nt, Homo sapiens
gcaaaugcuugauucuuuc

SEQ ID NO: 784142 - RNA, 19 nt, Homo sapiens
caacaaugacuaaugaguu

SEQ ID NO: 784143 - RNA, 19 nt, Homo sapiens
uagcugagccuucugauga

SEQ ID NO: 784144 - RNA, 19 nt, Homo sapiens
uagcugagccuucugauga

SEQ ID NO: 784145 - RNA, 19 nt, Homo sapiens
uagcugagccuucugauga

SEQ ID NO: 784146 - RNA, 19 nt, Homo sapiens
cacaggaacugggagauaa

SEQ ID NO: 784147 - RNA, 19 nt, Homo sapiens
gagcagaggacccaguuug

SEQ ID NO: 784148 - RNA, 19 nt, Homo sapiens
uggcaucuuucaacaauga

SEQ ID NO: 784149 - RNA, 19 nt, Homo sapiens
cgagucagcuccgauacuu

SEQ ID NO: 784150 - RNA, 19 nt, Homo sapiens
gaagugaaucucaucuuag

SEQ ID NO: 784151 - RNA, 19 nt, Homo sapiens
ccacaggaacugggagaua

SEQ ID NO: 784152 - RNA, 19 nt, Homo sapiens
caucuuagcugagccuucu

SEQ ID NO: 784153 - RNA, 19 nt, Homo sapiens
guuccuucauuaacucuuu

SEQ ID NO: 784154 - RNA, 19 nt, Homo sapiens
auagguagcugacaaugca

SEQ ID NO: 784155 - RNA, 19 nt, Homo sapiens
gcaauagguagcugacaau

SEQ ID NO: 784156 - RNA, 19 nt, Homo sapiens
gcagggcaaaugcuugauu

SEQ ID NO: 784157 - RNA, 19 nt, Homo sapiens
ccuggcaucuuucaacaau

SEQ ID NO: 784158 - RNA, 19 nt, Homo sapiens
cuacuucugucuuccuuca

SEQ ID NO: 784159 - RNA, 19 nt, Homo sapiens
gcaaaguccagccuguaug

SEQ ID NO: 784160 - RNA, 19 nt, Homo sapiens
cauuaacucuuuggucaug

SEQ ID NO: 784161 - RNA, 19 nt, Homo sapiens
cagggcaaaugcuugauuc

SEQ ID NO: 784162 - RNA, 19 nt, Homo sapiens
gguacaguuugcauaggaa

SEQ ID NO: 784163 - RNA, 19 nt, Homo sapiens
gauauucuacuucugucuu

SEQ ID NO: 784164 - RNA, 19 nt, Homo sapiens
ggaaaggcagggcaaaugc

SEQ ID NO: 784165 - RNA, 19 nt, Homo sapiens
cuucugucuuccuucauua

SEQ ID NO: 784166 - RNA, 19 nt, Homo sapiens
gggaagggcaggugaagca

SEQ ID NO: 784167 - RNA, 19 nt, Homo sapiens
ggauugcagacucaugaaa

SEQ ID NO: 784168 - RNA, 19 nt, Homo sapiens
ggauugcagacucaugaaa

SEQ ID NO: 784169 - RNA, 19 nt, Homo sapiens
ggauugcagacucaugaaa

SEQ ID NO: 784170 - RNA, 19 nt, Homo sapiens
gggcaaaugcuugauucuu

SEQ ID NO: 784171 - RNA, 19 nt, Homo sapiens
gagcuggaagugaaucuca

SEQ ID NO: 784172 - RNA, 19 nt, Homo sapiens
caaaguccagccuguaugg

SEQ ID NO: 784173 - RNA, 19 nt, Homo sapiens
uccgauacuucaccagauu

SEQ ID NO: 784174 - RNA, 19 nt, Homo sapiens
gguuugcaaaguagugaua

SEQ ID NO: 784175 - RNA, 19 nt, Homo sapiens
agcaauagguagcugacaa

SEQ ID NO: 784176 - RNA, 19 nt, Homo sapiens
ccucguagcugagccuucu

SEQ ID NO: 784177 - RNA, 19 nt, Homo sapiens
ccucguagcugagccuucu

SEQ ID NO: 784178 - RNA, 19 nt, Homo sapiens
ucccuuccuuuccucauuu

SEQ ID NO: 784179 - RNA, 19 nt, Homo sapiens
acaaugcacagcuaaaaua

SEQ ID NO: 784180 - RNA, 19 nt, Homo sapiens
gagauaaaacucugugguu

SEQ ID NO: 784181 - RNA, 19 nt, Homo sapiens
gcugagccuucugaugaga

SEQ ID NO: 784182 - RNA, 19 nt, Homo sapiens
gcugagccuucugaugaga

SEQ ID NO: 784183 - RNA, 19 nt, Homo sapiens
gcugagccuucugaugaga

SEQ ID NO: 784184 - RNA, 19 nt, Homo sapiens
guacaguuugcauaggaaa

SEQ ID NO: 784185 - RNA, 19 nt, Homo sapiens
uuaacucuuuggucauguu

SEQ ID NO: 784186 - RNA, 19 nt, Homo sapiens
cugucuuccuucauuauuu

SEQ ID NO: 784187 - RNA, 19 nt, Homo sapiens
gauugcagacucaugaaag

SEQ ID NO: 784188 - RNA, 19 nt, Homo sapiens
gaaagaccugaaacucuac

SEQ ID NO: 784189 - RNA, 19 nt, Homo sapiens
gauugcagacucaugaaag

SEQ ID NO: 784190 - RNA, 19 nt, Homo sapiens
gaaagaccugaaacucuac

SEQ ID NO: 784191 - RNA, 19 nt, Homo sapiens
gauugcagacucaugaaag

SEQ ID NO: 784192 - RNA, 19 nt, Homo sapiens
ugagguacaguuugcauag

SEQ ID NO: 784193 - RNA, 19 nt, Homo sapiens
uaacccuaaugcuaguuuc

SEQ ID NO: 784194 - RNA, 19 nt, Homo sapiens
gaaaggcagggcaaaugcu

SEQ ID NO: 784195 - RNA, 19 nt, Homo sapiens
caccuggauugcagacuca

SEQ ID NO: 784196 - RNA, 19 nt, Homo sapiens
caccuggauugcagacuca

SEQ ID NO: 784197 - RNA, 19 nt, Homo sapiens
caccuggauugcagacuca

SEQ ID NO: 784198 - RNA, 19 nt, Homo sapiens
cuuccuuuccucauuuaua

SEQ ID NO: 784199 - RNA, 19 nt, Homo sapiens
gagguacaguuugcauagg

SEQ ID NO: 784200 - RNA, 19 nt, Homo sapiens
caugaaagaccugaaacuc

SEQ ID NO: 784201 - RNA, 19 nt, Homo sapiens
caugaaagaccugaaacuc

SEQ ID NO: 784202 - RNA, 19 nt, Homo sapiens
ucaacaaugacuaaugagu

SEQ ID NO: 784203 - RNA, 19 nt, Homo sapiens
ucauguugagguacaguuu

SEQ ID NO: 784204 - RNA, 19 nt, Homo sapiens
acuucugucuuccuucauu

SEQ ID NO: 784205 - RNA, 19 nt, Homo sapiens
uaguuucauucauccauca

SEQ ID NO: 784206 - RNA, 19 nt, Homo sapiens
gcacagcuaaaauaauaga

SEQ ID NO: 784207 - RNA, 19 nt, Homo sapiens
ggauugcugguuccugugu

SEQ ID NO: 784208 - RNA, 19 nt, Homo sapiens
auugcagacucaugaaaga

SEQ ID NO: 784209 - RNA, 19 nt, Homo sapiens
guagcugagccuucugaug

SEQ ID NO: 784210 - RNA, 19 nt, Homo sapiens
auugcagacucaugaaaga

SEQ ID NO: 784211 - RNA, 19 nt, Homo sapiens
auugcagacucaugaaaga

SEQ ID NO: 784212 - RNA, 19 nt, Homo sapiens
guagcugagccuucugaug

SEQ ID NO: 784213 - RNA, 19 nt, Homo sapiens
gaacugcuguguuauaagu

SEQ ID NO: 784214 - RNA, 19 nt, Homo sapiens
ccaaggagcugcaguucaa

SEQ ID NO: 784215 - RNA, 19 nt, Homo sapiens
ugacgaaccugaccaguag

SEQ ID NO: 784216 - RNA, 19 nt, Homo sapiens
guacgucaaugucccuauu

SEQ ID NO: 784217 - RNA, 19 nt, Homo sapiens
ggacaggccacuacaagau

SEQ ID NO: 784218 - RNA, 19 nt, Homo sapiens
ggucccaucucccgaguga

SEQ ID NO: 784219 - RNA, 19 nt, Homo sapiens
ccauucaucucuacaagga

SEQ ID NO: 784220 - RNA, 19 nt, Homo sapiens
gagagguucugcagaugug

SEQ ID NO: 784221 - RNA, 19 nt, Homo sapiens
caucgacacuuucaacaag

SEQ ID NO: 784222 - RNA, 19 nt, Homo sapiens
ggucaccgauguggauuug

SEQ ID NO: 784223 - RNA, 19 nt, Homo sapiens
ggagagggugcuuaacuga

SEQ ID NO: 784224 - RNA, 19 nt, Homo sapiens
gaacauuuacugcgacuac

SEQ ID NO: 784225 - RNA, 19 nt, Homo sapiens
gccaccugaugguuauuua

SEQ ID NO: 784226 - RNA, 19 nt, Homo sapiens
ccucagagcuggucuugac

SEQ ID NO: 784227 - RNA, 19 nt, Homo sapiens
caggaacugcuguguuaua

SEQ ID NO: 784228 - RNA, 19 nt, Homo sapiens
caacuacauucccguggau

SEQ ID NO: 784229 - RNA, 19 nt, Homo sapiens
caccugaugguuauuuaua

SEQ ID NO: 784230 - RNA, 19 nt, Homo sapiens
gagaauuggccaccugaug

SEQ ID NO: 784231 - RNA, 19 nt, Homo sapiens
ggaucacguucaucaagga

SEQ ID NO: 784232 - RNA, 19 nt, Homo sapiens
caaugucccuauuugaaag

SEQ ID NO: 784233 - RNA, 19 nt, Homo sapiens
aggaacugcuguguuauaa

SEQ ID NO: 784234 - RNA, 19 nt, Homo sapiens
ucaccgauguggauuugga

SEQ ID NO: 784235 - RNA, 19 nt, Homo sapiens
gcucguggccagcauguug

SEQ ID NO: 784236 - RNA, 19 nt, Homo sapiens
ucacguucaucaaggauuc

SEQ ID NO: 784237 - RNA, 19 nt, Homo sapiens
ugagaaugcagccucuuaa

SEQ ID NO: 784238 - RNA, 19 nt, Homo sapiens
gucgagagguucugcagau

SEQ ID NO: 784239 - RNA, 19 nt, Homo sapiens
ggccaccuauggacaggaa

SEQ ID NO: 784240 - RNA, 19 nt, Homo sapiens
acaggccacuacaagauga

SEQ ID NO: 784241 - RNA, 19 nt, Homo sapiens
cggagagggugcuuaacug

SEQ ID NO: 784242 - RNA, 19 nt, Homo sapiens
cugagaaugcagccucuua

SEQ ID NO: 784243 - RNA, 19 nt, Homo sapiens
ccaagaccuccgacagaaa

SEQ ID NO: 784244 - RNA, 19 nt, Homo sapiens
gagaaugcagccucuuaag

SEQ ID NO: 784245 - RNA, 19 nt, Homo sapiens
auuuauacguccagaagaa

SEQ ID NO: 784246 - RNA, 19 nt, Homo sapiens
acgagggccugcaucaguu

SEQ ID NO: 784247 - RNA, 19 nt, Homo sapiens
gacaggccacuacaagaug

SEQ ID NO: 784248 - RNA, 19 nt, Homo sapiens
ccagcggagucgagagguu

SEQ ID NO: 784249 - RNA, 19 nt, Homo sapiens
ggccauucaucucuacaag

SEQ ID NO: 784250 - RNA, 19 nt, Homo sapiens
ccacucuggaugagaauug

SEQ ID NO: 784251 - RNA, 19 nt, Homo sapiens
gcagccuggucaccgaugu

SEQ ID NO: 784252 - RNA, 19 nt, Homo sapiens
ggagccagcagugguguau

SEQ ID NO: 784253 - RNA, 19 nt, Homo sapiens
accaagaccuccgacagaa

SEQ ID NO: 784254 - RNA, 19 nt, Homo sapiens
cagaagaacauccccaaaa

SEQ ID NO: 784255 - RNA, 19 nt, Homo sapiens
uaccaagaccuccgacaga

SEQ ID NO: 784256 - RNA, 19 nt, Homo sapiens
cugacgaaccugaccagua

SEQ ID NO: 784257 - RNA, 19 nt, Homo sapiens
ucccagagcugacgaaccu

SEQ ID NO: 784258 - RNA, 19 nt, Homo sapiens
ggagaacgagggccugcau

SEQ ID NO: 784259 - RNA, 19 nt, Homo sapiens
gcggagagggugcuuaacu

SEQ ID NO: 784260 - RNA, 19 nt, Homo sapiens
ucucgucgcagaacaaugu

SEQ ID NO: 784261 - RNA, 19 nt, Homo sapiens
caaggacaggccacuacaa

SEQ ID NO: 784262 - RNA, 19 nt, Homo sapiens
gagaccggcucuguguaca

SEQ ID NO: 784263 - RNA, 19 nt, Homo sapiens
gacccggcuucgaacauca

SEQ ID NO: 784264 - RNA, 19 nt, Homo sapiens
gaccggcucuguguacaac

SEQ ID NO: 784265 - RNA, 19 nt, Homo sapiens
gccccuuccugaacauuua

SEQ ID NO: 784266 - RNA, 19 nt, Homo sapiens
gaauuggccaccugauggu

SEQ ID NO: 784267 - RNA, 19 nt, Homo sapiens
ucccaucucccgagugauu

SEQ ID NO: 784268 - RNA, 19 nt, Homo sapiens
cgucgcagaacaaugugua

SEQ ID NO: 784269 - RNA, 19 nt, Homo sapiens
caagaccuccgacagaaaa

SEQ ID NO: 784270 - RNA, 19 nt, Homo sapiens
gaccaaggacaggccacua

SEQ ID NO: 784271 - RNA, 19 nt, Homo sapiens
gaggaacagcccguggaaa

SEQ ID NO: 784272 - RNA, 19 nt, Homo sapiens
ugacccggcuucgaacauc

SEQ ID NO: 784273 - RNA, 19 nt, Homo sapiens
cgagagguucugcagaugu

SEQ ID NO: 784274 - RNA, 19 nt, Homo sapiens
gaacgagggccugcaucag

SEQ ID NO: 784275 - RNA, 19 nt, Homo sapiens
ccaucgacacuuucaacaa

SEQ ID NO: 784276 - RNA, 19 nt, Homo sapiens
cuaacccacuccucucucu

SEQ ID NO: 784277 - RNA, 19 nt, Homo sapiens
cugcggagagggugcuuaa

SEQ ID NO: 784278 - RNA, 19 nt, Homo sapiens
ccagaaaggucagguauga

SEQ ID NO: 784279 - RNA, 19 nt, Homo sapiens
gggagagccuggacgaaga

SEQ ID NO: 784280 - RNA, 19 nt, Homo sapiens
gcagcuuccuggccaagaa

SEQ ID NO: 784281 - RNA, 19 nt, Homo sapiens
ggacccagccucacagugu

SEQ ID NO: 784282 - RNA, 19 nt, Homo sapiens
gaagucauguugccccuaa

SEQ ID NO: 784283 - RNA, 19 nt, Homo sapiens
cuuaggagagugccauuua

SEQ ID NO: 784284 - RNA, 19 nt, Homo sapiens
aaucccaccugccuguaua

SEQ ID NO: 784285 - RNA, 19 nt, Homo sapiens
cagaggcccugccaaacug

SEQ ID NO: 784286 - RNA, 19 nt, Homo sapiens
ccacggguccugcugcaaa

SEQ ID NO: 784287 - RNA, 19 nt, Homo sapiens
ccacggguccugcugcaaa

SEQ ID NO: 784288 - RNA, 19 nt, Homo sapiens
ucucugcgcuugaacaucu

SEQ ID NO: 784289 - RNA, 19 nt, Homo sapiens
acacagggccauugucuca

SEQ ID NO: 784290 - RNA, 19 nt, Homo sapiens
gcggcugacugcagacaug

SEQ ID NO: 784291 - RNA, 19 nt, Homo sapiens
gaccucaccuuaggagagu

SEQ ID NO: 784292 - RNA, 19 nt, Homo sapiens
ggccaccacuacccagaga

SEQ ID NO: 784293 - RNA, 19 nt, Homo sapiens
gaaucccaccugccuguau

SEQ ID NO: 784294 - RNA, 19 nt, Homo sapiens
ggaggaugaugaggucaag

SEQ ID NO: 784295 - RNA, 19 nt, Homo sapiens
agagugccauuuacagcuu

SEQ ID NO: 784296 - RNA, 19 nt, Homo sapiens
ucuggggccugauuaaaua

SEQ ID NO: 784297 - RNA, 19 nt, Homo sapiens
ggagagacgagccaugaac

SEQ ID NO: 784298 - RNA, 19 nt, Homo sapiens
ccacacagggccauugucu

SEQ ID NO: 784299 - RNA, 19 nt, Homo sapiens
ggaaucccaccugccugua

SEQ ID NO: 784300 - RNA, 19 nt, Homo sapiens
ccagaggcccugccaaacu

SEQ ID NO: 784301 - RNA, 19 nt, Homo sapiens
caucuauagcugcuucuga

SEQ ID NO: 784302 - RNA, 19 nt, Homo sapiens
acacguccuuccucagcaa

SEQ ID NO: 784303 - RNA, 19 nt, Homo sapiens
uuaggagagugccauuuac

SEQ ID NO: 784304 - RNA, 19 nt, Homo sapiens
gggagagacgagccaugaa

SEQ ID NO: 784305 - RNA, 19 nt, Homo sapiens
ucccagaggcccugccaaa

SEQ ID NO: 784306 - RNA, 19 nt, Homo sapiens
ccaccacuacccagagaug

SEQ ID NO: 784307 - RNA, 19 nt, Homo sapiens
cugacucucucuuguccuu

SEQ ID NO: 784308 - RNA, 19 nt, Homo sapiens
guaccacacagggccauug

SEQ ID NO: 784309 - RNA, 19 nt, Homo sapiens
ccacagccucugcauuugg

SEQ ID NO: 784310 - RNA, 19 nt, Homo sapiens
gaccgagaccgggaugguu

SEQ ID NO: 784311 - RNA, 19 nt, Homo sapiens
ccagaaaggucagguauga

SEQ ID NO: 784312 - RNA, 19 nt, Homo sapiens
gggagagccuggacgaaga

SEQ ID NO: 784313 - RNA, 19 nt, Homo sapiens
gcagcuuccuggccaagaa

SEQ ID NO: 784314 - RNA, 19 nt, Homo sapiens
ggacccagccucacagugu

SEQ ID NO: 784315 - RNA, 19 nt, Homo sapiens
gaagucauguugccccuaa

SEQ ID NO: 784316 - RNA, 19 nt, Homo sapiens
cuuaggagagugccauuua

SEQ ID NO: 784317 - RNA, 19 nt, Homo sapiens
aaucccaccugccuguaua

SEQ ID NO: 784318 - RNA, 19 nt, Homo sapiens
cagaggcccugccaaacug

SEQ ID NO: 784319 - RNA, 19 nt, Homo sapiens
ccacggguccugcugcaaa

SEQ ID NO: 784320 - RNA, 19 nt, Homo sapiens
ccacggguccugcugcaaa

SEQ ID NO: 784321 - RNA, 19 nt, Homo sapiens
ucucugcgcuugaacaucu

SEQ ID NO: 784322 - RNA, 19 nt, Homo sapiens
acacagggccauugucuca

SEQ ID NO: 784323 - RNA, 19 nt, Homo sapiens
gcggcugacugcagacaug

SEQ ID NO: 784324 - RNA, 19 nt, Homo sapiens
gaccucaccuuaggagagu

SEQ ID NO: 784325 - RNA, 19 nt, Homo sapiens
ggccaccacuacccagaga

SEQ ID NO: 784326 - RNA, 19 nt, Homo sapiens
gaaucccaccugccuguau

SEQ ID NO: 784327 - RNA, 19 nt, Homo sapiens
ggaggaugaugaggucaag

SEQ ID NO: 784328 - RNA, 19 nt, Homo sapiens
agagugccauuuacagcuu

SEQ ID NO: 784329 - RNA, 19 nt, Homo sapiens
ucuggggccugauuaaaua

SEQ ID NO: 784330 - RNA, 19 nt, Homo sapiens
ggagagacgagccaugaac

SEQ ID NO: 784331 - RNA, 19 nt, Homo sapiens
ccacacagggccauugucu

SEQ ID NO: 784332 - RNA, 19 nt, Homo sapiens
ggaaucccaccugccugua

SEQ ID NO: 784333 - RNA, 19 nt, Homo sapiens
ccagaggcccugccaaacu

SEQ ID NO: 784334 - RNA, 19 nt, Homo sapiens
caucuauagcugcuucuga

SEQ ID NO: 784335 - RNA, 19 nt, Homo sapiens
acacguccuuccucagcaa

SEQ ID NO: 784336 - RNA, 19 nt, Homo sapiens
uuaggagagugccauuuac

SEQ ID NO: 784337 - RNA, 19 nt, Homo sapiens
gggagagacgagccaugaa

SEQ ID NO: 784338 - RNA, 19 nt, Homo sapiens
ucccagaggcccugccaaa

SEQ ID NO: 784339 - RNA, 19 nt, Homo sapiens
ccaccacuacccagagaug

SEQ ID NO: 784340 - RNA, 19 nt, Homo sapiens
cugacucucucuuguccuu

SEQ ID NO: 784341 - RNA, 19 nt, Homo sapiens
guaccacacagggccauug

SEQ ID NO: 784342 - RNA, 19 nt, Homo sapiens
ccacagccucugcauuugg

SEQ ID NO: 784343 - RNA, 19 nt, Homo sapiens
gaccgagaccgggaugguu

SEQ ID NO: 784344 - RNA, 19 nt, Homo sapiens
caagucagcugaauuuauu

SEQ ID NO: 784345 - RNA, 19 nt, Homo sapiens
ggaaucaacucaauuacau

SEQ ID NO: 784346 - RNA, 19 nt, Homo sapiens
uaucaucccuggugacaua

SEQ ID NO: 784347 - RNA, 19 nt, Homo sapiens
gacauaaacucguuaguca

SEQ ID NO: 784348 - RNA, 19 nt, Homo sapiens
gauggaaucaacucaauua

SEQ ID NO: 784349 - RNA, 19 nt, Homo sapiens
ggaggaagacccugaguaa

SEQ ID NO: 784350 - RNA, 19 nt, Homo sapiens
ucaauuacaucacagaaga

SEQ ID NO: 784351 - RNA, 19 nt, Homo sapiens
gcacaaugaucaccaaguc

SEQ ID NO: 784352 - RNA, 19 nt, Homo sapiens
ggaagacccugaguaacaa

SEQ ID NO: 784353 - RNA, 19 nt, Homo sapiens
gugaugagauuuacaagga

SEQ ID NO: 784354 - RNA, 19 nt, Homo sapiens
caaggaaacacaaagaauu

SEQ ID NO: 784355 - RNA, 19 nt, Homo sapiens
gaugagauuuacaaggaaa

SEQ ID NO: 784356 - RNA, 19 nt, Homo sapiens
gaagcuacguccagaacau

SEQ ID NO: 784357 - RNA, 19 nt, Homo sapiens
gaacuuagaaacccuuaca

SEQ ID NO: 784358 - RNA, 19 nt, Homo sapiens
uuagaaacccuuacagaaa

SEQ ID NO: 784359 - RNA, 19 nt, Homo sapiens
guaacaagcuccgucucuu

SEQ ID NO: 784360 - RNA, 19 nt, Homo sapiens
uaagcggccuuuuauuuua

SEQ ID NO: 784361 - RNA, 19 nt, Homo sapiens
gagcuuggcacaaugauca

SEQ ID NO: 784362 - RNA, 19 nt, Homo sapiens
gcucugggaucuucguuuc

SEQ ID NO: 784363 - RNA, 19 nt, Homo sapiens
ggagagaggaugagaaguc

SEQ ID NO: 784364 - RNA, 19 nt, Homo sapiens
caaggugcccguagucauu

SEQ ID NO: 784365 - RNA, 19 nt, Homo sapiens
caaagccgauuaccaugca

SEQ ID NO: 784366 - RNA, 19 nt, Homo sapiens
ggcgguggcugugacauuu

SEQ ID NO: 784367 - RNA, 19 nt, Homo sapiens
uagaaacccuuacagaaac

SEQ ID NO: 784368 - RNA, 19 nt, Homo sapiens
gagaguaucccuaccugau

SEQ ID NO: 784369 - RNA, 19 nt, Homo sapiens
gaaagcggagagaggauga

SEQ ID NO: 784370 - RNA, 19 nt, Homo sapiens
ccaagucagcugaauuuau

SEQ ID NO: 784371 - RNA, 19 nt, Homo sapiens
gguaucauagcaacgauuu

SEQ ID NO: 784372 - RNA, 19 nt, Homo sapiens
ucacagaagaacuuagaaa

SEQ ID NO: 784373 - RNA, 19 nt, Homo sapiens
cauaaacucguuagucaau

SEQ ID NO: 784374 - RNA, 19 nt, Homo sapiens
ucaugaacguguccuacuu

SEQ ID NO: 784375 - RNA, 19 nt, Homo sapiens
gcugcugaaccaagauuua

SEQ ID NO: 784376 - RNA, 19 nt, Homo sapiens
gaucguggccaucaucauc

SEQ ID NO: 784377 - RNA, 19 nt, Homo sapiens
cugcaagccuccucaaauc

SEQ ID NO: 784378 - RNA, 19 nt, Homo sapiens
gacauuuggugaccguguu

SEQ ID NO: 784379 - RNA, 19 nt, Homo sapiens
caucacagaagaacuuaga

SEQ ID NO: 784380 - RNA, 19 nt, Homo sapiens
ucaacucaauuacaucaca

SEQ ID NO: 784381 - RNA, 19 nt, Homo sapiens
acugugugcuguuuauauu

SEQ ID NO: 784382 - RNA, 19 nt, Homo sapiens
ccaaggaaacacaaagaau

SEQ ID NO: 784383 - RNA, 19 nt, Homo sapiens
ucaaaucguugugaaaugc

SEQ ID NO: 784384 - RNA, 19 nt, Homo sapiens
gcugcaagccuccucaaau

SEQ ID NO: 784385 - RNA, 19 nt, Homo sapiens
uaacgggaccugcuucaca

SEQ ID NO: 784386 - RNA, 19 nt, Homo sapiens
aaaccugccuuuggccauu

SEQ ID NO: 784387 - RNA, 19 nt, Homo sapiens
ccagccugaucgucauuaa

SEQ ID NO: 784388 - RNA, 19 nt, Homo sapiens
ccucuacugugugcuguuu

SEQ ID NO: 784389 - RNA, 19 nt, Homo sapiens
uuacaucacagaagaacuu

SEQ ID NO: 784390 - RNA, 19 nt, Homo sapiens
ggauggaaucaacucaauu

SEQ ID NO: 784391 - RNA, 19 nt, Homo sapiens
ggcccugccucaucauaug

SEQ ID NO: 784392 - RNA, 19 nt, Homo sapiens
ucucaaagccgauuaccau

SEQ ID NO: 784393 - RNA, 19 nt, Homo sapiens
cuuagaaacccuuacagaa

SEQ ID NO: 784394 - RNA, 19 nt, Homo sapiens
gguucuggcuccaaucauc

SEQ ID NO: 784395 - RNA, 19 nt, Homo sapiens
gagcuggaaaggccuauca

SEQ ID NO: 784396 - RNA, 19 nt, Homo sapiens
caagccuccucaaaucguu

SEQ ID NO: 784397 - RNA, 19 nt, Homo sapiens
ucauuaagcccacguccuu

SEQ ID NO: 784398 - RNA, 19 nt, Homo sapiens
aggaagacccugaguaaca

SEQ ID NO: 784399 - RNA, 19 nt, Homo sapiens
cguagucauucccgucuug

SEQ ID NO: 784400 - RNA, 19 nt, Homo sapiens
gagaggaugagaagucgau

SEQ ID NO: 784401 - RNA, 19 nt, Homo sapiens
ugacauaaacucguuaguc

SEQ ID NO: 784402 - RNA, 19 nt, Homo sapiens
ucacggaggaagguaagua

SEQ ID NO: 784403 - RNA, 19 nt, Homo sapiens
uggauggaaucaacucaau

SEQ ID NO: 784404 - RNA, 19 nt, Homo sapiens
uauauuaagcggccuuuua

SEQ ID NO: 784405 - RNA, 19 nt, Homo sapiens
ugaugagauuuacaaggaa

SEQ ID NO: 784406 - RNA, 19 nt, Homo sapiens
gauacuggccugagaaagc

SEQ ID NO: 784407 - RNA, 19 nt, Homo sapiens
cgauuaccaugcaccuuca

SEQ ID NO: 784408 - RNA, 19 nt, Homo sapiens
uggaaaggccuaucaaggu

SEQ ID NO: 784409 - RNA, 19 nt, Homo sapiens
cgugcuacauccucaugaa

SEQ ID NO: 784410 - RNA, 19 nt, Homo sapiens
ggccuaugauggauggaau

SEQ ID NO: 784411 - RNA, 19 nt, Homo sapiens
ggaaccagcaggaggaaac

SEQ ID NO: 784412 - RNA, 19 nt, Homo sapiens
gggauacuggccugagaaa

SEQ ID NO: 784413 - RNA, 19 nt, Homo sapiens
ucuacugugugcuguuuau

SEQ ID NO: 784414 - RNA, 19 nt, Homo sapiens
cagcgggcagacucauuua

SEQ ID NO: 784415 - RNA, 19 nt, Homo sapiens
ccaucagccuggcguuuua

SEQ ID NO: 784416 - RNA, 19 nt, Homo sapiens
gcccaaggaaacacaaaga

SEQ ID NO: 784417 - RNA, 19 nt, Homo sapiens
gcggagagaggaugagaag

SEQ ID NO: 784418 - RNA, 19 nt, Homo sapiens
uugcggagcuuggcacaau

SEQ ID NO: 784419 - RNA, 19 nt, Homo sapiens
caucgugggcaccaucauu

SEQ ID NO: 784420 - RNA, 19 nt, Homo sapiens
agccaagucagcugaauuu

SEQ ID NO: 784421 - RNA, 19 nt, Homo sapiens
caaggaaagagcuggaaag

SEQ ID NO: 784422 - RNA, 19 nt, Homo sapiens
ucaauuauuucagcuuugc

SEQ ID NO: 784423 - RNA, 19 nt, Homo sapiens
gucaauuauuucagcuuug

SEQ ID NO: 784424 - RNA, 19 nt, Homo sapiens
ccucaaaucguugugaaau

SEQ ID NO: 784425 - RNA, 19 nt, Homo sapiens
acagcgggcagacucauuu

SEQ ID NO: 784426 - RNA, 19 nt, Homo sapiens
uuacagaaaccugccuuug

SEQ ID NO: 784427 - RNA, 19 nt, Homo sapiens
gcaagccuccucaaaucgu

SEQ ID NO: 784428 - RNA, 19 nt, Homo sapiens
cggaggaagacccugagua

SEQ ID NO: 784429 - RNA, 19 nt, Homo sapiens
ccaccagucuccaaaagga

SEQ ID NO: 784430 - RNA, 19 nt, Homo sapiens
gcuacauccucaugaacgu

SEQ ID NO: 784431 - RNA, 19 nt, Homo sapiens
gaaucaacucaauuacauc

SEQ ID NO: 784432 - RNA, 19 nt, Homo sapiens
ggacucugggccuaugaug

SEQ ID NO: 784433 - RNA, 19 nt, Homo sapiens
cggccaagcuggugaucgu

SEQ ID NO: 784434 - RNA, 19 nt, Homo sapiens
cucaaaucguugugaaaug

SEQ ID NO: 784435 - RNA, 19 nt, Homo sapiens
gcggagcuuggcacaauga

SEQ ID NO: 784436 - RNA, 19 nt, Homo sapiens
gccaagucagcugaauuua

SEQ ID NO: 784437 - RNA, 19 nt, Homo sapiens
guagccaagucagcugaau

SEQ ID NO: 784438 - RNA, 19 nt, Homo sapiens
ggagcugggccucaucagu

SEQ ID NO: 784439 - RNA, 19 nt, Homo sapiens
cguguucucuauccugcuu

SEQ ID NO: 784440 - RNA, 19 nt, Homo sapiens
aaccugccuuuggccauua

SEQ ID NO: 784441 - RNA, 19 nt, Homo sapiens
caauuacaucacagaagaa

SEQ ID NO: 784442 - RNA, 19 nt, Homo sapiens
uuguucaucucgacaguga

SEQ ID NO: 784443 - RNA, 19 nt, Homo sapiens
ugugugcgcccuucuaugu

SEQ ID NO: 784444 - RNA, 19 nt, Homo sapiens
ggaauaagcuaaucagaaa

SEQ ID NO: 784445 - RNA, 19 nt, Homo sapiens
gaugacggcuuuguauaua

SEQ ID NO: 784446 - RNA, 19 nt, Homo sapiens
ucagauggaugguuuguaa

SEQ ID NO: 784447 - RNA, 19 nt, Homo sapiens
gaugaaaucucuggucuug

SEQ ID NO: 784448 - RNA, 19 nt, Homo sapiens
gaacaggaccagugcaauu

SEQ ID NO: 784449 - RNA, 19 nt, Homo sapiens
gaaucucucuugggucuua

SEQ ID NO: 784450 - RNA, 19 nt, Homo sapiens
guaaggcucuuguugcauu

SEQ ID NO: 784451 - RNA, 19 nt, Homo sapiens
gaucuuagcagucaaauca

SEQ ID NO: 784452 - RNA, 19 nt, Homo sapiens
ggaguucucuucuguucuu

SEQ ID NO: 784453 - RNA, 19 nt, Homo sapiens
ggagauaggccaagucuag

SEQ ID NO: 784454 - RNA, 19 nt, Homo sapiens
ugaaaucucuggucuugau

SEQ ID NO: 784455 - RNA, 19 nt, Homo sapiens
acaggacgcuugaugauga

SEQ ID NO: 784456 - RNA, 19 nt, Homo sapiens
gauauacucuugucugcau

SEQ ID NO: 784457 - RNA, 19 nt, Homo sapiens
ugacaacacuguaauucug

SEQ ID NO: 784458 - RNA, 19 nt, Homo sapiens
gaagaguuccucagcagaa

SEQ ID NO: 784459 - RNA, 19 nt, Homo sapiens
cagcaaccaugcagaguga

SEQ ID NO: 784460 - RNA, 19 nt, Homo sapiens
ggagaaauugcaagaagaa

SEQ ID NO: 784461 - RNA, 19 nt, Homo sapiens
auacacccauggagucuua

SEQ ID NO: 784462 - RNA, 19 nt, Homo sapiens
cacagucucuucaguaaau

SEQ ID NO: 784463 - RNA, 19 nt, Homo sapiens
guaauucugugggauaugu

SEQ ID NO: 784464 - RNA, 19 nt, Homo sapiens
augaugagcuggcugagua

SEQ ID NO: 784465 - RNA, 19 nt, Homo sapiens
cagagugacugaaacacaa

SEQ ID NO: 784466 - RNA, 19 nt, Homo sapiens
gauccuagcccagaugauu

SEQ ID NO: 784467 - RNA, 19 nt, Homo sapiens
acaaauacgugaagaucug

SEQ ID NO: 784468 - RNA, 19 nt, Homo sapiens
gcgauucagugggcagaua

SEQ ID NO: 784469 - RNA, 19 nt, Homo sapiens
ggccaagucuaguucauuc

SEQ ID NO: 784470 - RNA, 19 nt, Homo sapiens
caguacagaugacggcuuu

SEQ ID NO: 784471 - RNA, 19 nt, Homo sapiens
caaaggagaaauugcaaga

SEQ ID NO: 784472 - RNA, 19 nt, Homo sapiens
acaauucauuucugacuga

SEQ ID NO: 784473 - RNA, 19 nt, Homo sapiens
ucaucuaauuuccugcuua

SEQ ID NO: 784474 - RNA, 19 nt, Homo sapiens
gcccugauuugccauuuau

SEQ ID NO: 784475 - RNA, 19 nt, Homo sapiens
auuuagaggugcauguuua

SEQ ID NO: 784476 - RNA, 19 nt, Homo sapiens
gaguacgacuuagauaaau

SEQ ID NO: 784477 - RNA, 19 nt, Homo sapiens
gacaggcaguccuucagaa

SEQ ID NO: 784478 - RNA, 19 nt, Homo sapiens
ugacugacauuccuuucug

SEQ ID NO: 784479 - RNA, 19 nt, Homo sapiens
ccaaagagacaccagacaa

SEQ ID NO: 784480 - RNA, 19 nt, Homo sapiens
auaagucaguggcuuugua

SEQ ID NO: 784481 - RNA, 19 nt, Homo sapiens
gaagugugggaccuugaua

SEQ ID NO: 784482 - RNA, 19 nt, Homo sapiens
uagaggugcauguuuauaa

SEQ ID NO: 784483 - RNA, 19 nt, Homo sapiens
ugauuaagcccagugauaa

SEQ ID NO: 784484 - RNA, 19 nt, Homo sapiens
gcucuuguugcauuucuua

SEQ ID NO: 784485 - RNA, 19 nt, Homo sapiens
ugaggaaggugacccagau

SEQ ID NO: 784486 - RNA, 19 nt, Homo sapiens
gaaauugcaagaagaaggu

SEQ ID NO: 784487 - RNA, 19 nt, Homo sapiens
cgagagaggcuuguucuug

SEQ ID NO: 784488 - RNA, 19 nt, Homo sapiens
uaauuuggaugcacguuca

SEQ ID NO: 784489 - RNA, 19 nt, Homo sapiens
gcaagugcaucagcugaca

SEQ ID NO: 784490 - RNA, 19 nt, Homo sapiens
agaacaauaugaacgugaa

SEQ ID NO: 784491 - RNA, 19 nt, Homo sapiens
ugaguacgacuuagauaaa

SEQ ID NO: 784492 - RNA, 19 nt, Homo sapiens
acacaaugaugaaaucucu

SEQ ID NO: 784493 - RNA, 19 nt, Homo sapiens
cuucgggucugggauauaa

SEQ ID NO: 784494 - RNA, 19 nt, Homo sapiens
ugacggcuuuguauauaau

SEQ ID NO: 784495 - RNA, 19 nt, Homo sapiens
cuaauuuccugcuuaccuu

SEQ ID NO: 784496 - RNA, 19 nt, Homo sapiens
uagagagagugacuuggaa

SEQ ID NO: 784497 - RNA, 19 nt, Homo sapiens
gcacagucucuucaguaaa

SEQ ID NO: 784498 - RNA, 19 nt, Homo sapiens
gaucugggacaucuuagga

SEQ ID NO: 784499 - RNA, 19 nt, Homo sapiens
ggaugcacguucagauaag

SEQ ID NO: 784500 - RNA, 19 nt, Homo sapiens
gaaguaaaacgccucauug

SEQ ID NO: 784501 - RNA, 19 nt, Homo sapiens
cagaugacggcuuuguaua

SEQ ID NO: 784502 - RNA, 19 nt, Homo sapiens
uggaauggcugaauuuuga

SEQ ID NO: 784503 - RNA, 19 nt, Homo sapiens
gcagagugacugaaacaca

SEQ ID NO: 784504 - RNA, 19 nt, Homo sapiens
gauauaagcacagucucuu

SEQ ID NO: 784505 - RNA, 19 nt, Homo sapiens
gaaaaugggaguucucuuc

SEQ ID NO: 784506 - RNA, 19 nt, Homo sapiens
agguagagcugaguaaaga

SEQ ID NO: 784507 - RNA, 19 nt, Homo sapiens
uggaauaagcuaaucagaa

SEQ ID NO: 784508 - RNA, 19 nt, Homo sapiens
aaggagaaauugcaagaag

SEQ ID NO: 784509 - RNA, 19 nt, Homo sapiens
gggcagauagagagaguga

SEQ ID NO: 784510 - RNA, 19 nt, Homo sapiens
gcucauaugauaagucagu

SEQ ID NO: 784511 - RNA, 19 nt, Homo sapiens
ucugauuucuggcucauau

SEQ ID NO: 784512 - RNA, 19 nt, Homo sapiens
agaggugcauguuuauaau

SEQ ID NO: 784513 - RNA, 19 nt, Homo sapiens
uaaauaugaugaggaaggu

SEQ ID NO: 784514 - RNA, 19 nt, Homo sapiens
gaugacaggacgcuugaug

SEQ ID NO: 784515 - RNA, 19 nt, Homo sapiens
gaaggugguggcagugaug

SEQ ID NO: 784516 - RNA, 19 nt, Homo sapiens
gccauuuauuuaugccuuu

SEQ ID NO: 784517 - RNA, 19 nt, Homo sapiens
ccaagucuaguucauucua

SEQ ID NO: 784518 - RNA, 19 nt, Homo sapiens
uuaaugcacacaaugauga

SEQ ID NO: 784519 - RNA, 19 nt, Homo sapiens
ugucauuucuuggccagua

SEQ ID NO: 784520 - RNA, 19 nt, Homo sapiens
uagccucgcuguacacaca

SEQ ID NO: 784521 - RNA, 19 nt, Homo sapiens
uaaggcucuuguugcauuu

SEQ ID NO: 784522 - RNA, 19 nt, Homo sapiens
gggcuucgggucugggaua

SEQ ID NO: 784523 - RNA, 19 nt, Homo sapiens
caagguagagcugaguaaa

SEQ ID NO: 784524 - RNA, 19 nt, Homo sapiens
agagacaccagacaaggua

SEQ ID NO: 784525 - RNA, 19 nt, Homo sapiens
ggagacaggcaguccuuca

SEQ ID NO: 784526 - RNA, 19 nt, Homo sapiens
caaagagacaccagacaag

SEQ ID NO: 784527 - RNA, 19 nt, Homo sapiens
caucuaauuuccugcuuac

SEQ ID NO: 784528 - RNA, 19 nt, Homo sapiens
aagcacagucucuucagua

SEQ ID NO: 784529 - RNA, 19 nt, Homo sapiens
uggcucauaugauaaguca

SEQ ID NO: 784530 - RNA, 19 nt, Homo sapiens
cagacaagguccaaacacu

SEQ ID NO: 784531 - RNA, 19 nt, Homo sapiens
gcugaguaaagaagaagua

SEQ ID NO: 784532 - RNA, 19 nt, Homo sapiens
caauaugaacgugaagauu

SEQ ID NO: 784533 - RNA, 19 nt, Homo sapiens
ggcagcaggagcucagaua

SEQ ID NO: 784534 - RNA, 19 nt, Homo sapiens
gcauuuggaagacgagaga

SEQ ID NO: 784535 - RNA, 19 nt, Homo sapiens
ccugauuugccauuuauuu

SEQ ID NO: 784536 - RNA, 19 nt, Homo sapiens
aaugggaguucucuucugu

SEQ ID NO: 784537 - RNA, 19 nt, Homo sapiens
ucucuggucuugaucuuag

SEQ ID NO: 784538 - RNA, 19 nt, Homo sapiens
cagaugauucuacuggaaa

SEQ ID NO: 784539 - RNA, 19 nt, Homo sapiens
gcugaguacgacuuagaua

SEQ ID NO: 784540 - RNA, 19 nt, Homo sapiens
gugcaagaaauucaucuau

SEQ ID NO: 784541 - RNA, 19 nt, Homo sapiens
gugacacgcccuugacuug

SEQ ID NO: 784542 - RNA, 19 nt, Homo sapiens
ucucuucuguucuucaugu

SEQ ID NO: 784543 - RNA, 19 nt, Homo sapiens
cugcuucagcugacaaaua

SEQ ID NO: 784544 - RNA, 19 nt, Homo sapiens
gaagauggcugcuguaaga

SEQ ID NO: 784545 - RNA, 19 nt, Homo sapiens
gaaaugaugucuucucaaa

SEQ ID NO: 784546 - RNA, 19 nt, Homo sapiens
gaaggcugcuggauaauga

SEQ ID NO: 784547 - RNA, 19 nt, Homo sapiens
gagaagcccuggugaaguu

SEQ ID NO: 784548 - RNA, 19 nt, Homo sapiens
gaaagaacguccaaugucu

SEQ ID NO: 784549 - RNA, 19 nt, Homo sapiens
acacaacccucaagcauuu

SEQ ID NO: 784550 - RNA, 19 nt, Homo sapiens
gaaagggacuggacugucu

SEQ ID NO: 784551 - RNA, 19 nt, Homo sapiens
gacaugaaauccaaacuug

SEQ ID NO: 784552 - RNA, 19 nt, Homo sapiens
gggaaaugcugccugguaa

SEQ ID NO: 784553 - RNA, 19 nt, Homo sapiens
gauuaaggauuuagccaaa

SEQ ID NO: 784554 - RNA, 19 nt, Homo sapiens
gcagaugauuaaggauuua

SEQ ID NO: 784555 - RNA, 19 nt, Homo sapiens
gggcaucccugaaucuuug

SEQ ID NO: 784556 - RNA, 19 nt, Homo sapiens
uaaacaaccugacaaacug

SEQ ID NO: 784557 - RNA, 19 nt, Homo sapiens
ccaugaagauccagaagaa

SEQ ID NO: 784558 - RNA, 19 nt, Homo sapiens
gaauuuauccaguucugua

SEQ ID NO: 784559 - RNA, 19 nt, Homo sapiens
caacaagcaugugcaguga

SEQ ID NO: 784560 - RNA, 19 nt, Homo sapiens
gagcgugacuucuccaugu

SEQ ID NO: 784561 - RNA, 19 nt, Homo sapiens
cggagaagcuggucaccua

SEQ ID NO: 784562 - RNA, 19 nt, Homo sapiens
ugaagcagaugauuaagga

SEQ ID NO: 784563 - RNA, 19 nt, Homo sapiens
agaaacagcugaagcagau

SEQ ID NO: 784564 - RNA, 19 nt, Homo sapiens
gcauuucuauguauugaga

SEQ ID NO: 784565 - RNA, 19 nt, Homo sapiens
aaaccgagauuucagucua

SEQ ID NO: 784566 - RNA, 19 nt, Homo sapiens
gaacuuaagcugaguaacu

SEQ ID NO: 784567 - RNA, 19 nt, Homo sapiens
ggguugauauccagaaauu

SEQ ID NO: 784568 - RNA, 19 nt, Homo sapiens
ccucaagcauuucuaugua

SEQ ID NO: 784569 - RNA, 19 nt, Homo sapiens
gcucuuggaugacaacaug

SEQ ID NO: 784570 - RNA, 19 nt, Homo sapiens
aagaugacauugccaguuu

SEQ ID NO: 784571 - RNA, 19 nt, Homo sapiens
gcucucagaugaacacaau

SEQ ID NO: 784572 - RNA, 19 nt, Homo sapiens
uagcuucacuucugacuga

SEQ ID NO: 784573 - RNA, 19 nt, Homo sapiens
guaaaacucuguacaguau

SEQ ID NO: 784574 - RNA, 19 nt, Homo sapiens
caagagagaacauaugaug

SEQ ID NO: 784575 - RNA, 19 nt, Homo sapiens
aaacgggaauugcugcuuu

SEQ ID NO: 784576 - RNA, 19 nt, Homo sapiens
guacauaccaugcuuucaa

SEQ ID NO: 784577 - RNA, 19 nt, Homo sapiens
ugacacagcugagccauuc

SEQ ID NO: 784578 - RNA, 19 nt, Homo sapiens
ugacggaucuugccucaca

SEQ ID NO: 784579 - RNA, 19 nt, Homo sapiens
gagagaauuuauccaguuc

SEQ ID NO: 784580 - RNA, 19 nt, Homo sapiens
aaauaagccuguggaauga

SEQ ID NO: 784581 - RNA, 19 nt, Homo sapiens
ggauuccuaugagaaauuu

SEQ ID NO: 784582 - RNA, 19 nt, Homo sapiens
ggacaugaaauccaaacuu

SEQ ID NO: 784583 - RNA, 19 nt, Homo sapiens
gcaguuugcacaccuguuu

SEQ ID NO: 784584 - RNA, 19 nt, Homo sapiens
gcacaugaacgaccucuca

SEQ ID NO: 784585 - RNA, 19 nt, Homo sapiens
gcagaaccguguguauguu

SEQ ID NO: 784586 - RNA, 19 nt, Homo sapiens
cgaaucaccacgcagaaua

SEQ ID NO: 784587 - RNA, 19 nt, Homo sapiens
caaucacaaucugaacuua

SEQ ID NO: 784588 - RNA, 19 nt, Homo sapiens
caagaucaaucaguacaau

SEQ ID NO: 784589 - RNA, 19 nt, Homo sapiens
gaaucaccacgcagaauaa

SEQ ID NO: 784590 - RNA, 19 nt, Homo sapiens
gcacgaaccagacuguuuc

SEQ ID NO: 784591 - RNA, 19 nt, Homo sapiens
cagcugaagcagaugauua

SEQ ID NO: 784592 - RNA, 19 nt, Homo sapiens
ggaggaacccgagaaauuc

SEQ ID NO: 784593 - RNA, 19 nt, Homo sapiens
agagagaauuuauccaguu

SEQ ID NO: 784594 - RNA, 19 nt, Homo sapiens
uuugugagcugccucgaua

SEQ ID NO: 784595 - RNA, 19 nt, Homo sapiens
gagaaagaauugcccaaaa

SEQ ID NO: 784596 - RNA, 19 nt, Homo sapiens
gagaagauggcugcuguaa

SEQ ID NO: 784597 - RNA, 19 nt, Homo sapiens
ugcgaaggcugcuggauaa

SEQ ID NO: 784598 - RNA, 19 nt, Homo sapiens
gaauaaggagcgugacuuc

SEQ ID NO: 784599 - RNA, 19 nt, Homo sapiens
gauggcugcuguaagauca

SEQ ID NO: 784600 - RNA, 19 nt, Homo sapiens
ccuaagguauccauugguu

SEQ ID NO: 784601 - RNA, 19 nt, Homo sapiens
gaaaugagccaccaaucac

SEQ ID NO: 784602 - RNA, 19 nt, Homo sapiens
gcgaggagagugagaaaga

SEQ ID NO: 784603 - RNA, 19 nt, Homo sapiens
gaacagucauuagucaacu

SEQ ID NO: 784604 - RNA, 19 nt, Homo sapiens
ucagagagguggugagcau

SEQ ID NO: 784605 - RNA, 19 nt, Homo sapiens
gaucuaagggaguccacua

SEQ ID NO: 784606 - RNA, 19 nt, Homo sapiens
caugaaauccaaacuugaa

SEQ ID NO: 784607 - RNA, 19 nt, Homo sapiens
ugagcugccucgauauuau

SEQ ID NO: 784608 - RNA, 19 nt, Homo sapiens
gaacgaaacgggaauugcu

SEQ ID NO: 784609 - RNA, 19 nt, Homo sapiens
gagauuucagucuaccuua

SEQ ID NO: 784610 - RNA, 19 nt, Homo sapiens
ugaaaugagccaccaauca

SEQ ID NO: 784611 - RNA, 19 nt, Homo sapiens
gaugccaacuuacaauuuu

SEQ ID NO: 784612 - RNA, 19 nt, Homo sapiens
uuaaggauuuagccaaaga

SEQ ID NO: 784613 - RNA, 19 nt, Homo sapiens
ggaggaggaacccgagaaa

SEQ ID NO: 784614 - RNA, 19 nt, Homo sapiens
gggcacuucugcugugaug

SEQ ID NO: 784615 - RNA, 19 nt, Homo sapiens
gaaacccaauggugaugca

SEQ ID NO: 784616 - RNA, 19 nt, Homo sapiens
gaggagcucuacgacuuau

SEQ ID NO: 784617 - RNA, 19 nt, Homo sapiens
gggcaaggaacuuaaacuu

SEQ ID NO: 784618 - RNA, 19 nt, Homo sapiens
acacaaugucucauacuaa

SEQ ID NO: 784619 - RNA, 19 nt, Homo sapiens
gacacaacccucaagcauu

SEQ ID NO: 784620 - RNA, 19 nt, Homo sapiens
cgaaccagacuguuucuug

SEQ ID NO: 784621 - RNA, 19 nt, Homo sapiens
gagaaaugaaugagaagau

SEQ ID NO: 784622 - RNA, 19 nt, Homo sapiens
gagcggaugcugcccgauu

SEQ ID NO: 784623 - RNA, 19 nt, Homo sapiens
uggaugagguguuuaaggu

SEQ ID NO: 784624 - RNA, 19 nt, Homo sapiens
gcaauuguauuuggcuuuu

SEQ ID NO: 784625 - RNA, 19 nt, Homo sapiens
cacuaucugugcaauugua

SEQ ID NO: 784626 - RNA, 19 nt, Homo sapiens
aacacaaugucucauacua

SEQ ID NO: 784627 - RNA, 19 nt, Homo sapiens
uggcuucucuucucagaug

SEQ ID NO: 784628 - RNA, 19 nt, Homo sapiens
uaccaugcuuucaauguug

SEQ ID NO: 784629 - RNA, 19 nt, Homo sapiens
ggagaggucaggaaucaag

SEQ ID NO: 784630 - RNA, 19 nt, Homo sapiens
gugcagugaccacagauuu

SEQ ID NO: 784631 - RNA, 19 nt, Homo sapiens
gaacguccaaugucuuucu

SEQ ID NO: 784632 - RNA, 19 nt, Homo sapiens
augccaagaucaaucagua

SEQ ID NO: 784633 - RNA, 19 nt, Homo sapiens
ccuugucugucuuugauaa

SEQ ID NO: 784634 - RNA, 19 nt, Homo sapiens
ggagcucuacgacuuauuc

SEQ ID NO: 784635 - RNA, 19 nt, Homo sapiens
uggcuucacucguguuuca

SEQ ID NO: 784636 - RNA, 19 nt, Homo sapiens
gaagccagagcacagaaug

SEQ ID NO: 784637 - RNA, 19 nt, Homo sapiens
agaagcuggucaccuacua

SEQ ID NO: 784638 - RNA, 19 nt, Homo sapiens
cuaagggaguccacuaucu

SEQ ID NO: 784639 - RNA, 19 nt, Homo sapiens
gcccuaagguauccauugg

SEQ ID NO: 784640 - RNA, 19 nt, Homo sapiens
gcacugggacuggcuggaa

SEQ ID NO: 784641 - RNA, 19 nt, Homo sapiens
gcuguugguugcugugugu

SEQ ID NO: 784642 - RNA, 19 nt, Homo sapiens
caccuugucugucuuugau

SEQ ID NO: 784643 - RNA, 19 nt, Homo sapiens
ccagagcacagaaugaguu

SEQ ID NO: 784644 - RNA, 19 nt, Homo sapiens
ggacaucaaucaagucuua

SEQ ID NO: 784645 - RNA, 19 nt, Homo sapiens
ccaaagggcuccagcuaua

SEQ ID NO: 784646 - RNA, 19 nt, Homo sapiens
gaagauaucuaccuccaau

SEQ ID NO: 784647 - RNA, 19 nt, Homo sapiens
gcaaagauguggcugugaa

SEQ ID NO: 784648 - RNA, 19 nt, Homo sapiens
gaucaaagauuacuaugca

SEQ ID NO: 784649 - RNA, 19 nt, Homo sapiens
acaggaaacugcacuauuu

SEQ ID NO: 784650 - RNA, 19 nt, Homo sapiens
gcaaugacaugaugaaucu

SEQ ID NO: 784651 - RNA, 19 nt, Homo sapiens
gauagguucuuucuguaua

SEQ ID NO: 784652 - RNA, 19 nt, Homo sapiens
guaaagaaaugcauucaca

SEQ ID NO: 784653 - RNA, 19 nt, Homo sapiens
ucacaaagcuacccgcaaa

SEQ ID NO: 784654 - RNA, 19 nt, Homo sapiens
uggcacagcucuuuauuaa

SEQ ID NO: 784655 - RNA, 19 nt, Homo sapiens
gcaaagaggagacauguau

SEQ ID NO: 784656 - RNA, 19 nt, Homo sapiens
gcacagcucuuuauuaagc

SEQ ID NO: 784657 - RNA, 19 nt, Homo sapiens
ggagacauguaucaacgua

SEQ ID NO: 784658 - RNA, 19 nt, Homo sapiens
acacugagcugaaugaaau

SEQ ID NO: 784659 - RNA, 19 nt, Homo sapiens
gaaagacuaugucaaggau

SEQ ID NO: 784660 - RNA, 19 nt, Homo sapiens
gugaugaucuugacccuaa

SEQ ID NO: 784661 - RNA, 19 nt, Homo sapiens
gaaggagaaugaaaucugu

SEQ ID NO: 784662 - RNA, 19 nt, Homo sapiens
guacaucguugcugaguau

SEQ ID NO: 784663 - RNA, 19 nt, Homo sapiens
gaagaaaguucgcgauggu

SEQ ID NO: 784664 - RNA, 19 nt, Homo sapiens
uaggauagauacccacaua

SEQ ID NO: 784665 - RNA, 19 nt, Homo sapiens
uaccaacacuuucugauuu

SEQ ID NO: 784666 - RNA, 19 nt, Homo sapiens
uaauggagaugucauguau

SEQ ID NO: 784667 - RNA, 19 nt, Homo sapiens
gagugaagcucauugacuu

SEQ ID NO: 784668 - RNA, 19 nt, Homo sapiens
gaucuugacccuaauacua

SEQ ID NO: 784669 - RNA, 19 nt, Homo sapiens
caacuauucugguuuagau

SEQ ID NO: 784670 - RNA, 19 nt, Homo sapiens
cgagaaagcaguggaguua

SEQ ID NO: 784671 - RNA, 19 nt, Homo sapiens
gaaucagccuucccaguga

SEQ ID NO: 784672 - RNA, 19 nt, Homo sapiens
uaacagagcauuaaguugu

SEQ ID NO: 784673 - RNA, 19 nt, Homo sapiens
uaccagaaccugugcauua

SEQ ID NO: 784674 - RNA, 19 nt, Homo sapiens
ccagagauuucaucaaugu

SEQ ID NO: 784675 - RNA, 19 nt, Homo sapiens
ggagaugucauguauauca

SEQ ID NO: 784676 - RNA, 19 nt, Homo sapiens
ggagaaaucacccugaaga

SEQ ID NO: 784677 - RNA, 19 nt, Homo sapiens
uagacuaccuuaugaauca

SEQ ID NO: 784678 - RNA, 19 nt, Homo sapiens
gaacauccuugacacugau

SEQ ID NO: 784679 - RNA, 19 nt, Homo sapiens
gagaagagcaagaaagguu

SEQ ID NO: 784680 - RNA, 19 nt, Homo sapiens
gaacaugugucugguguac

SEQ ID NO: 784681 - RNA, 19 nt, Homo sapiens
gucaagagcuacauuguca

SEQ ID NO: 784682 - RNA, 19 nt, Homo sapiens
gaaaucacccugaagaucu

SEQ ID NO: 784683 - RNA, 19 nt, Homo sapiens
gaagaaauaaagaggcaaa

SEQ ID NO: 784684 - RNA, 19 nt, Homo sapiens
gaaauguccuccucuuugc

SEQ ID NO: 784685 - RNA, 19 nt, Homo sapiens
ucacagaaguguucagaag

SEQ ID NO: 784686 - RNA, 19 nt, Homo sapiens
gaugaaauguccuccucuu

SEQ ID NO: 784687 - RNA, 19 nt, Homo sapiens
gccaggaaauaaauucaaa

SEQ ID NO: 784688 - RNA, 19 nt, Homo sapiens
ggccguuucucuauaguaa

SEQ ID NO: 784689 - RNA, 19 nt, Homo sapiens
gaaggaaaauuuugacuca

SEQ ID NO: 784690 - RNA, 19 nt, Homo sapiens
caagacagugggauuuaua

SEQ ID NO: 784691 - RNA, 19 nt, Homo sapiens
gaacaaaaccugauacauc

SEQ ID NO: 784692 - RNA, 19 nt, Homo sapiens
gcagguuauuugauuaaga

SEQ ID NO: 784693 - RNA, 19 nt, Homo sapiens
ggaggaugcuguccagauc

SEQ ID NO: 784694 - RNA, 19 nt, Homo sapiens
gauaacagcucagccacau

SEQ ID NO: 784695 - RNA, 19 nt, Homo sapiens
ggauguuuguccugaauga

SEQ ID NO: 784696 - RNA, 19 nt, Homo sapiens
agacagcgcugaugagaag

SEQ ID NO: 784697 - RNA, 19 nt, Homo sapiens
cagaagaagggcaaagaua

SEQ ID NO: 784698 - RNA, 19 nt, Homo sapiens
gaaaugcauucacaaagcu

SEQ ID NO: 784699 - RNA, 19 nt, Homo sapiens
acagaaguguucagaagaa

SEQ ID NO: 784700 - RNA, 19 nt, Homo sapiens
agauguggcugugaaauuu

SEQ ID NO: 784701 - RNA, 19 nt, Homo sapiens
gaguuaaugugccuuguuc

SEQ ID NO: 784702 - RNA, 19 nt, Homo sapiens
gaacaacguaccaacacuu

SEQ ID NO: 784703 - RNA, 19 nt, Homo sapiens
agaagaagggcaaagauaa

SEQ ID NO: 784704 - RNA, 19 nt, Homo sapiens
gaauacuucugugguguga

SEQ ID NO: 784705 - RNA, 19 nt, Homo sapiens
gcucuuagacuaccuuaug

SEQ ID NO: 784706 - RNA, 19 nt, Homo sapiens
guacaucacucuccaugac

SEQ ID NO: 784707 - RNA, 19 nt, Homo sapiens
gagaaugaaaucuguguga

SEQ ID NO: 784708 - RNA, 19 nt, Homo sapiens
gguuuggaguguucagaua

SEQ ID NO: 784709 - RNA, 19 nt, Homo sapiens
gaacuaaaaggacuaauug

SEQ ID NO: 784710 - RNA, 19 nt, Homo sapiens
gcuguagaauaccaucuuu

SEQ ID NO: 784711 - RNA, 19 nt, Homo sapiens
cagaaccugugcauuaaga

SEQ ID NO: 784712 - RNA, 19 nt, Homo sapiens
gcacugaaggagaaugaaa

SEQ ID NO: 784713 - RNA, 19 nt, Homo sapiens
agaauaccaucuuucagaa

SEQ ID NO: 784714 - RNA, 19 nt, Homo sapiens
guaccaacacuuucugauu

SEQ ID NO: 784715 - RNA, 19 nt, Homo sapiens
aggagaauguggacaauga

SEQ ID NO: 784716 - RNA, 19 nt, Homo sapiens
agaaagcaguggaguuaau

SEQ ID NO: 784717 - RNA, 19 nt, Homo sapiens
ucaaggaucugggcauugu

SEQ ID NO: 784718 - RNA, 19 nt, Homo sapiens
ugaaauguccuccucuuug

SEQ ID NO: 784719 - RNA, 19 nt, Homo sapiens
caacgacccuacacaggau

SEQ ID NO: 784720 - RNA, 19 nt, Homo sapiens
gagaugucauguauaucaa

SEQ ID NO: 784721 - RNA, 19 nt, Homo sapiens
gaagaagggcaaagauaag

SEQ ID NO: 784722 - RNA, 19 nt, Homo sapiens
acauagacgugcaguguga

SEQ ID NO: 784723 - RNA, 19 nt, Homo sapiens
gcaagcaccagaaugaugu

SEQ ID NO: 784724 - RNA, 19 nt, Homo sapiens
gcaaugcugccagagauuu

SEQ ID NO: 784725 - RNA, 19 nt, Homo sapiens
acacuuaccucgucaucga

SEQ ID NO: 784726 - RNA, 19 nt, Homo sapiens
caaauuucauccaagaagu

SEQ ID NO: 784727 - RNA, 19 nt, Homo sapiens
uagaauaccaucuuucaga

SEQ ID NO: 784728 - RNA, 19 nt, Homo sapiens
ccauucagguuucagaguu

SEQ ID NO: 784729 - RNA, 19 nt, Homo sapiens
ugccagagauuucaucaau

SEQ ID NO: 784730 - RNA, 19 nt, Homo sapiens
agacauguaucaacguaug

SEQ ID NO: 784731 - RNA, 19 nt, Homo sapiens
ccagugagcccucggaguu

SEQ ID NO: 784732 - RNA, 19 nt, Homo sapiens
caauggcaguccaggguuu

SEQ ID NO: 784733 - RNA, 19 nt, Homo sapiens
uaacugagauugcaauacc

SEQ ID NO: 784734 - RNA, 19 nt, Homo sapiens
ccgaaucauuacauuguuu

SEQ ID NO: 784735 - RNA, 19 nt, Homo sapiens
gacugaaugugacuguaaa

SEQ ID NO: 784736 - RNA, 19 nt, Homo sapiens
gaggaagguucucagaucu

SEQ ID NO: 784737 - RNA, 19 nt, Homo sapiens
cauacacggucuccucuug

SEQ ID NO: 784738 - RNA, 19 nt, Homo sapiens
caccaacacucuuaagaag

SEQ ID NO: 784739 - RNA, 19 nt, Homo sapiens
gcaaagggucacagaagug

SEQ ID NO: 784740 - RNA, 19 nt, Homo sapiens
ggcaaagggucacagaagu

SEQ ID NO: 784741 - RNA, 19 nt, Homo sapiens
aaagcaagacugaauguga

SEQ ID NO: 784742 - RNA, 19 nt, Homo sapiens
ccaccaacacucuuaagaa

SEQ ID NO: 784743 - RNA, 19 nt, Homo sapiens
agaggaagguucucagauc

SEQ ID NO: 784744 - RNA, 19 nt, Homo sapiens
gcaaugaucuuccaauaaa

SEQ ID NO: 784745 - RNA, 19 nt, Homo sapiens
ccaauuaccuggucauuug

SEQ ID NO: 784746 - RNA, 19 nt, Homo sapiens
ggagaaaugugcacucaug

SEQ ID NO: 784747 - RNA, 19 nt, Homo sapiens
cagcaaugaucuuccaaua

SEQ ID NO: 784748 - RNA, 19 nt, Homo sapiens
gcgaggagacagccaauua

SEQ ID NO: 784749 - RNA, 19 nt, Homo sapiens
gcaagagcaugguaaauac

SEQ ID NO: 784750 - RNA, 19 nt, Homo sapiens
aaagacggcuucagcaaga

SEQ ID NO: 784751 - RNA, 19 nt, Homo sapiens
agaaacagaucaagcacuu

SEQ ID NO: 784752 - RNA, 19 nt, Homo sapiens
gaggagaaaugugcacuca

SEQ ID NO: 784753 - RNA, 19 nt, Homo sapiens
ugaggugucugaugaugaa

SEQ ID NO: 784754 - RNA, 19 nt, Homo sapiens
acauugaggugucugauga

SEQ ID NO: 784755 - RNA, 19 nt, Homo sapiens
agaaggccaugaaggagua

SEQ ID NO: 784756 - RNA, 19 nt, Homo sapiens
gcaaagacggcuucagcaa

SEQ ID NO: 784757 - RNA, 19 nt, Homo sapiens
cacaagaccuucguggaaa

SEQ ID NO: 784758 - RNA, 19 nt, Homo sapiens
agacaaucgucaugcaauu

SEQ ID NO: 784759 - RNA, 19 nt, Homo sapiens
gcaaacagcaaugaucuuc

SEQ ID NO: 784760 - RNA, 19 nt, Homo sapiens
ccauucaagucucugcuuu

SEQ ID NO: 784761 - RNA, 19 nt, Homo sapiens
acaaucgucaugcaauuua

SEQ ID NO: 784762 - RNA, 19 nt, Homo sapiens
gcaagaugguggacuacag

SEQ ID NO: 784763 - RNA, 19 nt, Homo sapiens
aaacagaucaagcacuuug

SEQ ID NO: 784764 - RNA, 19 nt, Homo sapiens
cugaggaacuccagaagug

SEQ ID NO: 784765 - RNA, 19 nt, Homo sapiens
gcaagaaggagaagagcau

SEQ ID NO: 784766 - RNA, 19 nt, Homo sapiens
acacaagaccuucguggaa

SEQ ID NO: 784767 - RNA, 19 nt, Homo sapiens
aaacagcaaugaucuucca

SEQ ID NO: 784768 - RNA, 19 nt, Homo sapiens
gacaaucgucaugcaauuu

SEQ ID NO: 784769 - RNA, 19 nt, Homo sapiens
agaagagcaugcccuggaa

SEQ ID NO: 784770 - RNA, 19 nt, Homo sapiens
agcaagagcaugguaaaua

SEQ ID NO: 784771 - RNA, 19 nt, Homo sapiens
uggaggagaugcgcaagaa

SEQ ID NO: 784772 - RNA, 19 nt, Homo sapiens
gaaggaugucaguguguga

SEQ ID NO: 784773 - RNA, 19 nt, Homo sapiens
aaggcaagaugguggacua

SEQ ID NO: 784774 - RNA, 19 nt, Homo sapiens
ugagggagcagaaacacaa

SEQ ID NO: 784775 - RNA, 19 nt, Homo sapiens
cgacacggccagucucuuc

SEQ ID NO: 784776 - RNA, 19 nt, Homo sapiens
gagcuggccaagagccuaa

SEQ ID NO: 784777 - RNA, 19 nt, Homo sapiens
gaaacagaucaagcacuuu

SEQ ID NO: 784778 - RNA, 19 nt, Homo sapiens
caaucgucaugcaauuuau

SEQ ID NO: 784779 - RNA, 19 nt, Homo sapiens
ccaagacgggcgaugagaa

SEQ ID NO: 784780 - RNA, 19 nt, Homo sapiens
gccaauuaccuggucauuu

SEQ ID NO: 784781 - RNA, 19 nt, Homo sapiens
uaaauaccaagcccgagaa

SEQ ID NO: 784782 - RNA, 19 nt, Homo sapiens
agcagaagcuggaggagau

SEQ ID NO: 784783 - RNA, 19 nt, Homo sapiens
gcaucgagaaggccaugaa

SEQ ID NO: 784784 - RNA, 19 nt, Homo sapiens
gacagccgaucgccaguac

SEQ ID NO: 784785 - RNA, 19 nt, Homo sapiens
uggacacgcucagcaaaga

SEQ ID NO: 784786 - RNA, 19 nt, Homo sapiens
gagaaggaugucagugugu

SEQ ID NO: 784787 - RNA, 19 nt, Homo sapiens
ugaaggacgugcagaugcu

SEQ ID NO: 784788 - RNA, 19 nt, Homo sapiens
guacauggagggcuucaac

SEQ ID NO: 784789 - RNA, 19 nt, Homo sapiens
gaagacggaggaggacuca

SEQ ID NO: 784790 - RNA, 19 nt, Homo sapiens
ucgagaaggccaugaagga

SEQ ID NO: 784791 - RNA, 19 nt, Homo sapiens
agacggaggaggacucaga

SEQ ID NO: 784792 - RNA, 19 nt, Homo sapiens
caagacgggcgaugagaag

SEQ ID NO: 784793 - RNA, 19 nt, Homo sapiens
uccggcaguucuucacuaa

SEQ ID NO: 784794 - RNA, 19 nt, Homo sapiens
cgacgcaaaguaccacaug

SEQ ID NO: 784795 - RNA, 19 nt, Homo sapiens
ggaggaggagcgcaagaag

SEQ ID NO: 784796 - RNA, 19 nt, Homo sapiens
gugccaagcugcgcaucga

SEQ ID NO: 784797 - RNA, 19 nt, Homo sapiens
uggaacgcauggagcaguu

SEQ ID NO: 784798 - RNA, 19 nt, Homo sapiens
ucagcaagagcaugguaaa

SEQ ID NO: 784799 - RNA, 19 nt, Homo sapiens
gcuccugacuuccucuacu

SEQ ID NO: 784800 - RNA, 19 nt, Homo sapiens
agcaaugaucuuccaauaa

SEQ ID NO: 784801 - RNA, 19 nt, Homo sapiens
cugucugugucuucuauuu

SEQ ID NO: 784802 - RNA, 19 nt, Homo sapiens
ucacugggcucuguuuuca

SEQ ID NO: 784803 - RNA, 19 nt, Homo sapiens
cagacaaucgucaugcaau

SEQ ID NO: 784804 - RNA, 19 nt, Homo sapiens
gggaugacagccaaaagua

SEQ ID NO: 784805 - RNA, 19 nt, Homo sapiens
ggaggugagggagcagaaa

SEQ ID NO: 784806 - RNA, 19 nt, Homo sapiens
ggaccacauugaggugucu

SEQ ID NO: 784807 - RNA, 19 nt, Homo sapiens
gacgggcgaugagaaggau

SEQ ID NO: 784808 - RNA, 19 nt, Homo sapiens
ccaagcugcgcaucgagaa

SEQ ID NO: 784809 - RNA, 19 nt, Homo sapiens
ccagacaaucgucaugcaa

SEQ ID NO: 784810 - RNA, 19 nt, Homo sapiens
gaaggagaaggaggaacug

SEQ ID NO: 784811 - RNA, 19 nt, Homo sapiens
gagaagaacuacugaauua

SEQ ID NO: 784812 - RNA, 19 nt, Homo sapiens
gcaauuaccuuaccgacua

SEQ ID NO: 784813 - RNA, 19 nt, Homo sapiens
gaagaucuguauggaauua

SEQ ID NO: 784814 - RNA, 19 nt, Homo sapiens
gaacugagaggaauuauga

SEQ ID NO: 784815 - RNA, 19 nt, Homo sapiens
gaaaccagacuucgaaaua

SEQ ID NO: 784816 - RNA, 19 nt, Homo sapiens
gaaaguaaacugacaauuc

SEQ ID NO: 784817 - RNA, 19 nt, Homo sapiens
ggaaauuacuccuguuaug

SEQ ID NO: 784818 - RNA, 19 nt, Homo sapiens
gaaggugacuugggaaauu

SEQ ID NO: 784819 - RNA, 19 nt, Homo sapiens
cuacaaguguuacaagaua

SEQ ID NO: 784820 - RNA, 19 nt, Homo sapiens
gcaagcggcugauuauugu

SEQ ID NO: 784821 - RNA, 19 nt, Homo sapiens
gaaagugacauuagaauuc

SEQ ID NO: 784822 - RNA, 19 nt, Homo sapiens
gaagaagacuccauuuggu

SEQ ID NO: 784823 - RNA, 19 nt, Homo sapiens
gggaagaucuguauggaau

SEQ ID NO: 784824 - RNA, 19 nt, Homo sapiens
aaucaaaugugcacucuuu

SEQ ID NO: 784825 - RNA, 19 nt, Homo sapiens
gaacuuggcauuugugaau

SEQ ID NO: 784826 - RNA, 19 nt, Homo sapiens
uuuaagagcuggaagauga

SEQ ID NO: 784827 - RNA, 19 nt, Homo sapiens
ggaaacguuuacaguauga

SEQ ID NO: 784828 - RNA, 19 nt, Homo sapiens
ggagaugucaguccuuuaa

SEQ ID NO: 784829 - RNA, 19 nt, Homo sapiens
gaaguagaaugagcaaaga

SEQ ID NO: 784830 - RNA, 19 nt, Homo sapiens
ggaauuaucugcuuuuaug

SEQ ID NO: 784831 - RNA, 19 nt, Homo sapiens
gcaccuggauuguaucuuc

SEQ ID NO: 784832 - RNA, 19 nt, Homo sapiens
gcgggauacuugugaaaua

SEQ ID NO: 784833 - RNA, 19 nt, Homo sapiens
caaagcaagcggcugauua

SEQ ID NO: 784834 - RNA, 19 nt, Homo sapiens
gaagaugacauuggaaauu

SEQ ID NO: 784835 - RNA, 19 nt, Homo sapiens
ugagaggaauuaugaacua

SEQ ID NO: 784836 - RNA, 19 nt, Homo sapiens
gagauacucugcuuauaag

SEQ ID NO: 784837 - RNA, 19 nt, Homo sapiens
cagcauaccuacuguaaca

SEQ ID NO: 784838 - RNA, 19 nt, Homo sapiens
gaguugauguacccuuaua

SEQ ID NO: 784839 - RNA, 19 nt, Homo sapiens
gaaguuuccaucucauuaa

SEQ ID NO: 784840 - RNA, 19 nt, Homo sapiens
caaauuacguaguuagaag

SEQ ID NO: 784841 - RNA, 19 nt, Homo sapiens
gaucuguuauugcgggaua

SEQ ID NO: 784842 - RNA, 19 nt, Homo sapiens
cagagaaccugaaauccuu

SEQ ID NO: 784843 - RNA, 19 nt, Homo sapiens
acacuggacucugcuauaa

SEQ ID NO: 784844 - RNA, 19 nt, Homo sapiens
gaagaucaagggcaugaaa

SEQ ID NO: 784845 - RNA, 19 nt, Homo sapiens
ggaaagugacauuagaauu

SEQ ID NO: 784846 - RNA, 19 nt, Homo sapiens
gaugucaguccuuuaauuu

SEQ ID NO: 784847 - RNA, 19 nt, Homo sapiens
cagagaagaugacauugga

SEQ ID NO: 784848 - RNA, 19 nt, Homo sapiens
gaaauuucaugccgugaca

SEQ ID NO: 784849 - RNA, 19 nt, Homo sapiens
ucauagagcucgcagacuu

SEQ ID NO: 784850 - RNA, 19 nt, Homo sapiens
gcuugugacuggagaaauu

SEQ ID NO: 784851 - RNA, 19 nt, Homo sapiens
caaagaagaagacuccauu

SEQ ID NO: 784852 - RNA, 19 nt, Homo sapiens
gaauuucuuuguagcauca

SEQ ID NO: 784853 - RNA, 19 nt, Homo sapiens
uaagagaagucagagaaga

SEQ ID NO: 784854 - RNA, 19 nt, Homo sapiens
gcaagcaacacuccaauuc

SEQ ID NO: 784855 - RNA, 19 nt, Homo sapiens
ucacugcucuucagaauac

SEQ ID NO: 784856 - RNA, 19 nt, Homo sapiens
agacugauguguagauaga

SEQ ID NO: 784857 - RNA, 19 nt, Homo sapiens
gaaauuacuccuguuaugu

SEQ ID NO: 784858 - RNA, 19 nt, Homo sapiens
gaaacuccacuuacuguau

SEQ ID NO: 784859 - RNA, 19 nt, Homo sapiens
ccaaagugcuggacucagu

SEQ ID NO: 784860 - RNA, 19 nt, Homo sapiens
ggauagaacccauuacaca

SEQ ID NO: 784861 - RNA, 19 nt, Homo sapiens
gagaagaugacauuggaaa

SEQ ID NO: 784862 - RNA, 19 nt, Homo sapiens
ggcaagauguguagaucaa

SEQ ID NO: 784863 - RNA, 19 nt, Homo sapiens
gcaaucagcauaccuacug

SEQ ID NO: 784864 - RNA, 19 nt, Homo sapiens
aaaccagacuucgaaauau

SEQ ID NO: 784865 - RNA, 19 nt, Homo sapiens
ggacaaggagcaccggauu

SEQ ID NO: 784866 - RNA, 19 nt, Homo sapiens
ggaaguagaaugagcaaag

SEQ ID NO: 784867 - RNA, 19 nt, Homo sapiens
gaugaaagcuccgauucca

SEQ ID NO: 784868 - RNA, 19 nt, Homo sapiens
agaagagacugauguguag

SEQ ID NO: 784869 - RNA, 19 nt, Homo sapiens
gaagaugaaagcuccgauu

SEQ ID NO: 784870 - RNA, 19 nt, Homo sapiens
cuaacugucuuaacauuca

SEQ ID NO: 784871 - RNA, 19 nt, Homo sapiens
gcggagaugucaguccuuu

SEQ ID NO: 784872 - RNA, 19 nt, Homo sapiens
gauuguaucuucagcaaac

SEQ ID NO: 784873 - RNA, 19 nt, Homo sapiens
cuugaaauccuaccugaua

SEQ ID NO: 784874 - RNA, 19 nt, Homo sapiens
gaucaagggcaugaaauug

SEQ ID NO: 784875 - RNA, 19 nt, Homo sapiens
gagaacagugcaacaaaug

SEQ ID NO: 784876 - RNA, 19 nt, Homo sapiens
aagaagagacugaugugua

SEQ ID NO: 784877 - RNA, 19 nt, Homo sapiens
uagaacccauuacacauga

SEQ ID NO: 784878 - RNA, 19 nt, Homo sapiens
gaaaucaugcucuucuaca

SEQ ID NO: 784879 - RNA, 19 nt, Homo sapiens
ccagcguucuccuucauaa

SEQ ID NO: 784880 - RNA, 19 nt, Homo sapiens
gaagaacuacugaauuaac

SEQ ID NO: 784881 - RNA, 19 nt, Homo sapiens
aaacuccacuuacuguaug

SEQ ID NO: 784882 - RNA, 19 nt, Homo sapiens
gggagagccuguucgaauc

SEQ ID NO: 784883 - RNA, 19 nt, Homo sapiens
aagcaacacuccaauucuu

SEQ ID NO: 784884 - RNA, 19 nt, Homo sapiens
cagaugaggcccacacaaa

SEQ ID NO: 784885 - RNA, 19 nt, Homo sapiens
ggaccaggaggauuugaaa

SEQ ID NO: 784886 - RNA, 19 nt, Homo sapiens
caagauguguagaucaaag

SEQ ID NO: 784887 - RNA, 19 nt, Homo sapiens
aaucuaaccugcagagcuu

SEQ ID NO: 784888 - RNA, 19 nt, Homo sapiens
ggccaaguauuguauucaa

SEQ ID NO: 784889 - RNA, 19 nt, Homo sapiens
aaccugaaauccuuuggua

SEQ ID NO: 784890 - RNA, 19 nt, Homo sapiens
gcaaacaaucgggcacuuu

SEQ ID NO: 784891 - RNA, 19 nt, Homo sapiens
aaacagggucuuguacaua

SEQ ID NO: 784892 - RNA, 19 nt, Homo sapiens
gggugacucugcuaaucua

SEQ ID NO: 784893 - RNA, 19 nt, Homo sapiens
guauggaauuaucugcuuu

SEQ ID NO: 784894 - RNA, 19 nt, Homo sapiens
guugauguacccuuauaua

SEQ ID NO: 784895 - RNA, 19 nt, Homo sapiens
caacuggaacauacauuga

SEQ ID NO: 784896 - RNA, 19 nt, Homo sapiens
aaggugacuugggaaauua

SEQ ID NO: 784897 - RNA, 19 nt, Homo sapiens
gcagacuucucacuuaucg

SEQ ID NO: 784898 - RNA, 19 nt, Homo sapiens
uauggaggcuuuguuguga

SEQ ID NO: 784899 - RNA, 19 nt, Homo sapiens
uauaagagaagucagagaa

SEQ ID NO: 784900 - RNA, 19 nt, Homo sapiens
gccgugacauagaggauuu

SEQ ID NO: 784901 - RNA, 19 nt, Homo sapiens
cacacuugauucucuuaua

SEQ ID NO: 784902 - RNA, 19 nt, Homo sapiens
gggucuaacugucuuaaca

SEQ ID NO: 784903 - RNA, 19 nt, Homo sapiens
gagcaucuuugagcuggaa

SEQ ID NO: 784904 - RNA, 19 nt, Homo sapiens
guuuccaucucauuaauug

SEQ ID NO: 784905 - RNA, 19 nt, Homo sapiens
gaacuacugaauuaacugu

SEQ ID NO: 784906 - RNA, 19 nt, Homo sapiens
aaacauggaggccaaguau

SEQ ID NO: 784907 - RNA, 19 nt, Homo sapiens
caauuaccuuaccgacuaa

SEQ ID NO: 784908 - RNA, 19 nt, Homo sapiens
gagaagaucaagggcauga

SEQ ID NO: 784909 - RNA, 19 nt, Homo sapiens
gaggauagaacccauuaca

SEQ ID NO: 784910 - RNA, 19 nt, Homo sapiens
cuggaaacguuuacaguau

SEQ ID NO: 784911 - RNA, 19 nt, Homo sapiens
ggagagagcugacaaucaa

SEQ ID NO: 784912 - RNA, 19 nt, Homo sapiens
ggaaauaaaugccgaugau

SEQ ID NO: 784913 - RNA, 19 nt, Homo sapiens
gaagcuggcuggagacaug

SEQ ID NO: 784914 - RNA, 19 nt, Homo sapiens
uagcuaaacugucauugug

SEQ ID NO: 784915 - RNA, 19 nt, Homo sapiens
ggaaugcggucccugacau

SEQ ID NO: 784916 - RNA, 19 nt, Homo sapiens
agaauucccguacugauua

SEQ ID NO: 784917 - RNA, 19 nt, Homo sapiens
gaaauaaaugccgaugauu

SEQ ID NO: 784918 - RNA, 19 nt, Homo sapiens
ccagcagccucuucucuga

SEQ ID NO: 784919 - RNA, 19 nt, Homo sapiens
gggaccaccucgucuugaa

SEQ ID NO: 784920 - RNA, 19 nt, Homo sapiens
gagcuccacagauccauuu

SEQ ID NO: 784921 - RNA, 19 nt, Homo sapiens
gaagagaugcaagcaggaa

SEQ ID NO: 784922 - RNA, 19 nt, Homo sapiens
caccucgucuugaaucuga

SEQ ID NO: 784923 - RNA, 19 nt, Homo sapiens
cagguacacuuucaagaca

SEQ ID NO: 784924 - RNA, 19 nt, Homo sapiens
cagaauucccguacugauu

SEQ ID NO: 784925 - RNA, 19 nt, Homo sapiens
gaauucccguacugauuag

SEQ ID NO: 784926 - RNA, 19 nt, Homo sapiens
cagaccugcuugucccuuu

SEQ ID NO: 784927 - RNA, 19 nt, Homo sapiens
ccuaggacccaggaaauaa

SEQ ID NO: 784928 - RNA, 19 nt, Homo sapiens
ggauaagugacaccuagga

SEQ ID NO: 784929 - RNA, 19 nt, Homo sapiens
ccgcagaauucccguacug

SEQ ID NO: 784930 - RNA, 19 nt, Homo sapiens
gcagaauucccguacugau

SEQ ID NO: 784931 - RNA, 19 nt, Homo sapiens
aaacugucauugugcaucu

SEQ ID NO: 784932 - RNA, 19 nt, Homo sapiens
aaaccaggccagacugaga

SEQ ID NO: 784933 - RNA, 19 nt, Homo sapiens
cuaggacccaggaaauaaa

SEQ ID NO: 784934 - RNA, 19 nt, Homo sapiens
gagcuccaugucccagaua

SEQ ID NO: 784935 - RNA, 19 nt, Homo sapiens
gagagcugacaaucaauuc

SEQ ID NO: 784936 - RNA, 19 nt, Homo sapiens
agagagcugacaaucaauu

SEQ ID NO: 784937 - RNA, 19 nt, Homo sapiens
cggcgagaccgcagaauuc

SEQ ID NO: 784938 - RNA, 19 nt, Homo sapiens
gugcccagguacacuuuca

SEQ ID NO: 784939 - RNA, 19 nt, Homo sapiens
ggaccaccucgucuugaau

SEQ ID NO: 784940 - RNA, 19 nt, Homo sapiens
gaugggaccaccucgucuu

SEQ ID NO: 784941 - RNA, 19 nt, Homo sapiens
ugacauccagggagacuca

SEQ ID NO: 784942 - RNA, 19 nt, Homo sapiens
caagacacuguaaccacaa

SEQ ID NO: 784943 - RNA, 19 nt, Homo sapiens
gccgaugauuuguguaaaa

SEQ ID NO: 784944 - RNA, 19 nt, Homo sapiens
acagugagcagcccacaca

SEQ ID NO: 784945 - RNA, 19 nt, Homo sapiens
ucuugaaucugaccuuguc

SEQ ID NO: 784946 - RNA, 19 nt, Homo sapiens
gaccaccucgucuugaauc

SEQ ID NO: 784947 - RNA, 19 nt, Homo sapiens
ggacccaggaaauaaaugc

SEQ ID NO: 784948 - RNA, 19 nt, Homo sapiens
acaccuaggacccaggaaa

SEQ ID NO: 784949 - RNA, 19 nt, Homo sapiens
ccagguacacuuucaagac

SEQ ID NO: 784950 - RNA, 19 nt, Homo sapiens
cggacuucaucuccuguga

SEQ ID NO: 784951 - RNA, 19 nt, Homo sapiens
ggagcuccacagauccauu

SEQ ID NO: 784952 - RNA, 19 nt, Homo sapiens
gacccugucccaacaccaa

SEQ ID NO: 784953 - RNA, 19 nt, Homo sapiens
gcaagaugcuuauugauuu

SEQ ID NO: 784954 - RNA, 19 nt, Homo sapiens
gcaaagagauuucuaucaa

SEQ ID NO: 784955 - RNA, 19 nt, Homo sapiens
gaaaugcgccuucuucuga

SEQ ID NO: 784956 - RNA, 19 nt, Homo sapiens
ccacuagucugauacagua

SEQ ID NO: 784957 - RNA, 19 nt, Homo sapiens
gcaaagaacagaaagagaa

SEQ ID NO: 784958 - RNA, 19 nt, Homo sapiens
gcacugaggagccugcuua

SEQ ID NO: 784959 - RNA, 19 nt, Homo sapiens
gagggaagcaacaugauua

SEQ ID NO: 784960 - RNA, 19 nt, Homo sapiens
ugaaguggauggcaagaaa

SEQ ID NO: 784961 - RNA, 19 nt, Homo sapiens
gcugucaccugauuggaua

SEQ ID NO: 784962 - RNA, 19 nt, Homo sapiens
gaguaugacuuggaucuuu

SEQ ID NO: 784963 - RNA, 19 nt, Homo sapiens
gaaccgaagauuccgauuu

SEQ ID NO: 784964 - RNA, 19 nt, Homo sapiens
gagauguucccucuaauuu

SEQ ID NO: 784965 - RNA, 19 nt, Homo sapiens
caccagaccuccaaauaug

SEQ ID NO: 784966 - RNA, 19 nt, Homo sapiens
agaggcagcuucgauauaa

SEQ ID NO: 784967 - RNA, 19 nt, Homo sapiens
gaaaggaugcugucucaca

SEQ ID NO: 784968 - RNA, 19 nt, Homo sapiens
ugaaugagauggagagaag

SEQ ID NO: 784969 - RNA, 19 nt, Homo sapiens
gaugcccacuguaucauaa

SEQ ID NO: 784970 - RNA, 19 nt, Homo sapiens
accaggaccuuuccaguua

SEQ ID NO: 784971 - RNA, 19 nt, Homo sapiens
gaugggaucuguauuagac

SEQ ID NO: 784972 - RNA, 19 nt, Homo sapiens
gaacacagacagaccuaug

SEQ ID NO: 784973 - RNA, 19 nt, Homo sapiens
gcacacagacaguucagaa

SEQ ID NO: 784974 - RNA, 19 nt, Homo sapiens
gggauaagcagauagaaga

SEQ ID NO: 784975 - RNA, 19 nt, Homo sapiens
aaauacagcugaucaugau

SEQ ID NO: 784976 - RNA, 19 nt, Homo sapiens
cacccucccucuaggauua

SEQ ID NO: 784977 - RNA, 19 nt, Homo sapiens
gagaggcagcuucgauaua

SEQ ID NO: 784978 - RNA, 19 nt, Homo sapiens
gauguucccucuaauuucu

SEQ ID NO: 784979 - RNA, 19 nt, Homo sapiens
gcaaguacaguauccuuug

SEQ ID NO: 784980 - RNA, 19 nt, Homo sapiens
gaugagauauaucgcaaag

SEQ ID NO: 784981 - RNA, 19 nt, Homo sapiens
gacccaaggaguucuguua

SEQ ID NO: 784982 - RNA, 19 nt, Homo sapiens
cagaggauuuggagaaguu

SEQ ID NO: 784983 - RNA, 19 nt, Homo sapiens
gaaagcuacaacuucaaua

SEQ ID NO: 784984 - RNA, 19 nt, Homo sapiens
ugagauauaucgcaaaggu

SEQ ID NO: 784985 - RNA, 19 nt, Homo sapiens
ggcaagaugcuuauugauu

SEQ ID NO: 784986 - RNA, 19 nt, Homo sapiens
uaggacaccuuacaggaaa

SEQ ID NO: 784987 - RNA, 19 nt, Homo sapiens
ccauauaccuugcacugau

SEQ ID NO: 784988 - RNA, 19 nt, Homo sapiens
cuuauaagcuaucgcaguu

SEQ ID NO: 784989 - RNA, 19 nt, Homo sapiens
caagaugcuuauugauuuc

SEQ ID NO: 784990 - RNA, 19 nt, Homo sapiens
caaagaacagaaagagaaa

SEQ ID NO: 784991 - RNA, 19 nt, Homo sapiens
cagcuucgauauaaggaaa

SEQ ID NO: 784992 - RNA, 19 nt, Homo sapiens
aagaaaggaugcugucuca

SEQ ID NO: 784993 - RNA, 19 nt, Homo sapiens
auuauaaccugcuaucuug

SEQ ID NO: 784994 - RNA, 19 nt, Homo sapiens
ucuauucucuggucuucua

SEQ ID NO: 784995 - RNA, 19 nt, Homo sapiens
aaccagagccaaauacuuu

SEQ ID NO: 784996 - RNA, 19 nt, Homo sapiens
ccaaauguguguggaaaca

SEQ ID NO: 784997 - RNA, 19 nt, Homo sapiens
gcugggacgucucuauaug

SEQ ID NO: 784998 - RNA, 19 nt, Homo sapiens
gaaagggaacggauacuac

SEQ ID NO: 784999 - RNA, 19 nt, Homo sapiens
gagauggagagaagaauga

SEQ ID NO: 785000 - RNA, 19 nt, Homo sapiens
gaacguccacucucagauc

SEQ ID NO: 785001 - RNA, 19 nt, Homo sapiens
cuccauauccugaagaaua

SEQ ID NO: 785002 - RNA, 19 nt, Homo sapiens
ggacugagcaaagaacaga

SEQ ID NO: 785003 - RNA, 19 nt, Homo sapiens
gagccgggauaagcagaua

SEQ ID NO: 785004 - RNA, 19 nt, Homo sapiens
gcacagagccgggauaagc

SEQ ID NO: 785005 - RNA, 19 nt, Homo sapiens
uucgaaaucugcagucuuu

SEQ ID NO: 785006 - RNA, 19 nt, Homo sapiens
cauauaccuugcacugauu

SEQ ID NO: 785007 - RNA, 19 nt, Homo sapiens
aaggaguucuguuauggua

SEQ ID NO: 785008 - RNA, 19 nt, Homo sapiens
ccaaggaguucuguuaugg

SEQ ID NO: 785009 - RNA, 19 nt, Homo sapiens
caacgucuccuguauccuu

SEQ ID NO: 785010 - RNA, 19 nt, Homo sapiens
aacaagaucuacugccaaa

SEQ ID NO: 785011 - RNA, 19 nt, Homo sapiens
ucgcaaagguucaaucucu

SEQ ID NO: 785012 - RNA, 19 nt, Homo sapiens
cgccgucgcuuccaugaaa

SEQ ID NO: 785013 - RNA, 19 nt, Homo sapiens
gguuccaucuugcuuuaaa

SEQ ID NO: 785014 - RNA, 19 nt, Homo sapiens
ggccaaauguguguggaaa

SEQ ID NO: 785015 - RNA, 19 nt, Homo sapiens
caucuguacuuccauauac

SEQ ID NO: 785016 - RNA, 19 nt, Homo sapiens
ucagugagguugccuggau

SEQ ID NO: 785017 - RNA, 19 nt, Homo sapiens
gcaaugccgcgaaggaaga

SEQ ID NO: 785018 - RNA, 19 nt, Homo sapiens
aaacugagcaagugguuga

SEQ ID NO: 785019 - RNA, 19 nt, Homo sapiens
ggacuagucaugguaauag

SEQ ID NO: 785020 - RNA, 19 nt, Homo sapiens
gaucccagcugcuuaaaau

SEQ ID NO: 785021 - RNA, 19 nt, Homo sapiens
uccgcuaccugcauaauuu

SEQ ID NO: 785022 - RNA, 19 nt, Homo sapiens
ggaagcaacaugauuaaaa

SEQ ID NO: 785023 - RNA, 19 nt, Homo sapiens
cccuucagaugcucaaaua

SEQ ID NO: 785024 - RNA, 19 nt, Homo sapiens
ucaguuauuugcuuuccaa

SEQ ID NO: 785025 - RNA, 19 nt, Homo sapiens
agacagggcuauggcaaga

SEQ ID NO: 785026 - RNA, 19 nt, Homo sapiens
gaccacaagacauuauauu

SEQ ID NO: 785027 - RNA, 19 nt, Homo sapiens
gagcacagagccgggauaa

SEQ ID NO: 785028 - RNA, 19 nt, Homo sapiens
caccuccacuagucugaua

SEQ ID NO: 785029 - RNA, 19 nt, Homo sapiens
ccaucuugcuuuaaauuuc

SEQ ID NO: 785030 - RNA, 19 nt, Homo sapiens
ggagaggcagcuucgauau

SEQ ID NO: 785031 - RNA, 19 nt, Homo sapiens
ugucaucucuguacacuac

SEQ ID NO: 785032 - RNA, 19 nt, Homo sapiens
uggguuccaucuugcuuua

SEQ ID NO: 785033 - RNA, 19 nt, Homo sapiens
ucaccagaccuccaaauau

SEQ ID NO: 785034 - RNA, 19 nt, Homo sapiens
gcacugacccaaggaguuc

SEQ ID NO: 785035 - RNA, 19 nt, Homo sapiens
gaacacacgggaaccucuu

SEQ ID NO: 785036 - RNA, 19 nt, Homo sapiens
gauaagcagauagaagaaa

SEQ ID NO: 785037 - RNA, 19 nt, Homo sapiens
ggaaaugcgccuucuucug

SEQ ID NO: 785038 - RNA, 19 nt, Homo sapiens
cugagcaagugguugauuu

SEQ ID NO: 785039 - RNA, 19 nt, Homo sapiens
cuauaucuacuccucaaua

SEQ ID NO: 785040 - RNA, 19 nt, Homo sapiens
agccagaguucucaagauu

SEQ ID NO: 785041 - RNA, 19 nt, Homo sapiens
ccucucagcugacgaaugc

SEQ ID NO: 785042 - RNA, 19 nt, Homo sapiens
cuggaugggaucuguauua

SEQ ID NO: 785043 - RNA, 19 nt, Homo sapiens
aaagguccaacuccaauaa

SEQ ID NO: 785044 - RNA, 19 nt, Homo sapiens
gcaaagguucaaucucugu

SEQ ID NO: 785045 - RNA, 19 nt, Homo sapiens
cuauaugugugaauucugu

SEQ ID NO: 785046 - RNA, 19 nt, Homo sapiens
gaaauauauggaacacaga

SEQ ID NO: 785047 - RNA, 19 nt, Homo sapiens
ggaugcccacuguaucaua

SEQ ID NO: 785048 - RNA, 19 nt, Homo sapiens
guucuguuaugguacugua

SEQ ID NO: 785049 - RNA, 19 nt, Homo sapiens
ggaguucuguuaugguacu

SEQ ID NO: 785050 - RNA, 19 nt, Homo sapiens
ggcaguaguucagauggaa

SEQ ID NO: 785051 - RNA, 19 nt, Homo sapiens
agacagaccuaugggaaca

SEQ ID NO: 785052 - RNA, 19 nt, Homo sapiens
aaugugcucuucuauaucu

SEQ ID NO: 785053 - RNA, 19 nt, Homo sapiens
ggacauugcugaucgcuuu

SEQ ID NO: 785054 - RNA, 19 nt, Homo sapiens
gaaaagcagucuccaauuu

SEQ ID NO: 785055 - RNA, 19 nt, Homo sapiens
ccaggaauuugauaaguua

SEQ ID NO: 785056 - RNA, 19 nt, Homo sapiens
gaaccaggauuccaagaug

SEQ ID NO: 785057 - RNA, 19 nt, Homo sapiens
agauggagcuacuugauua

SEQ ID NO: 785058 - RNA, 19 nt, Homo sapiens
guaggaaucuguaccauca

SEQ ID NO: 785059 - RNA, 19 nt, Homo sapiens
gcugaucgcuuuaauguag

SEQ ID NO: 785060 - RNA, 19 nt, Homo sapiens
gaaggaggaucaaguugug

SEQ ID NO: 785061 - RNA, 19 nt, Homo sapiens
guauguaaauucagggaua

SEQ ID NO: 785062 - RNA, 19 nt, Homo sapiens
gaagagcucuaugcaaugu

SEQ ID NO: 785063 - RNA, 19 nt, Homo sapiens
gcucagaauugccaagauu

SEQ ID NO: 785064 - RNA, 19 nt, Homo sapiens
gagcaacuaugaccuuuca

SEQ ID NO: 785065 - RNA, 19 nt, Homo sapiens
ggagcuacuugauuaugua

SEQ ID NO: 785066 - RNA, 19 nt, Homo sapiens
gaauauaacguggcuguuu

SEQ ID NO: 785067 - RNA, 19 nt, Homo sapiens
cagcaaaguuccaugaaga

SEQ ID NO: 785068 - RNA, 19 nt, Homo sapiens
aagaagagcucuaugcaau

SEQ ID NO: 785069 - RNA, 19 nt, Homo sapiens
agaauaagcuugcgaaagg

SEQ ID NO: 785070 - RNA, 19 nt, Homo sapiens
gagguggaauugaaaguau

SEQ ID NO: 785071 - RNA, 19 nt, Homo sapiens
gcacgugcauauacuagug

SEQ ID NO: 785072 - RNA, 19 nt, Homo sapiens
gacuuucccuucaccauuu

SEQ ID NO: 785073 - RNA, 19 nt, Homo sapiens
gcauuugaguauagugaaa

SEQ ID NO: 785074 - RNA, 19 nt, Homo sapiens
aggaguagguggugaauug

SEQ ID NO: 785075 - RNA, 19 nt, Homo sapiens
gaggagagcucagaauugc

SEQ ID NO: 785076 - RNA, 19 nt, Homo sapiens
gcaguggcaugugcuugua

SEQ ID NO: 785077 - RNA, 19 nt, Homo sapiens
auuaggagcugaagaaaug

SEQ ID NO: 785078 - RNA, 19 nt, Homo sapiens
gaauugccaagauuuauga

SEQ ID NO: 785079 - RNA, 19 nt, Homo sapiens
gccaggaauuugauaaguu

SEQ ID NO: 785080 - RNA, 19 nt, Homo sapiens
ugacuuacauagcuagaug

SEQ ID NO: 785081 - RNA, 19 nt, Homo sapiens
ggaaaggaguacgugauuc

SEQ ID NO: 785082 - RNA, 19 nt, Homo sapiens
aaaagucccugauuuauga

SEQ ID NO: 785083 - RNA, 19 nt, Homo sapiens
gcucaugcuucaacaacaa

SEQ ID NO: 785084 - RNA, 19 nt, Homo sapiens
guauacagaugacaacaag

SEQ ID NO: 785085 - RNA, 19 nt, Homo sapiens
ccacugacuuacauagcua

SEQ ID NO: 785086 - RNA, 19 nt, Homo sapiens
aaacccagcuuucucauac

SEQ ID NO: 785087 - RNA, 19 nt, Homo sapiens
gaaaagaggaaaaugguuu

SEQ ID NO: 785088 - RNA, 19 nt, Homo sapiens
gaaaucaguaggaaucugu

SEQ ID NO: 785089 - RNA, 19 nt, Homo sapiens
gcuggcaucuucaagcuau

SEQ ID NO: 785090 - RNA, 19 nt, Homo sapiens
gcagcaaaguuccaugaag

SEQ ID NO: 785091 - RNA, 19 nt, Homo sapiens
ccacuaaacagaaagucua

SEQ ID NO: 785092 - RNA, 19 nt, Homo sapiens
gcagcgaacaaacuaauug

SEQ ID NO: 785093 - RNA, 19 nt, Homo sapiens
ggacuuucccuucaccauu

SEQ ID NO: 785094 - RNA, 19 nt, Homo sapiens
aauaacugcuggaggaauu

SEQ ID NO: 785095 - RNA, 19 nt, Homo sapiens
gaaaguauggcaauuacag

SEQ ID NO: 785096 - RNA, 19 nt, Homo sapiens
ucagaauugccaagauuua

SEQ ID NO: 785097 - RNA, 19 nt, Homo sapiens
ggagguggaauugaaagua

SEQ ID NO: 785098 - RNA, 19 nt, Homo sapiens
gggaaaggaguacgugauu

SEQ ID NO: 785099 - RNA, 19 nt, Homo sapiens
gguggugaauugaugcaaa

SEQ ID NO: 785100 - RNA, 19 nt, Homo sapiens
gcuuuaauguagaccauga

SEQ ID NO: 785101 - RNA, 19 nt, Homo sapiens
ucucauacccucuguguga

SEQ ID NO: 785102 - RNA, 19 nt, Homo sapiens
ugacugcauuugaguauag

SEQ ID NO: 785103 - RNA, 19 nt, Homo sapiens
guaaauucagggauaugua

SEQ ID NO: 785104 - RNA, 19 nt, Homo sapiens
aaagcagucuccaauuuca

SEQ ID NO: 785105 - RNA, 19 nt, Homo sapiens
ucuaagaguucagaaaugu

SEQ ID NO: 785106 - RNA, 19 nt, Homo sapiens
gaagaggagagcucagaau

SEQ ID NO: 785107 - RNA, 19 nt, Homo sapiens
gauccaggagcaacuauga

SEQ ID NO: 785108 - RNA, 19 nt, Homo sapiens
acuaggagguggaauugaa

SEQ ID NO: 785109 - RNA, 19 nt, Homo sapiens
gcaggagaauugcuugaac

SEQ ID NO: 785110 - RNA, 19 nt, Homo sapiens
gaaaccccaucucuacuaa

SEQ ID NO: 785111 - RNA, 19 nt, Homo sapiens
ucaaaugacugccgaucca

SEQ ID NO: 785112 - RNA, 19 nt, Homo sapiens
ccaaaguagacaagauuaa

SEQ ID NO: 785113 - RNA, 19 nt, Homo sapiens
uguagaccaugaugcagua

SEQ ID NO: 785114 - RNA, 19 nt, Homo sapiens
uaaagaggcagcgaacaaa

SEQ ID NO: 785115 - RNA, 19 nt, Homo sapiens
cgaggcagguggaucacuu

SEQ ID NO: 785116 - RNA, 19 nt, Homo sapiens
gaaagucuaagaguucaga

SEQ ID NO: 785117 - RNA, 19 nt, Homo sapiens
acagaaacauggaauuaac

SEQ ID NO: 785118 - RNA, 19 nt, Homo sapiens
agaggaaucuuuguuucaa

SEQ ID NO: 785119 - RNA, 19 nt, Homo sapiens
gaacaaacuaauugaacca

SEQ ID NO: 785120 - RNA, 19 nt, Homo sapiens
gccaaaguagacaagauua

SEQ ID NO: 785121 - RNA, 19 nt, Homo sapiens
ggaauuaacguggcugaca

SEQ ID NO: 785122 - RNA, 19 nt, Homo sapiens
gacaagcagaaauuacuuu

SEQ ID NO: 785123 - RNA, 19 nt, Homo sapiens
caacagaaaacagacauua

SEQ ID NO: 785124 - RNA, 19 nt, Homo sapiens
caaacugcauauucaccuu

SEQ ID NO: 785125 - RNA, 19 nt, Homo sapiens
gugagccacuaaacagaaa

SEQ ID NO: 785126 - RNA, 19 nt, Homo sapiens
ccacauguuacuaaagaaa

SEQ ID NO: 785127 - RNA, 19 nt, Homo sapiens
aacagaaagucuaagaguu

SEQ ID NO: 785128 - RNA, 19 nt, Homo sapiens
ucccacauguuacuaaaga

SEQ ID NO: 785129 - RNA, 19 nt, Homo sapiens
caagaagagcucuaugcaa

SEQ ID NO: 785130 - RNA, 19 nt, Homo sapiens
uaagggaggaauguuuaua

SEQ ID NO: 785131 - RNA, 19 nt, Homo sapiens
aaacagaaagucuaagagu

SEQ ID NO: 785132 - RNA, 19 nt, Homo sapiens
ggaagaggagagcucagaa

SEQ ID NO: 785133 - RNA, 19 nt, Homo sapiens
gcuauugauuaucgauuca

SEQ ID NO: 785134 - RNA, 19 nt, Homo sapiens
ggagccaggaauuugauaa

SEQ ID NO: 785135 - RNA, 19 nt, Homo sapiens
acagaaagucuaagaguuc

SEQ ID NO: 785136 - RNA, 19 nt, Homo sapiens
cuaaacagaaagucuaaga

SEQ ID NO: 785137 - RNA, 19 nt, Homo sapiens
cauauucaccuuuauagca

SEQ ID NO: 785138 - RNA, 19 nt, Homo sapiens
cagaaagucuaagaguuca

SEQ ID NO: 785139 - RNA, 19 nt, Homo sapiens
ggacaacguacuuuaugca

SEQ ID NO: 785140 - RNA, 19 nt, Homo sapiens
uuaaagaggcagcgaacaa

SEQ ID NO: 785141 - RNA, 19 nt, Homo sapiens
auacagaugacaacaagaa

SEQ ID NO: 785142 - RNA, 19 nt, Homo sapiens
ucuaugcaaugucaaagga

SEQ ID NO: 785143 - RNA, 19 nt, Homo sapiens
guggugaauugaugcaaau

SEQ ID NO: 785144 - RNA, 19 nt, Homo sapiens
caacaacaagaauaagcuu

SEQ ID NO: 785145 - RNA, 19 nt, Homo sapiens
uuuaagggaggaauguuua

SEQ ID NO: 785146 - RNA, 19 nt, Homo sapiens
ugagaugccugaaaaugaa

SEQ ID NO: 785147 - RNA, 19 nt, Homo sapiens
gcuucaacaacaagaauaa

SEQ ID NO: 785148 - RNA, 19 nt, Homo sapiens
cagauggagcuacuugauu

SEQ ID NO: 785149 - RNA, 19 nt, Homo sapiens
aggaaucuguaccaucaaa

SEQ ID NO: 785150 - RNA, 19 nt, Homo sapiens
uacagaagcuuuuggagaa

SEQ ID NO: 785151 - RNA, 19 nt, Homo sapiens
gaggaaucuuuguuucaag

SEQ ID NO: 785152 - RNA, 19 nt, Homo sapiens
gaaaggaguacgugauucc

SEQ ID NO: 785153 - RNA, 19 nt, Homo sapiens
gcaguuuccuuguuaauga

SEQ ID NO: 785154 - RNA, 19 nt, Homo sapiens
caacaaacaugaugacaag

SEQ ID NO: 785155 - RNA, 19 nt, Homo sapiens
agacgcaguuuccuuguua

SEQ ID NO: 785156 - RNA, 19 nt, Homo sapiens
agaaggaauugcuguauga

SEQ ID NO: 785157 - RNA, 19 nt, Homo sapiens
ugaaugagcugcgcuaugg

SEQ ID NO: 785158 - RNA, 19 nt, Homo sapiens
ucuacaagcugaccaguga

SEQ ID NO: 785159 - RNA, 19 nt, Homo sapiens
gaagaugcgugcgcccauu

SEQ ID NO: 785160 - RNA, 19 nt, Homo sapiens
gcgagcacuuugugaauga

SEQ ID NO: 785161 - RNA, 19 nt, Homo sapiens
ggcaggaggugcucuacaa

SEQ ID NO: 785162 - RNA, 19 nt, Homo sapiens
gcgagaaaguuguuaaagg

SEQ ID NO: 785163 - RNA, 19 nt, Homo sapiens
gaagaaggaauugcuguau

SEQ ID NO: 785164 - RNA, 19 nt, Homo sapiens
ggguuugguuuguggauuu

SEQ ID NO: 785165 - RNA, 19 nt, Homo sapiens
gaacugcgagcacuuugug

SEQ ID NO: 785166 - RNA, 19 nt, Homo sapiens
gcgaggaagagaucuaauu

SEQ ID NO: 785167 - RNA, 19 nt, Homo sapiens
acaaggccaucgugaagaa

SEQ ID NO: 785168 - RNA, 19 nt, Homo sapiens
gagacgcaguuuccuuguu

SEQ ID NO: 785169 - RNA, 19 nt, Homo sapiens
acaaacaugaugacaagua

SEQ ID NO: 785170 - RNA, 19 nt, Homo sapiens
caaacaugaugacaaguac

SEQ ID NO: 785171 - RNA, 19 nt, Homo sapiens
cgaggaagagaucuaauug

SEQ ID NO: 785172 - RNA, 19 nt, Homo sapiens
ucaagaaacaagcgacaaa

SEQ ID NO: 785173 - RNA, 19 nt, Homo sapiens
gcaaaacgagggaggauuu

SEQ ID NO: 785174 - RNA, 19 nt, Homo sapiens
aggaauugcuguaugaugu

SEQ ID NO: 785175 - RNA, 19 nt, Homo sapiens
aagaaggaauugcuguaug

SEQ ID NO: 785176 - RNA, 19 nt, Homo sapiens
ugaagaaggaauugcugua

SEQ ID NO: 785177 - RNA, 19 nt, Homo sapiens
acaaguaccaggucaacaa

SEQ ID NO: 785178 - RNA, 19 nt, Homo sapiens
cuggagaccugauugagau

SEQ ID NO: 785179 - RNA, 19 nt, Homo sapiens
gcagccaugagccuuauug

SEQ ID NO: 785180 - RNA, 19 nt, Homo sapiens
ugacaaggccaucgugaag

SEQ ID NO: 785181 - RNA, 19 nt, Homo sapiens
ggagaccugauugagauuu

SEQ ID NO: 785182 - RNA, 19 nt, Homo sapiens
gacgcaguuuccuuguuaa

SEQ ID NO: 785183 - RNA, 19 nt, Homo sapiens
acacugggccaucuauguu

SEQ ID NO: 785184 - RNA, 19 nt, Homo sapiens
agacaucuacgcagcgaaa

SEQ ID NO: 785185 - RNA, 19 nt, Homo sapiens
guuuguggauuucauugug

SEQ ID NO: 785186 - RNA, 19 nt, Homo sapiens
guaccaggucaacaacaaa

SEQ ID NO: 785187 - RNA, 19 nt, Homo sapiens
ggaauugcuguaugaugug

SEQ ID NO: 785188 - RNA, 19 nt, Homo sapiens
gacacugggccaucuaugu

SEQ ID NO: 785189 - RNA, 19 nt, Homo sapiens
gagccuuauuggagucaug

SEQ ID NO: 785190 - RNA, 19 nt, Homo sapiens
cgacaaaagcaauaacuga

SEQ ID NO: 785191 - RNA, 19 nt, Homo sapiens
ugagaacugcgagcacuuu

SEQ ID NO: 785192 - RNA, 19 nt, Homo sapiens
cgaggugccugggaugcuu

SEQ ID NO: 785193 - RNA, 19 nt, Homo sapiens
acaacaaacaugaugacaa

SEQ ID NO: 785194 - RNA, 19 nt, Homo sapiens
ucaacaacaaacaugauga

SEQ ID NO: 785195 - RNA, 19 nt, Homo sapiens
gaaacaagcgacaaaagca

SEQ ID NO: 785196 - RNA, 19 nt, Homo sapiens
gagaacugcgagcacuuug

SEQ ID NO: 785197 - RNA, 19 nt, Homo sapiens
ggucaacaacaaacaugau

SEQ ID NO: 785198 - RNA, 19 nt, Homo sapiens
aguaccaggucaacaacaa

SEQ ID NO: 785199 - RNA, 19 nt, Homo sapiens
gaggaagagaucuaauugg

SEQ ID NO: 785200 - RNA, 19 nt, Homo sapiens
caacaacaaacaugaugac

SEQ ID NO: 785201 - RNA, 19 nt, Homo sapiens
gaaggaauugcuguaugau

SEQ ID NO: 785202 - RNA, 19 nt, Homo sapiens
gacaaggccaucgugaaga

SEQ ID NO: 785203 - RNA, 19 nt, Homo sapiens
gagaccugauugagauuuu

SEQ ID NO: 785204 - RNA, 19 nt, Homo sapiens
gacugucugucagcgauga

SEQ ID NO: 785205 - RNA, 19 nt, Homo sapiens
gacaaaagcaauaacugaa

SEQ ID NO: 785206 - RNA, 19 nt, Homo sapiens
guggauuucauugugauuu

SEQ ID NO: 785207 - RNA, 19 nt, Homo sapiens
ggagacgcaguuuccuugu

SEQ ID NO: 785208 - RNA, 19 nt, Homo sapiens
aaucgagccuggccuugag

SEQ ID NO: 785209 - RNA, 19 nt, Homo sapiens
gugaaugagcugcgcuaug

SEQ ID NO: 785210 - RNA, 19 nt, Homo sapiens
uaaagggagcgaggugguu

SEQ ID NO: 785211 - RNA, 19 nt, Homo sapiens
uuuguggauuucauuguga

SEQ ID NO: 785212 - RNA, 19 nt, Homo sapiens
gcaggaggugcucuacaag

SEQ ID NO: 785213 - RNA, 19 nt, Homo sapiens
ccuggagaccugauugaga

SEQ ID NO: 785214 - RNA, 19 nt, Homo sapiens
gagaagagaucccuaauau

SEQ ID NO: 785215 - RNA, 19 nt, Homo sapiens
ggacagaacuuggaaauau

SEQ ID NO: 785216 - RNA, 19 nt, Homo sapiens
aaacagauaucccaaagua

SEQ ID NO: 785217 - RNA, 19 nt, Homo sapiens
gcacacagaccagcuauua

SEQ ID NO: 785218 - RNA, 19 nt, Homo sapiens
gaccagcuauuagaaauua

SEQ ID NO: 785219 - RNA, 19 nt, Homo sapiens
gagcaagacuuuaaagaag

SEQ ID NO: 785220 - RNA, 19 nt, Homo sapiens
gaaacuaggagaaauaaga

SEQ ID NO: 785221 - RNA, 19 nt, Homo sapiens
ggaagaacucauugaaaua

SEQ ID NO: 785222 - RNA, 19 nt, Homo sapiens
gaagagaucccuaauaugc

SEQ ID NO: 785223 - RNA, 19 nt, Homo sapiens
aaagagaugucaaauccua

SEQ ID NO: 785224 - RNA, 19 nt, Homo sapiens
guacagggcauccauauug

SEQ ID NO: 785225 - RNA, 19 nt, Homo sapiens
gcaaagaugcauagaagaa

SEQ ID NO: 785226 - RNA, 19 nt, Homo sapiens
gagaacacguaacaacaaa

SEQ ID NO: 785227 - RNA, 19 nt, Homo sapiens
uggaagaagucauugauaa

SEQ ID NO: 785228 - RNA, 19 nt, Homo sapiens
gauuggagcugcuggagaa

SEQ ID NO: 785229 - RNA, 19 nt, Homo sapiens
uaauaugccuccugaaaug

SEQ ID NO: 785230 - RNA, 19 nt, Homo sapiens
gaaacagauuuacugcaaa

SEQ ID NO: 785231 - RNA, 19 nt, Homo sapiens
gggcaaagaugcauagaag

SEQ ID NO: 785232 - RNA, 19 nt, Homo sapiens
ggagaagagaucccuaaua

SEQ ID NO: 785233 - RNA, 19 nt, Homo sapiens
gaaaugcccuuugcugaca

SEQ ID NO: 785234 - RNA, 19 nt, Homo sapiens
gaacuuggaauuaccuuga

SEQ ID NO: 785235 - RNA, 19 nt, Homo sapiens
gacagaacuuggaaauauu

SEQ ID NO: 785236 - RNA, 19 nt, Homo sapiens
uggaagaacucauugaaau

SEQ ID NO: 785237 - RNA, 19 nt, Homo sapiens
ggaaucagcuaucucuucu

SEQ ID NO: 785238 - RNA, 19 nt, Homo sapiens
aagaauggcuguagaggaa

SEQ ID NO: 785239 - RNA, 19 nt, Homo sapiens
aaacaaagucuaccucuga

SEQ ID NO: 785240 - RNA, 19 nt, Homo sapiens
ugauuucccuucuugauuu

SEQ ID NO: 785241 - RNA, 19 nt, Homo sapiens
agaauaaggucaucaucaa

SEQ ID NO: 785242 - RNA, 19 nt, Homo sapiens
ucaguuagcugggcaaaga

SEQ ID NO: 785243 - RNA, 19 nt, Homo sapiens
agaaacagauuuacugcaa

SEQ ID NO: 785244 - RNA, 19 nt, Homo sapiens
gcaaagaacagaagagucu

SEQ ID NO: 785245 - RNA, 19 nt, Homo sapiens
ugaagaagguggaaaugau

SEQ ID NO: 785246 - RNA, 19 nt, Homo sapiens
gaacacguaacaacaaaug

SEQ ID NO: 785247 - RNA, 19 nt, Homo sapiens
guuaaaggaugaauuacug

SEQ ID NO: 785248 - RNA, 19 nt, Homo sapiens
uagaagagcaagacuuuaa

SEQ ID NO: 785249 - RNA, 19 nt, Homo sapiens
gaacuuggaaauauugaga

SEQ ID NO: 785250 - RNA, 19 nt, Homo sapiens
gcacaauucuuugaacagu

SEQ ID NO: 785251 - RNA, 19 nt, Homo sapiens
gaugucaaauccuagaaga

SEQ ID NO: 785252 - RNA, 19 nt, Homo sapiens
gaaauaagaauggcuguag

SEQ ID NO: 785253 - RNA, 19 nt, Homo sapiens
guaaaguuaugcaauccaa

SEQ ID NO: 785254 - RNA, 19 nt, Homo sapiens
gagaauagaagacaauagu

SEQ ID NO: 785255 - RNA, 19 nt, Homo sapiens
aaagagaacuuggaauuac

SEQ ID NO: 785256 - RNA, 19 nt, Homo sapiens
caaggcauauucaauugga

SEQ ID NO: 785257 - RNA, 19 nt, Homo sapiens
uggcauaucuaguauuugu

SEQ ID NO: 785258 - RNA, 19 nt, Homo sapiens
gaagaagucauugauaaca

SEQ ID NO: 785259 - RNA, 19 nt, Homo sapiens
gcaaggccuuaauagaguu

SEQ ID NO: 785260 - RNA, 19 nt, Homo sapiens
ggaacuucagucuauaaua

SEQ ID NO: 785261 - RNA, 19 nt, Homo sapiens
cgaggguucuggccgauuu

SEQ ID NO: 785262 - RNA, 19 nt, Homo sapiens
acagauaucccaaaguauu

SEQ ID NO: 785263 - RNA, 19 nt, Homo sapiens
aaagaaaacucacuggaaa

SEQ ID NO: 785264 - RNA, 19 nt, Homo sapiens
aaacagugauucagaaacu

SEQ ID NO: 785265 - RNA, 19 nt, Homo sapiens
gaaaacagauaucccaaag

SEQ ID NO: 785266 - RNA, 19 nt, Homo sapiens
gaucuuuguucuauaacug

SEQ ID NO: 785267 - RNA, 19 nt, Homo sapiens
ucuggcauaucuaguauuu

SEQ ID NO: 785268 - RNA, 19 nt, Homo sapiens
caaagucuaccucugaaga

SEQ ID NO: 785269 - RNA, 19 nt, Homo sapiens
gaggaacuucagucuauaa

SEQ ID NO: 785270 - RNA, 19 nt, Homo sapiens
caagaggcccagaaaucua

SEQ ID NO: 785271 - RNA, 19 nt, Homo sapiens
auaaagagaugucaaaucc

SEQ ID NO: 785272 - RNA, 19 nt, Homo sapiens
ggaugacuauggccuuugu

SEQ ID NO: 785273 - RNA, 19 nt, Homo sapiens
ucagaaacuucauaacaag

SEQ ID NO: 785274 - RNA, 19 nt, Homo sapiens
guuaugcaauccaaaggaa

SEQ ID NO: 785275 - RNA, 19 nt, Homo sapiens
ucaagaauaugggcuggaa

SEQ ID NO: 785276 - RNA, 19 nt, Homo sapiens
gaagaagguggaaaugauc

SEQ ID NO: 785277 - RNA, 19 nt, Homo sapiens
gcaagacuuuaaagaagag

SEQ ID NO: 785278 - RNA, 19 nt, Homo sapiens
cagaccagcuauuagaaau

SEQ ID NO: 785279 - RNA, 19 nt, Homo sapiens
ccuaauaugccuccugaaa

SEQ ID NO: 785280 - RNA, 19 nt, Homo sapiens
uaaagccacuucauauagg

SEQ ID NO: 785281 - RNA, 19 nt, Homo sapiens
aaucagcuaucucuucuuc

SEQ ID NO: 785282 - RNA, 19 nt, Homo sapiens
uacaaacagugauucagaa

SEQ ID NO: 785283 - RNA, 19 nt, Homo sapiens
gcaauccaaaggaauuauu

SEQ ID NO: 785284 - RNA, 19 nt, Homo sapiens
acacagaccagcuauuaga

SEQ ID NO: 785285 - RNA, 19 nt, Homo sapiens
ggauuauggcuucauuaaa

SEQ ID NO: 785286 - RNA, 19 nt, Homo sapiens
ccuagaagagcaagacuuu

SEQ ID NO: 785287 - RNA, 19 nt, Homo sapiens
guaaagauaaagaggauag

SEQ ID NO: 785288 - RNA, 19 nt, Homo sapiens
cguaacaacaaaugguuua

SEQ ID NO: 785289 - RNA, 19 nt, Homo sapiens
ugcuucagcuguauauuaa

SEQ ID NO: 785290 - RNA, 19 nt, Homo sapiens
caucgaaacuaggagaaau

SEQ ID NO: 785291 - RNA, 19 nt, Homo sapiens
aaaacucacuggaaaauga

SEQ ID NO: 785292 - RNA, 19 nt, Homo sapiens
gaagagcaagacuuuaaag

SEQ ID NO: 785293 - RNA, 19 nt, Homo sapiens
gccaagaggcccagaaauc

SEQ ID NO: 785294 - RNA, 19 nt, Homo sapiens
ugagguauuugguuaucaa

SEQ ID NO: 785295 - RNA, 19 nt, Homo sapiens
aaacucagauaggauuaug

SEQ ID NO: 785296 - RNA, 19 nt, Homo sapiens
aaauaagaauggcuguaga

SEQ ID NO: 785297 - RNA, 19 nt, Homo sapiens
gaaucucguugguccuguu

SEQ ID NO: 785298 - RNA, 19 nt, Homo sapiens
cuuaaagccacuucauaua

SEQ ID NO: 785299 - RNA, 19 nt, Homo sapiens
ugaacagucugaagaaggu

SEQ ID NO: 785300 - RNA, 19 nt, Homo sapiens
cagcacaauucuuugaaca

SEQ ID NO: 785301 - RNA, 19 nt, Homo sapiens
ugacagcacaauucuuuga

SEQ ID NO: 785302 - RNA, 19 nt, Homo sapiens
aacaaggcauauucaauug

SEQ ID NO: 785303 - RNA, 19 nt, Homo sapiens
agagcaagacuuuaaagaa

SEQ ID NO: 785304 - RNA, 19 nt, Homo sapiens
uuaagcccauuguaccuuu

SEQ ID NO: 785305 - RNA, 19 nt, Homo sapiens
gauugaaaguguucuagcu

SEQ ID NO: 785306 - RNA, 19 nt, Homo sapiens
ggauucacaaggcaaauau

SEQ ID NO: 785307 - RNA, 19 nt, Homo sapiens
guacuuagaaaucaagagu

SEQ ID NO: 785308 - RNA, 19 nt, Homo sapiens
ucuguuaucuccaaaggau

SEQ ID NO: 785309 - RNA, 19 nt, Homo sapiens
acaguuagcagacucaaug

SEQ ID NO: 785310 - RNA, 19 nt, Homo sapiens
ggaagaagucauugauaac

SEQ ID NO: 785311 - RNA, 19 nt, Homo sapiens
guguaaagauaaagaggau

SEQ ID NO: 785312 - RNA, 19 nt, Homo sapiens
uuaaagccacuucauauag

SEQ ID NO: 785313 - RNA, 19 nt, Homo sapiens
caguugauuucccuucuug

SEQ ID NO: 785314 - RNA, 19 nt, Homo sapiens
gagaagagaucccuaauau

SEQ ID NO: 785315 - RNA, 19 nt, Homo sapiens
ggacagaacuuggaaauau

SEQ ID NO: 785316 - RNA, 19 nt, Homo sapiens
aaacagauaucccaaagua

SEQ ID NO: 785317 - RNA, 19 nt, Homo sapiens
gcacacagaccagcuauua

SEQ ID NO: 785318 - RNA, 19 nt, Homo sapiens
gaccagcuauuagaaauua

SEQ ID NO: 785319 - RNA, 19 nt, Homo sapiens
gagcaagacuuuaaagaag

SEQ ID NO: 785320 - RNA, 19 nt, Homo sapiens
gaaacuaggagaaauaaga

SEQ ID NO: 785321 - RNA, 19 nt, Homo sapiens
ggaagaacucauugaaaua

SEQ ID NO: 785322 - RNA, 19 nt, Homo sapiens
gaagagaucccuaauaugc

SEQ ID NO: 785323 - RNA, 19 nt, Homo sapiens
aaagagaugucaaauccua

SEQ ID NO: 785324 - RNA, 19 nt, Homo sapiens
guacagggcauccauauug

SEQ ID NO: 785325 - RNA, 19 nt, Homo sapiens
gcaaagaugcauagaagaa

SEQ ID NO: 785326 - RNA, 19 nt, Homo sapiens
gagaacacguaacaacaaa

SEQ ID NO: 785327 - RNA, 19 nt, Homo sapiens
uggaagaagucauugauaa

SEQ ID NO: 785328 - RNA, 19 nt, Homo sapiens
gauuggagcugcuggagaa

SEQ ID NO: 785329 - RNA, 19 nt, Homo sapiens
uaauaugccuccugaaaug

SEQ ID NO: 785330 - RNA, 19 nt, Homo sapiens
gaaacagauuuacugcaaa

SEQ ID NO: 785331 - RNA, 19 nt, Homo sapiens
gggcaaagaugcauagaag

SEQ ID NO: 785332 - RNA, 19 nt, Homo sapiens
ggagaagagaucccuaaua

SEQ ID NO: 785333 - RNA, 19 nt, Homo sapiens
gaaaugcccuuugcugaca

SEQ ID NO: 785334 - RNA, 19 nt, Homo sapiens
gaauacaaguaaucacuca

SEQ ID NO: 785335 - RNA, 19 nt, Homo sapiens
gaacuuggaauuaccuuga

SEQ ID NO: 785336 - RNA, 19 nt, Homo sapiens
gacagaacuuggaaauauu

SEQ ID NO: 785337 - RNA, 19 nt, Homo sapiens
uggaagaacucauugaaau

SEQ ID NO: 785338 - RNA, 19 nt, Homo sapiens
ggaaucagcuaucucuucu

SEQ ID NO: 785339 - RNA, 19 nt, Homo sapiens
aagaauggcuguagaggaa

SEQ ID NO: 785340 - RNA, 19 nt, Homo sapiens
aaacaaagucuaccucuga

SEQ ID NO: 785341 - RNA, 19 nt, Homo sapiens
ugauuucccuucuugauuu

SEQ ID NO: 785342 - RNA, 19 nt, Homo sapiens
agaauaaggucaucaucaa

SEQ ID NO: 785343 - RNA, 19 nt, Homo sapiens
ucaguuagcugggcaaaga

SEQ ID NO: 785344 - RNA, 19 nt, Homo sapiens
agaaacagauuuacugcaa

SEQ ID NO: 785345 - RNA, 19 nt, Homo sapiens
gcaaagaacagaagagucu

SEQ ID NO: 785346 - RNA, 19 nt, Homo sapiens
ugaagaagguggaaaugau

SEQ ID NO: 785347 - RNA, 19 nt, Homo sapiens
gaacacguaacaacaaaug

SEQ ID NO: 785348 - RNA, 19 nt, Homo sapiens
guuaaaggaugaauuacug

SEQ ID NO: 785349 - RNA, 19 nt, Homo sapiens
uagaagagcaagacuuuaa

SEQ ID NO: 785350 - RNA, 19 nt, Homo sapiens
gaacuuggaaauauugaga

SEQ ID NO: 785351 - RNA, 19 nt, Homo sapiens
gcacaauucuuugaacagu

SEQ ID NO: 785352 - RNA, 19 nt, Homo sapiens
gaugucaaauccuagaaga

SEQ ID NO: 785353 - RNA, 19 nt, Homo sapiens
gaaauaagaauggcuguag

SEQ ID NO: 785354 - RNA, 19 nt, Homo sapiens
guaaaguuaugcaauccaa

SEQ ID NO: 785355 - RNA, 19 nt, Homo sapiens
gagaauagaagacaauagu

SEQ ID NO: 785356 - RNA, 19 nt, Homo sapiens
aaagagaacuuggaauuac

SEQ ID NO: 785357 - RNA, 19 nt, Homo sapiens
caaggcauauucaauugga

SEQ ID NO: 785358 - RNA, 19 nt, Homo sapiens
uggcauaucuaguauuugu

SEQ ID NO: 785359 - RNA, 19 nt, Homo sapiens
gaagaagucauugauaaca

SEQ ID NO: 785360 - RNA, 19 nt, Homo sapiens
gcaaggccuuaauagaguu

SEQ ID NO: 785361 - RNA, 19 nt, Homo sapiens
ggaacuucagucuauaaua

SEQ ID NO: 785362 - RNA, 19 nt, Homo sapiens
cgaggguucuggccgauuu

SEQ ID NO: 785363 - RNA, 19 nt, Homo sapiens
acagauaucccaaaguauu

SEQ ID NO: 785364 - RNA, 19 nt, Homo sapiens
aaagaaaacucacuggaaa

SEQ ID NO: 785365 - RNA, 19 nt, Homo sapiens
aaacagugauucagaaacu

SEQ ID NO: 785366 - RNA, 19 nt, Homo sapiens
gaaaacagauaucccaaag

SEQ ID NO: 785367 - RNA, 19 nt, Homo sapiens
gaucuuuguucuauaacug

SEQ ID NO: 785368 - RNA, 19 nt, Homo sapiens
ucuggcauaucuaguauuu

SEQ ID NO: 785369 - RNA, 19 nt, Homo sapiens
caaagucuaccucugaaga

SEQ ID NO: 785370 - RNA, 19 nt, Homo sapiens
caagaggcccagaaaucua

SEQ ID NO: 785371 - RNA, 19 nt, Homo sapiens
gacaugucauuaaagagaa

SEQ ID NO: 785372 - RNA, 19 nt, Homo sapiens
auaaagagaugucaaaucc

SEQ ID NO: 785373 - RNA, 19 nt, Homo sapiens
gaggaacuucagucuauaa

SEQ ID NO: 785374 - RNA, 19 nt, Homo sapiens
ggaugacuauggccuuugu

SEQ ID NO: 785375 - RNA, 19 nt, Homo sapiens
ucagaaacuucauaacaag

SEQ ID NO: 785376 - RNA, 19 nt, Homo sapiens
guuaugcaauccaaaggaa

SEQ ID NO: 785377 - RNA, 19 nt, Homo sapiens
ucaagaauaugggcuggaa

SEQ ID NO: 785378 - RNA, 19 nt, Homo sapiens
gaagaagguggaaaugauc

SEQ ID NO: 785379 - RNA, 19 nt, Homo sapiens
gcaagacuuuaaagaagag

SEQ ID NO: 785380 - RNA, 19 nt, Homo sapiens
cagaccagcuauuagaaau

SEQ ID NO: 785381 - RNA, 19 nt, Homo sapiens
ccuaauaugccuccugaaa

SEQ ID NO: 785382 - RNA, 19 nt, Homo sapiens
uaaagccacuucauauagg

SEQ ID NO: 785383 - RNA, 19 nt, Homo sapiens
aaucagcuaucucuucuuc

SEQ ID NO: 785384 - RNA, 19 nt, Homo sapiens
uacaaacagugauucagaa

SEQ ID NO: 785385 - RNA, 19 nt, Homo sapiens
gcaauccaaaggaauuauu

SEQ ID NO: 785386 - RNA, 19 nt, Homo sapiens
acacagaccagcuauuaga

SEQ ID NO: 785387 - RNA, 19 nt, Homo sapiens
ggauuauggcuucauuaaa

SEQ ID NO: 785388 - RNA, 19 nt, Homo sapiens
ccuagaagagcaagacuuu

SEQ ID NO: 785389 - RNA, 19 nt, Homo sapiens
guaaagauaaagaggauag

SEQ ID NO: 785390 - RNA, 19 nt, Homo sapiens
cguaacaacaaaugguuua

SEQ ID NO: 785391 - RNA, 19 nt, Homo sapiens
ugcuucagcuguauauuaa

SEQ ID NO: 785392 - RNA, 19 nt, Homo sapiens
caucgaaacuaggagaaau

SEQ ID NO: 785393 - RNA, 19 nt, Homo sapiens
aaaacucacuggaaaauga

SEQ ID NO: 785394 - RNA, 19 nt, Homo sapiens
aaauaagaauggcuguaga

SEQ ID NO: 785395 - RNA, 19 nt, Homo sapiens
gccaagaggcccagaaauc

SEQ ID NO: 785396 - RNA, 19 nt, Homo sapiens
ugagguauuugguuaucaa

SEQ ID NO: 785397 - RNA, 19 nt, Homo sapiens
aaacucagauaggauuaug

SEQ ID NO: 785398 - RNA, 19 nt, Homo sapiens
uuaaagagaacacguaaca

SEQ ID NO: 785399 - RNA, 19 nt, Homo sapiens
gaagagcaagacuuuaaag

SEQ ID NO: 785400 - RNA, 19 nt, Homo sapiens
gaaucucguugguccuguu

SEQ ID NO: 785401 - RNA, 19 nt, Homo sapiens
cuuaaagccacuucauaua

SEQ ID NO: 785402 - RNA, 19 nt, Homo sapiens
ugaacagucugaagaaggu

SEQ ID NO: 785403 - RNA, 19 nt, Homo sapiens
cagcacaauucuuugaaca

SEQ ID NO: 785404 - RNA, 19 nt, Homo sapiens
ugacagcacaauucuuuga

SEQ ID NO: 785405 - RNA, 19 nt, Homo sapiens
aacaaggcauauucaauug

SEQ ID NO: 785406 - RNA, 19 nt, Homo sapiens
agagcaagacuuuaaagaa

SEQ ID NO: 785407 - RNA, 19 nt, Homo sapiens
uuaagcccauuguaccuuu

SEQ ID NO: 785408 - RNA, 19 nt, Homo sapiens
gauugaaaguguucuagcu

SEQ ID NO: 785409 - RNA, 19 nt, Homo sapiens
ggauucacaaggcaaauau

SEQ ID NO: 785410 - RNA, 19 nt, Homo sapiens
guacuuagaaaucaagagu

SEQ ID NO: 785411 - RNA, 19 nt, Homo sapiens
ucuguuaucuccaaaggau

SEQ ID NO: 785412 - RNA, 19 nt, Homo sapiens
acaguuagcagacucaaug

SEQ ID NO: 785413 - RNA, 19 nt, Homo sapiens
ggaagaagucauugauaac

SEQ ID NO: 785414 - RNA, 19 nt, Homo sapiens
gcagaggaaugcagaauga

SEQ ID NO: 785415 - RNA, 19 nt, Homo sapiens
caccuuaacugagcgauua

SEQ ID NO: 785416 - RNA, 19 nt, Homo sapiens
gaaagaauuugaggcgaau

SEQ ID NO: 785417 - RNA, 19 nt, Homo sapiens
ccugugaccugcauguaua

SEQ ID NO: 785418 - RNA, 19 nt, Homo sapiens
ugaagcaagugaagaauca

SEQ ID NO: 785419 - RNA, 19 nt, Homo sapiens
aaacaaugcuuagugaugu

SEQ ID NO: 785420 - RNA, 19 nt, Homo sapiens
gcgauuaaccugugaacuu

SEQ ID NO: 785421 - RNA, 19 nt, Homo sapiens
gaucaaacaaugcuuagug

SEQ ID NO: 785422 - RNA, 19 nt, Homo sapiens
ugccuuaacugaugacauu

SEQ ID NO: 785423 - RNA, 19 nt, Homo sapiens
caaacaaugcuuagugaug

SEQ ID NO: 785424 - RNA, 19 nt, Homo sapiens
gaguaagcaaggcaaguua

SEQ ID NO: 785425 - RNA, 19 nt, Homo sapiens
cgauuaaccugugaacuuc

SEQ ID NO: 785426 - RNA, 19 nt, Homo sapiens
gauacucagucaaccaaca

SEQ ID NO: 785427 - RNA, 19 nt, Homo sapiens
ucaccgagaugcagaggau

SEQ ID NO: 785428 - RNA, 19 nt, Homo sapiens
cagauggccugaagcaagu

SEQ ID NO: 785429 - RNA, 19 nt, Homo sapiens
guuccugccuuaacugaug

SEQ ID NO: 785430 - RNA, 19 nt, Homo sapiens
ccuuacagaucaaacaaug

SEQ ID NO: 785431 - RNA, 19 nt, Homo sapiens
acagaucaaacaaugcuua

SEQ ID NO: 785432 - RNA, 19 nt, Homo sapiens
ggugcacccuuacagauca

SEQ ID NO: 785433 - RNA, 19 nt, Homo sapiens
uauguucggugcauguuau

SEQ ID NO: 785434 - RNA, 19 nt, Homo sapiens
ccacagccuccguuggaua

SEQ ID NO: 785435 - RNA, 19 nt, Homo sapiens
cugaugacauuccaccauu

SEQ ID NO: 785436 - RNA, 19 nt, Homo sapiens
ugacauuccaccauuguga

SEQ ID NO: 785437 - RNA, 19 nt, Homo sapiens
gacacucucuuuggacuca

SEQ ID NO: 785438 - RNA, 19 nt, Homo sapiens
ccaccauugugauuuguuc

SEQ ID NO: 785439 - RNA, 19 nt, Homo sapiens
gagcauucuuggaucucuu

SEQ ID NO: 785440 - RNA, 19 nt, Homo sapiens
gaggcgaauccauagagua

SEQ ID NO: 785441 - RNA, 19 nt, Homo sapiens
ccaagcaaagccaucauau

SEQ ID NO: 785442 - RNA, 19 nt, Homo sapiens
caacauuuacugagcaucu

SEQ ID NO: 785443 - RNA, 19 nt, Homo sapiens
guucggugcauguuauaaa

SEQ ID NO: 785444 - RNA, 19 nt, Homo sapiens
gcgaauccauagaguaagc

SEQ ID NO: 785445 - RNA, 19 nt, Homo sapiens
aggcgaauccauagaguaa

SEQ ID NO: 785446 - RNA, 19 nt, Homo sapiens
ccucugagcccaagcaaag

SEQ ID NO: 785447 - RNA, 19 nt, Homo sapiens
gaugacauuccaccauugu

SEQ ID NO: 785448 - RNA, 19 nt, Homo sapiens
ugaugacauuccaccauug

SEQ ID NO: 785449 - RNA, 19 nt, Homo sapiens
caagcaaagccaucauauc

SEQ ID NO: 785450 - RNA, 19 nt, Homo sapiens
aauuugaggcgaauccaua

SEQ ID NO: 785451 - RNA, 19 nt, Homo sapiens
gagaugcagaggauacuca

SEQ ID NO: 785452 - RNA, 19 nt, Homo sapiens
gcacgcaggaugugauguc

SEQ ID NO: 785453 - RNA, 19 nt, Homo sapiens
ggauauguucggugcaugu

SEQ ID NO: 785454 - RNA, 19 nt, Homo sapiens
aucaaacaaugcuuaguga

SEQ ID NO: 785455 - RNA, 19 nt, Homo sapiens
cuacccaaauccuauaaaa

SEQ ID NO: 785456 - RNA, 19 nt, Homo sapiens
cucagucaaccaacauuua

SEQ ID NO: 785457 - RNA, 19 nt, Homo sapiens
aagcaaagccaucauaucc

SEQ ID NO: 785458 - RNA, 19 nt, Homo sapiens
cccaagcaaagccaucaua

SEQ ID NO: 785459 - RNA, 19 nt, Homo sapiens
agagagcauucuuggaucu

SEQ ID NO: 785460 - RNA, 19 nt, Homo sapiens
gccugaagcaagugaagaa

SEQ ID NO: 785461 - RNA, 19 nt, Homo sapiens
uuaccuacccaaauccuau

SEQ ID NO: 785462 - RNA, 19 nt, Homo sapiens
auucuuggaucucuugcaa

SEQ ID NO: 785463 - RNA, 19 nt, Homo sapiens
agaguaagcaaggcaaguu

SEQ ID NO: 785464 - RNA, 19 nt, Homo sapiens
cagccuccguuggauaugu

SEQ ID NO: 785465 - RNA, 19 nt, Homo sapiens
gcagaggauacucagucaa

SEQ ID NO: 785466 - RNA, 19 nt, Homo sapiens
gauauguucggugcauguu

SEQ ID NO: 785467 - RNA, 19 nt, Homo sapiens
ugaggcgaauccauagagu

SEQ ID NO: 785468 - RNA, 19 nt, Homo sapiens
aaccacagccuccguugga

SEQ ID NO: 785469 - RNA, 19 nt, Homo sapiens
gaauuugaggcgaauccau

SEQ ID NO: 785470 - RNA, 19 nt, Homo sapiens
cagaggauacucagucaac

SEQ ID NO: 785471 - RNA, 19 nt, Homo sapiens
aacauuuacugagcaucua

SEQ ID NO: 785472 - RNA, 19 nt, Homo sapiens
gcuauaagguucacaguua

SEQ ID NO: 785473 - RNA, 19 nt, Homo sapiens
gcaaagaguuguaaccauu

SEQ ID NO: 785474 - RNA, 19 nt, Homo sapiens
gaacacaaacagcuucuua

SEQ ID NO: 785475 - RNA, 19 nt, Homo sapiens
gaacaaaucgucauuggaa

SEQ ID NO: 785476 - RNA, 19 nt, Homo sapiens
ggacaucccuuuucuauaa

SEQ ID NO: 785477 - RNA, 19 nt, Homo sapiens
gaaaagaacugucucauuc

SEQ ID NO: 785478 - RNA, 19 nt, Homo sapiens
gaaacagggucuuuggauu

SEQ ID NO: 785479 - RNA, 19 nt, Homo sapiens
gaacagcaauucaagugau

SEQ ID NO: 785480 - RNA, 19 nt, Homo sapiens
gaguggaucucaaggcaua

SEQ ID NO: 785481 - RNA, 19 nt, Homo sapiens
uaacaaaggcuuauggauu

SEQ ID NO: 785482 - RNA, 19 nt, Homo sapiens
gaagguacuuuguaaucuu

SEQ ID NO: 785483 - RNA, 19 nt, Homo sapiens
aacaaaggcuuauggauuu

SEQ ID NO: 785484 - RNA, 19 nt, Homo sapiens
acaaagagcugauaaacca

SEQ ID NO: 785485 - RNA, 19 nt, Homo sapiens
cuaagaaucuggaagaaau

SEQ ID NO: 785486 - RNA, 19 nt, Homo sapiens
caacacaccuaucucugaa

SEQ ID NO: 785487 - RNA, 19 nt, Homo sapiens
caaacaaaguggugcuaaa

SEQ ID NO: 785488 - RNA, 19 nt, Homo sapiens
gaaagauggccuucauaaa

SEQ ID NO: 785489 - RNA, 19 nt, Homo sapiens
auaaaugccuggauguuaa

SEQ ID NO: 785490 - RNA, 19 nt, Homo sapiens
gcaaacaggacaucccuuu

SEQ ID NO: 785491 - RNA, 19 nt, Homo sapiens
gaacgcaccuccucugcau

SEQ ID NO: 785492 - RNA, 19 nt, Homo sapiens
agaacugucucauucauuu

SEQ ID NO: 785493 - RNA, 19 nt, Homo sapiens
uaaaguaacugaagaucca

SEQ ID NO: 785494 - RNA, 19 nt, Homo sapiens
gcauguaggagaauacuaa

SEQ ID NO: 785495 - RNA, 19 nt, Homo sapiens
gaacugucucauucauuua

SEQ ID NO: 785496 - RNA, 19 nt, Homo sapiens
cuaccugcauugaguauaa

SEQ ID NO: 785497 - RNA, 19 nt, Homo sapiens
gaaacagcuucccauaaca

SEQ ID NO: 785498 - RNA, 19 nt, Homo sapiens
caagaaacagcuucccaua

SEQ ID NO: 785499 - RNA, 19 nt, Homo sapiens
caaagucaccuuaguggaa

SEQ ID NO: 785500 - RNA, 19 nt, Homo sapiens
gaacaaagagcugauaaac

SEQ ID NO: 785501 - RNA, 19 nt, Homo sapiens
uggaagaaaugcaucacua

SEQ ID NO: 785502 - RNA, 19 nt, Homo sapiens
cacaaacagcuucuuaaua

SEQ ID NO: 785503 - RNA, 19 nt, Homo sapiens
caagaugauugauuugaca

SEQ ID NO: 785504 - RNA, 19 nt, Homo sapiens
gaaaccaagaugauugauu

SEQ ID NO: 785505 - RNA, 19 nt, Homo sapiens
cucaugaccugcauccuua

SEQ ID NO: 785506 - RNA, 19 nt, Homo sapiens
agaaacagcuucccauaac

SEQ ID NO: 785507 - RNA, 19 nt, Homo sapiens
uauaaaugccuggauguua

SEQ ID NO: 785508 - RNA, 19 nt, Homo sapiens
ggaacaaagagcugauaaa

SEQ ID NO: 785509 - RNA, 19 nt, Homo sapiens
gauccgaagucguaauaca

SEQ ID NO: 785510 - RNA, 19 nt, Homo sapiens
ugaccugcauccuuaauau

SEQ ID NO: 785511 - RNA, 19 nt, Homo sapiens
ugauggaucuuaaucuuuc

SEQ ID NO: 785512 - RNA, 19 nt, Homo sapiens
acagggcgcuggacgauga

SEQ ID NO: 785513 - RNA, 19 nt, Homo sapiens
cacccuaacugaucaaugu

SEQ ID NO: 785514 - RNA, 19 nt, Homo sapiens
gucaaccuguaaaugauua

SEQ ID NO: 785515 - RNA, 19 nt, Homo sapiens
caaacagcuucuuaauaug

SEQ ID NO: 785516 - RNA, 19 nt, Homo sapiens
gcaauucaagugauuacaa

SEQ ID NO: 785517 - RNA, 19 nt, Homo sapiens
ugauugauuugacaaggua

SEQ ID NO: 785518 - RNA, 19 nt, Homo sapiens
ggauuccaauuuaacuuug

SEQ ID NO: 785519 - RNA, 19 nt, Homo sapiens
ggaucaaauucaucuuaug

SEQ ID NO: 785520 - RNA, 19 nt, Homo sapiens
ccacuaagaaucuggaaga

SEQ ID NO: 785521 - RNA, 19 nt, Homo sapiens
ggaaaugagagaagacugu

SEQ ID NO: 785522 - RNA, 19 nt, Homo sapiens
ugacuucucuaugaauuug

SEQ ID NO: 785523 - RNA, 19 nt, Homo sapiens
caggaucaaauucaucuua

SEQ ID NO: 785524 - RNA, 19 nt, Homo sapiens
gcauauucccuuuggcuuu

SEQ ID NO: 785525 - RNA, 19 nt, Homo sapiens
gagccaaagucaccuuagu

SEQ ID NO: 785526 - RNA, 19 nt, Homo sapiens
caaagaguuguaaccauuu

SEQ ID NO: 785527 - RNA, 19 nt, Homo sapiens
caugucaaccuguaaauga

SEQ ID NO: 785528 - RNA, 19 nt, Homo sapiens
ggacaacacaccuaucucu

SEQ ID NO: 785529 - RNA, 19 nt, Homo sapiens
ugauggagcccaacaagaa

SEQ ID NO: 785530 - RNA, 19 nt, Homo sapiens
agccuuaacugaugacauu

SEQ ID NO: 785531 - RNA, 19 nt, Homo sapiens
gauguggaauauacuaaag

SEQ ID NO: 785532 - RNA, 19 nt, Homo sapiens
ggaaaaguauaggaaauga

SEQ ID NO: 785533 - RNA, 19 nt, Homo sapiens
caauauuucuucggaugaa

SEQ ID NO: 785534 - RNA, 19 nt, Homo sapiens
aagccaagaucccagauau

SEQ ID NO: 785535 - RNA, 19 nt, Homo sapiens
ggccuaaaguaacugaaga

SEQ ID NO: 785536 - RNA, 19 nt, Homo sapiens
uauaugaacgguuguauca

SEQ ID NO: 785537 - RNA, 19 nt, Homo sapiens
aaagucaccuuaguggaaa

SEQ ID NO: 785538 - RNA, 19 nt, Homo sapiens
gaacacguuucacucucau

SEQ ID NO: 785539 - RNA, 19 nt, Homo sapiens
gaauuuacaccugcuaugu

SEQ ID NO: 785540 - RNA, 19 nt, Homo sapiens
gggauccgaagucguaaua

SEQ ID NO: 785541 - RNA, 19 nt, Homo sapiens
acuaauauguucugcacaa

SEQ ID NO: 785542 - RNA, 19 nt, Homo sapiens
guuacuugguccagaauga

SEQ ID NO: 785543 - RNA, 19 nt, Homo sapiens
auuaacagcccacugaaua

SEQ ID NO: 785544 - RNA, 19 nt, Homo sapiens
cuuaauaugcagcguguua

SEQ ID NO: 785545 - RNA, 19 nt, Homo sapiens
gcagugaccauuuggaaag

SEQ ID NO: 785546 - RNA, 19 nt, Homo sapiens
ggaagaaaugcaucacuag

SEQ ID NO: 785547 - RNA, 19 nt, Homo sapiens
agaagacugugacaacuca

SEQ ID NO: 785548 - RNA, 19 nt, Homo sapiens
uauaggaaaugagagaaga

SEQ ID NO: 785549 - RNA, 19 nt, Homo sapiens
gcaauauuucuucggauga

SEQ ID NO: 785550 - RNA, 19 nt, Homo sapiens
uaacagcccacugaauauu

SEQ ID NO: 785551 - RNA, 19 nt, Homo sapiens
cagggucuuuggauucuuu

SEQ ID NO: 785552 - RNA, 19 nt, Homo sapiens
ccugugauuugcacguaua

SEQ ID NO: 785553 - RNA, 19 nt, Homo sapiens
gagagaagacugugacaac

SEQ ID NO: 785554 - RNA, 19 nt, Homo sapiens
ccacacagugcauguagaa

SEQ ID NO: 785555 - RNA, 19 nt, Homo sapiens
gaucuuaaucuuucagaca

SEQ ID NO: 785556 - RNA, 19 nt, Homo sapiens
aaagauggccuucauaaaa

SEQ ID NO: 785557 - RNA, 19 nt, Homo sapiens
ggaacagcaauucaaguga

SEQ ID NO: 785558 - RNA, 19 nt, Homo sapiens
caagaucccagauaugcaa

SEQ ID NO: 785559 - RNA, 19 nt, Homo sapiens
gauauaauucucccuucuu

SEQ ID NO: 785560 - RNA, 19 nt, Homo sapiens
aaacagggucuuuggauuc

SEQ ID NO: 785561 - RNA, 19 nt, Homo sapiens
gggaaugcgucgcuauuuu

SEQ ID NO: 785562 - RNA, 19 nt, Homo sapiens
aaagaacugucucauucau

SEQ ID NO: 785563 - RNA, 19 nt, Homo sapiens
gauggagcccaacaagaaa

SEQ ID NO: 785564 - RNA, 19 nt, Homo sapiens
aagaaacagcuucccauaa

SEQ ID NO: 785565 - RNA, 19 nt, Homo sapiens
cugcaugacuaauauguuc

SEQ ID NO: 785566 - RNA, 19 nt, Homo sapiens
gaaaacaacauggaagaaa

SEQ ID NO: 785567 - RNA, 19 nt, Homo sapiens
gaaaagaggaacacaaaca

SEQ ID NO: 785568 - RNA, 19 nt, Homo sapiens
uggaagacuugaugaagau

SEQ ID NO: 785569 - RNA, 19 nt, Homo sapiens
aaaauagccuuaacugaug

SEQ ID NO: 785570 - RNA, 19 nt, Homo sapiens
gauguuaaggauuccaauu

SEQ ID NO: 785571 - RNA, 19 nt, Homo sapiens
acaaaguggugcuaaaggu

SEQ ID NO: 785572 - RNA, 19 nt, Homo sapiens
caaauaagcucuacucauu

SEQ ID NO: 785573 - RNA, 19 nt, Homo sapiens
gaaccggcaucuccaaaua

SEQ ID NO: 785574 - RNA, 19 nt, Homo sapiens
gaauuuagaucaacucaga

SEQ ID NO: 785575 - RNA, 19 nt, Homo sapiens
gcacacagaucuccauguu

SEQ ID NO: 785576 - RNA, 19 nt, Homo sapiens
gaucccaccuuaaaugaua

SEQ ID NO: 785577 - RNA, 19 nt, Homo sapiens
cagggaaucucaaacuuua

SEQ ID NO: 785578 - RNA, 19 nt, Homo sapiens
gaagagaccgguaaagauu

SEQ ID NO: 785579 - RNA, 19 nt, Homo sapiens
gaugauaacugcagauuuu

SEQ ID NO: 785580 - RNA, 19 nt, Homo sapiens
ggucaaggauggaagaguu

SEQ ID NO: 785581 - RNA, 19 nt, Homo sapiens
caacuacucuucaccuuca

SEQ ID NO: 785582 - RNA, 19 nt, Homo sapiens
gaaaugaggaacaguauag

SEQ ID NO: 785583 - RNA, 19 nt, Homo sapiens
uaacauacuuucuggaauc

SEQ ID NO: 785584 - RNA, 19 nt, Homo sapiens
ccaauaagaccacuuguga

SEQ ID NO: 785585 - RNA, 19 nt, Homo sapiens
ggaaaagacaucacaaaua

SEQ ID NO: 785586 - RNA, 19 nt, Homo sapiens
gcaguuggguugguuauuc

SEQ ID NO: 785587 - RNA, 19 nt, Homo sapiens
ugaaugaucccaccuuaaa

SEQ ID NO: 785588 - RNA, 19 nt, Homo sapiens
caacucagaugcacaaagg

SEQ ID NO: 785589 - RNA, 19 nt, Homo sapiens
gagcagaagaugaugauga

SEQ ID NO: 785590 - RNA, 19 nt, Homo sapiens
gcagggaaucucaaacuuu

SEQ ID NO: 785591 - RNA, 19 nt, Homo sapiens
guucuugggugucaacauu

SEQ ID NO: 785592 - RNA, 19 nt, Homo sapiens
agagagagaauucagguua

SEQ ID NO: 785593 - RNA, 19 nt, Homo sapiens
gaugaaaccgauagaagaa

SEQ ID NO: 785594 - RNA, 19 nt, Homo sapiens
ggaaaugaggaacaguaua

SEQ ID NO: 785595 - RNA, 19 nt, Homo sapiens
aauaagcucuacucauuga

SEQ ID NO: 785596 - RNA, 19 nt, Homo sapiens
gagagaaucaacugccaua

SEQ ID NO: 785597 - RNA, 19 nt, Homo sapiens
cgaugugccuuggauauaa

SEQ ID NO: 785598 - RNA, 19 nt, Homo sapiens
uuacugagccuucugacua

SEQ ID NO: 785599 - RNA, 19 nt, Homo sapiens
gaauucagguuaccaagac

SEQ ID NO: 785600 - RNA, 19 nt, Homo sapiens
gauagaagaaggagcagaa

SEQ ID NO: 785601 - RNA, 19 nt, Homo sapiens
gagguuguccauuugauaa

SEQ ID NO: 785602 - RNA, 19 nt, Homo sapiens
gauaaaaccucaguugaug

SEQ ID NO: 785603 - RNA, 19 nt, Homo sapiens
aauguuaacucuaggaugu

SEQ ID NO: 785604 - RNA, 19 nt, Homo sapiens
aauaagaccacuugugaaa

SEQ ID NO: 785605 - RNA, 19 nt, Homo sapiens
gacggaaggugucuugaag

SEQ ID NO: 785606 - RNA, 19 nt, Homo sapiens
gaucaacucagaugcacaa

SEQ ID NO: 785607 - RNA, 19 nt, Homo sapiens
ggaacucaguggcauguac

SEQ ID NO: 785608 - RNA, 19 nt, Homo sapiens
aggcuaagguaacaugaaa

SEQ ID NO: 785609 - RNA, 19 nt, Homo sapiens
gagagagaauucagguuac

SEQ ID NO: 785610 - RNA, 19 nt, Homo sapiens
gaagaaggagcagaagaug

SEQ ID NO: 785611 - RNA, 19 nt, Homo sapiens
agaaucaacugccauaggu

SEQ ID NO: 785612 - RNA, 19 nt, Homo sapiens
uugcaucugucguaucuuu

SEQ ID NO: 785613 - RNA, 19 nt, Homo sapiens
agaagaugaugaugacguu

SEQ ID NO: 785614 - RNA, 19 nt, Homo sapiens
gauguacccuuuauaucgu

SEQ ID NO: 785615 - RNA, 19 nt, Homo sapiens
ggauguacccuuuauaucg

SEQ ID NO: 785616 - RNA, 19 nt, Homo sapiens
uuucauggcuuuuagguua

SEQ ID NO: 785617 - RNA, 19 nt, Homo sapiens
gcgagccucugccaagaug

SEQ ID NO: 785618 - RNA, 19 nt, Homo sapiens
guugaugaccgucugagua

SEQ ID NO: 785619 - RNA, 19 nt, Homo sapiens
gaugugccuuggauauaau

SEQ ID NO: 785620 - RNA, 19 nt, Homo sapiens
caccugaguuagaaaguau

SEQ ID NO: 785621 - RNA, 19 nt, Homo sapiens
acucuaggauguacccuuu

SEQ ID NO: 785622 - RNA, 19 nt, Homo sapiens
aaaugaaggucuccuaucg

SEQ ID NO: 785623 - RNA, 19 nt, Homo sapiens
gguuguccauuugauaauu

SEQ ID NO: 785624 - RNA, 19 nt, Homo sapiens
gaggacauuuucugcauaa

SEQ ID NO: 785625 - RNA, 19 nt, Homo sapiens
acaccugaguuagaaagua

SEQ ID NO: 785626 - RNA, 19 nt, Homo sapiens
agagaccgguaaagauuga

SEQ ID NO: 785627 - RNA, 19 nt, Homo sapiens
gacuaugccuuguucucuu

SEQ ID NO: 785628 - RNA, 19 nt, Homo sapiens
ucaccauuauugcagauga

SEQ ID NO: 785629 - RNA, 19 nt, Homo sapiens
uaccugugccuuccaauaa

SEQ ID NO: 785630 - RNA, 19 nt, Homo sapiens
ggagggaggaagugaggaa

SEQ ID NO: 785631 - RNA, 19 nt, Homo sapiens
gaaugaucccaccuuaaau

SEQ ID NO: 785632 - RNA, 19 nt, Homo sapiens
cuuuauagauucuccugaa

SEQ ID NO: 785633 - RNA, 19 nt, Homo sapiens
ucuaggauguacccuuuau

SEQ ID NO: 785634 - RNA, 19 nt, Homo sapiens
gaugaccgucugaguauuc

SEQ ID NO: 785635 - RNA, 19 nt, Homo sapiens
uaggauguacccuuuauau

SEQ ID NO: 785636 - RNA, 19 nt, Homo sapiens
cggcaucuccaaauacauu

SEQ ID NO: 785637 - RNA, 19 nt, Homo sapiens
agaaggagcagaagaugau

SEQ ID NO: 785638 - RNA, 19 nt, Homo sapiens
gauuuguucagaagacuaa

SEQ ID NO: 785639 - RNA, 19 nt, Homo sapiens
aagaagagaccgguaaaga

SEQ ID NO: 785640 - RNA, 19 nt, Homo sapiens
acucuucaccuucauauga

SEQ ID NO: 785641 - RNA, 19 nt, Homo sapiens
cucaaugccuuuucacuua

SEQ ID NO: 785642 - RNA, 19 nt, Homo sapiens
caauaagaccacuugugaa

SEQ ID NO: 785643 - RNA, 19 nt, Homo sapiens
aaucaacugccauagguuu

SEQ ID NO: 785644 - RNA, 19 nt, Homo sapiens
acuaugccuuguucucuuu

SEQ ID NO: 785645 - RNA, 19 nt, Homo sapiens
cagcugccuugaucagaga

SEQ ID NO: 785646 - RNA, 19 nt, Homo sapiens
caagaugaaaccgauagaa

SEQ ID NO: 785647 - RNA, 19 nt, Homo sapiens
cagcgagccucugccaaga

SEQ ID NO: 785648 - RNA, 19 nt, Homo sapiens
auugaaugaucccaccuua

SEQ ID NO: 785649 - RNA, 19 nt, Homo sapiens
agaugaaaccgauagaaga

SEQ ID NO: 785650 - RNA, 19 nt, Homo sapiens
agaagagaccgguaaagau

SEQ ID NO: 785651 - RNA, 19 nt, Homo sapiens
ugagguuguccauuugaua

SEQ ID NO: 785652 - RNA, 19 nt, Homo sapiens
agaagaaggagcagaagau

SEQ ID NO: 785653 - RNA, 19 nt, Homo sapiens
gagaaucaacugccauagg

SEQ ID NO: 785654 - RNA, 19 nt, Homo sapiens
gauauaaugaucuggaacu

SEQ ID NO: 785655 - RNA, 19 nt, Homo sapiens
ucacagucuuuucuagaua

SEQ ID NO: 785656 - RNA, 19 nt, Homo sapiens
gaagaugaugaugacguuu

SEQ ID NO: 785657 - RNA, 19 nt, Homo sapiens
gguaaagauugaaaaggaa

SEQ ID NO: 785658 - RNA, 19 nt, Homo sapiens
cuaccgaugugccuuggau

SEQ ID NO: 785659 - RNA, 19 nt, Homo sapiens
ucacaaauaagcucuacuc

SEQ ID NO: 785660 - RNA, 19 nt, Homo sapiens
ccgugugccuccagauuug

SEQ ID NO: 785661 - RNA, 19 nt, Homo sapiens
gaucagagagagaauucag

SEQ ID NO: 785662 - RNA, 19 nt, Homo sapiens
cccugugccuuuauagauu

SEQ ID NO: 785663 - RNA, 19 nt, Homo sapiens
ccagauuuguucagaagac

SEQ ID NO: 785664 - RNA, 19 nt, Homo sapiens
uacaagaagagaccgguaa

SEQ ID NO: 785665 - RNA, 19 nt, Homo sapiens
gaggcuaagguaacaugaa

SEQ ID NO: 785666 - RNA, 19 nt, Homo sapiens
gagccucugccaagaugaa

SEQ ID NO: 785667 - RNA, 19 nt, Homo sapiens
aaauaagcucuacucauug

SEQ ID NO: 785668 - RNA, 19 nt, Homo sapiens
gcauguaccggcgauuguu

SEQ ID NO: 785669 - RNA, 19 nt, Homo sapiens
uggauauaaugaucuggaa

SEQ ID NO: 785670 - RNA, 19 nt, Homo sapiens
ccgaugugccuuggauaua

SEQ ID NO: 785671 - RNA, 19 nt, Homo sapiens
uacugagccuucugacuau

SEQ ID NO: 785672 - RNA, 19 nt, Homo sapiens
caaauaagcucuacucauu

SEQ ID NO: 785673 - RNA, 19 nt, Homo sapiens
gaaccggcaucuccaaaua

SEQ ID NO: 785674 - RNA, 19 nt, Homo sapiens
gaauuuagaucaacucaga

SEQ ID NO: 785675 - RNA, 19 nt, Homo sapiens
gcacacagaucuccauguu

SEQ ID NO: 785676 - RNA, 19 nt, Homo sapiens
gaucccaccuuaaaugaua

SEQ ID NO: 785677 - RNA, 19 nt, Homo sapiens
gaagagaccgguaaagauu

SEQ ID NO: 785678 - RNA, 19 nt, Homo sapiens
gaugauaacugcagauuuu

SEQ ID NO: 785679 - RNA, 19 nt, Homo sapiens
ggucaaggauggaagaguu

SEQ ID NO: 785680 - RNA, 19 nt, Homo sapiens
caacuacucuucaccuuca

SEQ ID NO: 785681 - RNA, 19 nt, Homo sapiens
gaaacugccugcuuugaag

SEQ ID NO: 785682 - RNA, 19 nt, Homo sapiens
gaaaugaggaacaguauag

SEQ ID NO: 785683 - RNA, 19 nt, Homo sapiens
uaacauacuuucuggaauc

SEQ ID NO: 785684 - RNA, 19 nt, Homo sapiens
ccaauaagaccacuuguga

SEQ ID NO: 785685 - RNA, 19 nt, Homo sapiens
ggaaaagacaucacaaaua

SEQ ID NO: 785686 - RNA, 19 nt, Homo sapiens
gcaguuggguugguuauuc

SEQ ID NO: 785687 - RNA, 19 nt, Homo sapiens
ugaaugaucccaccuuaaa

SEQ ID NO: 785688 - RNA, 19 nt, Homo sapiens
caacucagaugcacaaagg

SEQ ID NO: 785689 - RNA, 19 nt, Homo sapiens
gagcagaagaugaugauga

SEQ ID NO: 785690 - RNA, 19 nt, Homo sapiens
guucuugggugucaacauu

SEQ ID NO: 785691 - RNA, 19 nt, Homo sapiens
agagagagaauucagguua

SEQ ID NO: 785692 - RNA, 19 nt, Homo sapiens
gaugaaaccgauagaagaa

SEQ ID NO: 785693 - RNA, 19 nt, Homo sapiens
ggaaaugaggaacaguaua

SEQ ID NO: 785694 - RNA, 19 nt, Homo sapiens
aauaagcucuacucauuga

SEQ ID NO: 785695 - RNA, 19 nt, Homo sapiens
cgaugugccuuggauauaa

SEQ ID NO: 785696 - RNA, 19 nt, Homo sapiens
gagagaaucaacugccaua

SEQ ID NO: 785697 - RNA, 19 nt, Homo sapiens
uuacugagccuucugacua

SEQ ID NO: 785698 - RNA, 19 nt, Homo sapiens
gaauucagguuaccaagac

SEQ ID NO: 785699 - RNA, 19 nt, Homo sapiens
gauagaagaaggagcagaa

SEQ ID NO: 785700 - RNA, 19 nt, Homo sapiens
cccagaaacugccugcuuu

SEQ ID NO: 785701 - RNA, 19 nt, Homo sapiens
gauaaaaccucaguugaug

SEQ ID NO: 785702 - RNA, 19 nt, Homo sapiens
aauguuaacucuaggaugu

SEQ ID NO: 785703 - RNA, 19 nt, Homo sapiens
aauaagaccacuugugaaa

SEQ ID NO: 785704 - RNA, 19 nt, Homo sapiens
gacggaaggugucuugaag

SEQ ID NO: 785705 - RNA, 19 nt, Homo sapiens
gaucaacucagaugcacaa

SEQ ID NO: 785706 - RNA, 19 nt, Homo sapiens
ggaacucaguggcauguac

SEQ ID NO: 785707 - RNA, 19 nt, Homo sapiens
gagagagaauucagguuac

SEQ ID NO: 785708 - RNA, 19 nt, Homo sapiens
gaagaaggagcagaagaug

SEQ ID NO: 785709 - RNA, 19 nt, Homo sapiens
uugcaucugucguaucuuu

SEQ ID NO: 785710 - RNA, 19 nt, Homo sapiens
agaaucaacugccauaggu

SEQ ID NO: 785711 - RNA, 19 nt, Homo sapiens
agaagaugaugaugacguu

SEQ ID NO: 785712 - RNA, 19 nt, Homo sapiens
gauguacccuuuauaucgu

SEQ ID NO: 785713 - RNA, 19 nt, Homo sapiens
ggauguacccuuuauaucg

SEQ ID NO: 785714 - RNA, 19 nt, Homo sapiens
uuucauggcuuuuagguua

SEQ ID NO: 785715 - RNA, 19 nt, Homo sapiens
gcgagccucugccaagaug

SEQ ID NO: 785716 - RNA, 19 nt, Homo sapiens
guugaugaccgucugagua

SEQ ID NO: 785717 - RNA, 19 nt, Homo sapiens
gaugugccuuggauauaau

SEQ ID NO: 785718 - RNA, 19 nt, Homo sapiens
caccugaguuagaaaguau

SEQ ID NO: 785719 - RNA, 19 nt, Homo sapiens
acucuaggauguacccuuu

SEQ ID NO: 785720 - RNA, 19 nt, Homo sapiens
aaaugaaggucuccuaucg

SEQ ID NO: 785721 - RNA, 19 nt, Homo sapiens
gaggacauuuucugcauaa

SEQ ID NO: 785722 - RNA, 19 nt, Homo sapiens
agagaccgguaaagauuga

SEQ ID NO: 785723 - RNA, 19 nt, Homo sapiens
acaccugaguuagaaagua

SEQ ID NO: 785724 - RNA, 19 nt, Homo sapiens
gacuaugccuuguucucuu

SEQ ID NO: 785725 - RNA, 19 nt, Homo sapiens
ucaccauuauugcagauga

SEQ ID NO: 785726 - RNA, 19 nt, Homo sapiens
uaccugugccuuccaauaa

SEQ ID NO: 785727 - RNA, 19 nt, Homo sapiens
ggagggaggaagugaggaa

SEQ ID NO: 785728 - RNA, 19 nt, Homo sapiens
gaaugaucccaccuuaaau

SEQ ID NO: 785729 - RNA, 19 nt, Homo sapiens
cuuuauagauucuccugaa

SEQ ID NO: 785730 - RNA, 19 nt, Homo sapiens
ucuaggauguacccuuuau

SEQ ID NO: 785731 - RNA, 19 nt, Homo sapiens
gaugaccgucugaguauuc

SEQ ID NO: 785732 - RNA, 19 nt, Homo sapiens
uaggauguacccuuuauau

SEQ ID NO: 785733 - RNA, 19 nt, Homo sapiens
cggcaucuccaaauacauu

SEQ ID NO: 785734 - RNA, 19 nt, Homo sapiens
agaaggagcagaagaugau

SEQ ID NO: 785735 - RNA, 19 nt, Homo sapiens
gauuuguucagaagacuaa

SEQ ID NO: 785736 - RNA, 19 nt, Homo sapiens
aagaagagaccgguaaaga

SEQ ID NO: 785737 - RNA, 19 nt, Homo sapiens
acucuucaccuucauauga

SEQ ID NO: 785738 - RNA, 19 nt, Homo sapiens
ccagacaagucccagaaac

SEQ ID NO: 785739 - RNA, 19 nt, Homo sapiens
caauaagaccacuugugaa

SEQ ID NO: 785740 - RNA, 19 nt, Homo sapiens
acuaugccuuguucucuuu

SEQ ID NO: 785741 - RNA, 19 nt, Homo sapiens
cagcugccuugaucagaga

SEQ ID NO: 785742 - RNA, 19 nt, Homo sapiens
caagaugaaaccgauagaa

SEQ ID NO: 785743 - RNA, 19 nt, Homo sapiens
cagcgagccucugccaaga

SEQ ID NO: 785744 - RNA, 19 nt, Homo sapiens
auugaaugaucccaccuua

SEQ ID NO: 785745 - RNA, 19 nt, Homo sapiens
aaucaacugccauagguuu

SEQ ID NO: 785746 - RNA, 19 nt, Homo sapiens
agaugaaaccgauagaaga

SEQ ID NO: 785747 - RNA, 19 nt, Homo sapiens
agaagagaccgguaaagau

SEQ ID NO: 785748 - RNA, 19 nt, Homo sapiens
agaaacugccugcuuugaa

SEQ ID NO: 785749 - RNA, 19 nt, Homo sapiens
agaagaaggagcagaagau

SEQ ID NO: 785750 - RNA, 19 nt, Homo sapiens
gagaaucaacugccauagg

SEQ ID NO: 785751 - RNA, 19 nt, Homo sapiens
gauauaaugaucuggaacu

SEQ ID NO: 785752 - RNA, 19 nt, Homo sapiens
gaagaugaugaugacguuu

SEQ ID NO: 785753 - RNA, 19 nt, Homo sapiens
gguaaagauugaaaaggaa

SEQ ID NO: 785754 - RNA, 19 nt, Homo sapiens
cuaccgaugugccuuggau

SEQ ID NO: 785755 - RNA, 19 nt, Homo sapiens
ucacaaauaagcucuacuc

SEQ ID NO: 785756 - RNA, 19 nt, Homo sapiens
ccgugugccuccagauuug

SEQ ID NO: 785757 - RNA, 19 nt, Homo sapiens
gaucagagagagaauucag

SEQ ID NO: 785758 - RNA, 19 nt, Homo sapiens
cccugugccuuuauagauu

SEQ ID NO: 785759 - RNA, 19 nt, Homo sapiens
ccagauuuguucagaagac

SEQ ID NO: 785760 - RNA, 19 nt, Homo sapiens
uacaagaagagaccgguaa

SEQ ID NO: 785761 - RNA, 19 nt, Homo sapiens
uuugaagcaugaauaagug

SEQ ID NO: 785762 - RNA, 19 nt, Homo sapiens
gagccucugccaagaugaa

SEQ ID NO: 785763 - RNA, 19 nt, Homo sapiens
aaauaagcucuacucauug

SEQ ID NO: 785764 - RNA, 19 nt, Homo sapiens
gcauguaccggcgauuguu

SEQ ID NO: 785765 - RNA, 19 nt, Homo sapiens
uggauauaaugaucuggaa

SEQ ID NO: 785766 - RNA, 19 nt, Homo sapiens
ccgaugugccuuggauaua

SEQ ID NO: 785767 - RNA, 19 nt, Homo sapiens
uacugagccuucugacuau

SEQ ID NO: 785768 - RNA, 19 nt, Homo sapiens
ggaagggucaaggauggaa

SEQ ID NO: 785769 - RNA, 19 nt, Homo sapiens
ccugugccuuccaauaaga

SEQ ID NO: 785770 - RNA, 19 nt, Homo sapiens
cagcauguccucucuucau

SEQ ID NO: 785771 - RNA, 19 nt, Homo sapiens
guauagccagcuccaguga

SEQ ID NO: 785772 - RNA, 19 nt, Homo sapiens
gauggaggccucauuugua

SEQ ID NO: 785773 - RNA, 19 nt, Homo sapiens
ccucaaggauggcuacgua

SEQ ID NO: 785774 - RNA, 19 nt, Homo sapiens
caaaggcacugucguagcu

SEQ ID NO: 785775 - RNA, 19 nt, Homo sapiens
caacaucgucuaccucugu

SEQ ID NO: 785776 - RNA, 19 nt, Homo sapiens
cgagauggaggccucauuu

SEQ ID NO: 785777 - RNA, 19 nt, Homo sapiens
gcacugucguagcugagaa

SEQ ID NO: 785778 - RNA, 19 nt, Homo sapiens
caaguuccgccacguguuu

SEQ ID NO: 785779 - RNA, 19 nt, Homo sapiens
gaccagugcuaugaagaug

SEQ ID NO: 785780 - RNA, 19 nt, Homo sapiens
ccgcaaaggcacugucgua

SEQ ID NO: 785781 - RNA, 19 nt, Homo sapiens
ccagugcuaugaagaugug

SEQ ID NO: 785782 - RNA, 19 nt, Homo sapiens
gccuggaggugaacaagug

SEQ ID NO: 785783 - RNA, 19 nt, Homo sapiens
gaggugaacaagugugaga

SEQ ID NO: 785784 - RNA, 19 nt, Homo sapiens
gagauggaggccucauuug

SEQ ID NO: 785785 - RNA, 19 nt, Homo sapiens
ggacuggagccgagaugga

SEQ ID NO: 785786 - RNA, 19 nt, Homo sapiens
gcugucaacccuaaguuug

SEQ ID NO: 785787 - RNA, 19 nt, Homo sapiens
agacaguccaggccaagua

SEQ ID NO: 785788 - RNA, 19 nt, Homo sapiens
ccaugacagugccucgaaa

SEQ ID NO: 785789 - RNA, 19 nt, Homo sapiens
gaaagucggaccuguucca

SEQ ID NO: 785790 - RNA, 19 nt, Homo sapiens
ugcacuaucucuccauguu

SEQ ID NO: 785791 - RNA, 19 nt, Homo sapiens
agugugagaucgccagguu

SEQ ID NO: 785792 - RNA, 19 nt, Homo sapiens
cacuaucucuccauguuca

SEQ ID NO: 785793 - RNA, 19 nt, Homo sapiens
gcacuaucucuccauguuc

SEQ ID NO: 785794 - RNA, 19 nt, Homo sapiens
ggacguguggacaagaaug

SEQ ID NO: 785795 - RNA, 19 nt, Homo sapiens
ucugugcugucaacccuaa

SEQ ID NO: 785796 - RNA, 19 nt, Homo sapiens
gcggaggugugagcccauu

SEQ ID NO: 785797 - RNA, 19 nt, Homo sapiens
gcaaguuccgccacguguu

SEQ ID NO: 785798 - RNA, 19 nt, Homo sapiens
gcacaccacagcccagaac

SEQ ID NO: 785799 - RNA, 19 nt, Homo sapiens
gugguccgcuccagcaagu

SEQ ID NO: 785800 - RNA, 19 nt, Homo sapiens
ccucaucucccucaaggau

SEQ ID NO: 785801 - RNA, 19 nt, Homo sapiens
gugacaacgugaucauggu

SEQ ID NO: 785802 - RNA, 19 nt, Homo sapiens
ccagcagggucagccauuc

SEQ ID NO: 785803 - RNA, 19 nt, Homo sapiens
cagcucggaugccgugucu

SEQ ID NO: 785804 - RNA, 19 nt, Homo sapiens
ucucucggcagcagaauga

SEQ ID NO: 785805 - RNA, 19 nt, Homo sapiens
caccaagcgugugggcauu

SEQ ID NO: 785806 - RNA, 19 nt, Homo sapiens
cgaccagugcuaugaagau

SEQ ID NO: 785807 - RNA, 19 nt, Homo sapiens
ccaaggccgaccagugcua

SEQ ID NO: 785808 - RNA, 19 nt, Homo sapiens
ugacagugccucgaaaguc

SEQ ID NO: 785809 - RNA, 19 nt, Homo sapiens
gcaagggugacagcucaau

SEQ ID NO: 785810 - RNA, 19 nt, Homo sapiens
ccaagcgugugggcauugu

SEQ ID NO: 785811 - RNA, 19 nt, Homo sapiens
ugucaacccuaaguuugug

SEQ ID NO: 785812 - RNA, 19 nt, Homo sapiens
gccaugacagugccucgaa

SEQ ID NO: 785813 - RNA, 19 nt, Homo sapiens
agauggaggccucauuugu

SEQ ID NO: 785814 - RNA, 19 nt, Homo sapiens
cuggacguguggacaagaa

SEQ ID NO: 785815 - RNA, 19 nt, Homo sapiens
ucgaaagucggaccuguuc

SEQ ID NO: 785816 - RNA, 19 nt, Homo sapiens
gcagagcuaugucuaaaua

SEQ ID NO: 785817 - RNA, 19 nt, Homo sapiens
gaacaauccugcaccauga

SEQ ID NO: 785818 - RNA, 19 nt, Homo sapiens
gaugggaccuuccacaaau

SEQ ID NO: 785819 - RNA, 19 nt, Homo sapiens
gaaagcuguuugaguuuga

SEQ ID NO: 785820 - RNA, 19 nt, Homo sapiens
gaacgucaacucugucauu

SEQ ID NO: 785821 - RNA, 19 nt, Homo sapiens
cagcagagcuaugucuaaa

SEQ ID NO: 785822 - RNA, 19 nt, Homo sapiens
ccaagaacgucaacucugu

SEQ ID NO: 785823 - RNA, 19 nt, Homo sapiens
ccacaaauaugucuucacu

SEQ ID NO: 785824 - RNA, 19 nt, Homo sapiens
cccgaaagcuguuugaguu

SEQ ID NO: 785825 - RNA, 19 nt, Homo sapiens
gaugaucuccgaugugaug

SEQ ID NO: 785826 - RNA, 19 nt, Homo sapiens
gagaggcuuucgacgugua

SEQ ID NO: 785827 - RNA, 19 nt, Homo sapiens
cgaaagcuguuugaguuug

SEQ ID NO: 785828 - RNA, 19 nt, Homo sapiens
gaugugaugaauacgaaua

SEQ ID NO: 785829 - RNA, 19 nt, Homo sapiens
guccauaucuuugcucuca

SEQ ID NO: 785830 - RNA, 19 nt, Homo sapiens
gcaucuauguguacuccuu

SEQ ID NO: 785831 - RNA, 19 nt, Homo sapiens
ugaagaaccgcaucuaugu

SEQ ID NO: 785832 - RNA, 19 nt, Homo sapiens
uaaauaaagagcucacuuc

SEQ ID NO: 785833 - RNA, 19 nt, Homo sapiens
ggcaguacguggacucuca

SEQ ID NO: 785834 - RNA, 19 nt, Homo sapiens
gaucuccgaugugaugaau

SEQ ID NO: 785835 - RNA, 19 nt, Homo sapiens
gccacccucuacugcauua

SEQ ID NO: 785836 - RNA, 19 nt, Homo sapiens
uaucuuugcucucaaggau

SEQ ID NO: 785837 - RNA, 19 nt, Homo sapiens
uaaggguacuguccauauc

SEQ ID NO: 785838 - RNA, 19 nt, Homo sapiens
ucaaugcacaucagaguga

SEQ ID NO: 785839 - RNA, 19 nt, Homo sapiens
gaagaaccgcaucuaugug

SEQ ID NO: 785840 - RNA, 19 nt, Homo sapiens
gaucaaugcacaucagagu

SEQ ID NO: 785841 - RNA, 19 nt, Homo sapiens
gauaaggguacuguccaua

SEQ ID NO: 785842 - RNA, 19 nt, Homo sapiens
caacguggagcccuugaug

SEQ ID NO: 785843 - RNA, 19 nt, Homo sapiens
ccgaugugaugaauacgaa

SEQ ID NO: 785844 - RNA, 19 nt, Homo sapiens
ucccuaaccuggaggaaau

SEQ ID NO: 785845 - RNA, 19 nt, Homo sapiens
caccagccagcaagcauua

SEQ ID NO: 785846 - RNA, 19 nt, Homo sapiens
ggaccuuccacaaauaugu

SEQ ID NO: 785847 - RNA, 19 nt, Homo sapiens
gcugaagaaccgcaucuau

SEQ ID NO: 785848 - RNA, 19 nt, Homo sapiens
agacaggugugcgcaucua

SEQ ID NO: 785849 - RNA, 19 nt, Homo sapiens
ugucuucacuccugaugga

SEQ ID NO: 785850 - RNA, 19 nt, Homo sapiens
gcaccucgucugcuccauu

SEQ ID NO: 785851 - RNA, 19 nt, Homo sapiens
gagcuaugucuaaauaaag

SEQ ID NO: 785852 - RNA, 19 nt, Homo sapiens
ccucugcgcuuccagugau

SEQ ID NO: 785853 - RNA, 19 nt, Homo sapiens
ccacucagcagagcuaugu

SEQ ID NO: 785854 - RNA, 19 nt, Homo sapiens
ggccuaugauugggcagua

SEQ ID NO: 785855 - RNA, 19 nt, Homo sapiens
gcacaucagagugacauag

SEQ ID NO: 785856 - RNA, 19 nt, Homo sapiens
uagccugugugucucuaaa

SEQ ID NO: 785857 - RNA, 19 nt, Homo sapiens
agagugacauagccugugu

SEQ ID NO: 785858 - RNA, 19 nt, Homo sapiens
gugggagucugcaacuugu

SEQ ID NO: 785859 - RNA, 19 nt, Homo sapiens
caccucgucugcuccauuc

SEQ ID NO: 785860 - RNA, 19 nt, Homo sapiens
gaaccgcaucuauguguac

SEQ ID NO: 785861 - RNA, 19 nt, Homo sapiens
gugcuggaguucaccuuca

SEQ ID NO: 785862 - RNA, 19 nt, Homo sapiens
ucuccgaugugaugaauac

SEQ ID NO: 785863 - RNA, 19 nt, Homo sapiens
ccauaucuuugcucucaag

SEQ ID NO: 785864 - RNA, 19 nt, Homo sapiens
agaaccgcaucuaugugua

SEQ ID NO: 785865 - RNA, 19 nt, Homo sapiens
cugaagaaccgcaucuaug

SEQ ID NO: 785866 - RNA, 19 nt, Homo sapiens
ucagcagagcuaugucuaa

SEQ ID NO: 785867 - RNA, 19 nt, Homo sapiens
ggugcccacuuuccacuca

SEQ ID NO: 785868 - RNA, 19 nt, Homo sapiens
gcaauacuuccaagaacgu

SEQ ID NO: 785869 - RNA, 19 nt, Homo sapiens
cuaaauaaagagcucacuu

SEQ ID NO: 785870 - RNA, 19 nt, Homo sapiens
gcaugggcuugguggagau

SEQ ID NO: 785871 - RNA, 19 nt, Homo sapiens
ggaagccaccagccagcaa

SEQ ID NO: 785872 - RNA, 19 nt, Homo sapiens
gguacuguccauaucuuug

SEQ ID NO: 785873 - RNA, 19 nt, Homo sapiens
ggugggcggugguaguagu

SEQ ID NO: 785874 - RNA, 19 nt, Homo sapiens
cgacguguaccuugacauc

SEQ ID NO: 785875 - RNA, 19 nt, Homo sapiens
cagccugcguuucaaccaa

SEQ ID NO: 785876 - RNA, 19 nt, Homo sapiens
acacacaauccaaggagaa

SEQ ID NO: 785877 - RNA, 19 nt, Homo sapiens
agaagcuggugcuggaguu

SEQ ID NO: 785878 - RNA, 19 nt, Homo sapiens
gugaugaugaugacuuuua

SEQ ID NO: 785879 - RNA, 19 nt, Homo sapiens
ugauggaaacugcaacaga

SEQ ID NO: 785880 - RNA, 19 nt, Homo sapiens
ugaccagccugcguuucaa

SEQ ID NO: 785881 - RNA, 19 nt, Homo sapiens
ccgaaagcuguuugaguuu

SEQ ID NO: 785882 - RNA, 19 nt, Homo sapiens
cugugaugaugaugacuuu

SEQ ID NO: 785883 - RNA, 19 nt, Homo sapiens
gguaguagucccaaguucu

SEQ ID NO: 785884 - RNA, 19 nt, Homo sapiens
gugaccagccugcguuuca

SEQ ID NO: 785885 - RNA, 19 nt, Homo sapiens
aaaccagccaggcacugua

SEQ ID NO: 785886 - RNA, 19 nt, Homo sapiens
ggaccuggcgagcacaaag

SEQ ID NO: 785887 - RNA, 19 nt, Homo sapiens
agaugggaccuuccacaaa

SEQ ID NO: 785888 - RNA, 19 nt, Homo sapiens
ucgcaauacuuccaagaac

SEQ ID NO: 785889 - RNA, 19 nt, Homo sapiens
ugauaaggguacuguccau

SEQ ID NO: 785890 - RNA, 19 nt, Homo sapiens
ccaccagccagcaagcauu

SEQ ID NO: 785891 - RNA, 19 nt, Homo sapiens
guaguagucccaaguucuc

SEQ ID NO: 785892 - RNA, 19 nt, Homo sapiens
augggaccuuccacaaaua

SEQ ID NO: 785893 - RNA, 19 nt, Homo sapiens
uagaugggaccuuccacaa

SEQ ID NO: 785894 - RNA, 19 nt, Homo sapiens
cuuauucgccucuuugaca

SEQ ID NO: 785895 - RNA, 19 nt, Homo sapiens
aagaaccgcaucuaugugu

SEQ ID NO: 785896 - RNA, 19 nt, Homo sapiens
ccccagcacuucuugauga

SEQ ID NO: 785897 - RNA, 19 nt, Homo sapiens
aacgucaacucugucauug

SEQ ID NO: 785898 - RNA, 19 nt, Homo sapiens
gaucccaggaggaacaauc

SEQ ID NO: 785899 - RNA, 19 nt, Homo sapiens
cacugugccugcugaguca

SEQ ID NO: 785900 - RNA, 19 nt, Homo sapiens
auaaggguacuguccauau

SEQ ID NO: 785901 - RNA, 19 nt, Homo sapiens
gcaccgcuccaaccuucug

SEQ ID NO: 785902 - RNA, 19 nt, Homo sapiens
caaaggcuguccugaggua

SEQ ID NO: 785903 - RNA, 19 nt, Homo sapiens
ugaagaaggucauguccau

SEQ ID NO: 785904 - RNA, 19 nt, Homo sapiens
gaucggacacugccucuug

SEQ ID NO: 785905 - RNA, 19 nt, Homo sapiens
gugcuuggcugugcucaaa

SEQ ID NO: 785906 - RNA, 19 nt, Homo sapiens
gacacugccucuuguggaa

SEQ ID NO: 785907 - RNA, 19 nt, Homo sapiens
accaauggcuucagugaug

SEQ ID NO: 785908 - RNA, 19 nt, Homo sapiens
cuagaaauccucagugaca

SEQ ID NO: 785909 - RNA, 19 nt, Homo sapiens
gugaagcccuaacccuaga

SEQ ID NO: 785910 - RNA, 19 nt, Homo sapiens
cgacuacuaccacguguug

SEQ ID NO: 785911 - RNA, 19 nt, Homo sapiens
gacgugaggccuuucauuc

SEQ ID NO: 785912 - RNA, 19 nt, Homo sapiens
gcagaugcaggaguuugua

SEQ ID NO: 785913 - RNA, 19 nt, Homo sapiens
gaagaagacaaggacauca

SEQ ID NO: 785914 - RNA, 19 nt, Homo sapiens
ggaagaagacaaggacauc

SEQ ID NO: 785915 - RNA, 19 nt, Homo sapiens
cauccacccuuucauugau

SEQ ID NO: 785916 - RNA, 19 nt, Homo sapiens
uuacauccacccuuucauu

SEQ ID NO: 785917 - RNA, 19 nt, Homo sapiens
cguggaagccggcagguuu

SEQ ID NO: 785918 - RNA, 19 nt, Homo sapiens
agccuuagcccauuauaaa

SEQ ID NO: 785919 - RNA, 19 nt, Homo sapiens
gccaugaaguacaucaaca

SEQ ID NO: 785920 - RNA, 19 nt, Homo sapiens
cuacuaccaucacaucuac

SEQ ID NO: 785921 - RNA, 19 nt, Homo sapiens
aaagggcccucuccugagu

SEQ ID NO: 785922 - RNA, 19 nt, Homo sapiens
caacacgacucugguuucg

SEQ ID NO: 785923 - RNA, 19 nt, Homo sapiens
cccuagaaauccucaguga

SEQ ID NO: 785924 - RNA, 19 nt, Homo sapiens
ggaggagaccuacuaccau

SEQ ID NO: 785925 - RNA, 19 nt, Homo sapiens
ggagcagaacgaggucaua

SEQ ID NO: 785926 - RNA, 19 nt, Homo sapiens
caucaucgacagcaaagug

SEQ ID NO: 785927 - RNA, 19 nt, Homo sapiens
caagauggacccggacuuc

SEQ ID NO: 785928 - RNA, 19 nt, Homo sapiens
ucguuuacauccacccuuu

SEQ ID NO: 785929 - RNA, 19 nt, Homo sapiens
uugcagccuuagcccauua

SEQ ID NO: 785930 - RNA, 19 nt, Homo sapiens
aaaagcagaugcaggaguu

SEQ ID NO: 785931 - RNA, 19 nt, Homo sapiens
gagcagaacgaggucauag

SEQ ID NO: 785932 - RNA, 19 nt, Homo sapiens
uagaaauccucagugacaa

SEQ ID NO: 785933 - RNA, 19 nt, Homo sapiens
cgacgugaggccuuucauu

SEQ ID NO: 785934 - RNA, 19 nt, Homo sapiens
ucauggaggagaccuacua

SEQ ID NO: 785935 - RNA, 19 nt, Homo sapiens
gagaucgaccagagguauu

SEQ ID NO: 785936 - RNA, 19 nt, Homo sapiens
uggacgcgcucaccgaguu

SEQ ID NO: 785937 - RNA, 19 nt, Homo sapiens
ccacggagcucagcaucac

SEQ ID NO: 785938 - RNA, 19 nt, Homo sapiens
gaaauccucagugacaaag

SEQ ID NO: 785939 - RNA, 19 nt, Homo sapiens
gcgcgauccugcucucucu

SEQ ID NO: 785940 - RNA, 19 nt, Homo sapiens
gaagcccuaacccuagaaa

SEQ ID NO: 785941 - RNA, 19 nt, Homo sapiens
cauccaggcggacuacuug

SEQ ID NO: 785942 - RNA, 19 nt, Homo sapiens
gagcagcgguccgacuacu

SEQ ID NO: 785943 - RNA, 19 nt, Homo sapiens
gccggcagguuucggacaa

SEQ ID NO: 785944 - RNA, 19 nt, Homo sapiens
cagccuuagcccauuauaa

SEQ ID NO: 785945 - RNA, 19 nt, Homo sapiens
caucaacacgacucugguu

SEQ ID NO: 785946 - RNA, 19 nt, Homo sapiens
acagcaaagugaagaaggu

SEQ ID NO: 785947 - RNA, 19 nt, Homo sapiens
ccuacuaccaucacaucua

SEQ ID NO: 785948 - RNA, 19 nt, Homo sapiens
gcaaagugaagaaggucau

SEQ ID NO: 785949 - RNA, 19 nt, Homo sapiens
agccagagcugcccugaac

SEQ ID NO: 785950 - RNA, 19 nt, Homo sapiens
cagcaucaucgacagcaaa

SEQ ID NO: 785951 - RNA, 19 nt, Homo sapiens
cagagguauuucagcauca

SEQ ID NO: 785952 - RNA, 19 nt, Homo sapiens
ucaccgaguuuggcaucuu

SEQ ID NO: 785953 - RNA, 19 nt, Homo sapiens
ggacgcgcucaccgaguuu

SEQ ID NO: 785954 - RNA, 19 nt, Homo sapiens
agaaauccucagugacaaa

SEQ ID NO: 785955 - RNA, 19 nt, Homo sapiens
gcagcgguccgacuacuac

SEQ ID NO: 785956 - RNA, 19 nt, Homo sapiens
aguggaguuugcagccuua

SEQ ID NO: 785957 - RNA, 19 nt, Homo sapiens
gaccuacuaccaucacauc

SEQ ID NO: 785958 - RNA, 19 nt, Homo sapiens
ccaucucacccuaccauga

SEQ ID NO: 785959 - RNA, 19 nt, Homo sapiens
gcagguuucggacaacaca

SEQ ID NO: 785960 - RNA, 19 nt, Homo sapiens
caccgaguuuggcaucuuc

SEQ ID NO: 785961 - RNA, 19 nt, Homo sapiens
ccucccgucugcucaugaa

SEQ ID NO: 785962 - RNA, 19 nt, Homo sapiens
ccagagcauugaccaucuc

SEQ ID NO: 785963 - RNA, 19 nt, Homo sapiens
caugcacgcccucaagaug

SEQ ID NO: 785964 - RNA, 19 nt, Homo sapiens
ucauaccaauggcuucagu

SEQ ID NO: 785965 - RNA, 19 nt, Homo sapiens
ucaacacgacucugguuuc

SEQ ID NO: 785966 - RNA, 19 nt, Homo sapiens
gcucauaccaauggcuuca

SEQ ID NO: 785967 - RNA, 19 nt, Homo sapiens
gagaccuacuaccaucaca

SEQ ID NO: 785968 - RNA, 19 nt, Homo sapiens
gaccaucucacccuaccau

SEQ ID NO: 785969 - RNA, 19 nt, Homo sapiens
cccaaaagcucuucaugca

SEQ ID NO: 785970 - RNA, 19 nt, Homo sapiens
uacauccacccuuucauug

SEQ ID NO: 785971 - RNA, 19 nt, Homo sapiens
gcagccuuagcccauuaua

SEQ ID NO: 785972 - RNA, 19 nt, Homo sapiens
ugagaaagcacuggucaac

SEQ ID NO: 785973 - RNA, 19 nt, Homo sapiens
agaacgagauggcuauuua

SEQ ID NO: 785974 - RNA, 19 nt, Homo sapiens
gcacaaauauaggcuagaa

SEQ ID NO: 785975 - RNA, 19 nt, Homo sapiens
cgagauggcuauuuaugaa

SEQ ID NO: 785976 - RNA, 19 nt, Homo sapiens
gcuagaauccggaauguuu

SEQ ID NO: 785977 - RNA, 19 nt, Homo sapiens
guaugcagcucucuucauu

SEQ ID NO: 785978 - RNA, 19 nt, Homo sapiens
aaacagaagucauaaagag

SEQ ID NO: 785979 - RNA, 19 nt, Homo sapiens
uuuauaaggucccuagaua

SEQ ID NO: 785980 - RNA, 19 nt, Homo sapiens
ccacaaauauaggcuagaa

SEQ ID NO: 785981 - RNA, 19 nt, Homo sapiens
ggaaacagaagucauaaag

SEQ ID NO: 785982 - RNA, 19 nt, Homo sapiens
gaaacagaagucauaaaga

SEQ ID NO: 785983 - RNA, 19 nt, Homo sapiens
caacuacucuucaaaucag

SEQ ID NO: 785984 - RNA, 19 nt, Homo sapiens
ccagacaguucaucauuca

SEQ ID NO: 785985 - RNA, 19 nt, Homo sapiens
ggaaccaauugaugaacuu

SEQ ID NO: 785986 - RNA, 19 nt, Homo sapiens
caccagcccucacuaucua

SEQ ID NO: 785987 - RNA, 19 nt, Homo sapiens
ccaaugaacagcacaguau

SEQ ID NO: 785988 - RNA, 19 nt, Homo sapiens
ccacaguacuuggcaaaug

SEQ ID NO: 785989 - RNA, 19 nt, Homo sapiens
gcugauauaucggcaguau

SEQ ID NO: 785990 - RNA, 19 nt, Homo sapiens
uaaagaggccuaaggacuu

SEQ ID NO: 785991 - RNA, 19 nt, Homo sapiens
caaaugcacucugguccuu

SEQ ID NO: 785992 - RNA, 19 nt, Homo sapiens
caacagagcgagaccuugu

SEQ ID NO: 785993 - RNA, 19 nt, Homo sapiens
gcuggagucucuacuuugu

SEQ ID NO: 785994 - RNA, 19 nt, Homo sapiens
gggcaggaaugauaagaag

SEQ ID NO: 785995 - RNA, 19 nt, Homo sapiens
gaacgagauggcuauuuau

SEQ ID NO: 785996 - RNA, 19 nt, Homo sapiens
uaaguacuaugaacaugug

SEQ ID NO: 785997 - RNA, 19 nt, Homo sapiens
ccaguaaucccagcacuuu

SEQ ID NO: 785998 - RNA, 19 nt, Homo sapiens
gaaggcccauucuaugucu

SEQ ID NO: 785999 - RNA, 19 nt, Homo sapiens
gcagcacagguuccaguua

SEQ ID NO: 786000 - RNA, 19 nt, Homo sapiens
uuacagccaucccuuguca

SEQ ID NO: 786001 - RNA, 19 nt, Homo sapiens
ccaaugaacaaugcucuuu

SEQ ID NO: 786002 - RNA, 19 nt, Homo sapiens
cagcacagguuccaguuac

SEQ ID NO: 786003 - RNA, 19 nt, Homo sapiens
gggcagacucgacuuucua

SEQ ID NO: 786004 - RNA, 19 nt, Homo sapiens
uggagucucuacuuuguau

SEQ ID NO: 786005 - RNA, 19 nt, Homo sapiens
gcagugagccaugauugug

SEQ ID NO: 786006 - RNA, 19 nt, Homo sapiens
gugagugaauuagauguau

SEQ ID NO: 786007 - RNA, 19 nt, Homo sapiens
gcaguaugcagcucucuuc

SEQ ID NO: 786008 - RNA, 19 nt, Homo sapiens
ccaacuacucuucaaauca

SEQ ID NO: 786009 - RNA, 19 nt, Homo sapiens
cagccgagugagugaauua

SEQ ID NO: 786010 - RNA, 19 nt, Homo sapiens
gagaacgagauggcuauuu

SEQ ID NO: 786011 - RNA, 19 nt, Homo sapiens
ucucuacuuuguauucuug

SEQ ID NO: 786012 - RNA, 19 nt, Homo sapiens
aggcuggagucucuacuuu

SEQ ID NO: 786013 - RNA, 19 nt, Homo sapiens
agacaguucaucauucaaa

SEQ ID NO: 786014 - RNA, 19 nt, Homo sapiens
caagggcagacucgacuuu

SEQ ID NO: 786015 - RNA, 19 nt, Homo sapiens
uauaaggucccuagauauc

SEQ ID NO: 786016 - RNA, 19 nt, Homo sapiens
aguauuuggugccuuuaaa

SEQ ID NO: 786017 - RNA, 19 nt, Homo sapiens
ccgagugagugaauuagau

SEQ ID NO: 786018 - RNA, 19 nt, Homo sapiens
gauggcuauuuaugaauuc

SEQ ID NO: 786019 - RNA, 19 nt, Homo sapiens
cuaugaacauguggauauu

SEQ ID NO: 786020 - RNA, 19 nt, Homo sapiens
gcacuccaaucuggcaaca

SEQ ID NO: 786021 - RNA, 19 nt, Homo sapiens
gaggugggaggaucacuug

SEQ ID NO: 786022 - RNA, 19 nt, Homo sapiens
acaaauauaggcuagaauc

SEQ ID NO: 786023 - RNA, 19 nt, Homo sapiens
acaaauauaggcuagaauc

SEQ ID NO: 786024 - RNA, 19 nt, Homo sapiens
uauuugggcuagacuggaa

SEQ ID NO: 786025 - RNA, 19 nt, Homo sapiens
ggagacacaccaacuacuc

SEQ ID NO: 786026 - RNA, 19 nt, Homo sapiens
gacaguucaucauucaaag

SEQ ID NO: 786027 - RNA, 19 nt, Homo sapiens
acagccaucccuugucaua

SEQ ID NO: 786028 - RNA, 19 nt, Homo sapiens
ugaugaacuucccaaaaua

SEQ ID NO: 786029 - RNA, 19 nt, Homo sapiens
caucccuugucauaacuuu

SEQ ID NO: 786030 - RNA, 19 nt, Homo sapiens
gucccuagauaucccagaa

SEQ ID NO: 786031 - RNA, 19 nt, Homo sapiens
ugucauaacuuuugaacug

SEQ ID NO: 786032 - RNA, 19 nt, Homo sapiens
gaguuaaugacacugagaa

SEQ ID NO: 786033 - RNA, 19 nt, Homo sapiens
augcagcucucuucauugu

SEQ ID NO: 786034 - RNA, 19 nt, Homo sapiens
gguggugugugccuauagu

SEQ ID NO: 786035 - RNA, 19 nt, Homo sapiens
gcacucugguccuuaucag

SEQ ID NO: 786036 - RNA, 19 nt, Homo sapiens
ggaguuaaugacacugaga

SEQ ID NO: 786037 - RNA, 19 nt, Homo sapiens
ggcagacucgacuuucuaa

SEQ ID NO: 786038 - RNA, 19 nt, Homo sapiens
uuaauaagcguacacuucu

SEQ ID NO: 786039 - RNA, 19 nt, Homo sapiens
ucaggaaccaauugaugaa

SEQ ID NO: 786040 - RNA, 19 nt, Homo sapiens
gaguauuucagccgaguga

SEQ ID NO: 786041 - RNA, 19 nt, Homo sapiens
acuaugaacauguggauau

SEQ ID NO: 786042 - RNA, 19 nt, Homo sapiens
cggaauguuuucuugauuu

SEQ ID NO: 786043 - RNA, 19 nt, Homo sapiens
auaagaaggcuggguggua

SEQ ID NO: 786044 - RNA, 19 nt, Homo sapiens
gagauggcuauuuaugaau

SEQ ID NO: 786045 - RNA, 19 nt, Homo sapiens
uuaaugacacugagaacga

SEQ ID NO: 786046 - RNA, 19 nt, Homo sapiens
cauugugguuggaguuaau

SEQ ID NO: 786047 - RNA, 19 nt, Homo sapiens
uaauaagcguacacuucug

SEQ ID NO: 786048 - RNA, 19 nt, Homo sapiens
ggcugaagcaggaggauug

SEQ ID NO: 786049 - RNA, 19 nt, Homo sapiens
aagcguacacuucuggaaa

SEQ ID NO: 786050 - RNA, 19 nt, Homo sapiens
caccaacuacucuucaaau

SEQ ID NO: 786051 - RNA, 19 nt, Homo sapiens
guugagaggaccaucacaa

SEQ ID NO: 786052 - RNA, 19 nt, Homo sapiens
cacaguacuuggcaaaugc

SEQ ID NO: 786053 - RNA, 19 nt, Homo sapiens
ugagugaauuagauguauc

SEQ ID NO: 786054 - RNA, 19 nt, Homo sapiens
ucauugugguuggaguuaa

SEQ ID NO: 786055 - RNA, 19 nt, Homo sapiens
caaugaacaaugcucuuuc

SEQ ID NO: 786056 - RNA, 19 nt, Homo sapiens
gagucucuacuuuguauuc

SEQ ID NO: 786057 - RNA, 19 nt, Homo sapiens
ccaccagcccucacuaucu

SEQ ID NO: 786058 - RNA, 19 nt, Homo sapiens
ugauauaucggcaguaugc

SEQ ID NO: 786059 - RNA, 19 nt, Homo sapiens
guacuaugaacauguggau

SEQ ID NO: 786060 - RNA, 19 nt, Homo sapiens
auacuggccaggaaagaaa

SEQ ID NO: 786061 - RNA, 19 nt, Homo sapiens
gagaggaccaucacaaccu

SEQ ID NO: 786062 - RNA, 19 nt, Homo sapiens
caaugaacagcacaguaug

SEQ ID NO: 786063 - RNA, 19 nt, Homo sapiens
gaaccaauugaugaacuuc

SEQ ID NO: 786064 - RNA, 19 nt, Homo sapiens
aaugcacucugguccuuau

SEQ ID NO: 786065 - RNA, 19 nt, Homo sapiens
uucaguauuuggugccuuu

SEQ ID NO: 786066 - RNA, 19 nt, Homo sapiens
uccagacaguucaucauuc

SEQ ID NO: 786067 - RNA, 19 nt, Homo sapiens
cgagugagugaauuagaug

SEQ ID NO: 786068 - RNA, 19 nt, Homo sapiens
cuaaguacuaugaacaugu

SEQ ID NO: 786069 - RNA, 19 nt, Homo sapiens
cacaccaacuacucuucaa

SEQ ID NO: 786070 - RNA, 19 nt, Homo sapiens
ucuaaguacuaugaacaug

SEQ ID NO: 786071 - RNA, 19 nt, Homo sapiens
acgagauggcuauuuauga

SEQ ID NO: 786072 - RNA, 19 nt, Homo sapiens
gagccaugauugugcuacu

SEQ ID NO: 786073 - RNA, 19 nt, Homo sapiens
ucaccuaccuggagaaaua

SEQ ID NO: 786074 - RNA, 19 nt, Homo sapiens
gaggugagcuacaaacaca

SEQ ID NO: 786075 - RNA, 19 nt, Homo sapiens
uugaggaccugaagaagua

SEQ ID NO: 786076 - RNA, 19 nt, Homo sapiens
gcacagggaucucguucuc

SEQ ID NO: 786077 - RNA, 19 nt, Homo sapiens
gcaagcagcucaccuaccu

SEQ ID NO: 786078 - RNA, 19 nt, Homo sapiens
aaacgccgcuggagaagga

SEQ ID NO: 786079 - RNA, 19 nt, Homo sapiens
ggucuccucuagccuguuu

SEQ ID NO: 786080 - RNA, 19 nt, Homo sapiens
ugaagugaccuaugacaaa

SEQ ID NO: 786081 - RNA, 19 nt, Homo sapiens
cacaugcgcuuccucauca

SEQ ID NO: 786082 - RNA, 19 nt, Homo sapiens
gaagugaccuaugacaaaa

SEQ ID NO: 786083 - RNA, 19 nt, Homo sapiens
ggaguugcccgcuuuacuu

SEQ ID NO: 786084 - RNA, 19 nt, Homo sapiens
ugugugaagugaccuauga

SEQ ID NO: 786085 - RNA, 19 nt, Homo sapiens
ggaucucguucuccucauu

SEQ ID NO: 786086 - RNA, 19 nt, Homo sapiens
aaacagaggcugcgguuca

SEQ ID NO: 786087 - RNA, 19 nt, Homo sapiens
uuaaaucucguuucucuug

SEQ ID NO: 786088 - RNA, 19 nt, Homo sapiens
gcggagccaucaacagcaa

SEQ ID NO: 786089 - RNA, 19 nt, Homo sapiens
gaguugcccgcuuuacuuu

SEQ ID NO: 786090 - RNA, 19 nt, Homo sapiens
guucucggcaccuuaaauu

SEQ ID NO: 786091 - RNA, 19 nt, Homo sapiens
ccucuagccuguuuguugu

SEQ ID NO: 786092 - RNA, 19 nt, Homo sapiens
ggacuggccguuugacgau

SEQ ID NO: 786093 - RNA, 19 nt, Homo sapiens
guuguggacuggccguuug

SEQ ID NO: 786094 - RNA, 19 nt, Homo sapiens
gaucucguucuccucauuu

SEQ ID NO: 786095 - RNA, 19 nt, Homo sapiens
guuuggaguugcccgcuuu

SEQ ID NO: 786096 - RNA, 19 nt, Homo sapiens
ggacacccgaaggcaauaa

SEQ ID NO: 786097 - RNA, 19 nt, Homo sapiens
aagacccggugcugcguua

SEQ ID NO: 786098 - RNA, 19 nt, Homo sapiens
ucggcaccuuaaauuauua

SEQ ID NO: 786099 - RNA, 19 nt, Homo sapiens
agacgggaguuuggaguug

SEQ ID NO: 786100 - RNA, 19 nt, Homo sapiens
gugcgugugugugaaguga

SEQ ID NO: 786101 - RNA, 19 nt, Homo sapiens
uuauguagcucaggaccuu

SEQ ID NO: 786102 - RNA, 19 nt, Homo sapiens
ucauugaggaccugaagaa

SEQ ID NO: 786103 - RNA, 19 nt, Homo sapiens
cucggcaccuuaaauuauu

SEQ ID NO: 786104 - RNA, 19 nt, Homo sapiens
ucucggcaccuuaaauuau

SEQ ID NO: 786105 - RNA, 19 nt, Homo sapiens
cgacaccuccgugcacuug

SEQ ID NO: 786106 - RNA, 19 nt, Homo sapiens
gagacgggaguuuggaguu

SEQ ID NO: 786107 - RNA, 19 nt, Homo sapiens
ugaaggccaaguucuguga

SEQ ID NO: 786108 - RNA, 19 nt, Homo sapiens
acagcaagcagcucaccua

SEQ ID NO: 786109 - RNA, 19 nt, Homo sapiens
ucucguuucucuuggacaa

SEQ ID NO: 786110 - RNA, 19 nt, Homo sapiens
uaaaacaggagccgugaaa

SEQ ID NO: 786111 - RNA, 19 nt, Homo sapiens
gugaagugaccuaugacaa

SEQ ID NO: 786112 - RNA, 19 nt, Homo sapiens
ggugaaggccaaguucugu

SEQ ID NO: 786113 - RNA, 19 nt, Homo sapiens
ccggcaagguaguggaaga

SEQ ID NO: 786114 - RNA, 19 nt, Homo sapiens
ggugagcuacaaacacaug

SEQ ID NO: 786115 - RNA, 19 nt, Homo sapiens
gaccuguucucggcaccuu

SEQ ID NO: 786116 - RNA, 19 nt, Homo sapiens
aaaucucguuucucuugga

SEQ ID NO: 786117 - RNA, 19 nt, Homo sapiens
gcucaccuaccuggagaaa

SEQ ID NO: 786118 - RNA, 19 nt, Homo sapiens
acacaugcgcuuccucauc

SEQ ID NO: 786119 - RNA, 19 nt, Homo sapiens
guugcccgcuuuacuuugg

SEQ ID NO: 786120 - RNA, 19 nt, Homo sapiens
acgcucagcaccuucauug

SEQ ID NO: 786121 - RNA, 19 nt, Homo sapiens
acaccuccgugcacuugug

SEQ ID NO: 786122 - RNA, 19 nt, Homo sapiens
acaaaacgccgcuggagaa

SEQ ID NO: 786123 - RNA, 19 nt, Homo sapiens
ucaccuaccuggagaaaua

SEQ ID NO: 786124 - RNA, 19 nt, Homo sapiens
gaggugagcuacaaacaca

SEQ ID NO: 786125 - RNA, 19 nt, Homo sapiens
uugaggaccugaagaagua

SEQ ID NO: 786126 - RNA, 19 nt, Homo sapiens
gcacagggaucucguucuc

SEQ ID NO: 786127 - RNA, 19 nt, Homo sapiens
gcaagcagcucaccuaccu

SEQ ID NO: 786128 - RNA, 19 nt, Homo sapiens
aaacgccgcuggagaagga

SEQ ID NO: 786129 - RNA, 19 nt, Homo sapiens
ggucuccucuagccuguuu

SEQ ID NO: 786130 - RNA, 19 nt, Homo sapiens
ugaagugaccuaugacaaa

SEQ ID NO: 786131 - RNA, 19 nt, Homo sapiens
cacaugcgcuuccucauca

SEQ ID NO: 786132 - RNA, 19 nt, Homo sapiens
gaagugaccuaugacaaaa

SEQ ID NO: 786133 - RNA, 19 nt, Homo sapiens
ggaguugcccgcuuuacuu

SEQ ID NO: 786134 - RNA, 19 nt, Homo sapiens
ugugugaagugaccuauga

SEQ ID NO: 786135 - RNA, 19 nt, Homo sapiens
ggaucucguucuccucauu

SEQ ID NO: 786136 - RNA, 19 nt, Homo sapiens
aaacagaggcugcgguuca

SEQ ID NO: 786137 - RNA, 19 nt, Homo sapiens
uuaaaucucguuucucuug

SEQ ID NO: 786138 - RNA, 19 nt, Homo sapiens
gcggagccaucaacagcaa

SEQ ID NO: 786139 - RNA, 19 nt, Homo sapiens
gaguugcccgcuuuacuuu

SEQ ID NO: 786140 - RNA, 19 nt, Homo sapiens
guucucggcaccuuaaauu

SEQ ID NO: 786141 - RNA, 19 nt, Homo sapiens
ccucuagccuguuuguugu

SEQ ID NO: 786142 - RNA, 19 nt, Homo sapiens
ggacuggccguuugacgau

SEQ ID NO: 786143 - RNA, 19 nt, Homo sapiens
guuguggacuggccguuug

SEQ ID NO: 786144 - RNA, 19 nt, Homo sapiens
gaucucguucuccucauuu

SEQ ID NO: 786145 - RNA, 19 nt, Homo sapiens
guuuggaguugcccgcuuu

SEQ ID NO: 786146 - RNA, 19 nt, Homo sapiens
ggacacccgaaggcaauaa

SEQ ID NO: 786147 - RNA, 19 nt, Homo sapiens
aagacccggugcugcguua

SEQ ID NO: 786148 - RNA, 19 nt, Homo sapiens
ucggcaccuuaaauuauua

SEQ ID NO: 786149 - RNA, 19 nt, Homo sapiens
agacgggaguuuggaguug

SEQ ID NO: 786150 - RNA, 19 nt, Homo sapiens
gugcgugugugugaaguga

SEQ ID NO: 786151 - RNA, 19 nt, Homo sapiens
uuauguagcucaggaccuu

SEQ ID NO: 786152 - RNA, 19 nt, Homo sapiens
ucauugaggaccugaagaa

SEQ ID NO: 786153 - RNA, 19 nt, Homo sapiens
cucggcaccuuaaauuauu

SEQ ID NO: 786154 - RNA, 19 nt, Homo sapiens
ucucggcaccuuaaauuau

SEQ ID NO: 786155 - RNA, 19 nt, Homo sapiens
cgacaccuccgugcacuug

SEQ ID NO: 786156 - RNA, 19 nt, Homo sapiens
cgaggacgccauccaguuc

SEQ ID NO: 786157 - RNA, 19 nt, Homo sapiens
gagacgggaguuuggaguu

SEQ ID NO: 786158 - RNA, 19 nt, Homo sapiens
ugaaggccaaguucuguga

SEQ ID NO: 786159 - RNA, 19 nt, Homo sapiens
acagcaagcagcucaccua

SEQ ID NO: 786160 - RNA, 19 nt, Homo sapiens
ucucguuucucuuggacaa

SEQ ID NO: 786161 - RNA, 19 nt, Homo sapiens
uaaaacaggagccgugaaa

SEQ ID NO: 786162 - RNA, 19 nt, Homo sapiens
agagcgggaugaaguacga

SEQ ID NO: 786163 - RNA, 19 nt, Homo sapiens
gugaagugaccuaugacaa

SEQ ID NO: 786164 - RNA, 19 nt, Homo sapiens
ggugaaggccaaguucugu

SEQ ID NO: 786165 - RNA, 19 nt, Homo sapiens
ccggcaagguaguggaaga

SEQ ID NO: 786166 - RNA, 19 nt, Homo sapiens
ggugagcuacaaacacaug

SEQ ID NO: 786167 - RNA, 19 nt, Homo sapiens
gaccuguucucggcaccuu

SEQ ID NO: 786168 - RNA, 19 nt, Homo sapiens
aaaucucguuucucuugga

SEQ ID NO: 786169 - RNA, 19 nt, Homo sapiens
gcucaccuaccuggagaaa

SEQ ID NO: 786170 - RNA, 19 nt, Homo sapiens
acacaugcgcuuccucauc

SEQ ID NO: 786171 - RNA, 19 nt, Homo sapiens
guugcccgcuuuacuuugg

SEQ ID NO: 786172 - RNA, 19 nt, Homo sapiens
acgcucagcaccuucauug

SEQ ID NO: 786173 - RNA, 19 nt, Homo sapiens
acaccuccgugcacuugug

SEQ ID NO: 786174 - RNA, 19 nt, Homo sapiens
gaggacgccauccaguuca

SEQ ID NO: 786175 - RNA, 19 nt, Homo sapiens
acaaaacgccgcuggagaa

SEQ ID NO: 786176 - RNA, 19 nt, Homo sapiens
gcagacagaagaauaugua

SEQ ID NO: 786177 - RNA, 19 nt, Homo sapiens
cuggauggcuacaugaaua

SEQ ID NO: 786178 - RNA, 19 nt, Homo sapiens
guaaauggacaacugaaga

SEQ ID NO: 786179 - RNA, 19 nt, Homo sapiens
auggacaacugaagaauaa

SEQ ID NO: 786180 - RNA, 19 nt, Homo sapiens
uaaauucuggaguggauua

SEQ ID NO: 786181 - RNA, 19 nt, Homo sapiens
ugacaugugaguaagauaa

SEQ ID NO: 786182 - RNA, 19 nt, Homo sapiens
gagcaacgcuuuucauagu

SEQ ID NO: 786183 - RNA, 19 nt, Homo sapiens
cagaagagacggaugugaa

SEQ ID NO: 786184 - RNA, 19 nt, Homo sapiens
ggagcagacagaagaauau

SEQ ID NO: 786185 - RNA, 19 nt, Homo sapiens
gaagacaccaagagagcaa

SEQ ID NO: 786186 - RNA, 19 nt, Homo sapiens
uaaauggacaacugaagaa

SEQ ID NO: 786187 - RNA, 19 nt, Homo sapiens
cuuguaaguuucagucauu

SEQ ID NO: 786188 - RNA, 19 nt, Homo sapiens
gacaacugaagaauaagua

SEQ ID NO: 786189 - RNA, 19 nt, Homo sapiens
gguccuggcuugccuggau

SEQ ID NO: 786190 - RNA, 19 nt, Homo sapiens
ggacaacugaagaauaagu

SEQ ID NO: 786191 - RNA, 19 nt, Homo sapiens
gcauuuauccgaggaaaca

SEQ ID NO: 786192 - RNA, 19 nt, Homo sapiens
gaagagacggaugugaaga

SEQ ID NO: 786193 - RNA, 19 nt, Homo sapiens
caacugaagaauaaguaug

SEQ ID NO: 786194 - RNA, 19 nt, Homo sapiens
gcaaaccccuagugacuuc

SEQ ID NO: 786195 - RNA, 19 nt, Homo sapiens
gacaugugaguaagauaaa

SEQ ID NO: 786196 - RNA, 19 nt, Homo sapiens
cuagugacuucuuaaagca

SEQ ID NO: 786197 - RNA, 19 nt, Homo sapiens
uuaccucguugucagugua

SEQ ID NO: 786198 - RNA, 19 nt, Homo sapiens
gagagcaacgcuuuucaua

SEQ ID NO: 786199 - RNA, 19 nt, Homo sapiens
ccuagugacuucuuaaagc

SEQ ID NO: 786200 - RNA, 19 nt, Homo sapiens
cagaagaauauguaaaugg

SEQ ID NO: 786201 - RNA, 19 nt, Homo sapiens
aauggacaacugaagaaua

SEQ ID NO: 786202 - RNA, 19 nt, Homo sapiens
ggauggcuacaugaauaua

SEQ ID NO: 786203 - RNA, 19 nt, Homo sapiens
uggagcagacagaagaaua

SEQ ID NO: 786204 - RNA, 19 nt, Homo sapiens
acacagaagagacggaugu

SEQ ID NO: 786205 - RNA, 19 nt, Homo sapiens
gagcagacagaagaauaug

SEQ ID NO: 786206 - RNA, 19 nt, Homo sapiens
ggaagcaaaccccuaguga

SEQ ID NO: 786207 - RNA, 19 nt, Homo sapiens
ucaguguacagaaugcuaa

SEQ ID NO: 786208 - RNA, 19 nt, Homo sapiens
auauguaaauggacaacug

SEQ ID NO: 786209 - RNA, 19 nt, Homo sapiens
caugugaguaagauaaaug

SEQ ID NO: 786210 - RNA, 19 nt, Homo sapiens
gaugugaagacaccaagag

SEQ ID NO: 786211 - RNA, 19 nt, Homo sapiens
agugacuucuuaaagcaaa

SEQ ID NO: 786212 - RNA, 19 nt, Homo sapiens
gauggcuacaugaauauag

SEQ ID NO: 786213 - RNA, 19 nt, Homo sapiens
accaagagagcaacgcuuu

SEQ ID NO: 786214 - RNA, 19 nt, Homo sapiens
cggcgaggauuguuaaaau

SEQ ID NO: 786215 - RNA, 19 nt, Homo sapiens
aaucaucggacgaccaguu

SEQ ID NO: 786216 - RNA, 19 nt, Homo sapiens
uauguaaauggacaacuga

SEQ ID NO: 786217 - RNA, 19 nt, Homo sapiens
cagacagaagaauauguaa

SEQ ID NO: 786218 - RNA, 19 nt, Homo sapiens
agagacggaugugaagaca

SEQ ID NO: 786219 - RNA, 19 nt, Homo sapiens
auuaaauucuggaguggau

SEQ ID NO: 786220 - RNA, 19 nt, Homo sapiens
gaggagagcuagcagauau

SEQ ID NO: 786221 - RNA, 19 nt, Homo sapiens
guagggaucagcaucauua

SEQ ID NO: 786222 - RNA, 19 nt, Homo sapiens
gcagauagcuauucauucc

SEQ ID NO: 786223 - RNA, 19 nt, Homo sapiens
caacccacccauccuauua

SEQ ID NO: 786224 - RNA, 19 nt, Homo sapiens
gcaauucgauuagcugugu

SEQ ID NO: 786225 - RNA, 19 nt, Homo sapiens
caggagcucuucuagguaa

SEQ ID NO: 786226 - RNA, 19 nt, Homo sapiens
gcucuucaaugaugcaauu

SEQ ID NO: 786227 - RNA, 19 nt, Homo sapiens
gagcagauagcuauucauu

SEQ ID NO: 786228 - RNA, 19 nt, Homo sapiens
ggaaguaugaugcugauga

SEQ ID NO: 786229 - RNA, 19 nt, Homo sapiens
gauuagcugugucuuacaa

SEQ ID NO: 786230 - RNA, 19 nt, Homo sapiens
gcaucgugguggccaauaa

SEQ ID NO: 786231 - RNA, 19 nt, Homo sapiens
auacagagcuucgggaguu

SEQ ID NO: 786232 - RNA, 19 nt, Homo sapiens
gauaaucucgggcauuguu

SEQ ID NO: 786233 - RNA, 19 nt, Homo sapiens
ggaauaguuuggaccuugu

SEQ ID NO: 786234 - RNA, 19 nt, Homo sapiens
cuccugagguaaugauuua

SEQ ID NO: 786235 - RNA, 19 nt, Homo sapiens
ccuauuagccucccacauu

SEQ ID NO: 786236 - RNA, 19 nt, Homo sapiens
gggcaaauccaaacucaug

SEQ ID NO: 786237 - RNA, 19 nt, Homo sapiens
uagcagauaugccuguuca

SEQ ID NO: 786238 - RNA, 19 nt, Homo sapiens
guggagcccuuuuaaaaua

SEQ ID NO: 786239 - RNA, 19 nt, Homo sapiens
ggaaagucaccuauaggaa

SEQ ID NO: 786240 - RNA, 19 nt, Homo sapiens
uacaguaaaggcugaauua

SEQ ID NO: 786241 - RNA, 19 nt, Homo sapiens
gaaguagggaucagcauca

SEQ ID NO: 786242 - RNA, 19 nt, Homo sapiens
agaggaaagucaccuauag

SEQ ID NO: 786243 - RNA, 19 nt, Homo sapiens
ccaaacucauggagagauu

SEQ ID NO: 786244 - RNA, 19 nt, Homo sapiens
ggugacaggccuagcuaua

SEQ ID NO: 786245 - RNA, 19 nt, Homo sapiens
ggaccauccuuguggacuu

SEQ ID NO: 786246 - RNA, 19 nt, Homo sapiens
ccacaagguacguccauuu

SEQ ID NO: 786247 - RNA, 19 nt, Homo sapiens
ccaaagugcugggauuaca

SEQ ID NO: 786248 - RNA, 19 nt, Homo sapiens
caaugaugcaauucgauua

SEQ ID NO: 786249 - RNA, 19 nt, Homo sapiens
gacauaaacgugacccaaa

SEQ ID NO: 786250 - RNA, 19 nt, Homo sapiens
gaccauccuuguggacuuu

SEQ ID NO: 786251 - RNA, 19 nt, Homo sapiens
ggaauacacaagccguaaa

SEQ ID NO: 786252 - RNA, 19 nt, Homo sapiens
ugacaggccuagcuauagu

SEQ ID NO: 786253 - RNA, 19 nt, Homo sapiens
ggccagagaucccaugcau

SEQ ID NO: 786254 - RNA, 19 nt, Homo sapiens
gaugacaacgugaagauca

SEQ ID NO: 786255 - RNA, 19 nt, Homo sapiens
gaaguaugaugcugaugac

SEQ ID NO: 786256 - RNA, 19 nt, Homo sapiens
gcauaaagaggcuguccuu

SEQ ID NO: 786257 - RNA, 19 nt, Homo sapiens
gggaucagcaucauuaaca

SEQ ID NO: 786258 - RNA, 19 nt, Homo sapiens
ggacgugccagaccaggaa

SEQ ID NO: 786259 - RNA, 19 nt, Homo sapiens
gcacacagccacgguagau

SEQ ID NO: 786260 - RNA, 19 nt, Homo sapiens
gaaccgcacugacaauacc

SEQ ID NO: 786261 - RNA, 19 nt, Homo sapiens
acaggaaauuuagguguuu

SEQ ID NO: 786262 - RNA, 19 nt, Homo sapiens
guaccaauguugugaagcu

SEQ ID NO: 786263 - RNA, 19 nt, Homo sapiens
ucaucugguuuguuuguuu

SEQ ID NO: 786264 - RNA, 19 nt, Homo sapiens
gggcauuguuugcauugug

SEQ ID NO: 786265 - RNA, 19 nt, Homo sapiens
cagaggaaagucaccuaua

SEQ ID NO: 786266 - RNA, 19 nt, Homo sapiens
uacaggaaauuuagguguu

SEQ ID NO: 786267 - RNA, 19 nt, Homo sapiens
ggcagacagugaagagaau

SEQ ID NO: 786268 - RNA, 19 nt, Homo sapiens
gcaacccacccauccuauu

SEQ ID NO: 786269 - RNA, 19 nt, Homo sapiens
uucaggagcucgagaacuu

SEQ ID NO: 786270 - RNA, 19 nt, Homo sapiens
gaacucccaggacuucaug

SEQ ID NO: 786271 - RNA, 19 nt, Homo sapiens
ucaaugaugcaauucgauu

SEQ ID NO: 786272 - RNA, 19 nt, Homo sapiens
guggcuugcuaguauguuu

SEQ ID NO: 786273 - RNA, 19 nt, Homo sapiens
ccuuuaaaguuccuauuuc

SEQ ID NO: 786274 - RNA, 19 nt, Homo sapiens
cuauuagccucccacauuc

SEQ ID NO: 786275 - RNA, 19 nt, Homo sapiens
guaugaugcugaugacaac

SEQ ID NO: 786276 - RNA, 19 nt, Homo sapiens
cauuuggacuacaagaaga

SEQ ID NO: 786277 - RNA, 19 nt, Homo sapiens
cuagcuauaguuaggaaua

SEQ ID NO: 786278 - RNA, 19 nt, Homo sapiens
caucugguuuguuuguuuc

SEQ ID NO: 786279 - RNA, 19 nt, Homo sapiens
ucaccacgcccagcuaauu

SEQ ID NO: 786280 - RNA, 19 nt, Homo sapiens
uaaaauacccuucccuuca

SEQ ID NO: 786281 - RNA, 19 nt, Homo sapiens
aaccugagcaccugguaua

SEQ ID NO: 786282 - RNA, 19 nt, Homo sapiens
ggcauuguuugcauugugu

SEQ ID NO: 786283 - RNA, 19 nt, Homo sapiens
guuccuauuucagcauaaa

SEQ ID NO: 786284 - RNA, 19 nt, Homo sapiens
acucuggacugguggaaga

SEQ ID NO: 786285 - RNA, 19 nt, Homo sapiens
gaaccugagcaccugguau

SEQ ID NO: 786286 - RNA, 19 nt, Homo sapiens
cguacgcccugacccugua

SEQ ID NO: 786287 - RNA, 19 nt, Homo sapiens
acuuguggcuugcuaguau

SEQ ID NO: 786288 - RNA, 19 nt, Homo sapiens
gugggcaaauccaaacuca

SEQ ID NO: 786289 - RNA, 19 nt, Homo sapiens
ucgauuagcugugucuuac

SEQ ID NO: 786290 - RNA, 19 nt, Homo sapiens
ccaauguugugaagcucuu

SEQ ID NO: 786291 - RNA, 19 nt, Homo sapiens
gaugguaccaauguuguga

SEQ ID NO: 786292 - RNA, 19 nt, Homo sapiens
caccacgcccagcuaauuu

SEQ ID NO: 786293 - RNA, 19 nt, Homo sapiens
aaaccaaaccgagugaguu

SEQ ID NO: 786294 - RNA, 19 nt, Homo sapiens
gcugaugguaccaauguug

SEQ ID NO: 786295 - RNA, 19 nt, Homo sapiens
augauaaucucgggcauug

SEQ ID NO: 786296 - RNA, 19 nt, Homo sapiens
gcuagcagauaugccuguu

SEQ ID NO: 786297 - RNA, 19 nt, Homo sapiens
gaggaauaguuuggaccuu

SEQ ID NO: 786298 - RNA, 19 nt, Homo sapiens
cacaagguacguccauuug

SEQ ID NO: 786299 - RNA, 19 nt, Homo sapiens
gggcuucuccugagguaau

SEQ ID NO: 786300 - RNA, 19 nt, Homo sapiens
aaaauacccuucccuucaa

SEQ ID NO: 786301 - RNA, 19 nt, Homo sapiens
ggaccccucucuacagcua

SEQ ID NO: 786302 - RNA, 19 nt, Homo sapiens
agagcuuccuuuaaaguuc

SEQ ID NO: 786303 - RNA, 19 nt, Homo sapiens
gaauacacaagccguaaaa

SEQ ID NO: 786304 - RNA, 19 nt, Homo sapiens
gaccaagggaaguaugaug

SEQ ID NO: 786305 - RNA, 19 nt, Homo sapiens
uucaggagcucuucuaggu

SEQ ID NO: 786306 - RNA, 19 nt, Homo sapiens
caucaccacgcccagcuaa

SEQ ID NO: 786307 - RNA, 19 nt, Homo sapiens
cugguuuguuuguuucuuu

SEQ ID NO: 786308 - RNA, 19 nt, Homo sapiens
ggguggagcccuuuuaaaa

SEQ ID NO: 786309 - RNA, 19 nt, Homo sapiens
cggaaccgcacugacaaua

SEQ ID NO: 786310 - RNA, 19 nt, Homo sapiens
gcaggcagacagugaagag

SEQ ID NO: 786311 - RNA, 19 nt, Homo sapiens
gauguacagaggaaaguca

SEQ ID NO: 786312 - RNA, 19 nt, Homo sapiens
agguaaagcugagaucaca

SEQ ID NO: 786313 - RNA, 19 nt, Homo sapiens
acauaaacgugacccaaaa

SEQ ID NO: 786314 - RNA, 19 nt, Homo sapiens
ggaaccugagcaccuggua

SEQ ID NO: 786315 - RNA, 19 nt, Homo sapiens
aaguuccuauuucagcaua

SEQ ID NO: 786316 - RNA, 19 nt, Homo sapiens
gcagugggcaaauccaaac

SEQ ID NO: 786317 - RNA, 19 nt, Homo sapiens
acaggccuagcuauaguua

SEQ ID NO: 786318 - RNA, 19 nt, Homo sapiens
uagcuauucauuccagauu

SEQ ID NO: 786319 - RNA, 19 nt, Homo sapiens
ggaaccgcacugacaauac

SEQ ID NO: 786320 - RNA, 19 nt, Homo sapiens
gaggagagcuagcagauau

SEQ ID NO: 786321 - RNA, 19 nt, Homo sapiens
gcaauucgauuagcugugu

SEQ ID NO: 786322 - RNA, 19 nt, Homo sapiens
gcucuucaaugaugcaauu

SEQ ID NO: 786323 - RNA, 19 nt, Homo sapiens
ggaaguaugaugcugauga

SEQ ID NO: 786324 - RNA, 19 nt, Homo sapiens
gauuagcugugucuuacaa

SEQ ID NO: 786325 - RNA, 19 nt, Homo sapiens
gcaucgugguggccaauaa

SEQ ID NO: 786326 - RNA, 19 nt, Homo sapiens
auacagagcuucgggaguu

SEQ ID NO: 786327 - RNA, 19 nt, Homo sapiens
gauaaucucgggcauuguu

SEQ ID NO: 786328 - RNA, 19 nt, Homo sapiens
ggaauaguuuggaccuugu

SEQ ID NO: 786329 - RNA, 19 nt, Homo sapiens
gggcaaauccaaacucaug

SEQ ID NO: 786330 - RNA, 19 nt, Homo sapiens
uagcagauaugccuguuca

SEQ ID NO: 786331 - RNA, 19 nt, Homo sapiens
ggaaagucaccuauaggaa

SEQ ID NO: 786332 - RNA, 19 nt, Homo sapiens
agaggaaagucaccuauag

SEQ ID NO: 786333 - RNA, 19 nt, Homo sapiens
ccaaacucauggagagauu

SEQ ID NO: 786334 - RNA, 19 nt, Homo sapiens
caaugaugcaauucgauua

SEQ ID NO: 786335 - RNA, 19 nt, Homo sapiens
gacauaaacgugacccaaa

SEQ ID NO: 786336 - RNA, 19 nt, Homo sapiens
gaccauccuuguggacuuu

SEQ ID NO: 786337 - RNA, 19 nt, Homo sapiens
ggccagagaucccaugcau

SEQ ID NO: 786338 - RNA, 19 nt, Homo sapiens
gaugacaacgugaagauca

SEQ ID NO: 786339 - RNA, 19 nt, Homo sapiens
gaaguaugaugcugaugac

SEQ ID NO: 786340 - RNA, 19 nt, Homo sapiens
ggacgugccagaccaggaa

SEQ ID NO: 786341 - RNA, 19 nt, Homo sapiens
gcacacagccacgguagau

SEQ ID NO: 786342 - RNA, 19 nt, Homo sapiens
gaaccgcacugacaauacc

SEQ ID NO: 786343 - RNA, 19 nt, Homo sapiens
guaccaauguugugaagcu

SEQ ID NO: 786344 - RNA, 19 nt, Homo sapiens
aguaaaggcugaaugacau

SEQ ID NO: 786345 - RNA, 19 nt, Homo sapiens
gggcauuguuugcauugug

SEQ ID NO: 786346 - RNA, 19 nt, Homo sapiens
cagaggaaagucaccuaua

SEQ ID NO: 786347 - RNA, 19 nt, Homo sapiens
uucaggagcucgagaacuu

SEQ ID NO: 786348 - RNA, 19 nt, Homo sapiens
gaacucccaggacuucaug

SEQ ID NO: 786349 - RNA, 19 nt, Homo sapiens
ucaaugaugcaauucgauu

SEQ ID NO: 786350 - RNA, 19 nt, Homo sapiens
guggcuugcuaguauguuu

SEQ ID NO: 786351 - RNA, 19 nt, Homo sapiens
gauauacagaggaaaguca

SEQ ID NO: 786352 - RNA, 19 nt, Homo sapiens
guaugaugcugaugacaac

SEQ ID NO: 786353 - RNA, 19 nt, Homo sapiens
aaccugagcaccugguaua

SEQ ID NO: 786354 - RNA, 19 nt, Homo sapiens
ggcauuguuugcauugugu

SEQ ID NO: 786355 - RNA, 19 nt, Homo sapiens
gaaccugagcaccugguau

SEQ ID NO: 786356 - RNA, 19 nt, Homo sapiens
cguacgcccugacccugua

SEQ ID NO: 786357 - RNA, 19 nt, Homo sapiens
acuuguggcuugcuaguau

SEQ ID NO: 786358 - RNA, 19 nt, Homo sapiens
ucgauuagcugugucuuac

SEQ ID NO: 786359 - RNA, 19 nt, Homo sapiens
ccaauguugugaagcucuu

SEQ ID NO: 786360 - RNA, 19 nt, Homo sapiens
gaugguaccaauguuguga

SEQ ID NO: 786361 - RNA, 19 nt, Homo sapiens
gugggcaaauccaaacuca

SEQ ID NO: 786362 - RNA, 19 nt, Homo sapiens
uacaguaaaggcugaauga

SEQ ID NO: 786363 - RNA, 19 nt, Homo sapiens
aaaccaaaccgagugaguu

SEQ ID NO: 786364 - RNA, 19 nt, Homo sapiens
gcugaugguaccaauguug

SEQ ID NO: 786365 - RNA, 19 nt, Homo sapiens
caguaaaggcugaaugaca

SEQ ID NO: 786366 - RNA, 19 nt, Homo sapiens
augauaaucucgggcauug

SEQ ID NO: 786367 - RNA, 19 nt, Homo sapiens
gcuagcagauaugccuguu

SEQ ID NO: 786368 - RNA, 19 nt, Homo sapiens
gaccaagggaaguaugaug

SEQ ID NO: 786369 - RNA, 19 nt, Homo sapiens
ggaccccucucuacagcua

SEQ ID NO: 786370 - RNA, 19 nt, Homo sapiens
cggaaccgcacugacaaua

SEQ ID NO: 786371 - RNA, 19 nt, Homo sapiens
acauaaacgugacccaaaa

SEQ ID NO: 786372 - RNA, 19 nt, Homo sapiens
ggaaccugagcaccuggua

SEQ ID NO: 786373 - RNA, 19 nt, Homo sapiens
ggaaccgcacugacaauac

SEQ ID NO: 786374 - RNA, 19 nt, Homo sapiens
cuucaaugaugcaauucga

SEQ ID NO: 786375 - RNA, 19 nt, Homo sapiens
caucgugguggccaauaaa

SEQ ID NO: 786376 - RNA, 19 nt, Homo sapiens
gaggaaagucaccuauagg

SEQ ID NO: 786377 - RNA, 19 nt, Homo sapiens
agaccauccuuguggacuu

SEQ ID NO: 786378 - RNA, 19 nt, Homo sapiens
gcagugggcaaauccaaac

SEQ ID NO: 786379 - RNA, 19 nt, Homo sapiens
agacagcgcagugggcaaa

SEQ ID NO: 786380 - RNA, 19 nt, Homo sapiens
ucucauggauggcuuucag

SEQ ID NO: 786381 - RNA, 19 nt, Homo sapiens
ggaguucaggccagagauc

SEQ ID NO: 786382 - RNA, 19 nt, Homo sapiens
uguuugauauacagaggaa

SEQ ID NO: 786383 - RNA, 19 nt, Homo sapiens
caaacucauggagagauuu

SEQ ID NO: 786384 - RNA, 19 nt, Homo sapiens
aaccaaaccgagugaguug

SEQ ID NO: 786385 - RNA, 19 nt, Homo sapiens
cgucucggcugcugauggu

SEQ ID NO: 786386 - RNA, 19 nt, Homo sapiens
aggaaagucaccuauagga

SEQ ID NO: 786387 - RNA, 19 nt, Homo sapiens
gaggagagcuagcagauau

SEQ ID NO: 786388 - RNA, 19 nt, Homo sapiens
gcagauagcuauucauucc

SEQ ID NO: 786389 - RNA, 19 nt, Homo sapiens
caacccacccauccuauua

SEQ ID NO: 786390 - RNA, 19 nt, Homo sapiens
gcaauucgauuagcugugu

SEQ ID NO: 786391 - RNA, 19 nt, Homo sapiens
caggagcucuucuagguaa

SEQ ID NO: 786392 - RNA, 19 nt, Homo sapiens
gcucuucaaugaugcaauu

SEQ ID NO: 786393 - RNA, 19 nt, Homo sapiens
gagcagauagcuauucauu

SEQ ID NO: 786394 - RNA, 19 nt, Homo sapiens
ggaaguaugaugcugauga

SEQ ID NO: 786395 - RNA, 19 nt, Homo sapiens
gauuagcugugucuuacaa

SEQ ID NO: 786396 - RNA, 19 nt, Homo sapiens
gcaucgugguggccaauaa

SEQ ID NO: 786397 - RNA, 19 nt, Homo sapiens
auacagagcuucgggaguu

SEQ ID NO: 786398 - RNA, 19 nt, Homo sapiens
gauaaucucgggcauuguu

SEQ ID NO: 786399 - RNA, 19 nt, Homo sapiens
ggaauaguuuggaccuugu

SEQ ID NO: 786400 - RNA, 19 nt, Homo sapiens
ccuauuagccucccacauu

SEQ ID NO: 786401 - RNA, 19 nt, Homo sapiens
uuagggaucagcaucauua

SEQ ID NO: 786402 - RNA, 19 nt, Homo sapiens
gggcaaauccaaacucaug

SEQ ID NO: 786403 - RNA, 19 nt, Homo sapiens
uagcagauaugccuguuca

SEQ ID NO: 786404 - RNA, 19 nt, Homo sapiens
guggagcccuuuuaaaaua

SEQ ID NO: 786405 - RNA, 19 nt, Homo sapiens
ggaaagucaccuauaggaa

SEQ ID NO: 786406 - RNA, 19 nt, Homo sapiens
agaggaaagucaccuauag

SEQ ID NO: 786407 - RNA, 19 nt, Homo sapiens
ccaaacucauggagagauu

SEQ ID NO: 786408 - RNA, 19 nt, Homo sapiens
ggugacaggccuagcuaua

SEQ ID NO: 786409 - RNA, 19 nt, Homo sapiens
ccacaagguacguccauuu

SEQ ID NO: 786410 - RNA, 19 nt, Homo sapiens
ccaaagugcugggauuaca

SEQ ID NO: 786411 - RNA, 19 nt, Homo sapiens
gaagcagaauuagggauca

SEQ ID NO: 786412 - RNA, 19 nt, Homo sapiens
caaugaugcaauucgauua

SEQ ID NO: 786413 - RNA, 19 nt, Homo sapiens
gacauaaacgugacccaaa

SEQ ID NO: 786414 - RNA, 19 nt, Homo sapiens
gaccauccuuguggacuuu

SEQ ID NO: 786415 - RNA, 19 nt, Homo sapiens
ggaauacacaagcgguaaa

SEQ ID NO: 786416 - RNA, 19 nt, Homo sapiens
ugacaggccuagcuauagu

SEQ ID NO: 786417 - RNA, 19 nt, Homo sapiens
ggccagagaucccaugcau

SEQ ID NO: 786418 - RNA, 19 nt, Homo sapiens
gaugacaacgugaagauca

SEQ ID NO: 786419 - RNA, 19 nt, Homo sapiens
gaaguaugaugcugaugac

SEQ ID NO: 786420 - RNA, 19 nt, Homo sapiens
gcauaaagaggcuguccuu

SEQ ID NO: 786421 - RNA, 19 nt, Homo sapiens
gggaucagcaucauuaaca

SEQ ID NO: 786422 - RNA, 19 nt, Homo sapiens
ggacgugccagaccaggaa

SEQ ID NO: 786423 - RNA, 19 nt, Homo sapiens
gcacacagccacgguagau

SEQ ID NO: 786424 - RNA, 19 nt, Homo sapiens
acaggaaauuuagguguuu

SEQ ID NO: 786425 - RNA, 19 nt, Homo sapiens
gaauuagggaucagcauca

SEQ ID NO: 786426 - RNA, 19 nt, Homo sapiens
gaaccgcacugacaauacc

SEQ ID NO: 786427 - RNA, 19 nt, Homo sapiens
guaccaauguugugaagcu

SEQ ID NO: 786428 - RNA, 19 nt, Homo sapiens
ucaucugguuuguuuguuu

SEQ ID NO: 786429 - RNA, 19 nt, Homo sapiens
aguaaaggcugaaugacau

SEQ ID NO: 786430 - RNA, 19 nt, Homo sapiens
gggcauuguuugcauugug

SEQ ID NO: 786431 - RNA, 19 nt, Homo sapiens
cagaggaaagucaccuaua

SEQ ID NO: 786432 - RNA, 19 nt, Homo sapiens
uacaggaaauuuagguguu

SEQ ID NO: 786433 - RNA, 19 nt, Homo sapiens
ggcagacagugaagagaau

SEQ ID NO: 786434 - RNA, 19 nt, Homo sapiens
gcaacccacccauccuauu

SEQ ID NO: 786435 - RNA, 19 nt, Homo sapiens
uucaggagcucgagaacuu

SEQ ID NO: 786436 - RNA, 19 nt, Homo sapiens
gaacucccaggacuucaug

SEQ ID NO: 786437 - RNA, 19 nt, Homo sapiens
ucaaugaugcaauucgauu

SEQ ID NO: 786438 - RNA, 19 nt, Homo sapiens
guggcuugcuaguauguuu

SEQ ID NO: 786439 - RNA, 19 nt, Homo sapiens
ccuuuaaaguuccuauuuc

SEQ ID NO: 786440 - RNA, 19 nt, Homo sapiens
cuauuagccucccacauuc

SEQ ID NO: 786441 - RNA, 19 nt, Homo sapiens
gauauacagaggaaaguca

SEQ ID NO: 786442 - RNA, 19 nt, Homo sapiens
cauuuggacuacaagaaga

SEQ ID NO: 786443 - RNA, 19 nt, Homo sapiens
cuagcuauaguuaggaaua

SEQ ID NO: 786444 - RNA, 19 nt, Homo sapiens
caucugguuuguuuguuuc

SEQ ID NO: 786445 - RNA, 19 nt, Homo sapiens
guaugaugcugaugacaac

SEQ ID NO: 786446 - RNA, 19 nt, Homo sapiens
ucaccacgcccagcuaauu

SEQ ID NO: 786447 - RNA, 19 nt, Homo sapiens
uaaaauacccuucccuuca

SEQ ID NO: 786448 - RNA, 19 nt, Homo sapiens
aaccugagcaccugguaua

SEQ ID NO: 786449 - RNA, 19 nt, Homo sapiens
ggcauuguuugcauugugu

SEQ ID NO: 786450 - RNA, 19 nt, Homo sapiens
guuccuauuucagcauaaa

SEQ ID NO: 786451 - RNA, 19 nt, Homo sapiens
acucuggacugguggaaga

SEQ ID NO: 786452 - RNA, 19 nt, Homo sapiens
gaaccugagcaccugguau

SEQ ID NO: 786453 - RNA, 19 nt, Homo sapiens
cguacgcccugacccugua

SEQ ID NO: 786454 - RNA, 19 nt, Homo sapiens
acuuguggcuugcuaguau

SEQ ID NO: 786455 - RNA, 19 nt, Homo sapiens
gugggcaaauccaaacuca

SEQ ID NO: 786456 - RNA, 19 nt, Homo sapiens
ucgauuagcugugucuuac

SEQ ID NO: 786457 - RNA, 19 nt, Homo sapiens
ccaauguugugaagcucuu

SEQ ID NO: 786458 - RNA, 19 nt, Homo sapiens
gaugguaccaauguuguga

SEQ ID NO: 786459 - RNA, 19 nt, Homo sapiens
uacaguaaaggcugaauga

SEQ ID NO: 786460 - RNA, 19 nt, Homo sapiens
aaaccaaaccgagugaguu

SEQ ID NO: 786461 - RNA, 19 nt, Homo sapiens
caccacgcccagcuaauuu

SEQ ID NO: 786462 - RNA, 19 nt, Homo sapiens
gcugaugguaccaauguug

SEQ ID NO: 786463 - RNA, 19 nt, Homo sapiens
caguaaaggcugaaugaca

SEQ ID NO: 786464 - RNA, 19 nt, Homo sapiens
augauaaucucgggcauug

SEQ ID NO: 786465 - RNA, 19 nt, Homo sapiens
gcuagcagauaugccuguu

SEQ ID NO: 786466 - RNA, 19 nt, Homo sapiens
cacaagguacguccauuug

SEQ ID NO: 786467 - RNA, 19 nt, Homo sapiens
gggcuucuccugagguaau

SEQ ID NO: 786468 - RNA, 19 nt, Homo sapiens
aaaauacccuucccuucaa

SEQ ID NO: 786469 - RNA, 19 nt, Homo sapiens
agagcuuccuuuaaaguuc

SEQ ID NO: 786470 - RNA, 19 nt, Homo sapiens
uucaggagcucuucuaggu

SEQ ID NO: 786471 - RNA, 19 nt, Homo sapiens
caucaccacgcccagcuaa

SEQ ID NO: 786472 - RNA, 19 nt, Homo sapiens
gaccaagggaaguaugaug

SEQ ID NO: 786473 - RNA, 19 nt, Homo sapiens
ggaccccucucuacagcua

SEQ ID NO: 786474 - RNA, 19 nt, Homo sapiens
cugguuuguuuguuucuuu

SEQ ID NO: 786475 - RNA, 19 nt, Homo sapiens
ggguggagcccuuuuaaaa

SEQ ID NO: 786476 - RNA, 19 nt, Homo sapiens
cggaaccgcacugacaaua

SEQ ID NO: 786477 - RNA, 19 nt, Homo sapiens
agguaaagcugagaucaca

SEQ ID NO: 786478 - RNA, 19 nt, Homo sapiens
ucuccuugaagcagaauua

SEQ ID NO: 786479 - RNA, 19 nt, Homo sapiens
acauaaacgugacccaaaa

SEQ ID NO: 786480 - RNA, 19 nt, Homo sapiens
ggaaccugagcaccuggua

SEQ ID NO: 786481 - RNA, 19 nt, Homo sapiens
ggaaccgcacugacaauac

SEQ ID NO: 786482 - RNA, 19 nt, Homo sapiens
aaguuccuauuucagcaua

SEQ ID NO: 786483 - RNA, 19 nt, Homo sapiens
acaggccuagcuauaguua

SEQ ID NO: 786484 - RNA, 19 nt, Homo sapiens
uagcuauucauuccagauu

SEQ ID NO: 786485 - RNA, 19 nt, Homo sapiens
gcagugggcaaauccaaac

SEQ ID NO: 786486 - RNA, 19 nt, Homo sapiens
gacaauuccuugggcuucu

SEQ ID NO: 786487 - RNA, 19 nt, Homo sapiens
gaacuauacugcugacuau

SEQ ID NO: 786488 - RNA, 19 nt, Homo sapiens
gcaaagacauuccuaacau

SEQ ID NO: 786489 - RNA, 19 nt, Homo sapiens
ggaagaaggcgcucauuga

SEQ ID NO: 786490 - RNA, 19 nt, Homo sapiens
gaacgcaguguaugauaua

SEQ ID NO: 786491 - RNA, 19 nt, Homo sapiens
cagaugaggugaagaaugu

SEQ ID NO: 786492 - RNA, 19 nt, Homo sapiens
agacaaagcuucucauugc

SEQ ID NO: 786493 - RNA, 19 nt, Homo sapiens
gaucuacuuugacagaauu

SEQ ID NO: 786494 - RNA, 19 nt, Homo sapiens
gauagaagagggacauauu

SEQ ID NO: 786495 - RNA, 19 nt, Homo sapiens
gugcuacacugcuaugaaa

SEQ ID NO: 786496 - RNA, 19 nt, Homo sapiens
caaagacauuccuaacaug

SEQ ID NO: 786497 - RNA, 19 nt, Homo sapiens
gaaaauagccgaagccaau

SEQ ID NO: 786498 - RNA, 19 nt, Homo sapiens
ggcagaaggugauggagaa

SEQ ID NO: 786499 - RNA, 19 nt, Homo sapiens
acauugagcuguuugauca

SEQ ID NO: 786500 - RNA, 19 nt, Homo sapiens
gaaggagacugagaagaag

SEQ ID NO: 786501 - RNA, 19 nt, Homo sapiens
caacagcaagauuuacuuu

SEQ ID NO: 786502 - RNA, 19 nt, Homo sapiens
ugacaaggcccucaucuuc

SEQ ID NO: 786503 - RNA, 19 nt, Homo sapiens
gguaacaaagcccaacaua

SEQ ID NO: 786504 - RNA, 19 nt, Homo sapiens
agaaggagacugagaagaa

SEQ ID NO: 786505 - RNA, 19 nt, Homo sapiens
cgaacgcaguguaugauau

SEQ ID NO: 786506 - RNA, 19 nt, Homo sapiens
gaauaucugcagcugauga

SEQ ID NO: 786507 - RNA, 19 nt, Homo sapiens
gugaugaucuacuuugaca

SEQ ID NO: 786508 - RNA, 19 nt, Homo sapiens
gaugaucuacuuugacaga

SEQ ID NO: 786509 - RNA, 19 nt, Homo sapiens
acaaggcccucaucuucaa

SEQ ID NO: 786510 - RNA, 19 nt, Homo sapiens
uaacaaagcccaacauacc

SEQ ID NO: 786511 - RNA, 19 nt, Homo sapiens
ggucuacauugagcuguuu

SEQ ID NO: 786512 - RNA, 19 nt, Homo sapiens
ggugaagaauguaccuugu

SEQ ID NO: 786513 - RNA, 19 nt, Homo sapiens
gaagcuaaccccugaauau

SEQ ID NO: 786514 - RNA, 19 nt, Homo sapiens
caacaagauccaccacgaa

SEQ ID NO: 786515 - RNA, 19 nt, Homo sapiens
gauggaaagugagaagaca

SEQ ID NO: 786516 - RNA, 19 nt, Homo sapiens
caacauaccagaggcaauc

SEQ ID NO: 786517 - RNA, 19 nt, Homo sapiens
agacagaugaggugaagaa

SEQ ID NO: 786518 - RNA, 19 nt, Homo sapiens
cugaauaucugcagcugau

SEQ ID NO: 786519 - RNA, 19 nt, Homo sapiens
agaccacacuccagacaga

SEQ ID NO: 786520 - RNA, 19 nt, Homo sapiens
agaaggugauggagaagga

SEQ ID NO: 786521 - RNA, 19 nt, Homo sapiens
acagcaagauuuacuuugg

SEQ ID NO: 786522 - RNA, 19 nt, Homo sapiens
gacaaggcccucaucuuca

SEQ ID NO: 786523 - RNA, 19 nt, Homo sapiens
agacugagaagaagauuuc

SEQ ID NO: 786524 - RNA, 19 nt, Homo sapiens
gcagagacagagcggaaga

SEQ ID NO: 786525 - RNA, 19 nt, Homo sapiens
ccagacagaugaggugaag

SEQ ID NO: 786526 - RNA, 19 nt, Homo sapiens
acaaggccauugcuuccaa

SEQ ID NO: 786527 - RNA, 19 nt, Homo sapiens
gugguggugugaugaucua

SEQ ID NO: 786528 - RNA, 19 nt, Homo sapiens
cagaggcaauccgcagaaa

SEQ ID NO: 786529 - RNA, 19 nt, Homo sapiens
ggcaaagacauuccuaaca

SEQ ID NO: 786530 - RNA, 19 nt, Homo sapiens
ucucagcugugcacaagau

SEQ ID NO: 786531 - RNA, 19 nt, Homo sapiens
caagauccaccacgaacug

SEQ ID NO: 786532 - RNA, 19 nt, Homo sapiens
gacuagugguggugugaug

SEQ ID NO: 786533 - RNA, 19 nt, Homo sapiens
guaacaaagcccaacauac

SEQ ID NO: 786534 - RNA, 19 nt, Homo sapiens
ugagcuguuugaucagauu

SEQ ID NO: 786535 - RNA, 19 nt, Homo sapiens
agaacuauacugcugacua

SEQ ID NO: 786536 - RNA, 19 nt, Homo sapiens
gugugaugaucuacuuuga

SEQ ID NO: 786537 - RNA, 19 nt, Homo sapiens
caucacaucauauaagucu

SEQ ID NO: 786538 - RNA, 19 nt, Homo sapiens
acgaguugauggaaaguga

SEQ ID NO: 786539 - RNA, 19 nt, Homo sapiens
guggugugaugaucuacuu

SEQ ID NO: 786540 - RNA, 19 nt, Homo sapiens
gagacugagaagaagauuu

SEQ ID NO: 786541 - RNA, 19 nt, Homo sapiens
aaacagaaggugguggaaa

SEQ ID NO: 786542 - RNA, 19 nt, Homo sapiens
ggcuguggcuuccaguuuc

SEQ ID NO: 786543 - RNA, 19 nt, Homo sapiens
ucccuuucaucacaucaua

SEQ ID NO: 786544 - RNA, 19 nt, Homo sapiens
cgcaguguaugauauagug

SEQ ID NO: 786545 - RNA, 19 nt, Homo sapiens
caugcucccuuucaucaca

SEQ ID NO: 786546 - RNA, 19 nt, Homo sapiens
gcagugugagcaagcaguu

SEQ ID NO: 786547 - RNA, 19 nt, Homo sapiens
ggagaaggagacugagaag

SEQ ID NO: 786548 - RNA, 19 nt, Homo sapiens
ugauggagaaggagacuga

SEQ ID NO: 786549 - RNA, 19 nt, Homo sapiens
cggaagaaggcgcucauug

SEQ ID NO: 786550 - RNA, 19 nt, Homo sapiens
ggugugaugaucuacuuug

SEQ ID NO: 786551 - RNA, 19 nt, Homo sapiens
ccacacuccagacagauga

SEQ ID NO: 786552 - RNA, 19 nt, Homo sapiens
gcagaccacacuccagaca

SEQ ID NO: 786553 - RNA, 19 nt, Homo sapiens
cuuccaacagcaagauuua

SEQ ID NO: 786554 - RNA, 19 nt, Homo sapiens
aaauagccgaagccaauaa

SEQ ID NO: 786555 - RNA, 19 nt, Homo sapiens
cuacacugcuaugaaaaua

SEQ ID NO: 786556 - RNA, 19 nt, Homo sapiens
gaaacagaaggugguggaa

SEQ ID NO: 786557 - RNA, 19 nt, Homo sapiens
gaggcaauccgcagaaacu

SEQ ID NO: 786558 - RNA, 19 nt, Homo sapiens
ccuuggagacggccacuaa

SEQ ID NO: 786559 - RNA, 19 nt, Homo sapiens
gagaaggagacugagaaga

SEQ ID NO: 786560 - RNA, 19 nt, Homo sapiens
ccuuucaucacaucauaua

SEQ ID NO: 786561 - RNA, 19 nt, Homo sapiens
gcuuuggcuuagaagauga

SEQ ID NO: 786562 - RNA, 19 nt, Homo sapiens
caagauagaagagggacau

SEQ ID NO: 786563 - RNA, 19 nt, Homo sapiens
aagacaaagcuucucauug

SEQ ID NO: 786564 - RNA, 19 nt, Homo sapiens
gaaagugagaagacaaagc

SEQ ID NO: 786565 - RNA, 19 nt, Homo sapiens
ugaucuacuuugacagaau

SEQ ID NO: 786566 - RNA, 19 nt, Homo sapiens
ucacaucauauaagucugu

SEQ ID NO: 786567 - RNA, 19 nt, Homo sapiens
aucugcagcugaugaagua

SEQ ID NO: 786568 - RNA, 19 nt, Homo sapiens
ggagaaggcaaaggcagau

SEQ ID NO: 786569 - RNA, 19 nt, Homo sapiens
cagcugugcacaagauaga

SEQ ID NO: 786570 - RNA, 19 nt, Homo sapiens
gcuucaagaggucuacauu

SEQ ID NO: 786571 - RNA, 19 nt, Homo sapiens
acuauacugcugacuauga

SEQ ID NO: 786572 - RNA, 19 nt, Homo sapiens
ccgaacgcaguguaugaua

SEQ ID NO: 786573 - RNA, 19 nt, Homo sapiens
ggcccugguuuccaucuca

SEQ ID NO: 786574 - RNA, 19 nt, Homo sapiens
aggcagaugcugagugcua

SEQ ID NO: 786575 - RNA, 19 nt, Homo sapiens
caucucaugcucccuuuca

SEQ ID NO: 786576 - RNA, 19 nt, Homo sapiens
auagaagagggacauauug

SEQ ID NO: 786577 - RNA, 19 nt, Homo sapiens
gcuuccaacagcaagauuu

SEQ ID NO: 786578 - RNA, 19 nt, Homo sapiens
uggaaagugagaagacaaa

SEQ ID NO: 786579 - RNA, 19 nt, Homo sapiens
ccaacagcaagauuuacuu

SEQ ID NO: 786580 - RNA, 19 nt, Homo sapiens
uggagaaggagacugagaa

SEQ ID NO: 786581 - RNA, 19 nt, Homo sapiens
ccagaggcaauccgcagaa

SEQ ID NO: 786582 - RNA, 19 nt, Homo sapiens
agacggccacuaaggagaa

SEQ ID NO: 786583 - RNA, 19 nt, Homo sapiens
uagaagagggacauauugg

SEQ ID NO: 786584 - RNA, 19 nt, Homo sapiens
ugagaagaagauuucagaa

SEQ ID NO: 786585 - RNA, 19 nt, Homo sapiens
ggaaaaggaagcagagaca

SEQ ID NO: 786586 - RNA, 19 nt, Homo sapiens
aacagaaggugguggaaaa

SEQ ID NO: 786587 - RNA, 19 nt, Homo sapiens
gauaagaacucuaacaaac

SEQ ID NO: 786588 - RNA, 19 nt, Homo sapiens
gaccacagcucuccuucua

SEQ ID NO: 786589 - RNA, 19 nt, Homo sapiens
ggaagagucugggcuguuu

SEQ ID NO: 786590 - RNA, 19 nt, Homo sapiens
gggaacaugugaacuauga

SEQ ID NO: 786591 - RNA, 19 nt, Homo sapiens
guucacaacuaaacacuaa

SEQ ID NO: 786592 - RNA, 19 nt, Homo sapiens
gaucaguucuuguacuuug

SEQ ID NO: 786593 - RNA, 19 nt, Homo sapiens
gaaguuggcugguuauggu

SEQ ID NO: 786594 - RNA, 19 nt, Homo sapiens
gcuaagaggugggauuuga

SEQ ID NO: 786595 - RNA, 19 nt, Homo sapiens
uuaagaaguuggcugguua

SEQ ID NO: 786596 - RNA, 19 nt, Homo sapiens
gaacuaggcagcauagaug

SEQ ID NO: 786597 - RNA, 19 nt, Homo sapiens
gaaccaguauccagacaga

SEQ ID NO: 786598 - RNA, 19 nt, Homo sapiens
gcucauuccucuuguauuc

SEQ ID NO: 786599 - RNA, 19 nt, Homo sapiens
ggaacacgcugcagagcuu

SEQ ID NO: 786600 - RNA, 19 nt, Homo sapiens
gaaacagauucuugagaga

SEQ ID NO: 786601 - RNA, 19 nt, Homo sapiens
ggacaggcaguucuucuaa

SEQ ID NO: 786602 - RNA, 19 nt, Homo sapiens
gaaacugaggccagcauua

SEQ ID NO: 786603 - RNA, 19 nt, Homo sapiens
gaacaugugaacuaugaaa

SEQ ID NO: 786604 - RNA, 19 nt, Homo sapiens
gauuugagcugagacuuga

SEQ ID NO: 786605 - RNA, 19 nt, Homo sapiens
gcaacuggaagguagaaua

SEQ ID NO: 786606 - RNA, 19 nt, Homo sapiens
gggaacguaacuuaaauua

SEQ ID NO: 786607 - RNA, 19 nt, Homo sapiens
cgucgucucuccucuuuaa

SEQ ID NO: 786608 - RNA, 19 nt, Homo sapiens
gaacuucaaauagggauaa

SEQ ID NO: 786609 - RNA, 19 nt, Homo sapiens
cagcauagaugaaacaacu

SEQ ID NO: 786610 - RNA, 19 nt, Homo sapiens
gcuccgguaucuagaagua

SEQ ID NO: 786611 - RNA, 19 nt, Homo sapiens
gcucugaucaguucuugua

SEQ ID NO: 786612 - RNA, 19 nt, Homo sapiens
ugcaucagcuucccaagua

SEQ ID NO: 786613 - RNA, 19 nt, Homo sapiens
ggauaagaacucuaacaaa

SEQ ID NO: 786614 - RNA, 19 nt, Homo sapiens
ggucagcuguauuugugua

SEQ ID NO: 786615 - RNA, 19 nt, Homo sapiens
ccacagcucuccuucuauc

SEQ ID NO: 786616 - RNA, 19 nt, Homo sapiens
gaauggacaguugcucuua

SEQ ID NO: 786617 - RNA, 19 nt, Homo sapiens
ugaaacaacugcaugacau

SEQ ID NO: 786618 - RNA, 19 nt, Homo sapiens
gaauacaccauagugagua

SEQ ID NO: 786619 - RNA, 19 nt, Homo sapiens
cuuuaugccugauugaaua

SEQ ID NO: 786620 - RNA, 19 nt, Homo sapiens
ccauugacauucacaacaa

SEQ ID NO: 786621 - RNA, 19 nt, Homo sapiens
gaagaguuaggaagugaaa

SEQ ID NO: 786622 - RNA, 19 nt, Homo sapiens
gaagguagaauagucuuau

SEQ ID NO: 786623 - RNA, 19 nt, Homo sapiens
ccacauccagcuaacauuu

SEQ ID NO: 786624 - RNA, 19 nt, Homo sapiens
ggacgcugcucucaucagu

SEQ ID NO: 786625 - RNA, 19 nt, Homo sapiens
cgucucuccucuuuaauuu

SEQ ID NO: 786626 - RNA, 19 nt, Homo sapiens
ggaagguagaauagucuua

SEQ ID NO: 786627 - RNA, 19 nt, Homo sapiens
uaggacagcucaugacaca

SEQ ID NO: 786628 - RNA, 19 nt, Homo sapiens
caaggaauaagaacuaugu

SEQ ID NO: 786629 - RNA, 19 nt, Homo sapiens
cugaauguguuaagaaguu

SEQ ID NO: 786630 - RNA, 19 nt, Homo sapiens
gggauaagaacucuaacaa

SEQ ID NO: 786631 - RNA, 19 nt, Homo sapiens
acagcauggugaagaguua

SEQ ID NO: 786632 - RNA, 19 nt, Homo sapiens
guacuuugaccucugcuaa

SEQ ID NO: 786633 - RNA, 19 nt, Homo sapiens
guuaagaaguuggcugguu

SEQ ID NO: 786634 - RNA, 19 nt, Homo sapiens
acaagacgcucuaucacau

SEQ ID NO: 786635 - RNA, 19 nt, Homo sapiens
ggugggaacaugugaacua

SEQ ID NO: 786636 - RNA, 19 nt, Homo sapiens
gugaagaguuaggaaguga

SEQ ID NO: 786637 - RNA, 19 nt, Homo sapiens
caagguaacagaaucaaca

SEQ ID NO: 786638 - RNA, 19 nt, Homo sapiens
cuaggagaaucacagcuuu

SEQ ID NO: 786639 - RNA, 19 nt, Homo sapiens
ccagacagaagaagagaaa

SEQ ID NO: 786640 - RNA, 19 nt, Homo sapiens
cgaggagaaugcacuggaa

SEQ ID NO: 786641 - RNA, 19 nt, Homo sapiens
ccucugcucugaucaguuc

SEQ ID NO: 786642 - RNA, 19 nt, Homo sapiens
gucaagaaauugccagcuu

SEQ ID NO: 786643 - RNA, 19 nt, Homo sapiens
ccauccaagucaagaaauu

SEQ ID NO: 786644 - RNA, 19 nt, Homo sapiens
gagaaucacagcuuuaugc

SEQ ID NO: 786645 - RNA, 19 nt, Homo sapiens
ccuccaagcucggaccuuu

SEQ ID NO: 786646 - RNA, 19 nt, Homo sapiens
gagcagcaacuggaaggua

SEQ ID NO: 786647 - RNA, 19 nt, Homo sapiens
ccucugagcccuaggagaa

SEQ ID NO: 786648 - RNA, 19 nt, Homo sapiens
gaacugcagcucccacgau

SEQ ID NO: 786649 - RNA, 19 nt, Homo sapiens
ucucugaguuguuugucua

SEQ ID NO: 786650 - RNA, 19 nt, Homo sapiens
caacuggaagguagaauag

SEQ ID NO: 786651 - RNA, 19 nt, Homo sapiens
uaagaacucuaacaaacac

SEQ ID NO: 786652 - RNA, 19 nt, Homo sapiens
gagucugcguucacaacua

SEQ ID NO: 786653 - RNA, 19 nt, Homo sapiens
caugugaacuaugaaacuu

SEQ ID NO: 786654 - RNA, 19 nt, Homo sapiens
cuccaggacuuucucguuu

SEQ ID NO: 786655 - RNA, 19 nt, Homo sapiens
caugagccguuuccugaau

SEQ ID NO: 786656 - RNA, 19 nt, Homo sapiens
cuuauuuccuccuaaagaa

SEQ ID NO: 786657 - RNA, 19 nt, Homo sapiens
agucugcguucacaacuaa

SEQ ID NO: 786658 - RNA, 19 nt, Homo sapiens
gcucggaccuuugggaucu

SEQ ID NO: 786659 - RNA, 19 nt, Homo sapiens
aaacugaggccagcauuau

SEQ ID NO: 786660 - RNA, 19 nt, Homo sapiens
ggcauuuccucucugaguu

SEQ ID NO: 786661 - RNA, 19 nt, Homo sapiens
ugaaugcccaggaguuaaa

SEQ ID NO: 786662 - RNA, 19 nt, Homo sapiens
ggauuugagcugagacuug

SEQ ID NO: 786663 - RNA, 19 nt, Homo sapiens
acgcugcucucaucaguga

SEQ ID NO: 786664 - RNA, 19 nt, Homo sapiens
agccaaaccuugugaaugg

SEQ ID NO: 786665 - RNA, 19 nt, Homo sapiens
acaacaagacgcucuauca

SEQ ID NO: 786666 - RNA, 19 nt, Homo sapiens
ggaauggacaguugcucuu

SEQ ID NO: 786667 - RNA, 19 nt, Homo sapiens
guaacuccauccaagucaa

SEQ ID NO: 786668 - RNA, 19 nt, Homo sapiens
ggugaagaguuaggaagug

SEQ ID NO: 786669 - RNA, 19 nt, Homo sapiens
gcccaggaguuaaaugucu

SEQ ID NO: 786670 - RNA, 19 nt, Homo sapiens
ggagcaggccguuagaaag

SEQ ID NO: 786671 - RNA, 19 nt, Homo sapiens
aauggacaguugcucuuaa

SEQ ID NO: 786672 - RNA, 19 nt, Homo sapiens
ggaagaagacaacuaaacc

SEQ ID NO: 786673 - RNA, 19 nt, Homo sapiens
ucaagagucugcguucaca

SEQ ID NO: 786674 - RNA, 19 nt, Homo sapiens
gagcaggccguuagaaagg

SEQ ID NO: 786675 - RNA, 19 nt, Homo sapiens
caaauagggauaagaacuc

SEQ ID NO: 786676 - RNA, 19 nt, Homo sapiens
gauggggucuuacuauguu

SEQ ID NO: 786677 - RNA, 19 nt, Homo sapiens
cuaacaaacacaagguauu

SEQ ID NO: 786678 - RNA, 19 nt, Homo sapiens
ccugugggccuuauauuau

SEQ ID NO: 786679 - RNA, 19 nt, Homo sapiens
caaaaggccauugcuauuu

SEQ ID NO: 786680 - RNA, 19 nt, Homo sapiens
gugggaacaugugaacuau

SEQ ID NO: 786681 - RNA, 19 nt, Homo sapiens
ggaacguaacuuaaauuag

SEQ ID NO: 786682 - RNA, 19 nt, Homo sapiens
gggaagaagacaacuaaac

SEQ ID NO: 786683 - RNA, 19 nt, Homo sapiens
gcaugaggguuggaagagu

SEQ ID NO: 786684 - RNA, 19 nt, Homo sapiens
gggacaggcaguucuucua

SEQ ID NO: 786685 - RNA, 19 nt, Homo sapiens
cuucaaauagggauaagaa

SEQ ID NO: 786686 - RNA, 19 nt, Homo sapiens
cuaaagaagaaacagauuc

SEQ ID NO: 786687 - RNA, 19 nt, Homo sapiens
gaagaaugcuuaagaugug

SEQ ID NO: 786688 - RNA, 19 nt, Homo sapiens
ggaagaaugcuuaagaugu

SEQ ID NO: 786689 - RNA, 19 nt, Homo sapiens
gaacugccagagaauuaua

SEQ ID NO: 786690 - RNA, 19 nt, Homo sapiens
uauaucaucugccgccuaa

SEQ ID NO: 786691 - RNA, 19 nt, Homo sapiens
cauguagacuaacgaauga

SEQ ID NO: 786692 - RNA, 19 nt, Homo sapiens
auaaggaacugccagagaa

SEQ ID NO: 786693 - RNA, 19 nt, Homo sapiens
ccauauucauucaccauaa

SEQ ID NO: 786694 - RNA, 19 nt, Homo sapiens
gagaagggcccagcagauu

SEQ ID NO: 786695 - RNA, 19 nt, Homo sapiens
cgaaugacauaagaaauag

SEQ ID NO: 786696 - RNA, 19 nt, Homo sapiens
gaagguagaacagcuguau

SEQ ID NO: 786697 - RNA, 19 nt, Homo sapiens
ugaagagacugguauaaaa

SEQ ID NO: 786698 - RNA, 19 nt, Homo sapiens
ggagcuguauuugaugaaa

SEQ ID NO: 786699 - RNA, 19 nt, Homo sapiens
cuccaaagccgauuuauug

SEQ ID NO: 786700 - RNA, 19 nt, Homo sapiens
caauggcgaucagaaggua

SEQ ID NO: 786701 - RNA, 19 nt, Homo sapiens
ucaaugaccuggcgaagac

SEQ ID NO: 786702 - RNA, 19 nt, Homo sapiens
cuaaagccauauucauuca

SEQ ID NO: 786703 - RNA, 19 nt, Homo sapiens
uuaaacaucugacugugau

SEQ ID NO: 786704 - RNA, 19 nt, Homo sapiens
ccaggaagaaugcuuaaga

SEQ ID NO: 786705 - RNA, 19 nt, Homo sapiens
acacaaauccuggagcuuu

SEQ ID NO: 786706 - RNA, 19 nt, Homo sapiens
caggaagaaugcuuaagau

SEQ ID NO: 786707 - RNA, 19 nt, Homo sapiens
caggagcuguauuugauga

SEQ ID NO: 786708 - RNA, 19 nt, Homo sapiens
cauaagaaauaguggacau

SEQ ID NO: 786709 - RNA, 19 nt, Homo sapiens
gccuaaagccauauucauu

SEQ ID NO: 786710 - RNA, 19 nt, Homo sapiens
agaagggcccagcagauua

SEQ ID NO: 786711 - RNA, 19 nt, Homo sapiens
ggauaugcuucacaucaag

SEQ ID NO: 786712 - RNA, 19 nt, Homo sapiens
gaaaauacaacucccauca

SEQ ID NO: 786713 - RNA, 19 nt, Homo sapiens
ugaccugacuguggaagaa

SEQ ID NO: 786714 - RNA, 19 nt, Homo sapiens
ugcaggagcuguauuugau

SEQ ID NO: 786715 - RNA, 19 nt, Homo sapiens
agacacagcgguucgagaa

SEQ ID NO: 786716 - RNA, 19 nt, Homo sapiens
uugcuaggcugcugcugua

SEQ ID NO: 786717 - RNA, 19 nt, Homo sapiens
guacagcaauggcgaucag

SEQ ID NO: 786718 - RNA, 19 nt, Homo sapiens
guauaugauuuccaugaag

SEQ ID NO: 786719 - RNA, 19 nt, Homo sapiens
gcacauucccauccuccaa

SEQ ID NO: 786720 - RNA, 19 nt, Homo sapiens
aaacaucugacugugauuu

SEQ ID NO: 786721 - RNA, 19 nt, Homo sapiens
acuaacgaaugacauaaga

SEQ ID NO: 786722 - RNA, 19 nt, Homo sapiens
uagacuaacgaaugacaua

SEQ ID NO: 786723 - RNA, 19 nt, Homo sapiens
caggauaugcuucacauca

SEQ ID NO: 786724 - RNA, 19 nt, Homo sapiens
aaauacugguuguacaaga

SEQ ID NO: 786725 - RNA, 19 nt, Homo sapiens
agggcgagcuggacagauu

SEQ ID NO: 786726 - RNA, 19 nt, Homo sapiens
gaagggcccagcagauuac

SEQ ID NO: 786727 - RNA, 19 nt, Homo sapiens
cauaaggaacugccagaga

SEQ ID NO: 786728 - RNA, 19 nt, Homo sapiens
gagcuguauuugaugaaag

SEQ ID NO: 786729 - RNA, 19 nt, Homo sapiens
ggaacugccagagaauuau

SEQ ID NO: 786730 - RNA, 19 nt, Homo sapiens
aggaacugccagagaauua

SEQ ID NO: 786731 - RNA, 19 nt, Homo sapiens
ccuaaagccauauucauuc

SEQ ID NO: 786732 - RNA, 19 nt, Homo sapiens
ggacauuuuggauugauua

SEQ ID NO: 786733 - RNA, 19 nt, Homo sapiens
gaagagacugguauaaaau

SEQ ID NO: 786734 - RNA, 19 nt, Homo sapiens
ggauugauuaaacaucuga

SEQ ID NO: 786735 - RNA, 19 nt, Homo sapiens
acacagcgguucgagaagu

SEQ ID NO: 786736 - RNA, 19 nt, Homo sapiens
cagcagauuaccaggauau

SEQ ID NO: 786737 - RNA, 19 nt, Homo sapiens
aaacauguagacuaacgaa

SEQ ID NO: 786738 - RNA, 19 nt, Homo sapiens
aggauaugcuucacaucaa

SEQ ID NO: 786739 - RNA, 19 nt, Homo sapiens
ugacugugauuuucuaaug

SEQ ID NO: 786740 - RNA, 19 nt, Homo sapiens
acauguagacuaacgaaug

SEQ ID NO: 786741 - RNA, 19 nt, Homo sapiens
gccauauucauucaccaua

SEQ ID NO: 786742 - RNA, 19 nt, Homo sapiens
ugauuaaacaucugacugu

SEQ ID NO: 786743 - RNA, 19 nt, Homo sapiens
gcaauggcgaucagaaggu

SEQ ID NO: 786744 - RNA, 19 nt, Homo sapiens
ccagcagauuaccaggaua

SEQ ID NO: 786745 - RNA, 19 nt, Homo sapiens
uaaagcaaaugcgugaaaa

SEQ ID NO: 786746 - RNA, 19 nt, Homo sapiens
gaaacauguagacuaacga

SEQ ID NO: 786747 - RNA, 19 nt, Homo sapiens
uugaagagacugguauaaa

SEQ ID NO: 786748 - RNA, 19 nt, Homo sapiens
cacagcgguucgagaaguu

SEQ ID NO: 786749 - RNA, 19 nt, Homo sapiens
guuguacaagaucgaaaua

SEQ ID NO: 786750 - RNA, 19 nt, Homo sapiens
auaaagcaaaugcgugaaa

SEQ ID NO: 786751 - RNA, 19 nt, Homo sapiens
agaaacauguagacuaacg

SEQ ID NO: 786752 - RNA, 19 nt, Homo sapiens
ucccugggcuucugcuuuc

SEQ ID NO: 786753 - RNA, 19 nt, Homo sapiens
gggaagucagauauguaua

SEQ ID NO: 786754 - RNA, 19 nt, Homo sapiens
aauacugguuguacaagau

SEQ ID NO: 786755 - RNA, 19 nt, Homo sapiens
guggauggaucucaaugac

SEQ ID NO: 786756 - RNA, 19 nt, Homo sapiens
ccuccaaagccgauuuauu

SEQ ID NO: 786757 - RNA, 19 nt, Homo sapiens
gcaggagcuguauuugaug

SEQ ID NO: 786758 - RNA, 19 nt, Homo sapiens
gcgaucagaagguagaaca

SEQ ID NO: 786759 - RNA, 19 nt, Homo sapiens
cuaggcugcugcuguaugg

SEQ ID NO: 786760 - RNA, 19 nt, Homo sapiens
gaagaagauauuggagaca

SEQ ID NO: 786761 - RNA, 19 nt, Homo sapiens
ucacaucaaguaggaguug

SEQ ID NO: 786762 - RNA, 19 nt, Homo sapiens
aagaaugcuuaagauguga

SEQ ID NO: 786763 - RNA, 19 nt, Homo sapiens
agacuaacgaaugacauaa

SEQ ID NO: 786764 - RNA, 19 nt, Homo sapiens
gaugugaguggauggaucu

SEQ ID NO: 786765 - RNA, 19 nt, Homo sapiens
uaucaucugccgccuaaag

SEQ ID NO: 786766 - RNA, 19 nt, Homo sapiens
cccagcagauuaccaggau

SEQ ID NO: 786767 - RNA, 19 nt, Homo sapiens
acagagaaggguuugacaa

SEQ ID NO: 786768 - RNA, 19 nt, Homo sapiens
ugggaagucagauauguau

SEQ ID NO: 786769 - RNA, 19 nt, Homo sapiens
uaaggaacugccagagaau

SEQ ID NO: 786770 - RNA, 19 nt, Homo sapiens
cacaaauccuggagcuuuu

SEQ ID NO: 786771 - RNA, 19 nt, Homo sapiens
ggaguugcaggagcuguau

SEQ ID NO: 786772 - RNA, 19 nt, Homo sapiens
guacagagaaggguuugac

SEQ ID NO: 786773 - RNA, 19 nt, Homo sapiens
gcuaggcugcugcuguaug

SEQ ID NO: 786774 - RNA, 19 nt, Homo sapiens
ggcaacagcacacaaaucc

SEQ ID NO: 786775 - RNA, 19 nt, Homo sapiens
cacauucccauccuccaaa

SEQ ID NO: 786776 - RNA, 19 nt, Homo sapiens
gcuguauggcugcacauuc

SEQ ID NO: 786777 - RNA, 19 nt, Homo sapiens
agaagauauuggagacaca

SEQ ID NO: 786778 - RNA, 19 nt, Homo sapiens
gaacauaccugaacuaaga

SEQ ID NO: 786779 - RNA, 19 nt, Homo sapiens
guacagagguuacauauuc

SEQ ID NO: 786780 - RNA, 19 nt, Homo sapiens
cagcugaacugaauauaaa

SEQ ID NO: 786781 - RNA, 19 nt, Homo sapiens
gaaauggccuuccuguuca

SEQ ID NO: 786782 - RNA, 19 nt, Homo sapiens
caaucacacuguuguauaa

SEQ ID NO: 786783 - RNA, 19 nt, Homo sapiens
gaauugacuugcagacaaa

SEQ ID NO: 786784 - RNA, 19 nt, Homo sapiens
gaaaugcugucauaaguac

SEQ ID NO: 786785 - RNA, 19 nt, Homo sapiens
gaaaugaggugggagaagu

SEQ ID NO: 786786 - RNA, 19 nt, Homo sapiens
gguauuaugucacuagcua

SEQ ID NO: 786787 - RNA, 19 nt, Homo sapiens
ccaaagccauguggaauuu

SEQ ID NO: 786788 - RNA, 19 nt, Homo sapiens
aaugagaucuugugccaua

SEQ ID NO: 786789 - RNA, 19 nt, Homo sapiens
ggauaauaaugccuuguuu

SEQ ID NO: 786790 - RNA, 19 nt, Homo sapiens
gggagaggcuucuuucguu

SEQ ID NO: 786791 - RNA, 19 nt, Homo sapiens
ccaugugccucccaaauaa

SEQ ID NO: 786792 - RNA, 19 nt, Homo sapiens
gaaaggcccuagggagauu

SEQ ID NO: 786793 - RNA, 19 nt, Homo sapiens
ggagaggcuucuuucguuu

SEQ ID NO: 786794 - RNA, 19 nt, Homo sapiens
gguacuauuugucacauaa

SEQ ID NO: 786795 - RNA, 19 nt, Homo sapiens
gaagagagagugguucaaa

SEQ ID NO: 786796 - RNA, 19 nt, Homo sapiens
caccugaaaugcugucaua

SEQ ID NO: 786797 - RNA, 19 nt, Homo sapiens
aaauacagcugaacugaau

SEQ ID NO: 786798 - RNA, 19 nt, Homo sapiens
ugaggaggcuggagucaaa

SEQ ID NO: 786799 - RNA, 19 nt, Homo sapiens
ggacugucauuugugauuu

SEQ ID NO: 786800 - RNA, 19 nt, Homo sapiens
aaucaagaaucccaucuaa

SEQ ID NO: 786801 - RNA, 19 nt, Homo sapiens
ucacauaacuaacuuucga

SEQ ID NO: 786802 - RNA, 19 nt, Homo sapiens
guaauaagguaaugaugca

SEQ ID NO: 786803 - RNA, 19 nt, Homo sapiens
guagugugaucaaacauga

SEQ ID NO: 786804 - RNA, 19 nt, Homo sapiens
gauuugggcuauuucugua

SEQ ID NO: 786805 - RNA, 19 nt, Homo sapiens
ggaguggagucuugaaauc

SEQ ID NO: 786806 - RNA, 19 nt, Homo sapiens
cuucagcccuuuguaaaua

SEQ ID NO: 786807 - RNA, 19 nt, Homo sapiens
auagguaccuuaucugaaa

SEQ ID NO: 786808 - RNA, 19 nt, Homo sapiens
gggaagauucuguuaauau

SEQ ID NO: 786809 - RNA, 19 nt, Homo sapiens
ugaauugacuugcagacaa

SEQ ID NO: 786810 - RNA, 19 nt, Homo sapiens
gagacaggguuucuucaug

SEQ ID NO: 786811 - RNA, 19 nt, Homo sapiens
acacauagguaccuuaucu

SEQ ID NO: 786812 - RNA, 19 nt, Homo sapiens
caguguagauugcucuuaa

SEQ ID NO: 786813 - RNA, 19 nt, Homo sapiens
uaucaaaguucuccagugu

SEQ ID NO: 786814 - RNA, 19 nt, Homo sapiens
aguagaagaugcuaucaaa

SEQ ID NO: 786815 - RNA, 19 nt, Homo sapiens
aaacugugcugcaugaugu

SEQ ID NO: 786816 - RNA, 19 nt, Homo sapiens
cuuagaaugucucaucuuu

SEQ ID NO: 786817 - RNA, 19 nt, Homo sapiens
uagaaacugugcugcauga

SEQ ID NO: 786818 - RNA, 19 nt, Homo sapiens
cgucaaccaucucuuuaaa

SEQ ID NO: 786819 - RNA, 19 nt, Homo sapiens
caaacaugaucauccagaa

SEQ ID NO: 786820 - RNA, 19 nt, Homo sapiens
caacagguacuauuuguca

SEQ ID NO: 786821 - RNA, 19 nt, Homo sapiens
ugaaauggccuuccuguuc

SEQ ID NO: 786822 - RNA, 19 nt, Homo sapiens
ucaaaguucuccaguguca

SEQ ID NO: 786823 - RNA, 19 nt, Homo sapiens
gagagugguucaaaguaga

SEQ ID NO: 786824 - RNA, 19 nt, Homo sapiens
uaacgucaaccaucucuuu

SEQ ID NO: 786825 - RNA, 19 nt, Homo sapiens
gaaacacuuggacugaaua

SEQ ID NO: 786826 - RNA, 19 nt, Homo sapiens
gauugacgcuugcaaacug

SEQ ID NO: 786827 - RNA, 19 nt, Homo sapiens
agaagaugcuaucaaaguu

SEQ ID NO: 786828 - RNA, 19 nt, Homo sapiens
guaaacagaugacauuuuc

SEQ ID NO: 786829 - RNA, 19 nt, Homo sapiens
caaaacgucuuuagucuau

SEQ ID NO: 786830 - RNA, 19 nt, Homo sapiens
ucaaccaucucuuuaaagu

SEQ ID NO: 786831 - RNA, 19 nt, Homo sapiens
cuccaugccuggcuaauuu

SEQ ID NO: 786832 - RNA, 19 nt, Homo sapiens
guuagagacugaagauugu

SEQ ID NO: 786833 - RNA, 19 nt, Homo sapiens
gagagagugguucaaagua

SEQ ID NO: 786834 - RNA, 19 nt, Homo sapiens
gguaaugaugcaugaauuu

SEQ ID NO: 786835 - RNA, 19 nt, Homo sapiens
guagauugcucuuaaaaug

SEQ ID NO: 786836 - RNA, 19 nt, Homo sapiens
gauuuagcaugcucaguug

SEQ ID NO: 786837 - RNA, 19 nt, Homo sapiens
ugacaucagucugugguuu

SEQ ID NO: 786838 - RNA, 19 nt, Homo sapiens
gaaggaagagagagugguu

SEQ ID NO: 786839 - RNA, 19 nt, Homo sapiens
uaacauagcagagaaacug

SEQ ID NO: 786840 - RNA, 19 nt, Homo sapiens
gggagaaguuugacuaaaa

SEQ ID NO: 786841 - RNA, 19 nt, Homo sapiens
gacaucagucugugguuua

SEQ ID NO: 786842 - RNA, 19 nt, Homo sapiens
gauaauaaugccuuguuug

SEQ ID NO: 786843 - RNA, 19 nt, Homo sapiens
gugcccaucuuguacauga

SEQ ID NO: 786844 - RNA, 19 nt, Homo sapiens
agacaggguuucuucaugu

SEQ ID NO: 786845 - RNA, 19 nt, Homo sapiens
caacugguauuaugucacu

SEQ ID NO: 786846 - RNA, 19 nt, Homo sapiens
ucagauuacuuguggguau

SEQ ID NO: 786847 - RNA, 19 nt, Homo sapiens
ucauaaaccuguacaugca

SEQ ID NO: 786848 - RNA, 19 nt, Homo sapiens
gaaagcacagaacauaugu

SEQ ID NO: 786849 - RNA, 19 nt, Homo sapiens
gaaacugugcugcaugaug

SEQ ID NO: 786850 - RNA, 19 nt, Homo sapiens
gcagagaaacuggauuguu

SEQ ID NO: 786851 - RNA, 19 nt, Homo sapiens
ucacagcauuagcauauuc

SEQ ID NO: 786852 - RNA, 19 nt, Homo sapiens
ucaaucacacuguuguaua

SEQ ID NO: 786853 - RNA, 19 nt, Homo sapiens
cgaaagcacagaacauaug

SEQ ID NO: 786854 - RNA, 19 nt, Homo sapiens
ccaaagugcugggauuaca

SEQ ID NO: 786855 - RNA, 19 nt, Homo sapiens
guagaguuggugaauauuu

SEQ ID NO: 786856 - RNA, 19 nt, Homo sapiens
caaaguauaacucuguaga

SEQ ID NO: 786857 - RNA, 19 nt, Homo sapiens
cagauuacuuguggguaua

SEQ ID NO: 786858 - RNA, 19 nt, Homo sapiens
ggguugccaucuaguguaa

SEQ ID NO: 786859 - RNA, 19 nt, Homo sapiens
guauaaagcagcagaacug

SEQ ID NO: 786860 - RNA, 19 nt, Homo sapiens
cuagggagauuuauuucug

SEQ ID NO: 786861 - RNA, 19 nt, Homo sapiens
cagaaacacuuggacugaa

SEQ ID NO: 786862 - RNA, 19 nt, Homo sapiens
caugauauucuuagaggua

SEQ ID NO: 786863 - RNA, 19 nt, Homo sapiens
ucccacaaauugacacuuu

SEQ ID NO: 786864 - RNA, 19 nt, Homo sapiens
ccuuauaacucaauaguac

SEQ ID NO: 786865 - RNA, 19 nt, Homo sapiens
aaaguucuccagugucaua

SEQ ID NO: 786866 - RNA, 19 nt, Homo sapiens
gaagaugcuaucaaaguuc

SEQ ID NO: 786867 - RNA, 19 nt, Homo sapiens
gcacaugccauccaauuuu

SEQ ID NO: 786868 - RNA, 19 nt, Homo sapiens
ugaaaugcugucauaagua

SEQ ID NO: 786869 - RNA, 19 nt, Homo sapiens
gagaucuugugccauaaau

SEQ ID NO: 786870 - RNA, 19 nt, Homo sapiens
uaucgauacucuuucuuug

SEQ ID NO: 786871 - RNA, 19 nt, Homo sapiens
caaaaugcauguaguaaag

SEQ ID NO: 786872 - RNA, 19 nt, Homo sapiens
cacaaaguauaacucugua

SEQ ID NO: 786873 - RNA, 19 nt, Homo sapiens
uuucacaacugguauuaug

SEQ ID NO: 786874 - RNA, 19 nt, Homo sapiens
caaaguagaagaugcuauc

SEQ ID NO: 786875 - RNA, 19 nt, Homo sapiens
gcccuagggagauuuauuu

SEQ ID NO: 786876 - RNA, 19 nt, Homo sapiens
guauuaacgucaaccaucu

SEQ ID NO: 786877 - RNA, 19 nt, Homo sapiens
uauaaacucuuggacuaug

SEQ ID NO: 786878 - RNA, 19 nt, Homo sapiens
agaagaaacuggcuacaaa

SEQ ID NO: 786879 - RNA, 19 nt, Homo sapiens
agagaacacuucacuauga

SEQ ID NO: 786880 - RNA, 19 nt, Homo sapiens
ggaguuaauuucagaagga

SEQ ID NO: 786881 - RNA, 19 nt, Homo sapiens
gcagagaacacuucacuau

SEQ ID NO: 786882 - RNA, 19 nt, Homo sapiens
guugugaccuuccuuuaaa

SEQ ID NO: 786883 - RNA, 19 nt, Homo sapiens
uguaaagacucguuugaaa

SEQ ID NO: 786884 - RNA, 19 nt, Homo sapiens
ucacuaagacuuuguauuc

SEQ ID NO: 786885 - RNA, 19 nt, Homo sapiens
gaacguaccaaccaggaaa

SEQ ID NO: 786886 - RNA, 19 nt, Homo sapiens
ggcaaacaguauaucauuu

SEQ ID NO: 786887 - RNA, 19 nt, Homo sapiens
gagacuugaugcucuggua

SEQ ID NO: 786888 - RNA, 19 nt, Homo sapiens
gcaaacaguauaucauuuc

SEQ ID NO: 786889 - RNA, 19 nt, Homo sapiens
gguauuugguauugagaaa

SEQ ID NO: 786890 - RNA, 19 nt, Homo sapiens
caccaggccuucuucacua

SEQ ID NO: 786891 - RNA, 19 nt, Homo sapiens
gaaauagaccugaguucuc

SEQ ID NO: 786892 - RNA, 19 nt, Homo sapiens
ugaccuuccuuuaaauuug

SEQ ID NO: 786893 - RNA, 19 nt, Homo sapiens
cagaggaguuaauuucaga

SEQ ID NO: 786894 - RNA, 19 nt, Homo sapiens
uuaaagcucaacagaguua

SEQ ID NO: 786895 - RNA, 19 nt, Homo sapiens
cagaauggcaaacaguaua

SEQ ID NO: 786896 - RNA, 19 nt, Homo sapiens
uguuauaacuccagcuaaa

SEQ ID NO: 786897 - RNA, 19 nt, Homo sapiens
gaccuuccuuuaaauuugu

SEQ ID NO: 786898 - RNA, 19 nt, Homo sapiens
guggugguauggaauugua

SEQ ID NO: 786899 - RNA, 19 nt, Homo sapiens
gaacuugggaaucagugaa

SEQ ID NO: 786900 - RNA, 19 nt, Homo sapiens
ccaacggaaucuucucaga

SEQ ID NO: 786901 - RNA, 19 nt, Homo sapiens
ggauggagaguuuguggaa

SEQ ID NO: 786902 - RNA, 19 nt, Homo sapiens
gaagaaacuggcuacaaag

SEQ ID NO: 786903 - RNA, 19 nt, Homo sapiens
gagaacacuucacuaugag

SEQ ID NO: 786904 - RNA, 19 nt, Homo sapiens
ucugguagcugaagaacau

SEQ ID NO: 786905 - RNA, 19 nt, Homo sapiens
gacccaggcuugucaaacu

SEQ ID NO: 786906 - RNA, 19 nt, Homo sapiens
gguugugaccuuccuuuaa

SEQ ID NO: 786907 - RNA, 19 nt, Homo sapiens
uccgggagcuugaagaaga

SEQ ID NO: 786908 - RNA, 19 nt, Homo sapiens
gaguuaauuucagaaggaa

SEQ ID NO: 786909 - RNA, 19 nt, Homo sapiens
guaauuacagguagguugu

SEQ ID NO: 786910 - RNA, 19 nt, Homo sapiens
gaaaauggagagccaagaa

SEQ ID NO: 786911 - RNA, 19 nt, Homo sapiens
acauggauccuacugguaa

SEQ ID NO: 786912 - RNA, 19 nt, Homo sapiens
gcuguaaagacucguuuga

SEQ ID NO: 786913 - RNA, 19 nt, Homo sapiens
uaucauuucagaggaguua

SEQ ID NO: 786914 - RNA, 19 nt, Homo sapiens
uggcaaacaguauaucauu

SEQ ID NO: 786915 - RNA, 19 nt, Homo sapiens
guaaagacucguuugaaaa

SEQ ID NO: 786916 - RNA, 19 nt, Homo sapiens
ccugagggcuguaaagacu

SEQ ID NO: 786917 - RNA, 19 nt, Homo sapiens
uagauuugccauuagcuuu

SEQ ID NO: 786918 - RNA, 19 nt, Homo sapiens
uuguggaagucauuucuuu

SEQ ID NO: 786919 - RNA, 19 nt, Homo sapiens
cagaugugguggugguaug

SEQ ID NO: 786920 - RNA, 19 nt, Homo sapiens
gccaagaaccaacggaauc

SEQ ID NO: 786921 - RNA, 19 nt, Homo sapiens
aaacaguuccgaccaccaa

SEQ ID NO: 786922 - RNA, 19 nt, Homo sapiens
cagagaacacuucacuaug

SEQ ID NO: 786923 - RNA, 19 nt, Homo sapiens
gagaaauagaccugaguuc

SEQ ID NO: 786924 - RNA, 19 nt, Homo sapiens
gacuuuguauucaacuuag

SEQ ID NO: 786925 - RNA, 19 nt, Homo sapiens
guaucguucuggugaaaca

SEQ ID NO: 786926 - RNA, 19 nt, Homo sapiens
gcucuagcgcugaaacaug

SEQ ID NO: 786927 - RNA, 19 nt, Homo sapiens
aacuagaacuugggaauca

SEQ ID NO: 786928 - RNA, 19 nt, Homo sapiens
ucagaggaguuaauuucag

SEQ ID NO: 786929 - RNA, 19 nt, Homo sapiens
gugaccuuccuuuaaauuu

SEQ ID NO: 786930 - RNA, 19 nt, Homo sapiens
cacuaagacuuuguauuca

SEQ ID NO: 786931 - RNA, 19 nt, Homo sapiens
cuaguuauuucguccucuu

SEQ ID NO: 786932 - RNA, 19 nt, Homo sapiens
ggucuauuccuacgcucua

SEQ ID NO: 786933 - RNA, 19 nt, Homo sapiens
uguggaagucauuucuuua

SEQ ID NO: 786934 - RNA, 19 nt, Homo sapiens
ccaggcuugucaaacugua

SEQ ID NO: 786935 - RNA, 19 nt, Homo sapiens
cauggauccuacugguaaa

SEQ ID NO: 786936 - RNA, 19 nt, Homo sapiens
aauaugacacuggccauuu

SEQ ID NO: 786937 - RNA, 19 nt, Homo sapiens
gccaggggauggagaguuu

SEQ ID NO: 786938 - RNA, 19 nt, Homo sapiens
acgcaaggccgaagccaaa

SEQ ID NO: 786939 - RNA, 19 nt, Homo sapiens
ugagaaauagaccugaguu

SEQ ID NO: 786940 - RNA, 19 nt, Homo sapiens
ucaacagaguuaacuacag

SEQ ID NO: 786941 - RNA, 19 nt, Homo sapiens
guagauuugccauuagcuu

SEQ ID NO: 786942 - RNA, 19 nt, Homo sapiens
cuaagacuuuguauucaac

SEQ ID NO: 786943 - RNA, 19 nt, Homo sapiens
gagaguuuguggaagucau

SEQ ID NO: 786944 - RNA, 19 nt, Homo sapiens
cuauacacaucgugacagu

SEQ ID NO: 786945 - RNA, 19 nt, Homo sapiens
guguaucguucuggugaaa

SEQ ID NO: 786946 - RNA, 19 nt, Homo sapiens
uuucagaggaguuaauuuc

SEQ ID NO: 786947 - RNA, 19 nt, Homo sapiens
gcucaacagaguuaacuac

SEQ ID NO: 786948 - RNA, 19 nt, Homo sapiens
ucagaauggcaaacaguau

SEQ ID NO: 786949 - RNA, 19 nt, Homo sapiens
gcgcugaaacaugcaaaug

SEQ ID NO: 786950 - RNA, 19 nt, Homo sapiens
acgccagggucuauuccua

SEQ ID NO: 786951 - RNA, 19 nt, Homo sapiens
gaagaagaaacuggcuaca

SEQ ID NO: 786952 - RNA, 19 nt, Homo sapiens
ccgggagcuugaagaagaa

SEQ ID NO: 786953 - RNA, 19 nt, Homo sapiens
uaaaagcacagaacagaug

SEQ ID NO: 786954 - RNA, 19 nt, Homo sapiens
aagaagaaacuggcuacaa

SEQ ID NO: 786955 - RNA, 19 nt, Homo sapiens
gccuccagcuaguuauuuc

SEQ ID NO: 786956 - RNA, 19 nt, Homo sapiens
agaauggcaaacaguauau

SEQ ID NO: 786957 - RNA, 19 nt, Homo sapiens
gaacacagggguauuuggu

SEQ ID NO: 786958 - RNA, 19 nt, Homo sapiens
aauuacagguagguuguga

SEQ ID NO: 786959 - RNA, 19 nt, Homo sapiens
ccaccaggccuucuucacu

SEQ ID NO: 786960 - RNA, 19 nt, Homo sapiens
gaaccaacggaaucuucuc

SEQ ID NO: 786961 - RNA, 19 nt, Homo sapiens
cugaagaacaucucacagu

SEQ ID NO: 786962 - RNA, 19 nt, Homo sapiens
gggcuacugcauagaguuc

SEQ ID NO: 786963 - RNA, 19 nt, Homo sapiens
acacagggguauuugguau

SEQ ID NO: 786964 - RNA, 19 nt, Homo sapiens
accaggccuucuucacuaa

SEQ ID NO: 786965 - RNA, 19 nt, Homo sapiens
gagaccaccaggccuucuu

SEQ ID NO: 786966 - RNA, 19 nt, Homo sapiens
guggaagucauuucuuuac

SEQ ID NO: 786967 - RNA, 19 nt, Homo sapiens
gggcuguaaagacucguuu

SEQ ID NO: 786968 - RNA, 19 nt, Homo sapiens
cauagaugauggugaaacc

SEQ ID NO: 786969 - RNA, 19 nt, Homo sapiens
ucagugaacguaccaacca

SEQ ID NO: 786970 - RNA, 19 nt, Homo sapiens
gcaaagaaaggguguauug

SEQ ID NO: 786971 - RNA, 19 nt, Homo sapiens
aagaaaggguguauugaua

SEQ ID NO: 786972 - RNA, 19 nt, Homo sapiens
gaaaggguguauugauaau

SEQ ID NO: 786973 - RNA, 19 nt, Homo sapiens
ucacugcaguauacauuua

SEQ ID NO: 786974 - RNA, 19 nt, Homo sapiens
gugcaaaucuucccucuca

SEQ ID NO: 786975 - RNA, 19 nt, Homo sapiens
ggccuccucuuucaaauaa

SEQ ID NO: 786976 - RNA, 19 nt, Homo sapiens
uaagagaaauggaaauugg

SEQ ID NO: 786977 - RNA, 19 nt, Homo sapiens
gcacaggacguaugucuau

SEQ ID NO: 786978 - RNA, 19 nt, Homo sapiens
ugaugaagcucaagucgaa

SEQ ID NO: 786979 - RNA, 19 nt, Homo sapiens
ucacaggccuccucuuuca

SEQ ID NO: 786980 - RNA, 19 nt, Homo sapiens
gaaggaagagggaaugguu

SEQ ID NO: 786981 - RNA, 19 nt, Homo sapiens
aaacuagacugaagugcaa

SEQ ID NO: 786982 - RNA, 19 nt, Homo sapiens
gaagagggaaugguuuaaa

SEQ ID NO: 786983 - RNA, 19 nt, Homo sapiens
ggaagauucaguuaacauu

SEQ ID NO: 786984 - RNA, 19 nt, Homo sapiens
gaagauucaguuaacauug

SEQ ID NO: 786985 - RNA, 19 nt, Homo sapiens
uaaaagugcugcaguauca

SEQ ID NO: 786986 - RNA, 19 nt, Homo sapiens
gcuguuugguguuaaguga

SEQ ID NO: 786987 - RNA, 19 nt, Homo sapiens
agacugaagugcaaaucuu

SEQ ID NO: 786988 - RNA, 19 nt, Homo sapiens
agaaaggguguauugauaa

SEQ ID NO: 786989 - RNA, 19 nt, Homo sapiens
ggaggaugaugaagcucaa

SEQ ID NO: 786990 - RNA, 19 nt, Homo sapiens
auaaugugcuguacaguuc

SEQ ID NO: 786991 - RNA, 19 nt, Homo sapiens
caaagaaaggguguauuga

SEQ ID NO: 786992 - RNA, 19 nt, Homo sapiens
uaaaauagaagacgccaua

SEQ ID NO: 786993 - RNA, 19 nt, Homo sapiens
ggaagauuaguuggaauuu

SEQ ID NO: 786994 - RNA, 19 nt, Homo sapiens
gggaagauuaguuggaauu

SEQ ID NO: 786995 - RNA, 19 nt, Homo sapiens
gguguguaauuuguaagua

SEQ ID NO: 786996 - RNA, 19 nt, Homo sapiens
ggaagagggaaugguuuaa

SEQ ID NO: 786997 - RNA, 19 nt, Homo sapiens
ggaagcacaggacguaugu

SEQ ID NO: 786998 - RNA, 19 nt, Homo sapiens
ugaggaggcuggaguaaaa

SEQ ID NO: 786999 - RNA, 19 nt, Homo sapiens
gaaguguuccuguuugucu

SEQ ID NO: 787000 - RNA, 19 nt, Homo sapiens
ggaagacugggaagauuca

SEQ ID NO: 787001 - RNA, 19 nt, Homo sapiens
aaagaaaggguguauugau

SEQ ID NO: 787002 - RNA, 19 nt, Homo sapiens
guaagagaaauggaaauug

SEQ ID NO: 787003 - RNA, 19 nt, Homo sapiens
ccauaaaagugcugcagua

SEQ ID NO: 787004 - RNA, 19 nt, Homo sapiens
gggaaugguuuaaaauaga

SEQ ID NO: 787005 - RNA, 19 nt, Homo sapiens
guaugucuaugugcucauu

SEQ ID NO: 787006 - RNA, 19 nt, Homo sapiens
gagaugaaaacuuccaaua

SEQ ID NO: 787007 - RNA, 19 nt, Homo sapiens
uugauaauguugcuguuug

SEQ ID NO: 787008 - RNA, 19 nt, Homo sapiens
ucucacaggccuccucuuu

SEQ ID NO: 787009 - RNA, 19 nt, Homo sapiens
ggccagacguuuucuuuga

SEQ ID NO: 787010 - RNA, 19 nt, Homo sapiens
gagaaauggaaauuggaaa

SEQ ID NO: 787011 - RNA, 19 nt, Homo sapiens
aaauagaagacgccauaaa

SEQ ID NO: 787012 - RNA, 19 nt, Homo sapiens
gagggaaugguuuaaaaua

SEQ ID NO: 787013 - RNA, 19 nt, Homo sapiens
aaagggacauugggaagau

SEQ ID NO: 787014 - RNA, 19 nt, Homo sapiens
uauaaugugcuguacaguu

SEQ ID NO: 787015 - RNA, 19 nt, Homo sapiens
aaggguguauugauaaugu

SEQ ID NO: 787016 - RNA, 19 nt, Homo sapiens
gcuguacaguucaguagag

SEQ ID NO: 787017 - RNA, 19 nt, Homo sapiens
gaucugucccucccucuuc

SEQ ID NO: 787018 - RNA, 19 nt, Homo sapiens
aggaagagggaaugguuua

SEQ ID NO: 787019 - RNA, 19 nt, Homo sapiens
ucacuuucacugcaguaua

SEQ ID NO: 787020 - RNA, 19 nt, Homo sapiens
ccuauaaugugcuguacag

SEQ ID NO: 787021 - RNA, 19 nt, Homo sapiens
ucugaaguguuccuguuug

SEQ ID NO: 787022 - RNA, 19 nt, Homo sapiens
gguuggguguguaauuugu

SEQ ID NO: 787023 - RNA, 19 nt, Homo sapiens
gacauugggaagauuaguu

SEQ ID NO: 787024 - RNA, 19 nt, Homo sapiens
gcaguauacauuuaucuac

SEQ ID NO: 787025 - RNA, 19 nt, Homo sapiens
gaaauggaaauuggaaacu

SEQ ID NO: 787026 - RNA, 19 nt, Homo sapiens
aauggaaauuggaaacuag

SEQ ID NO: 787027 - RNA, 19 nt, Homo sapiens
aagauucaguuaacauugg

SEQ ID NO: 787028 - RNA, 19 nt, Homo sapiens
caguuaacauuggaaggaa

SEQ ID NO: 787029 - RNA, 19 nt, Homo sapiens
agaggaagcacaggacgua

SEQ ID NO: 787030 - RNA, 19 nt, Homo sapiens
ugccuuggauucugaagug

SEQ ID NO: 787031 - RNA, 19 nt, Homo sapiens
ggcagcaguucgugaaguc

SEQ ID NO: 787032 - RNA, 19 nt, Homo sapiens
cuggaagacugggaagauu

SEQ ID NO: 787033 - RNA, 19 nt, Homo sapiens
gggguuggguguguaauuu

SEQ ID NO: 787034 - RNA, 19 nt, Homo sapiens
aagacuuccuguaagagaa

SEQ ID NO: 787035 - RNA, 19 nt, Homo sapiens
gugcaggcaucauauuuug

SEQ ID NO: 787036 - RNA, 19 nt, Homo sapiens
gagcaguagucgccaucca

SEQ ID NO: 787037 - RNA, 19 nt, Homo sapiens
caggacguaugucuaugug

SEQ ID NO: 787038 - RNA, 19 nt, Homo sapiens
cacauuauauaucggacau

SEQ ID NO: 787039 - RNA, 19 nt, Homo sapiens
cacuuucacugcaguauac

SEQ ID NO: 787040 - RNA, 19 nt, Homo sapiens
gggaagauucaguuaacau

SEQ ID NO: 787041 - RNA, 19 nt, Homo sapiens
uaaguacuuuugugcauga

SEQ ID NO: 787042 - RNA, 19 nt, Homo sapiens
cagcaaagaaaggguguau

SEQ ID NO: 787043 - RNA, 19 nt, Homo sapiens
gccaccacauacucgguuu

SEQ ID NO: 787044 - RNA, 19 nt, Homo sapiens
ucaguuaacauuggaagga

SEQ ID NO: 787045 - RNA, 19 nt, Homo sapiens
agagaaauggaaauuggaa

SEQ ID NO: 787046 - RNA, 19 nt, Homo sapiens
gugaggaggcuggaguaaa

SEQ ID NO: 787047 - RNA, 19 nt, Homo sapiens
uuggguguguaauuuguaa

SEQ ID NO: 787048 - RNA, 19 nt, Homo sapiens
ggagccguguagcggagaa

SEQ ID NO: 787049 - RNA, 19 nt, Homo sapiens
ggaaauuggaaacuagacu

SEQ ID NO: 787050 - RNA, 19 nt, Homo sapiens
aauagaagacgccauaaaa

SEQ ID NO: 787051 - RNA, 19 nt, Homo sapiens
aagagggaaugguuuaaaa

SEQ ID NO: 787052 - RNA, 19 nt, Homo sapiens
guguguaauuuguaaguac

SEQ ID NO: 787053 - RNA, 19 nt, Homo sapiens
acaggccuccucuuucaaa

SEQ ID NO: 787054 - RNA, 19 nt, Homo sapiens
gagcgaggaggaggugcua

SEQ ID NO: 787055 - RNA, 19 nt, Homo sapiens
uugggaagauuaguuggaa

SEQ ID NO: 787056 - RNA, 19 nt, Homo sapiens
gcuggaagacugggaagau

SEQ ID NO: 787057 - RNA, 19 nt, Homo sapiens
aguaugagaugaaaacuuc

SEQ ID NO: 787058 - RNA, 19 nt, Homo sapiens
auucugaaguguuccuguu

SEQ ID NO: 787059 - RNA, 19 nt, Homo sapiens
ugauaauguugcuguuugg

SEQ ID NO: 787060 - RNA, 19 nt, Homo sapiens
ccucucacccuggcucuuu

SEQ ID NO: 787061 - RNA, 19 nt, Homo sapiens
cugggaagauucaguuaac

SEQ ID NO: 787062 - RNA, 19 nt, Homo sapiens
cugaaguguuccuguuugu

SEQ ID NO: 787063 - RNA, 19 nt, Homo sapiens
cauggugggcagcaaagaa

SEQ ID NO: 787064 - RNA, 19 nt, Homo sapiens
aaauuggaaacuagacuga

SEQ ID NO: 787065 - RNA, 19 nt, Homo sapiens
gcaggcaucauauuuugaa

SEQ ID NO: 787066 - RNA, 19 nt, Homo sapiens
cuuggauucugaaguguuc

SEQ ID NO: 787067 - RNA, 19 nt, Homo sapiens
guuaacauuggaaggaaga

SEQ ID NO: 787068 - RNA, 19 nt, Homo sapiens
agacuuccuguaagagaaa

SEQ ID NO: 787069 - RNA, 19 nt, Homo sapiens
ggcaucauauuuugaaaca

SEQ ID NO: 787070 - RNA, 19 nt, Homo sapiens
gcaagauggcccaggagaa

SEQ ID NO: 787071 - RNA, 19 nt, Homo sapiens
aguggaaacugcucacaga

SEQ ID NO: 787072 - RNA, 19 nt, Homo sapiens
gaccugggcuccaaaaugg

SEQ ID NO: 787073 - RNA, 19 nt, Homo sapiens
gcuacaugaucccgugcaa

SEQ ID NO: 787074 - RNA, 19 nt, Homo sapiens
caagauggcccaggagaac

SEQ ID NO: 787075 - RNA, 19 nt, Homo sapiens
gaaacugccaucaauauua

SEQ ID NO: 787076 - RNA, 19 nt, Homo sapiens
gcagaaagcagauuaaaga

SEQ ID NO: 787077 - RNA, 19 nt, Homo sapiens
gaagguggcuggcuaggaa

SEQ ID NO: 787078 - RNA, 19 nt, Homo sapiens
gaaugaaacugccaucaau

SEQ ID NO: 787079 - RNA, 19 nt, Homo sapiens
ggucagucauuuacaguua

SEQ ID NO: 787080 - RNA, 19 nt, Homo sapiens
gaaacugcaucacgauuga

SEQ ID NO: 787081 - RNA, 19 nt, Homo sapiens
cgacuucugugauuauuaa

SEQ ID NO: 787082 - RNA, 19 nt, Homo sapiens
gaacaugguuaucauccaa

SEQ ID NO: 787083 - RNA, 19 nt, Homo sapiens
cauggaagcugcuaaauag

SEQ ID NO: 787084 - RNA, 19 nt, Homo sapiens
gcacuaaccuuuugauuug

SEQ ID NO: 787085 - RNA, 19 nt, Homo sapiens
caacuacagugaaauccua

SEQ ID NO: 787086 - RNA, 19 nt, Homo sapiens
gagaaacuguugugccaaa

SEQ ID NO: 787087 - RNA, 19 nt, Homo sapiens
ggagauagguuccugugau

SEQ ID NO: 787088 - RNA, 19 nt, Homo sapiens
uuaguaggcuucuauauug

SEQ ID NO: 787089 - RNA, 19 nt, Homo sapiens
gagcaaacaaacaggauua

SEQ ID NO: 787090 - RNA, 19 nt, Homo sapiens
gagauagguuccugugauu

SEQ ID NO: 787091 - RNA, 19 nt, Homo sapiens
ucagugagcugguaagaau

SEQ ID NO: 787092 - RNA, 19 nt, Homo sapiens
gcuggaagcugagaucauu

SEQ ID NO: 787093 - RNA, 19 nt, Homo sapiens
gaacaagaaaugucagaug

SEQ ID NO: 787094 - RNA, 19 nt, Homo sapiens
gauggacacugcaaagaga

SEQ ID NO: 787095 - RNA, 19 nt, Homo sapiens
ucucuucacuagucauuua

SEQ ID NO: 787096 - RNA, 19 nt, Homo sapiens
ccacauuccucuugaguuc

SEQ ID NO: 787097 - RNA, 19 nt, Homo sapiens
gaagagagugggaaagaga

SEQ ID NO: 787098 - RNA, 19 nt, Homo sapiens
agaccgagguggacuguaa

SEQ ID NO: 787099 - RNA, 19 nt, Homo sapiens
gugaaauccuagacaagua

SEQ ID NO: 787100 - RNA, 19 nt, Homo sapiens
gcagcacgccuuaaucaaa

SEQ ID NO: 787101 - RNA, 19 nt, Homo sapiens
aggaggagaugaccagaua

SEQ ID NO: 787102 - RNA, 19 nt, Homo sapiens
gagaagaaauccguaaguc

SEQ ID NO: 787103 - RNA, 19 nt, Homo sapiens
gacauaagaucucauuugc

SEQ ID NO: 787104 - RNA, 19 nt, Homo sapiens
ggaccagucugaaugucuu

SEQ ID NO: 787105 - RNA, 19 nt, Homo sapiens
caaaugaugcagauacuug

SEQ ID NO: 787106 - RNA, 19 nt, Homo sapiens
caauaacugccucuagaua

SEQ ID NO: 787107 - RNA, 19 nt, Homo sapiens
ccaucaauauuacaacgua

SEQ ID NO: 787108 - RNA, 19 nt, Homo sapiens
ccagugaauuccugaaguu

SEQ ID NO: 787109 - RNA, 19 nt, Homo sapiens
gaacuuugauaauggugau

SEQ ID NO: 787110 - RNA, 19 nt, Homo sapiens
gggcaagaguacaccaauu

SEQ ID NO: 787111 - RNA, 19 nt, Homo sapiens
caagaucugugccaaugug

SEQ ID NO: 787112 - RNA, 19 nt, Homo sapiens
ggaaacugcaucacgauug

SEQ ID NO: 787113 - RNA, 19 nt, Homo sapiens
gaucugugccaauguguuu

SEQ ID NO: 787114 - RNA, 19 nt, Homo sapiens
ggcaagaguacaccaauuu

SEQ ID NO: 787115 - RNA, 19 nt, Homo sapiens
gcagcucccuguccaagug

SEQ ID NO: 787116 - RNA, 19 nt, Homo sapiens
gaaagcauucccuuagaga

SEQ ID NO: 787117 - RNA, 19 nt, Homo sapiens
acaaguuucuguugcauau

SEQ ID NO: 787118 - RNA, 19 nt, Homo sapiens
ugacauaagaucucauuug

SEQ ID NO: 787119 - RNA, 19 nt, Homo sapiens
uaagagaaacuguaaaugg

SEQ ID NO: 787120 - RNA, 19 nt, Homo sapiens
uaggagugcuuuaagagaa

SEQ ID NO: 787121 - RNA, 19 nt, Homo sapiens
ucacuacccuguuucagau

SEQ ID NO: 787122 - RNA, 19 nt, Homo sapiens
uagaaagcauucccuuaga

SEQ ID NO: 787123 - RNA, 19 nt, Homo sapiens
uaagaaugcacuaaccuuu

SEQ ID NO: 787124 - RNA, 19 nt, Homo sapiens
gcuggaggcuaguaaggaa

SEQ ID NO: 787125 - RNA, 19 nt, Homo sapiens
gaucugaggaccauucaug

SEQ ID NO: 787126 - RNA, 19 nt, Homo sapiens
ccacagccuucauuucuag

SEQ ID NO: 787127 - RNA, 19 nt, Homo sapiens
gcaccaaagagaucuaaug

SEQ ID NO: 787128 - RNA, 19 nt, Homo sapiens
gcaaacaaacaggauuaaa

SEQ ID NO: 787129 - RNA, 19 nt, Homo sapiens
ucauggaagcugcuaaaua

SEQ ID NO: 787130 - RNA, 19 nt, Homo sapiens
uagggcagcugucgucuau

SEQ ID NO: 787131 - RNA, 19 nt, Homo sapiens
gcaagaaaccacagugucu

SEQ ID NO: 787132 - RNA, 19 nt, Homo sapiens
gcaagaguacaccaauuug

SEQ ID NO: 787133 - RNA, 19 nt, Homo sapiens
cccaauaacugccucuaga

SEQ ID NO: 787134 - RNA, 19 nt, Homo sapiens
gaaaagaccaagagaguga

SEQ ID NO: 787135 - RNA, 19 nt, Homo sapiens
gugaauuccugaaguuugu

SEQ ID NO: 787136 - RNA, 19 nt, Homo sapiens
ggcagcaacuacagugaaa

SEQ ID NO: 787137 - RNA, 19 nt, Homo sapiens
gcaguaauggcaagaccua

SEQ ID NO: 787138 - RNA, 19 nt, Homo sapiens
agaguacaccaauuuguua

SEQ ID NO: 787139 - RNA, 19 nt, Homo sapiens
uaaagaccaucagaaggaa

SEQ ID NO: 787140 - RNA, 19 nt, Homo sapiens
uaagaucucauuugcagaa

SEQ ID NO: 787141 - RNA, 19 nt, Homo sapiens
ucaccaguauuugcuuaua

SEQ ID NO: 787142 - RNA, 19 nt, Homo sapiens
gaugaaacguaugcagaug

SEQ ID NO: 787143 - RNA, 19 nt, Homo sapiens
gaagagcuaaggagcaaau

SEQ ID NO: 787144 - RNA, 19 nt, Homo sapiens
gaaaucuuguuacuagaac

SEQ ID NO: 787145 - RNA, 19 nt, Homo sapiens
uaaauucugugguucugau

SEQ ID NO: 787146 - RNA, 19 nt, Homo sapiens
uaccaaaggugcuauuucu

SEQ ID NO: 787147 - RNA, 19 nt, Homo sapiens
aaacugccaucaauauuac

SEQ ID NO: 787148 - RNA, 19 nt, Homo sapiens
ggaccucaguuuccucagu

SEQ ID NO: 787149 - RNA, 19 nt, Homo sapiens
aaucaccaguauuugcuua

SEQ ID NO: 787150 - RNA, 19 nt, Homo sapiens
caaauccacauuccucuug

SEQ ID NO: 787151 - RNA, 19 nt, Homo sapiens
gagcaaauccaagaucugu

SEQ ID NO: 787152 - RNA, 19 nt, Homo sapiens
gauuaaagaccaucagaag

SEQ ID NO: 787153 - RNA, 19 nt, Homo sapiens
gccacagccuucauuucua

SEQ ID NO: 787154 - RNA, 19 nt, Homo sapiens
ccaccugucucugcauuga

SEQ ID NO: 787155 - RNA, 19 nt, Homo sapiens
uuaaagaccaucagaagga

SEQ ID NO: 787156 - RNA, 19 nt, Homo sapiens
ggaggucagucauuuacag

SEQ ID NO: 787157 - RNA, 19 nt, Homo sapiens
aagagaaacuguaaauggu

SEQ ID NO: 787158 - RNA, 19 nt, Homo sapiens
caccaaagagaucuaauga

SEQ ID NO: 787159 - RNA, 19 nt, Homo sapiens
gcugagaucauuccagaug

SEQ ID NO: 787160 - RNA, 19 nt, Homo sapiens
caaacaaacaggauuaaac

SEQ ID NO: 787161 - RNA, 19 nt, Homo sapiens
caacauugaacucccaaga

SEQ ID NO: 787162 - RNA, 19 nt, Homo sapiens
cagcacgccuuaaucaaag

SEQ ID NO: 787163 - RNA, 19 nt, Homo sapiens
ccuuagagaugaggauaaa

SEQ ID NO: 787164 - RNA, 19 nt, Homo sapiens
aaaacaagaugaccagauu

SEQ ID NO: 787165 - RNA, 19 nt, Homo sapiens
ucugagaaguugaggcaaa

SEQ ID NO: 787166 - RNA, 19 nt, Homo sapiens
ugaaaaugcugauuggaaa

SEQ ID NO: 787167 - RNA, 19 nt, Homo sapiens
acagugaaauccuagacaa

SEQ ID NO: 787168 - RNA, 19 nt, Homo sapiens
ggagaaaauuccacuuugu

SEQ ID NO: 787169 - RNA, 19 nt, Homo sapiens
ggaagagagugggaaagag

SEQ ID NO: 787170 - RNA, 19 nt, Homo sapiens
caauaaaggauaugaaggu

SEQ ID NO: 787171 - RNA, 19 nt, Homo sapiens
ugaaacguaugcagaugga

SEQ ID NO: 787172 - RNA, 19 nt, Homo sapiens
ugaaguuuguggaacagaa

SEQ ID NO: 787173 - RNA, 19 nt, Homo sapiens
uaaacacuauagcaucugu

SEQ ID NO: 787174 - RNA, 19 nt, Homo sapiens
acucuacccugcaacauug

SEQ ID NO: 787175 - RNA, 19 nt, Homo sapiens
gagagaaccugcauauaua

SEQ ID NO: 787176 - RNA, 19 nt, Homo sapiens
uaaggaaacucaccuauuu

SEQ ID NO: 787177 - RNA, 19 nt, Homo sapiens
gaauaaaucucuugcugaa

SEQ ID NO: 787178 - RNA, 19 nt, Homo sapiens
gaaagaagccagaaguuaa

SEQ ID NO: 787179 - RNA, 19 nt, Homo sapiens
gaaucuggcuuuaggguua

SEQ ID NO: 787180 - RNA, 19 nt, Homo sapiens
guauaaaccuugccucuuu

SEQ ID NO: 787181 - RNA, 19 nt, Homo sapiens
ugacauaccuggaauauag

SEQ ID NO: 787182 - RNA, 19 nt, Homo sapiens
gaauaaagaugaaggaaag

SEQ ID NO: 787183 - RNA, 19 nt, Homo sapiens
gaacugagaauucuacaaa

SEQ ID NO: 787184 - RNA, 19 nt, Homo sapiens
gaagaaagaaguugaauca

SEQ ID NO: 787185 - RNA, 19 nt, Homo sapiens
gaaauagacugcuggaagu

SEQ ID NO: 787186 - RNA, 19 nt, Homo sapiens
ggaaagaagccagaaguua

SEQ ID NO: 787187 - RNA, 19 nt, Homo sapiens
gaagaaagggccaaacaaa

SEQ ID NO: 787188 - RNA, 19 nt, Homo sapiens
gaacaaacagggucaaaga

SEQ ID NO: 787189 - RNA, 19 nt, Homo sapiens
aaacugagcagcagaauaa

SEQ ID NO: 787190 - RNA, 19 nt, Homo sapiens
gcaaugaggaugugacuaa

SEQ ID NO: 787191 - RNA, 19 nt, Homo sapiens
ggauagcauuucuaagaua

SEQ ID NO: 787192 - RNA, 19 nt, Homo sapiens
gaaacucaccuauuugaaa

SEQ ID NO: 787193 - RNA, 19 nt, Homo sapiens
agaaggagaugaucaagaa

SEQ ID NO: 787194 - RNA, 19 nt, Homo sapiens
gaaggaauaugcugaaagg

SEQ ID NO: 787195 - RNA, 19 nt, Homo sapiens
aaacaugacucgcgauuuc

SEQ ID NO: 787196 - RNA, 19 nt, Homo sapiens
gagagagacugaaauaucu

SEQ ID NO: 787197 - RNA, 19 nt, Homo sapiens
cgagaaacaucaauggauu

SEQ ID NO: 787198 - RNA, 19 nt, Homo sapiens
gcauauauaccagucauua

SEQ ID NO: 787199 - RNA, 19 nt, Homo sapiens
gaagagagagagacugaaa

SEQ ID NO: 787200 - RNA, 19 nt, Homo sapiens
guaaucagccacaacauaa

SEQ ID NO: 787201 - RNA, 19 nt, Homo sapiens
auacggcgauucaaaguua

SEQ ID NO: 787202 - RNA, 19 nt, Homo sapiens
gaacuaggaaucaccguuu

SEQ ID NO: 787203 - RNA, 19 nt, Homo sapiens
ggaagaagauaagccaaga

SEQ ID NO: 787204 - RNA, 19 nt, Homo sapiens
ggauauauuuccuuacuca

SEQ ID NO: 787205 - RNA, 19 nt, Homo sapiens
gaaugaaucuggcuuuagg

SEQ ID NO: 787206 - RNA, 19 nt, Homo sapiens
gaaagaagcagcagaucga

SEQ ID NO: 787207 - RNA, 19 nt, Homo sapiens
ugagagaaccugcauauau

SEQ ID NO: 787208 - RNA, 19 nt, Homo sapiens
ugauaagucuguacauuga

SEQ ID NO: 787209 - RNA, 19 nt, Homo sapiens
gaugauuacuacacugaaa

SEQ ID NO: 787210 - RNA, 19 nt, Homo sapiens
acacagagaugauuacuac

SEQ ID NO: 787211 - RNA, 19 nt, Homo sapiens
gacuaaagcaguugacaua

SEQ ID NO: 787212 - RNA, 19 nt, Homo sapiens
uuaagaaaguggagaagaa

SEQ ID NO: 787213 - RNA, 19 nt, Homo sapiens
ggagauagauaacaaucca

SEQ ID NO: 787214 - RNA, 19 nt, Homo sapiens
ugaaauaucucugaaggau

SEQ ID NO: 787215 - RNA, 19 nt, Homo sapiens
ggaaaagucuacaauguug

SEQ ID NO: 787216 - RNA, 19 nt, Homo sapiens
cagcaucuguuaaucuaaa

SEQ ID NO: 787217 - RNA, 19 nt, Homo sapiens
uaggauacuucucauguuu

SEQ ID NO: 787218 - RNA, 19 nt, Homo sapiens
gguaaucagccacaacaua

SEQ ID NO: 787219 - RNA, 19 nt, Homo sapiens
ucacccaagugcugaauaa

SEQ ID NO: 787220 - RNA, 19 nt, Homo sapiens
gaauauagagaacacuuga

SEQ ID NO: 787221 - RNA, 19 nt, Homo sapiens
aaauaucucugaaggauuc

SEQ ID NO: 787222 - RNA, 19 nt, Homo sapiens
ggucaaagacucuaaaugg

SEQ ID NO: 787223 - RNA, 19 nt, Homo sapiens
ugaaggagauuccgugauc

SEQ ID NO: 787224 - RNA, 19 nt, Homo sapiens
ggauacaugcugagauuaa

SEQ ID NO: 787225 - RNA, 19 nt, Homo sapiens
gaaaggccaacaugagaaa

SEQ ID NO: 787226 - RNA, 19 nt, Homo sapiens
ucgccaagaugaaagguua

SEQ ID NO: 787227 - RNA, 19 nt, Homo sapiens
gaacucaugagacugcuuu

SEQ ID NO: 787228 - RNA, 19 nt, Homo sapiens
gccauaaguucaacgugua

SEQ ID NO: 787229 - RNA, 19 nt, Homo sapiens
agacaugguuguagcauau

SEQ ID NO: 787230 - RNA, 19 nt, Homo sapiens
gauacaugcugagauuaaa

SEQ ID NO: 787231 - RNA, 19 nt, Homo sapiens
gaaacugagcagcagaaua

SEQ ID NO: 787232 - RNA, 19 nt, Homo sapiens
aagcauagguuugauguug

SEQ ID NO: 787233 - RNA, 19 nt, Homo sapiens
agagugacaucauuacuga

SEQ ID NO: 787234 - RNA, 19 nt, Homo sapiens
gcauagguuugauguugaa

SEQ ID NO: 787235 - RNA, 19 nt, Homo sapiens
gcauugaggccuuggauga

SEQ ID NO: 787236 - RNA, 19 nt, Homo sapiens
ugacguguauggacuaaau

SEQ ID NO: 787237 - RNA, 19 nt, Homo sapiens
gaaaucauggcuauauugu

SEQ ID NO: 787238 - RNA, 19 nt, Homo sapiens
ggaugugacuaaagcaguu

SEQ ID NO: 787239 - RNA, 19 nt, Homo sapiens
gcaacuaaacaaucaaaug

SEQ ID NO: 787240 - RNA, 19 nt, Homo sapiens
guaggauacuucucauguu

SEQ ID NO: 787241 - RNA, 19 nt, Homo sapiens
uguaacuugugcaguauua

SEQ ID NO: 787242 - RNA, 19 nt, Homo sapiens
gaugugaacagaugcauug

SEQ ID NO: 787243 - RNA, 19 nt, Homo sapiens
caaacaaacuacccauuuu

SEQ ID NO: 787244 - RNA, 19 nt, Homo sapiens
gcaagaggaacaaauggaa

SEQ ID NO: 787245 - RNA, 19 nt, Homo sapiens
gaacaaugugugcucugua

SEQ ID NO: 787246 - RNA, 19 nt, Homo sapiens
acagcuacauuauacagua

SEQ ID NO: 787247 - RNA, 19 nt, Homo sapiens
aaacacacagagaugauua

SEQ ID NO: 787248 - RNA, 19 nt, Homo sapiens
aaggauacaugcugagauu

SEQ ID NO: 787249 - RNA, 19 nt, Homo sapiens
gaagccagaaguuaagaaa

SEQ ID NO: 787250 - RNA, 19 nt, Homo sapiens
ggaacaaugugugcucugu

SEQ ID NO: 787251 - RNA, 19 nt, Homo sapiens
acaaacaaacuacccauuu

SEQ ID NO: 787252 - RNA, 19 nt, Homo sapiens
agagagagagacugaaaua

SEQ ID NO: 787253 - RNA, 19 nt, Homo sapiens
ggaagaaagggccaaacaa

SEQ ID NO: 787254 - RNA, 19 nt, Homo sapiens
ugacauaacuacuccaaaa

SEQ ID NO: 787255 - RNA, 19 nt, Homo sapiens
caacugacuggguauauau

SEQ ID NO: 787256 - RNA, 19 nt, Homo sapiens
auagacugcuggaaguuua

SEQ ID NO: 787257 - RNA, 19 nt, Homo sapiens
gcaacaagcucagaaacac

SEQ ID NO: 787258 - RNA, 19 nt, Homo sapiens
gaagaagcgagaaacauca

SEQ ID NO: 787259 - RNA, 19 nt, Homo sapiens
gaagauaccgaccaugaag

SEQ ID NO: 787260 - RNA, 19 nt, Homo sapiens
acaacugacuggguauaua

SEQ ID NO: 787261 - RNA, 19 nt, Homo sapiens
auaaaucucuugcugaaca

SEQ ID NO: 787262 - RNA, 19 nt, Homo sapiens
ucagagagugacaucauua

SEQ ID NO: 787263 - RNA, 19 nt, Homo sapiens
ggcagcaacuaaacaauca

SEQ ID NO: 787264 - RNA, 19 nt, Homo sapiens
gaccagcgucucuguauga

SEQ ID NO: 787265 - RNA, 19 nt, Homo sapiens
aaggauagcauuucuaaga

SEQ ID NO: 787266 - RNA, 19 nt, Homo sapiens
uuacaaaccuuggauuuac

SEQ ID NO: 787267 - RNA, 19 nt, Homo sapiens
gucaaagacucuaaaugga

SEQ ID NO: 787268 - RNA, 19 nt, Homo sapiens
ggaaacaugacucgcgauu

SEQ ID NO: 787269 - RNA, 19 nt, Homo sapiens
ggaagauaccgaccaugaa

SEQ ID NO: 787270 - RNA, 19 nt, Homo sapiens
cagcuacauuauacaguaa

SEQ ID NO: 787271 - RNA, 19 nt, Homo sapiens
ucugaaggauucuacacua

SEQ ID NO: 787272 - RNA, 19 nt, Homo sapiens
gaaacacacagagaugauu

SEQ ID NO: 787273 - RNA, 19 nt, Homo sapiens
gaaacaugacucgcgauuu

SEQ ID NO: 787274 - RNA, 19 nt, Homo sapiens
ugagaaguuuguaaugguu

SEQ ID NO: 787275 - RNA, 19 nt, Homo sapiens
ggaaagacaucaagcagua

SEQ ID NO: 787276 - RNA, 19 nt, Homo sapiens
gaucagacaugugcuauua

SEQ ID NO: 787277 - RNA, 19 nt, Homo sapiens
ggaggaagauggucaagaa

SEQ ID NO: 787278 - RNA, 19 nt, Homo sapiens
ugaaagcacugaugaacua

SEQ ID NO: 787279 - RNA, 19 nt, Homo sapiens
gcagaaaccuuuagauuuu

SEQ ID NO: 787280 - RNA, 19 nt, Homo sapiens
ugagaaagguuaugcaauu

SEQ ID NO: 787281 - RNA, 19 nt, Homo sapiens
ucacagagguacaggauuu

SEQ ID NO: 787282 - RNA, 19 nt, Homo sapiens
ggaacuugcugaucuaaug

SEQ ID NO: 787283 - RNA, 19 nt, Homo sapiens
ucacugcaguuucuaauaa

SEQ ID NO: 787284 - RNA, 19 nt, Homo sapiens
gcaacuguuugucuuuaua

SEQ ID NO: 787285 - RNA, 19 nt, Homo sapiens
caaccaccuugauuauuua

SEQ ID NO: 787286 - RNA, 19 nt, Homo sapiens
gcaacacacuuaucaaaca

SEQ ID NO: 787287 - RNA, 19 nt, Homo sapiens
gauccuaaguucauuaaug

SEQ ID NO: 787288 - RNA, 19 nt, Homo sapiens
gguaauacguggacuccua

SEQ ID NO: 787289 - RNA, 19 nt, Homo sapiens
gaagucacauccuagaaga

SEQ ID NO: 787290 - RNA, 19 nt, Homo sapiens
uaacaaagccaaaggagaa

SEQ ID NO: 787291 - RNA, 19 nt, Homo sapiens
gagaaagguuaugcaauuu

SEQ ID NO: 787292 - RNA, 19 nt, Homo sapiens
gaaauccacugcacuuagu

SEQ ID NO: 787293 - RNA, 19 nt, Homo sapiens
acaaccaccuugauuauuu

SEQ ID NO: 787294 - RNA, 19 nt, Homo sapiens
gaaagguuaugcaauuugu

SEQ ID NO: 787295 - RNA, 19 nt, Homo sapiens
ucaguugucuguuuguaua

SEQ ID NO: 787296 - RNA, 19 nt, Homo sapiens
gcaagacaaugccauagau

SEQ ID NO: 787297 - RNA, 19 nt, Homo sapiens
gggaagacuuggaugauga

SEQ ID NO: 787298 - RNA, 19 nt, Homo sapiens
gcaaagaguggauaauaga

SEQ ID NO: 787299 - RNA, 19 nt, Homo sapiens
aaagaaaggugugggcuaa

SEQ ID NO: 787300 - RNA, 19 nt, Homo sapiens
uaagugaacuggcuguaga

SEQ ID NO: 787301 - RNA, 19 nt, Homo sapiens
ggaauuguucgaaugcuua

SEQ ID NO: 787302 - RNA, 19 nt, Homo sapiens
gaaccagccaugucaauga

SEQ ID NO: 787303 - RNA, 19 nt, Homo sapiens
gcccuaaacauguaaauaa

SEQ ID NO: 787304 - RNA, 19 nt, Homo sapiens
uaaagccucugauuccaaa

SEQ ID NO: 787305 - RNA, 19 nt, Homo sapiens
gaaccugaauuugucuaaa

SEQ ID NO: 787306 - RNA, 19 nt, Homo sapiens
ugaaagugaugaaacagaa

SEQ ID NO: 787307 - RNA, 19 nt, Homo sapiens
gggcaaaucauccaagaaa

SEQ ID NO: 787308 - RNA, 19 nt, Homo sapiens
uggagaagcugaugaugaa

SEQ ID NO: 787309 - RNA, 19 nt, Homo sapiens
ggaagaagaagaagaagau

SEQ ID NO: 787310 - RNA, 19 nt, Homo sapiens
gcaacgaugugauaaaugc

SEQ ID NO: 787311 - RNA, 19 nt, Homo sapiens
ugaaggaacugaagcaaag

SEQ ID NO: 787312 - RNA, 19 nt, Homo sapiens
ugaaaagucucccauuaua

SEQ ID NO: 787313 - RNA, 19 nt, Homo sapiens
caguugagaucccuucuuu

SEQ ID NO: 787314 - RNA, 19 nt, Homo sapiens
gggaugacgucuuuuaaua

SEQ ID NO: 787315 - RNA, 19 nt, Homo sapiens
cauuaaagccaagguauua

SEQ ID NO: 787316 - RNA, 19 nt, Homo sapiens
gguaacaggacauauguaa

SEQ ID NO: 787317 - RNA, 19 nt, Homo sapiens
ggaagaggaagaagaagaa

SEQ ID NO: 787318 - RNA, 19 nt, Homo sapiens
gcugugaauuuagccauua

SEQ ID NO: 787319 - RNA, 19 nt, Homo sapiens
uuucagagaugcauuguga

SEQ ID NO: 787320 - RNA, 19 nt, Homo sapiens
caaaagagaaccugaauuu

SEQ ID NO: 787321 - RNA, 19 nt, Homo sapiens
gaaggcagccgaauugaca

SEQ ID NO: 787322 - RNA, 19 nt, Homo sapiens
gagaacagcuuuucauugu

SEQ ID NO: 787323 - RNA, 19 nt, Homo sapiens
ucagcacguucaacuaaua

SEQ ID NO: 787324 - RNA, 19 nt, Homo sapiens
agaugaagcagacauaaua

SEQ ID NO: 787325 - RNA, 19 nt, Homo sapiens
gcacguucaacuaauauuu

SEQ ID NO: 787326 - RNA, 19 nt, Homo sapiens
ggucgaauaucguauacug

SEQ ID NO: 787327 - RNA, 19 nt, Homo sapiens
uggaaagggugaaacauga

SEQ ID NO: 787328 - RNA, 19 nt, Homo sapiens
aaagagaaccugaauuugu

SEQ ID NO: 787329 - RNA, 19 nt, Homo sapiens
gaaaacgugugguugauga

SEQ ID NO: 787330 - RNA, 19 nt, Homo sapiens
acaaauuccucugauguuu

SEQ ID NO: 787331 - RNA, 19 nt, Homo sapiens
ggacauggagaacagcuuu

SEQ ID NO: 787332 - RNA, 19 nt, Homo sapiens
ggaacucuauuggaauuau

SEQ ID NO: 787333 - RNA, 19 nt, Homo sapiens
aaaucaaucugcagacuug

SEQ ID NO: 787334 - RNA, 19 nt, Homo sapiens
cuagggaaguaauggauuu

SEQ ID NO: 787335 - RNA, 19 nt, Homo sapiens
gcaaaucauccaagaaauc

SEQ ID NO: 787336 - RNA, 19 nt, Homo sapiens
caaagaaccagccauguca

SEQ ID NO: 787337 - RNA, 19 nt, Homo sapiens
gaaaauccccagcaacuaa

SEQ ID NO: 787338 - RNA, 19 nt, Homo sapiens
ccacgaagcuauuuuguug

SEQ ID NO: 787339 - RNA, 19 nt, Homo sapiens
gaaggcagcauucacaauc

SEQ ID NO: 787340 - RNA, 19 nt, Homo sapiens
uaaaugaugaugaggauga

SEQ ID NO: 787341 - RNA, 19 nt, Homo sapiens
ugaaacaugagaaagguua

SEQ ID NO: 787342 - RNA, 19 nt, Homo sapiens
uaauaauacuggcccuaaa

SEQ ID NO: 787343 - RNA, 19 nt, Homo sapiens
agagagcacugcaaaggaa

SEQ ID NO: 787344 - RNA, 19 nt, Homo sapiens
cuucuucgauuguuuacua

SEQ ID NO: 787345 - RNA, 19 nt, Homo sapiens
uaauagacuugccucagaa

SEQ ID NO: 787346 - RNA, 19 nt, Homo sapiens
guggaacucuauuggaauu

SEQ ID NO: 787347 - RNA, 19 nt, Homo sapiens
ggacaucuuucuggcauca

SEQ ID NO: 787348 - RNA, 19 nt, Homo sapiens
gagaugcauugugauugua

SEQ ID NO: 787349 - RNA, 19 nt, Homo sapiens
gaagcaacuguuugucuuu

SEQ ID NO: 787350 - RNA, 19 nt, Homo sapiens
gucagaguguggcaaauuu

SEQ ID NO: 787351 - RNA, 19 nt, Homo sapiens
aagcaacuguuugucuuua

SEQ ID NO: 787352 - RNA, 19 nt, Homo sapiens
gaugaagcagacauaauaa

SEQ ID NO: 787353 - RNA, 19 nt, Homo sapiens
guacaaauuccucugaugu

SEQ ID NO: 787354 - RNA, 19 nt, Homo sapiens
gaacuugcugaucuaauga

SEQ ID NO: 787355 - RNA, 19 nt, Homo sapiens
gagaugauaugaguaaugc

SEQ ID NO: 787356 - RNA, 19 nt, Homo sapiens
ugaagcaacuguuugucuu

SEQ ID NO: 787357 - RNA, 19 nt, Homo sapiens
caagaaauccacugcacuu

SEQ ID NO: 787358 - RNA, 19 nt, Homo sapiens
gaagaagaagauuucagaa

SEQ ID NO: 787359 - RNA, 19 nt, Homo sapiens
gagcgagaauuccguugug

SEQ ID NO: 787360 - RNA, 19 nt, Homo sapiens
uaacagaggacuugguaau

SEQ ID NO: 787361 - RNA, 19 nt, Homo sapiens
uuacguggauucagaagga

SEQ ID NO: 787362 - RNA, 19 nt, Homo sapiens
aagcaaagaguggauaaua

SEQ ID NO: 787363 - RNA, 19 nt, Homo sapiens
ggucuggcauggcauccua

SEQ ID NO: 787364 - RNA, 19 nt, Homo sapiens
gauuguaauuacugaguug

SEQ ID NO: 787365 - RNA, 19 nt, Homo sapiens
gaggucacccggauaggua

SEQ ID NO: 787366 - RNA, 19 nt, Homo sapiens
agaaggaauuguucgaaug

SEQ ID NO: 787367 - RNA, 19 nt, Homo sapiens
cagaaggaauuguucgaau

SEQ ID NO: 787368 - RNA, 19 nt, Homo sapiens
auaauagacuugccucaga

SEQ ID NO: 787369 - RNA, 19 nt, Homo sapiens
gauaauuucaucucucaga

SEQ ID NO: 787370 - RNA, 19 nt, Homo sapiens
gcugcuggaucuagugauu

SEQ ID NO: 787371 - RNA, 19 nt, Homo sapiens
gaaagugaugaaacagaaa

SEQ ID NO: 787372 - RNA, 19 nt, Homo sapiens
ugaacuggcuguagagaag

SEQ ID NO: 787373 - RNA, 19 nt, Homo sapiens
guguggaacucuauuggaa

SEQ ID NO: 787374 - RNA, 19 nt, Homo sapiens
ucaaagaggaggaggaaga

SEQ ID NO: 787375 - RNA, 19 nt, Homo sapiens
ggauagaguuagacaauaa

SEQ ID NO: 787376 - RNA, 19 nt, Homo sapiens
ggaaccagcucaucaagaa

SEQ ID NO: 787377 - RNA, 19 nt, Homo sapiens
ucaguaggcuucuggaaua

SEQ ID NO: 787378 - RNA, 19 nt, Homo sapiens
gaucagguguggccaauga

SEQ ID NO: 787379 - RNA, 19 nt, Homo sapiens
ccaagaggcuccugaaugu

SEQ ID NO: 787380 - RNA, 19 nt, Homo sapiens
gcaacacgcuccugacuuc

SEQ ID NO: 787381 - RNA, 19 nt, Homo sapiens
caaacuugauugugcauaa

SEQ ID NO: 787382 - RNA, 19 nt, Homo sapiens
guucuggucuuacucauaa

SEQ ID NO: 787383 - RNA, 19 nt, Homo sapiens
cuaacaagcucccagguaa

SEQ ID NO: 787384 - RNA, 19 nt, Homo sapiens
ggaauagcaucuccuuuca

SEQ ID NO: 787385 - RNA, 19 nt, Homo sapiens
aaauaaagaucaccacuuc

SEQ ID NO: 787386 - RNA, 19 nt, Homo sapiens
ccaaguggaauaucuguua

SEQ ID NO: 787387 - RNA, 19 nt, Homo sapiens
gcaucgaacugcgguagua

SEQ ID NO: 787388 - RNA, 19 nt, Homo sapiens
caaauuguguugguuaugu

SEQ ID NO: 787389 - RNA, 19 nt, Homo sapiens
ggacacagcagucucugaa

SEQ ID NO: 787390 - RNA, 19 nt, Homo sapiens
gaauaaacaggaaugcaaa

SEQ ID NO: 787391 - RNA, 19 nt, Homo sapiens
gaagaugcacaaucccuaa

SEQ ID NO: 787392 - RNA, 19 nt, Homo sapiens
ccacuggcaugcucuuuga

SEQ ID NO: 787393 - RNA, 19 nt, Homo sapiens
ggaaagcaaauauacaaug

SEQ ID NO: 787394 - RNA, 19 nt, Homo sapiens
gggcugauauauauuggaa

SEQ ID NO: 787395 - RNA, 19 nt, Homo sapiens
acacagcagucucugaauu

SEQ ID NO: 787396 - RNA, 19 nt, Homo sapiens
cagaaggccuuuccugugu

SEQ ID NO: 787397 - RNA, 19 nt, Homo sapiens
uagcaucuccuuucacuuu

SEQ ID NO: 787398 - RNA, 19 nt, Homo sapiens
gaaggccuuuccuguguga

SEQ ID NO: 787399 - RNA, 19 nt, Homo sapiens
gauccugcauuucuaacaa

SEQ ID NO: 787400 - RNA, 19 nt, Homo sapiens
gggagauccugcauuucua

SEQ ID NO: 787401 - RNA, 19 nt, Homo sapiens
ucugggagauccugcauuu

SEQ ID NO: 787402 - RNA, 19 nt, Homo sapiens
ugacaagccuucuguucug

SEQ ID NO: 787403 - RNA, 19 nt, Homo sapiens
caaaggcugucucacuugu

SEQ ID NO: 787404 - RNA, 19 nt, Homo sapiens
aagcuuggcguguuucuua

SEQ ID NO: 787405 - RNA, 19 nt, Homo sapiens
ggagauccugcauuucuaa

SEQ ID NO: 787406 - RNA, 19 nt, Homo sapiens
acucauaacugggugguuu

SEQ ID NO: 787407 - RNA, 19 nt, Homo sapiens
gagaaucacagagucauug

SEQ ID NO: 787408 - RNA, 19 nt, Homo sapiens
uagcaaauuguguugguua

SEQ ID NO: 787409 - RNA, 19 nt, Homo sapiens
cuuaacccaugcuuucaua

SEQ ID NO: 787410 - RNA, 19 nt, Homo sapiens
gcucuccucuuugauguga

SEQ ID NO: 787411 - RNA, 19 nt, Homo sapiens
ggacucgaccugagaagga

SEQ ID NO: 787412 - RNA, 19 nt, Homo sapiens
uaccugggcuucugggaaa

SEQ ID NO: 787413 - RNA, 19 nt, Homo sapiens
gaauguguuuacgcuguuu

SEQ ID NO: 787414 - RNA, 19 nt, Homo sapiens
gcaaaggcugucucacuug

SEQ ID NO: 787415 - RNA, 19 nt, Homo sapiens
ccacuuugcuaccaugaca

SEQ ID NO: 787416 - RNA, 19 nt, Homo sapiens
ggcuguaaaugcagauauu

SEQ ID NO: 787417 - RNA, 19 nt, Homo sapiens
gauugcccgugaagacuuu

SEQ ID NO: 787418 - RNA, 19 nt, Homo sapiens
uguuuacgcuguuuaaugu

SEQ ID NO: 787419 - RNA, 19 nt, Homo sapiens
ccagguauccuucauuauc

SEQ ID NO: 787420 - RNA, 19 nt, Homo sapiens
cagggugccucacaaacuu

SEQ ID NO: 787421 - RNA, 19 nt, Homo sapiens
gaagaaggaggagcuggaa

SEQ ID NO: 787422 - RNA, 19 nt, Homo sapiens
ucauugacccuaucauuau

SEQ ID NO: 787423 - RNA, 19 nt, Homo sapiens
gcacaaucccuaaaauaaa

SEQ ID NO: 787424 - RNA, 19 nt, Homo sapiens
guucccaccugcuucugua

SEQ ID NO: 787425 - RNA, 19 nt, Homo sapiens
gcgaagagagagagcugua

SEQ ID NO: 787426 - RNA, 19 nt, Homo sapiens
cauugacccuaucauuauu

SEQ ID NO: 787427 - RNA, 19 nt, Homo sapiens
uaacccaugcuuucauaaa

SEQ ID NO: 787428 - RNA, 19 nt, Homo sapiens
uggauagaguuagacaaua

SEQ ID NO: 787429 - RNA, 19 nt, Homo sapiens
ggaaguggccgugcaccaa

SEQ ID NO: 787430 - RNA, 19 nt, Homo sapiens
gcguguggcuuggacauga

SEQ ID NO: 787431 - RNA, 19 nt, Homo sapiens
ucagacaugugaagagaag

SEQ ID NO: 787432 - RNA, 19 nt, Homo sapiens
ugacuggcgugcugagaau

SEQ ID NO: 787433 - RNA, 19 nt, Homo sapiens
ugcaaaggcugucucacuu

SEQ ID NO: 787434 - RNA, 19 nt, Homo sapiens
gaaaaccugcggagaauug

SEQ ID NO: 787435 - RNA, 19 nt, Homo sapiens
uaagaaacaagggaaauuc

SEQ ID NO: 787436 - RNA, 19 nt, Homo sapiens
ccgcauuccugcacucaga

SEQ ID NO: 787437 - RNA, 19 nt, Homo sapiens
ggacuucccgguggaguga

SEQ ID NO: 787438 - RNA, 19 nt, Homo sapiens
gcagauauugcgccugugu

SEQ ID NO: 787439 - RNA, 19 nt, Homo sapiens
cacagcagucucugaauuu

SEQ ID NO: 787440 - RNA, 19 nt, Homo sapiens
gaaggacacagcagucucu

SEQ ID NO: 787441 - RNA, 19 nt, Homo sapiens
agaauaaacaggaaugcaa

SEQ ID NO: 787442 - RNA, 19 nt, Homo sapiens
caagagaaucacagaguca

SEQ ID NO: 787443 - RNA, 19 nt, Homo sapiens
caugggaagugcuggaauc

SEQ ID NO: 787444 - RNA, 19 nt, Homo sapiens
ugcccuagcuggaucaaug

SEQ ID NO: 787445 - RNA, 19 nt, Homo sapiens
cuccagaauucuuguaaau

SEQ ID NO: 787446 - RNA, 19 nt, Homo sapiens
uaggauggcuaugugauca

SEQ ID NO: 787447 - RNA, 19 nt, Homo sapiens
uggaauagcaucuccuuuc

SEQ ID NO: 787448 - RNA, 19 nt, Homo sapiens
gaauacagagaguggaauc

SEQ ID NO: 787449 - RNA, 19 nt, Homo sapiens
gccugacccucccauaaga

SEQ ID NO: 787450 - RNA, 19 nt, Homo sapiens
cuaaacccaucaucuaagg

SEQ ID NO: 787451 - RNA, 19 nt, Homo sapiens
ccagggcugauauauauug

SEQ ID NO: 787452 - RNA, 19 nt, Homo sapiens
guggauagaguuagacaau

SEQ ID NO: 787453 - RNA, 19 nt, Homo sapiens
caggugaggguuacacuga

SEQ ID NO: 787454 - RNA, 19 nt, Homo sapiens
ggauuguucuggucuuacu

SEQ ID NO: 787455 - RNA, 19 nt, Homo sapiens
gaagcaaacgugggacugu

SEQ ID NO: 787456 - RNA, 19 nt, Homo sapiens
ucaauguuucgaucugaua

SEQ ID NO: 787457 - RNA, 19 nt, Homo sapiens
gacugcagguggccuuguu

SEQ ID NO: 787458 - RNA, 19 nt, Homo sapiens
augaaaagcugaacaguug

SEQ ID NO: 787459 - RNA, 19 nt, Homo sapiens
ggaauaucuguuacuauag

SEQ ID NO: 787460 - RNA, 19 nt, Homo sapiens
caaguggaauaucuguuac

SEQ ID NO: 787461 - RNA, 19 nt, Homo sapiens
cugcauuucuuaccagugu

SEQ ID NO: 787462 - RNA, 19 nt, Homo sapiens
caacuguggaggcuguaaa

SEQ ID NO: 787463 - RNA, 19 nt, Homo sapiens
aagaggcuccugaauguga

SEQ ID NO: 787464 - RNA, 19 nt, Homo sapiens
cgaugcaauucuagccaaa

SEQ ID NO: 787465 - RNA, 19 nt, Homo sapiens
gcagggugccucacaaacu

SEQ ID NO: 787466 - RNA, 19 nt, Homo sapiens
ccaaggacucgaccugaga

SEQ ID NO: 787467 - RNA, 19 nt, Homo sapiens
aaggcugucucacuuguug

SEQ ID NO: 787468 - RNA, 19 nt, Homo sapiens
gaaugcaaaggcugucuca

SEQ ID NO: 787469 - RNA, 19 nt, Homo sapiens
gccaagagaaucacagagu

SEQ ID NO: 787470 - RNA, 19 nt, Homo sapiens
cuagcuggaucaauguuuc

SEQ ID NO: 787471 - RNA, 19 nt, Homo sapiens
ugaagacuuuggccuagca

SEQ ID NO: 787472 - RNA, 19 nt, Homo sapiens
ggaaauaucaccccugaag

SEQ ID NO: 787473 - RNA, 19 nt, Homo sapiens
gcagaauugaggaggaaga

SEQ ID NO: 787474 - RNA, 19 nt, Homo sapiens
gagcucaucaagcccaaga

SEQ ID NO: 787475 - RNA, 19 nt, Homo sapiens
gaacaaaccugaagcagaa

SEQ ID NO: 787476 - RNA, 19 nt, Homo sapiens
gggaauacaugauaaagua

SEQ ID NO: 787477 - RNA, 19 nt, Homo sapiens
gaagagggaauacaugaua

SEQ ID NO: 787478 - RNA, 19 nt, Homo sapiens
gaauaaggaugccaccaaa

SEQ ID NO: 787479 - RNA, 19 nt, Homo sapiens
gauaaacuguuacgcauau

SEQ ID NO: 787480 - RNA, 19 nt, Homo sapiens
gaagggagguggaguuauc

SEQ ID NO: 787481 - RNA, 19 nt, Homo sapiens
gagaagaauuagaauccua

SEQ ID NO: 787482 - RNA, 19 nt, Homo sapiens
gauggaacauugagacuau

SEQ ID NO: 787483 - RNA, 19 nt, Homo sapiens
gagcgucaaucauauguug

SEQ ID NO: 787484 - RNA, 19 nt, Homo sapiens
gaaauuaguggucauacuu

SEQ ID NO: 787485 - RNA, 19 nt, Homo sapiens
gcagaaacagcaguaaaua

SEQ ID NO: 787486 - RNA, 19 nt, Homo sapiens
caucagccuuccagaguua

SEQ ID NO: 787487 - RNA, 19 nt, Homo sapiens
gaguuauccucuuauagua

SEQ ID NO: 787488 - RNA, 19 nt, Homo sapiens
aaacucaagugucagauga

SEQ ID NO: 787489 - RNA, 19 nt, Homo sapiens
ccaauuaaauccuuugaag

SEQ ID NO: 787490 - RNA, 19 nt, Homo sapiens
gugcaacacugaauaagga

SEQ ID NO: 787491 - RNA, 19 nt, Homo sapiens
gcaaagaugguaaaccuau

SEQ ID NO: 787492 - RNA, 19 nt, Homo sapiens
agaaauugcuucagagaau

SEQ ID NO: 787493 - RNA, 19 nt, Homo sapiens
gaggauaaacagauucuuu

SEQ ID NO: 787494 - RNA, 19 nt, Homo sapiens
gaauucagagugcaucuuu

SEQ ID NO: 787495 - RNA, 19 nt, Homo sapiens
ugacagaagugaaaucucu

SEQ ID NO: 787496 - RNA, 19 nt, Homo sapiens
ggaguuauccucuuauagu

SEQ ID NO: 787497 - RNA, 19 nt, Homo sapiens
ggccugagcgucaaucaua

SEQ ID NO: 787498 - RNA, 19 nt, Homo sapiens
aaucagcgcuugcaaagau

SEQ ID NO: 787499 - RNA, 19 nt, Homo sapiens
ucaaucauauguugcaguu

SEQ ID NO: 787500 - RNA, 19 nt, Homo sapiens
gaaacagcaguaaauaaug

SEQ ID NO: 787501 - RNA, 19 nt, Homo sapiens
ggagagauuuugguuauaa

SEQ ID NO: 787502 - RNA, 19 nt, Homo sapiens
gaagaggagcuagaagaaa

SEQ ID NO: 787503 - RNA, 19 nt, Homo sapiens
gcaggauaguaauuauuug

SEQ ID NO: 787504 - RNA, 19 nt, Homo sapiens
ucaguggcaucacgccuua

SEQ ID NO: 787505 - RNA, 19 nt, Homo sapiens
aagaggagcuagaagaaau

SEQ ID NO: 787506 - RNA, 19 nt, Homo sapiens
ggacccaauuaaauccuuu

SEQ ID NO: 787507 - RNA, 19 nt, Homo sapiens
gagacuggauuggaacauu

SEQ ID NO: 787508 - RNA, 19 nt, Homo sapiens
cagaaacagcaguaaauaa

SEQ ID NO: 787509 - RNA, 19 nt, Homo sapiens
ggaaauuaguggucauacu

SEQ ID NO: 787510 - RNA, 19 nt, Homo sapiens
agacuggauuggaacauuu

SEQ ID NO: 787511 - RNA, 19 nt, Homo sapiens
guggaguuauccucuuaua

SEQ ID NO: 787512 - RNA, 19 nt, Homo sapiens
ggcaaacugugguaggaaa

SEQ ID NO: 787513 - RNA, 19 nt, Homo sapiens
gcauauaugacuugaacaa

SEQ ID NO: 787514 - RNA, 19 nt, Homo sapiens
ggauaaacuguuacgcaua

SEQ ID NO: 787515 - RNA, 19 nt, Homo sapiens
ucacgcaggauaguaauua

SEQ ID NO: 787516 - RNA, 19 nt, Homo sapiens
caucacgccuuauggguau

SEQ ID NO: 787517 - RNA, 19 nt, Homo sapiens
ucuuguagcuguuuauguu

SEQ ID NO: 787518 - RNA, 19 nt, Homo sapiens
gcaucagccuuccagaguu

SEQ ID NO: 787519 - RNA, 19 nt, Homo sapiens
ucauaaaggugcuguuugg

SEQ ID NO: 787520 - RNA, 19 nt, Homo sapiens
aaucauauguugcaguuag

SEQ ID NO: 787521 - RNA, 19 nt, Homo sapiens
caaagaugguaaaccuaug

SEQ ID NO: 787522 - RNA, 19 nt, Homo sapiens
uggaacaacuaacuaacuu

SEQ ID NO: 787523 - RNA, 19 nt, Homo sapiens
caacagaagaggagcuaga

SEQ ID NO: 787524 - RNA, 19 nt, Homo sapiens
uaaagaagagggaauacau

SEQ ID NO: 787525 - RNA, 19 nt, Homo sapiens
ugacaaaacuguucgacuu

SEQ ID NO: 787526 - RNA, 19 nt, Homo sapiens
gcagugaggauaaacagau

SEQ ID NO: 787527 - RNA, 19 nt, Homo sapiens
gcucauaaacacauuguca

SEQ ID NO: 787528 - RNA, 19 nt, Homo sapiens
acaggagacuggauuggaa

SEQ ID NO: 787529 - RNA, 19 nt, Homo sapiens
aagagggaauacaugauaa

SEQ ID NO: 787530 - RNA, 19 nt, Homo sapiens
cagaagaggagcuagaaga

SEQ ID NO: 787531 - RNA, 19 nt, Homo sapiens
gagauuuaguccugaugga

SEQ ID NO: 787532 - RNA, 19 nt, Homo sapiens
gcagaaccuaaggaaauua

SEQ ID NO: 787533 - RNA, 19 nt, Homo sapiens
gaagcagaaccuaaggaaa

SEQ ID NO: 787534 - RNA, 19 nt, Homo sapiens
ggucauaaaggugcuguuu

SEQ ID NO: 787535 - RNA, 19 nt, Homo sapiens
caucaauucugcaucucuu

SEQ ID NO: 787536 - RNA, 19 nt, Homo sapiens
aagcagaaccuaaggaaau

SEQ ID NO: 787537 - RNA, 19 nt, Homo sapiens
aaacaagcaagcagagaaa

SEQ ID NO: 787538 - RNA, 19 nt, Homo sapiens
gauaaaguaacugguuuga

SEQ ID NO: 787539 - RNA, 19 nt, Homo sapiens
ccuuauggguauuucuuaa

SEQ ID NO: 787540 - RNA, 19 nt, Homo sapiens
gccaacauccaauuucuau

SEQ ID NO: 787541 - RNA, 19 nt, Homo sapiens
uucagaagauggaacauug

SEQ ID NO: 787542 - RNA, 19 nt, Homo sapiens
ggcagaaacagcaguaaau

SEQ ID NO: 787543 - RNA, 19 nt, Homo sapiens
cguauggccuuuggaaaug

SEQ ID NO: 787544 - RNA, 19 nt, Homo sapiens
gaugaagggagguggaguu

SEQ ID NO: 787545 - RNA, 19 nt, Homo sapiens
uauggacgaucuauugcuu

SEQ ID NO: 787546 - RNA, 19 nt, Homo sapiens
cagugaggauaaacagauu

SEQ ID NO: 787547 - RNA, 19 nt, Homo sapiens
cgcaggauaguaauuauuu

SEQ ID NO: 787548 - RNA, 19 nt, Homo sapiens
cucaggagaugaauugaug

SEQ ID NO: 787549 - RNA, 19 nt, Homo sapiens
caugauaaaguaacugguu

SEQ ID NO: 787550 - RNA, 19 nt, Homo sapiens
aaacguauggccuuuggaa

SEQ ID NO: 787551 - RNA, 19 nt, Homo sapiens
ugucaagacuguggauuuc

SEQ ID NO: 787552 - RNA, 19 nt, Homo sapiens
aagaagagggaauacauga

SEQ ID NO: 787553 - RNA, 19 nt, Homo sapiens
gaauauauacaagccaaca

SEQ ID NO: 787554 - RNA, 19 nt, Homo sapiens
guuauccucuuauaguaca

SEQ ID NO: 787555 - RNA, 19 nt, Homo sapiens
ggaacaacuaacuaacuug

SEQ ID NO: 787556 - RNA, 19 nt, Homo sapiens
gaaaugugugcuuccugaa

SEQ ID NO: 787557 - RNA, 19 nt, Homo sapiens
ugaauaaggaugccaccaa

SEQ ID NO: 787558 - RNA, 19 nt, Homo sapiens
uugcuucaguuguaaagaa

SEQ ID NO: 787559 - RNA, 19 nt, Homo sapiens
uuugauuucucguucauug

SEQ ID NO: 787560 - RNA, 19 nt, Homo sapiens
guaacugguuugauuucuc

SEQ ID NO: 787561 - RNA, 19 nt, Homo sapiens
agaagaggagcuagaagaa

SEQ ID NO: 787562 - RNA, 19 nt, Homo sapiens
ugauuucucguucauugua

SEQ ID NO: 787563 - RNA, 19 nt, Homo sapiens
agguggaguuauccucuua

SEQ ID NO: 787564 - RNA, 19 nt, Homo sapiens
uaaggcagaaacagcagua

SEQ ID NO: 787565 - RNA, 19 nt, Homo sapiens
ugaagcagaaccuaaggaa

SEQ ID NO: 787566 - RNA, 19 nt, Homo sapiens
gacccuggcucauaaacac

SEQ ID NO: 787567 - RNA, 19 nt, Homo sapiens
guaaagaagagggaauaca

SEQ ID NO: 787568 - RNA, 19 nt, Homo sapiens
agaauuagaauccuacaag

SEQ ID NO: 787569 - RNA, 19 nt, Homo sapiens
cauaaacacauugucaaga

SEQ ID NO: 787570 - RNA, 19 nt, Homo sapiens
ccucgucgacuguuucuug

SEQ ID NO: 787571 - RNA, 19 nt, Homo sapiens
acauugagacuauggcaaa

SEQ ID NO: 787572 - RNA, 19 nt, Homo sapiens
acgcauauaugacuugaac

SEQ ID NO: 787573 - RNA, 19 nt, Homo sapiens
auaaacacauugucaagac

SEQ ID NO: 787574 - RNA, 19 nt, Homo sapiens
caagccaacauccaauuuc

SEQ ID NO: 787575 - RNA, 19 nt, Homo sapiens
gaucaucacuuguaacuaa

SEQ ID NO: 787576 - RNA, 19 nt, Homo sapiens
gaagaaacguagaaacaaa

SEQ ID NO: 787577 - RNA, 19 nt, Homo sapiens
gcagguacuuggugaaaga

SEQ ID NO: 787578 - RNA, 19 nt, Homo sapiens
ggaagaagcaguaaacagu

SEQ ID NO: 787579 - RNA, 19 nt, Homo sapiens
ucagaaaaguguugucuua

SEQ ID NO: 787580 - RNA, 19 nt, Homo sapiens
gcaguaaacaguugggaaa

SEQ ID NO: 787581 - RNA, 19 nt, Homo sapiens
gaagaagcaguaaacaguu

SEQ ID NO: 787582 - RNA, 19 nt, Homo sapiens
gcacaaacccagugucuac

SEQ ID NO: 787583 - RNA, 19 nt, Homo sapiens
uugcaugucuuccauauau

SEQ ID NO: 787584 - RNA, 19 nt, Homo sapiens
gaacuuagcauugcauguc

SEQ ID NO: 787585 - RNA, 19 nt, Homo sapiens
guacuuggugaaagaaaua

SEQ ID NO: 787586 - RNA, 19 nt, Homo sapiens
cagaagaaacguagaaaca

SEQ ID NO: 787587 - RNA, 19 nt, Homo sapiens
aaagaagaacuuagcauug

SEQ ID NO: 787588 - RNA, 19 nt, Homo sapiens
guaaacaguugggaaaugc

SEQ ID NO: 787589 - RNA, 19 nt, Homo sapiens
gcaugucuuccauauauug

SEQ ID NO: 787590 - RNA, 19 nt, Homo sapiens
aagaagcaguaaacaguug

SEQ ID NO: 787591 - RNA, 19 nt, Homo sapiens
caaacccagugucuacuuc

SEQ ID NO: 787592 - RNA, 19 nt, Homo sapiens
cuaccugaguauaaggaua

SEQ ID NO: 787593 - RNA, 19 nt, Homo sapiens
gguacuuggugaaagaaau

SEQ ID NO: 787594 - RNA, 19 nt, Homo sapiens
cauugcaugucuuccauau

SEQ ID NO: 787595 - RNA, 19 nt, Homo sapiens
aagaagaacuuagcauugc

SEQ ID NO: 787596 - RNA, 19 nt, Homo sapiens
cgcagaggauauucagaaa

SEQ ID NO: 787597 - RNA, 19 nt, Homo sapiens
gaaaaguguugucuuacag

SEQ ID NO: 787598 - RNA, 19 nt, Homo sapiens
gauauucaccccuugguaa

SEQ ID NO: 787599 - RNA, 19 nt, Homo sapiens
uaccugaguauaaggauaa

SEQ ID NO: 787600 - RNA, 19 nt, Homo sapiens
ugcagucacuaccugagua

SEQ ID NO: 787601 - RNA, 19 nt, Homo sapiens
cuacagcccauaccaguuc

SEQ ID NO: 787602 - RNA, 19 nt, Homo sapiens
agaagaaacguagaaacaa

SEQ ID NO: 787603 - RNA, 19 nt, Homo sapiens
gcauugcaugucuuccaua

SEQ ID NO: 787604 - RNA, 19 nt, Homo sapiens
gaagaacuuagcauugcau

SEQ ID NO: 787605 - RNA, 19 nt, Homo sapiens
aguaaacaguugggaaaug

SEQ ID NO: 787606 - RNA, 19 nt, Homo sapiens
gcccauaccaguucgaaag

SEQ ID NO: 787607 - RNA, 19 nt, Homo sapiens
agucacuaccugaguauaa

SEQ ID NO: 787608 - RNA, 19 nt, Homo sapiens
gcagucacuaccugaguau

SEQ ID NO: 787609 - RNA, 19 nt, Homo sapiens
cagaggauauucagaaaag

SEQ ID NO: 787610 - RNA, 19 nt, Homo sapiens
acgcagaggauauucagaa

SEQ ID NO: 787611 - RNA, 19 nt, Homo sapiens
caucacuuguaacuaagau

SEQ ID NO: 787612 - RNA, 19 nt, Homo sapiens
ggaaaugcagucacuaccu

SEQ ID NO: 787613 - RNA, 19 nt, Homo sapiens
agaagaacuuagcauugca

SEQ ID NO: 787614 - RNA, 19 nt, Homo sapiens
guugggaaaugcagucacu

SEQ ID NO: 787615 - RNA, 19 nt, Homo sapiens
gggaagaagcaguaaacag

SEQ ID NO: 787616 - RNA, 19 nt, Homo sapiens
ugguaagacaagagaauuu

SEQ ID NO: 787617 - RNA, 19 nt, Homo sapiens
agaaaaguguugucuuaca

SEQ ID NO: 787618 - RNA, 19 nt, Homo sapiens
gucacuaccugaguauaag

SEQ ID NO: 787619 - RNA, 19 nt, Homo sapiens
ggagccaguuccguuucga

SEQ ID NO: 787620 - RNA, 19 nt, Homo sapiens
gguaagacaagagaauuuu

SEQ ID NO: 787621 - RNA, 19 nt, Homo sapiens
gcaauuucauuaacucuga

SEQ ID NO: 787622 - RNA, 19 nt, Homo sapiens
ucaccacacugacuuauuu

SEQ ID NO: 787623 - RNA, 19 nt, Homo sapiens
caugguggcuggccuguuu

SEQ ID NO: 787624 - RNA, 19 nt, Homo sapiens
gcgaggacccggagaagua

SEQ ID NO: 787625 - RNA, 19 nt, Homo sapiens
gaacgugggcugugacuuc

SEQ ID NO: 787626 - RNA, 19 nt, Homo sapiens
caacgaggacuacuucauu

SEQ ID NO: 787627 - RNA, 19 nt, Homo sapiens
ccaaggacauuaucgacuu

SEQ ID NO: 787628 - RNA, 19 nt, Homo sapiens
guaagaacgugggcuguga

SEQ ID NO: 787629 - RNA, 19 nt, Homo sapiens
gagauugacuccggugcua

SEQ ID NO: 787630 - RNA, 19 nt, Homo sapiens
gcugugacuucgagauuga

SEQ ID NO: 787631 - RNA, 19 nt, Homo sapiens
gccaguauaucaccagguu

SEQ ID NO: 787632 - RNA, 19 nt, Homo sapiens
gcagacaacacccugaaga

SEQ ID NO: 787633 - RNA, 19 nt, Homo sapiens
gaggaggaccuaaagauca

SEQ ID NO: 787634 - RNA, 19 nt, Homo sapiens
gagaugaggcuagcgauug

SEQ ID NO: 787635 - RNA, 19 nt, Homo sapiens
ccaaggagccugucuggau

SEQ ID NO: 787636 - RNA, 19 nt, Homo sapiens
uggcuggccuguuucauga

SEQ ID NO: 787637 - RNA, 19 nt, Homo sapiens
ugacuuauuucccuaaacu

SEQ ID NO: 787638 - RNA, 19 nt, Homo sapiens
caccgcagcugcagcauca

SEQ ID NO: 787639 - RNA, 19 nt, Homo sapiens
gaggaccgcuguggugugu

SEQ ID NO: 787640 - RNA, 19 nt, Homo sapiens
ccaaauacaaaggcagaua

SEQ ID NO: 787641 - RNA, 19 nt, Homo sapiens
aaacgaccuuucaucaugu

SEQ ID NO: 787642 - RNA, 19 nt, Homo sapiens
ccacggguuuggaaguuug

SEQ ID NO: 787643 - RNA, 19 nt, Homo sapiens
caccuggcguccucuauga

SEQ ID NO: 787644 - RNA, 19 nt, Homo sapiens
ggaggaggaccuaaagauc

SEQ ID NO: 787645 - RNA, 19 nt, Homo sapiens
gcuaugugcugaccaucau

SEQ ID NO: 787646 - RNA, 19 nt, Homo sapiens
guagggcaauuucauuaac

SEQ ID NO: 787647 - RNA, 19 nt, Homo sapiens
gcaucaacggcaucuguaa

SEQ ID NO: 787648 - RNA, 19 nt, Homo sapiens
caaggacauuaucgacuuc

SEQ ID NO: 787649 - RNA, 19 nt, Homo sapiens
cagaaaagcaucaacauga

SEQ ID NO: 787650 - RNA, 19 nt, Homo sapiens
ggacuggguggauggagaa

SEQ ID NO: 787651 - RNA, 19 nt, Homo sapiens
aaguagggcaauuucauua

SEQ ID NO: 787652 - RNA, 19 nt, Homo sapiens
aaaguagggcaauuucauu

SEQ ID NO: 787653 - RNA, 19 nt, Homo sapiens
gcagccacuuugacgcuau

SEQ ID NO: 787654 - RNA, 19 nt, Homo sapiens
gaagcggcaaugacuguga

SEQ ID NO: 787655 - RNA, 19 nt, Homo sapiens
ccgcuggccuucacuguag

SEQ ID NO: 787656 - RNA, 19 nt, Homo sapiens
acaacacccugaagagcuu

SEQ ID NO: 787657 - RNA, 19 nt, Homo sapiens
gagccucaguucuccaucu

SEQ ID NO: 787658 - RNA, 19 nt, Homo sapiens
gcaagcgggauguaucugu

SEQ ID NO: 787659 - RNA, 19 nt, Homo sapiens
ucaacggcaucuguaagaa

SEQ ID NO: 787660 - RNA, 19 nt, Homo sapiens
gaauaaguggugucucagu

SEQ ID NO: 787661 - RNA, 19 nt, Homo sapiens
gggcugugacuucgagauu

SEQ ID NO: 787662 - RNA, 19 nt, Homo sapiens
aacgaggacuacuucauug

SEQ ID NO: 787663 - RNA, 19 nt, Homo sapiens
cagggaccaccuucacaua

SEQ ID NO: 787664 - RNA, 19 nt, Homo sapiens
gcagggaccaccuucacau

SEQ ID NO: 787665 - RNA, 19 nt, Homo sapiens
auacaaaggcagauacugu

SEQ ID NO: 787666 - RNA, 19 nt, Homo sapiens
ucagugugcuccagcucuu

SEQ ID NO: 787667 - RNA, 19 nt, Homo sapiens
caccacggguuuggaaguu

SEQ ID NO: 787668 - RNA, 19 nt, Homo sapiens
ugccgaggcugccaacuuc

SEQ ID NO: 787669 - RNA, 19 nt, Homo sapiens
caaauacaaaggcagauac

SEQ ID NO: 787670 - RNA, 19 nt, Homo sapiens
ccuguggagugcaagugua

SEQ ID NO: 787671 - RNA, 19 nt, Homo sapiens
gggugcccguggucaauga

SEQ ID NO: 787672 - RNA, 19 nt, Homo sapiens
ccauccugcucaccagaaa

SEQ ID NO: 787673 - RNA, 19 nt, Homo sapiens
agaaaagcaucaacaugaa

SEQ ID NO: 787674 - RNA, 19 nt, Homo sapiens
gcuccuuccuguccuacga

SEQ ID NO: 787675 - RNA, 19 nt, Homo sapiens
augaguacuuugccaagaa

SEQ ID NO: 787676 - RNA, 19 nt, Homo sapiens
gaggaggaggaccuaaaga

SEQ ID NO: 787677 - RNA, 19 nt, Homo sapiens
ggacagccgcagguugaga

SEQ ID NO: 787678 - RNA, 19 nt, Homo sapiens
ggagugagcccugguucag

SEQ ID NO: 787679 - RNA, 19 nt, Homo sapiens
gugcugaccaucaugaaca

SEQ ID NO: 787680 - RNA, 19 nt, Homo sapiens
ggaggagugagcccugguu

SEQ ID NO: 787681 - RNA, 19 nt, Homo sapiens
ggcugugacuucgagauug

SEQ ID NO: 787682 - RNA, 19 nt, Homo sapiens
gccgggaccucugcaucaa

SEQ ID NO: 787683 - RNA, 19 nt, Homo sapiens
ggcguccucuaugauguaa

SEQ ID NO: 787684 - RNA, 19 nt, Homo sapiens
gcuagcgauugcccugugu

SEQ ID NO: 787685 - RNA, 19 nt, Homo sapiens
gauugacuccggugcuaug

SEQ ID NO: 787686 - RNA, 19 nt, Homo sapiens
ugaguacuuugccaagaag

SEQ ID NO: 787687 - RNA, 19 nt, Homo sapiens
aaugaguacuuugccaaga

SEQ ID NO: 787688 - RNA, 19 nt, Homo sapiens
gcagaaaagcaucaacaug

SEQ ID NO: 787689 - RNA, 19 nt, Homo sapiens
gagcccugguucagucaca

SEQ ID NO: 787690 - RNA, 19 nt, Homo sapiens
ccauccacaucaccauugu

SEQ ID NO: 787691 - RNA, 19 nt, Homo sapiens
ccaccuggcguccucuaug

SEQ ID NO: 787692 - RNA, 19 nt, Homo sapiens
ucacgcaccaugcagacaa

SEQ ID NO: 787693 - RNA, 19 nt, Homo sapiens
ugagaugaggcuagcgauu

SEQ ID NO: 787694 - RNA, 19 nt, Homo sapiens
gggaccaccuucacauacg

SEQ ID NO: 787695 - RNA, 19 nt, Homo sapiens
gcgcaagcgggauguaucu

SEQ ID NO: 787696 - RNA, 19 nt, Homo sapiens
ggauaaugucugccacaca

SEQ ID NO: 787697 - RNA, 19 nt, Homo sapiens
agccgcagguugagagcua

SEQ ID NO: 787698 - RNA, 19 nt, Homo sapiens
gcugcagccgccaguauau

SEQ ID NO: 787699 - RNA, 19 nt, Homo sapiens
gcugggaggguacauggau

SEQ ID NO: 787700 - RNA, 19 nt, Homo sapiens
gacggaagcggcaaugacu

SEQ ID NO: 787701 - RNA, 19 nt, Homo sapiens
gccgcuggccuucacugua

SEQ ID NO: 787702 - RNA, 19 nt, Homo sapiens
caccagaaaggaccugugu

SEQ ID NO: 787703 - RNA, 19 nt, Homo sapiens
gauccgcauccaagagguu

SEQ ID NO: 787704 - RNA, 19 nt, Homo sapiens
gcgagauccgcauccaaga

SEQ ID NO: 787705 - RNA, 19 nt, Homo sapiens
aaagaucacgcaccaugca

SEQ ID NO: 787706 - RNA, 19 nt, Homo sapiens
gaaaggagcugcagcauua

SEQ ID NO: 787707 - RNA, 19 nt, Homo sapiens
gcaaagacauugaacauua

SEQ ID NO: 787708 - RNA, 19 nt, Homo sapiens
gaagauagaugucgagucu

SEQ ID NO: 787709 - RNA, 19 nt, Homo sapiens
gaaguuggcuuuacaugga

SEQ ID NO: 787710 - RNA, 19 nt, Homo sapiens
gauaaacacucaaggagaa

SEQ ID NO: 787711 - RNA, 19 nt, Homo sapiens
gaaacagugugcagacuuu

SEQ ID NO: 787712 - RNA, 19 nt, Homo sapiens
ugacuuaucuugaacacua

SEQ ID NO: 787713 - RNA, 19 nt, Homo sapiens
gguaaaaccuugugcauua

SEQ ID NO: 787714 - RNA, 19 nt, Homo sapiens
ggaauuagguauaaguuca

SEQ ID NO: 787715 - RNA, 19 nt, Homo sapiens
ugaaggagaugauuacuau

SEQ ID NO: 787716 - RNA, 19 nt, Homo sapiens
gcagacaagucccucgaua

SEQ ID NO: 787717 - RNA, 19 nt, Homo sapiens
ggcaagcacuuucaucuaa

SEQ ID NO: 787718 - RNA, 19 nt, Homo sapiens
ggaaacguugugaauauua

SEQ ID NO: 787719 - RNA, 19 nt, Homo sapiens
caucuaaacuugacucuca

SEQ ID NO: 787720 - RNA, 19 nt, Homo sapiens
gcacuuucaucuaaacuug

SEQ ID NO: 787721 - RNA, 19 nt, Homo sapiens
gcaagcacuuucaucuaaa

SEQ ID NO: 787722 - RNA, 19 nt, Homo sapiens
ggcaguaucuaaguuauuu

SEQ ID NO: 787723 - RNA, 19 nt, Homo sapiens
uaggaaacguugugaauau

SEQ ID NO: 787724 - RNA, 19 nt, Homo sapiens
gagguaagaugcccacuag

SEQ ID NO: 787725 - RNA, 19 nt, Homo sapiens
gcacguaggcugugauaau

SEQ ID NO: 787726 - RNA, 19 nt, Homo sapiens
gugcagacuuugacaauau

SEQ ID NO: 787727 - RNA, 19 nt, Homo sapiens
gaauauuguugccaaacuu

SEQ ID NO: 787728 - RNA, 19 nt, Homo sapiens
ccaauuaacaacacacaua

SEQ ID NO: 787729 - RNA, 19 nt, Homo sapiens
gugaacacauucuugguaa

SEQ ID NO: 787730 - RNA, 19 nt, Homo sapiens
gaaguugccaugucaaaga

SEQ ID NO: 787731 - RNA, 19 nt, Homo sapiens
gacgaaaggucaugaagca

SEQ ID NO: 787732 - RNA, 19 nt, Homo sapiens
acacauccacuguuucuua

SEQ ID NO: 787733 - RNA, 19 nt, Homo sapiens
gcaggcaguaucuaaguua

SEQ ID NO: 787734 - RNA, 19 nt, Homo sapiens
caucggaauuucauaguga

SEQ ID NO: 787735 - RNA, 19 nt, Homo sapiens
gaagagaucagugagcauu

SEQ ID NO: 787736 - RNA, 19 nt, Homo sapiens
cacguaggcugugauaaua

SEQ ID NO: 787737 - RNA, 19 nt, Homo sapiens
uacagaagaugaagaguau

SEQ ID NO: 787738 - RNA, 19 nt, Homo sapiens
gaacacuaccagcuaacua

SEQ ID NO: 787739 - RNA, 19 nt, Homo sapiens
gcaagaaucagacaucaca

SEQ ID NO: 787740 - RNA, 19 nt, Homo sapiens
gagcuaugcuuuguguuug

SEQ ID NO: 787741 - RNA, 19 nt, Homo sapiens
ugacuggccuaggaaauuu

SEQ ID NO: 787742 - RNA, 19 nt, Homo sapiens
gcacaugugaugccauuga

SEQ ID NO: 787743 - RNA, 19 nt, Homo sapiens
ggaagacguugaccuggau

SEQ ID NO: 787744 - RNA, 19 nt, Homo sapiens
gagcaagaaucagacauca

SEQ ID NO: 787745 - RNA, 19 nt, Homo sapiens
gugcagauuuguugguaaa

SEQ ID NO: 787746 - RNA, 19 nt, Homo sapiens
gaugcaacuucuuguaaug

SEQ ID NO: 787747 - RNA, 19 nt, Homo sapiens
cucgauagcuucuguaaau

SEQ ID NO: 787748 - RNA, 19 nt, Homo sapiens
gauaaugaaguuggcuuua

SEQ ID NO: 787749 - RNA, 19 nt, Homo sapiens
gagacuacaucaccagcuu

SEQ ID NO: 787750 - RNA, 19 nt, Homo sapiens
cagaagaugaagaguauuu

SEQ ID NO: 787751 - RNA, 19 nt, Homo sapiens
uuucucagcuuuacuguga

SEQ ID NO: 787752 - RNA, 19 nt, Homo sapiens
caaagacauugaacauuac

SEQ ID NO: 787753 - RNA, 19 nt, Homo sapiens
caaaacacauucugagcua

SEQ ID NO: 787754 - RNA, 19 nt, Homo sapiens
gaaacaccauuccagaaaa

SEQ ID NO: 787755 - RNA, 19 nt, Homo sapiens
aaugacacauccacuguuu

SEQ ID NO: 787756 - RNA, 19 nt, Homo sapiens
cuacagaagaugaagagua

SEQ ID NO: 787757 - RNA, 19 nt, Homo sapiens
caggauauuugcaagauca

SEQ ID NO: 787758 - RNA, 19 nt, Homo sapiens
uagagaaguugccauguca

SEQ ID NO: 787759 - RNA, 19 nt, Homo sapiens
cuggauaucugcaucaaug

SEQ ID NO: 787760 - RNA, 19 nt, Homo sapiens
gcucuggugucucagcaaa

SEQ ID NO: 787761 - RNA, 19 nt, Homo sapiens
caagaucaacguaguacaa

SEQ ID NO: 787762 - RNA, 19 nt, Homo sapiens
ucaaggagaagacggagua

SEQ ID NO: 787763 - RNA, 19 nt, Homo sapiens
caagagaccaacugaugaa

SEQ ID NO: 787764 - RNA, 19 nt, Homo sapiens
gaggcucuguucacauuga

SEQ ID NO: 787765 - RNA, 19 nt, Homo sapiens
gaugaauauuguugccaaa

SEQ ID NO: 787766 - RNA, 19 nt, Homo sapiens
uaaugaaguuggcuuuaca

SEQ ID NO: 787767 - RNA, 19 nt, Homo sapiens
caguggagauaaugaaguu

SEQ ID NO: 787768 - RNA, 19 nt, Homo sapiens
aauggugccuggacuauug

SEQ ID NO: 787769 - RNA, 19 nt, Homo sapiens
cguaggcugugauaauauu

SEQ ID NO: 787770 - RNA, 19 nt, Homo sapiens
gcaagcacguaggcuguga

SEQ ID NO: 787771 - RNA, 19 nt, Homo sapiens
ggcugaagguuauaauuuc

SEQ ID NO: 787772 - RNA, 19 nt, Homo sapiens
cagaagaucagccaaacuu

SEQ ID NO: 787773 - RNA, 19 nt, Homo sapiens
caauaaggguugaucaaaa

SEQ ID NO: 787774 - RNA, 19 nt, Homo sapiens
ucacagaugcaacuucuug

SEQ ID NO: 787775 - RNA, 19 nt, Homo sapiens
gagaaguugccaugucaaa

SEQ ID NO: 787776 - RNA, 19 nt, Homo sapiens
ggaaauucuuguggacgaa

SEQ ID NO: 787777 - RNA, 19 nt, Homo sapiens
cauccacuguuucuuauuc

SEQ ID NO: 787778 - RNA, 19 nt, Homo sapiens
caacaacgacaucuguaug

SEQ ID NO: 787779 - RNA, 19 nt, Homo sapiens
cagaugcaacuucuuguaa

SEQ ID NO: 787780 - RNA, 19 nt, Homo sapiens
gaacacauucuugguaaag

SEQ ID NO: 787781 - RNA, 19 nt, Homo sapiens
ccaauaaggguugaucaaa

SEQ ID NO: 787782 - RNA, 19 nt, Homo sapiens
gagaccaacugaugaacca

SEQ ID NO: 787783 - RNA, 19 nt, Homo sapiens
ccuaggaaauuugauguug

SEQ ID NO: 787784 - RNA, 19 nt, Homo sapiens
ggauugcccaccacgauaa

SEQ ID NO: 787785 - RNA, 19 nt, Homo sapiens
acaagucccucgauagcuu

SEQ ID NO: 787786 - RNA, 19 nt, Homo sapiens
ggagauaaaccaccaugca

SEQ ID NO: 787787 - RNA, 19 nt, Homo sapiens
aaugggagaugagaaugua

SEQ ID NO: 787788 - RNA, 19 nt, Homo sapiens
ggagguaagaugcccacua

SEQ ID NO: 787789 - RNA, 19 nt, Homo sapiens
ggacagcuuuucauuacaa

SEQ ID NO: 787790 - RNA, 19 nt, Homo sapiens
gagcauuucucagcuuuac

SEQ ID NO: 787791 - RNA, 19 nt, Homo sapiens
auacaguucucaagaggaa

SEQ ID NO: 787792 - RNA, 19 nt, Homo sapiens
ccacaggcuuucauacagu

SEQ ID NO: 787793 - RNA, 19 nt, Homo sapiens
ucagaaugcucagcuacuu

SEQ ID NO: 787794 - RNA, 19 nt, Homo sapiens
gaggaaaguauuauaacug

SEQ ID NO: 787795 - RNA, 19 nt, Homo sapiens
ccaccacgauaaugcaguu

SEQ ID NO: 787796 - RNA, 19 nt, Homo sapiens
gggcuaccauggccgcaaa

SEQ ID NO: 787797 - RNA, 19 nt, Homo sapiens
gaaaauggccacccucaug

SEQ ID NO: 787798 - RNA, 19 nt, Homo sapiens
gaaggagaugauuacuaua

SEQ ID NO: 787799 - RNA, 19 nt, Homo sapiens
aagcacaugugaugccauu

SEQ ID NO: 787800 - RNA, 19 nt, Homo sapiens
cgaggaaaguauuauaacu

SEQ ID NO: 787801 - RNA, 19 nt, Homo sapiens
agacagaagagaucaguga

SEQ ID NO: 787802 - RNA, 19 nt, Homo sapiens
cagaggauuccaagcauuu

SEQ ID NO: 787803 - RNA, 19 nt, Homo sapiens
ccacagaggauuccaagca

SEQ ID NO: 787804 - RNA, 19 nt, Homo sapiens
aaauacaucuuggcacaau

SEQ ID NO: 787805 - RNA, 19 nt, Homo sapiens
cauugaaguuagagaaguu

SEQ ID NO: 787806 - RNA, 19 nt, Homo sapiens
ggagaagucugucaacaaa

SEQ ID NO: 787807 - RNA, 19 nt, Homo sapiens
gaaauaagcggaaacaaga

SEQ ID NO: 787808 - RNA, 19 nt, Homo sapiens
ggaagaggaugaagcaauu

SEQ ID NO: 787809 - RNA, 19 nt, Homo sapiens
guauuuggcugguaucuuu

SEQ ID NO: 787810 - RNA, 19 nt, Homo sapiens
cuaaauaacugcgcuguaa

SEQ ID NO: 787811 - RNA, 19 nt, Homo sapiens
ggaggagucuugagauuau

SEQ ID NO: 787812 - RNA, 19 nt, Homo sapiens
gagagugucugacuacuau

SEQ ID NO: 787813 - RNA, 19 nt, Homo sapiens
gaagauguguggcuacaau

SEQ ID NO: 787814 - RNA, 19 nt, Homo sapiens
gaaaagugcuugucaguug

SEQ ID NO: 787815 - RNA, 19 nt, Homo sapiens
gcaacuaccugccuuucaa

SEQ ID NO: 787816 - RNA, 19 nt, Homo sapiens
acucacagauuucuucuua

SEQ ID NO: 787817 - RNA, 19 nt, Homo sapiens
caaggaagcuaagaagaaa

SEQ ID NO: 787818 - RNA, 19 nt, Homo sapiens
ucacugagcuauugaacaa

SEQ ID NO: 787819 - RNA, 19 nt, Homo sapiens
gauaagacaccaagacgua

SEQ ID NO: 787820 - RNA, 19 nt, Homo sapiens
agaaaucucuccagaaguu

SEQ ID NO: 787821 - RNA, 19 nt, Homo sapiens
gggcaauccugaagaauga

SEQ ID NO: 787822 - RNA, 19 nt, Homo sapiens
gauaggauccauucaguuu

SEQ ID NO: 787823 - RNA, 19 nt, Homo sapiens
ggaguuaucaguuauagaa

SEQ ID NO: 787824 - RNA, 19 nt, Homo sapiens
cacaagaacuguaugauuc

SEQ ID NO: 787825 - RNA, 19 nt, Homo sapiens
gaaggagauugguucugua

SEQ ID NO: 787826 - RNA, 19 nt, Homo sapiens
gaggagguaugcaguggua

SEQ ID NO: 787827 - RNA, 19 nt, Homo sapiens
guuaauggcuuaucuacug

SEQ ID NO: 787828 - RNA, 19 nt, Homo sapiens
gaagaaaccacaccaucaa

SEQ ID NO: 787829 - RNA, 19 nt, Homo sapiens
agaacuggaucauuucaua

SEQ ID NO: 787830 - RNA, 19 nt, Homo sapiens
gauggaggcugucccagaa

SEQ ID NO: 787831 - RNA, 19 nt, Homo sapiens
gggagaaggugucugaaau

SEQ ID NO: 787832 - RNA, 19 nt, Homo sapiens
caguaucagugucauaaua

SEQ ID NO: 787833 - RNA, 19 nt, Homo sapiens
cuaaaugucuggcugaguu

SEQ ID NO: 787834 - RNA, 19 nt, Homo sapiens
agagguggauugaagaaua

SEQ ID NO: 787835 - RNA, 19 nt, Homo sapiens
gaaaccacaggaacaauuu

SEQ ID NO: 787836 - RNA, 19 nt, Homo sapiens
caacgaggaugacucugaa

SEQ ID NO: 787837 - RNA, 19 nt, Homo sapiens
ccagaaaucucuccagaag

SEQ ID NO: 787838 - RNA, 19 nt, Homo sapiens
gggcaccacuacagagaua

SEQ ID NO: 787839 - RNA, 19 nt, Homo sapiens
gcaaggugcugggcuuuga

SEQ ID NO: 787840 - RNA, 19 nt, Homo sapiens
gaucagucauccacuauuc

SEQ ID NO: 787841 - RNA, 19 nt, Homo sapiens
cgaaagaaagggaauguuu

SEQ ID NO: 787842 - RNA, 19 nt, Homo sapiens
gcacuucacaaacaccuua

SEQ ID NO: 787843 - RNA, 19 nt, Homo sapiens
gaagcaauuuccagaagug

SEQ ID NO: 787844 - RNA, 19 nt, Homo sapiens
gaacuggaucauuucauaa

SEQ ID NO: 787845 - RNA, 19 nt, Homo sapiens
gacccuguauuguuugaua

SEQ ID NO: 787846 - RNA, 19 nt, Homo sapiens
gcccugaucuucaagcauu

SEQ ID NO: 787847 - RNA, 19 nt, Homo sapiens
uaacugcgcuguaacaaac

SEQ ID NO: 787848 - RNA, 19 nt, Homo sapiens
ggagagaggugcgcaucaa

SEQ ID NO: 787849 - RNA, 19 nt, Homo sapiens
gcuuggagcuggaagaaga

SEQ ID NO: 787850 - RNA, 19 nt, Homo sapiens
guauucaucuucccuucua

SEQ ID NO: 787851 - RNA, 19 nt, Homo sapiens
ggaagaaaccacaccauca

SEQ ID NO: 787852 - RNA, 19 nt, Homo sapiens
ccaguaaguucuucaaaca

SEQ ID NO: 787853 - RNA, 19 nt, Homo sapiens
ggaagaagaggagucuaua

SEQ ID NO: 787854 - RNA, 19 nt, Homo sapiens
gauccaacaccaaccuuua

SEQ ID NO: 787855 - RNA, 19 nt, Homo sapiens
ugguagaacuggaucauuu

SEQ ID NO: 787856 - RNA, 19 nt, Homo sapiens
ggaaaccacaggaacaauu

SEQ ID NO: 787857 - RNA, 19 nt, Homo sapiens
ggagauugguucuguacug

SEQ ID NO: 787858 - RNA, 19 nt, Homo sapiens
gguauaagaugugcuagau

SEQ ID NO: 787859 - RNA, 19 nt, Homo sapiens
acaaacaccuuaacaagca

SEQ ID NO: 787860 - RNA, 19 nt, Homo sapiens
gauaccagauccugagaug

SEQ ID NO: 787861 - RNA, 19 nt, Homo sapiens
gagguggauugaagaauau

SEQ ID NO: 787862 - RNA, 19 nt, Homo sapiens
ccaaguaccuguuuucauu

SEQ ID NO: 787863 - RNA, 19 nt, Homo sapiens
gcccgaagccgaccucuaa

SEQ ID NO: 787864 - RNA, 19 nt, Homo sapiens
guagggcaauccugaagaa

SEQ ID NO: 787865 - RNA, 19 nt, Homo sapiens
gcuugucaguuguugaaua

SEQ ID NO: 787866 - RNA, 19 nt, Homo sapiens
gguccuagccucaguuuga

SEQ ID NO: 787867 - RNA, 19 nt, Homo sapiens
cuucaagcauucugguuua

SEQ ID NO: 787868 - RNA, 19 nt, Homo sapiens
ucgaagagauggagagguu

SEQ ID NO: 787869 - RNA, 19 nt, Homo sapiens
caaaaucacugagcuauug

SEQ ID NO: 787870 - RNA, 19 nt, Homo sapiens
uaacagcuuugaccugaau

SEQ ID NO: 787871 - RNA, 19 nt, Homo sapiens
gagcauuccuuguauucug

SEQ ID NO: 787872 - RNA, 19 nt, Homo sapiens
ggacuggcaccucaacgua

SEQ ID NO: 787873 - RNA, 19 nt, Homo sapiens
caagagaccaagagcuuaa

SEQ ID NO: 787874 - RNA, 19 nt, Homo sapiens
gaggauaaagcaaagauug

SEQ ID NO: 787875 - RNA, 19 nt, Homo sapiens
gaagaaauggaaacucaau

SEQ ID NO: 787876 - RNA, 19 nt, Homo sapiens
gaacaggaagaaauggaaa

SEQ ID NO: 787877 - RNA, 19 nt, Homo sapiens
cugaggaggugauaaagaa

SEQ ID NO: 787878 - RNA, 19 nt, Homo sapiens
ggagaccaguggcauggaa

SEQ ID NO: 787879 - RNA, 19 nt, Homo sapiens
gaacugggcggucugaagu

SEQ ID NO: 787880 - RNA, 19 nt, Homo sapiens
gagaguauguccagcuaca

SEQ ID NO: 787881 - RNA, 19 nt, Homo sapiens
gaaacucaaucuucagacu

SEQ ID NO: 787882 - RNA, 19 nt, Homo sapiens
gcuuugaccugaauaaugg

SEQ ID NO: 787883 - RNA, 19 nt, Homo sapiens
caucaacaccaacaaguuu

SEQ ID NO: 787884 - RNA, 19 nt, Homo sapiens
gagcugaggcauccaagaa

SEQ ID NO: 787885 - RNA, 19 nt, Homo sapiens
gugacuauguccaaguuaa

SEQ ID NO: 787886 - RNA, 19 nt, Homo sapiens
caauaguucuagugaaugu

SEQ ID NO: 787887 - RNA, 19 nt, Homo sapiens
gaggaugacucugaaguag

SEQ ID NO: 787888 - RNA, 19 nt, Homo sapiens
ggaaagacaaagcaggaaa

SEQ ID NO: 787889 - RNA, 19 nt, Homo sapiens
gaaacuggaggcccaagaa

SEQ ID NO: 787890 - RNA, 19 nt, Homo sapiens
agagaucacuggagaagga

SEQ ID NO: 787891 - RNA, 19 nt, Homo sapiens
agucaaacaucaacuucua

SEQ ID NO: 787892 - RNA, 19 nt, Homo sapiens
ggaggacuauaugguauug

SEQ ID NO: 787893 - RNA, 19 nt, Homo sapiens
aaauggcacuggcuuggua

SEQ ID NO: 787894 - RNA, 19 nt, Homo sapiens
ggaaagcagguuuaaaaua

SEQ ID NO: 787895 - RNA, 19 nt, Homo sapiens
gggaggagucuugagauua

SEQ ID NO: 787896 - RNA, 19 nt, Homo sapiens
gagggagaauucacucaga

SEQ ID NO: 787897 - RNA, 19 nt, Homo sapiens
ucagacugcuugaccauug

SEQ ID NO: 787898 - RNA, 19 nt, Homo sapiens
gaaaagaaggagaagguua

SEQ ID NO: 787899 - RNA, 19 nt, Homo sapiens
gaagaacagccagaacuga

SEQ ID NO: 787900 - RNA, 19 nt, Homo sapiens
gaagagauggagagguuga

SEQ ID NO: 787901 - RNA, 19 nt, Homo sapiens
ggaagaagaggaagaagag

SEQ ID NO: 787902 - RNA, 19 nt, Homo sapiens
ucacaagaacuguaugauu

SEQ ID NO: 787903 - RNA, 19 nt, Homo sapiens
guucagaggucccugucuu

SEQ ID NO: 787904 - RNA, 19 nt, Homo sapiens
ccaaagagaagacauacga

SEQ ID NO: 787905 - RNA, 19 nt, Homo sapiens
gaaacugacuccuuaaaag

SEQ ID NO: 787906 - RNA, 19 nt, Homo sapiens
caaguuagauugccaguua

SEQ ID NO: 787907 - RNA, 19 nt, Homo sapiens
ggaauuagaucaagauaug

SEQ ID NO: 787908 - RNA, 19 nt, Homo sapiens
gaaagaagaugagcaaaga

SEQ ID NO: 787909 - RNA, 19 nt, Homo sapiens
gguaugagcuguuaaguga

SEQ ID NO: 787910 - RNA, 19 nt, Homo sapiens
gagaagauauggaauguga

SEQ ID NO: 787911 - RNA, 19 nt, Homo sapiens
ggcaauagcugaagaagaa

SEQ ID NO: 787912 - RNA, 19 nt, Homo sapiens
gacagaaucuucagaguuu

SEQ ID NO: 787913 - RNA, 19 nt, Homo sapiens
caagauaugucgaaagaaa

SEQ ID NO: 787914 - RNA, 19 nt, Homo sapiens
gguauuaaguccaaguuua

SEQ ID NO: 787915 - RNA, 19 nt, Homo sapiens
gaacuaaggcugagagauu

SEQ ID NO: 787916 - RNA, 19 nt, Homo sapiens
gaccaaagcucaagacugu

SEQ ID NO: 787917 - RNA, 19 nt, Homo sapiens
gaagaugacucucaagaag

SEQ ID NO: 787918 - RNA, 19 nt, Homo sapiens
ggaaauugaugaacaaaca

SEQ ID NO: 787919 - RNA, 19 nt, Homo sapiens
uagaagagauggaaauuga

SEQ ID NO: 787920 - RNA, 19 nt, Homo sapiens
gaaucuaccuccaacauug

SEQ ID NO: 787921 - RNA, 19 nt, Homo sapiens
ggacaauguugcuaauaaa

SEQ ID NO: 787922 - RNA, 19 nt, Homo sapiens
caucaucucuuucaacgua

SEQ ID NO: 787923 - RNA, 19 nt, Homo sapiens
aaacuuagcucuucuuucu

SEQ ID NO: 787924 - RNA, 19 nt, Homo sapiens
gcaccucaguguaugauuu

SEQ ID NO: 787925 - RNA, 19 nt, Homo sapiens
gggaggaguucaugaauug

SEQ ID NO: 787926 - RNA, 19 nt, Homo sapiens
gcaagcagauguauuugug

SEQ ID NO: 787927 - RNA, 19 nt, Homo sapiens
gaaagugccuuaaaagaaa

SEQ ID NO: 787928 - RNA, 19 nt, Homo sapiens
gaucaacuguguaacaaga

SEQ ID NO: 787929 - RNA, 19 nt, Homo sapiens
ggaugagucuuccgcuaua

SEQ ID NO: 787930 - RNA, 19 nt, Homo sapiens
gguagaagccuaagaaaga

SEQ ID NO: 787931 - RNA, 19 nt, Homo sapiens
gcugagagauuuucuuuua

SEQ ID NO: 787932 - RNA, 19 nt, Homo sapiens
cuugauagcugcacucuuu

SEQ ID NO: 787933 - RNA, 19 nt, Homo sapiens
cgaggaagaccacaaguua

SEQ ID NO: 787934 - RNA, 19 nt, Homo sapiens
ggaaagugaugaagaugug

SEQ ID NO: 787935 - RNA, 19 nt, Homo sapiens
gugaugauaucuuugcaua

SEQ ID NO: 787936 - RNA, 19 nt, Homo sapiens
cagaauaugugcacagcua

SEQ ID NO: 787937 - RNA, 19 nt, Homo sapiens
gccauagccuguaccaaua

SEQ ID NO: 787938 - RNA, 19 nt, Homo sapiens
gaagaugagcaaagaaauu

SEQ ID NO: 787939 - RNA, 19 nt, Homo sapiens
guagaagacuguccuuuag

SEQ ID NO: 787940 - RNA, 19 nt, Homo sapiens
gccuagaccuucaucauuu

SEQ ID NO: 787941 - RNA, 19 nt, Homo sapiens
ugacaguucuuucagcuuu

SEQ ID NO: 787942 - RNA, 19 nt, Homo sapiens
caacuucccuaacuucaga

SEQ ID NO: 787943 - RNA, 19 nt, Homo sapiens
gcuagucuaucccaaguuu

SEQ ID NO: 787944 - RNA, 19 nt, Homo sapiens
gaaauucaacggcagauau

SEQ ID NO: 787945 - RNA, 19 nt, Homo sapiens
agaagcagcugccagaauu

SEQ ID NO: 787946 - RNA, 19 nt, Homo sapiens
cccauugccuuaaauauaa

SEQ ID NO: 787947 - RNA, 19 nt, Homo sapiens
caucauaccuacuguguuc

SEQ ID NO: 787948 - RNA, 19 nt, Homo sapiens
gaaugcgcguugcaagaua

SEQ ID NO: 787949 - RNA, 19 nt, Homo sapiens
gaugauccacccacauuua

SEQ ID NO: 787950 - RNA, 19 nt, Homo sapiens
ggaagaguaugagguagaa

SEQ ID NO: 787951 - RNA, 19 nt, Homo sapiens
gauagcaaaccaacauaua

SEQ ID NO: 787952 - RNA, 19 nt, Homo sapiens
ccaaagagcaacuaacuga

SEQ ID NO: 787953 - RNA, 19 nt, Homo sapiens
caagaugaguuuccugaug

SEQ ID NO: 787954 - RNA, 19 nt, Homo sapiens
ggaggaagaguaugaggua

SEQ ID NO: 787955 - RNA, 19 nt, Homo sapiens
ggaaguagccaaagagcaa

SEQ ID NO: 787956 - RNA, 19 nt, Homo sapiens
gaagagagacuaaagaaaa

SEQ ID NO: 787957 - RNA, 19 nt, Homo sapiens
gcgcuuacaugaaauuugu

SEQ ID NO: 787958 - RNA, 19 nt, Homo sapiens
ggaggaugcuucugaaucu

SEQ ID NO: 787959 - RNA, 19 nt, Homo sapiens
gaguaaaccuagagaagau

SEQ ID NO: 787960 - RNA, 19 nt, Homo sapiens
gaagaagagagacuaaaga

SEQ ID NO: 787961 - RNA, 19 nt, Homo sapiens
aacagacucuugcaaguua

SEQ ID NO: 787962 - RNA, 19 nt, Homo sapiens
gaccuggacugacguauca

SEQ ID NO: 787963 - RNA, 19 nt, Homo sapiens
gauggaaauugaugaacaa

SEQ ID NO: 787964 - RNA, 19 nt, Homo sapiens
ggaguuccuuaaugcauuu

SEQ ID NO: 787965 - RNA, 19 nt, Homo sapiens
ugaaggcuuuacuuuguua

SEQ ID NO: 787966 - RNA, 19 nt, Homo sapiens
ccagagaucuuggaaaaua

SEQ ID NO: 787967 - RNA, 19 nt, Homo sapiens
gaauacaacccucguaaca

SEQ ID NO: 787968 - RNA, 19 nt, Homo sapiens
gcccauugccuuaaauaua

SEQ ID NO: 787969 - RNA, 19 nt, Homo sapiens
gcaauggcacucuuucaaa

SEQ ID NO: 787970 - RNA, 19 nt, Homo sapiens
caaguacuguaucaacaaa

SEQ ID NO: 787971 - RNA, 19 nt, Homo sapiens
gugcacagcuagcccguuu

SEQ ID NO: 787972 - RNA, 19 nt, Homo sapiens
gaaagccguuugugagaca

SEQ ID NO: 787973 - RNA, 19 nt, Homo sapiens
guacauucuuucaacacua

SEQ ID NO: 787974 - RNA, 19 nt, Homo sapiens
ccaagagagugaauccaaa

SEQ ID NO: 787975 - RNA, 19 nt, Homo sapiens
gagggaaacuuagcucuuc

SEQ ID NO: 787976 - RNA, 19 nt, Homo sapiens
caaacaaaggucauaguaa

SEQ ID NO: 787977 - RNA, 19 nt, Homo sapiens
uauagacgauacuggauuu

SEQ ID NO: 787978 - RNA, 19 nt, Homo sapiens
ggaaugugaugaccuuaag

SEQ ID NO: 787979 - RNA, 19 nt, Homo sapiens
ccucuaacuuccuuaauga

SEQ ID NO: 787980 - RNA, 19 nt, Homo sapiens
ucacgaaucugacuuuguc

SEQ ID NO: 787981 - RNA, 19 nt, Homo sapiens
gaacugcuuugaauacaac

SEQ ID NO: 787982 - RNA, 19 nt, Homo sapiens
caauggcacucuuucaaau

SEQ ID NO: 787983 - RNA, 19 nt, Homo sapiens
gaaacaagaagaaaugaag

SEQ ID NO: 787984 - RNA, 19 nt, Homo sapiens
gaccauccuuggaaaguga

SEQ ID NO: 787985 - RNA, 19 nt, Homo sapiens
ugagcagugugguucauua

SEQ ID NO: 787986 - RNA, 19 nt, Homo sapiens
gaagagauggaaauugaug

SEQ ID NO: 787987 - RNA, 19 nt, Homo sapiens
gaagauauggaaugugaug

SEQ ID NO: 787988 - RNA, 19 nt, Homo sapiens
acaagaaccuggaagauac

SEQ ID NO: 787989 - RNA, 19 nt, Homo sapiens
gacagugggcguucuuaua

SEQ ID NO: 787990 - RNA, 19 nt, Homo sapiens
gcagugugguucauuaucu

SEQ ID NO: 787991 - RNA, 19 nt, Homo sapiens
gaguaacccuagaaguauu

SEQ ID NO: 787992 - RNA, 19 nt, Homo sapiens
ggaguaacccuagaaguau

SEQ ID NO: 787993 - RNA, 19 nt, Homo sapiens
ggagaguuaucuacaugga

SEQ ID NO: 787994 - RNA, 19 nt, Homo sapiens
gaggauuauucuggucuua

SEQ ID NO: 787995 - RNA, 19 nt, Homo sapiens
caauugaucccuuacuauu

SEQ ID NO: 787996 - RNA, 19 nt, Homo sapiens
cgaagaaacuguggaaguc

SEQ ID NO: 787997 - RNA, 19 nt, Homo sapiens
ccagagccaucgccuguga

SEQ ID NO: 787998 - RNA, 19 nt, Homo sapiens
cagucaagaucuguaaaua

SEQ ID NO: 787999 - RNA, 19 nt, Homo sapiens
gaagaagaaggucaaagug

SEQ ID NO: 788000 - RNA, 19 nt, Homo sapiens
ccaaagcaacguuguagaa

SEQ ID NO: 788001 - RNA, 19 nt, Homo sapiens
gagaucagcauuagaaagu

SEQ ID NO: 788002 - RNA, 19 nt, Homo sapiens
ggaguaaaccuagagaaga

SEQ ID NO: 788003 - RNA, 19 nt, Homo sapiens
gcuaauaaacagacucuug

SEQ ID NO: 788004 - RNA, 19 nt, Homo sapiens
gagaauguaggaaagauau

SEQ ID NO: 788005 - RNA, 19 nt, Homo sapiens
ggagaauguaggaaagaua

SEQ ID NO: 788006 - RNA, 19 nt, Homo sapiens
ucacuaagauggcauauau

SEQ ID NO: 788007 - RNA, 19 nt, Homo sapiens
gaagagcccauaucacuaa

SEQ ID NO: 788008 - RNA, 19 nt, Homo sapiens
uggaagauguacauaguua

SEQ ID NO: 788009 - RNA, 19 nt, Homo sapiens
gaaauagaaagaagccaua

SEQ ID NO: 788010 - RNA, 19 nt, Homo sapiens
gcuguuccauguucuauuu

SEQ ID NO: 788011 - RNA, 19 nt, Homo sapiens
ggugaccacucuucuuuaa

SEQ ID NO: 788012 - RNA, 19 nt, Homo sapiens
ugccaaagcuggucucaaa

SEQ ID NO: 788013 - RNA, 19 nt, Homo sapiens
uaagauggcauauauguga

SEQ ID NO: 788014 - RNA, 19 nt, Homo sapiens
agaaagaagccauauauga

SEQ ID NO: 788015 - RNA, 19 nt, Homo sapiens
ggaaugccuuggaaauaga

SEQ ID NO: 788016 - RNA, 19 nt, Homo sapiens
gcaaggccaugaccagaug

SEQ ID NO: 788017 - RNA, 19 nt, Homo sapiens
gcaaguauccugcgaccuu

SEQ ID NO: 788018 - RNA, 19 nt, Homo sapiens
cggcuacucuggaauguuu

SEQ ID NO: 788019 - RNA, 19 nt, Homo sapiens
gaaagaagccauauaugac

SEQ ID NO: 788020 - RNA, 19 nt, Homo sapiens
gcacuagaaugcaaguauc

SEQ ID NO: 788021 - RNA, 19 nt, Homo sapiens
ggaaggaggagaaggagaa

SEQ ID NO: 788022 - RNA, 19 nt, Homo sapiens
cagcaucccuucccacaug

SEQ ID NO: 788023 - RNA, 19 nt, Homo sapiens
gugcugagauugcagaugu

SEQ ID NO: 788024 - RNA, 19 nt, Homo sapiens
aggagaaggugauucagua

SEQ ID NO: 788025 - RNA, 19 nt, Homo sapiens
gcuuaaaccuggaaucuac

SEQ ID NO: 788026 - RNA, 19 nt, Homo sapiens
gaagguggccacagcaaga

SEQ ID NO: 788027 - RNA, 19 nt, Homo sapiens
gcccucaguuccuucauuu

SEQ ID NO: 788028 - RNA, 19 nt, Homo sapiens
gggaacgacuggacuguca

SEQ ID NO: 788029 - RNA, 19 nt, Homo sapiens
caaagcuggucucaaacuu

SEQ ID NO: 788030 - RNA, 19 nt, Homo sapiens
gagugcagccuucuccaua

SEQ ID NO: 788031 - RNA, 19 nt, Homo sapiens
gauaaaagguggaguuucu

SEQ ID NO: 788032 - RNA, 19 nt, Homo sapiens
ggagugcaguggcaugauc

SEQ ID NO: 788033 - RNA, 19 nt, Homo sapiens
gagcccauaucacuaagau

SEQ ID NO: 788034 - RNA, 19 nt, Homo sapiens
caucauagccacugagauc

SEQ ID NO: 788035 - RNA, 19 nt, Homo sapiens
gaguuucucuguuguuugg

SEQ ID NO: 788036 - RNA, 19 nt, Homo sapiens
aagcaggccucgcagaaga

SEQ ID NO: 788037 - RNA, 19 nt, Homo sapiens
gcucccaucacccagauua

SEQ ID NO: 788038 - RNA, 19 nt, Homo sapiens
cagaagagcccauaucacu

SEQ ID NO: 788039 - RNA, 19 nt, Homo sapiens
ggacagccagugaccuuug

SEQ ID NO: 788040 - RNA, 19 nt, Homo sapiens
ccaaggagcaggagcugaa

SEQ ID NO: 788041 - RNA, 19 nt, Homo sapiens
gauucugccucucuggaaa

SEQ ID NO: 788042 - RNA, 19 nt, Homo sapiens
caagguggcagaugucuuc

SEQ ID NO: 788043 - RNA, 19 nt, Homo sapiens
gacagccagugaccuuuga

SEQ ID NO: 788044 - RNA, 19 nt, Homo sapiens
caccgugccuggccagauu

SEQ ID NO: 788045 - RNA, 19 nt, Homo sapiens
ccaacuagcugggacuaca

SEQ ID NO: 788046 - RNA, 19 nt, Homo sapiens
ccaaagugcugagauugca

SEQ ID NO: 788047 - RNA, 19 nt, Homo sapiens
caaaagcgcccucacuauu

SEQ ID NO: 788048 - RNA, 19 nt, Homo sapiens
uggaaugccuuggaaauag

SEQ ID NO: 788049 - RNA, 19 nt, Homo sapiens
agagcuacguggccaugua

SEQ ID NO: 788050 - RNA, 19 nt, Homo sapiens
ucacccaccucuugugcaa

SEQ ID NO: 788051 - RNA, 19 nt, Homo sapiens
cuagcaggcuguuccaugu

SEQ ID NO: 788052 - RNA, 19 nt, Homo sapiens
gcugaguucuggguuucua

SEQ ID NO: 788053 - RNA, 19 nt, Homo sapiens
cauagccacugagaucuga

SEQ ID NO: 788054 - RNA, 19 nt, Homo sapiens
gugagacaguugcccgaaa

SEQ ID NO: 788055 - RNA, 19 nt, Homo sapiens
uuucaaaccauugcucuua

SEQ ID NO: 788056 - RNA, 19 nt, Homo sapiens
caccgugccuggcuaacuu

SEQ ID NO: 788057 - RNA, 19 nt, Homo sapiens
ucgagagccucaugaagga

SEQ ID NO: 788058 - RNA, 19 nt, Homo sapiens
gcucaugcccuucuccaau

SEQ ID NO: 788059 - RNA, 19 nt, Homo sapiens
agacguugccugagaagaa

SEQ ID NO: 788060 - RNA, 19 nt, Homo sapiens
cguccaagguggcagaugu

SEQ ID NO: 788061 - RNA, 19 nt, Homo sapiens
ggccgugccuuguuugagu

SEQ ID NO: 788062 - RNA, 19 nt, Homo sapiens
gggagcgucugggaacuug

SEQ ID NO: 788063 - RNA, 19 nt, Homo sapiens
ucccuaaacuuuggccuuu

SEQ ID NO: 788064 - RNA, 19 nt, Homo sapiens
gcaacaugaugagccugaa

SEQ ID NO: 788065 - RNA, 19 nt, Homo sapiens
ucuggaagauguacauagu

SEQ ID NO: 788066 - RNA, 19 nt, Homo sapiens
aagcuggucucaaacuugu

SEQ ID NO: 788067 - RNA, 19 nt, Homo sapiens
gagcugcagcgcaagaaga

SEQ ID NO: 788068 - RNA, 19 nt, Homo sapiens
guaaacuauuuguggcaau

SEQ ID NO: 788069 - RNA, 19 nt, Homo sapiens
ggaagauguacauaguuau

SEQ ID NO: 788070 - RNA, 19 nt, Homo sapiens
ggugggugcugccaugaca

SEQ ID NO: 788071 - RNA, 19 nt, Homo sapiens
gcaguggcaugaucauagc

SEQ ID NO: 788072 - RNA, 19 nt, Homo sapiens
ggugguagagagagauaaa

SEQ ID NO: 788073 - RNA, 19 nt, Homo sapiens
ggguuucucugcagaugug

SEQ ID NO: 788074 - RNA, 19 nt, Homo sapiens
gggcugaguucuggguuuc

SEQ ID NO: 788075 - RNA, 19 nt, Homo sapiens
ugaccacucuucuuuaagc

SEQ ID NO: 788076 - RNA, 19 nt, Homo sapiens
ccuaaacuuuggccuuugu

SEQ ID NO: 788077 - RNA, 19 nt, Homo sapiens
caggacagcaacaugauga

SEQ ID NO: 788078 - RNA, 19 nt, Homo sapiens
uggaguuucucuguuguuu

SEQ ID NO: 788079 - RNA, 19 nt, Homo sapiens
agaaggagaaggugauuca

SEQ ID NO: 788080 - RNA, 19 nt, Homo sapiens
ggagaaggagaaggugauu

SEQ ID NO: 788081 - RNA, 19 nt, Homo sapiens
cgcaucaccucaccaagga

SEQ ID NO: 788082 - RNA, 19 nt, Homo sapiens
gcacaguccagacccaagu

SEQ ID NO: 788083 - RNA, 19 nt, Homo sapiens
gagcuuuucuggaauuuca

SEQ ID NO: 788084 - RNA, 19 nt, Homo sapiens
guuguuugguucagggauu

SEQ ID NO: 788085 - RNA, 19 nt, Homo sapiens
ggccuuuguucgaaauaga

SEQ ID NO: 788086 - RNA, 19 nt, Homo sapiens
ucaagcaggccucgcagaa

SEQ ID NO: 788087 - RNA, 19 nt, Homo sapiens
ucaaaccauugcucuuagu

SEQ ID NO: 788088 - RNA, 19 nt, Homo sapiens
ucuggaauuucaaaccauu

SEQ ID NO: 788089 - RNA, 19 nt, Homo sapiens
gggucugucugcuuugguu

SEQ ID NO: 788090 - RNA, 19 nt, Homo sapiens
ucuuugugguuucuuguuu

SEQ ID NO: 788091 - RNA, 19 nt, Homo sapiens
agaagagcccauaucacua

SEQ ID NO: 788092 - RNA, 19 nt, Homo sapiens
caucaaggucagccagaaa

SEQ ID NO: 788093 - RNA, 19 nt, Homo sapiens
cgagaucucccuccugaag

SEQ ID NO: 788094 - RNA, 19 nt, Homo sapiens
gcccaaaggcggcaacaag

SEQ ID NO: 788095 - RNA, 19 nt, Homo sapiens
cagcagaagccuccaagca

SEQ ID NO: 788096 - RNA, 19 nt, Homo sapiens
aaagcgcccucacuauucu

SEQ ID NO: 788097 - RNA, 19 nt, Homo sapiens
gaggagcuuuucuggaauu

SEQ ID NO: 788098 - RNA, 19 nt, Homo sapiens
gggcagagggagaauccaa

SEQ ID NO: 788099 - RNA, 19 nt, Homo sapiens
gaggagggcagagggagaa

SEQ ID NO: 788100 - RNA, 19 nt, Homo sapiens
ggcacuagaaugcaaguau

SEQ ID NO: 788101 - RNA, 19 nt, Homo sapiens
gugcagccuucuccauauc

SEQ ID NO: 788102 - RNA, 19 nt, Homo sapiens
ccacggagacagaggaaag

SEQ ID NO: 788103 - RNA, 19 nt, Homo sapiens
ccucagcccucaguuccuu

SEQ ID NO: 788104 - RNA, 19 nt, Homo sapiens
ugaccucggugaccacucu

SEQ ID NO: 788105 - RNA, 19 nt, Homo sapiens
ccaggggucugucugcuuu

SEQ ID NO: 788106 - RNA, 19 nt, Homo sapiens
gaagaugacuggucugauu

SEQ ID NO: 788107 - RNA, 19 nt, Homo sapiens
gggaucaacuggaguauua

SEQ ID NO: 788108 - RNA, 19 nt, Homo sapiens
gaacaugcuuucaacauug

SEQ ID NO: 788109 - RNA, 19 nt, Homo sapiens
gaacagagaauaugacaga

SEQ ID NO: 788110 - RNA, 19 nt, Homo sapiens
caucuaaacuguaugcuuu

SEQ ID NO: 788111 - RNA, 19 nt, Homo sapiens
cagagaauaugacagauuu

SEQ ID NO: 788112 - RNA, 19 nt, Homo sapiens
gaacagcccaucacagauu

SEQ ID NO: 788113 - RNA, 19 nt, Homo sapiens
gaacaagacaaacuucuga

SEQ ID NO: 788114 - RNA, 19 nt, Homo sapiens
aaacagagacugagagaaa

SEQ ID NO: 788115 - RNA, 19 nt, Homo sapiens
ggaagaaguucaguuggaa

SEQ ID NO: 788116 - RNA, 19 nt, Homo sapiens
ggaagaaacuaaacacacu

SEQ ID NO: 788117 - RNA, 19 nt, Homo sapiens
cagaaacaauugagaaguu

SEQ ID NO: 788118 - RNA, 19 nt, Homo sapiens
gaacucacauggaagaaac

SEQ ID NO: 788119 - RNA, 19 nt, Homo sapiens
gggaagaaguucaguugga

SEQ ID NO: 788120 - RNA, 19 nt, Homo sapiens
ucaaguugguugcugauuu

SEQ ID NO: 788121 - RNA, 19 nt, Homo sapiens
ugaagcacaugauuauuga

SEQ ID NO: 788122 - RNA, 19 nt, Homo sapiens
aagugaaacuggucaauuu

SEQ ID NO: 788123 - RNA, 19 nt, Homo sapiens
aaacagcaucguaagauua

SEQ ID NO: 788124 - RNA, 19 nt, Homo sapiens
cuuaagaacucacauggaa

SEQ ID NO: 788125 - RNA, 19 nt, Homo sapiens
agacagauaugaaagaaca

SEQ ID NO: 788126 - RNA, 19 nt, Homo sapiens
ggaggaugcacacgaauuu

SEQ ID NO: 788127 - RNA, 19 nt, Homo sapiens
ugucauagcugaugucaag

SEQ ID NO: 788128 - RNA, 19 nt, Homo sapiens
agaagaaacuaccacagaa

SEQ ID NO: 788129 - RNA, 19 nt, Homo sapiens
ggaggcaaguucaccaaug

SEQ ID NO: 788130 - RNA, 19 nt, Homo sapiens
gaaguucaguuggaagaug

SEQ ID NO: 788131 - RNA, 19 nt, Homo sapiens
gaaccaguugcuacuauaa

SEQ ID NO: 788132 - RNA, 19 nt, Homo sapiens
uaauuccacugcuccauuu

SEQ ID NO: 788133 - RNA, 19 nt, Homo sapiens
gcacacgaauuugaucuuc

SEQ ID NO: 788134 - RNA, 19 nt, Homo sapiens
ggaagaugaucgggaguug

SEQ ID NO: 788135 - RNA, 19 nt, Homo sapiens
gaacgaaaugauaccaauu

SEQ ID NO: 788136 - RNA, 19 nt, Homo sapiens
cagcaagaacgaaaugaua

SEQ ID NO: 788137 - RNA, 19 nt, Homo sapiens
caaguugguugcugauuuc

SEQ ID NO: 788138 - RNA, 19 nt, Homo sapiens
caaauccaaagcagacuua

SEQ ID NO: 788139 - RNA, 19 nt, Homo sapiens
agaacaugcuuucaacauu

SEQ ID NO: 788140 - RNA, 19 nt, Homo sapiens
ugaaccaguugcuacuaua

SEQ ID NO: 788141 - RNA, 19 nt, Homo sapiens
agucagaacuuggauuaaa

SEQ ID NO: 788142 - RNA, 19 nt, Homo sapiens
gggaguugcuggaccauca

SEQ ID NO: 788143 - RNA, 19 nt, Homo sapiens
caucaucagugaagauaca

SEQ ID NO: 788144 - RNA, 19 nt, Homo sapiens
ugagacagauaugaaagaa

SEQ ID NO: 788145 - RNA, 19 nt, Homo sapiens
aaagcaagcagaaacaauu

SEQ ID NO: 788146 - RNA, 19 nt, Homo sapiens
ucauggcguuuguauguuu

SEQ ID NO: 788147 - RNA, 19 nt, Homo sapiens
caauugagaaguuguaugu

SEQ ID NO: 788148 - RNA, 19 nt, Homo sapiens
uuaaagaucacaugaggaa

SEQ ID NO: 788149 - RNA, 19 nt, Homo sapiens
gcacaugauuauugagcau

SEQ ID NO: 788150 - RNA, 19 nt, Homo sapiens
ucacauggaagaaacuaaa

SEQ ID NO: 788151 - RNA, 19 nt, Homo sapiens
uaagaacucacauggaaga

SEQ ID NO: 788152 - RNA, 19 nt, Homo sapiens
gaucaacuggaguauuauu

SEQ ID NO: 788153 - RNA, 19 nt, Homo sapiens
gaaacuaccacagaagcaa

SEQ ID NO: 788154 - RNA, 19 nt, Homo sapiens
gaagaaacuaccacagaag

SEQ ID NO: 788155 - RNA, 19 nt, Homo sapiens
uagaagaaacuaccacaga

SEQ ID NO: 788156 - RNA, 19 nt, Homo sapiens
caagugaaacuggucaauu

SEQ ID NO: 788157 - RNA, 19 nt, Homo sapiens
cauggaggaugcacacgaa

SEQ ID NO: 788158 - RNA, 19 nt, Homo sapiens
gagaacaugcuuucaacau

SEQ ID NO: 788159 - RNA, 19 nt, Homo sapiens
ccagagaacaugcuuucaa

SEQ ID NO: 788160 - RNA, 19 nt, Homo sapiens
gaacaucaacaaaagauug

SEQ ID NO: 788161 - RNA, 19 nt, Homo sapiens
cggcguagguguggagaaa

SEQ ID NO: 788162 - RNA, 19 nt, Homo sapiens
gaagaaacuaaacacacuu

SEQ ID NO: 788163 - RNA, 19 nt, Homo sapiens
gucagaacuuggauuaaau

SEQ ID NO: 788164 - RNA, 19 nt, Homo sapiens
agaaacaauugagaaguug

SEQ ID NO: 788165 - RNA, 19 nt, Homo sapiens
cauagcugaugucaaguug

SEQ ID NO: 788166 - RNA, 19 nt, Homo sapiens
guucaccaaugcagauguu

SEQ ID NO: 788167 - RNA, 19 nt, Homo sapiens
cagagaacaugcuuucaac

SEQ ID NO: 788168 - RNA, 19 nt, Homo sapiens
agaacgaaaugauaccaau

SEQ ID NO: 788169 - RNA, 19 nt, Homo sapiens
caaagcagacuuaagaacu

SEQ ID NO: 788170 - RNA, 19 nt, Homo sapiens
gaaguucaaauccaaagca

SEQ ID NO: 788171 - RNA, 19 nt, Homo sapiens
cuaagaacagagaauauga

SEQ ID NO: 788172 - RNA, 19 nt, Homo sapiens
caucguaagauuaauccua

SEQ ID NO: 788173 - RNA, 19 nt, Homo sapiens
ccacauggccagagaacau

SEQ ID NO: 788174 - RNA, 19 nt, Homo sapiens
gaacaacagcagcaagaac

SEQ ID NO: 788175 - RNA, 19 nt, Homo sapiens
gaggcaaguucaccaaugc

SEQ ID NO: 788176 - RNA, 19 nt, Homo sapiens
gagcauaagauugucauag

SEQ ID NO: 788177 - RNA, 19 nt, Homo sapiens
ccacugcuccauuugaaga

SEQ ID NO: 788178 - RNA, 19 nt, Homo sapiens
gcauaagauugucauagcu

SEQ ID NO: 788179 - RNA, 19 nt, Homo sapiens
uugcugauuuccaaaggua

SEQ ID NO: 788180 - RNA, 19 nt, Homo sapiens
ugaaccacauggccagaga

SEQ ID NO: 788181 - RNA, 19 nt, Homo sapiens
caaugaagaauuccuugga

SEQ ID NO: 788182 - RNA, 19 nt, Homo sapiens
ggaacaacagcagcaagaa

SEQ ID NO: 788183 - RNA, 19 nt, Homo sapiens
cugaagcacaugauuauug

SEQ ID NO: 788184 - RNA, 19 nt, Homo sapiens
uaucugacagugaaaguga

SEQ ID NO: 788185 - RNA, 19 nt, Homo sapiens
aaagcagacuuaagaacuc

SEQ ID NO: 788186 - RNA, 19 nt, Homo sapiens
gauuaauccuaagaacaga

SEQ ID NO: 788187 - RNA, 19 nt, Homo sapiens
gcagcaagaacgaaaugau

SEQ ID NO: 788188 - RNA, 19 nt, Homo sapiens
caccaccacuuuagaaggu

SEQ ID NO: 788189 - RNA, 19 nt, Homo sapiens
gcagaaacaauugagaagu

SEQ ID NO: 788190 - RNA, 19 nt, Homo sapiens
uagcugaugucaaguuggu

SEQ ID NO: 788191 - RNA, 19 nt, Homo sapiens
ccuaugagacagauaugaa

SEQ ID NO: 788192 - RNA, 19 nt, Homo sapiens
gaaaauguucccaucauca

SEQ ID NO: 788193 - RNA, 19 nt, Homo sapiens
cugaacagcccaucacaga

SEQ ID NO: 788194 - RNA, 19 nt, Homo sapiens
gaaagacgugggaucaacu

SEQ ID NO: 788195 - RNA, 19 nt, Homo sapiens
acacuuaaagaucacauga

SEQ ID NO: 788196 - RNA, 19 nt, Homo sapiens
gguccuuggugaaauaaac

SEQ ID NO: 788197 - RNA, 19 nt, Homo sapiens
caacuggaguauuauuuuc

SEQ ID NO: 788198 - RNA, 19 nt, Homo sapiens
aagcagaaacaauugagaa

SEQ ID NO: 788199 - RNA, 19 nt, Homo sapiens
gugggaagaaguucaguug

SEQ ID NO: 788200 - RNA, 19 nt, Homo sapiens
ggccagagaacaugcuuuc

SEQ ID NO: 788201 - RNA, 19 nt, Homo sapiens
ucuaaacuguaugcuuuga

SEQ ID NO: 788202 - RNA, 19 nt, Homo sapiens
caaguucaccaaugcagau

SEQ ID NO: 788203 - RNA, 19 nt, Homo sapiens
acagagaauaugacagauu

SEQ ID NO: 788204 - RNA, 19 nt, Homo sapiens
ccaucugugccuuguauuu

SEQ ID NO: 788205 - RNA, 19 nt, Homo sapiens
gaaccacauggccagagaa

SEQ ID NO: 788206 - RNA, 19 nt, Homo sapiens
gaacaugucugacuggauu

SEQ ID NO: 788207 - RNA, 19 nt, Homo sapiens
gaacccaccuucaugaaua

SEQ ID NO: 788208 - RNA, 19 nt, Homo sapiens
ggaaggagcugaccauagu

SEQ ID NO: 788209 - RNA, 19 nt, Homo sapiens
gcugaaaccuuccaccaua

SEQ ID NO: 788210 - RNA, 19 nt, Homo sapiens
gaacuugcauaucuagaga

SEQ ID NO: 788211 - RNA, 19 nt, Homo sapiens
ggucgaggcuccugaaaga

SEQ ID NO: 788212 - RNA, 19 nt, Homo sapiens
gguaguagcuugccuagag

SEQ ID NO: 788213 - RNA, 19 nt, Homo sapiens
ggacgaacaucugaccaaa

SEQ ID NO: 788214 - RNA, 19 nt, Homo sapiens
ugagaucacuuguguaaag

SEQ ID NO: 788215 - RNA, 19 nt, Homo sapiens
cgacuugacugacauugug

SEQ ID NO: 788216 - RNA, 19 nt, Homo sapiens
gaaccugcuuggccacuau

SEQ ID NO: 788217 - RNA, 19 nt, Homo sapiens
gggcugagaugcacugcuu

SEQ ID NO: 788218 - RNA, 19 nt, Homo sapiens
guaacaaacaguaccaauu

SEQ ID NO: 788219 - RNA, 19 nt, Homo sapiens
gcaaggccaucuuugucaa

SEQ ID NO: 788220 - RNA, 19 nt, Homo sapiens
gcuagaggauaaacauuuc

SEQ ID NO: 788221 - RNA, 19 nt, Homo sapiens
ugucauaccuggaaagcaa

SEQ ID NO: 788222 - RNA, 19 nt, Homo sapiens
ggaaggucgugucaagguu

SEQ ID NO: 788223 - RNA, 19 nt, Homo sapiens
ccaggaacuugcauaucua

SEQ ID NO: 788224 - RNA, 19 nt, Homo sapiens
ggccauagcugcccaugag

SEQ ID NO: 788225 - RNA, 19 nt, Homo sapiens
acgaacaucugaccaaaga

SEQ ID NO: 788226 - RNA, 19 nt, Homo sapiens
gagccucuguggccuuaaa

SEQ ID NO: 788227 - RNA, 19 nt, Homo sapiens
ggagugcugccaagaauau

SEQ ID NO: 788228 - RNA, 19 nt, Homo sapiens
gcccaucucuuugcucuug

SEQ ID NO: 788229 - RNA, 19 nt, Homo sapiens
gaauagcacuguguuccau

SEQ ID NO: 788230 - RNA, 19 nt, Homo sapiens
gcaccugaccgacgaauca

SEQ ID NO: 788231 - RNA, 19 nt, Homo sapiens
ggagggagacccagcauag

SEQ ID NO: 788232 - RNA, 19 nt, Homo sapiens
ggcaucaucuucagcaugu

SEQ ID NO: 788233 - RNA, 19 nt, Homo sapiens
gcuauaugacccuguagua

SEQ ID NO: 788234 - RNA, 19 nt, Homo sapiens
cuagagaauuaccuuauca

SEQ ID NO: 788235 - RNA, 19 nt, Homo sapiens
gaauauugggcacugcuuu

SEQ ID NO: 788236 - RNA, 19 nt, Homo sapiens
ggugcuauaugacccugua

SEQ ID NO: 788237 - RNA, 19 nt, Homo sapiens
uaauggagaccuugacuug

SEQ ID NO: 788238 - RNA, 19 nt, Homo sapiens
gccguaaggcucuuucuuu

SEQ ID NO: 788239 - RNA, 19 nt, Homo sapiens
gcaugguuauccuggguuu

SEQ ID NO: 788240 - RNA, 19 nt, Homo sapiens
caugguggcuauguguaua

SEQ ID NO: 788241 - RNA, 19 nt, Homo sapiens
ggugaugacucaggcauuc

SEQ ID NO: 788242 - RNA, 19 nt, Homo sapiens
guacccagcaacugccuua

SEQ ID NO: 788243 - RNA, 19 nt, Homo sapiens
acucaguggugcuauauga

SEQ ID NO: 788244 - RNA, 19 nt, Homo sapiens
uugcauaucuagagacaga

SEQ ID NO: 788245 - RNA, 19 nt, Homo sapiens
cagcauagccaggccagua

SEQ ID NO: 788246 - RNA, 19 nt, Homo sapiens
acaacucaguggugcuaua

SEQ ID NO: 788247 - RNA, 19 nt, Homo sapiens
guaguagcuugccuagaga

SEQ ID NO: 788248 - RNA, 19 nt, Homo sapiens
auaaacauuuccaguccua

SEQ ID NO: 788249 - RNA, 19 nt, Homo sapiens
guggagugcugccaagaau

SEQ ID NO: 788250 - RNA, 19 nt, Homo sapiens
cugaaaccuuccaccauaa

SEQ ID NO: 788251 - RNA, 19 nt, Homo sapiens
ccagagaccagguacaugu

SEQ ID NO: 788252 - RNA, 19 nt, Homo sapiens
aagcagagauggcacacau

SEQ ID NO: 788253 - RNA, 19 nt, Homo sapiens
ggccaucuuugucaaggaa

SEQ ID NO: 788254 - RNA, 19 nt, Homo sapiens
gcaggauucugggcggauu

SEQ ID NO: 788255 - RNA, 19 nt, Homo sapiens
cugcuuggccacuaucuua

SEQ ID NO: 788256 - RNA, 19 nt, Homo sapiens
aguaggagcugaaauccau

SEQ ID NO: 788257 - RNA, 19 nt, Homo sapiens
gcagacaacaaaccuguag

SEQ ID NO: 788258 - RNA, 19 nt, Homo sapiens
ggccguggguuccugaugu

SEQ ID NO: 788259 - RNA, 19 nt, Homo sapiens
ggucucagccuccauugau

SEQ ID NO: 788260 - RNA, 19 nt, Homo sapiens
ucaacagccugcacaccuu

SEQ ID NO: 788261 - RNA, 19 nt, Homo sapiens
gcugcagccuguagugaug

SEQ ID NO: 788262 - RNA, 19 nt, Homo sapiens
gcacucacagcuguuugua

SEQ ID NO: 788263 - RNA, 19 nt, Homo sapiens
uaagcgauguguccucaag

SEQ ID NO: 788264 - RNA, 19 nt, Homo sapiens
guguacagcuuggacuuug

SEQ ID NO: 788265 - RNA, 19 nt, Homo sapiens
guacccgguuguaguagga

SEQ ID NO: 788266 - RNA, 19 nt, Homo sapiens
ggccuuugcuuaccucaag

SEQ ID NO: 788267 - RNA, 19 nt, Homo sapiens
cagcaugucauaccuggaa

SEQ ID NO: 788268 - RNA, 19 nt, Homo sapiens
guaccaggaacuugcauau

SEQ ID NO: 788269 - RNA, 19 nt, Homo sapiens
guugaugacuuugugaaca

SEQ ID NO: 788270 - RNA, 19 nt, Homo sapiens
ggcuugagguuuacaacug

SEQ ID NO: 788271 - RNA, 19 nt, Homo sapiens
gaucaacggcugaccuucu

SEQ ID NO: 788272 - RNA, 19 nt, Homo sapiens
cacaugcagugccuuccua

SEQ ID NO: 788273 - RNA, 19 nt, Homo sapiens
cgggcaaccucggagcuua

SEQ ID NO: 788274 - RNA, 19 nt, Homo sapiens
gucaggggcuugagguuua

SEQ ID NO: 788275 - RNA, 19 nt, Homo sapiens
gcauucggcuguggcacuu

SEQ ID NO: 788276 - RNA, 19 nt, Homo sapiens
ugauaaagcgagugcagaa

SEQ ID NO: 788277 - RNA, 19 nt, Homo sapiens
cgaggcuccugaaagagaa

SEQ ID NO: 788278 - RNA, 19 nt, Homo sapiens
caugguggcuguguuugga

SEQ ID NO: 788279 - RNA, 19 nt, Homo sapiens
caacucaguggugcuauau

SEQ ID NO: 788280 - RNA, 19 nt, Homo sapiens
ggaacuugcauaucuagag

SEQ ID NO: 788281 - RNA, 19 nt, Homo sapiens
gcagggaagggcugucugu

SEQ ID NO: 788282 - RNA, 19 nt, Homo sapiens
ggucgggugcagaauauug

SEQ ID NO: 788283 - RNA, 19 nt, Homo sapiens
gaagcguucguaucuggaa

SEQ ID NO: 788284 - RNA, 19 nt, Homo sapiens
ggacuuuggugggcaucug

SEQ ID NO: 788285 - RNA, 19 nt, Homo sapiens
gucacuggcccaucucuuu

SEQ ID NO: 788286 - RNA, 19 nt, Homo sapiens
accaggaacuugcauaucu

SEQ ID NO: 788287 - RNA, 19 nt, Homo sapiens
gaacauucccagguauugg

SEQ ID NO: 788288 - RNA, 19 nt, Homo sapiens
uuacaacugguaugacuga

SEQ ID NO: 788289 - RNA, 19 nt, Homo sapiens
acagcuguuuguaaccaua

SEQ ID NO: 788290 - RNA, 19 nt, Homo sapiens
gcucuggccuguggaacau

SEQ ID NO: 788291 - RNA, 19 nt, Homo sapiens
cacgcuggcuugagggaaa

SEQ ID NO: 788292 - RNA, 19 nt, Homo sapiens
ugccuuagcagacaacaaa

SEQ ID NO: 788293 - RNA, 19 nt, Homo sapiens
caggccagaauaaagaaua

SEQ ID NO: 788294 - RNA, 19 nt, Homo sapiens
ugacaggccucaagauccu

SEQ ID NO: 788295 - RNA, 19 nt, Homo sapiens
acucacagcuguuuguaac

SEQ ID NO: 788296 - RNA, 19 nt, Homo sapiens
ucuagagaauuaccuuauc

SEQ ID NO: 788297 - RNA, 19 nt, Homo sapiens
ucacagcuguuuguaacca

SEQ ID NO: 788298 - RNA, 19 nt, Homo sapiens
ugacugacauugugaucac

SEQ ID NO: 788299 - RNA, 19 nt, Homo sapiens
uagcugggcuccguauagu

SEQ ID NO: 788300 - RNA, 19 nt, Homo sapiens
uggagccucuguggccuua

SEQ ID NO: 788301 - RNA, 19 nt, Homo sapiens
guuuacaacugguaugacu

SEQ ID NO: 788302 - RNA, 19 nt, Homo sapiens
ucgugggcauucucugaua

SEQ ID NO: 788303 - RNA, 19 nt, Homo sapiens
ggcaaggccaucuuuguca

SEQ ID NO: 788304 - RNA, 19 nt, Homo sapiens
gucccgauguccuggugua

SEQ ID NO: 788305 - RNA, 19 nt, Homo sapiens
uggacgcucucgaggacua

SEQ ID NO: 788306 - RNA, 19 nt, Homo sapiens
gaacaugucugacuggauu

SEQ ID NO: 788307 - RNA, 19 nt, Homo sapiens
ggaaggagcugaccauagu

SEQ ID NO: 788308 - RNA, 19 nt, Homo sapiens
gcaacugccuuuacccuau

SEQ ID NO: 788309 - RNA, 19 nt, Homo sapiens
caacugccuuuacccuaua

SEQ ID NO: 788310 - RNA, 19 nt, Homo sapiens
gcugagcuguaccagaaua

SEQ ID NO: 788311 - RNA, 19 nt, Homo sapiens
gaaccugcuuggccacuau

SEQ ID NO: 788312 - RNA, 19 nt, Homo sapiens
guaccagaauaaagaauag

SEQ ID NO: 788313 - RNA, 19 nt, Homo sapiens
gcuauaugacccuguagua

SEQ ID NO: 788314 - RNA, 19 nt, Homo sapiens
ggugcuauaugacccugua

SEQ ID NO: 788315 - RNA, 19 nt, Homo sapiens
uaauggagaccuugacuug

SEQ ID NO: 788316 - RNA, 19 nt, Homo sapiens
acucaguggugcuauauga

SEQ ID NO: 788317 - RNA, 19 nt, Homo sapiens
agaauagaguguagagugu

SEQ ID NO: 788318 - RNA, 19 nt, Homo sapiens
acaacucaguggugcuaua

SEQ ID NO: 788319 - RNA, 19 nt, Homo sapiens
augcugagcuguaccagaa

SEQ ID NO: 788320 - RNA, 19 nt, Homo sapiens
cugcuuggccacuaucuua

SEQ ID NO: 788321 - RNA, 19 nt, Homo sapiens
aguaggagcugaaauccau

SEQ ID NO: 788322 - RNA, 19 nt, Homo sapiens
guacccgguuguaguagga

SEQ ID NO: 788323 - RNA, 19 nt, Homo sapiens
guguacagcuuggacuuug

SEQ ID NO: 788324 - RNA, 19 nt, Homo sapiens
guacccagcaacugccuuu

SEQ ID NO: 788325 - RNA, 19 nt, Homo sapiens
cgggcaaccucggagcuua

SEQ ID NO: 788326 - RNA, 19 nt, Homo sapiens
ugauaaagcgagugcagaa

SEQ ID NO: 788327 - RNA, 19 nt, Homo sapiens
caacucaguggugcuauau

SEQ ID NO: 788328 - RNA, 19 nt, Homo sapiens
caugguggcuguguuugga

SEQ ID NO: 788329 - RNA, 19 nt, Homo sapiens
ggacuuuggugggcaucug

SEQ ID NO: 788330 - RNA, 19 nt, Homo sapiens
cacgcuggcuugagggaaa

SEQ ID NO: 788331 - RNA, 19 nt, Homo sapiens
gcucuggccuguggaacau

SEQ ID NO: 788332 - RNA, 19 nt, Homo sapiens
gagcuguaccagaauaaag

SEQ ID NO: 788333 - RNA, 19 nt, Homo sapiens
uggacgcucucgaggacua

SEQ ID NO: 788334 - RNA, 19 nt, Homo sapiens
gucccgauguccuggugua

SEQ ID NO: 788335 - RNA, 19 nt, Homo sapiens
uaaagaauagaguguagag

SEQ ID NO: 788336 - RNA, 19 nt, Homo sapiens
auggagaccuugacuugga

SEQ ID NO: 788337 - RNA, 19 nt, Homo sapiens
cauaguggcaggugcuguu

SEQ ID NO: 788338 - RNA, 19 nt, Homo sapiens
cuuauacuccucccaguga

SEQ ID NO: 788339 - RNA, 19 nt, Homo sapiens
ggauguguacccgguugua

SEQ ID NO: 788340 - RNA, 19 nt, Homo sapiens
ggccacuucugggagcuuu

SEQ ID NO: 788341 - RNA, 19 nt, Homo sapiens
gguguacagcuuggacuuu

SEQ ID NO: 788342 - RNA, 19 nt, Homo sapiens
uguaguaggagcugaaauc

SEQ ID NO: 788343 - RNA, 19 nt, Homo sapiens
uguguacccgguuguagua

SEQ ID NO: 788344 - RNA, 19 nt, Homo sapiens
ggcaaccucggagcuuaua

SEQ ID NO: 788345 - RNA, 19 nt, Homo sapiens
gggcaaccucggagcuuau

SEQ ID NO: 788346 - RNA, 19 nt, Homo sapiens
guacggccagagccuaaug

SEQ ID NO: 788347 - RNA, 19 nt, Homo sapiens
ggguacggccagagccuaa

SEQ ID NO: 788348 - RNA, 19 nt, Homo sapiens
gaaggagcugaccauagug

SEQ ID NO: 788349 - RNA, 19 nt, Homo sapiens
uaaagcgagugcagaaccu

SEQ ID NO: 788350 - RNA, 19 nt, Homo sapiens
gcuguaccagaauaaagaa

SEQ ID NO: 788351 - RNA, 19 nt, Homo sapiens
gcacgucccaccccguuuu

SEQ ID NO: 788352 - RNA, 19 nt, Homo sapiens
caggugcuguuuccaacca

SEQ ID NO: 788353 - RNA, 19 nt, Homo sapiens
ggaacaugucugacuggau

SEQ ID NO: 788354 - RNA, 19 nt, Homo sapiens
gaacccaccuucaugaaua

SEQ ID NO: 788355 - RNA, 19 nt, Homo sapiens
ggaaggagcugaccauagu

SEQ ID NO: 788356 - RNA, 19 nt, Homo sapiens
gcugaaaccuuccaccaua

SEQ ID NO: 788357 - RNA, 19 nt, Homo sapiens
gaacuugcauaucuagaga

SEQ ID NO: 788358 - RNA, 19 nt, Homo sapiens
ggucgaggcuccugaaaga

SEQ ID NO: 788359 - RNA, 19 nt, Homo sapiens
ggacgaacaucugaccaaa

SEQ ID NO: 788360 - RNA, 19 nt, Homo sapiens
gaaccugcuuggccacuau

SEQ ID NO: 788361 - RNA, 19 nt, Homo sapiens
guaacaaacaguaccaauu

SEQ ID NO: 788362 - RNA, 19 nt, Homo sapiens
ccaggaacuugcauaucua

SEQ ID NO: 788363 - RNA, 19 nt, Homo sapiens
acgaacaucugaccaaaga

SEQ ID NO: 788364 - RNA, 19 nt, Homo sapiens
gagccucuguggccuuaaa

SEQ ID NO: 788365 - RNA, 19 nt, Homo sapiens
ggagugcugccaagaauau

SEQ ID NO: 788366 - RNA, 19 nt, Homo sapiens
gcccaucucuuugcucuug

SEQ ID NO: 788367 - RNA, 19 nt, Homo sapiens
gaauagcacuguguuccau

SEQ ID NO: 788368 - RNA, 19 nt, Homo sapiens
ggagggagacccagcauag

SEQ ID NO: 788369 - RNA, 19 nt, Homo sapiens
uaauggagaccuugacuug

SEQ ID NO: 788370 - RNA, 19 nt, Homo sapiens
gccguaaggcucuuucuuu

SEQ ID NO: 788371 - RNA, 19 nt, Homo sapiens
guacccagcaacugccuua

SEQ ID NO: 788372 - RNA, 19 nt, Homo sapiens
uugcauaucuagagacaga

SEQ ID NO: 788373 - RNA, 19 nt, Homo sapiens
cagcauagccaggccagua

SEQ ID NO: 788374 - RNA, 19 nt, Homo sapiens
guggagugcugccaagaau

SEQ ID NO: 788375 - RNA, 19 nt, Homo sapiens
cugaaaccuuccaccauaa

SEQ ID NO: 788376 - RNA, 19 nt, Homo sapiens
ccagagaccagguacaugu

SEQ ID NO: 788377 - RNA, 19 nt, Homo sapiens
gcaggauucugggcggauu

SEQ ID NO: 788378 - RNA, 19 nt, Homo sapiens
cugcuuggccacuaucuua

SEQ ID NO: 788379 - RNA, 19 nt, Homo sapiens
aguaggagcugaaauccau

SEQ ID NO: 788380 - RNA, 19 nt, Homo sapiens
ggccguggguuccugaugu

SEQ ID NO: 788381 - RNA, 19 nt, Homo sapiens
ggucucagccuccauugau

SEQ ID NO: 788382 - RNA, 19 nt, Homo sapiens
ucaacagccugcacaccuu

SEQ ID NO: 788383 - RNA, 19 nt, Homo sapiens
gcugcagccuguagugaug

SEQ ID NO: 788384 - RNA, 19 nt, Homo sapiens
uaagcgauguguccucaag

SEQ ID NO: 788385 - RNA, 19 nt, Homo sapiens
guacccgguuguaguagga

SEQ ID NO: 788386 - RNA, 19 nt, Homo sapiens
guguacagcuuggacuuug

SEQ ID NO: 788387 - RNA, 19 nt, Homo sapiens
guaccaggaacuugcauau

SEQ ID NO: 788388 - RNA, 19 nt, Homo sapiens
guugaugacuuugugaaca

SEQ ID NO: 788389 - RNA, 19 nt, Homo sapiens
ggcuugagguuuacaacug

SEQ ID NO: 788390 - RNA, 19 nt, Homo sapiens
gaucaacggcugaccuucu

SEQ ID NO: 788391 - RNA, 19 nt, Homo sapiens
cgggcaaccucggagcuua

SEQ ID NO: 788392 - RNA, 19 nt, Homo sapiens
gucaggggcuugagguuua

SEQ ID NO: 788393 - RNA, 19 nt, Homo sapiens
ugauaaagcgagugcagaa

SEQ ID NO: 788394 - RNA, 19 nt, Homo sapiens
cgaggcuccugaaagagaa

SEQ ID NO: 788395 - RNA, 19 nt, Homo sapiens
caugguggcuguguuugga

SEQ ID NO: 788396 - RNA, 19 nt, Homo sapiens
ggaacuugcauaucuagag

SEQ ID NO: 788397 - RNA, 19 nt, Homo sapiens
ggacuuuggugggcaucug

SEQ ID NO: 788398 - RNA, 19 nt, Homo sapiens
gcagggaagggcugucugu

SEQ ID NO: 788399 - RNA, 19 nt, Homo sapiens
gucacuggcccaucucuuu

SEQ ID NO: 788400 - RNA, 19 nt, Homo sapiens
accaggaacuugcauaucu

SEQ ID NO: 788401 - RNA, 19 nt, Homo sapiens
gaacauucccagguauugg

SEQ ID NO: 788402 - RNA, 19 nt, Homo sapiens
uuacaacugguaugacuga

SEQ ID NO: 788403 - RNA, 19 nt, Homo sapiens
gcucuggccuguggaacau

SEQ ID NO: 788404 - RNA, 19 nt, Homo sapiens
caggccagaauaaagaaua

SEQ ID NO: 788405 - RNA, 19 nt, Homo sapiens
ugacaggccucaagauccu

SEQ ID NO: 788406 - RNA, 19 nt, Homo sapiens
gucccgauguccuggugua

SEQ ID NO: 788407 - RNA, 19 nt, Homo sapiens
uggagccucuguggccuua

SEQ ID NO: 788408 - RNA, 19 nt, Homo sapiens
guuuacaacugguaugacu

SEQ ID NO: 788409 - RNA, 19 nt, Homo sapiens
uggacgcucucgaggacua

SEQ ID NO: 788410 - RNA, 19 nt, Homo sapiens
auggagaccuugacuugga

SEQ ID NO: 788411 - RNA, 19 nt, Homo sapiens
ucacuggcccaucucuuug

SEQ ID NO: 788412 - RNA, 19 nt, Homo sapiens
gcauaucuagagacagaga

SEQ ID NO: 788413 - RNA, 19 nt, Homo sapiens
ugcgugugcuagaggaaua

SEQ ID NO: 788414 - RNA, 19 nt, Homo sapiens
cauaguggcaggugcuguu

SEQ ID NO: 788415 - RNA, 19 nt, Homo sapiens
ggauguguacccgguugua

SEQ ID NO: 788416 - RNA, 19 nt, Homo sapiens
caagacagaacuuuguaac

SEQ ID NO: 788417 - RNA, 19 nt, Homo sapiens
cuuauacuccucccaguga

SEQ ID NO: 788418 - RNA, 19 nt, Homo sapiens
ggagaugcuacagcuagaa

SEQ ID NO: 788419 - RNA, 19 nt, Homo sapiens
guaaggcucuuucuuuugc

SEQ ID NO: 788420 - RNA, 19 nt, Homo sapiens
ggccacuucugggagcuuu

SEQ ID NO: 788421 - RNA, 19 nt, Homo sapiens
ccguaaggcucuuucuuuu

SEQ ID NO: 788422 - RNA, 19 nt, Homo sapiens
uugugaacauucccaggua

SEQ ID NO: 788423 - RNA, 19 nt, Homo sapiens
ggaucucaccaccaugcua

SEQ ID NO: 788424 - RNA, 19 nt, Homo sapiens
cucauccucugcuuccuuu

SEQ ID NO: 788425 - RNA, 19 nt, Homo sapiens
gguguacagcuuggacuuu

SEQ ID NO: 788426 - RNA, 19 nt, Homo sapiens
cccagcaacugccuuagca

SEQ ID NO: 788427 - RNA, 19 nt, Homo sapiens
uguaguaggagcugaaauc

SEQ ID NO: 788428 - RNA, 19 nt, Homo sapiens
uguguacccgguuguagua

SEQ ID NO: 788429 - RNA, 19 nt, Homo sapiens
ccuuugccuuuacccuaua

SEQ ID NO: 788430 - RNA, 19 nt, Homo sapiens
ggcaaccucggagcuuaua

SEQ ID NO: 788431 - RNA, 19 nt, Homo sapiens
gugaacauucccagguauu

SEQ ID NO: 788432 - RNA, 19 nt, Homo sapiens
ucugggaucucaccaccau

SEQ ID NO: 788433 - RNA, 19 nt, Homo sapiens
gggcaaccucggagcuuau

SEQ ID NO: 788434 - RNA, 19 nt, Homo sapiens
ugaugacuuugugaacauu

SEQ ID NO: 788435 - RNA, 19 nt, Homo sapiens
caugacaagacagaacuuu

SEQ ID NO: 788436 - RNA, 19 nt, Homo sapiens
guacggccagagccuaaug

SEQ ID NO: 788437 - RNA, 19 nt, Homo sapiens
ggguacggccagagccuaa

SEQ ID NO: 788438 - RNA, 19 nt, Homo sapiens
uggagaugcuacagcuaga

SEQ ID NO: 788439 - RNA, 19 nt, Homo sapiens
cccaccggcuagaugagua

SEQ ID NO: 788440 - RNA, 19 nt, Homo sapiens
ugugaacauucccagguau

SEQ ID NO: 788441 - RNA, 19 nt, Homo sapiens
gagaugcuacagcuagaag

SEQ ID NO: 788442 - RNA, 19 nt, Homo sapiens
gaaggagcugaccauagug

SEQ ID NO: 788443 - RNA, 19 nt, Homo sapiens
gagcuguaccaggaacuug

SEQ ID NO: 788444 - RNA, 19 nt, Homo sapiens
gcacgucccaccccguuuu

SEQ ID NO: 788445 - RNA, 19 nt, Homo sapiens
ucgaggcuccugaaagaga

SEQ ID NO: 788446 - RNA, 19 nt, Homo sapiens
ugaacauucccagguauug

SEQ ID NO: 788447 - RNA, 19 nt, Homo sapiens
gaguuuggccaccguugug

SEQ ID NO: 788448 - RNA, 19 nt, Homo sapiens
ccugugagcccugaguuug

SEQ ID NO: 788449 - RNA, 19 nt, Homo sapiens
uaaagcgagugcagaaccu

SEQ ID NO: 788450 - RNA, 19 nt, Homo sapiens
cugagucacuggcccaucu

SEQ ID NO: 788451 - RNA, 19 nt, Homo sapiens
gcaggcggacgaacaucug

SEQ ID NO: 788452 - RNA, 19 nt, Homo sapiens
ucacgcacagcucucagaa

SEQ ID NO: 788453 - RNA, 19 nt, Homo sapiens
caggugcuguuuccaacca

SEQ ID NO: 788454 - RNA, 19 nt, Homo sapiens
ggacaaggcucugaaauac

SEQ ID NO: 788455 - RNA, 19 nt, Homo sapiens
ugaaauaccuggaggacaa

SEQ ID NO: 788456 - RNA, 19 nt, Homo sapiens
gauccugacuuaccaguau

SEQ ID NO: 788457 - RNA, 19 nt, Homo sapiens
cagaggagcugaugagcaa

SEQ ID NO: 788458 - RNA, 19 nt, Homo sapiens
cagcaaagauguggaguug

SEQ ID NO: 788459 - RNA, 19 nt, Homo sapiens
caugauggauugcuacuug

SEQ ID NO: 788460 - RNA, 19 nt, Homo sapiens
gcaaacuggugccuguuga

SEQ ID NO: 788461 - RNA, 19 nt, Homo sapiens
gcuauuaugucccuuaugg

SEQ ID NO: 788462 - RNA, 19 nt, Homo sapiens
gagcgguucucucucauau

SEQ ID NO: 788463 - RNA, 19 nt, Homo sapiens
ggaagaagcuggggaagaa

SEQ ID NO: 788464 - RNA, 19 nt, Homo sapiens
gcagaagucagccauguau

SEQ ID NO: 788465 - RNA, 19 nt, Homo sapiens
gaagauuucagaugccaaa

SEQ ID NO: 788466 - RNA, 19 nt, Homo sapiens
acaaccggauccugacuua

SEQ ID NO: 788467 - RNA, 19 nt, Homo sapiens
gucuauagcuccagaacaa

SEQ ID NO: 788468 - RNA, 19 nt, Homo sapiens
gggaggagaauaugaaguu

SEQ ID NO: 788469 - RNA, 19 nt, Homo sapiens
ggaaaacauugaaacacua

SEQ ID NO: 788470 - RNA, 19 nt, Homo sapiens
gcgguucucucucauauac

SEQ ID NO: 788471 - RNA, 19 nt, Homo sapiens
gaagaugaagccagagguu

SEQ ID NO: 788472 - RNA, 19 nt, Homo sapiens
cggacaaggcucugaaaua

SEQ ID NO: 788473 - RNA, 19 nt, Homo sapiens
gaaagaacuaccuccugaa

SEQ ID NO: 788474 - RNA, 19 nt, Homo sapiens
cuacuugacucacaccaau

SEQ ID NO: 788475 - RNA, 19 nt, Homo sapiens
gcugacaccuugccagaag

SEQ ID NO: 788476 - RNA, 19 nt, Homo sapiens
ccugugagagugagauuua

SEQ ID NO: 788477 - RNA, 19 nt, Homo sapiens
cagaacauccuuucauugu

SEQ ID NO: 788478 - RNA, 19 nt, Homo sapiens
gauuucagaugccaaacug

SEQ ID NO: 788479 - RNA, 19 nt, Homo sapiens
ugaagggcaugcugcagaa

SEQ ID NO: 788480 - RNA, 19 nt, Homo sapiens
gaaccaauuuugaugucua

SEQ ID NO: 788481 - RNA, 19 nt, Homo sapiens
ugaccugaaugccuuccua

SEQ ID NO: 788482 - RNA, 19 nt, Homo sapiens
ggaggagaauaugaaguuc

SEQ ID NO: 788483 - RNA, 19 nt, Homo sapiens
gagccugguucgauuacga

SEQ ID NO: 788484 - RNA, 19 nt, Homo sapiens
agaacuaccuccugaaucg

SEQ ID NO: 788485 - RNA, 19 nt, Homo sapiens
agaagucagccauguauga

SEQ ID NO: 788486 - RNA, 19 nt, Homo sapiens
caaugacaccgccuuucua

SEQ ID NO: 788487 - RNA, 19 nt, Homo sapiens
ccauguaugagaaguauga

SEQ ID NO: 788488 - RNA, 19 nt, Homo sapiens
cucagaacauccuuucauu

SEQ ID NO: 788489 - RNA, 19 nt, Homo sapiens
gcaggcguuuguccacgaa

SEQ ID NO: 788490 - RNA, 19 nt, Homo sapiens
auuacgaccuugagaagaa

SEQ ID NO: 788491 - RNA, 19 nt, Homo sapiens
agucagccauguaugagaa

SEQ ID NO: 788492 - RNA, 19 nt, Homo sapiens
gacccaggccugaguccua

SEQ ID NO: 788493 - RNA, 19 nt, Homo sapiens
ugccugggcuugcucauuc

SEQ ID NO: 788494 - RNA, 19 nt, Homo sapiens
gaaacacuagccuuggaau

SEQ ID NO: 788495 - RNA, 19 nt, Homo sapiens
cgaccucucuccagaagac

SEQ ID NO: 788496 - RNA, 19 nt, Homo sapiens
aaagaacuaccuccugaau

SEQ ID NO: 788497 - RNA, 19 nt, Homo sapiens
ucagaacauccuuucauug

SEQ ID NO: 788498 - RNA, 19 nt, Homo sapiens
ugcaucagcucuggaagaa

SEQ ID NO: 788499 - RNA, 19 nt, Homo sapiens
gaaggugccugggcuugcu

SEQ ID NO: 788500 - RNA, 19 nt, Homo sapiens
ccuccugaaucgcuauuau

SEQ ID NO: 788501 - RNA, 19 nt, Homo sapiens
gaugucuacucgcagaagu

SEQ ID NO: 788502 - RNA, 19 nt, Homo sapiens
gaagucagccauguaugag

SEQ ID NO: 788503 - RNA, 19 nt, Homo sapiens
acaaggcucugaaauaccu

SEQ ID NO: 788504 - RNA, 19 nt, Homo sapiens
ccaaugacaccgccuuucu

SEQ ID NO: 788505 - RNA, 19 nt, Homo sapiens
agaacauccuuucauugug

SEQ ID NO: 788506 - RNA, 19 nt, Homo sapiens
gcugaugagcaacuucuau

SEQ ID NO: 788507 - RNA, 19 nt, Homo sapiens
ccuaaaccaaguucaaaug

SEQ ID NO: 788508 - RNA, 19 nt, Homo sapiens
acacuagccuuggaauugg

SEQ ID NO: 788509 - RNA, 19 nt, Homo sapiens
aaacacuagccuuggaauu

SEQ ID NO: 788510 - RNA, 19 nt, Homo sapiens
gcuccuaaaccaaguucaa

SEQ ID NO: 788511 - RNA, 19 nt, Homo sapiens
ucgcagaagucagccaugu

SEQ ID NO: 788512 - RNA, 19 nt, Homo sapiens
gaccggagccugguucgau

SEQ ID NO: 788513 - RNA, 19 nt, Homo sapiens
ccagcuggcucagaauugg

SEQ ID NO: 788514 - RNA, 19 nt, Homo sapiens
gauguggaguuggcugaca

SEQ ID NO: 788515 - RNA, 19 nt, Homo sapiens
ugacaccgccuuucuacag

SEQ ID NO: 788516 - RNA, 19 nt, Homo sapiens
ucucauauacucagaacau

SEQ ID NO: 788517 - RNA, 19 nt, Homo sapiens
ucuucacgcuggcucauug

SEQ ID NO: 788518 - RNA, 19 nt, Homo sapiens
gcuuggagggaaagaacua

SEQ ID NO: 788519 - RNA, 19 nt, Homo sapiens
gauugcuacuugacucaca

SEQ ID NO: 788520 - RNA, 19 nt, Homo sapiens
gaaguucaggagggauuug

SEQ ID NO: 788521 - RNA, 19 nt, Homo sapiens
aacacuagccuuggaauug

SEQ ID NO: 788522 - RNA, 19 nt, Homo sapiens
uugaaacacuagccuugga

SEQ ID NO: 788523 - RNA, 19 nt, Homo sapiens
ggcggucgcuuuguugagu

SEQ ID NO: 788524 - RNA, 19 nt, Homo sapiens
gguucucucucauauacuc

SEQ ID NO: 788525 - RNA, 19 nt, Homo sapiens
cugaugagcaacuucuauu

SEQ ID NO: 788526 - RNA, 19 nt, Homo sapiens
gagcugaugagcaacuucu

SEQ ID NO: 788527 - RNA, 19 nt, Homo sapiens
ucaaauggccaagcucuac

SEQ ID NO: 788528 - RNA, 19 nt, Homo sapiens
ugaaacacuagccuuggaa

SEQ ID NO: 788529 - RNA, 19 nt, Homo sapiens
ugacccucaugauggauug

SEQ ID NO: 788530 - RNA, 19 nt, Homo sapiens
gccuggcggucgcuuuguu

SEQ ID NO: 788531 - RNA, 19 nt, Homo sapiens
gauuacgaccuugagaaga

SEQ ID NO: 788532 - RNA, 19 nt, Homo sapiens
aacaaguccugcagaccuu

SEQ ID NO: 788533 - RNA, 19 nt, Homo sapiens
gagcuuggagggaaagaac

SEQ ID NO: 788534 - RNA, 19 nt, Homo sapiens
caagcaguuuguggacaug

SEQ ID NO: 788535 - RNA, 19 nt, Homo sapiens
gcggucgcuuuguugaguu

SEQ ID NO: 788536 - RNA, 19 nt, Homo sapiens
agaaguaugacgucagcaa

SEQ ID NO: 788537 - RNA, 19 nt, Homo sapiens
ggauccugacuuaccagua

SEQ ID NO: 788538 - RNA, 19 nt, Homo sapiens
gaccugaaugccuuccuau

SEQ ID NO: 788539 - RNA, 19 nt, Homo sapiens
ggccugaguccuacagcaa

SEQ ID NO: 788540 - RNA, 19 nt, Homo sapiens
ggacuccuacugggucaug

SEQ ID NO: 788541 - RNA, 19 nt, Homo sapiens
gcucauucagucacaguca

SEQ ID NO: 788542 - RNA, 19 nt, Homo sapiens
cugguucgauuacgaccuu

SEQ ID NO: 788543 - RNA, 19 nt, Homo sapiens
ucgcuauuaugucccuuau

SEQ ID NO: 788544 - RNA, 19 nt, Homo sapiens
ggacugucucugugagcuu

SEQ ID NO: 788545 - RNA, 19 nt, Homo sapiens
ccugcagacuggaaagaca

SEQ ID NO: 788546 - RNA, 19 nt, Homo sapiens
gacaaccggauccugacuu

SEQ ID NO: 788547 - RNA, 19 nt, Homo sapiens
ccggagccugguucgauua

SEQ ID NO: 788548 - RNA, 19 nt, Homo sapiens
cccaguuccugcagaagau

SEQ ID NO: 788549 - RNA, 19 nt, Homo sapiens
cugcagaagauuucagaug

SEQ ID NO: 788550 - RNA, 19 nt, Homo sapiens
gagcugagaucaugccauu

SEQ ID NO: 788551 - RNA, 19 nt, Homo sapiens
ggccaaagcagguggauua

SEQ ID NO: 788552 - RNA, 19 nt, Homo sapiens
ggaacauccuggacuuaaa

SEQ ID NO: 788553 - RNA, 19 nt, Homo sapiens
caaacuguguucacccuuu

SEQ ID NO: 788554 - RNA, 19 nt, Homo sapiens
gcuccuaucugcaaacugu

SEQ ID NO: 788555 - RNA, 19 nt, Homo sapiens
gcucggcaauuucagcuuu

SEQ ID NO: 788556 - RNA, 19 nt, Homo sapiens
ccaggugccuuucuucuuc

SEQ ID NO: 788557 - RNA, 19 nt, Homo sapiens
gcaaggaagacccggcuuu

SEQ ID NO: 788558 - RNA, 19 nt, Homo sapiens
caaguaacguagucauauc

SEQ ID NO: 788559 - RNA, 19 nt, Homo sapiens
ccgcagugcucggcaauuu

SEQ ID NO: 788560 - RNA, 19 nt, Homo sapiens
agacagagcagccgaguau

SEQ ID NO: 788561 - RNA, 19 nt, Homo sapiens
gaacaggcagcuccuaucu

SEQ ID NO: 788562 - RNA, 19 nt, Homo sapiens
gcagaucgaguccuucuuc

SEQ ID NO: 788563 - RNA, 19 nt, Homo sapiens
gcaaggugcugcucuucgu

SEQ ID NO: 788564 - RNA, 19 nt, Homo sapiens
ccucaggccuagucccuuu

SEQ ID NO: 788565 - RNA, 19 nt, Homo sapiens
gauccugaccugcaucuga

SEQ ID NO: 788566 - RNA, 19 nt, Homo sapiens
gggaacauccuggacuuaa

SEQ ID NO: 788567 - RNA, 19 nt, Homo sapiens
ccaaguaacguagucauau

SEQ ID NO: 788568 - RNA, 19 nt, Homo sapiens
gcaucuggcugugcaagga

SEQ ID NO: 788569 - RNA, 19 nt, Homo sapiens
gcacacacccguaguucca

SEQ ID NO: 788570 - RNA, 19 nt, Homo sapiens
gaaaccccgucucuacuaa

SEQ ID NO: 788571 - RNA, 19 nt, Homo sapiens
gcagugcucggcaauuuca

SEQ ID NO: 788572 - RNA, 19 nt, Homo sapiens
gaacauccuggacuuaaaa

SEQ ID NO: 788573 - RNA, 19 nt, Homo sapiens
gccaaguaacguagucaua

SEQ ID NO: 788574 - RNA, 19 nt, Homo sapiens
ucaccuggcugcucauguc

SEQ ID NO: 788575 - RNA, 19 nt, Homo sapiens
guaacguagucauaucauc

SEQ ID NO: 788576 - RNA, 19 nt, Homo sapiens
ggagguggaggcugcaaug

SEQ ID NO: 788577 - RNA, 19 nt, Homo sapiens
caaggaagacccggcuuug

SEQ ID NO: 788578 - RNA, 19 nt, Homo sapiens
ccaccaugcucuucaucau

SEQ ID NO: 788579 - RNA, 19 nt, Homo sapiens
gacaacguccggagacaga

SEQ ID NO: 788580 - RNA, 19 nt, Homo sapiens
ccaagaggcagcagucauc

SEQ ID NO: 788581 - RNA, 19 nt, Homo sapiens
gacggucccuggagcagau

SEQ ID NO: 788582 - RNA, 19 nt, Homo sapiens
gguaugcccuggucuacac

SEQ ID NO: 788583 - RNA, 19 nt, Homo sapiens
ggaacaggcagcuccuauc

SEQ ID NO: 788584 - RNA, 19 nt, Homo sapiens
gcagccaaguaacguaguc

SEQ ID NO: 788585 - RNA, 19 nt, Homo sapiens
ccucuguguuggcuacaaa

SEQ ID NO: 788586 - RNA, 19 nt, Homo sapiens
ucggaucccugucccucua

SEQ ID NO: 788587 - RNA, 19 nt, Homo sapiens
gggaacaggcagcuccuau

SEQ ID NO: 788588 - RNA, 19 nt, Homo sapiens
gaagcugagcaucauguuc

SEQ ID NO: 788589 - RNA, 19 nt, Homo sapiens
ccuguaaucccagcacuuu

SEQ ID NO: 788590 - RNA, 19 nt, Homo sapiens
gcuuugcccucacaagucu

SEQ ID NO: 788591 - RNA, 19 nt, Homo sapiens
gagcagaucgaguccuucu

SEQ ID NO: 788592 - RNA, 19 nt, Homo sapiens
ucgagcagauccaggacaa

SEQ ID NO: 788593 - RNA, 19 nt, Homo sapiens
guacgugucugagauugcu

SEQ ID NO: 788594 - RNA, 19 nt, Homo sapiens
caauuucagcuuuggguau

SEQ ID NO: 788595 - RNA, 19 nt, Homo sapiens
uggcugggccucuguguug

SEQ ID NO: 788596 - RNA, 19 nt, Homo sapiens
uggagcagaucgaguccuu

SEQ ID NO: 788597 - RNA, 19 nt, Homo sapiens
ccuggcugcucaugucuga

SEQ ID NO: 788598 - RNA, 19 nt, Homo sapiens
ucacgcccauccuggucua

SEQ ID NO: 788599 - RNA, 19 nt, Homo sapiens
ggaagcugagcaucauguu

SEQ ID NO: 788600 - RNA, 19 nt, Homo sapiens
ucgggacccugcagaacaa

SEQ ID NO: 788601 - RNA, 19 nt, Homo sapiens
gccggaagcugagcaucau

SEQ ID NO: 788602 - RNA, 19 nt, Homo sapiens
gagacagagcagccgagua

SEQ ID NO: 788603 - RNA, 19 nt, Homo sapiens
gcugagaucaugccauugc

SEQ ID NO: 788604 - RNA, 19 nt, Homo sapiens
ugaccugcaucugaccaaa

SEQ ID NO: 788605 - RNA, 19 nt, Homo sapiens
ucucagcggccaucauguu

SEQ ID NO: 788606 - RNA, 19 nt, Homo sapiens
ggccggaagcugagcauca

SEQ ID NO: 788607 - RNA, 19 nt, Homo sapiens
gaggcagccaaguaacgua

SEQ ID NO: 788608 - RNA, 19 nt, Homo sapiens
gguguacgugucugagauu

SEQ ID NO: 788609 - RNA, 19 nt, Homo sapiens
ccgcaggagugcauacaac

SEQ ID NO: 788610 - RNA, 19 nt, Homo sapiens
cagcggccaucauguuugc

SEQ ID NO: 788611 - RNA, 19 nt, Homo sapiens
ggcuguacauccacuuugg

SEQ ID NO: 788612 - RNA, 19 nt, Homo sapiens
cgucucagcggccaucaug

SEQ ID NO: 788613 - RNA, 19 nt, Homo sapiens
aaacuguguucacccuuuu

SEQ ID NO: 788614 - RNA, 19 nt, Homo sapiens
gggcuguacauccacuuug

SEQ ID NO: 788615 - RNA, 19 nt, Homo sapiens
gccgcaaggugcugcucuu

SEQ ID NO: 788616 - RNA, 19 nt, Homo sapiens
gagguggaggcugcaauga

SEQ ID NO: 788617 - RNA, 19 nt, Homo sapiens
aauuucagcuuuggguaug

SEQ ID NO: 788618 - RNA, 19 nt, Homo sapiens
gugccaugauccucaacga

SEQ ID NO: 788619 - RNA, 19 nt, Homo sapiens
caaaugaucuguacuuuag

SEQ ID NO: 788620 - RNA, 19 nt, Homo sapiens
gaaaguaggccaacagaaa

SEQ ID NO: 788621 - RNA, 19 nt, Homo sapiens
guaagaaacuggccucuga

SEQ ID NO: 788622 - RNA, 19 nt, Homo sapiens
gcagagacuucuucuauug

SEQ ID NO: 788623 - RNA, 19 nt, Homo sapiens
caacaaagauuccugauac

SEQ ID NO: 788624 - RNA, 19 nt, Homo sapiens
uaacaucguugccuacuuu

SEQ ID NO: 788625 - RNA, 19 nt, Homo sapiens
guacuuggcuguauguuau

SEQ ID NO: 788626 - RNA, 19 nt, Homo sapiens
aaugagggcucucuucuua

SEQ ID NO: 788627 - RNA, 19 nt, Homo sapiens
gaacugaagaugguauuua

SEQ ID NO: 788628 - RNA, 19 nt, Homo sapiens
gcaaaugaucuguacuuua

SEQ ID NO: 788629 - RNA, 19 nt, Homo sapiens
gcacuaugauuugcuuuaa

SEQ ID NO: 788630 - RNA, 19 nt, Homo sapiens
ggagagagauaccguuuua

SEQ ID NO: 788631 - RNA, 19 nt, Homo sapiens
gaacaggaauacccuaugg

SEQ ID NO: 788632 - RNA, 19 nt, Homo sapiens
aaacugaucucaaaugaca

SEQ ID NO: 788633 - RNA, 19 nt, Homo sapiens
acggacagcuucagaaaua

SEQ ID NO: 788634 - RNA, 19 nt, Homo sapiens
gcaguuagauuccauucau

SEQ ID NO: 788635 - RNA, 19 nt, Homo sapiens
ccacaaauguugcauaguc

SEQ ID NO: 788636 - RNA, 19 nt, Homo sapiens
gcggaucacuucaagauau

SEQ ID NO: 788637 - RNA, 19 nt, Homo sapiens
uaacacaguuggagagaga

SEQ ID NO: 788638 - RNA, 19 nt, Homo sapiens
gaacggacagcuucagaaa

SEQ ID NO: 788639 - RNA, 19 nt, Homo sapiens
gaucucaaaugacaggaaa

SEQ ID NO: 788640 - RNA, 19 nt, Homo sapiens
caaaggcacugaaucgaau

SEQ ID NO: 788641 - RNA, 19 nt, Homo sapiens
ggucuugccuauuugcaua

SEQ ID NO: 788642 - RNA, 19 nt, Homo sapiens
aauacaaacugcacuauga

SEQ ID NO: 788643 - RNA, 19 nt, Homo sapiens
gaaaugggauugucaucag

SEQ ID NO: 788644 - RNA, 19 nt, Homo sapiens
caucuuggcuggacaugaa

SEQ ID NO: 788645 - RNA, 19 nt, Homo sapiens
ccaaguccuuugaauguuu

SEQ ID NO: 788646 - RNA, 19 nt, Homo sapiens
gauaagcaguuacccugaa

SEQ ID NO: 788647 - RNA, 19 nt, Homo sapiens
agacccaaauuucauguua

SEQ ID NO: 788648 - RNA, 19 nt, Homo sapiens
cagauaaccacgcacauua

SEQ ID NO: 788649 - RNA, 19 nt, Homo sapiens
gcauagagauaucaaaggu

SEQ ID NO: 788650 - RNA, 19 nt, Homo sapiens
ccauguuacuggaccauua

SEQ ID NO: 788651 - RNA, 19 nt, Homo sapiens
aggauuagcugcccauauu

SEQ ID NO: 788652 - RNA, 19 nt, Homo sapiens
gaacuucagccaccuaugu

SEQ ID NO: 788653 - RNA, 19 nt, Homo sapiens
uacagggucuugccuauuu

SEQ ID NO: 788654 - RNA, 19 nt, Homo sapiens
agaaacugaucucaaauga

SEQ ID NO: 788655 - RNA, 19 nt, Homo sapiens
gcaaaggcacugaaucgaa

SEQ ID NO: 788656 - RNA, 19 nt, Homo sapiens
aacagaaacugaucucaaa

SEQ ID NO: 788657 - RNA, 19 nt, Homo sapiens
caaagauuccugauacaaa

SEQ ID NO: 788658 - RNA, 19 nt, Homo sapiens
gcucuacucucacaaucuu

SEQ ID NO: 788659 - RNA, 19 nt, Homo sapiens
gcaccacaguuaccacgaa

SEQ ID NO: 788660 - RNA, 19 nt, Homo sapiens
gcaguuacccugaagacaa

SEQ ID NO: 788661 - RNA, 19 nt, Homo sapiens
gaagaaugguggcuacaac

SEQ ID NO: 788662 - RNA, 19 nt, Homo sapiens
cgaaucagguaguucaguu

SEQ ID NO: 788663 - RNA, 19 nt, Homo sapiens
gaugguauuuacacacuga

SEQ ID NO: 788664 - RNA, 19 nt, Homo sapiens
gacagaccauggcgaugua

SEQ ID NO: 788665 - RNA, 19 nt, Homo sapiens
caaacgagacuucccuaaa

SEQ ID NO: 788666 - RNA, 19 nt, Homo sapiens
uggguuauauugcaaauga

SEQ ID NO: 788667 - RNA, 19 nt, Homo sapiens
caacagaaacugaucucaa

SEQ ID NO: 788668 - RNA, 19 nt, Homo sapiens
ggcagagacuucuucuauu

SEQ ID NO: 788669 - RNA, 19 nt, Homo sapiens
cccaggagauuucagauga

SEQ ID NO: 788670 - RNA, 19 nt, Homo sapiens
ggaauacccuauggucugu

SEQ ID NO: 788671 - RNA, 19 nt, Homo sapiens
gcagaaauucauguugaua

SEQ ID NO: 788672 - RNA, 19 nt, Homo sapiens
gguaugagccaaugcagaa

SEQ ID NO: 788673 - RNA, 19 nt, Homo sapiens
aaacgagacuucccuaaac

SEQ ID NO: 788674 - RNA, 19 nt, Homo sapiens
caaaauagcacuaaccaaa

SEQ ID NO: 788675 - RNA, 19 nt, Homo sapiens
aagcagagcuccccaaauu

SEQ ID NO: 788676 - RNA, 19 nt, Homo sapiens
ggacagcuucagaaauaaa

SEQ ID NO: 788677 - RNA, 19 nt, Homo sapiens
uaacagcuaccauugcaaa

SEQ ID NO: 788678 - RNA, 19 nt, Homo sapiens
ccauggcgauguaaaauua

SEQ ID NO: 788679 - RNA, 19 nt, Homo sapiens
ggccagaaauguacacaca

SEQ ID NO: 788680 - RNA, 19 nt, Homo sapiens
gaccgaauacuaccaagaa

SEQ ID NO: 788681 - RNA, 19 nt, Homo sapiens
gcaaauacuggcaaaucaa

SEQ ID NO: 788682 - RNA, 19 nt, Homo sapiens
aaagugaacaauccagaua

SEQ ID NO: 788683 - RNA, 19 nt, Homo sapiens
ggucaucaacauuccauaa

SEQ ID NO: 788684 - RNA, 19 nt, Homo sapiens
gauaucaaaggugcuaaua

SEQ ID NO: 788685 - RNA, 19 nt, Homo sapiens
uaucugggcaguaggaaua

SEQ ID NO: 788686 - RNA, 19 nt, Homo sapiens
gaauauacuccauugaaag

SEQ ID NO: 788687 - RNA, 19 nt, Homo sapiens
uuugauggcuguccuuuga

SEQ ID NO: 788688 - RNA, 19 nt, Homo sapiens
ccacgcacauuacacugaa

SEQ ID NO: 788689 - RNA, 19 nt, Homo sapiens
ugagggcucucuucuuaau

SEQ ID NO: 788690 - RNA, 19 nt, Homo sapiens
cgucauaccauuagaucua

SEQ ID NO: 788691 - RNA, 19 nt, Homo sapiens
cugaaagacuucugacuca

SEQ ID NO: 788692 - RNA, 19 nt, Homo sapiens
cagaguagcccaaguugug

SEQ ID NO: 788693 - RNA, 19 nt, Homo sapiens
caacuuuccggaugaagaa

SEQ ID NO: 788694 - RNA, 19 nt, Homo sapiens
gagaugaaaugggauuguc

SEQ ID NO: 788695 - RNA, 19 nt, Homo sapiens
gaaagacuucugacucaca

SEQ ID NO: 788696 - RNA, 19 nt, Homo sapiens
cccagaaguugcagcagua

SEQ ID NO: 788697 - RNA, 19 nt, Homo sapiens
cauugaaucuguaguaugc

SEQ ID NO: 788698 - RNA, 19 nt, Homo sapiens
uggcagagacuucuucuau

SEQ ID NO: 788699 - RNA, 19 nt, Homo sapiens
gagguuacccaggagauuu

SEQ ID NO: 788700 - RNA, 19 nt, Homo sapiens
gcacuuugauuuuccuuug

SEQ ID NO: 788701 - RNA, 19 nt, Homo sapiens
ccaagaaaauucgcuuuaa

SEQ ID NO: 788702 - RNA, 19 nt, Homo sapiens
cucacaaucuuauagcuuu

SEQ ID NO: 788703 - RNA, 19 nt, Homo sapiens
caugcaaucauucgucaua

SEQ ID NO: 788704 - RNA, 19 nt, Homo sapiens
gaacuguuagacaaaguga

SEQ ID NO: 788705 - RNA, 19 nt, Homo sapiens
aagaccaacugcugaaaga

SEQ ID NO: 788706 - RNA, 19 nt, Homo sapiens
acaaacugcacuaugauuu

SEQ ID NO: 788707 - RNA, 19 nt, Homo sapiens
gcacagccaggucucucua

SEQ ID NO: 788708 - RNA, 19 nt, Homo sapiens
ggaauaacagcaauugaac

SEQ ID NO: 788709 - RNA, 19 nt, Homo sapiens
aaaauuagcugacuuuggu

SEQ ID NO: 788710 - RNA, 19 nt, Homo sapiens
gccuauguaugcagagaaa

SEQ ID NO: 788711 - RNA, 19 nt, Homo sapiens
gcagccagcaguuagauuc

SEQ ID NO: 788712 - RNA, 19 nt, Homo sapiens
gaaucagguaguucaguuu

SEQ ID NO: 788713 - RNA, 19 nt, Homo sapiens
augcagaaauucauguuga

SEQ ID NO: 788714 - RNA, 19 nt, Homo sapiens
auaccucuguggagcuuua

SEQ ID NO: 788715 - RNA, 19 nt, Homo sapiens
aggcaacgauggaacaguu

SEQ ID NO: 788716 - RNA, 19 nt, Homo sapiens
gaaacagaagcacgagaug

SEQ ID NO: 788717 - RNA, 19 nt, Homo sapiens
cuauaaggccagaaaugua

SEQ ID NO: 788718 - RNA, 19 nt, Homo sapiens
aauaacagcuaccauugca

SEQ ID NO: 788719 - RNA, 19 nt, Homo sapiens
ggacacaccuccuccacuu

SEQ ID NO: 788720 - RNA, 19 nt, Homo sapiens
gagcuaacauccucaucaa

SEQ ID NO: 788721 - RNA, 19 nt, Homo sapiens
ugucagagcuccagauuag

SEQ ID NO: 788722 - RNA, 19 nt, Homo sapiens
gaugugcccuucucguaaa

SEQ ID NO: 788723 - RNA, 19 nt, Homo sapiens
caacaacguucucaugucu

SEQ ID NO: 788724 - RNA, 19 nt, Homo sapiens
ggaccacuaugaccugcua

SEQ ID NO: 788725 - RNA, 19 nt, Homo sapiens
ccaccaagaugcucaguca

SEQ ID NO: 788726 - RNA, 19 nt, Homo sapiens
ggacacaucccuccaccaa

SEQ ID NO: 788727 - RNA, 19 nt, Homo sapiens
ggacuucgcacaccugaga

SEQ ID NO: 788728 - RNA, 19 nt, Homo sapiens
ggaaauccucauauugaaa

SEQ ID NO: 788729 - RNA, 19 nt, Homo sapiens
caacaccgcucgccuacag

SEQ ID NO: 788730 - RNA, 19 nt, Homo sapiens
gcuaacauccucaucaaug

SEQ ID NO: 788731 - RNA, 19 nt, Homo sapiens
caaguuccguucuccauca

SEQ ID NO: 788732 - RNA, 19 nt, Homo sapiens
ggaaaggacccuccauugg

SEQ ID NO: 788733 - RNA, 19 nt, Homo sapiens
caggacaucuaccaaguga

SEQ ID NO: 788734 - RNA, 19 nt, Homo sapiens
ggaguuaucucugguugca

SEQ ID NO: 788735 - RNA, 19 nt, Homo sapiens
gcaaggaagaacaugguuu

SEQ ID NO: 788736 - RNA, 19 nt, Homo sapiens
gauggagccugaugaugau

SEQ ID NO: 788737 - RNA, 19 nt, Homo sapiens
guccucaucucccaauaaa

SEQ ID NO: 788738 - RNA, 19 nt, Homo sapiens
gggaaaggacccuccauug

SEQ ID NO: 788739 - RNA, 19 nt, Homo sapiens
ggacaucuaccaagugaca

SEQ ID NO: 788740 - RNA, 19 nt, Homo sapiens
agacgccucucuuucauug

SEQ ID NO: 788741 - RNA, 19 nt, Homo sapiens
ggaugugcccuucucguaa

SEQ ID NO: 788742 - RNA, 19 nt, Homo sapiens
gaagauggagccugaugau

SEQ ID NO: 788743 - RNA, 19 nt, Homo sapiens
gggaugugcccuucucgua

SEQ ID NO: 788744 - RNA, 19 nt, Homo sapiens
ucaugucucucucaggaaa

SEQ ID NO: 788745 - RNA, 19 nt, Homo sapiens
acaaugagcugugugacau

SEQ ID NO: 788746 - RNA, 19 nt, Homo sapiens
gaagggaggauacaaugag

SEQ ID NO: 788747 - RNA, 19 nt, Homo sapiens
ggagcuaacauccucauca

SEQ ID NO: 788748 - RNA, 19 nt, Homo sapiens
ucaggaagcuccgaggaau

SEQ ID NO: 788749 - RNA, 19 nt, Homo sapiens
gauacaaugagcuguguga

SEQ ID NO: 788750 - RNA, 19 nt, Homo sapiens
agauggagccugaugauga

SEQ ID NO: 788751 - RNA, 19 nt, Homo sapiens
caaggaagaacaugguuuc

SEQ ID NO: 788752 - RNA, 19 nt, Homo sapiens
ugaagauggugaagaugga

SEQ ID NO: 788753 - RNA, 19 nt, Homo sapiens
ccgaguagcugggauuaca

SEQ ID NO: 788754 - RNA, 19 nt, Homo sapiens
cgacgccucuguccguguu

SEQ ID NO: 788755 - RNA, 19 nt, Homo sapiens
gguaccagcccaugaacaa

SEQ ID NO: 788756 - RNA, 19 nt, Homo sapiens
gcacucacagaagaagaua

SEQ ID NO: 788757 - RNA, 19 nt, Homo sapiens
gcacugaagauggugaaga

SEQ ID NO: 788758 - RNA, 19 nt, Homo sapiens
ccucaucucccaauaaaca

SEQ ID NO: 788759 - RNA, 19 nt, Homo sapiens
ccagguagaggaagauaug

SEQ ID NO: 788760 - RNA, 19 nt, Homo sapiens
gaagauacacagggacauc

SEQ ID NO: 788761 - RNA, 19 nt, Homo sapiens
uauuugcacucacagaaga

SEQ ID NO: 788762 - RNA, 19 nt, Homo sapiens
caagauccaggacaccaaa

SEQ ID NO: 788763 - RNA, 19 nt, Homo sapiens
ucaacaacguucucauguc

SEQ ID NO: 788764 - RNA, 19 nt, Homo sapiens
caucaacaacguucucaug

SEQ ID NO: 788765 - RNA, 19 nt, Homo sapiens
aggaaaagaugaagagaaa

SEQ ID NO: 788766 - RNA, 19 nt, Homo sapiens
ccaggaagcaacugucaga

SEQ ID NO: 788767 - RNA, 19 nt, Homo sapiens
gagagacccuacccucacu

SEQ ID NO: 788768 - RNA, 19 nt, Homo sapiens
gggcaucacggccaucgaa

SEQ ID NO: 788769 - RNA, 19 nt, Homo sapiens
ugacccagguagaggaaga

SEQ ID NO: 788770 - RNA, 19 nt, Homo sapiens
ccagacgccucucuuucau

SEQ ID NO: 788771 - RNA, 19 nt, Homo sapiens
gccagacgccucucuuuca

SEQ ID NO: 788772 - RNA, 19 nt, Homo sapiens
cacugaagauggugaagau

SEQ ID NO: 788773 - RNA, 19 nt, Homo sapiens
ccagcaaccucuacaucca

SEQ ID NO: 788774 - RNA, 19 nt, Homo sapiens
cuacguggguguacuccau

SEQ ID NO: 788775 - RNA, 19 nt, Homo sapiens
ucguaaaguuguucaaugg

SEQ ID NO: 788776 - RNA, 19 nt, Homo sapiens
ggagacacgcccaguggau

SEQ ID NO: 788777 - RNA, 19 nt, Homo sapiens
agaggaagauauggugaug

SEQ ID NO: 788778 - RNA, 19 nt, Homo sapiens
gagacccuacccucacuuu

SEQ ID NO: 788779 - RNA, 19 nt, Homo sapiens
ccucaccgcccauucagaa

SEQ ID NO: 788780 - RNA, 19 nt, Homo sapiens
aaagagaccagagcaggaa

SEQ ID NO: 788781 - RNA, 19 nt, Homo sapiens
ggaugaggagcccgagcua

SEQ ID NO: 788782 - RNA, 19 nt, Homo sapiens
aagauauggugaugguguu

SEQ ID NO: 788783 - RNA, 19 nt, Homo sapiens
aggaagauauggugauggu

SEQ ID NO: 788784 - RNA, 19 nt, Homo sapiens
gaucuucuugacaaacuga

SEQ ID NO: 788785 - RNA, 19 nt, Homo sapiens
ugaagggaggauacaauga

SEQ ID NO: 788786 - RNA, 19 nt, Homo sapiens
ggaucugcauggaauucug

SEQ ID NO: 788787 - RNA, 19 nt, Homo sapiens
cuacagccaccgcucuuug

SEQ ID NO: 788788 - RNA, 19 nt, Homo sapiens
caucaagggagcuaacauc

SEQ ID NO: 788789 - RNA, 19 nt, Homo sapiens
cgucguggacccugacauu

SEQ ID NO: 788790 - RNA, 19 nt, Homo sapiens
gugcccuucucguaaaguu

SEQ ID NO: 788791 - RNA, 19 nt, Homo sapiens
ccaccucaccgcccauuca

SEQ ID NO: 788792 - RNA, 19 nt, Homo sapiens
agccaccgcucuuugaugu

SEQ ID NO: 788793 - RNA, 19 nt, Homo sapiens
cuuuaaggcucgagacaag

SEQ ID NO: 788794 - RNA, 19 nt, Homo sapiens
ucacagaagaagauacaca

SEQ ID NO: 788795 - RNA, 19 nt, Homo sapiens
caaccucuacauccaggaa

SEQ ID NO: 788796 - RNA, 19 nt, Homo sapiens
ggcacgaucucgccucacu

SEQ ID NO: 788797 - RNA, 19 nt, Homo sapiens
ugaagauggagccugauga

SEQ ID NO: 788798 - RNA, 19 nt, Homo sapiens
ggccagacgccucucuuuc

SEQ ID NO: 788799 - RNA, 19 nt, Homo sapiens
agacacgcccaguggauga

SEQ ID NO: 788800 - RNA, 19 nt, Homo sapiens
gaucugcauggaauucugu

SEQ ID NO: 788801 - RNA, 19 nt, Homo sapiens
gcucggaucagcugcuaca

SEQ ID NO: 788802 - RNA, 19 nt, Homo sapiens
guaccagcccaugaacaaa

SEQ ID NO: 788803 - RNA, 19 nt, Homo sapiens
cucguaaaguuguucaaug

SEQ ID NO: 788804 - RNA, 19 nt, Homo sapiens
gaaaagaugaagagaaagg

SEQ ID NO: 788805 - RNA, 19 nt, Homo sapiens
caacaucguggccuaccau

SEQ ID NO: 788806 - RNA, 19 nt, Homo sapiens
uuccacaacuucaucaaag

SEQ ID NO: 788807 - RNA, 19 nt, Homo sapiens
ggacaucaagggagcuaac

SEQ ID NO: 788808 - RNA, 19 nt, Homo sapiens
gacuuuagccucugcaaaa

SEQ ID NO: 788809 - RNA, 19 nt, Homo sapiens
ugccucagccucccgagua

SEQ ID NO: 788810 - RNA, 19 nt, Homo sapiens
ccucccagguucaagcaau

SEQ ID NO: 788811 - RNA, 19 nt, Homo sapiens
gugcaggugugggcucuag

SEQ ID NO: 788812 - RNA, 19 nt, Homo sapiens
ggccguggcuaugguugga

SEQ ID NO: 788813 - RNA, 19 nt, Homo sapiens
ggacuacguggguguacuc

SEQ ID NO: 788814 - RNA, 19 nt, Homo sapiens
uggcagcuguggcccugaa

SEQ ID NO: 788815 - RNA, 19 nt, Homo sapiens
cuggauggcuccggaagug

SEQ ID NO: 788816 - RNA, 19 nt, Homo sapiens
gauauggugaugguguuga

SEQ ID NO: 788817 - RNA, 19 nt, Homo sapiens
ggagccugaugaugauguc

SEQ ID NO: 788818 - RNA, 19 nt, Homo sapiens
acaacguucucaugucucu

SEQ ID NO: 788819 - RNA, 19 nt, Homo sapiens
gcacacaccuccacuuguu

SEQ ID NO: 788820 - RNA, 19 nt, Homo sapiens
gaugagagcuguugcugaa

SEQ ID NO: 788821 - RNA, 19 nt, Homo sapiens
gcucauaaaucuccuaaau

SEQ ID NO: 788822 - RNA, 19 nt, Homo sapiens
ggaacaugcuuaaucuaaa

SEQ ID NO: 788823 - RNA, 19 nt, Homo sapiens
gagucuaccuaauauguua

SEQ ID NO: 788824 - RNA, 19 nt, Homo sapiens
gagucuaccuaauauguua

SEQ ID NO: 788825 - RNA, 19 nt, Homo sapiens
ggagucagcuggaacauac

SEQ ID NO: 788826 - RNA, 19 nt, Homo sapiens
ugagagcuguugcugaaua

SEQ ID NO: 788827 - RNA, 19 nt, Homo sapiens
gggacuacuuggcuacuua

SEQ ID NO: 788828 - RNA, 19 nt, Homo sapiens
gaacaugcuuaaucuaaac

SEQ ID NO: 788829 - RNA, 19 nt, Homo sapiens
gagccacuguugucuguaa

SEQ ID NO: 788830 - RNA, 19 nt, Homo sapiens
gaacauaccacugccucua

SEQ ID NO: 788831 - RNA, 19 nt, Homo sapiens
gagagcuguugcugaauaa

SEQ ID NO: 788832 - RNA, 19 nt, Homo sapiens
gagcuacucugucaccaau

SEQ ID NO: 788833 - RNA, 19 nt, Homo sapiens
ccgagaugcugaaguuuaa

SEQ ID NO: 788834 - RNA, 19 nt, Homo sapiens
caccuccacuuguuauaua

SEQ ID NO: 788835 - RNA, 19 nt, Homo sapiens
gugcuuuggucaaggaaua

SEQ ID NO: 788836 - RNA, 19 nt, Homo sapiens
ccuaauauguuaaggacaa

SEQ ID NO: 788837 - RNA, 19 nt, Homo sapiens
ccuaauauguuaaggacaa

SEQ ID NO: 788838 - RNA, 19 nt, Homo sapiens
acacuaacauuccaucuuc

SEQ ID NO: 788839 - RNA, 19 nt, Homo sapiens
aggaauggaugcugucuaa

SEQ ID NO: 788840 - RNA, 19 nt, Homo sapiens
ccugugagcuggaaggaaa

SEQ ID NO: 788841 - RNA, 19 nt, Homo sapiens
gacauuggcucagguccua

SEQ ID NO: 788842 - RNA, 19 nt, Homo sapiens
gcacugaugugugguaguc

SEQ ID NO: 788843 - RNA, 19 nt, Homo sapiens
gaugcuggcuuugacauug

SEQ ID NO: 788844 - RNA, 19 nt, Homo sapiens
ccucugagucuaccuaaua

SEQ ID NO: 788845 - RNA, 19 nt, Homo sapiens
ucucugauuucaacacuaa

SEQ ID NO: 788846 - RNA, 19 nt, Homo sapiens
aaagguaauuguccugcua

SEQ ID NO: 788847 - RNA, 19 nt, Homo sapiens
gaauggaugcugucuaaca

SEQ ID NO: 788848 - RNA, 19 nt, Homo sapiens
gcucagguccuaccaucua

SEQ ID NO: 788849 - RNA, 19 nt, Homo sapiens
ugagagagcuaguguaagc

SEQ ID NO: 788850 - RNA, 19 nt, Homo sapiens
cuucugaaauucugagauu

SEQ ID NO: 788851 - RNA, 19 nt, Homo sapiens
gccgagaugcugaaguuua

SEQ ID NO: 788852 - RNA, 19 nt, Homo sapiens
gauccuaggaguggaauuu

SEQ ID NO: 788853 - RNA, 19 nt, Homo sapiens
cauuccaucuucugaaauu

SEQ ID NO: 788854 - RNA, 19 nt, Homo sapiens
ccaaagugcugggauuaca

SEQ ID NO: 788855 - RNA, 19 nt, Homo sapiens
cuacuuggcuacuuacuac

SEQ ID NO: 788856 - RNA, 19 nt, Homo sapiens
caccaaugcugccaacaau

SEQ ID NO: 788857 - RNA, 19 nt, Homo sapiens
gggaggagcuggaaaagug

SEQ ID NO: 788858 - RNA, 19 nt, Homo sapiens
gagccaaagcuguccguuu

SEQ ID NO: 788859 - RNA, 19 nt, Homo sapiens
aaccagcucuguaaaggaa

SEQ ID NO: 788860 - RNA, 19 nt, Homo sapiens
caaggaaaccucugagucu

SEQ ID NO: 788861 - RNA, 19 nt, Homo sapiens
guaauuguccugcuaaugc

SEQ ID NO: 788862 - RNA, 19 nt, Homo sapiens
gaugugcuuuggucaagga

SEQ ID NO: 788863 - RNA, 19 nt, Homo sapiens
auaaccagcucauaaaucu

SEQ ID NO: 788864 - RNA, 19 nt, Homo sapiens
caccacacccagcuaauuu

SEQ ID NO: 788865 - RNA, 19 nt, Homo sapiens
aaaaguggcugaagaagga

SEQ ID NO: 788866 - RNA, 19 nt, Homo sapiens
ucuauaaccagcucuguaa

SEQ ID NO: 788867 - RNA, 19 nt, Homo sapiens
cgaucugacuccuguguga

SEQ ID NO: 788868 - RNA, 19 nt, Homo sapiens
uggaacaugcuuaaucuaa

SEQ ID NO: 788869 - RNA, 19 nt, Homo sapiens
gggacacgcugauugacau

SEQ ID NO: 788870 - RNA, 19 nt, Homo sapiens
ugaagcgggugcucaagug

SEQ ID NO: 788871 - RNA, 19 nt, Homo sapiens
gucuaacagucucugauuu

SEQ ID NO: 788872 - RNA, 19 nt, Homo sapiens
ugugagagagcuaguguaa

SEQ ID NO: 788873 - RNA, 19 nt, Homo sapiens
aaggaaaccucugagucua

SEQ ID NO: 788874 - RNA, 19 nt, Homo sapiens
uaaccuguuuguguaaguu

SEQ ID NO: 788875 - RNA, 19 nt, Homo sapiens
ucuggacagugguauauug

SEQ ID NO: 788876 - RNA, 19 nt, Homo sapiens
aacauuccaucuucugaaa

SEQ ID NO: 788877 - RNA, 19 nt, Homo sapiens
uaacauuccaucuucugaa

SEQ ID NO: 788878 - RNA, 19 nt, Homo sapiens
gggaggagaaggaggagaa

SEQ ID NO: 788879 - RNA, 19 nt, Homo sapiens
aggccgagaugcugaaguu

SEQ ID NO: 788880 - RNA, 19 nt, Homo sapiens
gaaauucugagauucuaac

SEQ ID NO: 788881 - RNA, 19 nt, Homo sapiens
cuaacagucucugauuuca

SEQ ID NO: 788882 - RNA, 19 nt, Homo sapiens
uaaauacucccaccauggu

SEQ ID NO: 788883 - RNA, 19 nt, Homo sapiens
gguagucaccaauuucugu

SEQ ID NO: 788884 - RNA, 19 nt, Homo sapiens
auucugagauucuaacauc

SEQ ID NO: 788885 - RNA, 19 nt, Homo sapiens
gauuucaacacuaacauuc

SEQ ID NO: 788886 - RNA, 19 nt, Homo sapiens
cauuguggcucgcaagaag

SEQ ID NO: 788887 - RNA, 19 nt, Homo sapiens
ggucugagccacuguuguc

SEQ ID NO: 788888 - RNA, 19 nt, Homo sapiens
uguccuggaugcuggcuuu

SEQ ID NO: 788889 - RNA, 19 nt, Homo sapiens
aguguaagcuguugaugag

SEQ ID NO: 788890 - RNA, 19 nt, Homo sapiens
agacggaguuucgcucugu

SEQ ID NO: 788891 - RNA, 19 nt, Homo sapiens
ccaccacacccagcuaauu

SEQ ID NO: 788892 - RNA, 19 nt, Homo sapiens
uuagcuggguguccuguau

SEQ ID NO: 788893 - RNA, 19 nt, Homo sapiens
cugaaauucugagauucua

SEQ ID NO: 788894 - RNA, 19 nt, Homo sapiens
ggacagugugagagagcua

SEQ ID NO: 788895 - RNA, 19 nt, Homo sapiens
ccaaugcugccaacaaugg

SEQ ID NO: 788896 - RNA, 19 nt, Homo sapiens
uuaagcugcugacccugaa

SEQ ID NO: 788897 - RNA, 19 nt, Homo sapiens
accacugccucuagacuaa

SEQ ID NO: 788898 - RNA, 19 nt, Homo sapiens
aaggaaaccucuggacagu

SEQ ID NO: 788899 - RNA, 19 nt, Homo sapiens
ucaccaaugcugccaacaa

SEQ ID NO: 788900 - RNA, 19 nt, Homo sapiens
gcuacucugucaccaaugc

SEQ ID NO: 788901 - RNA, 19 nt, Homo sapiens
agccaaagcuguccguuuu

SEQ ID NO: 788902 - RNA, 19 nt, Homo sapiens
ccuaccaucuaccaaguuc

SEQ ID NO: 788903 - RNA, 19 nt, Homo sapiens
ggacacgcugauugacauu

SEQ ID NO: 788904 - RNA, 19 nt, Homo sapiens
ggacgugguuuuagagucu

SEQ ID NO: 788905 - RNA, 19 nt, Homo sapiens
gagauucuaacauccuugu

SEQ ID NO: 788906 - RNA, 19 nt, Homo sapiens
acauaccacugccucuaga

SEQ ID NO: 788907 - RNA, 19 nt, Homo sapiens
uaacagucucugauuucaa

SEQ ID NO: 788908 - RNA, 19 nt, Homo sapiens
gaggaauggaugcugucua

SEQ ID NO: 788909 - RNA, 19 nt, Homo sapiens
ggaugcuggcuuugacauu

SEQ ID NO: 788910 - RNA, 19 nt, Homo sapiens
uaguguaagcuguugauga

SEQ ID NO: 788911 - RNA, 19 nt, Homo sapiens
gaauaggccaaggcagaga

SEQ ID NO: 788912 - RNA, 19 nt, Homo sapiens
guccuggguugacgccauu

SEQ ID NO: 788913 - RNA, 19 nt, Homo sapiens
cggugaaauucgccuguga

SEQ ID NO: 788914 - RNA, 19 nt, Homo sapiens
ccaacauuccucauucuag

SEQ ID NO: 788915 - RNA, 19 nt, Homo sapiens
uuuccaacauuccucauuc

SEQ ID NO: 788916 - RNA, 19 nt, Homo sapiens
ugucuaacagucucugauu

SEQ ID NO: 788917 - RNA, 19 nt, Homo sapiens
gcucacgcccagagagaga

SEQ ID NO: 788918 - RNA, 19 nt, Homo sapiens
gguaauuguccugcuaaug

SEQ ID NO: 788919 - RNA, 19 nt, Homo sapiens
cuacauaacuuccuacgua

SEQ ID NO: 788920 - RNA, 19 nt, Homo sapiens
guucauaccuuauuugcua

SEQ ID NO: 788921 - RNA, 19 nt, Homo sapiens
acagaagucuccucaauuu

SEQ ID NO: 788922 - RNA, 19 nt, Homo sapiens
ggagacaccugaccuuucu

SEQ ID NO: 788923 - RNA, 19 nt, Homo sapiens
ugaauguggucucaggaua

SEQ ID NO: 788924 - RNA, 19 nt, Homo sapiens
gcaagaagccacccuccuu

SEQ ID NO: 788925 - RNA, 19 nt, Homo sapiens
ggaaugagcccagagaaca

SEQ ID NO: 788926 - RNA, 19 nt, Homo sapiens
ggaagcuguuggaugauga

SEQ ID NO: 788927 - RNA, 19 nt, Homo sapiens
caaggacgguucuuacaca

SEQ ID NO: 788928 - RNA, 19 nt, Homo sapiens
gugaauguauguaaugugu

SEQ ID NO: 788929 - RNA, 19 nt, Homo sapiens
gccagauccugcagaagua

SEQ ID NO: 788930 - RNA, 19 nt, Homo sapiens
aagcugagauugagcagaa

SEQ ID NO: 788931 - RNA, 19 nt, Homo sapiens
ccaagugcgugccguguga

SEQ ID NO: 788932 - RNA, 19 nt, Homo sapiens
cagcaugccugaacuacau

SEQ ID NO: 788933 - RNA, 19 nt, Homo sapiens
caacagcaaccucuucaug

SEQ ID NO: 788934 - RNA, 19 nt, Homo sapiens
ggaguacaaugcccagauc

SEQ ID NO: 788935 - RNA, 19 nt, Homo sapiens
ugaacuacauaacuuccua

SEQ ID NO: 788936 - RNA, 19 nt, Homo sapiens
gacagaagucuccucaauu

SEQ ID NO: 788937 - RNA, 19 nt, Homo sapiens
gaucuugaauguggucuca

SEQ ID NO: 788938 - RNA, 19 nt, Homo sapiens
gaauguggucucaggauau

SEQ ID NO: 788939 - RNA, 19 nt, Homo sapiens
ugacaaggcccugagcuuu

SEQ ID NO: 788940 - RNA, 19 nt, Homo sapiens
ugcggaagcuguuggauga

SEQ ID NO: 788941 - RNA, 19 nt, Homo sapiens
agcagaagaucaaggagua

SEQ ID NO: 788942 - RNA, 19 nt, Homo sapiens
caguacagcaugugccuua

SEQ ID NO: 788943 - RNA, 19 nt, Homo sapiens
ugaagugcgugaauguaug

SEQ ID NO: 788944 - RNA, 19 nt, Homo sapiens
gacaaggcccugagcuuug

SEQ ID NO: 788945 - RNA, 19 nt, Homo sapiens
gaauaaggcaggcauugag

SEQ ID NO: 788946 - RNA, 19 nt, Homo sapiens
gcccaaggaugcugucaag

SEQ ID NO: 788947 - RNA, 19 nt, Homo sapiens
ggagugcuggcucacagua

SEQ ID NO: 788948 - RNA, 19 nt, Homo sapiens
gaggaaagguuuuggaucu

SEQ ID NO: 788949 - RNA, 19 nt, Homo sapiens
ggugacggcccucaucuau

SEQ ID NO: 788950 - RNA, 19 nt, Homo sapiens
gaagugcgugaauguaugu

SEQ ID NO: 788951 - RNA, 19 nt, Homo sapiens
uggagacccugcaaacaga

SEQ ID NO: 788952 - RNA, 19 nt, Homo sapiens
gaucaacagcaaccucuuc

SEQ ID NO: 788953 - RNA, 19 nt, Homo sapiens
gaagaucaaggaguacaau

SEQ ID NO: 788954 - RNA, 19 nt, Homo sapiens
uacagcaugugccuuaaug

SEQ ID NO: 788955 - RNA, 19 nt, Homo sapiens
aaacagaacagggucaugu

SEQ ID NO: 788956 - RNA, 19 nt, Homo sapiens
caggaguggugcagacaga

SEQ ID NO: 788957 - RNA, 19 nt, Homo sapiens
gugcgugaauguauguaau

SEQ ID NO: 788958 - RNA, 19 nt, Homo sapiens
cgaccucuguggcgacuuc

SEQ ID NO: 788959 - RNA, 19 nt, Homo sapiens
cugcagaaguacuccuauu

SEQ ID NO: 788960 - RNA, 19 nt, Homo sapiens
ugccugaacuacauaacuu

SEQ ID NO: 788961 - RNA, 19 nt, Homo sapiens
gccuuaaugcuucauauga

SEQ ID NO: 788962 - RNA, 19 nt, Homo sapiens
ggaaagguuuuggaucuug

SEQ ID NO: 788963 - RNA, 19 nt, Homo sapiens
uacauaacuuccuacguau

SEQ ID NO: 788964 - RNA, 19 nt, Homo sapiens
gaaagguuuuggaucuuga

SEQ ID NO: 788965 - RNA, 19 nt, Homo sapiens
caaguucaccugccacuac

SEQ ID NO: 788966 - RNA, 19 nt, Homo sapiens
gcagaaguacuccuauugc

SEQ ID NO: 788967 - RNA, 19 nt, Homo sapiens
gcccaaagccagcgaagca

SEQ ID NO: 788968 - RNA, 19 nt, Homo sapiens
gagauugagcagaagauca

SEQ ID NO: 788969 - RNA, 19 nt, Homo sapiens
gccagggucugugugaaug

SEQ ID NO: 788970 - RNA, 19 nt, Homo sapiens
gggugggugcucagaauaa

SEQ ID NO: 788971 - RNA, 19 nt, Homo sapiens
gagcgucacggccaagugu

SEQ ID NO: 788972 - RNA, 19 nt, Homo sapiens
gggagacaccugaccuuuc

SEQ ID NO: 788973 - RNA, 19 nt, Homo sapiens
acacaggcuucaucaaggu

SEQ ID NO: 788974 - RNA, 19 nt, Homo sapiens
aggcaggcauugaggaaga

SEQ ID NO: 788975 - RNA, 19 nt, Homo sapiens
gagaacagcgaaguagcuu

SEQ ID NO: 788976 - RNA, 19 nt, Homo sapiens
aagggcacgugaagucauu

SEQ ID NO: 788977 - RNA, 19 nt, Homo sapiens
gcgugaauguauguaaugu

SEQ ID NO: 788978 - RNA, 19 nt, Homo sapiens
guacagcaugugccuuaau

SEQ ID NO: 788979 - RNA, 19 nt, Homo sapiens
gagucuugguuucucucua

SEQ ID NO: 788980 - RNA, 19 nt, Homo sapiens
uaaggcaggcauugaggaa

SEQ ID NO: 788981 - RNA, 19 nt, Homo sapiens
cagaauaaggcaggcauug

SEQ ID NO: 788982 - RNA, 19 nt, Homo sapiens
gugccuuaaugcuucauau

SEQ ID NO: 788983 - RNA, 19 nt, Homo sapiens
agaauaaggcaggcauuga

SEQ ID NO: 788984 - RNA, 19 nt, Homo sapiens
caucuaugaggaaagguuu

SEQ ID NO: 788985 - RNA, 19 nt, Homo sapiens
gcaccccucugcccucauu

SEQ ID NO: 788986 - RNA, 19 nt, Homo sapiens
ccagagaacagcgaaguag

SEQ ID NO: 788987 - RNA, 19 nt, Homo sapiens
cggaagcuguuggaugaug

SEQ ID NO: 788988 - RNA, 19 nt, Homo sapiens
uuacacaggcuucaucaag

SEQ ID NO: 788989 - RNA, 19 nt, Homo sapiens
acagcaaccucuucaugag

SEQ ID NO: 788990 - RNA, 19 nt, Homo sapiens
gcacaagggcacgugaagu

SEQ ID NO: 788991 - RNA, 19 nt, Homo sapiens
ucugugcccuccagcaaga

SEQ ID NO: 788992 - RNA, 19 nt, Homo sapiens
gcaaguucaccugccacua

SEQ ID NO: 788993 - RNA, 19 nt, Homo sapiens
aagggugggugcucagaau

SEQ ID NO: 788994 - RNA, 19 nt, Homo sapiens
guacaaugcccagaucaac

SEQ ID NO: 788995 - RNA, 19 nt, Homo sapiens
gugcgcgcauugcaaguuc

SEQ ID NO: 788996 - RNA, 19 nt, Homo sapiens
aacagcaaccucuucauga

SEQ ID NO: 788997 - RNA, 19 nt, Homo sapiens
uugaggcccugcugcgaaa

SEQ ID NO: 788998 - RNA, 19 nt, Homo sapiens
ccuuaaugcuucauaugag

SEQ ID NO: 788999 - RNA, 19 nt, Homo sapiens
ggugggugcucagaauaag

SEQ ID NO: 789000 - RNA, 19 nt, Homo sapiens
gcaaccucuucaugagcuu

SEQ ID NO: 789001 - RNA, 19 nt, Homo sapiens
gggccagggucugugugaa

SEQ ID NO: 789002 - RNA, 19 nt, Homo sapiens
ggacggggcacaaguguca

SEQ ID NO: 789003 - RNA, 19 nt, Homo sapiens
gguuuuggaucuugaaugu

SEQ ID NO: 789004 - RNA, 19 nt, Homo sapiens
ggagacccugcaaacagaa

SEQ ID NO: 789005 - RNA, 19 nt, Homo sapiens
gaaugagcccagagaacag

SEQ ID NO: 789006 - RNA, 19 nt, Homo sapiens
cacaagggcacgugaaguc

SEQ ID NO: 789007 - RNA, 19 nt, Homo sapiens
uaugaagugcgugaaugua

SEQ ID NO: 789008 - RNA, 19 nt, Homo sapiens
uuuaugaagugcgugaaug

SEQ ID NO: 789009 - RNA, 19 nt, Homo sapiens
ggccagggucugugugaau

SEQ ID NO: 789010 - RNA, 19 nt, Homo sapiens
gcaaacagaacagggucau

SEQ ID NO: 789011 - RNA, 19 nt, Homo sapiens
cgccagauccugcagaagu

SEQ ID NO: 789012 - RNA, 19 nt, Homo sapiens
gcaugccugaacuacauaa

SEQ ID NO: 789013 - RNA, 19 nt, Homo sapiens
caaguuugcacucuuugag

SEQ ID NO: 789014 - RNA, 19 nt, Homo sapiens
gaaagggguuggggugaca

SEQ ID NO: 789015 - RNA, 19 nt, Homo sapiens
gugguggccucagcugaau

SEQ ID NO: 789016 - RNA, 19 nt, Homo sapiens
gcucaauaaagauuucaag

SEQ ID NO: 789017 - RNA, 19 nt, Homo sapiens
ucucagaagugaaaaucuu

SEQ ID NO: 789018 - RNA, 19 nt, Homo sapiens
cuacauaacuuccuacgua

SEQ ID NO: 789019 - RNA, 19 nt, Homo sapiens
guucauaccuuauuugcua

SEQ ID NO: 789020 - RNA, 19 nt, Homo sapiens
acagaagucuccucaauuu

SEQ ID NO: 789021 - RNA, 19 nt, Homo sapiens
ggagacaccugaccuuucu

SEQ ID NO: 789022 - RNA, 19 nt, Homo sapiens
ugaauguggucucaggaua

SEQ ID NO: 789023 - RNA, 19 nt, Homo sapiens
gcaagaagccacccuccuu

SEQ ID NO: 789024 - RNA, 19 nt, Homo sapiens
ggaaugagcccagagaaca

SEQ ID NO: 789025 - RNA, 19 nt, Homo sapiens
ggaagcuguuggaugauga

SEQ ID NO: 789026 - RNA, 19 nt, Homo sapiens
caaggacgguucuuacaca

SEQ ID NO: 789027 - RNA, 19 nt, Homo sapiens
gugaauguauguaaugugu

SEQ ID NO: 789028 - RNA, 19 nt, Homo sapiens
gccagauccugcagaagua

SEQ ID NO: 789029 - RNA, 19 nt, Homo sapiens
aagcugagauugagcagaa

SEQ ID NO: 789030 - RNA, 19 nt, Homo sapiens
ccaagugcgugccguguga

SEQ ID NO: 789031 - RNA, 19 nt, Homo sapiens
cagcaugccugaacuacau

SEQ ID NO: 789032 - RNA, 19 nt, Homo sapiens
caacagcaaccucuucaug

SEQ ID NO: 789033 - RNA, 19 nt, Homo sapiens
ggaguacaaugcccagauc

SEQ ID NO: 789034 - RNA, 19 nt, Homo sapiens
ugaacuacauaacuuccua

SEQ ID NO: 789035 - RNA, 19 nt, Homo sapiens
gacagaagucuccucaauu

SEQ ID NO: 789036 - RNA, 19 nt, Homo sapiens
gaucuugaauguggucuca

SEQ ID NO: 789037 - RNA, 19 nt, Homo sapiens
gaauguggucucaggauau

SEQ ID NO: 789038 - RNA, 19 nt, Homo sapiens
ugacaaggcccugagcuuu

SEQ ID NO: 789039 - RNA, 19 nt, Homo sapiens
ugcggaagcuguuggauga

SEQ ID NO: 789040 - RNA, 19 nt, Homo sapiens
agcagaagaucaaggagua

SEQ ID NO: 789041 - RNA, 19 nt, Homo sapiens
caguacagcaugugccuua

SEQ ID NO: 789042 - RNA, 19 nt, Homo sapiens
ugaagugcgugaauguaug

SEQ ID NO: 789043 - RNA, 19 nt, Homo sapiens
gacaaggcccugagcuuug

SEQ ID NO: 789044 - RNA, 19 nt, Homo sapiens
gaauaaggcaggcauugag

SEQ ID NO: 789045 - RNA, 19 nt, Homo sapiens
gcccaaggaugcugucaag

SEQ ID NO: 789046 - RNA, 19 nt, Homo sapiens
gcccagguggccaacauua

SEQ ID NO: 789047 - RNA, 19 nt, Homo sapiens
ggagugcuggcucacagua

SEQ ID NO: 789048 - RNA, 19 nt, Homo sapiens
gaggaaagguuuuggaucu

SEQ ID NO: 789049 - RNA, 19 nt, Homo sapiens
ggugacggcccucaucuau

SEQ ID NO: 789050 - RNA, 19 nt, Homo sapiens
gaagugcgugaauguaugu

SEQ ID NO: 789051 - RNA, 19 nt, Homo sapiens
uggagacccugcaaacaga

SEQ ID NO: 789052 - RNA, 19 nt, Homo sapiens
gaucaacagcaaccucuuc

SEQ ID NO: 789053 - RNA, 19 nt, Homo sapiens
gaagaucaaggaguacaau

SEQ ID NO: 789054 - RNA, 19 nt, Homo sapiens
agugugagauugcaaguuc

SEQ ID NO: 789055 - RNA, 19 nt, Homo sapiens
uacagcaugugccuuaaug

SEQ ID NO: 789056 - RNA, 19 nt, Homo sapiens
aaacagaacagggucaugu

SEQ ID NO: 789057 - RNA, 19 nt, Homo sapiens
caggaguggugcagacaga

SEQ ID NO: 789058 - RNA, 19 nt, Homo sapiens
gugcgugaauguauguaau

SEQ ID NO: 789059 - RNA, 19 nt, Homo sapiens
cugcagaaguacuccuauu

SEQ ID NO: 789060 - RNA, 19 nt, Homo sapiens
ugccugaacuacauaacuu

SEQ ID NO: 789061 - RNA, 19 nt, Homo sapiens
gccuuaaugcuucauauga

SEQ ID NO: 789062 - RNA, 19 nt, Homo sapiens
ccagguggccaacauuaga

SEQ ID NO: 789063 - RNA, 19 nt, Homo sapiens
ggaaagguuuuggaucuug

SEQ ID NO: 789064 - RNA, 19 nt, Homo sapiens
uacauaacuuccuacguau

SEQ ID NO: 789065 - RNA, 19 nt, Homo sapiens
gaaagguuuuggaucuuga

SEQ ID NO: 789066 - RNA, 19 nt, Homo sapiens
gcagaaguacuccuauugc

SEQ ID NO: 789067 - RNA, 19 nt, Homo sapiens
caaguucaccugccacuac

SEQ ID NO: 789068 - RNA, 19 nt, Homo sapiens
gccagggucugugugaaug

SEQ ID NO: 789069 - RNA, 19 nt, Homo sapiens
gagauugagcagaagauca

SEQ ID NO: 789070 - RNA, 19 nt, Homo sapiens
gggugggugcucagaauaa

SEQ ID NO: 789071 - RNA, 19 nt, Homo sapiens
gcguagcagugugagauug

SEQ ID NO: 789072 - RNA, 19 nt, Homo sapiens
gagcgucacggccaagugu

SEQ ID NO: 789073 - RNA, 19 nt, Homo sapiens
gggagacaccugaccuuuc

SEQ ID NO: 789074 - RNA, 19 nt, Homo sapiens
acacaggcuucaucaaggu

SEQ ID NO: 789075 - RNA, 19 nt, Homo sapiens
aggcaggcauugaggaaga

SEQ ID NO: 789076 - RNA, 19 nt, Homo sapiens
gagaacagcgaaguagcuu

SEQ ID NO: 789077 - RNA, 19 nt, Homo sapiens
aagggcacgugaagucauu

SEQ ID NO: 789078 - RNA, 19 nt, Homo sapiens
gcgugaauguauguaaugu

SEQ ID NO: 789079 - RNA, 19 nt, Homo sapiens
guacagcaugugccuuaau

SEQ ID NO: 789080 - RNA, 19 nt, Homo sapiens
gagucuugguuucucucua

SEQ ID NO: 789081 - RNA, 19 nt, Homo sapiens
uaaggcaggcauugaggaa

SEQ ID NO: 789082 - RNA, 19 nt, Homo sapiens
cagaauaaggcaggcauug

SEQ ID NO: 789083 - RNA, 19 nt, Homo sapiens
gugccuuaaugcuucauau

SEQ ID NO: 789084 - RNA, 19 nt, Homo sapiens
agaauaaggcaggcauuga

SEQ ID NO: 789085 - RNA, 19 nt, Homo sapiens
acagcaaccucuucaugag

SEQ ID NO: 789086 - RNA, 19 nt, Homo sapiens
caucuaugaggaaagguuu

SEQ ID NO: 789087 - RNA, 19 nt, Homo sapiens
gcaccccucugcccucauu

SEQ ID NO: 789088 - RNA, 19 nt, Homo sapiens
ccagagaacagcgaaguag

SEQ ID NO: 789089 - RNA, 19 nt, Homo sapiens
cggaagcuguuggaugaug

SEQ ID NO: 789090 - RNA, 19 nt, Homo sapiens
gcacaagggcacgugaagu

SEQ ID NO: 789091 - RNA, 19 nt, Homo sapiens
ucugugcccuccagcaaga

SEQ ID NO: 789092 - RNA, 19 nt, Homo sapiens
uuacacaggcuucaucaag

SEQ ID NO: 789093 - RNA, 19 nt, Homo sapiens
aagggugggugcucagaau

SEQ ID NO: 789094 - RNA, 19 nt, Homo sapiens
gcaaguucaccugccacua

SEQ ID NO: 789095 - RNA, 19 nt, Homo sapiens
aacagcaaccucuucauga

SEQ ID NO: 789096 - RNA, 19 nt, Homo sapiens
guacaaugcccagaucaac

SEQ ID NO: 789097 - RNA, 19 nt, Homo sapiens
uugaggcccugcugcgaaa

SEQ ID NO: 789098 - RNA, 19 nt, Homo sapiens
ccuuaaugcuucauaugag

SEQ ID NO: 789099 - RNA, 19 nt, Homo sapiens
ggugggugcucagaauaag

SEQ ID NO: 789100 - RNA, 19 nt, Homo sapiens
gggccagggucugugugaa

SEQ ID NO: 789101 - RNA, 19 nt, Homo sapiens
gcaaccucuucaugagcuu

SEQ ID NO: 789102 - RNA, 19 nt, Homo sapiens
gguuuuggaucuugaaugu

SEQ ID NO: 789103 - RNA, 19 nt, Homo sapiens
ggagacccugcaaacagaa

SEQ ID NO: 789104 - RNA, 19 nt, Homo sapiens
gaaugagcccagagaacag

SEQ ID NO: 789105 - RNA, 19 nt, Homo sapiens
cacaagggcacgugaaguc

SEQ ID NO: 789106 - RNA, 19 nt, Homo sapiens
ggacggggcacaaguguca

SEQ ID NO: 789107 - RNA, 19 nt, Homo sapiens
uaugaagugcgugaaugua

SEQ ID NO: 789108 - RNA, 19 nt, Homo sapiens
uuuaugaagugcgugaaug

SEQ ID NO: 789109 - RNA, 19 nt, Homo sapiens
ggccagggucugugugaau

SEQ ID NO: 789110 - RNA, 19 nt, Homo sapiens
gcaaacagaacagggucau

SEQ ID NO: 789111 - RNA, 19 nt, Homo sapiens
cgccagauccugcagaagu

SEQ ID NO: 789112 - RNA, 19 nt, Homo sapiens
gcaugccugaacuacauaa

SEQ ID NO: 789113 - RNA, 19 nt, Homo sapiens
caaguuugcacucuuugag

SEQ ID NO: 789114 - RNA, 19 nt, Homo sapiens
gaaagggguuggggugaca

SEQ ID NO: 789115 - RNA, 19 nt, Homo sapiens
gugguggccucagcugaau

SEQ ID NO: 789116 - RNA, 19 nt, Homo sapiens
gcucaauaaagauuucaag

SEQ ID NO: 789117 - RNA, 19 nt, Homo sapiens
ucucagaagugaaaaucuu

SEQ ID NO: 789118 - RNA, 19 nt, Homo sapiens
cuacauaacuuccuacgua

SEQ ID NO: 789119 - RNA, 19 nt, Homo sapiens
guucauaccuuauuugcua

SEQ ID NO: 789120 - RNA, 19 nt, Homo sapiens
acagaagucuccucaauuu

SEQ ID NO: 789121 - RNA, 19 nt, Homo sapiens
ggagacaccugaccuuucu

SEQ ID NO: 789122 - RNA, 19 nt, Homo sapiens
ugaauguggucucaggaua

SEQ ID NO: 789123 - RNA, 19 nt, Homo sapiens
gcaagaagccacccuccuu

SEQ ID NO: 789124 - RNA, 19 nt, Homo sapiens
ggaggcgccuucuuucgaa

SEQ ID NO: 789125 - RNA, 19 nt, Homo sapiens
ggaaugagcccagagaaca

SEQ ID NO: 789126 - RNA, 19 nt, Homo sapiens
ggaagcuguuggaugauga

SEQ ID NO: 789127 - RNA, 19 nt, Homo sapiens
caaggacgguucuuacaca

SEQ ID NO: 789128 - RNA, 19 nt, Homo sapiens
gugaauguauguaaugugu

SEQ ID NO: 789129 - RNA, 19 nt, Homo sapiens
gccagauccugcagaagua

SEQ ID NO: 789130 - RNA, 19 nt, Homo sapiens
aagcugagauugagcagaa

SEQ ID NO: 789131 - RNA, 19 nt, Homo sapiens
ccaagugcgugccguguga

SEQ ID NO: 789132 - RNA, 19 nt, Homo sapiens
cagcaugccugaacuacau

SEQ ID NO: 789133 - RNA, 19 nt, Homo sapiens
caacagcaaccucuucaug

SEQ ID NO: 789134 - RNA, 19 nt, Homo sapiens
ggaguacaaugcccagauc

SEQ ID NO: 789135 - RNA, 19 nt, Homo sapiens
ugaacuacauaacuuccua

SEQ ID NO: 789136 - RNA, 19 nt, Homo sapiens
gacagaagucuccucaauu

SEQ ID NO: 789137 - RNA, 19 nt, Homo sapiens
gaucuugaauguggucuca

SEQ ID NO: 789138 - RNA, 19 nt, Homo sapiens
gaauguggucucaggauau

SEQ ID NO: 789139 - RNA, 19 nt, Homo sapiens
ugacaaggcccugagcuuu

SEQ ID NO: 789140 - RNA, 19 nt, Homo sapiens
ugcggaagcuguuggauga

SEQ ID NO: 789141 - RNA, 19 nt, Homo sapiens
agcagaagaucaaggagua

SEQ ID NO: 789142 - RNA, 19 nt, Homo sapiens
caguacagcaugugccuua

SEQ ID NO: 789143 - RNA, 19 nt, Homo sapiens
ugaagugcgugaauguaug

SEQ ID NO: 789144 - RNA, 19 nt, Homo sapiens
gacaaggcccugagcuuug

SEQ ID NO: 789145 - RNA, 19 nt, Homo sapiens
gaauaaggcaggcauugag

SEQ ID NO: 789146 - RNA, 19 nt, Homo sapiens
gcccaaggaugcugucaag

SEQ ID NO: 789147 - RNA, 19 nt, Homo sapiens
ggagugcuggcucacagua

SEQ ID NO: 789148 - RNA, 19 nt, Homo sapiens
gaggaaagguuuuggaucu

SEQ ID NO: 789149 - RNA, 19 nt, Homo sapiens
ggugacggcccucaucuau

SEQ ID NO: 789150 - RNA, 19 nt, Homo sapiens
gaagugcgugaauguaugu

SEQ ID NO: 789151 - RNA, 19 nt, Homo sapiens
uggagacccugcaaacaga

SEQ ID NO: 789152 - RNA, 19 nt, Homo sapiens
gaucaacagcaaccucuuc

SEQ ID NO: 789153 - RNA, 19 nt, Homo sapiens
gaagaucaaggaguacaau

SEQ ID NO: 789154 - RNA, 19 nt, Homo sapiens
uacagcaugugccuuaaug

SEQ ID NO: 789155 - RNA, 19 nt, Homo sapiens
aaacagaacagggucaugu

SEQ ID NO: 789156 - RNA, 19 nt, Homo sapiens
caggaguggugcagacaga

SEQ ID NO: 789157 - RNA, 19 nt, Homo sapiens
gugcgugaauguauguaau

SEQ ID NO: 789158 - RNA, 19 nt, Homo sapiens
cugcagaaguacuccuauu

SEQ ID NO: 789159 - RNA, 19 nt, Homo sapiens
ugccugaacuacauaacuu

SEQ ID NO: 789160 - RNA, 19 nt, Homo sapiens
gccuuaaugcuucauauga

SEQ ID NO: 789161 - RNA, 19 nt, Homo sapiens
ggaaagguuuuggaucuug

SEQ ID NO: 789162 - RNA, 19 nt, Homo sapiens
uacauaacuuccuacguau

SEQ ID NO: 789163 - RNA, 19 nt, Homo sapiens
gaaagguuuuggaucuuga

SEQ ID NO: 789164 - RNA, 19 nt, Homo sapiens
gcagaaguacuccuauugc

SEQ ID NO: 789165 - RNA, 19 nt, Homo sapiens
gccagggucugugugaaug

SEQ ID NO: 789166 - RNA, 19 nt, Homo sapiens
gagauugagcagaagauca

SEQ ID NO: 789167 - RNA, 19 nt, Homo sapiens
gggugggugcucagaauaa

SEQ ID NO: 789168 - RNA, 19 nt, Homo sapiens
gagcgucacggccaagugu

SEQ ID NO: 789169 - RNA, 19 nt, Homo sapiens
gaggcgccuucuuucgaaa

SEQ ID NO: 789170 - RNA, 19 nt, Homo sapiens
gggagacaccugaccuuuc

SEQ ID NO: 789171 - RNA, 19 nt, Homo sapiens
acacaggcuucaucaaggu

SEQ ID NO: 789172 - RNA, 19 nt, Homo sapiens
aggcaggcauugaggaaga

SEQ ID NO: 789173 - RNA, 19 nt, Homo sapiens
gagaacagcgaaguagcuu

SEQ ID NO: 789174 - RNA, 19 nt, Homo sapiens
aagggcacgugaagucauu

SEQ ID NO: 789175 - RNA, 19 nt, Homo sapiens
gcgugaauguauguaaugu

SEQ ID NO: 789176 - RNA, 19 nt, Homo sapiens
guacagcaugugccuuaau

SEQ ID NO: 789177 - RNA, 19 nt, Homo sapiens
gagucuugguuucucucua

SEQ ID NO: 789178 - RNA, 19 nt, Homo sapiens
uaaggcaggcauugaggaa

SEQ ID NO: 789179 - RNA, 19 nt, Homo sapiens
cagaauaaggcaggcauug

SEQ ID NO: 789180 - RNA, 19 nt, Homo sapiens
gugccuuaaugcuucauau

SEQ ID NO: 789181 - RNA, 19 nt, Homo sapiens
agaauaaggcaggcauuga

SEQ ID NO: 789182 - RNA, 19 nt, Homo sapiens
uuacacaggcuucaucaag

SEQ ID NO: 789183 - RNA, 19 nt, Homo sapiens
caucuaugaggaaagguuu

SEQ ID NO: 789184 - RNA, 19 nt, Homo sapiens
acagcaaccucuucaugag

SEQ ID NO: 789185 - RNA, 19 nt, Homo sapiens
gcaccccucugcccucauu

SEQ ID NO: 789186 - RNA, 19 nt, Homo sapiens
ccagagaacagcgaaguag

SEQ ID NO: 789187 - RNA, 19 nt, Homo sapiens
cggaagcuguuggaugaug

SEQ ID NO: 789188 - RNA, 19 nt, Homo sapiens
gcacaagggcacgugaagu

SEQ ID NO: 789189 - RNA, 19 nt, Homo sapiens
ucugugcccuccagcaaga

SEQ ID NO: 789190 - RNA, 19 nt, Homo sapiens
aagggugggugcucagaau

SEQ ID NO: 789191 - RNA, 19 nt, Homo sapiens
aacagcaaccucuucauga

SEQ ID NO: 789192 - RNA, 19 nt, Homo sapiens
guacaaugcccagaucaac

SEQ ID NO: 789193 - RNA, 19 nt, Homo sapiens
uugaggcccugcugcgaaa

SEQ ID NO: 789194 - RNA, 19 nt, Homo sapiens
ccuuaaugcuucauaugag

SEQ ID NO: 789195 - RNA, 19 nt, Homo sapiens
ggugggugcucagaauaag

SEQ ID NO: 789196 - RNA, 19 nt, Homo sapiens
gggccagggucugugugaa

SEQ ID NO: 789197 - RNA, 19 nt, Homo sapiens
gcaaccucuucaugagcuu

SEQ ID NO: 789198 - RNA, 19 nt, Homo sapiens
ggacggggcacaaguguca

SEQ ID NO: 789199 - RNA, 19 nt, Homo sapiens
gguuuuggaucuugaaugu

SEQ ID NO: 789200 - RNA, 19 nt, Homo sapiens
ggagacccugcaaacagaa

SEQ ID NO: 789201 - RNA, 19 nt, Homo sapiens
gaaugagcccagagaacag

SEQ ID NO: 789202 - RNA, 19 nt, Homo sapiens
cacaagggcacgugaaguc

SEQ ID NO: 789203 - RNA, 19 nt, Homo sapiens
uaugaagugcgugaaugua

SEQ ID NO: 789204 - RNA, 19 nt, Homo sapiens
uuuaugaagugcgugaaug

SEQ ID NO: 789205 - RNA, 19 nt, Homo sapiens
ggccagggucugugugaau

SEQ ID NO: 789206 - RNA, 19 nt, Homo sapiens
gcaaacagaacagggucau

SEQ ID NO: 789207 - RNA, 19 nt, Homo sapiens
gcgccuucuuucgaaauga

SEQ ID NO: 789208 - RNA, 19 nt, Homo sapiens
cgccagauccugcagaagu

SEQ ID NO: 789209 - RNA, 19 nt, Homo sapiens
gcaugccugaacuacauaa

SEQ ID NO: 789210 - RNA, 19 nt, Homo sapiens
caaguuugcacucuuugag

SEQ ID NO: 789211 - RNA, 19 nt, Homo sapiens
gaaagggguuggggugaca

SEQ ID NO: 789212 - RNA, 19 nt, Homo sapiens
gugguggccucagcugaau

SEQ ID NO: 789213 - RNA, 19 nt, Homo sapiens
gcucaauaaagauuucaag

SEQ ID NO: 789214 - RNA, 19 nt, Homo sapiens
ucucagaagugaaaaucuu

SEQ ID NO: 789215 - RNA, 19 nt, Homo sapiens
cuacauaacuuccuacgua

SEQ ID NO: 789216 - RNA, 19 nt, Homo sapiens
guucauaccuuauuugcua

SEQ ID NO: 789217 - RNA, 19 nt, Homo sapiens
acagaagucuccucaauuu

SEQ ID NO: 789218 - RNA, 19 nt, Homo sapiens
ggagacaccugaccuuucu

SEQ ID NO: 789219 - RNA, 19 nt, Homo sapiens
ugaauguggucucaggaua

SEQ ID NO: 789220 - RNA, 19 nt, Homo sapiens
gcaagaagccacccuccuu

SEQ ID NO: 789221 - RNA, 19 nt, Homo sapiens
ggaaugagcccagagaaca

SEQ ID NO: 789222 - RNA, 19 nt, Homo sapiens
ggaagcuguuggaugauga

SEQ ID NO: 789223 - RNA, 19 nt, Homo sapiens
caaggacgguucuuacaca

SEQ ID NO: 789224 - RNA, 19 nt, Homo sapiens
gugaauguauguaaugugu

SEQ ID NO: 789225 - RNA, 19 nt, Homo sapiens
gccagauccugcagaagua

SEQ ID NO: 789226 - RNA, 19 nt, Homo sapiens
aagcugagauugagcagaa

SEQ ID NO: 789227 - RNA, 19 nt, Homo sapiens
ccaagugcgugccguguga

SEQ ID NO: 789228 - RNA, 19 nt, Homo sapiens
cagcaugccugaacuacau

SEQ ID NO: 789229 - RNA, 19 nt, Homo sapiens
caacagcaaccucuucaug

SEQ ID NO: 789230 - RNA, 19 nt, Homo sapiens
ggaguacaaugcccagauc

SEQ ID NO: 789231 - RNA, 19 nt, Homo sapiens
ugaacuacauaacuuccua

SEQ ID NO: 789232 - RNA, 19 nt, Homo sapiens
gacagaagucuccucaauu

SEQ ID NO: 789233 - RNA, 19 nt, Homo sapiens
gaucuugaauguggucuca

SEQ ID NO: 789234 - RNA, 19 nt, Homo sapiens
gaauguggucucaggauau

SEQ ID NO: 789235 - RNA, 19 nt, Homo sapiens
ugacaaggcccugagcuuu

SEQ ID NO: 789236 - RNA, 19 nt, Homo sapiens
ugcggaagcuguuggauga

SEQ ID NO: 789237 - RNA, 19 nt, Homo sapiens
agcagaagaucaaggagua

SEQ ID NO: 789238 - RNA, 19 nt, Homo sapiens
caguacagcaugugccuua

SEQ ID NO: 789239 - RNA, 19 nt, Homo sapiens
ugaagugcgugaauguaug

SEQ ID NO: 789240 - RNA, 19 nt, Homo sapiens
gacaaggcccugagcuuug

SEQ ID NO: 789241 - RNA, 19 nt, Homo sapiens
gaauaaggcaggcauugag

SEQ ID NO: 789242 - RNA, 19 nt, Homo sapiens
gcccaaggaugcugucaag

SEQ ID NO: 789243 - RNA, 19 nt, Homo sapiens
ggagugcuggcucacagua

SEQ ID NO: 789244 - RNA, 19 nt, Homo sapiens
gaggaaagguuuuggaucu

SEQ ID NO: 789245 - RNA, 19 nt, Homo sapiens
ggugacggcccucaucuau

SEQ ID NO: 789246 - RNA, 19 nt, Homo sapiens
gaagugcgugaauguaugu

SEQ ID NO: 789247 - RNA, 19 nt, Homo sapiens
uggagacccugcaaacaga

SEQ ID NO: 789248 - RNA, 19 nt, Homo sapiens
gaucaacagcaaccucuuc

SEQ ID NO: 789249 - RNA, 19 nt, Homo sapiens
gaagaucaaggaguacaau

SEQ ID NO: 789250 - RNA, 19 nt, Homo sapiens
uacagcaugugccuuaaug

SEQ ID NO: 789251 - RNA, 19 nt, Homo sapiens
aaacagaacagggucaugu

SEQ ID NO: 789252 - RNA, 19 nt, Homo sapiens
caggaguggugcagacaga

SEQ ID NO: 789253 - RNA, 19 nt, Homo sapiens
gugcgugaauguauguaau

SEQ ID NO: 789254 - RNA, 19 nt, Homo sapiens
cugcagaaguacuccuauu

SEQ ID NO: 789255 - RNA, 19 nt, Homo sapiens
ugccugaacuacauaacuu

SEQ ID NO: 789256 - RNA, 19 nt, Homo sapiens
cgaccucuguggcgacuuc

SEQ ID NO: 789257 - RNA, 19 nt, Homo sapiens
gccuuaaugcuucauauga

SEQ ID NO: 789258 - RNA, 19 nt, Homo sapiens
ggaaagguuuuggaucuug

SEQ ID NO: 789259 - RNA, 19 nt, Homo sapiens
uacauaacuuccuacguau

SEQ ID NO: 789260 - RNA, 19 nt, Homo sapiens
gaaagguuuuggaucuuga

SEQ ID NO: 789261 - RNA, 19 nt, Homo sapiens
caaguucaccugccacuac

SEQ ID NO: 789262 - RNA, 19 nt, Homo sapiens
gcagaaguacuccuauugc

SEQ ID NO: 789263 - RNA, 19 nt, Homo sapiens
gcccaaagccagcgaagca

SEQ ID NO: 789264 - RNA, 19 nt, Homo sapiens
gagauugagcagaagauca

SEQ ID NO: 789265 - RNA, 19 nt, Homo sapiens
gccagggucugugugaaug

SEQ ID NO: 789266 - RNA, 19 nt, Homo sapiens
gggugggugcucagaauaa

SEQ ID NO: 789267 - RNA, 19 nt, Homo sapiens
gagcgucacggccaagugu

SEQ ID NO: 789268 - RNA, 19 nt, Homo sapiens
gggagacaccugaccuuuc

SEQ ID NO: 789269 - RNA, 19 nt, Homo sapiens
acacaggcuucaucaaggu

SEQ ID NO: 789270 - RNA, 19 nt, Homo sapiens
aggcaggcauugaggaaga

SEQ ID NO: 789271 - RNA, 19 nt, Homo sapiens
gagaacagcgaaguagcuu

SEQ ID NO: 789272 - RNA, 19 nt, Homo sapiens
aagggcacgugaagucauu

SEQ ID NO: 789273 - RNA, 19 nt, Homo sapiens
gcgugaauguauguaaugu

SEQ ID NO: 789274 - RNA, 19 nt, Homo sapiens
guacagcaugugccuuaau

SEQ ID NO: 789275 - RNA, 19 nt, Homo sapiens
gagucuugguuucucucua

SEQ ID NO: 789276 - RNA, 19 nt, Homo sapiens
uaaggcaggcauugaggaa

SEQ ID NO: 789277 - RNA, 19 nt, Homo sapiens
cagaauaaggcaggcauug

SEQ ID NO: 789278 - RNA, 19 nt, Homo sapiens
gugccuuaaugcuucauau

SEQ ID NO: 789279 - RNA, 19 nt, Homo sapiens
agaauaaggcaggcauuga

SEQ ID NO: 789280 - RNA, 19 nt, Homo sapiens
caucuaugaggaaagguuu

SEQ ID NO: 789281 - RNA, 19 nt, Homo sapiens
uuacacaggcuucaucaag

SEQ ID NO: 789282 - RNA, 19 nt, Homo sapiens
acagcaaccucuucaugag

SEQ ID NO: 789283 - RNA, 19 nt, Homo sapiens
gcaccccucugcccucauu

SEQ ID NO: 789284 - RNA, 19 nt, Homo sapiens
ccagagaacagcgaaguag

SEQ ID NO: 789285 - RNA, 19 nt, Homo sapiens
cggaagcuguuggaugaug

SEQ ID NO: 789286 - RNA, 19 nt, Homo sapiens
gcacaagggcacgugaagu

SEQ ID NO: 789287 - RNA, 19 nt, Homo sapiens
ucugugcccuccagcaaga

SEQ ID NO: 789288 - RNA, 19 nt, Homo sapiens
gcgccucucugcagauugc

SEQ ID NO: 789289 - RNA, 19 nt, Homo sapiens
gcaaguucaccugccacua

SEQ ID NO: 789290 - RNA, 19 nt, Homo sapiens
aagggugggugcucagaau

SEQ ID NO: 789291 - RNA, 19 nt, Homo sapiens
guacaaugcccagaucaac

SEQ ID NO: 789292 - RNA, 19 nt, Homo sapiens
aacagcaaccucuucauga

SEQ ID NO: 789293 - RNA, 19 nt, Homo sapiens
uugaggcccugcugcgaaa

SEQ ID NO: 789294 - RNA, 19 nt, Homo sapiens
ccuuaaugcuucauaugag

SEQ ID NO: 789295 - RNA, 19 nt, Homo sapiens
ggugggugcucagaauaag

SEQ ID NO: 789296 - RNA, 19 nt, Homo sapiens
gggccagggucugugugaa

SEQ ID NO: 789297 - RNA, 19 nt, Homo sapiens
ggacggggcacaaguguca

SEQ ID NO: 789298 - RNA, 19 nt, Homo sapiens
gcaaccucuucaugagcuu

SEQ ID NO: 789299 - RNA, 19 nt, Homo sapiens
gguuuuggaucuugaaugu

SEQ ID NO: 789300 - RNA, 19 nt, Homo sapiens
ggagacccugcaaacagaa

SEQ ID NO: 789301 - RNA, 19 nt, Homo sapiens
gaaugagcccagagaacag

SEQ ID NO: 789302 - RNA, 19 nt, Homo sapiens
cacaagggcacgugaaguc

SEQ ID NO: 789303 - RNA, 19 nt, Homo sapiens
uaugaagugcgugaaugua

SEQ ID NO: 789304 - RNA, 19 nt, Homo sapiens
uuuaugaagugcgugaaug

SEQ ID NO: 789305 - RNA, 19 nt, Homo sapiens
ggccagggucugugugaau

SEQ ID NO: 789306 - RNA, 19 nt, Homo sapiens
gcaaacagaacagggucau

SEQ ID NO: 789307 - RNA, 19 nt, Homo sapiens
cgccagauccugcagaagu

SEQ ID NO: 789308 - RNA, 19 nt, Homo sapiens
gcaugccugaacuacauaa

SEQ ID NO: 789309 - RNA, 19 nt, Homo sapiens
caaguuugcacucuuugag

SEQ ID NO: 789310 - RNA, 19 nt, Homo sapiens
gaaagggguuggggugaca

SEQ ID NO: 789311 - RNA, 19 nt, Homo sapiens
gugguggccucagcugaau

SEQ ID NO: 789312 - RNA, 19 nt, Homo sapiens
gcucaauaaagauuucaag

SEQ ID NO: 789313 - RNA, 19 nt, Homo sapiens
ucucagaagugaaaaucuu

SEQ ID NO: 789314 - RNA, 19 nt, Homo sapiens
cuacauaacuuccuacgua

SEQ ID NO: 789315 - RNA, 19 nt, Homo sapiens
guucauaccuuauuugcua

SEQ ID NO: 789316 - RNA, 19 nt, Homo sapiens
acagaagucuccucaauuu

SEQ ID NO: 789317 - RNA, 19 nt, Homo sapiens
ggagacaccugaccuuucu

SEQ ID NO: 789318 - RNA, 19 nt, Homo sapiens
ugaauguggucucaggaua

SEQ ID NO: 789319 - RNA, 19 nt, Homo sapiens
gcaagaagccacccuccuu

SEQ ID NO: 789320 - RNA, 19 nt, Homo sapiens
ggaaugagcccagagaaca

SEQ ID NO: 789321 - RNA, 19 nt, Homo sapiens
ggaagcuguuggaugauga

SEQ ID NO: 789322 - RNA, 19 nt, Homo sapiens
caaggacgguucuuacaca

SEQ ID NO: 789323 - RNA, 19 nt, Homo sapiens
gugaauguauguaaugugu

SEQ ID NO: 789324 - RNA, 19 nt, Homo sapiens
gccagauccugcagaagua

SEQ ID NO: 789325 - RNA, 19 nt, Homo sapiens
aagcugagauugagcagaa

SEQ ID NO: 789326 - RNA, 19 nt, Homo sapiens
ccaagugcgugccguguga

SEQ ID NO: 789327 - RNA, 19 nt, Homo sapiens
cagcaugccugaacuacau

SEQ ID NO: 789328 - RNA, 19 nt, Homo sapiens
caacagcaaccucuucaug

SEQ ID NO: 789329 - RNA, 19 nt, Homo sapiens
ggaguacaaugcccagauc

SEQ ID NO: 789330 - RNA, 19 nt, Homo sapiens
ugaacuacauaacuuccua

SEQ ID NO: 789331 - RNA, 19 nt, Homo sapiens
gacagaagucuccucaauu

SEQ ID NO: 789332 - RNA, 19 nt, Homo sapiens
gaucuugaauguggucuca

SEQ ID NO: 789333 - RNA, 19 nt, Homo sapiens
gaauguggucucaggauau

SEQ ID NO: 789334 - RNA, 19 nt, Homo sapiens
ugacaaggcccugagcuuu

SEQ ID NO: 789335 - RNA, 19 nt, Homo sapiens
ugcggaagcuguuggauga

SEQ ID NO: 789336 - RNA, 19 nt, Homo sapiens
agcagaagaucaaggagua

SEQ ID NO: 789337 - RNA, 19 nt, Homo sapiens
caguacagcaugugccuua

SEQ ID NO: 789338 - RNA, 19 nt, Homo sapiens
ugaagugcgugaauguaug

SEQ ID NO: 789339 - RNA, 19 nt, Homo sapiens
gacaaggcccugagcuuug

SEQ ID NO: 789340 - RNA, 19 nt, Homo sapiens
gaauaaggcaggcauugag

SEQ ID NO: 789341 - RNA, 19 nt, Homo sapiens
gcccaaggaugcugucaag

SEQ ID NO: 789342 - RNA, 19 nt, Homo sapiens
ggagugcuggcucacagua

SEQ ID NO: 789343 - RNA, 19 nt, Homo sapiens
gaggaaagguuuuggaucu

SEQ ID NO: 789344 - RNA, 19 nt, Homo sapiens
ggugacggcccucaucuau

SEQ ID NO: 789345 - RNA, 19 nt, Homo sapiens
gaagugcgugaauguaugu

SEQ ID NO: 789346 - RNA, 19 nt, Homo sapiens
uggagacccugcaaacaga

SEQ ID NO: 789347 - RNA, 19 nt, Homo sapiens
gaucaacagcaaccucuuc

SEQ ID NO: 789348 - RNA, 19 nt, Homo sapiens
gaagaucaaggaguacaau

SEQ ID NO: 789349 - RNA, 19 nt, Homo sapiens
uacagcaugugccuuaaug

SEQ ID NO: 789350 - RNA, 19 nt, Homo sapiens
aaacagaacagggucaugu

SEQ ID NO: 789351 - RNA, 19 nt, Homo sapiens
caggaguggugcagacaga

SEQ ID NO: 789352 - RNA, 19 nt, Homo sapiens
gugcgugaauguauguaau

SEQ ID NO: 789353 - RNA, 19 nt, Homo sapiens
cugcagaaguacuccuauu

SEQ ID NO: 789354 - RNA, 19 nt, Homo sapiens
ugccugaacuacauaacuu

SEQ ID NO: 789355 - RNA, 19 nt, Homo sapiens
cgaccucuguggcgacuuc

SEQ ID NO: 789356 - RNA, 19 nt, Homo sapiens
gccuuaaugcuucauauga

SEQ ID NO: 789357 - RNA, 19 nt, Homo sapiens
ggaaagguuuuggaucuug

SEQ ID NO: 789358 - RNA, 19 nt, Homo sapiens
uacauaacuuccuacguau

SEQ ID NO: 789359 - RNA, 19 nt, Homo sapiens
gaaagguuuuggaucuuga

SEQ ID NO: 789360 - RNA, 19 nt, Homo sapiens
gcagaaguacuccuauugc

SEQ ID NO: 789361 - RNA, 19 nt, Homo sapiens
caaguucaccugccacuac

SEQ ID NO: 789362 - RNA, 19 nt, Homo sapiens
gcccaaagccagcgaagca

SEQ ID NO: 789363 - RNA, 19 nt, Homo sapiens
gccagggucugugugaaug

SEQ ID NO: 789364 - RNA, 19 nt, Homo sapiens
gagauugagcagaagauca

SEQ ID NO: 789365 - RNA, 19 nt, Homo sapiens
gggugggugcucagaauaa

SEQ ID NO: 789366 - RNA, 19 nt, Homo sapiens
gagcgucacggccaagugu

SEQ ID NO: 789367 - RNA, 19 nt, Homo sapiens
gggagacaccugaccuuuc

SEQ ID NO: 789368 - RNA, 19 nt, Homo sapiens
acacaggcuucaucaaggu

SEQ ID NO: 789369 - RNA, 19 nt, Homo sapiens
aggcaggcauugaggaaga

SEQ ID NO: 789370 - RNA, 19 nt, Homo sapiens
gagaacagcgaaguagcuu

SEQ ID NO: 789371 - RNA, 19 nt, Homo sapiens
aagggcacgugaagucauu

SEQ ID NO: 789372 - RNA, 19 nt, Homo sapiens
gcgugaauguauguaaugu

SEQ ID NO: 789373 - RNA, 19 nt, Homo sapiens
guacagcaugugccuuaau

SEQ ID NO: 789374 - RNA, 19 nt, Homo sapiens
gagucuugguuucucucua

SEQ ID NO: 789375 - RNA, 19 nt, Homo sapiens
uaaggcaggcauugaggaa

SEQ ID NO: 789376 - RNA, 19 nt, Homo sapiens
cagaauaaggcaggcauug

SEQ ID NO: 789377 - RNA, 19 nt, Homo sapiens
acagcaaccucuucaugag

SEQ ID NO: 789378 - RNA, 19 nt, Homo sapiens
gugccuuaaugcuucauau

SEQ ID NO: 789379 - RNA, 19 nt, Homo sapiens
agaauaaggcaggcauuga

SEQ ID NO: 789380 - RNA, 19 nt, Homo sapiens
caucuaugaggaaagguuu

SEQ ID NO: 789381 - RNA, 19 nt, Homo sapiens
gcaccccucugcccucauu

SEQ ID NO: 789382 - RNA, 19 nt, Homo sapiens
ccagagaacagcgaaguag

SEQ ID NO: 789383 - RNA, 19 nt, Homo sapiens
cggaagcuguuggaugaug

SEQ ID NO: 789384 - RNA, 19 nt, Homo sapiens
uuacacaggcuucaucaag

SEQ ID NO: 789385 - RNA, 19 nt, Homo sapiens
gcacaagggcacgugaagu

SEQ ID NO: 789386 - RNA, 19 nt, Homo sapiens
ucugugcccuccagcaaga

SEQ ID NO: 789387 - RNA, 19 nt, Homo sapiens
aagggugggugcucagaau

SEQ ID NO: 789388 - RNA, 19 nt, Homo sapiens
gcaaguucaccugccacua

SEQ ID NO: 789389 - RNA, 19 nt, Homo sapiens
gugcgcgcauugcaaguuc

SEQ ID NO: 789390 - RNA, 19 nt, Homo sapiens
guacaaugcccagaucaac

SEQ ID NO: 789391 - RNA, 19 nt, Homo sapiens
uugaggcccugcugcgaaa

SEQ ID NO: 789392 - RNA, 19 nt, Homo sapiens
aacagcaaccucuucauga

SEQ ID NO: 789393 - RNA, 19 nt, Homo sapiens
ccuuaaugcuucauaugag

SEQ ID NO: 789394 - RNA, 19 nt, Homo sapiens
ggugggugcucagaauaag

SEQ ID NO: 789395 - RNA, 19 nt, Homo sapiens
gggccagggucugugugaa

SEQ ID NO: 789396 - RNA, 19 nt, Homo sapiens
gcaaccucuucaugagcuu

SEQ ID NO: 789397 - RNA, 19 nt, Homo sapiens
gguuuuggaucuugaaugu

SEQ ID NO: 789398 - RNA, 19 nt, Homo sapiens
ggacggggcacaaguguca

SEQ ID NO: 789399 - RNA, 19 nt, Homo sapiens
ggagacccugcaaacagaa

SEQ ID NO: 789400 - RNA, 19 nt, Homo sapiens
gaaugagcccagagaacag

SEQ ID NO: 789401 - RNA, 19 nt, Homo sapiens
cacaagggcacgugaaguc

SEQ ID NO: 789402 - RNA, 19 nt, Homo sapiens
uaugaagugcgugaaugua

SEQ ID NO: 789403 - RNA, 19 nt, Homo sapiens
uuuaugaagugcgugaaug

SEQ ID NO: 789404 - RNA, 19 nt, Homo sapiens
ggccagggucugugugaau

SEQ ID NO: 789405 - RNA, 19 nt, Homo sapiens
gcaaacagaacagggucau

SEQ ID NO: 789406 - RNA, 19 nt, Homo sapiens
cgccagauccugcagaagu

SEQ ID NO: 789407 - RNA, 19 nt, Homo sapiens
gcaugccugaacuacauaa

SEQ ID NO: 789408 - RNA, 19 nt, Homo sapiens
caaguuugcacucuuugag

SEQ ID NO: 789409 - RNA, 19 nt, Homo sapiens
gaaagggguuggggugaca

SEQ ID NO: 789410 - RNA, 19 nt, Homo sapiens
gugguggccucagcugaau

SEQ ID NO: 789411 - RNA, 19 nt, Homo sapiens
gcucaauaaagauuucaag

SEQ ID NO: 789412 - RNA, 19 nt, Homo sapiens
ucucagaagugaaaaucuu

SEQ ID NO: 789413 - RNA, 19 nt, Homo sapiens
cuacauaacuuccuacgua

SEQ ID NO: 789414 - RNA, 19 nt, Homo sapiens
guucauaccuuauuugcua

SEQ ID NO: 789415 - RNA, 19 nt, Homo sapiens
acagaagucuccucaauuu

SEQ ID NO: 789416 - RNA, 19 nt, Homo sapiens
ggagacaccugaccuuucu

SEQ ID NO: 789417 - RNA, 19 nt, Homo sapiens
ugaauguggucucaggaua

SEQ ID NO: 789418 - RNA, 19 nt, Homo sapiens
gcaagaagccacccuccuu

SEQ ID NO: 789419 - RNA, 19 nt, Homo sapiens
ggaaugagcccagagaaca

SEQ ID NO: 789420 - RNA, 19 nt, Homo sapiens
ggaagcuguuggaugauga

SEQ ID NO: 789421 - RNA, 19 nt, Homo sapiens
caaggacgguucuuacaca

SEQ ID NO: 789422 - RNA, 19 nt, Homo sapiens
gugaauguauguaaugugu

SEQ ID NO: 789423 - RNA, 19 nt, Homo sapiens
gccagauccugcagaagua

SEQ ID NO: 789424 - RNA, 19 nt, Homo sapiens
aagcugagauugagcagaa

SEQ ID NO: 789425 - RNA, 19 nt, Homo sapiens
ccaagugcgugccguguga

SEQ ID NO: 789426 - RNA, 19 nt, Homo sapiens
cagcaugccugaacuacau

SEQ ID NO: 789427 - RNA, 19 nt, Homo sapiens
caacagcaaccucuucaug

SEQ ID NO: 789428 - RNA, 19 nt, Homo sapiens
ggaguacaaugcccagauc

SEQ ID NO: 789429 - RNA, 19 nt, Homo sapiens
ugaacuacauaacuuccua

SEQ ID NO: 789430 - RNA, 19 nt, Homo sapiens
gacagaagucuccucaauu

SEQ ID NO: 789431 - RNA, 19 nt, Homo sapiens
gaucuugaauguggucuca

SEQ ID NO: 789432 - RNA, 19 nt, Homo sapiens
gaauguggucucaggauau

SEQ ID NO: 789433 - RNA, 19 nt, Homo sapiens
ugacaaggcccugagcuuu

SEQ ID NO: 789434 - RNA, 19 nt, Homo sapiens
ugcggaagcuguuggauga

SEQ ID NO: 789435 - RNA, 19 nt, Homo sapiens
agcagaagaucaaggagua

SEQ ID NO: 789436 - RNA, 19 nt, Homo sapiens
caguacagcaugugccuua

SEQ ID NO: 789437 - RNA, 19 nt, Homo sapiens
ugaagugcgugaauguaug

SEQ ID NO: 789438 - RNA, 19 nt, Homo sapiens
gacaaggcccugagcuuug

SEQ ID NO: 789439 - RNA, 19 nt, Homo sapiens
gaauaaggcaggcauugag

SEQ ID NO: 789440 - RNA, 19 nt, Homo sapiens
gcccaaggaugcugucaag

SEQ ID NO: 789441 - RNA, 19 nt, Homo sapiens
ggagugcuggcucacagua

SEQ ID NO: 789442 - RNA, 19 nt, Homo sapiens
gaggaaagguuuuggaucu

SEQ ID NO: 789443 - RNA, 19 nt, Homo sapiens
ggugacggcccucaucuau

SEQ ID NO: 789444 - RNA, 19 nt, Homo sapiens
gaagugcgugaauguaugu

SEQ ID NO: 789445 - RNA, 19 nt, Homo sapiens
gaagaucaaggaguacaau

SEQ ID NO: 789446 - RNA, 19 nt, Homo sapiens
uggagacccugcaaacaga

SEQ ID NO: 789447 - RNA, 19 nt, Homo sapiens
gaucaacagcaaccucuuc

SEQ ID NO: 789448 - RNA, 19 nt, Homo sapiens
uacagcaugugccuuaaug

SEQ ID NO: 789449 - RNA, 19 nt, Homo sapiens
aaacagaacagggucaugu

SEQ ID NO: 789450 - RNA, 19 nt, Homo sapiens
caggaguggugcagacaga

SEQ ID NO: 789451 - RNA, 19 nt, Homo sapiens
gugcgugaauguauguaau

SEQ ID NO: 789452 - RNA, 19 nt, Homo sapiens
cugcagaaguacuccuauu

SEQ ID NO: 789453 - RNA, 19 nt, Homo sapiens
ugccugaacuacauaacuu

SEQ ID NO: 789454 - RNA, 19 nt, Homo sapiens
cgaccucuguggcgacuuc

SEQ ID NO: 789455 - RNA, 19 nt, Homo sapiens
gccuuaaugcuucauauga

SEQ ID NO: 789456 - RNA, 19 nt, Homo sapiens
ggaaagguuuuggaucuug

SEQ ID NO: 789457 - RNA, 19 nt, Homo sapiens
uacauaacuuccuacguau

SEQ ID NO: 789458 - RNA, 19 nt, Homo sapiens
gaaagguuuuggaucuuga

SEQ ID NO: 789459 - RNA, 19 nt, Homo sapiens
gcagaaguacuccuauugc

SEQ ID NO: 789460 - RNA, 19 nt, Homo sapiens
gcccaaagccagcgaagca

SEQ ID NO: 789461 - RNA, 19 nt, Homo sapiens
gccagggucugugugaaug

SEQ ID NO: 789462 - RNA, 19 nt, Homo sapiens
gagauugagcagaagauca

SEQ ID NO: 789463 - RNA, 19 nt, Homo sapiens
gggugggugcucagaauaa

SEQ ID NO: 789464 - RNA, 19 nt, Homo sapiens
gagcgucacggccaagugu

SEQ ID NO: 789465 - RNA, 19 nt, Homo sapiens
gggagacaccugaccuuuc

SEQ ID NO: 789466 - RNA, 19 nt, Homo sapiens
acacaggcuucaucaaggu

SEQ ID NO: 789467 - RNA, 19 nt, Homo sapiens
aggcaggcauugaggaaga

SEQ ID NO: 789468 - RNA, 19 nt, Homo sapiens
gagaacagcgaaguagcuu

SEQ ID NO: 789469 - RNA, 19 nt, Homo sapiens
aagggcacgugaagucauu

SEQ ID NO: 789470 - RNA, 19 nt, Homo sapiens
gcgugaauguauguaaugu

SEQ ID NO: 789471 - RNA, 19 nt, Homo sapiens
guacagcaugugccuuaau

SEQ ID NO: 789472 - RNA, 19 nt, Homo sapiens
gagucuugguuucucucua

SEQ ID NO: 789473 - RNA, 19 nt, Homo sapiens
uaaggcaggcauugaggaa

SEQ ID NO: 789474 - RNA, 19 nt, Homo sapiens
cagaauaaggcaggcauug

SEQ ID NO: 789475 - RNA, 19 nt, Homo sapiens
uuacacaggcuucaucaag

SEQ ID NO: 789476 - RNA, 19 nt, Homo sapiens
gugccuuaaugcuucauau

SEQ ID NO: 789477 - RNA, 19 nt, Homo sapiens
agaauaaggcaggcauuga

SEQ ID NO: 789478 - RNA, 19 nt, Homo sapiens
caucuaugaggaaagguuu

SEQ ID NO: 789479 - RNA, 19 nt, Homo sapiens
ucugugcccuccagcaaga

SEQ ID NO: 789480 - RNA, 19 nt, Homo sapiens
gcaccccucugcccucauu

SEQ ID NO: 789481 - RNA, 19 nt, Homo sapiens
ccagagaacagcgaaguag

SEQ ID NO: 789482 - RNA, 19 nt, Homo sapiens
acagcaaccucuucaugag

SEQ ID NO: 789483 - RNA, 19 nt, Homo sapiens
cggaagcuguuggaugaug

SEQ ID NO: 789484 - RNA, 19 nt, Homo sapiens
gcacaagggcacgugaagu

SEQ ID NO: 789485 - RNA, 19 nt, Homo sapiens
aagggugggugcucagaau

SEQ ID NO: 789486 - RNA, 19 nt, Homo sapiens
guacaaugcccagaucaac

SEQ ID NO: 789487 - RNA, 19 nt, Homo sapiens
aacagcaaccucuucauga

SEQ ID NO: 789488 - RNA, 19 nt, Homo sapiens
uugaggcccugcugcgaaa

SEQ ID NO: 789489 - RNA, 19 nt, Homo sapiens
ccuuaaugcuucauaugag

SEQ ID NO: 789490 - RNA, 19 nt, Homo sapiens
ggugggugcucagaauaag

SEQ ID NO: 789491 - RNA, 19 nt, Homo sapiens
gggccagggucugugugaa

SEQ ID NO: 789492 - RNA, 19 nt, Homo sapiens
gguuuuggaucuugaaugu

SEQ ID NO: 789493 - RNA, 19 nt, Homo sapiens
ggagacccugcaaacagaa

SEQ ID NO: 789494 - RNA, 19 nt, Homo sapiens
gaaugagcccagagaacag

SEQ ID NO: 789495 - RNA, 19 nt, Homo sapiens
gcaaccucuucaugagcuu

SEQ ID NO: 789496 - RNA, 19 nt, Homo sapiens
cacaagggcacgugaaguc

SEQ ID NO: 789497 - RNA, 19 nt, Homo sapiens
ggacggggcacaaguguca

SEQ ID NO: 789498 - RNA, 19 nt, Homo sapiens
uaugaagugcgugaaugua

SEQ ID NO: 789499 - RNA, 19 nt, Homo sapiens
uuuaugaagugcgugaaug

SEQ ID NO: 789500 - RNA, 19 nt, Homo sapiens
ggccagggucugugugaau

SEQ ID NO: 789501 - RNA, 19 nt, Homo sapiens
gcaaacagaacagggucau

SEQ ID NO: 789502 - RNA, 19 nt, Homo sapiens
cgccagauccugcagaagu

SEQ ID NO: 789503 - RNA, 19 nt, Homo sapiens
gcaugccugaacuacauaa

SEQ ID NO: 789504 - RNA, 19 nt, Homo sapiens
caaguuugcacucuuugag

SEQ ID NO: 789505 - RNA, 19 nt, Homo sapiens
gaaagggguuggggugaca

SEQ ID NO: 789506 - RNA, 19 nt, Homo sapiens
gugguggccucagcugaau

SEQ ID NO: 789507 - RNA, 19 nt, Homo sapiens
gcucaauaaagauuucaag

SEQ ID NO: 789508 - RNA, 19 nt, Homo sapiens
ucucagaagugaaaaucuu

SEQ ID NO: 789509 - RNA, 19 nt, Homo sapiens
cuacauaacuuccuacgua

SEQ ID NO: 789510 - RNA, 19 nt, Homo sapiens
guucauaccuuauuugcua

SEQ ID NO: 789511 - RNA, 19 nt, Homo sapiens
acagaagucuccucaauuu

SEQ ID NO: 789512 - RNA, 19 nt, Homo sapiens
gcaacaaggacgguucuua

SEQ ID NO: 789513 - RNA, 19 nt, Homo sapiens
ugaauguggucucaggaua

SEQ ID NO: 789514 - RNA, 19 nt, Homo sapiens
gcaagaagccacccuccuu

SEQ ID NO: 789515 - RNA, 19 nt, Homo sapiens
ggaaugagcccagagaaca

SEQ ID NO: 789516 - RNA, 19 nt, Homo sapiens
ggaagcuguuggaugauga

SEQ ID NO: 789517 - RNA, 19 nt, Homo sapiens
caaggacgguucuuacaca

SEQ ID NO: 789518 - RNA, 19 nt, Homo sapiens
gugaauguauguaaugugu

SEQ ID NO: 789519 - RNA, 19 nt, Homo sapiens
gccagauccugcagaagua

SEQ ID NO: 789520 - RNA, 19 nt, Homo sapiens
ccaagugcgugccguguga

SEQ ID NO: 789521 - RNA, 19 nt, Homo sapiens
cagcaugccugaacuacau

SEQ ID NO: 789522 - RNA, 19 nt, Homo sapiens
ugaacuacauaacuuccua

SEQ ID NO: 789523 - RNA, 19 nt, Homo sapiens
gacagaagucuccucaauu

SEQ ID NO: 789524 - RNA, 19 nt, Homo sapiens
gaucuugaauguggucuca

SEQ ID NO: 789525 - RNA, 19 nt, Homo sapiens
gaauguggucucaggauau

SEQ ID NO: 789526 - RNA, 19 nt, Homo sapiens
gcagugcgcgcaacaagga

SEQ ID NO: 789527 - RNA, 19 nt, Homo sapiens
ugacaaggcccugagcuuu

SEQ ID NO: 789528 - RNA, 19 nt, Homo sapiens
ugcggaagcuguuggauga

SEQ ID NO: 789529 - RNA, 19 nt, Homo sapiens
caguacagcaugugccuua

SEQ ID NO: 789530 - RNA, 19 nt, Homo sapiens
ugaagugcgugaauguaug

SEQ ID NO: 789531 - RNA, 19 nt, Homo sapiens
caacaaggacgguucuuac

SEQ ID NO: 789532 - RNA, 19 nt, Homo sapiens
gacaaggcccugagcuuug

SEQ ID NO: 789533 - RNA, 19 nt, Homo sapiens
gaauaaggcaggcauugag

SEQ ID NO: 789534 - RNA, 19 nt, Homo sapiens
gcccaaggaugcugucaag

SEQ ID NO: 789535 - RNA, 19 nt, Homo sapiens
ggagugcuggcucacagua

SEQ ID NO: 789536 - RNA, 19 nt, Homo sapiens
gaggaaagguuuuggaucu

SEQ ID NO: 789537 - RNA, 19 nt, Homo sapiens
ggugacggcccucaucuau

SEQ ID NO: 789538 - RNA, 19 nt, Homo sapiens
gaagugcgugaauguaugu

SEQ ID NO: 789539 - RNA, 19 nt, Homo sapiens
uggagacccugcaaacaga

SEQ ID NO: 789540 - RNA, 19 nt, Homo sapiens
uacagcaugugccuuaaug

SEQ ID NO: 789541 - RNA, 19 nt, Homo sapiens
aaacagaacagggucaugu

SEQ ID NO: 789542 - RNA, 19 nt, Homo sapiens
caggaguggugcagacaga

SEQ ID NO: 789543 - RNA, 19 nt, Homo sapiens
gugcgugaauguauguaau

SEQ ID NO: 789544 - RNA, 19 nt, Homo sapiens
cgaccucuguggcgacuuc

SEQ ID NO: 789545 - RNA, 19 nt, Homo sapiens
cugcagaaguacuccuauu

SEQ ID NO: 789546 - RNA, 19 nt, Homo sapiens
ugccugaacuacauaacuu

SEQ ID NO: 789547 - RNA, 19 nt, Homo sapiens
gccuuaaugcuucauauga

SEQ ID NO: 789548 - RNA, 19 nt, Homo sapiens
ggaaagguuuuggaucuug

SEQ ID NO: 789549 - RNA, 19 nt, Homo sapiens
uacauaacuuccuacguau

SEQ ID NO: 789550 - RNA, 19 nt, Homo sapiens
gaaagguuuuggaucuuga

SEQ ID NO: 789551 - RNA, 19 nt, Homo sapiens
gcagaaguacuccuauugc

SEQ ID NO: 789552 - RNA, 19 nt, Homo sapiens
gcccaaagccagcgaagca

SEQ ID NO: 789553 - RNA, 19 nt, Homo sapiens
gccagggucugugugaaug

SEQ ID NO: 789554 - RNA, 19 nt, Homo sapiens
gggugggugcucagaauaa

SEQ ID NO: 789555 - RNA, 19 nt, Homo sapiens
gagcgucacggccaagugu

SEQ ID NO: 789556 - RNA, 19 nt, Homo sapiens
acacaggcuucaucaaggu

SEQ ID NO: 789557 - RNA, 19 nt, Homo sapiens
aggcaggcauugaggaaga

SEQ ID NO: 789558 - RNA, 19 nt, Homo sapiens
gagaacagcgaaguagcuu

SEQ ID NO: 789559 - RNA, 19 nt, Homo sapiens
aagggcacgugaagucauu

SEQ ID NO: 789560 - RNA, 19 nt, Homo sapiens
gcgugaauguauguaaugu

SEQ ID NO: 789561 - RNA, 19 nt, Homo sapiens
guacagcaugugccuuaau

SEQ ID NO: 789562 - RNA, 19 nt, Homo sapiens
gagucuugguuucucucua

SEQ ID NO: 789563 - RNA, 19 nt, Homo sapiens
uaaggcaggcauugaggaa

SEQ ID NO: 789564 - RNA, 19 nt, Homo sapiens
cagaauaaggcaggcauug

SEQ ID NO: 789565 - RNA, 19 nt, Homo sapiens
gugccuuaaugcuucauau

SEQ ID NO: 789566 - RNA, 19 nt, Homo sapiens
gcacaagggcacgugaagu

SEQ ID NO: 789567 - RNA, 19 nt, Homo sapiens
uuacacaggcuucaucaag

SEQ ID NO: 789568 - RNA, 19 nt, Homo sapiens
agaauaaggcaggcauuga

SEQ ID NO: 789569 - RNA, 19 nt, Homo sapiens
caucuaugaggaaagguuu

SEQ ID NO: 789570 - RNA, 19 nt, Homo sapiens
ucugugcccuccagcaaga

SEQ ID NO: 789571 - RNA, 19 nt, Homo sapiens
gcaccccucugcccucauu

SEQ ID NO: 789572 - RNA, 19 nt, Homo sapiens
ccagagaacagcgaaguag

SEQ ID NO: 789573 - RNA, 19 nt, Homo sapiens
cggaagcuguuggaugaug

SEQ ID NO: 789574 - RNA, 19 nt, Homo sapiens
aagggugggugcucagaau

SEQ ID NO: 789575 - RNA, 19 nt, Homo sapiens
uugaggcccugcugcgaaa

SEQ ID NO: 789576 - RNA, 19 nt, Homo sapiens
ccuuaaugcuucauaugag

SEQ ID NO: 789577 - RNA, 19 nt, Homo sapiens
ggugggugcucagaauaag

SEQ ID NO: 789578 - RNA, 19 nt, Homo sapiens
cacaagggcacgugaaguc

SEQ ID NO: 789579 - RNA, 19 nt, Homo sapiens
gggccagggucugugugaa

SEQ ID NO: 789580 - RNA, 19 nt, Homo sapiens
ggacggggcacaaguguca

SEQ ID NO: 789581 - RNA, 19 nt, Homo sapiens
gguuuuggaucuugaaugu

SEQ ID NO: 789582 - RNA, 19 nt, Homo sapiens
ggagacccugcaaacagaa

SEQ ID NO: 789583 - RNA, 19 nt, Homo sapiens
gaaugagcccagagaacag

SEQ ID NO: 789584 - RNA, 19 nt, Homo sapiens
uaugaagugcgugaaugua

SEQ ID NO: 789585 - RNA, 19 nt, Homo sapiens
uuuaugaagugcgugaaug

SEQ ID NO: 789586 - RNA, 19 nt, Homo sapiens
ggccagggucugugugaau

SEQ ID NO: 789587 - RNA, 19 nt, Homo sapiens
caaguuugcacucuuugag

SEQ ID NO: 789588 - RNA, 19 nt, Homo sapiens
gcaaacagaacagggucau

SEQ ID NO: 789589 - RNA, 19 nt, Homo sapiens
cgccagauccugcagaagu

SEQ ID NO: 789590 - RNA, 19 nt, Homo sapiens
gcaugccugaacuacauaa

SEQ ID NO: 789591 - RNA, 19 nt, Homo sapiens
gaaagggguuggggugaca

SEQ ID NO: 789592 - RNA, 19 nt, Homo sapiens
gugguggccucagcugaau

SEQ ID NO: 789593 - RNA, 19 nt, Homo sapiens
gcucaauaaagauuucaag

SEQ ID NO: 789594 - RNA, 19 nt, Homo sapiens
ucucagaagugaaaaucuu

SEQ ID NO: 789595 - RNA, 19 nt, Homo sapiens
gaauaaagauggccaugaa

SEQ ID NO: 789596 - RNA, 19 nt, Homo sapiens
gaagauaguuggguuugga

SEQ ID NO: 789597 - RNA, 19 nt, Homo sapiens
cgacaacgcugacaacaag

SEQ ID NO: 789598 - RNA, 19 nt, Homo sapiens
cccgagaccugcuguauuu

SEQ ID NO: 789599 - RNA, 19 nt, Homo sapiens
ugacuggccucauccgaaa

SEQ ID NO: 789600 - RNA, 19 nt, Homo sapiens
ggacaggacgugaagauag

SEQ ID NO: 789601 - RNA, 19 nt, Homo sapiens
gaaagcucaucuucaucaa

SEQ ID NO: 789602 - RNA, 19 nt, Homo sapiens
gcuacagccuggugucuga

SEQ ID NO: 789603 - RNA, 19 nt, Homo sapiens
gagcaggagcguauucuga

SEQ ID NO: 789604 - RNA, 19 nt, Homo sapiens
caucauagcugugcucaac

SEQ ID NO: 789605 - RNA, 19 nt, Homo sapiens
ggagcaggaugaugagcuu

SEQ ID NO: 789606 - RNA, 19 nt, Homo sapiens
ggaauaaagauggccauga

SEQ ID NO: 789607 - RNA, 19 nt, Homo sapiens
gacaggacgugaagauagu

SEQ ID NO: 789608 - RNA, 19 nt, Homo sapiens
cgaaagcucaucuucauca

SEQ ID NO: 789609 - RNA, 19 nt, Homo sapiens
gggauccuguggaaccuuu

SEQ ID NO: 789610 - RNA, 19 nt, Homo sapiens
aggcggagaucuucuacaa

SEQ ID NO: 789611 - RNA, 19 nt, Homo sapiens
ucauagcugugcucaacaa

SEQ ID NO: 789612 - RNA, 19 nt, Homo sapiens
ucgcggagguguccaagga

SEQ ID NO: 789613 - RNA, 19 nt, Homo sapiens
caaggcugcucugguguau

SEQ ID NO: 789614 - RNA, 19 nt, Homo sapiens
ugagccaccugaucgagaa

SEQ ID NO: 789615 - RNA, 19 nt, Homo sapiens
caaccacgccaaccaggaa

SEQ ID NO: 789616 - RNA, 19 nt, Homo sapiens
gcaaaugcgaggacaagag

SEQ ID NO: 789617 - RNA, 19 nt, Homo sapiens
caagcuccaccgugacuuu

SEQ ID NO: 789618 - RNA, 19 nt, Homo sapiens
uggaggagaaggcuaauga

SEQ ID NO: 789619 - RNA, 19 nt, Homo sapiens
uccgaaagcucaucuucau

SEQ ID NO: 789620 - RNA, 19 nt, Homo sapiens
ggaacaaggacgagauguc

SEQ ID NO: 789621 - RNA, 19 nt, Homo sapiens
ggacgugcauggguucaac

SEQ ID NO: 789622 - RNA, 19 nt, Homo sapiens
gcuguggccuggcaguauc

SEQ ID NO: 789623 - RNA, 19 nt, Homo sapiens
gcaggagcguauucugaac

SEQ ID NO: 789624 - RNA, 19 nt, Homo sapiens
gcaaccucaucuacgacaa

SEQ ID NO: 789625 - RNA, 19 nt, Homo sapiens
ggaacgcuaggaacaagga

SEQ ID NO: 789626 - RNA, 19 nt, Homo sapiens
gcgaugcagccgccaagaa

SEQ ID NO: 789627 - RNA, 19 nt, Homo sapiens
ucaaggcugcucuggugua

SEQ ID NO: 789628 - RNA, 19 nt, Homo sapiens
ggccaugaacagucacaaa

SEQ ID NO: 789629 - RNA, 19 nt, Homo sapiens
gagaccugcuguauuuuga

SEQ ID NO: 789630 - RNA, 19 nt, Homo sapiens
ccgaggugcuggucaacau

SEQ ID NO: 789631 - RNA, 19 nt, Homo sapiens
gcccgagaccugcuguauu

SEQ ID NO: 789632 - RNA, 19 nt, Homo sapiens
aggcugcucugguguaugg

SEQ ID NO: 789633 - RNA, 19 nt, Homo sapiens
gcagucggaggcugaguuc

SEQ ID NO: 789634 - RNA, 19 nt, Homo sapiens
cggccuacauccagcacaa

SEQ ID NO: 789635 - RNA, 19 nt, Homo sapiens
ccaccgaacccugcagaga

SEQ ID NO: 789636 - RNA, 19 nt, Homo sapiens
gcccuggucaccucuauca

SEQ ID NO: 789637 - RNA, 19 nt, Homo sapiens
ugcauggguucaacagcua

SEQ ID NO: 789638 - RNA, 19 nt, Homo sapiens
agauggccaugaacaguca

SEQ ID NO: 789639 - RNA, 19 nt, Homo sapiens
caccagcugcgcucacuga

SEQ ID NO: 789640 - RNA, 19 nt, Homo sapiens
ggaugaugagcuucgcaaa

SEQ ID NO: 789641 - RNA, 19 nt, Homo sapiens
ggaggagaacgggaucuuc

SEQ ID NO: 789642 - RNA, 19 nt, Homo sapiens
ggacuuccugggcccauag

SEQ ID NO: 789643 - RNA, 19 nt, Homo sapiens
ggugcuggucaacaucaua

SEQ ID NO: 789644 - RNA, 19 nt, Homo sapiens
ggacaagagcguggagaac

SEQ ID NO: 789645 - RNA, 19 nt, Homo sapiens
ucaggccacucgccagaag

SEQ ID NO: 789646 - RNA, 19 nt, Homo sapiens
ccagcgaccaccugaagga

SEQ ID NO: 789647 - RNA, 19 nt, Homo sapiens
gaggugcuggucaacauca

SEQ ID NO: 789648 - RNA, 19 nt, Homo sapiens
gggcaaaugcgaggacaag

SEQ ID NO: 789649 - RNA, 19 nt, Homo sapiens
gaugaugagcuucgcaaaa

SEQ ID NO: 789650 - RNA, 19 nt, Homo sapiens
gugaagauaguuggguuug

SEQ ID NO: 789651 - RNA, 19 nt, Homo sapiens
aaagauggccaugaacagu

SEQ ID NO: 789652 - RNA, 19 nt, Homo sapiens
uaaagauggccaugaacag

SEQ ID NO: 789653 - RNA, 19 nt, Homo sapiens
auaaagauggccaugaaca

SEQ ID NO: 789654 - RNA, 19 nt, Homo sapiens
uagcugugcucaacaaccu

SEQ ID NO: 789655 - RNA, 19 nt, Homo sapiens
cgaugcagccgccaagaag

SEQ ID NO: 789656 - RNA, 19 nt, Homo sapiens
gagaaccgcuacuuugaaa

SEQ ID NO: 789657 - RNA, 19 nt, Homo sapiens
gagaacacgcucuucauua

SEQ ID NO: 789658 - RNA, 19 nt, Homo sapiens
gcagagagaaagauugaua

SEQ ID NO: 789659 - RNA, 19 nt, Homo sapiens
caacagcccuuuccacauc

SEQ ID NO: 789660 - RNA, 19 nt, Homo sapiens
gaagaaggguggugaagac

SEQ ID NO: 789661 - RNA, 19 nt, Homo sapiens
cagggaagauggagaacua

SEQ ID NO: 789662 - RNA, 19 nt, Homo sapiens
agaaggagcuggacacugu

SEQ ID NO: 789663 - RNA, 19 nt, Homo sapiens
ccaaggaggucaaguccaa

SEQ ID NO: 789664 - RNA, 19 nt, Homo sapiens
aaacugaucccaaagauug

SEQ ID NO: 789665 - RNA, 19 nt, Homo sapiens
gaccugcgcucaugcuuug

SEQ ID NO: 789666 - RNA, 19 nt, Homo sapiens
caccaaggcuguguacuuu

SEQ ID NO: 789667 - RNA, 19 nt, Homo sapiens
gcccagggauguucugauu

SEQ ID NO: 789668 - RNA, 19 nt, Homo sapiens
agaacacgcucuucauuau

SEQ ID NO: 789669 - RNA, 19 nt, Homo sapiens
gaggucaaguccaaacuga

SEQ ID NO: 789670 - RNA, 19 nt, Homo sapiens
agaaggaucuggaggucua

SEQ ID NO: 789671 - RNA, 19 nt, Homo sapiens
ggucugacuuucucuucua

SEQ ID NO: 789672 - RNA, 19 nt, Homo sapiens
gaaccgcuacuuugaaaug

SEQ ID NO: 789673 - RNA, 19 nt, Homo sapiens
gacuucaccugucgccuua

SEQ ID NO: 789674 - RNA, 19 nt, Homo sapiens
ccaaggugcuggcucaguu

SEQ ID NO: 789675 - RNA, 19 nt, Homo sapiens
cagagccacugcaggauuu

SEQ ID NO: 789676 - RNA, 19 nt, Homo sapiens
acaacaagcucuccuccuu

SEQ ID NO: 789677 - RNA, 19 nt, Homo sapiens
guuggcaucuugcugcuaa

SEQ ID NO: 789678 - RNA, 19 nt, Homo sapiens
gaaacugaucccaaagauu

SEQ ID NO: 789679 - RNA, 19 nt, Homo sapiens
caaccucgaugaaggaagu

SEQ ID NO: 789680 - RNA, 19 nt, Homo sapiens
ccaaggcuguguacuuugu

SEQ ID NO: 789681 - RNA, 19 nt, Homo sapiens
gcagaggccucaacuucag

SEQ ID NO: 789682 - RNA, 19 nt, Homo sapiens
gcugagaaccgcuacuuug

SEQ ID NO: 789683 - RNA, 19 nt, Homo sapiens
ggaccugagucacaaugga

SEQ ID NO: 789684 - RNA, 19 nt, Homo sapiens
ggccucaacuucagcuuug

SEQ ID NO: 789685 - RNA, 19 nt, Homo sapiens
ccaauaaagcagaguuuga

SEQ ID NO: 789686 - RNA, 19 nt, Homo sapiens
gcaggcaaccuccuagaga

SEQ ID NO: 789687 - RNA, 19 nt, Homo sapiens
gaucgacgagucugugaaa

SEQ ID NO: 789688 - RNA, 19 nt, Homo sapiens
gguccucggugguguucua

SEQ ID NO: 789689 - RNA, 19 nt, Homo sapiens
cagcagaggccucaacuuc

SEQ ID NO: 789690 - RNA, 19 nt, Homo sapiens
ugacuguccucgcagagaa

SEQ ID NO: 789691 - RNA, 19 nt, Homo sapiens
uguauaaccuugugcaucu

SEQ ID NO: 789692 - RNA, 19 nt, Homo sapiens
ugaaacugaucccaaagau

SEQ ID NO: 789693 - RNA, 19 nt, Homo sapiens
gcacgugucucugcugaac

SEQ ID NO: 789694 - RNA, 19 nt, Homo sapiens
gaacaucaagaccuuaaac

SEQ ID NO: 789695 - RNA, 19 nt, Homo sapiens
gaagcuugguggagaagag

SEQ ID NO: 789696 - RNA, 19 nt, Homo sapiens
ucuagucgcgucaaguuua

SEQ ID NO: 789697 - RNA, 19 nt, Homo sapiens
ggacuacucaggcaacauc

SEQ ID NO: 789698 - RNA, 19 nt, Homo sapiens
gaacacgcucuucauuauc

SEQ ID NO: 789699 - RNA, 19 nt, Homo sapiens
aaacugagcaacccagaga

SEQ ID NO: 789700 - RNA, 19 nt, Homo sapiens
caacaggaucgaacagaug

SEQ ID NO: 789701 - RNA, 19 nt, Homo sapiens
gggaacaucaagaccuuaa

SEQ ID NO: 789702 - RNA, 19 nt, Homo sapiens
gcaccuguauaaccuugug

SEQ ID NO: 789703 - RNA, 19 nt, Homo sapiens
gagcugauccacucuaguc

SEQ ID NO: 789704 - RNA, 19 nt, Homo sapiens
ccacagggaagauggagaa

SEQ ID NO: 789705 - RNA, 19 nt, Homo sapiens
ggaccugcgcucaugcuuu

SEQ ID NO: 789706 - RNA, 19 nt, Homo sapiens
gagcuuguggacacuuaua

SEQ ID NO: 789707 - RNA, 19 nt, Homo sapiens
cgacgagucugugaaacug

SEQ ID NO: 789708 - RNA, 19 nt, Homo sapiens
cgaguccaguccuuuguug

SEQ ID NO: 789709 - RNA, 19 nt, Homo sapiens
ccaccaaggcuguguacuu

SEQ ID NO: 789710 - RNA, 19 nt, Homo sapiens
ugagaacacgcucuucauu

SEQ ID NO: 789711 - RNA, 19 nt, Homo sapiens
gccguucgaccuaucaaua

SEQ ID NO: 789712 - RNA, 19 nt, Homo sapiens
acaggcagcuuccgaugau

SEQ ID NO: 789713 - RNA, 19 nt, Homo sapiens
gaggagguccggagcauag

SEQ ID NO: 789714 - RNA, 19 nt, Homo sapiens
cagagagaaagauugauaa

SEQ ID NO: 789715 - RNA, 19 nt, Homo sapiens
ggcgaggucuuugccauug

SEQ ID NO: 789716 - RNA, 19 nt, Homo sapiens
gcagcaggcuuuuguguuc

SEQ ID NO: 789717 - RNA, 19 nt, Homo sapiens
ccgccaaccugcacgaguu

SEQ ID NO: 789718 - RNA, 19 nt, Homo sapiens
ggaagaggaggaugaagag

SEQ ID NO: 789719 - RNA, 19 nt, Homo sapiens
ucaccugucgccuuaagua

SEQ ID NO: 789720 - RNA, 19 nt, Homo sapiens
gccagcugcucaccuucua

SEQ ID NO: 789721 - RNA, 19 nt, Homo sapiens
acaccagccugcaggaguu

SEQ ID NO: 789722 - RNA, 19 nt, Homo sapiens
ggaggaagaggaggaugaa

SEQ ID NO: 789723 - RNA, 19 nt, Homo sapiens
ggacgugccaggagcuguu

SEQ ID NO: 789724 - RNA, 19 nt, Homo sapiens
agccaugaguggacaguaa

SEQ ID NO: 789725 - RNA, 19 nt, Homo sapiens
cggagcuuguggacacuua

SEQ ID NO: 789726 - RNA, 19 nt, Homo sapiens
ggaggaagaggaggaggaa

SEQ ID NO: 789727 - RNA, 19 nt, Homo sapiens
ggcagcuuccgaugauuua

SEQ ID NO: 789728 - RNA, 19 nt, Homo sapiens
cgacuuccaugaccugcau

SEQ ID NO: 789729 - RNA, 19 nt, Homo sapiens
caucaaggccgacuucaac

SEQ ID NO: 789730 - RNA, 19 nt, Homo sapiens
acaacaggaucgaacagau

SEQ ID NO: 789731 - RNA, 19 nt, Homo sapiens
ggaagauggagaacuacga

SEQ ID NO: 789732 - RNA, 19 nt, Homo sapiens
gaccugcagucagucaaug

SEQ ID NO: 789733 - RNA, 19 nt, Homo sapiens
gcacauccgcauccucaag

SEQ ID NO: 789734 - RNA, 19 nt, Homo sapiens
gacaggcagcuuccgauga

SEQ ID NO: 789735 - RNA, 19 nt, Homo sapiens
uaaccaaggaaucauguuc

SEQ ID NO: 789736 - RNA, 19 nt, Homo sapiens
aaagcucguugcagagaga

SEQ ID NO: 789737 - RNA, 19 nt, Homo sapiens
cugugaaacugaucccaaa

SEQ ID NO: 789738 - RNA, 19 nt, Homo sapiens
ucaaggugcuguggugcuu

SEQ ID NO: 789739 - RNA, 19 nt, Homo sapiens
ugagaaccgcuacuuugaa

SEQ ID NO: 789740 - RNA, 19 nt, Homo sapiens
guggacacuuauacgguuu

SEQ ID NO: 789741 - RNA, 19 nt, Homo sapiens
ggaacaucaagaccuuaaa

SEQ ID NO: 789742 - RNA, 19 nt, Homo sapiens
ugucgugucugcuguugug

SEQ ID NO: 789743 - RNA, 19 nt, Homo sapiens
gcuacacggccaccaauca

SEQ ID NO: 789744 - RNA, 19 nt, Homo sapiens
acacuuauacgguuuacau

SEQ ID NO: 789745 - RNA, 19 nt, Homo sapiens
ggaggagguccggagcaua

SEQ ID NO: 789746 - RNA, 19 nt, Homo sapiens
gugaaacugaucccaaaga

SEQ ID NO: 789747 - RNA, 19 nt, Homo sapiens
gagggcuggucgcaucgaa

SEQ ID NO: 789748 - RNA, 19 nt, Homo sapiens
cguucgaccuaucaauauu

SEQ ID NO: 789749 - RNA, 19 nt, Homo sapiens
guugugggaccguuguuaa

SEQ ID NO: 789750 - RNA, 19 nt, Homo sapiens
agaguuugacaccgucuua

SEQ ID NO: 789751 - RNA, 19 nt, Homo sapiens
gauuccugcugccuguauu

SEQ ID NO: 789752 - RNA, 19 nt, Homo sapiens
gcaucgcagucuucgagau

SEQ ID NO: 789753 - RNA, 19 nt, Homo sapiens
aggaggacguggcugagaa

SEQ ID NO: 789754 - RNA, 19 nt, Homo sapiens
ugagcaacccagagaagaa

SEQ ID NO: 789755 - RNA, 19 nt, Homo sapiens
acacagugaccacagagaa

SEQ ID NO: 789756 - RNA, 19 nt, Homo sapiens
ggagggagaucguuuguuu

SEQ ID NO: 789757 - RNA, 19 nt, Homo sapiens
agacaguucucuaugcuua

SEQ ID NO: 789758 - RNA, 19 nt, Homo sapiens
gaaaagaccuuccccugaa

SEQ ID NO: 789759 - RNA, 19 nt, Homo sapiens
ggaagcagcagacagauga

SEQ ID NO: 789760 - RNA, 19 nt, Homo sapiens
gguaggauaucccugauuc

SEQ ID NO: 789761 - RNA, 19 nt, Homo sapiens
ggucuuuucugucuaaaua

SEQ ID NO: 789762 - RNA, 19 nt, Homo sapiens
cgaggcaucuggaggagaa

SEQ ID NO: 789763 - RNA, 19 nt, Homo sapiens
gaucaagcaucuggcauca

SEQ ID NO: 789764 - RNA, 19 nt, Homo sapiens
ggagucaguuucagacagu

SEQ ID NO: 789765 - RNA, 19 nt, Homo sapiens
caauguugcccuuggauuu

SEQ ID NO: 789766 - RNA, 19 nt, Homo sapiens
ccaaucaaagcaaauguuu

SEQ ID NO: 789767 - RNA, 19 nt, Homo sapiens
gcugcaacaucuucaucua

SEQ ID NO: 789768 - RNA, 19 nt, Homo sapiens
gcaaagagaaggcccugau

SEQ ID NO: 789769 - RNA, 19 nt, Homo sapiens
acagagacccuccuccuuu

SEQ ID NO: 789770 - RNA, 19 nt, Homo sapiens
gcaugaagcgccucaaagu

SEQ ID NO: 789771 - RNA, 19 nt, Homo sapiens
ucucuuaauuucucccuuu

SEQ ID NO: 789772 - RNA, 19 nt, Homo sapiens
ucagagauccuccagaugu

SEQ ID NO: 789773 - RNA, 19 nt, Homo sapiens
uaauuucucccuuugcuuu

SEQ ID NO: 789774 - RNA, 19 nt, Homo sapiens
ggaagagguuuuagggaaa

SEQ ID NO: 789775 - RNA, 19 nt, Homo sapiens
gagggagaucguuuguuua

SEQ ID NO: 789776 - RNA, 19 nt, Homo sapiens
cagagacccuccuccuuuc

SEQ ID NO: 789777 - RNA, 19 nt, Homo sapiens
cagagauccuccagauguu

SEQ ID NO: 789778 - RNA, 19 nt, Homo sapiens
acucagagauccuccagau

SEQ ID NO: 789779 - RNA, 19 nt, Homo sapiens
gcccaccacuuaucuccuu

SEQ ID NO: 789780 - RNA, 19 nt, Homo sapiens
caacagcagcagcagcaaa

SEQ ID NO: 789781 - RNA, 19 nt, Homo sapiens
gaugaggacguccggaaga

SEQ ID NO: 789782 - RNA, 19 nt, Homo sapiens
gaagggccauggcuaugcu

SEQ ID NO: 789783 - RNA, 19 nt, Homo sapiens
ccaguucccagcccucuaa

SEQ ID NO: 789784 - RNA, 19 nt, Homo sapiens
gguucccucuguguaaaua

SEQ ID NO: 789785 - RNA, 19 nt, Homo sapiens
gaccgagccaccaaucaaa

SEQ ID NO: 789786 - RNA, 19 nt, Homo sapiens
acaguucucuaugcuuauu

SEQ ID NO: 789787 - RNA, 19 nt, Homo sapiens
gcugguucccucuguguaa

SEQ ID NO: 789788 - RNA, 19 nt, Homo sapiens
gggaagccaacgagagauu

SEQ ID NO: 789789 - RNA, 19 nt, Homo sapiens
gcccaucuucgaacaguuu

SEQ ID NO: 789790 - RNA, 19 nt, Homo sapiens
gagguaggauaucccugau

SEQ ID NO: 789791 - RNA, 19 nt, Homo sapiens
cagggaagccaacgagaga

SEQ ID NO: 789792 - RNA, 19 nt, Homo sapiens
caaagagaaggcccugaug

SEQ ID NO: 789793 - RNA, 19 nt, Homo sapiens
gaggacguccggaagaugu

SEQ ID NO: 789794 - RNA, 19 nt, Homo sapiens
acaguuuggucggaucuuu

SEQ ID NO: 789795 - RNA, 19 nt, Homo sapiens
agacaauguugcccuugga

SEQ ID NO: 789796 - RNA, 19 nt, Homo sapiens
gagauccuccagauguuug

SEQ ID NO: 789797 - RNA, 19 nt, Homo sapiens
gaagccaacgagagauuca

SEQ ID NO: 789798 - RNA, 19 nt, Homo sapiens
ccagauggcaccagcaaag

SEQ ID NO: 789799 - RNA, 19 nt, Homo sapiens
uagggaagcagcagacaga

SEQ ID NO: 789800 - RNA, 19 nt, Homo sapiens
cugcugggcuccugugaca

SEQ ID NO: 789801 - RNA, 19 nt, Homo sapiens
ugaccgagccaccaaucaa

SEQ ID NO: 789802 - RNA, 19 nt, Homo sapiens
ggacguccggaagauguuu

SEQ ID NO: 789803 - RNA, 19 nt, Homo sapiens
gcugccaucucucuuucug

SEQ ID NO: 789804 - RNA, 19 nt, Homo sapiens
ucagcuagagguaggauau

SEQ ID NO: 789805 - RNA, 19 nt, Homo sapiens
ugaaguuugcugacacuga

SEQ ID NO: 789806 - RNA, 19 nt, Homo sapiens
gcccauuuccuccuagaug

SEQ ID NO: 789807 - RNA, 19 nt, Homo sapiens
gcaacaucuucaucuacca

SEQ ID NO: 789808 - RNA, 19 nt, Homo sapiens
gccuccagcucucaucuca

SEQ ID NO: 789809 - RNA, 19 nt, Homo sapiens
gggaugugccuuccugaca

SEQ ID NO: 789810 - RNA, 19 nt, Homo sapiens
gaacaguuuggucggaucu

SEQ ID NO: 789811 - RNA, 19 nt, Homo sapiens
ucagacaguucucuaugcu

SEQ ID NO: 789812 - RNA, 19 nt, Homo sapiens
gacgcugccaucucucuuu

SEQ ID NO: 789813 - RNA, 19 nt, Homo sapiens
ccacgucaucucagccaaa

SEQ ID NO: 789814 - RNA, 19 nt, Homo sapiens
gggaagcagcagacagaug

SEQ ID NO: 789815 - RNA, 19 nt, Homo sapiens
gccucaaaguccagcuaaa

SEQ ID NO: 789816 - RNA, 19 nt, Homo sapiens
ggugaaguuugcugacacu

SEQ ID NO: 789817 - RNA, 19 nt, Homo sapiens
ggaagccaacgagagauuc

SEQ ID NO: 789818 - RNA, 19 nt, Homo sapiens
uuaaacaguuggucuuuuc

SEQ ID NO: 789819 - RNA, 19 nt, Homo sapiens
ccaccaaucaaagcaaaug

SEQ ID NO: 789820 - RNA, 19 nt, Homo sapiens
ccagauguuuguccccuuu

SEQ ID NO: 789821 - RNA, 19 nt, Homo sapiens
gcagcagcagcaaagagaa

SEQ ID NO: 789822 - RNA, 19 nt, Homo sapiens
ucugggaguuuagacaaug

SEQ ID NO: 789823 - RNA, 19 nt, Homo sapiens
gggcccauuuccuccuaga

SEQ ID NO: 789824 - RNA, 19 nt, Homo sapiens
guggugaaguuugcugaca

SEQ ID NO: 789825 - RNA, 19 nt, Homo sapiens
gugcccagcguuuguacuu

SEQ ID NO: 789826 - RNA, 19 nt, Homo sapiens
gcuaaagcggccuaaggau

SEQ ID NO: 789827 - RNA, 19 nt, Homo sapiens
cagcuaaagcggccuaagg

SEQ ID NO: 789828 - RNA, 19 nt, Homo sapiens
gugccuuccugacauacug

SEQ ID NO: 789829 - RNA, 19 nt, Homo sapiens
ggacgcugccaucucucuu

SEQ ID NO: 789830 - RNA, 19 nt, Homo sapiens
cacuaccacccgugcguua

SEQ ID NO: 789831 - RNA, 19 nt, Homo sapiens
ccuccuagaugcccuuuug

SEQ ID NO: 789832 - RNA, 19 nt, Homo sapiens
cggcaugaagcgccucaaa

SEQ ID NO: 789833 - RNA, 19 nt, Homo sapiens
ccaucgcccuccaguuugg

SEQ ID NO: 789834 - RNA, 19 nt, Homo sapiens
ggaggagaaggaccugaag

SEQ ID NO: 789835 - RNA, 19 nt, Homo sapiens
gcaagcagcugucguagaa

SEQ ID NO: 789836 - RNA, 19 nt, Homo sapiens
gaagaaagaccaaaugauu

SEQ ID NO: 789837 - RNA, 19 nt, Homo sapiens
gaacaugaagcaucucuua

SEQ ID NO: 789838 - RNA, 19 nt, Homo sapiens
ggaccucgcugaacaacua

SEQ ID NO: 789839 - RNA, 19 nt, Homo sapiens
gaacucagaugccaagugu

SEQ ID NO: 789840 - RNA, 19 nt, Homo sapiens
caacggaucuggaagaaug

SEQ ID NO: 789841 - RNA, 19 nt, Homo sapiens
gaagagcgucuaacugaua

SEQ ID NO: 789842 - RNA, 19 nt, Homo sapiens
acaagaagcugacucuauu

SEQ ID NO: 789843 - RNA, 19 nt, Homo sapiens
ucagagagcucgagaagga

SEQ ID NO: 789844 - RNA, 19 nt, Homo sapiens
gagcagagcuacagcgaau

SEQ ID NO: 789845 - RNA, 19 nt, Homo sapiens
gaaggcagcccaugagaaa

SEQ ID NO: 789846 - RNA, 19 nt, Homo sapiens
ggagacaaaucacacagaa

SEQ ID NO: 789847 - RNA, 19 nt, Homo sapiens
ggaggaggcucugaggaua

SEQ ID NO: 789848 - RNA, 19 nt, Homo sapiens
gggaugagcuaaugaggaa

SEQ ID NO: 789849 - RNA, 19 nt, Homo sapiens
caacagagccaacauuuca

SEQ ID NO: 789850 - RNA, 19 nt, Homo sapiens
gaaaggagccaggaguuaa

SEQ ID NO: 789851 - RNA, 19 nt, Homo sapiens
gacccuagcugaaagagaa

SEQ ID NO: 789852 - RNA, 19 nt, Homo sapiens
gaauuggacucuaguaucu

SEQ ID NO: 789853 - RNA, 19 nt, Homo sapiens
uaauacagcugaagaguca

SEQ ID NO: 789854 - RNA, 19 nt, Homo sapiens
gaagaggaaccaagaggua

SEQ ID NO: 789855 - RNA, 19 nt, Homo sapiens
agaaggagcuggagagaga

SEQ ID NO: 789856 - RNA, 19 nt, Homo sapiens
gaaaugaagucagcuacug

SEQ ID NO: 789857 - RNA, 19 nt, Homo sapiens
ggaacuacaugaaacuaug

SEQ ID NO: 789858 - RNA, 19 nt, Homo sapiens
gaacaaccuggaagccuua

SEQ ID NO: 789859 - RNA, 19 nt, Homo sapiens
gcacagagaugaccuugcu

SEQ ID NO: 789860 - RNA, 19 nt, Homo sapiens
caugaagcaucucuuagua

SEQ ID NO: 789861 - RNA, 19 nt, Homo sapiens
gaaggaagcccaugaaagg

SEQ ID NO: 789862 - RNA, 19 nt, Homo sapiens
gaaggcugcuuuggaauug

SEQ ID NO: 789863 - RNA, 19 nt, Homo sapiens
gggcagcggccucuuguua

SEQ ID NO: 789864 - RNA, 19 nt, Homo sapiens
aagcugacguggugaauaa

SEQ ID NO: 789865 - RNA, 19 nt, Homo sapiens
gaagggaagggcccaagua

SEQ ID NO: 789866 - RNA, 19 nt, Homo sapiens
ggagaccacugggauacua

SEQ ID NO: 789867 - RNA, 19 nt, Homo sapiens
ugagaacucuuuggaauug

SEQ ID NO: 789868 - RNA, 19 nt, Homo sapiens
gagagacccaggaguauaa

SEQ ID NO: 789869 - RNA, 19 nt, Homo sapiens
ggagaaggaggcccuagua

SEQ ID NO: 789870 - RNA, 19 nt, Homo sapiens
caugagaacucuuuggaau

SEQ ID NO: 789871 - RNA, 19 nt, Homo sapiens
gaggagaaguugucuuuac

SEQ ID NO: 789872 - RNA, 19 nt, Homo sapiens
guaggaagguagaguuguu

SEQ ID NO: 789873 - RNA, 19 nt, Homo sapiens
gagaagaaagaccaaauga

SEQ ID NO: 789874 - RNA, 19 nt, Homo sapiens
caugaaaguccagaaauua

SEQ ID NO: 789875 - RNA, 19 nt, Homo sapiens
agaaggagguggaauguca

SEQ ID NO: 789876 - RNA, 19 nt, Homo sapiens
aagcagaacucccuagaau

SEQ ID NO: 789877 - RNA, 19 nt, Homo sapiens
ggagucaagucaccuggaa

SEQ ID NO: 789878 - RNA, 19 nt, Homo sapiens
ggaacaaucucuaaaacuu

SEQ ID NO: 789879 - RNA, 19 nt, Homo sapiens
gaguauaaccgaauucaga

SEQ ID NO: 789880 - RNA, 19 nt, Homo sapiens
uaaaggagcagcagacaga

SEQ ID NO: 789881 - RNA, 19 nt, Homo sapiens
gaaggaggcccuaguacga

SEQ ID NO: 789882 - RNA, 19 nt, Homo sapiens
aaaugaggcuuuggcguua

SEQ ID NO: 789883 - RNA, 19 nt, Homo sapiens
uggcugaacugcagaaaga

SEQ ID NO: 789884 - RNA, 19 nt, Homo sapiens
gcacagagagccagcuaga

SEQ ID NO: 789885 - RNA, 19 nt, Homo sapiens
cagaauuaauggaacauga

SEQ ID NO: 789886 - RNA, 19 nt, Homo sapiens
agacaaaucacacagaauu

SEQ ID NO: 789887 - RNA, 19 nt, Homo sapiens
gaacggaggaagcugaaga

SEQ ID NO: 789888 - RNA, 19 nt, Homo sapiens
gagaauaugauccaagaga

SEQ ID NO: 789889 - RNA, 19 nt, Homo sapiens
ggagcuaggagccucuuua

SEQ ID NO: 789890 - RNA, 19 nt, Homo sapiens
gcagaacucccuagaaucu

SEQ ID NO: 789891 - RNA, 19 nt, Homo sapiens
ugagagagacccaggagua

SEQ ID NO: 789892 - RNA, 19 nt, Homo sapiens
ggagagcagucuguuugaa

SEQ ID NO: 789893 - RNA, 19 nt, Homo sapiens
gacaaaucacacagaauua

SEQ ID NO: 789894 - RNA, 19 nt, Homo sapiens
gcacguaaucuauccgaaa

SEQ ID NO: 789895 - RNA, 19 nt, Homo sapiens
ggacauguacugccucuca

SEQ ID NO: 789896 - RNA, 19 nt, Homo sapiens
ggagaaggcccaggacuug

SEQ ID NO: 789897 - RNA, 19 nt, Homo sapiens
gagagaagaggaggagaua

SEQ ID NO: 789898 - RNA, 19 nt, Homo sapiens
gagcuaggagccucuuuaa

SEQ ID NO: 789899 - RNA, 19 nt, Homo sapiens
acaugaaaguccagaaauu

SEQ ID NO: 789900 - RNA, 19 nt, Homo sapiens
gagccaacauuucauagca

SEQ ID NO: 789901 - RNA, 19 nt, Homo sapiens
agaaagagcaucugacuca

SEQ ID NO: 789902 - RNA, 19 nt, Homo sapiens
gcaccguucuggcaagaga

SEQ ID NO: 789903 - RNA, 19 nt, Homo sapiens
uugcagagcugucgaguuc

SEQ ID NO: 789904 - RNA, 19 nt, Homo sapiens
ggaccaggaucuccgauac

SEQ ID NO: 789905 - RNA, 19 nt, Homo sapiens
gcaguugguuacucuggaa

SEQ ID NO: 789906 - RNA, 19 nt, Homo sapiens
gaaagcagaacucccuaga

SEQ ID NO: 789907 - RNA, 19 nt, Homo sapiens
ggaagagcgucuaacugau

SEQ ID NO: 789908 - RNA, 19 nt, Homo sapiens
gcucagauggaauuacuaa

SEQ ID NO: 789909 - RNA, 19 nt, Homo sapiens
ggcgggagguugugacauu

SEQ ID NO: 789910 - RNA, 19 nt, Homo sapiens
gcauggcaaugguuagaga

SEQ ID NO: 789911 - RNA, 19 nt, Homo sapiens
ggaagcagaagcaggacua

SEQ ID NO: 789912 - RNA, 19 nt, Homo sapiens
aagagaauaugauccaaga

SEQ ID NO: 789913 - RNA, 19 nt, Homo sapiens
ggagcaagcccauaugaca

SEQ ID NO: 789914 - RNA, 19 nt, Homo sapiens
gcaggagcauauccaugaa

SEQ ID NO: 789915 - RNA, 19 nt, Homo sapiens
gcucagugcucagauggaa

SEQ ID NO: 789916 - RNA, 19 nt, Homo sapiens
gggaagcccuggagucaag

SEQ ID NO: 789917 - RNA, 19 nt, Homo sapiens
aagcaacccuugugaggaa

SEQ ID NO: 789918 - RNA, 19 nt, Homo sapiens
gaauggagaagcagucaug

SEQ ID NO: 789919 - RNA, 19 nt, Homo sapiens
aagcugauccugcgugaua

SEQ ID NO: 789920 - RNA, 19 nt, Homo sapiens
gggaagggcccaaguaaag

SEQ ID NO: 789921 - RNA, 19 nt, Homo sapiens
agacagcucucccagaauc

SEQ ID NO: 789922 - RNA, 19 nt, Homo sapiens
ucagggacauccaagaaga

SEQ ID NO: 789923 - RNA, 19 nt, Homo sapiens
ggaagaaggggacaauaua

SEQ ID NO: 789924 - RNA, 19 nt, Homo sapiens
ggacagaagaacucagaug

SEQ ID NO: 789925 - RNA, 19 nt, Homo sapiens
ggagguagccauguuccua

SEQ ID NO: 789926 - RNA, 19 nt, Homo sapiens
gcaaaggaacaaccuggaa

SEQ ID NO: 789927 - RNA, 19 nt, Homo sapiens
cacgaaggcuggaggaaga

SEQ ID NO: 789928 - RNA, 19 nt, Homo sapiens
gaggagagggugaaggaaa

SEQ ID NO: 789929 - RNA, 19 nt, Homo sapiens
caagcucagugccuuaaau

SEQ ID NO: 789930 - RNA, 19 nt, Homo sapiens
ggaaugcgcaagaggagaa

SEQ ID NO: 789931 - RNA, 19 nt, Homo sapiens
gaacccaacggaucuggaa

SEQ ID NO: 789932 - RNA, 19 nt, Homo sapiens
gagaucugauggagcuaaa

SEQ ID NO: 789933 - RNA, 19 nt, Homo sapiens
gaaguggcauggcaauggu

SEQ ID NO: 789934 - RNA, 19 nt, Homo sapiens
ccucucaucuagaauuuau

SEQ ID NO: 789935 - RNA, 19 nt, Homo sapiens
ggagaaaccugaaggauuu

SEQ ID NO: 789936 - RNA, 19 nt, Homo sapiens
uaagaugacuguacaugua

SEQ ID NO: 789937 - RNA, 19 nt, Homo sapiens
gaugaaggcuugaucuaaa

SEQ ID NO: 789938 - RNA, 19 nt, Homo sapiens
gauauuaacuguuguccaa

SEQ ID NO: 789939 - RNA, 19 nt, Homo sapiens
gaaagaggaaagaaucaua

SEQ ID NO: 789940 - RNA, 19 nt, Homo sapiens
gaccagagguggaaagaug

SEQ ID NO: 789941 - RNA, 19 nt, Homo sapiens
gagaauggcaagaaauuaa

SEQ ID NO: 789942 - RNA, 19 nt, Homo sapiens
gcacauugauauuaacugu

SEQ ID NO: 789943 - RNA, 19 nt, Homo sapiens
gguagaagguuuaagugaa

SEQ ID NO: 789944 - RNA, 19 nt, Homo sapiens
ugagaaagcugauguaaaa

SEQ ID NO: 789945 - RNA, 19 nt, Homo sapiens
acaaauaaguaucggagua

SEQ ID NO: 789946 - RNA, 19 nt, Homo sapiens
ggcaagaaauuaaacaaga

SEQ ID NO: 789947 - RNA, 19 nt, Homo sapiens
gggagaaaccugaugauuu

SEQ ID NO: 789948 - RNA, 19 nt, Homo sapiens
ggagguagauuuggaacuu

SEQ ID NO: 789949 - RNA, 19 nt, Homo sapiens
ucagugagauuaaacagaa

SEQ ID NO: 789950 - RNA, 19 nt, Homo sapiens
gaaacagaauucauuaggu

SEQ ID NO: 789951 - RNA, 19 nt, Homo sapiens
ccaaagugguauuuaaaga

SEQ ID NO: 789952 - RNA, 19 nt, Homo sapiens
gacaucaaaucaacagaaa

SEQ ID NO: 789953 - RNA, 19 nt, Homo sapiens
gacaauaggccuaguguug

SEQ ID NO: 789954 - RNA, 19 nt, Homo sapiens
cagcugcccugaaagcaua

SEQ ID NO: 789955 - RNA, 19 nt, Homo sapiens
uggcuuaccuuacucaauu

SEQ ID NO: 789956 - RNA, 19 nt, Homo sapiens
cuucagaugugcuuaauau

SEQ ID NO: 789957 - RNA, 19 nt, Homo sapiens
gcauauuuauccugcauug

SEQ ID NO: 789958 - RNA, 19 nt, Homo sapiens
gaagaccguuuggguagaa

SEQ ID NO: 789959 - RNA, 19 nt, Homo sapiens
gaacuuccaagcacugaaa

SEQ ID NO: 789960 - RNA, 19 nt, Homo sapiens
gcaagaaauuaaacaagag

SEQ ID NO: 789961 - RNA, 19 nt, Homo sapiens
ggagaauggcaagaaauua

SEQ ID NO: 789962 - RNA, 19 nt, Homo sapiens
ggaagucacagccaaagaa

SEQ ID NO: 789963 - RNA, 19 nt, Homo sapiens
ggaaagaaucauaaggaaa

SEQ ID NO: 789964 - RNA, 19 nt, Homo sapiens
gaguucacauucuagcaua

SEQ ID NO: 789965 - RNA, 19 nt, Homo sapiens
gagaagaacugaaaaugga

SEQ ID NO: 789966 - RNA, 19 nt, Homo sapiens
gaaaucaaacccauaugga

SEQ ID NO: 789967 - RNA, 19 nt, Homo sapiens
gaggaaagaaucauaagga

SEQ ID NO: 789968 - RNA, 19 nt, Homo sapiens
caauaggccuaguguugaa

SEQ ID NO: 789969 - RNA, 19 nt, Homo sapiens
gaacccaaagugguauuua

SEQ ID NO: 789970 - RNA, 19 nt, Homo sapiens
gaagaugguuuuaccuauu

SEQ ID NO: 789971 - RNA, 19 nt, Homo sapiens
ccaccuaccucgacaucaa

SEQ ID NO: 789972 - RNA, 19 nt, Homo sapiens
guagaagguuuaagugaag

SEQ ID NO: 789973 - RNA, 19 nt, Homo sapiens
uuaaagcuguguagaugaa

SEQ ID NO: 789974 - RNA, 19 nt, Homo sapiens
gaagugacccagaaacaca

SEQ ID NO: 789975 - RNA, 19 nt, Homo sapiens
gggagaaaccugaaggauu

SEQ ID NO: 789976 - RNA, 19 nt, Homo sapiens
cagaugugcuuaauaugga

SEQ ID NO: 789977 - RNA, 19 nt, Homo sapiens
gaagucacagccaaagaaa

SEQ ID NO: 789978 - RNA, 19 nt, Homo sapiens
gaucuuaucucaggagcau

SEQ ID NO: 789979 - RNA, 19 nt, Homo sapiens
uauaaggucuccagcuuca

SEQ ID NO: 789980 - RNA, 19 nt, Homo sapiens
cgaaaacucuuaagaaauc

SEQ ID NO: 789981 - RNA, 19 nt, Homo sapiens
caucaaaucaacagaaaga

SEQ ID NO: 789982 - RNA, 19 nt, Homo sapiens
gaaagcauaccaagaggau

SEQ ID NO: 789983 - RNA, 19 nt, Homo sapiens
cauauuggcuuaccuuacu

SEQ ID NO: 789984 - RNA, 19 nt, Homo sapiens
gggauaaagaugaaugaaa

SEQ ID NO: 789985 - RNA, 19 nt, Homo sapiens
gaaaagacuuggcuuagag

SEQ ID NO: 789986 - RNA, 19 nt, Homo sapiens
gagguggaaagauguauuu

SEQ ID NO: 789987 - RNA, 19 nt, Homo sapiens
ccagaaacacagaaagaaa

SEQ ID NO: 789988 - RNA, 19 nt, Homo sapiens
gagcauauuuauccugcau

SEQ ID NO: 789989 - RNA, 19 nt, Homo sapiens
ggaacaggaagcagaagaa

SEQ ID NO: 789990 - RNA, 19 nt, Homo sapiens
cacccuagaugaauccaaa

SEQ ID NO: 789991 - RNA, 19 nt, Homo sapiens
aggguuaccauuacuauua

SEQ ID NO: 789992 - RNA, 19 nt, Homo sapiens
caaagcagcaaacguuguu

SEQ ID NO: 789993 - RNA, 19 nt, Homo sapiens
gcccagugaugauuugguu

SEQ ID NO: 789994 - RNA, 19 nt, Homo sapiens
gaugcuauguaucuguuau

SEQ ID NO: 789995 - RNA, 19 nt, Homo sapiens
ucacuucucuuggaguuau

SEQ ID NO: 789996 - RNA, 19 nt, Homo sapiens
uagaaggcauaaccucuga

SEQ ID NO: 789997 - RNA, 19 nt, Homo sapiens
caucagauucgcauaguga

SEQ ID NO: 789998 - RNA, 19 nt, Homo sapiens
ggaaagcgcgagucugagu

SEQ ID NO: 789999 - RNA, 19 nt, Homo sapiens
ugaaccaggcauuguguua

SEQ ID NO: 790000 - RNA, 19 nt, Homo sapiens
cuaccacauugcauuguaa

SEQ ID NO: 790001 - RNA, 19 nt, Homo sapiens
gacagaauggagacuuaua

SEQ ID NO: 790002 - RNA, 19 nt, Homo sapiens
ggguuaccauuacuauuau

SEQ ID NO: 790003 - RNA, 19 nt, Homo sapiens
guacuucagaugugcuuaa

SEQ ID NO: 790004 - RNA, 19 nt, Homo sapiens
ggccuuuauuccauucaua

SEQ ID NO: 790005 - RNA, 19 nt, Homo sapiens
cuuauacacccaaaguuua

SEQ ID NO: 790006 - RNA, 19 nt, Homo sapiens
aacccaaagugguauuuaa

SEQ ID NO: 790007 - RNA, 19 nt, Homo sapiens
ccaagcauaacaccaguaa

SEQ ID NO: 790008 - RNA, 19 nt, Homo sapiens
uauggagaauggcaagaaa

SEQ ID NO: 790009 - RNA, 19 nt, Homo sapiens
ggagacuuauacacccaaa

SEQ ID NO: 790010 - RNA, 19 nt, Homo sapiens
aggaaagaaucauaaggaa

SEQ ID NO: 790011 - RNA, 19 nt, Homo sapiens
cgacaucaaaucaacagaa

SEQ ID NO: 790012 - RNA, 19 nt, Homo sapiens
aagcauaccaagaggauuu

SEQ ID NO: 790013 - RNA, 19 nt, Homo sapiens
cggaguacgugagaauauu

SEQ ID NO: 790014 - RNA, 19 nt, Homo sapiens
aggacagaauggagacuua

SEQ ID NO: 790015 - RNA, 19 nt, Homo sapiens
agucacagccaaagaaauu

SEQ ID NO: 790016 - RNA, 19 nt, Homo sapiens
cuaguaaggucaaugaaaa

SEQ ID NO: 790017 - RNA, 19 nt, Homo sapiens
gaugggagaaaccugauga

SEQ ID NO: 790018 - RNA, 19 nt, Homo sapiens
ccuaccacauugcauugua

SEQ ID NO: 790019 - RNA, 19 nt, Homo sapiens
guuuaucuguguuuguuug

SEQ ID NO: 790020 - RNA, 19 nt, Homo sapiens
uggcuuagagucagaaauu

SEQ ID NO: 790021 - RNA, 19 nt, Homo sapiens
aguauaaggucuccagcuu

SEQ ID NO: 790022 - RNA, 19 nt, Homo sapiens
cuucaaagcagcaaacguu

SEQ ID NO: 790023 - RNA, 19 nt, Homo sapiens
guggaacccuggacgacuu

SEQ ID NO: 790024 - RNA, 19 nt, Homo sapiens
ggaggaagugacccagaaa

SEQ ID NO: 790025 - RNA, 19 nt, Homo sapiens
gcucagguacuucagaugu

SEQ ID NO: 790026 - RNA, 19 nt, Homo sapiens
gugagaaagcugauguaaa

SEQ ID NO: 790027 - RNA, 19 nt, Homo sapiens
ggauaaggcaaaggaagaa

SEQ ID NO: 790028 - RNA, 19 nt, Homo sapiens
uggaggaagugacccagaa

SEQ ID NO: 790029 - RNA, 19 nt, Homo sapiens
uguauuauguucagugucu

SEQ ID NO: 790030 - RNA, 19 nt, Homo sapiens
ggacagaauggagacuuau

SEQ ID NO: 790031 - RNA, 19 nt, Homo sapiens
cggagaacccaaaguggua

SEQ ID NO: 790032 - RNA, 19 nt, Homo sapiens
acaggaagcagaagaagga

SEQ ID NO: 790033 - RNA, 19 nt, Homo sapiens
ucacuuggcacccuagaug

SEQ ID NO: 790034 - RNA, 19 nt, Homo sapiens
gugaucugccuucuaguaa

SEQ ID NO: 790035 - RNA, 19 nt, Homo sapiens
caacugacgugcaggaauu

SEQ ID NO: 790036 - RNA, 19 nt, Homo sapiens
caaccucucuguccuguuu

SEQ ID NO: 790037 - RNA, 19 nt, Homo sapiens
gaauuuaagucauccuuca

SEQ ID NO: 790038 - RNA, 19 nt, Homo sapiens
ggucuuggguacccuauuu

SEQ ID NO: 790039 - RNA, 19 nt, Homo sapiens
augaagagcuccugaagaa

SEQ ID NO: 790040 - RNA, 19 nt, Homo sapiens
uaaaggucguggccaagua

SEQ ID NO: 790041 - RNA, 19 nt, Homo sapiens
gaagagcuccugaagaaag

SEQ ID NO: 790042 - RNA, 19 nt, Homo sapiens
guacacaagggaccacgua

SEQ ID NO: 790043 - RNA, 19 nt, Homo sapiens
gcuucgaggugcugaaaga

SEQ ID NO: 790044 - RNA, 19 nt, Homo sapiens
ccacugcauugucgucaug

SEQ ID NO: 790045 - RNA, 19 nt, Homo sapiens
cugccaagcaucaguguua

SEQ ID NO: 790046 - RNA, 19 nt, Homo sapiens
cagcacaaguccugagaag

SEQ ID NO: 790047 - RNA, 19 nt, Homo sapiens
uaagucauccuucaagcuu

SEQ ID NO: 790048 - RNA, 19 nt, Homo sapiens
gugagccgcuugacaacug

SEQ ID NO: 790049 - RNA, 19 nt, Homo sapiens
uccaagggcuuuccaacau

SEQ ID NO: 790050 - RNA, 19 nt, Homo sapiens
gcguggcuccguuacauuu

SEQ ID NO: 790051 - RNA, 19 nt, Homo sapiens
ccaagggcuuuccaacauc

SEQ ID NO: 790052 - RNA, 19 nt, Homo sapiens
gcucaggccuccgaaaauu

SEQ ID NO: 790053 - RNA, 19 nt, Homo sapiens
gacaaaacaucaccuucuu

SEQ ID NO: 790054 - RNA, 19 nt, Homo sapiens
ccacguagggaguuucaug

SEQ ID NO: 790055 - RNA, 19 nt, Homo sapiens
ggucucgcuuuaacuggaa

SEQ ID NO: 790056 - RNA, 19 nt, Homo sapiens
uuggguacccuauuuauug

SEQ ID NO: 790057 - RNA, 19 nt, Homo sapiens
aaacaucaccuucuuugac

SEQ ID NO: 790058 - RNA, 19 nt, Homo sapiens
gcacccaccugcuuauccu

SEQ ID NO: 790059 - RNA, 19 nt, Homo sapiens
uagggaguuucaugacuga

SEQ ID NO: 790060 - RNA, 19 nt, Homo sapiens
ucgaggugcugaaagacuu

SEQ ID NO: 790061 - RNA, 19 nt, Homo sapiens
aaaauugucucgccagugu

SEQ ID NO: 790062 - RNA, 19 nt, Homo sapiens
gugcaggaauuuaagucau

SEQ ID NO: 790063 - RNA, 19 nt, Homo sapiens
caacacggucgucggugaa

SEQ ID NO: 790064 - RNA, 19 nt, Homo sapiens
ggggagaccucauguccuu

SEQ ID NO: 790065 - RNA, 19 nt, Homo sapiens
ccaccugcuuauccucuau

SEQ ID NO: 790066 - RNA, 19 nt, Homo sapiens
gaugagggugaaacugcua

SEQ ID NO: 790067 - RNA, 19 nt, Homo sapiens
caugaagagcuccugaaga

SEQ ID NO: 790068 - RNA, 19 nt, Homo sapiens
cagcugcguggcuccguua

SEQ ID NO: 790069 - RNA, 19 nt, Homo sapiens
gcuauacgccgagcucauc

SEQ ID NO: 790070 - RNA, 19 nt, Homo sapiens
ucagugggaugagggugaa

SEQ ID NO: 790071 - RNA, 19 nt, Homo sapiens
gggaagaggagcgcuaugg

SEQ ID NO: 790072 - RNA, 19 nt, Homo sapiens
gggaccacguagggaguuu

SEQ ID NO: 790073 - RNA, 19 nt, Homo sapiens
gggaggcugggacacauga

SEQ ID NO: 790074 - RNA, 19 nt, Homo sapiens
cccgagcccuuaucaagca

SEQ ID NO: 790075 - RNA, 19 nt, Homo sapiens
guaaaggucguggccaagu

SEQ ID NO: 790076 - RNA, 19 nt, Homo sapiens
gagggugaaacugcuauug

SEQ ID NO: 790077 - RNA, 19 nt, Homo sapiens
aagcgaaugcucacgaguu

SEQ ID NO: 790078 - RNA, 19 nt, Homo sapiens
uugaguacauggcccugaa

SEQ ID NO: 790079 - RNA, 19 nt, Homo sapiens
ucacgcugcugcugauggu

SEQ ID NO: 790080 - RNA, 19 nt, Homo sapiens
guggcuccguuacauuuca

SEQ ID NO: 790081 - RNA, 19 nt, Homo sapiens
cgaaugcucacgaguucau

SEQ ID NO: 790082 - RNA, 19 nt, Homo sapiens
cggcaucgccuuguuccaa

SEQ ID NO: 790083 - RNA, 19 nt, Homo sapiens
ugcaggaauuuaagucauc

SEQ ID NO: 790084 - RNA, 19 nt, Homo sapiens
acucgugaauguacagauc

SEQ ID NO: 790085 - RNA, 19 nt, Homo sapiens
uguggucgcugccaagcau

SEQ ID NO: 790086 - RNA, 19 nt, Homo sapiens
ggagccaccagcacaaguc

SEQ ID NO: 790087 - RNA, 19 nt, Homo sapiens
agcgaaugcucacgaguuc

SEQ ID NO: 790088 - RNA, 19 nt, Homo sapiens
gaagauagcuaacuuugua

SEQ ID NO: 790089 - RNA, 19 nt, Homo sapiens
gaaagaagauagcuaacuu

SEQ ID NO: 790090 - RNA, 19 nt, Homo sapiens
ggacacagauagucgauuu

SEQ ID NO: 790091 - RNA, 19 nt, Homo sapiens
gaagugagaugcaccuuau

SEQ ID NO: 790092 - RNA, 19 nt, Homo sapiens
guaaaggguucuucaauau

SEQ ID NO: 790093 - RNA, 19 nt, Homo sapiens
gcaaguaguugaagcagaa

SEQ ID NO: 790094 - RNA, 19 nt, Homo sapiens
ggacaggaauauuaagaaa

SEQ ID NO: 790095 - RNA, 19 nt, Homo sapiens
gaagagugauucauuaaca

SEQ ID NO: 790096 - RNA, 19 nt, Homo sapiens
gcaaggagguagaauacaa

SEQ ID NO: 790097 - RNA, 19 nt, Homo sapiens
gcaguaacauuaaugcauu

SEQ ID NO: 790098 - RNA, 19 nt, Homo sapiens
gcauauagauuagaaccua

SEQ ID NO: 790099 - RNA, 19 nt, Homo sapiens
gauauggagucccugcuua

SEQ ID NO: 790100 - RNA, 19 nt, Homo sapiens
ugaagauacugcucuguua

SEQ ID NO: 790101 - RNA, 19 nt, Homo sapiens
gcacuuagccucucugaau

SEQ ID NO: 790102 - RNA, 19 nt, Homo sapiens
acagaagagugauucauua

SEQ ID NO: 790103 - RNA, 19 nt, Homo sapiens
gaucaaagaagaagaagaa

SEQ ID NO: 790104 - RNA, 19 nt, Homo sapiens
caaaggaggugucucuguu

SEQ ID NO: 790105 - RNA, 19 nt, Homo sapiens
gcaaggucauuuauauuug

SEQ ID NO: 790106 - RNA, 19 nt, Homo sapiens
uguaaaggguucuucaaua

SEQ ID NO: 790107 - RNA, 19 nt, Homo sapiens
gcaagcagaugagagguuu

SEQ ID NO: 790108 - RNA, 19 nt, Homo sapiens
ccaaucagaucaaagaaga

SEQ ID NO: 790109 - RNA, 19 nt, Homo sapiens
ugaaauguguugcuucuga

SEQ ID NO: 790110 - RNA, 19 nt, Homo sapiens
ccacuucgcuccugugaug

SEQ ID NO: 790111 - RNA, 19 nt, Homo sapiens
gcaagaaacucuggaagca

SEQ ID NO: 790112 - RNA, 19 nt, Homo sapiens
gaugagagguuuuccauuu

SEQ ID NO: 790113 - RNA, 19 nt, Homo sapiens
gcuuacaacucauuagauu

SEQ ID NO: 790114 - RNA, 19 nt, Homo sapiens
caacuuccauugcugagaa

SEQ ID NO: 790115 - RNA, 19 nt, Homo sapiens
gaaaguaugaaauguguug

SEQ ID NO: 790116 - RNA, 19 nt, Homo sapiens
ccacagaucaguuuaguug

SEQ ID NO: 790117 - RNA, 19 nt, Homo sapiens
uuacauaguucucauggaa

SEQ ID NO: 790118 - RNA, 19 nt, Homo sapiens
caagacugcuuuguaauau

SEQ ID NO: 790119 - RNA, 19 nt, Homo sapiens
gaugaggacuacuuaggaa

SEQ ID NO: 790120 - RNA, 19 nt, Homo sapiens
ggagggcgcuacgauguuu

SEQ ID NO: 790121 - RNA, 19 nt, Homo sapiens
gaugauaaccuugaugaaa

SEQ ID NO: 790122 - RNA, 19 nt, Homo sapiens
gggaagcgcucuccuagca

SEQ ID NO: 790123 - RNA, 19 nt, Homo sapiens
cuucugagcugccuuaaug

SEQ ID NO: 790124 - RNA, 19 nt, Homo sapiens
aggaaagguuggaauguua

SEQ ID NO: 790125 - RNA, 19 nt, Homo sapiens
cguaugaccuuguuguuga

SEQ ID NO: 790126 - RNA, 19 nt, Homo sapiens
acagaucaguuuaguugua

SEQ ID NO: 790127 - RNA, 19 nt, Homo sapiens
cagagucacuuaugcuauu

SEQ ID NO: 790128 - RNA, 19 nt, Homo sapiens
gaacauuaguccagaacag

SEQ ID NO: 790129 - RNA, 19 nt, Homo sapiens
uaaagcagccaaacugaaa

SEQ ID NO: 790130 - RNA, 19 nt, Homo sapiens
ccagaaagaagauagcuaa

SEQ ID NO: 790131 - RNA, 19 nt, Homo sapiens
gguguggacaggaauauua

SEQ ID NO: 790132 - RNA, 19 nt, Homo sapiens
caaagguuauuguucaguu

SEQ ID NO: 790133 - RNA, 19 nt, Homo sapiens
caagaugucucgaaugcau

SEQ ID NO: 790134 - RNA, 19 nt, Homo sapiens
ucacucauaucccaacuga

SEQ ID NO: 790135 - RNA, 19 nt, Homo sapiens
ccagaagacuaaagacaug

SEQ ID NO: 790136 - RNA, 19 nt, Homo sapiens
gaacccagacuucaaagga

SEQ ID NO: 790137 - RNA, 19 nt, Homo sapiens
ggugguuucucucaaauug

SEQ ID NO: 790138 - RNA, 19 nt, Homo sapiens
acuagaggcugaauauaaa

SEQ ID NO: 790139 - RNA, 19 nt, Homo sapiens
ggagguagaauacaaacaa

SEQ ID NO: 790140 - RNA, 19 nt, Homo sapiens
ccacagacauuuaguuacu

SEQ ID NO: 790141 - RNA, 19 nt, Homo sapiens
guaugaacuuguugagaaa

SEQ ID NO: 790142 - RNA, 19 nt, Homo sapiens
gcaccgaagauuagaguuu

SEQ ID NO: 790143 - RNA, 19 nt, Homo sapiens
ggagaggauuccacagaug

SEQ ID NO: 790144 - RNA, 19 nt, Homo sapiens
ccuaaaagcuguucucauu

SEQ ID NO: 790145 - RNA, 19 nt, Homo sapiens
gauuagaaccuaugauugu

SEQ ID NO: 790146 - RNA, 19 nt, Homo sapiens
ccaaugagccaaagaggaa

SEQ ID NO: 790147 - RNA, 19 nt, Homo sapiens
caaugaaacuuugcuagau

SEQ ID NO: 790148 - RNA, 19 nt, Homo sapiens
gcagcagggcuaauccuua

SEQ ID NO: 790149 - RNA, 19 nt, Homo sapiens
ggucagacuucuauucaca

SEQ ID NO: 790150 - RNA, 19 nt, Homo sapiens
aguaugaacuuguugagaa

SEQ ID NO: 790151 - RNA, 19 nt, Homo sapiens
ggaaagguuggaauguuaa

SEQ ID NO: 790152 - RNA, 19 nt, Homo sapiens
ccacaauucucggauauag

SEQ ID NO: 790153 - RNA, 19 nt, Homo sapiens
gacagaagagugauucauu

SEQ ID NO: 790154 - RNA, 19 nt, Homo sapiens
ucgaggaguugauaggaua

SEQ ID NO: 790155 - RNA, 19 nt, Homo sapiens
gugugugacuuacgcuuua

SEQ ID NO: 790156 - RNA, 19 nt, Homo sapiens
uguaaacgguuauuucugu

SEQ ID NO: 790157 - RNA, 19 nt, Homo sapiens
caguuuaguuguauaguug

SEQ ID NO: 790158 - RNA, 19 nt, Homo sapiens
ucagaggacuuucccacuu

SEQ ID NO: 790159 - RNA, 19 nt, Homo sapiens
caaggaugaggacuacuua

SEQ ID NO: 790160 - RNA, 19 nt, Homo sapiens
gaauugaugauaaccuuga

SEQ ID NO: 790161 - RNA, 19 nt, Homo sapiens
gcuacgauguuuaccucua

SEQ ID NO: 790162 - RNA, 19 nt, Homo sapiens
ucacugaugggaauaaauu

SEQ ID NO: 790163 - RNA, 19 nt, Homo sapiens
gcugugcacuugccuuguu

SEQ ID NO: 790164 - RNA, 19 nt, Homo sapiens
gaagguggccaaucagauc

SEQ ID NO: 790165 - RNA, 19 nt, Homo sapiens
uggagaagguggccaauca

SEQ ID NO: 790166 - RNA, 19 nt, Homo sapiens
gagagacaauuguuaugca

SEQ ID NO: 790167 - RNA, 19 nt, Homo sapiens
gaggaaauaaucaagauca

SEQ ID NO: 790168 - RNA, 19 nt, Homo sapiens
uuaccucuaugaccgaaua

SEQ ID NO: 790169 - RNA, 19 nt, Homo sapiens
ggacagucaccauuaacaa

SEQ ID NO: 790170 - RNA, 19 nt, Homo sapiens
guacuucugagcugccuua

SEQ ID NO: 790171 - RNA, 19 nt, Homo sapiens
guaaacgguuauuucuguu

SEQ ID NO: 790172 - RNA, 19 nt, Homo sapiens
caaagugcccagaagacua

SEQ ID NO: 790173 - RNA, 19 nt, Homo sapiens
gagcaaagugcccagaaga

SEQ ID NO: 790174 - RNA, 19 nt, Homo sapiens
gcauuggaccuguguguga

SEQ ID NO: 790175 - RNA, 19 nt, Homo sapiens
auauaaggcuacuucauga

SEQ ID NO: 790176 - RNA, 19 nt, Homo sapiens
gcauguaaacgguuauuuc

SEQ ID NO: 790177 - RNA, 19 nt, Homo sapiens
cagaagagugauucauuaa

SEQ ID NO: 790178 - RNA, 19 nt, Homo sapiens
gcacagaaagucccaguac

SEQ ID NO: 790179 - RNA, 19 nt, Homo sapiens
cagcauugaucaaacuuca

SEQ ID NO: 790180 - RNA, 19 nt, Homo sapiens
uaggaaagguuggaauguu

SEQ ID NO: 790181 - RNA, 19 nt, Homo sapiens
cacuuagccucucugaaua

SEQ ID NO: 790182 - RNA, 19 nt, Homo sapiens
gggagaggauuccacagau

SEQ ID NO: 790183 - RNA, 19 nt, Homo sapiens
acagauagucgauuuauuc

SEQ ID NO: 790184 - RNA, 19 nt, Homo sapiens
uauauaaggcuacuucaug

SEQ ID NO: 790185 - RNA, 19 nt, Homo sapiens
uuagugggcuauuaaacuu

SEQ ID NO: 790186 - RNA, 19 nt, Homo sapiens
uaugggaucugauuugaag

SEQ ID NO: 790187 - RNA, 19 nt, Homo sapiens
ccaguucauuggcauaguu

SEQ ID NO: 790188 - RNA, 19 nt, Homo sapiens
gaagauauccugauuguuu

SEQ ID NO: 790189 - RNA, 19 nt, Homo sapiens
aaacacagcucuuaccuaa

SEQ ID NO: 790190 - RNA, 19 nt, Homo sapiens
acacagcucuuaccuaaua

SEQ ID NO: 790191 - RNA, 19 nt, Homo sapiens
ggagguaaaugcauuggua

SEQ ID NO: 790192 - RNA, 19 nt, Homo sapiens
gcacacgccuucacuuaaa

SEQ ID NO: 790193 - RNA, 19 nt, Homo sapiens
ccacaacccugucgaaaug

SEQ ID NO: 790194 - RNA, 19 nt, Homo sapiens
gagcugauauuuacucuuc

SEQ ID NO: 790195 - RNA, 19 nt, Homo sapiens
uuccagagauucaguauua

SEQ ID NO: 790196 - RNA, 19 nt, Homo sapiens
guacgaagccagccucaua

SEQ ID NO: 790197 - RNA, 19 nt, Homo sapiens
ucacugagcugauauuuac

SEQ ID NO: 790198 - RNA, 19 nt, Homo sapiens
gaauuuggauggugcaguu

SEQ ID NO: 790199 - RNA, 19 nt, Homo sapiens
ugaagaagauauccugauu

SEQ ID NO: 790200 - RNA, 19 nt, Homo sapiens
ggaagacacugcaauaaaa

SEQ ID NO: 790201 - RNA, 19 nt, Homo sapiens
caagaguacucauaggauu

SEQ ID NO: 790202 - RNA, 19 nt, Homo sapiens
caacagagaaugccagcua

SEQ ID NO: 790203 - RNA, 19 nt, Homo sapiens
gaggagagccuguaccuau

SEQ ID NO: 790204 - RNA, 19 nt, Homo sapiens
gggaacaucagaaagguua

SEQ ID NO: 790205 - RNA, 19 nt, Homo sapiens
caagaagguuggcauggaa

SEQ ID NO: 790206 - RNA, 19 nt, Homo sapiens
gaaguggaugugauuguua

SEQ ID NO: 790207 - RNA, 19 nt, Homo sapiens
gcucuuaccuaauaaacau

SEQ ID NO: 790208 - RNA, 19 nt, Homo sapiens
ggagagcagugugaaauca

SEQ ID NO: 790209 - RNA, 19 nt, Homo sapiens
gaaguuacagcauuucaga

SEQ ID NO: 790210 - RNA, 19 nt, Homo sapiens
ggagugaacugugacaaag

SEQ ID NO: 790211 - RNA, 19 nt, Homo sapiens
caucagaaagguuaaauug

SEQ ID NO: 790212 - RNA, 19 nt, Homo sapiens
gaagccagccucauacaug

SEQ ID NO: 790213 - RNA, 19 nt, Homo sapiens
ucaaccaccugcuuuaaug

SEQ ID NO: 790214 - RNA, 19 nt, Homo sapiens
uaagaauacuggccugaau

SEQ ID NO: 790215 - RNA, 19 nt, Homo sapiens
guaguggcauuuaaacaau

SEQ ID NO: 790216 - RNA, 19 nt, Homo sapiens
gcaguuaauguugaaguua

SEQ ID NO: 790217 - RNA, 19 nt, Homo sapiens
cagcacacgccuucacuua

SEQ ID NO: 790218 - RNA, 19 nt, Homo sapiens
caacaaaugccaaugucaa

SEQ ID NO: 790219 - RNA, 19 nt, Homo sapiens
guaaguguuccaaagguua

SEQ ID NO: 790220 - RNA, 19 nt, Homo sapiens
aagaagauauccugauugu

SEQ ID NO: 790221 - RNA, 19 nt, Homo sapiens
gaagaagauauccugauug

SEQ ID NO: 790222 - RNA, 19 nt, Homo sapiens
guuacagcauuucagauuu

SEQ ID NO: 790223 - RNA, 19 nt, Homo sapiens
caacaccauucuccaaaca

SEQ ID NO: 790224 - RNA, 19 nt, Homo sapiens
ggagaccucuguucaaagc

SEQ ID NO: 790225 - RNA, 19 nt, Homo sapiens
ggcaucaguuguucaaguu

SEQ ID NO: 790226 - RNA, 19 nt, Homo sapiens
cauaggauuugaagaagau

SEQ ID NO: 790227 - RNA, 19 nt, Homo sapiens
gguaguggcauuuaaacaa

SEQ ID NO: 790228 - RNA, 19 nt, Homo sapiens
gcguaagucacaagaauuu

SEQ ID NO: 790229 - RNA, 19 nt, Homo sapiens
gccaugaacccaacaaaug

SEQ ID NO: 790230 - RNA, 19 nt, Homo sapiens
gaacaucagaaagguuaaa

SEQ ID NO: 790231 - RNA, 19 nt, Homo sapiens
guacgucuguagcaugaug

SEQ ID NO: 790232 - RNA, 19 nt, Homo sapiens
ggugaacuccgacaucuga

SEQ ID NO: 790233 - RNA, 19 nt, Homo sapiens
guucauagccuuuguuaac

SEQ ID NO: 790234 - RNA, 19 nt, Homo sapiens
caaaugccaaugucaagaa

SEQ ID NO: 790235 - RNA, 19 nt, Homo sapiens
ggaugugauuguuaugaau

SEQ ID NO: 790236 - RNA, 19 nt, Homo sapiens
ugaaguggaugugauuguu

SEQ ID NO: 790237 - RNA, 19 nt, Homo sapiens
cauggaagacacugcaaua

SEQ ID NO: 790238 - RNA, 19 nt, Homo sapiens
ucaagaagguuggcaugga

SEQ ID NO: 790239 - RNA, 19 nt, Homo sapiens
gugccgaaauggaggcuuu

SEQ ID NO: 790240 - RNA, 19 nt, Homo sapiens
ucaaguugguuucccaugu

SEQ ID NO: 790241 - RNA, 19 nt, Homo sapiens
gucaauauccauuccauga

SEQ ID NO: 790242 - RNA, 19 nt, Homo sapiens
gcaagaguacucauaggau

SEQ ID NO: 790243 - RNA, 19 nt, Homo sapiens
guuaaccuuucauguguug

SEQ ID NO: 790244 - RNA, 19 nt, Homo sapiens
gcaacaccauucuccaaac

SEQ ID NO: 790245 - RNA, 19 nt, Homo sapiens
ccagagauucaguauuaaa

SEQ ID NO: 790246 - RNA, 19 nt, Homo sapiens
uccgacaucugaaacguuu

SEQ ID NO: 790247 - RNA, 19 nt, Homo sapiens
uggaagacacugcaauaaa

SEQ ID NO: 790248 - RNA, 19 nt, Homo sapiens
aaauguaaguguuccaaag

SEQ ID NO: 790249 - RNA, 19 nt, Homo sapiens
ucuauggagugaacuguga

SEQ ID NO: 790250 - RNA, 19 nt, Homo sapiens
gaaauggaggcuuuuguaa

SEQ ID NO: 790251 - RNA, 19 nt, Homo sapiens
caaguugguuucccauguc

SEQ ID NO: 790252 - RNA, 19 nt, Homo sapiens
aaacaaaacacagcucuua

SEQ ID NO: 790253 - RNA, 19 nt, Homo sapiens
guagcaugaugguauagau

SEQ ID NO: 790254 - RNA, 19 nt, Homo sapiens
agaauacuggccugaauuu

SEQ ID NO: 790255 - RNA, 19 nt, Homo sapiens
gagguaaaugcauugguaa

SEQ ID NO: 790256 - RNA, 19 nt, Homo sapiens
gaaauggagguaaaugcau

SEQ ID NO: 790257 - RNA, 19 nt, Homo sapiens
gcucaaccaccugcuuuaa

SEQ ID NO: 790258 - RNA, 19 nt, Homo sapiens
guguguaguuggcagauau

SEQ ID NO: 790259 - RNA, 19 nt, Homo sapiens
ccaccugaauccaauuaca

SEQ ID NO: 790260 - RNA, 19 nt, Homo sapiens
acucauaggauuugaagaa

SEQ ID NO: 790261 - RNA, 19 nt, Homo sapiens
ucauaggauuugaagaaga

SEQ ID NO: 790262 - RNA, 19 nt, Homo sapiens
ucuguagcaugaugguaua

SEQ ID NO: 790263 - RNA, 19 nt, Homo sapiens
agggagaccucuguucaaa

SEQ ID NO: 790264 - RNA, 19 nt, Homo sapiens
gaaaagcgcaacagagaau

SEQ ID NO: 790265 - RNA, 19 nt, Homo sapiens
gucaauugaucagguuaaa

SEQ ID NO: 790266 - RNA, 19 nt, Homo sapiens
ccaauuacaucuggugaac

SEQ ID NO: 790267 - RNA, 19 nt, Homo sapiens
uaugaaugguggacuuugu

SEQ ID NO: 790268 - RNA, 19 nt, Homo sapiens
ccaggcaagaguacucaua

SEQ ID NO: 790269 - RNA, 19 nt, Homo sapiens
gcaaauguaaguguuccaa

SEQ ID NO: 790270 - RNA, 19 nt, Homo sapiens
uggaugugauuguuaugaa

SEQ ID NO: 790271 - RNA, 19 nt, Homo sapiens
gauggugcaguuaauguug

SEQ ID NO: 790272 - RNA, 19 nt, Homo sapiens
uauuugcccuccaggacua

SEQ ID NO: 790273 - RNA, 19 nt, Homo sapiens
gggaauauaauguaugaac

SEQ ID NO: 790274 - RNA, 19 nt, Homo sapiens
uguugaaguuacagcauuu

SEQ ID NO: 790275 - RNA, 19 nt, Homo sapiens
ggauggugcaguuaauguu

SEQ ID NO: 790276 - RNA, 19 nt, Homo sapiens
aaguacgucuguagcauga

SEQ ID NO: 790277 - RNA, 19 nt, Homo sapiens
gaacccaacaaaugccaau

SEQ ID NO: 790278 - RNA, 19 nt, Homo sapiens
caaauguaaguguuccaaa

SEQ ID NO: 790279 - RNA, 19 nt, Homo sapiens
ggcaacaccauucuccaaa

SEQ ID NO: 790280 - RNA, 19 nt, Homo sapiens
caaggcaucaguuguucaa

SEQ ID NO: 790281 - RNA, 19 nt, Homo sapiens
ggcaagaguacucauagga

SEQ ID NO: 790282 - RNA, 19 nt, Homo sapiens
ccagggagaccucuguuca

SEQ ID NO: 790283 - RNA, 19 nt, Homo sapiens
cgaaauggagguaaaugca

SEQ ID NO: 790284 - RNA, 19 nt, Homo sapiens
aagauauccugauuguuuc

SEQ ID NO: 790285 - RNA, 19 nt, Homo sapiens
gguggcagcauuugaagug

SEQ ID NO: 790286 - RNA, 19 nt, Homo sapiens
ccaaguucauagccuuugu

SEQ ID NO: 790287 - RNA, 19 nt, Homo sapiens
uguaaguguuccaaagguu

SEQ ID NO: 790288 - RNA, 19 nt, Homo sapiens
gaacaaagucgaaguauga

SEQ ID NO: 790289 - RNA, 19 nt, Homo sapiens
gaagauaugugacguguau

SEQ ID NO: 790290 - RNA, 19 nt, Homo sapiens
agacauggcucuuugguua

SEQ ID NO: 790291 - RNA, 19 nt, Homo sapiens
gaagaacuuugauauggua

SEQ ID NO: 790292 - RNA, 19 nt, Homo sapiens
ucaaaggagucaacauuua

SEQ ID NO: 790293 - RNA, 19 nt, Homo sapiens
ggacaaagacgcuuauuau

SEQ ID NO: 790294 - RNA, 19 nt, Homo sapiens
ggaaauaguugaugcagau

SEQ ID NO: 790295 - RNA, 19 nt, Homo sapiens
ggacagugaugaagauuau

SEQ ID NO: 790296 - RNA, 19 nt, Homo sapiens
cagaaugcuuuccgaauua

SEQ ID NO: 790297 - RNA, 19 nt, Homo sapiens
gaaaugaggcacaaacuga

SEQ ID NO: 790298 - RNA, 19 nt, Homo sapiens
gaaauacacagaaggagua

SEQ ID NO: 790299 - RNA, 19 nt, Homo sapiens
ggaaggagauuauacuuac

SEQ ID NO: 790300 - RNA, 19 nt, Homo sapiens
gaaugaagaugaggaagaa

SEQ ID NO: 790301 - RNA, 19 nt, Homo sapiens
gaaaggagaagaugaguau

SEQ ID NO: 790302 - RNA, 19 nt, Homo sapiens
gaaauuugcuaaugguugu

SEQ ID NO: 790303 - RNA, 19 nt, Homo sapiens
ggaaagagucauggaaaua

SEQ ID NO: 790304 - RNA, 19 nt, Homo sapiens
caaauucccuggagaguuc

SEQ ID NO: 790305 - RNA, 19 nt, Homo sapiens
gaagauauaucagguugug

SEQ ID NO: 790306 - RNA, 19 nt, Homo sapiens
gaagaacaaagucgaagua

SEQ ID NO: 790307 - RNA, 19 nt, Homo sapiens
gcaagaaagugaccaugau

SEQ ID NO: 790308 - RNA, 19 nt, Homo sapiens
gggaugaacuggaggaaga

SEQ ID NO: 790309 - RNA, 19 nt, Homo sapiens
gaagagcacaucagaaaga

SEQ ID NO: 790310 - RNA, 19 nt, Homo sapiens
gcaagaagauuggaguguu

SEQ ID NO: 790311 - RNA, 19 nt, Homo sapiens
gcacugcugcuccuuauuu

SEQ ID NO: 790312 - RNA, 19 nt, Homo sapiens
ucgagaagcugaagagaaa

SEQ ID NO: 790313 - RNA, 19 nt, Homo sapiens
gaaugaaggcaacaucuuu

SEQ ID NO: 790314 - RNA, 19 nt, Homo sapiens
gcgaagagcacaucagaaa

SEQ ID NO: 790315 - RNA, 19 nt, Homo sapiens
gggaggagguguucuugaa

SEQ ID NO: 790316 - RNA, 19 nt, Homo sapiens
ucagaaugcuuuccgaauu

SEQ ID NO: 790317 - RNA, 19 nt, Homo sapiens
cgugaaggcucccuaguaa

SEQ ID NO: 790318 - RNA, 19 nt, Homo sapiens
uaccgagcaucaaauauua

SEQ ID NO: 790319 - RNA, 19 nt, Homo sapiens
gaaauuacauaccgagcau

SEQ ID NO: 790320 - RNA, 19 nt, Homo sapiens
gcaacaccguuucacauug

SEQ ID NO: 790321 - RNA, 19 nt, Homo sapiens
agaauacccugaugagaaa

SEQ ID NO: 790322 - RNA, 19 nt, Homo sapiens
gcccugagcuccauucuuc

SEQ ID NO: 790323 - RNA, 19 nt, Homo sapiens
uaacggagcucccuauagg

SEQ ID NO: 790324 - RNA, 19 nt, Homo sapiens
ucagaaagcucgcaagucu

SEQ ID NO: 790325 - RNA, 19 nt, Homo sapiens
gauaaaccauacagcuuga

SEQ ID NO: 790326 - RNA, 19 nt, Homo sapiens
gcucuuugguuaugaacua

SEQ ID NO: 790327 - RNA, 19 nt, Homo sapiens
gacauaagaagcagugaua

SEQ ID NO: 790328 - RNA, 19 nt, Homo sapiens
gaagagaguggaaaggauu

SEQ ID NO: 790329 - RNA, 19 nt, Homo sapiens
gagaacagcagauucagaa

SEQ ID NO: 790330 - RNA, 19 nt, Homo sapiens
agaagaaagugaagaaugu

SEQ ID NO: 790331 - RNA, 19 nt, Homo sapiens
gcaguaggacuugauauuu

SEQ ID NO: 790332 - RNA, 19 nt, Homo sapiens
ggaagaagaagaacaaagu

SEQ ID NO: 790333 - RNA, 19 nt, Homo sapiens
gaucaacgccauuccugua

SEQ ID NO: 790334 - RNA, 19 nt, Homo sapiens
agucuaauguguccuauaa

SEQ ID NO: 790335 - RNA, 19 nt, Homo sapiens
gaaauguguuacccuccua

SEQ ID NO: 790336 - RNA, 19 nt, Homo sapiens
caacaaauucuucaaggaa

SEQ ID NO: 790337 - RNA, 19 nt, Homo sapiens
ugaagaccauuguugauga

SEQ ID NO: 790338 - RNA, 19 nt, Homo sapiens
caacguugaugccauuguu

SEQ ID NO: 790339 - RNA, 19 nt, Homo sapiens
caagaaugccaucauguuu

SEQ ID NO: 790340 - RNA, 19 nt, Homo sapiens
ggaguaauccgaaacugaa

SEQ ID NO: 790341 - RNA, 19 nt, Homo sapiens
gguauucgcuucaagucuu

SEQ ID NO: 790342 - RNA, 19 nt, Homo sapiens
gcaaugagaaugcuaaugg

SEQ ID NO: 790343 - RNA, 19 nt, Homo sapiens
gcucaaaggagucaacauu

SEQ ID NO: 790344 - RNA, 19 nt, Homo sapiens
ugaccgagaugaccucuau

SEQ ID NO: 790345 - RNA, 19 nt, Homo sapiens
gaaggcaacaucuuuccua

SEQ ID NO: 790346 - RNA, 19 nt, Homo sapiens
ugaaaugacugcagaagag

SEQ ID NO: 790347 - RNA, 19 nt, Homo sapiens
aagaggagcugcugaagga

SEQ ID NO: 790348 - RNA, 19 nt, Homo sapiens
caaaucaacugccuuacag

SEQ ID NO: 790349 - RNA, 19 nt, Homo sapiens
gaacuuugauaugguaauc

SEQ ID NO: 790350 - RNA, 19 nt, Homo sapiens
cagcaucaauuuaggauuc

SEQ ID NO: 790351 - RNA, 19 nt, Homo sapiens
gauugaagccauuaaagaa

SEQ ID NO: 790352 - RNA, 19 nt, Homo sapiens
ucaagguucucggaaauuu

SEQ ID NO: 790353 - RNA, 19 nt, Homo sapiens
agacauugauggcuucuga

SEQ ID NO: 790354 - RNA, 19 nt, Homo sapiens
ggaggacagugaugaagau

SEQ ID NO: 790355 - RNA, 19 nt, Homo sapiens
guagugcgcugguaaaugc

SEQ ID NO: 790356 - RNA, 19 nt, Homo sapiens
uuacagacauggcucuuug

SEQ ID NO: 790357 - RNA, 19 nt, Homo sapiens
gaagggaggccauaucuac

SEQ ID NO: 790358 - RNA, 19 nt, Homo sapiens
gcagauggaacgagaaaug

SEQ ID NO: 790359 - RNA, 19 nt, Homo sapiens
ugaaagaucuauacauucg

SEQ ID NO: 790360 - RNA, 19 nt, Homo sapiens
gaaguacagaaacguuaua

SEQ ID NO: 790361 - RNA, 19 nt, Homo sapiens
caagaagauuggaguguuc

SEQ ID NO: 790362 - RNA, 19 nt, Homo sapiens
gaagaagaacaaagucgaa

SEQ ID NO: 790363 - RNA, 19 nt, Homo sapiens
gaagauuauucaucagaag

SEQ ID NO: 790364 - RNA, 19 nt, Homo sapiens
gaaagagucauggaaauag

SEQ ID NO: 790365 - RNA, 19 nt, Homo sapiens
gagcucaaccuaaugaaga

SEQ ID NO: 790366 - RNA, 19 nt, Homo sapiens
gcauauaccaucgcuguaa

SEQ ID NO: 790367 - RNA, 19 nt, Homo sapiens
ugaagagacuguacagcaa

SEQ ID NO: 790368 - RNA, 19 nt, Homo sapiens
gaacagcuuuucaaguauu

SEQ ID NO: 790369 - RNA, 19 nt, Homo sapiens
uagaauacccugaugagaa

SEQ ID NO: 790370 - RNA, 19 nt, Homo sapiens
aggaggaacuggaauuuga

SEQ ID NO: 790371 - RNA, 19 nt, Homo sapiens
acacggaugugcaguucua

SEQ ID NO: 790372 - RNA, 19 nt, Homo sapiens
ggagacaaaguggauauuu

SEQ ID NO: 790373 - RNA, 19 nt, Homo sapiens
caaagaggcgauugacuga

SEQ ID NO: 790374 - RNA, 19 nt, Homo sapiens
ggaaaggagaagaugagua

SEQ ID NO: 790375 - RNA, 19 nt, Homo sapiens
guacagcaauuggcggaaa

SEQ ID NO: 790376 - RNA, 19 nt, Homo sapiens
cuagugaaauguagaggaa

SEQ ID NO: 790377 - RNA, 19 nt, Homo sapiens
gggcagacccuucuacugu

SEQ ID NO: 790378 - RNA, 19 nt, Homo sapiens
guaauaagaguagcuuuga

SEQ ID NO: 790379 - RNA, 19 nt, Homo sapiens
ucucaaagcuguauuucca

SEQ ID NO: 790380 - RNA, 19 nt, Homo sapiens
gacauggugugaagauaug

SEQ ID NO: 790381 - RNA, 19 nt, Homo sapiens
guauucgcuucaagucuua

SEQ ID NO: 790382 - RNA, 19 nt, Homo sapiens
gcaagaauggcaagaagau

SEQ ID NO: 790383 - RNA, 19 nt, Homo sapiens
caucuuauuuggugucuca

SEQ ID NO: 790384 - RNA, 19 nt, Homo sapiens
agucugaaauugaagauga

SEQ ID NO: 790385 - RNA, 19 nt, Homo sapiens
gagacaaaguggauauuuu

SEQ ID NO: 790386 - RNA, 19 nt, Homo sapiens
gcagugcucugggcaggaa

SEQ ID NO: 790387 - RNA, 19 nt, Homo sapiens
agaaagcucgcaagucuaa

SEQ ID NO: 790388 - RNA, 19 nt, Homo sapiens
gaauuugccuacuaucuaa

SEQ ID NO: 790389 - RNA, 19 nt, Homo sapiens
gcacaaaggaugaugauug

SEQ ID NO: 790390 - RNA, 19 nt, Homo sapiens
ucccugagguuaacaauua

SEQ ID NO: 790391 - RNA, 19 nt, Homo sapiens
cauaauggaugcccaaaug

SEQ ID NO: 790392 - RNA, 19 nt, Homo sapiens
gagaauugccucauugaaa

SEQ ID NO: 790393 - RNA, 19 nt, Homo sapiens
cagugaaccuuaauucuuu

SEQ ID NO: 790394 - RNA, 19 nt, Homo sapiens
gaaauacuagcuucaagaa

SEQ ID NO: 790395 - RNA, 19 nt, Homo sapiens
gggagcagcuuucggauca

SEQ ID NO: 790396 - RNA, 19 nt, Homo sapiens
gacuuugguuuccauaaua

SEQ ID NO: 790397 - RNA, 19 nt, Homo sapiens
gagacaaaccagccuauuu

SEQ ID NO: 790398 - RNA, 19 nt, Homo sapiens
gcacuccucuuucuagaca

SEQ ID NO: 790399 - RNA, 19 nt, Homo sapiens
caaaugauccucugcaaca

SEQ ID NO: 790400 - RNA, 19 nt, Homo sapiens
caauuucaaucccauaaug

SEQ ID NO: 790401 - RNA, 19 nt, Homo sapiens
acaaagacaugcugaucaa

SEQ ID NO: 790402 - RNA, 19 nt, Homo sapiens
agaauugccucauugaaau

SEQ ID NO: 790403 - RNA, 19 nt, Homo sapiens
gaauugccucauugaaaua

SEQ ID NO: 790404 - RNA, 19 nt, Homo sapiens
gaacagugaacauauuuac

SEQ ID NO: 790405 - RNA, 19 nt, Homo sapiens
gaccagagaggaaggauau

SEQ ID NO: 790406 - RNA, 19 nt, Homo sapiens
aauacuagcuucaagaaca

SEQ ID NO: 790407 - RNA, 19 nt, Homo sapiens
guacugugcacuccucuuu

SEQ ID NO: 790408 - RNA, 19 nt, Homo sapiens
aagaggacauuuauucaga

SEQ ID NO: 790409 - RNA, 19 nt, Homo sapiens
gauuuaacagugaaccuua

SEQ ID NO: 790410 - RNA, 19 nt, Homo sapiens
auacugaauuugccuacua

SEQ ID NO: 790411 - RNA, 19 nt, Homo sapiens
ucuagacacuuccaaauag

SEQ ID NO: 790412 - RNA, 19 nt, Homo sapiens
acaaagagcgauauggaaa

SEQ ID NO: 790413 - RNA, 19 nt, Homo sapiens
ucgggacacuucagagaua

SEQ ID NO: 790414 - RNA, 19 nt, Homo sapiens
ugaauuugccuacuaucua

SEQ ID NO: 790415 - RNA, 19 nt, Homo sapiens
gaagaggacuuggaguacu

SEQ ID NO: 790416 - RNA, 19 nt, Homo sapiens
ugacuuugguuuccauaau

SEQ ID NO: 790417 - RNA, 19 nt, Homo sapiens
uaaggaaacgauacaaaga

SEQ ID NO: 790418 - RNA, 19 nt, Homo sapiens
gaggacauuuauucagaga

SEQ ID NO: 790419 - RNA, 19 nt, Homo sapiens
uaacagugaaccuuaauuc

SEQ ID NO: 790420 - RNA, 19 nt, Homo sapiens
ucauggcacuauuaacaaa

SEQ ID NO: 790421 - RNA, 19 nt, Homo sapiens
aaauagaccugcugaccau

SEQ ID NO: 790422 - RNA, 19 nt, Homo sapiens
guagaugccauuaaugaau

SEQ ID NO: 790423 - RNA, 19 nt, Homo sapiens
ggaaccauccaacaaccua

SEQ ID NO: 790424 - RNA, 19 nt, Homo sapiens
gaucugagggagcagcuuu

SEQ ID NO: 790425 - RNA, 19 nt, Homo sapiens
ugccuacuauccugaauuu

SEQ ID NO: 790426 - RNA, 19 nt, Homo sapiens
guucauggcacuauuaaca

SEQ ID NO: 790427 - RNA, 19 nt, Homo sapiens
gcaauuguucucuguguuc

SEQ ID NO: 790428 - RNA, 19 nt, Homo sapiens
gguuaacaauuaccaucaa

SEQ ID NO: 790429 - RNA, 19 nt, Homo sapiens
ugugauggcuggccucaug

SEQ ID NO: 790430 - RNA, 19 nt, Homo sapiens
ucggaucacuucaaagaug

SEQ ID NO: 790431 - RNA, 19 nt, Homo sapiens
aaaccaugcugcaaaugau

SEQ ID NO: 790432 - RNA, 19 nt, Homo sapiens
gcuuucggaucacuucaaa

SEQ ID NO: 790433 - RNA, 19 nt, Homo sapiens
gacaaagacaugcugauca

SEQ ID NO: 790434 - RNA, 19 nt, Homo sapiens
ugugcaugauggaauaaua

SEQ ID NO: 790435 - RNA, 19 nt, Homo sapiens
cuagacacuuccaaauaga

SEQ ID NO: 790436 - RNA, 19 nt, Homo sapiens
cauaaggaaacgauacaaa

SEQ ID NO: 790437 - RNA, 19 nt, Homo sapiens
aauugugcaugauggaaua

SEQ ID NO: 790438 - RNA, 19 nt, Homo sapiens
ggaccagagaggaaggaua

SEQ ID NO: 790439 - RNA, 19 nt, Homo sapiens
cuucagggcauuauaagaa

SEQ ID NO: 790440 - RNA, 19 nt, Homo sapiens
ccaagaggacauuuauuca

SEQ ID NO: 790441 - RNA, 19 nt, Homo sapiens
ccuacuaucuaaucagcaa

SEQ ID NO: 790442 - RNA, 19 nt, Homo sapiens
ggaguaggcacugaugaga

SEQ ID NO: 790443 - RNA, 19 nt, Homo sapiens
cacaaaggaugaugauugc

SEQ ID NO: 790444 - RNA, 19 nt, Homo sapiens
gguagaugccauuaaugaa

SEQ ID NO: 790445 - RNA, 19 nt, Homo sapiens
gagaggaaggauauucaga

SEQ ID NO: 790446 - RNA, 19 nt, Homo sapiens
acagugaaccuuaauucuu

SEQ ID NO: 790447 - RNA, 19 nt, Homo sapiens
caugauggaauaauaggaa

SEQ ID NO: 790448 - RNA, 19 nt, Homo sapiens
ccuauuucaugauaucaga

SEQ ID NO: 790449 - RNA, 19 nt, Homo sapiens
ugaauguuaugauggauac

SEQ ID NO: 790450 - RNA, 19 nt, Homo sapiens
ugaucaacauucugacuca

SEQ ID NO: 790451 - RNA, 19 nt, Homo sapiens
aguaggcacugaugagaau

SEQ ID NO: 790452 - RNA, 19 nt, Homo sapiens
caauucaugacuuugguuu

SEQ ID NO: 790453 - RNA, 19 nt, Homo sapiens
uagugcaauucaugacuuu

SEQ ID NO: 790454 - RNA, 19 nt, Homo sapiens
gcugcugguugcaauuguu

SEQ ID NO: 790455 - RNA, 19 nt, Homo sapiens
gugcacuccucuuucuaga

SEQ ID NO: 790456 - RNA, 19 nt, Homo sapiens
gcugaggacuacuaaaaug

SEQ ID NO: 790457 - RNA, 19 nt, Homo sapiens
cuucccagcucccaauuuc

SEQ ID NO: 790458 - RNA, 19 nt, Homo sapiens
gaguaggcacugaugagaa

SEQ ID NO: 790459 - RNA, 19 nt, Homo sapiens
gaagggaguaggcacugau

SEQ ID NO: 790460 - RNA, 19 nt, Homo sapiens
guacccaccaccacuguau

SEQ ID NO: 790461 - RNA, 19 nt, Homo sapiens
auacaaagagcgauaugga

SEQ ID NO: 790462 - RNA, 19 nt, Homo sapiens
agacaaaccagccuauuuu

SEQ ID NO: 790463 - RNA, 19 nt, Homo sapiens
ugguagaugccauuaauga

SEQ ID NO: 790464 - RNA, 19 nt, Homo sapiens
uccaagaggacauuuauuc

SEQ ID NO: 790465 - RNA, 19 nt, Homo sapiens
auacuagcuucaagaacaa

SEQ ID NO: 790466 - RNA, 19 nt, Homo sapiens
gcaauucaugacuuugguu

SEQ ID NO: 790467 - RNA, 19 nt, Homo sapiens
ggaagccugucagcagaag

SEQ ID NO: 790468 - RNA, 19 nt, Homo sapiens
ucagagaccucgggacacu

SEQ ID NO: 790469 - RNA, 19 nt, Homo sapiens
uccaaggauuugacuguga

SEQ ID NO: 790470 - RNA, 19 nt, Homo sapiens
ggcauugggaauaggauuu

SEQ ID NO: 790471 - RNA, 19 nt, Homo sapiens
acaaguuuaugcaaucgau

SEQ ID NO: 790472 - RNA, 19 nt, Homo sapiens
gagcugcugguugcaauug

SEQ ID NO: 790473 - RNA, 19 nt, Homo sapiens
auacagcaauaaccuccaa

SEQ ID NO: 790474 - RNA, 19 nt, Homo sapiens
aaagacaugcugaucaaca

SEQ ID NO: 790475 - RNA, 19 nt, Homo sapiens
ugaagggaguaggcacuga

SEQ ID NO: 790476 - RNA, 19 nt, Homo sapiens
ccagagaggaaggauauuc

SEQ ID NO: 790477 - RNA, 19 nt, Homo sapiens
caagaggacauuuauucag

SEQ ID NO: 790478 - RNA, 19 nt, Homo sapiens
ugacaaagacaugcugauc

SEQ ID NO: 790479 - RNA, 19 nt, Homo sapiens
cggaucacuucaaagaugu

SEQ ID NO: 790480 - RNA, 19 nt, Homo sapiens
aaauuggcauugggaauag

SEQ ID NO: 790481 - RNA, 19 nt, Homo sapiens
cagagaggaaggauauuca

SEQ ID NO: 790482 - RNA, 19 nt, Homo sapiens
aagaggacuuggaguacug

SEQ ID NO: 790483 - RNA, 19 nt, Homo sapiens
augaagaggacuuggagua

SEQ ID NO: 790484 - RNA, 19 nt, Homo sapiens
caagaacaaauggagaaau

SEQ ID NO: 790485 - RNA, 19 nt, Homo sapiens
aagacaugcugaucaacau

SEQ ID NO: 790486 - RNA, 19 nt, Homo sapiens
uucagggcauuauaagaaa

SEQ ID NO: 790487 - RNA, 19 nt, Homo sapiens
auagugcaauucaugacuu

SEQ ID NO: 790488 - RNA, 19 nt, Homo sapiens
gaaauugcacugucacuaa

SEQ ID NO: 790489 - RNA, 19 nt, Homo sapiens
gaaaguagccauaaagauc

SEQ ID NO: 790490 - RNA, 19 nt, Homo sapiens
ggaauaaacgccugaaaga

SEQ ID NO: 790491 - RNA, 19 nt, Homo sapiens
guaagaaaguagccauaaa

SEQ ID NO: 790492 - RNA, 19 nt, Homo sapiens
gaacauacagcaagaaaca

SEQ ID NO: 790493 - RNA, 19 nt, Homo sapiens
acacugagcuccuuagaga

SEQ ID NO: 790494 - RNA, 19 nt, Homo sapiens
gcauaggacucaaguguca

SEQ ID NO: 790495 - RNA, 19 nt, Homo sapiens
guuuguaucugcagguuua

SEQ ID NO: 790496 - RNA, 19 nt, Homo sapiens
gaaguuugcuauugguuca

SEQ ID NO: 790497 - RNA, 19 nt, Homo sapiens
agacuaauguugcugauug

SEQ ID NO: 790498 - RNA, 19 nt, Homo sapiens
ccauaaagaucaucagcaa

SEQ ID NO: 790499 - RNA, 19 nt, Homo sapiens
gagcuucgcuguaucaacu

SEQ ID NO: 790500 - RNA, 19 nt, Homo sapiens
agucacugauguacaauua

SEQ ID NO: 790501 - RNA, 19 nt, Homo sapiens
gaauaaacgccugaaagaa

SEQ ID NO: 790502 - RNA, 19 nt, Homo sapiens
caauggaaccuuuguaaau

SEQ ID NO: 790503 - RNA, 19 nt, Homo sapiens
gacaaaagcugugaauauu

SEQ ID NO: 790504 - RNA, 19 nt, Homo sapiens
caggaacucuauucuauuc

SEQ ID NO: 790505 - RNA, 19 nt, Homo sapiens
ccauaaggcugaaguaguc

SEQ ID NO: 790506 - RNA, 19 nt, Homo sapiens
uagaugaucagucaguuua

SEQ ID NO: 790507 - RNA, 19 nt, Homo sapiens
gcaauggaaccuuuguaaa

SEQ ID NO: 790508 - RNA, 19 nt, Homo sapiens
gagcauaggacucaagugu

SEQ ID NO: 790509 - RNA, 19 nt, Homo sapiens
ucacuaagcagaaauaaag

SEQ ID NO: 790510 - RNA, 19 nt, Homo sapiens
gaauauugcuuugaugaac

SEQ ID NO: 790511 - RNA, 19 nt, Homo sapiens
ggacaaaagcugugaauau

SEQ ID NO: 790512 - RNA, 19 nt, Homo sapiens
gaaugacaacuacugguuu

SEQ ID NO: 790513 - RNA, 19 nt, Homo sapiens
ggaaaacgccguccuuuga

SEQ ID NO: 790514 - RNA, 19 nt, Homo sapiens
ccaagaaccugaggaccaa

SEQ ID NO: 790515 - RNA, 19 nt, Homo sapiens
guuccgcucucccuucuaa

SEQ ID NO: 790516 - RNA, 19 nt, Homo sapiens
uucaagaucuucugucuga

SEQ ID NO: 790517 - RNA, 19 nt, Homo sapiens
uauuauacaccgugacuua

SEQ ID NO: 790518 - RNA, 19 nt, Homo sapiens
gacagaagaagccuuaaga

SEQ ID NO: 790519 - RNA, 19 nt, Homo sapiens
agaaagcucuggaccuugu

SEQ ID NO: 790520 - RNA, 19 nt, Homo sapiens
agacccagcucucaauguu

SEQ ID NO: 790521 - RNA, 19 nt, Homo sapiens
gaacgguugcaguccauaa

SEQ ID NO: 790522 - RNA, 19 nt, Homo sapiens
gaucuucugucugaggaaa

SEQ ID NO: 790523 - RNA, 19 nt, Homo sapiens
gaugaagacaugaagagaa

SEQ ID NO: 790524 - RNA, 19 nt, Homo sapiens
gcuguggacugcuggaguu

SEQ ID NO: 790525 - RNA, 19 nt, Homo sapiens
ggacaagacgcugcaguug

SEQ ID NO: 790526 - RNA, 19 nt, Homo sapiens
aaaggaaguuugcuauugg

SEQ ID NO: 790527 - RNA, 19 nt, Homo sapiens
ccuaaggcauuaagagaug

SEQ ID NO: 790528 - RNA, 19 nt, Homo sapiens
ggcaauggaaccuuuguaa

SEQ ID NO: 790529 - RNA, 19 nt, Homo sapiens
gauaaauaccgaacauaca

SEQ ID NO: 790530 - RNA, 19 nt, Homo sapiens
guugugaacuccgugguuu

SEQ ID NO: 790531 - RNA, 19 nt, Homo sapiens
augaagacaugaagagaaa

SEQ ID NO: 790532 - RNA, 19 nt, Homo sapiens
ucaagaaguuguugguagu

SEQ ID NO: 790533 - RNA, 19 nt, Homo sapiens
gaaguucuuguuucuguug

SEQ ID NO: 790534 - RNA, 19 nt, Homo sapiens
ugagaccucuggcugaaga

SEQ ID NO: 790535 - RNA, 19 nt, Homo sapiens
gaagaucacaguggcaaug

SEQ ID NO: 790536 - RNA, 19 nt, Homo sapiens
cucaggaacucuauucuau

SEQ ID NO: 790537 - RNA, 19 nt, Homo sapiens
gaacacgaaagaaauguac

SEQ ID NO: 790538 - RNA, 19 nt, Homo sapiens
ugaaagaagcuaccugcaa

SEQ ID NO: 790539 - RNA, 19 nt, Homo sapiens
gaugaucagucaguuuauc

SEQ ID NO: 790540 - RNA, 19 nt, Homo sapiens
gacgcagcaucgcagcuua

SEQ ID NO: 790541 - RNA, 19 nt, Homo sapiens
aaauguaccuucuuucacu

SEQ ID NO: 790542 - RNA, 19 nt, Homo sapiens
ggggagagcuguuugacaa

SEQ ID NO: 790543 - RNA, 19 nt, Homo sapiens
uaagaaaguagccauaaag

SEQ ID NO: 790544 - RNA, 19 nt, Homo sapiens
gaagacaugaagagaaagu

SEQ ID NO: 790545 - RNA, 19 nt, Homo sapiens
gguauccaccuuucucuga

SEQ ID NO: 790546 - RNA, 19 nt, Homo sapiens
gcucuuggcugugcaguac

SEQ ID NO: 790547 - RNA, 19 nt, Homo sapiens
gaucacaguggcaauggaa

SEQ ID NO: 790548 - RNA, 19 nt, Homo sapiens
ccaccuuucucugagcaua

SEQ ID NO: 790549 - RNA, 19 nt, Homo sapiens
augagaaccuuauguggaa

SEQ ID NO: 790550 - RNA, 19 nt, Homo sapiens
gggaauaaacgccugaaag

SEQ ID NO: 790551 - RNA, 19 nt, Homo sapiens
aaacgccguccuuugaaua

SEQ ID NO: 790552 - RNA, 19 nt, Homo sapiens
ucagggaaguggguccuaa

SEQ ID NO: 790553 - RNA, 19 nt, Homo sapiens
gcaaagagagcgucuaacc

SEQ ID NO: 790554 - RNA, 19 nt, Homo sapiens
gguuugaacacgaaagaaa

SEQ ID NO: 790555 - RNA, 19 nt, Homo sapiens
guagaugaucagucaguuu

SEQ ID NO: 790556 - RNA, 19 nt, Homo sapiens
gcacugucacuaagcagaa

SEQ ID NO: 790557 - RNA, 19 nt, Homo sapiens
acagauaaauaccgaacau

SEQ ID NO: 790558 - RNA, 19 nt, Homo sapiens
gugaauauugcuuugauga

SEQ ID NO: 790559 - RNA, 19 nt, Homo sapiens
cagaagaagccuuaagaca

SEQ ID NO: 790560 - RNA, 19 nt, Homo sapiens
gugcaguaccuucaugaaa

SEQ ID NO: 790561 - RNA, 19 nt, Homo sapiens
gaggaaaacauguaagaaa

SEQ ID NO: 790562 - RNA, 19 nt, Homo sapiens
gaucagucaguuuauccua

SEQ ID NO: 790563 - RNA, 19 nt, Homo sapiens
aaugacaacuacugguuug

SEQ ID NO: 790564 - RNA, 19 nt, Homo sapiens
aagcaaagagagcgucuaa

SEQ ID NO: 790565 - RNA, 19 nt, Homo sapiens
aaaaggaaguuugcuauug

SEQ ID NO: 790566 - RNA, 19 nt, Homo sapiens
ggucuuauaggcaucauuc

SEQ ID NO: 790567 - RNA, 19 nt, Homo sapiens
ucaccagggucgaaugcuu

SEQ ID NO: 790568 - RNA, 19 nt, Homo sapiens
aauaaacgccugaaagaag

SEQ ID NO: 790569 - RNA, 19 nt, Homo sapiens
acccguggcuucaggauga

SEQ ID NO: 790570 - RNA, 19 nt, Homo sapiens
cugaaguucuuguuucugu

SEQ ID NO: 790571 - RNA, 19 nt, Homo sapiens
agaggacugucuuauaaag

SEQ ID NO: 790572 - RNA, 19 nt, Homo sapiens
aaucauccuugcaucauca

SEQ ID NO: 790573 - RNA, 19 nt, Homo sapiens
ugaaugacaacuacugguu

SEQ ID NO: 790574 - RNA, 19 nt, Homo sapiens
agacaugaagagaaaguuu

SEQ ID NO: 790575 - RNA, 19 nt, Homo sapiens
caguuuauccuaaggcauu

SEQ ID NO: 790576 - RNA, 19 nt, Homo sapiens
uugcauacauagaagauca

SEQ ID NO: 790577 - RNA, 19 nt, Homo sapiens
ggacacugagcuccuuaga

SEQ ID NO: 790578 - RNA, 19 nt, Homo sapiens
ugugugugcugcuguguug

SEQ ID NO: 790579 - RNA, 19 nt, Homo sapiens
gaguuuaggaguuauucuu

SEQ ID NO: 790580 - RNA, 19 nt, Homo sapiens
gggccaggagggucuuaua

SEQ ID NO: 790581 - RNA, 19 nt, Homo sapiens
uguaucaacucugaaggaa

SEQ ID NO: 790582 - RNA, 19 nt, Homo sapiens
gagcuuguagggaaaggaa

SEQ ID NO: 790583 - RNA, 19 nt, Homo sapiens
caguggcaauggaaccuuu

SEQ ID NO: 790584 - RNA, 19 nt, Homo sapiens
gaacuccgugguuugaaca

SEQ ID NO: 790585 - RNA, 19 nt, Homo sapiens
acaagacgcugcaguugcu

SEQ ID NO: 790586 - RNA, 19 nt, Homo sapiens
ugacuuaaagccagagaau

SEQ ID NO: 790587 - RNA, 19 nt, Homo sapiens
aaaguagccauaaagauca

SEQ ID NO: 790588 - RNA, 19 nt, Homo sapiens
gaaauugcacugucacuaa

SEQ ID NO: 790589 - RNA, 19 nt, Homo sapiens
gaaaguagccauaaagauc

SEQ ID NO: 790590 - RNA, 19 nt, Homo sapiens
ggaauaaacgccugaaaga

SEQ ID NO: 790591 - RNA, 19 nt, Homo sapiens
guaagaaaguagccauaaa

SEQ ID NO: 790592 - RNA, 19 nt, Homo sapiens
gaacauacagcaagaaaca

SEQ ID NO: 790593 - RNA, 19 nt, Homo sapiens
acacugagcuccuuagaga

SEQ ID NO: 790594 - RNA, 19 nt, Homo sapiens
gcauaggacucaaguguca

SEQ ID NO: 790595 - RNA, 19 nt, Homo sapiens
guuuguaucugcagguuua

SEQ ID NO: 790596 - RNA, 19 nt, Homo sapiens
gaaguuugcuauugguuca

SEQ ID NO: 790597 - RNA, 19 nt, Homo sapiens
agacuaauguugcugauug

SEQ ID NO: 790598 - RNA, 19 nt, Homo sapiens
ccauaaagaucaucagcaa

SEQ ID NO: 790599 - RNA, 19 nt, Homo sapiens
gcucuuggcugugcagauu

SEQ ID NO: 790600 - RNA, 19 nt, Homo sapiens
gagcuucgcuguaucaacu

SEQ ID NO: 790601 - RNA, 19 nt, Homo sapiens
agucacugauguacaauua

SEQ ID NO: 790602 - RNA, 19 nt, Homo sapiens
gaauaaacgccugaaagaa

SEQ ID NO: 790603 - RNA, 19 nt, Homo sapiens
caauggaaccuuuguaaau

SEQ ID NO: 790604 - RNA, 19 nt, Homo sapiens
gacaaaagcugugaauauu

SEQ ID NO: 790605 - RNA, 19 nt, Homo sapiens
caggaacucuauucuauuc

SEQ ID NO: 790606 - RNA, 19 nt, Homo sapiens
ccauaaggcugaaguaguc

SEQ ID NO: 790607 - RNA, 19 nt, Homo sapiens
uagaugaucagucaguuua

SEQ ID NO: 790608 - RNA, 19 nt, Homo sapiens
gcaauggaaccuuuguaaa

SEQ ID NO: 790609 - RNA, 19 nt, Homo sapiens
gagcauaggacucaagugu

SEQ ID NO: 790610 - RNA, 19 nt, Homo sapiens
ucacuaagcagaaauaaag

SEQ ID NO: 790611 - RNA, 19 nt, Homo sapiens
gaauauugcuuugaugaac

SEQ ID NO: 790612 - RNA, 19 nt, Homo sapiens
ggacaaaagcugugaauau

SEQ ID NO: 790613 - RNA, 19 nt, Homo sapiens
gaaugacaacuacugguuu

SEQ ID NO: 790614 - RNA, 19 nt, Homo sapiens
ggaaaacgccguccuuuga

SEQ ID NO: 790615 - RNA, 19 nt, Homo sapiens
ccaagaaccugaggaccaa

SEQ ID NO: 790616 - RNA, 19 nt, Homo sapiens
guuccgcucucccuucuaa

SEQ ID NO: 790617 - RNA, 19 nt, Homo sapiens
uucaagaucuucugucuga

SEQ ID NO: 790618 - RNA, 19 nt, Homo sapiens
gacagaagaagccuuaaga

SEQ ID NO: 790619 - RNA, 19 nt, Homo sapiens
agaaagcucuggaccuugu

SEQ ID NO: 790620 - RNA, 19 nt, Homo sapiens
agacccagcucucaauguu

SEQ ID NO: 790621 - RNA, 19 nt, Homo sapiens
gaacgguugcaguccauaa

SEQ ID NO: 790622 - RNA, 19 nt, Homo sapiens
gaucuucugucugaggaaa

SEQ ID NO: 790623 - RNA, 19 nt, Homo sapiens
gaugaagacaugaagagaa

SEQ ID NO: 790624 - RNA, 19 nt, Homo sapiens
gcuguggacugcuggaguu

SEQ ID NO: 790625 - RNA, 19 nt, Homo sapiens
ggacaagacgcugcaguug

SEQ ID NO: 790626 - RNA, 19 nt, Homo sapiens
aaaggaaguuugcuauugg

SEQ ID NO: 790627 - RNA, 19 nt, Homo sapiens
ccuaaggcauuaagagaug

SEQ ID NO: 790628 - RNA, 19 nt, Homo sapiens
ggcaauggaaccuuuguaa

SEQ ID NO: 790629 - RNA, 19 nt, Homo sapiens
gauaaauaccgaacauaca

SEQ ID NO: 790630 - RNA, 19 nt, Homo sapiens
guugugaacuccgugguuu

SEQ ID NO: 790631 - RNA, 19 nt, Homo sapiens
augaagacaugaagagaaa

SEQ ID NO: 790632 - RNA, 19 nt, Homo sapiens
ucaagaaguuguugguagu

SEQ ID NO: 790633 - RNA, 19 nt, Homo sapiens
ugagaccucuggcugaaga

SEQ ID NO: 790634 - RNA, 19 nt, Homo sapiens
gaaguucuuguuucuguug

SEQ ID NO: 790635 - RNA, 19 nt, Homo sapiens
gaagaucacaguggcaaug

SEQ ID NO: 790636 - RNA, 19 nt, Homo sapiens
cucaggaacucuauucuau

SEQ ID NO: 790637 - RNA, 19 nt, Homo sapiens
gaacacgaaagaaauguac

SEQ ID NO: 790638 - RNA, 19 nt, Homo sapiens
ugaaagaagcuaccugcaa

SEQ ID NO: 790639 - RNA, 19 nt, Homo sapiens
gaugaucagucaguuuauc

SEQ ID NO: 790640 - RNA, 19 nt, Homo sapiens
gacgcagcaucgcagcuua

SEQ ID NO: 790641 - RNA, 19 nt, Homo sapiens
aaauguaccuucuuucacu

SEQ ID NO: 790642 - RNA, 19 nt, Homo sapiens
ggggagagcuguuugacaa

SEQ ID NO: 790643 - RNA, 19 nt, Homo sapiens
uaagaaaguagccauaaag

SEQ ID NO: 790644 - RNA, 19 nt, Homo sapiens
gaagacaugaagagaaagu

SEQ ID NO: 790645 - RNA, 19 nt, Homo sapiens
gguauccaccuuucucuga

SEQ ID NO: 790646 - RNA, 19 nt, Homo sapiens
gaucacaguggcaauggaa

SEQ ID NO: 790647 - RNA, 19 nt, Homo sapiens
ccaccuuucucugagcaua

SEQ ID NO: 790648 - RNA, 19 nt, Homo sapiens
augagaaccuuauguggaa

SEQ ID NO: 790649 - RNA, 19 nt, Homo sapiens
gggaauaaacgccugaaag

SEQ ID NO: 790650 - RNA, 19 nt, Homo sapiens
aaacgccguccuuugaaua

SEQ ID NO: 790651 - RNA, 19 nt, Homo sapiens
ucagggaaguggguccuaa

SEQ ID NO: 790652 - RNA, 19 nt, Homo sapiens
gcaaagagagcgucuaacc

SEQ ID NO: 790653 - RNA, 19 nt, Homo sapiens
gguuugaacacgaaagaaa

SEQ ID NO: 790654 - RNA, 19 nt, Homo sapiens
guagaugaucagucaguuu

SEQ ID NO: 790655 - RNA, 19 nt, Homo sapiens
gcacugucacuaagcagaa

SEQ ID NO: 790656 - RNA, 19 nt, Homo sapiens
acagauaaauaccgaacau

SEQ ID NO: 790657 - RNA, 19 nt, Homo sapiens
gugaauauugcuuugauga

SEQ ID NO: 790658 - RNA, 19 nt, Homo sapiens
cagaagaagccuuaagaca

SEQ ID NO: 790659 - RNA, 19 nt, Homo sapiens
gaggaaaacauguaagaaa

SEQ ID NO: 790660 - RNA, 19 nt, Homo sapiens
gaucagucaguuuauccua

SEQ ID NO: 790661 - RNA, 19 nt, Homo sapiens
aaugacaacuacugguuug

SEQ ID NO: 790662 - RNA, 19 nt, Homo sapiens
aagcaaagagagcgucuaa

SEQ ID NO: 790663 - RNA, 19 nt, Homo sapiens
aaaaggaaguuugcuauug

SEQ ID NO: 790664 - RNA, 19 nt, Homo sapiens
ggucuuauaggcaucauuc

SEQ ID NO: 790665 - RNA, 19 nt, Homo sapiens
ucaccagggucgaaugcuu

SEQ ID NO: 790666 - RNA, 19 nt, Homo sapiens
aauaaacgccugaaagaag

SEQ ID NO: 790667 - RNA, 19 nt, Homo sapiens
acccguggcuucaggauga

SEQ ID NO: 790668 - RNA, 19 nt, Homo sapiens
cugaaguucuuguuucugu

SEQ ID NO: 790669 - RNA, 19 nt, Homo sapiens
cugugcagauuacugauuu

SEQ ID NO: 790670 - RNA, 19 nt, Homo sapiens
aaucauccuugcaucauca

SEQ ID NO: 790671 - RNA, 19 nt, Homo sapiens
ugaaugacaacuacugguu

SEQ ID NO: 790672 - RNA, 19 nt, Homo sapiens
agacaugaagagaaaguuu

SEQ ID NO: 790673 - RNA, 19 nt, Homo sapiens
caguuuauccuaaggcauu

SEQ ID NO: 790674 - RNA, 19 nt, Homo sapiens
uugcauacauagaagauca

SEQ ID NO: 790675 - RNA, 19 nt, Homo sapiens
ggacacugagcuccuuaga

SEQ ID NO: 790676 - RNA, 19 nt, Homo sapiens
ugugugugcugcuguguug

SEQ ID NO: 790677 - RNA, 19 nt, Homo sapiens
gaguuuaggaguuauucuu

SEQ ID NO: 790678 - RNA, 19 nt, Homo sapiens
gggccaggagggucuuaua

SEQ ID NO: 790679 - RNA, 19 nt, Homo sapiens
uguaucaacucugaaggaa

SEQ ID NO: 790680 - RNA, 19 nt, Homo sapiens
gagcuuguagggaaaggaa

SEQ ID NO: 790681 - RNA, 19 nt, Homo sapiens
caguggcaauggaaccuuu

SEQ ID NO: 790682 - RNA, 19 nt, Homo sapiens
gaacuccgugguuugaaca

SEQ ID NO: 790683 - RNA, 19 nt, Homo sapiens
acaagacgcugcaguugcu

SEQ ID NO: 790684 - RNA, 19 nt, Homo sapiens
aaaguagccauaaagauca

SEQ ID NO: 790685 - RNA, 19 nt, Homo sapiens
uugccaaucuugaaugugu

SEQ ID NO: 790686 - RNA, 19 nt, Homo sapiens
ggaugaagacaugaagaga

SEQ ID NO: 790687 - RNA, 19 nt, Homo sapiens
guggacugcuggaguuuag

SEQ ID NO: 790688 - RNA, 19 nt, Homo sapiens
agaaagggcuuauugauua

SEQ ID NO: 790689 - RNA, 19 nt, Homo sapiens
gaaagacacucauauggaa

SEQ ID NO: 790690 - RNA, 19 nt, Homo sapiens
uaacagaaaugguugagaa

SEQ ID NO: 790691 - RNA, 19 nt, Homo sapiens
uaaagaaccucaaggauuc

SEQ ID NO: 790692 - RNA, 19 nt, Homo sapiens
gaaauauggugaaugugaa

SEQ ID NO: 790693 - RNA, 19 nt, Homo sapiens
ggaguaaacuguuccagau

SEQ ID NO: 790694 - RNA, 19 nt, Homo sapiens
cuaauaaacuguuggcaaa

SEQ ID NO: 790695 - RNA, 19 nt, Homo sapiens
ggauuccacuuuacaaauu

SEQ ID NO: 790696 - RNA, 19 nt, Homo sapiens
ccucaaggauuccacuuua

SEQ ID NO: 790697 - RNA, 19 nt, Homo sapiens
gaaggaagccucauacagu

SEQ ID NO: 790698 - RNA, 19 nt, Homo sapiens
gaaagggcuuauugauuau

SEQ ID NO: 790699 - RNA, 19 nt, Homo sapiens
caucugaaguugaagcuaa

SEQ ID NO: 790700 - RNA, 19 nt, Homo sapiens
gaacaucaggcuuuaauag

SEQ ID NO: 790701 - RNA, 19 nt, Homo sapiens
gggaagccauguauaauca

SEQ ID NO: 790702 - RNA, 19 nt, Homo sapiens
ggaagaauuuaguccaguu

SEQ ID NO: 790703 - RNA, 19 nt, Homo sapiens
gaucucaaauccagagcua

SEQ ID NO: 790704 - RNA, 19 nt, Homo sapiens
gcagggaguucaugaucaa

SEQ ID NO: 790705 - RNA, 19 nt, Homo sapiens
acacucauauggaagauuu

SEQ ID NO: 790706 - RNA, 19 nt, Homo sapiens
gaucagauuuccacauugg

SEQ ID NO: 790707 - RNA, 19 nt, Homo sapiens
gaaauuagggacaggaaau

SEQ ID NO: 790708 - RNA, 19 nt, Homo sapiens
uggaguggcuucuaauaaa

SEQ ID NO: 790709 - RNA, 19 nt, Homo sapiens
ccacauuggacauaaauaa

SEQ ID NO: 790710 - RNA, 19 nt, Homo sapiens
gcaacagacucucaugaag

SEQ ID NO: 790711 - RNA, 19 nt, Homo sapiens
guaaacuguuccagauaaa

SEQ ID NO: 790712 - RNA, 19 nt, Homo sapiens
cuaaagaaccucaaggauu

SEQ ID NO: 790713 - RNA, 19 nt, Homo sapiens
gcaagauauucccauaaau

SEQ ID NO: 790714 - RNA, 19 nt, Homo sapiens
cgaaauauggugaauguga

SEQ ID NO: 790715 - RNA, 19 nt, Homo sapiens
cggauuagcgguuuauuaa

SEQ ID NO: 790716 - RNA, 19 nt, Homo sapiens
gacaggaaauuaugaugug

SEQ ID NO: 790717 - RNA, 19 nt, Homo sapiens
ggucauguauacaauaauc

SEQ ID NO: 790718 - RNA, 19 nt, Homo sapiens
gaaguaaauucuggcacaa

SEQ ID NO: 790719 - RNA, 19 nt, Homo sapiens
gaagaugccauuucaccuu

SEQ ID NO: 790720 - RNA, 19 nt, Homo sapiens
gauaaagcaagaauaguug

SEQ ID NO: 790721 - RNA, 19 nt, Homo sapiens
gauauucccauaaauccua

SEQ ID NO: 790722 - RNA, 19 nt, Homo sapiens
cuagaggaguauuaucuuu

SEQ ID NO: 790723 - RNA, 19 nt, Homo sapiens
aagaugccauuucaccuua

SEQ ID NO: 790724 - RNA, 19 nt, Homo sapiens
gaggauaacuccccuguga

SEQ ID NO: 790725 - RNA, 19 nt, Homo sapiens
gucaacaucuuauucauag

SEQ ID NO: 790726 - RNA, 19 nt, Homo sapiens
aguaaacuguuccagauaa

SEQ ID NO: 790727 - RNA, 19 nt, Homo sapiens
caguagauauucaagaaga

SEQ ID NO: 790728 - RNA, 19 nt, Homo sapiens
gaucauuuauccaguagca

SEQ ID NO: 790729 - RNA, 19 nt, Homo sapiens
gcacuauggucgugagagu

SEQ ID NO: 790730 - RNA, 19 nt, Homo sapiens
ccacaguugguauuaguua

SEQ ID NO: 790731 - RNA, 19 nt, Homo sapiens
agagaucauuuauccagua

SEQ ID NO: 790732 - RNA, 19 nt, Homo sapiens
caagauauucccauaaauc

SEQ ID NO: 790733 - RNA, 19 nt, Homo sapiens
ugcaagauauucccauaaa

SEQ ID NO: 790734 - RNA, 19 nt, Homo sapiens
ggacaggaaauuaugaugu

SEQ ID NO: 790735 - RNA, 19 nt, Homo sapiens
gaagcacuggguaucaaua

SEQ ID NO: 790736 - RNA, 19 nt, Homo sapiens
agacuuggauuugaugaaa

SEQ ID NO: 790737 - RNA, 19 nt, Homo sapiens
caacaaacagucuuauuac

SEQ ID NO: 790738 - RNA, 19 nt, Homo sapiens
gugcuggaguggcuucuaa

SEQ ID NO: 790739 - RNA, 19 nt, Homo sapiens
gcacaucagacuacuuguu

SEQ ID NO: 790740 - RNA, 19 nt, Homo sapiens
ccaaagacaaagaaacaaa

SEQ ID NO: 790741 - RNA, 19 nt, Homo sapiens
agagaaaugucuuauaagg

SEQ ID NO: 790742 - RNA, 19 nt, Homo sapiens
gaaaauagagagccagauu

SEQ ID NO: 790743 - RNA, 19 nt, Homo sapiens
acagauagccauaagcaaa

SEQ ID NO: 790744 - RNA, 19 nt, Homo sapiens
ggaacaucaggcuuuaaua

SEQ ID NO: 790745 - RNA, 19 nt, Homo sapiens
gauggaaggaagccucaua

SEQ ID NO: 790746 - RNA, 19 nt, Homo sapiens
gaauuuaguccaguuguug

SEQ ID NO: 790747 - RNA, 19 nt, Homo sapiens
aagaauaguugcaagaagu

SEQ ID NO: 790748 - RNA, 19 nt, Homo sapiens
gaaaccacacuacagauag

SEQ ID NO: 790749 - RNA, 19 nt, Homo sapiens
ccagaaaccacacuacaga

SEQ ID NO: 790750 - RNA, 19 nt, Homo sapiens
ccaaguggaagaauugaaa

SEQ ID NO: 790751 - RNA, 19 nt, Homo sapiens
guagaaaugaucucaaauc

SEQ ID NO: 790752 - RNA, 19 nt, Homo sapiens
gauuagcgguuuauuaagc

SEQ ID NO: 790753 - RNA, 19 nt, Homo sapiens
caugaaggacuuacagaaa

SEQ ID NO: 790754 - RNA, 19 nt, Homo sapiens
ccuauuccuucacauguaa

SEQ ID NO: 790755 - RNA, 19 nt, Homo sapiens
caagaauaguugcaagaag

SEQ ID NO: 790756 - RNA, 19 nt, Homo sapiens
ccagauaaagcaagaauag

SEQ ID NO: 790757 - RNA, 19 nt, Homo sapiens
gaguaaacuguuccagaua

SEQ ID NO: 790758 - RNA, 19 nt, Homo sapiens
ugaaagacacucauaugga

SEQ ID NO: 790759 - RNA, 19 nt, Homo sapiens
gugguuaccugcaacuaug

SEQ ID NO: 790760 - RNA, 19 nt, Homo sapiens
acagaaauauuuggugguu

SEQ ID NO: 790761 - RNA, 19 nt, Homo sapiens
agaaaccacacuacagaua

SEQ ID NO: 790762 - RNA, 19 nt, Homo sapiens
caagggaaaggaaguguga

SEQ ID NO: 790763 - RNA, 19 nt, Homo sapiens
ugaagguguugaccaagaa

SEQ ID NO: 790764 - RNA, 19 nt, Homo sapiens
cuuauuaccugaaaguugu

SEQ ID NO: 790765 - RNA, 19 nt, Homo sapiens
gaagccauguauaaucagu

SEQ ID NO: 790766 - RNA, 19 nt, Homo sapiens
uuacagaauuacuggaaga

SEQ ID NO: 790767 - RNA, 19 nt, Homo sapiens
aggaucagauuuccacauu

SEQ ID NO: 790768 - RNA, 19 nt, Homo sapiens
ugaacuaccagaagcagua

SEQ ID NO: 790769 - RNA, 19 nt, Homo sapiens
uccaguagauauucaagaa

SEQ ID NO: 790770 - RNA, 19 nt, Homo sapiens
aagaaagggcuuauugauu

SEQ ID NO: 790771 - RNA, 19 nt, Homo sapiens
gaaauuaugaugugaugac

SEQ ID NO: 790772 - RNA, 19 nt, Homo sapiens
ggaguggcuucuaauaaac

SEQ ID NO: 790773 - RNA, 19 nt, Homo sapiens
cgggucauguauacaauaa

SEQ ID NO: 790774 - RNA, 19 nt, Homo sapiens
cagaaauauuuggugguua

SEQ ID NO: 790775 - RNA, 19 nt, Homo sapiens
ggguucaacagaaauauuu

SEQ ID NO: 790776 - RNA, 19 nt, Homo sapiens
gagaucauuuauccaguag

SEQ ID NO: 790777 - RNA, 19 nt, Homo sapiens
cacuagauaccacaaauuu

SEQ ID NO: 790778 - RNA, 19 nt, Homo sapiens
ugagagacuuggauuugau

SEQ ID NO: 790779 - RNA, 19 nt, Homo sapiens
ggaucagauuuccacauug

SEQ ID NO: 790780 - RNA, 19 nt, Homo sapiens
aaugcaagauauucccaua

SEQ ID NO: 790781 - RNA, 19 nt, Homo sapiens
ggaagaauugaaaguacaa

SEQ ID NO: 790782 - RNA, 19 nt, Homo sapiens
agaaaugguugagaagaga

SEQ ID NO: 790783 - RNA, 19 nt, Homo sapiens
cagaaaugguugagaagag

SEQ ID NO: 790784 - RNA, 19 nt, Homo sapiens
agaaauauuuggugguuac

SEQ ID NO: 790785 - RNA, 19 nt, Homo sapiens
gcacuaaauacugcuaaga

SEQ ID NO: 790786 - RNA, 19 nt, Homo sapiens
ccaaugguugauauacuua

SEQ ID NO: 790787 - RNA, 19 nt, Homo sapiens
aaacagaguaugccaagau

SEQ ID NO: 790788 - RNA, 19 nt, Homo sapiens
cgacaaaccuggcgucuau

SEQ ID NO: 790789 - RNA, 19 nt, Homo sapiens
gcagagaacugaaguacug

SEQ ID NO: 790790 - RNA, 19 nt, Homo sapiens
gaccacagccuacagaaua

SEQ ID NO: 790791 - RNA, 19 nt, Homo sapiens
cacuagaucucccuuaaua

SEQ ID NO: 790792 - RNA, 19 nt, Homo sapiens
ccacaaccaugaucugaug

SEQ ID NO: 790793 - RNA, 19 nt, Homo sapiens
ucucaacugugcagaagua

SEQ ID NO: 790794 - RNA, 19 nt, Homo sapiens
gguggcaacuggguccuua

SEQ ID NO: 790795 - RNA, 19 nt, Homo sapiens
cuagaucucccuuaauaaa

SEQ ID NO: 790796 - RNA, 19 nt, Homo sapiens
agguggagauucccaguua

SEQ ID NO: 790797 - RNA, 19 nt, Homo sapiens
gcaagaaauaccugugguu

SEQ ID NO: 790798 - RNA, 19 nt, Homo sapiens
gguggagauucccaguuaa

SEQ ID NO: 790799 - RNA, 19 nt, Homo sapiens
gcacuagaucucccuuaau

SEQ ID NO: 790800 - RNA, 19 nt, Homo sapiens
uaccuggacuggaucaaga

SEQ ID NO: 790801 - RNA, 19 nt, Homo sapiens
gaagaagugugaggaugcu

SEQ ID NO: 790802 - RNA, 19 nt, Homo sapiens
ggagaccacagccuacaga

SEQ ID NO: 790803 - RNA, 19 nt, Homo sapiens
gaucugaugcuucuucaac

SEQ ID NO: 790804 - RNA, 19 nt, Homo sapiens
agaaauaccugugguucag

SEQ ID NO: 790805 - RNA, 19 nt, Homo sapiens
aaaccgaaauacacaguac

SEQ ID NO: 790806 - RNA, 19 nt, Homo sapiens
agaagugugaggaugcuua

SEQ ID NO: 790807 - RNA, 19 nt, Homo sapiens
gaccacaaccaugaucuga

SEQ ID NO: 790808 - RNA, 19 nt, Homo sapiens
agcacuagaucucccuuaa

SEQ ID NO: 790809 - RNA, 19 nt, Homo sapiens
gauucuaggauaagcacua

SEQ ID NO: 790810 - RNA, 19 nt, Homo sapiens
caacugugcagaaguaaaa

SEQ ID NO: 790811 - RNA, 19 nt, Homo sapiens
caaccaugaucugaugcuu

SEQ ID NO: 790812 - RNA, 19 nt, Homo sapiens
guggagauucccaguuaaa

SEQ ID NO: 790813 - RNA, 19 nt, Homo sapiens
guaccaggcagagaacuga

SEQ ID NO: 790814 - RNA, 19 nt, Homo sapiens
ccaucagccuggcagauca

SEQ ID NO: 790815 - RNA, 19 nt, Homo sapiens
uggacuggaucaagaagau

SEQ ID NO: 790816 - RNA, 19 nt, Homo sapiens
uggaggaccacaaccauga

SEQ ID NO: 790817 - RNA, 19 nt, Homo sapiens
uaaagauggcccagagcaa

SEQ ID NO: 790818 - RNA, 19 nt, Homo sapiens
accacagccuacagaauaa

SEQ ID NO: 790819 - RNA, 19 nt, Homo sapiens
uuaaaaggcuccagaaucg

SEQ ID NO: 790820 - RNA, 19 nt, Homo sapiens
gccgcuaccuggacuggau

SEQ ID NO: 790821 - RNA, 19 nt, Homo sapiens
aagggcugauucuaggaua

SEQ ID NO: 790822 - RNA, 19 nt, Homo sapiens
uggcccagagcaagaaaua

SEQ ID NO: 790823 - RNA, 19 nt, Homo sapiens
gcuccagaaucguguacca

SEQ ID NO: 790824 - RNA, 19 nt, Homo sapiens
ggaccacaaccaugaucug

SEQ ID NO: 790825 - RNA, 19 nt, Homo sapiens
gaucucccuuaauaaacuc

SEQ ID NO: 790826 - RNA, 19 nt, Homo sapiens
gaagugugaggaugcuuac

SEQ ID NO: 790827 - RNA, 19 nt, Homo sapiens
gcaagggcugauucuagga

SEQ ID NO: 790828 - RNA, 19 nt, Homo sapiens
gggcacaggaggacaaggu

SEQ ID NO: 790829 - RNA, 19 nt, Homo sapiens
ggauguuccugcucuugcu

SEQ ID NO: 790830 - RNA, 19 nt, Homo sapiens
agaucucccuuaauaaacu

SEQ ID NO: 790831 - RNA, 19 nt, Homo sapiens
gagguggagauucccaguu

SEQ ID NO: 790832 - RNA, 19 nt, Homo sapiens
cgagagaauuuuccugaca

SEQ ID NO: 790833 - RNA, 19 nt, Homo sapiens
gaaauaccugugguucagu

SEQ ID NO: 790834 - RNA, 19 nt, Homo sapiens
gagcaggagguggagauuc

SEQ ID NO: 790835 - RNA, 19 nt, Homo sapiens
ccacagccuacagaauaaa

SEQ ID NO: 790836 - RNA, 19 nt, Homo sapiens
gagaccacagccuacagaa

SEQ ID NO: 790837 - RNA, 19 nt, Homo sapiens
cuguggcgguguccuugua

SEQ ID NO: 790838 - RNA, 19 nt, Homo sapiens
aauaaacucacaacucucu

SEQ ID NO: 790839 - RNA, 19 nt, Homo sapiens
cuuaauaaacucacaacuc

SEQ ID NO: 790840 - RNA, 19 nt, Homo sapiens
ggagcaggagguggagauu

SEQ ID NO: 790841 - RNA, 19 nt, Homo sapiens
caugaucugaugcuucuuc

SEQ ID NO: 790842 - RNA, 19 nt, Homo sapiens
ccacaccccugcuacaaca

SEQ ID NO: 790843 - RNA, 19 nt, Homo sapiens
ccagaagugcaccgucuca

SEQ ID NO: 790844 - RNA, 19 nt, Homo sapiens
accaugaucugaugcuucu

SEQ ID NO: 790845 - RNA, 19 nt, Homo sapiens
ggaggaccacaaccaugau

SEQ ID NO: 790846 - RNA, 19 nt, Homo sapiens
cgacaaaccuggcgucuau

SEQ ID NO: 790847 - RNA, 19 nt, Homo sapiens
gcagagaacugaaguacug

SEQ ID NO: 790848 - RNA, 19 nt, Homo sapiens
gaccacagccuacagaaua

SEQ ID NO: 790849 - RNA, 19 nt, Homo sapiens
cacuagaucucccuuaaua

SEQ ID NO: 790850 - RNA, 19 nt, Homo sapiens
ccacaaccaugaucugaug

SEQ ID NO: 790851 - RNA, 19 nt, Homo sapiens
ucucaacugugcagaagua

SEQ ID NO: 790852 - RNA, 19 nt, Homo sapiens
gguggcaacuggguccuua

SEQ ID NO: 790853 - RNA, 19 nt, Homo sapiens
gccuggaccuccucacuaa

SEQ ID NO: 790854 - RNA, 19 nt, Homo sapiens
cuagaucucccuuaauaaa

SEQ ID NO: 790855 - RNA, 19 nt, Homo sapiens
agguggagauucccaguua

SEQ ID NO: 790856 - RNA, 19 nt, Homo sapiens
gcaagaaauaccugugguu

SEQ ID NO: 790857 - RNA, 19 nt, Homo sapiens
gaacuugccguguguccau

SEQ ID NO: 790858 - RNA, 19 nt, Homo sapiens
gguggagauucccaguuaa

SEQ ID NO: 790859 - RNA, 19 nt, Homo sapiens
gcacuagaucucccuuaau

SEQ ID NO: 790860 - RNA, 19 nt, Homo sapiens
uaccuggacuggaucaaga

SEQ ID NO: 790861 - RNA, 19 nt, Homo sapiens
gaagaagugugaggaugcu

SEQ ID NO: 790862 - RNA, 19 nt, Homo sapiens
ggagaccacagccuacaga

SEQ ID NO: 790863 - RNA, 19 nt, Homo sapiens
gaucugaugcuucuucaac

SEQ ID NO: 790864 - RNA, 19 nt, Homo sapiens
agaaauaccugugguucag

SEQ ID NO: 790865 - RNA, 19 nt, Homo sapiens
aaaccgaaauacacaguac

SEQ ID NO: 790866 - RNA, 19 nt, Homo sapiens
agaagugugaggaugcuua

SEQ ID NO: 790867 - RNA, 19 nt, Homo sapiens
gaccacaaccaugaucuga

SEQ ID NO: 790868 - RNA, 19 nt, Homo sapiens
agcacuagaucucccuuaa

SEQ ID NO: 790869 - RNA, 19 nt, Homo sapiens
gauucuaggauaagcacua

SEQ ID NO: 790870 - RNA, 19 nt, Homo sapiens
guggagauucccaguuaaa

SEQ ID NO: 790871 - RNA, 19 nt, Homo sapiens
caacugugcagaaguaaaa

SEQ ID NO: 790872 - RNA, 19 nt, Homo sapiens
caaccaugaucugaugcuu

SEQ ID NO: 790873 - RNA, 19 nt, Homo sapiens
guaccaggcagagaacuga

SEQ ID NO: 790874 - RNA, 19 nt, Homo sapiens
ccaucagccuggcagauca

SEQ ID NO: 790875 - RNA, 19 nt, Homo sapiens
cggagaacuugccgugugu

SEQ ID NO: 790876 - RNA, 19 nt, Homo sapiens
uggacuggaucaagaagau

SEQ ID NO: 790877 - RNA, 19 nt, Homo sapiens
uggaggaccacaaccauga

SEQ ID NO: 790878 - RNA, 19 nt, Homo sapiens
uaaagauggcccagagcaa

SEQ ID NO: 790879 - RNA, 19 nt, Homo sapiens
accacagccuacagaauaa

SEQ ID NO: 790880 - RNA, 19 nt, Homo sapiens
gccgcuaccuggacuggau

SEQ ID NO: 790881 - RNA, 19 nt, Homo sapiens
uuaaaaggcuccagaaucg

SEQ ID NO: 790882 - RNA, 19 nt, Homo sapiens
ggaccuccucacuaaguug

SEQ ID NO: 790883 - RNA, 19 nt, Homo sapiens
aagggcugauucuaggaua

SEQ ID NO: 790884 - RNA, 19 nt, Homo sapiens
uggcccagagcaagaaaua

SEQ ID NO: 790885 - RNA, 19 nt, Homo sapiens
gcuccagaaucguguacca

SEQ ID NO: 790886 - RNA, 19 nt, Homo sapiens
ggaccacaaccaugaucug

SEQ ID NO: 790887 - RNA, 19 nt, Homo sapiens
gaucucccuuaauaaacuc

SEQ ID NO: 790888 - RNA, 19 nt, Homo sapiens
gaagugugaggaugcuuac

SEQ ID NO: 790889 - RNA, 19 nt, Homo sapiens
gcaagggcugauucuagga

SEQ ID NO: 790890 - RNA, 19 nt, Homo sapiens
gggcacaggaggacaaggu

SEQ ID NO: 790891 - RNA, 19 nt, Homo sapiens
ggauguuccugcucuugcu

SEQ ID NO: 790892 - RNA, 19 nt, Homo sapiens
agaucucccuuaauaaacu

SEQ ID NO: 790893 - RNA, 19 nt, Homo sapiens
gagcaggagguggagauuc

SEQ ID NO: 790894 - RNA, 19 nt, Homo sapiens
cgagagaauuuuccugaca

SEQ ID NO: 790895 - RNA, 19 nt, Homo sapiens
gaaauaccugugguucagu

SEQ ID NO: 790896 - RNA, 19 nt, Homo sapiens
ccacagccuacagaauaaa

SEQ ID NO: 790897 - RNA, 19 nt, Homo sapiens
gagaccacagccuacagaa

SEQ ID NO: 790898 - RNA, 19 nt, Homo sapiens
cuguggcgguguccuugua

SEQ ID NO: 790899 - RNA, 19 nt, Homo sapiens
gagguggagauucccaguu

SEQ ID NO: 790900 - RNA, 19 nt, Homo sapiens
aauaaacucacaacucucu

SEQ ID NO: 790901 - RNA, 19 nt, Homo sapiens
cuuaauaaacucacaacuc

SEQ ID NO: 790902 - RNA, 19 nt, Homo sapiens
ggagcaggagguggagauu

SEQ ID NO: 790903 - RNA, 19 nt, Homo sapiens
caugaucugaugcuucuuc

SEQ ID NO: 790904 - RNA, 19 nt, Homo sapiens
ccacaccccugcuacaaca

SEQ ID NO: 790905 - RNA, 19 nt, Homo sapiens
ugccguguguccauuugaa

SEQ ID NO: 790906 - RNA, 19 nt, Homo sapiens
uaaguuguaugcggagaac

SEQ ID NO: 790907 - RNA, 19 nt, Homo sapiens
ccuccucacuaaguuguau

SEQ ID NO: 790908 - RNA, 19 nt, Homo sapiens
ccagaagugcaccgucuca

SEQ ID NO: 790909 - RNA, 19 nt, Homo sapiens
accaugaucugaugcuucu

SEQ ID NO: 790910 - RNA, 19 nt, Homo sapiens
ggaggaccacaaccaugau

SEQ ID NO: 790911 - RNA, 19 nt, Homo sapiens
cgacaaaccuggcgucuau

SEQ ID NO: 790912 - RNA, 19 nt, Homo sapiens
gcagagaacugaaguacug

SEQ ID NO: 790913 - RNA, 19 nt, Homo sapiens
cacuagaucucccuuaaua

SEQ ID NO: 790914 - RNA, 19 nt, Homo sapiens
ucucaacugugcagaagua

SEQ ID NO: 790915 - RNA, 19 nt, Homo sapiens
cuagaucucccuuaauaaa

SEQ ID NO: 790916 - RNA, 19 nt, Homo sapiens
agguggagauucccaguua

SEQ ID NO: 790917 - RNA, 19 nt, Homo sapiens
gagccugggcagagaauuu

SEQ ID NO: 790918 - RNA, 19 nt, Homo sapiens
gguggagauucccaguuaa

SEQ ID NO: 790919 - RNA, 19 nt, Homo sapiens
gcacuagaucucccuuaau

SEQ ID NO: 790920 - RNA, 19 nt, Homo sapiens
uaccuggacuggaucaaga

SEQ ID NO: 790921 - RNA, 19 nt, Homo sapiens
gaagaagugugaggaugcu

SEQ ID NO: 790922 - RNA, 19 nt, Homo sapiens
gcagagaauuuuccugaca

SEQ ID NO: 790923 - RNA, 19 nt, Homo sapiens
agaagugugaggaugcuua

SEQ ID NO: 790924 - RNA, 19 nt, Homo sapiens
agcacuagaucucccuuaa

SEQ ID NO: 790925 - RNA, 19 nt, Homo sapiens
gauucuaggauaagcacua

SEQ ID NO: 790926 - RNA, 19 nt, Homo sapiens
guggagauucccaguuaaa

SEQ ID NO: 790927 - RNA, 19 nt, Homo sapiens
caacugugcagaaguaaaa

SEQ ID NO: 790928 - RNA, 19 nt, Homo sapiens
guaccaggcagagaacuga

SEQ ID NO: 790929 - RNA, 19 nt, Homo sapiens
uggacuggaucaagaagau

SEQ ID NO: 790930 - RNA, 19 nt, Homo sapiens
gccgcuaccuggacuggau

SEQ ID NO: 790931 - RNA, 19 nt, Homo sapiens
uuaaaaggcuccagaaucg

SEQ ID NO: 790932 - RNA, 19 nt, Homo sapiens
aagggcugauucuaggaua

SEQ ID NO: 790933 - RNA, 19 nt, Homo sapiens
gcuccagaaucguguacca

SEQ ID NO: 790934 - RNA, 19 nt, Homo sapiens
gaucucccuuaauaaacuc

SEQ ID NO: 790935 - RNA, 19 nt, Homo sapiens
gaagugugaggaugcuuac

SEQ ID NO: 790936 - RNA, 19 nt, Homo sapiens
gcaagggcugauucuagga

SEQ ID NO: 790937 - RNA, 19 nt, Homo sapiens
ggauguuccugcucuugcu

SEQ ID NO: 790938 - RNA, 19 nt, Homo sapiens
agaucucccuuaauaaacu

SEQ ID NO: 790939 - RNA, 19 nt, Homo sapiens
gagcaggagguggagauuc

SEQ ID NO: 790940 - RNA, 19 nt, Homo sapiens
gagguggagauucccaguu

SEQ ID NO: 790941 - RNA, 19 nt, Homo sapiens
aauaaacucacaacucucu

SEQ ID NO: 790942 - RNA, 19 nt, Homo sapiens
cuuaauaaacucacaacuc

SEQ ID NO: 790943 - RNA, 19 nt, Homo sapiens
ggagcaggagguggagauu

SEQ ID NO: 790944 - RNA, 19 nt, Homo sapiens
cgacaaaccuggcgucuau

SEQ ID NO: 790945 - RNA, 19 nt, Homo sapiens
gcagagaacugaaguacug

SEQ ID NO: 790946 - RNA, 19 nt, Homo sapiens
cacuagaucucccuuaaua

SEQ ID NO: 790947 - RNA, 19 nt, Homo sapiens
cuagaucucccuuaauaaa

SEQ ID NO: 790948 - RNA, 19 nt, Homo sapiens
agguggagauucccaguua

SEQ ID NO: 790949 - RNA, 19 nt, Homo sapiens
gguggagauucccaguuaa

SEQ ID NO: 790950 - RNA, 19 nt, Homo sapiens
gcacuagaucucccuuaau

SEQ ID NO: 790951 - RNA, 19 nt, Homo sapiens
uaccuggacuggaucaaga

SEQ ID NO: 790952 - RNA, 19 nt, Homo sapiens
agcacuagaucucccuuaa

SEQ ID NO: 790953 - RNA, 19 nt, Homo sapiens
gauucuaggauaagcacua

SEQ ID NO: 790954 - RNA, 19 nt, Homo sapiens
guaccaggcagagaacuga

SEQ ID NO: 790955 - RNA, 19 nt, Homo sapiens
guggagauucccaguuaaa

SEQ ID NO: 790956 - RNA, 19 nt, Homo sapiens
uggacuggaucaagaagau

SEQ ID NO: 790957 - RNA, 19 nt, Homo sapiens
gccgcuaccuggacuggau

SEQ ID NO: 790958 - RNA, 19 nt, Homo sapiens
uuaaaaggcuccagaaucg

SEQ ID NO: 790959 - RNA, 19 nt, Homo sapiens
aagggcugauucuaggaua

SEQ ID NO: 790960 - RNA, 19 nt, Homo sapiens
gcuccagaaucguguacca

SEQ ID NO: 790961 - RNA, 19 nt, Homo sapiens
gaucucccuuaauaaacuc

SEQ ID NO: 790962 - RNA, 19 nt, Homo sapiens
gcaagggcugauucuagga

SEQ ID NO: 790963 - RNA, 19 nt, Homo sapiens
ggauguuccugcucuugcu

SEQ ID NO: 790964 - RNA, 19 nt, Homo sapiens
agaucucccuuaauaaacu

SEQ ID NO: 790965 - RNA, 19 nt, Homo sapiens
gagcaggagguggagauuc

SEQ ID NO: 790966 - RNA, 19 nt, Homo sapiens
gagguggagauucccaguu

SEQ ID NO: 790967 - RNA, 19 nt, Homo sapiens
aauaaacucacaacucucu

SEQ ID NO: 790968 - RNA, 19 nt, Homo sapiens
cuuaauaaacucacaacuc

SEQ ID NO: 790969 - RNA, 19 nt, Homo sapiens
ggagcaggagguggagauu

SEQ ID NO: 790970 - RNA, 19 nt, Homo sapiens
gaaguagccucuuguguaa

SEQ ID NO: 790971 - RNA, 19 nt, Homo sapiens
caaauaagaggacagauaa

SEQ ID NO: 790972 - RNA, 19 nt, Homo sapiens
gauaacugcuuugcaaauu

SEQ ID NO: 790973 - RNA, 19 nt, Homo sapiens
gaggacagauaacugcuuu

SEQ ID NO: 790974 - RNA, 19 nt, Homo sapiens
ggaaaccaagccaauguua

SEQ ID NO: 790975 - RNA, 19 nt, Homo sapiens
cagaaacccuucagugcua

SEQ ID NO: 790976 - RNA, 19 nt, Homo sapiens
aaaccaagccaauguuaua

SEQ ID NO: 790977 - RNA, 19 nt, Homo sapiens
ugaaguagccucuugugua

SEQ ID NO: 790978 - RNA, 19 nt, Homo sapiens
ggacaucggcuacaacaug

SEQ ID NO: 790979 - RNA, 19 nt, Homo sapiens
acagauaacugcuuugcaa

SEQ ID NO: 790980 - RNA, 19 nt, Homo sapiens
gcaaggacaucggcuacaa

SEQ ID NO: 790981 - RNA, 19 nt, Homo sapiens
ggagaaggaucauucaaaa

SEQ ID NO: 790982 - RNA, 19 nt, Homo sapiens
gacagaaaccuccaucaaa

SEQ ID NO: 790983 - RNA, 19 nt, Homo sapiens
gugauacacugaaaggaaa

SEQ ID NO: 790984 - RNA, 19 nt, Homo sapiens
caaaagaaaucuccuaaca

SEQ ID NO: 790985 - RNA, 19 nt, Homo sapiens
acaaauaagaggacagaua

SEQ ID NO: 790986 - RNA, 19 nt, Homo sapiens
gagcuaagauguggugcuu

SEQ ID NO: 790987 - RNA, 19 nt, Homo sapiens
gacaucggcuacaacauga

SEQ ID NO: 790988 - RNA, 19 nt, Homo sapiens
gaacucaaacgaugugcaa

SEQ ID NO: 790989 - RNA, 19 nt, Homo sapiens
ccucuuguguaacuaauuu

SEQ ID NO: 790990 - RNA, 19 nt, Homo sapiens
uaacugcuuugcaaauuca

SEQ ID NO: 790991 - RNA, 19 nt, Homo sapiens
uggcuuugcuacccauuua

SEQ ID NO: 790992 - RNA, 19 nt, Homo sapiens
gggagaaggaucauucaaa

SEQ ID NO: 790993 - RNA, 19 nt, Homo sapiens
gcuacaacaugacucguau

SEQ ID NO: 790994 - RNA, 19 nt, Homo sapiens
gaaaccaagccaauguuau

SEQ ID NO: 790995 - RNA, 19 nt, Homo sapiens
ccagugaaguagccucuug

SEQ ID NO: 790996 - RNA, 19 nt, Homo sapiens
ccaagaagaggccgaaguu

SEQ ID NO: 790997 - RNA, 19 nt, Homo sapiens
acagaaaccuccaucaaac

SEQ ID NO: 790998 - RNA, 19 nt, Homo sapiens
gcuaagauguggugcuuuu

SEQ ID NO: 790999 - RNA, 19 nt, Homo sapiens
cggcaucccugcagaggaa

SEQ ID NO: 791000 - RNA, 19 nt, Homo sapiens
ggacagcggccagcucuau

SEQ ID NO: 791001 - RNA, 19 nt, Homo sapiens
ggaagagggagaaggauca

SEQ ID NO: 791002 - RNA, 19 nt, Homo sapiens
ggacugauuuguggaaagg

SEQ ID NO: 791003 - RNA, 19 nt, Homo sapiens
aaacucaccacgggaaaua

SEQ ID NO: 791004 - RNA, 19 nt, Homo sapiens
guaucgggcucuucucugu

SEQ ID NO: 791005 - RNA, 19 nt, Homo sapiens
ugugaucgccugcuacuuu

SEQ ID NO: 791006 - RNA, 19 nt, Homo sapiens
gaaggaucauucaaaaguu

SEQ ID NO: 791007 - RNA, 19 nt, Homo sapiens
gaaaucuccuaacaaaaga

SEQ ID NO: 791008 - RNA, 19 nt, Homo sapiens
ggaagcuccuccagugaag

SEQ ID NO: 791009 - RNA, 19 nt, Homo sapiens
ccaacuaccugugcaugga

SEQ ID NO: 791010 - RNA, 19 nt, Homo sapiens
gcaccgagcaggucucuac

SEQ ID NO: 791011 - RNA, 19 nt, Homo sapiens
gcaaaugccagcccaucga

SEQ ID NO: 791012 - RNA, 19 nt, Homo sapiens
gaucaggaagcacuagguu

SEQ ID NO: 791013 - RNA, 19 nt, Homo sapiens
ccugggcgcuccaagaaga

SEQ ID NO: 791014 - RNA, 19 nt, Homo sapiens
gaacgccucaacauggauu

SEQ ID NO: 791015 - RNA, 19 nt, Homo sapiens
acaaacagaucaggaagca

SEQ ID NO: 791016 - RNA, 19 nt, Homo sapiens
aagaagaggccgaaguuug

SEQ ID NO: 791017 - RNA, 19 nt, Homo sapiens
gggaagcuccuccagugaa

SEQ ID NO: 791018 - RNA, 19 nt, Homo sapiens
ccaauguuauagacguuug

SEQ ID NO: 791019 - RNA, 19 nt, Homo sapiens
acuccggccuucaccaaua

SEQ ID NO: 791020 - RNA, 19 nt, Homo sapiens
gugguaaaguaguugauuc

SEQ ID NO: 791021 - RNA, 19 nt, Homo sapiens
gaaauucaggaugcuguga

SEQ ID NO: 791022 - RNA, 19 nt, Homo sapiens
uuauagacguuuggacuga

SEQ ID NO: 791023 - RNA, 19 nt, Homo sapiens
acucaaacgaugugcaaua

SEQ ID NO: 791024 - RNA, 19 nt, Homo sapiens
agacagaaaccuccaucaa

SEQ ID NO: 791025 - RNA, 19 nt, Homo sapiens
agccguagguuaaagaaga

SEQ ID NO: 791026 - RNA, 19 nt, Homo sapiens
ggugugcagccguagguua

SEQ ID NO: 791027 - RNA, 19 nt, Homo sapiens
aaaugaacaaccagacuaa

SEQ ID NO: 791028 - RNA, 19 nt, Homo sapiens
cgaggcagccauccaguug

SEQ ID NO: 791029 - RNA, 19 nt, Homo sapiens
aauucaggaugcugugaua

SEQ ID NO: 791030 - RNA, 19 nt, Homo sapiens
gcucuucucugugcuguac

SEQ ID NO: 791031 - RNA, 19 nt, Homo sapiens
caaagggcuuauugacucu

SEQ ID NO: 791032 - RNA, 19 nt, Homo sapiens
caagaagaggccgaaguuu

SEQ ID NO: 791033 - RNA, 19 nt, Homo sapiens
gauuuggaguugcuuaaaa

SEQ ID NO: 791034 - RNA, 19 nt, Homo sapiens
gccguagguuaaagaagaa

SEQ ID NO: 791035 - RNA, 19 nt, Homo sapiens
cugcguguguauauuugua

SEQ ID NO: 791036 - RNA, 19 nt, Homo sapiens
gcuuauugacucuuucuau

SEQ ID NO: 791037 - RNA, 19 nt, Homo sapiens
ggauuuggaguugcuuaaa

SEQ ID NO: 791038 - RNA, 19 nt, Homo sapiens
ugauucagcccucagaaga

SEQ ID NO: 791039 - RNA, 19 nt, Homo sapiens
ccagcgggauguggauuug

SEQ ID NO: 791040 - RNA, 19 nt, Homo sapiens
ccaagccaauguuauagac

SEQ ID NO: 791041 - RNA, 19 nt, Homo sapiens
gauucagcccucagaagaa

SEQ ID NO: 791042 - RNA, 19 nt, Homo sapiens
acccuucagugcuacauuu

SEQ ID NO: 791043 - RNA, 19 nt, Homo sapiens
ggacagauaacugcuuugc

SEQ ID NO: 791044 - RNA, 19 nt, Homo sapiens
gggcggugcugugcuucuu

SEQ ID NO: 791045 - RNA, 19 nt, Homo sapiens
auucagcccucagaagaaa

SEQ ID NO: 791046 - RNA, 19 nt, Homo sapiens
cuuaaaggguuuuguuuug

SEQ ID NO: 791047 - RNA, 19 nt, Homo sapiens
ugugauacacugaaaggaa

SEQ ID NO: 791048 - RNA, 19 nt, Homo sapiens
gugugcagccguagguuaa

SEQ ID NO: 791049 - RNA, 19 nt, Homo sapiens
uuacgaacgccucaacaug

SEQ ID NO: 791050 - RNA, 19 nt, Homo sapiens
ucgcuucccgguauuguuu

SEQ ID NO: 791051 - RNA, 19 nt, Homo sapiens
auaacugcuuugcaaauuc

SEQ ID NO: 791052 - RNA, 19 nt, Homo sapiens
agaagaagagccggagaaa

SEQ ID NO: 791053 - RNA, 19 nt, Homo sapiens
ugucuaguguauucucuuc

SEQ ID NO: 791054 - RNA, 19 nt, Homo sapiens
caacaaaagaaaucuccua

SEQ ID NO: 791055 - RNA, 19 nt, Homo sapiens
cccaguggauuuggaguug

SEQ ID NO: 791056 - RNA, 19 nt, Homo sapiens
cagauaacugcuuugcaaa

SEQ ID NO: 791057 - RNA, 19 nt, Homo sapiens
caccugggcgcuccaagaa

SEQ ID NO: 791058 - RNA, 19 nt, Homo sapiens
ggcuacaacaugacucgua

SEQ ID NO: 791059 - RNA, 19 nt, Homo sapiens
guucuuuaguuugcugcua

SEQ ID NO: 791060 - RNA, 19 nt, Homo sapiens
agagggagaaggaucauuc

SEQ ID NO: 791061 - RNA, 19 nt, Homo sapiens
uaauggaaaccaagccaau

SEQ ID NO: 791062 - RNA, 19 nt, Homo sapiens
ggaaacuccccaacaagaa

SEQ ID NO: 791063 - RNA, 19 nt, Homo sapiens
auagacguuuggacugauu

SEQ ID NO: 791064 - RNA, 19 nt, Homo sapiens
gcgaggcagccauccaguu

SEQ ID NO: 791065 - RNA, 19 nt, Homo sapiens
ccauccaguugcacgaguu

SEQ ID NO: 791066 - RNA, 19 nt, Homo sapiens
acgaacgccucaacaugga

SEQ ID NO: 791067 - RNA, 19 nt, Homo sapiens
ccugugugaucgccugcua

SEQ ID NO: 791068 - RNA, 19 nt, Homo sapiens
ggugaagaccauccugauc

SEQ ID NO: 791069 - RNA, 19 nt, Homo sapiens
gcggccagcucuaugucau

SEQ ID NO: 791070 - RNA, 19 nt, Homo sapiens
ccugaaagguuaaagguua

SEQ ID NO: 791071 - RNA, 19 nt, Homo sapiens
gcacauaaacgccaagugu

SEQ ID NO: 791072 - RNA, 19 nt, Homo sapiens
gaaguuggcagacaaagug

SEQ ID NO: 791073 - RNA, 19 nt, Homo sapiens
gcacuucauuggccaccua

SEQ ID NO: 791074 - RNA, 19 nt, Homo sapiens
gagaucaaauggcacuuca

SEQ ID NO: 791075 - RNA, 19 nt, Homo sapiens
cgaauaggaagcacgauuu

SEQ ID NO: 791076 - RNA, 19 nt, Homo sapiens
aaacauggccuuccaccuu

SEQ ID NO: 791077 - RNA, 19 nt, Homo sapiens
aaccaaaccugcagacaug

SEQ ID NO: 791078 - RNA, 19 nt, Homo sapiens
acaaauguccgaauaggaa

SEQ ID NO: 791079 - RNA, 19 nt, Homo sapiens
gagcgggauuacucaaaga

SEQ ID NO: 791080 - RNA, 19 nt, Homo sapiens
guccuaaccuggaguuugu

SEQ ID NO: 791081 - RNA, 19 nt, Homo sapiens
gcagacaaagugaacaguu

SEQ ID NO: 791082 - RNA, 19 nt, Homo sapiens
ggagaagagaguaaacaug

SEQ ID NO: 791083 - RNA, 19 nt, Homo sapiens
ggacaugggcagcgcacuu

SEQ ID NO: 791084 - RNA, 19 nt, Homo sapiens
gaucgaggccuauggacau

SEQ ID NO: 791085 - RNA, 19 nt, Homo sapiens
gcaugcgguugaaguagga

SEQ ID NO: 791086 - RNA, 19 nt, Homo sapiens
uaaagguuaugguccagau

SEQ ID NO: 791087 - RNA, 19 nt, Homo sapiens
gcuaguggcggucagcaaa

SEQ ID NO: 791088 - RNA, 19 nt, Homo sapiens
gagagcgggauuacucaaa

SEQ ID NO: 791089 - RNA, 19 nt, Homo sapiens
gaguaaacauggccuucca

SEQ ID NO: 791090 - RNA, 19 nt, Homo sapiens
aagguuaugguccagauua

SEQ ID NO: 791091 - RNA, 19 nt, Homo sapiens
gacaugggcagcgcacuuu

SEQ ID NO: 791092 - RNA, 19 nt, Homo sapiens
cuacaaauguccgaauagg

SEQ ID NO: 791093 - RNA, 19 nt, Homo sapiens
gauuaacaccagcggagaa

SEQ ID NO: 791094 - RNA, 19 nt, Homo sapiens
ccagcaugcgguugaagua

SEQ ID NO: 791095 - RNA, 19 nt, Homo sapiens
gggcugaugaccauaggaa

SEQ ID NO: 791096 - RNA, 19 nt, Homo sapiens
gaauaggaagcacgauuuu

SEQ ID NO: 791097 - RNA, 19 nt, Homo sapiens
cugaaagguuaaagguuau

SEQ ID NO: 791098 - RNA, 19 nt, Homo sapiens
cugcagacauggugaucga

SEQ ID NO: 791099 - RNA, 19 nt, Homo sapiens
gaucuacaaauguccgaau

SEQ ID NO: 791100 - RNA, 19 nt, Homo sapiens
gggcauguccgcggauuuc

SEQ ID NO: 791101 - RNA, 19 nt, Homo sapiens
gaccaaauccagacuucca

SEQ ID NO: 791102 - RNA, 19 nt, Homo sapiens
aaaccaaaccugcagacau

SEQ ID NO: 791103 - RNA, 19 nt, Homo sapiens
ggagagcgggauuacucaa

SEQ ID NO: 791104 - RNA, 19 nt, Homo sapiens
ccgaauaggaagcacgauu

SEQ ID NO: 791105 - RNA, 19 nt, Homo sapiens
gcaugaucuuagucaagga

SEQ ID NO: 791106 - RNA, 19 nt, Homo sapiens
gaucuuagucaaggaccaa

SEQ ID NO: 791107 - RNA, 19 nt, Homo sapiens
gcgggauuacucaaagaaa

SEQ ID NO: 791108 - RNA, 19 nt, Homo sapiens
agagcgggauuacucaaag

SEQ ID NO: 791109 - RNA, 19 nt, Homo sapiens
uaggaagcuuugggcauga

SEQ ID NO: 791110 - RNA, 19 nt, Homo sapiens
gaugaccauaggaagcuuu

SEQ ID NO: 791111 - RNA, 19 nt, Homo sapiens
cgggauuacucaaagaaac

SEQ ID NO: 791112 - RNA, 19 nt, Homo sapiens
ggugaucgaggccuaugga

SEQ ID NO: 791113 - RNA, 19 nt, Homo sapiens
gggcaugaucuuagucaag

SEQ ID NO: 791114 - RNA, 19 nt, Homo sapiens
cagcggagaagagaguaaa

SEQ ID NO: 791115 - RNA, 19 nt, Homo sapiens
uaacaccagcggagaagag

SEQ ID NO: 791116 - RNA, 19 nt, Homo sapiens
agguuaugguccagauuaa

SEQ ID NO: 791117 - RNA, 19 nt, Homo sapiens
aacaguuccuggcagagaa

SEQ ID NO: 791118 - RNA, 19 nt, Homo sapiens
caucaaaucccaaaauucu

SEQ ID NO: 791119 - RNA, 19 nt, Homo sapiens
gaaaagguucuccugaaag

SEQ ID NO: 791120 - RNA, 19 nt, Homo sapiens
aucuacaaauguccgaaua

SEQ ID NO: 791121 - RNA, 19 nt, Homo sapiens
aagguucuccugaaagguu

SEQ ID NO: 791122 - RNA, 19 nt, Homo sapiens
caucagaguuguaccauaa

SEQ ID NO: 791123 - RNA, 19 nt, Homo sapiens
ccacaaagacuuccuaauu

SEQ ID NO: 791124 - RNA, 19 nt, Homo sapiens
gaucauggguucugacuuc

SEQ ID NO: 791125 - RNA, 19 nt, Homo sapiens
ccaaauccacgcucaauua

SEQ ID NO: 791126 - RNA, 19 nt, Homo sapiens
cacaaagacuuccuaauug

SEQ ID NO: 791127 - RNA, 19 nt, Homo sapiens
ggaagacauuggcuccaua

SEQ ID NO: 791128 - RNA, 19 nt, Homo sapiens
ggauucaugucucucauuu

SEQ ID NO: 791129 - RNA, 19 nt, Homo sapiens
ugaggaagcuugcaacaug

SEQ ID NO: 791130 - RNA, 19 nt, Homo sapiens
ggucaucuguggcaguaua

SEQ ID NO: 791131 - RNA, 19 nt, Homo sapiens
gcaguaaacaucuguggua

SEQ ID NO: 791132 - RNA, 19 nt, Homo sapiens
aaacagaugucuacagcuu

SEQ ID NO: 791133 - RNA, 19 nt, Homo sapiens
gaaguucugucugauuuau

SEQ ID NO: 791134 - RNA, 19 nt, Homo sapiens
gagcagcuguuccuccaaa

SEQ ID NO: 791135 - RNA, 19 nt, Homo sapiens
gaugaaagccagaauaaca

SEQ ID NO: 791136 - RNA, 19 nt, Homo sapiens
ccaagagaaugaucaauag

SEQ ID NO: 791137 - RNA, 19 nt, Homo sapiens
gccaagagaaugaucaaua

SEQ ID NO: 791138 - RNA, 19 nt, Homo sapiens
ggaacaagagaauuacuuu

SEQ ID NO: 791139 - RNA, 19 nt, Homo sapiens
gacauuggcuccauaagca

SEQ ID NO: 791140 - RNA, 19 nt, Homo sapiens
gcagagagacuuucaagca

SEQ ID NO: 791141 - RNA, 19 nt, Homo sapiens
guagaguaguguuagauga

SEQ ID NO: 791142 - RNA, 19 nt, Homo sapiens
cuagaaauuuccacaaaga

SEQ ID NO: 791143 - RNA, 19 nt, Homo sapiens
agaaggaacuagaaauuuc

SEQ ID NO: 791144 - RNA, 19 nt, Homo sapiens
caggauaauugucucauga

SEQ ID NO: 791145 - RNA, 19 nt, Homo sapiens
ccacaucacuaaaguccuu

SEQ ID NO: 791146 - RNA, 19 nt, Homo sapiens
gaccaucggugaccuuuua

SEQ ID NO: 791147 - RNA, 19 nt, Homo sapiens
gaagacauuggcuccauaa

SEQ ID NO: 791148 - RNA, 19 nt, Homo sapiens
cugccaagcucuucuguuu

SEQ ID NO: 791149 - RNA, 19 nt, Homo sapiens
gaagagaggccuggauuca

SEQ ID NO: 791150 - RNA, 19 nt, Homo sapiens
guaaacaucugugguacau

SEQ ID NO: 791151 - RNA, 19 nt, Homo sapiens
ggagagcucugcgcuguuc

SEQ ID NO: 791152 - RNA, 19 nt, Homo sapiens
ggaugaauaugaacaguac

SEQ ID NO: 791153 - RNA, 19 nt, Homo sapiens
gagaauugauggagaagag

SEQ ID NO: 791154 - RNA, 19 nt, Homo sapiens
ccuaacauaugcugucaaa

SEQ ID NO: 791155 - RNA, 19 nt, Homo sapiens
cauaagcaaugccaagaga

SEQ ID NO: 791156 - RNA, 19 nt, Homo sapiens
gagaagagaggccuggauu

SEQ ID NO: 791157 - RNA, 19 nt, Homo sapiens
uuacagagacugagaaguu

SEQ ID NO: 791158 - RNA, 19 nt, Homo sapiens
gaacaagagaauuacuuug

SEQ ID NO: 791159 - RNA, 19 nt, Homo sapiens
ucaauuagagccauucaaa

SEQ ID NO: 791160 - RNA, 19 nt, Homo sapiens
agagaaugaucaauaguga

SEQ ID NO: 791161 - RNA, 19 nt, Homo sapiens
gaaaugaggaagcuugcaa

SEQ ID NO: 791162 - RNA, 19 nt, Homo sapiens
gaugaaggccugaggauag

SEQ ID NO: 791163 - RNA, 19 nt, Homo sapiens
gaugaugaaagccagaaua

SEQ ID NO: 791164 - RNA, 19 nt, Homo sapiens
caugagaaauggaacacuu

SEQ ID NO: 791165 - RNA, 19 nt, Homo sapiens
gaguacugcuuaaaucuuc

SEQ ID NO: 791166 - RNA, 19 nt, Homo sapiens
ccagagagcaagagaaaug

SEQ ID NO: 791167 - RNA, 19 nt, Homo sapiens
uaucugagcuugaaguuuu

SEQ ID NO: 791168 - RNA, 19 nt, Homo sapiens
gaacuagaaauuuccacaa

SEQ ID NO: 791169 - RNA, 19 nt, Homo sapiens
uuaaggcccuauaagguaa

SEQ ID NO: 791170 - RNA, 19 nt, Homo sapiens
aaaagggacuggauuguaa

SEQ ID NO: 791171 - RNA, 19 nt, Homo sapiens
gaaauuuccacaaagacuu

SEQ ID NO: 791172 - RNA, 19 nt, Homo sapiens
ucgucgagcuauucauuua

SEQ ID NO: 791173 - RNA, 19 nt, Homo sapiens
ucaaacagagugccuuaaa

SEQ ID NO: 791174 - RNA, 19 nt, Homo sapiens
agagaggccuggauucaug

SEQ ID NO: 791175 - RNA, 19 nt, Homo sapiens
ggcaguauaucaagugcaa

SEQ ID NO: 791176 - RNA, 19 nt, Homo sapiens
agagaagaguuaucaggaa

SEQ ID NO: 791177 - RNA, 19 nt, Homo sapiens
acaauuuacuaccuucuga

SEQ ID NO: 791178 - RNA, 19 nt, Homo sapiens
uuagagaauugauggagaa

SEQ ID NO: 791179 - RNA, 19 nt, Homo sapiens
gauguagaguaguguuaga

SEQ ID NO: 791180 - RNA, 19 nt, Homo sapiens
ggacaucgucgagcuauuc

SEQ ID NO: 791181 - RNA, 19 nt, Homo sapiens
cagcuguuccuccaaauuu

SEQ ID NO: 791182 - RNA, 19 nt, Homo sapiens
gauccucccacaucacuaa

SEQ ID NO: 791183 - RNA, 19 nt, Homo sapiens
guauguagaccaagguaaa

SEQ ID NO: 791184 - RNA, 19 nt, Homo sapiens
acaaagacuuccuaauugg

SEQ ID NO: 791185 - RNA, 19 nt, Homo sapiens
ugaagauccucccacauca

SEQ ID NO: 791186 - RNA, 19 nt, Homo sapiens
acagaugucuacagcuuug

SEQ ID NO: 791187 - RNA, 19 nt, Homo sapiens
gaacaucagaguuguacca

SEQ ID NO: 791188 - RNA, 19 nt, Homo sapiens
caacccaaacuaacugauu

SEQ ID NO: 791189 - RNA, 19 nt, Homo sapiens
ggauguucgucauauugaa

SEQ ID NO: 791190 - RNA, 19 nt, Homo sapiens
auaauugucucaugaccaa

SEQ ID NO: 791191 - RNA, 19 nt, Homo sapiens
gaaagccagaauaacaauu

SEQ ID NO: 791192 - RNA, 19 nt, Homo sapiens
aacccaaacuaacugauuu

SEQ ID NO: 791193 - RNA, 19 nt, Homo sapiens
gaagaguuaucaggaaggu

SEQ ID NO: 791194 - RNA, 19 nt, Homo sapiens
ucaugucucucauuucuag

SEQ ID NO: 791195 - RNA, 19 nt, Homo sapiens
gaaguucuaacaggaugua

SEQ ID NO: 791196 - RNA, 19 nt, Homo sapiens
guaauguccucuccaucau

SEQ ID NO: 791197 - RNA, 19 nt, Homo sapiens
gcccaguucuucuugugaa

SEQ ID NO: 791198 - RNA, 19 nt, Homo sapiens
caagagaaaugaggaagcu

SEQ ID NO: 791199 - RNA, 19 nt, Homo sapiens
cuaacaggauguagaguag

SEQ ID NO: 791200 - RNA, 19 nt, Homo sapiens
gucuacagcuuuggaauug

SEQ ID NO: 791201 - RNA, 19 nt, Homo sapiens
caaacagagugccuuaaaa

SEQ ID NO: 791202 - RNA, 19 nt, Homo sapiens
gggaugaauaugaacagua

SEQ ID NO: 791203 - RNA, 19 nt, Homo sapiens
ggagcaguguugaguccuu

SEQ ID NO: 791204 - RNA, 19 nt, Homo sapiens
agaguuggcugcauauuuu

SEQ ID NO: 791205 - RNA, 19 nt, Homo sapiens
uacuagaguuggcugcaua

SEQ ID NO: 791206 - RNA, 19 nt, Homo sapiens
uccaucagcuuucaaaaua

SEQ ID NO: 791207 - RNA, 19 nt, Homo sapiens
gaguuugggugaugcagau

SEQ ID NO: 791208 - RNA, 19 nt, Homo sapiens
gcacauucgaaucgguaua

SEQ ID NO: 791209 - RNA, 19 nt, Homo sapiens
uagaguuggcugcauauuu

SEQ ID NO: 791210 - RNA, 19 nt, Homo sapiens
cugcuuaaaucuuccauca

SEQ ID NO: 791211 - RNA, 19 nt, Homo sapiens
ggaguacugcuuaaaucuu

SEQ ID NO: 791212 - RNA, 19 nt, Homo sapiens
gcuggauguucgucauauu

SEQ ID NO: 791213 - RNA, 19 nt, Homo sapiens
uauaucaagugcaaacauc

SEQ ID NO: 791214 - RNA, 19 nt, Homo sapiens
guaagaagcauuggaagag

SEQ ID NO: 791215 - RNA, 19 nt, Homo sapiens
uaucauagaaggaacuaga

SEQ ID NO: 791216 - RNA, 19 nt, Homo sapiens
gauuccaucguuugguuua

SEQ ID NO: 791217 - RNA, 19 nt, Homo sapiens
gguaugaccuugggaagac

SEQ ID NO: 791218 - RNA, 19 nt, Homo sapiens
uuuacuaccuucugaugaa

SEQ ID NO: 791219 - RNA, 19 nt, Homo sapiens
uggagaauguaccaaguau

SEQ ID NO: 791220 - RNA, 19 nt, Homo sapiens
gauguucgucauauugaaa

SEQ ID NO: 791221 - RNA, 19 nt, Homo sapiens
ggucccaccuagaacauca

SEQ ID NO: 791222 - RNA, 19 nt, Homo sapiens
gaacagagaugaagaugaa

SEQ ID NO: 791223 - RNA, 19 nt, Homo sapiens
gaagaaaccuccacugaaa

SEQ ID NO: 791224 - RNA, 19 nt, Homo sapiens
ggacaaagcugaagaugau

SEQ ID NO: 791225 - RNA, 19 nt, Homo sapiens
gaagacauauggcaaguuu

SEQ ID NO: 791226 - RNA, 19 nt, Homo sapiens
gaaguaagcucugcaaaug

SEQ ID NO: 791227 - RNA, 19 nt, Homo sapiens
gaaagaguguauccaagua

SEQ ID NO: 791228 - RNA, 19 nt, Homo sapiens
caaagaauauugcagugua

SEQ ID NO: 791229 - RNA, 19 nt, Homo sapiens
cgaaacagcuggauucaga

SEQ ID NO: 791230 - RNA, 19 nt, Homo sapiens
ggacaaagcacuucagcua

SEQ ID NO: 791231 - RNA, 19 nt, Homo sapiens
caacagugaucucuuuaaa

SEQ ID NO: 791232 - RNA, 19 nt, Homo sapiens
caacauaaccagucuguaa

SEQ ID NO: 791233 - RNA, 19 nt, Homo sapiens
caaguaagccuguggauaa

SEQ ID NO: 791234 - RNA, 19 nt, Homo sapiens
caccagagcccgagaauua

SEQ ID NO: 791235 - RNA, 19 nt, Homo sapiens
gaaagagguucaagcaguu

SEQ ID NO: 791236 - RNA, 19 nt, Homo sapiens
ucaacagacucacuaaaua

SEQ ID NO: 791237 - RNA, 19 nt, Homo sapiens
gaaaugaaccaccggagua

SEQ ID NO: 791238 - RNA, 19 nt, Homo sapiens
caagacagcugccuucaga

SEQ ID NO: 791239 - RNA, 19 nt, Homo sapiens
gauaauagacagcaaguuu

SEQ ID NO: 791240 - RNA, 19 nt, Homo sapiens
gagaauauaucacacaaca

SEQ ID NO: 791241 - RNA, 19 nt, Homo sapiens
gaaacaaauucaucucaug

SEQ ID NO: 791242 - RNA, 19 nt, Homo sapiens
gaagaguggucagauguuu

SEQ ID NO: 791243 - RNA, 19 nt, Homo sapiens
gcagaacguuuaaagaaga

SEQ ID NO: 791244 - RNA, 19 nt, Homo sapiens
gaccagaagucaacaguga

SEQ ID NO: 791245 - RNA, 19 nt, Homo sapiens
caacaaagaugccuauacu

SEQ ID NO: 791246 - RNA, 19 nt, Homo sapiens
cacaguaccuuccacaaua

SEQ ID NO: 791247 - RNA, 19 nt, Homo sapiens
uaacaaaccugcugagucu

SEQ ID NO: 791248 - RNA, 19 nt, Homo sapiens
gaugugaauucccuugaua

SEQ ID NO: 791249 - RNA, 19 nt, Homo sapiens
gaagaagacuuucauuucg

SEQ ID NO: 791250 - RNA, 19 nt, Homo sapiens
gcaguaauaucagacagua

SEQ ID NO: 791251 - RNA, 19 nt, Homo sapiens
aaacaaaccucaagcagau

SEQ ID NO: 791252 - RNA, 19 nt, Homo sapiens
ugaauucccuugauaagaa

SEQ ID NO: 791253 - RNA, 19 nt, Homo sapiens
gauagcaagucaaucauga

SEQ ID NO: 791254 - RNA, 19 nt, Homo sapiens
gaugauaccucuugauugg

SEQ ID NO: 791255 - RNA, 19 nt, Homo sapiens
gaaagucccugugauuugu

SEQ ID NO: 791256 - RNA, 19 nt, Homo sapiens
gaagaaauauccugguuuu

SEQ ID NO: 791257 - RNA, 19 nt, Homo sapiens
gcauauugcuuguaacuca

SEQ ID NO: 791258 - RNA, 19 nt, Homo sapiens
ggcaagaaguaauauauga

SEQ ID NO: 791259 - RNA, 19 nt, Homo sapiens
gaaaucagcaggcuuugaa

SEQ ID NO: 791260 - RNA, 19 nt, Homo sapiens
caacagacucacuaaauaa

SEQ ID NO: 791261 - RNA, 19 nt, Homo sapiens
gaagagaacuauaauuucc

SEQ ID NO: 791262 - RNA, 19 nt, Homo sapiens
gaacgaaacagcuggauuc

SEQ ID NO: 791263 - RNA, 19 nt, Homo sapiens
guacaucuuugcaucauug

SEQ ID NO: 791264 - RNA, 19 nt, Homo sapiens
aaagaaagauguggucaaa

SEQ ID NO: 791265 - RNA, 19 nt, Homo sapiens
gaagagaaggagaugauuu

SEQ ID NO: 791266 - RNA, 19 nt, Homo sapiens
gcaaacugcucuguccuaa

SEQ ID NO: 791267 - RNA, 19 nt, Homo sapiens
cgugaaagcugaagaugaa

SEQ ID NO: 791268 - RNA, 19 nt, Homo sapiens
gaagagagaauauaucaca

SEQ ID NO: 791269 - RNA, 19 nt, Homo sapiens
ggaacaagauaaggauaaa

SEQ ID NO: 791270 - RNA, 19 nt, Homo sapiens
gagagacauugaugcauuu

SEQ ID NO: 791271 - RNA, 19 nt, Homo sapiens
agagaaggcuugaugugua

SEQ ID NO: 791272 - RNA, 19 nt, Homo sapiens
gaugacagauccagagaug

SEQ ID NO: 791273 - RNA, 19 nt, Homo sapiens
ucagcuacaucaagaauaa

SEQ ID NO: 791274 - RNA, 19 nt, Homo sapiens
gcaaagccuugauggauuc

SEQ ID NO: 791275 - RNA, 19 nt, Homo sapiens
gaaaagaugugaaacuaga

SEQ ID NO: 791276 - RNA, 19 nt, Homo sapiens
gggaugugcuuguaaauca

SEQ ID NO: 791277 - RNA, 19 nt, Homo sapiens
cgagagacauugaugcauu

SEQ ID NO: 791278 - RNA, 19 nt, Homo sapiens
gagcugaucaguauccaua

SEQ ID NO: 791279 - RNA, 19 nt, Homo sapiens
cacaaaggcugccgagaaa

SEQ ID NO: 791280 - RNA, 19 nt, Homo sapiens
gauuucagauggauuagaa

SEQ ID NO: 791281 - RNA, 19 nt, Homo sapiens
caagauuucagauggauua

SEQ ID NO: 791282 - RNA, 19 nt, Homo sapiens
gaacccagaugccacuguu

SEQ ID NO: 791283 - RNA, 19 nt, Homo sapiens
ugaagaugauguaguguuu

SEQ ID NO: 791284 - RNA, 19 nt, Homo sapiens
ugagagaaguggcacauga

SEQ ID NO: 791285 - RNA, 19 nt, Homo sapiens
uggaugagcugaucaguau

SEQ ID NO: 791286 - RNA, 19 nt, Homo sapiens
gaaagauucuaaagacaag

SEQ ID NO: 791287 - RNA, 19 nt, Homo sapiens
acagcaagcucccuuauau

SEQ ID NO: 791288 - RNA, 19 nt, Homo sapiens
gagaaggcuugauguguau

SEQ ID NO: 791289 - RNA, 19 nt, Homo sapiens
ccaaacaggucaagagauc

SEQ ID NO: 791290 - RNA, 19 nt, Homo sapiens
gagacugguuucccucuaa

SEQ ID NO: 791291 - RNA, 19 nt, Homo sapiens
gaugauggccaagaucuua

SEQ ID NO: 791292 - RNA, 19 nt, Homo sapiens
gcagagaccuuuggaggau

SEQ ID NO: 791293 - RNA, 19 nt, Homo sapiens
ucacggcccuuccacagua

SEQ ID NO: 791294 - RNA, 19 nt, Homo sapiens
gacaagauacucaacaauu

SEQ ID NO: 791295 - RNA, 19 nt, Homo sapiens
agagacagauggccaguuu

SEQ ID NO: 791296 - RNA, 19 nt, Homo sapiens
cagcaggcuuugaacuuua

SEQ ID NO: 791297 - RNA, 19 nt, Homo sapiens
ggucaugauuguugugaaa

SEQ ID NO: 791298 - RNA, 19 nt, Homo sapiens
gaaaguaauggccucguaa

SEQ ID NO: 791299 - RNA, 19 nt, Homo sapiens
gcaagucaaucaugaggau

SEQ ID NO: 791300 - RNA, 19 nt, Homo sapiens
agacagaguuucaucaugu

SEQ ID NO: 791301 - RNA, 19 nt, Homo sapiens
gagaugauaccucuugauu

SEQ ID NO: 791302 - RNA, 19 nt, Homo sapiens
gagagaauauaucacacaa

SEQ ID NO: 791303 - RNA, 19 nt, Homo sapiens
caacccagcucacaagauc

SEQ ID NO: 791304 - RNA, 19 nt, Homo sapiens
ggaccugucugcauauaca

SEQ ID NO: 791305 - RNA, 19 nt, Homo sapiens
gagugcauauugcuuguaa

SEQ ID NO: 791306 - RNA, 19 nt, Homo sapiens
gaugagcaguucaguuguu

SEQ ID NO: 791307 - RNA, 19 nt, Homo sapiens
gaucuaagcagcagggauu

SEQ ID NO: 791308 - RNA, 19 nt, Homo sapiens
gaaacaagccauccucauc

SEQ ID NO: 791309 - RNA, 19 nt, Homo sapiens
acacauagcccuagaguuc

SEQ ID NO: 791310 - RNA, 19 nt, Homo sapiens
gaccagaaguacaucuuug

SEQ ID NO: 791311 - RNA, 19 nt, Homo sapiens
acagcaaaguggcaaguua

SEQ ID NO: 791312 - RNA, 19 nt, Homo sapiens
uuacagaaguuucagucua

SEQ ID NO: 791313 - RNA, 19 nt, Homo sapiens
ggcaaagccuugauggauu

SEQ ID NO: 791314 - RNA, 19 nt, Homo sapiens
gcauguauuucucauuuca

SEQ ID NO: 791315 - RNA, 19 nt, Homo sapiens
guaauggccucguaaguac

SEQ ID NO: 791316 - RNA, 19 nt, Homo sapiens
gaugaagaguggucagaug

SEQ ID NO: 791317 - RNA, 19 nt, Homo sapiens
ggucaaacggcaagaagua

SEQ ID NO: 791318 - RNA, 19 nt, Homo sapiens
gcagagaguguaccucaaa

SEQ ID NO: 791319 - RNA, 19 nt, Homo sapiens
ggagaaugcuggagaacca

SEQ ID NO: 791320 - RNA, 19 nt, Homo sapiens
gaagaggccuacucaccau

SEQ ID NO: 791321 - RNA, 19 nt, Homo sapiens
cagaagaaauauccugguu

SEQ ID NO: 791322 - RNA, 19 nt, Homo sapiens
gaacagagaugaagaugaa

SEQ ID NO: 791323 - RNA, 19 nt, Homo sapiens
gaagaaaccuccacugaaa

SEQ ID NO: 791324 - RNA, 19 nt, Homo sapiens
ggacaaagcugaagaugau

SEQ ID NO: 791325 - RNA, 19 nt, Homo sapiens
gaagacauauggcaaguuu

SEQ ID NO: 791326 - RNA, 19 nt, Homo sapiens
gaaguaagcucugcaaaug

SEQ ID NO: 791327 - RNA, 19 nt, Homo sapiens
gaaagaguguauccaagua

SEQ ID NO: 791328 - RNA, 19 nt, Homo sapiens
caaagaauauugcagugua

SEQ ID NO: 791329 - RNA, 19 nt, Homo sapiens
guaaaggucuguuguugaa

SEQ ID NO: 791330 - RNA, 19 nt, Homo sapiens
cgaaacagcuggauucaga

SEQ ID NO: 791331 - RNA, 19 nt, Homo sapiens
ggacaaagcacuucagcua

SEQ ID NO: 791332 - RNA, 19 nt, Homo sapiens
caacagugaucucuuuaaa

SEQ ID NO: 791333 - RNA, 19 nt, Homo sapiens
caacauaaccagucuguaa

SEQ ID NO: 791334 - RNA, 19 nt, Homo sapiens
caaguaagccuguggauaa

SEQ ID NO: 791335 - RNA, 19 nt, Homo sapiens
caccagagcccgagaauua

SEQ ID NO: 791336 - RNA, 19 nt, Homo sapiens
gaaagagguucaagcaguu

SEQ ID NO: 791337 - RNA, 19 nt, Homo sapiens
ucaacagacucacuaaaua

SEQ ID NO: 791338 - RNA, 19 nt, Homo sapiens
caagacagcugccuucaga

SEQ ID NO: 791339 - RNA, 19 nt, Homo sapiens
gauaauagacagcaaguuu

SEQ ID NO: 791340 - RNA, 19 nt, Homo sapiens
gagaauauaucacacaaca

SEQ ID NO: 791341 - RNA, 19 nt, Homo sapiens
gaaacaaauucaucucaug

SEQ ID NO: 791342 - RNA, 19 nt, Homo sapiens
gaagaguggucagauguuu

SEQ ID NO: 791343 - RNA, 19 nt, Homo sapiens
gcagaacguuuaaagaaga

SEQ ID NO: 791344 - RNA, 19 nt, Homo sapiens
gaccagaagucaacaguga

SEQ ID NO: 791345 - RNA, 19 nt, Homo sapiens
caacaaagaugccuauacu

SEQ ID NO: 791346 - RNA, 19 nt, Homo sapiens
cacaguaccuuccacaaua

SEQ ID NO: 791347 - RNA, 19 nt, Homo sapiens
uaacaaaccugcugagucu

SEQ ID NO: 791348 - RNA, 19 nt, Homo sapiens
gaugugaauucccuugaua

SEQ ID NO: 791349 - RNA, 19 nt, Homo sapiens
gaagaagacuuucauuucg

SEQ ID NO: 791350 - RNA, 19 nt, Homo sapiens
gcaguaauaucagacagua

SEQ ID NO: 791351 - RNA, 19 nt, Homo sapiens
aaacaaaccucaagcagau

SEQ ID NO: 791352 - RNA, 19 nt, Homo sapiens
ugaauucccuugauaagaa

SEQ ID NO: 791353 - RNA, 19 nt, Homo sapiens
gauagcaagucaaucauga

SEQ ID NO: 791354 - RNA, 19 nt, Homo sapiens
gaugauaccucuugauugg

SEQ ID NO: 791355 - RNA, 19 nt, Homo sapiens
gaaagucccugugauuugu

SEQ ID NO: 791356 - RNA, 19 nt, Homo sapiens
gaagaaauauccugguuuu

SEQ ID NO: 791357 - RNA, 19 nt, Homo sapiens
gcauauugcuuguaacuca

SEQ ID NO: 791358 - RNA, 19 nt, Homo sapiens
ggcaagaaguaauauauga

SEQ ID NO: 791359 - RNA, 19 nt, Homo sapiens
gaaaucagcaggcuuugaa

SEQ ID NO: 791360 - RNA, 19 nt, Homo sapiens
caacagacucacuaaauaa

SEQ ID NO: 791361 - RNA, 19 nt, Homo sapiens
gaagagaacuauaauuucc

SEQ ID NO: 791362 - RNA, 19 nt, Homo sapiens
gaacgaaacagcuggauuc

SEQ ID NO: 791363 - RNA, 19 nt, Homo sapiens
guacaucuuugcaucauug

SEQ ID NO: 791364 - RNA, 19 nt, Homo sapiens
aaagaaagauguggucaaa

SEQ ID NO: 791365 - RNA, 19 nt, Homo sapiens
gcaggacaguucaugguaa

SEQ ID NO: 791366 - RNA, 19 nt, Homo sapiens
gaagagaaggagaugauuu

SEQ ID NO: 791367 - RNA, 19 nt, Homo sapiens
gaaaugaaccaccggaguu

SEQ ID NO: 791368 - RNA, 19 nt, Homo sapiens
gcaaacugcucuguccuaa

SEQ ID NO: 791369 - RNA, 19 nt, Homo sapiens
cgugaaagcugaagaugaa

SEQ ID NO: 791370 - RNA, 19 nt, Homo sapiens
gaagagagaauauaucaca

SEQ ID NO: 791371 - RNA, 19 nt, Homo sapiens
ggaacaagauaaggauaaa

SEQ ID NO: 791372 - RNA, 19 nt, Homo sapiens
gagagacauugaugcauuu

SEQ ID NO: 791373 - RNA, 19 nt, Homo sapiens
agagaaggcuugaugugua

SEQ ID NO: 791374 - RNA, 19 nt, Homo sapiens
gaugacagauccagagaug

SEQ ID NO: 791375 - RNA, 19 nt, Homo sapiens
ucagcuacaucaagaauaa

SEQ ID NO: 791376 - RNA, 19 nt, Homo sapiens
gcaaagccuugauggauuc

SEQ ID NO: 791377 - RNA, 19 nt, Homo sapiens
gaaaagaugugaaacuaga

SEQ ID NO: 791378 - RNA, 19 nt, Homo sapiens
gggaugugcuuguaaauca

SEQ ID NO: 791379 - RNA, 19 nt, Homo sapiens
cgagagacauugaugcauu

SEQ ID NO: 791380 - RNA, 19 nt, Homo sapiens
gagcugaucaguauccaua

SEQ ID NO: 791381 - RNA, 19 nt, Homo sapiens
cacaaaggcugccgagaaa

SEQ ID NO: 791382 - RNA, 19 nt, Homo sapiens
gauuucagauggauuagaa

SEQ ID NO: 791383 - RNA, 19 nt, Homo sapiens
caagauuucagauggauua

SEQ ID NO: 791384 - RNA, 19 nt, Homo sapiens
gaacccagaugccacuguu

SEQ ID NO: 791385 - RNA, 19 nt, Homo sapiens
ugaagaugauguaguguuu

SEQ ID NO: 791386 - RNA, 19 nt, Homo sapiens
ugagagaaguggcacauga

SEQ ID NO: 791387 - RNA, 19 nt, Homo sapiens
uggaugagcugaucaguau

SEQ ID NO: 791388 - RNA, 19 nt, Homo sapiens
gaaagauucuaaagacaag

SEQ ID NO: 791389 - RNA, 19 nt, Homo sapiens
acagcaagcucccuuauau

SEQ ID NO: 791390 - RNA, 19 nt, Homo sapiens
gagaaggcuugauguguau

SEQ ID NO: 791391 - RNA, 19 nt, Homo sapiens
ccaaacaggucaagagauc

SEQ ID NO: 791392 - RNA, 19 nt, Homo sapiens
gagacugguuucccucuaa

SEQ ID NO: 791393 - RNA, 19 nt, Homo sapiens
gaugauggccaagaucuua

SEQ ID NO: 791394 - RNA, 19 nt, Homo sapiens
gcagagaccuuuggaggau

SEQ ID NO: 791395 - RNA, 19 nt, Homo sapiens
ucacggcccuuccacagua

SEQ ID NO: 791396 - RNA, 19 nt, Homo sapiens
gacaagauacucaacaauu

SEQ ID NO: 791397 - RNA, 19 nt, Homo sapiens
agagacagauggccaguuu

SEQ ID NO: 791398 - RNA, 19 nt, Homo sapiens
cagcaggcuuugaacuuua

SEQ ID NO: 791399 - RNA, 19 nt, Homo sapiens
ggucaugauuguugugaaa

SEQ ID NO: 791400 - RNA, 19 nt, Homo sapiens
gaaagcgcccuucuuaugu

SEQ ID NO: 791401 - RNA, 19 nt, Homo sapiens
gaaaguaauggccucguaa

SEQ ID NO: 791402 - RNA, 19 nt, Homo sapiens
gcaagucaaucaugaggau

SEQ ID NO: 791403 - RNA, 19 nt, Homo sapiens
agacagaguuucaucaugu

SEQ ID NO: 791404 - RNA, 19 nt, Homo sapiens
gagaugauaccucuugauu

SEQ ID NO: 791405 - RNA, 19 nt, Homo sapiens
gagagaauauaucacacaa

SEQ ID NO: 791406 - RNA, 19 nt, Homo sapiens
caacccagcucacaagauc

SEQ ID NO: 791407 - RNA, 19 nt, Homo sapiens
ggaccugucugcauauaca

SEQ ID NO: 791408 - RNA, 19 nt, Homo sapiens
gagugcauauugcuuguaa

SEQ ID NO: 791409 - RNA, 19 nt, Homo sapiens
gaugagcaguucaguuguu

SEQ ID NO: 791410 - RNA, 19 nt, Homo sapiens
gaucuaagcagcagggauu

SEQ ID NO: 791411 - RNA, 19 nt, Homo sapiens
gaaacaagccauccucauc

SEQ ID NO: 791412 - RNA, 19 nt, Homo sapiens
acacauagcccuagaguuc

SEQ ID NO: 791413 - RNA, 19 nt, Homo sapiens
gaccagaaguacaucuuug

SEQ ID NO: 791414 - RNA, 19 nt, Homo sapiens
acagcaaaguggcaaguua

SEQ ID NO: 791415 - RNA, 19 nt, Homo sapiens
ggcaaagccuugauggauu

SEQ ID NO: 791416 - RNA, 19 nt, Homo sapiens
gaagccauguguagcaguu

SEQ ID NO: 791417 - RNA, 19 nt, Homo sapiens
gcauguauuucucauuuca

SEQ ID NO: 791418 - RNA, 19 nt, Homo sapiens
guaauggccucguaaguac

SEQ ID NO: 791419 - RNA, 19 nt, Homo sapiens
gaugaagaguggucagaug

SEQ ID NO: 791420 - RNA, 19 nt, Homo sapiens
ggucaaacggcaagaagua

SEQ ID NO: 791421 - RNA, 19 nt, Homo sapiens
gcagagaguguaccucaaa

SEQ ID NO: 791422 - RNA, 19 nt, Homo sapiens
gaacagagaugaagaugaa

SEQ ID NO: 791423 - RNA, 19 nt, Homo sapiens
gaagacauauggcaaguuu

SEQ ID NO: 791424 - RNA, 19 nt, Homo sapiens
gaaagaguguauccaagua

SEQ ID NO: 791425 - RNA, 19 nt, Homo sapiens
caaagaauauugcagugua

SEQ ID NO: 791426 - RNA, 19 nt, Homo sapiens
cgaaacagcuggauucaga

SEQ ID NO: 791427 - RNA, 19 nt, Homo sapiens
caacagugaucucuuuaaa

SEQ ID NO: 791428 - RNA, 19 nt, Homo sapiens
caacauaaccagucuguaa

SEQ ID NO: 791429 - RNA, 19 nt, Homo sapiens
caccagagcccgagaauua

SEQ ID NO: 791430 - RNA, 19 nt, Homo sapiens
gaaagagguucaagcaguu

SEQ ID NO: 791431 - RNA, 19 nt, Homo sapiens
ucaacagacucacuaaaua

SEQ ID NO: 791432 - RNA, 19 nt, Homo sapiens
gauaauagacagcaaguuu

SEQ ID NO: 791433 - RNA, 19 nt, Homo sapiens
gaagaguggucagauguuu

SEQ ID NO: 791434 - RNA, 19 nt, Homo sapiens
gcagaacguuuaaagaaga

SEQ ID NO: 791435 - RNA, 19 nt, Homo sapiens
gaccagaagucaacaguga

SEQ ID NO: 791436 - RNA, 19 nt, Homo sapiens
caacaaagaugccuauacu

SEQ ID NO: 791437 - RNA, 19 nt, Homo sapiens
cacaguaccuuccacaaua

SEQ ID NO: 791438 - RNA, 19 nt, Homo sapiens
gaggaggaguugcauaauu

SEQ ID NO: 791439 - RNA, 19 nt, Homo sapiens
gauagcaagucaaucauga

SEQ ID NO: 791440 - RNA, 19 nt, Homo sapiens
gaagaaauauccugguuuu

SEQ ID NO: 791441 - RNA, 19 nt, Homo sapiens
gcauauugcuuguaacuca

SEQ ID NO: 791442 - RNA, 19 nt, Homo sapiens
ggcaagaaguaauauauga

SEQ ID NO: 791443 - RNA, 19 nt, Homo sapiens
caacagacucacuaaauaa

SEQ ID NO: 791444 - RNA, 19 nt, Homo sapiens
gaagagaacuauaauuucc

SEQ ID NO: 791445 - RNA, 19 nt, Homo sapiens
gaacgaaacagcuggauuc

SEQ ID NO: 791446 - RNA, 19 nt, Homo sapiens
guacaucuuugcaucauug

SEQ ID NO: 791447 - RNA, 19 nt, Homo sapiens
aaagaaagauguggucaaa

SEQ ID NO: 791448 - RNA, 19 nt, Homo sapiens
gaagagaaggagaugauuu

SEQ ID NO: 791449 - RNA, 19 nt, Homo sapiens
agagaaggcuugaugugua

SEQ ID NO: 791450 - RNA, 19 nt, Homo sapiens
gaugacagauccagagaug

SEQ ID NO: 791451 - RNA, 19 nt, Homo sapiens
ucagcuacaucaagaauaa

SEQ ID NO: 791452 - RNA, 19 nt, Homo sapiens
gaagagggcuacucaccau

SEQ ID NO: 791453 - RNA, 19 nt, Homo sapiens
gggaugugcuuguaaauca

SEQ ID NO: 791454 - RNA, 19 nt, Homo sapiens
gagcugaucaguauccaua

SEQ ID NO: 791455 - RNA, 19 nt, Homo sapiens
cacaaaggcugccgagaaa

SEQ ID NO: 791456 - RNA, 19 nt, Homo sapiens
ugagagaaguggcacauga

SEQ ID NO: 791457 - RNA, 19 nt, Homo sapiens
uggaugagcugaucaguau

SEQ ID NO: 791458 - RNA, 19 nt, Homo sapiens
gaaagauucuaaagacaag

SEQ ID NO: 791459 - RNA, 19 nt, Homo sapiens
gagaaggcuugauguguau

SEQ ID NO: 791460 - RNA, 19 nt, Homo sapiens
gagacugguuucccucuaa

SEQ ID NO: 791461 - RNA, 19 nt, Homo sapiens
gaugauggccaagaucuua

SEQ ID NO: 791462 - RNA, 19 nt, Homo sapiens
gcagagaccuuuggaggau

SEQ ID NO: 791463 - RNA, 19 nt, Homo sapiens
ucacggcccuuccacagua

SEQ ID NO: 791464 - RNA, 19 nt, Homo sapiens
gaaaguaauggccucguaa

SEQ ID NO: 791465 - RNA, 19 nt, Homo sapiens
gcaagucaaucaugaggau

SEQ ID NO: 791466 - RNA, 19 nt, Homo sapiens
agacagaguuucaucaugu

SEQ ID NO: 791467 - RNA, 19 nt, Homo sapiens
ggaccugucugcauauaca

SEQ ID NO: 791468 - RNA, 19 nt, Homo sapiens
gagugcauauugcuuguaa

SEQ ID NO: 791469 - RNA, 19 nt, Homo sapiens
gaugagcaguucaguuguu

SEQ ID NO: 791470 - RNA, 19 nt, Homo sapiens
acacauagcccuagaguuc

SEQ ID NO: 791471 - RNA, 19 nt, Homo sapiens
gaccagaaguacaucuuug

SEQ ID NO: 791472 - RNA, 19 nt, Homo sapiens
acagcaaaguggcaaguua

SEQ ID NO: 791473 - RNA, 19 nt, Homo sapiens
ucucuuggcucuucuuauu

SEQ ID NO: 791474 - RNA, 19 nt, Homo sapiens
gcauguauuucucauuuca

SEQ ID NO: 791475 - RNA, 19 nt, Homo sapiens
guaauggccucguaaguac

SEQ ID NO: 791476 - RNA, 19 nt, Homo sapiens
gaugaagaguggucagaug

SEQ ID NO: 791477 - RNA, 19 nt, Homo sapiens
ggucaaacggcaagaagua

SEQ ID NO: 791478 - RNA, 19 nt, Homo sapiens
cagaagaaauauccugguu

SEQ ID NO: 791479 - RNA, 19 nt, Homo sapiens
ugaaaguaauggccucgua

SEQ ID NO: 791480 - RNA, 19 nt, Homo sapiens
aggaggaccuuuaaugaaa

SEQ ID NO: 791481 - RNA, 19 nt, Homo sapiens
aagaacaacuucaccagaa

SEQ ID NO: 791482 - RNA, 19 nt, Homo sapiens
agaugaagaugaaggaauu

SEQ ID NO: 791483 - RNA, 19 nt, Homo sapiens
gaucaugagugguguguac

SEQ ID NO: 791484 - RNA, 19 nt, Homo sapiens
gggaguagguacagacaug

SEQ ID NO: 791485 - RNA, 19 nt, Homo sapiens
ccacaaaggcugccgagaa

SEQ ID NO: 791486 - RNA, 19 nt, Homo sapiens
caacagaaucacuuacuga

SEQ ID NO: 791487 - RNA, 19 nt, Homo sapiens
gaugagaacaugucaaaca

SEQ ID NO: 791488 - RNA, 19 nt, Homo sapiens
gaaaugcuaaccugguauu

SEQ ID NO: 791489 - RNA, 19 nt, Homo sapiens
gaagaagcuuguacgugau

SEQ ID NO: 791490 - RNA, 19 nt, Homo sapiens
gcaguucaguuguuagaag

SEQ ID NO: 791491 - RNA, 19 nt, Homo sapiens
ccacauaccaagcugauga

SEQ ID NO: 791492 - RNA, 19 nt, Homo sapiens
aaagacagauagcaaguca

SEQ ID NO: 791493 - RNA, 19 nt, Homo sapiens
gaaggagucucugguggau

SEQ ID NO: 791494 - RNA, 19 nt, Homo sapiens
caaacggcaagaaguaaua

SEQ ID NO: 791495 - RNA, 19 nt, Homo sapiens
acaaagaugccuauacuug

SEQ ID NO: 791496 - RNA, 19 nt, Homo sapiens
gacuugaucuguguacgua

SEQ ID NO: 791497 - RNA, 19 nt, Homo sapiens
gacaauaagcaacagauga

SEQ ID NO: 791498 - RNA, 19 nt, Homo sapiens
uuaaagaagcugauuguga

SEQ ID NO: 791499 - RNA, 19 nt, Homo sapiens
gggaguguguuucugaaga

SEQ ID NO: 791500 - RNA, 19 nt, Homo sapiens
uaaccagucuguaaacuac

SEQ ID NO: 791501 - RNA, 19 nt, Homo sapiens
uauaauuuccugccacaua

SEQ ID NO: 791502 - RNA, 19 nt, Homo sapiens
gaagaugagcaguucaguu

SEQ ID NO: 791503 - RNA, 19 nt, Homo sapiens
ggagaaagauaagaagacu

SEQ ID NO: 791504 - RNA, 19 nt, Homo sapiens
uaacaaagccaaaggaaaa

SEQ ID NO: 791505 - RNA, 19 nt, Homo sapiens
gaaggaagagggagaugau

SEQ ID NO: 791506 - RNA, 19 nt, Homo sapiens
agucaacagugaucucuuu

SEQ ID NO: 791507 - RNA, 19 nt, Homo sapiens
caaaguggcaaguuaugaa

SEQ ID NO: 791508 - RNA, 19 nt, Homo sapiens
ugagaaugcagaacguuua

SEQ ID NO: 791509 - RNA, 19 nt, Homo sapiens
gucaucagauccagaagaa

SEQ ID NO: 791510 - RNA, 19 nt, Homo sapiens
uggaaaugcuaaccuggua

SEQ ID NO: 791511 - RNA, 19 nt, Homo sapiens
ucaacacccugaacagaga

SEQ ID NO: 791512 - RNA, 19 nt, Homo sapiens
agaagaagaugagcaguuc

SEQ ID NO: 791513 - RNA, 19 nt, Homo sapiens
gagaaugcagaacguuuaa

SEQ ID NO: 791514 - RNA, 19 nt, Homo sapiens
agacaugaaugaaggacaa

SEQ ID NO: 791515 - RNA, 19 nt, Homo sapiens
aaagaugccuauacuugug

SEQ ID NO: 791516 - RNA, 19 nt, Homo sapiens
gggcauggauaaagugaag

SEQ ID NO: 791517 - RNA, 19 nt, Homo sapiens
ggaaggaggcccagacucu

SEQ ID NO: 791518 - RNA, 19 nt, Homo sapiens
aaccugguauuuaugcuua

SEQ ID NO: 791519 - RNA, 19 nt, Homo sapiens
gcaaaguggcaaguuauga

SEQ ID NO: 791520 - RNA, 19 nt, Homo sapiens
aggagucucugguggauaa

SEQ ID NO: 791521 - RNA, 19 nt, Homo sapiens
gaaaagcuguuccccuguu

SEQ ID NO: 791522 - RNA, 19 nt, Homo sapiens
uaacaaagaucccgucaua

SEQ ID NO: 791523 - RNA, 19 nt, Homo sapiens
ggaaagacacugcuaauua

SEQ ID NO: 791524 - RNA, 19 nt, Homo sapiens
gcaaacaaaugguaucuaa

SEQ ID NO: 791525 - RNA, 19 nt, Homo sapiens
caaauuggcuugacauauu

SEQ ID NO: 791526 - RNA, 19 nt, Homo sapiens
gcaagucgcuguuugauug

SEQ ID NO: 791527 - RNA, 19 nt, Homo sapiens
gauaaugagugucacguua

SEQ ID NO: 791528 - RNA, 19 nt, Homo sapiens
gcacaaacauggaaaguca

SEQ ID NO: 791529 - RNA, 19 nt, Homo sapiens
uuaaagaacuccacaauug

SEQ ID NO: 791530 - RNA, 19 nt, Homo sapiens
ggagaauacuuugcauuua

SEQ ID NO: 791531 - RNA, 19 nt, Homo sapiens
ggaagauagugguuuauuu

SEQ ID NO: 791532 - RNA, 19 nt, Homo sapiens
gaaagacacugcuaauuac

SEQ ID NO: 791533 - RNA, 19 nt, Homo sapiens
gaaggaaucugcuaaggau

SEQ ID NO: 791534 - RNA, 19 nt, Homo sapiens
gaagagaaguuggauauag

SEQ ID NO: 791535 - RNA, 19 nt, Homo sapiens
guaauccacuuucuuguuu

SEQ ID NO: 791536 - RNA, 19 nt, Homo sapiens
gaacauguauuugaaggaa

SEQ ID NO: 791537 - RNA, 19 nt, Homo sapiens
cagcaagccuuaauauaaa

SEQ ID NO: 791538 - RNA, 19 nt, Homo sapiens
gaugugaccuuuacaacaa

SEQ ID NO: 791539 - RNA, 19 nt, Homo sapiens
ugagggcacuuacacauua

SEQ ID NO: 791540 - RNA, 19 nt, Homo sapiens
gaaaugaggucucccaacu

SEQ ID NO: 791541 - RNA, 19 nt, Homo sapiens
aaggaaagcuugccuguuu

SEQ ID NO: 791542 - RNA, 19 nt, Homo sapiens
gaugaaagaugauauagag

SEQ ID NO: 791543 - RNA, 19 nt, Homo sapiens
ggaugagcaugccaauuua

SEQ ID NO: 791544 - RNA, 19 nt, Homo sapiens
gcacuuaccuguguagaug

SEQ ID NO: 791545 - RNA, 19 nt, Homo sapiens
gagugaagcuuuaucaaau

SEQ ID NO: 791546 - RNA, 19 nt, Homo sapiens
gacagaugcugcucauaua

SEQ ID NO: 791547 - RNA, 19 nt, Homo sapiens
caaaugauccugcaauuau

SEQ ID NO: 791548 - RNA, 19 nt, Homo sapiens
gagcuucagugagaauuua

SEQ ID NO: 791549 - RNA, 19 nt, Homo sapiens
gaacaaacuuuagagacuu

SEQ ID NO: 791550 - RNA, 19 nt, Homo sapiens
gaaaaguugucaccucuua

SEQ ID NO: 791551 - RNA, 19 nt, Homo sapiens
ggagaagaaucacaguuga

SEQ ID NO: 791552 - RNA, 19 nt, Homo sapiens
gcagugagauugaauaggu

SEQ ID NO: 791553 - RNA, 19 nt, Homo sapiens
gauaagagcaaaucaguga

SEQ ID NO: 791554 - RNA, 19 nt, Homo sapiens
ggagauaggauucaugaaa

SEQ ID NO: 791555 - RNA, 19 nt, Homo sapiens
cuauaaagauugugcagua

SEQ ID NO: 791556 - RNA, 19 nt, Homo sapiens
gagguuacaucguagguuu

SEQ ID NO: 791557 - RNA, 19 nt, Homo sapiens
gcaaguaaauauagcuuuc

SEQ ID NO: 791558 - RNA, 19 nt, Homo sapiens
ggaagaagguucaguuugc

SEQ ID NO: 791559 - RNA, 19 nt, Homo sapiens
ccacuuagccaucaaauug

SEQ ID NO: 791560 - RNA, 19 nt, Homo sapiens
ggauuuagcugcaguuucu

SEQ ID NO: 791561 - RNA, 19 nt, Homo sapiens
gaccaguuauuagguauua

SEQ ID NO: 791562 - RNA, 19 nt, Homo sapiens
gauaguugcugaagccauu

SEQ ID NO: 791563 - RNA, 19 nt, Homo sapiens
acaaggaacuguuaauguu

SEQ ID NO: 791564 - RNA, 19 nt, Homo sapiens
gugcucaguuacuauauua

SEQ ID NO: 791565 - RNA, 19 nt, Homo sapiens
ucacauacuuucucaucua

SEQ ID NO: 791566 - RNA, 19 nt, Homo sapiens
aaaggagucucuucaugua

SEQ ID NO: 791567 - RNA, 19 nt, Homo sapiens
gaaaggagucucuucaugu

SEQ ID NO: 791568 - RNA, 19 nt, Homo sapiens
caaaggaguuucuauaggu

SEQ ID NO: 791569 - RNA, 19 nt, Homo sapiens
gauauuagauggcugacau

SEQ ID NO: 791570 - RNA, 19 nt, Homo sapiens
gaaaagaagugugaguuaa

SEQ ID NO: 791571 - RNA, 19 nt, Homo sapiens
gguauuagcauguguggua

SEQ ID NO: 791572 - RNA, 19 nt, Homo sapiens
uaacugaggucacauuucu

SEQ ID NO: 791573 - RNA, 19 nt, Homo sapiens
caacagaguccagauuuaa

SEQ ID NO: 791574 - RNA, 19 nt, Homo sapiens
ucaacagaguccagauuua

SEQ ID NO: 791575 - RNA, 19 nt, Homo sapiens
ggaugacacucuagagcua

SEQ ID NO: 791576 - RNA, 19 nt, Homo sapiens
cagcagaagucauuacaga

SEQ ID NO: 791577 - RNA, 19 nt, Homo sapiens
gaagauaaacagaaaguca

SEQ ID NO: 791578 - RNA, 19 nt, Homo sapiens
uggauuaacucuucauuga

SEQ ID NO: 791579 - RNA, 19 nt, Homo sapiens
gaacuucacacuuacauca

SEQ ID NO: 791580 - RNA, 19 nt, Homo sapiens
cauaaugacagaccaguua

SEQ ID NO: 791581 - RNA, 19 nt, Homo sapiens
cuaccgaucuguuaaauca

SEQ ID NO: 791582 - RNA, 19 nt, Homo sapiens
guuagugucucuacggaua

SEQ ID NO: 791583 - RNA, 19 nt, Homo sapiens
ggaauuguauaaccagaau

SEQ ID NO: 791584 - RNA, 19 nt, Homo sapiens
gaacaagccaauaaagaug

SEQ ID NO: 791585 - RNA, 19 nt, Homo sapiens
agaauuagccaaagaguuu

SEQ ID NO: 791586 - RNA, 19 nt, Homo sapiens
guacuaggcucaguucuuc

SEQ ID NO: 791587 - RNA, 19 nt, Homo sapiens
acaaucacaugaagacuaa

SEQ ID NO: 791588 - RNA, 19 nt, Homo sapiens
gagaaaugcaggaauugua

SEQ ID NO: 791589 - RNA, 19 nt, Homo sapiens
acagcaagccuuaauauaa

SEQ ID NO: 791590 - RNA, 19 nt, Homo sapiens
aaaggacccuggauccaua

SEQ ID NO: 791591 - RNA, 19 nt, Homo sapiens
gaaagaugauauagaggau

SEQ ID NO: 791592 - RNA, 19 nt, Homo sapiens
gaacauuacugugcuaagg

SEQ ID NO: 791593 - RNA, 19 nt, Homo sapiens
guaaauaugcuacugguau

SEQ ID NO: 791594 - RNA, 19 nt, Homo sapiens
ccacuuacccuucagauau

SEQ ID NO: 791595 - RNA, 19 nt, Homo sapiens
gcuagaaacugcacugaag

SEQ ID NO: 791596 - RNA, 19 nt, Homo sapiens
ggaacaagccaauaaagau

SEQ ID NO: 791597 - RNA, 19 nt, Homo sapiens
cagaugaaccucaguauug

SEQ ID NO: 791598 - RNA, 19 nt, Homo sapiens
ugaagaagauaaugagugu

SEQ ID NO: 791599 - RNA, 19 nt, Homo sapiens
cauguuugcugaccgguua

SEQ ID NO: 791600 - RNA, 19 nt, Homo sapiens
ggccaaggcucaucuguca

SEQ ID NO: 791601 - RNA, 19 nt, Homo sapiens
agauguggauacagaauua

SEQ ID NO: 791602 - RNA, 19 nt, Homo sapiens
gggagaauacuuugcauuu

SEQ ID NO: 791603 - RNA, 19 nt, Homo sapiens
ccuaaaguuucuucaagua

SEQ ID NO: 791604 - RNA, 19 nt, Homo sapiens
gaggauagguuccagugau

SEQ ID NO: 791605 - RNA, 19 nt, Homo sapiens
gauagugguuuauuuaguc

SEQ ID NO: 791606 - RNA, 19 nt, Homo sapiens
ggauucagacucagaagua

SEQ ID NO: 791607 - RNA, 19 nt, Homo sapiens
gcacauaaugcagaguuua

SEQ ID NO: 791608 - RNA, 19 nt, Homo sapiens
caacuaaugacgauauuga

SEQ ID NO: 791609 - RNA, 19 nt, Homo sapiens
guagugaaguuguaugcaa

SEQ ID NO: 791610 - RNA, 19 nt, Homo sapiens
uuagagacuugccuguuua

SEQ ID NO: 791611 - RNA, 19 nt, Homo sapiens
gaaaugcaggaauuguaua

SEQ ID NO: 791612 - RNA, 19 nt, Homo sapiens
guggagaaaugcaggaauu

SEQ ID NO: 791613 - RNA, 19 nt, Homo sapiens
uaaagauugugcaguaaga

SEQ ID NO: 791614 - RNA, 19 nt, Homo sapiens
gaaacccacuguuaaaauu

SEQ ID NO: 791615 - RNA, 19 nt, Homo sapiens
gugaaagugugacagauga

SEQ ID NO: 791616 - RNA, 19 nt, Homo sapiens
guggauccguuuauucuuu

SEQ ID NO: 791617 - RNA, 19 nt, Homo sapiens
aaagaagaguucauguuga

SEQ ID NO: 791618 - RNA, 19 nt, Homo sapiens
aauuagagcuucagugaga

SEQ ID NO: 791619 - RNA, 19 nt, Homo sapiens
ccacccagauaaacuauau

SEQ ID NO: 791620 - RNA, 19 nt, Homo sapiens
ggcauugucugaccacauu

SEQ ID NO: 791621 - RNA, 19 nt, Homo sapiens
agaaaagucucccaaauuu

SEQ ID NO: 791622 - RNA, 19 nt, Homo sapiens
uaacaaagaucccgucaua

SEQ ID NO: 791623 - RNA, 19 nt, Homo sapiens
gcacaaacauggaaaguca

SEQ ID NO: 791624 - RNA, 19 nt, Homo sapiens
ggauuaaccuggaaauauu

SEQ ID NO: 791625 - RNA, 19 nt, Homo sapiens
gagcaaaccuggcuugaug

SEQ ID NO: 791626 - RNA, 19 nt, Homo sapiens
ggaagauagugguuuauuu

SEQ ID NO: 791627 - RNA, 19 nt, Homo sapiens
gaaggaaucugcuaaggau

SEQ ID NO: 791628 - RNA, 19 nt, Homo sapiens
gaagagaaguuggauauag

SEQ ID NO: 791629 - RNA, 19 nt, Homo sapiens
gaccaaaguuguaauguga

SEQ ID NO: 791630 - RNA, 19 nt, Homo sapiens
gaacaacucugugcugaau

SEQ ID NO: 791631 - RNA, 19 nt, Homo sapiens
ucagagaccucacuugaaa

SEQ ID NO: 791632 - RNA, 19 nt, Homo sapiens
gaugugaccuuuacaacaa

SEQ ID NO: 791633 - RNA, 19 nt, Homo sapiens
aaggaaagcuugccuguuu

SEQ ID NO: 791634 - RNA, 19 nt, Homo sapiens
gaugaaagaugauauagag

SEQ ID NO: 791635 - RNA, 19 nt, Homo sapiens
ggaugagcaugccaauuua

SEQ ID NO: 791636 - RNA, 19 nt, Homo sapiens
gcacuuaccuguguagaug

SEQ ID NO: 791637 - RNA, 19 nt, Homo sapiens
gagugaagcuuuaucaaau

SEQ ID NO: 791638 - RNA, 19 nt, Homo sapiens
gacagaugcugcucauaua

SEQ ID NO: 791639 - RNA, 19 nt, Homo sapiens
caaaugauccugcaauuau

SEQ ID NO: 791640 - RNA, 19 nt, Homo sapiens
gaacaaacuuuagagacuu

SEQ ID NO: 791641 - RNA, 19 nt, Homo sapiens
ggagaagaaucacaguuga

SEQ ID NO: 791642 - RNA, 19 nt, Homo sapiens
gauaagagcaaaucaguga

SEQ ID NO: 791643 - RNA, 19 nt, Homo sapiens
ggagauaggauucaugaaa

SEQ ID NO: 791644 - RNA, 19 nt, Homo sapiens
gcagugagauugaauaggu

SEQ ID NO: 791645 - RNA, 19 nt, Homo sapiens
cuccagagaugaagauuua

SEQ ID NO: 791646 - RNA, 19 nt, Homo sapiens
ggaagaagguucaguuugc

SEQ ID NO: 791647 - RNA, 19 nt, Homo sapiens
ccacuuagccaucaaauug

SEQ ID NO: 791648 - RNA, 19 nt, Homo sapiens
ggauuuagcugcaguuucu

SEQ ID NO: 791649 - RNA, 19 nt, Homo sapiens
acaaggaacuguuaauguu

SEQ ID NO: 791650 - RNA, 19 nt, Homo sapiens
gaaucugcaugcuugauaa

SEQ ID NO: 791651 - RNA, 19 nt, Homo sapiens
ggaaugagguagcauaagg

SEQ ID NO: 791652 - RNA, 19 nt, Homo sapiens
ucacauacuuucucaucua

SEQ ID NO: 791653 - RNA, 19 nt, Homo sapiens
aaaggagucucuucaugua

SEQ ID NO: 791654 - RNA, 19 nt, Homo sapiens
gaaaggagucucuucaugu

SEQ ID NO: 791655 - RNA, 19 nt, Homo sapiens
caaaggaguuucuauaggu

SEQ ID NO: 791656 - RNA, 19 nt, Homo sapiens
gcagugagcugagauugug

SEQ ID NO: 791657 - RNA, 19 nt, Homo sapiens
gauaaagacuucggcgauu

SEQ ID NO: 791658 - RNA, 19 nt, Homo sapiens
uaacugaggucacauuucu

SEQ ID NO: 791659 - RNA, 19 nt, Homo sapiens
ggagucgucuuaccgguuu

SEQ ID NO: 791660 - RNA, 19 nt, Homo sapiens
cagcagaagucauuacaga

SEQ ID NO: 791661 - RNA, 19 nt, Homo sapiens
gaagauaaacagaaaguca

SEQ ID NO: 791662 - RNA, 19 nt, Homo sapiens
uggauuaacucuucauuga

SEQ ID NO: 791663 - RNA, 19 nt, Homo sapiens
cuaccgaucuguuaaauca

SEQ ID NO: 791664 - RNA, 19 nt, Homo sapiens
guuagugucucuacggaua

SEQ ID NO: 791665 - RNA, 19 nt, Homo sapiens
gaagauuuaugaagucagu

SEQ ID NO: 791666 - RNA, 19 nt, Homo sapiens
gaaaggaccuguggaccau

SEQ ID NO: 791667 - RNA, 19 nt, Homo sapiens
agaauuagccaaagaguuu

SEQ ID NO: 791668 - RNA, 19 nt, Homo sapiens
guacuaggcucaguucuuc

SEQ ID NO: 791669 - RNA, 19 nt, Homo sapiens
acaaucacaugaagacuaa

SEQ ID NO: 791670 - RNA, 19 nt, Homo sapiens
gguaggagauaaagacuuc

SEQ ID NO: 791671 - RNA, 19 nt, Homo sapiens
gaaagaugauauagaggau

SEQ ID NO: 791672 - RNA, 19 nt, Homo sapiens
gaacauuacugugcuaagg

SEQ ID NO: 791673 - RNA, 19 nt, Homo sapiens
guaaauaugcuacugguau

SEQ ID NO: 791674 - RNA, 19 nt, Homo sapiens
cauguuugcugaccgguua

SEQ ID NO: 791675 - RNA, 19 nt, Homo sapiens
ggccaaggcucaucuguca

SEQ ID NO: 791676 - RNA, 19 nt, Homo sapiens
gauagugguuuauuuaguc

SEQ ID NO: 791677 - RNA, 19 nt, Homo sapiens
ggauucagacucagaagua

SEQ ID NO: 791678 - RNA, 19 nt, Homo sapiens
gaaggcaacucuuggaaaa

SEQ ID NO: 791679 - RNA, 19 nt, Homo sapiens
caacuaaugacgauauuga

SEQ ID NO: 791680 - RNA, 19 nt, Homo sapiens
guagugaaguuguaugcaa

SEQ ID NO: 791681 - RNA, 19 nt, Homo sapiens
uuagagacuugccuguuua

SEQ ID NO: 791682 - RNA, 19 nt, Homo sapiens
acacaggcuucuaugauuu

SEQ ID NO: 791683 - RNA, 19 nt, Homo sapiens
gugaaagugugacagauga

SEQ ID NO: 791684 - RNA, 19 nt, Homo sapiens
guggauccguuuauucuuu

SEQ ID NO: 791685 - RNA, 19 nt, Homo sapiens
aaagaagaguucauguuga

SEQ ID NO: 791686 - RNA, 19 nt, Homo sapiens
agaaaagucucccaaauuu

SEQ ID NO: 791687 - RNA, 19 nt, Homo sapiens
guuguaaugugacuuaaug

SEQ ID NO: 791688 - RNA, 19 nt, Homo sapiens
gaaacacaggcuucuauga

SEQ ID NO: 791689 - RNA, 19 nt, Homo sapiens
gguuacuggucaucauuua

SEQ ID NO: 791690 - RNA, 19 nt, Homo sapiens
ggaaugcuuugugucauga

SEQ ID NO: 791691 - RNA, 19 nt, Homo sapiens
caaaucaagcugagguuaa

SEQ ID NO: 791692 - RNA, 19 nt, Homo sapiens
gcuuaaaugugcaaaguca

SEQ ID NO: 791693 - RNA, 19 nt, Homo sapiens
uuaacucacugcucacuuu

SEQ ID NO: 791694 - RNA, 19 nt, Homo sapiens
ccaaaugauccugcaauua

SEQ ID NO: 791695 - RNA, 19 nt, Homo sapiens
cagcuugucucagaaauau

SEQ ID NO: 791696 - RNA, 19 nt, Homo sapiens
aagcagauauucacaaaca

SEQ ID NO: 791697 - RNA, 19 nt, Homo sapiens
agaagcagauauucacaaa

SEQ ID NO: 791698 - RNA, 19 nt, Homo sapiens
gaaagccaacuccucguaa

SEQ ID NO: 791699 - RNA, 19 nt, Homo sapiens
gguaauagugaguugauaa

SEQ ID NO: 791700 - RNA, 19 nt, Homo sapiens
gcaaaaguccgaaauugua

SEQ ID NO: 791701 - RNA, 19 nt, Homo sapiens
uagagacacugccaucuug

SEQ ID NO: 791702 - RNA, 19 nt, Homo sapiens
gcugaccgguuaucuaaau

SEQ ID NO: 791703 - RNA, 19 nt, Homo sapiens
gcagaguuccucaaaauua

SEQ ID NO: 791704 - RNA, 19 nt, Homo sapiens
caaacacaguugcuagguu

SEQ ID NO: 791705 - RNA, 19 nt, Homo sapiens
aagggaagauagugguuua

SEQ ID NO: 791706 - RNA, 19 nt, Homo sapiens
gaacuuagccccuggaaau

SEQ ID NO: 791707 - RNA, 19 nt, Homo sapiens
gaaguugagaguagugaaa

SEQ ID NO: 791708 - RNA, 19 nt, Homo sapiens
gaaauguaauaccugauac

SEQ ID NO: 791709 - RNA, 19 nt, Homo sapiens
guaaagaagcagauauuca

SEQ ID NO: 791710 - RNA, 19 nt, Homo sapiens
gagauaggauucaugaaaa

SEQ ID NO: 791711 - RNA, 19 nt, Homo sapiens
cuucaaagccauacaauga

SEQ ID NO: 791712 - RNA, 19 nt, Homo sapiens
gauguggaauacucauuug

SEQ ID NO: 791713 - RNA, 19 nt, Homo sapiens
cagcagaucuuguggaaaa

SEQ ID NO: 791714 - RNA, 19 nt, Homo sapiens
gaacuagaacaaacuuuag

SEQ ID NO: 791715 - RNA, 19 nt, Homo sapiens
gaugaagauuuaugaaguc

SEQ ID NO: 791716 - RNA, 19 nt, Homo sapiens
aaaucaagcugagguuaaa

SEQ ID NO: 791717 - RNA, 19 nt, Homo sapiens
acaaagagcaccaccaaga

SEQ ID NO: 791718 - RNA, 19 nt, Homo sapiens
guuccagaauguaaaguuu

SEQ ID NO: 791719 - RNA, 19 nt, Homo sapiens
gcaaugcagugaagcuagu

SEQ ID NO: 791720 - RNA, 19 nt, Homo sapiens
agaaaggagucucuucaug

SEQ ID NO: 791721 - RNA, 19 nt, Homo sapiens
gaucaagguaggagauaaa

SEQ ID NO: 791722 - RNA, 19 nt, Homo sapiens
gcaguuaccuguaggcaua

SEQ ID NO: 791723 - RNA, 19 nt, Homo sapiens
ggaauugaccugaauaaua

SEQ ID NO: 791724 - RNA, 19 nt, Homo sapiens
gaauugaccugaauaauag

SEQ ID NO: 791725 - RNA, 19 nt, Homo sapiens
gcauagaacugauacuuga

SEQ ID NO: 791726 - RNA, 19 nt, Homo sapiens
gagaagaccucagauguga

SEQ ID NO: 791727 - RNA, 19 nt, Homo sapiens
gaaucuuccucuacacuua

SEQ ID NO: 791728 - RNA, 19 nt, Homo sapiens
gauaagagauuggaggauu

SEQ ID NO: 791729 - RNA, 19 nt, Homo sapiens
gagaugcacuauacuuaaa

SEQ ID NO: 791730 - RNA, 19 nt, Homo sapiens
cagaaucacuugcugcuuu

SEQ ID NO: 791731 - RNA, 19 nt, Homo sapiens
gaagucaccauuucuguaa

SEQ ID NO: 791732 - RNA, 19 nt, Homo sapiens
gaucccaacuguuucguuu

SEQ ID NO: 791733 - RNA, 19 nt, Homo sapiens
gcuaaaccaauaccaauua

SEQ ID NO: 791734 - RNA, 19 nt, Homo sapiens
gaagaugacauuuggaaga

SEQ ID NO: 791735 - RNA, 19 nt, Homo sapiens
ggacaaccauggagaaggu

SEQ ID NO: 791736 - RNA, 19 nt, Homo sapiens
gaacuaacagcacucagaa

SEQ ID NO: 791737 - RNA, 19 nt, Homo sapiens
gaugugaaguccauuaaag

SEQ ID NO: 791738 - RNA, 19 nt, Homo sapiens
gcauuaauuuggaaggaaa

SEQ ID NO: 791739 - RNA, 19 nt, Homo sapiens
agaaaugggugcaaggaaa

SEQ ID NO: 791740 - RNA, 19 nt, Homo sapiens
gaaagugaaaggcaaagaa

SEQ ID NO: 791741 - RNA, 19 nt, Homo sapiens
uaacuuucccuucagaaua

SEQ ID NO: 791742 - RNA, 19 nt, Homo sapiens
ggaacagggugagaguuaa

SEQ ID NO: 791743 - RNA, 19 nt, Homo sapiens
ucaguaugaucaaccguua

SEQ ID NO: 791744 - RNA, 19 nt, Homo sapiens
gagccugucucuccaucua

SEQ ID NO: 791745 - RNA, 19 nt, Homo sapiens
gagaccaaaucaagccuuu

SEQ ID NO: 791746 - RNA, 19 nt, Homo sapiens
uuacuuaacuuucccuuca

SEQ ID NO: 791747 - RNA, 19 nt, Homo sapiens
guaaauaccagauugaagu

SEQ ID NO: 791748 - RNA, 19 nt, Homo sapiens
cagaagcaaugagaaauga

SEQ ID NO: 791749 - RNA, 19 nt, Homo sapiens
gaacaagaugcagugaaua

SEQ ID NO: 791750 - RNA, 19 nt, Homo sapiens
ggaagcagauaagcauaga

SEQ ID NO: 791751 - RNA, 19 nt, Homo sapiens
gagcuagcuuggaagauug

SEQ ID NO: 791752 - RNA, 19 nt, Homo sapiens
gguuagaggcugaaaguuu

SEQ ID NO: 791753 - RNA, 19 nt, Homo sapiens
gaauucugcacuccaguua

SEQ ID NO: 791754 - RNA, 19 nt, Homo sapiens
gauaagcauagaacugaua

SEQ ID NO: 791755 - RNA, 19 nt, Homo sapiens
gaaggaauugaccugaaua

SEQ ID NO: 791756 - RNA, 19 nt, Homo sapiens
gaucaaccguuagagaaau

SEQ ID NO: 791757 - RNA, 19 nt, Homo sapiens
gcaaggaaauacugaugag

SEQ ID NO: 791758 - RNA, 19 nt, Homo sapiens
ccaaaucaagccuuucuaa

SEQ ID NO: 791759 - RNA, 19 nt, Homo sapiens
gaucuugucuggacuacca

SEQ ID NO: 791760 - RNA, 19 nt, Homo sapiens
ggacagccacacuuaagaa

SEQ ID NO: 791761 - RNA, 19 nt, Homo sapiens
cacaagcuaugaagaaaug

SEQ ID NO: 791762 - RNA, 19 nt, Homo sapiens
gcacaguccauagucuuua

SEQ ID NO: 791763 - RNA, 19 nt, Homo sapiens
cauuaaagcuucaauaucc

SEQ ID NO: 791764 - RNA, 19 nt, Homo sapiens
ggaaggaaacugacaaguc

SEQ ID NO: 791765 - RNA, 19 nt, Homo sapiens
aaacagcacuauauuucug

SEQ ID NO: 791766 - RNA, 19 nt, Homo sapiens
gacauucucuucugugagu

SEQ ID NO: 791767 - RNA, 19 nt, Homo sapiens
aagaugcagugaauacuuu

SEQ ID NO: 791768 - RNA, 19 nt, Homo sapiens
caagucauguugcaaucaa

SEQ ID NO: 791769 - RNA, 19 nt, Homo sapiens
aaggaaaucugcuugugaa

SEQ ID NO: 791770 - RNA, 19 nt, Homo sapiens
aggaagagcuagcuuggaa

SEQ ID NO: 791771 - RNA, 19 nt, Homo sapiens
agaacaagaugcagugaau

SEQ ID NO: 791772 - RNA, 19 nt, Homo sapiens
gaagagcuagcuuggaaga

SEQ ID NO: 791773 - RNA, 19 nt, Homo sapiens
acaacuuggucgcgaauaa

SEQ ID NO: 791774 - RNA, 19 nt, Homo sapiens
ugaaucugguuuacuuuga

SEQ ID NO: 791775 - RNA, 19 nt, Homo sapiens
uaaaggaaaucugcuugug

SEQ ID NO: 791776 - RNA, 19 nt, Homo sapiens
gauccagaaucuuuauauc

SEQ ID NO: 791777 - RNA, 19 nt, Homo sapiens
ugaugauguuguacgauua

SEQ ID NO: 791778 - RNA, 19 nt, Homo sapiens
acagaaugaugccaugauu

SEQ ID NO: 791779 - RNA, 19 nt, Homo sapiens
gacaggaggcacagaauga

SEQ ID NO: 791780 - RNA, 19 nt, Homo sapiens
acacuauuguccucccuua

SEQ ID NO: 791781 - RNA, 19 nt, Homo sapiens
gaaaugggugcaaggaaau

SEQ ID NO: 791782 - RNA, 19 nt, Homo sapiens
guccagcaaucuuuauuau

SEQ ID NO: 791783 - RNA, 19 nt, Homo sapiens
guuguacgauuagaaauug

SEQ ID NO: 791784 - RNA, 19 nt, Homo sapiens
cagaaggaauugaccugaa

SEQ ID NO: 791785 - RNA, 19 nt, Homo sapiens
ucagcacaguuguuuauga

SEQ ID NO: 791786 - RNA, 19 nt, Homo sapiens
gugugaaucugguuuacuu

SEQ ID NO: 791787 - RNA, 19 nt, Homo sapiens
agagcuagcuuggaagauu

SEQ ID NO: 791788 - RNA, 19 nt, Homo sapiens
gauguuguacgauuagaaa

SEQ ID NO: 791789 - RNA, 19 nt, Homo sapiens
aaaucaagccuuucuaaga

SEQ ID NO: 791790 - RNA, 19 nt, Homo sapiens
cggaacagggugagaguua

SEQ ID NO: 791791 - RNA, 19 nt, Homo sapiens
agugguaacucaucccuaa

SEQ ID NO: 791792 - RNA, 19 nt, Homo sapiens
cauaauugaugcacaugau

SEQ ID NO: 791793 - RNA, 19 nt, Homo sapiens
gaagaaaugggugcaagga

SEQ ID NO: 791794 - RNA, 19 nt, Homo sapiens
ggacauaugccgggaagau

SEQ ID NO: 791795 - RNA, 19 nt, Homo sapiens
cagauaacuuccagucuca

SEQ ID NO: 791796 - RNA, 19 nt, Homo sapiens
gcucagcacaguuguuuau

SEQ ID NO: 791797 - RNA, 19 nt, Homo sapiens
gcaaagaacaagagaagac

SEQ ID NO: 791798 - RNA, 19 nt, Homo sapiens
gaacagggugagaguuaau

SEQ ID NO: 791799 - RNA, 19 nt, Homo sapiens
cagauaagcauagaacuga

SEQ ID NO: 791800 - RNA, 19 nt, Homo sapiens
gcagauaagcauagaacug

SEQ ID NO: 791801 - RNA, 19 nt, Homo sapiens
gcaaggauuuguggagaag

SEQ ID NO: 791802 - RNA, 19 nt, Homo sapiens
gcaggacagccacacuuaa

SEQ ID NO: 791803 - RNA, 19 nt, Homo sapiens
ugguuuacuuugagcauua

SEQ ID NO: 791804 - RNA, 19 nt, Homo sapiens
gguaacucaucccuaauca

SEQ ID NO: 791805 - RNA, 19 nt, Homo sapiens
gggaagaugacauuuggaa

SEQ ID NO: 791806 - RNA, 19 nt, Homo sapiens
uggauuugaugauguugua

SEQ ID NO: 791807 - RNA, 19 nt, Homo sapiens
acaguagccaguagaaaua

SEQ ID NO: 791808 - RNA, 19 nt, Homo sapiens
caagagaagaccucagaug

SEQ ID NO: 791809 - RNA, 19 nt, Homo sapiens
ugagaugcacuauacuuaa

SEQ ID NO: 791810 - RNA, 19 nt, Homo sapiens
ugacagcggcauuaauuug

SEQ ID NO: 791811 - RNA, 19 nt, Homo sapiens
gggagacaauccuagacuu

SEQ ID NO: 791812 - RNA, 19 nt, Homo sapiens
ggacaggaggcacagaaug

SEQ ID NO: 791813 - RNA, 19 nt, Homo sapiens
ggaugcagugaauaucuua

SEQ ID NO: 791814 - RNA, 19 nt, Homo sapiens
gaaauggccagagcaggaa

SEQ ID NO: 791815 - RNA, 19 nt, Homo sapiens
agaaggaauugaccugaau

SEQ ID NO: 791816 - RNA, 19 nt, Homo sapiens
aauaagagcacacagucua

SEQ ID NO: 791817 - RNA, 19 nt, Homo sapiens
caagucaugggucaaguuu

SEQ ID NO: 791818 - RNA, 19 nt, Homo sapiens
gcagcaggcucaguaugau

SEQ ID NO: 791819 - RNA, 19 nt, Homo sapiens
cgaagucaccauuucugua

SEQ ID NO: 791820 - RNA, 19 nt, Homo sapiens
ggugagaguuaauuaugca

SEQ ID NO: 791821 - RNA, 19 nt, Homo sapiens
gaaaggcaaagaacaagag

SEQ ID NO: 791822 - RNA, 19 nt, Homo sapiens
gaacaauacugcauuagaa

SEQ ID NO: 791823 - RNA, 19 nt, Homo sapiens
gcaccgagcugaugcagua

SEQ ID NO: 791824 - RNA, 19 nt, Homo sapiens
gcacuuggguguacaggua

SEQ ID NO: 791825 - RNA, 19 nt, Homo sapiens
ggaagaagacaacgaauaa

SEQ ID NO: 791826 - RNA, 19 nt, Homo sapiens
gcaauuggcaccaucuuua

SEQ ID NO: 791827 - RNA, 19 nt, Homo sapiens
gaugccagcuuuaaucuuu

SEQ ID NO: 791828 - RNA, 19 nt, Homo sapiens
gaaagucauuccugccuaa

SEQ ID NO: 791829 - RNA, 19 nt, Homo sapiens
gaacacauuuucacaguua

SEQ ID NO: 791830 - RNA, 19 nt, Homo sapiens
ggauaaagcuguguccaaa

SEQ ID NO: 791831 - RNA, 19 nt, Homo sapiens
ugagauccguguuagauua

SEQ ID NO: 791832 - RNA, 19 nt, Homo sapiens
gcaauacuguguuuggaaa

SEQ ID NO: 791833 - RNA, 19 nt, Homo sapiens
ucacagagcagauagauuu

SEQ ID NO: 791834 - RNA, 19 nt, Homo sapiens
ggauggagaugcaguaaau

SEQ ID NO: 791835 - RNA, 19 nt, Homo sapiens
ggagaaagaaugggaauaa

SEQ ID NO: 791836 - RNA, 19 nt, Homo sapiens
guuuauagguguucacuuu

SEQ ID NO: 791837 - RNA, 19 nt, Homo sapiens
aaaccauccuuaugacuua

SEQ ID NO: 791838 - RNA, 19 nt, Homo sapiens
gaucgugucugcuuauaau

SEQ ID NO: 791839 - RNA, 19 nt, Homo sapiens
ccaagaaaccaagaaauua

SEQ ID NO: 791840 - RNA, 19 nt, Homo sapiens
gauaguaguuacacuucua

SEQ ID NO: 791841 - RNA, 19 nt, Homo sapiens
ucaagaaucugacgugaug

SEQ ID NO: 791842 - RNA, 19 nt, Homo sapiens
uaagaucccuguugcaaga

SEQ ID NO: 791843 - RNA, 19 nt, Homo sapiens
gaagcuauuucagcaagua

SEQ ID NO: 791844 - RNA, 19 nt, Homo sapiens
gagaaagaaugggaauaaa

SEQ ID NO: 791845 - RNA, 19 nt, Homo sapiens
agagguagaugauaagaaa

SEQ ID NO: 791846 - RNA, 19 nt, Homo sapiens
gaacaacucaugaucacaa

SEQ ID NO: 791847 - RNA, 19 nt, Homo sapiens
gaaagaacaauacugcauu

SEQ ID NO: 791848 - RNA, 19 nt, Homo sapiens
gaaagaggcagacugaaau

SEQ ID NO: 791849 - RNA, 19 nt, Homo sapiens
caaugcaaguauacaguua

SEQ ID NO: 791850 - RNA, 19 nt, Homo sapiens
gaaggaggaucgucuuuac

SEQ ID NO: 791851 - RNA, 19 nt, Homo sapiens
gaaguaggcacaaaguaaa

SEQ ID NO: 791852 - RNA, 19 nt, Homo sapiens
gaccagaagcugcaauaua

SEQ ID NO: 791853 - RNA, 19 nt, Homo sapiens
cuccagagcugauuaacua

SEQ ID NO: 791854 - RNA, 19 nt, Homo sapiens
ggaagaagaaugauggauu

SEQ ID NO: 791855 - RNA, 19 nt, Homo sapiens
gaucugcaguuuaugagaa

SEQ ID NO: 791856 - RNA, 19 nt, Homo sapiens
ccuagacaaugacauauaa

SEQ ID NO: 791857 - RNA, 19 nt, Homo sapiens
ccacuucuccuacauuuaa

SEQ ID NO: 791858 - RNA, 19 nt, Homo sapiens
gagaauggaugauaguagu

SEQ ID NO: 791859 - RNA, 19 nt, Homo sapiens
caagaagaauccuggcauu

SEQ ID NO: 791860 - RNA, 19 nt, Homo sapiens
gaaauacaaacgcuagaaa

SEQ ID NO: 791861 - RNA, 19 nt, Homo sapiens
cagaugaaguggucuuuga

SEQ ID NO: 791862 - RNA, 19 nt, Homo sapiens
cgaauaaacuuccuucaac

SEQ ID NO: 791863 - RNA, 19 nt, Homo sapiens
gagcaaaucauccuagaga

SEQ ID NO: 791864 - RNA, 19 nt, Homo sapiens
aaaaguagccuaaguguua

SEQ ID NO: 791865 - RNA, 19 nt, Homo sapiens
ccacauauauauacacaca

SEQ ID NO: 791866 - RNA, 19 nt, Homo sapiens
ggaaggaggaucgucuuua

SEQ ID NO: 791867 - RNA, 19 nt, Homo sapiens
aaagugggccuuagagaua

SEQ ID NO: 791868 - RNA, 19 nt, Homo sapiens
ccaagaaauuaacaacuga

SEQ ID NO: 791869 - RNA, 19 nt, Homo sapiens
gaggcagacugaaauagaa

SEQ ID NO: 791870 - RNA, 19 nt, Homo sapiens
gcaaaucauccuagagaaa

SEQ ID NO: 791871 - RNA, 19 nt, Homo sapiens
gagguaagagauacuauuu

SEQ ID NO: 791872 - RNA, 19 nt, Homo sapiens
gaagaauccuggcauugca

SEQ ID NO: 791873 - RNA, 19 nt, Homo sapiens
gggagaaugugcugcuaaa

SEQ ID NO: 791874 - RNA, 19 nt, Homo sapiens
gcaguuuacuugccucuuc

SEQ ID NO: 791875 - RNA, 19 nt, Homo sapiens
ccaaauagcacacaagcuu

SEQ ID NO: 791876 - RNA, 19 nt, Homo sapiens
cacugaagauccuauuaua

SEQ ID NO: 791877 - RNA, 19 nt, Homo sapiens
gagauaggaagaagaauga

SEQ ID NO: 791878 - RNA, 19 nt, Homo sapiens
gaauggaugauaguaguua

SEQ ID NO: 791879 - RNA, 19 nt, Homo sapiens
gaaauugaggugucuguug

SEQ ID NO: 791880 - RNA, 19 nt, Homo sapiens
ggccaccgcuuuguacaua

SEQ ID NO: 791881 - RNA, 19 nt, Homo sapiens
gcacuuauugcuuaaagaa

SEQ ID NO: 791882 - RNA, 19 nt, Homo sapiens
cacaaucuauucuacauga

SEQ ID NO: 791883 - RNA, 19 nt, Homo sapiens
gaagacaacgaauaaacuu

SEQ ID NO: 791884 - RNA, 19 nt, Homo sapiens
uacaaacgcuagaaaguga

SEQ ID NO: 791885 - RNA, 19 nt, Homo sapiens
gaaaccauccuuaugacuu

SEQ ID NO: 791886 - RNA, 19 nt, Homo sapiens
gaggaugaguucagaguca

SEQ ID NO: 791887 - RNA, 19 nt, Homo sapiens
uagaaguccugaugugaaa

SEQ ID NO: 791888 - RNA, 19 nt, Homo sapiens
gaaaaugagauccguguua

SEQ ID NO: 791889 - RNA, 19 nt, Homo sapiens
gaaaggaaacacgaaagaa

SEQ ID NO: 791890 - RNA, 19 nt, Homo sapiens
aaacaaaccaaauggauga

SEQ ID NO: 791891 - RNA, 19 nt, Homo sapiens
gcaaacaauuucagcugau

SEQ ID NO: 791892 - RNA, 19 nt, Homo sapiens
uguuagagauggugaauau

SEQ ID NO: 791893 - RNA, 19 nt, Homo sapiens
gaucccaaauggacccuuu

SEQ ID NO: 791894 - RNA, 19 nt, Homo sapiens
gguugagucuccugaauau

SEQ ID NO: 791895 - RNA, 19 nt, Homo sapiens
acagauggcagcccaaaua

SEQ ID NO: 791896 - RNA, 19 nt, Homo sapiens
uauagaggaugccagcuuu

SEQ ID NO: 791897 - RNA, 19 nt, Homo sapiens
gcaggcaccuccucacauc

SEQ ID NO: 791898 - RNA, 19 nt, Homo sapiens
ccaauccucuguucacgaa

SEQ ID NO: 791899 - RNA, 19 nt, Homo sapiens
gauuagaaguccugaugug

SEQ ID NO: 791900 - RNA, 19 nt, Homo sapiens
caaaccaaauggaugaugu

SEQ ID NO: 791901 - RNA, 19 nt, Homo sapiens
gaaaagggauguauuacca

SEQ ID NO: 791902 - RNA, 19 nt, Homo sapiens
gauggaacguacaauggaa

SEQ ID NO: 791903 - RNA, 19 nt, Homo sapiens
gaggccaacugcugugauu

SEQ ID NO: 791904 - RNA, 19 nt, Homo sapiens
ucagugagcugccaauuuu

SEQ ID NO: 791905 - RNA, 19 nt, Homo sapiens
gaugacacaaugcaguuua

SEQ ID NO: 791906 - RNA, 19 nt, Homo sapiens
ccuaauccaucgagagaaa

SEQ ID NO: 791907 - RNA, 19 nt, Homo sapiens
uaugcugccuuccggauua

SEQ ID NO: 791908 - RNA, 19 nt, Homo sapiens
ccaaagugcuucgggagaa

SEQ ID NO: 791909 - RNA, 19 nt, Homo sapiens
gcaaacaaacucagcaauc

SEQ ID NO: 791910 - RNA, 19 nt, Homo sapiens
ucucugugcucuugaguuu

SEQ ID NO: 791911 - RNA, 19 nt, Homo sapiens
caaagcagacacagggaua

SEQ ID NO: 791912 - RNA, 19 nt, Homo sapiens
ggaaccaucuacuaacaag

SEQ ID NO: 791913 - RNA, 19 nt, Homo sapiens
gcccuaaauuucuggauga

SEQ ID NO: 791914 - RNA, 19 nt, Homo sapiens
gaagaggcaguuaugauuc

SEQ ID NO: 791915 - RNA, 19 nt, Homo sapiens
gcguuucucuccauauuug

SEQ ID NO: 791916 - RNA, 19 nt, Homo sapiens
ggaggaagaagacaacgaa

SEQ ID NO: 791917 - RNA, 19 nt, Homo sapiens
ggaaacagcggacuuuguc

SEQ ID NO: 791918 - RNA, 19 nt, Homo sapiens
gcgcaagcaugauugacaa

SEQ ID NO: 791919 - RNA, 19 nt, Homo sapiens
agaaugugcugcuaaagga

SEQ ID NO: 791920 - RNA, 19 nt, Homo sapiens
aaagaaagaggcagacuga

SEQ ID NO: 791921 - RNA, 19 nt, Homo sapiens
ccuuaugacuuaccuuaaa

SEQ ID NO: 791922 - RNA, 19 nt, Homo sapiens
gaacaauacugcauuagaa

SEQ ID NO: 791923 - RNA, 19 nt, Homo sapiens
gcaccgagcugaugcagua

SEQ ID NO: 791924 - RNA, 19 nt, Homo sapiens
gcacuuggguguacaggua

SEQ ID NO: 791925 - RNA, 19 nt, Homo sapiens
ggaagaagacaacgaauaa

SEQ ID NO: 791926 - RNA, 19 nt, Homo sapiens
gaugccagcuuuaaucuuu

SEQ ID NO: 791927 - RNA, 19 nt, Homo sapiens
gaacacauuuucacaguua

SEQ ID NO: 791928 - RNA, 19 nt, Homo sapiens
ggauaaagcuguguccaaa

SEQ ID NO: 791929 - RNA, 19 nt, Homo sapiens
ucacagagcagauagauuu

SEQ ID NO: 791930 - RNA, 19 nt, Homo sapiens
ggauggagaugcaguaaau

SEQ ID NO: 791931 - RNA, 19 nt, Homo sapiens
ggagaaagaaugggaauaa

SEQ ID NO: 791932 - RNA, 19 nt, Homo sapiens
gaucgugucugcuuauaau

SEQ ID NO: 791933 - RNA, 19 nt, Homo sapiens
ccaagaaaccaagaaauua

SEQ ID NO: 791934 - RNA, 19 nt, Homo sapiens
ucaagaaucugacgugaug

SEQ ID NO: 791935 - RNA, 19 nt, Homo sapiens
gaagcuauuucagcaagua

SEQ ID NO: 791936 - RNA, 19 nt, Homo sapiens
gagaaagaaugggaauaaa

SEQ ID NO: 791937 - RNA, 19 nt, Homo sapiens
agagguagaugauaagaaa

SEQ ID NO: 791938 - RNA, 19 nt, Homo sapiens
gaacaacucaugaucacaa

SEQ ID NO: 791939 - RNA, 19 nt, Homo sapiens
gaaagaacaauacugcauu

SEQ ID NO: 791940 - RNA, 19 nt, Homo sapiens
gaaagaggcagacugaaau

SEQ ID NO: 791941 - RNA, 19 nt, Homo sapiens
gaccagaagcugcaauaua

SEQ ID NO: 791942 - RNA, 19 nt, Homo sapiens
ggaagaagaaugauggauu

SEQ ID NO: 791943 - RNA, 19 nt, Homo sapiens
gaucugcaguuuaugagaa

SEQ ID NO: 791944 - RNA, 19 nt, Homo sapiens
ccacuucuccuacauuuaa

SEQ ID NO: 791945 - RNA, 19 nt, Homo sapiens
gagaauggaugauaguagu

SEQ ID NO: 791946 - RNA, 19 nt, Homo sapiens
caagaagaauccuggcauu

SEQ ID NO: 791947 - RNA, 19 nt, Homo sapiens
gaaauacaaacgcuagaaa

SEQ ID NO: 791948 - RNA, 19 nt, Homo sapiens
cgaauaaacuuccuucaac

SEQ ID NO: 791949 - RNA, 19 nt, Homo sapiens
gagcaaaucauccuagaga

SEQ ID NO: 791950 - RNA, 19 nt, Homo sapiens
aaagugggccuuagagaua

SEQ ID NO: 791951 - RNA, 19 nt, Homo sapiens
ccaagaaauuaacaacuga

SEQ ID NO: 791952 - RNA, 19 nt, Homo sapiens
gcaaaucauccuagagaaa

SEQ ID NO: 791953 - RNA, 19 nt, Homo sapiens
gaggcagacugaaauagaa

SEQ ID NO: 791954 - RNA, 19 nt, Homo sapiens
gagguaagagauacuauuu

SEQ ID NO: 791955 - RNA, 19 nt, Homo sapiens
gaagaauccuggcauugca

SEQ ID NO: 791956 - RNA, 19 nt, Homo sapiens
gggagaaugugcugcuaaa

SEQ ID NO: 791957 - RNA, 19 nt, Homo sapiens
gagauaggaagaagaauga

SEQ ID NO: 791958 - RNA, 19 nt, Homo sapiens
gaaauugaggugucuguug

SEQ ID NO: 791959 - RNA, 19 nt, Homo sapiens
cacaaucuauucuacauga

SEQ ID NO: 791960 - RNA, 19 nt, Homo sapiens
gaagacaacgaauaaacuu

SEQ ID NO: 791961 - RNA, 19 nt, Homo sapiens
uacaaacgcuagaaaguga

SEQ ID NO: 791962 - RNA, 19 nt, Homo sapiens
gaggaugaguucagaguca

SEQ ID NO: 791963 - RNA, 19 nt, Homo sapiens
gaaaggaaacacgaaagaa

SEQ ID NO: 791964 - RNA, 19 nt, Homo sapiens
aaacaaaccaaauggauga

SEQ ID NO: 791965 - RNA, 19 nt, Homo sapiens
gcaaacaauuucagcugau

SEQ ID NO: 791966 - RNA, 19 nt, Homo sapiens
uauagaggaugccagcuuu

SEQ ID NO: 791967 - RNA, 19 nt, Homo sapiens
gcaggcaccuccucacauc

SEQ ID NO: 791968 - RNA, 19 nt, Homo sapiens
ccaauccucuguucacgaa

SEQ ID NO: 791969 - RNA, 19 nt, Homo sapiens
caaaccaaauggaugaugu

SEQ ID NO: 791970 - RNA, 19 nt, Homo sapiens
gaaaagggauguauuacca

SEQ ID NO: 791971 - RNA, 19 nt, Homo sapiens
gauggaacguacaauggaa

SEQ ID NO: 791972 - RNA, 19 nt, Homo sapiens
gaggccaacugcugugauu

SEQ ID NO: 791973 - RNA, 19 nt, Homo sapiens
gcaaacaaacucagcaauc

SEQ ID NO: 791974 - RNA, 19 nt, Homo sapiens
ccaaagugcuucgggagaa

SEQ ID NO: 791975 - RNA, 19 nt, Homo sapiens
gcccuaaauuucuggauga

SEQ ID NO: 791976 - RNA, 19 nt, Homo sapiens
gaagaggcaguuaugauuc

SEQ ID NO: 791977 - RNA, 19 nt, Homo sapiens
gcguuucucuccauauuug

SEQ ID NO: 791978 - RNA, 19 nt, Homo sapiens
ggaggaagaagacaacgaa

SEQ ID NO: 791979 - RNA, 19 nt, Homo sapiens
ggaaacagcggacuuuguc

SEQ ID NO: 791980 - RNA, 19 nt, Homo sapiens
gcgcaagcaugauugacaa

SEQ ID NO: 791981 - RNA, 19 nt, Homo sapiens
agaaugugcugcuaaagga

SEQ ID NO: 791982 - RNA, 19 nt, Homo sapiens
uaacaagguauuugcauga

SEQ ID NO: 791983 - RNA, 19 nt, Homo sapiens
gaaauuaacaacugaaagc

SEQ ID NO: 791984 - RNA, 19 nt, Homo sapiens
ucacuguggucaaggauga

SEQ ID NO: 791985 - RNA, 19 nt, Homo sapiens
auaauggccuccuuacuga

SEQ ID NO: 791986 - RNA, 19 nt, Homo sapiens
gcccagacaugacuaucaa

SEQ ID NO: 791987 - RNA, 19 nt, Homo sapiens
aaagaaagaggcagacuga

SEQ ID NO: 791988 - RNA, 19 nt, Homo sapiens
caaacacaaucuauucuac

SEQ ID NO: 791989 - RNA, 19 nt, Homo sapiens
ucacaaacacaaucuauuc

SEQ ID NO: 791990 - RNA, 19 nt, Homo sapiens
gaagaagacaacgaauaaa

SEQ ID NO: 791991 - RNA, 19 nt, Homo sapiens
aaagggauguauuaccaaa

SEQ ID NO: 791992 - RNA, 19 nt, Homo sapiens
ggcugaggauggagaauuu

SEQ ID NO: 791993 - RNA, 19 nt, Homo sapiens
aaaggaaacacgaaagaaa

SEQ ID NO: 791994 - RNA, 19 nt, Homo sapiens
ccaaauggaugauguuagc

SEQ ID NO: 791995 - RNA, 19 nt, Homo sapiens
gagaacaacucaugaucac

SEQ ID NO: 791996 - RNA, 19 nt, Homo sapiens
ggaaucagcuacaaauccu

SEQ ID NO: 791997 - RNA, 19 nt, Homo sapiens
ucaggaagguagagagaga

SEQ ID NO: 791998 - RNA, 19 nt, Homo sapiens
agaaagaggcagacugaaa

SEQ ID NO: 791999 - RNA, 19 nt, Homo sapiens
ugaagcgacuguagaggaa

SEQ ID NO: 792000 - RNA, 19 nt, Homo sapiens
cagacaagccacugacuaa

SEQ ID NO: 792001 - RNA, 19 nt, Homo sapiens
ggagguaagagauacuauu

SEQ ID NO: 792002 - RNA, 19 nt, Homo sapiens
gcgagagaauggaugauag

SEQ ID NO: 792003 - RNA, 19 nt, Homo sapiens
gagacccuauccaaugauu

SEQ ID NO: 792004 - RNA, 19 nt, Homo sapiens
auaauugggugcccuaaau

SEQ ID NO: 792005 - RNA, 19 nt, Homo sapiens
uuggagagguagaugauaa

SEQ ID NO: 792006 - RNA, 19 nt, Homo sapiens
acucagcaauccuuaugua

SEQ ID NO: 792007 - RNA, 19 nt, Homo sapiens
auaaugauguugccagaga

SEQ ID NO: 792008 - RNA, 19 nt, Homo sapiens
gaaacugaaggaaacagaa

SEQ ID NO: 792009 - RNA, 19 nt, Homo sapiens
uagagaaacugaaggaaac

SEQ ID NO: 792010 - RNA, 19 nt, Homo sapiens
gagucacaauuacaaaguu

SEQ ID NO: 792011 - RNA, 19 nt, Homo sapiens
ggaguggagugagaauuuc

SEQ ID NO: 792012 - RNA, 19 nt, Homo sapiens
caaagugcuucgggagaaa

SEQ ID NO: 792013 - RNA, 19 nt, Homo sapiens
caacucaugaucacaauuc

SEQ ID NO: 792014 - RNA, 19 nt, Homo sapiens
gcaguuaugauuccacuuc

SEQ ID NO: 792015 - RNA, 19 nt, Homo sapiens
cauaauggccuccuuacug

SEQ ID NO: 792016 - RNA, 19 nt, Homo sapiens
agacaugacuaucaagaag

SEQ ID NO: 792017 - RNA, 19 nt, Homo sapiens
gaggcuggagcaagaaaua

SEQ ID NO: 792018 - RNA, 19 nt, Homo sapiens
ggaauaaaauaaggaggua

SEQ ID NO: 792019 - RNA, 19 nt, Homo sapiens
agaagaggcaguuaugauu

SEQ ID NO: 792020 - RNA, 19 nt, Homo sapiens
caaacaauuucagcugaug

SEQ ID NO: 792021 - RNA, 19 nt, Homo sapiens
gggcacagcaggaacaguu

SEQ ID NO: 792022 - RNA, 19 nt, Homo sapiens
agaaauugcuguacagaua

SEQ ID NO: 792023 - RNA, 19 nt, Homo sapiens
caaguuggauggcagcuua

SEQ ID NO: 792024 - RNA, 19 nt, Homo sapiens
ugacauauaccaccacuua

SEQ ID NO: 792025 - RNA, 19 nt, Homo sapiens
gcaaaggaaauaagucaua

SEQ ID NO: 792026 - RNA, 19 nt, Homo sapiens
gggcauggcaagaauauua

SEQ ID NO: 792027 - RNA, 19 nt, Homo sapiens
gcacaacauuuggcugaua

SEQ ID NO: 792028 - RNA, 19 nt, Homo sapiens
gaagcaguauuacaaaguu

SEQ ID NO: 792029 - RNA, 19 nt, Homo sapiens
ccacauggcuuccucuaga

SEQ ID NO: 792030 - RNA, 19 nt, Homo sapiens
ggaaaagacucagcauuua

SEQ ID NO: 792031 - RNA, 19 nt, Homo sapiens
gauggcagcuuaucacaug

SEQ ID NO: 792032 - RNA, 19 nt, Homo sapiens
caagaaaugaugcauagua

SEQ ID NO: 792033 - RNA, 19 nt, Homo sapiens
gaacaaccaccaaauggaa

SEQ ID NO: 792034 - RNA, 19 nt, Homo sapiens
gagagaacccuucaaauuc

SEQ ID NO: 792035 - RNA, 19 nt, Homo sapiens
gcccagaaauguaauauca

SEQ ID NO: 792036 - RNA, 19 nt, Homo sapiens
gaugagaauugcccagaaa

SEQ ID NO: 792037 - RNA, 19 nt, Homo sapiens
gaaggugaaucugguugua

SEQ ID NO: 792038 - RNA, 19 nt, Homo sapiens
ucauagaacuugacuacuu

SEQ ID NO: 792039 - RNA, 19 nt, Homo sapiens
ccaggaagaugauugguau

SEQ ID NO: 792040 - RNA, 19 nt, Homo sapiens
ggacauagagcugaaaguu

SEQ ID NO: 792041 - RNA, 19 nt, Homo sapiens
gaagagcaaaugaagaauu

SEQ ID NO: 792042 - RNA, 19 nt, Homo sapiens
aaacuuaaguacccagauu

SEQ ID NO: 792043 - RNA, 19 nt, Homo sapiens
gaacugucaacaaaugaua

SEQ ID NO: 792044 - RNA, 19 nt, Homo sapiens
caagagaaauugcuguaca

SEQ ID NO: 792045 - RNA, 19 nt, Homo sapiens
cuauagaggugcauucuug

SEQ ID NO: 792046 - RNA, 19 nt, Homo sapiens
gaauugcccagaaauguaa

SEQ ID NO: 792047 - RNA, 19 nt, Homo sapiens
gcugauauccuuucuucua

SEQ ID NO: 792048 - RNA, 19 nt, Homo sapiens
agagagaacccuucaaauu

SEQ ID NO: 792049 - RNA, 19 nt, Homo sapiens
cagcagagcacaacauuug

SEQ ID NO: 792050 - RNA, 19 nt, Homo sapiens
gaauuaagcaacucauaga

SEQ ID NO: 792051 - RNA, 19 nt, Homo sapiens
ccagagaaauaucaagaau

SEQ ID NO: 792052 - RNA, 19 nt, Homo sapiens
uaucaaccuucucccuuua

SEQ ID NO: 792053 - RNA, 19 nt, Homo sapiens
ucuauaagaucuucccaaa

SEQ ID NO: 792054 - RNA, 19 nt, Homo sapiens
cauagaacuugacuacuug

SEQ ID NO: 792055 - RNA, 19 nt, Homo sapiens
ucuguuagcuuccaguaaa

SEQ ID NO: 792056 - RNA, 19 nt, Homo sapiens
gcaggaaggaauauuuaaa

SEQ ID NO: 792057 - RNA, 19 nt, Homo sapiens
cagcagaauuccauuuaau

SEQ ID NO: 792058 - RNA, 19 nt, Homo sapiens
cagaugaagacaagacuua

SEQ ID NO: 792059 - RNA, 19 nt, Homo sapiens
gaauguggaaucauagaaa

SEQ ID NO: 792060 - RNA, 19 nt, Homo sapiens
agagaacccuucaaauuca

SEQ ID NO: 792061 - RNA, 19 nt, Homo sapiens
uauaguggcauuucugaua

SEQ ID NO: 792062 - RNA, 19 nt, Homo sapiens
gcucagagacauccaaguu

SEQ ID NO: 792063 - RNA, 19 nt, Homo sapiens
ccgcuucucauucauauua

SEQ ID NO: 792064 - RNA, 19 nt, Homo sapiens
gaagaugauugguaugacu

SEQ ID NO: 792065 - RNA, 19 nt, Homo sapiens
gguagaggauuaugaacau

SEQ ID NO: 792066 - RNA, 19 nt, Homo sapiens
caaaagaacugggcuguga

SEQ ID NO: 792067 - RNA, 19 nt, Homo sapiens
ggaagaauguguggauugg

SEQ ID NO: 792068 - RNA, 19 nt, Homo sapiens
gucaacaaaugauaccuuu

SEQ ID NO: 792069 - RNA, 19 nt, Homo sapiens
cagauaagcuuuuagaaga

SEQ ID NO: 792070 - RNA, 19 nt, Homo sapiens
caggaacugucaacaaaug

SEQ ID NO: 792071 - RNA, 19 nt, Homo sapiens
gagcaaaggaaauaaguca

SEQ ID NO: 792072 - RNA, 19 nt, Homo sapiens
gcagaauuccauuuaauca

SEQ ID NO: 792073 - RNA, 19 nt, Homo sapiens
uaucaagaaucaccuggaa

SEQ ID NO: 792074 - RNA, 19 nt, Homo sapiens
ggauugggauguggaaguu

SEQ ID NO: 792075 - RNA, 19 nt, Homo sapiens
gcaauaugaaucagaauca

SEQ ID NO: 792076 - RNA, 19 nt, Homo sapiens
uacaagaaaugaugcauag

SEQ ID NO: 792077 - RNA, 19 nt, Homo sapiens
gaauccagaugaagacaag

SEQ ID NO: 792078 - RNA, 19 nt, Homo sapiens
aagcugcugugcauacaua

SEQ ID NO: 792079 - RNA, 19 nt, Homo sapiens
ucagcagaauuccauuuaa

SEQ ID NO: 792080 - RNA, 19 nt, Homo sapiens
agagaaaccuguggaaauc

SEQ ID NO: 792081 - RNA, 19 nt, Homo sapiens
cugaauugguagaggauua

SEQ ID NO: 792082 - RNA, 19 nt, Homo sapiens
guaccuaaccaacccuuaa

SEQ ID NO: 792083 - RNA, 19 nt, Homo sapiens
gacauagagcugaaaguuu

SEQ ID NO: 792084 - RNA, 19 nt, Homo sapiens
gaaacuucaucagauuguu

SEQ ID NO: 792085 - RNA, 19 nt, Homo sapiens
ggcaguauacgccucuuua

SEQ ID NO: 792086 - RNA, 19 nt, Homo sapiens
gaggaguacuggagagcuu

SEQ ID NO: 792087 - RNA, 19 nt, Homo sapiens
gcugaaagacucugaaucu

SEQ ID NO: 792088 - RNA, 19 nt, Homo sapiens
gaaaucaucaggcacuaca

SEQ ID NO: 792089 - RNA, 19 nt, Homo sapiens
cucagaauguggaaucaua

SEQ ID NO: 792090 - RNA, 19 nt, Homo sapiens
gagaauugcccagaaaugu

SEQ ID NO: 792091 - RNA, 19 nt, Homo sapiens
agaaauuuguagcauggua

SEQ ID NO: 792092 - RNA, 19 nt, Homo sapiens
ccagguauauuaucuucau

SEQ ID NO: 792093 - RNA, 19 nt, Homo sapiens
cauaguaaccagugauuau

SEQ ID NO: 792094 - RNA, 19 nt, Homo sapiens
gaugaagacaagacuuaaa

SEQ ID NO: 792095 - RNA, 19 nt, Homo sapiens
caaaggaaauaagucauac

SEQ ID NO: 792096 - RNA, 19 nt, Homo sapiens
gcgcugcgggcucgauuua

SEQ ID NO: 792097 - RNA, 19 nt, Homo sapiens
cugauauccuuucuucuaa

SEQ ID NO: 792098 - RNA, 19 nt, Homo sapiens
gcuguggaguucuuuacaa

SEQ ID NO: 792099 - RNA, 19 nt, Homo sapiens
aaccagugauuauaggaua

SEQ ID NO: 792100 - RNA, 19 nt, Homo sapiens
ggaacaaccaccaaaugga

SEQ ID NO: 792101 - RNA, 19 nt, Homo sapiens
agagugacagugauucuua

SEQ ID NO: 792102 - RNA, 19 nt, Homo sapiens
aagagcaaaugaagaauuc

SEQ ID NO: 792103 - RNA, 19 nt, Homo sapiens
ccgaagagcaaaugaagaa

SEQ ID NO: 792104 - RNA, 19 nt, Homo sapiens
ccagaaauguaauaucaac

SEQ ID NO: 792105 - RNA, 19 nt, Homo sapiens
uggcuaaacugaagcacuu

SEQ ID NO: 792106 - RNA, 19 nt, Homo sapiens
caccauagcuuuggacucu

SEQ ID NO: 792107 - RNA, 19 nt, Homo sapiens
auaguggcauuucugauaa

SEQ ID NO: 792108 - RNA, 19 nt, Homo sapiens
gaagacaagacuuaaagag

SEQ ID NO: 792109 - RNA, 19 nt, Homo sapiens
gcugcgggcucgauuuaau

SEQ ID NO: 792110 - RNA, 19 nt, Homo sapiens
gguuguaaaucuggaugua

SEQ ID NO: 792111 - RNA, 19 nt, Homo sapiens
ucauagguuugaagcagua

SEQ ID NO: 792112 - RNA, 19 nt, Homo sapiens
uuacagccauuggaauaaa

SEQ ID NO: 792113 - RNA, 19 nt, Homo sapiens
uggcauuucugauaaacuu

SEQ ID NO: 792114 - RNA, 19 nt, Homo sapiens
gcauaguaaccagugauua

SEQ ID NO: 792115 - RNA, 19 nt, Homo sapiens
ugacaaaguacaugagaga

SEQ ID NO: 792116 - RNA, 19 nt, Homo sapiens
auacgccucuuuauucuug

SEQ ID NO: 792117 - RNA, 19 nt, Homo sapiens
cuuagagugucaugucuuu

SEQ ID NO: 792118 - RNA, 19 nt, Homo sapiens
gcuuuggacucucuuguuc

SEQ ID NO: 792119 - RNA, 19 nt, Homo sapiens
ugaaagcuguccacauuuu

SEQ ID NO: 792120 - RNA, 19 nt, Homo sapiens
cuacaagaaaugaugcaua

SEQ ID NO: 792121 - RNA, 19 nt, Homo sapiens
caucagccauacacguuga

SEQ ID NO: 792122 - RNA, 19 nt, Homo sapiens
ggagagugcugccaaguug

SEQ ID NO: 792123 - RNA, 19 nt, Homo sapiens
caagaugaaugaacuaaug

SEQ ID NO: 792124 - RNA, 19 nt, Homo sapiens
ugaaugaacuaauggagaa

SEQ ID NO: 792125 - RNA, 19 nt, Homo sapiens
caacagaggugaagaucca

SEQ ID NO: 792126 - RNA, 19 nt, Homo sapiens
gcucaaggauuccgugaug

SEQ ID NO: 792127 - RNA, 19 nt, Homo sapiens
uagaaagucuucagugaug

SEQ ID NO: 792128 - RNA, 19 nt, Homo sapiens
gaacuaauggagaaauaga

SEQ ID NO: 792129 - RNA, 19 nt, Homo sapiens
aauagaaagucuucaguga

SEQ ID NO: 792130 - RNA, 19 nt, Homo sapiens
acaauggcuuugauuauga

SEQ ID NO: 792131 - RNA, 19 nt, Homo sapiens
ucacagagccaaagacaau

SEQ ID NO: 792132 - RNA, 19 nt, Homo sapiens
cacaauggcuuugauuaug

SEQ ID NO: 792133 - RNA, 19 nt, Homo sapiens
ggccgaggauggaugauug

SEQ ID NO: 792134 - RNA, 19 nt, Homo sapiens
gagucuagcuaccaagaug

SEQ ID NO: 792135 - RNA, 19 nt, Homo sapiens
caaagacaauucaggaacu

SEQ ID NO: 792136 - RNA, 19 nt, Homo sapiens
ccacaauggcuuugauuau

SEQ ID NO: 792137 - RNA, 19 nt, Homo sapiens
gaaauagaaagucuucagu

SEQ ID NO: 792138 - RNA, 19 nt, Homo sapiens
ggagaaauagaaagucuuc

SEQ ID NO: 792139 - RNA, 19 nt, Homo sapiens
gaagcccucucccaagauc

SEQ ID NO: 792140 - RNA, 19 nt, Homo sapiens
ggcagcagcuccgucauga

SEQ ID NO: 792141 - RNA, 19 nt, Homo sapiens
gugaagauccaagaaauga

SEQ ID NO: 792142 - RNA, 19 nt, Homo sapiens
cgagucuggugcccuagua

SEQ ID NO: 792143 - RNA, 19 nt, Homo sapiens
gaggugaagauccaagaaa

SEQ ID NO: 792144 - RNA, 19 nt, Homo sapiens
ccggaaggcuggcuuugau

SEQ ID NO: 792145 - RNA, 19 nt, Homo sapiens
cuaccaagaugaaugaacu

SEQ ID NO: 792146 - RNA, 19 nt, Homo sapiens
aggaagcccucucccaaga

SEQ ID NO: 792147 - RNA, 19 nt, Homo sapiens
gcuuagaacggaguacuuu

SEQ ID NO: 792148 - RNA, 19 nt, Homo sapiens
ucaacaagcagagugauga

SEQ ID NO: 792149 - RNA, 19 nt, Homo sapiens
ggaguacuuugcacagcau

SEQ ID NO: 792150 - RNA, 19 nt, Homo sapiens
uggcuuugauuaugauuuc

SEQ ID NO: 792151 - RNA, 19 nt, Homo sapiens
caauggcuuugauuaugau

SEQ ID NO: 792152 - RNA, 19 nt, Homo sapiens
gcagcuccgucaugagucu

SEQ ID NO: 792153 - RNA, 19 nt, Homo sapiens
gccgagcugucccucuuug

SEQ ID NO: 792154 - RNA, 19 nt, Homo sapiens
ggugaagauccaagaaaug

SEQ ID NO: 792155 - RNA, 19 nt, Homo sapiens
ugaaaggggucccaacaga

SEQ ID NO: 792156 - RNA, 19 nt, Homo sapiens
ucaaggauuccgugauguu

SEQ ID NO: 792157 - RNA, 19 nt, Homo sapiens
uagcuaccaagaugaauga

SEQ ID NO: 792158 - RNA, 19 nt, Homo sapiens
ucuggucacuuccgacuuc

SEQ ID NO: 792159 - RNA, 19 nt, Homo sapiens
ggaagcugaaggaccuaaa

SEQ ID NO: 792160 - RNA, 19 nt, Homo sapiens
cagcagcuccgucaugagu

SEQ ID NO: 792161 - RNA, 19 nt, Homo sapiens
cagggaugcugcugcaagu

SEQ ID NO: 792162 - RNA, 19 nt, Homo sapiens
ucagcacccuagaccagaa

SEQ ID NO: 792163 - RNA, 19 nt, Homo sapiens
ucaugagucuagcuaccaa

SEQ ID NO: 792164 - RNA, 19 nt, Homo sapiens
caaguggucauggcaguug

SEQ ID NO: 792165 - RNA, 19 nt, Homo sapiens
cccacaauggcuuugauua

SEQ ID NO: 792166 - RNA, 19 nt, Homo sapiens
gccaaagacaauucaggaa

SEQ ID NO: 792167 - RNA, 19 nt, Homo sapiens
aggugaagauccaagaaau

SEQ ID NO: 792168 - RNA, 19 nt, Homo sapiens
cagaguaccgcuuggagau

SEQ ID NO: 792169 - RNA, 19 nt, Homo sapiens
aaagacaauucaggaacug

SEQ ID NO: 792170 - RNA, 19 nt, Homo sapiens
gaaugaacuaauggagaaa

SEQ ID NO: 792171 - RNA, 19 nt, Homo sapiens
gcaaguggucauggcaguu

SEQ ID NO: 792172 - RNA, 19 nt, Homo sapiens
cagcuaaucuuggcuuuuc

SEQ ID NO: 792173 - RNA, 19 nt, Homo sapiens
uaucacagagccaaagaca

SEQ ID NO: 792174 - RNA, 19 nt, Homo sapiens
gaagcugaaggaccuaaac

SEQ ID NO: 792175 - RNA, 19 nt, Homo sapiens
gaugauuguggcagcagaa

SEQ ID NO: 792176 - RNA, 19 nt, Homo sapiens
ggaagcccucucccaagau

SEQ ID NO: 792177 - RNA, 19 nt, Homo sapiens
ccaagaugaaugaacuaau

SEQ ID NO: 792178 - RNA, 19 nt, Homo sapiens
gcagcaaggcgagcagauc

SEQ ID NO: 792179 - RNA, 19 nt, Homo sapiens
uccaagaaaugacgaagcu

SEQ ID NO: 792180 - RNA, 19 nt, Homo sapiens
ccaguuugaggacuugcua

SEQ ID NO: 792181 - RNA, 19 nt, Homo sapiens
ccucgagggucuguauauc

SEQ ID NO: 792182 - RNA, 19 nt, Homo sapiens
caaggauuccgugauguuc

SEQ ID NO: 792183 - RNA, 19 nt, Homo sapiens
gaagcugcgucuggucacu

SEQ ID NO: 792184 - RNA, 19 nt, Homo sapiens
gcccacaauggcuuugauu

SEQ ID NO: 792185 - RNA, 19 nt, Homo sapiens
ccguggagaccgugaagaa

SEQ ID NO: 792186 - RNA, 19 nt, Homo sapiens
gccagugccucugccaagu

SEQ ID NO: 792187 - RNA, 19 nt, Homo sapiens
accauugggugcuccaguu

SEQ ID NO: 792188 - RNA, 19 nt, Homo sapiens
acacccugcuccugaucuu

SEQ ID NO: 792189 - RNA, 19 nt, Homo sapiens
uugccgagcugucccucuu

SEQ ID NO: 792190 - RNA, 19 nt, Homo sapiens
cgaguuggccgaggaugga

SEQ ID NO: 792191 - RNA, 19 nt, Homo sapiens
uggagaccgugaagaagca

SEQ ID NO: 792192 - RNA, 19 nt, Homo sapiens
caaguugcacgcgcuuaga

SEQ ID NO: 792193 - RNA, 19 nt, Homo sapiens
ccaaguugcacgcgcuuag

SEQ ID NO: 792194 - RNA, 19 nt, Homo sapiens
cccagaagcagcuacacuu

SEQ ID NO: 792195 - RNA, 19 nt, Homo sapiens
ggagagugcugccaaguug

SEQ ID NO: 792196 - RNA, 19 nt, Homo sapiens
caagaugaaugaacuaaug

SEQ ID NO: 792197 - RNA, 19 nt, Homo sapiens
ugaaugaacuaauggagaa

SEQ ID NO: 792198 - RNA, 19 nt, Homo sapiens
caacagaggugaagaucca

SEQ ID NO: 792199 - RNA, 19 nt, Homo sapiens
uagaaagucuucagugaug

SEQ ID NO: 792200 - RNA, 19 nt, Homo sapiens
gaacuaauggagaaauaga

SEQ ID NO: 792201 - RNA, 19 nt, Homo sapiens
aauagaaagucuucaguga

SEQ ID NO: 792202 - RNA, 19 nt, Homo sapiens
ucacagagccaaagacaau

SEQ ID NO: 792203 - RNA, 19 nt, Homo sapiens
ggccgaggauggaugauug

SEQ ID NO: 792204 - RNA, 19 nt, Homo sapiens
gagucuagcuaccaagaug

SEQ ID NO: 792205 - RNA, 19 nt, Homo sapiens
caaagacaauucaggaacu

SEQ ID NO: 792206 - RNA, 19 nt, Homo sapiens
gaaauagaaagucuucagu

SEQ ID NO: 792207 - RNA, 19 nt, Homo sapiens
ggagaaauagaaagucuuc

SEQ ID NO: 792208 - RNA, 19 nt, Homo sapiens
gaagcccucucccaagauc

SEQ ID NO: 792209 - RNA, 19 nt, Homo sapiens
ggcagcagcuccgucauga

SEQ ID NO: 792210 - RNA, 19 nt, Homo sapiens
gugaagauccaagaaauga

SEQ ID NO: 792211 - RNA, 19 nt, Homo sapiens
acaaagaaagccuugguuu

SEQ ID NO: 792212 - RNA, 19 nt, Homo sapiens
gaggugaagauccaagaaa

SEQ ID NO: 792213 - RNA, 19 nt, Homo sapiens
ugacuuggacacaaagaaa

SEQ ID NO: 792214 - RNA, 19 nt, Homo sapiens
cuaccaagaugaaugaacu

SEQ ID NO: 792215 - RNA, 19 nt, Homo sapiens
aggaagcccucucccaaga

SEQ ID NO: 792216 - RNA, 19 nt, Homo sapiens
gcuuagaacggaguacuuu

SEQ ID NO: 792217 - RNA, 19 nt, Homo sapiens
ucaacaagcagagugauga

SEQ ID NO: 792218 - RNA, 19 nt, Homo sapiens
ggaguacuuugcacagcau

SEQ ID NO: 792219 - RNA, 19 nt, Homo sapiens
gcagcuccgucaugagucu

SEQ ID NO: 792220 - RNA, 19 nt, Homo sapiens
ggugaagauccaagaaaug

SEQ ID NO: 792221 - RNA, 19 nt, Homo sapiens
ugaaaggggucccaacaga

SEQ ID NO: 792222 - RNA, 19 nt, Homo sapiens
gcucuaggcagggaccuuu

SEQ ID NO: 792223 - RNA, 19 nt, Homo sapiens
uagcuaccaagaugaauga

SEQ ID NO: 792224 - RNA, 19 nt, Homo sapiens
ucuggucacuuccgacuuc

SEQ ID NO: 792225 - RNA, 19 nt, Homo sapiens
cagcagcuccgucaugagu

SEQ ID NO: 792226 - RNA, 19 nt, Homo sapiens
ucagcacccuagaccagaa

SEQ ID NO: 792227 - RNA, 19 nt, Homo sapiens
ggaagcugaaggaccuaaa

SEQ ID NO: 792228 - RNA, 19 nt, Homo sapiens
ucaugagucuagcuaccaa

SEQ ID NO: 792229 - RNA, 19 nt, Homo sapiens
caaguggucauggcaguug

SEQ ID NO: 792230 - RNA, 19 nt, Homo sapiens
gccaaagacaauucaggaa

SEQ ID NO: 792231 - RNA, 19 nt, Homo sapiens
aggugaagauccaagaaau

SEQ ID NO: 792232 - RNA, 19 nt, Homo sapiens
aaagacaauucaggaacug

SEQ ID NO: 792233 - RNA, 19 nt, Homo sapiens
cagaguaccgcuuggagau

SEQ ID NO: 792234 - RNA, 19 nt, Homo sapiens
gaaugaacuaauggagaaa

SEQ ID NO: 792235 - RNA, 19 nt, Homo sapiens
gcaaguggucauggcaguu

SEQ ID NO: 792236 - RNA, 19 nt, Homo sapiens
cagcuaaucuuggcuuuuc

SEQ ID NO: 792237 - RNA, 19 nt, Homo sapiens
uaucacagagccaaagaca

SEQ ID NO: 792238 - RNA, 19 nt, Homo sapiens
gaugauuguggcagcagaa

SEQ ID NO: 792239 - RNA, 19 nt, Homo sapiens
gaagcugaaggaccuaaac

SEQ ID NO: 792240 - RNA, 19 nt, Homo sapiens
ggaagcccucucccaagau

SEQ ID NO: 792241 - RNA, 19 nt, Homo sapiens
ccaagaugaaugaacuaau

SEQ ID NO: 792242 - RNA, 19 nt, Homo sapiens
gcagcaaggcgagcagauc

SEQ ID NO: 792243 - RNA, 19 nt, Homo sapiens
uccaagaaaugacgaagcu

SEQ ID NO: 792244 - RNA, 19 nt, Homo sapiens
ccucgagggucuguauauc

SEQ ID NO: 792245 - RNA, 19 nt, Homo sapiens
gaagcugcgucuggucacu

SEQ ID NO: 792246 - RNA, 19 nt, Homo sapiens
ccguggagaccgugaagaa

SEQ ID NO: 792247 - RNA, 19 nt, Homo sapiens
gccagugccucugccaagu

SEQ ID NO: 792248 - RNA, 19 nt, Homo sapiens
accauugggugcuccaguu

SEQ ID NO: 792249 - RNA, 19 nt, Homo sapiens
cgaguuggccgaggaugga

SEQ ID NO: 792250 - RNA, 19 nt, Homo sapiens
uggagaccgugaagaagca

SEQ ID NO: 792251 - RNA, 19 nt, Homo sapiens
caaguugcacgcgcuuaga

SEQ ID NO: 792252 - RNA, 19 nt, Homo sapiens
ccaaguugcacgcgcuuag

SEQ ID NO: 792253 - RNA, 19 nt, Homo sapiens
cccagaagcagcuacacuu

SEQ ID NO: 792254 - RNA, 19 nt, Homo sapiens
ggagagugcugccaaguug

SEQ ID NO: 792255 - RNA, 19 nt, Homo sapiens
caagaugaaugaacuaaug

SEQ ID NO: 792256 - RNA, 19 nt, Homo sapiens
ugaaugaacuaauggagaa

SEQ ID NO: 792257 - RNA, 19 nt, Homo sapiens
caacagaggugaagaucca

SEQ ID NO: 792258 - RNA, 19 nt, Homo sapiens
uagaaagucuucagugaug

SEQ ID NO: 792259 - RNA, 19 nt, Homo sapiens
gaacuaauggagaaauaga

SEQ ID NO: 792260 - RNA, 19 nt, Homo sapiens
aauagaaagucuucaguga

SEQ ID NO: 792261 - RNA, 19 nt, Homo sapiens
acaauggcuuugauuauga

SEQ ID NO: 792262 - RNA, 19 nt, Homo sapiens
ucacagagccaaagacaau

SEQ ID NO: 792263 - RNA, 19 nt, Homo sapiens
cacaauggcuuugauuaug

SEQ ID NO: 792264 - RNA, 19 nt, Homo sapiens
ggccgaggauggaugauug

SEQ ID NO: 792265 - RNA, 19 nt, Homo sapiens
gagucuagcuaccaagaug

SEQ ID NO: 792266 - RNA, 19 nt, Homo sapiens
caaagacaauucaggaacu

SEQ ID NO: 792267 - RNA, 19 nt, Homo sapiens
ccacaauggcuuugauuau

SEQ ID NO: 792268 - RNA, 19 nt, Homo sapiens
gaaauagaaagucuucagu

SEQ ID NO: 792269 - RNA, 19 nt, Homo sapiens
ggagaaauagaaagucuuc

SEQ ID NO: 792270 - RNA, 19 nt, Homo sapiens
gaagcccucucccaagauc

SEQ ID NO: 792271 - RNA, 19 nt, Homo sapiens
ggcagcagcuccgucauga

SEQ ID NO: 792272 - RNA, 19 nt, Homo sapiens
gugaagauccaagaaauga

SEQ ID NO: 792273 - RNA, 19 nt, Homo sapiens
cgagucuggugcccuagua

SEQ ID NO: 792274 - RNA, 19 nt, Homo sapiens
gaggugaagauccaagaaa

SEQ ID NO: 792275 - RNA, 19 nt, Homo sapiens
ccggaaggcuggcuuugau

SEQ ID NO: 792276 - RNA, 19 nt, Homo sapiens
cuaccaagaugaaugaacu

SEQ ID NO: 792277 - RNA, 19 nt, Homo sapiens
aggaagcccucucccaaga

SEQ ID NO: 792278 - RNA, 19 nt, Homo sapiens
gcuuagaacggaguacuuu

SEQ ID NO: 792279 - RNA, 19 nt, Homo sapiens
ucaacaagcagagugauga

SEQ ID NO: 792280 - RNA, 19 nt, Homo sapiens
ggaguacuuugcacagcau

SEQ ID NO: 792281 - RNA, 19 nt, Homo sapiens
uggcuuugauuaugauuuc

SEQ ID NO: 792282 - RNA, 19 nt, Homo sapiens
caauggcuuugauuaugau

SEQ ID NO: 792283 - RNA, 19 nt, Homo sapiens
gcagcuccgucaugagucu

SEQ ID NO: 792284 - RNA, 19 nt, Homo sapiens
gccgagcugucccucuuug

SEQ ID NO: 792285 - RNA, 19 nt, Homo sapiens
ggugaagauccaagaaaug

SEQ ID NO: 792286 - RNA, 19 nt, Homo sapiens
ugaaaggggucccaacaga

SEQ ID NO: 792287 - RNA, 19 nt, Homo sapiens
uagcuaccaagaugaauga

SEQ ID NO: 792288 - RNA, 19 nt, Homo sapiens
ucuggucacuuccgacuuc

SEQ ID NO: 792289 - RNA, 19 nt, Homo sapiens
ggaagcugaaggaccuaaa

SEQ ID NO: 792290 - RNA, 19 nt, Homo sapiens
cagcagcuccgucaugagu

SEQ ID NO: 792291 - RNA, 19 nt, Homo sapiens
ucagcacccuagaccagaa

SEQ ID NO: 792292 - RNA, 19 nt, Homo sapiens
ucaugagucuagcuaccaa

SEQ ID NO: 792293 - RNA, 19 nt, Homo sapiens
caaguggucauggcaguug

SEQ ID NO: 792294 - RNA, 19 nt, Homo sapiens
cccacaauggcuuugauua

SEQ ID NO: 792295 - RNA, 19 nt, Homo sapiens
gccaaagacaauucaggaa

SEQ ID NO: 792296 - RNA, 19 nt, Homo sapiens
aggugaagauccaagaaau

SEQ ID NO: 792297 - RNA, 19 nt, Homo sapiens
aaagacaauucaggaacug

SEQ ID NO: 792298 - RNA, 19 nt, Homo sapiens
cagaguaccgcuuggagau

SEQ ID NO: 792299 - RNA, 19 nt, Homo sapiens
gaaugaacuaauggagaaa

SEQ ID NO: 792300 - RNA, 19 nt, Homo sapiens
gcaaguggucauggcaguu

SEQ ID NO: 792301 - RNA, 19 nt, Homo sapiens
cagcuaaucuuggcuuuuc

SEQ ID NO: 792302 - RNA, 19 nt, Homo sapiens
ucggacaguuugaggacuu

SEQ ID NO: 792303 - RNA, 19 nt, Homo sapiens
uaucacagagccaaagaca

SEQ ID NO: 792304 - RNA, 19 nt, Homo sapiens
gaugauuguggcagcagaa

SEQ ID NO: 792305 - RNA, 19 nt, Homo sapiens
ggaagcccucucccaagau

SEQ ID NO: 792306 - RNA, 19 nt, Homo sapiens
ccaagaugaaugaacuaau

SEQ ID NO: 792307 - RNA, 19 nt, Homo sapiens
gcagcaaggcgagcagauc

SEQ ID NO: 792308 - RNA, 19 nt, Homo sapiens
gaagcugaaggaccuaaac

SEQ ID NO: 792309 - RNA, 19 nt, Homo sapiens
uccaagaaaugacgaagcu

SEQ ID NO: 792310 - RNA, 19 nt, Homo sapiens
ccucgagggucuguauauc

SEQ ID NO: 792311 - RNA, 19 nt, Homo sapiens
gaagcugcgucuggucacu

SEQ ID NO: 792312 - RNA, 19 nt, Homo sapiens
gcccacaauggcuuugauu

SEQ ID NO: 792313 - RNA, 19 nt, Homo sapiens
ccguggagaccgugaagaa

SEQ ID NO: 792314 - RNA, 19 nt, Homo sapiens
gccagugccucugccaagu

SEQ ID NO: 792315 - RNA, 19 nt, Homo sapiens
accauugggugcuccaguu

SEQ ID NO: 792316 - RNA, 19 nt, Homo sapiens
acacccugcuccugaucuu

SEQ ID NO: 792317 - RNA, 19 nt, Homo sapiens
uugccgagcugucccucuu

SEQ ID NO: 792318 - RNA, 19 nt, Homo sapiens
cgaguuggccgaggaugga

SEQ ID NO: 792319 - RNA, 19 nt, Homo sapiens
uggagaccgugaagaagca

SEQ ID NO: 792320 - RNA, 19 nt, Homo sapiens
caaguugcacgcgcuuaga

SEQ ID NO: 792321 - RNA, 19 nt, Homo sapiens
ccaaguugcacgcgcuuag

SEQ ID NO: 792322 - RNA, 19 nt, Homo sapiens
cccagaagcagcuacacuu

SEQ ID NO: 792323 - RNA, 19 nt, Homo sapiens
ggagagugcugccaaguug

SEQ ID NO: 792324 - RNA, 19 nt, Homo sapiens
caagaugaaugaacuaaug

SEQ ID NO: 792325 - RNA, 19 nt, Homo sapiens
ugaaugaacuaauggagaa

SEQ ID NO: 792326 - RNA, 19 nt, Homo sapiens
caacagaggugaagaucca

SEQ ID NO: 792327 - RNA, 19 nt, Homo sapiens
uagaaagucuucagugaug

SEQ ID NO: 792328 - RNA, 19 nt, Homo sapiens
gaacuaauggagaaauaga

SEQ ID NO: 792329 - RNA, 19 nt, Homo sapiens
aauagaaagucuucaguga

SEQ ID NO: 792330 - RNA, 19 nt, Homo sapiens
acaauggcuuugauuauga

SEQ ID NO: 792331 - RNA, 19 nt, Homo sapiens
ucacagagccaaagacaau

SEQ ID NO: 792332 - RNA, 19 nt, Homo sapiens
cacaauggcuuugauuaug

SEQ ID NO: 792333 - RNA, 19 nt, Homo sapiens
ggccgaggauggaugauug

SEQ ID NO: 792334 - RNA, 19 nt, Homo sapiens
gagucuagcuaccaagaug

SEQ ID NO: 792335 - RNA, 19 nt, Homo sapiens
caaagacaauucaggaacu

SEQ ID NO: 792336 - RNA, 19 nt, Homo sapiens
ccacaauggcuuugauuau

SEQ ID NO: 792337 - RNA, 19 nt, Homo sapiens
gaaauagaaagucuucagu

SEQ ID NO: 792338 - RNA, 19 nt, Homo sapiens
ggagaaauagaaagucuuc

SEQ ID NO: 792339 - RNA, 19 nt, Homo sapiens
gaagcccucucccaagauc

SEQ ID NO: 792340 - RNA, 19 nt, Homo sapiens
ggcagcagcuccgucauga

SEQ ID NO: 792341 - RNA, 19 nt, Homo sapiens
gugaagauccaagaaauga

SEQ ID NO: 792342 - RNA, 19 nt, Homo sapiens
cgagucuggugcccuagua

SEQ ID NO: 792343 - RNA, 19 nt, Homo sapiens
gaggugaagauccaagaaa

SEQ ID NO: 792344 - RNA, 19 nt, Homo sapiens
ccggaaggcuggcuuugau

SEQ ID NO: 792345 - RNA, 19 nt, Homo sapiens
cuaccaagaugaaugaacu

SEQ ID NO: 792346 - RNA, 19 nt, Homo sapiens
aggaagcccucucccaaga

SEQ ID NO: 792347 - RNA, 19 nt, Homo sapiens
gcuuagaacggaguacuuu

SEQ ID NO: 792348 - RNA, 19 nt, Homo sapiens
ucaacaagcagagugauga

SEQ ID NO: 792349 - RNA, 19 nt, Homo sapiens
gcucuaguuugaggacuug

SEQ ID NO: 792350 - RNA, 19 nt, Homo sapiens
ggaguacuuugcacagcau

SEQ ID NO: 792351 - RNA, 19 nt, Homo sapiens
uggcuuugauuaugauuuc

SEQ ID NO: 792352 - RNA, 19 nt, Homo sapiens
caauggcuuugauuaugau

SEQ ID NO: 792353 - RNA, 19 nt, Homo sapiens
gcagcuccgucaugagucu

SEQ ID NO: 792354 - RNA, 19 nt, Homo sapiens
gccgagcugucccucuuug

SEQ ID NO: 792355 - RNA, 19 nt, Homo sapiens
ggugaagauccaagaaaug

SEQ ID NO: 792356 - RNA, 19 nt, Homo sapiens
ugaaaggggucccaacaga

SEQ ID NO: 792357 - RNA, 19 nt, Homo sapiens
uagcuaccaagaugaauga

SEQ ID NO: 792358 - RNA, 19 nt, Homo sapiens
ucuggucacuuccgacuuc

SEQ ID NO: 792359 - RNA, 19 nt, Homo sapiens
ggaagcugaaggaccuaaa

SEQ ID NO: 792360 - RNA, 19 nt, Homo sapiens
ccacguugugcucuaguuu

SEQ ID NO: 792361 - RNA, 19 nt, Homo sapiens
cagcagcuccgucaugagu

SEQ ID NO: 792362 - RNA, 19 nt, Homo sapiens
ucagcacccuagaccagaa

SEQ ID NO: 792363 - RNA, 19 nt, Homo sapiens
ucaugagucuagcuaccaa

SEQ ID NO: 792364 - RNA, 19 nt, Homo sapiens
caaguggucauggcaguug

SEQ ID NO: 792365 - RNA, 19 nt, Homo sapiens
cccacaauggcuuugauua

SEQ ID NO: 792366 - RNA, 19 nt, Homo sapiens
gccaaagacaauucaggaa

SEQ ID NO: 792367 - RNA, 19 nt, Homo sapiens
aggugaagauccaagaaau

SEQ ID NO: 792368 - RNA, 19 nt, Homo sapiens
cagaguaccgcuuggagau

SEQ ID NO: 792369 - RNA, 19 nt, Homo sapiens
aaagacaauucaggaacug

SEQ ID NO: 792370 - RNA, 19 nt, Homo sapiens
gaaugaacuaauggagaaa

SEQ ID NO: 792371 - RNA, 19 nt, Homo sapiens
acguugugcucuaguuuga

SEQ ID NO: 792372 - RNA, 19 nt, Homo sapiens
gcaaguggucauggcaguu

SEQ ID NO: 792373 - RNA, 19 nt, Homo sapiens
cagcuaaucuuggcuuuuc

SEQ ID NO: 792374 - RNA, 19 nt, Homo sapiens
uaucacagagccaaagaca

SEQ ID NO: 792375 - RNA, 19 nt, Homo sapiens
gaagcugaaggaccuaaac

SEQ ID NO: 792376 - RNA, 19 nt, Homo sapiens
gaugauuguggcagcagaa

SEQ ID NO: 792377 - RNA, 19 nt, Homo sapiens
ggaagcccucucccaagau

SEQ ID NO: 792378 - RNA, 19 nt, Homo sapiens
ccaagaugaaugaacuaau

SEQ ID NO: 792379 - RNA, 19 nt, Homo sapiens
gcagcaaggcgagcagauc

SEQ ID NO: 792380 - RNA, 19 nt, Homo sapiens
uccaagaaaugacgaagcu

SEQ ID NO: 792381 - RNA, 19 nt, Homo sapiens
ccucgagggucuguauauc

SEQ ID NO: 792382 - RNA, 19 nt, Homo sapiens
gaagcugcgucuggucacu

SEQ ID NO: 792383 - RNA, 19 nt, Homo sapiens
gcccacaauggcuuugauu

SEQ ID NO: 792384 - RNA, 19 nt, Homo sapiens
ccguggagaccgugaagaa

SEQ ID NO: 792385 - RNA, 19 nt, Homo sapiens
gccagugccucugccaagu

SEQ ID NO: 792386 - RNA, 19 nt, Homo sapiens
accauugggugcuccaguu

SEQ ID NO: 792387 - RNA, 19 nt, Homo sapiens
acacccugcuccugaucuu

SEQ ID NO: 792388 - RNA, 19 nt, Homo sapiens
uugccgagcugucccucuu

SEQ ID NO: 792389 - RNA, 19 nt, Homo sapiens
cgaguuggccgaggaugga

SEQ ID NO: 792390 - RNA, 19 nt, Homo sapiens
uggagaccgugaagaagca

SEQ ID NO: 792391 - RNA, 19 nt, Homo sapiens
caaguugcacgcgcuuaga

SEQ ID NO: 792392 - RNA, 19 nt, Homo sapiens
ccaaguugcacgcgcuuag

SEQ ID NO: 792393 - RNA, 19 nt, Homo sapiens
cccagaagcagcuacacuu

SEQ ID NO: 792394 - RNA, 19 nt, Homo sapiens
ggagagugcugccaaguug

SEQ ID NO: 792395 - RNA, 19 nt, Homo sapiens
caagaugaaugaacuaaug

SEQ ID NO: 792396 - RNA, 19 nt, Homo sapiens
ugaaugaacuaauggagaa

SEQ ID NO: 792397 - RNA, 19 nt, Homo sapiens
caacagaggugaagaucca

SEQ ID NO: 792398 - RNA, 19 nt, Homo sapiens
uagaaagucuucagugaug

SEQ ID NO: 792399 - RNA, 19 nt, Homo sapiens
gaacuaauggagaaauaga

SEQ ID NO: 792400 - RNA, 19 nt, Homo sapiens
aauagaaagucuucaguga

SEQ ID NO: 792401 - RNA, 19 nt, Homo sapiens
acaauggcuuugauuauga

SEQ ID NO: 792402 - RNA, 19 nt, Homo sapiens
ucacagagccaaagacaau

SEQ ID NO: 792403 - RNA, 19 nt, Homo sapiens
cacaauggcuuugauuaug

SEQ ID NO: 792404 - RNA, 19 nt, Homo sapiens
ggccgaggauggaugauug

SEQ ID NO: 792405 - RNA, 19 nt, Homo sapiens
gagucuagcuaccaagaug

SEQ ID NO: 792406 - RNA, 19 nt, Homo sapiens
caaagacaauucaggaacu

SEQ ID NO: 792407 - RNA, 19 nt, Homo sapiens
ccacaauggcuuugauuau

SEQ ID NO: 792408 - RNA, 19 nt, Homo sapiens
gaaauagaaagucuucagu

SEQ ID NO: 792409 - RNA, 19 nt, Homo sapiens
ggagaaauagaaagucuuc

SEQ ID NO: 792410 - RNA, 19 nt, Homo sapiens
gaagcccucucccaagauc

SEQ ID NO: 792411 - RNA, 19 nt, Homo sapiens
ggcagcagcuccgucauga

SEQ ID NO: 792412 - RNA, 19 nt, Homo sapiens
gugaagauccaagaaauga

SEQ ID NO: 792413 - RNA, 19 nt, Homo sapiens
cgagucuggugcccuagua

SEQ ID NO: 792414 - RNA, 19 nt, Homo sapiens
gaggugaagauccaagaaa

SEQ ID NO: 792415 - RNA, 19 nt, Homo sapiens
ccggaaggcuggcuuugau

SEQ ID NO: 792416 - RNA, 19 nt, Homo sapiens
cuaccaagaugaaugaacu

SEQ ID NO: 792417 - RNA, 19 nt, Homo sapiens
aggaagcccucucccaaga

SEQ ID NO: 792418 - RNA, 19 nt, Homo sapiens
ucaacaagcagagugauga

SEQ ID NO: 792419 - RNA, 19 nt, Homo sapiens
gcucuaguuugaggacuug

SEQ ID NO: 792420 - RNA, 19 nt, Homo sapiens
uggcuuugauuaugauuuc

SEQ ID NO: 792421 - RNA, 19 nt, Homo sapiens
caauggcuuugauuaugau

SEQ ID NO: 792422 - RNA, 19 nt, Homo sapiens
gcagcuccgucaugagucu

SEQ ID NO: 792423 - RNA, 19 nt, Homo sapiens
gccgagcugucccucuuug

SEQ ID NO: 792424 - RNA, 19 nt, Homo sapiens
ggugaagauccaagaaaug

SEQ ID NO: 792425 - RNA, 19 nt, Homo sapiens
ugaaaggggucccaacaga

SEQ ID NO: 792426 - RNA, 19 nt, Homo sapiens
uagcuaccaagaugaauga

SEQ ID NO: 792427 - RNA, 19 nt, Homo sapiens
ggaagcugaaggaccuaaa

SEQ ID NO: 792428 - RNA, 19 nt, Homo sapiens
ccacguugugcucuaguuu

SEQ ID NO: 792429 - RNA, 19 nt, Homo sapiens
cagcagcuccgucaugagu

SEQ ID NO: 792430 - RNA, 19 nt, Homo sapiens
ucaugagucuagcuaccaa

SEQ ID NO: 792431 - RNA, 19 nt, Homo sapiens
caaguggucauggcaguug

SEQ ID NO: 792432 - RNA, 19 nt, Homo sapiens
cccacaauggcuuugauua

SEQ ID NO: 792433 - RNA, 19 nt, Homo sapiens
aggugaagauccaagaaau

SEQ ID NO: 792434 - RNA, 19 nt, Homo sapiens
gccaaagacaauucaggaa

SEQ ID NO: 792435 - RNA, 19 nt, Homo sapiens
aaagacaauucaggaacug

SEQ ID NO: 792436 - RNA, 19 nt, Homo sapiens
cagaguaccgcuuggagau

SEQ ID NO: 792437 - RNA, 19 nt, Homo sapiens
gaaugaacuaauggagaaa

SEQ ID NO: 792438 - RNA, 19 nt, Homo sapiens
acguugugcucuaguuuga

SEQ ID NO: 792439 - RNA, 19 nt, Homo sapiens
gcaaguggucauggcaguu

SEQ ID NO: 792440 - RNA, 19 nt, Homo sapiens
uaucacagagccaaagaca

SEQ ID NO: 792441 - RNA, 19 nt, Homo sapiens
gaagcugaaggaccuaaac

SEQ ID NO: 792442 - RNA, 19 nt, Homo sapiens
gaugauuguggcagcagaa

SEQ ID NO: 792443 - RNA, 19 nt, Homo sapiens
ggaagcccucucccaagau

SEQ ID NO: 792444 - RNA, 19 nt, Homo sapiens
ccaagaugaaugaacuaau

SEQ ID NO: 792445 - RNA, 19 nt, Homo sapiens
gcagcaaggcgagcagauc

SEQ ID NO: 792446 - RNA, 19 nt, Homo sapiens
uccaagaaaugacgaagcu

SEQ ID NO: 792447 - RNA, 19 nt, Homo sapiens
ccucgagggucuguauauc

SEQ ID NO: 792448 - RNA, 19 nt, Homo sapiens
gcccacaauggcuuugauu

SEQ ID NO: 792449 - RNA, 19 nt, Homo sapiens
ccguggagaccgugaagaa

SEQ ID NO: 792450 - RNA, 19 nt, Homo sapiens
gccagugccucugccaagu

SEQ ID NO: 792451 - RNA, 19 nt, Homo sapiens
accauugggugcuccaguu

SEQ ID NO: 792452 - RNA, 19 nt, Homo sapiens
acacccugcuccugaucuu

SEQ ID NO: 792453 - RNA, 19 nt, Homo sapiens
uugccgagcugucccucuu

SEQ ID NO: 792454 - RNA, 19 nt, Homo sapiens
cgaguuggccgaggaugga

SEQ ID NO: 792455 - RNA, 19 nt, Homo sapiens
uggagaccgugaagaagca

SEQ ID NO: 792456 - RNA, 19 nt, Homo sapiens
caaguugcacgcgcuuaga

SEQ ID NO: 792457 - RNA, 19 nt, Homo sapiens
ccaaguugcacgcgcuuag

SEQ ID NO: 792458 - RNA, 19 nt, Homo sapiens
cccagaagcagcuacacuu

SEQ ID NO: 792459 - RNA, 19 nt, Homo sapiens
caaagaagaugaccaaaug

SEQ ID NO: 792460 - RNA, 19 nt, Homo sapiens
ccauaaaccuuguuacaua

SEQ ID NO: 792461 - RNA, 19 nt, Homo sapiens
ccaaggagcuguccacauu

SEQ ID NO: 792462 - RNA, 19 nt, Homo sapiens
gaagagagaaggcaaagaa

SEQ ID NO: 792463 - RNA, 19 nt, Homo sapiens
gaagauacuacacacuuua

SEQ ID NO: 792464 - RNA, 19 nt, Homo sapiens
caaagaaccucugguguug

SEQ ID NO: 792465 - RNA, 19 nt, Homo sapiens
cccacaaacugacaaauua

SEQ ID NO: 792466 - RNA, 19 nt, Homo sapiens
agaaaggccuguucaacua

SEQ ID NO: 792467 - RNA, 19 nt, Homo sapiens
gcaaagaaccucugguguu

SEQ ID NO: 792468 - RNA, 19 nt, Homo sapiens
ggaguaaguuugugaaugg

SEQ ID NO: 792469 - RNA, 19 nt, Homo sapiens
gcugaaugauagacaaaua

SEQ ID NO: 792470 - RNA, 19 nt, Homo sapiens
gaccaugacugaugcuuau

SEQ ID NO: 792471 - RNA, 19 nt, Homo sapiens
caacaagagucacauccaa

SEQ ID NO: 792472 - RNA, 19 nt, Homo sapiens
gugaggaacugaccauuau

SEQ ID NO: 792473 - RNA, 19 nt, Homo sapiens
gaacaucggcuacgucauc

SEQ ID NO: 792474 - RNA, 19 nt, Homo sapiens
uaaggagguuaaagaagua

SEQ ID NO: 792475 - RNA, 19 nt, Homo sapiens
cgaagauacuacacacuuu

SEQ ID NO: 792476 - RNA, 19 nt, Homo sapiens
gcaaagaagaugaccaaau

SEQ ID NO: 792477 - RNA, 19 nt, Homo sapiens
uaagaauccuucaggcauu

SEQ ID NO: 792478 - RNA, 19 nt, Homo sapiens
uaaauagucugugcagguu

SEQ ID NO: 792479 - RNA, 19 nt, Homo sapiens
gagauucaccucccacaaa

SEQ ID NO: 792480 - RNA, 19 nt, Homo sapiens
aaaggcaaacgaccaauua

SEQ ID NO: 792481 - RNA, 19 nt, Homo sapiens
cugcgaaucugacguauau

SEQ ID NO: 792482 - RNA, 19 nt, Homo sapiens
gaagaucagggcagcuuaa

SEQ ID NO: 792483 - RNA, 19 nt, Homo sapiens
cgagaauccuuacaccaaa

SEQ ID NO: 792484 - RNA, 19 nt, Homo sapiens
gaucagggcagcuuaagug

SEQ ID NO: 792485 - RNA, 19 nt, Homo sapiens
guaaguuugugaauggaaa

SEQ ID NO: 792486 - RNA, 19 nt, Homo sapiens
ggauugcugcucuccauua

SEQ ID NO: 792487 - RNA, 19 nt, Homo sapiens
acaauggucuggauggaaa

SEQ ID NO: 792488 - RNA, 19 nt, Homo sapiens
caagaucacuguccuagac

SEQ ID NO: 792489 - RNA, 19 nt, Homo sapiens
gcagcuagccagcaucaaa

SEQ ID NO: 792490 - RNA, 19 nt, Homo sapiens
gaauacaggcucucuaagu

SEQ ID NO: 792491 - RNA, 19 nt, Homo sapiens
ggucaacaauaaugagaau

SEQ ID NO: 792492 - RNA, 19 nt, Homo sapiens
gaucucaaccuuuguuuag

SEQ ID NO: 792493 - RNA, 19 nt, Homo sapiens
gccagaugguggaggaaua

SEQ ID NO: 792494 - RNA, 19 nt, Homo sapiens
guugaaagguggacuuagu

SEQ ID NO: 792495 - RNA, 19 nt, Homo sapiens
uaagugugcaaacaaguua

SEQ ID NO: 792496 - RNA, 19 nt, Homo sapiens
gggaguaaguuugugaaug

SEQ ID NO: 792497 - RNA, 19 nt, Homo sapiens
ugacguauaugcccucauc

SEQ ID NO: 792498 - RNA, 19 nt, Homo sapiens
gagaaaggccuguucaacu

SEQ ID NO: 792499 - RNA, 19 nt, Homo sapiens
gcagcugaaugauagacaa

SEQ ID NO: 792500 - RNA, 19 nt, Homo sapiens
ccacaaacugacaaauuaa

SEQ ID NO: 792501 - RNA, 19 nt, Homo sapiens
gaggauggauucugguuuu

SEQ ID NO: 792502 - RNA, 19 nt, Homo sapiens
ccaccaucgucaucgcuua

SEQ ID NO: 792503 - RNA, 19 nt, Homo sapiens
aaggagcuguccacauuaa

SEQ ID NO: 792504 - RNA, 19 nt, Homo sapiens
gcaggcccuucauggagua

SEQ ID NO: 792505 - RNA, 19 nt, Homo sapiens
gcuuggagauagaaaggaa

SEQ ID NO: 792506 - RNA, 19 nt, Homo sapiens
gaggaacugaccauuauau

SEQ ID NO: 792507 - RNA, 19 nt, Homo sapiens
caugacugaugcuuauaaa

SEQ ID NO: 792508 - RNA, 19 nt, Homo sapiens
ggaucucaaccuuuguuua

SEQ ID NO: 792509 - RNA, 19 nt, Homo sapiens
gcucacuggugcaaagaga

SEQ ID NO: 792510 - RNA, 19 nt, Homo sapiens
gaucaaugaagccgaguga

SEQ ID NO: 792511 - RNA, 19 nt, Homo sapiens
cuucuugaauugccaguuu

SEQ ID NO: 792512 - RNA, 19 nt, Homo sapiens
caaaggcaaacgaccaauu

SEQ ID NO: 792513 - RNA, 19 nt, Homo sapiens
aaagguggacuuaguaguu

SEQ ID NO: 792514 - RNA, 19 nt, Homo sapiens
aagaaccucugguguugaa

SEQ ID NO: 792515 - RNA, 19 nt, Homo sapiens
ggagguuaaagaaguaauu

SEQ ID NO: 792516 - RNA, 19 nt, Homo sapiens
caaggagcuguccacauua

SEQ ID NO: 792517 - RNA, 19 nt, Homo sapiens
caaugaagccgagugaaug

SEQ ID NO: 792518 - RNA, 19 nt, Homo sapiens
cuacacacuuuaaaccaau

SEQ ID NO: 792519 - RNA, 19 nt, Homo sapiens
guucauagaccgaagauac

SEQ ID NO: 792520 - RNA, 19 nt, Homo sapiens
gagaauccuuacaccaaag

SEQ ID NO: 792521 - RNA, 19 nt, Homo sapiens
gggaaggcaaggacucuuu

SEQ ID NO: 792522 - RNA, 19 nt, Homo sapiens
ccaagcagcuagccagcau

SEQ ID NO: 792523 - RNA, 19 nt, Homo sapiens
ggagauagaaaggaauuca

SEQ ID NO: 792524 - RNA, 19 nt, Homo sapiens
ugaagaggcuuuugaguuc

SEQ ID NO: 792525 - RNA, 19 nt, Homo sapiens
uaacugugccgauaagauc

SEQ ID NO: 792526 - RNA, 19 nt, Homo sapiens
aagguggacuuaguaguuu

SEQ ID NO: 792527 - RNA, 19 nt, Homo sapiens
cuugaguucuucuugaauu

SEQ ID NO: 792528 - RNA, 19 nt, Homo sapiens
aaaauaaucuaccccaaug

SEQ ID NO: 792529 - RNA, 19 nt, Homo sapiens
gcgaguccauagcugaaga

SEQ ID NO: 792530 - RNA, 19 nt, Homo sapiens
gaggaaggaggauggauuc

SEQ ID NO: 792531 - RNA, 19 nt, Homo sapiens
uuaugaaacugucuugagu

SEQ ID NO: 792532 - RNA, 19 nt, Homo sapiens
ucgagucccugaagagaga

SEQ ID NO: 792533 - RNA, 19 nt, Homo sapiens
ggaggauggauucugguuu

SEQ ID NO: 792534 - RNA, 19 nt, Homo sapiens
agagucaccugccgaguca

SEQ ID NO: 792535 - RNA, 19 nt, Homo sapiens
aauacaggcucucuaaguc

SEQ ID NO: 792536 - RNA, 19 nt, Homo sapiens
ucaaugaagccgagugaau

SEQ ID NO: 792537 - RNA, 19 nt, Homo sapiens
gagaagaucagggcagcuu

SEQ ID NO: 792538 - RNA, 19 nt, Homo sapiens
ugucuugaguucuucuuga

SEQ ID NO: 792539 - RNA, 19 nt, Homo sapiens
ggcaaacgaccaauuaucu

SEQ ID NO: 792540 - RNA, 19 nt, Homo sapiens
ugaccaugacugaugcuua

SEQ ID NO: 792541 - RNA, 19 nt, Homo sapiens
cucaggaucucaaccuuug

SEQ ID NO: 792542 - RNA, 19 nt, Homo sapiens
caacgucaccacucaucuu

SEQ ID NO: 792543 - RNA, 19 nt, Homo sapiens
gagaauaccaaugaaccaa

SEQ ID NO: 792544 - RNA, 19 nt, Homo sapiens
caaacugacaaauuaagga

SEQ ID NO: 792545 - RNA, 19 nt, Homo sapiens
gauugcugcucuccauuag

SEQ ID NO: 792546 - RNA, 19 nt, Homo sapiens
ugccuucacuggcuucuug

SEQ ID NO: 792547 - RNA, 19 nt, Homo sapiens
ggaacugaccauuauaugc

SEQ ID NO: 792548 - RNA, 19 nt, Homo sapiens
guaguugggaguaaguuug

SEQ ID NO: 792549 - RNA, 19 nt, Homo sapiens
ccaugacugaugcuuauaa

SEQ ID NO: 792550 - RNA, 19 nt, Homo sapiens
caaccuuuguuuagacucu

SEQ ID NO: 792551 - RNA, 19 nt, Homo sapiens
ccaaaugcagcaagaguca

SEQ ID NO: 792552 - RNA, 19 nt, Homo sapiens
gauagaaaggaauucaaca

SEQ ID NO: 792553 - RNA, 19 nt, Homo sapiens
gagauagaaaggaauucaa

SEQ ID NO: 792554 - RNA, 19 nt, Homo sapiens
caucuugcccuuccuguuc

SEQ ID NO: 792555 - RNA, 19 nt, Homo sapiens
gaucacuguccuagacuug

SEQ ID NO: 792556 - RNA, 19 nt, Homo sapiens
ucacuggcuucuugugcaa

SEQ ID NO: 792557 - RNA, 19 nt, Homo sapiens
gugaauggaaacaaacuug

SEQ ID NO: 792558 - RNA, 19 nt, Homo sapiens
ugacaauggucuggaugga

SEQ ID NO: 792559 - RNA, 19 nt, Homo sapiens
ccauaaaccuuguuacaua

SEQ ID NO: 792560 - RNA, 19 nt, Homo sapiens
gagcagguguucaugauaa

SEQ ID NO: 792561 - RNA, 19 nt, Homo sapiens
gaagauacuacacacuuua

SEQ ID NO: 792562 - RNA, 19 nt, Homo sapiens
cccacaaacugacaaauua

SEQ ID NO: 792563 - RNA, 19 nt, Homo sapiens
agaaaggccuguucaacua

SEQ ID NO: 792564 - RNA, 19 nt, Homo sapiens
ggaguaaguuugugaaugg

SEQ ID NO: 792565 - RNA, 19 nt, Homo sapiens
ggaagaugcucugguggua

SEQ ID NO: 792566 - RNA, 19 nt, Homo sapiens
gcugaaugauagacaaaua

SEQ ID NO: 792567 - RNA, 19 nt, Homo sapiens
gaccaugacugaugcuuau

SEQ ID NO: 792568 - RNA, 19 nt, Homo sapiens
gugaggaacugaccauuau

SEQ ID NO: 792569 - RNA, 19 nt, Homo sapiens
gcuauugucuuaccauaau

SEQ ID NO: 792570 - RNA, 19 nt, Homo sapiens
gaacaucggcuacgucauc

SEQ ID NO: 792571 - RNA, 19 nt, Homo sapiens
gagguggacuuaguaguuu

SEQ ID NO: 792572 - RNA, 19 nt, Homo sapiens
uaaggagguuaaagaagua

SEQ ID NO: 792573 - RNA, 19 nt, Homo sapiens
cgaagauacuacacacuuu

SEQ ID NO: 792574 - RNA, 19 nt, Homo sapiens
gaaacaacacggaucaaga

SEQ ID NO: 792575 - RNA, 19 nt, Homo sapiens
uaagaauccuucaggcauu

SEQ ID NO: 792576 - RNA, 19 nt, Homo sapiens
uaaauagucugugcagguu

SEQ ID NO: 792577 - RNA, 19 nt, Homo sapiens
gagauucaccucccacaaa

SEQ ID NO: 792578 - RNA, 19 nt, Homo sapiens
aaaggcaaacgaccaauua

SEQ ID NO: 792579 - RNA, 19 nt, Homo sapiens
gaagaucagggcagcuuaa

SEQ ID NO: 792580 - RNA, 19 nt, Homo sapiens
cgagaauccuuacaccaaa

SEQ ID NO: 792581 - RNA, 19 nt, Homo sapiens
ugaugugucuagccucuua

SEQ ID NO: 792582 - RNA, 19 nt, Homo sapiens
gaucagggcagcuuaagug

SEQ ID NO: 792583 - RNA, 19 nt, Homo sapiens
guaaguuugugaauggaaa

SEQ ID NO: 792584 - RNA, 19 nt, Homo sapiens
ggauugcugcucuccauua

SEQ ID NO: 792585 - RNA, 19 nt, Homo sapiens
acaauggucuggauggaaa

SEQ ID NO: 792586 - RNA, 19 nt, Homo sapiens
gugauucccaggauauuua

SEQ ID NO: 792587 - RNA, 19 nt, Homo sapiens
uaagugugcaaacaaguua

SEQ ID NO: 792588 - RNA, 19 nt, Homo sapiens
gggaguaaguuugugaaug

SEQ ID NO: 792589 - RNA, 19 nt, Homo sapiens
ucuagccucuuacaaauga

SEQ ID NO: 792590 - RNA, 19 nt, Homo sapiens
gagaaaggccuguucaacu

SEQ ID NO: 792591 - RNA, 19 nt, Homo sapiens
gcagcugaaugauagacaa

SEQ ID NO: 792592 - RNA, 19 nt, Homo sapiens
ccacaaacugacaaauuaa

SEQ ID NO: 792593 - RNA, 19 nt, Homo sapiens
gauccuagaccuccuaauc

SEQ ID NO: 792594 - RNA, 19 nt, Homo sapiens
gaggauggauucugguuuu

SEQ ID NO: 792595 - RNA, 19 nt, Homo sapiens
ccaccaucgucaucgcuua

SEQ ID NO: 792596 - RNA, 19 nt, Homo sapiens
gcagagcagguguucauga

SEQ ID NO: 792597 - RNA, 19 nt, Homo sapiens
gcuuggagauagaaaggaa

SEQ ID NO: 792598 - RNA, 19 nt, Homo sapiens
gaggaacugaccauuauau

SEQ ID NO: 792599 - RNA, 19 nt, Homo sapiens
caugacugaugcuuauaaa

SEQ ID NO: 792600 - RNA, 19 nt, Homo sapiens
agaggaggauagccaauga

SEQ ID NO: 792601 - RNA, 19 nt, Homo sapiens
gcagucgacuuggaagaug

SEQ ID NO: 792602 - RNA, 19 nt, Homo sapiens
gaggauagccaaugaucau

SEQ ID NO: 792603 - RNA, 19 nt, Homo sapiens
gauauuuacccugcuauug

SEQ ID NO: 792604 - RNA, 19 nt, Homo sapiens
gcucacuggugcaaagaga

SEQ ID NO: 792605 - RNA, 19 nt, Homo sapiens
uuacccugcuauugucuua

SEQ ID NO: 792606 - RNA, 19 nt, Homo sapiens
gauagccaaugaucaugau

SEQ ID NO: 792607 - RNA, 19 nt, Homo sapiens
caaaggcaaacgaccaauu

SEQ ID NO: 792608 - RNA, 19 nt, Homo sapiens
aaacaacacggaucaagau

SEQ ID NO: 792609 - RNA, 19 nt, Homo sapiens
ggagguuaaagaaguaauu

SEQ ID NO: 792610 - RNA, 19 nt, Homo sapiens
ugucuagccucuuacaaau

SEQ ID NO: 792611 - RNA, 19 nt, Homo sapiens
ggugguagagguggacuua

SEQ ID NO: 792612 - RNA, 19 nt, Homo sapiens
cagagcagguguucaugau

SEQ ID NO: 792613 - RNA, 19 nt, Homo sapiens
ggauagccaaugaucauga

SEQ ID NO: 792614 - RNA, 19 nt, Homo sapiens
cuacacacuuuaaaccaau

SEQ ID NO: 792615 - RNA, 19 nt, Homo sapiens
guucauagaccgaagauac

SEQ ID NO: 792616 - RNA, 19 nt, Homo sapiens
gagaauccuuacaccaaag

SEQ ID NO: 792617 - RNA, 19 nt, Homo sapiens
gguagagguggacuuagua

SEQ ID NO: 792618 - RNA, 19 nt, Homo sapiens
ggagauagaaaggaauuca

SEQ ID NO: 792619 - RNA, 19 nt, Homo sapiens
ugaagaggcuuuugaguuc

SEQ ID NO: 792620 - RNA, 19 nt, Homo sapiens
ggaugcagcugagauucug

SEQ ID NO: 792621 - RNA, 19 nt, Homo sapiens
gaggaaacaacacggauca

SEQ ID NO: 792622 - RNA, 19 nt, Homo sapiens
gaggaaggaggauggauuc

SEQ ID NO: 792623 - RNA, 19 nt, Homo sapiens
ggaggauggauucugguuu

SEQ ID NO: 792624 - RNA, 19 nt, Homo sapiens
ggacagccuagacuucuuc

SEQ ID NO: 792625 - RNA, 19 nt, Homo sapiens
gagaagaucagggcagcuu

SEQ ID NO: 792626 - RNA, 19 nt, Homo sapiens
ggcaaacgaccaauuaucu

SEQ ID NO: 792627 - RNA, 19 nt, Homo sapiens
ugaccaugacugaugcuua

SEQ ID NO: 792628 - RNA, 19 nt, Homo sapiens
caacgucaccacucaucuu

SEQ ID NO: 792629 - RNA, 19 nt, Homo sapiens
aagaugcucuggugguaga

SEQ ID NO: 792630 - RNA, 19 nt, Homo sapiens
ggaaacaacacggaucaag

SEQ ID NO: 792631 - RNA, 19 nt, Homo sapiens
caaacugacaaauuaagga

SEQ ID NO: 792632 - RNA, 19 nt, Homo sapiens
gauugcugcucuccauuag

SEQ ID NO: 792633 - RNA, 19 nt, Homo sapiens
ugccuucacuggcuucuug

SEQ ID NO: 792634 - RNA, 19 nt, Homo sapiens
ggaacugaccauuauaugc

SEQ ID NO: 792635 - RNA, 19 nt, Homo sapiens
guaguugggaguaaguuug

SEQ ID NO: 792636 - RNA, 19 nt, Homo sapiens
ccaugacugaugcuuauaa

SEQ ID NO: 792637 - RNA, 19 nt, Homo sapiens
gauagaaaggaauucaaca

SEQ ID NO: 792638 - RNA, 19 nt, Homo sapiens
gagauagaaaggaauucaa

SEQ ID NO: 792639 - RNA, 19 nt, Homo sapiens
gugucuagccucuuacaaa

SEQ ID NO: 792640 - RNA, 19 nt, Homo sapiens
caucuugcccuuccuguuc

SEQ ID NO: 792641 - RNA, 19 nt, Homo sapiens
ggauauuuacccugcuauu

SEQ ID NO: 792642 - RNA, 19 nt, Homo sapiens
gcaagucuuuugugucuuc

SEQ ID NO: 792643 - RNA, 19 nt, Homo sapiens
ucacuggcuucuugugcaa

SEQ ID NO: 792644 - RNA, 19 nt, Homo sapiens
gugaauggaaacaaacuug

SEQ ID NO: 792645 - RNA, 19 nt, Homo sapiens
ugacaauggucuggaugga

SEQ ID NO: 792646 - RNA, 19 nt, Homo sapiens
ccgagaauccuuacaccaa

SEQ ID NO: 792647 - RNA, 19 nt, Homo sapiens
ugucuuaccauaaucuuga

SEQ ID NO: 792648 - RNA, 19 nt, Homo sapiens
agagguggacuuaguaguu

SEQ ID NO: 792649 - RNA, 19 nt, Homo sapiens
agugaggaacugaccauua

SEQ ID NO: 792650 - RNA, 19 nt, Homo sapiens
ccgaagauacuacacacuu

SEQ ID NO: 792651 - RNA, 19 nt, Homo sapiens
ugacaaauuaaggagguua

SEQ ID NO: 792652 - RNA, 19 nt, Homo sapiens
gcaaacgaccaauuaucuc

SEQ ID NO: 792653 - RNA, 19 nt, Homo sapiens
gaaaggccuguucaacuac

SEQ ID NO: 792654 - RNA, 19 nt, Homo sapiens
ggcuucuugugcaauaaua

SEQ ID NO: 792655 - RNA, 19 nt, Homo sapiens
ugaggaaggaggauggauu

SEQ ID NO: 792656 - RNA, 19 nt, Homo sapiens
uugcugcucuccauuagga

SEQ ID NO: 792657 - RNA, 19 nt, Homo sapiens
cugcuauugucuuaccaua

SEQ ID NO: 792658 - RNA, 19 nt, Homo sapiens
uaacaaguguaagaagacu

SEQ ID NO: 792659 - RNA, 19 nt, Homo sapiens
ccauaaaccuuguuacaua

SEQ ID NO: 792660 - RNA, 19 nt, Homo sapiens
gaagauacuacacacuuua

SEQ ID NO: 792661 - RNA, 19 nt, Homo sapiens
cccacaaacugacaaauua

SEQ ID NO: 792662 - RNA, 19 nt, Homo sapiens
agaaaggccuguucaacua

SEQ ID NO: 792663 - RNA, 19 nt, Homo sapiens
ggaguaaguuugugaaugg

SEQ ID NO: 792664 - RNA, 19 nt, Homo sapiens
gcugaaugauagacaaaua

SEQ ID NO: 792665 - RNA, 19 nt, Homo sapiens
gaccaugacugaugcuuau

SEQ ID NO: 792666 - RNA, 19 nt, Homo sapiens
gugaggaacugaccauuau

SEQ ID NO: 792667 - RNA, 19 nt, Homo sapiens
gaacaucggcuacgucauc

SEQ ID NO: 792668 - RNA, 19 nt, Homo sapiens
uaaggagguuaaagaagua

SEQ ID NO: 792669 - RNA, 19 nt, Homo sapiens
cgaagauacuacacacuuu

SEQ ID NO: 792670 - RNA, 19 nt, Homo sapiens
uaagaauccuucaggcauu

SEQ ID NO: 792671 - RNA, 19 nt, Homo sapiens
uaaauagucugugcagguu

SEQ ID NO: 792672 - RNA, 19 nt, Homo sapiens
gagauucaccucccacaaa

SEQ ID NO: 792673 - RNA, 19 nt, Homo sapiens
aaaggcaaacgaccaauua

SEQ ID NO: 792674 - RNA, 19 nt, Homo sapiens
gaagaucagggcagcuuaa

SEQ ID NO: 792675 - RNA, 19 nt, Homo sapiens
cgagaauccuuacaccaaa

SEQ ID NO: 792676 - RNA, 19 nt, Homo sapiens
gaucagggcagcuuaagug

SEQ ID NO: 792677 - RNA, 19 nt, Homo sapiens
guaaguuugugaauggaaa

SEQ ID NO: 792678 - RNA, 19 nt, Homo sapiens
ggauugcugcucuccauua

SEQ ID NO: 792679 - RNA, 19 nt, Homo sapiens
acaauggucuggauggaaa

SEQ ID NO: 792680 - RNA, 19 nt, Homo sapiens
gccagaugguggaggaaua

SEQ ID NO: 792681 - RNA, 19 nt, Homo sapiens
uaagugugcaaacaaguua

SEQ ID NO: 792682 - RNA, 19 nt, Homo sapiens
gggaguaaguuugugaaug

SEQ ID NO: 792683 - RNA, 19 nt, Homo sapiens
gagaaaggccuguucaacu

SEQ ID NO: 792684 - RNA, 19 nt, Homo sapiens
gcagcugaaugauagacaa

SEQ ID NO: 792685 - RNA, 19 nt, Homo sapiens
ccacaaacugacaaauuaa

SEQ ID NO: 792686 - RNA, 19 nt, Homo sapiens
gaggauggauucugguuuu

SEQ ID NO: 792687 - RNA, 19 nt, Homo sapiens
ccaccaucgucaucgcuua

SEQ ID NO: 792688 - RNA, 19 nt, Homo sapiens
gcuuggagauagaaaggaa

SEQ ID NO: 792689 - RNA, 19 nt, Homo sapiens
gaggaacugaccauuauau

SEQ ID NO: 792690 - RNA, 19 nt, Homo sapiens
caugacugaugcuuauaaa

SEQ ID NO: 792691 - RNA, 19 nt, Homo sapiens
gcucacuggugcaaagaga

SEQ ID NO: 792692 - RNA, 19 nt, Homo sapiens
gaucaaugaagccgaguga

SEQ ID NO: 792693 - RNA, 19 nt, Homo sapiens
caaaggcaaacgaccaauu

SEQ ID NO: 792694 - RNA, 19 nt, Homo sapiens
ggagguuaaagaaguaauu

SEQ ID NO: 792695 - RNA, 19 nt, Homo sapiens
cuacacacuuuaaaccaau

SEQ ID NO: 792696 - RNA, 19 nt, Homo sapiens
guucauagaccgaagauac

SEQ ID NO: 792697 - RNA, 19 nt, Homo sapiens
caaugaagccgagugaaug

SEQ ID NO: 792698 - RNA, 19 nt, Homo sapiens
gagaauccuuacaccaaag

SEQ ID NO: 792699 - RNA, 19 nt, Homo sapiens
ggagauagaaaggaauuca

SEQ ID NO: 792700 - RNA, 19 nt, Homo sapiens
ugaagaggcuuuugaguuc

SEQ ID NO: 792701 - RNA, 19 nt, Homo sapiens
gcgaguccauagcugaaga

SEQ ID NO: 792702 - RNA, 19 nt, Homo sapiens
gaggaaggaggauggauuc

SEQ ID NO: 792703 - RNA, 19 nt, Homo sapiens
ucaaugaagccgagugaau

SEQ ID NO: 792704 - RNA, 19 nt, Homo sapiens
ggaggauggauucugguuu

SEQ ID NO: 792705 - RNA, 19 nt, Homo sapiens
gagaagaucagggcagcuu

SEQ ID NO: 792706 - RNA, 19 nt, Homo sapiens
ggcaaacgaccaauuaucu

SEQ ID NO: 792707 - RNA, 19 nt, Homo sapiens
ugaccaugacugaugcuua

SEQ ID NO: 792708 - RNA, 19 nt, Homo sapiens
caacgucaccacucaucuu

SEQ ID NO: 792709 - RNA, 19 nt, Homo sapiens
caaacugacaaauuaagga

SEQ ID NO: 792710 - RNA, 19 nt, Homo sapiens
gauugcugcucuccauuag

SEQ ID NO: 792711 - RNA, 19 nt, Homo sapiens
ugccuucacuggcuucuug

SEQ ID NO: 792712 - RNA, 19 nt, Homo sapiens
ggaacugaccauuauaugc

SEQ ID NO: 792713 - RNA, 19 nt, Homo sapiens
guaguugggaguaaguuug

SEQ ID NO: 792714 - RNA, 19 nt, Homo sapiens
ccaugacugaugcuuauaa

SEQ ID NO: 792715 - RNA, 19 nt, Homo sapiens
gauagaaaggaauucaaca

SEQ ID NO: 792716 - RNA, 19 nt, Homo sapiens
gagauagaaaggaauucaa

SEQ ID NO: 792717 - RNA, 19 nt, Homo sapiens
caucuugcccuuccuguuc

SEQ ID NO: 792718 - RNA, 19 nt, Homo sapiens
ucacuggcuucuugugcaa

SEQ ID NO: 792719 - RNA, 19 nt, Homo sapiens
gugaauggaaacaaacuug

SEQ ID NO: 792720 - RNA, 19 nt, Homo sapiens
ugacaauggucuggaugga

SEQ ID NO: 792721 - RNA, 19 nt, Homo sapiens
ccgagaauccuuacaccaa

SEQ ID NO: 792722 - RNA, 19 nt, Homo sapiens
agugaggaacugaccauua

SEQ ID NO: 792723 - RNA, 19 nt, Homo sapiens
ccgaagauacuacacacuu

SEQ ID NO: 792724 - RNA, 19 nt, Homo sapiens
ugacaaauuaaggagguua

SEQ ID NO: 792725 - RNA, 19 nt, Homo sapiens
gcaaacgaccaauuaucuc

SEQ ID NO: 792726 - RNA, 19 nt, Homo sapiens
gaaaggccuguucaacuac

SEQ ID NO: 792727 - RNA, 19 nt, Homo sapiens
ggcuucuugugcaauaaua

SEQ ID NO: 792728 - RNA, 19 nt, Homo sapiens
ugaggaaggaggauggauu

SEQ ID NO: 792729 - RNA, 19 nt, Homo sapiens
uugcugcucuccauuagga

SEQ ID NO: 792730 - RNA, 19 nt, Homo sapiens
agagaaaguaacuauguug

SEQ ID NO: 792731 - RNA, 19 nt, Homo sapiens
uaacaaguguaagaagacu

SEQ ID NO: 792732 - RNA, 19 nt, Homo sapiens
ggaaggaggauggauucug

SEQ ID NO: 792733 - RNA, 19 nt, Homo sapiens
cgaggaagaccuaaacaac

SEQ ID NO: 792734 - RNA, 19 nt, Homo sapiens
ccacucaucuuccccucua

SEQ ID NO: 792735 - RNA, 19 nt, Homo sapiens
gaaugauagacaaauagug

SEQ ID NO: 792736 - RNA, 19 nt, Homo sapiens
ugaaauagugaggaacuga

SEQ ID NO: 792737 - RNA, 19 nt, Homo sapiens
gauacuacacacuuuaaac

SEQ ID NO: 792738 - RNA, 19 nt, Homo sapiens
ucaucaacgucaccacuca

SEQ ID NO: 792739 - RNA, 19 nt, Homo sapiens
gauagacaaauagugcaaa

SEQ ID NO: 792740 - RNA, 19 nt, Homo sapiens
aaccugggcuguccacaca

SEQ ID NO: 792741 - RNA, 19 nt, Homo sapiens
acuacacacuuuaaaccaa

SEQ ID NO: 792742 - RNA, 19 nt, Homo sapiens
uggagacgguugugugaca

SEQ ID NO: 792743 - RNA, 19 nt, Homo sapiens
ccucuaccacuaugagaaa

SEQ ID NO: 792744 - RNA, 19 nt, Homo sapiens
cuucaggcauucuuuaagg

SEQ ID NO: 792745 - RNA, 19 nt, Homo sapiens
gaaaaccucugugacaacu

SEQ ID NO: 792746 - RNA, 19 nt, Homo sapiens
aauagucugugcagguuca

SEQ ID NO: 792747 - RNA, 19 nt, Homo sapiens
ucccacaaacugacaaauu

SEQ ID NO: 792748 - RNA, 19 nt, Homo sapiens
gaguaaguuugugaaugga

SEQ ID NO: 792749 - RNA, 19 nt, Homo sapiens
gaccuaaacaacgguguga

SEQ ID NO: 792750 - RNA, 19 nt, Homo sapiens
cggaugaccaugacugaug

SEQ ID NO: 792751 - RNA, 19 nt, Homo sapiens
ccacugacagcaacaagca

SEQ ID NO: 792752 - RNA, 19 nt, Homo sapiens
guguuucuguugauugugu

SEQ ID NO: 792753 - RNA, 19 nt, Homo sapiens
auacuuuccuucccaccuu

SEQ ID NO: 792754 - RNA, 19 nt, Homo sapiens
ugaggaacugaccauuaua

SEQ ID NO: 792755 - RNA, 19 nt, Homo sapiens
acaaguguaagaagacuau

SEQ ID NO: 792756 - RNA, 19 nt, Homo sapiens
gacaauggucuggauggaa

SEQ ID NO: 792757 - RNA, 19 nt, Homo sapiens
gccauaaaccuuguuacau

SEQ ID NO: 792758 - RNA, 19 nt, Homo sapiens
acuggcuucuugugcaaua

SEQ ID NO: 792759 - RNA, 19 nt, Homo sapiens
cuacauauuucccaaguua

SEQ ID NO: 792760 - RNA, 19 nt, Homo sapiens
ggucaaagauucuaaacug

SEQ ID NO: 792761 - RNA, 19 nt, Homo sapiens
gacagaauauggacugaaa

SEQ ID NO: 792762 - RNA, 19 nt, Homo sapiens
uaaauuaucgguccuguuu

SEQ ID NO: 792763 - RNA, 19 nt, Homo sapiens
ggcagaaccuuacauauuc

SEQ ID NO: 792764 - RNA, 19 nt, Homo sapiens
guaaagaaaccauuugcua

SEQ ID NO: 792765 - RNA, 19 nt, Homo sapiens
cagaagauuuguaugauga

SEQ ID NO: 792766 - RNA, 19 nt, Homo sapiens
gagccagagugauaucaua

SEQ ID NO: 792767 - RNA, 19 nt, Homo sapiens
gggcauaaauauaucauuc

SEQ ID NO: 792768 - RNA, 19 nt, Homo sapiens
ggacaaaggaaagacaaua

SEQ ID NO: 792769 - RNA, 19 nt, Homo sapiens
gaacuaaaaugccuggaaa

SEQ ID NO: 792770 - RNA, 19 nt, Homo sapiens
gaagauaaagcccaauuag

SEQ ID NO: 792771 - RNA, 19 nt, Homo sapiens
aaucacacaugucaucuuu

SEQ ID NO: 792772 - RNA, 19 nt, Homo sapiens
gaauauggacugaaagugu

SEQ ID NO: 792773 - RNA, 19 nt, Homo sapiens
cugaaaguguggagaauaa

SEQ ID NO: 792774 - RNA, 19 nt, Homo sapiens
uaaacuguguccucugaaa

SEQ ID NO: 792775 - RNA, 19 nt, Homo sapiens
gacaaaggaaagacaauaa

SEQ ID NO: 792776 - RNA, 19 nt, Homo sapiens
ucacacaugucaucuuugu

SEQ ID NO: 792777 - RNA, 19 nt, Homo sapiens
cuaaacugccugcauauaa

SEQ ID NO: 792778 - RNA, 19 nt, Homo sapiens
aaacacaaagcacaacaua

SEQ ID NO: 792779 - RNA, 19 nt, Homo sapiens
ucguaaagcuacauccaua

SEQ ID NO: 792780 - RNA, 19 nt, Homo sapiens
uaguaaaggucaaagauuc

SEQ ID NO: 792781 - RNA, 19 nt, Homo sapiens
acacaaagcacaacauaau

SEQ ID NO: 792782 - RNA, 19 nt, Homo sapiens
gaugaaccauggccuauac

SEQ ID NO: 792783 - RNA, 19 nt, Homo sapiens
uuagaggucuucauggaaa

SEQ ID NO: 792784 - RNA, 19 nt, Homo sapiens
aagaggaacugccagaaga

SEQ ID NO: 792785 - RNA, 19 nt, Homo sapiens
ggacugaaaguguggagaa

SEQ ID NO: 792786 - RNA, 19 nt, Homo sapiens
gaaaagauggggauuuaaa

SEQ ID NO: 792787 - RNA, 19 nt, Homo sapiens
ggaaaacuguaauggaaaa

SEQ ID NO: 792788 - RNA, 19 nt, Homo sapiens
aauuaucgguccuguuuaa

SEQ ID NO: 792789 - RNA, 19 nt, Homo sapiens
caaccuauuuggguaaaga

SEQ ID NO: 792790 - RNA, 19 nt, Homo sapiens
ugauggagaugaagaggaa

SEQ ID NO: 792791 - RNA, 19 nt, Homo sapiens
ccagguuccuuuagaguug

SEQ ID NO: 792792 - RNA, 19 nt, Homo sapiens
ccagaagauuuguaugaug

SEQ ID NO: 792793 - RNA, 19 nt, Homo sapiens
uaaacugccugcauauaag

SEQ ID NO: 792794 - RNA, 19 nt, Homo sapiens
gaauaaacacaaagcacaa

SEQ ID NO: 792795 - RNA, 19 nt, Homo sapiens
guaaagcuacauccauauu

SEQ ID NO: 792796 - RNA, 19 nt, Homo sapiens
gaaauugguguugggcaua

SEQ ID NO: 792797 - RNA, 19 nt, Homo sapiens
uggcagaaccuuacauauu

SEQ ID NO: 792798 - RNA, 19 nt, Homo sapiens
auucuaaacugccugcaua

SEQ ID NO: 792799 - RNA, 19 nt, Homo sapiens
gaacacacaucuggcuuuu

SEQ ID NO: 792800 - RNA, 19 nt, Homo sapiens
ggucucugaugaagauaaa

SEQ ID NO: 792801 - RNA, 19 nt, Homo sapiens
cauauaaggaucucgguaa

SEQ ID NO: 792802 - RNA, 19 nt, Homo sapiens
gauaaagcccaauuagcaa

SEQ ID NO: 792803 - RNA, 19 nt, Homo sapiens
uagauuggauuugcugaaa

SEQ ID NO: 792804 - RNA, 19 nt, Homo sapiens
gucaagggcauaaauauau

SEQ ID NO: 792805 - RNA, 19 nt, Homo sapiens
ggaacugccagaagauuug

SEQ ID NO: 792806 - RNA, 19 nt, Homo sapiens
ucgaugagccagagugaua

SEQ ID NO: 792807 - RNA, 19 nt, Homo sapiens
uuaagcaguuggucucuga

SEQ ID NO: 792808 - RNA, 19 nt, Homo sapiens
aucauacucuccuuucuua

SEQ ID NO: 792809 - RNA, 19 nt, Homo sapiens
ugaagauaaagcccaauua

SEQ ID NO: 792810 - RNA, 19 nt, Homo sapiens
acauuugccuaacaucuuu

SEQ ID NO: 792811 - RNA, 19 nt, Homo sapiens
caaagcacaacauaaucua

SEQ ID NO: 792812 - RNA, 19 nt, Homo sapiens
ugaaauagugguuguggaa

SEQ ID NO: 792813 - RNA, 19 nt, Homo sapiens
gaagaggaacugccagaag

SEQ ID NO: 792814 - RNA, 19 nt, Homo sapiens
cuauguaaauggcucugua

SEQ ID NO: 792815 - RNA, 19 nt, Homo sapiens
ucacauuacuucagguaca

SEQ ID NO: 792816 - RNA, 19 nt, Homo sapiens
ccaauuagcaaguaaacug

SEQ ID NO: 792817 - RNA, 19 nt, Homo sapiens
aaaccaggcacuccucuuu

SEQ ID NO: 792818 - RNA, 19 nt, Homo sapiens
uaacagauaaugcugcaau

SEQ ID NO: 792819 - RNA, 19 nt, Homo sapiens
ggaaagagugguacauggu

SEQ ID NO: 792820 - RNA, 19 nt, Homo sapiens
uaccauucccuacauauuu

SEQ ID NO: 792821 - RNA, 19 nt, Homo sapiens
guuggucucugaugaagau

SEQ ID NO: 792822 - RNA, 19 nt, Homo sapiens
ugucaagggcauaaauaua

SEQ ID NO: 792823 - RNA, 19 nt, Homo sapiens
aguaaacuguguccucuga

SEQ ID NO: 792824 - RNA, 19 nt, Homo sapiens
uaucauaaccaccagaaau

SEQ ID NO: 792825 - RNA, 19 nt, Homo sapiens
gcaguuggucucugaugaa

SEQ ID NO: 792826 - RNA, 19 nt, Homo sapiens
gccagaagauuuguaugau

SEQ ID NO: 792827 - RNA, 19 nt, Homo sapiens
uuuguggacucgauucuuu

SEQ ID NO: 792828 - RNA, 19 nt, Homo sapiens
agauaaagcccaauuagca

SEQ ID NO: 792829 - RNA, 19 nt, Homo sapiens
acauauacaggacagaaua

SEQ ID NO: 792830 - RNA, 19 nt, Homo sapiens
cuuuagaguuggucuuauu

SEQ ID NO: 792831 - RNA, 19 nt, Homo sapiens
ugaguuaaguagauuggau

SEQ ID NO: 792832 - RNA, 19 nt, Homo sapiens
ucaagggcauaaauauauc

SEQ ID NO: 792833 - RNA, 19 nt, Homo sapiens
gauaucauaaccaccagaa

SEQ ID NO: 792834 - RNA, 19 nt, Homo sapiens
aaccuuacauauucuguga

SEQ ID NO: 792835 - RNA, 19 nt, Homo sapiens
ggacguggcagaaccuuac

SEQ ID NO: 792836 - RNA, 19 nt, Homo sapiens
auauaaggaucucgguaaa

SEQ ID NO: 792837 - RNA, 19 nt, Homo sapiens
ucuuuaugcugcucacuuu

SEQ ID NO: 792838 - RNA, 19 nt, Homo sapiens
uaaagcuacauccauauug

SEQ ID NO: 792839 - RNA, 19 nt, Homo sapiens
gaaccauggccuauacauc

SEQ ID NO: 792840 - RNA, 19 nt, Homo sapiens
acacaugucaucuuuguca

SEQ ID NO: 792841 - RNA, 19 nt, Homo sapiens
guaaaggucaaagauucua

SEQ ID NO: 792842 - RNA, 19 nt, Homo sapiens
aaagcuacauccauauugg

SEQ ID NO: 792843 - RNA, 19 nt, Homo sapiens
guuaaaggccggacaaagg

SEQ ID NO: 792844 - RNA, 19 nt, Homo sapiens
ggucacauuacuucaggua

SEQ ID NO: 792845 - RNA, 19 nt, Homo sapiens
uguuagaggucuucaugga

SEQ ID NO: 792846 - RNA, 19 nt, Homo sapiens
gaaaguguggagaauaaac

SEQ ID NO: 792847 - RNA, 19 nt, Homo sapiens
aaauagugguuguggaaca

SEQ ID NO: 792848 - RNA, 19 nt, Homo sapiens
aaacauauacaggacagaa

SEQ ID NO: 792849 - RNA, 19 nt, Homo sapiens
agucuggccuggaacuaaa

SEQ ID NO: 792850 - RNA, 19 nt, Homo sapiens
uuaaguagauuggauuugc

SEQ ID NO: 792851 - RNA, 19 nt, Homo sapiens
ggacagaauauggacugaa

SEQ ID NO: 792852 - RNA, 19 nt, Homo sapiens
uguguccucugaaagauga

SEQ ID NO: 792853 - RNA, 19 nt, Homo sapiens
uguugcaacuggugauauu

SEQ ID NO: 792854 - RNA, 19 nt, Homo sapiens
gaguuaaguagauuggauu

SEQ ID NO: 792855 - RNA, 19 nt, Homo sapiens
gaggaacugccagaagauu

SEQ ID NO: 792856 - RNA, 19 nt, Homo sapiens
aaggaaaacuguaauggaa

SEQ ID NO: 792857 - RNA, 19 nt, Homo sapiens
caaucuuugugaaauagug

SEQ ID NO: 792858 - RNA, 19 nt, Homo sapiens
gcucuguaccuggacauaa

SEQ ID NO: 792859 - RNA, 19 nt, Homo sapiens
uaaccagacucagaaagaa

SEQ ID NO: 792860 - RNA, 19 nt, Homo sapiens
aggaggagcugcugaaaca

SEQ ID NO: 792861 - RNA, 19 nt, Homo sapiens
gaaagaaaaccucaggaaa

SEQ ID NO: 792862 - RNA, 19 nt, Homo sapiens
gaaggaggagcugcugaaa

SEQ ID NO: 792863 - RNA, 19 nt, Homo sapiens
gugcagcaauggccaagau

SEQ ID NO: 792864 - RNA, 19 nt, Homo sapiens
ucaacaagcacgaggagaa

SEQ ID NO: 792865 - RNA, 19 nt, Homo sapiens
aggagaaccugaagaccaa

SEQ ID NO: 792866 - RNA, 19 nt, Homo sapiens
gaccugcggccuaagaaga

SEQ ID NO: 792867 - RNA, 19 nt, Homo sapiens
gcagcaauggccaagauca

SEQ ID NO: 792868 - RNA, 19 nt, Homo sapiens
uuaaccagacucagaaaga

SEQ ID NO: 792869 - RNA, 19 nt, Homo sapiens
aaagaaaaccucaggaaau

SEQ ID NO: 792870 - RNA, 19 nt, Homo sapiens
gcacgaggagaaccugaag

SEQ ID NO: 792871 - RNA, 19 nt, Homo sapiens
agaaggaggagcugcugaa

SEQ ID NO: 792872 - RNA, 19 nt, Homo sapiens
cagcaauggccaagaucaa

SEQ ID NO: 792873 - RNA, 19 nt, Homo sapiens
uuauuaaccagacucagaa

SEQ ID NO: 792874 - RNA, 19 nt, Homo sapiens
gaaccugaagaccaagaag

SEQ ID NO: 792875 - RNA, 19 nt, Homo sapiens
gagaaccugaagaccaaga

SEQ ID NO: 792876 - RNA, 19 nt, Homo sapiens
gaaacuccaucucuacuaa

SEQ ID NO: 792877 - RNA, 19 nt, Homo sapiens
gaaacaggauugcugaugu

SEQ ID NO: 792878 - RNA, 19 nt, Homo sapiens
gcucacaccuguaauccua

SEQ ID NO: 792879 - RNA, 19 nt, Homo sapiens
gcucaugccugaaauccua

SEQ ID NO: 792880 - RNA, 19 nt, Homo sapiens
gaaacuccaucucaggaaa

SEQ ID NO: 792881 - RNA, 19 nt, Homo sapiens
ccagugaaaugauauauuc

SEQ ID NO: 792882 - RNA, 19 nt, Homo sapiens
aauagaggcucccaaagua

SEQ ID NO: 792883 - RNA, 19 nt, Homo sapiens
gaacaaccuuagagauuca

SEQ ID NO: 792884 - RNA, 19 nt, Homo sapiens
cagcaaagauggcccaaga

SEQ ID NO: 792885 - RNA, 19 nt, Homo sapiens
gggaacaacugcacuguca

SEQ ID NO: 792886 - RNA, 19 nt, Homo sapiens
ccaucgaccuuaauacuuu

SEQ ID NO: 792887 - RNA, 19 nt, Homo sapiens
gcacaucgguaccuaugau

SEQ ID NO: 792888 - RNA, 19 nt, Homo sapiens
gcacagaggagcaccuaaa

SEQ ID NO: 792889 - RNA, 19 nt, Homo sapiens
ggaagaaggcuauaagaag

SEQ ID NO: 792890 - RNA, 19 nt, Homo sapiens
caagggcacuagugucauu

SEQ ID NO: 792891 - RNA, 19 nt, Homo sapiens
aggagaagcuggagcagua

SEQ ID NO: 792892 - RNA, 19 nt, Homo sapiens
gcuauaagaagcacuguuu

SEQ ID NO: 792893 - RNA, 19 nt, Homo sapiens
aaagauggcccaagagaaa

SEQ ID NO: 792894 - RNA, 19 nt, Homo sapiens
gcaaagauggcccaagaga

SEQ ID NO: 792895 - RNA, 19 nt, Homo sapiens
gcgcaaggaugaaacauac

SEQ ID NO: 792896 - RNA, 19 nt, Homo sapiens
cuacagccauguccuauuc

SEQ ID NO: 792897 - RNA, 19 nt, Homo sapiens
ucacuucacuggcaagaau

SEQ ID NO: 792898 - RNA, 19 nt, Homo sapiens
ggaagacaaugugggagaa

SEQ ID NO: 792899 - RNA, 19 nt, Homo sapiens
gaagagaccauuaggacau

SEQ ID NO: 792900 - RNA, 19 nt, Homo sapiens
aagaagcacuguuucaaug

SEQ ID NO: 792901 - RNA, 19 nt, Homo sapiens
gagaggaggccacagagaa

SEQ ID NO: 792902 - RNA, 19 nt, Homo sapiens
ccguaaagauggauuucua

SEQ ID NO: 792903 - RNA, 19 nt, Homo sapiens
caacugcacugucacaacu

SEQ ID NO: 792904 - RNA, 19 nt, Homo sapiens
caaagcagcugugucuaca

SEQ ID NO: 792905 - RNA, 19 nt, Homo sapiens
gcagagaggaggccacaga

SEQ ID NO: 792906 - RNA, 19 nt, Homo sapiens
gcaaugcugaguucaagaa

SEQ ID NO: 792907 - RNA, 19 nt, Homo sapiens
ugaacaaccuuagagauuc

SEQ ID NO: 792908 - RNA, 19 nt, Homo sapiens
ccugguaccugcacaaugu

SEQ ID NO: 792909 - RNA, 19 nt, Homo sapiens
gaacaacugcacugucaca

SEQ ID NO: 792910 - RNA, 19 nt, Homo sapiens
gaaauccuucggugacauu

SEQ ID NO: 792911 - RNA, 19 nt, Homo sapiens
caacaacauugggcccauu

SEQ ID NO: 792912 - RNA, 19 nt, Homo sapiens
ggaagccccucaucaugua

SEQ ID NO: 792913 - RNA, 19 nt, Homo sapiens
agaguccagugaaaugaua

SEQ ID NO: 792914 - RNA, 19 nt, Homo sapiens
ggacgaggaaugggaauug

SEQ ID NO: 792915 - RNA, 19 nt, Homo sapiens
agaaauagaggcucccaaa

SEQ ID NO: 792916 - RNA, 19 nt, Homo sapiens
gcaaagcagcugugucuac

SEQ ID NO: 792917 - RNA, 19 nt, Homo sapiens
ucaagaaccucggcaccaa

SEQ ID NO: 792918 - RNA, 19 nt, Homo sapiens
ggaaacaggauugcugaug

SEQ ID NO: 792919 - RNA, 19 nt, Homo sapiens
aggaucagcucaucaggaa

SEQ ID NO: 792920 - RNA, 19 nt, Homo sapiens
cacaaugucuacccagaga

SEQ ID NO: 792921 - RNA, 19 nt, Homo sapiens
gagaaauccuucggugaca

SEQ ID NO: 792922 - RNA, 19 nt, Homo sapiens
gggagaacguggaaauguc

SEQ ID NO: 792923 - RNA, 19 nt, Homo sapiens
cagaggagcaccuaaagga

SEQ ID NO: 792924 - RNA, 19 nt, Homo sapiens
ggacagcuacaagaagauu

SEQ ID NO: 792925 - RNA, 19 nt, Homo sapiens
aaagauggauuucuaaacc

SEQ ID NO: 792926 - RNA, 19 nt, Homo sapiens
caaagauggcccaagagaa

SEQ ID NO: 792927 - RNA, 19 nt, Homo sapiens
ggauggacagcuacaagaa

SEQ ID NO: 792928 - RNA, 19 nt, Homo sapiens
gagcacaucgguaccuaug

SEQ ID NO: 792929 - RNA, 19 nt, Homo sapiens
uaagaagcacuguuucaau

SEQ ID NO: 792930 - RNA, 19 nt, Homo sapiens
gcagaguccagugaaauga

SEQ ID NO: 792931 - RNA, 19 nt, Homo sapiens
ccugaaauccuagcacuuu

SEQ ID NO: 792932 - RNA, 19 nt, Homo sapiens
gaaauagaggcucccaaag

SEQ ID NO: 792933 - RNA, 19 nt, Homo sapiens
aagagaccauuaggacaua

SEQ ID NO: 792934 - RNA, 19 nt, Homo sapiens
gagauucaaugcccaagcu

SEQ ID NO: 792935 - RNA, 19 nt, Homo sapiens
caucaguuguggcucuuug

SEQ ID NO: 792936 - RNA, 19 nt, Homo sapiens
aagcagcugugucuacaug

SEQ ID NO: 792937 - RNA, 19 nt, Homo sapiens
gaaacacuuccuccacaug

SEQ ID NO: 792938 - RNA, 19 nt, Homo sapiens
gugggaggauugcuuguuc

SEQ ID NO: 792939 - RNA, 19 nt, Homo sapiens
ggccugagcaacauaguga

SEQ ID NO: 792940 - RNA, 19 nt, Homo sapiens
aaauagaggcucccaaagu

SEQ ID NO: 792941 - RNA, 19 nt, Homo sapiens
aaacacuuccuccacauga

SEQ ID NO: 792942 - RNA, 19 nt, Homo sapiens
aaacaggauugcugauguc

SEQ ID NO: 792943 - RNA, 19 nt, Homo sapiens
ccaccagcgugaucauugu

SEQ ID NO: 792944 - RNA, 19 nt, Homo sapiens
gagccaagacagcaccauu

SEQ ID NO: 792945 - RNA, 19 nt, Homo sapiens
ggaaccugaucaccagcuu

SEQ ID NO: 792946 - RNA, 19 nt, Homo sapiens
cuugggagcugucacuuca

SEQ ID NO: 792947 - RNA, 19 nt, Homo sapiens
gcccagacaucgucaccau

SEQ ID NO: 792948 - RNA, 19 nt, Homo sapiens
gaaccucggcaccaaccaa

SEQ ID NO: 792949 - RNA, 19 nt, Homo sapiens
cagugagccuugauugugu

SEQ ID NO: 792950 - RNA, 19 nt, Homo sapiens
gagaccauuaggacauaua

SEQ ID NO: 792951 - RNA, 19 nt, Homo sapiens
gcagcugugucuacauguc

SEQ ID NO: 792952 - RNA, 19 nt, Homo sapiens
aaacauaccccaucaaauc

SEQ ID NO: 792953 - RNA, 19 nt, Homo sapiens
ccaaaucagggcuccagaa

SEQ ID NO: 792954 - RNA, 19 nt, Homo sapiens
aggcggaggugcucacguu

SEQ ID NO: 792955 - RNA, 19 nt, Homo sapiens
uauaagaagcacuguuuca

SEQ ID NO: 792956 - RNA, 19 nt, Homo sapiens
ugaaacuccaucucuacua

SEQ ID NO: 792957 - RNA, 19 nt, Homo sapiens
uggugaaacuccaucucua

SEQ ID NO: 792958 - RNA, 19 nt, Homo sapiens
ccuguaauccuagcacuuu

SEQ ID NO: 792959 - RNA, 19 nt, Homo sapiens
gagguugaagcuacaguga

SEQ ID NO: 792960 - RNA, 19 nt, Homo sapiens
ggccaaggcagguggauca

SEQ ID NO: 792961 - RNA, 19 nt, Homo sapiens
gccauguccuauuccuuga

SEQ ID NO: 792962 - RNA, 19 nt, Homo sapiens
cguaaagauggauuucuaa

SEQ ID NO: 792963 - RNA, 19 nt, Homo sapiens
gaucagcucaucaggaacu

SEQ ID NO: 792964 - RNA, 19 nt, Homo sapiens
caaaucagggcuccagaag

SEQ ID NO: 792965 - RNA, 19 nt, Homo sapiens
ggcgcaaggaugaaacaua

SEQ ID NO: 792966 - RNA, 19 nt, Homo sapiens
agacucuguucuccauaaa

SEQ ID NO: 792967 - RNA, 19 nt, Homo sapiens
ggcaggagaaucacucgaa

SEQ ID NO: 792968 - RNA, 19 nt, Homo sapiens
aaaauuagcugggcaugau

SEQ ID NO: 792969 - RNA, 19 nt, Homo sapiens
ccuaauccuugcaacaaca

SEQ ID NO: 792970 - RNA, 19 nt, Homo sapiens
gggaauuggcccaggauca

SEQ ID NO: 792971 - RNA, 19 nt, Homo sapiens
gccacaacaucgcaaagca

SEQ ID NO: 792972 - RNA, 19 nt, Homo sapiens
gcggcaaccaguacuuuga

SEQ ID NO: 792973 - RNA, 19 nt, Homo sapiens
ucgaaucgcugaggacaag

SEQ ID NO: 792974 - RNA, 19 nt, Homo sapiens
guuccuggaugcccacugu

SEQ ID NO: 792975 - RNA, 19 nt, Homo sapiens
gugaggaucccaucucuac

SEQ ID NO: 792976 - RNA, 19 nt, Homo sapiens
agaaacagcuggaaucuaa

SEQ ID NO: 792977 - RNA, 19 nt, Homo sapiens
gcuggaaucuaaugaaaua

SEQ ID NO: 792978 - RNA, 19 nt, Homo sapiens
gaaacgauguagaaauuga

SEQ ID NO: 792979 - RNA, 19 nt, Homo sapiens
gauaagagauagcaagugu

SEQ ID NO: 792980 - RNA, 19 nt, Homo sapiens
caucaaagcuguggaaaga

SEQ ID NO: 792981 - RNA, 19 nt, Homo sapiens
ggaucaacuucaagaaaua

SEQ ID NO: 792982 - RNA, 19 nt, Homo sapiens
uaacacccaucucuacuaa

SEQ ID NO: 792983 - RNA, 19 nt, Homo sapiens
gaaacugagugccugugua

SEQ ID NO: 792984 - RNA, 19 nt, Homo sapiens
gcacagauccggacuaugg

SEQ ID NO: 792985 - RNA, 19 nt, Homo sapiens
gauuagauaucacaccaaa

SEQ ID NO: 792986 - RNA, 19 nt, Homo sapiens
gcagggaaaugcaaaucaa

SEQ ID NO: 792987 - RNA, 19 nt, Homo sapiens
gaacaagugggacuacauu

SEQ ID NO: 792988 - RNA, 19 nt, Homo sapiens
ggaaaguggucuugaagca

SEQ ID NO: 792989 - RNA, 19 nt, Homo sapiens
auagagaaauggagagaua

SEQ ID NO: 792990 - RNA, 19 nt, Homo sapiens
gaggaagaauucugggaaa

SEQ ID NO: 792991 - RNA, 19 nt, Homo sapiens
agccuuagcucaagcaaua

SEQ ID NO: 792992 - RNA, 19 nt, Homo sapiens
gcagaaggauugcuugaac

SEQ ID NO: 792993 - RNA, 19 nt, Homo sapiens
cagagaagcuucaauccau

SEQ ID NO: 792994 - RNA, 19 nt, Homo sapiens
ggacuacauuaaacccaaa

SEQ ID NO: 792995 - RNA, 19 nt, Homo sapiens
aggaagagguuaaaggaaa

SEQ ID NO: 792996 - RNA, 19 nt, Homo sapiens
cagcuggaaucuaaugaaa

SEQ ID NO: 792997 - RNA, 19 nt, Homo sapiens
gcucacgccuguaaucuca

SEQ ID NO: 792998 - RNA, 19 nt, Homo sapiens
caagugggacuacauuaaa

SEQ ID NO: 792999 - RNA, 19 nt, Homo sapiens
gguacacccuuauagagaa

SEQ ID NO: 793000 - RNA, 19 nt, Homo sapiens
caaaucaaagccacaauga

SEQ ID NO: 793001 - RNA, 19 nt, Homo sapiens
gcaguugacuaaggaguug

SEQ ID NO: 793002 - RNA, 19 nt, Homo sapiens
ggagagauacugaaagaca

SEQ ID NO: 793003 - RNA, 19 nt, Homo sapiens
ggaacucacagaacuuaaa

SEQ ID NO: 793004 - RNA, 19 nt, Homo sapiens
cuagagacaugaccuaaca

SEQ ID NO: 793005 - RNA, 19 nt, Homo sapiens
gcaaaucaaagccacaaug

SEQ ID NO: 793006 - RNA, 19 nt, Homo sapiens
ggaagagguuaaaggaaag

SEQ ID NO: 793007 - RNA, 19 nt, Homo sapiens
gcaguaugcuagugaugug

SEQ ID NO: 793008 - RNA, 19 nt, Homo sapiens
cagcaagggucuggagaaa

SEQ ID NO: 793009 - RNA, 19 nt, Homo sapiens
ccuguaaucucagcacuuu

SEQ ID NO: 793010 - RNA, 19 nt, Homo sapiens
aagcaggaguguaaagauu

SEQ ID NO: 793011 - RNA, 19 nt, Homo sapiens
ucaaagcuguggaaagauc

SEQ ID NO: 793012 - RNA, 19 nt, Homo sapiens
gcaauaggucgaacuggaa

SEQ ID NO: 793013 - RNA, 19 nt, Homo sapiens
ggaaaacaguguagagguu

SEQ ID NO: 793014 - RNA, 19 nt, Homo sapiens
gaaacgaucaccaaaauga

SEQ ID NO: 793015 - RNA, 19 nt, Homo sapiens
caaaggaaacgaucaccaa

SEQ ID NO: 793016 - RNA, 19 nt, Homo sapiens
gcaggaguguaaagauuag

SEQ ID NO: 793017 - RNA, 19 nt, Homo sapiens
gaaauagaggccucacaug

SEQ ID NO: 793018 - RNA, 19 nt, Homo sapiens
guacacccuuauagagaaa

SEQ ID NO: 793019 - RNA, 19 nt, Homo sapiens
gugggaauguaaaucagua

SEQ ID NO: 793020 - RNA, 19 nt, Homo sapiens
ucaaagccacaaugagaua

SEQ ID NO: 793021 - RNA, 19 nt, Homo sapiens
gaaauggagagauacugaa

SEQ ID NO: 793022 - RNA, 19 nt, Homo sapiens
ggaguucagaggauuguuu

SEQ ID NO: 793023 - RNA, 19 nt, Homo sapiens
cagcggagcccauugaaau

SEQ ID NO: 793024 - RNA, 19 nt, Homo sapiens
guaaaucaguacggcuauu

SEQ ID NO: 793025 - RNA, 19 nt, Homo sapiens
aaucaaagccacaaugaga

SEQ ID NO: 793026 - RNA, 19 nt, Homo sapiens
ggaguguaaagauuagaua

SEQ ID NO: 793027 - RNA, 19 nt, Homo sapiens
ggacaaagaacaggaacug

SEQ ID NO: 793028 - RNA, 19 nt, Homo sapiens
aaagaucgguaaggucaaa

SEQ ID NO: 793029 - RNA, 19 nt, Homo sapiens
caaaagaaacgauguagaa

SEQ ID NO: 793030 - RNA, 19 nt, Homo sapiens
ggauggaguucagaggauu

SEQ ID NO: 793031 - RNA, 19 nt, Homo sapiens
gacuguagauugggagaaa

SEQ ID NO: 793032 - RNA, 19 nt, Homo sapiens
acacuuagcaccucaugaa

SEQ ID NO: 793033 - RNA, 19 nt, Homo sapiens
gagccgagaucgcauuacu

SEQ ID NO: 793034 - RNA, 19 nt, Homo sapiens
uauggaaaguggucuugaa

SEQ ID NO: 793035 - RNA, 19 nt, Homo sapiens
ccucaagacuaccucauuc

SEQ ID NO: 793036 - RNA, 19 nt, Homo sapiens
uagguuacaucugcuauug

SEQ ID NO: 793037 - RNA, 19 nt, Homo sapiens
cugauaagcaggaguguaa

SEQ ID NO: 793038 - RNA, 19 nt, Homo sapiens
ggccucacaugcagacauu

SEQ ID NO: 793039 - RNA, 19 nt, Homo sapiens
cugcugagcugacuacaca

SEQ ID NO: 793040 - RNA, 19 nt, Homo sapiens
gaagaauucugggaaaaug

SEQ ID NO: 793041 - RNA, 19 nt, Homo sapiens
cagcagaugaguugaagaa

SEQ ID NO: 793042 - RNA, 19 nt, Homo sapiens
uacaggaggugccaaagga

SEQ ID NO: 793043 - RNA, 19 nt, Homo sapiens
gcaagggucuggagaaaag

SEQ ID NO: 793044 - RNA, 19 nt, Homo sapiens
uaagagauagcaaguguca

SEQ ID NO: 793045 - RNA, 19 nt, Homo sapiens
ggaucaucauucuuucuga

SEQ ID NO: 793046 - RNA, 19 nt, Homo sapiens
uguagaucauccuagaaua

SEQ ID NO: 793047 - RNA, 19 nt, Homo sapiens
ccuaucauauccuuaaaca

SEQ ID NO: 793048 - RNA, 19 nt, Homo sapiens
gaacucacagaacuuaaag

SEQ ID NO: 793049 - RNA, 19 nt, Homo sapiens
gcacaacaaaggaaacgau

SEQ ID NO: 793050 - RNA, 19 nt, Homo sapiens
gguuacaucugcuauuguc

SEQ ID NO: 793051 - RNA, 19 nt, Homo sapiens
ucacugaucagcagggaaa

SEQ ID NO: 793052 - RNA, 19 nt, Homo sapiens
ugcaaaccguuaucuggua

SEQ ID NO: 793053 - RNA, 19 nt, Homo sapiens
aaagguggacuguagauug

SEQ ID NO: 793054 - RNA, 19 nt, Homo sapiens
acaagugggacuacauuaa

SEQ ID NO: 793055 - RNA, 19 nt, Homo sapiens
ucaaugaggaagagguuaa

SEQ ID NO: 793056 - RNA, 19 nt, Homo sapiens
ggugcaccauggaacuuaa

SEQ ID NO: 793057 - RNA, 19 nt, Homo sapiens
gagaaacagcuggaaucua

SEQ ID NO: 793058 - RNA, 19 nt, Homo sapiens
aggaucaacuucaagaaau

SEQ ID NO: 793059 - RNA, 19 nt, Homo sapiens
guacggcuauuguggaaaa

SEQ ID NO: 793060 - RNA, 19 nt, Homo sapiens
ucagggaccuugagugacu

SEQ ID NO: 793061 - RNA, 19 nt, Homo sapiens
auaaggaacucacagaacu

SEQ ID NO: 793062 - RNA, 19 nt, Homo sapiens
agagaagcuucaauccauu

SEQ ID NO: 793063 - RNA, 19 nt, Homo sapiens
cagaugaguugaagaagcu

SEQ ID NO: 793064 - RNA, 19 nt, Homo sapiens
ugaccuaacacccugauga

SEQ ID NO: 793065 - RNA, 19 nt, Homo sapiens
ugucauagccuuagcucaa

SEQ ID NO: 793066 - RNA, 19 nt, Homo sapiens
ggagguugucauagccuua

SEQ ID NO: 793067 - RNA, 19 nt, Homo sapiens
gugcuguccuuccucaaga

SEQ ID NO: 793068 - RNA, 19 nt, Homo sapiens
gggcuaacacccaucucua

SEQ ID NO: 793069 - RNA, 19 nt, Homo sapiens
gaggaagagguuaaaggaa

SEQ ID NO: 793070 - RNA, 19 nt, Homo sapiens
ggaaauuguccgucuagag

SEQ ID NO: 793071 - RNA, 19 nt, Homo sapiens
agacagagaagcuucaauc

SEQ ID NO: 793072 - RNA, 19 nt, Homo sapiens
caguacggcuauuguggaa

SEQ ID NO: 793073 - RNA, 19 nt, Homo sapiens
ugaggaagagguuaaagga

SEQ ID NO: 793074 - RNA, 19 nt, Homo sapiens
gagcaaaagaucaaaagaa

SEQ ID NO: 793075 - RNA, 19 nt, Homo sapiens
agaaauggagagauacuga

SEQ ID NO: 793076 - RNA, 19 nt, Homo sapiens
gagcauccauggccaauuu

SEQ ID NO: 793077 - RNA, 19 nt, Homo sapiens
gcaaggcacucucaaaucu

SEQ ID NO: 793078 - RNA, 19 nt, Homo sapiens
ucaacaaccuccucuacua

SEQ ID NO: 793079 - RNA, 19 nt, Homo sapiens
caacccaggucaagacauu

SEQ ID NO: 793080 - RNA, 19 nt, Homo sapiens
agaacaagauugagaacaa

SEQ ID NO: 793081 - RNA, 19 nt, Homo sapiens
gaacaagauugagaacaag

SEQ ID NO: 793082 - RNA, 19 nt, Homo sapiens
ccaacuaccuucucugcuu

SEQ ID NO: 793083 - RNA, 19 nt, Homo sapiens
gggcguauauguuaguguu

SEQ ID NO: 793084 - RNA, 19 nt, Homo sapiens
gaacucagaacccaagugu

SEQ ID NO: 793085 - RNA, 19 nt, Homo sapiens
gucaagacauugccaaauc

SEQ ID NO: 793086 - RNA, 19 nt, Homo sapiens
gaauggggcguauauguua

SEQ ID NO: 793087 - RNA, 19 nt, Homo sapiens
caaugggccugcuacuaga

SEQ ID NO: 793088 - RNA, 19 nt, Homo sapiens
ccaaugggccugcuacuag

SEQ ID NO: 793089 - RNA, 19 nt, Homo sapiens
gaacaagaucgagagcauu

SEQ ID NO: 793090 - RNA, 19 nt, Homo sapiens
aauaaagccuguugcaucu

SEQ ID NO: 793091 - RNA, 19 nt, Homo sapiens
caaaccaacuaccuucucu

SEQ ID NO: 793092 - RNA, 19 nt, Homo sapiens
cagcucugcuuaggcauuu

SEQ ID NO: 793093 - RNA, 19 nt, Homo sapiens
ucaagacauugccaaaucu

SEQ ID NO: 793094 - RNA, 19 nt, Homo sapiens
gcaccuuccuguucagcau

SEQ ID NO: 793095 - RNA, 19 nt, Homo sapiens
uaaagccuguugcaucucu

SEQ ID NO: 793096 - RNA, 19 nt, Homo sapiens
agaacaagaucgagagcau

SEQ ID NO: 793097 - RNA, 19 nt, Homo sapiens
agacauugccaaaucuuga

SEQ ID NO: 793098 - RNA, 19 nt, Homo sapiens
aaggcacucucaaaucuug

SEQ ID NO: 793099 - RNA, 19 nt, Homo sapiens
gcuugcaccuuccuguuca

SEQ ID NO: 793100 - RNA, 19 nt, Homo sapiens
gccaaaucuugaacucaga

SEQ ID NO: 793101 - RNA, 19 nt, Homo sapiens
uagaggcacugggacaaga

SEQ ID NO: 793102 - RNA, 19 nt, Homo sapiens
caacaaccuccucuacuac

SEQ ID NO: 793103 - RNA, 19 nt, Homo sapiens
ggaccaagagccaccuaca

SEQ ID NO: 793104 - RNA, 19 nt, Homo sapiens
gccaaugggccugcuacua

SEQ ID NO: 793105 - RNA, 19 nt, Homo sapiens
ggaauggggcguauauguu

SEQ ID NO: 793106 - RNA, 19 nt, Homo sapiens
gacauugccaaaucuugaa

SEQ ID NO: 793107 - RNA, 19 nt, Homo sapiens
caaauugugaacccagaga

SEQ ID NO: 793108 - RNA, 19 nt, Homo sapiens
ucggguauccugacuguug

SEQ ID NO: 793109 - RNA, 19 nt, Homo sapiens
ggucaagacauugccaaau

SEQ ID NO: 793110 - RNA, 19 nt, Homo sapiens
cuuaagaacaagauugaga

SEQ ID NO: 793111 - RNA, 19 nt, Homo sapiens
ugcgcaaccuuaagaacaa

SEQ ID NO: 793112 - RNA, 19 nt, Homo sapiens
gaccaagagccaccuacau

SEQ ID NO: 793113 - RNA, 19 nt, Homo sapiens
ccaaaucuugaacucagaa

SEQ ID NO: 793114 - RNA, 19 nt, Homo sapiens
cuugaacccuggaccaaag

SEQ ID NO: 793115 - RNA, 19 nt, Homo sapiens
caucaacaaccuccucuac

SEQ ID NO: 793116 - RNA, 19 nt, Homo sapiens
aacaagaucgagagcauug

SEQ ID NO: 793117 - RNA, 19 nt, Homo sapiens
uacgugcggccacuucaua

SEQ ID NO: 793118 - RNA, 19 nt, Homo sapiens
caaggcacucucaaaucuu

SEQ ID NO: 793119 - RNA, 19 nt, Homo sapiens
cuaccaaaccaacuaccuu

SEQ ID NO: 793120 - RNA, 19 nt, Homo sapiens
caagauugagaacaagauc

SEQ ID NO: 793121 - RNA, 19 nt, Homo sapiens
gcgcuugcaccuuccuguu

SEQ ID NO: 793122 - RNA, 19 nt, Homo sapiens
ucuacuaccaaaccaacua

SEQ ID NO: 793123 - RNA, 19 nt, Homo sapiens
caaccuccucuacuaccaa

SEQ ID NO: 793124 - RNA, 19 nt, Homo sapiens
caagagccaccuacaucca

SEQ ID NO: 793125 - RNA, 19 nt, Homo sapiens
caaccuuaagaacaagauu

SEQ ID NO: 793126 - RNA, 19 nt, Homo sapiens
uaacaucgcucaaguuuaa

SEQ ID NO: 793127 - RNA, 19 nt, Homo sapiens
ccacuuaccugcccauaua

SEQ ID NO: 793128 - RNA, 19 nt, Homo sapiens
gaaugaagcugcaguaaag

SEQ ID NO: 793129 - RNA, 19 nt, Homo sapiens
agaagaagaugaugacuaa

SEQ ID NO: 793130 - RNA, 19 nt, Homo sapiens
aaacaaagaugaugaagca

SEQ ID NO: 793131 - RNA, 19 nt, Homo sapiens
aacaauggcugaaguauuu

SEQ ID NO: 793132 - RNA, 19 nt, Homo sapiens
uaaaggaggugaugagguu

SEQ ID NO: 793133 - RNA, 19 nt, Homo sapiens
gaagaagaaguuucagaua

SEQ ID NO: 793134 - RNA, 19 nt, Homo sapiens
aaaggaagaugaagaagaa

SEQ ID NO: 793135 - RNA, 19 nt, Homo sapiens
uacaacagcuccacucaua

SEQ ID NO: 793136 - RNA, 19 nt, Homo sapiens
gaaaugggugcauaauaua

SEQ ID NO: 793137 - RNA, 19 nt, Homo sapiens
gaagaaaccaauagagauu

SEQ ID NO: 793138 - RNA, 19 nt, Homo sapiens
ggauuggcauuuaugguua

SEQ ID NO: 793139 - RNA, 19 nt, Homo sapiens
guauauggauuggcauuua

SEQ ID NO: 793140 - RNA, 19 nt, Homo sapiens
gaagauagcaacaacauca

SEQ ID NO: 793141 - RNA, 19 nt, Homo sapiens
gcaugaagcuuucucagau

SEQ ID NO: 793142 - RNA, 19 nt, Homo sapiens
guacagaacugauguugag

SEQ ID NO: 793143 - RNA, 19 nt, Homo sapiens
caauagagauucccaaagu

SEQ ID NO: 793144 - RNA, 19 nt, Homo sapiens
acaguaggauccuuaguua

SEQ ID NO: 793145 - RNA, 19 nt, Homo sapiens
ggcuggagcuucugaauuu

SEQ ID NO: 793146 - RNA, 19 nt, Homo sapiens
gaaguuuguugacucguaa

SEQ ID NO: 793147 - RNA, 19 nt, Homo sapiens
gaaaguguaucauaaacca

SEQ ID NO: 793148 - RNA, 19 nt, Homo sapiens
gcaaacaccacaaauaugu

SEQ ID NO: 793149 - RNA, 19 nt, Homo sapiens
ggaaggagcagacauuaau

SEQ ID NO: 793150 - RNA, 19 nt, Homo sapiens
gauaaucucuugauaagcu

SEQ ID NO: 793151 - RNA, 19 nt, Homo sapiens
caagaaaacugcuaaauca

SEQ ID NO: 793152 - RNA, 19 nt, Homo sapiens
aauguaaucugccaacuaa

SEQ ID NO: 793153 - RNA, 19 nt, Homo sapiens
aagcugaacuacauccuua

SEQ ID NO: 793154 - RNA, 19 nt, Homo sapiens
caagaauggugguggcuuu

SEQ ID NO: 793155 - RNA, 19 nt, Homo sapiens
gaagaagaagaaaccaaua

SEQ ID NO: 793156 - RNA, 19 nt, Homo sapiens
gauaaguucuagcucuaaa

SEQ ID NO: 793157 - RNA, 19 nt, Homo sapiens
gagcaaauucgauuaaaga

SEQ ID NO: 793158 - RNA, 19 nt, Homo sapiens
gguguuagaugaugaagau

SEQ ID NO: 793159 - RNA, 19 nt, Homo sapiens
ugaagaagaucagcaauuc

SEQ ID NO: 793160 - RNA, 19 nt, Homo sapiens
ggaaugaagcugcaguaaa

SEQ ID NO: 793161 - RNA, 19 nt, Homo sapiens
aaucacagguguuagauga

SEQ ID NO: 793162 - RNA, 19 nt, Homo sapiens
gcagcucccucauauugaa

SEQ ID NO: 793163 - RNA, 19 nt, Homo sapiens
gcacaacacagauuuauac

SEQ ID NO: 793164 - RNA, 19 nt, Homo sapiens
cagcuccacucauagauuu

SEQ ID NO: 793165 - RNA, 19 nt, Homo sapiens
gagcagacauuaauaucca

SEQ ID NO: 793166 - RNA, 19 nt, Homo sapiens
gaaggagcagacauuaaua

SEQ ID NO: 793167 - RNA, 19 nt, Homo sapiens
gcaaacaauggcugaagua

SEQ ID NO: 793168 - RNA, 19 nt, Homo sapiens
ugacuaagcaguacucuga

SEQ ID NO: 793169 - RNA, 19 nt, Homo sapiens
gccacaagcuuuggaauug

SEQ ID NO: 793170 - RNA, 19 nt, Homo sapiens
agaguuaucagacagauua

SEQ ID NO: 793171 - RNA, 19 nt, Homo sapiens
gagaauaccaagaauacaa

SEQ ID NO: 793172 - RNA, 19 nt, Homo sapiens
gcaggcaaauggagucguu

SEQ ID NO: 793173 - RNA, 19 nt, Homo sapiens
gauaagcucuguuguugac

SEQ ID NO: 793174 - RNA, 19 nt, Homo sapiens
ccacaguguuugcacauau

SEQ ID NO: 793175 - RNA, 19 nt, Homo sapiens
ugaauuugauccucaguau

SEQ ID NO: 793176 - RNA, 19 nt, Homo sapiens
gaagcagaguggcaagaau

SEQ ID NO: 793177 - RNA, 19 nt, Homo sapiens
ugagaaagaugaugguagu

SEQ ID NO: 793178 - RNA, 19 nt, Homo sapiens
agacggguuucuaaucaua

SEQ ID NO: 793179 - RNA, 19 nt, Homo sapiens
uagcaaacaccacaaauau

SEQ ID NO: 793180 - RNA, 19 nt, Homo sapiens
ggaagaagaggaggaagaa

SEQ ID NO: 793181 - RNA, 19 nt, Homo sapiens
uaaguaacaucgcucaagu

SEQ ID NO: 793182 - RNA, 19 nt, Homo sapiens
uaaguaacaucgcucaagu

SEQ ID NO: 793183 - RNA, 19 nt, Homo sapiens
uggcaagaauuacaacaaa

SEQ ID NO: 793184 - RNA, 19 nt, Homo sapiens
gaugggcauuguucuuauu

SEQ ID NO: 793185 - RNA, 19 nt, Homo sapiens
caacagcuccacucauaga

SEQ ID NO: 793186 - RNA, 19 nt, Homo sapiens
acagugggauacagcaaua

SEQ ID NO: 793187 - RNA, 19 nt, Homo sapiens
ggagguagagcugaaguuu

SEQ ID NO: 793188 - RNA, 19 nt, Homo sapiens
gcagaccaacggauaauau

SEQ ID NO: 793189 - RNA, 19 nt, Homo sapiens
ggaacaccuucuucuacuu

SEQ ID NO: 793190 - RNA, 19 nt, Homo sapiens
ucacauuccacaugauaua

SEQ ID NO: 793191 - RNA, 19 nt, Homo sapiens
gagaucagacuccuauaug

SEQ ID NO: 793192 - RNA, 19 nt, Homo sapiens
gauggcaacagaagaguaa

SEQ ID NO: 793193 - RNA, 19 nt, Homo sapiens
aaaggaggauggcaacaga

SEQ ID NO: 793194 - RNA, 19 nt, Homo sapiens
cacaguagcagaaauuaaa

SEQ ID NO: 793195 - RNA, 19 nt, Homo sapiens
gaacaccuucuucuacuuc

SEQ ID NO: 793196 - RNA, 19 nt, Homo sapiens
gaagaaguuucagauaagg

SEQ ID NO: 793197 - RNA, 19 nt, Homo sapiens
ggaagaugaagaagaaguu

SEQ ID NO: 793198 - RNA, 19 nt, Homo sapiens
gaguaaaggacccaagaaa

SEQ ID NO: 793199 - RNA, 19 nt, Homo sapiens
uguaaucugccaacuaaua

SEQ ID NO: 793200 - RNA, 19 nt, Homo sapiens
gaauuugauccucaguaua

SEQ ID NO: 793201 - RNA, 19 nt, Homo sapiens
ggaugggcauuguucuuau

SEQ ID NO: 793202 - RNA, 19 nt, Homo sapiens
agugagggcuuugaagaua

SEQ ID NO: 793203 - RNA, 19 nt, Homo sapiens
agaagaaguuucagauaag

SEQ ID NO: 793204 - RNA, 19 nt, Homo sapiens
uaccacagcuaaucagaga

SEQ ID NO: 793205 - RNA, 19 nt, Homo sapiens
ggaggacagugagggcuuu

SEQ ID NO: 793206 - RNA, 19 nt, Homo sapiens
gaaagauacagaggaggua

SEQ ID NO: 793207 - RNA, 19 nt, Homo sapiens
gaagaugaagaagaaguuu

SEQ ID NO: 793208 - RNA, 19 nt, Homo sapiens
ucagggacuucagcaauuu

SEQ ID NO: 793209 - RNA, 19 nt, Homo sapiens
cagagaaauuggcagcauu

SEQ ID NO: 793210 - RNA, 19 nt, Homo sapiens
ggaauugcccugccagcuu

SEQ ID NO: 793211 - RNA, 19 nt, Homo sapiens
ggaaaguaaguauaacaug

SEQ ID NO: 793212 - RNA, 19 nt, Homo sapiens
uugauaagcucuguuguug

SEQ ID NO: 793213 - RNA, 19 nt, Homo sapiens
uguauuaucugaucagucu

SEQ ID NO: 793214 - RNA, 19 nt, Homo sapiens
uauuauaacuguccagaag

SEQ ID NO: 793215 - RNA, 19 nt, Homo sapiens
uggaucagauuaaaccauu

SEQ ID NO: 793216 - RNA, 19 nt, Homo sapiens
gaauggugguggcuuuaca

SEQ ID NO: 793217 - RNA, 19 nt, Homo sapiens
uaaaggaagaugaagaaga

SEQ ID NO: 793218 - RNA, 19 nt, Homo sapiens
gaagaugggcagggugaaa

SEQ ID NO: 793219 - RNA, 19 nt, Homo sapiens
uuacaguguugguuaaguu

SEQ ID NO: 793220 - RNA, 19 nt, Homo sapiens
aagaaugagccuccacuua

SEQ ID NO: 793221 - RNA, 19 nt, Homo sapiens
agaaguuuguugacucgua

SEQ ID NO: 793222 - RNA, 19 nt, Homo sapiens
acugguggcuuauguuauu

SEQ ID NO: 793223 - RNA, 19 nt, Homo sapiens
gaucagauuaaaccauuga

SEQ ID NO: 793224 - RNA, 19 nt, Homo sapiens
ggucauaaguuggcauucu

SEQ ID NO: 793225 - RNA, 19 nt, Homo sapiens
ugaauggaccacaguguuu

SEQ ID NO: 793226 - RNA, 19 nt, Homo sapiens
ggaaaggaguuaauagaaa

SEQ ID NO: 793227 - RNA, 19 nt, Homo sapiens
ggaacaaacuuuacuacaa

SEQ ID NO: 793228 - RNA, 19 nt, Homo sapiens
ggacagugccuucagguua

SEQ ID NO: 793229 - RNA, 19 nt, Homo sapiens
gagaauggauuaauacauc

SEQ ID NO: 793230 - RNA, 19 nt, Homo sapiens
gaaagguacuuaaacuuca

SEQ ID NO: 793231 - RNA, 19 nt, Homo sapiens
gaagaaggccggaaaggaa

SEQ ID NO: 793232 - RNA, 19 nt, Homo sapiens
gauacgaaaugguguuaaa

SEQ ID NO: 793233 - RNA, 19 nt, Homo sapiens
gaacuuaggagaucacgaa

SEQ ID NO: 793234 - RNA, 19 nt, Homo sapiens
ugaaggaaaugaugcauau

SEQ ID NO: 793235 - RNA, 19 nt, Homo sapiens
gagaacuccuuuacaagaa

SEQ ID NO: 793236 - RNA, 19 nt, Homo sapiens
gaaaggaguuaauagaaac

SEQ ID NO: 793237 - RNA, 19 nt, Homo sapiens
acaaagagcugaguaagga

SEQ ID NO: 793238 - RNA, 19 nt, Homo sapiens
gucaagggcuauuuaauga

SEQ ID NO: 793239 - RNA, 19 nt, Homo sapiens
acagagaacuccuuuacaa

SEQ ID NO: 793240 - RNA, 19 nt, Homo sapiens
gacugaagcuucguuagua

SEQ ID NO: 793241 - RNA, 19 nt, Homo sapiens
gagaaggcauuuccuaagu

SEQ ID NO: 793242 - RNA, 19 nt, Homo sapiens
gaaguaugaugaaaugagu

SEQ ID NO: 793243 - RNA, 19 nt, Homo sapiens
ggagaaaguuugccaugag

SEQ ID NO: 793244 - RNA, 19 nt, Homo sapiens
uaaauuacauggccgagau

SEQ ID NO: 793245 - RNA, 19 nt, Homo sapiens
uaaacaagaggcuaccuua

SEQ ID NO: 793246 - RNA, 19 nt, Homo sapiens
gcagagacaccacaaugaa

SEQ ID NO: 793247 - RNA, 19 nt, Homo sapiens
gaaacuacuuuggagaaug

SEQ ID NO: 793248 - RNA, 19 nt, Homo sapiens
gaaaugaguauucucuuca

SEQ ID NO: 793249 - RNA, 19 nt, Homo sapiens
uggaacaacuuuauucgaa

SEQ ID NO: 793250 - RNA, 19 nt, Homo sapiens
uaagguugcuuuggaugua

SEQ ID NO: 793251 - RNA, 19 nt, Homo sapiens
aguauucucuucacaguuu

SEQ ID NO: 793252 - RNA, 19 nt, Homo sapiens
gaaccuggccgcagaaugg

SEQ ID NO: 793253 - RNA, 19 nt, Homo sapiens
gcgaggcgcuguuagagau

SEQ ID NO: 793254 - RNA, 19 nt, Homo sapiens
ugaaaugaguauucucuuc

SEQ ID NO: 793255 - RNA, 19 nt, Homo sapiens
gggaaaggaguuaauagaa

SEQ ID NO: 793256 - RNA, 19 nt, Homo sapiens
gcagaaacucuacgcgaaa

SEQ ID NO: 793257 - RNA, 19 nt, Homo sapiens
ggaccucgguggugguguu

SEQ ID NO: 793258 - RNA, 19 nt, Homo sapiens
gagaaaguuugccaugagu

SEQ ID NO: 793259 - RNA, 19 nt, Homo sapiens
gaacggcgagcacccagaa

SEQ ID NO: 793260 - RNA, 19 nt, Homo sapiens
caagggcuauuuaaugagu

SEQ ID NO: 793261 - RNA, 19 nt, Homo sapiens
acacuaagcagauacgaaa

SEQ ID NO: 793262 - RNA, 19 nt, Homo sapiens
acaagaggcuaccuuaugg

SEQ ID NO: 793263 - RNA, 19 nt, Homo sapiens
gaaacccuguggaacuuag

SEQ ID NO: 793264 - RNA, 19 nt, Homo sapiens
gacagugccuucagguuag

SEQ ID NO: 793265 - RNA, 19 nt, Homo sapiens
cuuaggagaucacgaacuu

SEQ ID NO: 793266 - RNA, 19 nt, Homo sapiens
gaaaugaugcauauaucca

SEQ ID NO: 793267 - RNA, 19 nt, Homo sapiens
cagagaaggcauuuccuaa

SEQ ID NO: 793268 - RNA, 19 nt, Homo sapiens
gaaggaaaugaugcauaua

SEQ ID NO: 793269 - RNA, 19 nt, Homo sapiens
cuauuaagguugcuuugga

SEQ ID NO: 793270 - RNA, 19 nt, Homo sapiens
ggcaaugugucuaaauuac

SEQ ID NO: 793271 - RNA, 19 nt, Homo sapiens
uagaaacccuguggaacuu

SEQ ID NO: 793272 - RNA, 19 nt, Homo sapiens
gccuggaucugguaaacaa

SEQ ID NO: 793273 - RNA, 19 nt, Homo sapiens
caucagcuaagaauguaua

SEQ ID NO: 793274 - RNA, 19 nt, Homo sapiens
aaacuacuuuggagaaugg

SEQ ID NO: 793275 - RNA, 19 nt, Homo sapiens
uaauagaaacccuguggaa

SEQ ID NO: 793276 - RNA, 19 nt, Homo sapiens
ggauuaauacaucugagaa

SEQ ID NO: 793277 - RNA, 19 nt, Homo sapiens
acacauguauccuggcaau

SEQ ID NO: 793278 - RNA, 19 nt, Homo sapiens
cuaguagcauuucuugaga

SEQ ID NO: 793279 - RNA, 19 nt, Homo sapiens
aaacuaugcaguccucauu

SEQ ID NO: 793280 - RNA, 19 nt, Homo sapiens
caaaccaguggcuugauuu

SEQ ID NO: 793281 - RNA, 19 nt, Homo sapiens
caaaggagggcaugugaag

SEQ ID NO: 793282 - RNA, 19 nt, Homo sapiens
gcguagaguugcggaagaa

SEQ ID NO: 793283 - RNA, 19 nt, Homo sapiens
cagcuaagaauguauagau

SEQ ID NO: 793284 - RNA, 19 nt, Homo sapiens
agagaacuccuuuacaaga

SEQ ID NO: 793285 - RNA, 19 nt, Homo sapiens
uggccuaccucuaugauuc

SEQ ID NO: 793286 - RNA, 19 nt, Homo sapiens
ggaugaagaaggccggaaa

SEQ ID NO: 793287 - RNA, 19 nt, Homo sapiens
guggcuugauuucugguua

SEQ ID NO: 793288 - RNA, 19 nt, Homo sapiens
ugucaagggcuauuuaaug

SEQ ID NO: 793289 - RNA, 19 nt, Homo sapiens
agaaagguacuuaaacuuc

SEQ ID NO: 793290 - RNA, 19 nt, Homo sapiens
guugggauccguugaguga

SEQ ID NO: 793291 - RNA, 19 nt, Homo sapiens
caagacaaagagcugagua

SEQ ID NO: 793292 - RNA, 19 nt, Homo sapiens
uaucaucagcuaagaaugu

SEQ ID NO: 793293 - RNA, 19 nt, Homo sapiens
gaugaaaugaguauucucu

SEQ ID NO: 793294 - RNA, 19 nt, Homo sapiens
uguguggccugguuauuug

SEQ ID NO: 793295 - RNA, 19 nt, Homo sapiens
agaacuccuuuacaagaaa

SEQ ID NO: 793296 - RNA, 19 nt, Homo sapiens
ugacagagaacuccuuuac

SEQ ID NO: 793297 - RNA, 19 nt, Homo sapiens
gcaaugugucuaaauuaca

SEQ ID NO: 793298 - RNA, 19 nt, Homo sapiens
cagaaacucuacgcgaaau

SEQ ID NO: 793299 - RNA, 19 nt, Homo sapiens
ucagagaaggcauuuccua

SEQ ID NO: 793300 - RNA, 19 nt, Homo sapiens
uggcaaugugucuaaauua

SEQ ID NO: 793301 - RNA, 19 nt, Homo sapiens
gcagauacgaaaugguguu

SEQ ID NO: 793302 - RNA, 19 nt, Homo sapiens
ggagaauggauuaauacau

SEQ ID NO: 793303 - RNA, 19 nt, Homo sapiens
gaagaaccuggccgcagaa

SEQ ID NO: 793304 - RNA, 19 nt, Homo sapiens
uggagaaaguuugccauga

SEQ ID NO: 793305 - RNA, 19 nt, Homo sapiens
gaguaaggaacagcuagua

SEQ ID NO: 793306 - RNA, 19 nt, Homo sapiens
agaaggcauuuccuaagug

SEQ ID NO: 793307 - RNA, 19 nt, Homo sapiens
ugaaacuacuuuggagaau

SEQ ID NO: 793308 - RNA, 19 nt, Homo sapiens
ggaaaggaguagccccaaa

SEQ ID NO: 793309 - RNA, 19 nt, Homo sapiens
cuggcaaugugucuaaauu

SEQ ID NO: 793310 - RNA, 19 nt, Homo sapiens
ugaguauucucuucacagu

SEQ ID NO: 793311 - RNA, 19 nt, Homo sapiens
guaaacaagaggcuaccuu

SEQ ID NO: 793312 - RNA, 19 nt, Homo sapiens
guauauaucaucagcuaag

SEQ ID NO: 793313 - RNA, 19 nt, Homo sapiens
acaccacaaugaaggaaau

SEQ ID NO: 793314 - RNA, 19 nt, Homo sapiens
cuucauagaaagguacuua

SEQ ID NO: 793315 - RNA, 19 nt, Homo sapiens
cuaccucuaugauucuuuc

SEQ ID NO: 793316 - RNA, 19 nt, Homo sapiens
aaacaagaggcuaccuuau

SEQ ID NO: 793317 - RNA, 19 nt, Homo sapiens
ugaagaaggccggaaagga

SEQ ID NO: 793318 - RNA, 19 nt, Homo sapiens
ccggagcuguugacggaaa

SEQ ID NO: 793319 - RNA, 19 nt, Homo sapiens
cgaaaugguguuaaaagua

SEQ ID NO: 793320 - RNA, 19 nt, Homo sapiens
cagauacgaaaugguguua

SEQ ID NO: 793321 - RNA, 19 nt, Homo sapiens
aacaagaggcuaccuuaug

SEQ ID NO: 793322 - RNA, 19 nt, Homo sapiens
gaaacucuacgcgaaaucu

SEQ ID NO: 793323 - RNA, 19 nt, Homo sapiens
uuacugaaacuacuuugga

SEQ ID NO: 793324 - RNA, 19 nt, Homo sapiens
cugguuauuuggaaacuau

SEQ ID NO: 793325 - RNA, 19 nt, Homo sapiens
gcugacagagaacuccuuu

SEQ ID NO: 793326 - RNA, 19 nt, Homo sapiens
ggaaagagauggagaauau

SEQ ID NO: 793327 - RNA, 19 nt, Homo sapiens
gaaauaagacgguguauaa

SEQ ID NO: 793328 - RNA, 19 nt, Homo sapiens
uaacaaagcuguguacuaa

SEQ ID NO: 793329 - RNA, 19 nt, Homo sapiens
gaagacagaugguauuauu

SEQ ID NO: 793330 - RNA, 19 nt, Homo sapiens
gaaccaggaugugcuauua

SEQ ID NO: 793331 - RNA, 19 nt, Homo sapiens
guaaguagauugucauuug

SEQ ID NO: 793332 - RNA, 19 nt, Homo sapiens
ggaaugaauuguucuguuu

SEQ ID NO: 793333 - RNA, 19 nt, Homo sapiens
gaucagaaccucaguauga

SEQ ID NO: 793334 - RNA, 19 nt, Homo sapiens
ggaacgaccuggcugaauu

SEQ ID NO: 793335 - RNA, 19 nt, Homo sapiens
acaaagcuguguacuaaua

SEQ ID NO: 793336 - RNA, 19 nt, Homo sapiens
guagaacacugaagauuug

SEQ ID NO: 793337 - RNA, 19 nt, Homo sapiens
gaagguuucugcuaucaaa

SEQ ID NO: 793338 - RNA, 19 nt, Homo sapiens
ggagugaagucaaagauau

SEQ ID NO: 793339 - RNA, 19 nt, Homo sapiens
caacaguacucuccugaaa

SEQ ID NO: 793340 - RNA, 19 nt, Homo sapiens
gaacuuggcugcucguaca

SEQ ID NO: 793341 - RNA, 19 nt, Homo sapiens
gaauguggcacuucuguua

SEQ ID NO: 793342 - RNA, 19 nt, Homo sapiens
ggaguggcuuucacauuua

SEQ ID NO: 793343 - RNA, 19 nt, Homo sapiens
gaacgcauuuguuauugaa

SEQ ID NO: 793344 - RNA, 19 nt, Homo sapiens
cccaaacucuuacaucuua

SEQ ID NO: 793345 - RNA, 19 nt, Homo sapiens
ggauacagcuauucuuaga

SEQ ID NO: 793346 - RNA, 19 nt, Homo sapiens
gcucguacaugcugucuuu

SEQ ID NO: 793347 - RNA, 19 nt, Homo sapiens
gaauguuaauguccuagua

SEQ ID NO: 793348 - RNA, 19 nt, Homo sapiens
ucacaucucucccugauau

SEQ ID NO: 793349 - RNA, 19 nt, Homo sapiens
ugaaagaaauggcaaguuc

SEQ ID NO: 793350 - RNA, 19 nt, Homo sapiens
gcagauaaauuggagcauu

SEQ ID NO: 793351 - RNA, 19 nt, Homo sapiens
ucaaagauauucaggaugu

SEQ ID NO: 793352 - RNA, 19 nt, Homo sapiens
ucaagaaacuccucucguu

SEQ ID NO: 793353 - RNA, 19 nt, Homo sapiens
gcaaugagauguguuugug

SEQ ID NO: 793354 - RNA, 19 nt, Homo sapiens
gacuggaguugaauuauuu

SEQ ID NO: 793355 - RNA, 19 nt, Homo sapiens
agagaggccuucaccaaua

SEQ ID NO: 793356 - RNA, 19 nt, Homo sapiens
gcucuucgauccuuaauca

SEQ ID NO: 793357 - RNA, 19 nt, Homo sapiens
ucaagucgccuguuguuua

SEQ ID NO: 793358 - RNA, 19 nt, Homo sapiens
gaugaccuguuucaaauau

SEQ ID NO: 793359 - RNA, 19 nt, Homo sapiens
ggaguugaauguauugaau

SEQ ID NO: 793360 - RNA, 19 nt, Homo sapiens
gauggaaggcuacuuauau

SEQ ID NO: 793361 - RNA, 19 nt, Homo sapiens
gaacaaauguaugugucuu

SEQ ID NO: 793362 - RNA, 19 nt, Homo sapiens
ggacagaaagaggaauuua

SEQ ID NO: 793363 - RNA, 19 nt, Homo sapiens
ggaauuaacacccaaaaua

SEQ ID NO: 793364 - RNA, 19 nt, Homo sapiens
ucagagaaguuuaccagaa

SEQ ID NO: 793365 - RNA, 19 nt, Homo sapiens
ggaagacacugaggaggaa

SEQ ID NO: 793366 - RNA, 19 nt, Homo sapiens
auauggagcuuguuucuuu

SEQ ID NO: 793367 - RNA, 19 nt, Homo sapiens
gauaugagccugaugaaag

SEQ ID NO: 793368 - RNA, 19 nt, Homo sapiens
cagcugauccuucaucuaa

SEQ ID NO: 793369 - RNA, 19 nt, Homo sapiens
gaagaggccuauggaacuu

SEQ ID NO: 793370 - RNA, 19 nt, Homo sapiens
gcugacuaauucauucuua

SEQ ID NO: 793371 - RNA, 19 nt, Homo sapiens
cagagggccuugauacaaa

SEQ ID NO: 793372 - RNA, 19 nt, Homo sapiens
acaguacucuccugaaauu

SEQ ID NO: 793373 - RNA, 19 nt, Homo sapiens
gcaaucaugugaagaggau

SEQ ID NO: 793374 - RNA, 19 nt, Homo sapiens
ggaaaugaagacaauguuu

SEQ ID NO: 793375 - RNA, 19 nt, Homo sapiens
guacacaucaguucaagaa

SEQ ID NO: 793376 - RNA, 19 nt, Homo sapiens
ugacuggaguugaauuauu

SEQ ID NO: 793377 - RNA, 19 nt, Homo sapiens
cggcaucugugacucuuua

SEQ ID NO: 793378 - RNA, 19 nt, Homo sapiens
aguaauagcccuucuguuu

SEQ ID NO: 793379 - RNA, 19 nt, Homo sapiens
gcugauccuucaucuaauu

SEQ ID NO: 793380 - RNA, 19 nt, Homo sapiens
uuucuaaucugaacccaua

SEQ ID NO: 793381 - RNA, 19 nt, Homo sapiens
gagaggccuucaccaauau

SEQ ID NO: 793382 - RNA, 19 nt, Homo sapiens
aggaguggcuuucacauuu

SEQ ID NO: 793383 - RNA, 19 nt, Homo sapiens
agaagaagcuccauuucau

SEQ ID NO: 793384 - RNA, 19 nt, Homo sapiens
gagaauauggagcuuguuu

SEQ ID NO: 793385 - RNA, 19 nt, Homo sapiens
ccacaagaaucaugcacuu

SEQ ID NO: 793386 - RNA, 19 nt, Homo sapiens
gcuuguugcuaguggauua

SEQ ID NO: 793387 - RNA, 19 nt, Homo sapiens
gguuaaaguuacuagauga

SEQ ID NO: 793388 - RNA, 19 nt, Homo sapiens
gccaaacccucucagaaga

SEQ ID NO: 793389 - RNA, 19 nt, Homo sapiens
gggaaagucucacaucucu

SEQ ID NO: 793390 - RNA, 19 nt, Homo sapiens
cccaaauccugccaucuua

SEQ ID NO: 793391 - RNA, 19 nt, Homo sapiens
gccaguuccugaagaagua

SEQ ID NO: 793392 - RNA, 19 nt, Homo sapiens
gaagaggaccugccagauc

SEQ ID NO: 793393 - RNA, 19 nt, Homo sapiens
auauacagcugacuaauuc

SEQ ID NO: 793394 - RNA, 19 nt, Homo sapiens
gaaggagaguaucaagcuu

SEQ ID NO: 793395 - RNA, 19 nt, Homo sapiens
caggaugugcuauuaguua

SEQ ID NO: 793396 - RNA, 19 nt, Homo sapiens
ucagauaccugcccaaagg

SEQ ID NO: 793397 - RNA, 19 nt, Homo sapiens
caccuacaaugaucuaauu

SEQ ID NO: 793398 - RNA, 19 nt, Homo sapiens
ccagcaaccucugauauau

SEQ ID NO: 793399 - RNA, 19 nt, Homo sapiens
gagaguaucaagcuuaguu

SEQ ID NO: 793400 - RNA, 19 nt, Homo sapiens
uaaaguagcaacagcagaa

SEQ ID NO: 793401 - RNA, 19 nt, Homo sapiens
gaagaugagagauuuaaag

SEQ ID NO: 793402 - RNA, 19 nt, Homo sapiens
gaagcuccauuucaucaca

SEQ ID NO: 793403 - RNA, 19 nt, Homo sapiens
gcagagggccuugauacaa

SEQ ID NO: 793404 - RNA, 19 nt, Homo sapiens
guaauagcccuucuguuug

SEQ ID NO: 793405 - RNA, 19 nt, Homo sapiens
cgaccuggcugaauugaca

SEQ ID NO: 793406 - RNA, 19 nt, Homo sapiens
caagggagucuuuggauga

SEQ ID NO: 793407 - RNA, 19 nt, Homo sapiens
acacggaaaugaagacaau

SEQ ID NO: 793408 - RNA, 19 nt, Homo sapiens
gaaguuauaaguacacauc

SEQ ID NO: 793409 - RNA, 19 nt, Homo sapiens
ggauggaaggcuacuuaua

SEQ ID NO: 793410 - RNA, 19 nt, Homo sapiens
auuccgaacuacaguauua

SEQ ID NO: 793411 - RNA, 19 nt, Homo sapiens
guuacuagaugacgagguu

SEQ ID NO: 793412 - RNA, 19 nt, Homo sapiens
ccaacaagguuaaaguuac

SEQ ID NO: 793413 - RNA, 19 nt, Homo sapiens
uggaugaccuguuucaaau

SEQ ID NO: 793414 - RNA, 19 nt, Homo sapiens
cagaguagcccacaagaau

SEQ ID NO: 793415 - RNA, 19 nt, Homo sapiens
caaguucuuuccauccauu

SEQ ID NO: 793416 - RNA, 19 nt, Homo sapiens
gaacgaccuggcugaauug

SEQ ID NO: 793417 - RNA, 19 nt, Homo sapiens
caaaggaggaagacacuga

SEQ ID NO: 793418 - RNA, 19 nt, Homo sapiens
gaggaugugaguucagaua

SEQ ID NO: 793419 - RNA, 19 nt, Homo sapiens
ggucuccucucaagaaauc

SEQ ID NO: 793420 - RNA, 19 nt, Homo sapiens
aaauguaugugucuucaga

SEQ ID NO: 793421 - RNA, 19 nt, Homo sapiens
ggaaaccggaacaaaugua

SEQ ID NO: 793422 - RNA, 19 nt, Homo sapiens
gagauguguuugugccauu

SEQ ID NO: 793423 - RNA, 19 nt, Homo sapiens
ugaccucaguguuucuuaa

SEQ ID NO: 793424 - RNA, 19 nt, Homo sapiens
ucaccaauauuguguaucu

SEQ ID NO: 793425 - RNA, 19 nt, Homo sapiens
caauggaugaugaagguua

SEQ ID NO: 793426 - RNA, 19 nt, Homo sapiens
ggauauagcuagugcaaua

SEQ ID NO: 793427 - RNA, 19 nt, Homo sapiens
gaagaaauauugcagugaa

SEQ ID NO: 793428 - RNA, 19 nt, Homo sapiens
gaacugccuuuaucuguaa

SEQ ID NO: 793429 - RNA, 19 nt, Homo sapiens
gcgauaugcugcaagauaa

SEQ ID NO: 793430 - RNA, 19 nt, Homo sapiens
uggaagagaugaagaauga

SEQ ID NO: 793431 - RNA, 19 nt, Homo sapiens
caaaccaacuuaauacuuc

SEQ ID NO: 793432 - RNA, 19 nt, Homo sapiens
gcugcaagauaauguauuu

SEQ ID NO: 793433 - RNA, 19 nt, Homo sapiens
ggauucaguuccaguuuaa

SEQ ID NO: 793434 - RNA, 19 nt, Homo sapiens
ucaguaagaucccagauga

SEQ ID NO: 793435 - RNA, 19 nt, Homo sapiens
caaaagaauuuacgccuua

SEQ ID NO: 793436 - RNA, 19 nt, Homo sapiens
ccacauccaugguuucuau

SEQ ID NO: 793437 - RNA, 19 nt, Homo sapiens
gaaugaggaugacaaugga

SEQ ID NO: 793438 - RNA, 19 nt, Homo sapiens
guagaagaguauaugauug

SEQ ID NO: 793439 - RNA, 19 nt, Homo sapiens
ggcaauaaauguguucgua

SEQ ID NO: 793440 - RNA, 19 nt, Homo sapiens
uauggcagcugaugaugua

SEQ ID NO: 793441 - RNA, 19 nt, Homo sapiens
gcaauaaauguguucguaa

SEQ ID NO: 793442 - RNA, 19 nt, Homo sapiens
gcacgagcacuuaaacaaa

SEQ ID NO: 793443 - RNA, 19 nt, Homo sapiens
guaguuggcuuuugaauga

SEQ ID NO: 793444 - RNA, 19 nt, Homo sapiens
ggaagaaggaagagacaaa

SEQ ID NO: 793445 - RNA, 19 nt, Homo sapiens
guauugaacugccuuuauc

SEQ ID NO: 793446 - RNA, 19 nt, Homo sapiens
gaaauauugcagugaauga

SEQ ID NO: 793447 - RNA, 19 nt, Homo sapiens
ugaacugccuuuaucugua

SEQ ID NO: 793448 - RNA, 19 nt, Homo sapiens
gcaaggcaauaaauguguu

SEQ ID NO: 793449 - RNA, 19 nt, Homo sapiens
gcacuuaaacaaauucuca

SEQ ID NO: 793450 - RNA, 19 nt, Homo sapiens
gagagccgcuuucaucaag

SEQ ID NO: 793451 - RNA, 19 nt, Homo sapiens
cggauucaguuccaguuua

SEQ ID NO: 793452 - RNA, 19 nt, Homo sapiens
gaaggaagagacaaauguu

SEQ ID NO: 793453 - RNA, 19 nt, Homo sapiens
ccugaaaguuguauauguu

SEQ ID NO: 793454 - RNA, 19 nt, Homo sapiens
caauaaauguguucguaag

SEQ ID NO: 793455 - RNA, 19 nt, Homo sapiens
ucauguauccuguguuuaa

SEQ ID NO: 793456 - RNA, 19 nt, Homo sapiens
gauguugaaugggauuauu

SEQ ID NO: 793457 - RNA, 19 nt, Homo sapiens
guaaaguacuccaaaaguu

SEQ ID NO: 793458 - RNA, 19 nt, Homo sapiens
agucauguauccuguguuu

SEQ ID NO: 793459 - RNA, 19 nt, Homo sapiens
gaagauuccucugcauuuu

SEQ ID NO: 793460 - RNA, 19 nt, Homo sapiens
gaauuuacgccuuaaugug

SEQ ID NO: 793461 - RNA, 19 nt, Homo sapiens
gcagucauguauccugugu

SEQ ID NO: 793462 - RNA, 19 nt, Homo sapiens
cacgagcacuuaaacaaau

SEQ ID NO: 793463 - RNA, 19 nt, Homo sapiens
gaagaaggaagagacaaau

SEQ ID NO: 793464 - RNA, 19 nt, Homo sapiens
gaaaaggcacgagcacuua

SEQ ID NO: 793465 - RNA, 19 nt, Homo sapiens
gaagaggagcacuggaaga

SEQ ID NO: 793466 - RNA, 19 nt, Homo sapiens
ugaagauuccucugcauuu

SEQ ID NO: 793467 - RNA, 19 nt, Homo sapiens
uuaaugauguggcccucua

SEQ ID NO: 793468 - RNA, 19 nt, Homo sapiens
aaagcgauaugcugcaaga

SEQ ID NO: 793469 - RNA, 19 nt, Homo sapiens
guaagugccaaccgacuaa

SEQ ID NO: 793470 - RNA, 19 nt, Homo sapiens
gaacuucuugauacaguga

SEQ ID NO: 793471 - RNA, 19 nt, Homo sapiens
gaagagaugaagaaugaag

SEQ ID NO: 793472 - RNA, 19 nt, Homo sapiens
ggaugacaauggaagagau

SEQ ID NO: 793473 - RNA, 19 nt, Homo sapiens
gguguuuguuucugacauu

SEQ ID NO: 793474 - RNA, 19 nt, Homo sapiens
aaagauggcaaggcaauaa

SEQ ID NO: 793475 - RNA, 19 nt, Homo sapiens
cauaaucucacacugaaga

SEQ ID NO: 793476 - RNA, 19 nt, Homo sapiens
gccugaaaguuguauaugu

SEQ ID NO: 793477 - RNA, 19 nt, Homo sapiens
cugaugauguagaagagua

SEQ ID NO: 793478 - RNA, 19 nt, Homo sapiens
uguauccuguguuuaauga

SEQ ID NO: 793479 - RNA, 19 nt, Homo sapiens
ggagauaauuuugccuuaa

SEQ ID NO: 793480 - RNA, 19 nt, Homo sapiens
cggagucccuucuucguau

SEQ ID NO: 793481 - RNA, 19 nt, Homo sapiens
caucaaaccaacuuaauac

SEQ ID NO: 793482 - RNA, 19 nt, Homo sapiens
gcagacaaucaaggauaua

SEQ ID NO: 793483 - RNA, 19 nt, Homo sapiens
ggccauggcugaggcacuu

SEQ ID NO: 793484 - RNA, 19 nt, Homo sapiens
caauggaagagaugaagaa

SEQ ID NO: 793485 - RNA, 19 nt, Homo sapiens
aaucauaaucucacacuga

SEQ ID NO: 793486 - RNA, 19 nt, Homo sapiens
ugggauuauugccaucuua

SEQ ID NO: 793487 - RNA, 19 nt, Homo sapiens
gugauacucugaaaacgua

SEQ ID NO: 793488 - RNA, 19 nt, Homo sapiens
ucacacaagacaucauuau

SEQ ID NO: 793489 - RNA, 19 nt, Homo sapiens
ugaaugaggaugacaaugg

SEQ ID NO: 793490 - RNA, 19 nt, Homo sapiens
ugaaagcgauaugcugcaa

SEQ ID NO: 793491 - RNA, 19 nt, Homo sapiens
ccaaccgacuaauucauca

SEQ ID NO: 793492 - RNA, 19 nt, Homo sapiens
gauauagcuagugcaauaa

SEQ ID NO: 793493 - RNA, 19 nt, Homo sapiens
ugagguuucugcagacaau

SEQ ID NO: 793494 - RNA, 19 nt, Homo sapiens
gauguagaagaguauauga

SEQ ID NO: 793495 - RNA, 19 nt, Homo sapiens
ucaaaacuguggccugaaa

SEQ ID NO: 793496 - RNA, 19 nt, Homo sapiens
ggcagcugaugauguagaa

SEQ ID NO: 793497 - RNA, 19 nt, Homo sapiens
gaaccgcagggcacuugaa

SEQ ID NO: 793498 - RNA, 19 nt, Homo sapiens
auaaauguguucguaagug

SEQ ID NO: 793499 - RNA, 19 nt, Homo sapiens
gauggcaaggcaauaaaug

SEQ ID NO: 793500 - RNA, 19 nt, Homo sapiens
uccaaaaguuucagugaua

SEQ ID NO: 793501 - RNA, 19 nt, Homo sapiens
ggcacgagcacuuaaacaa

SEQ ID NO: 793502 - RNA, 19 nt, Homo sapiens
gaccagagccagaauucca

SEQ ID NO: 793503 - RNA, 19 nt, Homo sapiens
gaacgaccagagccagaau

SEQ ID NO: 793504 - RNA, 19 nt, Homo sapiens
uaaagauggcaaggcaaua

SEQ ID NO: 793505 - RNA, 19 nt, Homo sapiens
ggagucccuucuucguaug

SEQ ID NO: 793506 - RNA, 19 nt, Homo sapiens
agaaggaagagacaaaugu

SEQ ID NO: 793507 - RNA, 19 nt, Homo sapiens
uaccuaagaucaguguguu

SEQ ID NO: 793508 - RNA, 19 nt, Homo sapiens
aaucaaggauauagcuagu

SEQ ID NO: 793509 - RNA, 19 nt, Homo sapiens
ugucauaccuaagaucagu

SEQ ID NO: 793510 - RNA, 19 nt, Homo sapiens
cagcugaugauguagaaga

SEQ ID NO: 793511 - RNA, 19 nt, Homo sapiens
cggaagaggagcacuggaa

SEQ ID NO: 793512 - RNA, 19 nt, Homo sapiens
gaaauaucaauaccagaac

SEQ ID NO: 793513 - RNA, 19 nt, Homo sapiens
cugcagacaaucaaggaua

SEQ ID NO: 793514 - RNA, 19 nt, Homo sapiens
gauaugcugcaagauaaug

SEQ ID NO: 793515 - RNA, 19 nt, Homo sapiens
ugcagacaaucaaggauau

SEQ ID NO: 793516 - RNA, 19 nt, Homo sapiens
ugauguggcccucuaagga

SEQ ID NO: 793517 - RNA, 19 nt, Homo sapiens
cuagaacgaguaaaucugu

SEQ ID NO: 793518 - RNA, 19 nt, Homo sapiens
gagcuagaacgaguaaauc

SEQ ID NO: 793519 - RNA, 19 nt, Homo sapiens
ugagcuagaacgaguaaau

SEQ ID NO: 793520 - RNA, 19 nt, Homo sapiens
gaugauguagaagaguaua

SEQ ID NO: 793521 - RNA, 19 nt, Homo sapiens
aaauccaggucucacacaa

SEQ ID NO: 793522 - RNA, 19 nt, Homo sapiens
aucauaaucucacacugaa

SEQ ID NO: 793523 - RNA, 19 nt, Homo sapiens
uacagugaauaaugucuuc

SEQ ID NO: 793524 - RNA, 19 nt, Homo sapiens
ucccagaugagaucaauga

SEQ ID NO: 793525 - RNA, 19 nt, Homo sapiens
ggugucauaccuaagauca

SEQ ID NO: 793526 - RNA, 19 nt, Homo sapiens
ggauauagcuagugcaaua

SEQ ID NO: 793527 - RNA, 19 nt, Homo sapiens
gaagaaauauugcagugaa

SEQ ID NO: 793528 - RNA, 19 nt, Homo sapiens
gaacugccuuuaucuguaa

SEQ ID NO: 793529 - RNA, 19 nt, Homo sapiens
gcgauaugcugcaagauaa

SEQ ID NO: 793530 - RNA, 19 nt, Homo sapiens
uggaagagaugaagaauga

SEQ ID NO: 793531 - RNA, 19 nt, Homo sapiens
ggaagugacuaacagcauu

SEQ ID NO: 793532 - RNA, 19 nt, Homo sapiens
caaaccaacuuaauacuuc

SEQ ID NO: 793533 - RNA, 19 nt, Homo sapiens
gcugcaagauaauguauuu

SEQ ID NO: 793534 - RNA, 19 nt, Homo sapiens
ucaguaagaucccagauga

SEQ ID NO: 793535 - RNA, 19 nt, Homo sapiens
caaaagaauuuacgccuua

SEQ ID NO: 793536 - RNA, 19 nt, Homo sapiens
ccacauccaugguuucuau

SEQ ID NO: 793537 - RNA, 19 nt, Homo sapiens
gaaugaggaugacaaugga

SEQ ID NO: 793538 - RNA, 19 nt, Homo sapiens
guagaagaguauaugauug

SEQ ID NO: 793539 - RNA, 19 nt, Homo sapiens
ggcaauaaauguguucgua

SEQ ID NO: 793540 - RNA, 19 nt, Homo sapiens
uauggcagcugaugaugua

SEQ ID NO: 793541 - RNA, 19 nt, Homo sapiens
gcaauaaauguguucguaa

SEQ ID NO: 793542 - RNA, 19 nt, Homo sapiens
gcacgagcacuuaaacaaa

SEQ ID NO: 793543 - RNA, 19 nt, Homo sapiens
guaguuggcuuuugaauga

SEQ ID NO: 793544 - RNA, 19 nt, Homo sapiens
guauugaacugccuuuauc

SEQ ID NO: 793545 - RNA, 19 nt, Homo sapiens
gaaauauugcagugaauga

SEQ ID NO: 793546 - RNA, 19 nt, Homo sapiens
ugaacugccuuuaucugua

SEQ ID NO: 793547 - RNA, 19 nt, Homo sapiens
gcaaggcaauaaauguguu

SEQ ID NO: 793548 - RNA, 19 nt, Homo sapiens
gcacuuaaacaaauucuca

SEQ ID NO: 793549 - RNA, 19 nt, Homo sapiens
gagagccgcuuucaucaag

SEQ ID NO: 793550 - RNA, 19 nt, Homo sapiens
ccugaaaguuguauauguu

SEQ ID NO: 793551 - RNA, 19 nt, Homo sapiens
caauaaauguguucguaag

SEQ ID NO: 793552 - RNA, 19 nt, Homo sapiens
ucauguauccuguguuuaa

SEQ ID NO: 793553 - RNA, 19 nt, Homo sapiens
gauguugaaugggauuauu

SEQ ID NO: 793554 - RNA, 19 nt, Homo sapiens
gaagugacuaacagcauuu

SEQ ID NO: 793555 - RNA, 19 nt, Homo sapiens
guaaaguacuccaaaaguu

SEQ ID NO: 793556 - RNA, 19 nt, Homo sapiens
agucauguauccuguguuu

SEQ ID NO: 793557 - RNA, 19 nt, Homo sapiens
gaagauuccucugcauuuu

SEQ ID NO: 793558 - RNA, 19 nt, Homo sapiens
gaauuuacgccuuaaugug

SEQ ID NO: 793559 - RNA, 19 nt, Homo sapiens
gcagucauguauccugugu

SEQ ID NO: 793560 - RNA, 19 nt, Homo sapiens
cacgagcacuuaaacaaau

SEQ ID NO: 793561 - RNA, 19 nt, Homo sapiens
ugaagucagugccucaguu

SEQ ID NO: 793562 - RNA, 19 nt, Homo sapiens
gaagucagugccucaguug

SEQ ID NO: 793563 - RNA, 19 nt, Homo sapiens
gaaaaggcacgagcacuua

SEQ ID NO: 793564 - RNA, 19 nt, Homo sapiens
ugaagauuccucugcauuu

SEQ ID NO: 793565 - RNA, 19 nt, Homo sapiens
aaagcgauaugcugcaaga

SEQ ID NO: 793566 - RNA, 19 nt, Homo sapiens
guaagugccaaccgacuaa

SEQ ID NO: 793567 - RNA, 19 nt, Homo sapiens
gaacuucuugauacaguga

SEQ ID NO: 793568 - RNA, 19 nt, Homo sapiens
gaagagaugaagaaugaag

SEQ ID NO: 793569 - RNA, 19 nt, Homo sapiens
ggaugacaauggaagagau

SEQ ID NO: 793570 - RNA, 19 nt, Homo sapiens
gguguuuguuucugacauu

SEQ ID NO: 793571 - RNA, 19 nt, Homo sapiens
aaagauggcaaggcaauaa

SEQ ID NO: 793572 - RNA, 19 nt, Homo sapiens
cauaaucucacacugaaga

SEQ ID NO: 793573 - RNA, 19 nt, Homo sapiens
gccugaaaguuguauaugu

SEQ ID NO: 793574 - RNA, 19 nt, Homo sapiens
cugaugauguagaagagua

SEQ ID NO: 793575 - RNA, 19 nt, Homo sapiens
uguauccuguguuuaauga

SEQ ID NO: 793576 - RNA, 19 nt, Homo sapiens
cggagucccuucuucguau

SEQ ID NO: 793577 - RNA, 19 nt, Homo sapiens
caucaaaccaacuuaauac

SEQ ID NO: 793578 - RNA, 19 nt, Homo sapiens
aaaucuuggucucuuguuu

SEQ ID NO: 793579 - RNA, 19 nt, Homo sapiens
ggugggaagugaagucagu

SEQ ID NO: 793580 - RNA, 19 nt, Homo sapiens
gcugcaaggugggaaguga

SEQ ID NO: 793581 - RNA, 19 nt, Homo sapiens
gcagacaaucaaggauaua

SEQ ID NO: 793582 - RNA, 19 nt, Homo sapiens
caauggaagagaugaagaa

SEQ ID NO: 793583 - RNA, 19 nt, Homo sapiens
aaucauaaucucacacuga

SEQ ID NO: 793584 - RNA, 19 nt, Homo sapiens
ugggauuauugccaucuua

SEQ ID NO: 793585 - RNA, 19 nt, Homo sapiens
gugauacucugaaaacgua

SEQ ID NO: 793586 - RNA, 19 nt, Homo sapiens
ucacacaagacaucauuau

SEQ ID NO: 793587 - RNA, 19 nt, Homo sapiens
ugaaugaggaugacaaugg

SEQ ID NO: 793588 - RNA, 19 nt, Homo sapiens
ugaaagcgauaugcugcaa

SEQ ID NO: 793589 - RNA, 19 nt, Homo sapiens
ccaaccgacuaauucauca

SEQ ID NO: 793590 - RNA, 19 nt, Homo sapiens
gauauagcuagugcaauaa

SEQ ID NO: 793591 - RNA, 19 nt, Homo sapiens
ugagguuucugcagacaau

SEQ ID NO: 793592 - RNA, 19 nt, Homo sapiens
gauguagaagaguauauga

SEQ ID NO: 793593 - RNA, 19 nt, Homo sapiens
gcugcuuucuccucuaaau

SEQ ID NO: 793594 - RNA, 19 nt, Homo sapiens
ucaaaacuguggccugaaa

SEQ ID NO: 793595 - RNA, 19 nt, Homo sapiens
ggcagcugaugauguagaa

SEQ ID NO: 793596 - RNA, 19 nt, Homo sapiens
gaaccgcagggcacuugaa

SEQ ID NO: 793597 - RNA, 19 nt, Homo sapiens
gugccucaguugcugcuuu

SEQ ID NO: 793598 - RNA, 19 nt, Homo sapiens
auaaauguguucguaagug

SEQ ID NO: 793599 - RNA, 19 nt, Homo sapiens
gauggcaaggcaauaaaug

SEQ ID NO: 793600 - RNA, 19 nt, Homo sapiens
uccaaaaguuucagugaua

SEQ ID NO: 793601 - RNA, 19 nt, Homo sapiens
ggcacgagcacuuaaacaa

SEQ ID NO: 793602 - RNA, 19 nt, Homo sapiens
gaccagagccagaauucca

SEQ ID NO: 793603 - RNA, 19 nt, Homo sapiens
gaacgaccagagccagaau

SEQ ID NO: 793604 - RNA, 19 nt, Homo sapiens
uaaagauggcaaggcaaua

SEQ ID NO: 793605 - RNA, 19 nt, Homo sapiens
cuuggucucuuguuuggaa

SEQ ID NO: 793606 - RNA, 19 nt, Homo sapiens
ggagucccuucuucguaug

SEQ ID NO: 793607 - RNA, 19 nt, Homo sapiens
aaucaaggauauagcuagu

SEQ ID NO: 793608 - RNA, 19 nt, Homo sapiens
cagcugaugauguagaaga

SEQ ID NO: 793609 - RNA, 19 nt, Homo sapiens
gaaauaucaauaccagaac

SEQ ID NO: 793610 - RNA, 19 nt, Homo sapiens
cugcagacaaucaaggaua

SEQ ID NO: 793611 - RNA, 19 nt, Homo sapiens
ucuaaaucuuggucucuug

SEQ ID NO: 793612 - RNA, 19 nt, Homo sapiens
gauaugcugcaagauaaug

SEQ ID NO: 793613 - RNA, 19 nt, Homo sapiens
ugcagacaaucaaggauau

SEQ ID NO: 793614 - RNA, 19 nt, Homo sapiens
cuagaacgaguaaaucugu

SEQ ID NO: 793615 - RNA, 19 nt, Homo sapiens
gagcuagaacgaguaaauc

SEQ ID NO: 793616 - RNA, 19 nt, Homo sapiens
ugagcuagaacgaguaaau

SEQ ID NO: 793617 - RNA, 19 nt, Homo sapiens
gaugauguagaagaguaua

SEQ ID NO: 793618 - RNA, 19 nt, Homo sapiens
aaauccaggucucacacaa

SEQ ID NO: 793619 - RNA, 19 nt, Homo sapiens
aucauaaucucacacugaa

SEQ ID NO: 793620 - RNA, 19 nt, Homo sapiens
uugcugcuuucuccucuaa

SEQ ID NO: 793621 - RNA, 19 nt, Homo sapiens
uacagugaauaaugucuuc

SEQ ID NO: 793622 - RNA, 19 nt, Homo sapiens
ucccagaugagaucaauga

SEQ ID NO: 793623 - RNA, 19 nt, Homo sapiens
gaugacaauggaagagaug

SEQ ID NO: 793624 - RNA, 19 nt, Homo sapiens
agaauuuacgccuuaaugu

SEQ ID NO: 793625 - RNA, 19 nt, Homo sapiens
acgagcacuuaaacaaauu

SEQ ID NO: 793626 - RNA, 19 nt, Homo sapiens
ggauauagcuagugcaaua

SEQ ID NO: 793627 - RNA, 19 nt, Homo sapiens
gaagaaauauugcagugaa

SEQ ID NO: 793628 - RNA, 19 nt, Homo sapiens
gaacugccuuuaucuguaa

SEQ ID NO: 793629 - RNA, 19 nt, Homo sapiens
gcgauaugcugcaagauaa

SEQ ID NO: 793630 - RNA, 19 nt, Homo sapiens
uggaagagaugaagaauga

SEQ ID NO: 793631 - RNA, 19 nt, Homo sapiens
caaaccaacuuaauacuuc

SEQ ID NO: 793632 - RNA, 19 nt, Homo sapiens
gcugcaagauaauguauuu

SEQ ID NO: 793633 - RNA, 19 nt, Homo sapiens
ucaguaagaucccagauga

SEQ ID NO: 793634 - RNA, 19 nt, Homo sapiens
caaaagaauuuacgccuua

SEQ ID NO: 793635 - RNA, 19 nt, Homo sapiens
ccacauccaugguuucuau

SEQ ID NO: 793636 - RNA, 19 nt, Homo sapiens
gaaugaggaugacaaugga

SEQ ID NO: 793637 - RNA, 19 nt, Homo sapiens
guagaagaguauaugauug

SEQ ID NO: 793638 - RNA, 19 nt, Homo sapiens
ggcaauaaauguguucgua

SEQ ID NO: 793639 - RNA, 19 nt, Homo sapiens
uauggcagcugaugaugua

SEQ ID NO: 793640 - RNA, 19 nt, Homo sapiens
gcaauaaauguguucguaa

SEQ ID NO: 793641 - RNA, 19 nt, Homo sapiens
gcacgagcacuuaaacaaa

SEQ ID NO: 793642 - RNA, 19 nt, Homo sapiens
guaguuggcuuuugaauga

SEQ ID NO: 793643 - RNA, 19 nt, Homo sapiens
guauugaacugccuuuauc

SEQ ID NO: 793644 - RNA, 19 nt, Homo sapiens
gaaauauugcagugaauga

SEQ ID NO: 793645 - RNA, 19 nt, Homo sapiens
ugaacugccuuuaucugua

SEQ ID NO: 793646 - RNA, 19 nt, Homo sapiens
gcaaggcaauaaauguguu

SEQ ID NO: 793647 - RNA, 19 nt, Homo sapiens
gcacuuaaacaaauucuca

SEQ ID NO: 793648 - RNA, 19 nt, Homo sapiens
gagagccgcuuucaucaag

SEQ ID NO: 793649 - RNA, 19 nt, Homo sapiens
ccugaaaguuguauauguu

SEQ ID NO: 793650 - RNA, 19 nt, Homo sapiens
caauaaauguguucguaag

SEQ ID NO: 793651 - RNA, 19 nt, Homo sapiens
ucauguauccuguguuuaa

SEQ ID NO: 793652 - RNA, 19 nt, Homo sapiens
gauguugaaugggauuauu

SEQ ID NO: 793653 - RNA, 19 nt, Homo sapiens
guaaaguacuccaaaaguu

SEQ ID NO: 793654 - RNA, 19 nt, Homo sapiens
gaagauuccucugcauuuu

SEQ ID NO: 793655 - RNA, 19 nt, Homo sapiens
agucauguauccuguguuu

SEQ ID NO: 793656 - RNA, 19 nt, Homo sapiens
gaauuuacgccuuaaugug

SEQ ID NO: 793657 - RNA, 19 nt, Homo sapiens
gcagucauguauccugugu

SEQ ID NO: 793658 - RNA, 19 nt, Homo sapiens
cacgagcacuuaaacaaau

SEQ ID NO: 793659 - RNA, 19 nt, Homo sapiens
ugaagucagugccucaguu

SEQ ID NO: 793660 - RNA, 19 nt, Homo sapiens
gaagucagugccucaguug

SEQ ID NO: 793661 - RNA, 19 nt, Homo sapiens
ugaagauuccucugcauuu

SEQ ID NO: 793662 - RNA, 19 nt, Homo sapiens
gaaaaggcacgagcacuua

SEQ ID NO: 793663 - RNA, 19 nt, Homo sapiens
aaagcgauaugcugcaaga

SEQ ID NO: 793664 - RNA, 19 nt, Homo sapiens
guaagugccaaccgacuaa

SEQ ID NO: 793665 - RNA, 19 nt, Homo sapiens
gaacuucuugauacaguga

SEQ ID NO: 793666 - RNA, 19 nt, Homo sapiens
gaagagaugaagaaugaag

SEQ ID NO: 793667 - RNA, 19 nt, Homo sapiens
ggaugacaauggaagagau

SEQ ID NO: 793668 - RNA, 19 nt, Homo sapiens
gguguuuguuucugacauu

SEQ ID NO: 793669 - RNA, 19 nt, Homo sapiens
aaagauggcaaggcaauaa

SEQ ID NO: 793670 - RNA, 19 nt, Homo sapiens
cauaaucucacacugaaga

SEQ ID NO: 793671 - RNA, 19 nt, Homo sapiens
gccugaaaguuguauaugu

SEQ ID NO: 793672 - RNA, 19 nt, Homo sapiens
cugaugauguagaagagua

SEQ ID NO: 793673 - RNA, 19 nt, Homo sapiens
uguauccuguguuuaauga

SEQ ID NO: 793674 - RNA, 19 nt, Homo sapiens
cggagucccuucuucguau

SEQ ID NO: 793675 - RNA, 19 nt, Homo sapiens
ggugggaagugaagucagu

SEQ ID NO: 793676 - RNA, 19 nt, Homo sapiens
caucaaaccaacuuaauac

SEQ ID NO: 793677 - RNA, 19 nt, Homo sapiens
gcagacaaucaaggauaua

SEQ ID NO: 793678 - RNA, 19 nt, Homo sapiens
caauggaagagaugaagaa

SEQ ID NO: 793679 - RNA, 19 nt, Homo sapiens
ugaaugaggaugacaaugg

SEQ ID NO: 793680 - RNA, 19 nt, Homo sapiens
aaucauaaucucacacuga

SEQ ID NO: 793681 - RNA, 19 nt, Homo sapiens
ugggauuauugccaucuua

SEQ ID NO: 793682 - RNA, 19 nt, Homo sapiens
gugauacucugaaaacgua

SEQ ID NO: 793683 - RNA, 19 nt, Homo sapiens
ucacacaagacaucauuau

SEQ ID NO: 793684 - RNA, 19 nt, Homo sapiens
ugaaagcgauaugcugcaa

SEQ ID NO: 793685 - RNA, 19 nt, Homo sapiens
ccaaccgacuaauucauca

SEQ ID NO: 793686 - RNA, 19 nt, Homo sapiens
gauauagcuagugcaauaa

SEQ ID NO: 793687 - RNA, 19 nt, Homo sapiens
ugagguuucugcagacaau

SEQ ID NO: 793688 - RNA, 19 nt, Homo sapiens
gauguagaagaguauauga

SEQ ID NO: 793689 - RNA, 19 nt, Homo sapiens
ucaaaacuguggccugaaa

SEQ ID NO: 793690 - RNA, 19 nt, Homo sapiens
ggcagcugaugauguagaa

SEQ ID NO: 793691 - RNA, 19 nt, Homo sapiens
gaaccgcagggcacuugaa

SEQ ID NO: 793692 - RNA, 19 nt, Homo sapiens
auaaauguguucguaagug

SEQ ID NO: 793693 - RNA, 19 nt, Homo sapiens
gauggcaaggcaauaaaug

SEQ ID NO: 793694 - RNA, 19 nt, Homo sapiens
uccaaaaguuucagugaua

SEQ ID NO: 793695 - RNA, 19 nt, Homo sapiens
ggcacgagcacuuaaacaa

SEQ ID NO: 793696 - RNA, 19 nt, Homo sapiens
gaccagagccagaauucca

SEQ ID NO: 793697 - RNA, 19 nt, Homo sapiens
gaacgaccagagccagaau

SEQ ID NO: 793698 - RNA, 19 nt, Homo sapiens
uaaagauggcaaggcaaua

SEQ ID NO: 793699 - RNA, 19 nt, Homo sapiens
ggagucccuucuucguaug

SEQ ID NO: 793700 - RNA, 19 nt, Homo sapiens
aaucaaggauauagcuagu

SEQ ID NO: 793701 - RNA, 19 nt, Homo sapiens
cagcugaugauguagaaga

SEQ ID NO: 793702 - RNA, 19 nt, Homo sapiens
gaaauaucaauaccagaac

SEQ ID NO: 793703 - RNA, 19 nt, Homo sapiens
cugcagacaaucaaggaua

SEQ ID NO: 793704 - RNA, 19 nt, Homo sapiens
gauaugcugcaagauaaug

SEQ ID NO: 793705 - RNA, 19 nt, Homo sapiens
ugcagacaaucaaggauau

SEQ ID NO: 793706 - RNA, 19 nt, Homo sapiens
cuagaacgaguaaaucugu

SEQ ID NO: 793707 - RNA, 19 nt, Homo sapiens
gagcuagaacgaguaaauc

SEQ ID NO: 793708 - RNA, 19 nt, Homo sapiens
ugagcuagaacgaguaaau

SEQ ID NO: 793709 - RNA, 19 nt, Homo sapiens
gaugauguagaagaguaua

SEQ ID NO: 793710 - RNA, 19 nt, Homo sapiens
aaauccaggucucacacaa

SEQ ID NO: 793711 - RNA, 19 nt, Homo sapiens
aucauaaucucacacugaa

SEQ ID NO: 793712 - RNA, 19 nt, Homo sapiens
gaugacaauggaagagaug

SEQ ID NO: 793713 - RNA, 19 nt, Homo sapiens
uacagugaauaaugucuuc

SEQ ID NO: 793714 - RNA, 19 nt, Homo sapiens
ucccagaugagaucaauga

SEQ ID NO: 793715 - RNA, 19 nt, Homo sapiens
agaauuuacgccuuaaugu

SEQ ID NO: 793716 - RNA, 19 nt, Homo sapiens
cauguauccuguguuuaau

SEQ ID NO: 793717 - RNA, 19 nt, Homo sapiens
acgagcacuuaaacaaauu

SEQ ID NO: 793718 - RNA, 19 nt, Homo sapiens
agcgauaugcugcaagaua

SEQ ID NO: 793719 - RNA, 19 nt, Homo sapiens
uauugguguuuguuucuga

SEQ ID NO: 793720 - RNA, 19 nt, Homo sapiens
cguaagugccaaccgacua

SEQ ID NO: 793721 - RNA, 19 nt, Homo sapiens
gagaucaaugacagaguga

SEQ ID NO: 793722 - RNA, 19 nt, Homo sapiens
acugagagccgcuuucauc

SEQ ID NO: 793723 - RNA, 19 nt, Homo sapiens
aagaauuuacgccuuaaug

SEQ ID NO: 793724 - RNA, 19 nt, Homo sapiens
uuaaagauggcaaggcaau

SEQ ID NO: 793725 - RNA, 19 nt, Homo sapiens
cuugauacagugaauaaug

SEQ ID NO: 793726 - RNA, 19 nt, Homo sapiens
gcacauguaucgaauuuau

SEQ ID NO: 793727 - RNA, 19 nt, Homo sapiens
gggaaaagcuugacgauua

SEQ ID NO: 793728 - RNA, 19 nt, Homo sapiens
gaacgaagaugacaguaca

SEQ ID NO: 793729 - RNA, 19 nt, Homo sapiens
gaaacugauuccuucuuua

SEQ ID NO: 793730 - RNA, 19 nt, Homo sapiens
gaacugugcuuaaaaguaa

SEQ ID NO: 793731 - RNA, 19 nt, Homo sapiens
agaaagaaauggagugauu

SEQ ID NO: 793732 - RNA, 19 nt, Homo sapiens
cagagagacuuuacuguuu

SEQ ID NO: 793733 - RNA, 19 nt, Homo sapiens
gaagaugacaguacagauu

SEQ ID NO: 793734 - RNA, 19 nt, Homo sapiens
gggcaugagugcuguaauu

SEQ ID NO: 793735 - RNA, 19 nt, Homo sapiens
cuaaauacaugguuguuug

SEQ ID NO: 793736 - RNA, 19 nt, Homo sapiens
gaccucauuugcaaucuua

SEQ ID NO: 793737 - RNA, 19 nt, Homo sapiens
caaugaaacuccagaggaa

SEQ ID NO: 793738 - RNA, 19 nt, Homo sapiens
ucacagagcuaccauuaca

SEQ ID NO: 793739 - RNA, 19 nt, Homo sapiens
cagcucagccuuucuguua

SEQ ID NO: 793740 - RNA, 19 nt, Homo sapiens
agagagacuuuacuguuua

SEQ ID NO: 793741 - RNA, 19 nt, Homo sapiens
agaggaagcuguaagagaa

SEQ ID NO: 793742 - RNA, 19 nt, Homo sapiens
gggagccgcuuacaagaaa

SEQ ID NO: 793743 - RNA, 19 nt, Homo sapiens
ugaaacugauuccuucuuu

SEQ ID NO: 793744 - RNA, 19 nt, Homo sapiens
gaaaguauacaucgaagau

SEQ ID NO: 793745 - RNA, 19 nt, Homo sapiens
caguguuggugaauuauua

SEQ ID NO: 793746 - RNA, 19 nt, Homo sapiens
gagcuaccauuacacauca

SEQ ID NO: 793747 - RNA, 19 nt, Homo sapiens
gcugaagaauuuaaugaug

SEQ ID NO: 793748 - RNA, 19 nt, Homo sapiens
ugacaggcgucuuggcuuu

SEQ ID NO: 793749 - RNA, 19 nt, Homo sapiens
cagcuaacauuuggaauug

SEQ ID NO: 793750 - RNA, 19 nt, Homo sapiens
guauuugcauccaguauug

SEQ ID NO: 793751 - RNA, 19 nt, Homo sapiens
ucucuugguuccuguaaua

SEQ ID NO: 793752 - RNA, 19 nt, Homo sapiens
caacaggcaguauuauuga

SEQ ID NO: 793753 - RNA, 19 nt, Homo sapiens
agagagacuuauucgcuua

SEQ ID NO: 793754 - RNA, 19 nt, Homo sapiens
guaauauccuucaccuuca

SEQ ID NO: 793755 - RNA, 19 nt, Homo sapiens
aagagaagcugcugcugaa

SEQ ID NO: 793756 - RNA, 19 nt, Homo sapiens
caaaugaaacugauuccuu

SEQ ID NO: 793757 - RNA, 19 nt, Homo sapiens
guacagauugugaugauga

SEQ ID NO: 793758 - RNA, 19 nt, Homo sapiens
gcacuuugccuucggaaau

SEQ ID NO: 793759 - RNA, 19 nt, Homo sapiens
ggaagacauuuaugaaucg

SEQ ID NO: 793760 - RNA, 19 nt, Homo sapiens
ggugaccuguuuaaauuug

SEQ ID NO: 793761 - RNA, 19 nt, Homo sapiens
aaucugcuaucaugaguuu

SEQ ID NO: 793762 - RNA, 19 nt, Homo sapiens
gcuaagaccagaagagaga

SEQ ID NO: 793763 - RNA, 19 nt, Homo sapiens
uuggugaccuguuuaaauu

SEQ ID NO: 793764 - RNA, 19 nt, Homo sapiens
ccucucaugugucaucuuu

SEQ ID NO: 793765 - RNA, 19 nt, Homo sapiens
uacaacaucugcucguauu

SEQ ID NO: 793766 - RNA, 19 nt, Homo sapiens
aaucacagagcuaccauua

SEQ ID NO: 793767 - RNA, 19 nt, Homo sapiens
gaugugcuacuguaaauau

SEQ ID NO: 793768 - RNA, 19 nt, Homo sapiens
gcaaucugcuaucaugagu

SEQ ID NO: 793769 - RNA, 19 nt, Homo sapiens
caugauugauggcuacuau

SEQ ID NO: 793770 - RNA, 19 nt, Homo sapiens
gaucaacugaggaagauga

SEQ ID NO: 793771 - RNA, 19 nt, Homo sapiens
gcuaacauuuggaauugga

SEQ ID NO: 793772 - RNA, 19 nt, Homo sapiens
uggaagacauuuaugaauc

SEQ ID NO: 793773 - RNA, 19 nt, Homo sapiens
agacuuuacuguuuacuuc

SEQ ID NO: 793774 - RNA, 19 nt, Homo sapiens
gaaguaaaauucgggcuuu

SEQ ID NO: 793775 - RNA, 19 nt, Homo sapiens
ucaacaggcaguauuauug

SEQ ID NO: 793776 - RNA, 19 nt, Homo sapiens
ucuuaaggauggcaaauga

SEQ ID NO: 793777 - RNA, 19 nt, Homo sapiens
gugaugugcuacuguaaau

SEQ ID NO: 793778 - RNA, 19 nt, Homo sapiens
ggaaaagcuugacgauuau

SEQ ID NO: 793779 - RNA, 19 nt, Homo sapiens
aggcacauguaucgaauuu

SEQ ID NO: 793780 - RNA, 19 nt, Homo sapiens
ucagagagacuuuacuguu

SEQ ID NO: 793781 - RNA, 19 nt, Homo sapiens
ucuguuagcugcaacuuca

SEQ ID NO: 793782 - RNA, 19 nt, Homo sapiens
guucaaagagaaagaaaug

SEQ ID NO: 793783 - RNA, 19 nt, Homo sapiens
ggaccucauuugcaaucuu

SEQ ID NO: 793784 - RNA, 19 nt, Homo sapiens
ggacugcugugaagaaaau

SEQ ID NO: 793785 - RNA, 19 nt, Homo sapiens
gggcuuacacuaugauguu

SEQ ID NO: 793786 - RNA, 19 nt, Homo sapiens
uauaauguccucugggaaa

SEQ ID NO: 793787 - RNA, 19 nt, Homo sapiens
gcuguaauuuccucaguag

SEQ ID NO: 793788 - RNA, 19 nt, Homo sapiens
gaaagaaauggagugauuc

SEQ ID NO: 793789 - RNA, 19 nt, Homo sapiens
gaaauggggcuuacacuau

SEQ ID NO: 793790 - RNA, 19 nt, Homo sapiens
guuguaauguuuggaaaug

SEQ ID NO: 793791 - RNA, 19 nt, Homo sapiens
ggauggcacuuaucguucu

SEQ ID NO: 793792 - RNA, 19 nt, Homo sapiens
ucucuuuggugaccuguuu

SEQ ID NO: 793793 - RNA, 19 nt, Homo sapiens
uugaaucugugaaugguuu

SEQ ID NO: 793794 - RNA, 19 nt, Homo sapiens
ugaugauacugacugauga

SEQ ID NO: 793795 - RNA, 19 nt, Homo sapiens
ugaugaugauguucaaaga

SEQ ID NO: 793796 - RNA, 19 nt, Homo sapiens
ucucacuguuuauacguua

SEQ ID NO: 793797 - RNA, 19 nt, Homo sapiens
guuuauucuuccugucuua

SEQ ID NO: 793798 - RNA, 19 nt, Homo sapiens
gauuacaguuauugaugga

SEQ ID NO: 793799 - RNA, 19 nt, Homo sapiens
gugaaugguuuuccguuua

SEQ ID NO: 793800 - RNA, 19 nt, Homo sapiens
gauacugacugaugaaaau

SEQ ID NO: 793801 - RNA, 19 nt, Homo sapiens
uaaugaugauacugacuga

SEQ ID NO: 793802 - RNA, 19 nt, Homo sapiens
caggcaguauuauugaauu

SEQ ID NO: 793803 - RNA, 19 nt, Homo sapiens
ugauugauggcuacuauaa

SEQ ID NO: 793804 - RNA, 19 nt, Homo sapiens
gcacauugacuucuauggu

SEQ ID NO: 793805 - RNA, 19 nt, Homo sapiens
ggaguuguaauguuuggaa

SEQ ID NO: 793806 - RNA, 19 nt, Homo sapiens
gagagagacaggagaggaa

SEQ ID NO: 793807 - RNA, 19 nt, Homo sapiens
ugucucugcuugccuguuu

SEQ ID NO: 793808 - RNA, 19 nt, Homo sapiens
gauggcaaaugaaacugau

SEQ ID NO: 793809 - RNA, 19 nt, Homo sapiens
cagcugaagaauuuaauga

SEQ ID NO: 793810 - RNA, 19 nt, Homo sapiens
ucaaagagaaagaaaugga

SEQ ID NO: 793811 - RNA, 19 nt, Homo sapiens
gggaauugaacgaagauga

SEQ ID NO: 793812 - RNA, 19 nt, Homo sapiens
ucagaaaguauacaucgaa

SEQ ID NO: 793813 - RNA, 19 nt, Homo sapiens
aaagggagccgcuuacaag

SEQ ID NO: 793814 - RNA, 19 nt, Homo sapiens
gcuggaagacauuuaugaa

SEQ ID NO: 793815 - RNA, 19 nt, Homo sapiens
gaguuguaauguuuggaaa

SEQ ID NO: 793816 - RNA, 19 nt, Homo sapiens
caucaucgacgccaucuuc

SEQ ID NO: 793817 - RNA, 19 nt, Homo sapiens
gcaucgugcuccagaucuu

SEQ ID NO: 793818 - RNA, 19 nt, Homo sapiens
caguacagauugugaugau

SEQ ID NO: 793819 - RNA, 19 nt, Homo sapiens
acagggaauugaacgaaga

SEQ ID NO: 793820 - RNA, 19 nt, Homo sapiens
gagaagcugcugcugaauc

SEQ ID NO: 793821 - RNA, 19 nt, Homo sapiens
gagccgcuuacaagaaaua

SEQ ID NO: 793822 - RNA, 19 nt, Homo sapiens
guaggacugcugugaagaa

SEQ ID NO: 793823 - RNA, 19 nt, Homo sapiens
cuacuacguucguucaaca

SEQ ID NO: 793824 - RNA, 19 nt, Homo sapiens
guguggaacugugcuuaaa

SEQ ID NO: 793825 - RNA, 19 nt, Homo sapiens
gcacuaaauacaugguugu

SEQ ID NO: 793826 - RNA, 19 nt, Homo sapiens
cacagaaagugccuuauua

SEQ ID NO: 793827 - RNA, 19 nt, Homo sapiens
gaaucugccucucaacaua

SEQ ID NO: 793828 - RNA, 19 nt, Homo sapiens
cagaagccauuuccucuua

SEQ ID NO: 793829 - RNA, 19 nt, Homo sapiens
gcucggauuucccacauua

SEQ ID NO: 793830 - RNA, 19 nt, Homo sapiens
ggaaaggccuagucagaag

SEQ ID NO: 793831 - RNA, 19 nt, Homo sapiens
caaaucaucuaagcugaaa

SEQ ID NO: 793832 - RNA, 19 nt, Homo sapiens
gggcagagaacauuguaua

SEQ ID NO: 793833 - RNA, 19 nt, Homo sapiens
guaaagaagggaacuaaga

SEQ ID NO: 793834 - RNA, 19 nt, Homo sapiens
uacaacaccugcuaucaaa

SEQ ID NO: 793835 - RNA, 19 nt, Homo sapiens
gagaacauuguauagcuua

SEQ ID NO: 793836 - RNA, 19 nt, Homo sapiens
gaauuuacaugagcucugu

SEQ ID NO: 793837 - RNA, 19 nt, Homo sapiens
ccacagaaagugccuuauu

SEQ ID NO: 793838 - RNA, 19 nt, Homo sapiens
gccauuuccucuuaucauu

SEQ ID NO: 793839 - RNA, 19 nt, Homo sapiens
ucaugagggucucuuacua

SEQ ID NO: 793840 - RNA, 19 nt, Homo sapiens
caucuaagcugaaaacaug

SEQ ID NO: 793841 - RNA, 19 nt, Homo sapiens
gagggucucuuacuaacuc

SEQ ID NO: 793842 - RNA, 19 nt, Homo sapiens
gaagggagccacugugaac

SEQ ID NO: 793843 - RNA, 19 nt, Homo sapiens
acagaaagugccuuauuaa

SEQ ID NO: 793844 - RNA, 19 nt, Homo sapiens
ucaagcacacaaagaauuu

SEQ ID NO: 793845 - RNA, 19 nt, Homo sapiens
gaagccauuuccucuuauc

SEQ ID NO: 793846 - RNA, 19 nt, Homo sapiens
caacaccugcuaucaaauc

SEQ ID NO: 793847 - RNA, 19 nt, Homo sapiens
uuaguuuacucuucuguug

SEQ ID NO: 793848 - RNA, 19 nt, Homo sapiens
guacugcuauauuugucuu

SEQ ID NO: 793849 - RNA, 19 nt, Homo sapiens
caugagggucucuuacuaa

SEQ ID NO: 793850 - RNA, 19 nt, Homo sapiens
cagccaaacugggaaccua

SEQ ID NO: 793851 - RNA, 19 nt, Homo sapiens
caggaugccuaauauugga

SEQ ID NO: 793852 - RNA, 19 nt, Homo sapiens
uggaugagccugcggguuu

SEQ ID NO: 793853 - RNA, 19 nt, Homo sapiens
cagagaacauuguauagcu

SEQ ID NO: 793854 - RNA, 19 nt, Homo sapiens
ccucucaacauauauauug

SEQ ID NO: 793855 - RNA, 19 nt, Homo sapiens
gcuaucaaaucaucuaagc

SEQ ID NO: 793856 - RNA, 19 nt, Homo sapiens
gcuggagguucguaaagug

SEQ ID NO: 793857 - RNA, 19 nt, Homo sapiens
ggaugagccugcggguuug

SEQ ID NO: 793858 - RNA, 19 nt, Homo sapiens
ggacaccagcugccacuuc

SEQ ID NO: 793859 - RNA, 19 nt, Homo sapiens
gagcucggauuucccacau

SEQ ID NO: 793860 - RNA, 19 nt, Homo sapiens
aagcacgccuuccacagaa

SEQ ID NO: 793861 - RNA, 19 nt, Homo sapiens
ugcccuaucucucuuucua

SEQ ID NO: 793862 - RNA, 19 nt, Homo sapiens
cagaagggagccacuguga

SEQ ID NO: 793863 - RNA, 19 nt, Homo sapiens
caugagaugcgcuuggaaa

SEQ ID NO: 793864 - RNA, 19 nt, Homo sapiens
caacaugccaguucuacag

SEQ ID NO: 793865 - RNA, 19 nt, Homo sapiens
ggagguucguaaagugugu

SEQ ID NO: 793866 - RNA, 19 nt, Homo sapiens
uaagcacgccuuccacaga

SEQ ID NO: 793867 - RNA, 19 nt, Homo sapiens
cauuuccucuuaucauuuc

SEQ ID NO: 793868 - RNA, 19 nt, Homo sapiens
uuacaacaccugcuaucaa

SEQ ID NO: 793869 - RNA, 19 nt, Homo sapiens
ggguaaagaagggaacuaa

SEQ ID NO: 793870 - RNA, 19 nt, Homo sapiens
caugagcucugugcagugu

SEQ ID NO: 793871 - RNA, 19 nt, Homo sapiens
ccucuccuaugcaccagua

SEQ ID NO: 793872 - RNA, 19 nt, Homo sapiens
gacaccagcugccacuucu

SEQ ID NO: 793873 - RNA, 19 nt, Homo sapiens
agagaacauuguauagcuu

SEQ ID NO: 793874 - RNA, 19 nt, Homo sapiens
gcucauguuguaugccuuu

SEQ ID NO: 793875 - RNA, 19 nt, Homo sapiens
uaaagaagggaacuaagag

SEQ ID NO: 793876 - RNA, 19 nt, Homo sapiens
caagcaggaggguaaagaa

SEQ ID NO: 793877 - RNA, 19 nt, Homo sapiens
caccagcugccacuucuuu

SEQ ID NO: 793878 - RNA, 19 nt, Homo sapiens
ccuacaaacagguuauauu

SEQ ID NO: 793879 - RNA, 19 nt, Homo sapiens
acucuucuguugcuacuug

SEQ ID NO: 793880 - RNA, 19 nt, Homo sapiens
cuaucucucuuucuacuuc

SEQ ID NO: 793881 - RNA, 19 nt, Homo sapiens
gagccacugugaaccucuu

SEQ ID NO: 793882 - RNA, 19 nt, Homo sapiens
cauguuguaugccuuugau

SEQ ID NO: 793883 - RNA, 19 nt, Homo sapiens
uauggcugcucucuaccua

SEQ ID NO: 793884 - RNA, 19 nt, Homo sapiens
gagaugaguuggggauuug

SEQ ID NO: 793885 - RNA, 19 nt, Homo sapiens
ucauuucccucuccuaugc

SEQ ID NO: 793886 - RNA, 19 nt, Homo sapiens
ccauuuccucuuaucauuu

SEQ ID NO: 793887 - RNA, 19 nt, Homo sapiens
ucaaaucaucuaagcugaa

SEQ ID NO: 793888 - RNA, 19 nt, Homo sapiens
caccugcuaucaaaucauc

SEQ ID NO: 793889 - RNA, 19 nt, Homo sapiens
uagcuuaccgcaaggauca

SEQ ID NO: 793890 - RNA, 19 nt, Homo sapiens
uggcccaguugcacaguaa

SEQ ID NO: 793891 - RNA, 19 nt, Homo sapiens
gacaucaagcacacaaaga

SEQ ID NO: 793892 - RNA, 19 nt, Homo sapiens
ccgcaaggaucagacuguu

SEQ ID NO: 793893 - RNA, 19 nt, Homo sapiens
uaucauuucccucuccuau

SEQ ID NO: 793894 - RNA, 19 nt, Homo sapiens
auggauggguuucucugua

SEQ ID NO: 793895 - RNA, 19 nt, Homo sapiens
gaucacggagggaaguuca

SEQ ID NO: 793896 - RNA, 19 nt, Homo sapiens
acaucaagcacacaaagaa

SEQ ID NO: 793897 - RNA, 19 nt, Homo sapiens
uaagacaucaagcacacaa

SEQ ID NO: 793898 - RNA, 19 nt, Homo sapiens
cauccuuaguuuacucuuc

SEQ ID NO: 793899 - RNA, 19 nt, Homo sapiens
ccacugccacugccucaga

SEQ ID NO: 793900 - RNA, 19 nt, Homo sapiens
gcagagaacauuguauagc

SEQ ID NO: 793901 - RNA, 19 nt, Homo sapiens
ugucuucauccuuaguuua

SEQ ID NO: 793902 - RNA, 19 nt, Homo sapiens
uggauggguuucucuguag

SEQ ID NO: 793903 - RNA, 19 nt, Homo sapiens
uggaaaggccuagucagaa

SEQ ID NO: 793904 - RNA, 19 nt, Homo sapiens
uguuguaugccuuugauaa

SEQ ID NO: 793905 - RNA, 19 nt, Homo sapiens
ucucuuacuaacuccauua

SEQ ID NO: 793906 - RNA, 19 nt, Homo sapiens
gagccaggaggaacacaug

SEQ ID NO: 793907 - RNA, 19 nt, Homo sapiens
caucaagcacacaaagaau

SEQ ID NO: 793908 - RNA, 19 nt, Homo sapiens
agaagccauuuccucuuau

SEQ ID NO: 793909 - RNA, 19 nt, Homo sapiens
gagaagaggaguggaugag

SEQ ID NO: 793910 - RNA, 19 nt, Homo sapiens
cacauguggugucuguaug

SEQ ID NO: 793911 - RNA, 19 nt, Homo sapiens
cuucaagccucgagaugag

SEQ ID NO: 793912 - RNA, 19 nt, Homo sapiens
ggagaucacggagggaagu

SEQ ID NO: 793913 - RNA, 19 nt, Homo sapiens
gcccacaaggcucauguug

SEQ ID NO: 793914 - RNA, 19 nt, Homo sapiens
cgagagaagaggaguggau

SEQ ID NO: 793915 - RNA, 19 nt, Homo sapiens
gcaacaugccaguucuaca

SEQ ID NO: 793916 - RNA, 19 nt, Homo sapiens
cgagaugaguuggggauuu

SEQ ID NO: 793917 - RNA, 19 nt, Homo sapiens
ggauuacaacaccugcuau

SEQ ID NO: 793918 - RNA, 19 nt, Homo sapiens
caaggcucauguuguaugc

SEQ ID NO: 793919 - RNA, 19 nt, Homo sapiens
cuguauggcugcucucuac

SEQ ID NO: 793920 - RNA, 19 nt, Homo sapiens
ucaggaugccuaauauugg

SEQ ID NO: 793921 - RNA, 19 nt, Homo sapiens
ggccuagucagaagccauu

SEQ ID NO: 793922 - RNA, 19 nt, Homo sapiens
gauuacaacaccugcuauc

SEQ ID NO: 793923 - RNA, 19 nt, Homo sapiens
ucaagcaggaggguaaaga

SEQ ID NO: 793924 - RNA, 19 nt, Homo sapiens
ggcuggagguucguaaagu

SEQ ID NO: 793925 - RNA, 19 nt, Homo sapiens
uucuguugcuacuugauua

SEQ ID NO: 793926 - RNA, 19 nt, Homo sapiens
gaacacaacuaccgauuga

SEQ ID NO: 793927 - RNA, 19 nt, Homo sapiens
caacuuaacugggaacuga

SEQ ID NO: 793928 - RNA, 19 nt, Homo sapiens
gaucaagauuucaagcuaa

SEQ ID NO: 793929 - RNA, 19 nt, Homo sapiens
gagagacgcucagauuauu

SEQ ID NO: 793930 - RNA, 19 nt, Homo sapiens
auaaggagcuacagaaauu

SEQ ID NO: 793931 - RNA, 19 nt, Homo sapiens
ggaauaauggguacucuuu

SEQ ID NO: 793932 - RNA, 19 nt, Homo sapiens
gaaauuaguggauacuuug

SEQ ID NO: 793933 - RNA, 19 nt, Homo sapiens
cuacagaaauuaguggaua

SEQ ID NO: 793934 - RNA, 19 nt, Homo sapiens
caguagagguugaucauga

SEQ ID NO: 793935 - RNA, 19 nt, Homo sapiens
gauugaagcaguuccauuu

SEQ ID NO: 793936 - RNA, 19 nt, Homo sapiens
gaacugaucaagauuucaa

SEQ ID NO: 793937 - RNA, 19 nt, Homo sapiens
ggagagacgcucagauuau

SEQ ID NO: 793938 - RNA, 19 nt, Homo sapiens
ucaccuggaucauuaagaa

SEQ ID NO: 793939 - RNA, 19 nt, Homo sapiens
ucugucaccuggaucauua

SEQ ID NO: 793940 - RNA, 19 nt, Homo sapiens
ggagggacaguguuuauga

SEQ ID NO: 793941 - RNA, 19 nt, Homo sapiens
uaaagaugguggugaugaa

SEQ ID NO: 793942 - RNA, 19 nt, Homo sapiens
gauacuuugccgucaauua

SEQ ID NO: 793943 - RNA, 19 nt, Homo sapiens
ggagaaaguuccagauucc

SEQ ID NO: 793944 - RNA, 19 nt, Homo sapiens
gaaucgcacuguucguuca

SEQ ID NO: 793945 - RNA, 19 nt, Homo sapiens
ggacgcccuuguggaauuu

SEQ ID NO: 793946 - RNA, 19 nt, Homo sapiens
gaaaaugguuuggcuguga

SEQ ID NO: 793947 - RNA, 19 nt, Homo sapiens
ggaacgcagucagauuuga

SEQ ID NO: 793948 - RNA, 19 nt, Homo sapiens
aaagaaugguggacaacuu

SEQ ID NO: 793949 - RNA, 19 nt, Homo sapiens
gagacgcucagauuauuaa

SEQ ID NO: 793950 - RNA, 19 nt, Homo sapiens
gaacgcagucagauuugaa

SEQ ID NO: 793951 - RNA, 19 nt, Homo sapiens
ugaucaagauuucaagcua

SEQ ID NO: 793952 - RNA, 19 nt, Homo sapiens
gggaacugaucaagauuuc

SEQ ID NO: 793953 - RNA, 19 nt, Homo sapiens
acgcucagauuauuaaguu

SEQ ID NO: 793954 - RNA, 19 nt, Homo sapiens
ggaacacaacuaccgauug

SEQ ID NO: 793955 - RNA, 19 nt, Homo sapiens
ccacugaccaucucuuaug

SEQ ID NO: 793956 - RNA, 19 nt, Homo sapiens
augaucagcuugagcaauu

SEQ ID NO: 793957 - RNA, 19 nt, Homo sapiens
gagggacaguguuuaugau

SEQ ID NO: 793958 - RNA, 19 nt, Homo sapiens
gaucgccagucacccauca

SEQ ID NO: 793959 - RNA, 19 nt, Homo sapiens
auacuuugccgucaauuaa

SEQ ID NO: 793960 - RNA, 19 nt, Homo sapiens
ugccgucaauuaagcauaa

SEQ ID NO: 793961 - RNA, 19 nt, Homo sapiens
caagauuucaagcuaaaga

SEQ ID NO: 793962 - RNA, 19 nt, Homo sapiens
ucauaucuaggcaguauuu

SEQ ID NO: 793963 - RNA, 19 nt, Homo sapiens
uggagagacgcucagauua

SEQ ID NO: 793964 - RNA, 19 nt, Homo sapiens
gaacgugcagguugcgaau

SEQ ID NO: 793965 - RNA, 19 nt, Homo sapiens
aagcuaggcaaacaucaua

SEQ ID NO: 793966 - RNA, 19 nt, Homo sapiens
gaauaauggguacucuuuc

SEQ ID NO: 793967 - RNA, 19 nt, Homo sapiens
gaaccgagccuugcaucca

SEQ ID NO: 793968 - RNA, 19 nt, Homo sapiens
uaaggagcuacagaaauua

SEQ ID NO: 793969 - RNA, 19 nt, Homo sapiens
cauaaggagcuacagaaau

SEQ ID NO: 793970 - RNA, 19 nt, Homo sapiens
gcacaccguggacagcaaa

SEQ ID NO: 793971 - RNA, 19 nt, Homo sapiens
acugggaacugaucaagau

SEQ ID NO: 793972 - RNA, 19 nt, Homo sapiens
augauuaugugcugaaugu

SEQ ID NO: 793973 - RNA, 19 nt, Homo sapiens
gcacuguucguucauccuu

SEQ ID NO: 793974 - RNA, 19 nt, Homo sapiens
ccagucacccaucaacauu

SEQ ID NO: 793975 - RNA, 19 nt, Homo sapiens
ggaugcagcacuggaagaa

SEQ ID NO: 793976 - RNA, 19 nt, Homo sapiens
cacugaccaucucuuauga

SEQ ID NO: 793977 - RNA, 19 nt, Homo sapiens
ggagagcguggaccugguu

SEQ ID NO: 793978 - RNA, 19 nt, Homo sapiens
ccugcagccucuauacuug

SEQ ID NO: 793979 - RNA, 19 nt, Homo sapiens
aaauugcuguggagaaagu

SEQ ID NO: 793980 - RNA, 19 nt, Homo sapiens
caauuucggacccugcuuu

SEQ ID NO: 793981 - RNA, 19 nt, Homo sapiens
ucauaaggagcuacagaaa

SEQ ID NO: 793982 - RNA, 19 nt, Homo sapiens
cuaaagaugguggugauga

SEQ ID NO: 793983 - RNA, 19 nt, Homo sapiens
cauccuuccggcaugauua

SEQ ID NO: 793984 - RNA, 19 nt, Homo sapiens
gcauuggaacgcagucaga

SEQ ID NO: 793985 - RNA, 19 nt, Homo sapiens
auucauaucuaggcaguau

SEQ ID NO: 793986 - RNA, 19 nt, Homo sapiens
caucauaaggagcuacaga

SEQ ID NO: 793987 - RNA, 19 nt, Homo sapiens
agagacgcucagauuauua

SEQ ID NO: 793988 - RNA, 19 nt, Homo sapiens
uguuuaugaucccggcuua

SEQ ID NO: 793989 - RNA, 19 nt, Homo sapiens
gaacagccugagggucauu

SEQ ID NO: 793990 - RNA, 19 nt, Homo sapiens
uuaagaagcaaccaguaga

SEQ ID NO: 793991 - RNA, 19 nt, Homo sapiens
cuggagagacgcucagauu

SEQ ID NO: 793992 - RNA, 19 nt, Homo sapiens
guggauacuuugccgucaa

SEQ ID NO: 793993 - RNA, 19 nt, Homo sapiens
gcaugauuaugugcugaau

SEQ ID NO: 793994 - RNA, 19 nt, Homo sapiens
ggagaaagagaaaagaaug

SEQ ID NO: 793995 - RNA, 19 nt, Homo sapiens
uguggaauuugggucauuu

SEQ ID NO: 793996 - RNA, 19 nt, Homo sapiens
aggacgcccuuguggaauu

SEQ ID NO: 793997 - RNA, 19 nt, Homo sapiens
ggagcuacagaaauuagug

SEQ ID NO: 793998 - RNA, 19 nt, Homo sapiens
gauuaugugcugaauguac

SEQ ID NO: 793999 - RNA, 19 nt, Homo sapiens
augccuaccugcccagauu

SEQ ID NO: 794000 - RNA, 19 nt, Homo sapiens
caaacaucauaaggagcua

SEQ ID NO: 794001 - RNA, 19 nt, Homo sapiens
uuggaacgcagucagauuu

SEQ ID NO: 794002 - RNA, 19 nt, Homo sapiens
ggacccugcuuuucacuuc

SEQ ID NO: 794003 - RNA, 19 nt, Homo sapiens
cauuaagaagcaaccagua

SEQ ID NO: 794004 - RNA, 19 nt, Homo sapiens
aaccacugaccaucucuua

SEQ ID NO: 794005 - RNA, 19 nt, Homo sapiens
gguggagggacaguguuua

SEQ ID NO: 794006 - RNA, 19 nt, Homo sapiens
ccucuauacuuguacuuac

SEQ ID NO: 794007 - RNA, 19 nt, Homo sapiens
gaucagcuugagcaauuuc

SEQ ID NO: 794008 - RNA, 19 nt, Homo sapiens
acacaacuaccgauugaag

SEQ ID NO: 794009 - RNA, 19 nt, Homo sapiens
ugcagccucuauacuugua

SEQ ID NO: 794010 - RNA, 19 nt, Homo sapiens
guggagggacaguguuuau

SEQ ID NO: 794011 - RNA, 19 nt, Homo sapiens
gccugagggucauucuuca

SEQ ID NO: 794012 - RNA, 19 nt, Homo sapiens
ugaucagcuugagcaauuu

SEQ ID NO: 794013 - RNA, 19 nt, Homo sapiens
gcggcuagguucgugaucu

SEQ ID NO: 794014 - RNA, 19 nt, Homo sapiens
uaagaagcaaccaguagag

SEQ ID NO: 794015 - RNA, 19 nt, Homo sapiens
ccgagucugucaccuggau

SEQ ID NO: 794016 - RNA, 19 nt, Homo sapiens
ugggaacugaucaagauuu

SEQ ID NO: 794017 - RNA, 19 nt, Homo sapiens
cgauugaagcaguuccauu

SEQ ID NO: 794018 - RNA, 19 nt, Homo sapiens
gccucuauacuuguacuua

SEQ ID NO: 794019 - RNA, 19 nt, Homo sapiens
acugaugaaucgcacuguu

SEQ ID NO: 794020 - RNA, 19 nt, Homo sapiens
gccagucacccaucaacau

SEQ ID NO: 794021 - RNA, 19 nt, Homo sapiens
agaaaagaaugguggacaa

SEQ ID NO: 794022 - RNA, 19 nt, Homo sapiens
uggauacuuugccgucaau

SEQ ID NO: 794023 - RNA, 19 nt, Homo sapiens
uaggcaaacaucauaagga

SEQ ID NO: 794024 - RNA, 19 nt, Homo sapiens
gcagucagauuugaaaacu

SEQ ID NO: 794025 - RNA, 19 nt, Homo sapiens
aguagagguugaucaugau

SEQ ID NO: 794026 - RNA, 19 nt, Homo sapiens
ugaagaaccuuguggagaa

SEQ ID NO: 794027 - RNA, 19 nt, Homo sapiens
cuaaaggacuucccuguga

SEQ ID NO: 794028 - RNA, 19 nt, Homo sapiens
gauacgagauaguucugua

SEQ ID NO: 794029 - RNA, 19 nt, Homo sapiens
caacuacuaugacgaggaa

SEQ ID NO: 794030 - RNA, 19 nt, Homo sapiens
gaagaaccuuguggagaaa

SEQ ID NO: 794031 - RNA, 19 nt, Homo sapiens
gaaggauaauuaccuguuc

SEQ ID NO: 794032 - RNA, 19 nt, Homo sapiens
gggagcagcuuuccucugu

SEQ ID NO: 794033 - RNA, 19 nt, Homo sapiens
cgagauaguucuguacauu

SEQ ID NO: 794034 - RNA, 19 nt, Homo sapiens
gagaagaacaacccaaaga

SEQ ID NO: 794035 - RNA, 19 nt, Homo sapiens
ucaacaagauucuguccaa

SEQ ID NO: 794036 - RNA, 19 nt, Homo sapiens
guacauggcccaggacauu

SEQ ID NO: 794037 - RNA, 19 nt, Homo sapiens
ucaccagccuugacucauu

SEQ ID NO: 794038 - RNA, 19 nt, Homo sapiens
gaaauugaguuuggcuaca

SEQ ID NO: 794039 - RNA, 19 nt, Homo sapiens
auaauuaccuguuccugaa

SEQ ID NO: 794040 - RNA, 19 nt, Homo sapiens
ggcggaagcucuaccaugu

SEQ ID NO: 794041 - RNA, 19 nt, Homo sapiens
uaaaggacuucccugugaa

SEQ ID NO: 794042 - RNA, 19 nt, Homo sapiens
gagauaguucuguacauuu

SEQ ID NO: 794043 - RNA, 19 nt, Homo sapiens
ggacugccgugaugagaag

SEQ ID NO: 794044 - RNA, 19 nt, Homo sapiens
gcaagcgaaucaccaucaa

SEQ ID NO: 794045 - RNA, 19 nt, Homo sapiens
gagaggccaucauguucaa

SEQ ID NO: 794046 - RNA, 19 nt, Homo sapiens
gcaaggaagaucucaagga

SEQ ID NO: 794047 - RNA, 19 nt, Homo sapiens
gaaucaccaucaacaagau

SEQ ID NO: 794048 - RNA, 19 nt, Homo sapiens
gaagaacaacccaaagaag

SEQ ID NO: 794049 - RNA, 19 nt, Homo sapiens
ccgcggagcugcuguucuu

SEQ ID NO: 794050 - RNA, 19 nt, Homo sapiens
gcaccaacguccgcaggaa

SEQ ID NO: 794051 - RNA, 19 nt, Homo sapiens
caccagccuugacucauuu

SEQ ID NO: 794052 - RNA, 19 nt, Homo sapiens
gggauggugugguggagaa

SEQ ID NO: 794053 - RNA, 19 nt, Homo sapiens
gcagaaggacggccaugga

SEQ ID NO: 794054 - RNA, 19 nt, Homo sapiens
gaaauuccugcuacucaug

SEQ ID NO: 794055 - RNA, 19 nt, Homo sapiens
gaacugugaccgagagaca

SEQ ID NO: 794056 - RNA, 19 nt, Homo sapiens
gaacagaacacaacaaaac

SEQ ID NO: 794057 - RNA, 19 nt, Homo sapiens
ccagagccuucuucccaaa

SEQ ID NO: 794058 - RNA, 19 nt, Homo sapiens
caaagaaauuccugcuacu

SEQ ID NO: 794059 - RNA, 19 nt, Homo sapiens
ccguggagcucuacucaga

SEQ ID NO: 794060 - RNA, 19 nt, Homo sapiens
gagcagcuuuccucugucu

SEQ ID NO: 794061 - RNA, 19 nt, Homo sapiens
cgaaucaccaucaacaaga

SEQ ID NO: 794062 - RNA, 19 nt, Homo sapiens
ggagaggccaucauguuca

SEQ ID NO: 794063 - RNA, 19 nt, Homo sapiens
gaaggucuacagcaaggaa

SEQ ID NO: 794064 - RNA, 19 nt, Homo sapiens
ugacagagcaggacaucau

SEQ ID NO: 794065 - RNA, 19 nt, Homo sapiens
gcugcaugaaggauaauua

SEQ ID NO: 794066 - RNA, 19 nt, Homo sapiens
agauaguucuguacauuuc

SEQ ID NO: 794067 - RNA, 19 nt, Homo sapiens
aggaagaucucaaggacau

SEQ ID NO: 794068 - RNA, 19 nt, Homo sapiens
ggacuggaaccgugacauc

SEQ ID NO: 794069 - RNA, 19 nt, Homo sapiens
acaagauucuguccaacga

SEQ ID NO: 794070 - RNA, 19 nt, Homo sapiens
gaagaucucaaggacaugu

SEQ ID NO: 794071 - RNA, 19 nt, Homo sapiens
aaggaggacugccgugaug

SEQ ID NO: 794072 - RNA, 19 nt, Homo sapiens
agaagaacaacccaaagaa

SEQ ID NO: 794073 - RNA, 19 nt, Homo sapiens
gagauggaaaccuaaagga

SEQ ID NO: 794074 - RNA, 19 nt, Homo sapiens
ucacagccauugagaucuc

SEQ ID NO: 794075 - RNA, 19 nt, Homo sapiens
caaggucaccgucaacuac

SEQ ID NO: 794076 - RNA, 19 nt, Homo sapiens
cagagcaggacaucauuga

SEQ ID NO: 794077 - RNA, 19 nt, Homo sapiens
gcgaaucaccaucaacaag

SEQ ID NO: 794078 - RNA, 19 nt, Homo sapiens
ugaaggauaauuaccuguu

SEQ ID NO: 794079 - RNA, 19 nt, Homo sapiens
ucaagugguugcacauggu

SEQ ID NO: 794080 - RNA, 19 nt, Homo sapiens
ggaaugcugccuggagaug

SEQ ID NO: 794081 - RNA, 19 nt, Homo sapiens
ggagaagaacaacccaaag

SEQ ID NO: 794082 - RNA, 19 nt, Homo sapiens
agaaauuccugcuacucau

SEQ ID NO: 794083 - RNA, 19 nt, Homo sapiens
guguuugugugcugcauga

SEQ ID NO: 794084 - RNA, 19 nt, Homo sapiens
ucccaaacauggugaacau

SEQ ID NO: 794085 - RNA, 19 nt, Homo sapiens
aggaugaaauugaguuugg

SEQ ID NO: 794086 - RNA, 19 nt, Homo sapiens
agacaaagugggcguguuc

SEQ ID NO: 794087 - RNA, 19 nt, Homo sapiens
cagugagccucgacucugu

SEQ ID NO: 794088 - RNA, 19 nt, Homo sapiens
gacagagcaggacaucauu

SEQ ID NO: 794089 - RNA, 19 nt, Homo sapiens
agccuugacucauuuggaa

SEQ ID NO: 794090 - RNA, 19 nt, Homo sapiens
ugugcugcaugaaggauaa

SEQ ID NO: 794091 - RNA, 19 nt, Homo sapiens
augagaaggucuacagcaa

SEQ ID NO: 794092 - RNA, 19 nt, Homo sapiens
gcaccuucaucgacgacau

SEQ ID NO: 794093 - RNA, 19 nt, Homo sapiens
ccaacgcuauauccacauc

SEQ ID NO: 794094 - RNA, 19 nt, Homo sapiens
ugacauaaggaacagaaca

SEQ ID NO: 794095 - RNA, 19 nt, Homo sapiens
gcaccucggccugcuacaa

SEQ ID NO: 794096 - RNA, 19 nt, Homo sapiens
gggccauccugcuggugaa

SEQ ID NO: 794097 - RNA, 19 nt, Homo sapiens
aggaacagaacacaacaaa

SEQ ID NO: 794098 - RNA, 19 nt, Homo sapiens
ugaucgugcuggacaagga

SEQ ID NO: 794099 - RNA, 19 nt, Homo sapiens
aaauugaguuuggcuacau

SEQ ID NO: 794100 - RNA, 19 nt, Homo sapiens
ucucaggccuggucuccau

SEQ ID NO: 794101 - RNA, 19 nt, Homo sapiens
caaagugggcguguucuac

SEQ ID NO: 794102 - RNA, 19 nt, Homo sapiens
uggagaagaacaacccaaa

SEQ ID NO: 794103 - RNA, 19 nt, Homo sapiens
gcagcaagcgaaucaccau

SEQ ID NO: 794104 - RNA, 19 nt, Homo sapiens
aagaaauuccugcuacuca

SEQ ID NO: 794105 - RNA, 19 nt, Homo sapiens
cacaaagaaauuccugcua

SEQ ID NO: 794106 - RNA, 19 nt, Homo sapiens
ccaagguggugcgugacuu

SEQ ID NO: 794107 - RNA, 19 nt, Homo sapiens
ccaggaugaaauugaguuu

SEQ ID NO: 794108 - RNA, 19 nt, Homo sapiens
guucuucggccaacgcuau

SEQ ID NO: 794109 - RNA, 19 nt, Homo sapiens
cauaaggaacagaacacaa

SEQ ID NO: 794110 - RNA, 19 nt, Homo sapiens
cagcaaggaagaucucaag

SEQ ID NO: 794111 - RNA, 19 nt, Homo sapiens
ggucaccgucaacuacuau

SEQ ID NO: 794112 - RNA, 19 nt, Homo sapiens
accgugacauccucaagaa

SEQ ID NO: 794113 - RNA, 19 nt, Homo sapiens
gaaccgugacauccucaag

SEQ ID NO: 794114 - RNA, 19 nt, Homo sapiens
aggagaaccuguacuucca

SEQ ID NO: 794115 - RNA, 19 nt, Homo sapiens
auggaaaccuaaaggacuu

SEQ ID NO: 794116 - RNA, 19 nt, Homo sapiens
gcaugaaggauaauuaccu

SEQ ID NO: 794117 - RNA, 19 nt, Homo sapiens
accgugauauuccggauug

SEQ ID NO: 794118 - RNA, 19 nt, Homo sapiens
acaaagugggcguguucua

SEQ ID NO: 794119 - RNA, 19 nt, Homo sapiens
caaggaggacugccgugau

SEQ ID NO: 794120 - RNA, 19 nt, Homo sapiens
caagguggugcgugacuuc

SEQ ID NO: 794121 - RNA, 19 nt, Homo sapiens
ugaccugcccgcucuguuc

SEQ ID NO: 794122 - RNA, 19 nt, Homo sapiens
cagacaaagugggcguguu

SEQ ID NO: 794123 - RNA, 19 nt, Homo sapiens
acaaggucaccgucaacua

SEQ ID NO: 794124 - RNA, 19 nt, Homo sapiens
gaggacugccgugaugaga

SEQ ID NO: 794125 - RNA, 19 nt, Homo sapiens
gaaggagcugggacugaca

SEQ ID NO: 794126 - RNA, 19 nt, Homo sapiens
gcacgaagaccaugcauau

SEQ ID NO: 794127 - RNA, 19 nt, Homo sapiens
gggaaacugugguugcuuu

SEQ ID NO: 794128 - RNA, 19 nt, Homo sapiens
cuacaaacagcucuaauaa

SEQ ID NO: 794129 - RNA, 19 nt, Homo sapiens
ugagguggcugcagaaauc

SEQ ID NO: 794130 - RNA, 19 nt, Homo sapiens
gcucuagcuucccgacuuu

SEQ ID NO: 794131 - RNA, 19 nt, Homo sapiens
ugacagcucuggugcucuu

SEQ ID NO: 794132 - RNA, 19 nt, Homo sapiens
ccugugcacuuuaccauau

SEQ ID NO: 794133 - RNA, 19 nt, Homo sapiens
gcaguaccugugcacuuua

SEQ ID NO: 794134 - RNA, 19 nt, Homo sapiens
ggagacgaguggcauaucg

SEQ ID NO: 794135 - RNA, 19 nt, Homo sapiens
aaacagcucuaauaauucc

SEQ ID NO: 794136 - RNA, 19 nt, Homo sapiens
gagcuuggucuccuuacaa

SEQ ID NO: 794137 - RNA, 19 nt, Homo sapiens
caaacagcucuaauaauuc

SEQ ID NO: 794138 - RNA, 19 nt, Homo sapiens
acuacaaacagcucuaaua

SEQ ID NO: 794139 - RNA, 19 nt, Homo sapiens
gaacgcagggcagcugaga

SEQ ID NO: 794140 - RNA, 19 nt, Homo sapiens
gcagggcagcugagaagga

SEQ ID NO: 794141 - RNA, 19 nt, Homo sapiens
gccccuaacuggucuaauu

SEQ ID NO: 794142 - RNA, 19 nt, Homo sapiens
ccucgccgcagucccauua

SEQ ID NO: 794143 - RNA, 19 nt, Homo sapiens
gcucaucucagacucauac

SEQ ID NO: 794144 - RNA, 19 nt, Homo sapiens
cccacucgcucaucucaga

SEQ ID NO: 794145 - RNA, 19 nt, Homo sapiens
cagggacaaugggauuauu

SEQ ID NO: 794146 - RNA, 19 nt, Homo sapiens
aaacugugguugcuuuuga

SEQ ID NO: 794147 - RNA, 19 nt, Homo sapiens
ccaggcagcgacuuuaugu

SEQ ID NO: 794148 - RNA, 19 nt, Homo sapiens
gccaggagccccacuguaa

SEQ ID NO: 794149 - RNA, 19 nt, Homo sapiens
cugggcagcugcucuuugu

SEQ ID NO: 794150 - RNA, 19 nt, Homo sapiens
gggacaaugggauuauuuc

SEQ ID NO: 794151 - RNA, 19 nt, Homo sapiens
ucacuacaaacagcucuaa

SEQ ID NO: 794152 - RNA, 19 nt, Homo sapiens
guggccgucuucagaguau

SEQ ID NO: 794153 - RNA, 19 nt, Homo sapiens
gcucugggcagcugcucuu

SEQ ID NO: 794154 - RNA, 19 nt, Homo sapiens
auccaugcgucacuacaaa

SEQ ID NO: 794155 - RNA, 19 nt, Homo sapiens
ggaaaucucugacaucaaa

SEQ ID NO: 794156 - RNA, 19 nt, Homo sapiens
ggaauuugcuggaggacua

SEQ ID NO: 794157 - RNA, 19 nt, Homo sapiens
gcgaaucuaugacaaguuu

SEQ ID NO: 794158 - RNA, 19 nt, Homo sapiens
gagauucacugacugcuau

SEQ ID NO: 794159 - RNA, 19 nt, Homo sapiens
gaggaaaucucugacauca

SEQ ID NO: 794160 - RNA, 19 nt, Homo sapiens
ccuagaagcugucuugaau

SEQ ID NO: 794161 - RNA, 19 nt, Homo sapiens
gaaccuagaagcugucuug

SEQ ID NO: 794162 - RNA, 19 nt, Homo sapiens
agaaggaucugcacagugu

SEQ ID NO: 794163 - RNA, 19 nt, Homo sapiens
aaacuuccuucacuacaaa

SEQ ID NO: 794164 - RNA, 19 nt, Homo sapiens
ugacacagcgaaucuauga

SEQ ID NO: 794165 - RNA, 19 nt, Homo sapiens
uaaacuuccuucacuacaa

SEQ ID NO: 794166 - RNA, 19 nt, Homo sapiens
gauaauucuuggccauguu

SEQ ID NO: 794167 - RNA, 19 nt, Homo sapiens
cauguucucucuucucuag

SEQ ID NO: 794168 - RNA, 19 nt, Homo sapiens
ccacauccguaaauaaacu

SEQ ID NO: 794169 - RNA, 19 nt, Homo sapiens
ggauaauucuuggccaugu

SEQ ID NO: 794170 - RNA, 19 nt, Homo sapiens
gggaggaaaucucugacau

SEQ ID NO: 794171 - RNA, 19 nt, Homo sapiens
gagaaucuguuuucaaucu

SEQ ID NO: 794172 - RNA, 19 nt, Homo sapiens
uagaagcugucuugaaugc

SEQ ID NO: 794173 - RNA, 19 nt, Homo sapiens
gaugacacagcgaaucuau

SEQ ID NO: 794174 - RNA, 19 nt, Homo sapiens
uaccagagauucacugacu

SEQ ID NO: 794175 - RNA, 19 nt, Homo sapiens
ccagcgggaucccagagaa

SEQ ID NO: 794176 - RNA, 19 nt, Homo sapiens
ggaggaaaucucugacauc

SEQ ID NO: 794177 - RNA, 19 nt, Homo sapiens
guaaauaaacuuccuucac

SEQ ID NO: 794178 - RNA, 19 nt, Homo sapiens
ucuucuaccuggauaauuc

SEQ ID NO: 794179 - RNA, 19 nt, Homo sapiens
gaucugcacaguguuauag

SEQ ID NO: 794180 - RNA, 19 nt, Homo sapiens
cagcgaaucuaugacaagu

SEQ ID NO: 794181 - RNA, 19 nt, Homo sapiens
ccacccggcacuaccauuu

SEQ ID NO: 794182 - RNA, 19 nt, Homo sapiens
ucacugccacugugccuuu

SEQ ID NO: 794183 - RNA, 19 nt, Homo sapiens
cagcagugauggaauuugc

SEQ ID NO: 794184 - RNA, 19 nt, Homo sapiens
gcugagggagccugaguga

SEQ ID NO: 794185 - RNA, 19 nt, Homo sapiens
ggauaaaauuguggaagaa

SEQ ID NO: 794186 - RNA, 19 nt, Homo sapiens
ggaucugcacaguguuaua

SEQ ID NO: 794187 - RNA, 19 nt, Homo sapiens
uagcucaguugcagacauc

SEQ ID NO: 794188 - RNA, 19 nt, Homo sapiens
ucugagaacggcugaaaug

SEQ ID NO: 794189 - RNA, 19 nt, Homo sapiens
aaggaucugcacaguguua

SEQ ID NO: 794190 - RNA, 19 nt, Homo sapiens
gaaggcaaaguccgcaaag

SEQ ID NO: 794191 - RNA, 19 nt, Homo sapiens
uaagugcuucuaccaguug

SEQ ID NO: 794192 - RNA, 19 nt, Homo sapiens
gccauguucucucuucucu

SEQ ID NO: 794193 - RNA, 19 nt, Homo sapiens
ccuuuagauuccucuguuu

SEQ ID NO: 794194 - RNA, 19 nt, Homo sapiens
agaaacaggaggccgagaa

SEQ ID NO: 794195 - RNA, 19 nt, Homo sapiens
acaaguuuauagcucaguu

SEQ ID NO: 794196 - RNA, 19 nt, Homo sapiens
cuccacauccguaaauaaa

SEQ ID NO: 794197 - RNA, 19 nt, Homo sapiens
auaagugcuucuaccaguu

SEQ ID NO: 794198 - RNA, 19 nt, Homo sapiens
gaaacaggaggccgagaac

SEQ ID NO: 794199 - RNA, 19 nt, Homo sapiens
agagaaggaucugcacagu

SEQ ID NO: 794200 - RNA, 19 nt, Homo sapiens
uggagaaucuguuuucaau

SEQ ID NO: 794201 - RNA, 19 nt, Homo sapiens
acacagcgaaucuaugaca

SEQ ID NO: 794202 - RNA, 19 nt, Homo sapiens
uguuauagcacccuacuuc

SEQ ID NO: 794203 - RNA, 19 nt, Homo sapiens
gccggcagcuaccagagau

SEQ ID NO: 794204 - RNA, 19 nt, Homo sapiens
cccuuuagauuccucuguu

SEQ ID NO: 794205 - RNA, 19 nt, Homo sapiens
gcgaugacacagcgaaucu

SEQ ID NO: 794206 - RNA, 19 nt, Homo sapiens
uuagauuccucuguuucuu

SEQ ID NO: 794207 - RNA, 19 nt, Homo sapiens
cuggcaggcucuacacaga

SEQ ID NO: 794208 - RNA, 19 nt, Homo sapiens
gcuauaagugcuucuacca

SEQ ID NO: 794209 - RNA, 19 nt, Homo sapiens
ucuugaaugccuuggauaa

SEQ ID NO: 794210 - RNA, 19 nt, Homo sapiens
ugucuugaaugccuuggau

SEQ ID NO: 794211 - RNA, 19 nt, Homo sapiens
gcuaccagagauucacuga

SEQ ID NO: 794212 - RNA, 19 nt, Homo sapiens
cacagcgaaucuaugacaa

SEQ ID NO: 794213 - RNA, 19 nt, Homo sapiens
gcucaguugcagacaucua

SEQ ID NO: 794214 - RNA, 19 nt, Homo sapiens
gcccuggcuuggagaaucu

SEQ ID NO: 794215 - RNA, 19 nt, Homo sapiens
ugagaacggcugaaauggu

SEQ ID NO: 794216 - RNA, 19 nt, Homo sapiens
uggauaaaauuguggaaga

SEQ ID NO: 794217 - RNA, 19 nt, Homo sapiens
ugaaugccuuggauaaaau

SEQ ID NO: 794218 - RNA, 19 nt, Homo sapiens
ccaggggccuuuaccaugu

SEQ ID NO: 794219 - RNA, 19 nt, Homo sapiens
caaguuuauagcucaguug

SEQ ID NO: 794220 - RNA, 19 nt, Homo sapiens
gaacagacauaguuaguug

SEQ ID NO: 794221 - RNA, 19 nt, Homo sapiens
gaaaugaagccuuugaaua

SEQ ID NO: 794222 - RNA, 19 nt, Homo sapiens
ggaggaagaugaaguuauu

SEQ ID NO: 794223 - RNA, 19 nt, Homo sapiens
gguaaacccugauucauuu

SEQ ID NO: 794224 - RNA, 19 nt, Homo sapiens
ggaagaggaugaagaagaa

SEQ ID NO: 794225 - RNA, 19 nt, Homo sapiens
acaaacaccuugccaguua

SEQ ID NO: 794226 - RNA, 19 nt, Homo sapiens
acaauaagcucuuuacuug

SEQ ID NO: 794227 - RNA, 19 nt, Homo sapiens
ccaacaaugucagaaauua

SEQ ID NO: 794228 - RNA, 19 nt, Homo sapiens
gggaauaucuaucaguaaa

SEQ ID NO: 794229 - RNA, 19 nt, Homo sapiens
gggugaagcuuugaaauaa

SEQ ID NO: 794230 - RNA, 19 nt, Homo sapiens
ggacguuccugaagagaaa

SEQ ID NO: 794231 - RNA, 19 nt, Homo sapiens
aaacugacaugguaauuug

SEQ ID NO: 794232 - RNA, 19 nt, Homo sapiens
gcacuaagauuaaaaguug

SEQ ID NO: 794233 - RNA, 19 nt, Homo sapiens
gaaauggaacuuaauguug

SEQ ID NO: 794234 - RNA, 19 nt, Homo sapiens
gaacugcaauacuuaagga

SEQ ID NO: 794235 - RNA, 19 nt, Homo sapiens
gaagacagacugcugcuuu

SEQ ID NO: 794236 - RNA, 19 nt, Homo sapiens
caagaugucugauuuacug

SEQ ID NO: 794237 - RNA, 19 nt, Homo sapiens
gcuuacaucucaacaauga

SEQ ID NO: 794238 - RNA, 19 nt, Homo sapiens
agaaaucgaugcuugguuu

SEQ ID NO: 794239 - RNA, 19 nt, Homo sapiens
ggauugcaguucaucauaa

SEQ ID NO: 794240 - RNA, 19 nt, Homo sapiens
uaauuucccucaucucuuu

SEQ ID NO: 794241 - RNA, 19 nt, Homo sapiens
gaaaugguacuacuacuau

SEQ ID NO: 794242 - RNA, 19 nt, Homo sapiens
gaagguggauaugaaugua

SEQ ID NO: 794243 - RNA, 19 nt, Homo sapiens
uaagaugggcuauauauug

SEQ ID NO: 794244 - RNA, 19 nt, Homo sapiens
cauauucaguccaguuuaa

SEQ ID NO: 794245 - RNA, 19 nt, Homo sapiens
gaagagaaagagaaugaaa

SEQ ID NO: 794246 - RNA, 19 nt, Homo sapiens
cugcaauacuuaaggauua

SEQ ID NO: 794247 - RNA, 19 nt, Homo sapiens
agacauaguuaguugguuu

SEQ ID NO: 794248 - RNA, 19 nt, Homo sapiens
cagagaaauucaaagagua

SEQ ID NO: 794249 - RNA, 19 nt, Homo sapiens
ucaaagaacagaaugcuaa

SEQ ID NO: 794250 - RNA, 19 nt, Homo sapiens
gaaacugacaugguaauuu

SEQ ID NO: 794251 - RNA, 19 nt, Homo sapiens
ggccugagcuaaacaucua

SEQ ID NO: 794252 - RNA, 19 nt, Homo sapiens
gaauaugcaugcugcuuuc

SEQ ID NO: 794253 - RNA, 19 nt, Homo sapiens
gcaccuaagucagggagua

SEQ ID NO: 794254 - RNA, 19 nt, Homo sapiens
uuacagacaugccaaauag

SEQ ID NO: 794255 - RNA, 19 nt, Homo sapiens
gauaucagauuuggaugaa

SEQ ID NO: 794256 - RNA, 19 nt, Homo sapiens
ugagaaagcugcuaaugag

SEQ ID NO: 794257 - RNA, 19 nt, Homo sapiens
acagagaagaucagaauua

SEQ ID NO: 794258 - RNA, 19 nt, Homo sapiens
cagaaauucagcaguauua

SEQ ID NO: 794259 - RNA, 19 nt, Homo sapiens
gaagaagaaacagaugaua

SEQ ID NO: 794260 - RNA, 19 nt, Homo sapiens
agaagaagcuggagaaacu

SEQ ID NO: 794261 - RNA, 19 nt, Homo sapiens
gcagguaguuccaaagaag

SEQ ID NO: 794262 - RNA, 19 nt, Homo sapiens
uaacaggccugacgaaagg

SEQ ID NO: 794263 - RNA, 19 nt, Homo sapiens
acaugaaacugcauuggua

SEQ ID NO: 794264 - RNA, 19 nt, Homo sapiens
aaaagaaacugacauggua

SEQ ID NO: 794265 - RNA, 19 nt, Homo sapiens
ccagagaaauucaaagagu

SEQ ID NO: 794266 - RNA, 19 nt, Homo sapiens
gggauacccuuccauuuca

SEQ ID NO: 794267 - RNA, 19 nt, Homo sapiens
gaagaugaaguuauugaug

SEQ ID NO: 794268 - RNA, 19 nt, Homo sapiens
gaccaucacucauaaaauu

SEQ ID NO: 794269 - RNA, 19 nt, Homo sapiens
gcagaaagacagagaagau

SEQ ID NO: 794270 - RNA, 19 nt, Homo sapiens
aaacuuaccagaagagaaa

SEQ ID NO: 794271 - RNA, 19 nt, Homo sapiens
ugacuauggugaaacguaa

SEQ ID NO: 794272 - RNA, 19 nt, Homo sapiens
ucagacagcuggcuuugug

SEQ ID NO: 794273 - RNA, 19 nt, Homo sapiens
ggugaagcuuugaaauaaa

SEQ ID NO: 794274 - RNA, 19 nt, Homo sapiens
ucacuggcccuuaauaauu

SEQ ID NO: 794275 - RNA, 19 nt, Homo sapiens
gcaugggcuuauacaauuu

SEQ ID NO: 794276 - RNA, 19 nt, Homo sapiens
caaagaagaagcuggagaa

SEQ ID NO: 794277 - RNA, 19 nt, Homo sapiens
gaacagaucaagauauggu

SEQ ID NO: 794278 - RNA, 19 nt, Homo sapiens
caaguucccuuacccaaca

SEQ ID NO: 794279 - RNA, 19 nt, Homo sapiens
aaaaugcgcuuucuucgua

SEQ ID NO: 794280 - RNA, 19 nt, Homo sapiens
uggaaguucugcaauguaa

SEQ ID NO: 794281 - RNA, 19 nt, Homo sapiens
gaagcugucuaaaucagau

SEQ ID NO: 794282 - RNA, 19 nt, Homo sapiens
gagaagaucagaauuaggu

SEQ ID NO: 794283 - RNA, 19 nt, Homo sapiens
aaaccaaacuuaccagaag

SEQ ID NO: 794284 - RNA, 19 nt, Homo sapiens
uaaagaccguaaugcacua

SEQ ID NO: 794285 - RNA, 19 nt, Homo sapiens
guggaaaucagaaauguuu

SEQ ID NO: 794286 - RNA, 19 nt, Homo sapiens
gcaggaaauuaauucugaa

SEQ ID NO: 794287 - RNA, 19 nt, Homo sapiens
cuaguaagaugggcuauau

SEQ ID NO: 794288 - RNA, 19 nt, Homo sapiens
cuaauaugauggagacauu

SEQ ID NO: 794289 - RNA, 19 nt, Homo sapiens
gagcuaaacaucuaacuag

SEQ ID NO: 794290 - RNA, 19 nt, Homo sapiens
gaaggaaacaauucaaugg

SEQ ID NO: 794291 - RNA, 19 nt, Homo sapiens
gaauuugcccaaucuuuga

SEQ ID NO: 794292 - RNA, 19 nt, Homo sapiens
guuaacaaaucacauaugg

SEQ ID NO: 794293 - RNA, 19 nt, Homo sapiens
gcuagaacagacauaguua

SEQ ID NO: 794294 - RNA, 19 nt, Homo sapiens
agaagaguaugacaaguug

SEQ ID NO: 794295 - RNA, 19 nt, Homo sapiens
gaaaucgaugcuugguuua

SEQ ID NO: 794296 - RNA, 19 nt, Homo sapiens
gcaagaaggaaacaauuca

SEQ ID NO: 794297 - RNA, 19 nt, Homo sapiens
gcaagcagaaucuacagaa

SEQ ID NO: 794298 - RNA, 19 nt, Homo sapiens
ccaauguagugcuaaauuc

SEQ ID NO: 794299 - RNA, 19 nt, Homo sapiens
uaaggaagcuguggcaagu

SEQ ID NO: 794300 - RNA, 19 nt, Homo sapiens
gcaagugauuggaguugug

SEQ ID NO: 794301 - RNA, 19 nt, Homo sapiens
gaaccuccacgacauguga

SEQ ID NO: 794302 - RNA, 19 nt, Homo sapiens
gaucagaauuagguauaga

SEQ ID NO: 794303 - RNA, 19 nt, Homo sapiens
gagaugugauuaagcuuag

SEQ ID NO: 794304 - RNA, 19 nt, Homo sapiens
gagcuuguccucauauuca

SEQ ID NO: 794305 - RNA, 19 nt, Homo sapiens
gaugucugauuuacuguga

SEQ ID NO: 794306 - RNA, 19 nt, Homo sapiens
gaagaauggaaacuugaaa

SEQ ID NO: 794307 - RNA, 19 nt, Homo sapiens
aaacuucuccugcagauga

SEQ ID NO: 794308 - RNA, 19 nt, Homo sapiens
gugcuuacaucucaacaau

SEQ ID NO: 794309 - RNA, 19 nt, Homo sapiens
aaucagugcuuacaucuca

SEQ ID NO: 794310 - RNA, 19 nt, Homo sapiens
guaauaaccagacaaucuu

SEQ ID NO: 794311 - RNA, 19 nt, Homo sapiens
ugaacaagauccagaccuu

SEQ ID NO: 794312 - RNA, 19 nt, Homo sapiens
gcaugguccuugccaguga

SEQ ID NO: 794313 - RNA, 19 nt, Homo sapiens
ugcaugggcuuauacaauu

SEQ ID NO: 794314 - RNA, 19 nt, Homo sapiens
gaaguucugcaauguaaau

SEQ ID NO: 794315 - RNA, 19 nt, Homo sapiens
cagagaagaucagaauuag

SEQ ID NO: 794316 - RNA, 19 nt, Homo sapiens
gcuaugagcaggucagaga

SEQ ID NO: 794317 - RNA, 19 nt, Homo sapiens
cagagaagaagaaaucaaa

SEQ ID NO: 794318 - RNA, 19 nt, Homo sapiens
aagagcaacuggcagaauu

SEQ ID NO: 794319 - RNA, 19 nt, Homo sapiens
caaagugucaaacaugaaa

SEQ ID NO: 794320 - RNA, 19 nt, Homo sapiens
gacaagagcugggcaguuu

SEQ ID NO: 794321 - RNA, 19 nt, Homo sapiens
gcacaaccguguucaaauc

SEQ ID NO: 794322 - RNA, 19 nt, Homo sapiens
ggcaaacccuguucucuuu

SEQ ID NO: 794323 - RNA, 19 nt, Homo sapiens
gaagaagaaggucaucaua

SEQ ID NO: 794324 - RNA, 19 nt, Homo sapiens
uagcaaggauuguaaauuc

SEQ ID NO: 794325 - RNA, 19 nt, Homo sapiens
ccugaaacauucccugaua

SEQ ID NO: 794326 - RNA, 19 nt, Homo sapiens
aaacauucccugauaagua

SEQ ID NO: 794327 - RNA, 19 nt, Homo sapiens
gaaacuucaugguguuaug

SEQ ID NO: 794328 - RNA, 19 nt, Homo sapiens
aagaugagcagaaacaaua

SEQ ID NO: 794329 - RNA, 19 nt, Homo sapiens
ggaaugcuguggccaugug

SEQ ID NO: 794330 - RNA, 19 nt, Homo sapiens
ccaguguccucuuuauuga

SEQ ID NO: 794331 - RNA, 19 nt, Homo sapiens
agacaaaggugcccaaggu

SEQ ID NO: 794332 - RNA, 19 nt, Homo sapiens
gauagggaaaucuacauaa

SEQ ID NO: 794333 - RNA, 19 nt, Homo sapiens
gagcagaaacaauaaagug

SEQ ID NO: 794334 - RNA, 19 nt, Homo sapiens
aaaguauucugcucuguga

SEQ ID NO: 794335 - RNA, 19 nt, Homo sapiens
ugaguugauuccuccaaua

SEQ ID NO: 794336 - RNA, 19 nt, Homo sapiens
gcacggaagucuggagcaa

SEQ ID NO: 794337 - RNA, 19 nt, Homo sapiens
ccacagaacaccaucucua

SEQ ID NO: 794338 - RNA, 19 nt, Homo sapiens
ccacagaggaugaggaaga

SEQ ID NO: 794339 - RNA, 19 nt, Homo sapiens
gaagaugagcagaaacaau

SEQ ID NO: 794340 - RNA, 19 nt, Homo sapiens
uuagugaaguccacauuau

SEQ ID NO: 794341 - RNA, 19 nt, Homo sapiens
gcaggucgucaucuucaua

SEQ ID NO: 794342 - RNA, 19 nt, Homo sapiens
gaagccaacaggacugaaa

SEQ ID NO: 794343 - RNA, 19 nt, Homo sapiens
aaagguggauuccuagcaa

SEQ ID NO: 794344 - RNA, 19 nt, Homo sapiens
guacuacucaguccucuau

SEQ ID NO: 794345 - RNA, 19 nt, Homo sapiens
ggcagcagcagaucuuuaa

SEQ ID NO: 794346 - RNA, 19 nt, Homo sapiens
cccgugaacuggugaugua

SEQ ID NO: 794347 - RNA, 19 nt, Homo sapiens
uguggaaccugaaacauuc

SEQ ID NO: 794348 - RNA, 19 nt, Homo sapiens
ucugcaaggucgucaaauu

SEQ ID NO: 794349 - RNA, 19 nt, Homo sapiens
ggagcacucuaagggaauu

SEQ ID NO: 794350 - RNA, 19 nt, Homo sapiens
gcaaggauuguaaauucuu

SEQ ID NO: 794351 - RNA, 19 nt, Homo sapiens
aacauucccugauaaguau

SEQ ID NO: 794352 - RNA, 19 nt, Homo sapiens
cugaaacauucccugauaa

SEQ ID NO: 794353 - RNA, 19 nt, Homo sapiens
gggcagcagcagaucuuua

SEQ ID NO: 794354 - RNA, 19 nt, Homo sapiens
cagaacaccaucucuauuc

SEQ ID NO: 794355 - RNA, 19 nt, Homo sapiens
uguacguucugguguauaa

SEQ ID NO: 794356 - RNA, 19 nt, Homo sapiens
gaagagcugauccagacaa

SEQ ID NO: 794357 - RNA, 19 nt, Homo sapiens
gcauuacguuggcuucaca

SEQ ID NO: 794358 - RNA, 19 nt, Homo sapiens
caccaucucuauucccuau

SEQ ID NO: 794359 - RNA, 19 nt, Homo sapiens
gaagaaggucaucauagca

SEQ ID NO: 794360 - RNA, 19 nt, Homo sapiens
ugaaugauagggaaaucua

SEQ ID NO: 794361 - RNA, 19 nt, Homo sapiens
gggagcaggagcacucuaa

SEQ ID NO: 794362 - RNA, 19 nt, Homo sapiens
uaacaucaccacggucauu

SEQ ID NO: 794363 - RNA, 19 nt, Homo sapiens
caaccguguucaaaucugu

SEQ ID NO: 794364 - RNA, 19 nt, Homo sapiens
guugauuccuccaauaugg

SEQ ID NO: 794365 - RNA, 19 nt, Homo sapiens
gugauuguaugaucuccuu

SEQ ID NO: 794366 - RNA, 19 nt, Homo sapiens
gagcggaagaugagcagaa

SEQ ID NO: 794367 - RNA, 19 nt, Homo sapiens
agaagaaggucaucauagc

SEQ ID NO: 794368 - RNA, 19 nt, Homo sapiens
ucaccaacagguucauuaa

SEQ ID NO: 794369 - RNA, 19 nt, Homo sapiens
ggacaagagcugggcaguu

SEQ ID NO: 794370 - RNA, 19 nt, Homo sapiens
ucagugauccauguccuua

SEQ ID NO: 794371 - RNA, 19 nt, Homo sapiens
gaguugauuccuccaauau

SEQ ID NO: 794372 - RNA, 19 nt, Homo sapiens
gacaaaggugcccaaggua

SEQ ID NO: 794373 - RNA, 19 nt, Homo sapiens
gagcugauccagacaaagg

SEQ ID NO: 794374 - RNA, 19 nt, Homo sapiens
gaaguccacauuauucucu

SEQ ID NO: 794375 - RNA, 19 nt, Homo sapiens
gccagaugcuuuugaauga

SEQ ID NO: 794376 - RNA, 19 nt, Homo sapiens
gaugagcagaaacaauaaa

SEQ ID NO: 794377 - RNA, 19 nt, Homo sapiens
cugcaaggucgucaaauuu

SEQ ID NO: 794378 - RNA, 19 nt, Homo sapiens
gaaacauucccugauaagu

SEQ ID NO: 794379 - RNA, 19 nt, Homo sapiens
ccuguucucuuucuuacug

SEQ ID NO: 794380 - RNA, 19 nt, Homo sapiens
gguguuccucuucuugaua

SEQ ID NO: 794381 - RNA, 19 nt, Homo sapiens
guucugguguauaacauca

SEQ ID NO: 794382 - RNA, 19 nt, Homo sapiens
gaguauauguauccaucuc

SEQ ID NO: 794383 - RNA, 19 nt, Homo sapiens
ugauagggaaaucuacaua

SEQ ID NO: 794384 - RNA, 19 nt, Homo sapiens
gccaugugauuguaugauc

SEQ ID NO: 794385 - RNA, 19 nt, Homo sapiens
gaaugccuccuucuguguu

SEQ ID NO: 794386 - RNA, 19 nt, Homo sapiens
uaggcucgcugcucggaaa

SEQ ID NO: 794387 - RNA, 19 nt, Homo sapiens
acaccaugcucuucugcaa

SEQ ID NO: 794388 - RNA, 19 nt, Homo sapiens
aauaugggccagaugcuuu

SEQ ID NO: 794389 - RNA, 19 nt, Homo sapiens
uaaguauucccugcaguuu

SEQ ID NO: 794390 - RNA, 19 nt, Homo sapiens
caaacccuguucucuuucu

SEQ ID NO: 794391 - RNA, 19 nt, Homo sapiens
ugacacuuccgucuucuug

SEQ ID NO: 794392 - RNA, 19 nt, Homo sapiens
gguguacguucugguguau

SEQ ID NO: 794393 - RNA, 19 nt, Homo sapiens
gaacacacagagagaagac

SEQ ID NO: 794394 - RNA, 19 nt, Homo sapiens
cagaugcuuuugaaugaua

SEQ ID NO: 794395 - RNA, 19 nt, Homo sapiens
gaaacaauaaagugagcau

SEQ ID NO: 794396 - RNA, 19 nt, Homo sapiens
cacagaacaccaucucuau

SEQ ID NO: 794397 - RNA, 19 nt, Homo sapiens
ugauccauguccuuaguga

SEQ ID NO: 794398 - RNA, 19 nt, Homo sapiens
gugaguugauuccuccaau

SEQ ID NO: 794399 - RNA, 19 nt, Homo sapiens
gccguaauguggucaguac

SEQ ID NO: 794400 - RNA, 19 nt, Homo sapiens
cuauugcuuuggacaggua

SEQ ID NO: 794401 - RNA, 19 nt, Homo sapiens
gucaccaacagguucauua

SEQ ID NO: 794402 - RNA, 19 nt, Homo sapiens
aauccaguguccucuuuau

SEQ ID NO: 794403 - RNA, 19 nt, Homo sapiens
gagaacacacagagagaag

SEQ ID NO: 794404 - RNA, 19 nt, Homo sapiens
cuuagugaaguccacauua

SEQ ID NO: 794405 - RNA, 19 nt, Homo sapiens
aaaauccaguguccucuuu

SEQ ID NO: 794406 - RNA, 19 nt, Homo sapiens
ggaagaugagcagaaacaa

SEQ ID NO: 794407 - RNA, 19 nt, Homo sapiens
aagagcugauccagacaaa

SEQ ID NO: 794408 - RNA, 19 nt, Homo sapiens
gcugcucacugcuguuugg

SEQ ID NO: 794409 - RNA, 19 nt, Homo sapiens
acagaacaccaucucuauu

SEQ ID NO: 794410 - RNA, 19 nt, Homo sapiens
gaccaucgaaugccuccuu

SEQ ID NO: 794411 - RNA, 19 nt, Homo sapiens
gcucgcugcucggaaacuu

SEQ ID NO: 794412 - RNA, 19 nt, Homo sapiens
uccaguguccucuuuauug

SEQ ID NO: 794413 - RNA, 19 nt, Homo sapiens
gcugucaagcuguguucua

SEQ ID NO: 794414 - RNA, 19 nt, Homo sapiens
gugaacuggugauguacau

SEQ ID NO: 794415 - RNA, 19 nt, Homo sapiens
gaucuacaccaugcucuuc

SEQ ID NO: 794416 - RNA, 19 nt, Homo sapiens
caccaacagguucauuaaa

SEQ ID NO: 794417 - RNA, 19 nt, Homo sapiens
cagagaacacacagagaga

SEQ ID NO: 794418 - RNA, 19 nt, Homo sapiens
gcccacagaggaugaggaa

SEQ ID NO: 794419 - RNA, 19 nt, Homo sapiens
caacuacaccaccgguaca

SEQ ID NO: 794420 - RNA, 19 nt, Homo sapiens
ggagggaagucuugugaaa

SEQ ID NO: 794421 - RNA, 19 nt, Homo sapiens
caguaaagcuguagaguuc

SEQ ID NO: 794422 - RNA, 19 nt, Homo sapiens
gcuaagcccuugguucuug

SEQ ID NO: 794423 - RNA, 19 nt, Homo sapiens
cagaaggugugcccagauu

SEQ ID NO: 794424 - RNA, 19 nt, Homo sapiens
ggccacaucucaccuaagu

SEQ ID NO: 794425 - RNA, 19 nt, Homo sapiens
ccacggagccacagagaga

SEQ ID NO: 794426 - RNA, 19 nt, Homo sapiens
gcacacccauccuuaagcu

SEQ ID NO: 794427 - RNA, 19 nt, Homo sapiens
ucaagacgguggcccugaa

SEQ ID NO: 794428 - RNA, 19 nt, Homo sapiens
ccacaucucaccuaaguca

SEQ ID NO: 794429 - RNA, 19 nt, Homo sapiens
ggucaucuguggccaggau

SEQ ID NO: 794430 - RNA, 19 nt, Homo sapiens
ccaguaaagcuguagaguu

SEQ ID NO: 794431 - RNA, 19 nt, Homo sapiens
gcuaagacaggacgauugu

SEQ ID NO: 794432 - RNA, 19 nt, Homo sapiens
gaucaagucaugggaggaa

SEQ ID NO: 794433 - RNA, 19 nt, Homo sapiens
guaaagcuguagaguucca

SEQ ID NO: 794434 - RNA, 19 nt, Homo sapiens
gaaggugugcccagauuac

SEQ ID NO: 794435 - RNA, 19 nt, Homo sapiens
guucuuggagcaggaaaua

SEQ ID NO: 794436 - RNA, 19 nt, Homo sapiens
acacccauccuuaagcuaa

SEQ ID NO: 794437 - RNA, 19 nt, Homo sapiens
gcuguggagugacuagauc

SEQ ID NO: 794438 - RNA, 19 nt, Homo sapiens
caaagucgucugugucuac

SEQ ID NO: 794439 - RNA, 19 nt, Homo sapiens
ccagauuacaacuaccaua

SEQ ID NO: 794440 - RNA, 19 nt, Homo sapiens
gcucccagcccuucaaagu

SEQ ID NO: 794441 - RNA, 19 nt, Homo sapiens
agagaaagggucccaagug

SEQ ID NO: 794442 - RNA, 19 nt, Homo sapiens
gacgagagcggaggaggaa

SEQ ID NO: 794443 - RNA, 19 nt, Homo sapiens
cagauuacaacuaccauag

SEQ ID NO: 794444 - RNA, 19 nt, Homo sapiens
ggugcaggguagccucuau

SEQ ID NO: 794445 - RNA, 19 nt, Homo sapiens
gugcccagauuacaacuac

SEQ ID NO: 794446 - RNA, 19 nt, Homo sapiens
ucaaagucgucugugucua

SEQ ID NO: 794447 - RNA, 19 nt, Homo sapiens
gcugauugcugacuuuugu

SEQ ID NO: 794448 - RNA, 19 nt, Homo sapiens
cagggaaacaucuccauca

SEQ ID NO: 794449 - RNA, 19 nt, Homo sapiens
cgacuucuacuccaacauc

SEQ ID NO: 794450 - RNA, 19 nt, Homo sapiens
cagccaaggugaagaaaau

SEQ ID NO: 794451 - RNA, 19 nt, Homo sapiens
cgagagcggaggaggaaga

SEQ ID NO: 794452 - RNA, 19 nt, Homo sapiens
agaaggugugcccagauua

SEQ ID NO: 794453 - RNA, 19 nt, Homo sapiens
ucuuggagcaggaaauaaa

SEQ ID NO: 794454 - RNA, 19 nt, Homo sapiens
gugucuacaucgccuucua

SEQ ID NO: 794455 - RNA, 19 nt, Homo sapiens
gaggaggagugggcucucu

SEQ ID NO: 794456 - RNA, 19 nt, Homo sapiens
gaccuucagcguccacuuc

SEQ ID NO: 794457 - RNA, 19 nt, Homo sapiens
aagcuaagcccuugguucu

SEQ ID NO: 794458 - RNA, 19 nt, Homo sapiens
gcucgucacagggaagauu

SEQ ID NO: 794459 - RNA, 19 nt, Homo sapiens
cuggaucuguucugugugu

SEQ ID NO: 794460 - RNA, 19 nt, Homo sapiens
ggaggagugggcucucugu

SEQ ID NO: 794461 - RNA, 19 nt, Homo sapiens
gacuucuacuccaacauca

SEQ ID NO: 794462 - RNA, 19 nt, Homo sapiens
ccacgacccagccaagauc

SEQ ID NO: 794463 - RNA, 19 nt, Homo sapiens
gccaaggccuccaaaaucu

SEQ ID NO: 794464 - RNA, 19 nt, Homo sapiens
cagucagccucaccuguca

SEQ ID NO: 794465 - RNA, 19 nt, Homo sapiens
agucaugggaggaagcuaa

SEQ ID NO: 794466 - RNA, 19 nt, Homo sapiens
gugcuggucccaaccugaa

SEQ ID NO: 794467 - RNA, 19 nt, Homo sapiens
aacagcagaucuucaucga

SEQ ID NO: 794468 - RNA, 19 nt, Homo sapiens
ggaggaggaagaugcaacu

SEQ ID NO: 794469 - RNA, 19 nt, Homo sapiens
ccucagccaaggugaagaa

SEQ ID NO: 794470 - RNA, 19 nt, Homo sapiens
ggccaauuccacucuccua

SEQ ID NO: 794471 - RNA, 19 nt, Homo sapiens
ugcuggaucuguucugugu

SEQ ID NO: 794472 - RNA, 19 nt, Homo sapiens
ggccaccccuuuccaaaau

SEQ ID NO: 794473 - RNA, 19 nt, Homo sapiens
uggcugagagggcuuccua

SEQ ID NO: 794474 - RNA, 19 nt, Homo sapiens
ccugucaacuuaggaugga

SEQ ID NO: 794475 - RNA, 19 nt, Homo sapiens
ggggagauuucaucagugu

SEQ ID NO: 794476 - RNA, 19 nt, Homo sapiens
ggagcaggaaauaaagcuu

SEQ ID NO: 794477 - RNA, 19 nt, Homo sapiens
gcacgucccuugaggcuua

SEQ ID NO: 794478 - RNA, 19 nt, Homo sapiens
ccacagacauccaggaaga

SEQ ID NO: 794479 - RNA, 19 nt, Homo sapiens
acacauaccugcugcugaa

SEQ ID NO: 794480 - RNA, 19 nt, Homo sapiens
caagagaaacccugagaaa

SEQ ID NO: 794481 - RNA, 19 nt, Homo sapiens
gcaacgucauuaagucaaa

SEQ ID NO: 794482 - RNA, 19 nt, Homo sapiens
guacucauuuguaaucaga

SEQ ID NO: 794483 - RNA, 19 nt, Homo sapiens
gagcggauccgaaggagaa

SEQ ID NO: 794484 - RNA, 19 nt, Homo sapiens
gaucuguccugcucuguuc

SEQ ID NO: 794485 - RNA, 19 nt, Homo sapiens
gaacugcaacgucauuaag

SEQ ID NO: 794486 - RNA, 19 nt, Homo sapiens
ggucauagucugcacuuug

SEQ ID NO: 794487 - RNA, 19 nt, Homo sapiens
ccaagggucucuccacgau

SEQ ID NO: 794488 - RNA, 19 nt, Homo sapiens
cagccacgcucuacugguu

SEQ ID NO: 794489 - RNA, 19 nt, Homo sapiens
gcagccagcagacaaagaa

SEQ ID NO: 794490 - RNA, 19 nt, Homo sapiens
ggaacugcaacgucauuaa

SEQ ID NO: 794491 - RNA, 19 nt, Homo sapiens
gcuaugcgcucggccauca

SEQ ID NO: 794492 - RNA, 19 nt, Homo sapiens
gcuccuggguguucauuca

SEQ ID NO: 794493 - RNA, 19 nt, Homo sapiens
caauuuaagcacaaaggua

SEQ ID NO: 794494 - RNA, 19 nt, Homo sapiens
ccaggguucuucagcuauu

SEQ ID NO: 794495 - RNA, 19 nt, Homo sapiens
caccaggguucuucagcua

SEQ ID NO: 794496 - RNA, 19 nt, Homo sapiens
guggaccgcuuccucauca

SEQ ID NO: 794497 - RNA, 19 nt, Homo sapiens
gugcagaaguugggcagaa

SEQ ID NO: 794498 - RNA, 19 nt, Homo sapiens
gucauagucugcacuuugu

SEQ ID NO: 794499 - RNA, 19 nt, Homo sapiens
cuucagcuauugauguuug

SEQ ID NO: 794500 - RNA, 19 nt, Homo sapiens
gcaacacuguggucugcau

SEQ ID NO: 794501 - RNA, 19 nt, Homo sapiens
uuggcacgaugaauuauuu

SEQ ID NO: 794502 - RNA, 19 nt, Homo sapiens
ggaaugaagcugguugagu

SEQ ID NO: 794503 - RNA, 19 nt, Homo sapiens
ucuguucccuggcauguug

SEQ ID NO: 794504 - RNA, 19 nt, Homo sapiens
ucaacacgguccgcaagaa

SEQ ID NO: 794505 - RNA, 19 nt, Homo sapiens
gcaacagcacgucccuuga

SEQ ID NO: 794506 - RNA, 19 nt, Homo sapiens
gcgccuacguggucaccuu

SEQ ID NO: 794507 - RNA, 19 nt, Homo sapiens
gcagcucccaaauuucaaa

SEQ ID NO: 794508 - RNA, 19 nt, Homo sapiens
ccuggguguucauucauuu

SEQ ID NO: 794509 - RNA, 19 nt, Homo sapiens
gguggcaauuuaagcacaa

SEQ ID NO: 794510 - RNA, 19 nt, Homo sapiens
acuuugugguggcaauuua

SEQ ID NO: 794511 - RNA, 19 nt, Homo sapiens
caacagcacgucccuugag

SEQ ID NO: 794512 - RNA, 19 nt, Homo sapiens
gggaacugcaacgucauua

SEQ ID NO: 794513 - RNA, 19 nt, Homo sapiens
gaugcagccagcagacaaa

SEQ ID NO: 794514 - RNA, 19 nt, Homo sapiens
ccuugaggcuuacacauac

SEQ ID NO: 794515 - RNA, 19 nt, Homo sapiens
ggccuucuccgacaucaug

SEQ ID NO: 794516 - RNA, 19 nt, Homo sapiens
ggagggcaacagggaauga

SEQ ID NO: 794517 - RNA, 19 nt, Homo sapiens
gcaauuuaagcacaaaggu

SEQ ID NO: 794518 - RNA, 19 nt, Homo sapiens
cagucuacgugugcaauga

SEQ ID NO: 794519 - RNA, 19 nt, Homo sapiens
ccaccauccugauccucuu

SEQ ID NO: 794520 - RNA, 19 nt, Homo sapiens
gaggagggcaacagggaau

SEQ ID NO: 794521 - RNA, 19 nt, Homo sapiens
cccuugaggcuuacacaua

SEQ ID NO: 794522 - RNA, 19 nt, Homo sapiens
ccacuucugccgccucuca

SEQ ID NO: 794523 - RNA, 19 nt, Homo sapiens
guucuucagcuauugaugu

SEQ ID NO: 794524 - RNA, 19 nt, Homo sapiens
aagcacaaagguacucauu

SEQ ID NO: 794525 - RNA, 19 nt, Homo sapiens
auagugaugcugcugauga

SEQ ID NO: 794526 - RNA, 19 nt, Homo sapiens
ccauagugaugcugcugau

SEQ ID NO: 794527 - RNA, 19 nt, Homo sapiens
ucaagagaaacccugagaa

SEQ ID NO: 794528 - RNA, 19 nt, Homo sapiens
cugcagcucccaaauuuca

SEQ ID NO: 794529 - RNA, 19 nt, Homo sapiens
ggaucuguccugcucuguu

SEQ ID NO: 794530 - RNA, 19 nt, Homo sapiens
gucuacugcuggagaauca

SEQ ID NO: 794531 - RNA, 19 nt, Homo sapiens
ugcagaaguugggcagaaa

SEQ ID NO: 794532 - RNA, 19 nt, Homo sapiens
gggcugaugggaacugcaa

SEQ ID NO: 794533 - RNA, 19 nt, Homo sapiens
gcacuuugugguggcaauu

SEQ ID NO: 794534 - RNA, 19 nt, Homo sapiens
ccaaggccuucaccaccau

SEQ ID NO: 794535 - RNA, 19 nt, Homo sapiens
ggugguggccguguucuuc

SEQ ID NO: 794536 - RNA, 19 nt, Homo sapiens
gcagaaguugggcagaaag

SEQ ID NO: 794537 - RNA, 19 nt, Homo sapiens
uugcagagagccaaauaug

SEQ ID NO: 794538 - RNA, 19 nt, Homo sapiens
gucuacgugugcaaugaaa

SEQ ID NO: 794539 - RNA, 19 nt, Homo sapiens
ucucugcaccugcucaaga

SEQ ID NO: 794540 - RNA, 19 nt, Homo sapiens
acucauuuguaaucagaug

SEQ ID NO: 794541 - RNA, 19 nt, Homo sapiens
ggaucuccuuggccauagu

SEQ ID NO: 794542 - RNA, 19 nt, Homo sapiens
cgcgaggccugcauagagu

SEQ ID NO: 794543 - RNA, 19 nt, Homo sapiens
caacacgguccgcaagaac

SEQ ID NO: 794544 - RNA, 19 nt, Homo sapiens
ggaccgcuuccucaucauc

SEQ ID NO: 794545 - RNA, 19 nt, Homo sapiens
ggaagaagcagaugagaaa

SEQ ID NO: 794546 - RNA, 19 nt, Homo sapiens
cagcacacgucauuucuua

SEQ ID NO: 794547 - RNA, 19 nt, Homo sapiens
gaagagagaggaaagguuu

SEQ ID NO: 794548 - RNA, 19 nt, Homo sapiens
gagaaacucuugagaucuu

SEQ ID NO: 794549 - RNA, 19 nt, Homo sapiens
ggaaggaguuuuauguuaa

SEQ ID NO: 794550 - RNA, 19 nt, Homo sapiens
ucaacacggugcccuauuu

SEQ ID NO: 794551 - RNA, 19 nt, Homo sapiens
aacaggcacucaauaaaua

SEQ ID NO: 794552 - RNA, 19 nt, Homo sapiens
gcaacaggcacucaauaaa

SEQ ID NO: 794553 - RNA, 19 nt, Homo sapiens
caacaggcacucaauaaau

SEQ ID NO: 794554 - RNA, 19 nt, Homo sapiens
gggaaggaguuuuauguua

SEQ ID NO: 794555 - RNA, 19 nt, Homo sapiens
ggacuuuggucuauugucu

SEQ ID NO: 794556 - RNA, 19 nt, Homo sapiens
cacagggucugcacucuaa

SEQ ID NO: 794557 - RNA, 19 nt, Homo sapiens
guuaaaccauccauguauu

SEQ ID NO: 794558 - RNA, 19 nt, Homo sapiens
ggaguaacacaaagugaaa

SEQ ID NO: 794559 - RNA, 19 nt, Homo sapiens
gucagagacugcuguguuu

SEQ ID NO: 794560 - RNA, 19 nt, Homo sapiens
gcacuccuccaucuucuuu

SEQ ID NO: 794561 - RNA, 19 nt, Homo sapiens
cacagcaacucuaagacua

SEQ ID NO: 794562 - RNA, 19 nt, Homo sapiens
gcagcuaccauuucccuuu

SEQ ID NO: 794563 - RNA, 19 nt, Homo sapiens
acagugaggugcccagcua

SEQ ID NO: 794564 - RNA, 19 nt, Homo sapiens
gcacucacacgcgaaagua

SEQ ID NO: 794565 - RNA, 19 nt, Homo sapiens
ggucagagacugcuguguu

SEQ ID NO: 794566 - RNA, 19 nt, Homo sapiens
gcagagccacccuguguug

SEQ ID NO: 794567 - RNA, 19 nt, Homo sapiens
uuaagaugcuaccuuguga

SEQ ID NO: 794568 - RNA, 19 nt, Homo sapiens
aaacugcacuccuccaucu

SEQ ID NO: 794569 - RNA, 19 nt, Homo sapiens
gcagggacuuuggucuauu

SEQ ID NO: 794570 - RNA, 19 nt, Homo sapiens
ggacuuaagaugcuaccuu

SEQ ID NO: 794571 - RNA, 19 nt, Homo sapiens
agccugcccucuucauuua

SEQ ID NO: 794572 - RNA, 19 nt, Homo sapiens
gaugagaaacucuugagau

SEQ ID NO: 794573 - RNA, 19 nt, Homo sapiens
gacauucucugaccuacuc

SEQ ID NO: 794574 - RNA, 19 nt, Homo sapiens
gcucagggagguuaaguga

SEQ ID NO: 794575 - RNA, 19 nt, Homo sapiens
gagaggaaagguuugagaa

SEQ ID NO: 794576 - RNA, 19 nt, Homo sapiens
gggcacagcaacucuaaga

SEQ ID NO: 794577 - RNA, 19 nt, Homo sapiens
ucagaaacagugaguuaaa

SEQ ID NO: 794578 - RNA, 19 nt, Homo sapiens
gagcgaggacauucucuga

SEQ ID NO: 794579 - RNA, 19 nt, Homo sapiens
guacugagagucugcacuu

SEQ ID NO: 794580 - RNA, 19 nt, Homo sapiens
acaaugugcugcuccugaa

SEQ ID NO: 794581 - RNA, 19 nt, Homo sapiens
acacgucauuucuuagcua

SEQ ID NO: 794582 - RNA, 19 nt, Homo sapiens
ggcgaggccuggaguaaca

SEQ ID NO: 794583 - RNA, 19 nt, Homo sapiens
gggagacucugaaucuuuu

SEQ ID NO: 794584 - RNA, 19 nt, Homo sapiens
caucuucuuucucaacaug

SEQ ID NO: 794585 - RNA, 19 nt, Homo sapiens
cagggacuuuggucuauug

SEQ ID NO: 794586 - RNA, 19 nt, Homo sapiens
gggcagggacuuuggucua

SEQ ID NO: 794587 - RNA, 19 nt, Homo sapiens
cagaaacagugaguuaaag

SEQ ID NO: 794588 - RNA, 19 nt, Homo sapiens
gaauggagucauccucuuc

SEQ ID NO: 794589 - RNA, 19 nt, Homo sapiens
gcacagcaacucuaagacu

SEQ ID NO: 794590 - RNA, 19 nt, Homo sapiens
ucagggagguuaagugacu

SEQ ID NO: 794591 - RNA, 19 nt, Homo sapiens
ggcagggacuuuggucuau

SEQ ID NO: 794592 - RNA, 19 nt, Homo sapiens
cuuguuaagugcagucuga

SEQ ID NO: 794593 - RNA, 19 nt, Homo sapiens
ggucuauugucuguauuug

SEQ ID NO: 794594 - RNA, 19 nt, Homo sapiens
caaaggccagggucacuga

SEQ ID NO: 794595 - RNA, 19 nt, Homo sapiens
ugaaaugucaguggaagaa

SEQ ID NO: 794596 - RNA, 19 nt, Homo sapiens
gcacugguaaucccaagau

SEQ ID NO: 794597 - RNA, 19 nt, Homo sapiens
gacuacagcacacgucauu

SEQ ID NO: 794598 - RNA, 19 nt, Homo sapiens
gggcuaaucaaauccaaug

SEQ ID NO: 794599 - RNA, 19 nt, Homo sapiens
gaaacagugaguuaaagca

SEQ ID NO: 794600 - RNA, 19 nt, Homo sapiens
gaaaaguuggugucaauga

SEQ ID NO: 794601 - RNA, 19 nt, Homo sapiens
cagccugcccucuucauuu

SEQ ID NO: 794602 - RNA, 19 nt, Homo sapiens
gggcaccaccuucugcaaa

SEQ ID NO: 794603 - RNA, 19 nt, Homo sapiens
gcagaugagaaacucuuga

SEQ ID NO: 794604 - RNA, 19 nt, Homo sapiens
gaggacauucucugaccua

SEQ ID NO: 794605 - RNA, 19 nt, Homo sapiens
ggauugugccuguaugcaa

SEQ ID NO: 794606 - RNA, 19 nt, Homo sapiens
gggauggcguggucaagca

SEQ ID NO: 794607 - RNA, 19 nt, Homo sapiens
ccacagggucugcacucua

SEQ ID NO: 794608 - RNA, 19 nt, Homo sapiens
cuacagcacacgucauuuc

SEQ ID NO: 794609 - RNA, 19 nt, Homo sapiens
gagagucugcacuuaacaa

SEQ ID NO: 794610 - RNA, 19 nt, Homo sapiens
gguggagaauggagucauc

SEQ ID NO: 794611 - RNA, 19 nt, Homo sapiens
gagccacccuguguugaca

SEQ ID NO: 794612 - RNA, 19 nt, Homo sapiens
augagaaacucuugagauc

SEQ ID NO: 794613 - RNA, 19 nt, Homo sapiens
cagagacugcuguguuuga

SEQ ID NO: 794614 - RNA, 19 nt, Homo sapiens
uugcaccucugaccuauca

SEQ ID NO: 794615 - RNA, 19 nt, Homo sapiens
guuccagccugcccucuuc

SEQ ID NO: 794616 - RNA, 19 nt, Homo sapiens
uuggacacguggugcauuu

SEQ ID NO: 794617 - RNA, 19 nt, Homo sapiens
cacgucauuucuuagcuaa

SEQ ID NO: 794618 - RNA, 19 nt, Homo sapiens
cgggagacucugaaucuuu

SEQ ID NO: 794619 - RNA, 19 nt, Homo sapiens
ugagcagcaccucgaguua

SEQ ID NO: 794620 - RNA, 19 nt, Homo sapiens
ugcaacaggcacucaauaa

SEQ ID NO: 794621 - RNA, 19 nt, Homo sapiens
gaccuacucgagggacuua

SEQ ID NO: 794622 - RNA, 19 nt, Homo sapiens
cuuuacagcugagcacauu

SEQ ID NO: 794623 - RNA, 19 nt, Homo sapiens
agaauggagucauccucuu

SEQ ID NO: 794624 - RNA, 19 nt, Homo sapiens
ggaugaaaugucaguggaa

SEQ ID NO: 794625 - RNA, 19 nt, Homo sapiens
cuucaucccacaaucuuaa

SEQ ID NO: 794626 - RNA, 19 nt, Homo sapiens
gagcagcaccucgaguuag

SEQ ID NO: 794627 - RNA, 19 nt, Homo sapiens
caacacggugcccuauuuc

SEQ ID NO: 794628 - RNA, 19 nt, Homo sapiens
cuugguggaugaaauguca

SEQ ID NO: 794629 - RNA, 19 nt, Homo sapiens
aaguuggugucaaugaauu

SEQ ID NO: 794630 - RNA, 19 nt, Homo sapiens
gcaaacugcacuccuccau

SEQ ID NO: 794631 - RNA, 19 nt, Homo sapiens
cuucuucaccuacuucuug

SEQ ID NO: 794632 - RNA, 19 nt, Homo sapiens
cagcaacucuaagacuaca

SEQ ID NO: 794633 - RNA, 19 nt, Homo sapiens
cgagggacuuaagaugcua

SEQ ID NO: 794634 - RNA, 19 nt, Homo sapiens
agaucuugguccuguguuu

SEQ ID NO: 794635 - RNA, 19 nt, Homo sapiens
gcacacgucauuucuuagc

SEQ ID NO: 794636 - RNA, 19 nt, Homo sapiens
aggaaagguuugagaagca

SEQ ID NO: 794637 - RNA, 19 nt, Homo sapiens
uauguuaaaccauccaugu

SEQ ID NO: 794638 - RNA, 19 nt, Homo sapiens
gcagugcuucucaaaccuu

SEQ ID NO: 794639 - RNA, 19 nt, Homo sapiens
agaagcagaugagaaacuc

SEQ ID NO: 794640 - RNA, 19 nt, Homo sapiens
aaaaguuggugucaaugaa

SEQ ID NO: 794641 - RNA, 19 nt, Homo sapiens
ucuauuagccagucuuuac

SEQ ID NO: 794642 - RNA, 19 nt, Homo sapiens
gagaagagagaggaaaggu

SEQ ID NO: 794643 - RNA, 19 nt, Homo sapiens
cgcauuaugugcuacuaca

SEQ ID NO: 794644 - RNA, 19 nt, Homo sapiens
gguuugagaagcacuguuc

SEQ ID NO: 794645 - RNA, 19 nt, Homo sapiens
gcagaugucuugcuuggaa

SEQ ID NO: 794646 - RNA, 19 nt, Homo sapiens
gcaaaugcaucuguaaaga

SEQ ID NO: 794647 - RNA, 19 nt, Homo sapiens
ggaaugcucuuugugcuuu

SEQ ID NO: 794648 - RNA, 19 nt, Homo sapiens
ggaggcagcuuguggagaa

SEQ ID NO: 794649 - RNA, 19 nt, Homo sapiens
gggaugagcugaccaagau

SEQ ID NO: 794650 - RNA, 19 nt, Homo sapiens
caauguggcugguuacaaa

SEQ ID NO: 794651 - RNA, 19 nt, Homo sapiens
gaacuuaccagcagaaauc

SEQ ID NO: 794652 - RNA, 19 nt, Homo sapiens
cugaacagcucaagaaauu

SEQ ID NO: 794653 - RNA, 19 nt, Homo sapiens
gccuauacccggcaaauua

SEQ ID NO: 794654 - RNA, 19 nt, Homo sapiens
acaaagccauuuaccauga

SEQ ID NO: 794655 - RNA, 19 nt, Homo sapiens
gguagaagcagcaaagaaa

SEQ ID NO: 794656 - RNA, 19 nt, Homo sapiens
aauggaagcuuuacauaga

SEQ ID NO: 794657 - RNA, 19 nt, Homo sapiens
gaaacgaucucccuauucc

SEQ ID NO: 794658 - RNA, 19 nt, Homo sapiens
caacuuaaaugaacaagcu

SEQ ID NO: 794659 - RNA, 19 nt, Homo sapiens
aaacagaagcugggucuua

SEQ ID NO: 794660 - RNA, 19 nt, Homo sapiens
gaucuuguuccacugauua

SEQ ID NO: 794661 - RNA, 19 nt, Homo sapiens
ccaaagagaaguaugagaa

SEQ ID NO: 794662 - RNA, 19 nt, Homo sapiens
gcagcgaccucaugaacug

SEQ ID NO: 794663 - RNA, 19 nt, Homo sapiens
gcaggaagacgcagaacaa

SEQ ID NO: 794664 - RNA, 19 nt, Homo sapiens
ggagguuugucuacagauu

SEQ ID NO: 794665 - RNA, 19 nt, Homo sapiens
ucaagcaaaugcaucugua

SEQ ID NO: 794666 - RNA, 19 nt, Homo sapiens
gcacucgucuacuguuuua

SEQ ID NO: 794667 - RNA, 19 nt, Homo sapiens
cuaaagcacucgucuacug

SEQ ID NO: 794668 - RNA, 19 nt, Homo sapiens
gaaacgccuucgcuucuuc

SEQ ID NO: 794669 - RNA, 19 nt, Homo sapiens
gcuuaaaacuguacucuuu

SEQ ID NO: 794670 - RNA, 19 nt, Homo sapiens
uaaauuauggcacagauug

SEQ ID NO: 794671 - RNA, 19 nt, Homo sapiens
guccaucaccugcaacuua

SEQ ID NO: 794672 - RNA, 19 nt, Homo sapiens
gaauggaagcuuuacauag

SEQ ID NO: 794673 - RNA, 19 nt, Homo sapiens
ccagugagcagaugucuug

SEQ ID NO: 794674 - RNA, 19 nt, Homo sapiens
caagaaauugcaagacaaa

SEQ ID NO: 794675 - RNA, 19 nt, Homo sapiens
gcaucugaauggaagcuuu

SEQ ID NO: 794676 - RNA, 19 nt, Homo sapiens
ccgagucaaugguggguua

SEQ ID NO: 794677 - RNA, 19 nt, Homo sapiens
ccagacaggcgaccaguuu

SEQ ID NO: 794678 - RNA, 19 nt, Homo sapiens
ucaagaaauugcaagacaa

SEQ ID NO: 794679 - RNA, 19 nt, Homo sapiens
gcaccagucuugaggaaac

SEQ ID NO: 794680 - RNA, 19 nt, Homo sapiens
uaacaguuccuuuacaugu

SEQ ID NO: 794681 - RNA, 19 nt, Homo sapiens
gauuucagucgucguguua

SEQ ID NO: 794682 - RNA, 19 nt, Homo sapiens
gugagaaggaggacauuaa

SEQ ID NO: 794683 - RNA, 19 nt, Homo sapiens
uguccaauguggcugguua

SEQ ID NO: 794684 - RNA, 19 nt, Homo sapiens
ugaauggaagcuuuacaua

SEQ ID NO: 794685 - RNA, 19 nt, Homo sapiens
ggguuacacugaucuuguu

SEQ ID NO: 794686 - RNA, 19 nt, Homo sapiens
caguuuaacaguuccuuua

SEQ ID NO: 794687 - RNA, 19 nt, Homo sapiens
acagugaguuucguuugua

SEQ ID NO: 794688 - RNA, 19 nt, Homo sapiens
cgaucucccuauucccuua

SEQ ID NO: 794689 - RNA, 19 nt, Homo sapiens
ggaaacgaucucccuauuc

SEQ ID NO: 794690 - RNA, 19 nt, Homo sapiens
uuauacaccuguucauuuc

SEQ ID NO: 794691 - RNA, 19 nt, Homo sapiens
gaaguugaccccugacuaa

SEQ ID NO: 794692 - RNA, 19 nt, Homo sapiens
aaagaaagcccaccaugca

SEQ ID NO: 794693 - RNA, 19 nt, Homo sapiens
gcgcaccagucuugaggaa

SEQ ID NO: 794694 - RNA, 19 nt, Homo sapiens
gaacagcucaagaaauugc

SEQ ID NO: 794695 - RNA, 19 nt, Homo sapiens
ucgagaagaucaagaacug

SEQ ID NO: 794696 - RNA, 19 nt, Homo sapiens
acgcagaacaacagaaaua

SEQ ID NO: 794697 - RNA, 19 nt, Homo sapiens
aggaaacgaucucccuauu

SEQ ID NO: 794698 - RNA, 19 nt, Homo sapiens
gagaagacccagagcuauc

SEQ ID NO: 794699 - RNA, 19 nt, Homo sapiens
ugucuguccugagaacuua

SEQ ID NO: 794700 - RNA, 19 nt, Homo sapiens
uaacagcuuuuaacaguga

SEQ ID NO: 794701 - RNA, 19 nt, Homo sapiens
caucugaauggaagcuuua

SEQ ID NO: 794702 - RNA, 19 nt, Homo sapiens
ggaagacgcagaacaacag

SEQ ID NO: 794703 - RNA, 19 nt, Homo sapiens
ccuauucccuuacccuguu

SEQ ID NO: 794704 - RNA, 19 nt, Homo sapiens
auacaccuguucauuucua

SEQ ID NO: 794705 - RNA, 19 nt, Homo sapiens
uccaucaccugcaacuuaa

SEQ ID NO: 794706 - RNA, 19 nt, Homo sapiens
agaagaagaaggccacuga

SEQ ID NO: 794707 - RNA, 19 nt, Homo sapiens
uaaacugcuugaagucugu

SEQ ID NO: 794708 - RNA, 19 nt, Homo sapiens
uaacagugaguuucguuug

SEQ ID NO: 794709 - RNA, 19 nt, Homo sapiens
ucucuauguucuugacuuu

SEQ ID NO: 794710 - RNA, 19 nt, Homo sapiens
ccucacugaugaacgauga

SEQ ID NO: 794711 - RNA, 19 nt, Homo sapiens
gagguuugucuacagauuu

SEQ ID NO: 794712 - RNA, 19 nt, Homo sapiens
caagcaaaugcaucuguaa

SEQ ID NO: 794713 - RNA, 19 nt, Homo sapiens
ggaaggugggaccggguua

SEQ ID NO: 794714 - RNA, 19 nt, Homo sapiens
ucagguggcagauguuuga

SEQ ID NO: 794715 - RNA, 19 nt, Homo sapiens
gaggaaacgaucucccuau

SEQ ID NO: 794716 - RNA, 19 nt, Homo sapiens
cagugaguuucguuuguaa

SEQ ID NO: 794717 - RNA, 19 nt, Homo sapiens
cagugucuaucuguauaua

SEQ ID NO: 794718 - RNA, 19 nt, Homo sapiens
uuacaaagccauuuaccau

SEQ ID NO: 794719 - RNA, 19 nt, Homo sapiens
ggaauuaugccaggaaggu

SEQ ID NO: 794720 - RNA, 19 nt, Homo sapiens
gagugaagauuuugagguu

SEQ ID NO: 794721 - RNA, 19 nt, Homo sapiens
caccuaaaccuguccaaug

SEQ ID NO: 794722 - RNA, 19 nt, Homo sapiens
gccagcaguucgaggagaa

SEQ ID NO: 794723 - RNA, 19 nt, Homo sapiens
gggccaagaagcugaaaga

SEQ ID NO: 794724 - RNA, 19 nt, Homo sapiens
ccuguucauuucuacuuaa

SEQ ID NO: 794725 - RNA, 19 nt, Homo sapiens
gcugaaagagguagaagca

SEQ ID NO: 794726 - RNA, 19 nt, Homo sapiens
ugucaugucucagugucua

SEQ ID NO: 794727 - RNA, 19 nt, Homo sapiens
gugaagauuuugagguuuu

SEQ ID NO: 794728 - RNA, 19 nt, Homo sapiens
gugagcagcuacgagaaga

SEQ ID NO: 794729 - RNA, 19 nt, Homo sapiens
aaagagaaguaugagaagu

SEQ ID NO: 794730 - RNA, 19 nt, Homo sapiens
aagcacucgucuacuguuu

SEQ ID NO: 794731 - RNA, 19 nt, Homo sapiens
ucuauguucuugacuuugu

SEQ ID NO: 794732 - RNA, 19 nt, Homo sapiens
agaccaaagagaaguauga

SEQ ID NO: 794733 - RNA, 19 nt, Homo sapiens
cucagugucuaucuguaua

SEQ ID NO: 794734 - RNA, 19 nt, Homo sapiens
ucacucuauucuugcuuaa

SEQ ID NO: 794735 - RNA, 19 nt, Homo sapiens
agacgcagaacaacagaaa

SEQ ID NO: 794736 - RNA, 19 nt, Homo sapiens
gcagcaccgucagugagaa

SEQ ID NO: 794737 - RNA, 19 nt, Homo sapiens
acauggagcagguguuuga

SEQ ID NO: 794738 - RNA, 19 nt, Homo sapiens
ggaaaguggaccugugucu

SEQ ID NO: 794739 - RNA, 19 nt, Homo sapiens
gaagacgcagaacaacaga

SEQ ID NO: 794740 - RNA, 19 nt, Homo sapiens
caagauggaggacgaggau

SEQ ID NO: 794741 - RNA, 19 nt, Homo sapiens
caaagagaaguaugagaag

SEQ ID NO: 794742 - RNA, 19 nt, Homo sapiens
cucaagaaauugcaagaca

SEQ ID NO: 794743 - RNA, 19 nt, Homo sapiens
guuuaacaguuccuuuaca

SEQ ID NO: 794744 - RNA, 19 nt, Homo sapiens
aaaguggaccugugucugu

SEQ ID NO: 794745 - RNA, 19 nt, Homo sapiens
ggaagcaacugucgagauu

SEQ ID NO: 794746 - RNA, 19 nt, Homo sapiens
gaacaucgguacuggaguu

SEQ ID NO: 794747 - RNA, 19 nt, Homo sapiens
gaaaggauaccgcaaguuu

SEQ ID NO: 794748 - RNA, 19 nt, Homo sapiens
ggaagugggugucgaagaa

SEQ ID NO: 794749 - RNA, 19 nt, Homo sapiens
ccaguaagcucaccuuugu

SEQ ID NO: 794750 - RNA, 19 nt, Homo sapiens
caacuuggcugaccauugg

SEQ ID NO: 794751 - RNA, 19 nt, Homo sapiens
ggacuccucuucuacauca

SEQ ID NO: 794752 - RNA, 19 nt, Homo sapiens
gcuaaugccugccuucaga

SEQ ID NO: 794753 - RNA, 19 nt, Homo sapiens
gaacuuaccugagauuucg

SEQ ID NO: 794754 - RNA, 19 nt, Homo sapiens
gagcagaagugcccaccaa

SEQ ID NO: 794755 - RNA, 19 nt, Homo sapiens
gaagaugaggccagaaauu

SEQ ID NO: 794756 - RNA, 19 nt, Homo sapiens
gggagacgcucaaguaucu

SEQ ID NO: 794757 - RNA, 19 nt, Homo sapiens
gaggaaagcugaggauuuu

SEQ ID NO: 794758 - RNA, 19 nt, Homo sapiens
ccugagaacuuaccugaga

SEQ ID NO: 794759 - RNA, 19 nt, Homo sapiens
gaggaaagaauuugaggaa

SEQ ID NO: 794760 - RNA, 19 nt, Homo sapiens
ccaccucaccugcagauua

SEQ ID NO: 794761 - RNA, 19 nt, Homo sapiens
gaucuugggucugaggaaa

SEQ ID NO: 794762 - RNA, 19 nt, Homo sapiens
cagaagacacgaaucauga

SEQ ID NO: 794763 - RNA, 19 nt, Homo sapiens
caccgacccugagaacuua

SEQ ID NO: 794764 - RNA, 19 nt, Homo sapiens
gagauuucgucacagaaga

SEQ ID NO: 794765 - RNA, 19 nt, Homo sapiens
gggacaagauggagagcuu

SEQ ID NO: 794766 - RNA, 19 nt, Homo sapiens
gugcccauguucaucaaua

SEQ ID NO: 794767 - RNA, 19 nt, Homo sapiens
ggagacuuguuaccagaug

SEQ ID NO: 794768 - RNA, 19 nt, Homo sapiens
ccucgucucugcuuuaauc

SEQ ID NO: 794769 - RNA, 19 nt, Homo sapiens
ugaggaaagcugaggauuu

SEQ ID NO: 794770 - RNA, 19 nt, Homo sapiens
caucaacaauguccaggau

SEQ ID NO: 794771 - RNA, 19 nt, Homo sapiens
cagaacaccauccaagauu

SEQ ID NO: 794772 - RNA, 19 nt, Homo sapiens
ccaccacuguagucaugua

SEQ ID NO: 794773 - RNA, 19 nt, Homo sapiens
cauccaagauuccuuacuc

SEQ ID NO: 794774 - RNA, 19 nt, Homo sapiens
cgagcucccuccaagaaga

SEQ ID NO: 794775 - RNA, 19 nt, Homo sapiens
agacacgaaucaugacuca

SEQ ID NO: 794776 - RNA, 19 nt, Homo sapiens
gcuggaagacuacguggaa

SEQ ID NO: 794777 - RNA, 19 nt, Homo sapiens
uaccugagauuucgucaca

SEQ ID NO: 794778 - RNA, 19 nt, Homo sapiens
cagaagaugaggccagaaa

SEQ ID NO: 794779 - RNA, 19 nt, Homo sapiens
gggagauucugcagagcuu

SEQ ID NO: 794780 - RNA, 19 nt, Homo sapiens
gagacuuguuaccagauga

SEQ ID NO: 794781 - RNA, 19 nt, Homo sapiens
gccgacagcuacuaugagu

SEQ ID NO: 794782 - RNA, 19 nt, Homo sapiens
caccucaccugcagauuag

SEQ ID NO: 794783 - RNA, 19 nt, Homo sapiens
ccugagauuucgucacaga

SEQ ID NO: 794784 - RNA, 19 nt, Homo sapiens
gaggaagagcagaagauga

SEQ ID NO: 794785 - RNA, 19 nt, Homo sapiens
ccagaagacacgaaucaug

SEQ ID NO: 794786 - RNA, 19 nt, Homo sapiens
gcacauccacggccugucu

SEQ ID NO: 794787 - RNA, 19 nt, Homo sapiens
ggagauaaaaguugauuug

SEQ ID NO: 794788 - RNA, 19 nt, Homo sapiens
caagugaggccgucagucu

SEQ ID NO: 794789 - RNA, 19 nt, Homo sapiens
ggcgagagcuaugacaaca

SEQ ID NO: 794790 - RNA, 19 nt, Homo sapiens
gggcgugauugacgucuuc

SEQ ID NO: 794791 - RNA, 19 nt, Homo sapiens
caccauccaagauuccuua

SEQ ID NO: 794792 - RNA, 19 nt, Homo sapiens
gaagacacaaagacacauc

SEQ ID NO: 794793 - RNA, 19 nt, Homo sapiens
agaaauugcuggguuaaaa

SEQ ID NO: 794794 - RNA, 19 nt, Homo sapiens
ucuguggacuccucuucua

SEQ ID NO: 794795 - RNA, 19 nt, Homo sapiens
agaacaccauccaagauuc

SEQ ID NO: 794796 - RNA, 19 nt, Homo sapiens
gccagaagggcgugauuga

SEQ ID NO: 794797 - RNA, 19 nt, Homo sapiens
gcaagaagccccuguggau

SEQ ID NO: 794798 - RNA, 19 nt, Homo sapiens
gaucgugcacuucaaccuu

SEQ ID NO: 794799 - RNA, 19 nt, Homo sapiens
aagaugaggccagaaauug

SEQ ID NO: 794800 - RNA, 19 nt, Homo sapiens
cuccuugccuuucugcuuu

SEQ ID NO: 794801 - RNA, 19 nt, Homo sapiens
gcucugguguuuacaagcu

SEQ ID NO: 794802 - RNA, 19 nt, Homo sapiens
gggccgacagcuacuauga

SEQ ID NO: 794803 - RNA, 19 nt, Homo sapiens
ggaaaggauaccgcaaguu

SEQ ID NO: 794804 - RNA, 19 nt, Homo sapiens
caccagugcaucugaacua

SEQ ID NO: 794805 - RNA, 19 nt, Homo sapiens
guucaucaauacccacagu

SEQ ID NO: 794806 - RNA, 19 nt, Homo sapiens
gagaacuuaccugagauuu

SEQ ID NO: 794807 - RNA, 19 nt, Homo sapiens
ggacaccgacccugagaac

SEQ ID NO: 794808 - RNA, 19 nt, Homo sapiens
ccgcuucagugccaagaug

SEQ ID NO: 794809 - RNA, 19 nt, Homo sapiens
gcuauucuuccaucaacaa

SEQ ID NO: 794810 - RNA, 19 nt, Homo sapiens
gagcuucagccgauucaca

SEQ ID NO: 794811 - RNA, 19 nt, Homo sapiens
cgccaccacuguagucaug

SEQ ID NO: 794812 - RNA, 19 nt, Homo sapiens
acaccgacccugagaacuu

SEQ ID NO: 794813 - RNA, 19 nt, Homo sapiens
cgagauugcagcggaauau

SEQ ID NO: 794814 - RNA, 19 nt, Homo sapiens
gcgggaagcaggagacaca

SEQ ID NO: 794815 - RNA, 19 nt, Homo sapiens
gaaggugacacagcacauc

SEQ ID NO: 794816 - RNA, 19 nt, Homo sapiens
ucagaacaccauccaagau

SEQ ID NO: 794817 - RNA, 19 nt, Homo sapiens
cagaagacacaaagacaca

SEQ ID NO: 794818 - RNA, 19 nt, Homo sapiens
ggucugaggaaagaauuug

SEQ ID NO: 794819 - RNA, 19 nt, Homo sapiens
cagcaaauccacccgucuu

SEQ ID NO: 794820 - RNA, 19 nt, Homo sapiens
gucccgagaucgugcacuu

SEQ ID NO: 794821 - RNA, 19 nt, Homo sapiens
uaugacaacagcaagaguu

SEQ ID NO: 794822 - RNA, 19 nt, Homo sapiens
uggaaaggauaccgcaagu

SEQ ID NO: 794823 - RNA, 19 nt, Homo sapiens
gaagcaacugucgagauug

SEQ ID NO: 794824 - RNA, 19 nt, Homo sapiens
gauugcagcggaauaugau

SEQ ID NO: 794825 - RNA, 19 nt, Homo sapiens
gcagagcuucagccgauuc

SEQ ID NO: 794826 - RNA, 19 nt, Homo sapiens
gcucucgguuccucucagu

SEQ ID NO: 794827 - RNA, 19 nt, Homo sapiens
cagugcaucugaacuaucg

SEQ ID NO: 794828 - RNA, 19 nt, Homo sapiens
auucuuccaucaacaaugu

SEQ ID NO: 794829 - RNA, 19 nt, Homo sapiens
ccaggaagugggugucgaa

SEQ ID NO: 794830 - RNA, 19 nt, Homo sapiens
aaaggauaccgcaaguuug

SEQ ID NO: 794831 - RNA, 19 nt, Homo sapiens
gcaaauccacccgucuuac

SEQ ID NO: 794832 - RNA, 19 nt, Homo sapiens
gaagacacgaaucaugacu

SEQ ID NO: 794833 - RNA, 19 nt, Homo sapiens
uaucuguucuugcucuucu

SEQ ID NO: 794834 - RNA, 19 nt, Homo sapiens
guccuucagugagugguuu

SEQ ID NO: 794835 - RNA, 19 nt, Homo sapiens
cugcaugcauggaaaggau

SEQ ID NO: 794836 - RNA, 19 nt, Homo sapiens
ucacagaagacacaaagac

SEQ ID NO: 794837 - RNA, 19 nt, Homo sapiens
gagauucugcagagcuuca

SEQ ID NO: 794838 - RNA, 19 nt, Homo sapiens
ucgugcacuucaaccuuua

SEQ ID NO: 794839 - RNA, 19 nt, Homo sapiens
ucaacuuggcugaccauug

SEQ ID NO: 794840 - RNA, 19 nt, Homo sapiens
ugagaacuuaccugagauu

SEQ ID NO: 794841 - RNA, 19 nt, Homo sapiens
cuuaccagcuccucagaag

SEQ ID NO: 794842 - RNA, 19 nt, Homo sapiens
ccuccucgucucugcuuua

SEQ ID NO: 794843 - RNA, 19 nt, Homo sapiens
caaguggcccaggcucuga

SEQ ID NO: 794844 - RNA, 19 nt, Homo sapiens
gagcucauggagacuuguu

SEQ ID NO: 794845 - RNA, 19 nt, Homo sapiens
ggaagcaacugucgagauu

SEQ ID NO: 794846 - RNA, 19 nt, Homo sapiens
gaacaucgguacuggaguu

SEQ ID NO: 794847 - RNA, 19 nt, Homo sapiens
gaaaggauaccgcaaguuu

SEQ ID NO: 794848 - RNA, 19 nt, Homo sapiens
ggaagugggugucgaagaa

SEQ ID NO: 794849 - RNA, 19 nt, Homo sapiens
ccaguaagcucaccuuugu

SEQ ID NO: 794850 - RNA, 19 nt, Homo sapiens
gcaccgagcucccuucaag

SEQ ID NO: 794851 - RNA, 19 nt, Homo sapiens
caacuuggcugaccauugg

SEQ ID NO: 794852 - RNA, 19 nt, Homo sapiens
ggacuccucuucuacauca

SEQ ID NO: 794853 - RNA, 19 nt, Homo sapiens
gcuaaugccugccuucaga

SEQ ID NO: 794854 - RNA, 19 nt, Homo sapiens
gaacuuaccugagauuucg

SEQ ID NO: 794855 - RNA, 19 nt, Homo sapiens
gagcagaagugcccaccaa

SEQ ID NO: 794856 - RNA, 19 nt, Homo sapiens
gaagaugaggccagaaauu

SEQ ID NO: 794857 - RNA, 19 nt, Homo sapiens
gggagacgcucaaguaucu

SEQ ID NO: 794858 - RNA, 19 nt, Homo sapiens
gaggaaagcugaggauuuu

SEQ ID NO: 794859 - RNA, 19 nt, Homo sapiens
ccugagaacuuaccugaga

SEQ ID NO: 794860 - RNA, 19 nt, Homo sapiens
gaggaaagaauuugaggaa

SEQ ID NO: 794861 - RNA, 19 nt, Homo sapiens
ccaccucaccugcagauua

SEQ ID NO: 794862 - RNA, 19 nt, Homo sapiens
gaucuugggucugaggaaa

SEQ ID NO: 794863 - RNA, 19 nt, Homo sapiens
cagaagacacgaaucauga

SEQ ID NO: 794864 - RNA, 19 nt, Homo sapiens
caccgacccugagaacuua

SEQ ID NO: 794865 - RNA, 19 nt, Homo sapiens
gagauuucgucacagaaga

SEQ ID NO: 794866 - RNA, 19 nt, Homo sapiens
gggacaagauggagagcuu

SEQ ID NO: 794867 - RNA, 19 nt, Homo sapiens
gugcccauguucaucaaua

SEQ ID NO: 794868 - RNA, 19 nt, Homo sapiens
ggagacuuguuaccagaug

SEQ ID NO: 794869 - RNA, 19 nt, Homo sapiens
ccucgucucugcuuuaauc

SEQ ID NO: 794870 - RNA, 19 nt, Homo sapiens
ugaggaaagcugaggauuu

SEQ ID NO: 794871 - RNA, 19 nt, Homo sapiens
caucaacaauguccaggau

SEQ ID NO: 794872 - RNA, 19 nt, Homo sapiens
ccaccacuguagucaugua

SEQ ID NO: 794873 - RNA, 19 nt, Homo sapiens
cagaacaccauccaagauu

SEQ ID NO: 794874 - RNA, 19 nt, Homo sapiens
cauccaagauuccuuacuc

SEQ ID NO: 794875 - RNA, 19 nt, Homo sapiens
agacacgaaucaugacuca

SEQ ID NO: 794876 - RNA, 19 nt, Homo sapiens
gcuggaagacuacguggaa

SEQ ID NO: 794877 - RNA, 19 nt, Homo sapiens
uaccugagauuucgucaca

SEQ ID NO: 794878 - RNA, 19 nt, Homo sapiens
cagaagaugaggccagaaa

SEQ ID NO: 794879 - RNA, 19 nt, Homo sapiens
gggagauucugcagagcuu

SEQ ID NO: 794880 - RNA, 19 nt, Homo sapiens
gagacuuguuaccagauga

SEQ ID NO: 794881 - RNA, 19 nt, Homo sapiens
gccgacagcuacuaugagu

SEQ ID NO: 794882 - RNA, 19 nt, Homo sapiens
caccucaccugcagauuag

SEQ ID NO: 794883 - RNA, 19 nt, Homo sapiens
ccugagauuucgucacaga

SEQ ID NO: 794884 - RNA, 19 nt, Homo sapiens
gaggaagagcagaagauga

SEQ ID NO: 794885 - RNA, 19 nt, Homo sapiens
ccagaagacacgaaucaug

SEQ ID NO: 794886 - RNA, 19 nt, Homo sapiens
gcacauccacggccugucu

SEQ ID NO: 794887 - RNA, 19 nt, Homo sapiens
ggagauaaaaguugauuug

SEQ ID NO: 794888 - RNA, 19 nt, Homo sapiens
caagugaggccgucagucu

SEQ ID NO: 794889 - RNA, 19 nt, Homo sapiens
ggcgagagcuaugacaaca

SEQ ID NO: 794890 - RNA, 19 nt, Homo sapiens
gggcgugauugacgucuuc

SEQ ID NO: 794891 - RNA, 19 nt, Homo sapiens
caccauccaagauuccuua

SEQ ID NO: 794892 - RNA, 19 nt, Homo sapiens
gaagacacaaagacacauc

SEQ ID NO: 794893 - RNA, 19 nt, Homo sapiens
agaaauugcuggguuaaaa

SEQ ID NO: 794894 - RNA, 19 nt, Homo sapiens
ucuguggacuccucuucua

SEQ ID NO: 794895 - RNA, 19 nt, Homo sapiens
agaacaccauccaagauuc

SEQ ID NO: 794896 - RNA, 19 nt, Homo sapiens
gccagaagggcgugauuga

SEQ ID NO: 794897 - RNA, 19 nt, Homo sapiens
gcaagaagccccuguggau

SEQ ID NO: 794898 - RNA, 19 nt, Homo sapiens
gaucgugcacuucaaccuu

SEQ ID NO: 794899 - RNA, 19 nt, Homo sapiens
aagaugaggccagaaauug

SEQ ID NO: 794900 - RNA, 19 nt, Homo sapiens
cuccuugccuuucugcuuu

SEQ ID NO: 794901 - RNA, 19 nt, Homo sapiens
gcucugguguuuacaagcu

SEQ ID NO: 794902 - RNA, 19 nt, Homo sapiens
gggccgacagcuacuauga

SEQ ID NO: 794903 - RNA, 19 nt, Homo sapiens
ggaaaggauaccgcaaguu

SEQ ID NO: 794904 - RNA, 19 nt, Homo sapiens
caccagugcaucugaacua

SEQ ID NO: 794905 - RNA, 19 nt, Homo sapiens
guucaucaauacccacagu

SEQ ID NO: 794906 - RNA, 19 nt, Homo sapiens
gagaacuuaccugagauuu

SEQ ID NO: 794907 - RNA, 19 nt, Homo sapiens
ggacaccgacccugagaac

SEQ ID NO: 794908 - RNA, 19 nt, Homo sapiens
ccgcuucagugccaagaug

SEQ ID NO: 794909 - RNA, 19 nt, Homo sapiens
gcuauucuuccaucaacaa

SEQ ID NO: 794910 - RNA, 19 nt, Homo sapiens
gagcuucagccgauucaca

SEQ ID NO: 794911 - RNA, 19 nt, Homo sapiens
cgagauugcagcggaauau

SEQ ID NO: 794912 - RNA, 19 nt, Homo sapiens
cgccaccacuguagucaug

SEQ ID NO: 794913 - RNA, 19 nt, Homo sapiens
acaccgacccugagaacuu

SEQ ID NO: 794914 - RNA, 19 nt, Homo sapiens
gcgggaagcaggagacaca

SEQ ID NO: 794915 - RNA, 19 nt, Homo sapiens
gaaggugacacagcacauc

SEQ ID NO: 794916 - RNA, 19 nt, Homo sapiens
ucagaacaccauccaagau

SEQ ID NO: 794917 - RNA, 19 nt, Homo sapiens
cagaagacacaaagacaca

SEQ ID NO: 794918 - RNA, 19 nt, Homo sapiens
ggucugaggaaagaauuug

SEQ ID NO: 794919 - RNA, 19 nt, Homo sapiens
cagcaaauccacccgucuu

SEQ ID NO: 794920 - RNA, 19 nt, Homo sapiens
uaugacaacagcaagaguu

SEQ ID NO: 794921 - RNA, 19 nt, Homo sapiens
gucccgagaucgugcacuu

SEQ ID NO: 794922 - RNA, 19 nt, Homo sapiens
uggaaaggauaccgcaagu

SEQ ID NO: 794923 - RNA, 19 nt, Homo sapiens
gaagcaacugucgagauug

SEQ ID NO: 794924 - RNA, 19 nt, Homo sapiens
gauugcagcggaauaugau

SEQ ID NO: 794925 - RNA, 19 nt, Homo sapiens
gcagagcuucagccgauuc

SEQ ID NO: 794926 - RNA, 19 nt, Homo sapiens
cagugcaucugaacuaucg

SEQ ID NO: 794927 - RNA, 19 nt, Homo sapiens
gcucucgguuccucucagu

SEQ ID NO: 794928 - RNA, 19 nt, Homo sapiens
auucuuccaucaacaaugu

SEQ ID NO: 794929 - RNA, 19 nt, Homo sapiens
ccaggaagugggugucgaa

SEQ ID NO: 794930 - RNA, 19 nt, Homo sapiens
aaaggauaccgcaaguuug

SEQ ID NO: 794931 - RNA, 19 nt, Homo sapiens
gcaaauccacccgucuuac

SEQ ID NO: 794932 - RNA, 19 nt, Homo sapiens
gaagacacgaaucaugacu

SEQ ID NO: 794933 - RNA, 19 nt, Homo sapiens
uaucuguucuugcucuucu

SEQ ID NO: 794934 - RNA, 19 nt, Homo sapiens
guccuucagugagugguuu

SEQ ID NO: 794935 - RNA, 19 nt, Homo sapiens
cugcaugcauggaaaggau

SEQ ID NO: 794936 - RNA, 19 nt, Homo sapiens
ucacagaagacacaaagac

SEQ ID NO: 794937 - RNA, 19 nt, Homo sapiens
gagauucugcagagcuuca

SEQ ID NO: 794938 - RNA, 19 nt, Homo sapiens
ucgugcacuucaaccuuua

SEQ ID NO: 794939 - RNA, 19 nt, Homo sapiens
ucaacuuggcugaccauug

SEQ ID NO: 794940 - RNA, 19 nt, Homo sapiens
ugagaacuuaccugagauu

SEQ ID NO: 794941 - RNA, 19 nt, Homo sapiens
cuuaccagcuccucagaag

SEQ ID NO: 794942 - RNA, 19 nt, Homo sapiens
ccuccucgucucugcuuua

SEQ ID NO: 794943 - RNA, 19 nt, Homo sapiens
caaguggcccaggcucuga

SEQ ID NO: 794944 - RNA, 19 nt, Homo sapiens
agauugcagcggaauauga

SEQ ID NO: 794945 - RNA, 19 nt, Homo sapiens
gauaaacacugccuauaua

SEQ ID NO: 794946 - RNA, 19 nt, Homo sapiens
gaagguagguaaauaggua

SEQ ID NO: 794947 - RNA, 19 nt, Homo sapiens
gagaauagauggcuaacaa

SEQ ID NO: 794948 - RNA, 19 nt, Homo sapiens
gaaacuggcuuuaaucaau

SEQ ID NO: 794949 - RNA, 19 nt, Homo sapiens
ggugauaacuugcauacua

SEQ ID NO: 794950 - RNA, 19 nt, Homo sapiens
uaagaggacuguaguuuaa

SEQ ID NO: 794951 - RNA, 19 nt, Homo sapiens
ggaaauaaaucagcacauu

SEQ ID NO: 794952 - RNA, 19 nt, Homo sapiens
gaaugagacuggaguaauu

SEQ ID NO: 794953 - RNA, 19 nt, Homo sapiens
ggaaagauauaaagacaug

SEQ ID NO: 794954 - RNA, 19 nt, Homo sapiens
gcaaagagguggauauucu

SEQ ID NO: 794955 - RNA, 19 nt, Homo sapiens
ggaaguuucucaaguugua

SEQ ID NO: 794956 - RNA, 19 nt, Homo sapiens
gcaaaugagugacaauaga

SEQ ID NO: 794957 - RNA, 19 nt, Homo sapiens
ggguagacaucaacaauuu

SEQ ID NO: 794958 - RNA, 19 nt, Homo sapiens
ccaaagaaguuuaagaauc

SEQ ID NO: 794959 - RNA, 19 nt, Homo sapiens
guggagagcuugcugguuu

SEQ ID NO: 794960 - RNA, 19 nt, Homo sapiens
gaaauuguguuugacauuc

SEQ ID NO: 794961 - RNA, 19 nt, Homo sapiens
ccauauaucuggaaaggaa

SEQ ID NO: 794962 - RNA, 19 nt, Homo sapiens
gcacagauuucaacagagu

SEQ ID NO: 794963 - RNA, 19 nt, Homo sapiens
ggucaaaugcuguuaguaa

SEQ ID NO: 794964 - RNA, 19 nt, Homo sapiens
caacggcagugaaauuuau

SEQ ID NO: 794965 - RNA, 19 nt, Homo sapiens
cggauuaucuucuaucuau

SEQ ID NO: 794966 - RNA, 19 nt, Homo sapiens
gagagaguccguagguuua

SEQ ID NO: 794967 - RNA, 19 nt, Homo sapiens
aagcaggaaugcaauauaa

SEQ ID NO: 794968 - RNA, 19 nt, Homo sapiens
caugaaauaccuacuguua

SEQ ID NO: 794969 - RNA, 19 nt, Homo sapiens
gcuuuaggcugguguauga

SEQ ID NO: 794970 - RNA, 19 nt, Homo sapiens
gaaccaccucucuaaguua

SEQ ID NO: 794971 - RNA, 19 nt, Homo sapiens
gaaacgaucacaacaacaa

SEQ ID NO: 794972 - RNA, 19 nt, Homo sapiens
aaaggaaguuucucaaguu

SEQ ID NO: 794973 - RNA, 19 nt, Homo sapiens
ggacuguaguuuaauacuu

SEQ ID NO: 794974 - RNA, 19 nt, Homo sapiens
gcucuaucaucuuacaaua

SEQ ID NO: 794975 - RNA, 19 nt, Homo sapiens
ucaaaucccacuuacuuua

SEQ ID NO: 794976 - RNA, 19 nt, Homo sapiens
caacagagugcuuggcaua

SEQ ID NO: 794977 - RNA, 19 nt, Homo sapiens
ggagagaguccguagguuu

SEQ ID NO: 794978 - RNA, 19 nt, Homo sapiens
ugaaauaccuacuguuagu

SEQ ID NO: 794979 - RNA, 19 nt, Homo sapiens
ggaaagaugcugccacuca

SEQ ID NO: 794980 - RNA, 19 nt, Homo sapiens
caaaugcuguuaguaaguu

SEQ ID NO: 794981 - RNA, 19 nt, Homo sapiens
gccaugugcuuauuauauu

SEQ ID NO: 794982 - RNA, 19 nt, Homo sapiens
gggacaauuugcuagcuua

SEQ ID NO: 794983 - RNA, 19 nt, Homo sapiens
gaagaugaaaggaguaaga

SEQ ID NO: 794984 - RNA, 19 nt, Homo sapiens
guaauuacgccuauccuuu

SEQ ID NO: 794985 - RNA, 19 nt, Homo sapiens
ggaggauucuuccauuguu

SEQ ID NO: 794986 - RNA, 19 nt, Homo sapiens
gcagugggauuaggaaaug

SEQ ID NO: 794987 - RNA, 19 nt, Homo sapiens
guaaauagguaggccucua

SEQ ID NO: 794988 - RNA, 19 nt, Homo sapiens
ggagggaacagauucauug

SEQ ID NO: 794989 - RNA, 19 nt, Homo sapiens
gagcagcacuauuuaaagg

SEQ ID NO: 794990 - RNA, 19 nt, Homo sapiens
uagcagaucaccaauagua

SEQ ID NO: 794991 - RNA, 19 nt, Homo sapiens
cuugauaccuuaugcaauu

SEQ ID NO: 794992 - RNA, 19 nt, Homo sapiens
ucagagaauuuccauguug

SEQ ID NO: 794993 - RNA, 19 nt, Homo sapiens
gaagauuugggcauauuaa

SEQ ID NO: 794994 - RNA, 19 nt, Homo sapiens
gaaagugucggcuucauca

SEQ ID NO: 794995 - RNA, 19 nt, Homo sapiens
cauuauaccucucugaaau

SEQ ID NO: 794996 - RNA, 19 nt, Homo sapiens
uaaggaagcugagguaugg

SEQ ID NO: 794997 - RNA, 19 nt, Homo sapiens
caucaaaucccacuuacuu

SEQ ID NO: 794998 - RNA, 19 nt, Homo sapiens
cugaaggccucacuuaauu

SEQ ID NO: 794999 - RNA, 19 nt, Homo sapiens
aaacugaaggccucacuua

SEQ ID NO: 795000 - RNA, 19 nt, Homo sapiens
caaaaggcauuucauacua

SEQ ID NO: 795001 - RNA, 19 nt, Homo sapiens
uacaagagaucauccaaau

SEQ ID NO: 795002 - RNA, 19 nt, Homo sapiens
aaagugaacuaccauggaa

SEQ ID NO: 795003 - RNA, 19 nt, Homo sapiens
gaauuuccauguuggugaa

SEQ ID NO: 795004 - RNA, 19 nt, Homo sapiens
gcagcacuauuuaaaggaa

SEQ ID NO: 795005 - RNA, 19 nt, Homo sapiens
ggaagauuugggcauauua

SEQ ID NO: 795006 - RNA, 19 nt, Homo sapiens
gaauagauggcuaacaaga

SEQ ID NO: 795007 - RNA, 19 nt, Homo sapiens
aagcugaaauuguguuuga

SEQ ID NO: 795008 - RNA, 19 nt, Homo sapiens
ugaaccaccucucuaaguu

SEQ ID NO: 795009 - RNA, 19 nt, Homo sapiens
gaggauucuuccauuguuu

SEQ ID NO: 795010 - RNA, 19 nt, Homo sapiens
uagcuuagguccaguuuca

SEQ ID NO: 795011 - RNA, 19 nt, Homo sapiens
caaaucccacuuacuuuaa

SEQ ID NO: 795012 - RNA, 19 nt, Homo sapiens
aagcacagauuucaacaga

SEQ ID NO: 795013 - RNA, 19 nt, Homo sapiens
gaugaaaggaguaagaaau

SEQ ID NO: 795014 - RNA, 19 nt, Homo sapiens
gggagcauaugaaaccaaa

SEQ ID NO: 795015 - RNA, 19 nt, Homo sapiens
agaggacuguaguuuaaua

SEQ ID NO: 795016 - RNA, 19 nt, Homo sapiens
cagggcagcuucccaguga

SEQ ID NO: 795017 - RNA, 19 nt, Homo sapiens
gggaagauuugggcauauu

SEQ ID NO: 795018 - RNA, 19 nt, Homo sapiens
gagaaaagccaaauuagaa

SEQ ID NO: 795019 - RNA, 19 nt, Homo sapiens
ggagcuaguuggaaucauc

SEQ ID NO: 795020 - RNA, 19 nt, Homo sapiens
ggacaugaagguagguaaa

SEQ ID NO: 795021 - RNA, 19 nt, Homo sapiens
auacagugcugcuggcuuu

SEQ ID NO: 795022 - RNA, 19 nt, Homo sapiens
guccguagguuuaucagaa

SEQ ID NO: 795023 - RNA, 19 nt, Homo sapiens
gugauaacuugcauacuau

SEQ ID NO: 795024 - RNA, 19 nt, Homo sapiens
caaauucaguguuguucau

SEQ ID NO: 795025 - RNA, 19 nt, Homo sapiens
gagcaaagagguggauauu

SEQ ID NO: 795026 - RNA, 19 nt, Homo sapiens
gaacagauucauugaggau

SEQ ID NO: 795027 - RNA, 19 nt, Homo sapiens
uaguugcucuaucaucuua

SEQ ID NO: 795028 - RNA, 19 nt, Homo sapiens
cagggaagauuugggcaua

SEQ ID NO: 795029 - RNA, 19 nt, Homo sapiens
caaauggacuauacauacu

SEQ ID NO: 795030 - RNA, 19 nt, Homo sapiens
gacaaauggacuauacaua

SEQ ID NO: 795031 - RNA, 19 nt, Homo sapiens
uguguuaacugaauaggaa

SEQ ID NO: 795032 - RNA, 19 nt, Homo sapiens
ggauaccaauuauggcuau

SEQ ID NO: 795033 - RNA, 19 nt, Homo sapiens
gaucaccaauaguaacuca

SEQ ID NO: 795034 - RNA, 19 nt, Homo sapiens
gcaauucagggaagauuug

SEQ ID NO: 795035 - RNA, 19 nt, Homo sapiens
caaaugagugacaauagaa

SEQ ID NO: 795036 - RNA, 19 nt, Homo sapiens
gcauacuauuggaagauaa

SEQ ID NO: 795037 - RNA, 19 nt, Homo sapiens
gagaaacuggcuuuaauca

SEQ ID NO: 795038 - RNA, 19 nt, Homo sapiens
gcugagguauggaaagaug

SEQ ID NO: 795039 - RNA, 19 nt, Homo sapiens
uaucugaccuacagcaaug

SEQ ID NO: 795040 - RNA, 19 nt, Homo sapiens
acaugaagguagguaaaua

SEQ ID NO: 795041 - RNA, 19 nt, Homo sapiens
uauacaaucuuccuuccuu

SEQ ID NO: 795042 - RNA, 19 nt, Homo sapiens
caaauaugagugggaaaua

SEQ ID NO: 795043 - RNA, 19 nt, Homo sapiens
ggaauuuacuggguucauc

SEQ ID NO: 795044 - RNA, 19 nt, Homo sapiens
gagacuggaguaauuguuu

SEQ ID NO: 795045 - RNA, 19 nt, Homo sapiens
ucagaaagaugaagaagaa

SEQ ID NO: 795046 - RNA, 19 nt, Homo sapiens
aaacaugucugugaacuug

SEQ ID NO: 795047 - RNA, 19 nt, Homo sapiens
gaagaaaacaugucuguga

SEQ ID NO: 795048 - RNA, 19 nt, Homo sapiens
gauguuuaaucaagagaga

SEQ ID NO: 795049 - RNA, 19 nt, Homo sapiens
ccaugccgcugcacaggua

SEQ ID NO: 795050 - RNA, 19 nt, Homo sapiens
ccacugcuaugccgaguuc

SEQ ID NO: 795051 - RNA, 19 nt, Homo sapiens
gauguucgugggauguuua

SEQ ID NO: 795052 - RNA, 19 nt, Homo sapiens
gcaacgcgcuggucaugcu

SEQ ID NO: 795053 - RNA, 19 nt, Homo sapiens
cauacacgcugcugaugau

SEQ ID NO: 795054 - RNA, 19 nt, Homo sapiens
ccaagucgcuggccgucau

SEQ ID NO: 795055 - RNA, 19 nt, Homo sapiens
gcaucuaccugaacaucca

SEQ ID NO: 795056 - RNA, 19 nt, Homo sapiens
gagcuucacccagcgcuuu

SEQ ID NO: 795057 - RNA, 19 nt, Homo sapiens
ccuucugucucuugcauaa

SEQ ID NO: 795058 - RNA, 19 nt, Homo sapiens
caacugguacuuccucauc

SEQ ID NO: 795059 - RNA, 19 nt, Homo sapiens
ugucaacccuguccucuac

SEQ ID NO: 795060 - RNA, 19 nt, Homo sapiens
gaggucacaauaaagugua

SEQ ID NO: 795061 - RNA, 19 nt, Homo sapiens
acaggaaaguggccaaguc

SEQ ID NO: 795062 - RNA, 19 nt, Homo sapiens
cgugggauguuuaaucaag

SEQ ID NO: 795063 - RNA, 19 nt, Homo sapiens
ccauacacgcugcugauga

SEQ ID NO: 795064 - RNA, 19 nt, Homo sapiens
gaaaacaugucugugaacu

SEQ ID NO: 795065 - RNA, 19 nt, Homo sapiens
ugucuguggcccucucuua

SEQ ID NO: 795066 - RNA, 19 nt, Homo sapiens
uggagaagcgcaugaagau

SEQ ID NO: 795067 - RNA, 19 nt, Homo sapiens
gugggauguuuaaucaaga

SEQ ID NO: 795068 - RNA, 19 nt, Homo sapiens
ucuuuaaccucagcaucua

SEQ ID NO: 795069 - RNA, 19 nt, Homo sapiens
ccugacuacugguacgaaa

SEQ ID NO: 795070 - RNA, 19 nt, Homo sapiens
gccacugcgucccugacua

SEQ ID NO: 795071 - RNA, 19 nt, Homo sapiens
gcuaugccgaguucuucua

SEQ ID NO: 795072 - RNA, 19 nt, Homo sapiens
ccaggacacugccuuugcu

SEQ ID NO: 795073 - RNA, 19 nt, Homo sapiens
guuacugguugguguucuu

SEQ ID NO: 795074 - RNA, 19 nt, Homo sapiens
ccucagcgucaccuucuuu

SEQ ID NO: 795075 - RNA, 19 nt, Homo sapiens
acaucgugcucaucagcua

SEQ ID NO: 795076 - RNA, 19 nt, Homo sapiens
ugcccacccuucgcaguua

SEQ ID NO: 795077 - RNA, 19 nt, Homo sapiens
guucgugggauguuuaauc

SEQ ID NO: 795078 - RNA, 19 nt, Homo sapiens
ggagaagcgcaugaagaug

SEQ ID NO: 795079 - RNA, 19 nt, Homo sapiens
ggagcucagggcuggauug

SEQ ID NO: 795080 - RNA, 19 nt, Homo sapiens
gcucauggcgcugcucauc

SEQ ID NO: 795081 - RNA, 19 nt, Homo sapiens
aagaaaacaugucugugaa

SEQ ID NO: 795082 - RNA, 19 nt, Homo sapiens
ugccuuugcugccuucugu

SEQ ID NO: 795083 - RNA, 19 nt, Homo sapiens
cuguggcccucucuuaaug

SEQ ID NO: 795084 - RNA, 19 nt, Homo sapiens
uucgugggauguuuaauca

SEQ ID NO: 795085 - RNA, 19 nt, Homo sapiens
cgucaucgugagcaucuuu

SEQ ID NO: 795086 - RNA, 19 nt, Homo sapiens
ugauguucgugggauguuu

SEQ ID NO: 795087 - RNA, 19 nt, Homo sapiens
ucauggcgcugcucaucgu

SEQ ID NO: 795088 - RNA, 19 nt, Homo sapiens
ucacccgagcggucucaua

SEQ ID NO: 795089 - RNA, 19 nt, Homo sapiens
gcaccuccucugccuucaa

SEQ ID NO: 795090 - RNA, 19 nt, Homo sapiens
acaugucugugaacuugau

SEQ ID NO: 795091 - RNA, 19 nt, Homo sapiens
cagcgucaccuucuuuaac

SEQ ID NO: 795092 - RNA, 19 nt, Homo sapiens
caaaugagcuguccuaacu

SEQ ID NO: 795093 - RNA, 19 nt, Homo sapiens
gaacagugaucacacagau

SEQ ID NO: 795094 - RNA, 19 nt, Homo sapiens
ucacacagauuccuacuug

SEQ ID NO: 795095 - RNA, 19 nt, Homo sapiens
uaacaauucucuucaccuu

SEQ ID NO: 795096 - RNA, 19 nt, Homo sapiens
guaaaggaaucuuauuguc

SEQ ID NO: 795097 - RNA, 19 nt, Homo sapiens
gaguaacccugguaacaau

SEQ ID NO: 795098 - RNA, 19 nt, Homo sapiens
uaaaguuucugaguccuaa

SEQ ID NO: 795099 - RNA, 19 nt, Homo sapiens
acaauucucuucaccuuau

SEQ ID NO: 795100 - RNA, 19 nt, Homo sapiens
gcucuuuccuuuaaucuuc

SEQ ID NO: 795101 - RNA, 19 nt, Homo sapiens
agcuaaaucuucccucuua

SEQ ID NO: 795102 - RNA, 19 nt, Homo sapiens
aaucuucccucuuaaugaa

SEQ ID NO: 795103 - RNA, 19 nt, Homo sapiens
gcuaaaucuucccucuuaa

SEQ ID NO: 795104 - RNA, 19 nt, Homo sapiens
gaagacaggagacaaacug

SEQ ID NO: 795105 - RNA, 19 nt, Homo sapiens
ggagaagaaugagaagaca

SEQ ID NO: 795106 - RNA, 19 nt, Homo sapiens
gaaccucuaacauuuacuu

SEQ ID NO: 795107 - RNA, 19 nt, Homo sapiens
aaagaacagugaucacaca

SEQ ID NO: 795108 - RNA, 19 nt, Homo sapiens
augguaaucuggaauugua

SEQ ID NO: 795109 - RNA, 19 nt, Homo sapiens
cuugggcucuuuccuuuaa

SEQ ID NO: 795110 - RNA, 19 nt, Homo sapiens
uaaaucuucccucuuaaug

SEQ ID NO: 795111 - RNA, 19 nt, Homo sapiens
ugagaagacaggagacaaa

SEQ ID NO: 795112 - RNA, 19 nt, Homo sapiens
uacuugggcucuuuccuuu

SEQ ID NO: 795113 - RNA, 19 nt, Homo sapiens
ccagggagaagaaugagaa

SEQ ID NO: 795114 - RNA, 19 nt, Homo sapiens
gagcuggcaggucugagua

SEQ ID NO: 795115 - RNA, 19 nt, Homo sapiens
gaugaugacagcagagagu

SEQ ID NO: 795116 - RNA, 19 nt, Homo sapiens
ggucugaguaacccuggua

SEQ ID NO: 795117 - RNA, 19 nt, Homo sapiens
ccgcaggucuggcuuacca

SEQ ID NO: 795118 - RNA, 19 nt, Homo sapiens
gguaaucuggaauuguauu

SEQ ID NO: 795119 - RNA, 19 nt, Homo sapiens
ugaguaacccugguaacaa

SEQ ID NO: 795120 - RNA, 19 nt, Homo sapiens
ugccuugucuuaaaguuuc

SEQ ID NO: 795121 - RNA, 19 nt, Homo sapiens
aaacugccagggagaagaa

SEQ ID NO: 795122 - RNA, 19 nt, Homo sapiens
acagugaucacacagauuc

SEQ ID NO: 795123 - RNA, 19 nt, Homo sapiens
ucuucccucuuaaugaaua

SEQ ID NO: 795124 - RNA, 19 nt, Homo sapiens
cuaaaucuucccucuuaau

SEQ ID NO: 795125 - RNA, 19 nt, Homo sapiens
gcaggaagcgaugguuaag

SEQ ID NO: 795126 - RNA, 19 nt, Homo sapiens
uaucaaaaccugagcuaaa

SEQ ID NO: 795127 - RNA, 19 nt, Homo sapiens
cuacuugggcucuuuccuu

SEQ ID NO: 795128 - RNA, 19 nt, Homo sapiens
gggagaagaaugagaagac

SEQ ID NO: 795129 - RNA, 19 nt, Homo sapiens
uaaccaccaaggacucuga

SEQ ID NO: 795130 - RNA, 19 nt, Homo sapiens
ccaacccucugggauagau

SEQ ID NO: 795131 - RNA, 19 nt, Homo sapiens
aaaucuucccucuuaauga

SEQ ID NO: 795132 - RNA, 19 nt, Homo sapiens
aggaagcgaugguuaagac

SEQ ID NO: 795133 - RNA, 19 nt, Homo sapiens
aaugagcuguccuaacucu

SEQ ID NO: 795134 - RNA, 19 nt, Homo sapiens
uugcccaacucagguuuaa

SEQ ID NO: 795135 - RNA, 19 nt, Homo sapiens
guaacccugguaacaauuc

SEQ ID NO: 795136 - RNA, 19 nt, Homo sapiens
gagaagacaggagacaaac

SEQ ID NO: 795137 - RNA, 19 nt, Homo sapiens
gcaccaggcgaacacuuac

SEQ ID NO: 795138 - RNA, 19 nt, Homo sapiens
ccaaaugagcuguccuaac

SEQ ID NO: 795139 - RNA, 19 nt, Homo sapiens
gugaucacacagauuccua

SEQ ID NO: 795140 - RNA, 19 nt, Homo sapiens
ggacagugcucacaucaaa

SEQ ID NO: 795141 - RNA, 19 nt, Homo sapiens
agaggaagcuuuguauuua

SEQ ID NO: 795142 - RNA, 19 nt, Homo sapiens
caacaagacuacaaugcuu

SEQ ID NO: 795143 - RNA, 19 nt, Homo sapiens
gaggaagcuuuguauuuau

SEQ ID NO: 795144 - RNA, 19 nt, Homo sapiens
cagaggaagcuuuguauuu

SEQ ID NO: 795145 - RNA, 19 nt, Homo sapiens
ccaaucaguguucuuauuu

SEQ ID NO: 795146 - RNA, 19 nt, Homo sapiens
ggugaagauucucuacaaa

SEQ ID NO: 795147 - RNA, 19 nt, Homo sapiens
gggugaagauucucuacaa

SEQ ID NO: 795148 - RNA, 19 nt, Homo sapiens
gcagugggaugagcuacuu

SEQ ID NO: 795149 - RNA, 19 nt, Homo sapiens
ccucuaagcugcaauucau

SEQ ID NO: 795150 - RNA, 19 nt, Homo sapiens
acucugggcucuaaaguug

SEQ ID NO: 795151 - RNA, 19 nt, Homo sapiens
gaauacaacaagacuacaa

SEQ ID NO: 795152 - RNA, 19 nt, Homo sapiens
caauaaaccauagagauga

SEQ ID NO: 795153 - RNA, 19 nt, Homo sapiens
gacaauaaaccauagagau

SEQ ID NO: 795154 - RNA, 19 nt, Homo sapiens
cccaaucaguguucuuauu

SEQ ID NO: 795155 - RNA, 19 nt, Homo sapiens
gcagaggaagcuuuguauu

SEQ ID NO: 795156 - RNA, 19 nt, Homo sapiens
gggagagggugaagauucu

SEQ ID NO: 795157 - RNA, 19 nt, Homo sapiens
acaauaaaccauagagaug

SEQ ID NO: 795158 - RNA, 19 nt, Homo sapiens
caaucaguguucuuauuuc

SEQ ID NO: 795159 - RNA, 19 nt, Homo sapiens
ucagugacaauaaaccaua

SEQ ID NO: 795160 - RNA, 19 nt, Homo sapiens
ggaccaguguguggaaauc

SEQ ID NO: 795161 - RNA, 19 nt, Homo sapiens
uagcagaggagcaguuuau

SEQ ID NO: 795162 - RNA, 19 nt, Homo sapiens
gaagccagcagaggaguga

SEQ ID NO: 795163 - RNA, 19 nt, Homo sapiens
ucaguguucuuauuucagu

SEQ ID NO: 795164 - RNA, 19 nt, Homo sapiens
gaagcuuuguauuuauugg

SEQ ID NO: 795165 - RNA, 19 nt, Homo sapiens
gcuacaggcccgaguggaa

SEQ ID NO: 795166 - RNA, 19 nt, Homo sapiens
ggaagcuuuguauuuauug

SEQ ID NO: 795167 - RNA, 19 nt, Homo sapiens
caaggcagaggaagcuuug

SEQ ID NO: 795168 - RNA, 19 nt, Homo sapiens
ucuguacucugggcucuaa

SEQ ID NO: 795169 - RNA, 19 nt, Homo sapiens
caaagccguuccugagcau

SEQ ID NO: 795170 - RNA, 19 nt, Homo sapiens
ucaaggugcagguggcuuu

SEQ ID NO: 795171 - RNA, 19 nt, Homo sapiens
guucuuauuucagugacaa

SEQ ID NO: 795172 - RNA, 19 nt, Homo sapiens
gaggaauacaacaagacua

SEQ ID NO: 795173 - RNA, 19 nt, Homo sapiens
gcuggacagugcucacauc

SEQ ID NO: 795174 - RNA, 19 nt, Homo sapiens
gcaggaccaguguguggaa

SEQ ID NO: 795175 - RNA, 19 nt, Homo sapiens
cgaggugggucgguaguag

SEQ ID NO: 795176 - RNA, 19 nt, Homo sapiens
uggcgggucugacugacuu

SEQ ID NO: 795177 - RNA, 19 nt, Homo sapiens
gaguacaucgaccgcauug

SEQ ID NO: 795178 - RNA, 19 nt, Homo sapiens
ggaggaauacaacaagacu

SEQ ID NO: 795179 - RNA, 19 nt, Homo sapiens
ugacaauaaaccauagaga

SEQ ID NO: 795180 - RNA, 19 nt, Homo sapiens
ggcagaggaagcuuuguau

SEQ ID NO: 795181 - RNA, 19 nt, Homo sapiens
gcaagagggagagggugaa

SEQ ID NO: 795182 - RNA, 19 nt, Homo sapiens
guuuauccuuucccagguu

SEQ ID NO: 795183 - RNA, 19 nt, Homo sapiens
caaggcccaccucucugua

SEQ ID NO: 795184 - RNA, 19 nt, Homo sapiens
uggcccagauccacauuca

SEQ ID NO: 795185 - RNA, 19 nt, Homo sapiens
caucgaccgcauugccaua

SEQ ID NO: 795186 - RNA, 19 nt, Homo sapiens
aggcagaggaagcuuugua

SEQ ID NO: 795187 - RNA, 19 nt, Homo sapiens
augccaaccugccuuuguu

SEQ ID NO: 795188 - RNA, 19 nt, Homo sapiens
ucaaggcccaccucucugu

SEQ ID NO: 795189 - RNA, 19 nt, Homo sapiens
acaaggcagaggaagcuuu

SEQ ID NO: 795190 - RNA, 19 nt, Homo sapiens
ccauaccugaugccucuaa

SEQ ID NO: 795191 - RNA, 19 nt, Homo sapiens
cagugacaauaaaccauag

SEQ ID NO: 795192 - RNA, 19 nt, Homo sapiens
cuggaggaauacaacaaga

SEQ ID NO: 795193 - RNA, 19 nt, Homo sapiens
uaagcugcaauucauccua

SEQ ID NO: 795194 - RNA, 19 nt, Homo sapiens
agagggagagggugaagau

SEQ ID NO: 795195 - RNA, 19 nt, Homo sapiens
gcccaccucucuguacucu

SEQ ID NO: 795196 - RNA, 19 nt, Homo sapiens
caggaccaguguguggaaa

SEQ ID NO: 795197 - RNA, 19 nt, Homo sapiens
gcagaggagcaguuuaucc

SEQ ID NO: 795198 - RNA, 19 nt, Homo sapiens
ggacagugcucacaucaaa

SEQ ID NO: 795199 - RNA, 19 nt, Homo sapiens
agaggaagcuuuguauuua

SEQ ID NO: 795200 - RNA, 19 nt, Homo sapiens
caacaagacuacaaugcuu

SEQ ID NO: 795201 - RNA, 19 nt, Homo sapiens
gaggaagcuuuguauuuau

SEQ ID NO: 795202 - RNA, 19 nt, Homo sapiens
cagaggaagcuuuguauuu

SEQ ID NO: 795203 - RNA, 19 nt, Homo sapiens
gaaguuuaguggaagaugu

SEQ ID NO: 795204 - RNA, 19 nt, Homo sapiens
ccaaucaguguucuuauuu

SEQ ID NO: 795205 - RNA, 19 nt, Homo sapiens
ggugaagauucucuacaaa

SEQ ID NO: 795206 - RNA, 19 nt, Homo sapiens
gggugaagauucucuacaa

SEQ ID NO: 795207 - RNA, 19 nt, Homo sapiens
gcagugggaugagcuacuu

SEQ ID NO: 795208 - RNA, 19 nt, Homo sapiens
ggcaggaaguuuaguggaa

SEQ ID NO: 795209 - RNA, 19 nt, Homo sapiens
ccucuaagcugcaauucau

SEQ ID NO: 795210 - RNA, 19 nt, Homo sapiens
acucugggcucuaaaguug

SEQ ID NO: 795211 - RNA, 19 nt, Homo sapiens
gaauacaacaagacuacaa

SEQ ID NO: 795212 - RNA, 19 nt, Homo sapiens
caauaaaccauagagauga

SEQ ID NO: 795213 - RNA, 19 nt, Homo sapiens
gacaauaaaccauagagau

SEQ ID NO: 795214 - RNA, 19 nt, Homo sapiens
cccaaucaguguucuuauu

SEQ ID NO: 795215 - RNA, 19 nt, Homo sapiens
gcagaggaagcuuuguauu

SEQ ID NO: 795216 - RNA, 19 nt, Homo sapiens
gggagagggugaagauucu

SEQ ID NO: 795217 - RNA, 19 nt, Homo sapiens
acaauaaaccauagagaug

SEQ ID NO: 795218 - RNA, 19 nt, Homo sapiens
caaucaguguucuuauuuc

SEQ ID NO: 795219 - RNA, 19 nt, Homo sapiens
ucagugacaauaaaccaua

SEQ ID NO: 795220 - RNA, 19 nt, Homo sapiens
ggaccaguguguggaaauc

SEQ ID NO: 795221 - RNA, 19 nt, Homo sapiens
ccaguuccuuucugugcua

SEQ ID NO: 795222 - RNA, 19 nt, Homo sapiens
ugaugaggcaggaaguuua

SEQ ID NO: 795223 - RNA, 19 nt, Homo sapiens
uagcagaggagcaguuuau

SEQ ID NO: 795224 - RNA, 19 nt, Homo sapiens
gaagccagcagaggaguga

SEQ ID NO: 795225 - RNA, 19 nt, Homo sapiens
ucaguguucuuauuucagu

SEQ ID NO: 795226 - RNA, 19 nt, Homo sapiens
gaagcuuuguauuuauugg

SEQ ID NO: 795227 - RNA, 19 nt, Homo sapiens
gcuacaggcccgaguggaa

SEQ ID NO: 795228 - RNA, 19 nt, Homo sapiens
ggagugggaguccgugaug

SEQ ID NO: 795229 - RNA, 19 nt, Homo sapiens
ggaagcuuuguauuuauug

SEQ ID NO: 795230 - RNA, 19 nt, Homo sapiens
caaggcagaggaagcuuug

SEQ ID NO: 795231 - RNA, 19 nt, Homo sapiens
ucuguacucugggcucuaa

SEQ ID NO: 795232 - RNA, 19 nt, Homo sapiens
caaagccguuccugagcau

SEQ ID NO: 795233 - RNA, 19 nt, Homo sapiens
ucaaggugcagguggcuuu

SEQ ID NO: 795234 - RNA, 19 nt, Homo sapiens
guucuuauuucagugacaa

SEQ ID NO: 795235 - RNA, 19 nt, Homo sapiens
gaggaauacaacaagacua

SEQ ID NO: 795236 - RNA, 19 nt, Homo sapiens
gcuggacagugcucacauc

SEQ ID NO: 795237 - RNA, 19 nt, Homo sapiens
caggaaguuuaguggaaga

SEQ ID NO: 795238 - RNA, 19 nt, Homo sapiens
gugaugaggcaggaaguuu

SEQ ID NO: 795239 - RNA, 19 nt, Homo sapiens
gagugggaguccgugauga

SEQ ID NO: 795240 - RNA, 19 nt, Homo sapiens
cgaggugggucgguaguag

SEQ ID NO: 795241 - RNA, 19 nt, Homo sapiens
gaugaggcaggaaguuuag

SEQ ID NO: 795242 - RNA, 19 nt, Homo sapiens
aguggaagaugugggcuuu

SEQ ID NO: 795243 - RNA, 19 nt, Homo sapiens
uggcgggucugacugacuu

SEQ ID NO: 795244 - RNA, 19 nt, Homo sapiens
gaguacaucgaccgcauug

SEQ ID NO: 795245 - RNA, 19 nt, Homo sapiens
ggaggaauacaacaagacu

SEQ ID NO: 795246 - RNA, 19 nt, Homo sapiens
ugacaauaaaccauagaga

SEQ ID NO: 795247 - RNA, 19 nt, Homo sapiens
ggcagaggaagcuuuguau

SEQ ID NO: 795248 - RNA, 19 nt, Homo sapiens
gcaagagggagagggugaa

SEQ ID NO: 795249 - RNA, 19 nt, Homo sapiens
guuuauccuuucccagguu

SEQ ID NO: 795250 - RNA, 19 nt, Homo sapiens
caaggcccaccucucugua

SEQ ID NO: 795251 - RNA, 19 nt, Homo sapiens
caucgaccgcauugccaua

SEQ ID NO: 795252 - RNA, 19 nt, Homo sapiens
uggcccagauccacauuca

SEQ ID NO: 795253 - RNA, 19 nt, Homo sapiens
aggcagaggaagcuuugua

SEQ ID NO: 795254 - RNA, 19 nt, Homo sapiens
augccaaccugccuuuguu

SEQ ID NO: 795255 - RNA, 19 nt, Homo sapiens
ucaaggcccaccucucugu

SEQ ID NO: 795256 - RNA, 19 nt, Homo sapiens
acaaggcagaggaagcuuu

SEQ ID NO: 795257 - RNA, 19 nt, Homo sapiens
ccauaccugaugccucuaa

SEQ ID NO: 795258 - RNA, 19 nt, Homo sapiens
cagugacaauaaaccauag

SEQ ID NO: 795259 - RNA, 19 nt, Homo sapiens
cuggaggaauacaacaaga

SEQ ID NO: 795260 - RNA, 19 nt, Homo sapiens
ggaaguuuaguggaagaug

SEQ ID NO: 795261 - RNA, 19 nt, Homo sapiens
uaagcugcaauucauccua

SEQ ID NO: 795262 - RNA, 19 nt, Homo sapiens
gcccaccucucuguacucu

SEQ ID NO: 795263 - RNA, 19 nt, Homo sapiens
caggaccaguguguggaaa

SEQ ID NO: 795264 - RNA, 19 nt, Homo sapiens
gcagaggagcaguuuaucc

SEQ ID NO: 795265 - RNA, 19 nt, Homo sapiens
agagggagagggugaagau

SEQ ID NO: 795266 - RNA, 19 nt, Homo sapiens
gaacagagauuuaggaaga

SEQ ID NO: 795267 - RNA, 19 nt, Homo sapiens
gaaaugaucuccugucaag

SEQ ID NO: 795268 - RNA, 19 nt, Homo sapiens
uaaccgaacucaaggcuua

SEQ ID NO: 795269 - RNA, 19 nt, Homo sapiens
ccgaagaccucaugaauuu

SEQ ID NO: 795270 - RNA, 19 nt, Homo sapiens
gcagagaucucaauaagag

SEQ ID NO: 795271 - RNA, 19 nt, Homo sapiens
ggaaacacauaccaaacua

SEQ ID NO: 795272 - RNA, 19 nt, Homo sapiens
ugaccaagcugaagucuuu

SEQ ID NO: 795273 - RNA, 19 nt, Homo sapiens
gaacgaagguaugcuaaug

SEQ ID NO: 795274 - RNA, 19 nt, Homo sapiens
ggagagagaugauuuaaaa

SEQ ID NO: 795275 - RNA, 19 nt, Homo sapiens
gaucuccugucaagaguua

SEQ ID NO: 795276 - RNA, 19 nt, Homo sapiens
ccacaaaguuucaccaaga

SEQ ID NO: 795277 - RNA, 19 nt, Homo sapiens
gaagcuaauugaucaagaa

SEQ ID NO: 795278 - RNA, 19 nt, Homo sapiens
caagagaaguggaugcauu

SEQ ID NO: 795279 - RNA, 19 nt, Homo sapiens
gaagaggagcugcaagaua

SEQ ID NO: 795280 - RNA, 19 nt, Homo sapiens
cuaaagagcuagaacaugu

SEQ ID NO: 795281 - RNA, 19 nt, Homo sapiens
agaagacgcuuucaacaaa

SEQ ID NO: 795282 - RNA, 19 nt, Homo sapiens
ccucgacaaucacaaauua

SEQ ID NO: 795283 - RNA, 19 nt, Homo sapiens
gaacucaaggcuuaauuaa

SEQ ID NO: 795284 - RNA, 19 nt, Homo sapiens
ugacugaacucguacuuug

SEQ ID NO: 795285 - RNA, 19 nt, Homo sapiens
caagaaugcuacucucuga

SEQ ID NO: 795286 - RNA, 19 nt, Homo sapiens
uuaaggagcucucucaaga

SEQ ID NO: 795287 - RNA, 19 nt, Homo sapiens
gaaauccacaacagcauua

SEQ ID NO: 795288 - RNA, 19 nt, Homo sapiens
uggcgaagcucaccaauga

SEQ ID NO: 795289 - RNA, 19 nt, Homo sapiens
gaaaagauguacagcguaa

SEQ ID NO: 795290 - RNA, 19 nt, Homo sapiens
uaucauggcugaaguggaa

SEQ ID NO: 795291 - RNA, 19 nt, Homo sapiens
cuaaagaaguucagacaga

SEQ ID NO: 795292 - RNA, 19 nt, Homo sapiens
gcacucagccggcagauug

SEQ ID NO: 795293 - RNA, 19 nt, Homo sapiens
aagaggagcugcaagauau

SEQ ID NO: 795294 - RNA, 19 nt, Homo sapiens
ugaaagccauugaggauga

SEQ ID NO: 795295 - RNA, 19 nt, Homo sapiens
caaagcaguugucucaaga

SEQ ID NO: 795296 - RNA, 19 nt, Homo sapiens
gcacuuacuguauaucuuu

SEQ ID NO: 795297 - RNA, 19 nt, Homo sapiens
acaaacaggucuuuacgaa

SEQ ID NO: 795298 - RNA, 19 nt, Homo sapiens
gcagauugaugaguuagaa

SEQ ID NO: 795299 - RNA, 19 nt, Homo sapiens
gagcaggcaguucagauua

SEQ ID NO: 795300 - RNA, 19 nt, Homo sapiens
cagcaccacugcaggauaa

SEQ ID NO: 795301 - RNA, 19 nt, Homo sapiens
gcuaauugaucaagaaauc

SEQ ID NO: 795302 - RNA, 19 nt, Homo sapiens
uccaagagcugaccacaaa

SEQ ID NO: 795303 - RNA, 19 nt, Homo sapiens
gcacagcucacccuucaaa

SEQ ID NO: 795304 - RNA, 19 nt, Homo sapiens
acaaugaaccaccugauua

SEQ ID NO: 795305 - RNA, 19 nt, Homo sapiens
agcaauagcucaaguguga

SEQ ID NO: 795306 - RNA, 19 nt, Homo sapiens
agucaucaauggucaguua

SEQ ID NO: 795307 - RNA, 19 nt, Homo sapiens
uaaagaaguucagacagaa

SEQ ID NO: 795308 - RNA, 19 nt, Homo sapiens
aagaaaggaugaccacaaa

SEQ ID NO: 795309 - RNA, 19 nt, Homo sapiens
gaccacaaaugcaaaggaa

SEQ ID NO: 795310 - RNA, 19 nt, Homo sapiens
aaagucaccagcaguauua

SEQ ID NO: 795311 - RNA, 19 nt, Homo sapiens
gggcagccacuucauauaa

SEQ ID NO: 795312 - RNA, 19 nt, Homo sapiens
gaucugugcuguccuucaa

SEQ ID NO: 795313 - RNA, 19 nt, Homo sapiens
aaacaggaacagagauuua

SEQ ID NO: 795314 - RNA, 19 nt, Homo sapiens
cagaagcaguagacaauga

SEQ ID NO: 795315 - RNA, 19 nt, Homo sapiens
ggagcucucucaagaagug

SEQ ID NO: 795316 - RNA, 19 nt, Homo sapiens
gaagagaaaggaaaugauc

SEQ ID NO: 795317 - RNA, 19 nt, Homo sapiens
agacagaauucacucuaaa

SEQ ID NO: 795318 - RNA, 19 nt, Homo sapiens
gugcagagaucucaauaag

SEQ ID NO: 795319 - RNA, 19 nt, Homo sapiens
gacugaaacugaagcuaaa

SEQ ID NO: 795320 - RNA, 19 nt, Homo sapiens
gaaagcggaagaagagaaa

SEQ ID NO: 795321 - RNA, 19 nt, Homo sapiens
uggaaacgcugguaucaug

SEQ ID NO: 795322 - RNA, 19 nt, Homo sapiens
caaacuagcccuugcugaa

SEQ ID NO: 795323 - RNA, 19 nt, Homo sapiens
aaaccucacuaaggaguua

SEQ ID NO: 795324 - RNA, 19 nt, Homo sapiens
gcaggcaguucagauuaaa

SEQ ID NO: 795325 - RNA, 19 nt, Homo sapiens
caagugugauaacuacuga

SEQ ID NO: 795326 - RNA, 19 nt, Homo sapiens
uaacagaaagcuauggauu

SEQ ID NO: 795327 - RNA, 19 nt, Homo sapiens
gaagcuaaaggacaugaaa

SEQ ID NO: 795328 - RNA, 19 nt, Homo sapiens
caacagcauuacaccaaga

SEQ ID NO: 795329 - RNA, 19 nt, Homo sapiens
caaggagagagaugauuua

SEQ ID NO: 795330 - RNA, 19 nt, Homo sapiens
uaacugugauguuuguaga

SEQ ID NO: 795331 - RNA, 19 nt, Homo sapiens
caugaacuauacaagagua

SEQ ID NO: 795332 - RNA, 19 nt, Homo sapiens
caaggcauguccccaauua

SEQ ID NO: 795333 - RNA, 19 nt, Homo sapiens
uaaacccaaugccaacuuu

SEQ ID NO: 795334 - RNA, 19 nt, Homo sapiens
ggagggccaucuucagaau

SEQ ID NO: 795335 - RNA, 19 nt, Homo sapiens
gucaagaguuaauauguug

SEQ ID NO: 795336 - RNA, 19 nt, Homo sapiens
aaacaggucuuuacgaaaa

SEQ ID NO: 795337 - RNA, 19 nt, Homo sapiens
caaccagacuagagaagga

SEQ ID NO: 795338 - RNA, 19 nt, Homo sapiens
cgaacucaaggcuuaauua

SEQ ID NO: 795339 - RNA, 19 nt, Homo sapiens
ccucaugaauuuagaacaa

SEQ ID NO: 795340 - RNA, 19 nt, Homo sapiens
ucaauggucaguuauauga

SEQ ID NO: 795341 - RNA, 19 nt, Homo sapiens
caucaauggucaguuauau

SEQ ID NO: 795342 - RNA, 19 nt, Homo sapiens
ggaagaagagaaaggaaau

SEQ ID NO: 795343 - RNA, 19 nt, Homo sapiens
gcucaagugugauaacuac

SEQ ID NO: 795344 - RNA, 19 nt, Homo sapiens
gaagaccucaugaauuuag

SEQ ID NO: 795345 - RNA, 19 nt, Homo sapiens
ccaaggagagagaugauuu

SEQ ID NO: 795346 - RNA, 19 nt, Homo sapiens
caaaaccgauguagaagaa

SEQ ID NO: 795347 - RNA, 19 nt, Homo sapiens
aaagggcgcucaaguccaa

SEQ ID NO: 795348 - RNA, 19 nt, Homo sapiens
gcagaaggcaaccagacua

SEQ ID NO: 795349 - RNA, 19 nt, Homo sapiens
aaacacagccacucuugaa

SEQ ID NO: 795350 - RNA, 19 nt, Homo sapiens
ggcagccacuucauauaaa

SEQ ID NO: 795351 - RNA, 19 nt, Homo sapiens
cauggcaacugaagaccua

SEQ ID NO: 795352 - RNA, 19 nt, Homo sapiens
guggaaagacugaaacuga

SEQ ID NO: 795353 - RNA, 19 nt, Homo sapiens
ggaaauccacaacagcauu

SEQ ID NO: 795354 - RNA, 19 nt, Homo sapiens
gcuagaagccauugaaagu

SEQ ID NO: 795355 - RNA, 19 nt, Homo sapiens
caagaccaagacacaauua

SEQ ID NO: 795356 - RNA, 19 nt, Homo sapiens
cacgaguacugcagugaua

SEQ ID NO: 795357 - RNA, 19 nt, Homo sapiens
gaacgugcagucaucaaug

SEQ ID NO: 795358 - RNA, 19 nt, Homo sapiens
gacagaagcaguagacaau

SEQ ID NO: 795359 - RNA, 19 nt, Homo sapiens
uggaagcaauugagaaaga

SEQ ID NO: 795360 - RNA, 19 nt, Homo sapiens
gaaugcuacucucugaaau

SEQ ID NO: 795361 - RNA, 19 nt, Homo sapiens
gaaagggagacguuacaga

SEQ ID NO: 795362 - RNA, 19 nt, Homo sapiens
uauuuagucugcacuugua

SEQ ID NO: 795363 - RNA, 19 nt, Homo sapiens
cugaagaccuaauauguca

SEQ ID NO: 795364 - RNA, 19 nt, Homo sapiens
caacugaagaccuaauaug

SEQ ID NO: 795365 - RNA, 19 nt, Homo sapiens
ggaaaacaaugagugaaaa

SEQ ID NO: 795366 - RNA, 19 nt, Homo sapiens
gcaaguagcuccagaaaua

SEQ ID NO: 795367 - RNA, 19 nt, Homo sapiens
gagaagaccuuuauacgaa

SEQ ID NO: 795368 - RNA, 19 nt, Homo sapiens
gaacauaugcucaaagauu

SEQ ID NO: 795369 - RNA, 19 nt, Homo sapiens
gaauggacccuguugauaa

SEQ ID NO: 795370 - RNA, 19 nt, Homo sapiens
gagcagcgaugaucaacuu

SEQ ID NO: 795371 - RNA, 19 nt, Homo sapiens
guagaaagaguguugguua

SEQ ID NO: 795372 - RNA, 19 nt, Homo sapiens
gcaugugacuguuuauuug

SEQ ID NO: 795373 - RNA, 19 nt, Homo sapiens
gcucaaagauugugaagca

SEQ ID NO: 795374 - RNA, 19 nt, Homo sapiens
gcaaucauguuggccguua

SEQ ID NO: 795375 - RNA, 19 nt, Homo sapiens
uaaccaugcuguuggauuu

SEQ ID NO: 795376 - RNA, 19 nt, Homo sapiens
ggaaucaugguaccaaaua

SEQ ID NO: 795377 - RNA, 19 nt, Homo sapiens
ccaaggagcaguugaauau

SEQ ID NO: 795378 - RNA, 19 nt, Homo sapiens
ggaagaagcaugugacugu

SEQ ID NO: 795379 - RNA, 19 nt, Homo sapiens
gggagacgcucauaucaug

SEQ ID NO: 795380 - RNA, 19 nt, Homo sapiens
ggaugaacaggcucuauua

SEQ ID NO: 795381 - RNA, 19 nt, Homo sapiens
ucaaaucucucaauaagca

SEQ ID NO: 795382 - RNA, 19 nt, Homo sapiens
gaacagugcauuccaaauc

SEQ ID NO: 795383 - RNA, 19 nt, Homo sapiens
gcauacaucugugacauug

SEQ ID NO: 795384 - RNA, 19 nt, Homo sapiens
ggaauacucucauaaaaga

SEQ ID NO: 795385 - RNA, 19 nt, Homo sapiens
ugaccagucugcugcuuua

SEQ ID NO: 795386 - RNA, 19 nt, Homo sapiens
cagaacauaugcucaaaga

SEQ ID NO: 795387 - RNA, 19 nt, Homo sapiens
ggucauaugucaauagaag

SEQ ID NO: 795388 - RNA, 19 nt, Homo sapiens
ggaauggacccuguugaua

SEQ ID NO: 795389 - RNA, 19 nt, Homo sapiens
agaagcaugugacuguuua

SEQ ID NO: 795390 - RNA, 19 nt, Homo sapiens
ucgaaacuguuguuagaua

SEQ ID NO: 795391 - RNA, 19 nt, Homo sapiens
gagcgaaguuauagcaaau

SEQ ID NO: 795392 - RNA, 19 nt, Homo sapiens
ggaaguugaaguagcaaua

SEQ ID NO: 795393 - RNA, 19 nt, Homo sapiens
gaaagaguguugguuacug

SEQ ID NO: 795394 - RNA, 19 nt, Homo sapiens
gaagaagcaugugacuguu

SEQ ID NO: 795395 - RNA, 19 nt, Homo sapiens
guacuggaacaucaaguua

SEQ ID NO: 795396 - RNA, 19 nt, Homo sapiens
gauucagacuuuagacaaa

SEQ ID NO: 795397 - RNA, 19 nt, Homo sapiens
gacuuacgaugaagaauau

SEQ ID NO: 795398 - RNA, 19 nt, Homo sapiens
guucaacaacagcuaauua

SEQ ID NO: 795399 - RNA, 19 nt, Homo sapiens
gaaguugaaguagcaauaa

SEQ ID NO: 795400 - RNA, 19 nt, Homo sapiens
aaguuuaucuggacuguuu

SEQ ID NO: 795401 - RNA, 19 nt, Homo sapiens
ugucaaaucucucaauaag

SEQ ID NO: 795402 - RNA, 19 nt, Homo sapiens
gaaacuaguggaaucuuug

SEQ ID NO: 795403 - RNA, 19 nt, Homo sapiens
guaggaauacucucauaaa

SEQ ID NO: 795404 - RNA, 19 nt, Homo sapiens
ugacuuacgaugaagaaua

SEQ ID NO: 795405 - RNA, 19 nt, Homo sapiens
gcacuacaagcuauugaaa

SEQ ID NO: 795406 - RNA, 19 nt, Homo sapiens
ugaaacuaguggaaucuuu

SEQ ID NO: 795407 - RNA, 19 nt, Homo sapiens
ccucauggcuauugauuca

SEQ ID NO: 795408 - RNA, 19 nt, Homo sapiens
gaaucaugguaccaaauau

SEQ ID NO: 795409 - RNA, 19 nt, Homo sapiens
aagaauaccugcccuccuu

SEQ ID NO: 795410 - RNA, 19 nt, Homo sapiens
gaauguagaaagaguguug

SEQ ID NO: 795411 - RNA, 19 nt, Homo sapiens
guacuuuccuucaucgaau

SEQ ID NO: 795412 - RNA, 19 nt, Homo sapiens
gcuagugcuuugcaggaua

SEQ ID NO: 795413 - RNA, 19 nt, Homo sapiens
gaagaugaagccauguuug

SEQ ID NO: 795414 - RNA, 19 nt, Homo sapiens
gaagaccuuuauacgaaau

SEQ ID NO: 795415 - RNA, 19 nt, Homo sapiens
cagaauguguucaguaucu

SEQ ID NO: 795416 - RNA, 19 nt, Homo sapiens
cgaaacuguuguuagauau

SEQ ID NO: 795417 - RNA, 19 nt, Homo sapiens
cuucgaaacuguuguuaga

SEQ ID NO: 795418 - RNA, 19 nt, Homo sapiens
gcuuaugucucuuggauag

SEQ ID NO: 795419 - RNA, 19 nt, Homo sapiens
caaaucugguggaaucaug

SEQ ID NO: 795420 - RNA, 19 nt, Homo sapiens
gaaguuauagcaaaucaag

SEQ ID NO: 795421 - RNA, 19 nt, Homo sapiens
uuacagugcucucggauca

SEQ ID NO: 795422 - RNA, 19 nt, Homo sapiens
gcugcuaggucauauguca

SEQ ID NO: 795423 - RNA, 19 nt, Homo sapiens
gggcuuaugucucuuggau

SEQ ID NO: 795424 - RNA, 19 nt, Homo sapiens
ccacuaauggagaaguuua

SEQ ID NO: 795425 - RNA, 19 nt, Homo sapiens
cagaaauaauucaggaguu

SEQ ID NO: 795426 - RNA, 19 nt, Homo sapiens
caaacaguauuggcuuuau

SEQ ID NO: 795427 - RNA, 19 nt, Homo sapiens
gaauauccagauccaauug

SEQ ID NO: 795428 - RNA, 19 nt, Homo sapiens
ccucuuaucaaccagauua

SEQ ID NO: 795429 - RNA, 19 nt, Homo sapiens
guaaagcuuucagcaacaa

SEQ ID NO: 795430 - RNA, 19 nt, Homo sapiens
gaaucuuugugucaaguau

SEQ ID NO: 795431 - RNA, 19 nt, Homo sapiens
uuacagaguaucucacuaa

SEQ ID NO: 795432 - RNA, 19 nt, Homo sapiens
gcgaaguuauagcaaauca

SEQ ID NO: 795433 - RNA, 19 nt, Homo sapiens
ggagugcugauuguuaaua

SEQ ID NO: 795434 - RNA, 19 nt, Homo sapiens
gcuggagugcugauuguua

SEQ ID NO: 795435 - RNA, 19 nt, Homo sapiens
ucaaguuucaccagaguua

SEQ ID NO: 795436 - RNA, 19 nt, Homo sapiens
ccagugggauuugcugauu

SEQ ID NO: 795437 - RNA, 19 nt, Homo sapiens
gcaguugaauauccagauc

SEQ ID NO: 795438 - RNA, 19 nt, Homo sapiens
ggaguucauuccucuuauc

SEQ ID NO: 795439 - RNA, 19 nt, Homo sapiens
gaagccauguuuguagaau

SEQ ID NO: 795440 - RNA, 19 nt, Homo sapiens
cauguuggccguuaugaaa

SEQ ID NO: 795441 - RNA, 19 nt, Homo sapiens
caagaggcacuacaagcua

SEQ ID NO: 795442 - RNA, 19 nt, Homo sapiens
gcagaugcacaaacaguau

SEQ ID NO: 795443 - RNA, 19 nt, Homo sapiens
ugagcgaaguuauagcaaa

SEQ ID NO: 795444 - RNA, 19 nt, Homo sapiens
gcaagucgaaccaguaaag

SEQ ID NO: 795445 - RNA, 19 nt, Homo sapiens
gaugcgaacucugguaaca

SEQ ID NO: 795446 - RNA, 19 nt, Homo sapiens
aaaugagggugaagaugaa

SEQ ID NO: 795447 - RNA, 19 nt, Homo sapiens
aauggacccuguugauaaa

SEQ ID NO: 795448 - RNA, 19 nt, Homo sapiens
cacaaacaguauuggcuuu

SEQ ID NO: 795449 - RNA, 19 nt, Homo sapiens
caaauucaagauacaggua

SEQ ID NO: 795450 - RNA, 19 nt, Homo sapiens
aacauaugcucaaagauug

SEQ ID NO: 795451 - RNA, 19 nt, Homo sapiens
gcauugaccaggaagaaga

SEQ ID NO: 795452 - RNA, 19 nt, Homo sapiens
gaggaggcucguaggaaua

SEQ ID NO: 795453 - RNA, 19 nt, Homo sapiens
gcagccugaugcuaaaguu

SEQ ID NO: 795454 - RNA, 19 nt, Homo sapiens
ggaaacaagccuuaaugag

SEQ ID NO: 795455 - RNA, 19 nt, Homo sapiens
aaaugaaacuaguggaauc

SEQ ID NO: 795456 - RNA, 19 nt, Homo sapiens
cagaggacauacagugaug

SEQ ID NO: 795457 - RNA, 19 nt, Homo sapiens
cuggagugcugauuguuaa

SEQ ID NO: 795458 - RNA, 19 nt, Homo sapiens
uauagccaaugauagguuu

SEQ ID NO: 795459 - RNA, 19 nt, Homo sapiens
cccagaauguguucaguau

SEQ ID NO: 795460 - RNA, 19 nt, Homo sapiens
aaaucaaggugcagagaau

SEQ ID NO: 795461 - RNA, 19 nt, Homo sapiens
agaagaccuuuauacgaaa

SEQ ID NO: 795462 - RNA, 19 nt, Homo sapiens
gaugaagccauguuuguag

SEQ ID NO: 795463 - RNA, 19 nt, Homo sapiens
gauguugcagcuacuaauu

SEQ ID NO: 795464 - RNA, 19 nt, Homo sapiens
gauaguuaguuggaguaaa

SEQ ID NO: 795465 - RNA, 19 nt, Homo sapiens
ucuguugacuccacuaaug

SEQ ID NO: 795466 - RNA, 19 nt, Homo sapiens
gaucaucaaugccuucuuu

SEQ ID NO: 795467 - RNA, 19 nt, Homo sapiens
gaaaagaucucccgugaug

SEQ ID NO: 795468 - RNA, 19 nt, Homo sapiens
gagcaaagaugugaaugga

SEQ ID NO: 795469 - RNA, 19 nt, Homo sapiens
gaagguggauguagaacag

SEQ ID NO: 795470 - RNA, 19 nt, Homo sapiens
ucaaaucacucgccucuac

SEQ ID NO: 795471 - RNA, 19 nt, Homo sapiens
cauccgauuucuucacuaa

SEQ ID NO: 795472 - RNA, 19 nt, Homo sapiens
ucacagaauuuguuaaggu

SEQ ID NO: 795473 - RNA, 19 nt, Homo sapiens
ugccauaucuuucacagaa

SEQ ID NO: 795474 - RNA, 19 nt, Homo sapiens
uaaaggagaccaaacuguu

SEQ ID NO: 795475 - RNA, 19 nt, Homo sapiens
gcacuuugcuuuucgacua

SEQ ID NO: 795476 - RNA, 19 nt, Homo sapiens
aaacuuccguggauucaug

SEQ ID NO: 795477 - RNA, 19 nt, Homo sapiens
gagaggaccagguaaacuu

SEQ ID NO: 795478 - RNA, 19 nt, Homo sapiens
ccauaucuuucacagaauu

SEQ ID NO: 795479 - RNA, 19 nt, Homo sapiens
ggauaaagaugaaaagauc

SEQ ID NO: 795480 - RNA, 19 nt, Homo sapiens
gaagauuuccagaggauuc

SEQ ID NO: 795481 - RNA, 19 nt, Homo sapiens
ggagaagguggauguagaa

SEQ ID NO: 795482 - RNA, 19 nt, Homo sapiens
ggacagugccauaucuuuc

SEQ ID NO: 795483 - RNA, 19 nt, Homo sapiens
ucgaggagaucaagaagga

SEQ ID NO: 795484 - RNA, 19 nt, Homo sapiens
acgaagagcucgaggagau

SEQ ID NO: 795485 - RNA, 19 nt, Homo sapiens
gaaaagagcaaagauguga

SEQ ID NO: 795486 - RNA, 19 nt, Homo sapiens
cagguaaacuuccguggau

SEQ ID NO: 795487 - RNA, 19 nt, Homo sapiens
cacagaauuuguuaagguu

SEQ ID NO: 795488 - RNA, 19 nt, Homo sapiens
ccagaggauuccagaacuu

SEQ ID NO: 795489 - RNA, 19 nt, Homo sapiens
uggagaagguggauguaga

SEQ ID NO: 795490 - RNA, 19 nt, Homo sapiens
caacagccgaagcaacaaa

SEQ ID NO: 795491 - RNA, 19 nt, Homo sapiens
caagaaggagaccggcuuu

SEQ ID NO: 795492 - RNA, 19 nt, Homo sapiens
gggacagugccauaucuuu

SEQ ID NO: 795493 - RNA, 19 nt, Homo sapiens
gcaugauggucggaguaaa

SEQ ID NO: 795494 - RNA, 19 nt, Homo sapiens
gacagugccauaucuuuca

SEQ ID NO: 795495 - RNA, 19 nt, Homo sapiens
uuacaggugcuacgcauga

SEQ ID NO: 795496 - RNA, 19 nt, Homo sapiens
uuccagaacuugccaucaa

SEQ ID NO: 795497 - RNA, 19 nt, Homo sapiens
gaagagcucgaggagauca

SEQ ID NO: 795498 - RNA, 19 nt, Homo sapiens
gguaaacuuccguggauuc

SEQ ID NO: 795499 - RNA, 19 nt, Homo sapiens
caugauggucggaguaaau

SEQ ID NO: 795500 - RNA, 19 nt, Homo sapiens
guggauucaugcgaacuuu

SEQ ID NO: 795501 - RNA, 19 nt, Homo sapiens
agagggagaggaccaggua

SEQ ID NO: 795502 - RNA, 19 nt, Homo sapiens
gcauccgauuucuucacua

SEQ ID NO: 795503 - RNA, 19 nt, Homo sapiens
ucgacuauaugauuuggau

SEQ ID NO: 795504 - RNA, 19 nt, Homo sapiens
gauggucggaguaaauauc

SEQ ID NO: 795505 - RNA, 19 nt, Homo sapiens
gaagcaacaaacugcacuu

SEQ ID NO: 795506 - RNA, 19 nt, Homo sapiens
aaaggagaccaaacuguuc

SEQ ID NO: 795507 - RNA, 19 nt, Homo sapiens
aaagagcaaagaugugaau

SEQ ID NO: 795508 - RNA, 19 nt, Homo sapiens
ugcgaacuuuggcucauuu

SEQ ID NO: 795509 - RNA, 19 nt, Homo sapiens
ggucggaguaaauaucuca

SEQ ID NO: 795510 - RNA, 19 nt, Homo sapiens
aaagaucucccgugaugag

SEQ ID NO: 795511 - RNA, 19 nt, Homo sapiens
gggaccggaucaucaaugc

SEQ ID NO: 795512 - RNA, 19 nt, Homo sapiens
cuaaaggagaccaaacugu

SEQ ID NO: 795513 - RNA, 19 nt, Homo sapiens
ccacucaacagccgaagca

SEQ ID NO: 795514 - RNA, 19 nt, Homo sapiens
guaaacuuccguggauuca

SEQ ID NO: 795515 - RNA, 19 nt, Homo sapiens
gccauaucuuucacagaau

SEQ ID NO: 795516 - RNA, 19 nt, Homo sapiens
ggauucaugcgaacuuugg

SEQ ID NO: 795517 - RNA, 19 nt, Homo sapiens
caucaaugccuucuuucca

SEQ ID NO: 795518 - RNA, 19 nt, Homo sapiens
aaacugcacuuugcuuuuc

SEQ ID NO: 795519 - RNA, 19 nt, Homo sapiens
ggagaggaccagguaaacu

SEQ ID NO: 795520 - RNA, 19 nt, Homo sapiens
uccgauuucuucacuaaag

SEQ ID NO: 795521 - RNA, 19 nt, Homo sapiens
caaaucacucgccucuaca

SEQ ID NO: 795522 - RNA, 19 nt, Homo sapiens
cagaggauuccagaacuug

SEQ ID NO: 795523 - RNA, 19 nt, Homo sapiens
gcuaagggcucugcucgua

SEQ ID NO: 795524 - RNA, 19 nt, Homo sapiens
ucuaguagcugcauuacaa

SEQ ID NO: 795525 - RNA, 19 nt, Homo sapiens
gcagcugacuucugugaga

SEQ ID NO: 795526 - RNA, 19 nt, Homo sapiens
caacuguucuuaugucaca

SEQ ID NO: 795527 - RNA, 19 nt, Homo sapiens
gauacugccuucucaagau

SEQ ID NO: 795528 - RNA, 19 nt, Homo sapiens
gaacggggcugucuaugga

SEQ ID NO: 795529 - RNA, 19 nt, Homo sapiens
ccuguaaucucagaacuuu

SEQ ID NO: 795530 - RNA, 19 nt, Homo sapiens
gaaacacgugagccauaua

SEQ ID NO: 795531 - RNA, 19 nt, Homo sapiens
gcucacuccuguaaucuca

SEQ ID NO: 795532 - RNA, 19 nt, Homo sapiens
ggcaguggguuguaaauac

SEQ ID NO: 795533 - RNA, 19 nt, Homo sapiens
ggcuguggcucaagauuug

SEQ ID NO: 795534 - RNA, 19 nt, Homo sapiens
caagagccgucccuccaau

SEQ ID NO: 795535 - RNA, 19 nt, Homo sapiens
guggguauguucauucuuc

SEQ ID NO: 795536 - RNA, 19 nt, Homo sapiens
acagccagaucaacaugua

SEQ ID NO: 795537 - RNA, 19 nt, Homo sapiens
gcaguggguuguaaauacu

SEQ ID NO: 795538 - RNA, 19 nt, Homo sapiens
uagaaacacgugagccaua

SEQ ID NO: 795539 - RNA, 19 nt, Homo sapiens
agaaacacgugagccauau

SEQ ID NO: 795540 - RNA, 19 nt, Homo sapiens
aaagaagccugggcacugu

SEQ ID NO: 795541 - RNA, 19 nt, Homo sapiens
cacgugagccauauaugua

SEQ ID NO: 795542 - RNA, 19 nt, Homo sapiens
ggauacugccuucucaaga

SEQ ID NO: 795543 - RNA, 19 nt, Homo sapiens
gagccgucccuccaauuaa

SEQ ID NO: 795544 - RNA, 19 nt, Homo sapiens
ugaggcagguggaucacuu

SEQ ID NO: 795545 - RNA, 19 nt, Homo sapiens
gggcaguggguuguaaaua

SEQ ID NO: 795546 - RNA, 19 nt, Homo sapiens
uaagggcucugcucguagu

SEQ ID NO: 795547 - RNA, 19 nt, Homo sapiens
gcacgacaucucagacuuc

SEQ ID NO: 795548 - RNA, 19 nt, Homo sapiens
ggugggcaguggguuguaa

SEQ ID NO: 795549 - RNA, 19 nt, Homo sapiens
gagaagcugugggccauac

SEQ ID NO: 795550 - RNA, 19 nt, Homo sapiens
gauucccacuguccaauag

SEQ ID NO: 795551 - RNA, 19 nt, Homo sapiens
aaacacgugagccauauau

SEQ ID NO: 795552 - RNA, 19 nt, Homo sapiens
guucauucuucaacuguuc

SEQ ID NO: 795553 - RNA, 19 nt, Homo sapiens
caacagccagaucaacaug

SEQ ID NO: 795554 - RNA, 19 nt, Homo sapiens
agagccgucccuccaauua

SEQ ID NO: 795555 - RNA, 19 nt, Homo sapiens
ugcuguggcucuuugagua

SEQ ID NO: 795556 - RNA, 19 nt, Homo sapiens
ucacuccuguaaucucaga

SEQ ID NO: 795557 - RNA, 19 nt, Homo sapiens
ggcacgacaucucagacuu

SEQ ID NO: 795558 - RNA, 19 nt, Homo sapiens
ucgcugcaguccuccauga

SEQ ID NO: 795559 - RNA, 19 nt, Homo sapiens
uaacaucaacagccagauc

SEQ ID NO: 795560 - RNA, 19 nt, Homo sapiens
ggagaaaacaauaacauca

SEQ ID NO: 795561 - RNA, 19 nt, Homo sapiens
guggcucacuccuguaauc

SEQ ID NO: 795562 - RNA, 19 nt, Homo sapiens
cagccacacuacucucuag

SEQ ID NO: 795563 - RNA, 19 nt, Homo sapiens
uaugaggacagcaauguau

SEQ ID NO: 795564 - RNA, 19 nt, Homo sapiens
acacgugagccauauaugu

SEQ ID NO: 795565 - RNA, 19 nt, Homo sapiens
ccauacugcaggccacaua

SEQ ID NO: 795566 - RNA, 19 nt, Homo sapiens
ccgccuggcuguagagaag

SEQ ID NO: 795567 - RNA, 19 nt, Homo sapiens
caagaucauaggccucaga

SEQ ID NO: 795568 - RNA, 19 nt, Homo sapiens
cuucaacuguucuuauguc

SEQ ID NO: 795569 - RNA, 19 nt, Homo sapiens
gugcagcugacuucuguga

SEQ ID NO: 795570 - RNA, 19 nt, Homo sapiens
ugcagacccucccaaagga

SEQ ID NO: 795571 - RNA, 19 nt, Homo sapiens
gcccugcaguccuacauac

SEQ ID NO: 795572 - RNA, 19 nt, Homo sapiens
guuucuaguagcugcauua

SEQ ID NO: 795573 - RNA, 19 nt, Homo sapiens
ggagaagcugugggccaua

SEQ ID NO: 795574 - RNA, 19 nt, Homo sapiens
uggcacaaguggccgaauc

SEQ ID NO: 795575 - RNA, 19 nt, Homo sapiens
gacuccaacugguguuauc

SEQ ID NO: 795576 - RNA, 19 nt, Homo sapiens
cagacccucccaaaggaua

SEQ ID NO: 795577 - RNA, 19 nt, Homo sapiens
uccaugaccuaccucuaug

SEQ ID NO: 795578 - RNA, 19 nt, Homo sapiens
guugucacgcguccuguuu

SEQ ID NO: 795579 - RNA, 19 nt, Homo sapiens
uauguucauucuucaacug

SEQ ID NO: 795580 - RNA, 19 nt, Homo sapiens
guggguaccuuuguauggu

SEQ ID NO: 795581 - RNA, 19 nt, Homo sapiens
auacugcaggccacauaua

SEQ ID NO: 795582 - RNA, 19 nt, Homo sapiens
cgugagccauauauguaau

SEQ ID NO: 795583 - RNA, 19 nt, Homo sapiens
cugugcagcugacuucugu

SEQ ID NO: 795584 - RNA, 19 nt, Homo sapiens
ccaguggguaccuuuguau

SEQ ID NO: 795585 - RNA, 19 nt, Homo sapiens
ccaugcagacccucccaaa

SEQ ID NO: 795586 - RNA, 19 nt, Homo sapiens
uggcuguggcucaagauuu

SEQ ID NO: 795587 - RNA, 19 nt, Homo sapiens
gaagcugugggccauacug

SEQ ID NO: 795588 - RNA, 19 nt, Homo sapiens
agccgucccuccaauuaau

SEQ ID NO: 795589 - RNA, 19 nt, Homo sapiens
cuacccagcacacgcauuc

SEQ ID NO: 795590 - RNA, 19 nt, Homo sapiens
cacgguuuguguucaccua

SEQ ID NO: 795591 - RNA, 19 nt, Homo sapiens
guauguucauucuucaacu

SEQ ID NO: 795592 - RNA, 19 nt, Homo sapiens
cuaugaggacagcaaugua

SEQ ID NO: 795593 - RNA, 19 nt, Homo sapiens
cuccaugaccuaccucuau

SEQ ID NO: 795594 - RNA, 19 nt, Homo sapiens
gcuguggcucuuugaguau

SEQ ID NO: 795595 - RNA, 19 nt, Homo sapiens
gaacagugcucuuguggua

SEQ ID NO: 795596 - RNA, 19 nt, Homo sapiens
ggaagaaacuugcagauga

SEQ ID NO: 795597 - RNA, 19 nt, Homo sapiens
gauggaaucugcuuuguug

SEQ ID NO: 795598 - RNA, 19 nt, Homo sapiens
gauguaaccuggaaacuau

SEQ ID NO: 795599 - RNA, 19 nt, Homo sapiens
gaugauaugugcugccuuu

SEQ ID NO: 795600 - RNA, 19 nt, Homo sapiens
gaagaaacuugcagaugau

SEQ ID NO: 795601 - RNA, 19 nt, Homo sapiens
gaauuuaccucaagaacuc

SEQ ID NO: 795602 - RNA, 19 nt, Homo sapiens
ugaaggaaguggaccuaua

SEQ ID NO: 795603 - RNA, 19 nt, Homo sapiens
ucacaaggauugaaagaug

SEQ ID NO: 795604 - RNA, 19 nt, Homo sapiens
uagaguggaugaaaugaaa

SEQ ID NO: 795605 - RNA, 19 nt, Homo sapiens
gaauagaguggaugaaaug

SEQ ID NO: 795606 - RNA, 19 nt, Homo sapiens
agagaaguauccagaauug

SEQ ID NO: 795607 - RNA, 19 nt, Homo sapiens
gaaauuauaccaggcaaug

SEQ ID NO: 795608 - RNA, 19 nt, Homo sapiens
ggauaccucuagugcaauu

SEQ ID NO: 795609 - RNA, 19 nt, Homo sapiens
caugaagacugaccaacuu

SEQ ID NO: 795610 - RNA, 19 nt, Homo sapiens
gaggcaagcucaauguaca

SEQ ID NO: 795611 - RNA, 19 nt, Homo sapiens
aagaugagguucucuacaa

SEQ ID NO: 795612 - RNA, 19 nt, Homo sapiens
gugcugccuuugcuucuua

SEQ ID NO: 795613 - RNA, 19 nt, Homo sapiens
gaaggaaguggaccuauag

SEQ ID NO: 795614 - RNA, 19 nt, Homo sapiens
guggauaccucuagugcaa

SEQ ID NO: 795615 - RNA, 19 nt, Homo sapiens
guuagugcuuucaacauuu

SEQ ID NO: 795616 - RNA, 19 nt, Homo sapiens
gaaacuugcagaugauaug

SEQ ID NO: 795617 - RNA, 19 nt, Homo sapiens
ugaaaugggagaagauaaa

SEQ ID NO: 795618 - RNA, 19 nt, Homo sapiens
aguggcaacugaaauuaua

SEQ ID NO: 795619 - RNA, 19 nt, Homo sapiens
cgaaguguggccauaauaa

SEQ ID NO: 795620 - RNA, 19 nt, Homo sapiens
gauaacaccugcuuuucaa

SEQ ID NO: 795621 - RNA, 19 nt, Homo sapiens
cacaaggauugaaagauga

SEQ ID NO: 795622 - RNA, 19 nt, Homo sapiens
uaucauucauggcagauug

SEQ ID NO: 795623 - RNA, 19 nt, Homo sapiens
agaauagaguggaugaaau

SEQ ID NO: 795624 - RNA, 19 nt, Homo sapiens
caacugguauggugaacag

SEQ ID NO: 795625 - RNA, 19 nt, Homo sapiens
guucuaguauucuggauca

SEQ ID NO: 795626 - RNA, 19 nt, Homo sapiens
ggaagugcagccaggauug

SEQ ID NO: 795627 - RNA, 19 nt, Homo sapiens
gcagauuguuagugcuuuc

SEQ ID NO: 795628 - RNA, 19 nt, Homo sapiens
gacaccaucuuccaugcuu

SEQ ID NO: 795629 - RNA, 19 nt, Homo sapiens
uuucgaaguucuaguauuc

SEQ ID NO: 795630 - RNA, 19 nt, Homo sapiens
acagagaaguauccagaau

SEQ ID NO: 795631 - RNA, 19 nt, Homo sapiens
caagcucaauguacaucuu

SEQ ID NO: 795632 - RNA, 19 nt, Homo sapiens
gugcaggcgaucauuauuu

SEQ ID NO: 795633 - RNA, 19 nt, Homo sapiens
gaaagugcaggcgaucauu

SEQ ID NO: 795634 - RNA, 19 nt, Homo sapiens
gauaugugcugccuuugcu

SEQ ID NO: 795635 - RNA, 19 nt, Homo sapiens
ggugaacagugcucuugug

SEQ ID NO: 795636 - RNA, 19 nt, Homo sapiens
gaucauuauuucgaaguuc

SEQ ID NO: 795637 - RNA, 19 nt, Homo sapiens
aaagugcaggcgaucauua

SEQ ID NO: 795638 - RNA, 19 nt, Homo sapiens
ugaccaacuucccuuugaa

SEQ ID NO: 795639 - RNA, 19 nt, Homo sapiens
gaaagaugagguucucuac

SEQ ID NO: 795640 - RNA, 19 nt, Homo sapiens
ugaaagaugagguucucua

SEQ ID NO: 795641 - RNA, 19 nt, Homo sapiens
gaaaagcuccagauucuca

SEQ ID NO: 795642 - RNA, 19 nt, Homo sapiens
gaccaacuucccuuugaaa

SEQ ID NO: 795643 - RNA, 19 nt, Homo sapiens
gcaggagucagucgaagug

SEQ ID NO: 795644 - RNA, 19 nt, Homo sapiens
cagagaaguauccagaauu

SEQ ID NO: 795645 - RNA, 19 nt, Homo sapiens
ggguuugaguggcaacuga

SEQ ID NO: 795646 - RNA, 19 nt, Homo sapiens
gggaagaaacuugcagaug

SEQ ID NO: 795647 - RNA, 19 nt, Homo sapiens
cuagugcaauuuauaagca

SEQ ID NO: 795648 - RNA, 19 nt, Homo sapiens
ccucuagugcaauuuauaa

SEQ ID NO: 795649 - RNA, 19 nt, Homo sapiens
uggaaacuaugcuuuacau

SEQ ID NO: 795650 - RNA, 19 nt, Homo sapiens
ggauggaaucugcuuuguu

SEQ ID NO: 795651 - RNA, 19 nt, Homo sapiens
aaguggaccuauagccuuu

SEQ ID NO: 795652 - RNA, 19 nt, Homo sapiens
uacaaaagguuacagagaa

SEQ ID NO: 795653 - RNA, 19 nt, Homo sapiens
caaaccagaggcuaagaug

SEQ ID NO: 795654 - RNA, 19 nt, Homo sapiens
ugauguaaccuggaaacua

SEQ ID NO: 795655 - RNA, 19 nt, Homo sapiens
aagaauagaguggaugaaa

SEQ ID NO: 795656 - RNA, 19 nt, Homo sapiens
gcucaauguacaucuuauu

SEQ ID NO: 795657 - RNA, 19 nt, Homo sapiens
gcagaauuuaccucaagaa

SEQ ID NO: 795658 - RNA, 19 nt, Homo sapiens
ugaguggcaacugaaauua

SEQ ID NO: 795659 - RNA, 19 nt, Homo sapiens
cagaggcuaagaugaauga

SEQ ID NO: 795660 - RNA, 19 nt, Homo sapiens
cugaccaacuucccuuuga

SEQ ID NO: 795661 - RNA, 19 nt, Homo sapiens
gcaauaucguuuacaaaag

SEQ ID NO: 795662 - RNA, 19 nt, Homo sapiens
gaaguggauaccucuagug

SEQ ID NO: 795663 - RNA, 19 nt, Homo sapiens
ugaaguggauaccucuagu

SEQ ID NO: 795664 - RNA, 19 nt, Homo sapiens
aaccagaggcuaagaugaa

SEQ ID NO: 795665 - RNA, 19 nt, Homo sapiens
gaaguguggccauaauaac

SEQ ID NO: 795666 - RNA, 19 nt, Homo sapiens
cauaauaacugcuuuucuc

SEQ ID NO: 795667 - RNA, 19 nt, Homo sapiens
gcuuucaacauuucauuug

SEQ ID NO: 795668 - RNA, 19 nt, Homo sapiens
gggaggcaagcucaaugua

SEQ ID NO: 795669 - RNA, 19 nt, Homo sapiens
acaccaucuuccaugcuua

SEQ ID NO: 795670 - RNA, 19 nt, Homo sapiens
ugcaggcgaucauuauuuc

SEQ ID NO: 795671 - RNA, 19 nt, Homo sapiens
ggcaaugggauaugaagug

SEQ ID NO: 795672 - RNA, 19 nt, Homo sapiens
gaguggcaacugaaauuau

SEQ ID NO: 795673 - RNA, 19 nt, Homo sapiens
gaagugcagccaggauugu

SEQ ID NO: 795674 - RNA, 19 nt, Homo sapiens
aaaaugcagugccaaguug

SEQ ID NO: 795675 - RNA, 19 nt, Homo sapiens
ggaggcaagcucaauguac

SEQ ID NO: 795676 - RNA, 19 nt, Homo sapiens
cgaucauuauuucgaaguu

SEQ ID NO: 795677 - RNA, 19 nt, Homo sapiens
aaugggauaugaaguggau

SEQ ID NO: 795678 - RNA, 19 nt, Homo sapiens
aagcucaauguacaucuua

SEQ ID NO: 795679 - RNA, 19 nt, Homo sapiens
gaaaugggagaagauaaaa

SEQ ID NO: 795680 - RNA, 19 nt, Homo sapiens
uuagugcuuucaacauuuc

SEQ ID NO: 795681 - RNA, 19 nt, Homo sapiens
gaaugacaccaucuuccau

SEQ ID NO: 795682 - RNA, 19 nt, Homo sapiens
gccuuugcuucuuaucauu

SEQ ID NO: 795683 - RNA, 19 nt, Homo sapiens
ggaaacuaugcuuuacaug

SEQ ID NO: 795684 - RNA, 19 nt, Homo sapiens
gagaagauaaaaucacuug

SEQ ID NO: 795685 - RNA, 19 nt, Homo sapiens
gucgaaguguggccauaau

SEQ ID NO: 795686 - RNA, 19 nt, Homo sapiens
ggcagauuguuagugcuuu

SEQ ID NO: 795687 - RNA, 19 nt, Homo sapiens
agugauggauggacagcuu

SEQ ID NO: 795688 - RNA, 19 nt, Homo sapiens
uaacugcuuuucucaugaa

SEQ ID NO: 795689 - RNA, 19 nt, Homo sapiens
auaccucuagugcaauuua

SEQ ID NO: 795690 - RNA, 19 nt, Homo sapiens
cagccaggauuguauuucg

SEQ ID NO: 795691 - RNA, 19 nt, Homo sapiens
gaugagguucucuacaagu

SEQ ID NO: 795692 - RNA, 19 nt, Homo sapiens
ggaggagcccagcuucaag

SEQ ID NO: 795693 - RNA, 19 nt, Homo sapiens
ucgaaguguggccauaaua

SEQ ID NO: 795694 - RNA, 19 nt, Homo sapiens
agaaguauccagaauugca

SEQ ID NO: 795695 - RNA, 19 nt, Homo sapiens
gaacuagguguccaaauua

SEQ ID NO: 795696 - RNA, 19 nt, Homo sapiens
ggacuucuauuacgaacua

SEQ ID NO: 795697 - RNA, 19 nt, Homo sapiens
gaucaaagccagucuuaaa

SEQ ID NO: 795698 - RNA, 19 nt, Homo sapiens
gaucagagccaucaagaaa

SEQ ID NO: 795699 - RNA, 19 nt, Homo sapiens
cgaacuagguguccaaauu

SEQ ID NO: 795700 - RNA, 19 nt, Homo sapiens
ggacaugugugcaaccauu

SEQ ID NO: 795701 - RNA, 19 nt, Homo sapiens
gaacggcaagcacauauaa

SEQ ID NO: 795702 - RNA, 19 nt, Homo sapiens
aaaccucgcucguucagua

SEQ ID NO: 795703 - RNA, 19 nt, Homo sapiens
caaagcaguuggacauguu

SEQ ID NO: 795704 - RNA, 19 nt, Homo sapiens
caaauaaaccugggcaauu

SEQ ID NO: 795705 - RNA, 19 nt, Homo sapiens
aggcggagguggcaaauaa

SEQ ID NO: 795706 - RNA, 19 nt, Homo sapiens
gagaucaaagccagucuua

SEQ ID NO: 795707 - RNA, 19 nt, Homo sapiens
agaccaaccuggaggaauu

SEQ ID NO: 795708 - RNA, 19 nt, Homo sapiens
gaauggaggucugauaacu

SEQ ID NO: 795709 - RNA, 19 nt, Homo sapiens
gcaagcacauauaaaauga

SEQ ID NO: 795710 - RNA, 19 nt, Homo sapiens
caaagccagucuuaaaugg

SEQ ID NO: 795711 - RNA, 19 nt, Homo sapiens
uugcagaggccaaguauaa

SEQ ID NO: 795712 - RNA, 19 nt, Homo sapiens
ccuagaauguggguuguuu

SEQ ID NO: 795713 - RNA, 19 nt, Homo sapiens
gcaaauaaaccugggcaau

SEQ ID NO: 795714 - RNA, 19 nt, Homo sapiens
uggaacaccugcugaagga

SEQ ID NO: 795715 - RNA, 19 nt, Homo sapiens
gaagagcugggccuagaau

SEQ ID NO: 795716 - RNA, 19 nt, Homo sapiens
ugccagcucucuucacuga

SEQ ID NO: 795717 - RNA, 19 nt, Homo sapiens
ucugauaacuuuggaggaa

SEQ ID NO: 795718 - RNA, 19 nt, Homo sapiens
gagaacggcaagcacauau

SEQ ID NO: 795719 - RNA, 19 nt, Homo sapiens
auggaggucugauaacuuu

SEQ ID NO: 795720 - RNA, 19 nt, Homo sapiens
uggaagagcugggccuaga

SEQ ID NO: 795721 - RNA, 19 nt, Homo sapiens
ucaaagcaguuggacaugu

SEQ ID NO: 795722 - RNA, 19 nt, Homo sapiens
ucaaagccagucuuaaaug

SEQ ID NO: 795723 - RNA, 19 nt, Homo sapiens
cggaauggaggucugauaa

SEQ ID NO: 795724 - RNA, 19 nt, Homo sapiens
gcaaacacaagcaggagau

SEQ ID NO: 795725 - RNA, 19 nt, Homo sapiens
cagccuaugcuaauucaaa

SEQ ID NO: 795726 - RNA, 19 nt, Homo sapiens
ucagagccaucaagaaacu

SEQ ID NO: 795727 - RNA, 19 nt, Homo sapiens
gaagaauggcuacgugacu

SEQ ID NO: 795728 - RNA, 19 nt, Homo sapiens
caggagauccggaagaauc

SEQ ID NO: 795729 - RNA, 19 nt, Homo sapiens
uaggucaucugcaaguuca

SEQ ID NO: 795730 - RNA, 19 nt, Homo sapiens
uggaggaacuacaucaaca

SEQ ID NO: 795731 - RNA, 19 nt, Homo sapiens
ggaagagcugggccuagaa

SEQ ID NO: 795732 - RNA, 19 nt, Homo sapiens
uggcguggcuggacuuaca

SEQ ID NO: 795733 - RNA, 19 nt, Homo sapiens
gagcugggccuagaaugug

SEQ ID NO: 795734 - RNA, 19 nt, Homo sapiens
ccggaagaauccugaguuc

SEQ ID NO: 795735 - RNA, 19 nt, Homo sapiens
uagauuacagccuaugcua

SEQ ID NO: 795736 - RNA, 19 nt, Homo sapiens
ucucuucacugaccucuac

SEQ ID NO: 795737 - RNA, 19 nt, Homo sapiens
gcucguucaguaagcauaa

SEQ ID NO: 795738 - RNA, 19 nt, Homo sapiens
gcagaggccaaguauaagg

SEQ ID NO: 795739 - RNA, 19 nt, Homo sapiens
gcaaguucgcccaggaugu

SEQ ID NO: 795740 - RNA, 19 nt, Homo sapiens
ccuggccugucuagucuuu

SEQ ID NO: 795741 - RNA, 19 nt, Homo sapiens
uagcccagaugucaaagca

SEQ ID NO: 795742 - RNA, 19 nt, Homo sapiens
gcugaagcaucggaaugga

SEQ ID NO: 795743 - RNA, 19 nt, Homo sapiens
gcaguuccaggacaugugu

SEQ ID NO: 795744 - RNA, 19 nt, Homo sapiens
cagcugaggaggccagaga

SEQ ID NO: 795745 - RNA, 19 nt, Homo sapiens
ggcacuggcuucggcauca

SEQ ID NO: 795746 - RNA, 19 nt, Homo sapiens
caggaugucagucaagaug

SEQ ID NO: 795747 - RNA, 19 nt, Homo sapiens
ccagcuagcccagauguca

SEQ ID NO: 795748 - RNA, 19 nt, Homo sapiens
gaccaaccuggaggaauuu

SEQ ID NO: 795749 - RNA, 19 nt, Homo sapiens
gcgcugaagcaucggaaug

SEQ ID NO: 795750 - RNA, 19 nt, Homo sapiens
gcugugagacauagauuac

SEQ ID NO: 795751 - RNA, 19 nt, Homo sapiens
ucugcaaguucauggaaga

SEQ ID NO: 795752 - RNA, 19 nt, Homo sapiens
gaggucugauaacuuugga

SEQ ID NO: 795753 - RNA, 19 nt, Homo sapiens
agagaacggcaagcacaua

SEQ ID NO: 795754 - RNA, 19 nt, Homo sapiens
ggaauggaggucugauaac

SEQ ID NO: 795755 - RNA, 19 nt, Homo sapiens
ggaggucugauaacuuugg

SEQ ID NO: 795756 - RNA, 19 nt, Homo sapiens
guaggucaucugcaaguuc

SEQ ID NO: 795757 - RNA, 19 nt, Homo sapiens
ugaguuccgugugcaguuc

SEQ ID NO: 795758 - RNA, 19 nt, Homo sapiens
agaacggcaagcacauaua

SEQ ID NO: 795759 - RNA, 19 nt, Homo sapiens
agcaggagauccggaagaa

SEQ ID NO: 795760 - RNA, 19 nt, Homo sapiens
gcagcuggcagagaagaau

SEQ ID NO: 795761 - RNA, 19 nt, Homo sapiens
gcacuggcuucggcaucau

SEQ ID NO: 795762 - RNA, 19 nt, Homo sapiens
aacuagguguccaaauuau

SEQ ID NO: 795763 - RNA, 19 nt, Homo sapiens
uacagccuaugcuaauuca

SEQ ID NO: 795764 - RNA, 19 nt, Homo sapiens
gaccagcuagcccagaugu

SEQ ID NO: 795765 - RNA, 19 nt, Homo sapiens
caucugcaaguucauggaa

SEQ ID NO: 795766 - RNA, 19 nt, Homo sapiens
caaguucgcccaggauguc

SEQ ID NO: 795767 - RNA, 19 nt, Homo sapiens
gagaagcccuccccugacu

SEQ ID NO: 795768 - RNA, 19 nt, Homo sapiens
ccagaugucaaagcaguug

SEQ ID NO: 795769 - RNA, 19 nt, Homo sapiens
cccaggaugucagucaaga

SEQ ID NO: 795770 - RNA, 19 nt, Homo sapiens
uuacagccuaugcuaauuc

SEQ ID NO: 795771 - RNA, 19 nt, Homo sapiens
agauuacagccuaugcuaa

SEQ ID NO: 795772 - RNA, 19 nt, Homo sapiens
ugugagacauagauuacag

SEQ ID NO: 795773 - RNA, 19 nt, Homo sapiens
gaagacagaugaagaagag

SEQ ID NO: 795774 - RNA, 19 nt, Homo sapiens
gaaacuaccuaccucacuu

SEQ ID NO: 795775 - RNA, 19 nt, Homo sapiens
gccaugaucuucugccaua

SEQ ID NO: 795776 - RNA, 19 nt, Homo sapiens
gaagaucagugagcagauu

SEQ ID NO: 795777 - RNA, 19 nt, Homo sapiens
acacaaccuuggaagauua

SEQ ID NO: 795778 - RNA, 19 nt, Homo sapiens
caacuugcaucuuaaggaa

SEQ ID NO: 795779 - RNA, 19 nt, Homo sapiens
gaaagaggccagaagauca

SEQ ID NO: 795780 - RNA, 19 nt, Homo sapiens
cuaccuaccucacuucaaa

SEQ ID NO: 795781 - RNA, 19 nt, Homo sapiens
gaaaauagccaacugagaa

SEQ ID NO: 795782 - RNA, 19 nt, Homo sapiens
ggacgggaauccugacaau

SEQ ID NO: 795783 - RNA, 19 nt, Homo sapiens
gagaacgcauugccacuga

SEQ ID NO: 795784 - RNA, 19 nt, Homo sapiens
ucaacaagcugaucagaag

SEQ ID NO: 795785 - RNA, 19 nt, Homo sapiens
cagcagagcucucaaaaga

SEQ ID NO: 795786 - RNA, 19 nt, Homo sapiens
guucauugaucccaagaaa

SEQ ID NO: 795787 - RNA, 19 nt, Homo sapiens
aguagaaccugcaaacaaa

SEQ ID NO: 795788 - RNA, 19 nt, Homo sapiens
cuaccucacuucaaauuau

SEQ ID NO: 795789 - RNA, 19 nt, Homo sapiens
acacagagauuuaccuuuu

SEQ ID NO: 795790 - RNA, 19 nt, Homo sapiens
ggaagauuaggcaugaaua

SEQ ID NO: 795791 - RNA, 19 nt, Homo sapiens
gcuccaagcucaaguucau

SEQ ID NO: 795792 - RNA, 19 nt, Homo sapiens
ggaaagaggccagaagauc

SEQ ID NO: 795793 - RNA, 19 nt, Homo sapiens
uaacacaaaccaaguggaa

SEQ ID NO: 795794 - RNA, 19 nt, Homo sapiens
cauccaagauacaagagaa

SEQ ID NO: 795795 - RNA, 19 nt, Homo sapiens
gaucagaagcaaccuuguu

SEQ ID NO: 795796 - RNA, 19 nt, Homo sapiens
gauuaggcaugaauacaca

SEQ ID NO: 795797 - RNA, 19 nt, Homo sapiens
ugaggcugaugucaugaua

SEQ ID NO: 795798 - RNA, 19 nt, Homo sapiens
gagaaaaucaaaccagaua

SEQ ID NO: 795799 - RNA, 19 nt, Homo sapiens
ggacgagauugagaaaaua

SEQ ID NO: 795800 - RNA, 19 nt, Homo sapiens
acaagugucugucgucauc

SEQ ID NO: 795801 - RNA, 19 nt, Homo sapiens
gcaugaauacacagagauu

SEQ ID NO: 795802 - RNA, 19 nt, Homo sapiens
gcaugaacauccugaacag

SEQ ID NO: 795803 - RNA, 19 nt, Homo sapiens
gaaguuugcccagaaagug

SEQ ID NO: 795804 - RNA, 19 nt, Homo sapiens
ggccaugcuuagccaagua

SEQ ID NO: 795805 - RNA, 19 nt, Homo sapiens
uagaaagauuggacacaga

SEQ ID NO: 795806 - RNA, 19 nt, Homo sapiens
caauggugcuguugucaag

SEQ ID NO: 795807 - RNA, 19 nt, Homo sapiens
gaccauggccacugacuca

SEQ ID NO: 795808 - RNA, 19 nt, Homo sapiens
gauuggacacagaugauuu

SEQ ID NO: 795809 - RNA, 19 nt, Homo sapiens
gauacaagagaacgcauug

SEQ ID NO: 795810 - RNA, 19 nt, Homo sapiens
gaagauuaggcaugaauac

SEQ ID NO: 795811 - RNA, 19 nt, Homo sapiens
gcagagcucucaaaagaag

SEQ ID NO: 795812 - RNA, 19 nt, Homo sapiens
gugagcagauugucauugg

SEQ ID NO: 795813 - RNA, 19 nt, Homo sapiens
cagaugauuuggacgagau

SEQ ID NO: 795814 - RNA, 19 nt, Homo sapiens
ugaacauccugaacagaau

SEQ ID NO: 795815 - RNA, 19 nt, Homo sapiens
guggaaguuugcccagaaa

SEQ ID NO: 795816 - RNA, 19 nt, Homo sapiens
caagguguuuguucuggau

SEQ ID NO: 795817 - RNA, 19 nt, Homo sapiens
uagaaccugcaaacaaaua

SEQ ID NO: 795818 - RNA, 19 nt, Homo sapiens
gaacgcauugccacugaug

SEQ ID NO: 795819 - RNA, 19 nt, Homo sapiens
cagagaagacagaugaaga

SEQ ID NO: 795820 - RNA, 19 nt, Homo sapiens
caagaccaaugccaaugca

SEQ ID NO: 795821 - RNA, 19 nt, Homo sapiens
gcccaguccuuacucaaca

SEQ ID NO: 795822 - RNA, 19 nt, Homo sapiens
agagaagacagaugaagaa

SEQ ID NO: 795823 - RNA, 19 nt, Homo sapiens
uacacaaccuuggaagauu

SEQ ID NO: 795824 - RNA, 19 nt, Homo sapiens
gaacagaauccaggagcau

SEQ ID NO: 795825 - RNA, 19 nt, Homo sapiens
gaaguuccaggccuugugu

SEQ ID NO: 795826 - RNA, 19 nt, Homo sapiens
agaggaugcugcccaggaa

SEQ ID NO: 795827 - RNA, 19 nt, Homo sapiens
gaacauccugaacagaauc

SEQ ID NO: 795828 - RNA, 19 nt, Homo sapiens
cagcagagacgagaaguuc

SEQ ID NO: 795829 - RNA, 19 nt, Homo sapiens
ccaucaagcaguacuaugu

SEQ ID NO: 795830 - RNA, 19 nt, Homo sapiens
ggaaguuugcccagaaagu

SEQ ID NO: 795831 - RNA, 19 nt, Homo sapiens
gauccaaacuccccucugu

SEQ ID NO: 795832 - RNA, 19 nt, Homo sapiens
cuuggaagauuaggcauga

SEQ ID NO: 795833 - RNA, 19 nt, Homo sapiens
ccagguggcucugcugagu

SEQ ID NO: 795834 - RNA, 19 nt, Homo sapiens
ccaagaaaaucaagguguu

SEQ ID NO: 795835 - RNA, 19 nt, Homo sapiens
uugaacaaaugggcaaauu

SEQ ID NO: 795836 - RNA, 19 nt, Homo sapiens
aaagauuggacacagauga

SEQ ID NO: 795837 - RNA, 19 nt, Homo sapiens
uguggaaguuugcccagaa

SEQ ID NO: 795838 - RNA, 19 nt, Homo sapiens
aaucaaaccagauaccaau

SEQ ID NO: 795839 - RNA, 19 nt, Homo sapiens
gaaagauuggacacagaug

SEQ ID NO: 795840 - RNA, 19 nt, Homo sapiens
gcaagcacagcaugaacau

SEQ ID NO: 795841 - RNA, 19 nt, Homo sapiens
acgggaauccugacaauga

SEQ ID NO: 795842 - RNA, 19 nt, Homo sapiens
gacagaugaagaagagaaa

SEQ ID NO: 795843 - RNA, 19 nt, Homo sapiens
aaaucaagguguuuguucu

SEQ ID NO: 795844 - RNA, 19 nt, Homo sapiens
gcuguucgaggcaauaaau

SEQ ID NO: 795845 - RNA, 19 nt, Homo sapiens
cagaugaagaagagaaaga

SEQ ID NO: 795846 - RNA, 19 nt, Homo sapiens
aaguagaaccugcaaacaa

SEQ ID NO: 795847 - RNA, 19 nt, Homo sapiens
gagucuaugccauggguuu

SEQ ID NO: 795848 - RNA, 19 nt, Homo sapiens
agacagaugaagaagagaa

SEQ ID NO: 795849 - RNA, 19 nt, Homo sapiens
acagaauccaggagcauuu

SEQ ID NO: 795850 - RNA, 19 nt, Homo sapiens
ugaacaugguggacagcaa

SEQ ID NO: 795851 - RNA, 19 nt, Homo sapiens
ccacucagggccaccaaga

SEQ ID NO: 795852 - RNA, 19 nt, Homo sapiens
ccaaguagaaccugcaaac

SEQ ID NO: 795853 - RNA, 19 nt, Homo sapiens
ccaaugcagagaagacaga

SEQ ID NO: 795854 - RNA, 19 nt, Homo sapiens
gcagagaagacagaugaag

SEQ ID NO: 795855 - RNA, 19 nt, Homo sapiens
ccaaugccaaugcagagaa

SEQ ID NO: 795856 - RNA, 19 nt, Homo sapiens
gaggccagaagaucaguga

SEQ ID NO: 795857 - RNA, 19 nt, Homo sapiens
uaccucacuucaaauuaug

SEQ ID NO: 795858 - RNA, 19 nt, Homo sapiens
gcagagacgagaaguucca

SEQ ID NO: 795859 - RNA, 19 nt, Homo sapiens
gcagcagagacgagaaguu

SEQ ID NO: 795860 - RNA, 19 nt, Homo sapiens
caaacugaagcgugaggaa

SEQ ID NO: 795861 - RNA, 19 nt, Homo sapiens
aggcaugaauacacagaga

SEQ ID NO: 795862 - RNA, 19 nt, Homo sapiens
gauagaaagauuggacaca

SEQ ID NO: 795863 - RNA, 19 nt, Homo sapiens
gacagcaagcacagcauga

SEQ ID NO: 795864 - RNA, 19 nt, Homo sapiens
caaucguccauccaagaua

SEQ ID NO: 795865 - RNA, 19 nt, Homo sapiens
acacaaaccaaguggaagu

SEQ ID NO: 795866 - RNA, 19 nt, Homo sapiens
uuacacaaccuuggaagau

SEQ ID NO: 795867 - RNA, 19 nt, Homo sapiens
caaugccaaugcagagaag

SEQ ID NO: 795868 - RNA, 19 nt, Homo sapiens
guagaaccugcaaacaaau

SEQ ID NO: 795869 - RNA, 19 nt, Homo sapiens
aaucguccauccaagauac

SEQ ID NO: 795870 - RNA, 19 nt, Homo sapiens
caugaauacacagagauuu

SEQ ID NO: 795871 - RNA, 19 nt, Homo sapiens
gcucaagccaugaucuucu

SEQ ID NO: 795872 - RNA, 19 nt, Homo sapiens
augcagagaagacagauga

SEQ ID NO: 795873 - RNA, 19 nt, Homo sapiens
gcucuuaacucgaugacuu

SEQ ID NO: 795874 - RNA, 19 nt, Homo sapiens
ggaagaugcucugcaggaa

SEQ ID NO: 795875 - RNA, 19 nt, Homo sapiens
gaggagcucacucugguua

SEQ ID NO: 795876 - RNA, 19 nt, Homo sapiens
gggcccagcuacaaagaaa

SEQ ID NO: 795877 - RNA, 19 nt, Homo sapiens
ccaaauccauggacugaag

SEQ ID NO: 795878 - RNA, 19 nt, Homo sapiens
uagcauccuucucgucuuu

SEQ ID NO: 795879 - RNA, 19 nt, Homo sapiens
gaagaugcucugcaggaaa

SEQ ID NO: 795880 - RNA, 19 nt, Homo sapiens
gggauucuccugcucuuaa

SEQ ID NO: 795881 - RNA, 19 nt, Homo sapiens
uacccuaaauucugaguuu

SEQ ID NO: 795882 - RNA, 19 nt, Homo sapiens
cuucagaggucacuguaug

SEQ ID NO: 795883 - RNA, 19 nt, Homo sapiens
ggacaucccgguacuuugg

SEQ ID NO: 795884 - RNA, 19 nt, Homo sapiens
ugacuaugcugagcucaug

SEQ ID NO: 795885 - RNA, 19 nt, Homo sapiens
ccaaaggcccuguguugug

SEQ ID NO: 795886 - RNA, 19 nt, Homo sapiens
cugcugcccucgccucuuu

SEQ ID NO: 795887 - RNA, 19 nt, Homo sapiens
ccucauggcagcugaaaga

SEQ ID NO: 795888 - RNA, 19 nt, Homo sapiens
ggagaugccccuucuacua

SEQ ID NO: 795889 - RNA, 19 nt, Homo sapiens
gaacuccaagguccacuuc

SEQ ID NO: 795890 - RNA, 19 nt, Homo sapiens
gcauccuucucgucuuuga

SEQ ID NO: 795891 - RNA, 19 nt, Homo sapiens
ggagcucacucugguuaca

SEQ ID NO: 795892 - RNA, 19 nt, Homo sapiens
guguggagcugcugacagu

SEQ ID NO: 795893 - RNA, 19 nt, Homo sapiens
ucaacagccuccugagaag

SEQ ID NO: 795894 - RNA, 19 nt, Homo sapiens
uccauacccuaaauucuga

SEQ ID NO: 795895 - RNA, 19 nt, Homo sapiens
gcuccugcuucuauuuguu

SEQ ID NO: 795896 - RNA, 19 nt, Homo sapiens
ucuacuacuugagacuuua

SEQ ID NO: 795897 - RNA, 19 nt, Homo sapiens
gcccaaauccauggacuga

SEQ ID NO: 795898 - RNA, 19 nt, Homo sapiens
ucacgggcuugaucagcaa

SEQ ID NO: 795899 - RNA, 19 nt, Homo sapiens
gcauggacaucccgguacu

SEQ ID NO: 795900 - RNA, 19 nt, Homo sapiens
ccagcuccauacccuaaau

SEQ ID NO: 795901 - RNA, 19 nt, Homo sapiens
ccacugaauucuaaauccu

SEQ ID NO: 795902 - RNA, 19 nt, Homo sapiens
gaccgucuccuccuugcuu

SEQ ID NO: 795903 - RNA, 19 nt, Homo sapiens
ucuccuggcuccucaucuu

SEQ ID NO: 795904 - RNA, 19 nt, Homo sapiens
guuacaagcccuguucuuc

SEQ ID NO: 795905 - RNA, 19 nt, Homo sapiens
guggaguucgugcgcuuua

SEQ ID NO: 795906 - RNA, 19 nt, Homo sapiens
gcaccggaguggaguucgu

SEQ ID NO: 795907 - RNA, 19 nt, Homo sapiens
gcucaugggccucaaacag

SEQ ID NO: 795908 - RNA, 19 nt, Homo sapiens
guccagcuccauacccuaa

SEQ ID NO: 795909 - RNA, 19 nt, Homo sapiens
gggcuccugcuucuauuug

SEQ ID NO: 795910 - RNA, 19 nt, Homo sapiens
cuccuugcuuuccuccuua

SEQ ID NO: 795911 - RNA, 19 nt, Homo sapiens
ccuccuugcuuuccuccuu

SEQ ID NO: 795912 - RNA, 19 nt, Homo sapiens
ucuaaauccuuaacaucca

SEQ ID NO: 795913 - RNA, 19 nt, Homo sapiens
aagaugcucugcaggaaaa

SEQ ID NO: 795914 - RNA, 19 nt, Homo sapiens
ucccugcucucccgaggaa

SEQ ID NO: 795915 - RNA, 19 nt, Homo sapiens
ggauucuccugcucuuaac

SEQ ID NO: 795916 - RNA, 19 nt, Homo sapiens
ucugucccuucacuguuua

SEQ ID NO: 795917 - RNA, 19 nt, Homo sapiens
acccaaaggcccuguguug

SEQ ID NO: 795918 - RNA, 19 nt, Homo sapiens
ccucaucuuuagcauccuu

SEQ ID NO: 795919 - RNA, 19 nt, Homo sapiens
uccauggacugaaggagau

SEQ ID NO: 795920 - RNA, 19 nt, Homo sapiens
ccucaaacagguauacuac

SEQ ID NO: 795921 - RNA, 19 nt, Homo sapiens
ggguauggaagucaucugu

SEQ ID NO: 795922 - RNA, 19 nt, Homo sapiens
gaaagagugaaggcaugga

SEQ ID NO: 795923 - RNA, 19 nt, Homo sapiens
gccagaggcccaaauccau

SEQ ID NO: 795924 - RNA, 19 nt, Homo sapiens
gccucaaacagguauacua

SEQ ID NO: 795925 - RNA, 19 nt, Homo sapiens
guccacuucucaccagcaa

SEQ ID NO: 795926 - RNA, 19 nt, Homo sapiens
gaaauaauguggucauaac

SEQ ID NO: 795927 - RNA, 19 nt, Homo sapiens
gcaggaagcaucaucauuc

SEQ ID NO: 795928 - RNA, 19 nt, Homo sapiens
ccagagaccuccuccugaa

SEQ ID NO: 795929 - RNA, 19 nt, Homo sapiens
agacuuuacuuucaccaua

SEQ ID NO: 795930 - RNA, 19 nt, Homo sapiens
gccaugacauugaaauaau

SEQ ID NO: 795931 - RNA, 19 nt, Homo sapiens
agaaagccaugacauugaa

SEQ ID NO: 795932 - RNA, 19 nt, Homo sapiens
ugugaacuaugaagacuuu

SEQ ID NO: 795933 - RNA, 19 nt, Homo sapiens
ggacagaccagcaagacau

SEQ ID NO: 795934 - RNA, 19 nt, Homo sapiens
cagaaagccaugacauuga

SEQ ID NO: 795935 - RNA, 19 nt, Homo sapiens
cagauaaugaugugaacua

SEQ ID NO: 795936 - RNA, 19 nt, Homo sapiens
ucagaaagccaugacauug

SEQ ID NO: 795937 - RNA, 19 nt, Homo sapiens
aagauaacuuccuucagaa

SEQ ID NO: 795938 - RNA, 19 nt, Homo sapiens
ccacucugguaaucuagaa

SEQ ID NO: 795939 - RNA, 19 nt, Homo sapiens
gaacuaugaagacuuuacu

SEQ ID NO: 795940 - RNA, 19 nt, Homo sapiens
gaugugaacuaugaagacu

SEQ ID NO: 795941 - RNA, 19 nt, Homo sapiens
gaaagccaugacauugaaa

SEQ ID NO: 795942 - RNA, 19 nt, Homo sapiens
caggaagcaucaucauucu

SEQ ID NO: 795943 - RNA, 19 nt, Homo sapiens
gauaacuuccuucagaaag

SEQ ID NO: 795944 - RNA, 19 nt, Homo sapiens
gauaaugaugugaacuaug

SEQ ID NO: 795945 - RNA, 19 nt, Homo sapiens
aauguggucauaacucuuu

SEQ ID NO: 795946 - RNA, 19 nt, Homo sapiens
gacuuuacuuucaccauac

SEQ ID NO: 795947 - RNA, 19 nt, Homo sapiens
cuaugaagacuuuacuuuc

SEQ ID NO: 795948 - RNA, 19 nt, Homo sapiens
ucagagcacagauaaugau

SEQ ID NO: 795949 - RNA, 19 nt, Homo sapiens
caagucagagaccagauca

SEQ ID NO: 795950 - RNA, 19 nt, Homo sapiens
caccauaccagauguagag

SEQ ID NO: 795951 - RNA, 19 nt, Homo sapiens
auaauguggucauaacucu

SEQ ID NO: 795952 - RNA, 19 nt, Homo sapiens
agaauucaguggcagaaaa

SEQ ID NO: 795953 - RNA, 19 nt, Homo sapiens
aagccaugacauugaaaua

SEQ ID NO: 795954 - RNA, 19 nt, Homo sapiens
cgaggacaccgucaacucu

SEQ ID NO: 795955 - RNA, 19 nt, Homo sapiens
agccaugacauugaaauaa

SEQ ID NO: 795956 - RNA, 19 nt, Homo sapiens
agauaacuuccuucagaaa

SEQ ID NO: 795957 - RNA, 19 nt, Homo sapiens
caacgaggacaccgucaac

SEQ ID NO: 795958 - RNA, 19 nt, Homo sapiens
gagggacagaccagcaaga

SEQ ID NO: 795959 - RNA, 19 nt, Homo sapiens
gugaauaaauccaccagua

SEQ ID NO: 795960 - RNA, 19 nt, Homo sapiens
gaggauggcuggacaagga

SEQ ID NO: 795961 - RNA, 19 nt, Homo sapiens
gccaugaacucgaaaguga

SEQ ID NO: 795962 - RNA, 19 nt, Homo sapiens
ccaguuggcucgagagauu

SEQ ID NO: 795963 - RNA, 19 nt, Homo sapiens
gaaggcgucuacaacaauu

SEQ ID NO: 795964 - RNA, 19 nt, Homo sapiens
gaaaggagaaagagguuga

SEQ ID NO: 795965 - RNA, 19 nt, Homo sapiens
gaaagucccuggucuucag

SEQ ID NO: 795966 - RNA, 19 nt, Homo sapiens
gaggagaacuacgguguga

SEQ ID NO: 795967 - RNA, 19 nt, Homo sapiens
gcaccugucugugaaguau

SEQ ID NO: 795968 - RNA, 19 nt, Homo sapiens
gggcuccacuugugaugua

SEQ ID NO: 795969 - RNA, 19 nt, Homo sapiens
gacggaagaucuuuuauuu

SEQ ID NO: 795970 - RNA, 19 nt, Homo sapiens
ccgacugucuccugacuua

SEQ ID NO: 795971 - RNA, 19 nt, Homo sapiens
gcaggcaccucagauguau

SEQ ID NO: 795972 - RNA, 19 nt, Homo sapiens
caccucagauguauccaua

SEQ ID NO: 795973 - RNA, 19 nt, Homo sapiens
caaagccucugcugucugu

SEQ ID NO: 795974 - RNA, 19 nt, Homo sapiens
uaaaagaacucucuaccaa

SEQ ID NO: 795975 - RNA, 19 nt, Homo sapiens
ggacaaggacuuuuacuuu

SEQ ID NO: 795976 - RNA, 19 nt, Homo sapiens
auagcagucuuucuucuua

SEQ ID NO: 795977 - RNA, 19 nt, Homo sapiens
uaacuugagugaccugugu

SEQ ID NO: 795978 - RNA, 19 nt, Homo sapiens
aaagacaaguucaccgauu

SEQ ID NO: 795979 - RNA, 19 nt, Homo sapiens
ggaguucaauccuacaaag

SEQ ID NO: 795980 - RNA, 19 nt, Homo sapiens
gacaaggacuuuuacuuuu

SEQ ID NO: 795981 - RNA, 19 nt, Homo sapiens
gagcugggcacaugaguga

SEQ ID NO: 795982 - RNA, 19 nt, Homo sapiens
gaacuacggugugaagacu

SEQ ID NO: 795983 - RNA, 19 nt, Homo sapiens
ucaagacgcuaagcucaaa

SEQ ID NO: 795984 - RNA, 19 nt, Homo sapiens
acuaugaccucgagucuga

SEQ ID NO: 795985 - RNA, 19 nt, Homo sapiens
agaacagccuggauccuuu

SEQ ID NO: 795986 - RNA, 19 nt, Homo sapiens
caacuaugcuacuaaagac

SEQ ID NO: 795987 - RNA, 19 nt, Homo sapiens
ggacagagcacaggaaagg

SEQ ID NO: 795988 - RNA, 19 nt, Homo sapiens
gcuccuggcucuguccuuu

SEQ ID NO: 795989 - RNA, 19 nt, Homo sapiens
gaaauguucaaguucaaug

SEQ ID NO: 795990 - RNA, 19 nt, Homo sapiens
guucaccgauucagccauu

SEQ ID NO: 795991 - RNA, 19 nt, Homo sapiens
ugacaggauucgugaguuc

SEQ ID NO: 795992 - RNA, 19 nt, Homo sapiens
cuacaacccucagcaguuc

SEQ ID NO: 795993 - RNA, 19 nt, Homo sapiens
caagggagaagacaaagau

SEQ ID NO: 795994 - RNA, 19 nt, Homo sapiens
ggagaaagagguugauggu

SEQ ID NO: 795995 - RNA, 19 nt, Homo sapiens
ccaaaggaaaggagaaaga

SEQ ID NO: 795996 - RNA, 19 nt, Homo sapiens
gagaacagccuggauccuu

SEQ ID NO: 795997 - RNA, 19 nt, Homo sapiens
ucccuggucuucagaauga

SEQ ID NO: 795998 - RNA, 19 nt, Homo sapiens
gugaagacuaccuaugaua

SEQ ID NO: 795999 - RNA, 19 nt, Homo sapiens
ucaacuaugcuacuaaaga

SEQ ID NO: 796000 - RNA, 19 nt, Homo sapiens
cggaagaucuuuuauuuuc

SEQ ID NO: 796001 - RNA, 19 nt, Homo sapiens
gagugagggcucuggcuua

SEQ ID NO: 796002 - RNA, 19 nt, Homo sapiens
gaccugcaccugucuguga

SEQ ID NO: 796003 - RNA, 19 nt, Homo sapiens
caucaagggagaagacaaa

SEQ ID NO: 796004 - RNA, 19 nt, Homo sapiens
agaaugaacagaaacgauu

SEQ ID NO: 796005 - RNA, 19 nt, Homo sapiens
gcaacagcgacgacuauga

SEQ ID NO: 796006 - RNA, 19 nt, Homo sapiens
cuucaacuaugcuacuaaa

SEQ ID NO: 796007 - RNA, 19 nt, Homo sapiens
guucuuucuuucccauuaa

SEQ ID NO: 796008 - RNA, 19 nt, Homo sapiens
gcacugaagaggagaagca

SEQ ID NO: 796009 - RNA, 19 nt, Homo sapiens
uaugauagcagucuuucuu

SEQ ID NO: 796010 - RNA, 19 nt, Homo sapiens
uaagccaagugaugucaug

SEQ ID NO: 796011 - RNA, 19 nt, Homo sapiens
cuccugcucucuucucuuu

SEQ ID NO: 796012 - RNA, 19 nt, Homo sapiens
ccucagauguauccauauc

SEQ ID NO: 796013 - RNA, 19 nt, Homo sapiens
ccucugcugucugugaaua

SEQ ID NO: 796014 - RNA, 19 nt, Homo sapiens
caaggaaccugggagaacu

SEQ ID NO: 796015 - RNA, 19 nt, Homo sapiens
ggacgcugccaucauguug

SEQ ID NO: 796016 - RNA, 19 nt, Homo sapiens
gugugaagacuaccuauga

SEQ ID NO: 796017 - RNA, 19 nt, Homo sapiens
gccaagugaugucaugcuu

SEQ ID NO: 796018 - RNA, 19 nt, Homo sapiens
caguacaucuccuacauac

SEQ ID NO: 796019 - RNA, 19 nt, Homo sapiens
ccaguacaucuccuacaua

SEQ ID NO: 796020 - RNA, 19 nt, Homo sapiens
ugagggcccuguugcugaa

SEQ ID NO: 796021 - RNA, 19 nt, Homo sapiens
gauagcagucuuucuucuu

SEQ ID NO: 796022 - RNA, 19 nt, Homo sapiens
gacgcuaagcucaaaguuu

SEQ ID NO: 796023 - RNA, 19 nt, Homo sapiens
ugagggcucuggcuuacug

SEQ ID NO: 796024 - RNA, 19 nt, Homo sapiens
agagguugauggucuguug

SEQ ID NO: 796025 - RNA, 19 nt, Homo sapiens
ggagaacuacggugugaag

SEQ ID NO: 796026 - RNA, 19 nt, Homo sapiens
ccauugccaugaacucgaa

SEQ ID NO: 796027 - RNA, 19 nt, Homo sapiens
cuuguucacuuccgaaaug

SEQ ID NO: 796028 - RNA, 19 nt, Homo sapiens
ggagacggaagaucuuuua

SEQ ID NO: 796029 - RNA, 19 nt, Homo sapiens
gagggaagagugaucuaug

SEQ ID NO: 796030 - RNA, 19 nt, Homo sapiens
cauauccuguauccaauuc

SEQ ID NO: 796031 - RNA, 19 nt, Homo sapiens
agaacucucuaccaaggaa

SEQ ID NO: 796032 - RNA, 19 nt, Homo sapiens
ggacagccacagcagaauc

SEQ ID NO: 796033 - RNA, 19 nt, Homo sapiens
guacaucuccuacauaccu

SEQ ID NO: 796034 - RNA, 19 nt, Homo sapiens
ucggauagcugggaaaguc

SEQ ID NO: 796035 - RNA, 19 nt, Homo sapiens
cguccucgcucaguuguga

SEQ ID NO: 796036 - RNA, 19 nt, Homo sapiens
ccugugaccucaucagucu

SEQ ID NO: 796037 - RNA, 19 nt, Homo sapiens
cuuauacggugcccuuaga

SEQ ID NO: 796038 - RNA, 19 nt, Homo sapiens
aagacaaguucaccgauuc

SEQ ID NO: 796039 - RNA, 19 nt, Homo sapiens
gacuucaacuaugcuacua

SEQ ID NO: 796040 - RNA, 19 nt, Homo sapiens
uguucuuucuuucccauua

SEQ ID NO: 796041 - RNA, 19 nt, Homo sapiens
cccauccucucaucuauuc

SEQ ID NO: 796042 - RNA, 19 nt, Homo sapiens
gacagcugcuuggguucua

SEQ ID NO: 796043 - RNA, 19 nt, Homo sapiens
gcccuauucuuccuacauc

SEQ ID NO: 796044 - RNA, 19 nt, Homo sapiens
uaaaggaggagcccaaagg

SEQ ID NO: 796045 - RNA, 19 nt, Homo sapiens
caacagcgacgacuaugac

SEQ ID NO: 796046 - RNA, 19 nt, Homo sapiens
cagcaacagcgacgacuau

SEQ ID NO: 796047 - RNA, 19 nt, Homo sapiens
ggaagagugaucuaugucu

SEQ ID NO: 796048 - RNA, 19 nt, Homo sapiens
ggagggaagagugaucuau

SEQ ID NO: 796049 - RNA, 19 nt, Homo sapiens
gauguauccauauccugua

SEQ ID NO: 796050 - RNA, 19 nt, Homo sapiens
uugauggucuguugacuuc

SEQ ID NO: 796051 - RNA, 19 nt, Homo sapiens
aggaggagcccaaaggaaa

SEQ ID NO: 796052 - RNA, 19 nt, Homo sapiens
ggaaagucccuggucuuca

SEQ ID NO: 796053 - RNA, 19 nt, Homo sapiens
guauaucccucugccucaa

SEQ ID NO: 796054 - RNA, 19 nt, Homo sapiens
cguugaacccuaaugcuaa

SEQ ID NO: 796055 - RNA, 19 nt, Homo sapiens
cugaacaaguaaagaaauc

SEQ ID NO: 796056 - RNA, 19 nt, Homo sapiens
ugucaugcuuguucacuuc

SEQ ID NO: 796057 - RNA, 19 nt, Homo sapiens
gcucuggcuuacugggaaa

SEQ ID NO: 796058 - RNA, 19 nt, Homo sapiens
gaugacaggauucgugagu

SEQ ID NO: 796059 - RNA, 19 nt, Homo sapiens
gaggauggcuggacaagga

SEQ ID NO: 796060 - RNA, 19 nt, Homo sapiens
gccaugaacucgaaaguga

SEQ ID NO: 796061 - RNA, 19 nt, Homo sapiens
ccaguuggcucgagagauu

SEQ ID NO: 796062 - RNA, 19 nt, Homo sapiens
gaaggcgucuacaacaauu

SEQ ID NO: 796063 - RNA, 19 nt, Homo sapiens
gaggagaacuacgguguga

SEQ ID NO: 796064 - RNA, 19 nt, Homo sapiens
gggcuccacuugugaugua

SEQ ID NO: 796065 - RNA, 19 nt, Homo sapiens
gacggaagaucuuuuauuu

SEQ ID NO: 796066 - RNA, 19 nt, Homo sapiens
ggacaaggacuuuuacuuu

SEQ ID NO: 796067 - RNA, 19 nt, Homo sapiens
auagcagucuuucuucuua

SEQ ID NO: 796068 - RNA, 19 nt, Homo sapiens
uaacuugagugaccugugu

SEQ ID NO: 796069 - RNA, 19 nt, Homo sapiens
aaagacaaguucaccgauu

SEQ ID NO: 796070 - RNA, 19 nt, Homo sapiens
gacaaggacuuuuacuuuu

SEQ ID NO: 796071 - RNA, 19 nt, Homo sapiens
gaacuacggugugaagacu

SEQ ID NO: 796072 - RNA, 19 nt, Homo sapiens
ucaagacgcuaagcucaaa

SEQ ID NO: 796073 - RNA, 19 nt, Homo sapiens
acuaugaccucgagucuga

SEQ ID NO: 796074 - RNA, 19 nt, Homo sapiens
caacuaugcuacuaaagac

SEQ ID NO: 796075 - RNA, 19 nt, Homo sapiens
ggacagagcacaggaaagg

SEQ ID NO: 796076 - RNA, 19 nt, Homo sapiens
gaaauguucaaguucaaug

SEQ ID NO: 796077 - RNA, 19 nt, Homo sapiens
guucaccgauucagccauu

SEQ ID NO: 796078 - RNA, 19 nt, Homo sapiens
gugaagacuaccuaugaua

SEQ ID NO: 796079 - RNA, 19 nt, Homo sapiens
ucaacuaugcuacuaaaga

SEQ ID NO: 796080 - RNA, 19 nt, Homo sapiens
cggaagaucuuuuauuuuc

SEQ ID NO: 796081 - RNA, 19 nt, Homo sapiens
gcaacagcgacgacuauga

SEQ ID NO: 796082 - RNA, 19 nt, Homo sapiens
cuucaacuaugcuacuaaa

SEQ ID NO: 796083 - RNA, 19 nt, Homo sapiens
guucuuucuuucccauuaa

SEQ ID NO: 796084 - RNA, 19 nt, Homo sapiens
gcacugaagaggagaagca

SEQ ID NO: 796085 - RNA, 19 nt, Homo sapiens
uaugauagcagucuuucuu

SEQ ID NO: 796086 - RNA, 19 nt, Homo sapiens
uaagccaagugaugucaug

SEQ ID NO: 796087 - RNA, 19 nt, Homo sapiens
gugugaagacuaccuauga

SEQ ID NO: 796088 - RNA, 19 nt, Homo sapiens
ggacgcugccaucauguug

SEQ ID NO: 796089 - RNA, 19 nt, Homo sapiens
gccaagugaugucaugcuu

SEQ ID NO: 796090 - RNA, 19 nt, Homo sapiens
gauagcagucuuucuucuu

SEQ ID NO: 796091 - RNA, 19 nt, Homo sapiens
gacgcuaagcucaaaguuu

SEQ ID NO: 796092 - RNA, 19 nt, Homo sapiens
ggagaacuacggugugaag

SEQ ID NO: 796093 - RNA, 19 nt, Homo sapiens
ccauugccaugaacucgaa

SEQ ID NO: 796094 - RNA, 19 nt, Homo sapiens
cuuguucacuuccgaaaug

SEQ ID NO: 796095 - RNA, 19 nt, Homo sapiens
ggagacggaagaucuuuua

SEQ ID NO: 796096 - RNA, 19 nt, Homo sapiens
cuuauacggugcccuuaga

SEQ ID NO: 796097 - RNA, 19 nt, Homo sapiens
aagacaaguucaccgauuc

SEQ ID NO: 796098 - RNA, 19 nt, Homo sapiens
gacuucaacuaugcuacua

SEQ ID NO: 796099 - RNA, 19 nt, Homo sapiens
uguucuuucuuucccauua

SEQ ID NO: 796100 - RNA, 19 nt, Homo sapiens
cccauccucucaucuauuc

SEQ ID NO: 796101 - RNA, 19 nt, Homo sapiens
caacagcgacgacuaugac

SEQ ID NO: 796102 - RNA, 19 nt, Homo sapiens
cagcaacagcgacgacuau

SEQ ID NO: 796103 - RNA, 19 nt, Homo sapiens
ugucaugcuuguucacuuc

SEQ ID NO: 796104 - RNA, 19 nt, Homo sapiens
agucugacauguccaaugg

SEQ ID NO: 796105 - RNA, 19 nt, Homo sapiens
ggaucgccauggagaacga

SEQ ID NO: 796106 - RNA, 19 nt, Homo sapiens
uugaaggcgucuacaacaa

SEQ ID NO: 796107 - RNA, 19 nt, Homo sapiens
agcagucuuucuucuuaua

SEQ ID NO: 796108 - RNA, 19 nt, Homo sapiens
uagcagucuuucuucuuau

SEQ ID NO: 796109 - RNA, 19 nt, Homo sapiens
cuuccgaaauguugacuuc

SEQ ID NO: 796110 - RNA, 19 nt, Homo sapiens
guucacuuccgaaauguug

SEQ ID NO: 796111 - RNA, 19 nt, Homo sapiens
gcauuuccuuacagcuguu

SEQ ID NO: 796112 - RNA, 19 nt, Homo sapiens
cucccucccuucucucuaa

SEQ ID NO: 796113 - RNA, 19 nt, Homo sapiens
ugaaggcgucuacaacaau

SEQ ID NO: 796114 - RNA, 19 nt, Homo sapiens
ugugaagacuaccuaugau

SEQ ID NO: 796115 - RNA, 19 nt, Homo sapiens
ugauagcagucuuucuucu

SEQ ID NO: 796116 - RNA, 19 nt, Homo sapiens
acgcugccaucauguugaa

SEQ ID NO: 796117 - RNA, 19 nt, Homo sapiens
gugaugucaugcuuguuca

SEQ ID NO: 796118 - RNA, 19 nt, Homo sapiens
aaaaugguaccacuuauga

SEQ ID NO: 796119 - RNA, 19 nt, Homo sapiens
uccggacgcugccaucaug

SEQ ID NO: 796120 - RNA, 19 nt, Homo sapiens
gaaaaggacaacucagaag

SEQ ID NO: 796121 - RNA, 19 nt, Homo sapiens
ccucccuucucucuaauuc

SEQ ID NO: 796122 - RNA, 19 nt, Homo sapiens
gggagccgaaggcaucuug

SEQ ID NO: 796123 - RNA, 19 nt, Homo sapiens
gacgaugggcgcacugaag

SEQ ID NO: 796124 - RNA, 19 nt, Homo sapiens
caugaacucgaaagugaau

SEQ ID NO: 796125 - RNA, 19 nt, Homo sapiens
ugugagagacagacagaug

SEQ ID NO: 796126 - RNA, 19 nt, Homo sapiens
ggaccccaaugaaauguuc

SEQ ID NO: 796127 - RNA, 19 nt, Homo sapiens
gaccucgagucugacaugu

SEQ ID NO: 796128 - RNA, 19 nt, Homo sapiens
ccacuugugauguaaaggu

SEQ ID NO: 796129 - RNA, 19 nt, Homo sapiens
ccucccauccucucaucua

SEQ ID NO: 796130 - RNA, 19 nt, Homo sapiens
uauacggugcccuuagaaa

SEQ ID NO: 796131 - RNA, 19 nt, Homo sapiens
ggugugaagacuaccuaug

SEQ ID NO: 796132 - RNA, 19 nt, Homo sapiens
gugaauaaauccaccagua

SEQ ID NO: 796133 - RNA, 19 nt, Homo sapiens
gaggauggcuggacaagga

SEQ ID NO: 796134 - RNA, 19 nt, Homo sapiens
gccaugaacucgaaaguga

SEQ ID NO: 796135 - RNA, 19 nt, Homo sapiens
ccaguuggcucgagagauu

SEQ ID NO: 796136 - RNA, 19 nt, Homo sapiens
gaaggcgucuacaacaauu

SEQ ID NO: 796137 - RNA, 19 nt, Homo sapiens
gaaaggagaaagagguuga

SEQ ID NO: 796138 - RNA, 19 nt, Homo sapiens
gaaagucccuggucuucag

SEQ ID NO: 796139 - RNA, 19 nt, Homo sapiens
gaggagaacuacgguguga

SEQ ID NO: 796140 - RNA, 19 nt, Homo sapiens
gggcuccacuugugaugua

SEQ ID NO: 796141 - RNA, 19 nt, Homo sapiens
gacggaagaucuuuuauuu

SEQ ID NO: 796142 - RNA, 19 nt, Homo sapiens
gcaggcaccucagauguau

SEQ ID NO: 796143 - RNA, 19 nt, Homo sapiens
caccucagauguauccaua

SEQ ID NO: 796144 - RNA, 19 nt, Homo sapiens
caaagccucugcugucugu

SEQ ID NO: 796145 - RNA, 19 nt, Homo sapiens
uaaaagaacucucuaccaa

SEQ ID NO: 796146 - RNA, 19 nt, Homo sapiens
ggacaaggacuuuuacuuu

SEQ ID NO: 796147 - RNA, 19 nt, Homo sapiens
auagcagucuuucuucuua

SEQ ID NO: 796148 - RNA, 19 nt, Homo sapiens
uaacuugagugaccugugu

SEQ ID NO: 796149 - RNA, 19 nt, Homo sapiens
aaagacaaguucaccgauu

SEQ ID NO: 796150 - RNA, 19 nt, Homo sapiens
ggaguucaauccuacaaag

SEQ ID NO: 796151 - RNA, 19 nt, Homo sapiens
gacaaggacuuuuacuuuu

SEQ ID NO: 796152 - RNA, 19 nt, Homo sapiens
gaacuacggugugaagacu

SEQ ID NO: 796153 - RNA, 19 nt, Homo sapiens
ucaagacgcuaagcucaaa

SEQ ID NO: 796154 - RNA, 19 nt, Homo sapiens
acuaugaccucgagucuga

SEQ ID NO: 796155 - RNA, 19 nt, Homo sapiens
agaacagccuggauccuuu

SEQ ID NO: 796156 - RNA, 19 nt, Homo sapiens
caacuaugcuacuaaagac

SEQ ID NO: 796157 - RNA, 19 nt, Homo sapiens
ggacagagcacaggaaagg

SEQ ID NO: 796158 - RNA, 19 nt, Homo sapiens
gaaauguucaaguucaaug

SEQ ID NO: 796159 - RNA, 19 nt, Homo sapiens
guucaccgauucagccauu

SEQ ID NO: 796160 - RNA, 19 nt, Homo sapiens
cuacaacccucagcaguuc

SEQ ID NO: 796161 - RNA, 19 nt, Homo sapiens
caagggagaagacaaagau

SEQ ID NO: 796162 - RNA, 19 nt, Homo sapiens
ggagaaagagguugauggu

SEQ ID NO: 796163 - RNA, 19 nt, Homo sapiens
ccaaaggaaaggagaaaga

SEQ ID NO: 796164 - RNA, 19 nt, Homo sapiens
gagaacagccuggauccuu

SEQ ID NO: 796165 - RNA, 19 nt, Homo sapiens
ucccuggucuucagaauga

SEQ ID NO: 796166 - RNA, 19 nt, Homo sapiens
gugaagacuaccuaugaua

SEQ ID NO: 796167 - RNA, 19 nt, Homo sapiens
ucaacuaugcuacuaaaga

SEQ ID NO: 796168 - RNA, 19 nt, Homo sapiens
cggaagaucuuuuauuuuc

SEQ ID NO: 796169 - RNA, 19 nt, Homo sapiens
caucaagggagaagacaaa

SEQ ID NO: 796170 - RNA, 19 nt, Homo sapiens
agaaugaacagaaacgauu

SEQ ID NO: 796171 - RNA, 19 nt, Homo sapiens
gcaacagcgacgacuauga

SEQ ID NO: 796172 - RNA, 19 nt, Homo sapiens
cuucaacuaugcuacuaaa

SEQ ID NO: 796173 - RNA, 19 nt, Homo sapiens
guucuuucuuucccauuaa

SEQ ID NO: 796174 - RNA, 19 nt, Homo sapiens
gcacugaagaggagaagca

SEQ ID NO: 796175 - RNA, 19 nt, Homo sapiens
uaugauagcagucuuucuu

SEQ ID NO: 796176 - RNA, 19 nt, Homo sapiens
uaagccaagugaugucaug

SEQ ID NO: 796177 - RNA, 19 nt, Homo sapiens
ccucagauguauccauauc

SEQ ID NO: 796178 - RNA, 19 nt, Homo sapiens
ccucugcugucugugaaua

SEQ ID NO: 796179 - RNA, 19 nt, Homo sapiens
caaggaaccugggagaacu

SEQ ID NO: 796180 - RNA, 19 nt, Homo sapiens
ggacgcugccaucauguug

SEQ ID NO: 796181 - RNA, 19 nt, Homo sapiens
gugugaagacuaccuauga

SEQ ID NO: 796182 - RNA, 19 nt, Homo sapiens
gccaagugaugucaugcuu

SEQ ID NO: 796183 - RNA, 19 nt, Homo sapiens
caguacaucuccuacauac

SEQ ID NO: 796184 - RNA, 19 nt, Homo sapiens
ccaguacaucuccuacaua

SEQ ID NO: 796185 - RNA, 19 nt, Homo sapiens
ugagggcccuguugcugaa

SEQ ID NO: 796186 - RNA, 19 nt, Homo sapiens
gauagcagucuuucuucuu

SEQ ID NO: 796187 - RNA, 19 nt, Homo sapiens
gacgcuaagcucaaaguuu

SEQ ID NO: 796188 - RNA, 19 nt, Homo sapiens
agagguugauggucuguug

SEQ ID NO: 796189 - RNA, 19 nt, Homo sapiens
ggagaacuacggugugaag

SEQ ID NO: 796190 - RNA, 19 nt, Homo sapiens
ccauugccaugaacucgaa

SEQ ID NO: 796191 - RNA, 19 nt, Homo sapiens
cuuguucacuuccgaaaug

SEQ ID NO: 796192 - RNA, 19 nt, Homo sapiens
ggagacggaagaucuuuua

SEQ ID NO: 796193 - RNA, 19 nt, Homo sapiens
gagggaagagugaucuaug

SEQ ID NO: 796194 - RNA, 19 nt, Homo sapiens
cauauccuguauccaauuc

SEQ ID NO: 796195 - RNA, 19 nt, Homo sapiens
agaacucucuaccaaggaa

SEQ ID NO: 796196 - RNA, 19 nt, Homo sapiens
ggacagccacagcagaauc

SEQ ID NO: 796197 - RNA, 19 nt, Homo sapiens
guacaucuccuacauaccu

SEQ ID NO: 796198 - RNA, 19 nt, Homo sapiens
ucggauagcugggaaaguc

SEQ ID NO: 796199 - RNA, 19 nt, Homo sapiens
ccugugaccucaucagucu

SEQ ID NO: 796200 - RNA, 19 nt, Homo sapiens
cuuauacggugcccuuaga

SEQ ID NO: 796201 - RNA, 19 nt, Homo sapiens
aagacaaguucaccgauuc

SEQ ID NO: 796202 - RNA, 19 nt, Homo sapiens
gacuucaacuaugcuacua

SEQ ID NO: 796203 - RNA, 19 nt, Homo sapiens
uguucuuucuuucccauua

SEQ ID NO: 796204 - RNA, 19 nt, Homo sapiens
cccauccucucaucuauuc

SEQ ID NO: 796205 - RNA, 19 nt, Homo sapiens
gcccuauucuuccuacauc

SEQ ID NO: 796206 - RNA, 19 nt, Homo sapiens
uaaaggaggagcccaaagg

SEQ ID NO: 796207 - RNA, 19 nt, Homo sapiens
caacagcgacgacuaugac

SEQ ID NO: 796208 - RNA, 19 nt, Homo sapiens
cagcaacagcgacgacuau

SEQ ID NO: 796209 - RNA, 19 nt, Homo sapiens
ggaagagugaucuaugucu

SEQ ID NO: 796210 - RNA, 19 nt, Homo sapiens
ggagggaagagugaucuau

SEQ ID NO: 796211 - RNA, 19 nt, Homo sapiens
gauguauccauauccugua

SEQ ID NO: 796212 - RNA, 19 nt, Homo sapiens
uugauggucuguugacuuc

SEQ ID NO: 796213 - RNA, 19 nt, Homo sapiens
aggaggagcccaaaggaaa

SEQ ID NO: 796214 - RNA, 19 nt, Homo sapiens
ggaaagucccuggucuuca

SEQ ID NO: 796215 - RNA, 19 nt, Homo sapiens
guauaucccucugccucaa

SEQ ID NO: 796216 - RNA, 19 nt, Homo sapiens
cguugaacccuaaugcuaa

SEQ ID NO: 796217 - RNA, 19 nt, Homo sapiens
cugaacaaguaaagaaauc

SEQ ID NO: 796218 - RNA, 19 nt, Homo sapiens
ugucaugcuuguucacuuc

SEQ ID NO: 796219 - RNA, 19 nt, Homo sapiens
gggcccaguuuaagcuuca

SEQ ID NO: 796220 - RNA, 19 nt, Homo sapiens
agucugacauguccaaugg
